United States Patent 11,640,849 (METHODS FOR HISTOLOGICAL DIAGNOSIS AND TREATMENT OF DISEASES) - sequence listing, part 28

SEQ ID NO: 1085355 - protein, 5 aa, Mycobacterium
TAVEP

SEQ ID NO: 1085356 - protein, 7 aa, Mycobacterium
TCGGQGV

SEQ ID NO: 1085357 - protein, 20 aa, Mycobacterium
TDAPDDSVIGGRSFSSDPAV

SEQ ID NO: 1085358 - protein, 7 aa, Mycobacterium
TDATHPV

SEQ ID NO: 1085359 - protein, 4 aa, Mycobacterium
TDDQ

SEQ ID NO: 1085360 - protein, 9 aa, Mycobacterium
TDGSTTVDT

SEQ ID NO: 1085361 - protein, 6 aa, Mycobacterium
TDPAIA

SEQ ID NO: 1085362 - protein, 9 aa, Mycobacterium
TDPVGGQRT

SEQ ID NO: 1085363 - protein, 9 aa, Mycobacterium
TDTAGPLTG

SEQ ID NO: 1085364 - protein, 12 aa, Mycobacterium
TDTGGLNKGDKV

SEQ ID NO: 1085365 - protein, 12 aa, Mycobacterium
TDTGPDNYTDNG

SEQ ID NO: 1085366 - protein, 15 aa, Mycobacterium
TEAAAEQQVRGQQAA

SEQ ID NO: 1085367 - protein, 9 aa, Mycobacterium
TEGPTKGQT

SEQ ID NO: 1085368 - protein, 24 aa, Mycobacterium
TGCSSGDSTVAKTPVPPSTTTGTI

SEQ ID NO: 1085369 - protein, 6 aa, Mycobacterium
TGFETG

SEQ ID NO: 1085370 - protein, 20 aa, Mycobacterium
TGHRSAGTLTGADDPDGASG

SEQ ID NO: 1085371 - protein, 22 aa, Mycobacterium
TGKSGSATLKPRPDINPEGPTT

SEQ ID NO: 1085372 - protein, 11 aa, Mycobacterium
TGLPGRDTTSD

SEQ ID NO: 1085373 - protein, 7 aa, Mycobacterium
TGLTSGT

SEQ ID NO: 1085374 - protein, 5 aa, Mycobacterium
TGMAA

SEQ ID NO: 1085375 - protein, 6 aa, Mycobacterium
TGNAPR

SEQ ID NO: 1085376 - protein, 10 aa, Mycobacterium
TGPNSPNKTL

SEQ ID NO: 1085377 - protein, 9 aa, Mycobacterium
TGPPPSKQQ

SEQ ID NO: 1085378 - protein, 11 aa, Mycobacterium
TGQPNSSRPYT

SEQ ID NO: 1085379 - protein, 10 aa, Mycobacterium
TGREASNLTA

SEQ ID NO: 1085380 - protein, 20 aa, Mycobacterium
TGRPPRAIPEPRPRSSHGPA

SEQ ID NO: 1085381 - protein, 5 aa, Mycobacterium
TGRSP

SEQ ID NO: 1085382 - protein, 5 aa, Mycobacterium
TGRTH

SEQ ID NO: 1085383 - protein, 10 aa, Mycobacterium
TGSFGGPEAS

SEQ ID NO: 1085384 - protein, 12 aa, Mycobacterium
TGSWSKDSCTVT

SEQ ID NO: 1085385 - protein, 7 aa, Mycobacterium
TGTGLSG

SEQ ID NO: 1085386 - protein, 6 aa, Mycobacterium
TGTISI

SEQ ID NO: 1085387 - protein, 11 aa, Mycobacterium
TGTTPQPPKNL

SEQ ID NO: 1085388 - protein, 10 aa, Mycobacterium
TGVKNPDYAD

SEQ ID NO: 1085389 - protein, 6 aa, Mycobacterium
TGVYAN

SEQ ID NO: 1085390 - protein, 8 aa, Mycobacterium
TGWSDDGM

SEQ ID NO: 1085391 - protein, 7 aa, Mycobacterium
THTPSAV

SEQ ID NO: 1085392 - protein, 17 aa, Mycobacterium
TIPGTEVAEQGAPGMPG

SEQ ID NO: 1085393 - protein, 10 aa, Mycobacterium
TKDGTLDGPN

SEQ ID NO: 1085394 - protein, 10 aa, Mycobacterium
TKDRASEEIS

SEQ ID NO: 1085395 - protein, 7 aa, Mycobacterium
TKNPRLP

SEQ ID NO: 1085396 - protein, 22 aa, Mycobacterium
TKPGRTSDPRGLGYADATTGTI

SEQ ID NO: 1085397 - protein, 11 aa, Mycobacterium
TKVDPAADPAV

SEQ ID NO: 1085398 - protein, 8 aa, Mycobacterium
TLAGSSLI

SEQ ID NO: 1085399 - protein, 9 aa, Mycobacterium
TLPPPTPVG

SEQ ID NO: 1085400 - protein, 8 aa, Mycobacterium
TLSGAGPS

SEQ ID NO: 1085401 - protein, 9 aa, Mycobacterium
TLTSRDQIN

SEQ ID NO: 1085402 - protein, 8 aa, Mycobacterium
TNAVNPTT

SEQ ID NO: 1085403 - protein, 13 aa, Mycobacterium
TNGSKTGGTFSEV

SEQ ID NO: 1085404 - protein, 9 aa, Mycobacterium
TNRIGTASR

SEQ ID NO: 1085405 - protein, 11 aa, Mycobacterium
TPDAKDDDVAA

SEQ ID NO: 1085406 - protein, 12 aa, Mycobacterium
TPDTAKAWSGSD

SEQ ID NO: 1085407 - protein, 5 aa, Mycobacterium
TPIPR

SEQ ID NO: 1085408 - protein, 13 aa, Mycobacterium
TPITSSTEQTRYG

SEQ ID NO: 1085409 - protein, 7 aa, Mycobacterium
TPPATPT

SEQ ID NO: 1085410 - protein, 6 aa, Mycobacterium
TPPEER

SEQ ID NO: 1085411 - protein, 8 aa, Mycobacterium
TPPTVTPQ

SEQ ID NO: 1085412 - protein, 4 aa, Mycobacterium
TPPV

SEQ ID NO: 1085413 - protein, 22 aa, Mycobacterium
TPSGPPSAVYSPQSGELVGPDG

SEQ ID NO: 1085414 - protein, 7 aa, Mycobacterium
TPSYDPN

SEQ ID NO: 1085415 - protein, 14 aa, Mycobacterium
TQAPKEVDGPGATS

SEQ ID NO: 1085416 - protein, 7 aa, Mycobacterium
TQDTPCE

SEQ ID NO: 1085417 - protein, 12 aa, Mycobacterium
TQPTSVPQAPLQ

SEQ ID NO: 1085418 - protein, 6 aa, Mycobacterium
TQRPRF

SEQ ID NO: 1085419 - protein, 9 aa, Mycobacterium
TQTGSTNAD

SEQ ID NO: 1085420 - protein, 6 aa, Mycobacterium
TQVSNA

SEQ ID NO: 1085421 - protein, 4 aa, Mycobacterium
TRAR

SEQ ID NO: 1085422 - protein, 6 aa, Mycobacterium
TRARQG

SEQ ID NO: 1085423 - protein, 12 aa, Mycobacterium
TRDEPHADAEKY

SEQ ID NO: 1085424 - protein, 12 aa, Mycobacterium
TRGERFGDPSGG

SEQ ID NO: 1085425 - protein, 8 aa, Mycobacterium
TRGGGMDV

SEQ ID NO: 1085426 - protein, 4 aa, Mycobacterium
TRKQ

SEQ ID NO: 1085427 - protein, 6 aa, Mycobacterium
TRQKAV

SEQ ID NO: 1085428 - protein, 4 aa, Mycobacterium
TRSR

SEQ ID NO: 1085429 - protein, 13 aa, Mycobacterium
TSAAPAGLGGANR

SEQ ID NO: 1085430 - protein, 4 aa, Mycobacterium
TSAM

SEQ ID NO: 1085431 - protein, 7 aa, Mycobacterium
TSDIPSA

SEQ ID NO: 1085432 - protein, 5 aa, Mycobacterium
TSGCD

SEQ ID NO: 1085433 - protein, 14 aa, Mycobacterium
TSGQRTMISAFGRA

SEQ ID NO: 1085434 - protein, 5 aa, Mycobacterium
TSIAA

SEQ ID NO: 1085435 - protein, 13 aa, Mycobacterium
TSMPHPAPPVAPG

SEQ ID NO: 1085436 - protein, 14 aa, Mycobacterium
TSPATGGPKRRQIQ

SEQ ID NO: 1085437 - protein, 7 aa, Mycobacterium
TSTSPQV

SEQ ID NO: 1085438 - protein, 9 aa, Mycobacterium
TTAQRTNGI

SEQ ID NO: 1085439 - protein, 10 aa, Mycobacterium
TTDAPQSWAK

SEQ ID NO: 1085440 - protein, 4 aa, Mycobacterium
TTDS

SEQ ID NO: 1085441 - protein, 5 aa, Mycobacterium
TTEPL

SEQ ID NO: 1085442 - protein, 5 aa, Mycobacterium
TTGKV

SEQ ID NO: 1085443 - protein, 5 aa, Mycobacterium
TTGNM

SEQ ID NO: 1085444 - protein, 10 aa, Mycobacterium
TTGVIGRDGG

SEQ ID NO: 1085445 - protein, 11 aa, Mycobacterium
TTHDPATPYQA

SEQ ID NO: 1085446 - protein, 15 aa, Mycobacterium
TTPEHPSQKRLTPQT

SEQ ID NO: 1085447 - protein, 4 aa, Mycobacterium
TTSF

SEQ ID NO: 1085448 - protein, 9 aa, Mycobacterium
TTSGVPERQ

SEQ ID NO: 1085449 - protein, 4 aa, Mycobacterium
TTSL

SEQ ID NO: 1085450 - protein, 4 aa, Mycobacterium
TTTT

SEQ ID NO: 1085451 - protein, 5 aa, Mycobacterium
TTVEQ

SEQ ID NO: 1085452 - protein, 7 aa, Mycobacterium
TVGADSL

SEQ ID NO: 1085453 - protein, 5 aa, Mycobacterium
TVPEH

SEQ ID NO: 1085454 - protein, 20 aa, Mycobacterium
TVPGHGPANLGPHSWPTGCT

SEQ ID NO: 1085455 - protein, 20 aa, Mycobacterium
TVPGSRRAATSQDSRQTQIS

SEQ ID NO: 1085456 - protein, 14 aa, Mycobacterium
TVPKDDTRGLEQGL

SEQ ID NO: 1085457 - protein, 4 aa, Mycobacterium
TVPP

SEQ ID NO: 1085458 - protein, 4 aa, Mycobacterium
TVQK

SEQ ID NO: 1085459 - protein, 5 aa, Mycobacterium
TVTSR

SEQ ID NO: 1085460 - protein, 6 aa, Mycobacterium
TVTTDD

SEQ ID NO: 1085461 - protein, 9 aa, Mycobacterium
TYADSDCGE

SEQ ID NO: 1085462 - protein, 14 aa, Mycobacterium
TYGVPVNSPNGYRA

SEQ ID NO: 1085463 - protein, 11 aa, Mycobacterium
TYRRPKQLGAG

SEQ ID NO: 1085464 - protein, 16 aa, Mycobacterium
VADGKTAITPEEPKDV

SEQ ID NO: 1085465 - protein, 13 aa, Mycobacterium
VADPPDFVRVPRQ

SEQ ID NO: 1085466 - protein, 7 aa, Mycobacterium
VAESSSF

SEQ ID NO: 1085467 - protein, 17 aa, Mycobacterium
VAGPAKIPLPGPGPGQA

SEQ ID NO: 1085468 - protein, 32 aa, Mycobacterium
VANNQGSHVKSSQVRAAKSDDLGAQKVSKELG

SEQ ID NO: 1085469 - protein, 14 aa, Mycobacterium
VANRSTAQAPTQRT

SEQ ID NO: 1085470 - protein, 10 aa, Mycobacterium
VASRGSRVPL

SEQ ID NO: 1085471 - protein, 6 aa, Mycobacterium
VDADGT

SEQ ID NO: 1085472 - protein, 7 aa, Mycobacterium
VDAGAQQ

SEQ ID NO: 1085473 - protein, 5 aa, Mycobacterium
VDGAA

SEQ ID NO: 1085474 - protein, 9 aa, Mycobacterium
VDQGSQAGD

SEQ ID NO: 1085475 - protein, 8 aa, Mycobacterium
VDRGKDQS

SEQ ID NO: 1085476 - protein, 7 aa, Mycobacterium
VDTDTQY

SEQ ID NO: 1085477 - protein, 8 aa, Mycobacterium
VDVQANPL

SEQ ID NO: 1085478 - protein, 5 aa, Mycobacterium
VEEDS

SEQ ID NO: 1085479 - protein, 9 aa, Mycobacterium
VEGADPASV

SEQ ID NO: 1085480 - protein, 11 aa, Mycobacterium
VEPPRSPAQME

SEQ ID NO: 1085481 - protein, 4 aa, Mycobacterium
VETA

SEQ ID NO: 1085482 - protein, 6 aa, Mycobacterium
VETRGT

SEQ ID NO: 1085483 - protein, 11 aa, Mycobacterium
VGAQGHTNTSH

SEQ ID NO: 1085484 - protein, 16 aa, Mycobacterium
VGEPPDWAEALALWPR

SEQ ID NO: 1085485 - protein, 6 aa, Mycobacterium
VGGARR

SEQ ID NO: 1085486 - protein, 12 aa, Mycobacterium
VGKQCVDDAAEF

SEQ ID NO: 1085487 - protein, 5 aa, Mycobacterium
VGNYP

SEQ ID NO: 1085488 - protein, 11 aa, Mycobacterium
VGPGPNGRPRY

SEQ ID NO: 1085489 - protein, 5 aa, Mycobacterium
VGQLS

SEQ ID NO: 1085490 - protein, 8 aa, Mycobacterium
VGRSHERG

SEQ ID NO: 1085491 - protein, 9 aa, Mycobacterium
VHTESDART

SEQ ID NO: 1085492 - protein, 9 aa, Mycobacterium
VKGDMEKSV

SEQ ID NO: 1085493 - protein, 8 aa, Mycobacterium
VKPNDGHR

SEQ ID NO: 1085494 - protein, 8 aa, Mycobacterium
VLPDPGPV

SEQ ID NO: 1085495 - protein, 10 aa, Mycobacterium
VNPTDPTRGL

SEQ ID NO: 1085496 - protein, 5 aa, Mycobacterium
VNTTT

SEQ ID NO: 1085497 - protein, 5 aa, Mycobacterium
VPAGD

SEQ ID NO: 1085498 - protein, 9 aa, Mycobacterium
VPAGEQSSL

SEQ ID NO: 1085499 - protein, 7 aa, Mycobacterium
VPAPDRE

SEQ ID NO: 1085500 - protein, 5 aa, Mycobacterium
VPEAA

SEQ ID NO: 1085501 - protein, 37 aa, Mycobacterium
VPIPSPRPDVVPGPVAPTPSPAANVGDPPLPAELGAG

SEQ ID NO: 1085502 - protein, 19 aa, Mycobacterium
VPPGPNPAVPGQPPNTVRR

SEQ ID NO: 1085503 - protein, 10 aa, Mycobacterium
VQAPGLGKAK

SEQ ID NO: 1085504 - protein, 7 aa, Mycobacterium
VQGGRTS

SEQ ID NO: 1085505 - protein, 7 aa, Mycobacterium
VQINDGG

SEQ ID NO: 1085506 - protein, 24 aa, Mycobacterium
VQNGNVAGDLSGSVTPAAISLIPV

SEQ ID NO: 1085507 - protein, 16 aa, Mycobacterium
VQNGQCTAGIISATTA

SEQ ID NO: 1085508 - protein, 7 aa, Mycobacterium
VQPEPLN

SEQ ID NO: 1085509 - protein, 8 aa, Mycobacterium
VRDRLNPK

SEQ ID NO: 1085510 - protein, 15 aa, Mycobacterium
VRKAGMTPFVTRIIE

SEQ ID NO: 1085511 - protein, 6 aa, Mycobacterium
VRPPSM

SEQ ID NO: 1085512 - protein, 9 aa, Mycobacterium
VRTDPPSGL

SEQ ID NO: 1085513 - protein, 15 aa, Mycobacterium
VRTSGMTPYVVRYIE

SEQ ID NO: 1085514 - protein, 18 aa, Mycobacterium
VSANNTGIVSSPIIARKD

SEQ ID NO: 1085515 - protein, 10 aa, Mycobacterium
VSCGPGPTVS

SEQ ID NO: 1085516 - protein, 7 aa, Mycobacterium
VSDRTNV

SEQ ID NO: 1085517 - protein, 12 aa, Mycobacterium
VSPRPDDAHGEQ

SEQ ID NO: 1085518 - protein, 6 aa, Mycobacterium
VSPSNA

SEQ ID NO: 1085519 - protein, 8 aa, Mycobacterium
VSQRDDLT

SEQ ID NO: 1085520 - protein, 10 aa, Mycobacterium
VTAQATQTTL

SEQ ID NO: 1085521 - protein, 26 aa, Mycobacterium
VTDPGQSVGKLKSGDAVDAVNGSPVA

SEQ ID NO: 1085522 - protein, 11 aa, Mycobacterium
VTDRSAAERSI

SEQ ID NO: 1085523 - protein, 5 aa, Mycobacterium
VTFPR

SEQ ID NO: 1085524 - protein, 13 aa, Mycobacterium
VTGQQVAPSSLPG

SEQ ID NO: 1085525 - protein, 9 aa, Mycobacterium
VTGSVPPTV

SEQ ID NO: 1085526 - protein, 9 aa, Mycobacterium
VTPGTGTAH

SEQ ID NO: 1085527 - protein, 19 aa, Mycobacterium
VTRADGSKSGIGRGYGGAR

SEQ ID NO: 1085528 - protein, 11 aa, Mycobacterium
VTRASNSFDRY

SEQ ID NO: 1085529 - protein, 19 aa, Mycobacterium
VTRGNVNDKCPDCGGRGIA

SEQ ID NO: 1085530 - protein, 8 aa, Mycobacterium
VTSESGCD

SEQ ID NO: 1085531 - protein, 6 aa, Mycobacterium
VTTKEK

SEQ ID NO: 1085532 - protein, 5 aa, Mycobacterium
VVSSA

SEQ ID NO: 1085533 - protein, 11 aa, Mycobacterium
WAPKSGGARAY

SEQ ID NO: 1085534 - protein, 20 aa, Mycobacterium
WGGGNAAGPSRGIDSGAGIT

SEQ ID NO: 1085535 - protein, 8 aa, Mycobacterium
WGPPETPN

SEQ ID NO: 1085536 - protein, 10 aa, Mycobacterium
WGRDGEWTTN

SEQ ID NO: 1085537 - protein, 12 aa, Mycobacterium
WPSANKRGTNTV

SEQ ID NO: 1085538 - protein, 9 aa, Mycobacterium
WRPSPGSVY

SEQ ID NO: 1085539 - protein, 12 aa, Mycobacterium
WRSPADTSLQPL

SEQ ID NO: 1085540 - protein, 5 aa, Mycobacterium
YARGL

SEQ ID NO: 1085541 - protein, 16 aa, Mycobacterium
YDSDLDPVNGGSGTVT

SEQ ID NO: 1085542 - protein, 10 aa, Mycobacterium
YEARSDNRTG

SEQ ID NO: 1085543 - protein, 4 aa, Mycobacterium
YEGS

SEQ ID NO: 1085544 - protein, 8 aa, Mycobacterium
YGAGPCSG

SEQ ID NO: 1085545 - protein, 9 aa, Mycobacterium
YGKGNTADW

SEQ ID NO: 1085546 - protein, 4 aa, Mycobacterium
YGPT

SEQ ID NO: 1085547 - protein, 7 aa, Mycobacterium
YGRTVSG

SEQ ID NO: 1085548 - protein, 7 aa, Mycobacterium
YKPGNVK

SEQ ID NO: 1085549 - protein, 16 aa, Mycobacterium
YNGRDRNGHYTNDQDA

SEQ ID NO: 1085550 - protein, 8 aa, Mycobacterium
YNNPDGVH

SEQ ID NO: 1085551 - protein, 9 aa, Mycobacterium
YPEGIPATD

SEQ ID NO: 1085552 - protein, 12 aa, Mycobacterium
YPPGKSREDVDK

SEQ ID NO: 1085553 - protein, 7 aa, Mycobacterium
YPTANSP

SEQ ID NO: 1085554 - protein, 16 aa, Mycobacterium
YQGPPNKFEAGTGNIA

SEQ ID NO: 1085555 - protein, 5 aa, Mycobacterium
YQRPM

SEQ ID NO: 1085556 - protein, 18 aa, Mycobacterium
YQSDGESNFGKISSPAVD

SEQ ID NO: 1085557 - protein, 22 aa, Mycobacterium
YSGVAENDRCTDRTDSQPGHPN

SEQ ID NO: 1085558 - protein, 9 aa, Mycobacterium
YSTEQSNAY

SEQ ID NO: 1085559 - protein, 20 aa, Mycobacterium
YTTNPNDAPGGPLVERADRR

SEQ ID NO: 1085560 - protein, 5 aa, Mycobacterium
YTTPK

SEQ ID NO: 1085561 - protein, 14 aa, Mycobacterium
AAAAATARSAPPGL

SEQ ID NO: 1085562 - protein, 9 aa, Mycobacterium
AAAADEVST

SEQ ID NO: 1085563 - protein, 9 aa, Mycobacterium
AAAAPTLQE

SEQ ID NO: 1085564 - protein, 9 aa, Mycobacterium
AAAAQGGPV

SEQ ID NO: 1085565 - protein, 18 aa, Mycobacterium
AAADPAAPQPNPNPQLPG

SEQ ID NO: 1085566 - protein, 6 aa, Mycobacterium
AAAGAV

SEQ ID NO: 1085567 - protein, 9 aa, Mycobacterium
AAAGEDEVS

SEQ ID NO: 1085568 - protein, 13 aa, Mycobacterium
AAAGNSASQHPDA

SEQ ID NO: 1085569 - protein, 10 aa, Mycobacterium
AAAGPAAATT

SEQ ID NO: 1085570 - protein, 10 aa, Mycobacterium
AAAGPDQPAL

SEQ ID NO: 1085571 - protein, 22 aa, Mycobacterium
AAAGPVPAGAHSAPAAIPAAPG

SEQ ID NO: 1085572 - protein, 8 aa, Mycobacterium
AAAGRAGG

SEQ ID NO: 1085573 - protein, 6 aa, Mycobacterium
AAAGSA

SEQ ID NO: 1085574 - protein, 8 aa, Mycobacterium
AAAGSTTA

SEQ ID NO: 1085575 - protein, 17 aa, Mycobacterium
AAAHDHDHDHGGDPTPI

SEQ ID NO: 1085576 - protein, 8 aa, Mycobacterium
AAAKGHRD

SEQ ID NO: 1085577 - protein, 5 aa, Mycobacterium
AAAPA

SEQ ID NO: 1085578 - protein, 17 aa, Mycobacterium
AAAPGGTGTDPAGAPRT

SEQ ID NO: 1085579 - protein, 7 aa, Mycobacterium
AAAPGRL

SEQ ID NO: 1085580 - protein, 11 aa, Mycobacterium
AAAPPHDPGTY

SEQ ID NO: 1085581 - protein, 66 aa, Mycobacterium
AAAPTGSTGAIAPARERARGAGATITSGPTGTALAAGPTGTLTAQEADQAALASSAADAPGAATAA

SEQ ID NO: 1085582 - protein, 8 aa, Mycobacterium
AAAQQHPQ

SEQ ID NO: 1085583 - protein, 5 aa, Mycobacterium
AAARE

SEQ ID NO: 1085584 - protein, 8 aa, Mycobacterium
AAASASAA

SEQ ID NO: 1085585 - protein, 8 aa, Mycobacterium
AAATAAGL

SEQ ID NO: 1085586 - protein, 16 aa, Mycobacterium
AAATAPAQAPAPNLTP

SEQ ID NO: 1085587 - protein, 7 aa, Mycobacterium
AAATDVA

SEQ ID NO: 1085588 - protein, 7 aa, Mycobacterium
AAATGVT

SEQ ID NO: 1085589 - protein, 14 aa, Mycobacterium
AAATPAGDSAQTIT

SEQ ID NO: 1085590 - protein, 9 aa, Mycobacterium
AAATRRSRP

SEQ ID NO: 1085591 - protein, 14 aa, Mycobacterium
AAAYGGFGGTGSPA

SEQ ID NO: 1085592 - protein, 6 aa, Mycobacterium
AAAYSG

SEQ ID NO: 1085593 - protein, 16 aa, Mycobacterium
AADGKTFEGGVGPTLS

SEQ ID NO: 1085594 - protein, 14 aa, Mycobacterium
AADGTRTEEPRPEG

SEQ ID NO: 1085595 - protein, 13 aa, Mycobacterium
AADPQPAPPALKT

SEQ ID NO: 1085596 - protein, 20 aa, Mycobacterium
AADRQSPASTIGFVTAVRST

SEQ ID NO: 1085597 - protein, 12 aa, Mycobacterium
AADSYAGAEAAG

SEQ ID NO: 1085598 - protein, 5 aa, Mycobacterium
AADVS

SEQ ID NO: 1085599 - protein, 5 aa, Mycobacterium
AAEEA

SEQ ID NO: 1085600 - protein, 12 aa, Mycobacterium
AAELSDAQRTRV

SEQ ID NO: 1085601 - protein, 10 aa, Mycobacterium
AAEPEPTAAE

SEQ ID NO: 1085602 - protein, 9 aa, Mycobacterium
AAEPPSCAS

SEQ ID NO: 1085603 - protein, 12 aa, Mycobacterium
AAERARNDRGTI

SEQ ID NO: 1085604 - protein, 4 aa, Mycobacterium
AAES

SEQ ID NO: 1085605 - protein, 41 aa, Mycobacterium
AAESAGAAVTGGALGAHGGSGAAATGCAAGTAGAALASGAA

SEQ ID NO: 1085606 - protein, 6 aa, Mycobacterium
AAESNG

SEQ ID NO: 1085607 - protein, 34 aa, Mycobacterium
AAGAARAAGTTSPAGAAGTSGARDRSGAALTGPA

SEQ ID NO: 1085608 - protein, 16 aa, Mycobacterium
AAGAASAAPSHQPDYG

SEQ ID NO: 1085609 - protein, 78 aa, Mycobacterium
AAGATDPAVARTSTTTGATGTTATQQPRVSASATDPAVEGAAAPGPTGTTGAPEPGPTTGASRTSDHSLSTGAASSAV

SEQ ID NO: 1085610 - protein, 9 aa, Mycobacterium
AAGAVAPAT

SEQ ID NO: 1085611 - protein, 6 aa, Mycobacterium
AAGGGH

SEQ ID NO: 1085612 - protein, 8 aa, Mycobacterium
AAGGGQGA

SEQ ID NO: 1085613 - protein, 10 aa, Mycobacterium
AAGGPPSAPI

SEQ ID NO: 1085614 - protein, 8 aa, Mycobacterium
AAGGTASA

SEQ ID NO: 1085615 - protein, 7 aa, Mycobacterium
AAGLGRA

SEQ ID NO: 1085616 - protein, 9 aa, Mycobacterium
AAGNPEQAT

SEQ ID NO: 1085617 - protein, 22 aa, Mycobacterium
AAGPEAADAARPLPGPKTPAAG

SEQ ID NO: 1085618 - protein, 6 aa, Mycobacterium
AAGPQS

SEQ ID NO: 1085619 - protein, 18 aa, Mycobacterium
AAGQAESAANQARTAATA

SEQ ID NO: 1085620 - protein, 7 aa, Mycobacterium
AAGRAGG

SEQ ID NO: 1085621 - protein, 10 aa, Mycobacterium
AAGSTAQKNA

SEQ ID NO: 1085622 - protein, 15 aa, Mycobacterium
AAIGTGGAGSAGALT

SEQ ID NO: 1085623 - protein, 11 aa, Mycobacterium
AAINPGNSGGA

SEQ ID NO: 1085624 - protein, 14 aa, Mycobacterium
AAKNRPGSGFVSVP

SEQ ID NO: 1085625 - protein, 14 aa, Mycobacterium
AAKPPAGAPEPKTT

SEQ ID NO: 1085626 - protein, 10 aa, Mycobacterium
AAKRRGTTAP

SEQ ID NO: 1085627 - protein, 14 aa, Mycobacterium
AALSVGSDGGGSIR

SEQ ID NO: 1085628 - protein, 4 aa, Mycobacterium
AALT

SEQ ID NO: 1085629 - protein, 10 aa, Mycobacterium
AANAAAAVST

SEQ ID NO: 1085630 - protein, 13 aa, Mycobacterium
AANAERTASRDHA

SEQ ID NO: 1085631 - protein, 7 aa, Mycobacterium
AANAPQI

SEQ ID NO: 1085632 - protein, 7 aa, Mycobacterium
AANAPVA

SEQ ID NO: 1085633 - protein, 5 aa, Mycobacterium
AANDF

SEQ ID NO: 1085634 - protein, 7 aa, Mycobacterium
AANDPQA

SEQ ID NO: 1085635 - protein, 6 aa, Mycobacterium
AAPAAG

SEQ ID NO: 1085636 - protein, 17 aa, Mycobacterium
AAPAATGGAASDGTGWA

SEQ ID NO: 1085637 - protein, 13 aa, Mycobacterium
AAPAQADDYDAPF

SEQ ID NO: 1085638 - protein, 6 aa, Mycobacterium
AAPATG

SEQ ID NO: 1085639 - protein, 14 aa, Mycobacterium
AAPGIAAADPSVRP

SEQ ID NO: 1085640 - protein, 10 aa, Mycobacterium
AAPPNPSSQL

SEQ ID NO: 1085641 - protein, 13 aa, Mycobacterium
AAPPRAYDGEPSL

SEQ ID NO: 1085642 - protein, 6 aa, Mycobacterium
AAPQAK

SEQ ID NO: 1085643 - protein, 9 aa, Mycobacterium
AAPQSWTNG

SEQ ID NO: 1085644 - protein, 8 aa, Mycobacterium
AAPRAWAG

SEQ ID NO: 1085645 - protein, 5 aa, Mycobacterium
AAPRL

SEQ ID NO: 1085646 - protein, 6 aa, Mycobacterium
AAPSAL

SEQ ID NO: 1085647 - protein, 8 aa, Mycobacterium
AAPVSAAS

SEQ ID NO: 1085648 - protein, 5 aa, Mycobacterium
AAPYA

SEQ ID NO: 1085649 - protein, 14 aa, Mycobacterium
AAQAEQAAAQAAVT

SEQ ID NO: 1085650 - protein, 4 aa, Mycobacterium
AAQN

SEQ ID NO: 1085651 - protein, 14 aa, Mycobacterium
AAQPGAAGRHQGGG

SEQ ID NO: 1085652 - protein, 24 aa, Mycobacterium
AAQQAAENKLTDDQAALDATKGQL

SEQ ID NO: 1085653 - protein, 14 aa, Mycobacterium
AAQRLPGTSLDPHG

SEQ ID NO: 1085654 - protein, 18 aa, Mycobacterium
AAQSRHDATHAATAAAER

SEQ ID NO: 1085655 - protein, 5 aa, Mycobacterium
AARAG

SEQ ID NO: 1085656 - protein, 8 aa, Mycobacterium
AARAGPAD

SEQ ID NO: 1085657 - protein, 46 aa, Mycobacterium
AARATGASRHEPVGSGTTGATGAPDTARASRPTGTDQPATATTGAA

SEQ ID NO: 1085658 - protein, 6 aa, Mycobacterium
AARDGL

SEQ ID NO: 1085659 - protein, 7 aa, Mycobacterium
AARDRAQ

SEQ ID NO: 1085660 - protein, 7 aa, Mycobacterium
AAREEAA

SEQ ID NO: 1085661 - protein, 9 aa, Mycobacterium
AARGDTGTA

SEQ ID NO: 1085662 - protein, 6 aa, Mycobacterium
AARNGR

SEQ ID NO: 1085663 - protein, 4 aa, Mycobacterium
AARS

SEQ ID NO: 1085664 - protein, 11 aa, Mycobacterium
AASAAGNPEIR

SEQ ID NO: 1085665 - protein, 9 aa, Mycobacterium
AASAATEQK

SEQ ID NO: 1085666 - protein, 23 aa, Mycobacterium
AASALGAAKASMAEPADAERTTG

SEQ ID NO: 1085667 - protein, 7 aa, Mycobacterium
AASAPVA

SEQ ID NO: 1085668 - protein, 8 aa, Mycobacterium
AASATSTS

SEQ ID NO: 1085669 - protein, 8 aa, Mycobacterium
AASEAAST

SEQ ID NO: 1085670 - protein, 5 aa, Mycobacterium
AASGG

SEQ ID NO: 1085671 - protein, 6 aa, Mycobacterium
AASGLD

SEQ ID NO: 1085672 - protein, 18 aa, Mycobacterium
AASNRSGRTRIPDPEAAA

SEQ ID NO: 1085673 - protein, 6 aa, Mycobacterium
AASSAG

SEQ ID NO: 1085674 - protein, 15 aa, Mycobacterium
AASSLSACSGSAAGQ

SEQ ID NO: 1085675 - protein, 7 aa, Mycobacterium
AASTPDE

SEQ ID NO: 1085676 - protein, 5 aa, Mycobacterium
AASYA

SEQ ID NO: 1085677 - protein, 9 aa, Mycobacterium
AATESQRGT

SEQ ID NO: 1085678 - protein, 17 aa, Mycobacterium
AATGAAPSPAGAAVASD

SEQ ID NO: 1085679 - protein, 8 aa, Mycobacterium
AATPNPEL

SEQ ID NO: 1085680 - protein, 6 aa, Mycobacterium
AATQAG

SEQ ID NO: 1085681 - protein, 8 aa, Mycobacterium
AATQIGEA

SEQ ID NO: 1085682 - protein, 5 aa, Mycobacterium
AATSS

SEQ ID NO: 1085683 - protein, 17 aa, Mycobacterium
AATSSTPRTPIPPQPGM

SEQ ID NO: 1085684 - protein, 5 aa, Mycobacterium
AATSV

SEQ ID NO: 1085685 - protein, 13 aa, Mycobacterium
AATTSSAQSQASL

SEQ ID NO: 1085686 - protein, 4 aa, Mycobacterium
AATV

SEQ ID NO: 1085687 - protein, 4 aa, Mycobacterium
AAVP

SEQ ID NO: 1085688 - protein, 22 aa, Mycobacterium
AAVPAGTTAAAGPAGTTGRTGD

SEQ ID NO: 1085689 - protein, 11 aa, Mycobacterium
AAWEGPSAQSY

SEQ ID NO: 1085690 - protein, 16 aa, Mycobacterium
AAYATYTSGTTGPPKA

SEQ ID NO: 1085691 - protein, 9 aa, Mycobacterium
ACGKAGCQT

SEQ ID NO: 1085692 - protein, 12 aa, Mycobacterium
ACRGGAGHGGVV

SEQ ID NO: 1085693 - protein, 16 aa, Mycobacterium
ACSSSKPQAGTADTGA

SEQ ID NO: 1085694 - protein, 6 aa, Mycobacterium
ACSTNG

SEQ ID NO: 1085695 - protein, 7 aa, Mycobacterium
ADAAPDL

SEQ ID NO: 1085696 - protein, 5 aa, Mycobacterium
ADAAT

SEQ ID NO: 1085697 - protein, 4 aa, Mycobacterium
ADAG

SEQ ID NO: 1085698 - protein, 4 aa, Mycobacterium
ADAI

SEQ ID NO: 1085699 - protein, 17 aa, Mycobacterium
ADANNGTRAVGTPGYEA

SEQ ID NO: 1085700 - protein, 10 aa, Mycobacterium
ADASQEQTDV

SEQ ID NO: 1085701 - protein, 8 aa, Mycobacterium
ADDEPAAA

SEQ ID NO: 1085702 - protein, 8 aa, Mycobacterium
ADENGVTA

SEQ ID NO: 1085703 - protein, 8 aa, Mycobacterium
ADESVTRA

SEQ ID NO: 1085704 - protein, 6 aa, Mycobacterium
ADEVSG

SEQ ID NO: 1085705 - protein, 14 aa, Mycobacterium
ADFPAGRQKLTGPQ

SEQ ID NO: 1085706 - protein, 11 aa, Mycobacterium
ADGANDASDHV

SEQ ID NO: 1085707 - protein, 5 aa, Mycobacterium
ADGAT

SEQ ID NO: 1085708 - protein, 6 aa, Mycobacterium
ADGDPY

SEQ ID NO: 1085709 - protein, 9 aa, Mycobacterium
ADGEKPRVA

SEQ ID NO: 1085710 - protein, 8 aa, Mycobacterium
ADGPHSGV

SEQ ID NO: 1085711 - protein, 10 aa, Mycobacterium
ADGPKPNNAY

SEQ ID NO: 1085712 - protein, 10 aa, Mycobacterium
ADGSAEHPSV

SEQ ID NO: 1085713 - protein, 7 aa, Mycobacterium
ADGSRAA

SEQ ID NO: 1085714 - protein, 10 aa, Mycobacterium
ADHPARSEQD

SEQ ID NO: 1085715 - protein, 7 aa, Mycobacterium
ADLAGVG

SEQ ID NO: 1085716 - protein, 5 aa, Mycobacterium
ADNAE

SEQ ID NO: 1085717 - protein, 11 aa, Mycobacterium
ADNLRGEGANI

SEQ ID NO: 1085718 - protein, 14 aa, Mycobacterium
ADPAPAPAPAPNIP

SEQ ID NO: 1085719 - protein, 11 aa, Mycobacterium
ADPEPPPDARA

SEQ ID NO: 1085720 - protein, 8 aa, Mycobacterium
ADPGNGQS

SEQ ID NO: 1085721 - protein, 8 aa, Mycobacterium
ADPPANCT

SEQ ID NO: 1085722 - protein, 6 aa, Mycobacterium
ADPQFD

SEQ ID NO: 1085723 - protein, 8 aa, Mycobacterium
ADPSGTSL

SEQ ID NO: 1085724 - protein, 12 aa, Mycobacterium
ADPTPAGNSQLP

SEQ ID NO: 1085725 - protein, 6 aa, Mycobacterium
ADPTSD

SEQ ID NO: 1085726 - protein, 6 aa, Mycobacterium
ADPVSR

SEQ ID NO: 1085727 - protein, 14 aa, Mycobacterium
ADQRGVGAAASATV

SEQ ID NO: 1085728 - protein, 14 aa, Mycobacterium
ADQRRGETATHYAQ

SEQ ID NO: 1085729 - protein, 22 aa, Mycobacterium
ADRPRRAEIASTATPWQASTPT

SEQ ID NO: 1085730 - protein, 5 aa, Mycobacterium
ADRSG

SEQ ID NO: 1085731 - protein, 4 aa, Mycobacterium
ADSG

SEQ ID NO: 1085732 - protein, 20 aa, Mycobacterium
ADSGATAPPLIGTGRPDQVG

SEQ ID NO: 1085733 - protein, 20 aa, Mycobacterium
ADSGSPPSSKRSTANTGTSM

SEQ ID NO: 1085734 - protein, 21 aa, Mycobacterium
ADSTPYRPDPTRAHTPASNYG

SEQ ID NO: 1085735 - protein, 10 aa, Mycobacterium
ADSVNKTKAN

SEQ ID NO: 1085736 - protein, 8 aa, Mycobacterium
ADSVQPAK

SEQ ID NO: 1085737 - protein, 4 aa, Mycobacterium
ADTT

SEQ ID NO: 1085738 - protein, 31 aa, Mycobacterium
ADTTAASGADGVGSTATTAAVAAGRGNGPVR

SEQ ID NO: 1085739 - protein, 17 aa, Mycobacterium
ADVPAAPPDLSASRAEI

SEQ ID NO: 1085740 - protein, 4 aa, Mycobacterium
ADVQ

SEQ ID NO: 1085741 - protein, 11 aa, Mycobacterium
ADYSGKPYDEW

SEQ ID NO: 1085742 - protein, 7 aa, Mycobacterium
AEAADTA

SEQ ID NO: 1085743 - protein, 9 aa, Mycobacterium
AEAGPQLAQ

SEQ ID NO: 1085744 - protein, 12 aa, Mycobacterium
AEAPATPDPAAG

SEQ ID NO: 1085745 - protein, 7 aa, Mycobacterium
AEASLSA

SEQ ID NO: 1085746 - protein, 7 aa, Mycobacterium
AEDAAPR

SEQ ID NO: 1085747 - protein, 10 aa, Mycobacterium
AEDEDEPYYP

SEQ ID NO: 1085748 - protein, 7 aa, Mycobacterium
AEDGPLT

SEQ ID NO: 1085749 - protein, 11 aa, Mycobacterium
AEDLRAQAAGQ

SEQ ID NO: 1085750 - protein, 13 aa, Mycobacterium
AEDPDAALEAGQA

SEQ ID NO: 1085751 - protein, 6 aa, Mycobacterium
AEDPER

SEQ ID NO: 1085752 - protein, 4 aa, Mycobacterium
AEDT

SEQ ID NO: 1085753 - protein, 12 aa, Mycobacterium
AEEELSQLLLPS

SEQ ID NO: 1085754 - protein, 4 aa, Mycobacterium
AEEP

SEQ ID NO: 1085755 - protein, 10 aa, Mycobacterium
AEESVTNSWS

SEQ ID NO: 1085756 - protein, 12 aa, Mycobacterium
AEGEQTTAEAVG

SEQ ID NO: 1085757 - protein, 13 aa, Mycobacterium
AEIDTADAQNLEE

SEQ ID NO: 1085758 - protein, 9 aa, Mycobacterium
AEKRRRGTR

SEQ ID NO: 1085759 - protein, 5 aa, Mycobacterium
AELRP

SEQ ID NO: 1085760 - protein, 15 aa, Mycobacterium
AEPAADALAANTGEL

SEQ ID NO: 1085761 - protein, 6 aa, Mycobacterium
AEPDLT

SEQ ID NO: 1085762 - protein, 4 aa, Mycobacterium
AEPE

SEQ ID NO: 1085763 - protein, 8 aa, Mycobacterium
AEQGRTSA

SEQ ID NO: 1085764 - protein, 8 aa, Mycobacterium
AEQTGKRV

SEQ ID NO: 1085765 - protein, 8 aa, Mycobacterium
AEQTQQAA

SEQ ID NO: 1085766 - protein, 4 aa, Mycobacterium
AERA

SEQ ID NO: 1085767 - protein, 10 aa, Mycobacterium
AERDEAEAKL

SEQ ID NO: 1085768 - protein, 7 aa, Mycobacterium
AERGADV

SEQ ID NO: 1085769 - protein, 4 aa, Mycobacterium
AERH

SEQ ID NO: 1085770 - protein, 9 aa, Mycobacterium
AERTTGAVK

SEQ ID NO: 1085771 - protein, 6 aa, Mycobacterium
AESDQV

SEQ ID NO: 1085772 - protein, 14 aa, Mycobacterium
AESSALAAAQAAAS

SEQ ID NO: 1085773 - protein, 14 aa, Mycobacterium
AESTGLSSKGAKTF

SEQ ID NO: 1085774 - protein, 5 aa, Mycobacterium
AETAD

SEQ ID NO: 1085775 - protein, 5 aa, Mycobacterium
AETDP

SEQ ID NO: 1085776 - protein, 5 aa, Mycobacterium
AETGY

SEQ ID NO: 1085777 - protein, 14 aa, Mycobacterium
AETKKTDLNANDID

SEQ ID NO: 1085778 - protein, 4 aa, Mycobacterium
AETR

SEQ ID NO: 1085779 - protein, 6 aa, Mycobacterium
AEVERP

SEQ ID NO: 1085780 - protein, 6 aa, Mycobacterium
AEVPQR

SEQ ID NO: 1085781 - protein, 4 aa, Mycobacterium
AEYR

SEQ ID NO: 1085782 - protein, 5 aa, Mycobacterium
AFAEP

SEQ ID NO: 1085783 - protein, 16 aa, Mycobacterium
AFAGQASAANTELSQP

SEQ ID NO: 1085784 - protein, 7 aa, Mycobacterium
AFGAAPG

SEQ ID NO: 1085785 - protein, 6 aa, Mycobacterium
AFPDDI

SEQ ID NO: 1085786 - protein, 8 aa, Mycobacterium
AFTGREND

SEQ ID NO: 1085787 - protein, 6 aa, Mycobacterium
AFTPTD

SEQ ID NO: 1085788 - protein, 6 aa, Mycobacterium
AFTSKT

SEQ ID NO: 1085789 - protein, 4 aa, Mycobacterium
AGAA

SEQ ID NO: 1085790 - protein, 15 aa, Mycobacterium
AGAAAGPADRPLAAA

SEQ ID NO: 1085791 - protein, 31 aa, Mycobacterium
AGAAETQCTDTQLAQADQAALAARADSAIAG

SEQ ID NO: 1085792 - protein, 95 aa, Mycobacterium; identical to SEQ ID NO: 894236

SEQ ID NO: 1085793 - protein, 7 aa, Mycobacterium
AGAARAT

SEQ ID NO: 1085794 - protein, 9 aa, Mycobacterium
AGAASTAYA

SEQ ID NO: 1085795 - protein, 13 aa, Mycobacterium
AGAAYAQAEAANA

SEQ ID NO: 1085796 - protein, 20 aa, Mycobacterium
AGADPDDPAPVPAPAPPNCT

SEQ ID NO: 1085797 - protein, 7 aa, Mycobacterium
AGADVGQ

SEQ ID NO: 1085798 - protein, 16 aa, Mycobacterium
AGAEDGQDDSDPERGG

SEQ ID NO: 1085799 - protein, 6 aa, Mycobacterium
AGAESY

SEQ ID NO: 1085800 - protein, 13 aa, Mycobacterium
AGAGGAGGNAPLL

SEQ ID NO: 1085801 - protein, 12 aa, Mycobacterium
AGAGGNGGVGLG

SEQ ID NO: 1085802 - protein, 13 aa, Mycobacterium
AGAGGTGGSGGAA

SEQ ID NO: 1085803 - protein, 5 aa, Mycobacterium
AGAGI

SEQ ID NO: 1085804 - protein, 7 aa, Mycobacterium
AGAGQAA

SEQ ID NO: 1085805 - protein, 6 aa, Mycobacterium
AGAGSY

SEQ ID NO: 1085806 - protein, 11 aa, Mycobacterium
AGAPAGAAPRQ

SEQ ID NO: 1085807 - protein, 12 aa, Mycobacterium
AGAPDPAFRPAG

SEQ ID NO: 1085808 - protein, 11 aa, Mycobacterium
AGAPEDSGIPN

SEQ ID NO: 1085809 - protein, 10 aa, Mycobacterium
AGAPITPGAA

SEQ ID NO: 1085810 - protein, 19 aa, Mycobacterium
AGAPLQGNDQVAPSAATPI

SEQ ID NO: 1085811 - protein, 11 aa, Mycobacterium
AGAPLTAHGPA

SEQ ID NO: 1085812 - protein, 6 aa, Mycobacterium
AGAPRR

SEQ ID NO: 1085813 - protein, 18 aa, Mycobacterium
AGASAAEAAAAGTEAGRE

SEQ ID NO: 1085814 - protein, 10 aa, Mycobacterium
AGATGEGAMD

SEQ ID NO: 1085815 - protein, 21 aa, Mycobacterium
AGATTALPPPGPAAAAALPGA

SEQ ID NO: 1085816 - protein, 15 aa, Mycobacterium
AGCPDAKPSPPASYC

SEQ ID NO: 1085817 - protein, 21 aa, Mycobacterium
AGCSTQRESPVEPVVPTYPEE

SEQ ID NO: 1085818 - protein, 4 aa, Mycobacterium
AGCT

SEQ ID NO: 1085819 - protein, 10 aa, Mycobacterium
AGDEEATNTD

SEQ ID NO: 1085820 - protein, 6 aa, Mycobacterium
AGDEVS

SEQ ID NO: 1085821 - protein, 7 aa, Mycobacterium
AGDGNTH

SEQ ID NO: 1085822 - protein, 4 aa, Mycobacterium
AGDI

SEQ ID NO: 1085823 - protein, 11 aa, Mycobacterium
AGDSDQGGYNT

SEQ ID NO: 1085824 - protein, 5 aa, Mycobacterium
AGDSR

SEQ ID NO: 1085825 - protein, 7 aa, Mycobacterium
AGEFPDG

SEQ ID NO: 1085826 - protein, 16 aa, Mycobacterium
AGEGSPKSVHETDDES

SEQ ID NO: 1085827 - protein, 8 aa, Mycobacterium
AGERSGRE

SEQ ID NO: 1085828 - protein, 14 aa, Mycobacterium
AGESVPERVNDGGF

SEQ ID NO: 1085829 - protein, 11 aa, Mycobacterium
AGFDPQRSSAW

SEQ ID NO: 1085830 - protein, 27 aa, Mycobacterium
AGFGSSGCAHGNSSTSESAVPSTFPGI

SEQ ID NO: 1085831 - protein, 7 aa, Mycobacterium
AGGAGQP

SEQ ID NO: 1085832 - protein, 8 aa, Mycobacterium
AGGDAGVR

SEQ ID NO: 1085833 - protein, 7 aa, Mycobacterium
AGGDEVS

SEQ ID NO: 1085834 - protein, 8 aa, Mycobacterium
AGGGAGPR

SEQ ID NO: 1085835 - protein, 45 aa, Mycobacterium
AGGGDGGAGGFTGGIDGAGGVGGAGGNTGLLGGPGGSGGSGGDGI

SEQ ID NO: 1085836 - protein, 19 aa, Mycobacterium
AGGGLGPFPNGDGGYDNDD

SEQ ID NO: 1085837 - protein, 17 aa, Mycobacterium
AGGGLYSSAEAAAATPL

SEQ ID NO: 1085838 - protein, 22 aa, Mycobacterium
AGGGWTDGRQRLGTSPEKDVGF

SEQ ID NO: 1085839 - protein, 10 aa, Mycobacterium
AGGKARPDVG

SEQ ID NO: 1085840 - protein, 15 aa, Mycobacterium
AGGLPAAAIGGGVSV

SEQ ID NO: 1085841 - protein, 7 aa, Mycobacterium
AGGLPGD

SEQ ID NO: 1085842 - protein, 36 aa, Mycobacterium
AGGNGGGAGAGGAGGNGGDAGAGVAAADGGDGGNAG

SEQ ID NO: 1085843 - protein, 34 aa, Mycobacterium; identical to SEQ ID NO: 421781

SEQ ID NO: 1085844 - protein, 11 aa, Mycobacterium
AGGRTYATRPV

SEQ ID NO: 1085845 - protein, 34 aa, Mycobacterium; identical to SEQ ID NO: 421845

SEQ ID NO: 1085846 - protein, 13 aa, Mycobacterium
AGGSGGDGGQGGD

SEQ ID NO: 1085847 - protein, 8 aa, Mycobacterium
AGHHDPAS

SEQ ID NO: 1085848 - protein, 4 aa, Mycobacterium
AGHT

SEQ ID NO: 1085849 - protein, 5 aa, Mycobacterium
AGIPG

SEQ ID NO: 1085850 - protein, 6 aa, Mycobacterium
AGIPQR

SEQ ID NO: 1085851 - protein, 15 aa, Mycobacterium
AGKPGAATPVIPGPV

SEQ ID NO: 1085852 - protein, 5 aa, Mycobacterium
AGLPP

SEQ ID NO: 1085853 - protein, 9 aa, Mycobacterium
AGNAARTRY

SEQ ID NO: 1085854 - protein, 4 aa, Mycobacterium
AGPA

SEQ ID NO: 1085855 - protein, 9 aa, Mycobacterium
AGPAGSAAA

SEQ ID NO: 1085856 - protein, 5 aa, Mycobacterium
AGPAK

SEQ ID NO: 1085857 - protein, 17 aa, Mycobacterium
AGPARAGYTATKAASSA

SEQ ID NO: 1085858 - protein, 16 aa, Mycobacterium
AGPATIPTPGPGPGQT

SEQ ID NO: 1085859 - protein, 5 aa, Mycobacterium
AGPDV

SEQ ID NO: 1085860 - protein, 5 aa, Mycobacterium
AGPER

SEQ ID NO: 1085861 - protein, 9 aa, Mycobacterium
AGPGHSQGL

SEQ ID NO: 1085862 - protein, 7 aa, Mycobacterium
AGPGLAD

SEQ ID NO: 1085863 - protein, 8 aa, Mycobacterium
AGPGSSSM

SEQ ID NO: 1085864 - protein, 13 aa, Mycobacterium
AGPLPGPARANRA

SEQ ID NO: 1085865 - protein, 20 aa, Mycobacterium
AGPPDRPQATKAACGSEDSN

SEQ ID NO: 1085866 - protein, 6 aa, Mycobacterium
AGPSGL

SEQ ID NO: 1085867 - protein, 17 aa, Mycobacterium
AGQAEHAATQAQSAAAA

SEQ ID NO: 1085868 - protein, 8 aa, Mycobacterium
AGQDIPEG

SEQ ID NO: 1085869 - protein, 17 aa, Mycobacterium
AGQISQTASQESAVNGN

SEQ ID NO: 1085870 - protein, 4 aa, Mycobacterium
AGQR

SEQ ID NO: 1085871 - protein, 11 aa, Mycobacterium
AGRDGSSTGAA

SEQ ID NO: 1085872 - protein, 28 aa, Mycobacterium
AGRGATGAGSRSPSESATNEDEQPQRKP

SEQ ID NO: 1085873 - protein, 8 aa, Mycobacterium
AGRGPPSV

SEQ ID NO: 1085874 - protein, 6 aa, Mycobacterium
AGRGTR

SEQ ID NO: 1085875 - protein, 4 aa, Mycobacterium
AGRH

SEQ ID NO: 1085876 - protein, 16 aa, Mycobacterium
AGRPAELSAPHGGVPH

SEQ ID NO: 1085877 - protein, 8 aa, Mycobacterium
AGRPDIKS

SEQ ID NO: 1085878 - protein, 6 aa, Mycobacterium
AGRPVQ

SEQ ID NO: 1085879 - protein, 9 aa, Mycobacterium
AGRQRSQVV

SEQ ID NO: 1085880 - protein, 8 aa, Mycobacterium
AGRRESLA

SEQ ID NO: 1085881 - protein, 5 aa, Mycobacterium
AGRRR

SEQ ID NO: 1085882 - protein, 9 aa, Mycobacterium
AGRRVQGSA

SEQ ID NO: 1085883 - protein, 10 aa, Mycobacterium
AGRSVAADPA

SEQ ID NO: 1085884 - protein, 7 aa, Mycobacterium
AGSAGSV

SEQ ID NO: 1085885 - protein, 8 aa, Mycobacterium
AGSAPTLA

SEQ ID NO: 1085886 - protein, 4 aa, Mycobacterium
AGSD

SEQ ID NO: 1085887 - protein, 16 aa, Mycobacterium
AGSGGNGGAGGSVSGI

SEQ ID NO: 1085888 - protein, 25 aa, Mycobacterium
AGSGGQGQAGTSGFGGFGGSGGSAE

SEQ ID NO: 1085889 - protein, 42 aa, Mycobacterium
AGSGGSGGAGGDGAPGDSGTAGGTGGTGSARGAGGTGGVGGA

SEQ ID NO: 1085890 - protein, 14 aa, Mycobacterium
AGSGGSGGTGGAAG

SEQ ID NO: 1085891 - protein, 9 aa, Mycobacterium
AGSPSGQGS

SEQ ID NO: 1085892 - protein, 10 aa, Mycobacterium
AGSSAPATEL

SEQ ID NO: 1085893 - protein, 23 aa, Mycobacterium
AGSSGTLTTPDNYQRTDSPSEGI

SEQ ID NO: 1085894 - protein, 7 aa, Mycobacterium
AGSTNTG

SEQ ID NO: 1085895 - protein, 17 aa, Mycobacterium
AGSTNTGFGNAGSADFG

SEQ ID NO: 1085896 - protein, 10 aa, Mycobacterium
AGSTPEGEKI

SEQ ID NO: 1085897 - protein, 16 aa, Mycobacterium
AGTAPAGADASPLQSL

SEQ ID NO: 1085898 - protein, 23 aa, Mycobacterium
AGTARPRLAPPVPSIPGRRGKPT

SEQ ID NO: 1085899 - protein, 15 aa, Mycobacterium
AGTDGSVTYDRGSDG

SEQ ID NO: 1085900 - protein, 6 aa, Mycobacterium
AGTGAA

SEQ ID NO: 1085901 - protein, 5 aa, Mycobacterium
AGTGE

SEQ ID NO: 1085902 - protein, 5 aa, Mycobacterium
AGTGG

SEQ ID NO: 1085903 - protein, 14 aa, Mycobacterium
AGTNGAGARPGPRY

SEQ ID NO: 1085904 - protein, 9 aa, Mycobacterium
AGTNTNQPL

SEQ ID NO: 1085905 - protein, 18 aa, Mycobacterium
AGTQRAARYQDGSQTQIR

SEQ ID NO: 1085906 - protein, 11 aa, Mycobacterium
AGTYRSAGGDS

SEQ ID NO: 1085907 - protein, 9 aa, Mycobacterium
AGVDDSEHA

SEQ ID NO: 1085908 - protein, 12 aa, Mycobacterium
AGVDRKDIRTTE

SEQ ID NO: 1085909 - protein, 8 aa, Mycobacterium
AGVPGLQQ

SEQ ID NO: 1085910 - protein, 5 aa, Mycobacterium
AGVRG

SEQ ID NO: 1085911 - protein, 11 aa, Mycobacterium
AGVSGADPVGW

SEQ ID NO: 1085912 - protein, 20 aa, Mycobacterium
AGYRGTPGNPLTVPYHWDQG

SEQ ID NO: 1085913 - protein, 5 aa, Mycobacterium
AGYSE

SEQ ID NO: 1085914 - protein, 10 aa, Mycobacterium
AHDAARSDAA

SEQ ID NO: 1085915 - protein, 10 aa, Mycobacterium
AHDDSEVGVP

SEQ ID NO: 1085916 - protein, 7 aa, Mycobacterium
AHEGQPV

SEQ ID NO: 1085917 - protein, 24 aa, Mycobacterium
AHETKEGEEDALAAPGAEGAAAGH

SEQ ID NO: 1085918 - protein, 6 aa, Mycobacterium
AHGEQV

SEQ ID NO: 1085919 - protein, 8 aa, Mycobacterium
AHGPNPVL

SEQ ID NO: 1085920 - protein, 7 aa, Mycobacterium
AHHDSSR

SEQ ID NO: 1085921 - protein, 12 aa, Mycobacterium
AHPRPASGPSHR

SEQ ID NO: 1085922 - protein, 17 aa, Mycobacterium
AIGSAGSQVAAGLGSGA

SEQ ID NO: 1085923 - protein, 16 aa, Mycobacterium
AIPAASQELPNPLRGQ

SEQ ID NO: 1085924 - protein, 6 aa, Mycobacterium
AIPPPW

SEQ ID NO: 1085925 - protein, 8 aa, Mycobacterium
AIPPRGTQ

SEQ ID NO: 1085926 - protein, 7 aa, Mycobacterium
AISPDGR

SEQ ID NO: 1085927 - protein, 8 aa, Mycobacterium
AISRADDH

SEQ ID NO: 1085928 - protein, 7 aa, Mycobacterium
AITDAGR

SEQ ID NO: 1085929 - protein, 48 aa, Mycobacterium
AITTTTTTTTTTSTTPVTLPKGAQACPNVSGPAGGFAQSAAGTPATSC

SEQ ID NO: 1085930 - protein, 7 aa, Mycobacterium
AKAAAVA

SEQ ID NO: 1085931 - protein, 7 aa, Mycobacterium
AKAAGGS

SEQ ID NO: 1085932 - protein, 6 aa, Mycobacterium
AKAATR

SEQ ID NO: 1085933 - protein, 10 aa, Mycobacterium
AKANGSEWKT

SEQ ID NO: 1085934 - protein, 21 aa, Mycobacterium
AKAYGTDDRESSRQQSQPQQQ

SEQ ID NO: 1085935 - protein, 9 aa, Mycobacterium
AKEAAHPNN

SEQ ID NO: 1085936 - protein, 9 aa, Mycobacterium
AKEDGDAND

SEQ ID NO: 1085937 - protein, 4 aa, Mycobacterium
AKGF

SEQ ID NO: 1085938 - protein, 4 aa, Mycobacterium
AKGN

SEQ ID NO: 1085939 - protein, 6 aa, Mycobacterium
AKLESS

SEQ ID NO: 1085940 - protein, 7 aa, Mycobacterium
AKPDRGW

SEQ ID NO: 1085941 - protein, 5 aa, Mycobacterium
AKPPC

SEQ ID NO: 1085942 - protein, 8 aa, Mycobacterium
AKPQRIDG

SEQ ID NO: 1085943 - protein, 10 aa, Mycobacterium
AKQSGGPVTA

SEQ ID NO: 1085944 - protein, 10 aa, Mycobacterium
AKRPRRAPTI

SEQ ID NO: 1085945 - protein, 12 aa, Mycobacterium
AKRRGTNQLLEA

SEQ ID NO: 1085946 - protein, 14 aa, Mycobacterium
AKSELPPRFGGTER

SEQ ID NO: 1085947 - protein, 18 aa, Mycobacterium
AKSKAVGSSGLELSPGDH

SEQ ID NO: 1085948 - protein, 11 aa, Mycobacterium
AKSSTARDAPY

SEQ ID NO: 1085949 - protein, 6 aa, Mycobacterium
AKTPAE

SEQ ID NO: 1085950 - protein, 8 aa, Mycobacterium
AKVADRYG

SEQ ID NO: 1085951 - protein, 9 aa, Mycobacterium
ALAGPGAAA

SEQ ID NO: 1085952 - protein, 10 aa, Mycobacterium
ALAQTPRATA

SEQ ID NO: 1085953 - protein, 7 aa, Mycobacterium
ALDNPEP

SEQ ID NO: 1085954 - protein, 6 aa, Mycobacterium
ALDSEQ

SEQ ID NO: 1085955 - protein, 6 aa, Mycobacterium
ALEPER

SEQ ID NO: 1085956 - protein, 13 aa, Mycobacterium
ALGETSTDAGNNA

SEQ ID NO: 1085957 - protein, 11 aa, Mycobacterium
ALGSPTRNPKP

SEQ ID NO: 1085958 - protein, 6 aa, Mycobacterium
ALGTGH

SEQ ID NO: 1085959 - protein, 7 aa, Mycobacterium
ALKADAA

SEQ ID NO: 1085960 - protein, 13 aa, Mycobacterium
ALPADAGNQGASV

SEQ ID NO: 1085961 - protein, 7 aa, Mycobacterium
ALPASGK

SEQ ID NO: 1085962 - protein, 74 aa, Mycobacterium
ALPPPKPAGAPIEPTPRPVESVPPGKPALEAPSGAPGSVVPGRSEPAFGPHDPASAPVAGSHPAATAVTPGERL

SEQ ID NO: 1085963 - protein, 9 aa, Mycobacterium
ALPPPPGHR

SEQ ID NO: 1085964 - protein, 9 aa, Mycobacterium
ALQEPSTGK

SEQ ID NO: 1085965 - protein, 6 aa, Mycobacterium
ALRQSE

SEQ ID NO: 1085966 - protein, 16 aa, Mycobacterium
ALTDTQRKFDQQREEV

SEQ ID NO: 1085967 - protein, 7 aa, Mycobacterium
AMADGPD

SEQ ID NO: 1085968 - protein, 5 aa, Mycobacterium
AMDDA

SEQ ID NO: 1085969 - protein, 5 aa, Mycobacterium
AMEGM

SEQ ID NO: 1085970 - protein, 15 aa, Mycobacterium
ANAAAADDKVPLGGG

SEQ ID NO: 1085971 - protein, 9 aa, Mycobacterium
ANADSRTDS

SEQ ID NO: 1085972 - protein, 7 aa, Mycobacterium
ANAGPAL

SEQ ID NO: 1085973 - protein, 8 aa, Mycobacterium
ANAGPSLT

SEQ ID NO: 1085974 - protein, 6 aa, Mycobacterium
ANDPGH

SEQ ID NO: 1085975 - protein, 9 aa, Mycobacterium
ANDPSTGVR

SEQ ID NO: 1085976 - protein, 7 aa, Mycobacterium
ANGALTG

SEQ ID NO: 1085977 - protein, 9 aa, Mycobacterium
ANGKEKPTV

SEQ ID NO: 1085978 - protein, 11 aa, Mycobacterium
ANIGSTLSAAN

SEQ ID NO: 1085979 - protein, 11 aa, Mycobacterium
ANLAAEGAASF

SEQ ID NO: 1085980 - protein, 8 aa, Mycobacterium
ANPDPAAM

SEQ ID NO: 1085981 - protein, 8 aa, Mycobacterium
ANPGATDL

SEQ ID NO: 1085982 - protein, 8 aa, Mycobacterium
ANPGTITG

SEQ ID NO: 1085983 - protein, 7 aa, Mycobacterium
ANRDEHR

SEQ ID NO: 1085984 - protein, 5 aa, Mycobacterium
ANRRD

SEQ ID NO: 1085985 - protein, 17 aa, Mycobacterium
ANRSGGSLTTQSSLLGS

SEQ ID NO: 1085986 - protein, 6 aa, Mycobacterium
ANRTTH

SEQ ID NO: 1085987 - protein, 9 aa, Mycobacterium
ANRVSPDSG

SEQ ID NO: 1085988 - protein, 7 aa, Mycobacterium
ANSAEKL

SEQ ID NO: 1085989 - protein, 9 aa, Mycobacterium
ANSGDTNTG

SEQ ID NO: 1085990 - protein, 22 aa, Mycobacterium
ANSTPYQPDPTRAHTPASNYGA

SEQ ID NO: 1085991 - protein, 11 aa, Mycobacterium
ANTAAAGSTTG

SEQ ID NO: 1085992 - protein, 9 aa, Mycobacterium
ANTGSTALD

SEQ ID NO: 1085993 - protein, 23 aa, Mycobacterium
ANTRGSQLARAQTAAVKAAGGVP

SEQ ID NO: 1085994 - protein, 8 aa, Mycobacterium
ANTSGAMG

SEQ ID NO: 1085995 - protein, 5 aa, Mycobacterium
APAAA

SEQ ID NO: 1085996 - protein, 6 aa, Mycobacterium
APAAGD

SEQ ID NO: 1085997 - protein, 16 aa, Mycobacterium
APAAPATAPAVTPAIP

SEQ ID NO: 1085998 - protein, 20 aa, Mycobacterium
APAAPVAPSPATAVTPSIPG

SEQ ID NO: 1085999 - protein, 11 aa, Mycobacterium
APAERQRELQD

SEQ ID NO: 1086000 - protein, 5 aa, Mycobacterium
APAGF

SEQ ID NO: 1086001 - protein, 5 aa, Mycobacterium
APAGG

SEQ ID NO: 1086002 - protein, 9 aa, Mycobacterium
APAKTTADV

SEQ ID NO: 1086003 - protein, 7 aa, Mycobacterium
APANSEE

SEQ ID NO: 1086004 - protein, 10 aa, Mycobacterium
APAPAQVPAP

SEQ ID NO: 1086005 - protein, 10 aa, Mycobacterium
APAPNGQSGP

SEQ ID NO: 1086006 - protein, 5 aa, Mycobacterium
APAQG

SEQ ID NO: 1086007 - protein, 12 aa, Mycobacterium
APARAGLAAAEA

SEQ ID NO: 1086008 - protein, 6 aa, Mycobacterium
APASVK

SEQ ID NO: 1086009 - protein, 11 aa, Mycobacterium
APATETVSESV

SEQ ID NO: 1086010 - protein, 8 aa, Mycobacterium
APDETGII

SEQ ID NO: 1086011 - protein, 8 aa, Mycobacterium
APDPADAR

SEQ ID NO: 1086012 - protein, 6 aa, Mycobacterium
APDSGV

SEQ ID NO: 1086013 - protein, 6 aa, Mycobacterium
APEPGW

SEQ ID NO: 1086014 - protein, 5 aa, Mycobacterium
APEQG

SEQ ID NO: 1086015 - protein, 31 aa, Mycobacterium
APGCGHKSAPRPTTAPDTCKNSDGPSSQTVR

SEQ ID NO: 1086016 - protein, 10 aa, Mycobacterium
APGGSATGGF

SEQ ID NO: 1086017 - protein, 15 aa, Mycobacterium
APGPLDSNESAKATV

SEQ ID NO: 1086018 - protein, 13 aa, Mycobacterium
APGPPANSQLRPG

SEQ ID NO: 1086019 - protein, 12 aa, Mycobacterium
APGQVRADSASP

SEQ ID NO: 1086020 - protein, 8 aa, Mycobacterium
APHESFDT

SEQ ID NO: 1086021 - protein, 7 aa, Mycobacterium
APHGSGT

SEQ ID NO: 1086022 - protein, 6 aa, Mycobacterium
APISSG

SEQ ID NO: 1086023 - protein, 11 aa, Mycobacterium
APKQPDASIEP

SEQ ID NO: 1086024 - protein, 31 aa, Mycobacterium
APKQSNSNPPSTPSQLPPNEVSGSDIPPGRI

SEQ ID NO: 1086025 - protein, 15 aa, Mycobacterium
APKSLPPTAAPDLSR

SEQ ID NO: 1086026 - protein, 27 aa, Mycobacterium
APLASGALGAAGAGSGCAAGATLAACA

SEQ ID NO: 1086027 - protein, 4 aa, Mycobacterium
APMG

SEQ ID NO: 1086028 - protein, 6 aa, Mycobacterium
APNGPM

SEQ ID NO: 1086029 - protein, 5 aa, Mycobacterium
APPAA

SEQ ID NO: 1086030 - protein, 6 aa, Mycobacterium
APPAVG

SEQ ID NO: 1086031 - protein, 12 aa, Mycobacterium
APPDDDDGAEPQ

SEQ ID NO: 1086032 - protein, 5 aa, Mycobacterium
APPGY

SEQ ID NO: 1086033 - protein, 12 aa, Mycobacterium
APPLSPQPPGPP

SEQ ID NO: 1086034 - protein, 7 aa, Mycobacterium
APPMPPG

SEQ ID NO: 1086035 - protein, 17 aa, Mycobacterium
APPPDTTSVNAAGGQSA

SEQ ID NO: 1086036 - protein, 13 aa, Mycobacterium
APPRPEERASTSL

SEQ ID NO: 1086037 - protein, 14 aa, Mycobacterium
APQAPQPVPAAPGL

SEQ ID NO: 1086038 - protein, 9 aa, Mycobacterium
APQLRKAGG

SEQ ID NO: 1086039 - protein, 42 aa, Mycobacterium
APQTASPPTTAASSSTSETATTSPTTAAAAGAKSGVSNGETY

SEQ ID NO: 1086040 - protein, 4 aa, Mycobacterium
APRD

SEQ ID NO: 1086041 - protein, 4 aa, Mycobacterium
APRR

SEQ ID NO: 1086042 - protein, 7 aa, Mycobacterium
APRSARG

SEQ ID NO: 1086043 - protein, 13 aa, Mycobacterium
APSAMASPPDTLV

SEQ ID NO: 1086044 - protein, 19 aa, Mycobacterium
APSITGTAIPSASAADCPD

SEQ ID NO: 1086045 - protein, 5 aa, Mycobacterium
APSPQ

SEQ ID NO: 1086046 - protein, 21 aa, Mycobacterium
APTATSALPTAASATAEPSLA

SEQ ID NO: 1086047 - protein, 5 aa, Mycobacterium
APTPL

SEQ ID NO: 1086048 - protein, 12 aa, Mycobacterium
APTSLAREPGAA

SEQ ID NO: 1086049 - protein, 11 aa, Mycobacterium
APTVGGTTAVS

SEQ ID NO: 1086050 - protein, 12 aa, Mycobacterium
APVSGGVKGAVA

SEQ ID NO: 1086051 - protein, 25 aa, Mycobacterium
APVTPPGAPILSGTPTSGSGTARPG

SEQ ID NO: 1086052 - protein, 15 aa, Mycobacterium
APVTQPPPTGEPEPL

SEQ ID NO: 1086053 - protein, 8 aa, Mycobacterium
APWEKTAS

SEQ ID NO: 1086054 - protein, 6 aa, Mycobacterium
APWPGR

SEQ ID NO: 1086055 - protein, 13 aa, Mycobacterium
APYTGKAVDDNPY

SEQ ID NO: 1086056 - protein, 15 aa, Mycobacterium
AQANENDSDPAPADL

SEQ ID NO: 1086057 - protein, 5 aa, Mycobacterium
AQAPK

SEQ ID NO: 1086058 - protein, 7 aa, Mycobacterium
AQAQTLQ

SEQ ID NO: 1086059 - protein, 16 aa, Mycobacterium
AQAYGSTEATNASPLE

SEQ ID NO: 1086060 - protein, 5 aa, Mycobacterium
AQDDF

SEQ ID NO: 1086061 - protein, 6 aa, Mycobacterium
AQDDFS

SEQ ID NO: 1086062 - protein, 6 aa, Mycobacterium
AQDDYN

SEQ ID NO: 1086063 - protein, 6 aa, Mycobacterium
AQDEVS

SEQ ID NO: 1086064 - protein, 4 aa, Mycobacterium
AQDL

SEQ ID NO: 1086065 - protein, 12 aa, Mycobacterium
AQEYQAAAAQAA

SEQ ID NO: 1086066 - protein, 4 aa, Mycobacterium
AQGA

SEQ ID NO: 1086067 - protein, 7 aa, Mycobacterium
AQGGERA

SEQ ID NO: 1086068 - protein, 9 aa, Mycobacterium
AQGHTNTSH

SEQ ID NO: 1086069 - protein, 6 aa, Mycobacterium
AQNSVR

SEQ ID NO: 1086070 - protein, 11 aa, Mycobacterium
AQPPTSAYPGD

SEQ ID NO: 1086071 - protein, 5 aa, Mycobacterium
AQPQQ

SEQ ID NO: 1086072 - protein, 7 aa, Mycobacterium
AQQARTG

SEQ ID NO: 1086073 - protein, 7 aa, Mycobacterium
AQRSPER

SEQ ID NO: 1086074 - protein, 7 aa, Mycobacterium
AQSEPIG

SEQ ID NO: 1086075 - protein, 11 aa, Mycobacterium
AQSTPNGIDGY

SEQ ID NO: 1086076 - protein, 16 aa, Mycobacterium
AQTGESVPHYPAPDGV

SEQ ID NO: 1086077 - protein, 5 aa, Mycobacterium
AQTNN

SEQ ID NO: 1086078 - protein, 11 aa, Mycobacterium
AQTSTYSAPAN

SEQ ID NO: 1086079 - protein, 8 aa, Mycobacterium
AQVGTNGS

SEQ ID NO: 1086080 - protein, 5 aa, Mycobacterium
ARAAG

SEQ ID NO: 1086081 - protein, 5 aa, Mycobacterium
ARAAT

SEQ ID NO: 1086082 - protein, 10 aa, Mycobacterium
ARAATAADPM

SEQ ID NO: 1086083 - protein, 13 aa, Mycobacterium
ARAAVTAAQANAA

SEQ ID NO: 1086084 - protein, 15 aa, Mycobacterium
ARAFEDAKSRAQQYA

SEQ ID NO: 1086085 - protein, 5 aa, Mycobacterium
ARAPF

SEQ ID NO: 1086086 - protein, 9 aa, Mycobacterium
ARASSSFDR

SEQ ID NO: 1086087 - protein, 7 aa, Mycobacterium
ARDGGHR

SEQ ID NO: 1086088 - protein, 8 aa, Mycobacterium
ARDPRSNM

SEQ ID NO: 1086089 - protein, 8 aa, Mycobacterium
ARDTGGLD

SEQ ID NO: 1086090 - protein, 14 aa, Mycobacterium
ARGLATRLRRWYRC

SEQ ID NO: 1086091 - protein, 9 aa, Mycobacterium
ARLSDGTTV

SEQ ID NO: 1086092 - protein, 6 aa, Mycobacterium
ARNPGF

SEQ ID NO: 1086093 - protein, 12 aa, Mycobacterium
ARPATEASASQL

SEQ ID NO: 1086094 - protein, 6 aa, Mycobacterium
ARPGER

SEQ ID NO: 1086095 - protein, 6 aa, Mycobacterium
ARPPEC

SEQ ID NO: 1086096 - protein, 7 aa, Mycobacterium
ARPSGMQ

SEQ ID NO: 1086097 - protein, 9 aa, Mycobacterium
ARPTRASRR

SEQ ID NO: 1086098 - protein, 19 aa, Mycobacterium
ARQRSARAAGSADSARPAV

SEQ ID NO: 1086099 - protein, 8 aa, Mycobacterium
ARRAADAG

SEQ ID NO: 1086100 - protein, 12 aa, Mycobacterium
ARRAGPAGRDQC

SEQ ID NO: 1086101 - protein, 12 aa, Mycobacterium
ARRDSDPVGAAA

SEQ ID NO: 1086102 - protein, 6 aa, Mycobacterium
ARRDTL

SEQ ID NO: 1086103 - protein, 5 aa, Mycobacterium
ARRPV

SEQ ID NO: 1086104 - protein, 4 aa, Mycobacterium
ARRS

SEQ ID NO: 1086105 - protein, 5 aa, Mycobacterium
ARRSG

SEQ ID NO: 1086106 - protein, 10 aa, Mycobacterium
ARSESEGQRR

SEQ ID NO: 1086107 - protein, 12 aa, Mycobacterium
ARSGAPVHEWPL

SEQ ID NO: 1086108 - protein, 18 aa, Mycobacterium
ARSGVGVAESGAAYAARD

SEQ ID NO: 1086109 - protein, 5 aa, Mycobacterium
ARSPA

SEQ ID NO: 1086110 - protein, 17 aa, Mycobacterium
ARSRSGPAGAASATQAR

SEQ ID NO: 1086111 - protein, 6 aa, Mycobacterium
ARSVGG

SEQ ID NO: 1086112 - protein, 5 aa, Mycobacterium
ARTGM

SEQ ID NO: 1086113 - protein, 7 aa, Mycobacterium
ARTGQLE

SEQ ID NO: 1086114 - protein, 33 aa, Mycobacterium
ARTRQVNKESASRLAEQKADKAAEDAKTSQDAA

SEQ ID NO: 1086115 - protein, 10 aa, Mycobacterium
ASAGRPRRRR

SEQ ID NO: 1086116 - protein, 8 aa, Mycobacterium
ASAGSQAA

SEQ ID NO: 1086117 - protein, 5 aa, Mycobacterium
ASAGV

SEQ ID NO: 1086118 - protein, 10 aa, Mycobacterium
ASALGDRSAQ

SEQ ID NO: 1086119 - protein, 17 aa, Mycobacterium
ASANPGPRIPGPPGPHV

SEQ ID NO: 1086120 - protein, 29 aa, Mycobacterium
ASAPAARSVPGAPSSPGCGGARSRWLVDP

SEQ ID NO: 1086121 - protein, 8 aa, Mycobacterium
ASAPAGAR

SEQ ID NO: 1086122 - protein, 9 aa, Mycobacterium
ASAPTRGEN

SEQ ID NO: 1086123 - protein, 19 aa, Mycobacterium
ASAQEAPDEPVRPPFDSDA

SEQ ID NO: 1086124 - protein, 10 aa, Mycobacterium
ASASAAPGVE

SEQ ID NO: 1086125 - protein, 7 aa, Mycobacterium
ASATAAG

SEQ ID NO: 1086126 - protein, 5 aa, Mycobacterium
ASDAA

SEQ ID NO: 1086127 - protein, 40 aa, Mycobacterium; identical to SEQ ID NO: 896656

SEQ ID NO: 1086128 - protein, 6 aa, Mycobacterium
ASDSVP

SEQ ID NO: 1086129 - protein, 7 aa, Mycobacterium
ASEEGKD

SEQ ID NO: 1086130 - protein, 16 aa, Mycobacterium
ASGAVPANRQAKPIPA

SEQ ID NO: 1086131 - protein, 18 aa, Mycobacterium
ASGAYASAEAANASPLQT

SEQ ID NO: 1086132 - protein, 6 aa, Mycobacterium
ASGEVD

SEQ ID NO: 1086133 - protein, 8 aa, Mycobacterium
ASGGPNCR

SEQ ID NO: 1086134 - protein, 6 aa, Mycobacterium
ASGGRN

SEQ ID NO: 1086135 - protein, 9 aa, Mycobacterium
ASGKTGTDI

SEQ ID NO: 1086136 - protein, 8 aa, Mycobacterium
ASGRSAPL

SEQ ID NO: 1086137 - protein, 6 aa, Mycobacterium
ASGSEN

SEQ ID NO: 1086138 - protein, 6 aa, Mycobacterium
ASGSGP

SEQ ID NO: 1086139 - protein, 5 aa, Mycobacterium
ASGYS

SEQ ID NO: 1086140 - protein, 5 aa, Mycobacterium
ASHLD

SEQ ID NO: 1086141 - protein, 7 aa, Mycobacterium
ASHPDVA

SEQ ID NO: 1086142 - protein, 8 aa, Mycobacterium
ASKTAQEH

SEQ ID NO: 1086143 - protein, 5 aa, Mycobacterium
ASLPS

SEQ ID NO: 1086144 - protein, 17 aa, Mycobacterium
ASNAPGNATTDPPPEGY

SEQ ID NO: 1086145 - protein, 6 aa, Mycobacterium
ASNNPM

SEQ ID NO: 1086146 - protein, 4 aa, Mycobacterium
ASNP

SEQ ID NO: 1086147 - protein, 19 aa, Mycobacterium
ASPAGAASGTMYGDPAAAA

SEQ ID NO: 1086148 - protein, 10 aa, Mycobacterium
ASPDPSVPPR

SEQ ID NO: 1086149 - protein, 17 aa, Mycobacterium
ASPRKLSYTRGANSSIR

SEQ ID NO: 1086150 - protein, 7 aa, Mycobacterium
ASPTLPG

SEQ ID NO: 1086151 - protein, 17 aa, Mycobacterium
ASPTQPSAPANSSGTPF

SEQ ID NO: 1086152 - protein, 11 aa, Mycobacterium
ASQAAGSASDI

SEQ ID NO: 1086153 - protein, 13 aa, Mycobacterium
ASQSDAPVGAPRR

SEQ ID NO: 1086154 - protein, 9 aa, Mycobacterium
ASRLGGEQA

SEQ ID NO: 1086155 - protein, 8 aa, Mycobacterium
ASSARKEQ

SEQ ID NO: 1086156 - protein, 5 aa, Mycobacterium
ASSAT

SEQ ID NO: 1086157 - protein, 7 aa, Mycobacterium
ASSCPNT

SEQ ID NO: 1086158 - protein, 7 aa, Mycobacterium
ASSDDAQ

SEQ ID NO: 1086159 - protein, 9 aa, Mycobacterium
ASSDEADEL

SEQ ID NO: 1086160 - protein, 9 aa, Mycobacterium
ASSGGSDRV

SEQ ID NO: 1086161 - protein, 5 aa, Mycobacterium
ASSGN

SEQ ID NO: 1086162 - protein, 8 aa, Mycobacterium
ASSGTSYW

SEQ ID NO: 1086163 - protein, 4 aa, Mycobacterium
ASSM

SEQ ID NO: 1086164 - protein, 7 aa, Mycobacterium
ASSQSFK

SEQ ID NO: 1086165 - protein, 10 aa, Mycobacterium
ASSSKVGGLS

SEQ ID NO: 1086166 - protein, 6 aa, Mycobacterium
ASTGDM

SEQ ID NO: 1086167 - protein, 8 aa, Mycobacterium
ASTTSTTV

SEQ ID NO: 1086168 - protein, 4 aa, Mycobacterium
ASTV

SEQ ID NO: 1086169 - protein, 10 aa, Mycobacterium
ASVDDPAGVR

SEQ ID NO: 1086170 - protein, 10 aa, Mycobacterium
ASVGRSGSIG

SEQ ID NO: 1086171 - protein, 7 aa, Mycobacterium
ASVPQLE

SEQ ID NO: 1086172 - protein, 7 aa, Mycobacterium
ASVTDGA

SEQ ID NO: 1086173 - protein, 16 aa, Mycobacterium
ASWGTTPGAVEQASTK

SEQ ID NO: 1086174 - protein, 4 aa, Mycobacterium
ASYD

SEQ ID NO: 1086175 - protein, 27 aa, Mycobacterium
ATAAPVPAAIPATGQMPAAGQVPAAGQ

SEQ ID NO: 1086176 - protein, 4 aa, Mycobacterium
ATAD

SEQ ID NO: 1086177 - protein, 8 aa, Mycobacterium
ATADSEST

SEQ ID NO: 1086178 - protein, 13 aa, Mycobacterium
ATAGPPDPHQPDM

SEQ ID NO: 1086179 - protein, 25 aa, Mycobacterium
ATAGQRRKENDTMHGNQPGDPAKAA

SEQ ID NO: 1086180 - protein, 7 aa, Mycobacterium
ATAHADA

SEQ ID NO: 1086181 - protein, 8 aa, Mycobacterium
ATAPPSDG

SEQ ID NO: 1086182 - protein, 51 aa, Mycobacterium
ATASADPAPAPAPSTTAAPPADPNAAPPPADPNAPPPPVVDPNAPEPGRVN

SEQ ID NO: 1086183 - protein, 6 aa, Mycobacterium
ATDAFG

SEQ ID NO: 1086184 - protein, 9 aa, Mycobacterium
ATDITKNVT

SEQ ID NO: 1086185 - protein, 6 aa, Mycobacterium
ATDPAI

SEQ ID NO: 1086186 - protein, 8 aa, Mycobacterium
ATDPATSV

SEQ ID NO: 1086187 - protein, 10 aa, Mycobacterium
ATDPNKVGQA

SEQ ID NO: 1086188 - protein, 5 aa, Mycobacterium
ATDQA

SEQ ID NO: 1086189 - protein, 4 aa, Mycobacterium
ATEA

SEQ ID NO: 1086190 - protein, 6 aa, Mycobacterium
ATETPT

SEQ ID NO: 1086191 - protein, 11 aa, Mycobacterium
ATFATDGDGEA

SEQ ID NO: 1086192 - protein, 7 aa, Mycobacterium
ATGDDKA

SEQ ID NO: 1086193 - protein, 6 aa, Mycobacterium
ATGDKI

SEQ ID NO: 1086194 - protein, 6 aa, Mycobacterium
ATGRAT

SEQ ID NO: 1086195 - protein, 5 aa, Mycobacterium
ATGRY

SEQ ID NO: 1086196 - protein, 12 aa, Mycobacterium
ATGSGRRDQPYQ

SEQ ID NO: 1086197 - protein, 13 aa, Mycobacterium
ATGSTGKANAAPY

SEQ ID NO: 1086198 - protein, 8 aa, Mycobacterium
ATHPGVNI

SEQ ID NO: 1086199 - protein, 6 aa, Mycobacterium
ATIGDP

SEQ ID NO: 1086200 - protein, 7 aa, Mycobacterium
ATKAGLP

SEQ ID NO: 1086201 - protein, 19 aa, Mycobacterium
ATNGADGATNDGQERIRHE

SEQ ID NO: 1086202 - protein, 4 aa, Mycobacterium
ATNP

SEQ ID NO: 1086203 - protein, 5 aa, Mycobacterium
ATPAE

SEQ ID NO: 1086204 - protein, 10 aa, Mycobacterium
ATPDDNARHE

SEQ ID NO: 1086205 - protein, 14 aa, Mycobacterium
ATPDVAAGEIDPLS

SEQ ID NO: 1086206 - protein, 5 aa, Mycobacterium
ATPGL

SEQ ID NO: 1086207 - protein, 15 aa, Mycobacterium
ATPPDGHVHEVVIRP

SEQ ID NO: 1086208 - protein, 15 aa, Mycobacterium
ATPPRTPATPGPAAS

SEQ ID NO: 1086209 - protein, 9 aa, Mycobacterium
ATPQGRRAA

SEQ ID NO: 1086210 - protein, 5 aa, Mycobacterium
ATQSQ

SEQ ID NO: 1086211 - protein, 14 aa, Mycobacterium
ATRALGAATQAKAA

SEQ ID NO: 1086212 - protein, 39 aa, Mycobacterium; identical to SEQ ID NO: 897310

SEQ ID NO: 1086213 - protein, 7 aa, Mycobacterium
ATRLQGE

SEQ ID NO: 1086214 - protein, 18 aa, Mycobacterium
ATSAQAAAQHEAAAAAYT

SEQ ID NO: 1086215 - protein, 9 aa, Mycobacterium
ATSAQVTAN

SEQ ID NO: 1086216 - protein, 4 aa, Mycobacterium
ATSD

SEQ ID NO: 1086217 - protein, 8 aa, Mycobacterium
ATSGEGPF

SEQ ID NO: 1086218 - protein, 8 aa, Mycobacterium
ATSPFPTA

SEQ ID NO: 1086219 - protein, 16 aa, Mycobacterium
ATTEQHAAGQPPHNTR

SEQ ID NO: 1086220 - protein, 32 aa, Mycobacterium
ATTGGTGPRLAGAPRGQTGPAFAASSPSTGIT

SEQ ID NO: 1086221 - protein, 20 aa, Mycobacterium
ATTGPAASAAAALASGPAAA

SEQ ID NO: 1086222 - protein, 12 aa, Mycobacterium
ATTNPDGATGDG

SEQ ID NO: 1086223 - protein, 12 aa, Mycobacterium
ATTNPEGSTGDG

SEQ ID NO: 1086224 - protein, 14 aa, Mycobacterium
AVAAGPASATGAAT

SEQ ID NO: 1086225 - protein, 15 aa, Mycobacterium
AVAAPAAGTTAPTRP

SEQ ID NO: 1086226 - protein, 10 aa, Mycobacterium
AVAAPDALSA

SEQ ID NO: 1086227 - protein, 13 aa, Mycobacterium
AVASTPPSTPAPR

SEQ ID NO: 1086228 - protein, 19 aa, Mycobacterium
AVATGTDSCTASADTAGAA

SEQ ID NO: 1086229 - protein, 7 aa, Mycobacterium
AVEGYTE

SEQ ID NO: 1086230 - protein, 4 aa, Mycobacterium
AVGG

SEQ ID NO: 1086231 - protein, 14 aa, Mycobacterium
AVGGPDDPEFHPPR

SEQ ID NO: 1086232 - protein, 13 aa, Mycobacterium
AVGHDGKAVPVTG

SEQ ID NO: 1086233 - protein, 7 aa, Mycobacterium
AVGPAAP

SEQ ID NO: 1086234 - protein, 12 aa, Mycobacterium
AVGTASDKLASI

SEQ ID NO: 1086235 - protein, 6 aa, Mycobacterium
AVNGTA

SEQ ID NO: 1086236 - protein, 7 aa, Mycobacterium
AVNTARQ

SEQ ID NO: 1086237 - protein, 51 aa, Mycobacterium; identical to SEQ ID NO: 897520

SEQ ID NO: 1086238 - protein, 5 aa, Mycobacterium
AVQAV

SEQ ID NO: 1086239 - protein, 7 aa, Mycobacterium
AVRGKNT

SEQ ID NO: 1086240 - protein, 6 aa, Mycobacterium
AVSPDT

SEQ ID NO: 1086241 - protein, 4 aa, Mycobacterium
AVST

SEQ ID NO: 1086242 - protein, 4 aa, Mycobacterium
AVTG

SEQ ID NO: 1086243 - protein, 12 aa, Mycobacterium
AVTGASAESAAT

SEQ ID NO: 1086244 - protein, 13 aa, Mycobacterium
AYAASKAGLSSLG

SEQ ID NO: 1086245 - protein, 8 aa, Mycobacterium
AYDEPESV

SEQ ID NO: 1086246 - protein, 10 aa, Mycobacterium
AYDRDGNDIT

SEQ ID NO: 1086247 - protein, 6 aa, Mycobacterium
AYGQTE

SEQ ID NO: 1086248 - protein, 7 aa, Mycobacterium
AYGSDGR

SEQ ID NO: 1086249 - protein, 10 aa, Mycobacterium
AYSGAEAANA

SEQ ID NO: 1086250 - protein, 5 aa, Mycobacterium
CAANG

SEQ ID NO: 1086251 - protein, 16 aa, Mycobacterium
CAENDSCPLGTDPAKA

SEQ ID NO: 1086252 - protein, 10 aa, Mycobacterium
CARPKVAPSG

SEQ ID NO: 1086253 - protein, 6 aa, Mycobacterium
CASDDD

SEQ ID NO: 1086254 - protein, 6 aa, Mycobacterium
CEPGGN

SEQ ID NO: 1086255 - protein, 18 aa, Mycobacterium
CESGGNWSVNTGNGAYGG

SEQ ID NO: 1086256 - protein, 9 aa, Mycobacterium
CESPEYDRT

SEQ ID NO: 1086257 - protein, 23 aa, Mycobacterium
CETNTAPTSFAGSSPTSWVGRSL

SEQ ID NO: 1086258 - protein, 7 aa, Mycobacterium
CGAGADC

SEQ ID NO: 1086259 - protein, 8 aa, Mycobacterium
CGARPSPA

SEQ ID NO: 1086260 - protein, 8 aa, Mycobacterium
CGDGLTPR

SEQ ID NO: 1086261 - protein, 6 aa, Mycobacterium
CGEPRE

SEQ ID NO: 1086262 - protein, 19 aa, Mycobacterium
CGGAGGDQTVRTAYVPRSI

SEQ ID NO: 1086263 - protein, 10 aa, Mycobacterium
CGGDPSIPFN

SEQ ID NO: 1086264 - protein, 18 aa, Mycobacterium
CGGPGAPVAAEGAEDKGV

SEQ ID NO: 1086265 - protein, 16 aa, Mycobacterium
CGGRNTLTAEGSTAQE

SEQ ID NO: 1086266 - protein, 53 aa, Mycobacterium
CGGSNSPSADDAASTGSESRAATPASSTEAAAAGKVNTRYDDAQTPDAEQGRG

SEQ ID NO: 1086267 - protein, 4 aa, Mycobacterium
CGMP

SEQ ID NO: 1086268 - protein, 8 aa, Mycobacterium
CGPAESPI

SEQ ID NO: 1086269 - protein, 7 aa, Mycobacterium
CGQEGTG

SEQ ID NO: 1086270 - protein, 7 aa, Mycobacterium
CGSGYEG

SEQ ID NO: 1086271 - protein, 8 aa, Mycobacterium
CGSPEEVP

SEQ ID NO: 1086272 - protein, 11 aa, Mycobacterium
CNPGGPEEAEL

SEQ ID NO: 1086273 - protein, 27 aa, Mycobacterium
CNSQSLAEDLETDTQNAQDLTPHPAVS

SEQ ID NO: 1086274 - protein, 4 aa, Mycobacterium
CPAP

SEQ ID NO: 1086275 - protein, 4 aa, Mycobacterium
CPPS

SEQ ID NO: 1086276 - protein, 6 aa, Mycobacterium
CPTNQD

SEQ ID NO: 1086277 - protein, 19 aa, Mycobacterium
CQGGPSDIAGGGGPTDAHT

SEQ ID NO: 1086278 - protein, 11 aa, Mycobacterium
CQTPQTQGELP

SEQ ID NO: 1086279 - protein, 13 aa, Mycobacterium
CSAGSPLTGPGAS

SEQ ID NO: 1086280 - protein, 5 aa, Mycobacterium
CSAPV

SEQ ID NO: 1086281 - protein, 20 aa, Mycobacterium
CSGGGDHSGTASTSSTGTAC

SEQ ID NO: 1086282 - protein, 9 aa, Mycobacterium
CSGGSPGLR

SEQ ID NO: 1086283 - protein, 4 aa, Mycobacterium
CSGR

SEQ ID NO: 1086284 - protein, 8 aa, Mycobacterium
CSNNYGPY

SEQ ID NO: 1086285 - protein, 38 aa, Mycobacterium
CSPSPDNAESSTSAVAPAPPAAPSALPVPPSAPLPPPE

SEQ ID NO: 1086286 - protein, 11 aa, Mycobacterium
CSRSHENNSPL

SEQ ID NO: 1086287 - protein, 16 aa, Mycobacterium
CSSGSNLSSGPLPDAT

SEQ ID NO: 1086288 - protein, 41 aa, Mycobacterium
CSTDASNGTATTSSGPSAKTTAPPVSSLAPGAVGVSPTGVT

SEQ ID NO: 1086289 - protein, 16 aa, Mycobacterium
CTPDPGYDDAGTPTFE

SEQ ID NO: 1086290 - protein, 8 aa, Mycobacterium
CTPGQKKA

SEQ ID NO: 1086291 - protein, 6 aa, Mycobacterium
CVPEPN

SEQ ID NO: 1086292 - protein, 27 aa, Mycobacterium
DAAAAGSGCAAGASGGALGAGADRGGV

SEQ ID NO: 1086293 - protein, 12 aa, Mycobacterium
DAADAPAYGGHN

SEQ ID NO: 1086294 - protein, 7 aa, Mycobacterium
DAADPGW

SEQ ID NO: 1086295 - protein, 6 aa, Mycobacterium
DAADQY

SEQ ID NO: 1086296 - protein, 24 aa, Mycobacterium
DAAEDAAIAASSGLGGAAPGLGGF

SEQ ID NO: 1086297 - protein, 18 aa, Mycobacterium
DAAEQAPRHERENAENEL

SEQ ID NO: 1086298 - protein, 8 aa, Mycobacterium
DAARPPDE

SEQ ID NO: 1086299 - protein, 6 aa, Mycobacterium
DAARPT

SEQ ID NO: 1086300 - protein, 7 aa, Mycobacterium
DADGISV

SEQ ID NO: 1086301 - protein, 18 aa, Mycobacterium
DADNDRLRAEPQVDYSEA

SEQ ID NO: 1086302 - protein, 7 aa, Mycobacterium
DADTSQL

SEQ ID NO: 1086303 - protein, 7 aa, Mycobacterium
DAETGED

SEQ ID NO: 1086304 - protein, 7 aa, Mycobacterium
DAGGYKA

SEQ ID NO: 1086305 - protein, 8 aa, Mycobacterium
DAGGYKAS

SEQ ID NO: 1086306 - protein, 9 aa, Mycobacterium
DAGPNGRNA

SEQ ID NO: 1086307 - protein, 9 aa, Mycobacterium
DAGSGTVTV

SEQ ID NO: 1086308 - protein, 15 aa, Mycobacterium
DAGSPEMAADPNSLA

SEQ ID NO: 1086309 - protein, 14 aa, Mycobacterium
DAIGDSERAIGAEH

SEQ ID NO: 1086310 - protein, 8 aa, Mycobacterium
DAIGQAAP

SEQ ID NO: 1086311 - protein, 10 aa, Mycobacterium
DAISRDAGVP

SEQ ID NO: 1086312 - protein, 9 aa, Mycobacterium
DAKGKPSLE

SEQ ID NO: 1086313 - protein, 7 aa, Mycobacterium
DALPNRT

SEQ ID NO: 1086314 - protein, 9 aa, Mycobacterium
DANPSVKAD

SEQ ID NO: 1086315 - protein, 7 aa, Mycobacterium
DAPPGGK

SEQ ID NO: 1086316 - protein, 8 aa, Mycobacterium
DAPPTEIA

SEQ ID NO: 1086317 - protein, 4 aa, Mycobacterium
DAPS

SEQ ID NO: 1086318 - protein, 4 aa, Mycobacterium
DAQD

SEQ ID NO: 1086319 - protein, 18 aa, Mycobacterium
DAQRDANGRFPRDASPDD

SEQ ID NO: 1086320 - protein, 10 aa, Mycobacterium
DASAPHRQRA

SEQ ID NO: 1086321 - protein, 5 aa, Mycobacterium
DASQI

SEQ ID NO: 1086322 - protein, 4 aa, Mycobacterium
DASR

SEQ ID NO: 1086323 - protein, 6 aa, Mycobacterium
DASSAD

SEQ ID NO: 1086324 - protein, 7 aa, Mycobacterium
DATAGPV

SEQ ID NO: 1086325 - protein, 7 aa, Mycobacterium
DATGERI

SEQ ID NO: 1086326 - protein, 6 aa, Mycobacterium
DATKSD

SEQ ID NO: 1086327 - protein, 10 aa, Mycobacterium
DAVAAAAGKA

SEQ ID NO: 1086328 - protein, 4 aa, Mycobacterium
DCTA

SEQ ID NO: 1086329 - protein, 10 aa, Mycobacterium
DDADTRAAVT

SEQ ID NO: 1086330 - protein, 6 aa, Mycobacterium
DDDPMT

SEQ ID NO: 1086331 - protein, 6 aa, Mycobacterium
DDDTDT

SEQ ID NO: 1086332 - protein, 7 aa, Mycobacterium
DDESIET

SEQ ID NO: 1086333 - protein, 5 aa, Mycobacterium
DDGAL

SEQ ID NO: 1086334 - protein, 4 aa, Mycobacterium
DDGG

SEQ ID NO: 1086335 - protein, 18 aa, Mycobacterium
DDNNDAPGGHNGCDTRDD

SEQ ID NO: 1086336 - protein, 9 aa, Mycobacterium
DDNPSYEQY

SEQ ID NO: 1086337 - protein, 4 aa, Mycobacterium
DDPA

SEQ ID NO: 1086338 - protein, 7 aa, Mycobacterium
DDPTNTT

SEQ ID NO: 1086339 - protein, 6 aa, Mycobacterium
DDQKGD

SEQ ID NO: 1086340 - protein, 7 aa, Mycobacterium
DDRTNEI

SEQ ID NO: 1086341 - protein, 17 aa, Mycobacterium
DDSYSGADFPAGRQRLD

SEQ ID NO: 1086342 - protein, 4 aa, Mycobacterium
DDTE

SEQ ID NO: 1086343 - protein, 9 aa, Mycobacterium
DDTPWGGKP

SEQ ID NO: 1086344 - protein, 8 aa, Mycobacterium
DDTVSASD

SEQ ID NO: 1086345 - protein, 5 aa, Mycobacterium
DEADT

SEQ ID NO: 1086346 - protein, 9 aa, Mycobacterium
DEAEGGMGP

SEQ ID NO: 1086347 - protein, 6 aa, Mycobacterium
DEAKGA

SEQ ID NO: 1086348 - protein, 7 aa, Mycobacterium
DEAKGAR

SEQ ID NO: 1086349 - protein, 11 aa, Mycobacterium
DEDTEVRPVGY

SEQ ID NO: 1086350 - protein, 9 aa, Mycobacterium
DEDVPSPAG

SEQ ID NO: 1086351 - protein, 9 aa, Mycobacterium
DEGAAQPHR

SEQ ID NO: 1086352 - protein, 9 aa, Mycobacterium
DEGNSPTTV

SEQ ID NO: 1086353 - protein, 7 aa, Mycobacterium
DEPLEGG

SEQ ID NO: 1086354 - protein, 6 aa, Mycobacterium
DEPLGY

SEQ ID NO: 1086355 - protein, 9 aa, Mycobacterium
DEPLNSARP

SEQ ID NO: 1086356 - protein, 4 aa, Mycobacterium
DEQF

SEQ ID NO: 1086357 - protein, 7 aa, Mycobacterium
DEQKSTY

SEQ ID NO: 1086358 - protein, 5 aa, Mycobacterium
DESIP

SEQ ID NO: 1086359 - protein, 10 aa, Mycobacterium
DESKQTIAAT

SEQ ID NO: 1086360 - protein, 7 aa, Mycobacterium
DESPAAA

SEQ ID NO: 1086361 - protein, 6 aa, Mycobacterium
DETRAA

SEQ ID NO: 1086362 - protein, 11 aa, Mycobacterium
DEYGRGAASPL

SEQ ID NO: 1086363 - protein, 98 aa, Mycobacterium
DGAAGTGGMGGDGGNGADGGDGHSGDPSWRSGGDGGNGGNGAYGGSGGQGGLNGDGATRAAHGVQGTMGDGGDGGDGGNGSTTSDQVDIDGGNGGYGG

SEQ ID NO: 1086364 - protein, 18 aa, Mycobacterium
DGADGQTVNGVGQAGGDG

SEQ ID NO: 1086365 - protein, 16 aa, Mycobacterium
DGADGTAPGQAGGAGG

SEQ ID NO: 1086366 - protein, 4 aa, Mycobacterium
DGAG

SEQ ID NO: 1086367 - protein, 12 aa, Mycobacterium
DGAKFDETSTGR

SEQ ID NO: 1086368 - protein, 193 aa, Mycobacterium
DGANGVDGTGGNGGAGGNGGNGANPGIGGLGGAGGTSGDGTDTAAHGINGTTPTTTNGSGGRGGHGYTSTDPTLNGGNGGAGGTGGTGGLYGDGGNGGDGGAAGAGGTYGQSGTNGTGGDAGNGGSGGTGGNGGAGGETPSTQSPDGQPGATGAMGASGQDGIAGATPGTGTGGPPAGGPDGNGGDGGPGVPG

SEQ ID NO: 1086369 - protein, 7 aa, Mycobacterium
DGAPQNR

SEQ ID NO: 1086370 - protein, 5 aa, Mycobacterium
DGAPV

SEQ ID NO: 1086371 - protein, 6 aa, Mycobacterium
DGAWSI

SEQ ID NO: 1086372 - protein, 7 aa, Mycobacterium
DGAYGAQ

SEQ ID NO: 1086373 - protein, 7 aa, Mycobacterium
DGDDARA

SEQ ID NO: 1086374 - protein, 10 aa, Mycobacterium
DGDEQARARP

SEQ ID NO: 1086375 - protein, 21 aa, Mycobacterium
DGDIGSDGSTPSDRAAAAGFR

SEQ ID NO: 1086376 - protein, 14 aa, Mycobacterium
DGESNFGKIGSPQI

SEQ ID NO: 1086377 - protein, 28 aa, Mycobacterium
DGETGGFGGDGGVGGAGGAGGGGGAAGL

SEQ ID NO: 1086378 - protein, 10 aa, Mycobacterium
DGGAGGAGVN

SEQ ID NO: 1086379 - protein, 24 aa, Mycobacterium
DGGAGGSAAATPGAAGGAGGAAGL

SEQ ID NO: 1086380 - protein, 7 aa, Mycobacterium
DGGMPAD

SEQ ID NO: 1086381 - protein, 17 aa, Mycobacterium
DGGNGGAGGGQGANGGL

SEQ ID NO: 1086382 - protein, 22 aa, Mycobacterium
DGGPGAAATATSAAGRGGDAGL

SEQ ID NO: 1086383 - protein, 134 aa, Mycobacterium
DGGPGSPGAASFDPTVAGGAGGPGGDARGIGDGGRGGDGGPGATGAPGGRGSDGGPGGKGGNAGDYGTGGTGGTGGIGGAGGPGSPGGTPGAQGFRAGDAGNGGVGGIGGDGGHIKGHGGAGGIGGTGGAGVIG

SEQ ID NO: 1086384 - protein, 12 aa, Mycobacterium
DGGPGYTPTGGI

SEQ ID NO: 1086385 - protein, 8 aa, Mycobacterium
DGGTGPGE

SEQ ID NO: 1086386 - protein, 14 aa, Mycobacterium
DGHVGGTPGFDPGR

SEQ ID NO: 1086387 - protein, 8 aa, Mycobacterium
DGIDATAR

SEQ ID NO: 1086388 - protein, 13 aa, Mycobacterium
DGITPPSAARAIS

SEQ ID NO: 1086389 - protein, 5 aa, Mycobacterium
DGKEH

SEQ ID NO: 1086390 - protein, 12 aa, Mycobacterium
DGLAATTTSGLP

SEQ ID NO: 1086391 - protein, 4 aa, Mycobacterium
DGLG

SEQ ID NO: 1086392 - protein, 34 aa, Mycobacterium; identical to SEQ ID NO: 898805

SEQ ID NO: 1086393 - protein, 4 aa, Mycobacterium
DGNT

SEQ ID NO: 1086394 - protein, 13 aa, Mycobacterium
DGPAGSAPDSSKW

SEQ ID NO: 1086395 - protein, 9 aa, Mycobacterium
DGPAQDEVY

SEQ ID NO: 1086396 - protein, 8 aa, Mycobacterium
DGPSGDTA

SEQ ID NO: 1086397 - protein, 13 aa, Mycobacterium
DGQPLTGSAQRPG

SEQ ID NO: 1086398 - protein, 6 aa, Mycobacterium
DGQTVG

SEQ ID NO: 1086399 - protein, 13 aa, Mycobacterium
DGRQRYRTAGVPK

SEQ ID NO: 1086400 - protein, 5 aa, Mycobacterium
DGRTY

SEQ ID NO: 1086401 - protein, 8 aa, Mycobacterium
DGSSSPVE

SEQ ID NO: 1086402 - protein, 4 aa, Mycobacterium
DGTE

SEQ ID NO: 1086403 - protein, 8 aa, Mycobacterium
DGTGSELT

SEQ ID NO: 1086404 - protein, 5 aa, Mycobacterium
DGTQH

SEQ ID NO: 1086405 - protein, 6 aa, Mycobacterium
DGTQHT

SEQ ID NO: 1086406 - protein, 102 aa, Mycobacterium
DGVESSPPNPNGLPPTPGIPIPGRPGEPAPDAPGTPVPLPPDAPPGARTEPVGPAGPTPPPSTFAPGLPPGPPAPPGPGPQLPDPYITPGGTGGSGATGGSQ

SEQ ID NO: 1086407 - protein, 10 aa, Mycobacterium
DGVNGEAAPP

SEQ ID NO: 1086408 - protein, 9 aa, Mycobacterium
DGYNAGGGH

SEQ ID NO: 1086409 - protein, 4 aa, Mycobacterium
DGYR

SEQ ID NO: 1086410 - protein, 5 aa, Mycobacterium
DHADQ

SEQ ID NO: 1086411 - protein, 9 aa, Mycobacterium
DHATEAAKA

SEQ ID NO: 1086412 - protein, 4 aa, Mycobacterium
DHDQ

SEQ ID NO: 1086413 - protein, 4 aa, Mycobacterium
DHGP

SEQ ID NO: 1086414 - protein, 5 aa, Mycobacterium
DHGRA

SEQ ID NO: 1086415 - protein, 9 aa, Mycobacterium
DHLDSTRAV

SEQ ID NO: 1086416 - protein, 5 aa, Mycobacterium
DHPDV

SEQ ID NO: 1086417 - protein, 12 aa, Mycobacterium
DIDARPDVEPES

SEQ ID NO: 1086418 - protein, 9 aa, Mycobacterium
DIDKNTSYR

SEQ ID NO: 1086419 - protein, 11 aa, Mycobacterium
DIGATSKTLPE

SEQ ID NO: 1086420 - protein, 11 aa, Mycobacterium
DIGPSSARDRI

SEQ ID NO: 1086421 - protein, 5 aa, Mycobacterium
DIPNA

SEQ ID NO: 1086422 - protein, 19 aa, Mycobacterium
DIPSSTRADHQAVPNSPHR

SEQ ID NO: 1086423 - protein, 6 aa, Mycobacterium
DIQETP

SEQ ID NO: 1086424 - protein, 8 aa, Mycobacterium
DIRPGGQT

SEQ ID NO: 1086425 - protein, 7 aa, Mycobacterium
DIRSTSP

SEQ ID NO: 1086426 - protein, 6 aa, Mycobacterium
DITSAD

SEQ ID NO: 1086427 - protein, 6 aa, Mycobacterium
DKFGGD

SEQ ID NO: 1086428 - protein, 6 aa, Mycobacterium
DKPGVA

SEQ ID NO: 1086429 - protein, 7 aa, Mycobacterium
DKQNDLD

SEQ ID NO: 1086430 - protein, 12 aa, Mycobacterium
DKRASGSAPDDC

SEQ ID NO: 1086431 - protein, 8 aa, Mycobacterium
DKSNGRLT

SEQ ID NO: 1086432 - protein, 6 aa, Mycobacterium
DKTGQP

SEQ ID NO: 1086433 - protein, 20 aa, Mycobacterium
DKYPEVGSERQDLRQYPGGS

SEQ ID NO: 1086434 - protein, 20 aa, Mycobacterium
DLAGAGRTLGDIGKTGRGLT

SEQ ID NO: 1086435 - protein, 7 aa, Mycobacterium
DLATREE

SEQ ID NO: 1086436 - protein, 4 aa, Mycobacterium
DLGT

SEQ ID NO: 1086437 - protein, 28 aa, Mycobacterium
DLPDDANALEGSATALADSMDADRRTEG

SEQ ID NO: 1086438 - protein, 6 aa, Mycobacterium
DLPDGF

SEQ ID NO: 1086439 - protein, 4 aa, Mycobacterium
DLPE

SEQ ID NO: 1086440 - protein, 7 aa, Mycobacterium
DLPGANA

SEQ ID NO: 1086441 - protein, 4 aa, Mycobacterium
DLPN

SEQ ID NO: 1086442 - protein, 9 aa, Mycobacterium
DLPTAQDPR

SEQ ID NO: 1086443 - protein, 7 aa, Mycobacterium
DLPTEPA

SEQ ID NO: 1086444 - protein, 4 aa, Mycobacterium
DLPV

SEQ ID NO: 1086445 - protein, 5 aa, Mycobacterium
DLQPG

SEQ ID NO: 1086446 - protein, 24 aa, Mycobacterium
DMASSTSLASSATYATGGTATLSS

SEQ ID NO: 1086447 - protein, 7 aa, Mycobacterium
DMDDTAG

SEQ ID NO: 1086448 - protein, 4 aa, Mycobacterium
DMKP

SEQ ID NO: 1086449 - protein, 10 aa, Mycobacterium
DMSGPLNQTP

SEQ ID NO: 1086450 - protein, 9 aa, Mycobacterium
DMSKSGKVT

SEQ ID NO: 1086451 - protein, 22 aa, Mycobacterium
DNAAPAHGVAPQAPAAAVDSGA

SEQ ID NO: 1086452 - protein, 8 aa, Mycobacterium
DNAPSNGV

SEQ ID NO: 1086453 - protein, 6 aa, Mycobacterium
DNASGV

SEQ ID NO: 1086454 - protein, 9 aa, Mycobacterium
DNDDSGHAG

SEQ ID NO: 1086455 - protein, 17 aa, Mycobacterium
DNGRCDPVQGTNTAESL

SEQ ID NO: 1086456 - protein, 6 aa, Mycobacterium
DNGTHS

SEQ ID NO: 1086457 - protein, 10 aa, Mycobacterium
DNKSSGNSVQ

SEQ ID NO: 1086458 - protein, 10 aa, Mycobacterium
DNLRGQGSTI

SEQ ID NO: 1086459 - protein, 8 aa, Mycobacterium
DNNDTGAK

SEQ ID NO: 1086460 - protein, 5 aa, Mycobacterium
DNPPA

SEQ ID NO: 1086461 - protein, 8 aa, Mycobacterium
DNSRAAAQ

SEQ ID NO: 1086462 - protein, 7 aa, Mycobacterium
DNTTITG

SEQ ID NO: 1086463 - protein, 5 aa, Mycobacterium
DNTTP

SEQ ID NO: 1086464 - protein, 12 aa, Mycobacterium
DPAAAAFDEGGA

SEQ ID NO: 1086465 - protein, 10 aa, Mycobacterium
DPADAAAIGE

SEQ ID NO: 1086466 - protein, 13 aa, Mycobacterium
DPADVARRGNDDA

SEQ ID NO: 1086467 - protein, 7 aa, Mycobacterium
DPAGDGG

SEQ ID NO: 1086468 - protein, 27 aa, Mycobacterium
DPAGTPGRKLTDGPADTQPAPSPDGTR

SEQ ID NO: 1086469 - protein, 76 aa, Mycobacterium
DPAHAAGPAPVAAPAGAPPASAPAPAAAAPASAPGTAPAPAAAPGPAPAAPAPAPAAAAPAPAPAPAAPPAAPVAA

SEQ ID NO: 1086470 - protein, 7 aa, Mycobacterium
DPAKAGM

SEQ ID NO: 1086471 - protein, 8 aa, Mycobacterium
DPATAAPP

SEQ ID NO: 1086472 - protein, 9 aa, Mycobacterium
DPATLGPKM

SEQ ID NO: 1086473 - protein, 5 aa, Mycobacterium
DPDAR

SEQ ID NO: 1086474 - protein, 4 aa, Mycobacterium
DPDD

SEQ ID NO: 1086475 - protein, 8 aa, Mycobacterium
DPDHKTDP

SEQ ID NO: 1086476 - protein, 11 aa, Mycobacterium
DPDPTAAPADV

SEQ ID NO: 1086477 - protein, 4 aa, Mycobacterium
DPDR

SEQ ID NO: 1086478 - protein, 6 aa, Mycobacterium
DPDRLA

SEQ ID NO: 1086479 - protein, 9 aa, Mycobacterium
DPDSARRAQ

SEQ ID NO: 1086480 - protein, 7 aa, Mycobacterium
DPEATAQ

SEQ ID NO: 1086481 - protein, 8 aa, Mycobacterium
DPEPPERA

SEQ ID NO: 1086482 - protein, 6 aa, Mycobacterium
DPEVPD

SEQ ID NO: 1086483 - protein, 4 aa, Mycobacterium
DPGA

SEQ ID NO: 1086484 - protein, 6 aa, Mycobacterium
DPGMDG

SEQ ID NO: 1086485 - protein, 44 aa, Mycobacterium
DPGQVPAGLPGAPGPAPEGTPPGGPPPAGAPVPGEAPPPGAGGV

SEQ ID NO: 1086486 - protein, 11 aa, Mycobacterium
DPGWYGDNRDR

SEQ ID NO: 1086487 - protein, 8 aa, Mycobacterium
DPHATPRH

SEQ ID NO: 1086488 - protein, 7 aa, Mycobacterium
DPKHTTT

SEQ ID NO: 1086489 - protein, 6 aa, Mycobacterium
DPLAPP

SEQ ID NO: 1086490 - protein, 6 aa, Mycobacterium
DPNIPG

SEQ ID NO: 1086491 - protein, 8 aa, Mycobacterium
DPNIPGDK

SEQ ID NO: 1086492 - protein, 9 aa, Mycobacterium
DPPAPGPAP

SEQ ID NO: 1086493 - protein, 8 aa, Mycobacterium
DPPIGGTE

SEQ ID NO: 1086494 - protein, 8 aa, Mycobacterium
DPPRRTTL

SEQ ID NO: 1086495 - protein, 4 aa, Mycobacterium
DPRV

SEQ ID NO: 1086496 - protein, 7 aa, Mycobacterium
DPSAPRI

SEQ ID NO: 1086497 - protein, 8 aa, Mycobacterium
DPSNAMGP

SEQ ID NO: 1086498 - protein, 8 aa, Mycobacterium
DPSQAGSY

SEQ ID NO: 1086499 - protein, 8 aa, Mycobacterium
DPSQGIGP

SEQ ID NO: 1086500 - protein, 6 aa, Mycobacterium
DPSRAA

SEQ ID NO: 1086501 - protein, 8 aa, Mycobacterium
DPTDQQQR

SEQ ID NO: 1086502 - protein, 16 aa, Mycobacterium
DPTPADSSTSRDTYGN

SEQ ID NO: 1086503 - protein, 12 aa, Mycobacterium
DPVCNTADTHTW

SEQ ID NO: 1086504 - protein, 9 aa, Mycobacterium
DPVEVTGSS

SEQ ID NO: 1086505 - protein, 8 aa, Mycobacterium
DQATTLAG

SEQ ID NO: 1086506 - protein, 17 aa, Mycobacterium
DQAVDPAPPTGCGAAPD

SEQ ID NO: 1086507 - protein, 13 aa, Mycobacterium
DQDTVCVEALAAV

SEQ ID NO: 1086508 - protein, 8 aa, Mycobacterium
DQGSQAGD

SEQ ID NO: 1086509 - protein, 17 aa, Mycobacterium
DQISPERLPGPALAGRS

SEQ ID NO: 1086510 - protein, 9 aa, Mycobacterium
DQPHYEGDV

SEQ ID NO: 1086511 - protein, 4 aa, Mycobacterium
DQPI

SEQ ID NO: 1086512 - protein, 26 aa, Mycobacterium
DQPNAVNSSARYGEAVGTSPSGQTIP

SEQ ID NO: 1086513 - protein, 7 aa, Mycobacterium
DQSALAQ

SEQ ID NO: 1086514 - protein, 8 aa, Mycobacterium
DQSGTTAN

SEQ ID NO: 1086515 - protein, 4 aa, Mycobacterium
DQSL

SEQ ID NO: 1086516 - protein, 43 aa, Mycobacterium; identical to SEQ ID NO: 1005215

SEQ ID NO: 1086517 - protein, 13 aa, Mycobacterium
DQSRRDELNDTDQ

SEQ ID NO: 1086518 - protein, 6 aa, Mycobacterium
DQTGVT

SEQ ID NO: 1086519 - protein, 13 aa, Mycobacterium
DQVPDSPAMSGPY

SEQ ID NO: 1086520 - protein, 6 aa, Mycobacterium
DRAATY

SEQ ID NO: 1086521 - protein, 7 aa, Mycobacterium
DRAATYV

SEQ ID NO: 1086522 - protein, 6 aa, Mycobacterium
DRADYS

SEQ ID NO: 1086523 - protein, 20 aa, Mycobacterium
DRAEETRTDTRSRVEESRAR

SEQ ID NO: 1086524 - protein, 6 aa, Mycobacterium
DRAITS

SEQ ID NO: 1086525 - protein, 8 aa, Mycobacterium
DRARNGDC

SEQ ID NO: 1086526 - protein, 4 aa, Mycobacterium
DRDT

SEQ ID NO: 1086527 - protein, 6 aa, Mycobacterium
DRDTGA

SEQ ID NO: 1086528 - protein, 12 aa, Mycobacterium
DRGAGSVRSVRG

SEQ ID NO: 1086529 - protein, 9 aa, Mycobacterium
DRGALDRAA

SEQ ID NO: 1086530 - protein, 6 aa, Mycobacterium
DRLRSG

SEQ ID NO: 1086531 - protein, 12 aa, Mycobacterium
DRPQRGNPGLEI

SEQ ID NO: 1086532 - protein, 6 aa, Mycobacterium
DRRPGG

SEQ ID NO: 1086533 - protein, 5 aa, Mycobacterium
DSAAS

SEQ ID NO: 1086534 - protein, 7 aa, Mycobacterium
DSASGLY

SEQ ID NO: 1086535 - protein, 9 aa, Mycobacterium
DSDANPVAA

SEQ ID NO: 1086536 - protein, 9 aa, Mycobacterium
DSDRTPWEQ

SEQ ID NO: 1086537 - protein, 5 aa, Mycobacterium
DSDSS

SEQ ID NO: 1086538 - protein, 7 aa, Mycobacterium
DSEPADV

SEQ ID NO: 1086539 - protein, 10 aa, Mycobacterium
DSGGINNGDK

SEQ ID NO: 1086540 - protein, 8 aa, Mycobacterium
DSGGYNAN

SEQ ID NO: 1086541 - protein, 22 aa, Mycobacterium
DSGRQKSDVAGDVAASSSLDGY

SEQ ID NO: 1086542 - protein, 11 aa, Mycobacterium
DSGSDEGRDEQ

SEQ ID NO: 1086543 - protein, 9 aa, Mycobacterium
DSHPETNQA

SEQ ID NO: 1086544 - protein, 16 aa, Mycobacterium
DSNGGNRATGTPGYDA

SEQ ID NO: 1086545 - protein, 7 aa, Mycobacterium
DSNGTMA

SEQ ID NO: 1086546 - protein, 6 aa, Mycobacterium
DSNHGA

SEQ ID NO: 1086547 - protein, 7 aa, Mycobacterium
DSNSPTY

SEQ ID NO: 1086548 - protein, 5 aa, Mycobacterium
DSNSW

SEQ ID NO: 1086549 - protein, 10 aa, Mycobacterium
DSPGGSVTAS

SEQ ID NO: 1086550 - protein, 5 aa, Mycobacterium
DSPRR

SEQ ID NO: 1086551 - protein, 37 aa, Mycobacterium
DSSGKAVDDSSSLTTMPTSSSATKSPTSTSAKPAALK

SEQ ID NO: 1086552 - protein, 7 aa, Mycobacterium
DSSGLSV

SEQ ID NO: 1086553 - protein, 13 aa, Mycobacterium
DSSGNSETGEVPI

SEQ ID NO: 1086554 - protein, 5 aa, Mycobacterium
DSSLT

SEQ ID NO: 1086555 - protein, 6 aa, Mycobacterium
DSSPVG

SEQ ID NO: 1086556 - protein, 9 aa, Mycobacterium
DSSRNLDNT

SEQ ID NO: 1086557 - protein, 8 aa, Mycobacterium
DSTNPTDL

SEQ ID NO: 1086558 - protein, 5 aa, Mycobacterium
DSTYN

SEQ ID NO: 1086559 - protein, 8 aa, Mycobacterium
DSVNQTKD

SEQ ID NO: 1086560 - protein, 8 aa, Mycobacterium
DSYPNNTN

SEQ ID NO: 1086561 - protein, 5 aa, Mycobacterium
DTAAR

SEQ ID NO: 1086562 - protein, 6 aa, Mycobacterium
DTAEEA

SEQ ID NO: 1086563 - protein, 14 aa, Mycobacterium
DTAPATASRGSRVP

SEQ ID NO: 1086564 - protein, 5 aa, Mycobacterium
DTDAT

SEQ ID NO: 1086565 - protein, 4 aa, Mycobacterium
DTDI

SEQ ID NO: 1086566 - protein, 10 aa, Mycobacterium
DTGPHNYTDD

SEQ ID NO: 1086567 - protein, 16 aa, Mycobacterium
DTGSVLSPPQRPAAAD

SEQ ID NO: 1086568 - protein, 5 aa, Mycobacterium
DTGYV

SEQ ID NO: 1086569 - protein, 6 aa, Mycobacterium
DTKPGD

SEQ ID NO: 1086570 - protein, 9 aa, Mycobacterium
DTLGKRDDE

SEQ ID NO: 1086571 - protein, 7 aa, Mycobacterium
DTPPSAI

SEQ ID NO: 1086572 - protein, 12 aa, Mycobacterium
DTPQAAYADNRA

SEQ ID NO: 1086573 - protein, 6 aa, Mycobacterium
DTSVYA

SEQ ID NO: 1086574 - protein, 25 aa, Mycobacterium
DTTANAGVVTSGDLPEDRAGNCEDE

SEQ ID NO: 1086575 - protein, 8 aa, Mycobacterium
DVAGGSAD

SEQ ID NO: 1086576 - protein, 14 aa, Mycobacterium
DVAGKLNNKPDAPT

SEQ ID NO: 1086577 - protein, 10 aa, Mycobacterium
DVANASPLQT

SEQ ID NO: 1086578 - protein, 6 aa, Mycobacterium
DVGPDI

SEQ ID NO: 1086579 - protein, 21 aa, Mycobacterium
DVKDEQSAQGHHAQTFCLVKA

SEQ ID NO: 1086580 - protein, 8 aa, Mycobacterium
DVPKGGSF

SEQ ID NO: 1086581 - protein, 7 aa, Mycobacterium
DVPTPAG

SEQ ID NO: 1086582 - protein, 4 aa, Mycobacterium
DVRE

SEQ ID NO: 1086583 - protein, 9 aa, Mycobacterium
DVSTDQPDT

SEQ ID NO: 1086584 - protein, 14 aa, Mycobacterium
DVTGAMSQANARQQ

SEQ ID NO: 1086585 - protein, 4 aa, Mycobacterium
DWPA

SEQ ID NO: 1086586 - protein, 8 aa, Mycobacterium
DYDDTSHD

SEQ ID NO: 1086587 - protein, 4 aa, Mycobacterium
DYDL

SEQ ID NO: 1086588 - protein, 26 aa, Mycobacterium
DYRPELPGGQPAGGRSLGPAAFEPSR

SEQ ID NO: 1086589 - protein, 12 aa, Mycobacterium
DYSGPGSGLGGA

SEQ ID NO: 1086590 - protein, 4 aa, Mycobacterium
DYSP

SEQ ID NO: 1086591 - protein, 7 aa, Mycobacterium
EAAQERN

SEQ ID NO: 1086592 - protein, 9 aa, Mycobacterium
EADDKQSRL

SEQ ID NO: 1086593 - protein, 4 aa, Mycobacterium
EAEN

SEQ ID NO: 1086594 - protein, 5 aa, Mycobacterium
EAGAE

SEQ ID NO: 1086595 - protein, 10 aa, Mycobacterium
EAGASYASAE

SEQ ID NO: 1086596 - protein, 7 aa, Mycobacterium
EAGATPS

SEQ ID NO: 1086597 - protein, 5 aa, Mycobacterium
EAGGL

SEQ ID NO: 1086598 - protein, 36 aa, Mycobacterium
EAGGNDGGGGAGGSGGNGFGTIGGTGGSGGRGGDAR

SEQ ID NO: 1086599 - protein, 9 aa, Mycobacterium
EAGKARWAA

SEQ ID NO: 1086600 - protein, 28 aa, Mycobacterium
EAGTGPTAPPAAGSTAPVAPVAQGGKGV

SEQ ID NO: 1086601 - protein, 7 aa, Mycobacterium
EAHSGET

SEQ ID NO: 1086602 - protein, 9 aa, Mycobacterium
EAKEEAKRI

SEQ ID NO: 1086603 - protein, 8 aa, Mycobacterium
EANAANAR

SEQ ID NO: 1086604 - protein, 5 aa, Mycobacterium
EANMT

SEQ ID NO: 1086605 - protein, 8 aa, Mycobacterium
EAQRPQGF

SEQ ID NO: 1086606 - protein, 11 aa, Mycobacterium
EARASRAAQAV

SEQ ID NO: 1086607 - protein, 9 aa, Mycobacterium
EAREAQANW

SEQ ID NO: 1086608 - protein, 10 aa, Mycobacterium
EAREQAKTEV

SEQ ID NO: 1086609 - protein, 23 aa, Mycobacterium
EARGNQPLRPGGTLPLGQSTTPY

SEQ ID NO: 1086610 - protein, 10 aa, Mycobacterium
EASAAASALA

SEQ ID NO: 1086611 - protein, 9 aa, Mycobacterium
EASGGVDGR

SEQ ID NO: 1086612 - protein, 13 aa, Mycobacterium
EASGSAGKVTVSP

SEQ ID NO: 1086613 - protein, 7 aa, Mycobacterium
EATGAST

SEQ ID NO: 1086614 - protein, 6 aa, Mycobacterium
EATNVE

SEQ ID NO: 1086615 - protein, 18 aa, Mycobacterium
EATPYNPSSPYSATKAGA

SEQ ID NO: 1086616 - protein, 4 aa, Mycobacterium
EAVA

SEQ ID NO: 1086617 - protein, 7 aa, Mycobacterium
EAVEGRD

SEQ ID NO: 1086618 - protein, 12 aa, Mycobacterium
EAVEKANDTEYG

SEQ ID NO: 1086619 - protein, 4 aa, Mycobacterium
EAVP

SEQ ID NO: 1086620 - protein, 8 aa, Mycobacterium
EAYGGSPV

SEQ ID NO: 1086621 - protein, 5 aa, Mycobacterium
EAYPQ

SEQ ID NO: 1086622 - protein, 7 aa, Mycobacterium
ECNPRSA

SEQ ID NO: 1086623 - protein, 6 aa, Mycobacterium
ECTGAA

SEQ ID NO: 1086624 - protein, 10 aa, Mycobacterium
EDAGGRAWAE

SEQ ID NO: 1086625 - protein, 9 aa, Mycobacterium
EDAPAGAPH

SEQ ID NO: 1086626 - protein, 6 aa, Mycobacterium
EDAPLG

SEQ ID NO: 1086627 - protein, 10 aa, Mycobacterium
EDDGGSRNQI

SEQ ID NO: 1086628 - protein, 5 aa, Mycobacterium
EDEVS

SEQ ID NO: 1086629 - protein, 5 aa, Mycobacterium
EDGGQ

SEQ ID NO: 1086630 - protein, 11 aa, Mycobacterium
EDGYTDANREA

SEQ ID NO: 1086631 - protein, 7 aa, Mycobacterium
EDHTRAR

SEQ ID NO: 1086632 - protein, 10 aa, Mycobacterium
EDHTTTESTL

SEQ ID NO: 1086633 - protein, 7 aa, Mycobacterium
EDPDRVQ

SEQ ID NO: 1086634 - protein, 10 aa, Mycobacterium
EDPGAPGTQD

SEQ ID NO: 1086635 - protein, 8 aa, Mycobacterium
EDRSTAER

SEQ ID NO: 1086636 - protein, 8 aa, Mycobacterium
EDRVPDQS

SEQ ID NO: 1086637 - protein, 13 aa, Mycobacterium
EDSISTPEIETAT

SEQ ID NO: 1086638 - protein, 15 aa, Mycobacterium
EDVSSEIRTEEVTQA

SEQ ID NO: 1086639 - protein, 8 aa, Mycobacterium
EEAVAADK

SEQ ID NO: 1086640 - protein, 4 aa, Mycobacterium
EEDS

SEQ ID NO: 1086641 - protein, 5 aa, Mycobacterium
EGAGG

SEQ ID NO: 1086642 - protein, 6 aa, Mycobacterium
EGAMTP

SEQ ID NO: 1086643 - protein, 6 aa, Mycobacterium
EGGATY

SEQ ID NO: 1086644 - protein, 7 aa, Mycobacterium
EGGHSRR

SEQ ID NO: 1086645 - protein, 7 aa, Mycobacterium
EGGPTYW

SEQ ID NO: 1086646 - protein, 6 aa, Mycobacterium
EGGSAK

SEQ ID NO: 1086647 - protein, 4 aa, Mycobacterium
EGIA

SEQ ID NO: 1086648 - protein, 6 aa, Mycobacterium
EGLPAG

SEQ ID NO: 1086649 - protein, 9 aa, Mycobacterium
EGLRGHGDD

SEQ ID NO: 1086650 - protein, 4 aa, Mycobacterium
EGMP

SEQ ID NO: 1086651 - protein, 8 aa, Mycobacterium
EGNPKNIR

SEQ ID NO: 1086652 - protein, 7 aa, Mycobacterium
EGNSGQL

SEQ ID NO: 1086653 - protein, 14 aa, Mycobacterium
EGPAASQVAAANPG

SEQ ID NO: 1086654 - protein, 11 aa, Mycobacterium
EGPPDKYQTTG

SEQ ID NO: 1086655 - protein, 9 aa, Mycobacterium
EGSGAPYGG

SEQ ID NO: 1086656 - protein, 9 aa, Mycobacterium
EGSTPDTAA

SEQ ID NO: 1086657 - protein, 34 aa, Mycobacterium
EGTPDHPLPAVPPGSPCSYTPAADALPRPDNPLP

SEQ ID NO: 1086658 - protein, 10 aa, Mycobacterium
EGTRSPDGRL

SEQ ID NO: 1086659 - protein, 7 aa, Mycobacterium
EGTVNGI

SEQ ID NO: 1086660 - protein, 20 aa, Mycobacterium
EGVGTRPSPGEMNTPAPRTS

SEQ ID NO: 1086661 - protein, 15 aa, Mycobacterium
EGVRGQGERIGQATA

SEQ ID NO: 1086662 - protein, 5 aa, Mycobacterium
EHDGE

SEQ ID NO: 1086663 - protein, 5 aa, Mycobacterium
EHPGV

SEQ ID NO: 1086664 - protein, 25 aa, Mycobacterium
EHRSDAPGQLDDQSASALVSGSREV

SEQ ID NO: 1086665 - protein, 7 aa, Mycobacterium
EHSSPDQ

SEQ ID NO: 1086666 - protein, 6 aa, Mycobacterium
EIPPRA

SEQ ID NO: 1086667 - protein, 7 aa, Mycobacterium
EISPKSQ

SEQ ID NO: 1086668 - protein, 9 aa, Mycobacterium
EKGSVDVGG

SEQ ID NO: 1086669 - protein, 6 aa, Mycobacterium
EKKAEI

SEQ ID NO: 1086670 - protein, 8 aa, Mycobacterium
EKKSLAER

SEQ ID NO: 1086671 - protein, 10 aa, Mycobacterium
EKNPKVASDL

SEQ ID NO: 1086672 - protein, 6 aa, Mycobacterium
EKPDDV

SEQ ID NO: 1086673 - protein, 5 aa, Mycobacterium
ELGGK

SEQ ID NO: 1086674 - protein, 11 aa, Mycobacterium
ELGRSGVGVGE

SEQ ID NO: 1086675 - protein, 9 aa, Mycobacterium
ELGTTAETC

SEQ ID NO: 1086676 - protein, 13 aa, Mycobacterium
ELPANATATLGQT

SEQ ID NO: 1086677 - protein, 6 aa, Mycobacterium
ELPPGY

SEQ ID NO: 1086678 - protein, 13 aa, Mycobacterium
ELPPPARRIEDPE

SEQ ID NO: 1086679 - protein, 5 aa, Mycobacterium
ELPRG

SEQ ID NO: 1086680 - protein, 13 aa, Mycobacterium
ELQPTEPGGVSPL

SEQ ID NO: 1086681 - protein, 9 aa, Mycobacterium
ELSGGQRQR

SEQ ID NO: 1086682 - protein, 6 aa, Mycobacterium
ELSGTG

SEQ ID NO: 1086683 - protein, 7 aa, Mycobacterium
ELSQRGD

SEQ ID NO: 1086684 - protein, 8 aa, Mycobacterium
ELTEDRGD

SEQ ID NO: 1086685 - protein, 5 aa, Mycobacterium
ELTPS

SEQ ID NO: 1086686 - protein, 35 aa, Mycobacterium; identical to SEQ ID NO: 467742

SEQ ID NO: 1086687 - protein, 7 aa, Mycobacterium
ENARSQD

SEQ ID NO: 1086688 - protein, 30 aa, Mycobacterium
ENPAAATGPASSTGARRAGSAARAPGTAIT

SEQ ID NO: 1086689 - protein, 4 aa, Mycobacterium
ENPS

SEQ ID NO: 1086690 - protein, 10 aa, Mycobacterium
ENRGARADDA

SEQ ID NO: 1086691 - protein, 10 aa, Mycobacterium
ENVGQYRDDR

SEQ ID NO: 1086692 - protein, 6 aa, Mycobacterium
ENVYPR

SEQ ID NO: 1086693 - protein, 14 aa, Mycobacterium
EPAAAQTLKVPEGG

SEQ ID NO: 1086694 - protein, 5 aa, Mycobacterium
EPAEA

SEQ ID NO: 1086695 - protein, 14 aa, Mycobacterium
EPAEELRSARTPQE

SEQ ID NO: 1086696 - protein, 9 aa, Mycobacterium
EPAQAGGDY

SEQ ID NO: 1086697 - protein, 5 aa, Mycobacterium
EPAQR

SEQ ID NO: 1086698 - protein, 8 aa, Mycobacterium
EPDNPAKV

SEQ ID NO: 1086699 - protein, 4 aa, Mycobacterium
EPET

SEQ ID NO: 1086700 - protein, 23 aa, Mycobacterium
EPGGSFNSAASKVVAGGSGMSPE

SEQ ID NO: 1086701 - protein, 17 aa, Mycobacterium
EPGQQTVSFSVTAVWEL

SEQ ID NO: 1086702 - protein, 7 aa, Mycobacterium
EPGRGPR

SEQ ID NO: 1086703 - protein, 5 aa, Mycobacterium
EPGTG

SEQ ID NO: 1086704 - protein, 6 aa, Mycobacterium
EPGVGK

SEQ ID NO: 1086705 - protein, 9 aa, Mycobacterium
EPITSPEAA

SEQ ID NO: 1086706 - protein, 7 aa, Mycobacterium
EPKLGQP

SEQ ID NO: 1086707 - protein, 5 aa, Mycobacterium
EPLDT

SEQ ID NO: 1086708 - protein, 4 aa, Mycobacterium
EPLP

SEQ ID NO: 1086709 - protein, 6 aa, Mycobacterium
EPNPFG

SEQ ID NO: 1086710 - protein, 4 aa, Mycobacterium
EPNT

SEQ ID NO: 1086711 - protein, 14 aa, Mycobacterium
EPPAPDVAPPPAPK

SEQ ID NO: 1086712 - protein, 6 aa, Mycobacterium
EPPAQA

SEQ ID NO: 1086713 - protein, 12 aa, Mycobacterium
EPPARAKAASTA

SEQ ID NO: 1086714 - protein, 4 aa, Mycobacterium
EPPF

SEQ ID NO: 1086715 - protein, 7 aa, Mycobacterium
EPPHGNA

SEQ ID NO: 1086716 - protein, 5 aa, Mycobacterium
EPQGE

SEQ ID NO: 1086717 - protein, 4 aa, Mycobacterium
EPSA

SEQ ID NO: 1086718 - protein, 5 aa, Mycobacterium
EPSTG

SEQ ID NO: 1086719 - protein, 13 aa, Mycobacterium
EPTATGATDPCAA

SEQ ID NO: 1086720 - protein, 6 aa, Mycobacterium
EPTSAL

SEQ ID NO: 1086721 - protein, 7 aa, Mycobacterium
EPVPAGG

SEQ ID NO: 1086722 - protein, 7 aa, Mycobacterium
EQAQGQR

SEQ ID NO: 1086723 - protein, 16 aa, Mycobacterium
EQARQTAAQARAAATA

SEQ ID NO: 1086724 - protein, 8 aa, Mycobacterium
EQDGSKQW

SEQ ID NO: 1086725 - protein, 5 aa, Mycobacterium
EQEGV

SEQ ID NO: 1086726 - protein, 10 aa, Mycobacterium
EQNEGKTAEL

SEQ ID NO: 1086727 - protein, 31 aa, Mycobacterium
EQPGGSGCDSNGNCGSGGVNGGPGSGPGGQG

SEQ ID NO: 1086728 - protein, 4 aa, Mycobacterium
EQQP

SEQ ID NO: 1086729 - protein, 6 aa, Mycobacterium
EQQVPR

SEQ ID NO: 1086730 - protein, 9 aa, Mycobacterium
EQSAELDPG

SEQ ID NO: 1086731 - protein, 4 aa, Mycobacterium
EQTL

SEQ ID NO: 1086732 - protein, 8 aa, Mycobacterium
EQTPARPI

SEQ ID NO: 1086733 - protein, 14 aa, Mycobacterium
EQYDAGEPGGVEQA

SEQ ID NO: 1086734 - protein, 5 aa, Mycobacterium
ERENL

SEQ ID NO: 1086735 - protein, 7 aa, Mycobacterium
EREPGRA

SEQ ID NO: 1086736 - protein, 6 aa, Mycobacterium
ERGARV

SEQ ID NO: 1086737 - protein, 14 aa, Mycobacterium
ERGPLGLPTSAEIQ

SEQ ID NO: 1086738 - protein, 9 aa, Mycobacterium
ERHPEQPYQ

SEQ ID NO: 1086739 - protein, 6 aa, Mycobacterium
ERKDKL

SEQ ID NO: 1086740 - protein, 4 aa, Mycobacterium
ERLS

SEQ ID NO: 1086741 - protein, 9 aa, Mycobacterium
ERNPDPFPR

SEQ ID NO: 1086742 - protein, 5 aa, Mycobacterium
ERPIH

SEQ ID NO: 1086743 - protein, 8 aa, Mycobacterium
ERQTGAVE

SEQ ID NO: 1086744 - protein, 6 aa, Mycobacterium
ERRTDI

SEQ ID NO: 1086745 - protein, 4 aa, Mycobacterium
ERRV

SEQ ID NO: 1086746 - protein, 4 aa, Mycobacterium
ERTG

SEQ ID NO: 1086747 - protein, 5 aa, Mycobacterium
ERTRP

SEQ ID NO: 1086748 - protein, 4 aa, Mycobacterium
ESAA

SEQ ID NO: 1086749 - protein, 37 aa, Mycobacterium; identical to SEQ ID NO: 901496

SEQ ID NO: 1086750 - protein, 8 aa, Mycobacterium
ESFPPSDI

SEQ ID NO: 1086751 - protein, 14 aa, Mycobacterium
ESFTPSHADSNQQL

SEQ ID NO: 1086752 - protein, 9 aa, Mycobacterium
ESGKSISGK

SEQ ID NO: 1086753 - protein, 6 aa, Mycobacterium
ESGRYA

SEQ ID NO: 1086754 - protein, 7 aa, Mycobacterium
ESGTASD

SEQ ID NO: 1086755 - protein, 6 aa, Mycobacterium
ESLGEN

SEQ ID NO: 1086756 - protein, 6 aa, Mycobacterium
ESPAPP

SEQ ID NO: 1086757 - protein, 5 aa, Mycobacterium
ESQTI

SEQ ID NO: 1086758 - protein, 8 aa, Mycobacterium
ESRGAPWR

SEQ ID NO: 1086759 - protein, 7 aa, Mycobacterium
ESSPGKP

SEQ ID NO: 1086760 - protein, 8 aa, Mycobacterium
ESSPHGKR

SEQ ID NO: 1086761 - protein, 16 aa, Mycobacterium
ESTDVSSAIPAGDQSV

SEQ ID NO: 1086762 - protein, 6 aa, Mycobacterium
ESTGGS

SEQ ID NO: 1086763 - protein, 14 aa, Mycobacterium
ESTGSSYTTVPGGA

SEQ ID NO: 1086764 - protein, 8 aa, Mycobacterium
ESTSSVTA

SEQ ID NO: 1086765 - protein, 13 aa, Mycobacterium
ESYNTTIAPGSSV

SEQ ID NO: 1086766 - protein, 26 aa, Mycobacterium
ETAAPDEQGAGAPATAGTSERPRSTE

SEQ ID NO: 1086767 - protein, 14 aa, Mycobacterium
ETAASQARAAAAAY

SEQ ID NO: 1086768 - protein, 10 aa, Mycobacterium
ETANTASLQT

SEQ ID NO: 1086769 - protein, 9 aa, Mycobacterium
ETASATTEV

SEQ ID NO: 1086770 - protein, 18 aa, Mycobacterium
ETDTSTTRVFDVADGLPW

SEQ ID NO: 1086771 - protein, 12 aa, Mycobacterium
ETETAAAAAVAD

SEQ ID NO: 1086772 - protein, 11 aa, Mycobacterium
ETETRAAEARY

SEQ ID NO: 1086773 - protein, 17 aa, Mycobacterium
ETGSQHAGTSGFAGTTV

SEQ ID NO: 1086774 - protein, 8 aa, Mycobacterium
ETHPSEPN

SEQ ID NO: 1086775 - protein, 13 aa, Mycobacterium
ETRSGEGESSKSL

SEQ ID NO: 1086776 - protein, 7 aa, Mycobacterium
ETTYRSS

SEQ ID NO: 1086777 - protein, 6 aa, Mycobacterium
ETVGRP

SEQ ID NO: 1086778 - protein, 8 aa, Mycobacterium
EVADTQDA

SEQ ID NO: 1086779 - protein, 4 aa, Mycobacterium
EVDG

SEQ ID NO: 1086780 - protein, 13 aa, Mycobacterium
EVEQSEIGGSPRH

SEQ ID NO: 1086781 - protein, 11 aa, Mycobacterium
EVGKGERLAQA

SEQ ID NO: 1086782 - protein, 6 aa, Mycobacterium
EVGPDD

SEQ ID NO: 1086783 - protein, 8 aa, Mycobacterium
EVRTDGPI

SEQ ID NO: 1086784 - protein, 9 aa, Mycobacterium
EVRTDSSSG

SEQ ID NO: 1086785 - protein, 7 aa, Mycobacterium
EVTHGDD

SEQ ID NO: 1086786 - protein, 14 aa, Mycobacterium
EWPEPAESLPPPFD

SEQ ID NO: 1086787 - protein, 6 aa, Mycobacterium
EWRPGS

SEQ ID NO: 1086788 - protein, 16 aa, Mycobacterium
EYGGVGNPASASKQQQ

SEQ ID NO: 1086789 - protein, 13 aa, Mycobacterium
EYHPDPGSTMAER

SEQ ID NO: 1086790 - protein, 4 aa, Mycobacterium
EYPD

SEQ ID NO: 1086791 - protein, 12 aa, Mycobacterium
EYPDTAPEHARS

SEQ ID NO: 1086792 - protein, 13 aa, Mycobacterium
FAANAPAIADIWG

SEQ ID NO: 1086793 - protein, 13 aa, Mycobacterium
FADPPPTTSPEAG

SEQ ID NO: 1086794 - protein, 5 aa, Mycobacterium
FAGQG

SEQ ID NO: 1086795 - protein, 11 aa, Mycobacterium
FDGGGEDTGAF

SEQ ID NO: 1086796 - protein, 13 aa, Mycobacterium
FDTAAGKSAPDYY

SEQ ID NO: 1086797 - protein, 10 aa, Mycobacterium
FDTTQPTAWS

SEQ ID NO: 1086798 - protein, 9 aa, Mycobacterium
FEGHPDNAA

SEQ ID NO: 1086799 - protein, 4 aa, Mycobacterium
FGEE

SEQ ID NO: 1086800 - protein, 11 aa, Mycobacterium
FGGDGGAGGNS

SEQ ID NO: 1086801 - protein, 6 aa, Mycobacterium
FGGGPK

SEQ ID NO: 1086802 - protein, 6 aa, Mycobacterium
FGGNGH

SEQ ID NO: 1086803 - protein, 6 aa, Mycobacterium
FGGRGF

SEQ ID NO: 1086804 - protein, 9 aa, Mycobacterium
FGNNGSNNI

SEQ ID NO: 1086805 - protein, 8 aa, Mycobacterium
FGNTGDNN

SEQ ID NO: 1086806 - protein, 8 aa, Mycobacterium
FGPSTRTR

SEQ ID NO: 1086807 - protein, 9 aa, Mycobacterium
FGRPAPDLP

SEQ ID NO: 1086808 - protein, 9 aa, Mycobacterium
FGSPDTKRY

SEQ ID NO: 1086809 - protein, 6 aa, Mycobacterium
FGTPAE

SEQ ID NO: 1086810 - protein, 17 aa, Mycobacterium
FKQTDADVGSFDGGYGS

SEQ ID NO: 1086811 - protein, 10 aa, Mycobacterium
FNAPAGSSPV

SEQ ID NO: 1086812 - protein, 15 aa, Mycobacterium
FNGATTQTSATDQTH

SEQ ID NO: 1086813 - protein, 13 aa, Mycobacterium
FNGGGNPQSLRHS

SEQ ID NO: 1086814 - protein, 5 aa, Mycobacterium
FNPQR

SEQ ID NO: 1086815 - protein, 20 aa, Mycobacterium
FPDPKGTRFPNGAPPPGPRV

SEQ ID NO: 1086816 - protein, 10 aa, Mycobacterium
FPGEDGEHPI

SEQ ID NO: 1086817 - protein, 11 aa, Mycobacterium
FPGGGDNGWGS

SEQ ID NO: 1086818 - protein, 4 aa, Mycobacterium
FPPD

SEQ ID NO: 1086819 - protein, 7 aa, Mycobacterium
FPPPQQS

SEQ ID NO: 1086820 - protein, 7 aa, Mycobacterium
FQQQSGG

SEQ ID NO: 1086821 - protein, 7 aa, Mycobacterium
FREKDGH

SEQ ID NO: 1086822 - protein, 15 aa, Mycobacterium
FRSPKALPVTFEAVP

SEQ ID NO: 1086823 - protein, 16 aa, Mycobacterium
FRTSPTPGSNGTTHRA

SEQ ID NO: 1086824 - protein, 4 aa, Mycobacterium
FSSA

SEQ ID NO: 1086825 - protein, 33 aa, Mycobacterium; identical to SEQ ID NO: 476665

SEQ ID NO: 1086826 - protein, 12 aa, Mycobacterium
FTDEQRARREAE

SEQ ID NO: 1086827 - protein, 4 aa, Mycobacterium
FTKP

SEQ ID NO: 1086828 - protein, 12 aa, Mycobacterium
FTPPDGAGGDRA

SEQ ID NO: 1086829 - protein, 14 aa, Mycobacterium
FTTSPGEANPANGL

SEQ ID NO: 1086830 - protein, 12 aa, Mycobacterium
GAAAGRAAMLAL

SEQ ID NO: 1086831 - protein, 6 aa, Mycobacterium
GAAATA

SEQ ID NO: 1086832 - protein, 11 aa, Mycobacterium
GAAEESSIDQA

SEQ ID NO: 1086833 - protein, 6 aa, Mycobacterium
GAAGGS

SEQ ID NO: 1086834 - protein, 12 aa, Mycobacterium
GAAHPAHRPALV

SEQ ID NO: 1086835 - protein, 8 aa, Mycobacterium
GAAMGDSR

SEQ ID NO: 1086836 - protein, 7 aa, Mycobacterium
GAAPGGF

SEQ ID NO: 1086837 - protein, 8 aa, Mycobacterium
GAAPSMTA

SEQ ID NO: 1086838 - protein, 13 aa, Mycobacterium
GAARTTLAGPTTY

SEQ ID NO: 1086839 - protein, 6 aa, Mycobacterium
GAARYT

SEQ ID NO: 1086840 - protein, 16 aa, Mycobacterium
GAAVPGDQRSGGRLSR

SEQ ID NO: 1086841 - protein, 7 aa, Mycobacterium
GACGRGP

SEQ ID NO: 1086842 - protein, 6 aa, Mycobacterium
GADAAD

SEQ ID NO: 1086843 - protein, 26 aa, Mycobacterium
GADAPPPPRRVRRGGGGIRRDVAGRL

SEQ ID NO: 1086844 - protein, 8 aa, Mycobacterium
GADDVSTA

SEQ ID NO: 1086845 - protein, 6 aa, Mycobacterium
GADEIS

SEQ ID NO: 1086846 - protein, 5 aa, Mycobacterium
GADEV

SEQ ID NO: 1086847 - protein, 10 aa, Mycobacterium
GADGTPYPNG

SEQ ID NO: 1086848 - protein, 16 aa, Mycobacterium
GADRLSATGGALAAPI

SEQ ID NO: 1086849 - protein, 7 aa, Mycobacterium
GADTYAP

SEQ ID NO: 1086850 - protein, 8 aa, Mycobacterium
GAEDPRVG

SEQ ID NO: 1086851 - protein, 9 aa, Mycobacterium
GAEGGGHGE

SEQ ID NO: 1086852 - protein, 8 aa, Mycobacterium
GAEHADAA

SEQ ID NO: 1086853 - protein, 5 aa, Mycobacterium
GAERG

SEQ ID NO: 1086854 - protein, 39 aa, Mycobacterium
GAGGAGAGAKGAAGAARAAEVGGEAADAAAAAGRGGRLA

SEQ ID NO: 1086855 - protein, 45 aa, Mycobacterium
GAGGAGGAGANTGISNPGFGGAGGAGGAGAGAGGGVGEAGGAGGL

SEQ ID NO: 1086856 - protein, 29 aa, Mycobacterium
GAGGAGGAGGNSPLRNTANGGNGGTGGAG

SEQ ID NO: 1086857 - protein, 13 aa, Mycobacterium
GAGGAGGAGWANS

SEQ ID NO: 1086858 - protein, 22 aa, Mycobacterium
GAGGAGGDASTGGGGLGGNGGV

SEQ ID NO: 1086859 - protein, 14 aa, Mycobacterium
GAGGAGGNGGGAPL

SEQ ID NO: 1086860 - protein, 26 aa, Mycobacterium
GAGGGDGGSGGLGAAGGDGGNGGRAG

SEQ ID NO: 1086861 - protein, 14 aa, Mycobacterium
GAGGTGGGGGVAPS

SEQ ID NO: 1086862 - protein, 10 aa, Mycobacterium
GAGGTGGSGI

SEQ ID NO: 1086863 - protein, 32 aa, Mycobacterium; identical to SEQ ID NO: 902348

SEQ ID NO: 1086864 - protein, 7 aa, Mycobacterium
GAGPAAM

SEQ ID NO: 1086865 - protein, 8 aa, Mycobacterium
GAGRNVSA

SEQ ID NO: 1086866 - protein, 7 aa, Mycobacterium
GAGSGIG

SEQ ID NO: 1086867 - protein, 9 aa, Mycobacterium
GAHRPTPTI

SEQ ID NO: 1086868 - protein, 9 aa, Mycobacterium
GAHSRRSGA

SEQ ID NO: 1086869 - protein, 8 aa, Mycobacterium
GAHTDPHT

SEQ ID NO: 1086870 - protein, 13 aa, Mycobacterium
GAIGGKTGYTNAA

SEQ ID NO: 1086871 - protein, 13 aa, Mycobacterium
GAIPNAGRSEVAA

SEQ ID NO: 1086872 - protein, 18 aa, Mycobacterium
GAIPPADAPPPANAPPPA

SEQ ID NO: 1086873 - protein, 9 aa, Mycobacterium
GAKPPPTFG

SEQ ID NO: 1086874 - protein, 10 aa, Mycobacterium
GALASTGTAY

SEQ ID NO: 1086875 - protein, 7 aa, Mycobacterium
GALGDLD

SEQ ID NO: 1086876 - protein, 4 aa, Mycobacterium
GANF

SEQ ID NO: 1086877 - protein, 6 aa, Mycobacterium
GANPVR

SEQ ID NO: 1086878 - protein, 6 aa, Mycobacterium
GANSIT

SEQ ID NO: 1086879 - protein, 23 aa, Mycobacterium
GAPAALGADPAAIEAASDGSPYY

SEQ ID NO: 1086880 - protein, 6 aa, Mycobacterium
GAPGAV

SEQ ID NO: 1086881 - protein, 11 aa, Mycobacterium
GAPINSATAMS

SEQ ID NO: 1086882 - protein, 6 aa, Mycobacterium
GAPLGA

SEQ ID NO: 1086883 - protein, 7 aa, Mycobacterium
GAPPEPR

SEQ ID NO: 1086884 - protein, 7 aa, Mycobacterium
GAPQPTF

SEQ ID NO: 1086885 - protein, 17 aa, Mycobacterium
GAPTSPEADGAGGARYA

SEQ ID NO: 1086886 - protein, 11 aa, Mycobacterium
GAQARARQTMP

SEQ ID NO: 1086887 - protein, 9 aa, Mycobacterium
GAQESSPTA

SEQ ID NO: 1086888 - protein, 5 aa, Mycobacterium
GAQRG

SEQ ID NO: 1086889 - protein, 17 aa, Mycobacterium
GARGAVTPATRPPADRD

SEQ ID NO: 1086890 - protein, 9 aa, Mycobacterium
GARRRDGGV

SEQ ID NO: 1086891 - protein, 9 aa, Mycobacterium
GARSHDELR

SEQ ID NO: 1086892 - protein, 9 aa, Mycobacterium
GARSSLGRK

SEQ ID NO: 1086893 - protein, 8 aa, Mycobacterium
GARTGSAT

SEQ ID NO: 1086894 - protein, 17 aa, Mycobacterium
GASADQSRGVADGKPAD

SEQ ID NO: 1086895 - protein, 13 aa, Mycobacterium
GASAPAHAGGDEL

SEQ ID NO: 1086896 - protein, 13 aa, Mycobacterium
GASLAGNSRSTIQ

SEQ ID NO: 1086897 - protein, 9 aa, Mycobacterium
GASPTADHH

SEQ ID NO: 1086898 - protein, 8 aa, Mycobacterium
GATATPAR

SEQ ID NO: 1086899 - protein, 16 aa, Mycobacterium
GATGAGRGVGSGPRYG

SEQ ID NO: 1086900 - protein, 8 aa, Mycobacterium
GATGGLGR

SEQ ID NO: 1086901 - protein, 11 aa, Mycobacterium
GATPAANPYPT

SEQ ID NO: 1086902 - protein, 9 aa, Mycobacterium
GATPDNPGR

SEQ ID NO: 1086903 - protein, 10 aa, Mycobacterium
GATQAQVPRN

SEQ ID NO: 1086904 - protein, 7 aa, Mycobacterium
GATTTRE

SEQ ID NO: 1086905 - protein, 29 aa, Mycobacterium
GAVGPPDCSATAGQAVSAATEDSTTTATE

SEQ ID NO: 1086906 - protein, 12 aa, Mycobacterium
GCCGRSARDGVD

SEQ ID NO: 1086907 - protein, 7 aa, Mycobacterium
GCGGPCK

SEQ ID NO: 1086908 - protein, 28 aa, Mycobacterium
GCPEDRPATRSARRVQPAPRSGQQDASA

SEQ ID NO: 1086909 - protein, 7 aa, Mycobacterium
GCSGQTT

SEQ ID NO: 1086910 - protein, 26 aa, Mycobacterium
GCSNSGDNNPGATASSTPGSSEGRHG

SEQ ID NO: 1086911 - protein, 15 aa, Mycobacterium
GDAISQDRTTTPVTP

SEQ ID NO: 1086912 - protein, 4 aa, Mycobacterium
GDAN

SEQ ID NO: 1086913 - protein, 8 aa, Mycobacterium
GDASGPNF

SEQ ID NO: 1086914 - protein, 6 aa, Mycobacterium
GDDPAT

SEQ ID NO: 1086915 - protein, 14 aa, Mycobacterium
GDEAAAAGYGAFGG

SEQ ID NO: 1086916 - protein, 15 aa, Mycobacterium
GDEPLPGPPPPGGCD

SEQ ID NO: 1086917 - protein, 4 aa, Mycobacterium
GDEQ

SEQ ID NO: 1086918 - protein, 6 aa, Mycobacterium
GDEVSA

SEQ ID NO: 1086919 - protein, 17 aa, Mycobacterium
GDGADGTAPGQGGGAGG

SEQ ID NO: 1086920 - protein, 245 aa, Mycobacterium
GDGGHGGTGGAGGTGGAGGSGVGSGLAGGTGGDGGVGGAAGRGGAADAGGPLVTPGHAGNTGTGGTGGTGGTGGNGDLHTDGGNGGTGGSGGAGIAGVGGGNGGHGTDGSAGVAGHGGGAGGAGGDAGDGGKGGDALDGGTAGTGGAGGNAGNGGGAGSGGKGTFDGGAGGAGGDGGKAGNGGAGGIDSNGQVADGGNGGDGGNGGDGSPVGAGGTGGIGTAGGAGGGGGAVSGRPGQNGSEGQP

SEQ ID NO: 1086921 - protein, 7 aa, Mycobacterium
GDGGRTL

SEQ ID NO: 1086922 - protein, 5 aa, Mycobacterium
GDGNF

SEQ ID NO: 1086923 - protein, 7 aa, Mycobacterium
GDGPLTG

SEQ ID NO: 1086924 - protein, 5 aa, Mycobacterium
GDGQV

SEQ ID NO: 1086925 - protein, 18 aa, Mycobacterium
GDGTNGAPGTGQAGGNGG

SEQ ID NO: 1086926 - protein, 4 aa, Mycobacterium
GDHS

SEQ ID NO: 1086927 - protein, 7 aa, Mycobacterium
GDIDPTA

SEQ ID NO: 1086928 - protein, 4 aa, Mycobacterium
GDIN

SEQ ID NO: 1086929 - protein, 6 aa, Mycobacterium
GDLDAQ

SEQ ID NO: 1086930 - protein, 6 aa, Mycobacterium
GDLPTE

SEQ ID NO: 1086931 - protein, 6 aa, Mycobacterium
GDLPTG

SEQ ID NO: 1086932 - protein, 8 aa, Mycobacterium
GDNNMHDG

SEQ ID NO: 1086933 - protein, 8 aa, Mycobacterium
GDNPLGAD

SEQ ID NO: 1086934 - protein, 16 aa, Mycobacterium
GDNTPLGPASSTRVGE

SEQ ID NO: 1086935 - protein, 11 aa, Mycobacterium
GDPAAPKRSRT

SEQ ID NO: 1086936 - protein, 6 aa, Mycobacterium
GDPANH

SEQ ID NO: 1086937 - protein, 10 aa, Mycobacterium
GDPICSDGDQ

SEQ ID NO: 1086938 - protein, 13 aa, Mycobacterium
GDPTLSAAPPGVE

SEQ ID NO: 1086939 - protein, 4 aa, Mycobacterium
GDQA

SEQ ID NO: 1086940 - protein, 7 aa, Mycobacterium
GDQAEID

SEQ ID NO: 1086941 - protein, 5 aa, Mycobacterium
GDQAS

SEQ ID NO: 1086942 - protein, 7 aa, Mycobacterium
GDRGQRR

SEQ ID NO: 1086943 - protein, 11 aa, Mycobacterium
GDRTTDDSGTD

SEQ ID NO: 1086944 - protein, 13 aa, Mycobacterium
GDSITGTSGDAQQ

SEQ ID NO: 1086945 - protein, 5 aa, Mycobacterium
GDSRG

SEQ ID NO: 1086946 - protein, 7 aa, Mycobacterium
GDTGYTK

SEQ ID NO: 1086947 - protein, 14 aa, Mycobacterium
GDTIGLDSTTAAAT

SEQ ID NO: 1086948 - protein, 18 aa, Mycobacterium
GDTIPLKNSSAYPNTEQT

SEQ ID NO: 1086949 - protein, 7 aa, Mycobacterium
GDTPPSD

SEQ ID NO: 1086950 - protein, 4 aa, Mycobacterium
GDTV

SEQ ID NO: 1086951 - protein, 5 aa, Mycobacterium
GDVPK

SEQ ID NO: 1086952 - protein, 11 aa, Mycobacterium
GDYATAAEDKP

SEQ ID NO: 1086953 - protein, 5 aa, Mycobacterium
GEAFG

SEQ ID NO: 1086954 - protein, 24 aa, Mycobacterium
GECGGGAKLSGTVRADGTRQATWR

SEQ ID NO: 1086955 - protein, 8 aa, Mycobacterium
GEDGRFRP

SEQ ID NO: 1086956 - protein, 5 aa, Mycobacterium
GEEGR

SEQ ID NO: 1086957 - protein, 11 aa, Mycobacterium
GEEYGGTTTLR

SEQ ID NO: 1086958 - protein, 6 aa, Mycobacterium
GEFSAP

SEQ ID NO: 1086959 - protein, 9 aa, Mycobacterium
GEGAGQVPL

SEQ ID NO: 1086960 - protein, 11 aa, Mycobacterium
GEISATKDSVA

SEQ ID NO: 1086961 - protein, 7 aa, Mycobacterium
GEKYPDG

SEQ ID NO: 1086962 - protein, 9 aa, Mycobacterium
GEPDPRSVN

SEQ ID NO: 1086963 - protein, 8 aa, Mycobacterium
GEPSAEDT

SEQ ID NO: 1086964 - protein, 7 aa, Mycobacterium
GERQQVN

SEQ ID NO: 1086965 - protein, 8 aa, Mycobacterium
GERRLQPD

SEQ ID NO: 1086966 - protein, 4 aa, Mycobacterium
GESG

SEQ ID NO: 1086967 - protein, 12 aa, Mycobacterium
GESGSGKSTAAA

SEQ ID NO: 1086968 - protein, 10 aa, Mycobacterium
GESGSGKSTV

SEQ ID NO: 1086969 - protein, 10 aa, Mycobacterium
GESPPKRPAV

SEQ ID NO: 1086970 - protein, 7 aa, Mycobacterium
GETMRPQ

SEQ ID NO: 1086971 - protein, 5 aa, Mycobacterium
GEVAR

SEQ ID NO: 1086972 - protein, 5 aa, Mycobacterium
GEVKD

SEQ ID NO: 1086973 - protein, 6 aa, Mycobacterium
GEYKSA

SEQ ID NO: 1086974 - protein, 10 aa, Mycobacterium
GFDDTTDPAI

SEQ ID NO: 1086975 - protein, 25 aa, Mycobacterium
GFDTPSSAFQQKGWNPQTQSIDPAG

SEQ ID NO: 1086976 - protein, 54 aa, Mycobacterium
GFGGTGGNAGWLGSGGSGGAGGGSNGDGGAGGTGGSGGQIVGDGGAGGAGGQGD

SEQ ID NO: 1086977 - protein, 5 aa, Mycobacterium
GFGPT

SEQ ID NO: 1086978 - protein, 4 aa, Mycobacterium
GFGS

SEQ ID NO: 1086979 - protein, 7 aa, Mycobacterium
GFPGTAH

SEQ ID NO: 1086980 - protein, 7 aa, Mycobacterium
GFPRDKA

SEQ ID NO: 1086981 - protein, 5 aa, Mycobacterium
GFTEQ

SEQ ID NO: 1086982 - protein, 10 aa, Mycobacterium
GGAAATAGLP

SEQ ID NO: 1086983 - protein, 14 aa, Mycobacterium
GGAATAGAFSRPGL

SEQ ID NO: 1086984 - protein, 26 aa, Mycobacterium
GGAGGAGGMGATGGHSGGDGGAGGDA

SEQ ID NO: 1086985 - protein, 19 aa, Mycobacterium
GGAGGAGGTGGVAPPTGVG

SEQ ID NO: 1086986 - protein, 13 aa, Mycobacterium
GGAGGAPAARHRA

SEQ ID NO: 1086987 - protein, 8 aa, Mycobacterium
GGAGGDGG

SEQ ID NO: 1086988 - protein, 23 aa, Mycobacterium
GGAGGDGGTATTGTAGSGGNGGF

SEQ ID NO: 1086989 - protein, 12 aa, Mycobacterium
GGAGGGSALGGR

SEQ ID NO: 1086990 - protein, 24 aa, Mycobacterium
GGAGGHGGAAPTGNGGSGGAGAGG

SEQ ID NO: 1086991 - protein, 25 aa, Mycobacterium
GGAGGHGGAGATGGAGGGGGSAYSG

SEQ ID NO: 1086992 - protein, 22 aa, Mycobacterium
GGAGGHGGSGTSGADGGAGGVS

SEQ ID NO: 1086993 - protein, 26 aa, Mycobacterium
GGAGGLGGPASGAGNGGAGGAGGAGG

SEQ ID NO: 1086994 - protein, 6 aa, Mycobacterium
GGAGTA

SEQ ID NO: 1086995 - protein, 8 aa, Mycobacterium
GGANQTAA

SEQ ID NO: 1086996 - protein, 14 aa, Mycobacterium
GGAPFNGASLQGKP

SEQ ID NO: 1086997 - protein, 6 aa, Mycobacterium
GGASSV

SEQ ID NO: 1086998 - protein, 4 aa, Mycobacterium
GGAW

SEQ ID NO: 1086999 - protein, 7 aa, Mycobacterium
GGAYAAA

SEQ ID NO: 1087000 - protein, 10 aa, Mycobacterium
GGAYPSTEQT

SEQ ID NO: 1087001 - protein, 9 aa, Mycobacterium
GGDATGAEV

SEQ ID NO: 1087002 - protein, 10 aa, Mycobacterium
GGDATGAEVQ

SEQ ID NO: 1087003 - protein, 16 aa, Mycobacterium
GGDDRRGSSANSGAVS

SEQ ID NO: 1087004 - protein, 7 aa, Mycobacterium
GGDDSVD

SEQ ID NO: 1087005 - protein, 7 aa, Mycobacterium
GGDGAND

SEQ ID NO: 1087006 - protein, 35 aa, Mycobacterium
GGDGGFGGWGGNGYGGVGGGNGGAGGTAYTSGGVY

SEQ ID NO: 1087007 - protein, 25 aa, Mycobacterium
GGDGGGAGTGVGSNGGDGGGGGGAH

SEQ ID NO: 1087008 - protein, 8 aa, Mycobacterium
GGDHNPIH

SEQ ID NO: 1087009 - protein, 14 aa, Mycobacterium
GGDLPKADPPVGGR

SEQ ID NO: 1087010 - protein, 10 aa, Mycobacterium
GGDPGLHGPK

SEQ ID NO: 1087011 - protein, 9 aa, Mycobacterium
GGEAHEQRA

SEQ ID NO: 1087012 - protein, 19 aa, Mycobacterium
GGEPPNPLIPTGTNDSYGG

SEQ ID NO: 1087013 - protein, 7 aa, Mycobacterium
GGESGRK

SEQ ID NO: 1087014 - protein, 7 aa, Mycobacterium
GGGETAA

SEQ ID NO: 1087015 - protein, 8 aa, Mycobacterium
GGGGGNFG

SEQ ID NO: 1087016 - protein, 19 aa, Mycobacterium
GGGNAAGPSKGIDSGAGIT

SEQ ID NO: 1087017 - protein, 15 aa, Mycobacterium
GGGRASRLIDRRPPF

SEQ ID NO: 1087018 - protein, 4 aa, Mycobacterium
GGHG

SEQ ID NO: 1087019 - protein, 19 aa, Mycobacterium
GGHPGQYGTGHGATSVTVA

SEQ ID NO: 1087020 - protein, 5 aa, Mycobacterium
GGHPQ

SEQ ID NO: 1087021 - protein, 17 aa, Mycobacterium
GGHSSNTSSSTGSSTPL

SEQ ID NO: 1087022 - protein, 6 aa, Mycobacterium
GGHYPT

SEQ ID NO: 1087023 - protein, 18 aa, Mycobacterium
GGIAAKAADEIAAGQLHK

SEQ ID NO: 1087024 - protein, 8 aa, Mycobacterium
GGIGGDAG

SEQ ID NO: 1087025 - protein, 13 aa, Mycobacterium
GGITGPSRGKGTG

SEQ ID NO: 1087026 - protein, 6 aa, Mycobacterium
GGKQKD

SEQ ID NO: 1087027 - protein, 17 aa, Mycobacterium
GGKVPQGDYTVTDVFEE

SEQ ID NO: 1087028 - protein, 5 aa, Mycobacterium
GGLGQ

SEQ ID NO: 1087029 - protein, 5 aa, Mycobacterium
GGLPL

SEQ ID NO: 1087030 - protein, 50 aa, Mycobacterium
GGLTPTAATPAAAAPAAAAPVAAAAADAGPVSAGANSGSTAGAGLRSPAV

SEQ ID NO: 1087031 - protein, 11 aa, Mycobacterium
GGMGADSRHAG

SEQ ID NO: 1087032 - protein, 5 aa, Mycobacterium
GGNDV

SEQ ID NO: 1087033 - protein, 24 aa, Mycobacterium
GGNGGFGGAATGLGPGGAGGYGGH

SEQ ID NO: 1087034 - protein, 14 aa, Mycobacterium
GGNGGHGGQGGHGG

SEQ ID NO: 1087035 - protein, 11 aa, Mycobacterium
GGPGDSGAPVT

SEQ ID NO: 1087036 - protein, 31 aa, Mycobacterium; identical to SEQ ID NO: 486023

SEQ ID NO: 1087037 - protein, 11 aa, Mycobacterium
GGPKSGKSTAL

SEQ ID NO: 1087038 - protein, 16 aa, Mycobacterium
GGPSPMLDEPGNRPIA

SEQ ID NO: 1087039 - protein, 18 aa, Mycobacterium
GGQFSSLDGTPGPHGGSA

SEQ ID NO: 1087040 - protein, 8 aa, Mycobacterium
GGQGQGTV

SEQ ID NO: 1087041 - protein, 4 aa, Mycobacterium
GGQL

SEQ ID NO: 1087042 - protein, 5 aa, Mycobacterium
GGQLT

SEQ ID NO: 1087043 - protein, 8 aa, Mycobacterium
GGQPGQGF

SEQ ID NO: 1087044 - protein, 5 aa, Mycobacterium
GGQSS

SEQ ID NO: 1087045 - protein, 6 aa, Mycobacterium
GGRANG

SEQ ID NO: 1087046 - protein, 17 aa, Mycobacterium
GGRARGVRARRPDGTAI

SEQ ID NO: 1087047 - protein, 16 aa, Mycobacterium
GGRGPSARELARTDTV

SEQ ID NO: 1087048 - protein, 5 aa, Mycobacterium
GGRIT

SEQ ID NO: 1087049 - protein, 5 aa, Mycobacterium
GGRPM

SEQ ID NO: 1087050 - protein, 11 aa, Mycobacterium
GGSDGYGTSKA

SEQ ID NO: 1087051 - protein, 12 aa, Mycobacterium
GGSEFERGSREP

SEQ ID NO: 1087052 - protein, 19 aa, Mycobacterium
GGSGGAGGTGGTGGSGDIY

SEQ ID NO: 1087053 - protein, 18 aa, Mycobacterium
GGSLQGPSKGVDSGANTV

SEQ ID NO: 1087054 - protein, 15 aa, Mycobacterium
GGSPAPSAANTGANR

SEQ ID NO: 1087055 - protein, 5 aa, Mycobacterium
GGSPT

SEQ ID NO: 1087056 - protein, 5 aa, Mycobacterium
GGSQM

SEQ ID NO: 1087057 - protein, 11 aa, Mycobacterium
GGSSASSPRGF

SEQ ID NO: 1087058 - protein, 11 aa, Mycobacterium
GGSSATPTATK

SEQ ID NO: 1087059 - protein, 10 aa, Mycobacterium
GGSTKPGAAL

SEQ ID NO: 1087060 - protein, 19 aa, Mycobacterium
GGTADEPFDPNYHQKSDTI

SEQ ID NO: 1087061 - protein, 13 aa, Mycobacterium
GGTGGAGGAGGAA

SEQ ID NO: 1087062 - protein, 10 aa, Mycobacterium
GGTLPGTEGL

SEQ ID NO: 1087063 - protein, 5 aa, Mycobacterium
GGTTV

SEQ ID NO: 1087064 - protein, 23 aa, Mycobacterium
GGTVNSGINNSGNTNAGIGNLGD

SEQ ID NO: 1087065 - protein, 6 aa, Mycobacterium
GGTYDP

SEQ ID NO: 1087066 - protein, 10 aa, Mycobacterium
GGVGGAGGAS

SEQ ID NO: 1087067 - protein, 14 aa, Mycobacterium
GGVGGTGGAGGGGA

SEQ ID NO: 1087068 - protein, 11 aa, Mycobacterium
GGVPPPPTSWD

SEQ ID NO: 1087069 - protein, 5 aa, Mycobacterium
GGYDP

SEQ ID NO: 1087070 - protein, 5 aa, Mycobacterium
GGYGE

SEQ ID NO: 1087071 - protein, 4 aa, Mycobacterium
GHAP

SEQ ID NO: 1087072 - protein, 13 aa, Mycobacterium
GHAPTTTTRAAPR

SEQ ID NO: 1087073 - protein, 9 aa, Mycobacterium
GHGASPQAL

SEQ ID NO: 1087074 - protein, 14 aa, Mycobacterium
GHGRASGDSHTGGV

SEQ ID NO: 1087075 - protein, 10 aa, Mycobacterium
GHHDPASMTP

SEQ ID NO: 1087076 - protein, 4 aa, Mycobacterium
GHRP

SEQ ID NO: 1087077 - protein, 7 aa, Mycobacterium
GHSSSGV

SEQ ID NO: 1087078 - protein, 5 aa, Mycobacterium
GHTYT

SEQ ID NO: 1087079 - protein, 7 aa, Mycobacterium
GIADGRG

SEQ ID NO: 1087080 - protein, 5 aa, Mycobacterium
GIAGP

SEQ ID NO: 1087081 - protein, 11 aa, Mycobacterium
GIANSGSDSSG

SEQ ID NO: 1087082 - protein, 7 aa, Mycobacterium
GIASPRS

SEQ ID NO: 1087083 - protein, 4 aa, Mycobacterium
GIEV

SEQ ID NO: 1087084 - protein, 5 aa, Mycobacterium
GIGGA

SEQ ID NO: 1087085 - protein, 9 aa, Mycobacterium
GIGPSTERL

SEQ ID NO: 1087086 - protein, 4 aa, Mycobacterium
GIGS

SEQ ID NO: 1087087 - protein, 5 aa, Mycobacterium
GIPDT

SEQ ID NO: 1087088 - protein, 20 aa, Mycobacterium
GIPPAPPPPPEGEPPPPVGS

SEQ ID NO: 1087089 - protein, 5 aa, Mycobacterium
GIQGG

SEQ ID NO: 1087090 - protein, 10 aa, Mycobacterium
GIRDNSAAAP

SEQ ID NO: 1087091 - protein, 5 aa, Mycobacterium
GIRPA

SEQ ID NO: 1087092 - protein, 9 aa, Mycobacterium
GISKEQLAR

SEQ ID NO: 1087093 - protein, 6 aa, Mycobacterium
GITYPD

SEQ ID NO: 1087094 - protein, 10 aa, Mycobacterium
GKAAGNDGEV

SEQ ID NO: 1087095 - protein, 9 aa, Mycobacterium
GKGAPLGSG

SEQ ID NO: 1087096 - protein, 14 aa, Mycobacterium
GKGLGSGGAKGCPK

SEQ ID NO: 1087097 - protein, 8 aa, Mycobacterium
GKGSTSDW

SEQ ID NO: 1087098 - protein, 9 aa, Mycobacterium
GKGYPGDPH

SEQ ID NO: 1087099 - protein, 11 aa, Mycobacterium
GKPSDLGGDNL

SEQ ID NO: 1087100 - protein, 12 aa, Mycobacterium
GKPTELGGNNLP

SEQ ID NO: 1087101 - protein, 9 aa, Mycobacterium
GKQIAPSDL

SEQ ID NO: 1087102 - protein, 17 aa, Mycobacterium
GKQVNTARSEVQRDYDE

SEQ ID NO: 1087103 - protein, 9 aa, Mycobacterium
GKSPPASGW

SEQ ID NO: 1087104 - protein, 6 aa, Mycobacterium
GKSPRF

SEQ ID NO: 1087105 - protein, 7 aa, Mycobacterium
GKSSNVG

SEQ ID NO: 1087106 - protein, 10 aa, Mycobacterium
GKTGTAQQIN

SEQ ID NO: 1087107 - protein, 8 aa, Mycobacterium
GLAPGSGA

SEQ ID NO: 1087108 - protein, 7 aa, Mycobacterium
GLGASPT

SEQ ID NO: 1087109 - protein, 8 aa, Mycobacterium
GLGGAATR

SEQ ID NO: 1087110 - protein, 8 aa, Mycobacterium
GLGGQTPV

SEQ ID NO: 1087111 - protein, 22 aa, Mycobacterium
GLGGVGGSGNVGGNGGAGGAGG

SEQ ID NO: 1087112 - protein, 6 aa, Mycobacterium
GLGSSA

SEQ ID NO: 1087113 - protein, 8 aa, Mycobacterium
GLGTPGTH

SEQ ID NO: 1087114 - protein, 16 aa, Mycobacterium
GLPGSAGSGAAGAPGG

SEQ ID NO: 1087115 - protein, 4 aa, Mycobacterium
GLPS

SEQ ID NO: 1087116 - protein, 22 aa, Mycobacterium
GLRTGSTGGAVPAKTAGPALAA

SEQ ID NO: 1087117 - protein, 9 aa, Mycobacterium
GLSAGTQFA

SEQ ID NO: 1087118 - protein, 13 aa, Mycobacterium
GLTGDEPASLSKN

SEQ ID NO: 1087119 - protein, 13 aa, Mycobacterium
GMPDPDKHAQRYP

SEQ ID NO: 1087120 - protein, 9 aa, Mycobacterium
GNAAPEVTV

SEQ ID NO: 1087121 - protein, 7 aa, Mycobacterium
GNAGDNN

SEQ ID NO: 1087122 - protein, 9 aa, Mycobacterium
GNAGDRNMG

SEQ ID NO: 1087123 - protein, 8 aa, Mycobacterium
GNAPQGSI

SEQ ID NO: 1087124 - protein, 10 aa, Mycobacterium
GNATGDQGQA

SEQ ID NO: 1087125 - protein, 8 aa, Mycobacterium
GNCEQTSD

SEQ ID NO: 1087126 - protein, 11 aa, Mycobacterium
GNDLPPHSPPM

SEQ ID NO: 1087127 - protein, 6 aa, Mycobacterium
GNGAGL

SEQ ID NO: 1087128 - protein, 17 aa, Mycobacterium
GNGANGVPGTGANGAAG

SEQ ID NO: 1087129 - protein, 28 aa, Mycobacterium
GNGGAGGTGADADVSATNGGAGGAGGNA

SEQ ID NO: 1087130 - protein, 35 aa, Mycobacterium
GNGGDGAHGGDGTPDGASGTGGSGGILFGQNGSDG

SEQ ID NO: 1087131 - protein, 11 aa, Mycobacterium
GNGGGGNTGFY

SEQ ID NO: 1087132 - protein, 24 aa, Mycobacterium
GNGGNGAAGTNPGVAGGAGGAAGL

SEQ ID NO: 1087133 - protein, 19 aa, Mycobacterium
GNGGNGGTSTTAGVAGGAG

SEQ ID NO: 1087134 - protein, 49 aa, Mycobacterium
GNGGNGYSFTSGGLQNGGSGGSAGLIGNGGNGGNGFLGGTGGAGGSGGW

SEQ ID NO: 1087135 - protein, 47 aa, Mycobacterium
GNGGSGAAGTNTGVAGGAGGAAGLVGNGGSGGAGGGGAAGGAGGNGG

SEQ ID NO: 1087136 - protein, 18 aa, Mycobacterium
GNGGSGGQGGLAGTADPV

SEQ ID NO: 1087137 - protein, 32 aa, Mycobacterium; identical to SEQ ID NO: 904211

SEQ ID NO: 1087138 - protein, 6 aa, Mycobacterium
GNGPVS

SEQ ID NO: 1087139 - protein, 18 aa, Mycobacterium
GNGTNGAPGSGDAGGPGG

SEQ ID NO: 1087140 - protein, 28 aa, Mycobacterium
GNLGDTNFGSGNSGNLNLGSGNRFGSGN

SEQ ID NO: 1087141 - protein, 17 aa, Mycobacterium
GNLGSGNVGFGNTGNGD

SEQ ID NO: 1087142 - protein, 40 aa, Mycobacterium; identical to SEQ ID NO: 904233

SEQ ID NO: 1087143 - protein, 13 aa, Mycobacterium
GNPADSGKIRGQR

SEQ ID NO: 1087144 - protein, 30 aa, Mycobacterium
GNQTDFAGSDTPMNPAKNEPQKASERCGSE

SEQ ID NO: 1087145 - protein, 12 aa, Mycobacterium
GNSAAADPNQDD

SEQ ID NO: 1087146 - protein, 51 aa, Mycobacterium
GNSGTGNVGNNNVGNDNWGSGNTGSSNVGTGNTGSSNIGIGSGNTGNSNVG

SEQ ID NO: 1087147 - protein, 5 aa, Mycobacterium
GNSPH

SEQ ID NO: 1087148 - protein, 9 aa, Mycobacterium
GNTDCPGNA

SEQ ID NO: 1087149 - protein, 13 aa, Mycobacterium
GPADKGSADINTS

SEQ ID NO: 1087150 - protein, 22 aa, Mycobacterium
GPAGPVTATAARAAGGGQVEVA

SEQ ID NO: 1087151 - protein, 8 aa, Mycobacterium
GPANPGGE

SEQ ID NO: 1087152 - protein, 21 aa, Mycobacterium
GPAPTATDAAWTKQEADTDRR

SEQ ID NO: 1087153 - protein, 25 aa, Mycobacterium
GPDEVSGVGQAARPSSVHDTSGVEP

SEQ ID NO: 1087154 - protein, 14 aa, Mycobacterium
GPDGKLKALGPIPH

SEQ ID NO: 1087155 - protein, 12 aa, Mycobacterium
GPDKANLGCTTR

SEQ ID NO: 1087156 - protein, 8 aa, Mycobacterium
GPESFPDT

SEQ ID NO: 1087157 - protein, 8 aa, Mycobacterium
GPEVETEQ

SEQ ID NO: 1087158 - protein, 17 aa, Mycobacterium
GPGLAPDVARADPPGAH

SEQ ID NO: 1087159 - protein, 8 aa, Mycobacterium
GPGPRAGE

SEQ ID NO: 1087160 - protein, 8 aa, Mycobacterium
GPGQPERS

SEQ ID NO: 1087161 - protein, 8 aa, Mycobacterium
GPLAPPNP

SEQ ID NO: 1087162 - protein, 4 aa, Mycobacterium
GPNA

SEQ ID NO: 1087163 - protein, 4 aa, Mycobacterium
GPPA

SEQ ID NO: 1087164 - protein, 7 aa, Mycobacterium
GPPEAPD

SEQ ID NO: 1087165 - protein, 9 aa, Mycobacterium
GPPGSGKST

SEQ ID NO: 1087166 - protein, 5 aa, Mycobacterium
GPQPL

SEQ ID NO: 1087167 - protein, 10 aa, Mycobacterium
GPSGTAGSVS

SEQ ID NO: 1087168 - protein, 12 aa, Mycobacterium
GPTRGIADRNDF

SEQ ID NO: 1087169 - protein, 4 aa, Mycobacterium
GPTV

SEQ ID NO: 1087170 - protein, 34 aa, Mycobacterium; identical to SEQ ID NO: 904575

SEQ ID NO: 1087171 - protein, 6 aa, Mycobacterium
GQAGVA

SEQ ID NO: 1087172 - protein, 12 aa, Mycobacterium
GQANYGAAKAGI

SEQ ID NO: 1087173 - protein, 18 aa, Mycobacterium
GQAQPARDAAMRANQARD

SEQ ID NO: 1087174 - protein, 4 aa, Mycobacterium
GQDA

SEQ ID NO: 1087175 - protein, 14 aa, Mycobacterium
GQDRDAMSANTQNY

SEQ ID NO: 1087176 - protein, 5 aa, Mycobacterium
GQGAF

SEQ ID NO: 1087177 - protein, 10 aa, Mycobacterium
GQGPAAWPKC

SEQ ID NO: 1087178 - protein, 6 aa, Mycobacterium
GQGPTI

SEQ ID NO: 1087179 - protein, 9 aa, Mycobacterium
GQLDGVGSA

SEQ ID NO: 1087180 - protein, 6 aa, Mycobacterium
GQPAEE

SEQ ID NO: 1087181 - protein, 11 aa, Mycobacterium
GQQRAPTPGVH

SEQ ID NO: 1087182 - protein, 8 aa, Mycobacterium
GQQSQETV

SEQ ID NO: 1087183 - protein, 15 aa, Mycobacterium
GQRTGVGLPGESAGL

SEQ ID NO: 1087184 - protein, 4 aa, Mycobacterium
GQSS

SEQ ID NO: 1087185 - protein, 5 aa, Mycobacterium
GQSSF

SEQ ID NO: 1087186 - protein, 7 aa, Mycobacterium
GQTASNV

SEQ ID NO: 1087187 - protein, 6 aa, Mycobacterium
GQTIPL

SEQ ID NO: 1087188 - protein, 29 aa, Mycobacterium
GQTSVTTIDADGRAEQALRAGEGATTMAA

SEQ ID NO: 1087189 - protein, 10 aa, Mycobacterium
GQVGDGREAA

SEQ ID NO: 1087190 - protein, 5 aa, Mycobacterium
GRADA

SEQ ID NO: 1087191 - protein, 14 aa, Mycobacterium
GRAGKGAAAHAAAA

SEQ ID NO: 1087192 - protein, 17 aa, Mycobacterium
GRAGRAAAAHAAAAGRA

SEQ ID NO: 1087193 - protein, 12 aa, Mycobacterium
GRAIPTGSCPTV

SEQ ID NO: 1087194 - protein, 8 aa, Mycobacterium
GRATGSGH

SEQ ID NO: 1087195 - protein, 7 aa, Mycobacterium
GRAVGPR

SEQ ID NO: 1087196 - protein, 6 aa, Mycobacterium
GRDPDE

SEQ ID NO: 1087197 - protein, 10 aa, Mycobacterium
GRDPRGGNVD

SEQ ID NO: 1087198 - protein, 13 aa, Mycobacterium
GRDQNVTHPPAST

SEQ ID NO: 1087199 - protein, 8 aa, Mycobacterium
GREEDVAD

SEQ ID NO: 1087200 - protein, 17 aa, Mycobacterium
GRGEQLASAGAPWPTYE

SEQ ID NO: 1087201 - protein, 9 aa, Mycobacterium
GRGPGSPQL

SEQ ID NO: 1087202 - protein, 4 aa, Mycobacterium
GRGS

SEQ ID NO: 1087203 - protein, 4 aa, Mycobacterium
GRGT

SEQ ID NO: 1087204 - protein, 7 aa, Mycobacterium
GRHQPSA

SEQ ID NO: 1087205 - protein, 9 aa, Mycobacterium
GRISEQSSE

SEQ ID NO: 1087206 - protein, 9 aa, Mycobacterium
GRLGDSRND

SEQ ID NO: 1087207 - protein, 4 aa, Mycobacterium
GRLR

SEQ ID NO: 1087208 - protein, 6 aa, Mycobacterium
GRNAEI

SEQ ID NO: 1087209 - protein, 7 aa, Mycobacterium
GRNDFRG

SEQ ID NO: 1087210 - protein, 8 aa, Mycobacterium
GRNLRTED

SEQ ID NO: 1087211 - protein, 14 aa, Mycobacterium
GRPLAEPPAEESAR

SEQ ID NO: 1087212 - protein, 35 aa, Mycobacterium
GRPRSTNSPKGAANRSRPETPTGTPRSSPTPPRCA

SEQ ID NO: 1087213 - protein, 8 aa, Mycobacterium
GRQARAQQ

SEQ ID NO: 1087214 - protein, 7 aa, Mycobacterium
GRRHGPE

SEQ ID NO: 1087215 - protein, 21 aa, Mycobacterium
GRRQPGVGNDIPPSPPGEGAE

SEQ ID NO: 1087216 - protein, 6 aa, Mycobacterium
GRRRAE

SEQ ID NO: 1087217 - protein, 7 aa, Mycobacterium
GRSDAAA

SEQ ID NO: 1087218 - protein, 5 aa, Mycobacterium
GRSIT

SEQ ID NO: 1087219 - protein, 11 aa, Mycobacterium
GRSRTTPPTLR

SEQ ID NO: 1087220 - protein, 13 aa, Mycobacterium
GRSTAAAPPTPDG

SEQ ID NO: 1087221 - protein, 4 aa, Mycobacterium
GRSV

SEQ ID NO: 1087222 - protein, 12 aa, Mycobacterium
GRTGPGPGAAAR

SEQ ID NO: 1087223 - protein, 12 aa, Mycobacterium
GRWDTTPDPAVT

SEQ ID NO: 1087224 - protein, 11 aa, Mycobacterium
GSAANDVANPR

SEQ ID NO: 1087225 - protein, 6 aa, Mycobacterium
GSAGWD

SEQ ID NO: 1087226 - protein, 7 aa, Mycobacterium
GSAHTGE

SEQ ID NO: 1087227 - protein, 11 aa, Mycobacterium
GSAPTAKEMSS

SEQ ID NO: 1087228 - protein, 11 aa, Mycobacterium
GSATARRALAE

SEQ ID NO: 1087229 - protein, 12 aa, Mycobacterium
GSATASAFSRPG

SEQ ID NO: 1087230 - protein, 16 aa, Mycobacterium
GSDNTPTCTFTAKVTV

SEQ ID NO: 1087231 - protein, 9 aa, Mycobacterium
GSDVGGGQR

SEQ ID NO: 1087232 - protein, 5 aa, Mycobacterium
GSGAD

SEQ ID NO: 1087233 - protein, 15 aa, Mycobacterium
GSGAGVQVIEHAAGV

SEQ ID NO: 1087234 - protein, 9 aa, Mycobacterium
GSGARYGRQ

SEQ ID NO: 1087235 - protein, 9 aa, Mycobacterium
GSGDRRGAA

SEQ ID NO: 1087236 - protein, 26 aa, Mycobacterium
GSGGRSAAPRLPNGGNEESRLPPIYP

SEQ ID NO: 1087237 - protein, 5 aa, Mycobacterium
GSGKG

SEQ ID NO: 1087238 - protein, 34 aa, Mycobacterium
GSGLGRSLDGYGTAALAGGPLGAVGSGAPGAVGG

SEQ ID NO: 1087239 - protein, 6 aa, Mycobacterium
GSGNFG

SEQ ID NO: 1087240 - protein, 9 aa, Mycobacterium
GSGNHGDAN

SEQ ID NO: 1087241 - protein, 21 aa, Mycobacterium
GSGNIGDASLGSGNAGDSNVG

SEQ ID NO: 1087242 - protein, 6 aa, Mycobacterium
GSGPLP

SEQ ID NO: 1087243 - protein, 27 aa, Mycobacterium
GSGRVSHPAAHGSSSAQETTTAPELSA

SEQ ID NO: 1087244 - protein, 37 aa, Mycobacterium
GSGTTSDNKTSTSTSTSTSTSTTTSATSPTPGAQANY

SEQ ID NO: 1087245 - protein, 4 aa, Mycobacterium
GSGV

SEQ ID NO: 1087246 - protein, 13 aa, Mycobacterium
GSISGLASQVSNA

SEQ ID NO: 1087247 - protein, 19 aa, Mycobacterium
GSLSTAGRDLGAGGGDGGL

SEQ ID NO: 1087248 - protein, 6 aa, Mycobacterium
GSNQIG

SEQ ID NO: 1087249 - protein, 9 aa, Mycobacterium
GSPKGYTHP

SEQ ID NO: 1087250 - protein, 22 aa, Mycobacterium
GSQFSSSRASSEAAITGSSSFA

SEQ ID NO: 1087251 - protein, 10 aa, Mycobacterium
GSQPLAEDAD

SEQ ID NO: 1087252 - protein, 11 aa, Mycobacterium
GSRGAQRTGNL

SEQ ID NO: 1087253 - protein, 6 aa, Mycobacterium
GSRLDR

SEQ ID NO: 1087254 - protein, 7 aa, Mycobacterium
GSRPATS

SEQ ID NO: 1087255 - protein, 4 aa, Mycobacterium
GSSA

SEQ ID NO: 1087256 - protein, 9 aa, Mycobacterium
GSSESAGAV

SEQ ID NO: 1087257 - protein, 8 aa, Mycobacterium
GSSPNPGI

SEQ ID NO: 1087258 - protein, 13 aa, Mycobacterium
GSSRPVAASVPEA

SEQ ID NO: 1087259 - protein, 8 aa, Mycobacterium
GSSTITGA

SEQ ID NO: 1087260 - protein, 6 aa, Mycobacterium
GSTEVG

SEQ ID NO: 1087261 - protein, 8 aa, Mycobacterium
GSTGIGRG

SEQ ID NO: 1087262 - protein, 7 aa, Mycobacterium
GSTNGTY

SEQ ID NO: 1087263 - protein, 17 aa, Mycobacterium
GSTVSTDVPSDPAAPTI

SEQ ID NO: 1087264 - protein, 4 aa, Mycobacterium
GSTY

SEQ ID NO: 1087265 - protein, 4 aa, Mycobacterium
GSVG

SEQ ID NO: 1087266 - protein, 8 aa, Mycobacterium
GSWPSATT

SEQ ID NO: 1087267 - protein, 13 aa, Mycobacterium
GSYTKNGKQRAVA

SEQ ID NO: 1087268 - protein, 9 aa, Mycobacterium
GTAGTRGLR

SEQ ID NO: 1087269 - protein, 20 aa, Mycobacterium
GTAHAGPGAHGPVPQAPRGP

SEQ ID NO: 1087270 - protein, 5 aa, Mycobacterium
GTAPN

SEQ ID NO: 1087271 - protein, 8 aa, Mycobacterium
GTDARTRA

SEQ ID NO: 1087272 - protein, 13 aa, Mycobacterium
GTDATAAVEHRGD

SEQ ID NO: 1087273 - protein, 10 aa, Mycobacterium
GTDEDPVAAE

SEQ ID NO: 1087274 - protein, 10 aa, Mycobacterium
GTDHDAHPGA

SEQ ID NO: 1087275 - protein, 11 aa, Mycobacterium
GTDSNGSTEPV

SEQ ID NO: 1087276 - protein, 16 aa, Mycobacterium
GTGAGSNDVGYSNQEF

SEQ ID NO: 1087277 - protein, 10 aa, Mycobacterium
GTGEPPGLGR

SEQ ID NO: 1087278 - protein, 4 aa, Mycobacterium
GTGF

SEQ ID NO: 1087279 - protein, 31 aa, Mycobacterium
GTGGAGRAGGAGGASQTFTGAGGAGGTGGAG

SEQ ID NO: 1087280 - protein, 15 aa, Mycobacterium
GTGGTGGAGGVGGAS

SEQ ID NO: 1087281 - protein, 11 aa, Mycobacterium
GTGKDGNPRST

SEQ ID NO: 1087282 - protein, 22 aa, Mycobacterium
GTGLPRQPRGAITAGAALTADA

SEQ ID NO: 1087283 - protein, 15 aa, Mycobacterium
GTGSHSVSKSDVAEQ

SEQ ID NO: 1087284 - protein, 9 aa, Mycobacterium
GTGSVAGGT

SEQ ID NO: 1087285 - protein, 8 aa, Mycobacterium
GTGTGGEI

SEQ ID NO: 1087286 - protein, 10 aa, Mycobacterium
GTGTGGRRPL

SEQ ID NO: 1087287 - protein, 8 aa, Mycobacterium
GTITGEHG

SEQ ID NO: 1087288 - protein, 13 aa, Mycobacterium
GTKGGPRTDRDGR

SEQ ID NO: 1087289 - protein, 8 aa, Mycobacterium
GTKGKTAI

SEQ ID NO: 1087290 - protein, 8 aa, Mycobacterium
GTKPGTEV

SEQ ID NO: 1087291 - protein, 6 aa, Mycobacterium
GTNEIQ

SEQ ID NO: 1087292 - protein, 8 aa, Mycobacterium
GTNKDRDY

SEQ ID NO: 1087293 - protein, 18 aa, Mycobacterium
GTNSSGALNSGDDQSGFN

SEQ ID NO: 1087294 - protein, 14 aa, Mycobacterium
GTPAGSTPNEGPPQ

SEQ ID NO: 1087295 - protein, 8 aa, Mycobacterium
GTPGPAEV

SEQ ID NO: 1087296 - protein, 10 aa, Mycobacterium
GTPPGRGGSA

SEQ ID NO: 1087297 - protein, 9 aa, Mycobacterium
GTQTHPTTG

SEQ ID NO: 1087298 - protein, 20 aa, Mycobacterium
GTRRGATTAATAGPTDSGVA

SEQ ID NO: 1087299 - protein, 9 aa, Mycobacterium
GTRSAARDF

SEQ ID NO: 1087300 - protein, 9 aa, Mycobacterium
GTSAGSAVA

SEQ ID NO: 1087301 - protein, 6 aa, Mycobacterium
GTSEIQ

SEQ ID NO: 1087302 - protein, 14 aa, Mycobacterium
GTSGGNGGNGGGAG

SEQ ID NO: 1087303 - protein, 7 aa, Mycobacterium
GTSGQAE

SEQ ID NO: 1087304 - protein, 9 aa, Mycobacterium
GTSISGSAG

SEQ ID NO: 1087305 - protein, 17 aa, Mycobacterium
GTSLGAANAAVAAPTTS

SEQ ID NO: 1087306 - protein, 5 aa, Mycobacterium
GTSPN

SEQ ID NO: 1087307 - protein, 9 aa, Mycobacterium
GTSSPRRAA

SEQ ID NO: 1087308 - protein, 10 aa, Mycobacterium
GTTGGSRRGR

SEQ ID NO: 1087309 - protein, 20 aa, Mycobacterium
GTTGVPKGVPRKPKVSSGIG

SEQ ID NO: 1087310 - protein, 5 aa, Mycobacterium
GTTLT

SEQ ID NO: 1087311 - protein, 6 aa, Mycobacterium
GTWSGR

SEQ ID NO: 1087312 - protein, 8 aa, Mycobacterium
GTWTSPGE

SEQ ID NO: 1087313 - protein, 5 aa, Mycobacterium
GTYRE

SEQ ID NO: 1087314 - protein, 6 aa, Mycobacterium
GVAAPP

SEQ ID NO: 1087315 - protein, 9 aa, Mycobacterium
GVAENSVKR

SEQ ID NO: 1087316 - protein, 12 aa, Mycobacterium
GVAGRTADQLKE

SEQ ID NO: 1087317 - protein, 13 aa, Mycobacterium
GVAKGSAEPHKTK

SEQ ID NO: 1087318 - protein, 7 aa, Mycobacterium
GVDPAEL

SEQ ID NO: 1087319 - protein, 9 aa, Mycobacterium
GVDPQRGWG

SEQ ID NO: 1087320 - protein, 12 aa, Mycobacterium
GVDPTDADPAGW

SEQ ID NO: 1087321 - protein, 12 aa, Mycobacterium
GVENMGHGNAGS

SEQ ID NO: 1087322 - protein, 4 aa, Mycobacterium
GVFT

SEQ ID NO: 1087323 - protein, 11 aa, Mycobacterium
GVGAGGAGIGE

SEQ ID NO: 1087324 - protein, 5 aa, Mycobacterium
GVGGH

SEQ ID NO: 1087325 - protein, 27 aa, Mycobacterium
GVGGVGGVGGAATGAGATAAAGGAGGL

SEQ ID NO: 1087326 - protein, 14 aa, Mycobacterium
GVGIAGGTAARRLG

SEQ ID NO: 1087327 - protein, 7 aa, Mycobacterium
GVGKTEL

SEQ ID NO: 1087328 - protein, 5 aa, Mycobacterium
GVGNP

SEQ ID NO: 1087329 - protein, 6 aa, Mycobacterium
GVGSGG

SEQ ID NO: 1087330 - protein, 4 aa, Mycobacterium
GVGT

SEQ ID NO: 1087331 - protein, 13 aa, Mycobacterium
GVNYGDAGGAEAL

SEQ ID NO: 1087332 - protein, 10 aa, Mycobacterium
GVPRSTPRMN

SEQ ID NO: 1087333 - protein, 10 aa, Mycobacterium
GVPTVQPGTD

SEQ ID NO: 1087334 - protein, 7 aa, Mycobacterium
GVSPESI

SEQ ID NO: 1087335 - protein, 20 aa, Mycobacterium
GVTSQRELETRGREAGRAAT

SEQ ID NO: 1087336 - protein, 8 aa, Mycobacterium
GVVPNSGA

SEQ ID NO: 1087337 - protein, 5 aa, Mycobacterium
GVYAN

SEQ ID NO: 1087338 - protein, 17 aa, Mycobacterium
GWAGGPGGGWNKPPTPL

SEQ ID NO: 1087339 - protein, 15 aa, Mycobacterium
GWDPRTQSIDPAGIT

SEQ ID NO: 1087340 - protein, 7 aa, Mycobacterium
GWDSEAP

SEQ ID NO: 1087341 - protein, 13 aa, Mycobacterium
GWGGVGGSGGDGG

SEQ ID NO: 1087342 - protein, 17 aa, Mycobacterium
GYASGDLDTRGGSTIEQ

SEQ ID NO: 1087343 - protein, 5 aa, Mycobacterium
GYCPG

SEQ ID NO: 1087344 - protein, 9 aa, Mycobacterium
GYDAETGAA

SEQ ID NO: 1087345 - protein, 4 aa, Mycobacterium
GYDP

SEQ ID NO: 1087346 - protein, 4 aa, Mycobacterium
GYGY

SEQ ID NO: 1087347 - protein, 9 aa, Mycobacterium
GYHDSQGDE

SEQ ID NO: 1087348 - protein, 8 aa, Mycobacterium
GYPAGEFG

SEQ ID NO: 1087349 - protein, 5 aa, Mycobacterium
GYSTE

SEQ ID NO: 1087350 - protein, 12 aa, Mycobacterium
GYSVGDGDDLYP

SEQ ID NO: 1087351 - protein, 30 aa, Mycobacterium
HAAPTDSDASNGESRADVPAPPGGENTAAS

SEQ ID NO: 1087352 - protein, 13 aa, Mycobacterium
HAARARYDSFPRS

SEQ ID NO: 1087353 - protein, 18 aa, Mycobacterium
HAATPSGLDGPGGSGWST

SEQ ID NO: 1087354 - protein, 4 aa, Mycobacterium
HAPT

SEQ ID NO: 1087355 - protein, 7 aa, Mycobacterium
HASAAEE

SEQ ID NO: 1087356 - protein, 7 aa, Mycobacterium
HASPEGI

SEQ ID NO: 1087357 - protein, 9 aa, Mycobacterium
HATSGADNR

SEQ ID NO: 1087358 - protein, 6 aa, Mycobacterium
HAVGGG

SEQ ID NO: 1087359 - protein, 6 aa, Mycobacterium
HDGDTV

SEQ ID NO: 1087360 - protein, 12 aa, Mycobacterium
HDGHYDQGSGVV

SEQ ID NO: 1087361 - protein, 6 aa, Mycobacterium
HDKNGD

SEQ ID NO: 1087362 - protein, 20 aa, Mycobacterium
HDKPGTAGGPTDAPRAPVGA

SEQ ID NO: 1087363 - protein, 9 aa, Mycobacterium
HDPEAQAEA

SEQ ID NO: 1087364 - protein, 8 aa, Mycobacterium
HERAGSTP

SEQ ID NO: 1087365 - protein, 9 aa, Mycobacterium
HERAGSTPV

SEQ ID NO: 1087366 - protein, 9 aa, Mycobacterium
HESGRSAND

SEQ ID NO: 1087367 - protein, 4 aa, Mycobacterium
HETD

SEQ ID NO: 1087368 - protein, 8 aa, Mycobacterium
HETDKTIQ

SEQ ID NO: 1087369 - protein, 4 aa, Mycobacterium
HGAT

SEQ ID NO: 1087370 - protein, 9 aa, Mycobacterium
HGDPGSPNI

SEQ ID NO: 1087371 - protein, 26 aa, Mycobacterium
HGGAGGTGGAATGVGATAGAAGSGGL

SEQ ID NO: 1087372 - protein, 7 aa, Mycobacterium
HGGASAV

SEQ ID NO: 1087373 - protein, 31 aa, Mycobacterium
HGGDGGSGGAASGAGGIGGAGGNGGSGTTPL

SEQ ID NO: 1087374 - protein, 8 aa, Mycobacterium
HGGPEAEN

SEQ ID NO: 1087375 - protein, 12 aa, Mycobacterium
HGGTLSSATRVL

SEQ ID NO: 1087376 - protein, 29 aa, Mycobacterium
HGGTRTGSSSTTTSAGASRSATSSTPMAA

SEQ ID NO: 1087377 - protein, 10 aa, Mycobacterium
HGHYTNATDA

SEQ ID NO: 1087378 - protein, 6 aa, Mycobacterium
HGPDGQ

SEQ ID NO: 1087379 - protein, 9 aa, Mycobacterium
HGSDAPPRI

SEQ ID NO: 1087380 - protein, 15 aa, Mycobacterium
HGSRDPRSSANARAV

SEQ ID NO: 1087381 - protein, 17 aa, Mycobacterium
HGSSPHSAALPVAHSSV

SEQ ID NO: 1087382 - protein, 7 aa, Mycobacterium
HGTEEQR

SEQ ID NO: 1087383 - protein, 16 aa, Mycobacterium
HGVSGGAEIRRSDAPR

SEQ ID NO: 1087384 - protein, 7 aa, Mycobacterium
HHADGSN

SEQ ID NO: 1087385 - protein, 15 aa, Mycobacterium
HHPSEGAPEDTTGLA

SEQ ID NO: 1087386 - protein, 15 aa, Mycobacterium
HIGGNAYSEPEPQTG

SEQ ID NO: 1087387 - protein, 5 aa, Mycobacterium
HKQSQ

SEQ ID NO: 1087388 - protein, 11 aa, Mycobacterium
HNNASGANGIS

SEQ ID NO: 1087389 - protein, 6 aa, Mycobacterium
HPAEQS

SEQ ID NO: 1087390 - protein, 40 aa, Mycobacterium
HPAQPLAPAGRRNPGCPAGHRARRGTPAELGGGRRAGRSR

SEQ ID NO: 1087391 - protein, 6 aa, Mycobacterium
HPDKTA

SEQ ID NO: 1087392 - protein, 14 aa, Mycobacterium
HPMTGTAQSGWGAG

SEQ ID NO: 1087393 - protein, 5 aa, Mycobacterium
HPPPV

SEQ ID NO: 1087394 - protein, 8 aa, Mycobacterium
HPQRRTPW

SEQ ID NO: 1087395 - protein, 4 aa, Mycobacterium
HQPP

SEQ ID NO: 1087396 - protein, 10 aa, Mycobacterium
HQVAPTASEL

SEQ ID NO: 1087397 - protein, 4 aa, Mycobacterium
HRAG

SEQ ID NO: 1087398 - protein, 9 aa, Mycobacterium
HRAHTGNGA

SEQ ID NO: 1087399 - protein, 9 aa, Mycobacterium
HRAHTRNGA

SEQ ID NO: 1087400 - protein, 12 aa, Mycobacterium
HRGAPPPAGFAE

SEQ ID NO: 1087401 - protein, 4 aa, Mycobacterium
HRPV

SEQ ID NO: 1087402 - protein, 10 aa, Mycobacterium
HRTGASDHSR

SEQ ID NO: 1087403 - protein, 14 aa, Mycobacterium
HSAHRSAASVPTQR

SEQ ID NO: 1087404 - protein, 15 aa, Mycobacterium
HSASPYANTADPGLR

SEQ ID NO: 1087405 - protein, 6 aa, Mycobacterium
HSDDRG

SEQ ID NO: 1087406 - protein, 9 aa, Mycobacterium
HSDHPLATS

SEQ ID NO: 1087407 - protein, 11 aa, Mycobacterium
HSESAATAAGL

SEQ ID NO: 1087408 - protein, 15 aa, Mycobacterium
HSGNGNNLSGYANPQ

SEQ ID NO: 1087409 - protein, 14 aa, Mycobacterium
HSGPGNDWNGHTDG

SEQ ID NO: 1087410 - protein, 29 aa, Mycobacterium
HSKKRSGLRAQSGRLRDSGDAVSSPRWEP

SEQ ID NO: 1087411 - protein, 7 aa, Mycobacterium
HSQSHYA

SEQ ID NO: 1087412 - protein, 9 aa, Mycobacterium
HSSNGNHSY

SEQ ID NO: 1087413 - protein, 8 aa, Mycobacterium
HTDPNDGR

SEQ ID NO: 1087414 - protein, 10 aa, Mycobacterium
HTGGLNPALA

SEQ ID NO: 1087415 - protein, 15 aa, Mycobacterium
HTGPASDSIAAAPMP

SEQ ID NO: 1087416 - protein, 10 aa, Mycobacterium
HTGSELPSAP

SEQ ID NO: 1087417 - protein, 7 aa, Mycobacterium
HTPFTST

SEQ ID NO: 1087418 - protein, 8 aa, Mycobacterium
HTPQSPVE

SEQ ID NO: 1087419 - protein, 5 aa, Mycobacterium
HTSPV

SEQ ID NO: 1087420 - protein, 32 aa, Mycobacterium; identical to SEQ ID NO: 906363

SEQ ID NO: 1087421 - protein, 7 aa, Mycobacterium
HVTPPQS

SEQ ID NO: 1087422 - protein, 5 aa, Mycobacterium
IADAG

SEQ ID NO: 1087423 - protein, 8 aa, Mycobacterium
IADTGSGS

SEQ ID NO: 1087424 - protein, 13 aa, Mycobacterium
IANADPEDATPPI

SEQ ID NO: 1087425 - protein, 9 aa, Mycobacterium
IANSATNGL

SEQ ID NO: 1087426 - protein, 4 aa, Mycobacterium
IAPE

SEQ ID NO: 1087427 - protein, 7 aa, Mycobacterium
IAPEYTG

SEQ ID NO: 1087428 - protein, 10 aa, Mycobacterium
IAPGDSGGPI

SEQ ID NO: 1087429 - protein, 12 aa, Mycobacterium
IAPPFNATQPMP

SEQ ID NO: 1087430 - protein, 9 aa, Mycobacterium
IAPRGGGHS

SEQ ID NO: 1087431 - protein, 14 aa, Mycobacterium
IAQDTSFDGRSDYD

SEQ ID NO: 1087432 - protein, 7 aa, Mycobacterium
IAQRDGT

SEQ ID NO: 1087433 - protein, 4 aa, Mycobacterium
IASG

SEQ ID NO: 1087434 - protein, 9 aa, Mycobacterium
IATERQGKR

SEQ ID NO: 1087435 - protein, 5 aa, Mycobacterium
IATNA

SEQ ID NO: 1087436 - protein, 17 aa, Mycobacterium
IATRSAGPTAGAVEGGI

SEQ ID NO: 1087437 - protein, 5 aa, Mycobacterium
IDEEG

SEQ ID NO: 1087438 - protein, 9 aa, Mycobacterium
IDGEKLSEE

SEQ ID NO: 1087439 - protein, 4 aa, Mycobacterium
IDGQ

SEQ ID NO: 1087440 - protein, 9 aa, Mycobacterium
IDPAREPIP

SEQ ID NO: 1087441 - protein, 13 aa, Mycobacterium
IDPDNAADYQANA

SEQ ID NO: 1087442 - protein, 6 aa, Mycobacterium
IDPIPG

SEQ ID NO: 1087443 - protein, 4 aa, Mycobacterium
IDST

SEQ ID NO: 1087444 - protein, 6 aa, Mycobacterium
IDTTDN

SEQ ID NO: 1087445 - protein, 5 aa, Mycobacterium
IEDGR

SEQ ID NO: 1087446 - protein, 12 aa, Mycobacterium
IEESPDFTELGD

SEQ ID NO: 1087447 - protein, 7 aa, Mycobacterium
IEPRPAD

SEQ ID NO: 1087448 - protein, 5 aa, Mycobacterium
IERQS

SEQ ID NO: 1087449 - protein, 9 aa, Mycobacterium
IESGKEHKG

SEQ ID NO: 1087450 - protein, 5 aa, Mycobacterium
IESRY

SEQ ID NO: 1087451 - protein, 6 aa, Mycobacterium
IGAPGT

SEQ ID NO: 1087452 - protein, 16 aa, Mycobacterium
IGDGGGFSISRDGYQL

SEQ ID NO: 1087453 - protein, 9 aa, Mycobacterium
IGGDGGSRG

SEQ ID NO: 1087454 - protein, 23 aa, Mycobacterium
IGNGGAGGIGGAGGSGGAGGTGG

SEQ ID NO: 1087455 - protein, 41 aa, Mycobacterium
IGNGGDGGAGAPGGNSAPPGDGGVGGAGGTLSGTPGATGAL

SEQ ID NO: 1087456 - protein, 22 aa, Mycobacterium
IGNGGLGGNGLGGGTGGMGGTG

SEQ ID NO: 1087457 - protein, 35 aa, Mycobacterium
IGNGGSGGTAGTGGAGGPDDPPNNIPAGTQGSGVV

SEQ ID NO: 1087458 - protein, 8 aa, Mycobacterium
IGNNGSGN

SEQ ID NO: 1087459 - protein, 4 aa, Mycobacterium
IGPA

SEQ ID NO: 1087460 - protein, 13 aa, Mycobacterium
IGPAADRCGGNPA

SEQ ID NO: 1087461 - protein, 7 aa, Mycobacterium
IGPDPTF

SEQ ID NO: 1087462 - protein, 6 aa, Mycobacterium
IGPGQA

SEQ ID NO: 1087463 - protein, 22 aa, Mycobacterium
IGSTSTAATATTTPAKPSPSTV

SEQ ID NO: 1087464 - protein, 17 aa, Mycobacterium
IGSTVSAANAAAAIPTT

SEQ ID NO: 1087465 - protein, 5 aa, Mycobacterium
IHDGP

SEQ ID NO: 1087466 - protein, 23 aa, Mycobacterium
IKNGGKGDDDGSGDAVRIPETAA

SEQ ID NO: 1087467 - protein, 9 aa, Mycobacterium
IKSGTASWD

SEQ ID NO: 1087468 - protein, 13 aa, Mycobacterium
IKTGSSQGTIPAR

SEQ ID NO: 1087469 - protein, 21 aa, Mycobacterium
IKTPDGQSSTDHAFAQLVVER

SEQ ID NO: 1087470 - protein, 4 aa, Mycobacterium
INGN

SEQ ID NO: 1087471 - protein, 19 aa, Mycobacterium
INHGQPDPAHPLRADLQQQ

SEQ ID NO: 1087472 - protein, 12 aa, Mycobacterium
INNTGKSVEGPF

SEQ ID NO: 1087473 - protein, 5 aa, Mycobacterium
INPDA

SEQ ID NO: 1087474 - protein, 10 aa, Mycobacterium
INPDTSAALE

SEQ ID NO: 1087475 - protein, 5 aa, Mycobacterium
INRDT

SEQ ID NO: 1087476 - protein, 6 aa, Mycobacterium
IPADAQ

SEQ ID NO: 1087477 - protein, 23 aa, Mycobacterium
IPASFDSEHPELDQAADEGTELG

SEQ ID NO: 1087478 - protein, 12 aa, Mycobacterium
IPGAPGTGKGSY

SEQ ID NO: 1087479 - protein, 4 aa, Mycobacterium
IPGN

SEQ ID NO: 1087480 - protein, 4 aa, Mycobacterium
IPGR

SEQ ID NO: 1087481 - protein, 12 aa, Mycobacterium
IPGSAGATPVQN

SEQ ID NO: 1087482 - protein, 14 aa, Mycobacterium
IPHSRGLGSSASAV

SEQ ID NO: 1087483 - protein, 10 aa, Mycobacterium
IPKGPTGNTG

SEQ ID NO: 1087484 - protein, 24 aa, Mycobacterium
IPLPDSTATLENYGGAPCGSGQTV

SEQ ID NO: 1087485 - protein, 4 aa, Mycobacterium
IPNA

SEQ ID NO: 1087486 - protein, 23 aa, Mycobacterium
IPPSAMPPGLGDPETTTESSRAA

SEQ ID NO: 1087487 - protein, 15 aa, Mycobacterium
IPSEADALRAAKAEP

SEQ ID NO: 1087488 - protein, 8 aa, Mycobacterium
IPSSGPAI

SEQ ID NO: 1087489 - protein, 17 aa, Mycobacterium
IPTPPGWSPYEGPKINP

SEQ ID NO: 1087490 - protein, 5 aa, Mycobacterium
IPTPV

SEQ ID NO: 1087491 - protein, 7 aa, Mycobacterium
IPTSQMR

SEQ ID NO: 1087492 - protein, 4 aa, Mycobacterium
IQPG

SEQ ID NO: 1087493 - protein, 5 aa, Mycobacterium
IQPQG

SEQ ID NO: 1087494 - protein, 10 aa, Mycobacterium
IRASGQPRAH

SEQ ID NO: 1087495 - protein, 18 aa, Mycobacterium
IRKQTGLNSPRPTPVLAE

SEQ ID NO: 1087496 - protein, 12 aa, Mycobacterium
IRNQAAEQRAAA

SEQ ID NO: 1087497 - protein, 14 aa, Mycobacterium
IRPEGTGEQQTPSV

SEQ ID NO: 1087498 - protein, 7 aa, Mycobacterium
IRPKGGY

SEQ ID NO: 1087499 - protein, 11 aa, Mycobacterium
IRSGGGSPTVH

SEQ ID NO: 1087500 - protein, 4 aa, Mycobacterium
ISDK

SEQ ID NO: 1087501 - protein, 13 aa, Mycobacterium
ISDQPPGVIVLVT

SEQ ID NO: 1087502 - protein, 26 aa, Mycobacterium
ISGATASADTEMQPAGSVPIPDGPAQ

SEQ ID NO: 1087503 - protein, 10 aa, Mycobacterium
ISGNVSADAV

SEQ ID NO: 1087504 - protein, 8 aa, Mycobacterium
ISGSGSYA

SEQ ID NO: 1087505 - protein, 5 aa, Mycobacterium
ISPAN

SEQ ID NO: 1087506 - protein, 7 aa, Mycobacterium
ISPGSTL

SEQ ID NO: 1087507 - protein, 5 aa, Mycobacterium
ISPWS

SEQ ID NO: 1087508 - protein, 19 aa, Mycobacterium
ISQPAQQGSSQGGAAPAQL

SEQ ID NO: 1087509 - protein, 8 aa, Mycobacterium
ISQRATAD

SEQ ID NO: 1087510 - protein, 11 aa, Mycobacterium
ISTGRTGTRRR

SEQ ID NO: 1087511 - protein, 6 aa, Mycobacterium
ISTTPA

SEQ ID NO: 1087512 - protein, 7 aa, Mycobacterium
ITDKATV

SEQ ID NO: 1087513 - protein, 15 aa, Mycobacterium
IVNTPDAYTFCLDKS

SEQ ID NO: 1087514 - protein, 5 aa, Mycobacterium
KAAAE

SEQ ID NO: 1087515 - protein, 8 aa, Mycobacterium
KAAGEPVG

SEQ ID NO: 1087516 - protein, 7 aa, Mycobacterium
KAAPEKL

SEQ ID NO: 1087517 - protein, 8 aa, Mycobacterium
KAAQAGHD

SEQ ID NO: 1087518 - protein, 10 aa, Mycobacterium
KAASATPAVD

SEQ ID NO: 1087519 - protein, 8 aa, Mycobacterium
KAASDQHL

SEQ ID NO: 1087520 - protein, 51 aa, Mycobacterium
KADDADDERDAKAGADGAGAAPGSQTLGGAPIEGGTGTTADNQSAGPDVTV

SEQ ID NO: 1087521 - protein, 8 aa, Mycobacterium
KAGGLPGD

SEQ ID NO: 1087522 - protein, 6 aa, Mycobacterium
KAGQGS

SEQ ID NO: 1087523 - protein, 7 aa, Mycobacterium
KAGRRRY

SEQ ID NO: 1087524 - protein, 7 aa, Mycobacterium
KANGDPC

SEQ ID NO: 1087525 - protein, 21 aa, Mycobacterium
KANSGGRGGIENGRTDPANGQ

SEQ ID NO: 1087526 - protein, 5 aa, Mycobacterium
KDANS

SEQ ID NO: 1087527 - protein, 19 aa, Mycobacterium
KDERTATGVDALTYCFVKS

SEQ ID NO: 1087528 - protein, 7 aa, Mycobacterium
KDGGTYY

SEQ ID NO: 1087529 - protein, 9 aa, Mycobacterium
KDGSETGRR

SEQ ID NO: 1087530 - protein, 12 aa, Mycobacterium
KDGTDHTECPAD

SEQ ID NO: 1087531 - protein, 8 aa, Mycobacterium
KDLEPQSS

SEQ ID NO: 1087532 - protein, 5 aa, Mycobacterium
KDSKG

SEQ ID NO: 1087533 - protein, 8 aa, Mycobacterium
KDTADEID

SEQ ID NO: 1087534 - protein, 11 aa, Mycobacterium
KDWDAAATRGI

SEQ ID NO: 1087535 - protein, 6 aa, Mycobacterium
KEPPKR

SEQ ID NO: 1087536 - protein, 4 aa, Mycobacterium
KFRT

SEQ ID NO: 1087537 - protein, 9 aa, Mycobacterium
KGEAGADSF

SEQ ID NO: 1087538 - protein, 10 aa, Mycobacterium
KGEYTQDEDP

SEQ ID NO: 1087539 - protein, 15 aa, Mycobacterium
KGFTTGSVGNNEAGH

SEQ ID NO: 1087540 - protein, 6 aa, Mycobacterium
KGKTGL

SEQ ID NO: 1087541 - protein, 19 aa, Mycobacterium
KGLAPGGHAAVGASQGGYG

SEQ ID NO: 1087542 - protein, 6 aa, Mycobacterium
KGPLAD

SEQ ID NO: 1087543 - protein, 13 aa, Mycobacterium
KGQLTGPGPSAGP

SEQ ID NO: 1087544 - protein, 4 aa, Mycobacterium
KGRS

SEQ ID NO: 1087545 - protein, 11 aa, Mycobacterium
KGSRPDPSEYL

SEQ ID NO: 1087546 - protein, 14 aa, Mycobacterium
KGTGSITNIYMQAT

SEQ ID NO: 1087547 - protein, 7 aa, Mycobacterium
KGTTTGE

SEQ ID NO: 1087548 - protein, 10 aa, Mycobacterium
KGVKPTGSGV

SEQ ID NO: 1087549 - protein, 10 aa, Mycobacterium
KGVSPTGNAA

SEQ ID NO: 1087550 - protein, 5 aa, Mycobacterium
KIPRD

SEQ ID NO: 1087551 - protein, 7 aa, Mycobacterium
KITKGSL

SEQ ID NO: 1087552 - protein, 7 aa, Mycobacterium
KKDGADW

SEQ ID NO: 1087553 - protein, 11 aa, Mycobacterium
KKDGSNESQEA

SEQ ID NO: 1087554 - protein, 40 aa, Mycobacterium
KKEELEAPAKKAPAKKTPAAKKAPAKKAPAKKAPAKKVTQ

SEQ ID NO: 1087555 - protein, 5 aa, Mycobacterium
KLDSE

SEQ ID NO: 1087556 - protein, 5 aa, Mycobacterium
KLGAA

SEQ ID NO: 1087557 - protein, 14 aa, Mycobacterium
KLKSPAAPDPQQRL

SEQ ID NO: 1087558 - protein, 9 aa, Mycobacterium
KLTGSGRGG

SEQ ID NO: 1087559 - protein, 4 aa, Mycobacterium
KMAE

SEQ ID NO: 1087560 - protein, 9 aa, Mycobacterium
KNAEPEEAD

SEQ ID NO: 1087561 - protein, 7 aa, Mycobacterium
KNEAPGV

SEQ ID NO: 1087562 - protein, 4 aa, Mycobacterium
KNGQ

SEQ ID NO: 1087563 - protein, 4 aa, Mycobacterium
KNNT

SEQ ID NO: 1087564 - protein, 5 aa, Mycobacterium
KNSAG

SEQ ID NO: 1087565 - protein, 5 aa, Mycobacterium
KNSEF

SEQ ID NO: 1087566 - protein, 8 aa, Mycobacterium
KPDSQTPY

SEQ ID NO: 1087567 - protein, 7 aa, Mycobacterium
KPFPPPC

SEQ ID NO: 1087568 - protein, 9 aa, Mycobacterium
KPGTTTITT

SEQ ID NO: 1087569 - protein, 4 aa, Mycobacterium
KPIG

SEQ ID NO: 1087570 - protein, 12 aa, Mycobacterium
KPPPAGGPPAAR

SEQ ID NO: 1087571 - protein, 8 aa, Mycobacterium
KPQTESQL

SEQ ID NO: 1087572 - protein, 9 aa, Mycobacterium
KPTEPGGVS

SEQ ID NO: 1087573 - protein, 14 aa, Mycobacterium
KQARAGTLTVGERS

SEQ ID NO: 1087574 - protein, 6 aa, Mycobacterium
KQHRDH

SEQ ID NO: 1087575 - protein, 11 aa, Mycobacterium
KQIKPTGSAAV

SEQ ID NO: 1087576 - protein, 6 aa, Mycobacterium
KQRHRA

SEQ ID NO: 1087577 - protein, 6 aa, Mycobacterium
KQSSIE

SEQ ID NO: 1087578 - protein, 7 aa, Mycobacterium
KQVYDGS

SEQ ID NO: 1087579 - protein, 11 aa, Mycobacterium
KQWQTDPKQLP

SEQ ID NO: 1087580 - protein, 12 aa, Mycobacterium
KRAPDWSSFPRY

SEQ ID NO: 1087581 - protein, 7 aa, Mycobacterium
KRGLSPE

SEQ ID NO: 1087582 - protein, 7 aa, Mycobacterium
KRPVSER

SEQ ID NO: 1087583 - protein, 9 aa, Mycobacterium
KRTRQQIDT

SEQ ID NO: 1087584 - protein, 22 aa, Mycobacterium
KRVSAMPPTTPRPASGRADARR

SEQ ID NO: 1087585 - protein, 11 aa, Mycobacterium
KSFPGSSVNRA

SEQ ID NO: 1087586 - protein, 16 aa, Mycobacterium
KSSGDNRVQARDRDTG

SEQ ID NO: 1087587 - protein, 16 aa, Mycobacterium
KSVSYKATGSGAGREQ

SEQ ID NO: 1087588 - protein, 11 aa, Mycobacterium
KTGSGEYGRAN

SEQ ID NO: 1087589 - protein, 7 aa, Mycobacterium
KTLGPID

SEQ ID NO: 1087590 - protein, 9 aa, Mycobacterium
KTLSSPTTV

SEQ ID NO: 1087591 - protein, 5 aa, Mycobacterium
KTQQS

SEQ ID NO: 1087592 - protein, 4 aa, Mycobacterium
KTQT

SEQ ID NO: 1087593 - protein, 6 aa, Mycobacterium
KTTSAE

SEQ ID NO: 1087594 - protein, 14 aa, Mycobacterium
KVAKQAEQKAPEAP

SEQ ID NO: 1087595 - protein, 7 aa, Mycobacterium
KVPADAK

SEQ ID NO: 1087596 - protein, 7 aa, Mycobacterium
KVPGAPE

SEQ ID NO: 1087597 - protein, 23 aa, Mycobacterium
KVRQPAAGDWTSTSPYLTPPAAA

SEQ ID NO: 1087598 - protein, 5 aa, Mycobacterium
KVTGD

SEQ ID NO: 1087599 - protein, 4 aa, Mycobacterium
KVTP

SEQ ID NO: 1087600 - protein, 10 aa, Mycobacterium
LAAAAPPKSY

SEQ ID NO: 1087601 - protein, 11 aa, Mycobacterium
LAAPAEADSVD

SEQ ID NO: 1087602 - protein, 17 aa, Mycobacterium
LAAPGQPLPTGSETGCA

SEQ ID NO: 1087603 - protein, 12 aa, Mycobacterium
LAAPSKVDSVEA

SEQ ID NO: 1087604 - protein, 9 aa, Mycobacterium
LADKKEELA

SEQ ID NO: 1087605 - protein, 11 aa, Mycobacterium
LADPGDGRDQF

SEQ ID NO: 1087606 - protein, 25 aa, Mycobacterium
LADPYTAPAPLGSPDDVELGTLRVA

SEQ ID NO: 1087607 - protein, 4 aa, Mycobacterium
LAEA

SEQ ID NO: 1087608 - protein, 6 aa, Mycobacterium
LAEPGA

SEQ ID NO: 1087609 - protein, 10 aa, Mycobacterium
LAGDSSSQGI

SEQ ID NO: 1087610 - protein, 7 aa, Mycobacterium
LANDDTV

SEQ ID NO: 1087611 - protein, 5 aa, Mycobacterium
LAPDA

SEQ ID NO: 1087612 - protein, 9 aa, Mycobacterium
LAPSGDAVQ

SEQ ID NO: 1087613 - protein, 6 aa, Mycobacterium
LAQKHP

SEQ ID NO: 1087614 - protein, 8 aa, Mycobacterium
LARNESRG

SEQ ID NO: 1087615 - protein, 9 aa, Mycobacterium
LARNESRGC

SEQ ID NO: 1087616 - protein, 12 aa, Mycobacterium
LARTASGVSNAT

SEQ ID NO: 1087617 - protein, 8 aa, Mycobacterium
LASAAEKL

SEQ ID NO: 1087618 - protein, 7 aa, Mycobacterium
LASAAQS

SEQ ID NO: 1087619 - protein, 13 aa, Mycobacterium
LASEADMDPAHGP

SEQ ID NO: 1087620 - protein, 8 aa, Mycobacterium
LASPGSVS

SEQ ID NO: 1087621 - protein, 10 aa, Mycobacterium
LASPSASGVT

SEQ ID NO: 1087622 - protein, 9 aa, Mycobacterium
LASPSGTQS

SEQ ID NO: 1087623 - protein, 15 aa, Mycobacterium
LATNKSNNRWETTGR

SEQ ID NO: 1087624 - protein, 8 aa, Mycobacterium
LATSPNTA

SEQ ID NO: 1087625 - protein, 24 aa, Mycobacterium
LDAETSEGRTVEEQYEQRQRAAAE

SEQ ID NO: 1087626 - protein, 8 aa, Mycobacterium
LDAKNQAV

SEQ ID NO: 1087627 - protein, 4 aa, Mycobacterium
LDDQ

SEQ ID NO: 1087628 - protein, 4 aa, Mycobacterium
LDEA

SEQ ID NO: 1087629 - protein, 23 aa, Mycobacterium
LDEEPSDTDRNGPSLPPEPGADS

SEQ ID NO: 1087630 - protein, 7 aa, Mycobacterium
LDGDKRD

SEQ ID NO: 1087631 - protein, 5 aa, Mycobacterium
LDGPT

SEQ ID NO: 1087632 - protein, 4 aa, Mycobacterium
LDNA

SEQ ID NO: 1087633 - protein, 10 aa, Mycobacterium
LDNGDLDRTH

SEQ ID NO: 1087634 - protein, 6 aa, Mycobacterium
LDPAEA

SEQ ID NO: 1087635 - protein, 20 aa, Mycobacterium
LDPGEQVANSISASPANRVG

SEQ ID NO: 1087636 - protein, 10 aa, Mycobacterium
LDRPGTDKAA

SEQ ID NO: 1087637 - protein, 12 aa, Mycobacterium
LDTAGPGALRDG

SEQ ID NO: 1087638 - protein, 10 aa, Mycobacterium
LEKGEPPKVF

SEQ ID NO: 1087639 - protein, 6 aa, Mycobacterium
LEPSGQ

SEQ ID NO: 1087640 - protein, 7 aa, Mycobacterium
LERDGQK

SEQ ID NO: 1087641 - protein, 4 aa, Mycobacterium
LETR

SEQ ID NO: 1087642 - protein, 5 aa, Mycobacterium
LGADE

SEQ ID NO: 1087643 - protein, 13 aa, Mycobacterium
LGADSGDAQSGSI

SEQ ID NO: 1087644 - protein, 34 aa, Mycobacterium
LGAGGSGGTGGAGATSGPASSHFAGGAGGAGGHG

SEQ ID NO: 1087645 - protein, 5 aa, Mycobacterium
LGAPC

SEQ ID NO: 1087646 - protein, 12 aa, Mycobacterium
LGATPNTGDTQG

SEQ ID NO: 1087647 - protein, 13 aa, Mycobacterium
LGDAARAAQVDPN

SEQ ID NO: 1087648 - protein, 67 aa, Mycobacterium
LGDAGPSGGHPHGLPPHGGGPHGPGDASHGARHAEPPRDGTAHGTADGGDAHGDDVSGHGLSAEKRD

SEQ ID NO: 1087649 - protein, 7 aa, Mycobacterium
LGDATTL

SEQ ID NO: 1087650 - protein, 14 aa, Mycobacterium
LGDNATSGPAAINQ

SEQ ID NO: 1087651 - protein, 7 aa, Mycobacterium
LGDRSPL

SEQ ID NO: 1087652 - protein, 10 aa, Mycobacterium
LGDRSSAPIE

SEQ ID NO: 1087653 - protein, 26 aa, Mycobacterium
LGEASSIAATGSVRGPAFRSSYGSST

SEQ ID NO: 1087654 - protein, 10 aa, Mycobacterium
LGETAADDEV

SEQ ID NO: 1087655 - protein, 55 aa, Mycobacterium
LGGGGAGGAGGFGTISDGGAGGRGGGGGQLLGNGGAGGAGGQGGNDGGAGGLGGN

SEQ ID NO: 1087656 - protein, 7 aa, Mycobacterium
LGGNVEG

SEQ ID NO: 1087657 - protein, 5 aa, Mycobacterium
LGGPR

SEQ ID NO: 1087658 - protein, 9 aa, Mycobacterium
LGGQSDRLD

SEQ ID NO: 1087659 - protein, 10 aa, Mycobacterium
LGGTDTSGRS

SEQ ID NO: 1087660 - protein, 7 aa, Mycobacterium
LGGTPGQ

SEQ ID NO: 1087661 - protein, 11 aa, Mycobacterium
LGPAHGDGIDE

SEQ ID NO: 1087662 - protein, 17 aa, Mycobacterium
LGPGGTTAGAGGAWYPT

SEQ ID NO: 1087663 - protein, 5 aa, Mycobacterium
LGPTL

SEQ ID NO: 1087664 - protein, 6 aa, Mycobacterium
LGQPAD

SEQ ID NO: 1087665 - protein, 5 aa, Mycobacterium
LGQRE

SEQ ID NO: 1087666 - protein, 7 aa, Mycobacterium
LGSAAGF

SEQ ID NO: 1087667 - protein, 9 aa, Mycobacterium
LGSGGTPDQ

SEQ ID NO: 1087668 - protein, 15 aa, Mycobacterium
LGSGNTGDANFGSGN

SEQ ID NO: 1087669 - protein, 10 aa, Mycobacterium
LGSGNTGSFN

SEQ ID NO: 1087670 - protein, 7 aa, Mycobacterium
LGSHPRL

SEQ ID NO: 1087671 - protein, 9 aa, Mycobacterium
LGTPPDGVT

SEQ ID NO: 1087672 - protein, 9 aa, Mycobacterium
LGTRDGANL

SEQ ID NO: 1087673 - protein, 4 aa, Mycobacterium
LGTT

SEQ ID NO: 1087674 - protein, 16 aa, Mycobacterium
LGVGSETLRTNANADA

SEQ ID NO: 1087675 - protein, 5 aa, Mycobacterium
LHSPR

SEQ ID NO: 1087676 - protein, 7 aa, Mycobacterium
LKATGDS

SEQ ID NO: 1087677 - protein, 11 aa, Mycobacterium
LKDSGERNDVA

SEQ ID NO: 1087678 - protein, 13 aa, Mycobacterium
LKPTHGRIPRTGS

SEQ ID NO: 1087679 - protein, 9 aa, Mycobacterium
LNASGEQVY

SEQ ID NO: 1087680 - protein, 12 aa, Mycobacterium
LNATNKPVQDLT

SEQ ID NO: 1087681 - protein, 6 aa, Mycobacterium
LNDSLD

SEQ ID NO: 1087682 - protein, 8 aa, Mycobacterium
LNEGPGFP

SEQ ID NO: 1087683 - protein, 10 aa, Mycobacterium
LNRATAKTTY

SEQ ID NO: 1087684 - protein, 16 aa, Mycobacterium
LNRNPPGDVRDTTTPH

SEQ ID NO: 1087685 - protein, 17 aa, Mycobacterium
LNRTGPATRSFGTGDGV

SEQ ID NO: 1087686 - protein, 13 aa, Mycobacterium
LNSDGYSGGGGKA

SEQ ID NO: 1087687 - protein, 7 aa, Mycobacterium
LNSTAQG

SEQ ID NO: 1087688 - protein, 35 aa, Mycobacterium
LNTGMGSPEDQSVANSGFRNAGSGNSGFNNTGSFS

SEQ ID NO: 1087689 - protein, 4 aa, Mycobacterium
LNTK

SEQ ID NO: 1087690 - protein, 6 aa, Mycobacterium
LPAAGL

SEQ ID NO: 1087691 - protein, 4 aa, Mycobacterium
LPAD

SEQ ID NO: 1087692 - protein, 12 aa, Mycobacterium
LPANATARIGTT

SEQ ID NO: 1087693 - protein, 11 aa, Mycobacterium
LPAPGLGSGGY

SEQ ID NO: 1087694 - protein, 13 aa, Mycobacterium
LPAPSARTPGTQI

SEQ ID NO: 1087695 - protein, 21 aa, Mycobacterium
LPAPSEPAQFTAPGAPGTLGS

SEQ ID NO: 1087696 - protein, 11 aa, Mycobacterium
LPAPTLGSGGY

SEQ ID NO: 1087697 - protein, 21 aa, Mycobacterium
LPATNGPSGPRPDGPPPTGTV

SEQ ID NO: 1087698 - protein, 5 aa, Mycobacterium
LPEVG

SEQ ID NO: 1087699 - protein, 13 aa, Mycobacterium
LPGAPTVTSPAAL

SEQ ID NO: 1087700 - protein, 33 aa, Mycobacterium
LPGLTGGAIPGLPAPGAAPAAPANQPQTLLAAL

SEQ ID NO: 1087701 - protein, 8 aa, Mycobacterium
LPGPGFPD

SEQ ID NO: 1087702 - protein, 19 aa, Mycobacterium
LPGQGVDPAGPLRFNPWWR

SEQ ID NO: 1087703 - protein, 7 aa, Mycobacterium
LPGRDRR

SEQ ID NO: 1087704 - protein, 24 aa, Mycobacterium
LPGRRPARRSSSRPVRSQRVVDAD

SEQ ID NO: 1087705 - protein, 50 aa, Mycobacterium
LPGTTLPPTPGAAVNPALTNPALTSPTGLAPGLTSPTGLDPSLGGTNEIP

SEQ ID NO: 1087706 - protein, 4 aa, Mycobacterium
LPKN

SEQ ID NO: 1087707 - protein, 4 aa, Mycobacterium
LPLP

SEQ ID NO: 1087708 - protein, 5 aa, Mycobacterium
LPPAD

SEQ ID NO: 1087709 - protein, 7 aa, Mycobacterium
LPPGTQL

SEQ ID NO: 1087710 - protein, 6 aa, Mycobacterium
LPPPTI

SEQ ID NO: 1087711 - protein, 4 aa, Mycobacterium
LPPQ

SEQ ID NO: 1087712 - protein, 4 aa, Mycobacterium
LPPT

SEQ ID NO: 1087713 - protein, 19 aa, Mycobacterium
LPPTDPRYVDGAPGSRVPS

SEQ ID NO: 1087714 - protein, 5 aa, Mycobacterium
LPQIP

SEQ ID NO: 1087715 - protein, 6 aa, Mycobacterium
LPQQAR

SEQ ID NO: 1087716 - protein, 5 aa, Mycobacterium
LPQTL

SEQ ID NO: 1087717 - protein, 6 aa, Mycobacterium
LPRDTL

SEQ ID NO: 1087718 - protein, 14 aa, Mycobacterium
LPRGSTAELRTATP

SEQ ID NO: 1087719 - protein, 8 aa, Mycobacterium
LPRSSGEM

SEQ ID NO: 1087720 - protein, 22 aa, Mycobacterium
LPSAGGLSAPAGPDMGGVAPTG

SEQ ID NO: 1087721 - protein, 4 aa, Mycobacterium
LPSG

SEQ ID NO: 1087722 - protein, 12 aa, Mycobacterium
LPSTRQPTGARH

SEQ ID NO: 1087723 - protein, 14 aa, Mycobacterium
LPSVPHGRATVPQD

SEQ ID NO: 1087724 - protein, 13 aa, Mycobacterium
LPTQQSPVQQAPT

SEQ ID NO: 1087725 - protein, 11 aa, Mycobacterium
LPTSPGYTGNT

SEQ ID NO: 1087726 - protein, 4 aa, Mycobacterium
LPTT

SEQ ID NO: 1087727 - protein, 5 aa, Mycobacterium
LPTTS

SEQ ID NO: 1087728 - protein, 10 aa, Mycobacterium
LQAKAAAAAY

SEQ ID NO: 1087729 - protein, 6 aa, Mycobacterium
LQAPYG

SEQ ID NO: 1087730 - protein, 12 aa, Mycobacterium
LQATAQATQTTL

SEQ ID NO: 1087731 - protein, 22 aa, Mycobacterium
LQNTLGDGSAPAARIDAIGGLS

SEQ ID NO: 1087732 - protein, 8 aa, Mycobacterium
LQRSDPRN

SEQ ID NO: 1087733 - protein, 9 aa, Mycobacterium
LQSASERLR

SEQ ID NO: 1087734 - protein, 11 aa, Mycobacterium
LRDDPSSALTN

SEQ ID NO: 1087735 - protein, 17 aa, Mycobacterium
LRGESERAERDGDLAKA

SEQ ID NO: 1087736 - protein, 13 aa, Mycobacterium
LRGSTAGVAGATA

SEQ ID NO: 1087737 - protein, 6 aa, Mycobacterium
LRNGGE

SEQ ID NO: 1087738 - protein, 10 aa, Mycobacterium
LRPDRPSPRV

SEQ ID NO: 1087739 - protein, 15 aa, Mycobacterium
LRPRGANERAPLPKL

SEQ ID NO: 1087740 - protein, 4 aa, Mycobacterium
LRQA

SEQ ID NO: 1087741 - protein, 10 aa, Mycobacterium
LRQSAEDANR

SEQ ID NO: 1087742 - protein, 4 aa, Mycobacterium
LRRR

SEQ ID NO: 1087743 - protein, 6 aa, Mycobacterium
LRSRDT

SEQ ID NO: 1087744 - protein, 4 aa, Mycobacterium
LRSS

SEQ ID NO: 1087745 - protein, 7 aa, Mycobacterium
LRTDEST

SEQ ID NO: 1087746 - protein, 12 aa, Mycobacterium
LRTPEGPTGFPP

SEQ ID NO: 1087747 - protein, 18 aa, Mycobacterium
LSADGQMSYNDSRAEGTR

SEQ ID NO: 1087748 - protein, 8 aa, Mycobacterium
LSAPGSRL

SEQ ID NO: 1087749 - protein, 5 aa, Mycobacterium
LSDAG

SEQ ID NO: 1087750 - protein, 10 aa, Mycobacterium
LSEATRESLE

SEQ ID NO: 1087751 - protein, 5 aa, Mycobacterium
LSEGT

SEQ ID NO: 1087752 - protein, 18 aa, Mycobacterium
LSGADRRVTPQSARSGAR

SEQ ID NO: 1087753 - protein, 7 aa, Mycobacterium
LSGKLNP

SEQ ID NO: 1087754 - protein, 5 aa, Mycobacterium
LSGMG

SEQ ID NO: 1087755 - protein, 7 aa, Mycobacterium
LSGTTGA

SEQ ID NO: 1087756 - protein, 8 aa, Mycobacterium
LSKQSEEQ

SEQ ID NO: 1087757 - protein, 9 aa, Mycobacterium
LSKTGARYS

SEQ ID NO: 1087758 - protein, 7 aa, Mycobacterium
LSPAGEQ

SEQ ID NO: 1087759 - protein, 13 aa, Mycobacterium
LSPGKRPGGRSGL

SEQ ID NO: 1087760 - protein, 7 aa, Mycobacterium
LSPGVDT

SEQ ID NO: 1087761 - protein, 9 aa, Mycobacterium
LSPSSPAAA

SEQ ID NO: 1087762 - protein, 12 aa, Mycobacterium
LSRQAEQTTEAM

SEQ ID NO: 1087763 - protein, 4 aa, Mycobacterium
LSSG

SEQ ID NO: 1087764 - protein, 13 aa, Mycobacterium
LSSQQRPADRSRQ

SEQ ID NO: 1087765 - protein, 7 aa, Mycobacterium
LSTDPSC

SEQ ID NO: 1087766 - protein, 14 aa, Mycobacterium
LSTSAAGAAGTTIT

SEQ ID NO: 1087767 - protein, 9 aa, Mycobacterium
LSTTKRPAD

SEQ ID NO: 1087768 - protein, 8 aa, Mycobacterium
LTATTRTG

SEQ ID NO: 1087769 - protein, 13 aa, Mycobacterium
LTEASSGRVPNPY

SEQ ID NO: 1087770 - protein, 19 aa, Mycobacterium
LTGCGSSSGSQLASTASMT

SEQ ID NO: 1087771 - protein, 4 aa, Mycobacterium
LTGD

SEQ ID NO: 1087772 - protein, 8 aa, Mycobacterium
LTGEPSRQ

SEQ ID NO: 1087773 - protein, 4 aa, Mycobacterium
LTGG

SEQ ID NO: 1087774 - protein, 10 aa, Mycobacterium
LTGGSAGARF

SEQ ID NO: 1087775 - protein, 6 aa, Mycobacterium
LTGRNG

SEQ ID NO: 1087776 - protein, 10 aa, Mycobacterium
LTGSPAAKTV

SEQ ID NO: 1087777 - protein, 9 aa, Mycobacterium
LTNTASQQA

SEQ ID NO: 1087778 - protein, 14 aa, Mycobacterium
LTPSKWSDFGKASD

SEQ ID NO: 1087779 - protein, 15 aa, Mycobacterium
LTRPSETTNPGGIAS

SEQ ID NO: 1087780 - protein, 6 aa, Mycobacterium
LTRTTP

SEQ ID NO: 1087781 - protein, 4 aa, Mycobacterium
LTTG

SEQ ID NO: 1087782 - protein, 5 aa, Mycobacterium
LTTGP

SEQ ID NO: 1087783 - protein, 5 aa, Mycobacterium
LTTPS

SEQ ID NO: 1087784 - protein, 9 aa, Mycobacterium
LYGGNEPAR

SEQ ID NO: 1087785 - protein, 8 aa, Mycobacterium
MADQAEDA

SEQ ID NO: 1087786 - protein, 7 aa, Mycobacterium
MAEGRGS

SEQ ID NO: 1087787 - protein, 6 aa, Mycobacterium
MASYSA

SEQ ID NO: 1087788 - protein, 13 aa, Mycobacterium
MDDSVDDSKRRKH

SEQ ID NO: 1087789 - protein, 8 aa, Mycobacterium
MDHDGTYA

SEQ ID NO: 1087790 - protein, 7 aa, Mycobacterium
MDPSGAS

SEQ ID NO: 1087791 - protein, 15 aa, Mycobacterium
MDTDEQNDDEHGSAL

SEQ ID NO: 1087792 - protein, 4 aa, Mycobacterium
MEGA

SEQ ID NO: 1087793 - protein, 10 aa, Mycobacterium
MGVDADPTAV

SEQ ID NO: 1087794 - protein, 5 aa, Mycobacterium
MHSGE

SEQ ID NO: 1087795 - protein, 16 aa, Mycobacterium
MNGPSDSYLTATSPDE

SEQ ID NO: 1087796 - protein, 13 aa, Mycobacterium
MNSPDASSLQATK

SEQ ID NO: 1087797 - protein, 7 aa, Mycobacterium
MNTLGGK

SEQ ID NO: 1087798 - protein, 47 aa, Mycobacterium
MPAPDDSDDDTTVYPKPNAYYNGGDDSSSYPAPDHGQPIDGGGVPCV

SEQ ID NO: 1087799 - protein, 11 aa, Mycobacterium
MPDSDDSPSEL

SEQ ID NO: 1087800 - protein, 7 aa, Mycobacterium
MPHTTPA

SEQ ID NO: 1087801 - protein, 9 aa, Mycobacterium
MPQQTTSAV

SEQ ID NO: 1087802 - protein, 7 aa, Mycobacterium
MPSPYTV

SEQ ID NO: 1087803 - protein, 14 aa, Mycobacterium
MPTSMGKDSTPTAN

SEQ ID NO: 1087804 - protein, 17 aa, Mycobacterium
MRAPGKPSTSAATSRES

SEQ ID NO: 1087805 - protein, 11 aa, Mycobacterium
MRARQSDGSWG

SEQ ID NO: 1087806 - protein, 13 aa, Mycobacterium
MRPSHDPATAKAG

SEQ ID NO: 1087807 - protein, 4 aa, Mycobacterium
MRRS

SEQ ID NO: 1087808 - protein, 6 aa, Mycobacterium
MSAQGS

SEQ ID NO: 1087809 - protein, 4 aa, Mycobacterium
MSGG

SEQ ID NO: 1087810 - protein, 4 aa, Mycobacterium
MSQT

SEQ ID NO: 1087811 - protein, 7 aa, Mycobacterium
MTAKSGS

SEQ ID NO: 1087812 - protein, 8 aa, Mycobacterium
MTATPEAF

SEQ ID NO: 1087813 - protein, 15 aa, Mycobacterium
MTDASGNKPESVTCP

SEQ ID NO: 1087814 - protein, 4 aa, Mycobacterium
MTEE

SEQ ID NO: 1087815 - protein, 5 aa, Mycobacterium
MTPRA

SEQ ID NO: 1087816 - protein, 6 aa, Mycobacterium
MTPRGE

SEQ ID NO: 1087817 - protein, 12 aa, Mycobacterium
MWGPKDDPAWAR

SEQ ID NO: 1087818 - protein, 10 aa, Mycobacterium
NAAAAAPTTA

SEQ ID NO: 1087819 - protein, 7 aa, Mycobacterium
NAAAGSV

SEQ ID NO: 1087820 - protein, 6 aa, Mycobacterium
NAAGGH

SEQ ID NO: 1087821 - protein, 8 aa, Mycobacterium
NAAPTGMP

SEQ ID NO: 1087822 - protein, 23 aa, Mycobacterium
NADGYNTDKPAEPTTAAFRISVN

SEQ ID NO: 1087823 - protein, 8 aa, Mycobacterium
NADSGHQE

SEQ ID NO: 1087824 - protein, 10 aa, Mycobacterium
NAGDEQSGFF

SEQ ID NO: 1087825 - protein, 15 aa, Mycobacterium
NAGGSQSVGINNTGS

SEQ ID NO: 1087826 - protein, 9 aa, Mycobacterium
NAKSPQAQR

SEQ ID NO: 1087827 - protein, 6 aa, Mycobacterium
NALRDN

SEQ ID NO: 1087828 - protein, 8 aa, Mycobacterium
NANGSGAG

SEQ ID NO: 1087829 - protein, 12 aa, Mycobacterium
NAPAIAATESTY

SEQ ID NO: 1087830 - protein, 11 aa, Mycobacterium
NAPAIASTEAA

SEQ ID NO: 1087831 - protein, 6 aa, Mycobacterium
NAPEIA

SEQ ID NO: 1087832 - protein, 15 aa, Mycobacterium
NAPPEADGVQPPDGD

SEQ ID NO: 1087833 - protein, 5 aa, Mycobacterium
NAPTE

SEQ ID NO: 1087834 - protein, 16 aa, Mycobacterium
NARQAERSDDWDELAD

SEQ ID NO: 1087835 - protein, 8 aa, Mycobacterium
NARSFSDA

SEQ ID NO: 1087836 - protein, 8 aa, Mycobacterium
NASPGSIT

SEQ ID NO: 1087837 - protein, 7 aa, Mycobacterium
NASRATG

SEQ ID NO: 1087838 - protein, 5 aa, Mycobacterium
NASVS

SEQ ID NO: 1087839 - protein, 29 aa, Mycobacterium
NATTHRQGTSRNAAIDRANAAEDRVNAAC

SEQ ID NO: 1087840 - protein, 7 aa, Mycobacterium
NAVGAGT

SEQ ID NO: 1087841 - protein, 6 aa, Mycobacterium
NDAANT

SEQ ID NO: 1087842 - protein, 6 aa, Mycobacterium
NDADGR

SEQ ID NO: 1087843 - protein, 17 aa, Mycobacterium
NDAGSADAGPLPGPGAR

SEQ ID NO: 1087844 - protein, 5 aa, Mycobacterium
NDAQS

SEQ ID NO: 1087845 - protein, 36 aa, Mycobacterium
NDAQSQPFTTNPELRPQPSSTPPPPPPLPPTPFPKE

SEQ ID NO: 1087846 - protein, 6 aa, Mycobacterium
NDPAPL

SEQ ID NO: 1087847 - protein, 9 aa, Mycobacterium
NDPEPYDPK

SEQ ID NO: 1087848 - protein, 7 aa, Mycobacterium
NDPNEVA

SEQ ID NO: 1087849 - protein, 6 aa, Mycobacterium
NDPPEE

SEQ ID NO: 1087850 - protein, 5 aa, Mycobacterium
NDPRN

SEQ ID NO: 1087851 - protein, 8 aa, Mycobacterium
NDQRNALN

SEQ ID NO: 1087852 - protein, 4 aa, Mycobacterium
NDRG

SEQ ID NO: 1087853 - protein, 4 aa, Mycobacterium
NDSL

SEQ ID NO: 1087854 - protein, 13 aa, Mycobacterium
NDTIDGKQRSRSV

SEQ ID NO: 1087855 - protein, 5 aa, Mycobacterium
NECPN

SEQ ID NO: 1087856 - protein, 11 aa, Mycobacterium
NEGAPGRGPTL

SEQ ID NO: 1087857 - protein, 4 aa, Mycobacterium
NEHE

SEQ ID NO: 1087858 - protein, 9 aa, Mycobacterium
NEKTRSGAA

SEQ ID NO: 1087859 - protein, 5 aa, Mycobacterium
NEPRD

SEQ ID NO: 1087860 - protein, 7 aa, Mycobacterium
NEPTLGD

SEQ ID NO: 1087861 - protein, 6 aa, Mycobacterium
NEQRDD

SEQ ID NO: 1087862 - protein, 7 aa, Mycobacterium
NETARSA

SEQ ID NO: 1087863 - protein, 4 aa, Mycobacterium
NETF

SEQ ID NO: 1087864 - protein, 25 aa, Mycobacterium
NGAAGGLGGQSTDGDGGSGGSGGRA

SEQ ID NO: 1087865 - protein, 15 aa, Mycobacterium
NGAAGTAAHPNGGAG

SEQ ID NO: 1087866 - protein, 17 aa, Mycobacterium
NGAAGVAGVDGGAGQAG

SEQ ID NO: 1087867 - protein, 26 aa, Mycobacterium
NGAAGVAGVDGGAGQAGGWLCRGVVI

SEQ ID NO: 1087868 - protein, 17 aa, Mycobacterium
NGADGAPGTGQSGGNDG

SEQ ID NO: 1087869 - protein, 8 aa, Mycobacterium
NGAGTGPQ

SEQ ID NO: 1087870 - protein, 15 aa, Mycobacterium
NGAHGAPGQAGGDGG

SEQ ID NO: 1087871 - protein, 16 aa, Mycobacterium
NGANGTATSPNGSAGG

SEQ ID NO: 1087872 - protein, 9 aa, Mycobacterium
NGASFTSGK

SEQ ID NO: 1087873 - protein, 4 aa, Mycobacterium
NGCG

SEQ ID NO: 1087874 - protein, 12 aa, Mycobacterium
NGEAAKQTLAQE

SEQ ID NO: 1087875 - protein, 5 aa, Mycobacterium
NGEGI

SEQ ID NO: 1087876 - protein, 16 aa, Mycobacterium
NGESCGDGPAPTASVR

SEQ ID NO: 1087877 - protein, 5 aa, Mycobacterium
NGGAG

SEQ ID NO: 1087878 - protein, 22 aa, Mycobacterium
NGGAGGSGAAGQAGGDGGAAGL

SEQ ID NO: 1087879 - protein, 20 aa, Mycobacterium
NGGAGGTGGSGAAGGNGGAG

SEQ ID NO: 1087880 - protein, 8 aa, Mycobacterium
NGGEIDGT

SEQ ID NO: 1087881 - protein, 14 aa, Mycobacterium
NGGGGGVGGVGGVG

SEQ ID NO: 1087882 - protein, 24 aa, Mycobacterium
NGGNGAEGGTSSATGGDGGNGGDA

SEQ ID NO: 1087883 - protein, 9 aa, Mycobacterium
NGGNGGAAG

SEQ ID NO: 1087884 - protein, 23 aa, Mycobacterium
NGGNGGDSTSAGVAGGAGGSAGL

SEQ ID NO: 1087885 - protein, 17 aa, Mycobacterium
NGGNGGNGGDGGTRPKG

SEQ ID NO: 1087886 - protein, 21 aa, Mycobacterium
NGGNGGSGANNQGGGNGGSAG

SEQ ID NO: 1087887 - protein, 44 aa, Mycobacterium; identical to SEQ ID NO: 909941

SEQ ID NO: 1087888 - protein, 22 aa, Mycobacterium
NGGNGGVGGVGETPGGDGGGGI

SEQ ID NO: 1087889 - protein, 27 aa, Mycobacterium
NGGNRGIGGAGDSGNPAGGQGGNGGGA

SEQ ID NO: 1087890 - protein, 14 aa, Mycobacterium
NGGPSGAAGGQPLP

SEQ ID NO: 1087891 - protein, 6 aa, Mycobacterium
NGGSST

SEQ ID NO: 1087892 - protein, 6 aa, Mycobacterium
NGHHPG

SEQ ID NO: 1087893 - protein, 8 aa, Mycobacterium
NGIPALEN

SEQ ID NO: 1087894 - protein, 8 aa, Mycobacterium
NGITGSAS

SEQ ID NO: 1087895 - protein, 7 aa, Mycobacterium
NGKGGQP

SEQ ID NO: 1087896 - protein, 7 aa, Mycobacterium
NGLDPTH

SEQ ID NO: 1087897 - protein, 22 aa, Mycobacterium
NGRGGPQGLPLGPSSAGGDTIA

SEQ ID NO: 1087898 - protein, 8 aa, Mycobacterium
NGRPVGAR

SEQ ID NO: 1087899 - protein, 5 aa, Mycobacterium
NGSTG

SEQ ID NO: 1087900 - protein, 6 aa, Mycobacterium
NGTEYG

SEQ ID NO: 1087901 - protein, 11 aa, Mycobacterium
NGTGYGGPPFD

SEQ ID NO: 1087902 - protein, 12 aa, Mycobacterium
NGTPSDLGGDNM

SEQ ID NO: 1087903 - protein, 4 aa, Mycobacterium
NGTT

SEQ ID NO: 1087904 - protein, 5 aa, Mycobacterium
NGTVS

SEQ ID NO: 1087905 - protein, 10 aa, Mycobacterium
NGYETLAPAE

SEQ ID NO: 1087906 - protein, 5 aa, Mycobacterium
NHNGS

SEQ ID NO: 1087907 - protein, 8 aa, Mycobacterium
NHQEQAEQ

SEQ ID NO: 1087908 - protein, 6 aa, Mycobacterium
NHSQAN

SEQ ID NO: 1087909 - protein, 7 aa, Mycobacterium
NIEPNSR

SEQ ID NO: 1087910 - protein, 5 aa, Mycobacterium
NIPYE

SEQ ID NO: 1087911 - protein, 7 aa, Mycobacterium
NIQPNSR

SEQ ID NO: 1087912 - protein, 7 aa, Mycobacterium
NISYGRS

SEQ ID NO: 1087913 - protein, 7 aa, Mycobacterium
NKAPQVE

SEQ ID NO: 1087914 - protein, 19 aa, Mycobacterium
NKASEQSYRVSITTSARSV

SEQ ID NO: 1087915 - protein, 10 aa, Mycobacterium
NKDEAGNPVS

SEQ ID NO: 1087916 - protein, 6 aa, Mycobacterium
NKGTPF

SEQ ID NO: 1087917 - protein, 17 aa, Mycobacterium
NLPGYEGSNNGSASTLS

SEQ ID NO: 1087918 - protein, 7 aa, Mycobacterium
NNGANDN

SEQ ID NO: 1087919 - protein, 14 aa, Mycobacterium
NNGANDTRLPSQYS

SEQ ID NO: 1087920 - protein, 12 aa, Mycobacterium
NNGKSATAISIP

SEQ ID NO: 1087921 - protein, 15 aa, Mycobacterium
NNGKSATAISIPRDS

SEQ ID NO: 1087922 - protein, 9 aa, Mycobacterium
NNGRSATAI

SEQ ID NO: 1087923 - protein, 7 aa, Mycobacterium
NNGTQTV

SEQ ID NO: 1087924 - protein, 11 aa, Mycobacterium
NNNSGLSRIPR

SEQ ID NO: 1087925 - protein, 7 aa, Mycobacterium
NNSNPAA

SEQ ID NO: 1087926 - protein, 8 aa, Mycobacterium
NPAAGYSN

SEQ ID NO: 1087927 - protein, 14 aa, Mycobacterium
NPAAPTESRNVASS

SEQ ID NO: 1087928 - protein, 4 aa, Mycobacterium
NPAG

SEQ ID NO: 1087929 - protein, 6 aa, Mycobacterium
NPATAT

SEQ ID NO: 1087930 - protein, 5 aa, Mycobacterium
NPDAG

SEQ ID NO: 1087931 - protein, 8 aa, Mycobacterium
NPDDPGTA

SEQ ID NO: 1087932 - protein, 9 aa, Mycobacterium
NPDLPPEAV

SEQ ID NO: 1087933 - protein, 14 aa, Mycobacterium
NPDYRGNRKPRNKG

SEQ ID NO: 1087934 - protein, 7 aa, Mycobacterium
NPEEADA

SEQ ID NO: 1087935 - protein, 15 aa, Mycobacterium
NPERNSDGTAGHSSA

SEQ ID NO: 1087936 - protein, 6 aa, Mycobacterium
NPGGAA

SEQ ID NO: 1087937 - protein, 9 aa, Mycobacterium
NPGPPTGLG

SEQ ID NO: 1087938 - protein, 8 aa, Mycobacterium
NPGSAEGI

SEQ ID NO: 1087939 - protein, 9 aa, Mycobacterium
NPGTSLNET

SEQ ID NO: 1087940 - protein, 20 aa, Mycobacterium
NPIEGAKQQSEAVNAADQVA

SEQ ID NO: 1087941 - protein, 11 aa, Mycobacterium
NPLDKRRSDVV

SEQ ID NO: 1087942 - protein, 31 aa, Mycobacterium
NPLQPVNPAHSDSSANQGGPARRTGVERDGP

SEQ ID NO: 1087943 - protein, 15 aa, Mycobacterium
NPQSAGAQGNSNVTN

SEQ ID NO: 1087944 - protein, 11 aa, Mycobacterium
NPRGTPGGPQH

SEQ ID NO: 1087945 - protein, 6 aa, Mycobacterium
NPSGKV

SEQ ID NO: 1087946 - protein, 8 aa, Mycobacterium
NPSGRAGG

SEQ ID NO: 1087947 - protein, 13 aa, Mycobacterium
NPTVKSAINTAAR

SEQ ID NO: 1087948 - protein, 11 aa, Mycobacterium
NQASDASGHQQ

SEQ ID NO: 1087949 - protein, 15 aa, Mycobacterium
NQDGAATATFTDGTI

SEQ ID NO: 1087950 - protein, 6 aa, Mycobacterium
NQKSTA

SEQ ID NO: 1087951 - protein, 7 aa, Mycobacterium
NQLGAGQ

SEQ ID NO: 1087952 - protein, 7 aa, Mycobacterium
NRGGATA

SEQ ID NO: 1087953 - protein, 10 aa, Mycobacterium
NRGGENVSSV

SEQ ID NO: 1087954 - protein, 13 aa, Mycobacterium
NRGGSRPAKPIPL

SEQ ID NO: 1087955 - protein, 7 aa, Mycobacterium
NRPRSFS

SEQ ID NO: 1087956 - protein, 10 aa, Mycobacterium
NRTAGDAEKL

SEQ ID NO: 1087957 - protein, 6 aa, Mycobacterium
NRTPAA

SEQ ID NO: 1087958 - protein, 22 aa, Mycobacterium
NRTPPAFTATHENENDPSAADM

SEQ ID NO: 1087959 - protein, 5 aa, Mycobacterium
NSAEV

SEQ ID NO: 1087960 - protein, 4 aa, Mycobacterium
NSAG

SEQ ID NO: 1087961 - protein, 28 aa, Mycobacterium
NSANSDAGARSVATREAPANAGAGIPRS

SEQ ID NO: 1087962 - protein, 16 aa, Mycobacterium
NSGAGNLGFGNSGTNN

SEQ ID NO: 1087963 - protein, 14 aa, Mycobacterium
NSGDGNSGFENSNT

SEQ ID NO: 1087964 - protein, 11 aa, Mycobacterium
NSGERGEPRAV

SEQ ID NO: 1087965 - protein, 14 aa, Mycobacterium
NSGGTNTGFGNGGS

SEQ ID NO: 1087966 - protein, 10 aa, Mycobacterium
NSGNGSSGVF

SEQ ID NO: 1087967 - protein, 8 aa, Mycobacterium
NSGPQRPE

SEQ ID NO: 1087968 - protein, 16 aa, Mycobacterium
NSGSGNVGIGNSGTGN

SEQ ID NO: 1087969 - protein, 63 aa, Mycobacterium
NSGTYNTGFSNAAETNTGWENSGNVNTGGYNSGGLNTGIGSPDTQAGPNSGFGHSGSGNSGFF

SEQ ID NO: 1087970 - protein, 20 aa, Mycobacterium
NSGVNNVGAGNGGSSNVGLG

SEQ ID NO: 1087971 - protein, 4 aa, Mycobacterium
NSNQ

SEQ ID NO: 1087972 - protein, 11 aa, Mycobacterium
NSPAADETISG

SEQ ID NO: 1087973 - protein, 6 aa, Mycobacterium
NSSAGN

SEQ ID NO: 1087974 - protein, 19 aa, Mycobacterium
NSSGLTNPAPIKAPTPTPS

SEQ ID NO: 1087975 - protein, 9 aa, Mycobacterium
NSTNSNSEF

SEQ ID NO: 1087976 - protein, 8 aa, Mycobacterium
NSTPPCPE

SEQ ID NO: 1087977 - protein, 8 aa, Mycobacterium
NSTSDYGG

SEQ ID NO: 1087978 - protein, 12 aa, Mycobacterium
NSTTADADLSGT

SEQ ID NO: 1087979 - protein, 4 aa, Mycobacterium
NTEL

SEQ ID NO: 1087980 - protein, 4 aa, Mycobacterium
NTEN

SEQ ID NO: 1087981 - protein, 17 aa, Mycobacterium
NTFDPSQDIGRQGDRQL

SEQ ID NO: 1087982 - protein, 13 aa, Mycobacterium
NTGGQGGTPRAVP

SEQ ID NO: 1087983 - protein, 9 aa, Mycobacterium
NTGNGYSGG

SEQ ID NO: 1087984 - protein, 6 aa, Mycobacterium
NTKPAL

SEQ ID NO: 1087985 - protein, 8 aa, Mycobacterium
NTPAIAAT

SEQ ID NO: 1087986 - protein, 8 aa, Mycobacterium
NTPIPGIT

SEQ ID NO: 1087987 - protein, 8 aa, Mycobacterium
NTQPPSIT

SEQ ID NO: 1087988 - protein, 5 aa, Mycobacterium
NTSET

SEQ ID NO: 1087989 - protein, 6 aa, Mycobacterium
NTTSAL

SEQ ID NO: 1087990 - protein, 6 aa, Mycobacterium
NTYDAA

SEQ ID NO: 1087991 - protein, 10 aa, Mycobacterium
NVPGPPLTAE

SEQ ID NO: 1087992 - protein, 10 aa, Mycobacterium
NVSDSADTEF

SEQ ID NO: 1087993 - protein, 5 aa, Mycobacterium
NVSTE

SEQ ID NO: 1087994 - protein, 6 aa, Mycobacterium
NYRGSM

SEQ ID NO: 1087995 - protein, 5 aa, Mycobacterium
NYTTP

SEQ ID NO: 1087996 - protein, 4 aa, Mycobacterium
PAAA

SEQ ID NO: 1087997 - protein, 16 aa, Mycobacterium
PAAAAAAALPKVPGLG

SEQ ID NO: 1087998 - protein, 6 aa, Mycobacterium
PAAAAV

SEQ ID NO: 1087999 - protein, 15 aa, Mycobacterium
PAAATDDSRGHGRVE

SEQ ID NO: 1088000 - protein, 8 aa, Mycobacterium
PAADPVSV

SEQ ID NO: 1088001 - protein, 7 aa, Mycobacterium
PAAGYSN

SEQ ID NO: 1088002 - protein, 4 aa, Mycobacterium
PAAN

SEQ ID NO: 1088003 - protein, 25 aa, Mycobacterium
PADADPGGWDPTLPATASAGAPGDA

SEQ ID NO: 1088004 - protein, 5 aa, Mycobacterium
PADGE

SEQ ID NO: 1088005 - protein, 4 aa, Mycobacterium
PAEA

SEQ ID NO: 1088006 - protein, 157 aa, Mycobacterium; identical to SEQ ID NO: 910811

SEQ ID NO: 1088007 - protein, 6 aa, Mycobacterium
PAEITD

SEQ ID NO: 1088008 - protein, 7 aa, Mycobacterium
PAESNGF

SEQ ID NO: 1088009 - protein, 8 aa, Mycobacterium
PAESTEEE

SEQ ID NO: 1088010 - protein, 7 aa, Mycobacterium
PAEVAAN

SEQ ID NO: 1088011 - protein, 9 aa, Mycobacterium
PAGAGRGVA

SEQ ID NO: 1088012 - protein, 8 aa, Mycobacterium
PAGEAQQL

SEQ ID NO: 1088013 - protein, 7 aa, Mycobacterium
PAGGDEV

SEQ ID NO: 1088014 - protein, 10 aa, Mycobacterium
PAGGDEVSAA

SEQ ID NO: 1088015 - protein, 7 aa, Mycobacterium
PAGPGCS

SEQ ID NO: 1088016 - protein, 4 aa, Mycobacterium
PAGR

SEQ ID NO: 1088017 - protein, 8 aa, Mycobacterium
PAHADAND

SEQ ID NO: 1088018 - protein, 30 aa, Mycobacterium
PAHASNPGYSDTAPPPSPILTAGSDQPECI

SEQ ID NO: 1088019 - protein, 4 aa, Mycobacterium
PAIT

SEQ ID NO: 1088020 - protein, 8 aa, Mycobacterium
PAKVGAQA

SEQ ID NO: 1088021 - protein, 11 aa, Mycobacterium
PALANPSDPGV

SEQ ID NO: 1088022 - protein, 10 aa, Mycobacterium
PAPAHAASSN

SEQ ID NO: 1088023 - protein, 5 aa, Mycobacterium
PAPAM

SEQ ID NO: 1088024 - protein, 15 aa, Mycobacterium
PAPARRIGGHPAKRT

SEQ ID NO: 1088025 - protein, 12 aa, Mycobacterium
PAPQPAPGNTTD

SEQ ID NO: 1088026 - protein, 8 aa, Mycobacterium
PAPQRTPP

SEQ ID NO: 1088027 - protein, 6 aa, Mycobacterium
PAPRDI

SEQ ID NO: 1088028 - protein, 17 aa, Mycobacterium
PAPTTPHPRKPRPAFQD

SEQ ID NO: 1088029 - protein, 18 aa, Mycobacterium
PAPVGTNRSKGRSDEYQS

SEQ ID NO: 1088030 - protein, 6 aa, Mycobacterium
PAQGTL

SEQ ID NO: 1088031 - protein, 5 aa, Mycobacterium
PAQYA

SEQ ID NO: 1088032 - protein, 7 aa, Mycobacterium
PASTSKV

SEQ ID NO: 1088033 - protein, 14 aa, Mycobacterium
PASVGAQGNTNVTN

SEQ ID NO: 1088034 - protein, 4 aa, Mycobacterium
PATA

SEQ ID NO: 1088035 - protein, 7 aa, Mycobacterium
PATATDD

SEQ ID NO: 1088036 - protein, 7 aa, Mycobacterium
PATIRTE

SEQ ID NO: 1088037 - protein, 14 aa, Mycobacterium
PAVDGTTAVISPMH

SEQ ID NO: 1088038 - protein, 20 aa, Mycobacterium
PAVPAAPAAPEAPAAPVAPA

SEQ ID NO: 1088039 - protein, 5 aa, Mycobacterium
PAVTG

SEQ ID NO: 1088040 - protein, 5 aa, Mycobacterium
PAYAG

SEQ ID NO: 1088041 - protein, 11 aa, Mycobacterium
PAYTGGPAMSD

SEQ ID NO: 1088042 - protein, 15 aa, Mycobacterium
PCSGDAANAPPPANA

SEQ ID NO: 1088043 - protein, 21 aa, Mycobacterium
PDAAADAGAGDASAAQPVHSP

SEQ ID NO: 1088044 - protein, 8 aa, Mycobacterium
PDARDSNV

SEQ ID NO: 1088045 - protein, 9 aa, Mycobacterium
PDASDDDVA

SEQ ID NO: 1088046 - protein, 7 aa, Mycobacterium
PDEQPAI

SEQ ID NO: 1088047 - protein, 12 aa, Mycobacterium
PDGAAAGPGGEG

SEQ ID NO: 1088048 - protein, 9 aa, Mycobacterium
PDGEEVKAA

SEQ ID NO: 1088049 - protein, 4 aa, Mycobacterium
PDGL

SEQ ID NO: 1088050 - protein, 4 aa, Mycobacterium
PDGN

SEQ ID NO: 1088051 - protein, 30 aa, Mycobacterium; identical to SEQ ID NO: 911176

SEQ ID NO: 1088052 - protein, 5 aa, Mycobacterium
PDGRP

SEQ ID NO: 1088053 - protein, 10 aa, Mycobacterium
PDGRPYRESE

SEQ ID NO: 1088054 - protein, 6 aa, Mycobacterium
PDGSRQ

SEQ ID NO: 1088055 - protein, 8 aa, Mycobacterium
PDGSTTVD

SEQ ID NO: 1088056 - protein, 9 aa, Mycobacterium
PDGTQRPST

SEQ ID NO: 1088057 - protein, 7 aa, Mycobacterium
PDHTPAA

SEQ ID NO: 1088058 - protein, 12 aa, Mycobacterium
PDIPTKQTGGSF

SEQ ID NO: 1088059 - protein, 8 aa, Mycobacterium
PDKVYSGG

SEQ ID NO: 1088060 - protein, 7 aa, Mycobacterium
PDNEYTA

SEQ ID NO: 1088061 - protein, 12 aa, Mycobacterium
PDNPWPGSGPRP

SEQ ID NO: 1088062 - protein, 7 aa, Mycobacterium
PDPDSGF

SEQ ID NO: 1088063 - protein, 20 aa, Mycobacterium
PDSARADGGFESEGDQSQYD

SEQ ID NO: 1088064 - protein, 7 aa, Mycobacterium
PDSGTHS

SEQ ID NO: 1088065 - protein, 4 aa, Mycobacterium
PDSR

SEQ ID NO: 1088066 - protein, 20 aa, Mycobacterium
PDWGGPLDDEPVASTQGAGR

SEQ ID NO: 1088067 - protein, 6 aa, Mycobacterium
PEAAGA

SEQ ID NO: 1088068 - protein, 8 aa, Mycobacterium
PEADTPGM

SEQ ID NO: 1088069 - protein, 5 aa, Mycobacterium
PEAET

SEQ ID NO: 1088070 - protein, 11 aa, Mycobacterium
PEAGNLDQSHY

SEQ ID NO: 1088071 - protein, 19 aa, Mycobacterium
PEALAATPSEVSAAGSRIS

SEQ ID NO: 1088072 - protein, 5 aa, Mycobacterium
PEAVE

SEQ ID NO: 1088073 - protein, 5 aa, Mycobacterium
PEEHT

SEQ ID NO: 1088074 - protein, 4 aa, Mycobacterium
PEEQ

SEQ ID NO: 1088075 - protein, 12 aa, Mycobacterium
PEERGGPTSTEF

SEQ ID NO: 1088076 - protein, 7 aa, Mycobacterium
PEGGNPT

SEQ ID NO: 1088077 - protein, 17 aa, Mycobacterium
PEGPAVRQGSQAAEVPR

SEQ ID NO: 1088078 - protein, 6 aa, Mycobacterium
PEGTQS

SEQ ID NO: 1088079 - protein, 4 aa, Mycobacterium
PEKR

SEQ ID NO: 1088080 - protein, 15 aa, Mycobacterium
PENGAASAGSASPAQ

SEQ ID NO: 1088081 - protein, 4 aa, Mycobacterium
PENM

SEQ ID NO: 1088082 - protein, 7 aa, Mycobacterium
PENMDTL

SEQ ID NO: 1088083 - protein, 4 aa, Mycobacterium
PERD

SEQ ID NO: 1088084 - protein, 4 aa, Mycobacterium
PERG

SEQ ID NO: 1088085 - protein, 5 aa, Mycobacterium
PETDP

SEQ ID NO: 1088086 - protein, 6 aa, Mycobacterium
PFEPGS

SEQ ID NO: 1088087 - protein, 5 aa, Mycobacterium
PFGQR

SEQ ID NO: 1088088 - protein, 8 aa, Mycobacterium
PFPANADQ

SEQ ID NO: 1088089 - protein, 9 aa, Mycobacterium
PFTAQSPSR

SEQ ID NO: 1088090 - protein, 44 aa, Mycobacterium
PGAAQPGAVPGAAQPGAALPGTALPGAASPGVGTPQLDPSNIPD

SEQ ID NO: 1088091 - protein, 6 aa, Mycobacterium
PGAISG

SEQ ID NO: 1088092 - protein, 4 aa, Mycobacterium
PGAP

SEQ ID NO: 1088093 - protein, 11 aa, Mycobacterium
PGARPGNGRRW

SEQ ID NO: 1088094 - protein, 12 aa, Mycobacterium
PGARRSAPVQQQ

SEQ ID NO: 1088095 - protein, 15 aa, Mycobacterium
PGATKRGNVPSYDAA

SEQ ID NO: 1088096 - protein, 20 aa, Mycobacterium
PGCSSSPTPSANAANPQRRI

SEQ ID NO: 1088097 - protein, 6 aa, Mycobacterium
PGDDRV

SEQ ID NO: 1088098 - protein, 5 aa, Mycobacterium
PGGLN

SEQ ID NO: 1088099 - protein, 10 aa, Mycobacterium
PGGPGESGIE

SEQ ID NO: 1088100 - protein, 5 aa, Mycobacterium
PGGTP

SEQ ID NO: 1088101 - protein, 5 aa, Mycobacterium
PGHGP

SEQ ID NO: 1088102 - protein, 5 aa, Mycobacterium
PGIRA

SEQ ID NO: 1088103 - protein, 6 aa, Mycobacterium
PGKESH

SEQ ID NO: 1088104 - protein, 11 aa, Mycobacterium
PGLPCEAQSVS

SEQ ID NO: 1088105 - protein, 7 aa, Mycobacterium
PGLTRTR

SEQ ID NO: 1088106 - protein, 10 aa, Mycobacterium
PGMPRDTPYS

SEQ ID NO: 1088107 - protein, 48 aa, Mycobacterium
PGNSRGSQTATPEPSPGPAPNPEPAPVEPAPEESPPATGSVAPSSGPP

SEQ ID NO: 1088108 - protein, 46 aa, Mycobacterium
PGPAATEDAVAPGAAPGYGAPEAPADRAVRAAPASTATPPSPTASI

SEQ ID NO: 1088109 - protein, 5 aa, Mycobacterium
PGPGL

SEQ ID NO: 1088110 - protein, 7 aa, Mycobacterium
PGPGSVV

SEQ ID NO: 1088111 - protein, 6 aa, Mycobacterium
PGPSAV

SEQ ID NO: 1088112 - protein, 9 aa, Mycobacterium
PGPSFPAYS

SEQ ID NO: 1088113 - protein, 5 aa, Mycobacterium
PGQPV

SEQ ID NO: 1088114 - protein, 7 aa, Mycobacterium
PGRSHAQ

SEQ ID NO: 1088115 - protein, 18 aa, Mycobacterium
PGSDDSVDAHASDTLAAG

SEQ ID NO: 1088116 - protein, 6 aa, Mycobacterium
PGTTPL

SEQ ID NO: 1088117 - protein, 15 aa, Mycobacterium
PGTTTSYPGPAHGVG

SEQ ID NO: 1088118 - protein, 9 aa, Mycobacterium
PGTVGQGDQ

SEQ ID NO: 1088119 - protein, 5 aa, Mycobacterium
PGTYT

SEQ ID NO: 1088120 - protein, 13 aa, Mycobacterium
PGTYTSAGPVGDG

SEQ ID NO: 1088121 - protein, 11 aa, Mycobacterium
PGVQGGGPGSF

SEQ ID NO: 1088122 - protein, 13 aa, Mycobacterium
PHPISKPRKSVTG

SEQ ID NO: 1088123 - protein, 10 aa, Mycobacterium
PHRPRPTDLE

SEQ ID NO: 1088124 - protein, 22 aa, Mycobacterium
PIPGLTAPAPAAPATPAAALPG

SEQ ID NO: 1088125 - protein, 23 aa, Mycobacterium
PIPPADAGLSTATPAPAPPSPIA

SEQ ID NO: 1088126 - protein, 8 aa, Mycobacterium
PIPRNAPG

SEQ ID NO: 1088127 - protein, 10 aa, Mycobacterium
PIPTPDSPGG

SEQ ID NO: 1088128 - protein, 10 aa, Mycobacterium
PISDKSAVEK

SEQ ID NO: 1088129 - protein, 5 aa, Mycobacterium
PISDN

SEQ ID NO: 1088130 - protein, 15 aa, Mycobacterium
PISHPDTAILAMLLA

SEQ ID NO: 1088131 - protein, 15 aa, Mycobacterium
PISHPDTAILPMLLA

SEQ ID NO: 1088132 - protein, 10 aa, Mycobacterium
PISTDFPESR

SEQ ID NO: 1088133 - protein, 5 aa, Mycobacterium
PITRE

SEQ ID NO: 1088134 - protein, 11 aa, Mycobacterium
PITSATERARY

SEQ ID NO: 1088135 - protein, 5 aa, Mycobacterium
PKDEL

SEQ ID NO: 1088136 - protein, 7 aa, Mycobacterium
PKGSGRV

SEQ ID NO: 1088137 - protein, 11 aa, Mycobacterium
PKHDAPQGRLR

SEQ ID NO: 1088138 - protein, 16 aa, Mycobacterium
PKNPDNWNFALEEPPE

SEQ ID NO: 1088139 - protein, 6 aa, Mycobacterium
PKPQDT

SEQ ID NO: 1088140 - protein, 10 aa, Mycobacterium
PLGPNGRAAC

SEQ ID NO: 1088141 - protein, 10 aa, Mycobacterium
PLGQPSDASA

SEQ ID NO: 1088142 - protein, 7 aa, Mycobacterium
PLPAQAA

SEQ ID NO: 1088143 - protein, 4 aa, Mycobacterium
PLPG

SEQ ID NO: 1088144 - protein, 12 aa, Mycobacterium
PLPGTEGNGPGS

SEQ ID NO: 1088145 - protein, 4 aa, Mycobacterium
PLPP

SEQ ID NO: 1088146 - protein, 20 aa, Mycobacterium
PLPPAPPAPEAPALPPLAPW

SEQ ID NO: 1088147 - protein, 7 aa, Mycobacterium
PLPRNVG

SEQ ID NO: 1088148 - protein, 4 aa, Mycobacterium
PLPT

SEQ ID NO: 1088149 - protein, 20 aa, Mycobacterium
PLPTYNTNTVTGAASAGAQA

SEQ ID NO: 1088150 - protein, 6 aa, Mycobacterium
PLRPGS

SEQ ID NO: 1088151 - protein, 13 aa, Mycobacterium
PLRPPGSADFAES

SEQ ID NO: 1088152 - protein, 14 aa, Mycobacterium
PLSADPGPPLLLQA

SEQ ID NO: 1088153 - protein, 17 aa, Mycobacterium
PMGYQQGTGTAAAVPGY

SEQ ID NO: 1088154 - protein, 12 aa, Mycobacterium
PMPTPVEPQGPP

SEQ ID NO: 1088155 - protein, 9 aa, Mycobacterium
PMSGNRPAT

SEQ ID NO: 1088156 - protein, 12 aa, Mycobacterium
PMTGTAHSGWGA

SEQ ID NO: 1088157 - protein, 12 aa, Mycobacterium
PNASELERKDAY

SEQ ID NO: 1088158 - protein, 10 aa, Mycobacterium
PNDPNGACGV

SEQ ID NO: 1088159 - protein, 5 aa, Mycobacterium
PNGAQ

SEQ ID NO: 1088160 - protein, 8 aa, Mycobacterium
PNGEQGGP

SEQ ID NO: 1088161 - protein, 6 aa, Mycobacterium
PNGSRD

SEQ ID NO: 1088162 - protein, 4 aa, Mycobacterium
PNNG

SEQ ID NO: 1088163 - protein, 7 aa, Mycobacterium
PNNPDGG

SEQ ID NO: 1088164 - protein, 30 aa, Mycobacterium
PPAAAPVSPVSPAPAPVSAPHTASPVEAQS

SEQ ID NO: 1088165 - protein, 9 aa, Mycobacterium
PPAGAGTEA

SEQ ID NO: 1088166 - protein, 5 aa, Mycobacterium
PPALA

SEQ ID NO: 1088167 - protein, 5 aa, Mycobacterium
PPAPI

SEQ ID NO: 1088168 - protein, 16 aa, Mycobacterium
PPASRGHPGPLSGPDL

SEQ ID NO: 1088169 - protein, 8 aa, Mycobacterium
PPATRASG

SEQ ID NO: 1088170 - protein, 8 aa, Mycobacterium
PPCGETTP

SEQ ID NO: 1088171 - protein, 6 aa, Mycobacterium
PPDPSS

SEQ ID NO: 1088172 - protein, 4 aa, Mycobacterium
PPEV

SEQ ID NO: 1088173 - protein, 7 aa, Mycobacterium
PPGPPRA

SEQ ID NO: 1088174 - protein, 4 aa, Mycobacterium
PPGQ

SEQ ID NO: 1088175 - protein, 11 aa, Mycobacterium
PPHTSTPDEAT

SEQ ID NO: 1088176 - protein, 8 aa, Mycobacterium
PPKDEQAA

SEQ ID NO: 1088177 - protein, 20 aa, Mycobacterium
PPKTPSPTSLHPNAKVTASE

SEQ ID NO: 1088178 - protein, 11 aa, Mycobacterium
PPNASPPNLDH

SEQ ID NO: 1088179 - protein, 11 aa, Mycobacterium
PPNPSRPELDP

SEQ ID NO: 1088180 - protein, 47 aa, Mycobacterium
PPPAPAPAPAPGEPAPQPGAPEPVPAPAPAPAAGVAPTVAPAPRTQP

SEQ ID NO: 1088181 - protein, 11 aa, Mycobacterium
PPPNQFPATTT

SEQ ID NO: 1088182 - protein, 12 aa, Mycobacterium
PPPPPDAEGNPA

SEQ ID NO: 1088183 - protein, 11 aa, Mycobacterium
PPPRPPTVKPA

SEQ ID NO: 1088184 - protein, 25 aa, Mycobacterium
PPQAPAGTHWTPPTGVTMPGQAPPI

SEQ ID NO: 1088185 - protein, 9 aa, Mycobacterium
PPRQDPRDA

SEQ ID NO: 1088186 - protein, 13 aa, Mycobacterium
PPRRASGPYGRCV

SEQ ID NO: 1088187 - protein, 9 aa, Mycobacterium
PPSDQTTVQ

SEQ ID NO: 1088188 - protein, 17 aa, Mycobacterium
PPSQRAADTPTLQDGDT

SEQ ID NO: 1088189 - protein, 4 aa, Mycobacterium
PPSV

SEQ ID NO: 1088190 - protein, 9 aa, Mycobacterium
PPSWSAPSA

SEQ ID NO: 1088191 - protein, 12 aa, Mycobacterium
PPTDVPPEGNLR

SEQ ID NO: 1088192 - protein, 8 aa, Mycobacterium
PPTPSRAR

SEQ ID NO: 1088193 - protein, 8 aa, Mycobacterium
PPTSKPHA

SEQ ID NO: 1088194 - protein, 11 aa, Mycobacterium
PPTWATTSPVG

SEQ ID NO: 1088195 - protein, 16 aa, Mycobacterium
PQAGQMAQQASPIAQT

SEQ ID NO: 1088196 - protein, 24 aa, Mycobacterium
PQAIPPQQAPPAAAPPAQAPPPAV

SEQ ID NO: 1088197 - protein, 14 aa, Mycobacterium
PQASGASTQPQLSR

SEQ ID NO: 1088198 - protein, 12 aa, Mycobacterium
PQDALPDGDPYV

SEQ ID NO: 1088199 - protein, 6 aa, Mycobacterium
PQGHTQ

SEQ ID NO: 1088200 - protein, 4 aa, Mycobacterium
PQIS

SEQ ID NO: 1088201 - protein, 22 aa, Mycobacterium
PQKSNAATNGLQAAARRSGVPV

SEQ ID NO: 1088202 - protein, 12 aa, Mycobacterium
PQPGRQYGNATN

SEQ ID NO: 1088203 - protein, 5 aa, Mycobacterium
PQPLR

SEQ ID NO: 1088204 - protein, 6 aa, Mycobacterium
PQQPGQ

SEQ ID NO: 1088205 - protein, 11 aa, Mycobacterium
PQQQAATYSAP

SEQ ID NO: 1088206 - protein, 11 aa, Mycobacterium
PQTATATTAGL

SEQ ID NO: 1088207 - protein, 4 aa, Mycobacterium
PRAH

SEQ ID NO: 1088208 - protein, 9 aa, Mycobacterium
PRARAADDR

SEQ ID NO: 1088209 - protein, 4 aa, Mycobacterium
PRDS

SEQ ID NO: 1088210 - protein, 12 aa, Mycobacterium
PRGPEIGCFNRH

SEQ ID NO: 1088211 - protein, 5 aa, Mycobacterium
PRGRQ

SEQ ID NO: 1088212 - protein, 8 aa, Mycobacterium
PRGTTQGQ

SEQ ID NO: 1088213 - protein, 8 aa, Mycobacterium
PRGVASSR

SEQ ID NO: 1088214 - protein, 4 aa, Mycobacterium
PRIP

SEQ ID NO: 1088215 - protein, 8 aa, Mycobacterium
PRKSGARR

SEQ ID NO: 1088216 - protein, 7 aa, Mycobacterium
PRNPAGK

SEQ ID NO: 1088217 - protein, 9 aa, Mycobacterium
PRPGTRGRA

SEQ ID NO: 1088218 - protein, 5 aa, Mycobacterium
PRPVT

SEQ ID NO: 1088219 - protein, 5 aa, Mycobacterium
PRRRP

SEQ ID NO: 1088220 - protein, 15 aa, Mycobacterium
PRRRQRASASAAQLS

SEQ ID NO: 1088221 - protein, 4 aa, Mycobacterium
PRSA

SEQ ID NO: 1088222 - protein, 6 aa, Mycobacterium
PRTANG

SEQ ID NO: 1088223 - protein, 15 aa, Mycobacterium
PRTAQRSNTSPRGDR

SEQ ID NO: 1088224 - protein, 4 aa, Mycobacterium
PSDA

SEQ ID NO: 1088225 - protein, 5 aa, Mycobacterium
PSDAA

SEQ ID NO: 1088226 - protein, 17 aa, Mycobacterium
PSDDSPGCTPSDYDNLP

SEQ ID NO: 1088227 - protein, 14 aa, Mycobacterium
PSDSPGVTIQPPED

SEQ ID NO: 1088228 - protein, 8 aa, Mycobacterium
PSDTTPAS

SEQ ID NO: 1088229 - protein, 7 aa, Mycobacterium
PSETMPS

SEQ ID NO: 1088230 - protein, 15 aa, Mycobacterium
PSETTPSLPECTGAA

SEQ ID NO: 1088231 - protein, 4 aa, Mycobacterium
PSFG

SEQ ID NO: 1088232 - protein, 18 aa, Mycobacterium
PSGELREAPHAEWSVRVV

SEQ ID NO: 1088233 - protein, 4 aa, Mycobacterium
PSGG

SEQ ID NO: 1088234 - protein, 6 aa, Mycobacterium
PSGGAV

SEQ ID NO: 1088235 - protein, 12 aa, Mycobacterium
PSGIRTNDGIEH

SEQ ID NO: 1088236 - protein, 11 aa, Mycobacterium
PSGNEAGANEQ

SEQ ID NO: 1088237 - protein, 10 aa, Mycobacterium
PSGPASAVTS

SEQ ID NO: 1088238 - protein, 4 aa, Mycobacterium
PSLT

SEQ ID NO: 1088239 - protein, 17 aa, Mycobacterium
PSNLGGGPQLPMLPATW

SEQ ID NO: 1088240 - protein, 10 aa, Mycobacterium
PSNYPDGKSL

SEQ ID NO: 1088241 - protein, 30 aa, Mycobacterium
PSPAPDRHPPAGATSREALAASPRRRRPLG

SEQ ID NO: 1088242 - protein, 5 aa, Mycobacterium
PSPCT

SEQ ID NO: 1088243 - protein, 10 aa, Mycobacterium
PSPLSSGSAK

SEQ ID NO: 1088244 - protein, 7 aa, Mycobacterium
PSPSMGR

SEQ ID NO: 1088245 - protein, 6 aa, Mycobacterium
PSRPTA

SEQ ID NO: 1088246 - protein, 7 aa, Mycobacterium
PSSGPYK

SEQ ID NO: 1088247 - protein, 7 aa, Mycobacterium
PSSPVSL

SEQ ID NO: 1088248 - protein, 14 aa, Mycobacterium
PSTSRPARTAPTHR

SEQ ID NO: 1088249 - protein, 6 aa, Mycobacterium
PSYTYP

SEQ ID NO: 1088250 - protein, 19 aa, Mycobacterium
PTAEHKFSADGPAWEPGQL

SEQ ID NO: 1088251 - protein, 14 aa, Mycobacterium
PTAGTGTPTGDYGI

SEQ ID NO: 1088252 - protein, 10 aa, Mycobacterium
PTDEPDARRR

SEQ ID NO: 1088253 - protein, 34 aa, Mycobacterium; identical to SEQ ID NO: 912636

SEQ ID NO: 1088254 - protein, 15 aa, Mycobacterium
PTDTGITNAATGATR

SEQ ID NO: 1088255 - protein, 6 aa, Mycobacterium
PTDTIS

SEQ ID NO: 1088256 - protein, 10 aa, Mycobacterium
PTGASEAVVD

SEQ ID NO: 1088257 - protein, 4 aa, Mycobacterium
PTGF

SEQ ID NO: 1088258 - protein, 12 aa, Mycobacterium
PTGTAAAGADSQ

SEQ ID NO: 1088259 - protein, 13 aa, Mycobacterium
PTIPAGSDLAAPA

SEQ ID NO: 1088260 - protein, 9 aa, Mycobacterium
PTIPQSGGD

SEQ ID NO: 1088261 - protein, 14 aa, Mycobacterium
PTLPEPAALATPPA

SEQ ID NO: 1088262 - protein, 4 aa, Mycobacterium
PTLV

SEQ ID NO: 1088263 - protein, 6 aa, Mycobacterium
PTNDQL

SEQ ID NO: 1088264 - protein, 5 aa, Mycobacterium
PTPAD

SEQ ID NO: 1088265 - protein, 7 aa, Mycobacterium
PTPDNNY

SEQ ID NO: 1088266 - protein, 4 aa, Mycobacterium
PTQA

SEQ ID NO: 1088267 - protein, 4 aa, Mycobacterium
PTQD

SEQ ID NO: 1088268 - protein, 7 aa, Mycobacterium
PTSGTVS

SEQ ID NO: 1088269 - protein, 32 aa, Mycobacterium
PTSSAPDDSDQPDQPRGRDARPNRSQREEELS

SEQ ID NO: 1088270 - protein, 11 aa, Mycobacterium
PTTAPEGTPGE

SEQ ID NO: 1088271 - protein, 6 aa, Mycobacterium
PTTQTV

SEQ ID NO: 1088272 - protein, 24 aa, Mycobacterium
PTVATGPTGPPFGSGSAAATGAPV

SEQ ID NO: 1088273 - protein, 8 aa, Mycobacterium
PTVQQPNS

SEQ ID NO: 1088274 - protein, 4 aa, Mycobacterium
PTWA

SEQ ID NO: 1088275 - protein, 5 aa, Mycobacterium
PTYSQ

SEQ ID NO: 1088276 - protein, 6 aa, Mycobacterium
PTYTTQ

SEQ ID NO: 1088277 - protein, 4 aa, Mycobacterium
PVAA

SEQ ID NO: 1088278 - protein, 19 aa, Mycobacterium
PVAADTSGVVAPPSPTAPC

SEQ ID NO: 1088279 - protein, 14 aa, Mycobacterium
PVDPTDDDAPGQLT

SEQ ID NO: 1088280 - protein, 5 aa, Mycobacterium
PVDTH

SEQ ID NO: 1088281 - protein, 20 aa, Mycobacterium
PVGAYGPSGKHTGTSSADRR

SEQ ID NO: 1088282 - protein, 14 aa, Mycobacterium
PVGNQFGEAGEGVK

SEQ ID NO: 1088283 - protein, 5 aa, Mycobacterium
PVGPR

SEQ ID NO: 1088284 - protein, 13 aa, Mycobacterium
PVGSGAELRTATP

SEQ ID NO: 1088285 - protein, 11 aa, Mycobacterium
PVGTQSSSEVQ

SEQ ID NO: 1088286 - protein, 15 aa, Mycobacterium
PVPAAASATAAKGAT

SEQ ID NO: 1088287 - protein, 4 aa, Mycobacterium
PVPD

SEQ ID NO: 1088288 - protein, 18 aa, Mycobacterium
PVPGPVPTSPANNDFKPG

SEQ ID NO: 1088289 - protein, 4 aa, Mycobacterium
PVRG

SEQ ID NO: 1088290 - protein, 6 aa, Mycobacterium
PVRRGD

SEQ ID NO: 1088291 - protein, 8 aa, Mycobacterium
PVSGTQLD

SEQ ID NO: 1088292 - protein, 12 aa, Mycobacterium
PVSQDPYGLAGS

SEQ ID NO: 1088293 - protein, 6 aa, Mycobacterium
PVTGQS

SEQ ID NO: 1088294 - protein, 11 aa, Mycobacterium
PVVPEGSAGIE

SEQ ID NO: 1088295 - protein, 4 aa, Mycobacterium
PWGT

SEQ ID NO: 1088296 - protein, 6 aa, Mycobacterium
PYTKPP

SEQ ID NO: 1088297 - protein, 25 aa, Mycobacterium
QAAAAKESTDETVTDEEDRAPAPSR

SEQ ID NO: 1088298 - protein, 18 aa, Mycobacterium
QAAADPNLGKLGGRVSDA

SEQ ID NO: 1088299 - protein, 13 aa, Mycobacterium
QAAAGAGAFDPDR

SEQ ID NO: 1088300 - protein, 13 aa, Mycobacterium
QAADTLNGNGDSF

SEQ ID NO: 1088301 - protein, 12 aa, Mycobacterium
QAAQDGGALSGL

SEQ ID NO: 1088302 - protein, 7 aa, Mycobacterium
QAATAHP

SEQ ID NO: 1088303 - protein, 5 aa, Mycobacterium
QAERD

SEQ ID NO: 1088304 - protein, 9 aa, Mycobacterium
QAFQERDTQ

SEQ ID NO: 1088305 - protein, 11 aa, Mycobacterium
QAGATENDQLT

SEQ ID NO: 1088306 - protein, 10 aa, Mycobacterium
QAGGSVPGTV

SEQ ID NO: 1088307 - protein, 4 aa, Mycobacterium
QAGL

SEQ ID NO: 1088308 - protein, 5 aa, Mycobacterium
QAGTP

SEQ ID NO: 1088309 - protein, 9 aa, Mycobacterium
QALRDNTTR

SEQ ID NO: 1088310 - protein, 6 aa, Mycobacterium
QALRGS

SEQ ID NO: 1088311 - protein, 11 aa, Mycobacterium
QANPAPPVGPA

SEQ ID NO: 1088312 - protein, 8 aa, Mycobacterium
QAPEGPCE

SEQ ID NO: 1088313 - protein, 4 aa, Mycobacterium
QAPG

SEQ ID NO: 1088314 - protein, 9 aa, Mycobacterium
QAPGLGKTK

SEQ ID NO: 1088315 - protein, 48 aa, Mycobacterium
QAPGPTPGSPPGYGPAPGPPPAPAPAGPDAGLSSPAPGAPLPAEQGAG

SEQ ID NO: 1088316 - protein, 14 aa, Mycobacterium
QAPLQQTPLPQTPL

SEQ ID NO: 1088317 - protein, 6 aa, Mycobacterium
QARDRT

SEQ ID NO: 1088318 - protein, 22 aa, Mycobacterium
QARHDSALASAAAGAIGNPPQI

SEQ ID NO: 1088319 - protein, 8 aa, Mycobacterium
QARPNEVT

SEQ ID NO: 1088320 - protein, 9 aa, Mycobacterium
QARQDEAMR

SEQ ID NO: 1088321 - protein, 6 aa, Mycobacterium
QARQRL

SEQ ID NO: 1088322 - protein, 7 aa, Mycobacterium
QASAQQR

SEQ ID NO: 1088323 - protein, 12 aa, Mycobacterium
QASDDATARETI

SEQ ID NO: 1088324 - protein, 6 aa, Mycobacterium
QASDMA

SEQ ID NO: 1088325 - protein, 5 aa, Mycobacterium
QASPL

SEQ ID NO: 1088326 - protein, 15 aa, Mycobacterium
QASRPPRSGCSVVPN

SEQ ID NO: 1088327 - protein, 9 aa, Mycobacterium
QATKARAPF

SEQ ID NO: 1088328 - protein, 8 aa, Mycobacterium
QAVSAGQR

SEQ ID NO: 1088329 - protein, 6 aa, Mycobacterium
QAYQTI

SEQ ID NO: 1088330 - protein, 9 aa, Mycobacterium
QCESETSGV

SEQ ID NO: 1088331 - protein, 8 aa, Mycobacterium
QCGEPNDY

SEQ ID NO: 1088332 - protein, 7 aa, Mycobacterium
QDAGAPV

SEQ ID NO: 1088333 - protein, 18 aa, Mycobacterium
QDPDGSTRTVQVTLGKAE

SEQ ID NO: 1088334 - protein, 4 aa, Mycobacterium
QDPM

SEQ ID NO: 1088335 - protein, 5 aa, Mycobacterium
QDRGE

SEQ ID NO: 1088336 - protein, 5 aa, Mycobacterium
QDRNL

SEQ ID NO: 1088337 - protein, 7 aa, Mycobacterium
QDSGTFT

SEQ ID NO: 1088338 - protein, 6 aa, Mycobacterium
QDTVRQ

SEQ ID NO: 1088339 - protein, 5 aa, Mycobacterium
QDVAN

SEQ ID NO: 1088340 - protein, 8 aa, Mycobacterium
QDYPDQQA

SEQ ID NO: 1088341 - protein, 12 aa, Mycobacterium
QEAFSPANLPTT

SEQ ID NO: 1088342 - protein, 5 aa, Mycobacterium
QEDPR

SEQ ID NO: 1088343 - protein, 5 aa, Mycobacterium
QEGAR

SEQ ID NO: 1088344 - protein, 19 aa, Mycobacterium
QEGYQDNSSPYDPEQAKRE

SEQ ID NO: 1088345 - protein, 6 aa, Mycobacterium
QEISPS

SEQ ID NO: 1088346 - protein, 12 aa, Mycobacterium
QEPAAGSTPPGP

SEQ ID NO: 1088347 - protein, 9 aa, Mycobacterium
QESSGTTDN

SEQ ID NO: 1088348 - protein, 6 aa, Mycobacterium
QGAAET

SEQ ID NO: 1088349 - protein, 13 aa, Mycobacterium
QGADIQDRVNNRD

SEQ ID NO: 1088350 - protein, 11 aa, Mycobacterium
QGALNSPKSVV

SEQ ID NO: 1088351 - protein, 8 aa, Mycobacterium
QGDGGDAG

SEQ ID NO: 1088352 - protein, 5 aa, Mycobacterium
QGETP

SEQ ID NO: 1088353 - protein, 9 aa, Mycobacterium
QGGAGGANG

SEQ ID NO: 1088354 - protein, 24 aa, Mycobacterium
QGGAGGIGGAASTGMAGAGGSGGS

SEQ ID NO: 1088355 - protein, 10 aa, Mycobacterium
QGGAIDPEAT

SEQ ID NO: 1088356 - protein, 5 aa, Mycobacterium
QGGGA

SEQ ID NO: 1088357 - protein, 11 aa, Mycobacterium
QGGGAAASAAE

SEQ ID NO: 1088358 - protein, 7 aa, Mycobacterium
QGGSPQL

SEQ ID NO: 1088359 - protein, 8 aa, Mycobacterium
QGGYSQGA

SEQ ID NO: 1088360 - protein, 7 aa, Mycobacterium
QGNGGTI

SEQ ID NO: 1088361 - protein, 7 aa, Mycobacterium
QGNGSSI

SEQ ID NO: 1088362 - protein, 7 aa, Mycobacterium
QGNSDSI

SEQ ID NO: 1088363 - protein, 7 aa, Mycobacterium
QGPQSYR

SEQ ID NO: 1088364 - protein, 4 aa, Mycobacterium
QGQG

SEQ ID NO: 1088365 - protein, 9 aa, Mycobacterium
QGRTTGNSC

SEQ ID NO: 1088366 - protein, 10 aa, Mycobacterium
QGSAGPQSFG

SEQ ID NO: 1088367 - protein, 10 aa, Mycobacterium
QGSESGGHGM

SEQ ID NO: 1088368 - protein, 5 aa, Mycobacterium
QGTEF

SEQ ID NO: 1088369 - protein, 10 aa, Mycobacterium
QGVSGSGAGG

SEQ ID NO: 1088370 - protein, 18 aa, Mycobacterium
QHSSSGGARNGAAGGDGP

SEQ ID NO: 1088371 - protein, 4 aa, Mycobacterium
QIGS

SEQ ID NO: 1088372 - protein, 5 aa, Mycobacterium
QINDG

SEQ ID NO: 1088373 - protein, 8 aa, Mycobacterium
QISSGTSL

SEQ ID NO: 1088374 - protein, 11 aa, Mycobacterium
QKEDAAAQRGA

SEQ ID NO: 1088375 - protein, 16 aa, Mycobacterium
QKESSQRTEIAWPVLF

SEQ ID NO: 1088376 - protein, 7 aa, Mycobacterium
QLGGSRR

SEQ ID NO: 1088377 - protein, 9 aa, Mycobacterium
QLPGGPDRI

SEQ ID NO: 1088378 - protein, 22 aa, Mycobacterium
QLPTYADSTPAGSVSSSGPKRV

SEQ ID NO: 1088379 - protein, 6 aa, Mycobacterium
QMTSPN

SEQ ID NO: 1088380 - protein, 6 aa, Mycobacterium
QNEKNS

SEQ ID NO: 1088381 - protein, 45 aa, Mycobacterium; identical to SEQ ID NO: 913543

SEQ ID NO: 1088382 - protein, 9 aa, Mycobacterium
QNGGANSPA

SEQ ID NO: 1088383 - protein, 5 aa, Mycobacterium
QNSGF

SEQ ID NO: 1088384 - protein, 7 aa, Mycobacterium
QNTPAIE

SEQ ID NO: 1088385 - protein, 9 aa, Mycobacterium
QPATEQPRI

SEQ ID NO: 1088386 - protein, 6 aa, Mycobacterium
QPATQI

SEQ ID NO: 1088387 - protein, 5 aa, Mycobacterium
QPDLR

SEQ ID NO: 1088388 - protein, 5 aa, Mycobacterium
QPGGL

SEQ ID NO: 1088389 - protein, 5 aa, Mycobacterium
QPGIR

SEQ ID NO: 1088390 - protein, 6 aa, Mycobacterium
QPNELP

SEQ ID NO: 1088391 - protein, 9 aa, Mycobacterium
QPPAQDPRA

SEQ ID NO: 1088392 - protein, 6 aa, Mycobacterium
QPPITD

SEQ ID NO: 1088393 - protein, 12 aa, Mycobacterium
QPQRASAMPASA

SEQ ID NO: 1088394 - protein, 22 aa, Mycobacterium
QPQYTSPEPGAAAAISSYRADN

SEQ ID NO: 1088395 - protein, 10 aa, Mycobacterium
QPSATALSDK

SEQ ID NO: 1088396 - protein, 11 aa, Mycobacterium
QPSQGNGQGYT

SEQ ID NO: 1088397 - protein, 29 aa, Mycobacterium
QPTPAATTGSGPLTTRGSVSQSVPAGCGD

SEQ ID NO: 1088398 - protein, 14 aa, Mycobacterium
QPTTIGQAPPTTAL

SEQ ID NO: 1088399 - protein, 19 aa, Mycobacterium
QPVSQPVAEPAEGSPYGGY

SEQ ID NO: 1088400 - protein, 4 aa, Mycobacterium
QPVT

SEQ ID NO: 1088401 - protein, 4 aa, Mycobacterium
QPYG

SEQ ID NO: 1088402 - protein, 13 aa, Mycobacterium
QQAKNLSGARNAS

SEQ ID NO: 1088403 - protein, 4 aa, Mycobacterium
QQRF

SEQ ID NO: 1088404 - protein, 10 aa, Mycobacterium
QQRSGEKFIK

SEQ ID NO: 1088405 - protein, 26 aa, Mycobacterium
QQSEQRFAGSGNPDSTTAAVDATTSG

SEQ ID NO: 1088406 - protein, 5 aa, Mycobacterium
QQTAR

SEQ ID NO: 1088407 - protein, 11 aa, Mycobacterium
QQVPTGPGSVA

SEQ ID NO: 1088408 - protein, 13 aa, Mycobacterium
QRATEEAAAKGAT

SEQ ID NO: 1088409 - protein, 9 aa, Mycobacterium
QRDGQVDEV

SEQ ID NO: 1088410 - protein, 10 aa, Mycobacterium
QRDPAQQRYP

SEQ ID NO: 1088411 - protein, 9 aa, Mycobacterium
QRERPGDSV

SEQ ID NO: 1088412 - protein, 5 aa, Mycobacterium
QRGFQ

SEQ ID NO: 1088413 - protein, 5 aa, Mycobacterium
QRPYP

SEQ ID NO: 1088414 - protein, 9 aa, Mycobacterium
QRSPDRDLT

SEQ ID NO: 1088415 - protein, 37 aa, Mycobacterium
QRTEEKPRKSSPIQRRCGQSDQLRQQGECRRVGDQPV

SEQ ID NO: 1088416 - protein, 5 aa, Mycobacterium
QRTEP

SEQ ID NO: 1088417 - protein, 6 aa, Mycobacterium
QRYRRT

SEQ ID NO: 1088418 - protein, 4 aa, Mycobacterium
QSED

SEQ ID NO: 1088419 - protein, 6 aa, Mycobacterium
QSGADS

SEQ ID NO: 1088420 - protein, 9 aa, Mycobacterium
QSGGANSPA

SEQ ID NO: 1088421 - protein, 8 aa, Mycobacterium
QSGGLLPN

SEQ ID NO: 1088422 - protein, 7 aa, Mycobacterium
QSGRSIS

SEQ ID NO: 1088423 - protein, 12 aa, Mycobacterium
QSHPEGALEGQG

SEQ ID NO: 1088424 - protein, 9 aa, Mycobacterium
QSIGQSTQQ

SEQ ID NO: 1088425 - protein, 9 aa, Mycobacterium
QSLSAQATS

SEQ ID NO: 1088426 - protein, 8 aa, Mycobacterium
QSNADEDK

SEQ ID NO: 1088427 - protein, 4 aa, Mycobacterium
QSNE

SEQ ID NO: 1088428 - protein, 6 aa, Mycobacterium
QSPDLS

SEQ ID NO: 1088429 - protein, 7 aa, Mycobacterium
QSPHGDL

SEQ ID NO: 1088430 - protein, 4 aa, Mycobacterium
QSPP

SEQ ID NO: 1088431 - protein, 5 aa, Mycobacterium
QSPWR

SEQ ID NO: 1088432 - protein, 16 aa, Mycobacterium
QSQSSVNRLSAERDAL

SEQ ID NO: 1088433 - protein, 7 aa, Mycobacterium
QSRSGSG

SEQ ID NO: 1088434 - protein, 9 aa, Mycobacterium
QSSNGGPAV

SEQ ID NO: 1088435 - protein, 8 aa, Mycobacterium
QSTARRGV

SEQ ID NO: 1088436 - protein, 7 aa, Mycobacterium
QSTPNSI

SEQ ID NO: 1088437 - protein, 9 aa, Mycobacterium
QTADPRSNL

SEQ ID NO: 1088438 - protein, 13 aa, Mycobacterium
QTAGSNDYSPLES

SEQ ID NO: 1088439 - protein, 6 aa, Mycobacterium
QTAQTV

SEQ ID NO: 1088440 - protein, 4 aa, Mycobacterium
QTAS

SEQ ID NO: 1088441 - protein, 17 aa, Mycobacterium
QTDAEKRAAVETTPARK

SEQ ID NO: 1088442 - protein, 9 aa, Mycobacterium
QTKTGSTSD

SEQ ID NO: 1088443 - protein, 10 aa, Mycobacterium
QTLSDQSDNI

SEQ ID NO: 1088444 - protein, 4 aa, Mycobacterium
QTPE

SEQ ID NO: 1088445 - protein, 10 aa, Mycobacterium
QTTPSAVHPG

SEQ ID NO: 1088446 - protein, 11 aa, Mycobacterium
QVAQQKGAIPG

SEQ ID NO: 1088447 - protein, 6 aa, Mycobacterium
QVGNPA

SEQ ID NO: 1088448 - protein, 13 aa, Mycobacterium
QVGYDQDDVLHHI

SEQ ID NO: 1088449 - protein, 29 aa, Mycobacterium
QVPPTQETTPARGTPSGPCERPKASPATR

SEQ ID NO: 1088450 - protein, 41 aa, Mycobacterium; identical to SEQ ID NO: 914092

SEQ ID NO: 1088451 - protein, 9 aa, Mycobacterium
QWKQASQQL

SEQ ID NO: 1088452 - protein, 6 aa, Mycobacterium
QWPSTG

SEQ ID NO: 1088453 - protein, 27 aa, Mycobacterium
QWSHPEPTALAGVPGSRRQWERDPHDS

SEQ ID NO: 1088454 - protein, 4 aa, Mycobacterium
QYDE

SEQ ID NO: 1088455 - protein, 6 aa, Mycobacterium
QYRSGD

SEQ ID NO: 1088456 - protein, 5 aa, Mycobacterium
RAADT

SEQ ID NO: 1088457 - protein, 4 aa, Mycobacterium
RAAH

SEQ ID NO: 1088458 - protein, 8 aa, Mycobacterium
RAANPEAP

SEQ ID NO: 1088459 - protein, 11 aa, Mycobacterium
RAAQSDFEPLT

SEQ ID NO: 1088460 - protein, 4 aa, Mycobacterium
RAAS

SEQ ID NO: 1088461 - protein, 4 aa, Mycobacterium
RAAV

SEQ ID NO: 1088462 - protein, 6 aa, Mycobacterium
RADAVT

SEQ ID NO: 1088463 - protein, 4 aa, Mycobacterium
RADP

SEQ ID NO: 1088464 - protein, 5 aa, Mycobacterium
RADRL

SEQ ID NO: 1088465 - protein, 8 aa, Mycobacterium
RAETGPDT

SEQ ID NO: 1088466 - protein, 7 aa, Mycobacterium
RAGADSV

SEQ ID NO: 1088467 - protein, 5 aa, Mycobacterium
RAGDD

SEQ ID NO: 1088468 - protein, 6 aa, Mycobacterium
RAGPPE

SEQ ID NO: 1088469 - protein, 10 aa, Mycobacterium
RALDPSAGKP

SEQ ID NO: 1088470 - protein, 6 aa, Mycobacterium
RANQRL

SEQ ID NO: 1088471 - protein, 12 aa, Mycobacterium
RANTDGRDARRR

SEQ ID NO: 1088472 - protein, 4 aa, Mycobacterium
RAPA

SEQ ID NO: 1088473 - protein, 6 aa, Mycobacterium
RAPAPS

SEQ ID NO: 1088474 - protein, 4 aa, Mycobacterium
RAPL

SEQ ID NO: 1088475 - protein, 6 aa, Mycobacterium
RAPRTR

SEQ ID NO: 1088476 - protein, 9 aa, Mycobacterium
RARDRGKSV

SEQ ID NO: 1088477 - protein, 6 aa, Mycobacterium
RARMSG

SEQ ID NO: 1088478 - protein, 4 aa, Mycobacterium
RARN

SEQ ID NO: 1088479 - protein, 6 aa, Mycobacterium
RARQGV

SEQ ID NO: 1088480 - protein, 18 aa, Mycobacterium
RASGGAGSAAGASREEQI

SEQ ID NO: 1088481 - protein, 9 aa, Mycobacterium
RASGPDSGR

SEQ ID NO: 1088482 - protein, 9 aa, Mycobacterium
RASTARHAE

SEQ ID NO: 1088483 - protein, 15 aa, Mycobacterium
RATGTGISARDRART

SEQ ID NO: 1088484 - protein, 12 aa, Mycobacterium
RAVEASGDDTIR

SEQ ID NO: 1088485 - protein, 7 aa, Mycobacterium
RCSPSDL

SEQ ID NO: 1088486 - protein, 4 aa, Mycobacterium
RDAG

SEQ ID NO: 1088487 - protein, 8 aa, Mycobacterium
RDDAPAEL

SEQ ID NO: 1088488 - protein, 7 aa, Mycobacterium
RDDMGPE

SEQ ID NO: 1088489 - protein, 11 aa, Mycobacterium
RDEHDDATPDV

SEQ ID NO: 1088490 - protein, 8 aa, Mycobacterium
RDGEWTTN

SEQ ID NO: 1088491 - protein, 5 aa, Mycobacterium
RDGLA

SEQ ID NO: 1088492 - protein, 6 aa, Mycobacterium
RDGTAD

SEQ ID NO: 1088493 - protein, 9 aa, Mycobacterium
RDGTNGGPL

SEQ ID NO: 1088494 - protein, 7 aa, Mycobacterium
RDHGPNV

SEQ ID NO: 1088495 - protein, 7 aa, Mycobacterium
RDHGPTV

SEQ ID NO: 1088496 - protein, 7 aa, Mycobacterium
RDLESSD

SEQ ID NO: 1088497 - protein, 11 aa, Mycobacterium
RDNTDQFNTRN

SEQ ID NO: 1088498 - protein, 15 aa, Mycobacterium
RDPRTTLADTVAALT

SEQ ID NO: 1088499 - protein, 6 aa, Mycobacterium
RDPSAL

SEQ ID NO: 1088500 - protein, 9 aa, Mycobacterium
RDQCAQDPD

SEQ ID NO: 1088501 - protein, 20 aa, Mycobacterium
RDQGCPEPKPLSGELIREML

SEQ ID NO: 1088502 - protein, 7 aa, Mycobacterium
RDRPGLG

SEQ ID NO: 1088503 - protein, 11 aa, Mycobacterium
RDTNTGFGNSG

SEQ ID NO: 1088504 - protein, 7 aa, Mycobacterium
RDYADVP

SEQ ID NO: 1088505 - protein, 9 aa, Mycobacterium
RDYQRTGAY

SEQ ID NO: 1088506 - protein, 4 aa, Mycobacterium
REAA

SEQ ID NO: 1088507 - protein, 15 aa, Mycobacterium
REALGTTSDKLAGVS

SEQ ID NO: 1088508 - protein, 11 aa, Mycobacterium
REDPDGDSEPI

SEQ ID NO: 1088509 - protein, 10 aa, Mycobacterium
REEAKSDVNV

SEQ ID NO: 1088510 - protein, 5 aa, Mycobacterium
REEDL

SEQ ID NO: 1088511 - protein, 7 aa, Mycobacterium
REEMKDP

SEQ ID NO: 1088512 - protein, 7 aa, Mycobacterium
REGGHSR

SEQ ID NO: 1088513 - protein, 9 aa, Mycobacterium
RELAEETGL

SEQ ID NO: 1088514 - protein, 8 aa, Mycobacterium
REPRSGIR

SEQ ID NO: 1088515 - protein, 21 aa, Mycobacterium
RERTAHGTPSGVDAAATGADE

SEQ ID NO: 1088516 - protein, 24 aa, Mycobacterium
RETGPSTDRAHQDTSDLGLSETGP

SEQ ID NO: 1088517 - protein, 6 aa, Mycobacterium
REYPDD

SEQ ID NO: 1088518 - protein, 7 aa, Mycobacterium
REYPSDQ

SEQ ID NO: 1088519 - protein, 12 aa, Mycobacterium
RFEPSLDGRTEL

SEQ ID NO: 1088520 - protein, 4 aa, Mycobacterium
RFEQ

SEQ ID NO: 1088521 - protein, 7 aa, Mycobacterium
RFSGEQQ

SEQ ID NO: 1088522 - protein, 60 aa, Mycobacterium
RGAGAALAADSARAAGTASATVAGLGSAETPGPAVTTGSSGSTGVTGQTRRRAAGTRGAF

SEQ ID NO: 1088523 - protein, 15 aa, Mycobacterium
RGAGSGLSGGATALD

SEQ ID NO: 1088524 - protein, 18 aa, Mycobacterium
RGAPGPAPPPILRGRRCR

SEQ ID NO: 1088525 - protein, 6 aa, Mycobacterium
RGARPY

SEQ ID NO: 1088526 - protein, 4 aa, Mycobacterium
RGDA

SEQ ID NO: 1088527 - protein, 13 aa, Mycobacterium
RGGAYSAAKGGLA

SEQ ID NO: 1088528 - protein, 6 aa, Mycobacterium
RGGGAT

SEQ ID NO: 1088529 - protein, 4 aa, Mycobacterium
RGGY

SEQ ID NO: 1088530 - protein, 19 aa, Mycobacterium
RGHGRSTLGAEGIGSEPMA

SEQ ID NO: 1088531 - protein, 9 aa, Mycobacterium
RGKSGPATI

SEQ ID NO: 1088532 - protein, 4 aa, Mycobacterium
RGNL

SEQ ID NO: 1088533 - protein, 12 aa, Mycobacterium
RGPASESMAASA

SEQ ID NO: 1088534 - protein, 16 aa, Mycobacterium
RGPDEPGTWADPDADG

SEQ ID NO: 1088535 - protein, 33 aa, Mycobacterium
RGPGPNPQPGHAGPGGPGEPAPGQQGPGGPGGP

SEQ ID NO: 1088536 - protein, 6 aa, Mycobacterium
RGPKVR

SEQ ID NO: 1088537 - protein, 9 aa, Mycobacterium
RGPRGALAS

SEQ ID NO: 1088538 - protein, 9 aa, Mycobacterium
RGQPRDDIR

SEQ ID NO: 1088539 - protein, 8 aa, Mycobacterium
RGQTPAKP

SEQ ID NO: 1088540 - protein, 9 aa, Mycobacterium
RGRPSPAHD

SEQ ID NO: 1088541 - protein, 4 aa, Mycobacterium
RGSG

SEQ ID NO: 1088542 - protein, 4 aa, Mycobacterium
RGTE

SEQ ID NO: 1088543 - protein, 6 aa, Mycobacterium
RGTGKC

SEQ ID NO: 1088544 - protein, 10 aa, Mycobacterium
RGTSEPPGIG

SEQ ID NO: 1088545 - protein, 10 aa, Mycobacterium
RGVDGDAYKS

SEQ ID NO: 1088546 - protein, 14 aa, Mycobacterium
RHADQHSATPSLPQ

SEQ ID NO: 1088547 - protein, 5 aa, Mycobacterium
RHAER

SEQ ID NO: 1088548 - protein, 4 aa, Mycobacterium
RHDT

SEQ ID NO: 1088549 - protein, 16 aa, Mycobacterium
RHPAKTVTTGAAETAV

SEQ ID NO: 1088550 - protein, 6 aa, Mycobacterium
RHPPQA

SEQ ID NO: 1088551 - protein, 5 aa, Mycobacterium
RIEGA

SEQ ID NO: 1088552 - protein, 11 aa, Mycobacterium
RIQPDKLDRDA

SEQ ID NO: 1088553 - protein, 13 aa, Mycobacterium
RISETDTPSPPPP

SEQ ID NO: 1088554 - protein, 13 aa, Mycobacterium
RISETDTPSPPPT

SEQ ID NO: 1088555 - protein, 4 aa, Mycobacterium
RKAV

SEQ ID NO: 1088556 - protein, 7 aa, Mycobacterium
RKPAELD

SEQ ID NO: 1088557 - protein, 33 aa, Mycobacterium; identical to SEQ ID NO: 914973

SEQ ID NO: 1088558 - protein, 6 aa, Mycobacterium
RKVGGV

SEQ ID NO: 1088559 - protein, 5 aa, Mycobacterium
RLASN

SEQ ID NO: 1088560 - protein, 14 aa, Mycobacterium
RLDEADSAVQDAAG

SEQ ID NO: 1088561 - protein, 5 aa, Mycobacterium
RLGAH

SEQ ID NO: 1088562 - protein, 6 aa, Mycobacterium
RLGYEQ

SEQ ID NO: 1088563 - protein, 38 aa, Mycobacterium; identical to SEQ ID NO: 915008

SEQ ID NO: 1088564 - protein, 22 aa, Mycobacterium
RLPASAARQRDRRGRRYGVFGG

SEQ ID NO: 1088565 - protein, 8 aa, Mycobacterium
RLPDPPPP

SEQ ID NO: 1088566 - protein, 8 aa, Mycobacterium
RLSPGVDT

SEQ ID NO: 1088567 - protein, 8 aa, Mycobacterium
RLSQRGSE

SEQ ID NO: 1088568 - protein, 10 aa, Mycobacterium
RLTDGQGRTV

SEQ ID NO: 1088569 - protein, 6 aa, Mycobacterium
RMEEET

SEQ ID NO: 1088570 - protein, 16 aa, Mycobacterium
RMGPASASMAAAAAPY

SEQ ID NO: 1088571 - protein, 16 aa, Mycobacterium
RMPPSRQPHRAADHVG

SEQ ID NO: 1088572 - protein, 31 aa, Mycobacterium; identical to SEQ ID NO: 281568

SEQ ID NO: 1088573 - protein, 6 aa, Mycobacterium
RNEKRD

SEQ ID NO: 1088574 - protein, 6 aa, Mycobacterium
RNGNEV

SEQ ID NO: 1088575 - protein, 13 aa, Mycobacterium
RNPEHNFSASSLM

SEQ ID NO: 1088576 - protein, 20 aa, Mycobacterium
RNPIGNGPYRLDSGGEEPAW

SEQ ID NO: 1088577 - protein, 6 aa, Mycobacterium
RNPTRW

SEQ ID NO: 1088578 - protein, 5 aa, Mycobacterium
RNRGE

SEQ ID NO: 1088579 - protein, 5 aa, Mycobacterium
RNVTR

SEQ ID NO: 1088580 - protein, 8 aa, Mycobacterium
RPAAPNGP

SEQ ID NO: 1088581 - protein, 4 aa, Mycobacterium
RPAG

SEQ ID NO: 1088582 - protein, 7 aa, Mycobacterium
RPATKEL

SEQ ID NO: 1088583 - protein, 8 aa, Mycobacterium
RPEATSAT

SEQ ID NO: 1088584 - protein, 4 aa, Mycobacterium
RPEL

SEQ ID NO: 1088585 - protein, 4 aa, Mycobacterium
RPEP

SEQ ID NO: 1088586 - protein, 7 aa, Mycobacterium
RPGAQYT

SEQ ID NO: 1088587 - protein, 7 aa, Mycobacterium
RPGSGRE

SEQ ID NO: 1088588 - protein, 7 aa, Mycobacterium
RPGTYNQ

SEQ ID NO: 1088589 - protein, 9 aa, Mycobacterium
RPHSQPGTR

SEQ ID NO: 1088590 - protein, 7 aa, Mycobacterium
RPIGSSS

SEQ ID NO: 1088591 - protein, 19 aa, Mycobacterium
RPKRKTRTRTARTQPKEDP

SEQ ID NO: 1088592 - protein, 9 aa, Mycobacterium
RPPAGSPTQ

SEQ ID NO: 1088593 - protein, 5 aa, Mycobacterium
RPPAQ

SEQ ID NO: 1088594 - protein, 7 aa, Mycobacterium
RPPDAAS

SEQ ID NO: 1088595 - protein, 6 aa, Mycobacterium
RPPPDA

SEQ ID NO: 1088596 - protein, 16 aa, Mycobacterium
RPPPSTHEQPSAQDTR

SEQ ID NO: 1088597 - protein, 5 aa, Mycobacterium
RPPSM

SEQ ID NO: 1088598 - protein, 18 aa, Mycobacterium
RPQAQAHSDDGDIGRRTS

SEQ ID NO: 1088599 - protein, 4 aa, Mycobacterium
RPRQ

SEQ ID NO: 1088600 - protein, 4 aa, Mycobacterium
RPRR

SEQ ID NO: 1088601 - protein, 6 aa, Mycobacterium
RPSAQL

SEQ ID NO: 1088602 - protein, 26 aa, Mycobacterium
RPTAAHAEAGQQRIPAGTGVLQNRSL

SEQ ID NO: 1088603 - protein, 7 aa, Mycobacterium
RPVSPAP

SEQ ID NO: 1088604 - protein, 14 aa, Mycobacterium
RPVSTTGESGNQNT

SEQ ID NO: 1088605 - protein, 21 aa, Mycobacterium
RQASAAAAAPTAAVQPAGGDV

SEQ ID NO: 1088606 - protein, 4 aa, Mycobacterium
RQDQ

SEQ ID NO: 1088607 - protein, 12 aa, Mycobacterium
RQDRTGADPTPS

SEQ ID NO: 1088608 - protein, 19 aa, Mycobacterium
RQENLAAAENAEQTVGSTQ

SEQ ID NO: 1088609 - protein, 9 aa, Mycobacterium
RQKTDQSIG

SEQ ID NO: 1088610 - protein, 6 aa, Mycobacterium
RQPRGD

SEQ ID NO: 1088611 - protein, 8 aa, Mycobacterium
RQQASTEW

SEQ ID NO: 1088612 - protein, 7 aa, Mycobacterium
RQQTGKN

SEQ ID NO: 1088613 - protein, 16 aa, Mycobacterium
RQSASSRGRTLTAPRS

SEQ ID NO: 1088614 - protein, 4 aa, Mycobacterium
RRDF

SEQ ID NO: 1088615 - protein, 4 aa, Mycobacterium
RRDP

SEQ ID NO: 1088616 - protein, 6 aa, Mycobacterium
RRGGSL

SEQ ID NO: 1088617 - protein, 4 aa, Mycobacterium
RRHS

SEQ ID NO: 1088618 - protein, 9 aa, Mycobacterium
RRLGETAAE

SEQ ID NO: 1088619 - protein, 11 aa, Mycobacterium
RRNDAGRDGVR

SEQ ID NO: 1088620 - protein, 16 aa, Mycobacterium
RRPADAVPHDQPGRGL

SEQ ID NO: 1088621 - protein, 5 aa, Mycobacterium
RRPGT

SEQ ID NO: 1088622 - protein, 10 aa, Mycobacterium
RRPKLYGTGA

SEQ ID NO: 1088623 - protein, 4 aa, Mycobacterium
RRPP

SEQ ID NO: 1088624 - protein, 7 aa, Mycobacterium
RRPPVGL

SEQ ID NO: 1088625 - protein, 4 aa, Mycobacterium
RRPQ

SEQ ID NO: 1088626 - protein, 12 aa, Mycobacterium
RRPTGATALSAD

SEQ ID NO: 1088627 - protein, 11 aa, Mycobacterium
RRQVEERREGL

SEQ ID NO: 1088628 - protein, 4 aa, Mycobacterium
RRRA

SEQ ID NO: 1088629 - protein, 6 aa, Mycobacterium
RRRDDE

SEQ ID NO: 1088630 - protein, 10 aa, Mycobacterium
RRRSKPSEDI

SEQ ID NO: 1088631 - protein, 7 aa, Mycobacterium
RRTKNNP

SEQ ID NO: 1088632 - protein, 5 aa, Mycobacterium
RRTRR

SEQ ID NO: 1088633 - protein, 6 aa, Mycobacterium
RRTSSV

SEQ ID NO: 1088634 - protein, 6 aa, Mycobacterium
RSAADA

SEQ ID NO: 1088635 - protein, 4 aa, Mycobacterium
RSAE

SEQ ID NO: 1088636 - protein, 8 aa, Mycobacterium
RSAGRRRV

SEQ ID NO: 1088637 - protein, 6 aa, Mycobacterium
RSAKPI

SEQ ID NO: 1088638 - protein, 7 aa, Mycobacterium
RSAQTSS

SEQ ID NO: 1088639 - protein, 11 aa, Mycobacterium
RSASRARGTWR

SEQ ID NO: 1088640 - protein, 8 aa, Mycobacterium
RSASRRAL

SEQ ID NO: 1088641 - protein, 5 aa, Mycobacterium
RSATG

SEQ ID NO: 1088642 - protein, 17 aa, Mycobacterium
RSDRCRQTRGGGEVVDG

SEQ ID NO: 1088643 - protein, 6 aa, Mycobacterium
RSDTEL

SEQ ID NO: 1088644 - protein, 7 aa, Mycobacterium
RSDVSPI

SEQ ID NO: 1088645 - protein, 13 aa, Mycobacterium
RSERAVDRKLGAS

SEQ ID NO: 1088646 - protein, 12 aa, Mycobacterium
RSFGSNPETVTE

SEQ ID NO: 1088647 - protein, 4 aa, Mycobacterium
RSGA

SEQ ID NO: 1088648 - protein, 17 aa, Mycobacterium
RSGRRRRRYRGRWRQRW

SEQ ID NO: 1088649 - protein, 10 aa, Mycobacterium
RSGRTGAAWQ

SEQ ID NO: 1088650 - protein, 10 aa, Mycobacterium
RSGSTTVSTR

SEQ ID NO: 1088651 - protein, 4 aa, Mycobacterium
RSHP

SEQ ID NO: 1088652 - protein, 12 aa, Mycobacterium
RSITTTATSYPA

SEQ ID NO: 1088653 - protein, 12 aa, Mycobacterium
RSKGPAAARNTG

SEQ ID NO: 1088654 - protein, 10 aa, Mycobacterium
RSPATSSGRE

SEQ ID NO: 1088655 - protein, 7 aa, Mycobacterium
RSPDGAV

SEQ ID NO: 1088656 - protein, 6 aa, Mycobacterium
RSPHPV

SEQ ID NO: 1088657 - protein, 6 aa, Mycobacterium
RSPPAV

SEQ ID NO: 1088658 - protein, 28 aa, Mycobacterium
RSQASRPKTRVIGPDDDPEFLRKLGQGG

SEQ ID NO: 1088659 - protein, 8 aa, Mycobacterium
RSQDSSVE

SEQ ID NO: 1088660 - protein, 10 aa, Mycobacterium
RSQGERADDR

SEQ ID NO: 1088661 - protein, 4 aa, Mycobacterium
RSQV

SEQ ID NO: 1088662 - protein, 9 aa, Mycobacterium
RSRAPGTEI

SEQ ID NO: 1088663 - protein, 10 aa, Mycobacterium
RSSNPNVKIP

SEQ ID NO: 1088664 - protein, 5 aa, Mycobacterium
RSTGD

SEQ ID NO: 1088665 - protein, 9 aa, Mycobacterium
RSTTGAKRI

SEQ ID NO: 1088666 - protein, 15 aa, Mycobacterium
RSTVEANARGGDSRD

SEQ ID NO: 1088667 - protein, 12 aa, Mycobacterium
RTAPTPQGPWSP

SEQ ID NO: 1088668 - protein, 9 aa, Mycobacterium
RTDEVDATH

SEQ ID NO: 1088669 - protein, 6 aa, Mycobacterium
RTDEVG

SEQ ID NO: 1088670 - protein, 5 aa, Mycobacterium
RTEPS

SEQ ID NO: 1088671 - protein, 4 aa, Mycobacterium
RTGA

SEQ ID NO: 1088672 - protein, 4 aa, Mycobacterium
RTKG

SEQ ID NO: 1088673 - protein, 11 aa, Mycobacterium
RTPEQAGTFGN

SEQ ID NO: 1088674 - protein, 10 aa, Mycobacterium
RTPPPPPDAK

SEQ ID NO: 1088675 - protein, 7 aa, Mycobacterium
RTPTADR

SEQ ID NO: 1088676 - protein, 16 aa, Mycobacterium
RTQHGVEPQQPTRRGD

SEQ ID NO: 1088677 - protein, 8 aa, Mycobacterium
RVAGTAPD

SEQ ID NO: 1088678 - protein, 6 aa, Mycobacterium
RVDAAG

SEQ ID NO: 1088679 - protein, 12 aa, Mycobacterium
RVGHPGGPQQRV

SEQ ID NO: 1088680 - protein, 5 aa, Mycobacterium
RVGQS

SEQ ID NO: 1088681 - protein, 16 aa, Mycobacterium
RVQPTTVNSRRSLTPA

SEQ ID NO: 1088682 - protein, 4 aa, Mycobacterium
RWSA

SEQ ID NO: 1088683 - protein, 7 aa, Mycobacterium
RWSPTGK

SEQ ID NO: 1088684 - protein, 8 aa, Mycobacterium
RYDSGQRC

SEQ ID NO: 1088685 - protein, 6 aa, Mycobacterium
RYEPRA

SEQ ID NO: 1088686 - protein, 7 aa, Mycobacterium
RYPLDRG

SEQ ID NO: 1088687 - protein, 16 aa, Mycobacterium
RYPQTGRDISGTTGEL

SEQ ID NO: 1088688 - protein, 4 aa, Mycobacterium
SAAA

SEQ ID NO: 1088689 - protein, 6 aa, Mycobacterium
SAANDL

SEQ ID NO: 1088690 - protein, 7 aa, Mycobacterium
SAATGPL

SEQ ID NO: 1088691 - protein, 8 aa, Mycobacterium
SACSGAAL

SEQ ID NO: 1088692 - protein, 9 aa, Mycobacterium
SADDSDTVR

SEQ ID NO: 1088693 - protein, 6 aa, Mycobacterium
SADGNA

SEQ ID NO: 1088694 - protein, 6 aa, Mycobacterium
SADPAE

SEQ ID NO: 1088695 - protein, 4 aa, Mycobacterium
SADS

SEQ ID NO: 1088696 - protein, 10 aa, Mycobacterium
SAEATNPKAA

SEQ ID NO: 1088697 - protein, 7 aa, Mycobacterium
SAEGIDG

SEQ ID NO: 1088698 - protein, 11 aa, Mycobacterium
SAGAEGPPPGA

SEQ ID NO: 1088699 - protein, 8 aa, Mycobacterium
SAGDTGIR

SEQ ID NO: 1088700 - protein, 5 aa, Mycobacterium
SAGGH

SEQ ID NO: 1088701 - protein, 8 aa, Mycobacterium
SAGGLTKP

SEQ ID NO: 1088702 - protein, 9 aa, Mycobacterium
SAGKYGRKH

SEQ ID NO: 1088703 - protein, 9 aa, Mycobacterium
SAGLDPKNY

SEQ ID NO: 1088704 - protein, 8 aa, Mycobacterium
SAGNEYLG

SEQ ID NO: 1088705 - protein, 8 aa, Mycobacterium
SAGPEPVT

SEQ ID NO: 1088706 - protein, 6 aa, Mycobacterium
SAGSVN

SEQ ID NO: 1088707 - protein, 11 aa, Mycobacterium
SAGTGLREGSA

SEQ ID NO: 1088708 - protein, 12 aa, Mycobacterium
SAGVGNAASIGS

SEQ ID NO: 1088709 - protein, 13 aa, Mycobacterium
SAHPSFPEGEPNK

SEQ ID NO: 1088710 - protein, 9 aa, Mycobacterium
SAIAANEAQ

SEQ ID NO: 1088711 - protein, 15 aa, Mycobacterium
SAIKPSEKKTTPAPH

SEQ ID NO: 1088712 - protein, 15 aa, Mycobacterium
SAKADMANTASSMAT

SEQ ID NO: 1088713 - protein, 19 aa, Mycobacterium
SAKPDPAAGPGVDDAQRDT

SEQ ID NO: 1088714 - protein, 14 aa, Mycobacterium
SAKSTRQRGATAGR

SEQ ID NO: 1088715 - protein, 6 aa, Mycobacterium
SALGAT

SEQ ID NO: 1088716 - protein, 8 aa, Mycobacterium
SANIPGDP

SEQ ID NO: 1088717 - protein, 4 aa, Mycobacterium
SAPA

SEQ ID NO: 1088718 - protein, 12 aa, Mycobacterium
SAPAEAFSRPGL

SEQ ID NO: 1088719 - protein, 7 aa, Mycobacterium
SAPPELP

SEQ ID NO: 1088720 - protein, 10 aa, Mycobacterium
SAQAEALSPR

SEQ ID NO: 1088721 - protein, 6 aa, Mycobacterium
SAQGAQ

SEQ ID NO: 1088722 - protein, 4 aa, Mycobacterium
SAQP

SEQ ID NO: 1088723 - protein, 18 aa, Mycobacterium
SARHPAGPQAGSPAPKDH

SEQ ID NO: 1088724 - protein, 8 aa, Mycobacterium
SARPNELT

SEQ ID NO: 1088725 - protein, 4 aa, Mycobacterium
SARR

SEQ ID NO: 1088726 - protein, 13 aa, Mycobacterium
SARVTSPEPEATY

SEQ ID NO: 1088727 - protein, 18 aa, Mycobacterium
SASNYSAAEAASTLGGGA

SEQ ID NO: 1088728 - protein, 8 aa, Mycobacterium
SATERARI

SEQ ID NO: 1088729 - protein, 8 aa, Mycobacterium
SATEREID

SEQ ID NO: 1088730 - protein, 8 aa, Mycobacterium
SATPDSAV

SEQ ID NO: 1088731 - protein, 9 aa, Mycobacterium
SATPVPAAS

SEQ ID NO: 1088732 - protein, 29 aa, Mycobacterium
SATSETSSSSPSPSATEPQAPPPPPPPLS

SEQ ID NO: 1088733 - protein, 5 aa, Mycobacterium
SATTA

SEQ ID NO: 1088734 - protein, 11 aa, Mycobacterium
SAVAGEPGWST

SEQ ID NO: 1088735 - protein, 12 aa, Mycobacterium
SAVGAQPTGIET

SEQ ID NO: 1088736 - protein, 14 aa, Mycobacterium
SAYQSARRSGSVEN

SEQ ID NO: 1088737 - protein, 12 aa, Mycobacterium
SCGKSGSVADGA

SEQ ID NO: 1088738 - protein, 7 aa, Mycobacterium
SCGPAGI

SEQ ID NO: 1088739 - protein, 9 aa, Mycobacterium
SCSGDAQPV

SEQ ID NO: 1088740 - protein, 6 aa, Mycobacterium
SDAAMA

SEQ ID NO: 1088741 - protein, 16 aa, Mycobacterium
SDADEAADDETGTPEL

SEQ ID NO: 1088742 - protein, 10 aa, Mycobacterium
SDASAPRALT

SEQ ID NO: 1088743 - protein, 8 aa, Mycobacterium
SDASYSTA

SEQ ID NO: 1088744 - protein, 7 aa, Mycobacterium
SDDGAVT

SEQ ID NO: 1088745 - protein, 8 aa, Mycobacterium
SDEETPAD

SEQ ID NO: 1088746 - protein, 13 aa, Mycobacterium
SDERGQADRDDAE

SEQ ID NO: 1088747 - protein, 10 aa, Mycobacterium
SDESKPNGQI

SEQ ID NO: 1088748 - protein, 8 aa, Mycobacterium
SDGEPATE

SEQ ID NO: 1088749 - protein, 8 aa, Mycobacterium
SDGSTRAN

SEQ ID NO: 1088750 - protein, 5 aa, Mycobacterium
SDHIG

SEQ ID NO: 1088751 - protein, 9 aa, Mycobacterium
SDHVDDDAI

SEQ ID NO: 1088752 - protein, 11 aa, Mycobacterium
SDIGNGRGPVD

SEQ ID NO: 1088753 - protein, 11 aa, Mycobacterium
SDLGPRGRKEY

SEQ ID NO: 1088754 - protein, 18 aa, Mycobacterium
SDLKGTPAPEGDGMTEGC

SEQ ID NO: 1088755 - protein, 4 aa, Mycobacterium
SDNM

SEQ ID NO: 1088756 - protein, 5 aa, Mycobacterium
SDNSD

SEQ ID NO: 1088757 - protein, 33 aa, Mycobacterium; identical to SEQ ID NO: 576259

SEQ ID NO: 1088758 - protein, 12 aa, Mycobacterium
SDPQCCPTGSGT

SEQ ID NO: 1088759 - protein, 11 aa, Mycobacterium
SDTKPDEDAEL

SEQ ID NO: 1088760 - protein, 10 aa, Mycobacterium
SDVPEGAPPR

SEQ ID NO: 1088761 - protein, 6 aa, Mycobacterium
SDYARM

SEQ ID NO: 1088762 - protein, 7 aa, Mycobacterium
SDYGPGL

SEQ ID NO: 1088763 - protein, 5 aa, Mycobacterium
SDYPA

SEQ ID NO: 1088764 - protein, 12 aa, Mycobacterium
SEAAAQPGAPTQ

SEQ ID NO: 1088765 - protein, 11 aa, Mycobacterium
SEDDKARARTE

SEQ ID NO: 1088766 - protein, 12 aa, Mycobacterium
SEDEDESVAPPR

SEQ ID NO: 1088767 - protein, 7 aa, Mycobacterium
SEGERDN

SEQ ID NO: 1088768 - protein, 7 aa, Mycobacterium
SEGHDYD

SEQ ID NO: 1088769 - protein, 8 aa, Mycobacterium
SEGKPTLT

SEQ ID NO: 1088770 - protein, 7 aa, Mycobacterium
SEIRSNA

SEQ ID NO: 1088771 - protein, 4 aa, Mycobacterium
SEPD

SEQ ID NO: 1088772 - protein, 7 aa, Mycobacterium
SEPELGS

SEQ ID NO: 1088773 - protein, 8 aa, Mycobacterium
SEQEKTHY

SEQ ID NO: 1088774 - protein, 4 aa, Mycobacterium
SERS

SEQ ID NO: 1088775 - protein, 6 aa, Mycobacterium
SESAPQ

SEQ ID NO: 1088776 - protein, 7 aa, Mycobacterium
SESGVAG

SEQ ID NO: 1088777 - protein, 5 aa, Mycobacterium
SESRI

SEQ ID NO: 1088778 - protein, 9 aa, Mycobacterium
SESRPGANF

SEQ ID NO: 1088779 - protein, 11 aa, Mycobacterium
SETPPSAVPPG

SEQ ID NO: 1088780 - protein, 9 aa, Mycobacterium
SETYPPGST

SEQ ID NO: 1088781 - protein, 10 aa, Mycobacterium
SEVATGHQGI

SEQ ID NO: 1088782 - protein, 9 aa, Mycobacterium
SEVVANGSA

SEQ ID NO: 1088783 - protein, 5 aa, Mycobacterium
SFADP

SEQ ID NO: 1088784 - protein, 20 aa, Mycobacterium
SFAGTSTKGSVGQPAGLTAL

SEQ ID NO: 1088785 - protein, 5 aa, Mycobacterium
SFRDA

SEQ ID NO: 1088786 - protein, 14 aa, Mycobacterium
SFRDATRVAGTAPD

SEQ ID NO: 1088787 - protein, 8 aa, Mycobacterium
SGAGGAMT

SEQ ID NO: 1088788 - protein, 13 aa, Mycobacterium
SGAGSAVAAAGDA

SEQ ID NO: 1088789 - protein, 17 aa, Mycobacterium
SGAPSVPAANMPPGSVE

SEQ ID NO: 1088790 - protein, 6 aa, Mycobacterium
SGASAV

SEQ ID NO: 1088791 - protein, 4 aa, Mycobacterium
SGDF

SEQ ID NO: 1088792 - protein, 5 aa, Mycobacterium
SGDNN

SEQ ID NO: 1088793 - protein, 18 aa, Mycobacterium
SGDQYNAGRHISPDQARR

SEQ ID NO: 1088794 - protein, 8 aa, Mycobacterium
SGDRLDPS

SEQ ID NO: 1088795 - protein, 4 aa, Mycobacterium
SGEA

SEQ ID NO: 1088796 - protein, 7 aa, Mycobacterium
SGEGADE

SEQ ID NO: 1088797 - protein, 13 aa, Mycobacterium
SGETVTASAEDHP

SEQ ID NO: 1088798 - protein, 15 aa, Mycobacterium
SGFVSPPTARASASS

SEQ ID NO: 1088799 - protein, 31 aa, Mycobacterium
SGGAGGDGGAATGTGGAGGNGVAGGAASGLG

SEQ ID NO: 1088800 - protein, 7 aa, Mycobacterium
SGGAGLT

SEQ ID NO: 1088801 - protein, 8 aa, Mycobacterium
SGGAPQTI

SEQ ID NO: 1088802 - protein, 4 aa, Mycobacterium
SGGF

SEQ ID NO: 1088803 - protein, 26 aa, Mycobacterium
SGGSGGVGGAGSIDGGAGGAGGDAGW

SEQ ID NO: 1088804 - protein, 27 aa, Mycobacterium
SGGTGGDGGFAKGGNGGAGGAGGDAGL

SEQ ID NO: 1088805 - protein, 29 aa, Mycobacterium
SGGTGGFGGVGGVGTSTGIGGAGGRGGNA

SEQ ID NO: 1088806 - protein, 6 aa, Mycobacterium
SGGVSQ

SEQ ID NO: 1088807 - protein, 11 aa, Mycobacterium
SGIGTSGRARE

SEQ ID NO: 1088808 - protein, 15 aa, Mycobacterium
SGKPTKVFGDGTNTR

SEQ ID NO: 1088809 - protein, 10 aa, Mycobacterium
SGKTATARAS

SEQ ID NO: 1088810 - protein, 12 aa, Mycobacterium
SGKTGTTEAHRS

SEQ ID NO: 1088811 - protein, 10 aa, Mycobacterium
SGLPDHAGDA

SEQ ID NO: 1088812 - protein, 10 aa, Mycobacterium
SGLRGASQED

SEQ ID NO: 1088813 - protein, 5 aa, Mycobacterium
SGLRP

SEQ ID NO: 1088814 - protein, 7 aa, Mycobacterium
SGMTPTS

SEQ ID NO: 1088815 - protein, 7 aa, Mycobacterium
SGPDEAA

SEQ ID NO: 1088816 - protein, 6 aa, Mycobacterium
SGPGAL

SEQ ID NO: 1088817 - protein, 5 aa, Mycobacterium
SGQAN

SEQ ID NO: 1088818 - protein, 6 aa, Mycobacterium
SGQDTV

SEQ ID NO: 1088819 - protein, 7 aa, Mycobacterium
SGREASE

SEQ ID NO: 1088820 - protein, 38 aa, Mycobacterium; identical to SEQ ID NO: 916874

SEQ ID NO: 1088821 - protein, 5 aa, Mycobacterium
SGSAA

SEQ ID NO: 1088822 - protein, 4 aa, Mycobacterium
SGSE

SEQ ID NO: 1088823 - protein, 7 aa, Mycobacterium
SGSGTLG

SEQ ID NO: 1088824 - protein, 4 aa, Mycobacterium
SGSN

SEQ ID NO: 1088825 - protein, 6 aa, Mycobacterium
SGSPIR

SEQ ID NO: 1088826 - protein, 28 aa, Mycobacterium
SGTASADPLYPQPPSPAPAPAQAAVPPV

SEQ ID NO: 1088827 - protein, 4 aa, Mycobacterium
SGTG

SEQ ID NO: 1088828 - protein, 13 aa, Mycobacterium
SGTTGHPKGVPTT

SEQ ID NO: 1088829 - protein, 6 aa, Mycobacterium
SGTVNV

SEQ ID NO: 1088830 - protein, 5 aa, Mycobacterium
SGVAG

SEQ ID NO: 1088831 - protein, 9 aa, Mycobacterium
SGVAPESGL

SEQ ID NO: 1088832 - protein, 10 aa, Mycobacterium
SGVDSTGMSS

SEQ ID NO: 1088833 - protein, 17 aa, Mycobacterium
SGVPISQSRPLAAAQSS

SEQ ID NO: 1088834 - protein, 8 aa, Mycobacterium
SGWSDDGM

SEQ ID NO: 1088835 - protein, 13 aa, Mycobacterium
SHTAAAPGANPRQ

SEQ ID NO: 1088836 - protein, 12 aa, Mycobacterium
SHYPTRAAAEAT

SEQ ID NO: 1088837 - protein, 12 aa, Mycobacterium
SIAGTDSSGRSV

SEQ ID NO: 1088838 - protein, 8 aa, Mycobacterium
SIEDDSQL

SEQ ID NO: 1088839 - protein, 8 aa, Mycobacterium
SIEPQPES

SEQ ID NO: 1088840 - protein, 20 aa, Mycobacterium
SIPPTTTSAGPASGIPGDGT

SEQ ID NO: 1088841 - protein, 7 aa, Mycobacterium
SITQGTD

SEQ ID NO: 1088842 - protein, 8 aa, Mycobacterium
SKAPGDKV

SEQ ID NO: 1088843 - protein, 18 aa, Mycobacterium
SKDAVGGGTASGSAGAAG

SEQ ID NO: 1088844 - protein, 9 aa, Mycobacterium
SKDGTASTL

SEQ ID NO: 1088845 - protein, 15 aa, Mycobacterium
SKDHKTIRNRSLDSR

SEQ ID NO: 1088846 - protein, 12 aa, Mycobacterium
SKEEDDASKDRL

SEQ ID NO: 1088847 - protein, 4 aa, Mycobacterium
SKGM

SEQ ID NO: 1088848 - protein, 10 aa, Mycobacterium
SKGNSVTSGV

SEQ ID NO: 1088849 - protein, 8 aa, Mycobacterium
SKGVPGVK

SEQ ID NO: 1088850 - protein, 7 aa, Mycobacterium
SKISSGA

SEQ ID NO: 1088851 - protein, 8 aa, Mycobacterium
SKLAQSGT

SEQ ID NO: 1088852 - protein, 13 aa, Mycobacterium
SKLGGGYIDTWAC

SEQ ID NO: 1088853 - protein, 8 aa, Mycobacterium
SKLSKTGT

SEQ ID NO: 1088854 - protein, 8 aa, Mycobacterium
SKPGTGST

SEQ ID NO: 1088855 - protein, 9 aa, Mycobacterium
SKPLPEGMR

SEQ ID NO: 1088856 - protein, 7 aa, Mycobacterium
SKSGKTT

SEQ ID NO: 1088857 - protein, 8 aa, Mycobacterium
SKTGARYS

SEQ ID NO: 1088858 - protein, 17 aa, Mycobacterium
SKTGTAEHGTDPRHTPP

SEQ ID NO: 1088859 - protein, 5 aa, Mycobacterium
SKTYG

SEQ ID NO: 1088860 - protein, 7 aa, Mycobacterium
SKYRGEF

SEQ ID NO: 1088861 - protein, 6 aa, Mycobacterium
SLADRG

SEQ ID NO: 1088862 - protein, 10 aa, Mycobacterium
SLASSPASAA

SEQ ID NO: 1088863 - protein, 10 aa, Mycobacterium
SLGHGADDGA

SEQ ID NO: 1088864 - protein, 24 aa, Mycobacterium
SLGYGPGTSSLGGSGLGSSTGGGI

SEQ ID NO: 1088865 - protein, 8 aa, Mycobacterium
SLPGRNHR

SEQ ID NO: 1088866 - protein, 11 aa, Mycobacterium
SLRAEYDKSPI

SEQ ID NO: 1088867 - protein, 9 aa, Mycobacterium
SLRKEGRER

SEQ ID NO: 1088868 - protein, 10 aa, Mycobacterium
SLSNERKVAE

SEQ ID NO: 1088869 - protein, 17 aa, Mycobacterium
SLSSVSSMSPSAASSPT

SEQ ID NO: 1088870 - protein, 5 aa, Mycobacterium
SMDDG

SEQ ID NO: 1088871 - protein, 10 aa, Mycobacterium
SNDPVDKGAA

SEQ ID NO: 1088872 - protein, 6 aa, Mycobacterium
SNGKTS

SEQ ID NO: 1088873 - protein, 8 aa, Mycobacterium
SNKNPSDV

SEQ ID NO: 1088874 - protein, 6 aa, Mycobacterium
SNPDGA

SEQ ID NO: 1088875 - protein, 4 aa, Mycobacterium
SNRL

SEQ ID NO: 1088876 - protein, 11 aa, Mycobacterium
SPAAGELQGPL

SEQ ID NO: 1088877 - protein, 5 aa, Mycobacterium
SPAEL

SEQ ID NO: 1088878 - protein, 6 aa, Mycobacterium
SPAGLS

SEQ ID NO: 1088879 - protein, 4 aa, Mycobacterium
SPDL

SEQ ID NO: 1088880 - protein, 21 aa, Mycobacterium
SPDTTDNYAGYDYQNPRSTGF

SEQ ID NO: 1088881 - protein, 12 aa, Mycobacterium
SPEAHAAAATAT

SEQ ID NO: 1088882 - protein, 7 aa, Mycobacterium
SPEDEQA

SEQ ID NO: 1088883 - protein, 14 aa, Mycobacterium
SPEPLNPIGDPERT

SEQ ID NO: 1088884 - protein, 9 aa, Mycobacterium
SPESGEFDR

SEQ ID NO: 1088885 - protein, 23 aa, Mycobacterium
SPETRARRRNDQNVASGSADDYD

SEQ ID NO: 1088886 - protein, 5 aa, Mycobacterium
SPFGP

SEQ ID NO: 1088887 - protein, 7 aa, Mycobacterium
SPGAAPI

SEQ ID NO: 1088888 - protein, 6 aa, Mycobacterium
SPGGKT

SEQ ID NO: 1088889 - protein, 8 aa, Mycobacterium
SPGPPNQG

SEQ ID NO: 1088890 - protein, 11 aa, Mycobacterium
SPGSDASAPAS

SEQ ID NO: 1088891 - protein, 15 aa, Mycobacterium
SPIGRERKTEELSRA

SEQ ID NO: 1088892 - protein, 5 aa, Mycobacterium
SPLNP

SEQ ID NO: 1088893 - protein, 5 aa, Mycobacterium
SPNPG

SEQ ID NO: 1088894 - protein, 16 aa, Mycobacterium
SPPSPSAAEVAAARTQ

SEQ ID NO: 1088895 - protein, 20 aa, Mycobacterium
SPPVESAGGGETSTGSVSAP

SEQ ID NO: 1088896 - protein, 6 aa, Mycobacterium
SPQHEY

SEQ ID NO: 1088897 - protein, 9 aa, Mycobacterium
SPQQDPPVR

SEQ ID NO: 1088898 - protein, 12 aa, Mycobacterium
SPQTPASAGTAQ

SEQ ID NO: 1088899 - protein, 23 aa, Mycobacterium
SPSGLTTIPGTEEAAAAGSPGFP

SEQ ID NO: 1088900 - protein, 5 aa, Mycobacterium
SPSNA

SEQ ID NO: 1088901 - protein, 8 aa, Mycobacterium
SPSNSAPP

SEQ ID NO: 1088902 - protein, 7 aa, Mycobacterium
SPSYDPN

SEQ ID NO: 1088903 - protein, 9 aa, Mycobacterium
SPTDPPTLS

SEQ ID NO: 1088904 - protein, 12 aa, Mycobacterium
SPTSAAASNTAT

SEQ ID NO: 1088905 - protein, 44 aa, Mycobacterium
SPVQSTDPSRAQASTAAGAAAAGTTAQTTASQPTTAATDTAQGL

SEQ ID NO: 1088906 - protein, 4 aa, Mycobacterium
SPVS

SEQ ID NO: 1088907 - protein, 6 aa, Mycobacterium
SQADVE

SEQ ID NO: 1088908 - protein, 8 aa, Mycobacterium
SQEPGSGY

SEQ ID NO: 1088909 - protein, 5 aa, Mycobacterium
SQERA

SEQ ID NO: 1088910 - protein, 14 aa, Mycobacterium
SQETSPTRGIPSGP

SEQ ID NO: 1088911 - protein, 14 aa, Mycobacterium
SQGKTTLSAQDRQA

SEQ ID NO: 1088912 - protein, 5 aa, Mycobacterium
SQIGT

SEQ ID NO: 1088913 - protein, 18 aa, Mycobacterium
SQNPPPTSLARQKRPLRF

SEQ ID NO: 1088914 - protein, 15 aa, Mycobacterium
SQPAFEDASARAEGY

SEQ ID NO: 1088915 - protein, 6 aa, Mycobacterium
SQPLTN

SEQ ID NO: 1088916 - protein, 7 aa, Mycobacterium
SQRDGLS

SEQ ID NO: 1088917 - protein, 9 aa, Mycobacterium
SQSGSVAAD

SEQ ID NO: 1088918 - protein, 6 aa, Mycobacterium
SQSNEQ

SEQ ID NO: 1088919 - protein, 13 aa, Mycobacterium
SQTLPTNDPGKEC

SEQ ID NO: 1088920 - protein, 5 aa, Mycobacterium
SRAGD

SEQ ID NO: 1088921 - protein, 5 aa, Mycobacterium
SRAIS

SEQ ID NO: 1088922 - protein, 7 aa, Mycobacterium
SRATRAA

SEQ ID NO: 1088923 - protein, 6 aa, Mycobacterium
SRDDTA

SEQ ID NO: 1088924 - protein, 16 aa, Mycobacterium
SRFGGTGGDGGQGGLF

SEQ ID NO: 1088925 - protein, 12 aa, Mycobacterium
SRGATTEGPADE

SEQ ID NO: 1088926 - protein, 5 aa, Mycobacterium
SRGPH

SEQ ID NO: 1088927 - protein, 18 aa, Mycobacterium
SRIPAPGGAGFAAGNDAL

SEQ ID NO: 1088928 - protein, 10 aa, Mycobacterium
SRKDQEGNDL

SEQ ID NO: 1088929 - protein, 20 aa, Mycobacterium
SRKEQQADPELVGIHISWRA

SEQ ID NO: 1088930 - protein, 9 aa, Mycobacterium
SRLPDSAPE

SEQ ID NO: 1088931 - protein, 9 aa, Mycobacterium
SRPAPAPPT

SEQ ID NO: 1088932 - protein, 15 aa, Mycobacterium
SRPGSSFGAKPITRR

SEQ ID NO: 1088933 - protein, 8 aa, Mycobacterium
SRPSTHAR

SEQ ID NO: 1088934 - protein, 13 aa, Mycobacterium
SRQHRIPDHAPSR

SEQ ID NO: 1088935 - protein, 5 aa, Mycobacterium
SRQID

SEQ ID NO: 1088936 - protein, 10 aa, Mycobacterium
SRQRGQITAG

SEQ ID NO: 1088937 - protein, 9 aa, Mycobacterium
SRRKRGDNV

SEQ ID NO: 1088938 - protein, 15 aa, Mycobacterium
SRRPSEVKASAPARV

SEQ ID NO: 1088939 - protein, 8 aa, Mycobacterium
SRRRGQSA

SEQ ID NO: 1088940 - protein, 9 aa, Mycobacterium
SRSEQISTG

SEQ ID NO: 1088941 - protein, 14 aa, Mycobacterium
SRSSGSLPVATATD

SEQ ID NO: 1088942 - protein, 14 aa, Mycobacterium
SRTDAHGNPLTPEE

SEQ ID NO: 1088943 - protein, 5 aa, Mycobacterium
SRTIQ

SEQ ID NO: 1088944 - protein, 4 aa, Mycobacterium
SRTV

SEQ ID NO: 1088945 - protein, 22 aa, Mycobacterium
SRYRTAASPTGTAGTTSTADAT

SEQ ID NO: 1088946 - protein, 8 aa, Mycobacterium
SSAARAHG

SEQ ID NO: 1088947 - protein, 5 aa, Mycobacterium
SSADL

SEQ ID NO: 1088948 - protein, 8 aa, Mycobacterium
SSAGGLPP

SEQ ID NO: 1088949 - protein, 5 aa, Mycobacterium
SSAGR

SEQ ID NO: 1088950 - protein, 6 aa, Mycobacterium
SSALAT

SEQ ID NO: 1088951 - protein, 8 aa, Mycobacterium
SSALATPV

SEQ ID NO: 1088952 - protein, 10 aa, Mycobacterium
SSARSGSLDD

SEQ ID NO: 1088953 - protein, 13 aa, Mycobacterium
SSATGSRLAERAG

SEQ ID NO: 1088954 - protein, 26 aa, Mycobacterium
SSATTHSTPDSPAGTTSGSQPTSTAA

SEQ ID NO: 1088955 - protein, 8 aa, Mycobacterium
SSDDGAAE

SEQ ID NO: 1088956 - protein, 9 aa, Mycobacterium
SSDEPEPNA

SEQ ID NO: 1088957 - protein, 12 aa, Mycobacterium
SSENPAEVTPSD

SEQ ID NO: 1088958 - protein, 6 aa, Mycobacterium
SSETAG

SEQ ID NO: 1088959 - protein, 6 aa, Mycobacterium
SSFGPD

SEQ ID NO: 1088960 - protein, 14 aa, Mycobacterium
SSGGEVKDERTSSA

SEQ ID NO: 1088961 - protein, 7 aa, Mycobacterium
SSGGRRP

SEQ ID NO: 1088962 - protein, 15 aa, Mycobacterium
SSGHNTGLGNSGFTN

SEQ ID NO: 1088963 - protein, 7 aa, Mycobacterium
SSGLGAG

SEQ ID NO: 1088964 - protein, 10 aa, Mycobacterium
SSGPGPASLL

SEQ ID NO: 1088965 - protein, 29 aa, Mycobacterium
SSGPLQSVPPTIEPARPAVSPPISQPPAG

SEQ ID NO: 1088966 - protein, 9 aa, Mycobacterium
SSGTAAGAK

SEQ ID NO: 1088967 - protein, 10 aa, Mycobacterium
SSISSEDSQT

SEQ ID NO: 1088968 - protein, 15 aa, Mycobacterium
SSITAPPATGLPAPE

SEQ ID NO: 1088969 - protein, 11 aa, Mycobacterium
SSKAYPSTEQA

SEQ ID NO: 1088970 - protein, 22 aa, Mycobacterium
SSNAAVNSHTAQVGPKLAEGTR

SEQ ID NO: 1088971 - protein, 4 aa, Mycobacterium
SSNT

SEQ ID NO: 1088972 - protein, 8 aa, Mycobacterium
SSPAARSA

SEQ ID NO: 1088973 - protein, 7 aa, Mycobacterium
SSPAGEV

SEQ ID NO: 1088974 - protein, 9 aa, Mycobacterium
SSPATSATL

SEQ ID NO: 1088975 - protein, 11 aa, Mycobacterium
SSPQAADREGH

SEQ ID NO: 1088976 - protein, 5 aa, Mycobacterium
SSPRA

SEQ ID NO: 1088977 - protein, 5 aa, Mycobacterium
SSRQF

SEQ ID NO: 1088978 - protein, 5 aa, Mycobacterium
SSRQQ

SEQ ID NO: 1088979 - protein, 8 aa, Mycobacterium
SSRTSHRV

SEQ ID NO: 1088980 - protein, 16 aa, Mycobacterium
SSTAPASAASGGGLGS

SEQ ID NO: 1088981 - protein, 25 aa, Mycobacterium
SSTFVNNPTSAMSQQELADRVAALT

SEQ ID NO: 1088982 - protein, 7 aa, Mycobacterium
SSTGSSV

SEQ ID NO: 1088983 - protein, 7 aa, Mycobacterium
SSTRSAA

SEQ ID NO: 1088984 - protein, 8 aa, Mycobacterium
SSTTKAAD

SEQ ID NO: 1088985 - protein, 7 aa, Mycobacterium
SSTTTNG

SEQ ID NO: 1088986 - protein, 10 aa, Mycobacterium
SSVTSELTSG

SEQ ID NO: 1088987 - protein, 16 aa, Mycobacterium
STANGGLNGTCAERSG

SEQ ID NO: 1088988 - protein, 15 aa, Mycobacterium
STAPAAHADNKRLND

SEQ ID NO: 1088989 - protein, 34 aa, Mycobacterium
STAPAPAAGLATAGSAVPASNSVSTVASERGADM

SEQ ID NO: 1088990 - protein, 4 aa, Mycobacterium
STAQ

SEQ ID NO: 1088991 - protein, 6 aa, Mycobacterium
STARGA

SEQ ID NO: 1088992 - protein, 43 aa, Mycobacterium
STARPTSSGSSRRRRATPRSPTARSGFPSSTSPARRPSSSTSR

SEQ ID NO: 1088993 - protein, 11 aa, Mycobacterium
STGAVTGEPDV

SEQ ID NO: 1088994 - protein, 8 aa, Mycobacterium
STGDAEQF

SEQ ID NO: 1088995 - protein, 17 aa, Mycobacterium
STGGASGSGSTGSSSMD

SEQ ID NO: 1088996 - protein, 9 aa, Mycobacterium
STGKASHAS

SEQ ID NO: 1088997 - protein, 16 aa, Mycobacterium
STGLERAEDPLLNGSD

SEQ ID NO: 1088998 - protein, 16 aa, Mycobacterium
STHAGQPGANALTPEQ

SEQ ID NO: 1088999 - protein, 6 aa, Mycobacterium
STLSDH

SEQ ID NO: 1089000 - protein, 5 aa, Mycobacterium
STNAQ

SEQ ID NO: 1089001 - protein, 5 aa, Mycobacterium
STPDE

SEQ ID NO: 1089002 - protein, 8 aa, Mycobacterium
STPEPPDY

SEQ ID NO: 1089003 - protein, 7 aa, Mycobacterium
STSNAEE

SEQ ID NO: 1089004 - protein, 16 aa, Mycobacterium
STSTLNPYTNPDGALA

SEQ ID NO: 1089005 - protein, 16 aa, Mycobacterium
STTAPHQQRRAVSPQV

SEQ ID NO: 1089006 - protein, 10 aa, Mycobacterium
STTAPLSSTM

SEQ ID NO: 1089007 - protein, 6 aa, Mycobacterium
STTARM

SEQ ID NO: 1089008 - protein, 11 aa, Mycobacterium
STTDPDEGEPF

SEQ ID NO: 1089009 - protein, 10 aa, Mycobacterium
STTETKPTEH

SEQ ID NO: 1089010 - protein, 7 aa, Mycobacterium
STTGYGD

SEQ ID NO: 1089011 - protein, 6 aa, Mycobacterium
STVADG

SEQ ID NO: 1089012 - protein, 6 aa, Mycobacterium
STVTAR

SEQ ID NO: 1089013 - protein, 8 aa, Mycobacterium
STVTDQAG

SEQ ID NO: 1089014 - protein, 11 aa, Mycobacterium
SVDAPRAGATS

SEQ ID NO: 1089015 - protein, 6 aa, Mycobacterium
SVDGKD

SEQ ID NO: 1089016 - protein, 4 aa, Mycobacterium
SVGD

SEQ ID NO: 1089017 - protein, 17 aa, Mycobacterium
SVGKTIAGATFKGKGND

SEQ ID NO: 1089018 - protein, 18 aa, Mycobacterium
SVKGAQSARSDGFDATTK

SEQ ID NO: 1089019 - protein, 4 aa, Mycobacterium
SVND

SEQ ID NO: 1089020 - protein, 15 aa, Mycobacterium
SVPQGPGINDNGSGV

SEQ ID NO: 1089021 - protein, 9 aa, Mycobacterium
SVPSADGAA

SEQ ID NO: 1089022 - protein, 5 aa, Mycobacterium
SVRQA

SEQ ID NO: 1089023 - protein, 5 aa, Mycobacterium
SVSPL

SEQ ID NO: 1089024 - protein, 6 aa, Mycobacterium
SVTGTD

SEQ ID NO: 1089025 - protein, 17 aa, Mycobacterium
SVTSGLASGSWQGPAAA

SEQ ID NO: 1089026 - protein, 8 aa, Mycobacterium
SWETGQPM

SEQ ID NO: 1089027 - protein, 6 aa, Mycobacterium
SWLGPS

SEQ ID NO: 1089028 - protein, 6 aa, Mycobacterium
SWPGAS

SEQ ID NO: 1089029 - protein, 6 aa, Mycobacterium
SYGARQ

SEQ ID NO: 1089030 - protein, 5 aa, Mycobacterium
SYSVD

SEQ ID NO: 1089031 - protein, 6 aa, Mycobacterium
SYTRTD

SEQ ID NO: 1089032 - protein, 9 aa, Mycobacterium
TAAAAAPPR

SEQ ID NO: 1089033 - protein, 8 aa, Mycobacterium
TAAADDVS

SEQ ID NO: 1089034 - protein, 12 aa, Mycobacterium
TAAARTPSGRML

SEQ ID NO: 1089035 - protein, 4 aa, Mycobacterium
TAAG

SEQ ID NO: 1089036 - protein, 7 aa, Mycobacterium
TAAGTDY

SEQ ID NO: 1089037 - protein, 11 aa, Mycobacterium
TAAKTLAASAQ

SEQ ID NO: 1089038 - protein, 8 aa, Mycobacterium
TAARDGGY

SEQ ID NO: 1089039 - protein, 5 aa, Mycobacterium
TAASA

SEQ ID NO: 1089040 - protein, 15 aa, Mycobacterium
TAASDNFQMSGGGTG

SEQ ID NO: 1089041 - protein, 62 aa, Mycobacterium; identical to SEQ ID NO: 918385

SEQ ID NO: 1089042 - protein, 6 aa, Mycobacterium
TADDNT

SEQ ID NO: 1089043 - protein, 6 aa, Mycobacterium
TADDPH

SEQ ID NO: 1089044 - protein, 9 aa, Mycobacterium
TADGWGSSE

SEQ ID NO: 1089045 - protein, 7 aa, Mycobacterium
TADHPAC

SEQ ID NO: 1089046 - protein, 9 aa, Mycobacterium
TADYGSETL

SEQ ID NO: 1089047 - protein, 7 aa, Mycobacterium
TAEAGRE

SEQ ID NO: 1089048 - protein, 11 aa, Mycobacterium
TAEDPRSTGNN

SEQ ID NO: 1089049 - protein, 5 aa, Mycobacterium
TAEDV

SEQ ID NO: 1089050 - protein, 6 aa, Mycobacterium
TAEGGA

SEQ ID NO: 1089051 - protein, 7 aa, Mycobacterium
TAEGNGN

SEQ ID NO: 1089052 - protein, 7 aa, Mycobacterium
TAGDATR

SEQ ID NO: 1089053 - protein, 4 aa, Mycobacterium
TAGR

SEQ ID NO: 1089054 - protein, 12 aa, Mycobacterium
TAGSAAASTDDT

SEQ ID NO: 1089055 - protein, 19 aa, Mycobacterium
TAGSTAYATAEAANAGPLQ

SEQ ID NO: 1089056 - protein, 17 aa, Mycobacterium
TAHRGPAPTPVRQPTVG

SEQ ID NO: 1089057 - protein, 18 aa, Mycobacterium
TAIATGAAGSAGSAGSAV

SEQ ID NO: 1089058 - protein, 8 aa, Mycobacterium
TAKNGPLE

SEQ ID NO: 1089059 - protein, 9 aa, Mycobacterium
TALGGGPAL

SEQ ID NO: 1089060 - protein, 20 aa, Mycobacterium
TANDPDYQSELPEGSDTSVD

SEQ ID NO: 1089061 - protein, 25 aa, Mycobacterium
TAPATPSTAPSLSGTPTTPSTTTPG

SEQ ID NO: 1089062 - protein, 8 aa, Mycobacterium
TAPGKSSW

SEQ ID NO: 1089063 - protein, 18 aa, Mycobacterium
TAPPPVANAKNGDTHVTG

SEQ ID NO: 1089064 - protein, 17 aa, Mycobacterium
TAPRGEDEVRVAAWRFS

SEQ ID NO: 1089065 - protein, 8 aa, Mycobacterium
TAPRRDDL

SEQ ID NO: 1089066 - protein, 11 aa, Mycobacterium
TAPSSKTLGPM

SEQ ID NO: 1089067 - protein, 5 aa, Mycobacterium
TAQNS

SEQ ID NO: 1089068 - protein, 8 aa, Mycobacterium
TAQPENRE

SEQ ID NO: 1089069 - protein, 27 aa, Mycobacterium
TARDEAAAAEHELEASQQAVKDANAAI

SEQ ID NO: 1089070 - protein, 7 aa, Mycobacterium
TARDERR

SEQ ID NO: 1089071 - protein, 29 aa, Mycobacterium
TAREQTAKAEQASEKSAADAKSAAEQAAA

SEQ ID NO: 1089072 - protein, 36 aa, Mycobacterium; identical to SEQ ID NO: 918637

SEQ ID NO: 1089073 - protein, 8 aa, Mycobacterium
TARSEDPW

SEQ ID NO: 1089074 - protein, 6 aa, Mycobacterium
TASLAA

SEQ ID NO: 1089075 - protein, 10 aa, Mycobacterium
TASPDSPSVV

SEQ ID NO: 1089076 - protein, 13 aa, Mycobacterium
TASQAGGAAPAQH

SEQ ID NO: 1089077 - protein, 4 aa, Mycobacterium
TAST

SEQ ID NO: 1089078 - protein, 7 aa, Mycobacterium
TASTVDE

SEQ ID NO: 1089079 - protein, 7 aa, Mycobacterium
TATAATV

SEQ ID NO: 1089080 - protein, 7 aa, Mycobacterium
TATADHG

SEQ ID NO: 1089081 - protein, 6 aa, Mycobacterium
TATARS

SEQ ID NO: 1089082 - protein, 11 aa, Mycobacterium
TATATAGSTDD

SEQ ID NO: 1089083 - protein, 7 aa, Mycobacterium
TATPPGM

SEQ ID NO: 1089084 - protein, 5 aa, Mycobacterium
TAVTA

SEQ ID NO: 1089085 - protein, 13 aa, Mycobacterium
TCPVNAGSTPNLA

SEQ ID NO: 1089086 - protein, 12 aa, Mycobacterium
TCSGGDGAIVYL

SEQ ID NO: 1089087 - protein, 6 aa, Mycobacterium
TDAAGD

SEQ ID NO: 1089088 - protein, 6 aa, Mycobacterium
TDAASR

SEQ ID NO: 1089089 - protein, 8 aa, Mycobacterium
TDAPDDTV

SEQ ID NO: 1089090 - protein, 5 aa, Mycobacterium
TDAPS

SEQ ID NO: 1089091 - protein, 4 aa, Mycobacterium
TDDT

SEQ ID NO: 1089092 - protein, 6 aa, Mycobacterium
TDDTAV

SEQ ID NO: 1089093 - protein, 4 aa, Mycobacterium
TDFE

SEQ ID NO: 1089094 - protein, 11 aa, Mycobacterium
TDGGGYPTGQK

SEQ ID NO: 1089095 - protein, 5 aa, Mycobacterium
TDGNS

SEQ ID NO: 1089096 - protein, 8 aa, Mycobacterium
TDGSPLGT

SEQ ID NO: 1089097 - protein, 8 aa, Mycobacterium
TDGSPVTA

SEQ ID NO: 1089098 - protein, 7 aa, Mycobacterium
TDLTSKQ

SEQ ID NO: 1089099 - protein, 9 aa, Mycobacterium
TDPPPGKDR

SEQ ID NO: 1089100 - protein, 4 aa, Mycobacterium
TDPT

SEQ ID NO: 1089101 - protein, 12 aa, Mycobacterium
TDPTVTEGYRQD

SEQ ID NO: 1089102 - protein, 8 aa, Mycobacterium
TDQRQTQD

SEQ ID NO: 1089103 - protein, 5 aa, Mycobacterium
TDQRS

SEQ ID NO: 1089104 - protein, 7 aa, Mycobacterium
TDRPAFT

SEQ ID NO: 1089105 - protein, 6 aa, Mycobacterium
TDSSGR

SEQ ID NO: 1089106 - protein, 6 aa, Mycobacterium
TDTLKS

SEQ ID NO: 1089107 - protein, 8 aa, Mycobacterium
TDTRGNPI

SEQ ID NO: 1089108 - protein, 13 aa, Mycobacterium
TDTVGATATHYAQ

SEQ ID NO: 1089109 - protein, 9 aa, Mycobacterium
TDVDDAAQT

SEQ ID NO: 1089110 - protein, 5 aa, Mycobacterium
TEAGA

SEQ ID NO: 1089111 - protein, 5 aa, Mycobacterium
TEAHS

SEQ ID NO: 1089112 - protein, 5 aa, Mycobacterium
TEALS

SEQ ID NO: 1089113 - protein, 34 aa, Mycobacterium
TEAPTIASPAASTTQGAAVSAAQATSAASTQSTV

SEQ ID NO: 1089114 - protein, 5 aa, Mycobacterium
TEARY

SEQ ID NO: 1089115 - protein, 4 aa, Mycobacterium
TEDM

SEQ ID NO: 1089116 - protein, 5 aa, Mycobacterium
TEEDS

SEQ ID NO: 1089117 - protein, 12 aa, Mycobacterium
TEEGRRGETGSL

SEQ ID NO: 1089118 - protein, 6 aa, Mycobacterium
TEGQEH

SEQ ID NO: 1089119 - protein, 7 aa, Mycobacterium
TENKPVG

SEQ ID NO: 1089120 - protein, 6 aa, Mycobacterium
TEPDQI

SEQ ID NO: 1089121 - protein, 13 aa, Mycobacterium
TEPGGGSDLQNMS

SEQ ID NO: 1089122 - protein, 8 aa, Mycobacterium
TEPPTPGR

SEQ ID NO: 1089123 - protein, 5 aa, Mycobacterium
TEPRG

SEQ ID NO: 1089124 - protein, 10 aa, Mycobacterium
TERVEDQPPR

SEQ ID NO: 1089125 - protein, 10 aa, Mycobacterium
TESSKDEARA

SEQ ID NO: 1089126 - protein, 21 aa, Mycobacterium
TESTTAHSKAVEAAKAEAEQV

SEQ ID NO: 1089127 - protein, 4 aa, Mycobacterium
TETL

SEQ ID NO: 1089128 - protein, 6 aa, Mycobacterium
TETSRQ

SEQ ID NO: 1089129 - protein, 13 aa, Mycobacterium
TFNTGAGNSSGGA

SEQ ID NO: 1089130 - protein, 15 aa, Mycobacterium
TGAASDPHSYQASPV

SEQ ID NO: 1089131 - protein, 20 aa, Mycobacterium
TGAGGAYAAAEAANVSPLQA

SEQ ID NO: 1089132 - protein, 6 aa, Mycobacterium
TGAGLV

SEQ ID NO: 1089133 - protein, 9 aa, Mycobacterium
TGAGSADEF

SEQ ID NO: 1089134 - protein, 16 aa, Mycobacterium
TGAKTEGRDSINGQSA

SEQ ID NO: 1089135 - protein, 8 aa, Mycobacterium
TGAPDPGD

SEQ ID NO: 1089136 - protein, 17 aa, Mycobacterium
TGASCPGPNSAAQTEDG

SEQ ID NO: 1089137 - protein, 15 aa, Mycobacterium
TGCSHRGRSPATKTI

SEQ ID NO: 1089138 - protein, 30 aa, Mycobacterium
TGCSRSISGNAIKAGGGGVPRNNNSEQQYP

SEQ ID NO: 1089139 - protein, 8 aa, Mycobacterium
TGDAQLPA

SEQ ID NO: 1089140 - protein, 5 aa, Mycobacterium
TGDHQ

SEQ ID NO: 1089141 - protein, 19 aa, Mycobacterium
TGDLTTHPNTVASGNATIT

SEQ ID NO: 1089142 - protein, 5 aa, Mycobacterium
TGDMT

SEQ ID NO: 1089143 - protein, 7 aa, Mycobacterium
TGDQAGA

SEQ ID NO: 1089144 - protein, 6 aa, Mycobacterium
TGDSEV

SEQ ID NO: 1089145 - protein, 16 aa, Mycobacterium
TGEPPMPGQAPPIAND

SEQ ID NO: 1089146 - protein, 7 aa, Mycobacterium
TGESRGA

SEQ ID NO: 1089147 - protein, 14 aa, Mycobacterium
TGFSANTGQDTAGE

SEQ ID NO: 1089148 - protein, 25 aa, Mycobacterium
TGGAGGAGGHAFDGDGGAGGAGGNA

SEQ ID NO: 1089149 - protein, 4 aa, Mycobacterium
TGGC

SEQ ID NO: 1089150 - protein, 9 aa, Mycobacterium
TGGDATRIS

SEQ ID NO: 1089151 - protein, 6 aa, Mycobacterium
TGGGRR

SEQ ID NO: 1089152 - protein, 11 aa, Mycobacterium
TGGNGGNGASG

SEQ ID NO: 1089153 - protein, 13 aa, Mycobacterium
TGGTGGDGGAGGL

SEQ ID NO: 1089154 - protein, 6 aa, Mycobacterium
TGIDPD

SEQ ID NO: 1089155 - protein, 4 aa, Mycobacterium
TGIP

SEQ ID NO: 1089156 - protein, 23 aa, Mycobacterium
TGKSGSVTLKPRSDINPEGPTTL

SEQ ID NO: 1089157 - protein, 6 aa, Mycobacterium
TGNGYY

SEQ ID NO: 1089158 - protein, 5 aa, Mycobacterium
TGNVE

SEQ ID NO: 1089159 - protein, 7 aa, Mycobacterium
TGPAGQA

SEQ ID NO: 1089160 - protein, 21 aa, Mycobacterium
TGPARSPSATARAGSHSGDLS

SEQ ID NO: 1089161 - protein, 10 aa, Mycobacterium
TGPDSPNKTL

SEQ ID NO: 1089162 - protein, 10 aa, Mycobacterium
TGPGGTALAS

SEQ ID NO: 1089163 - protein, 8 aa, Mycobacterium
TGPPPDNQ

SEQ ID NO: 1089164 - protein, 4 aa, Mycobacterium
TGPQ

SEQ ID NO: 1089165 - protein, 8 aa, Mycobacterium
TGPQGPAQ

SEQ ID NO: 1089166 - protein, 9 aa, Mycobacterium
TGPRPGGFG

SEQ ID NO: 1089167 - protein, 20 aa, Mycobacterium
TGPTMAPGWDPSDVGNGDIA

SEQ ID NO: 1089168 - protein, 4 aa, Mycobacterium
TGQL

SEQ ID NO: 1089169 - protein, 8 aa, Mycobacterium
TGQLPEAA

SEQ ID NO: 1089170 - protein, 7 aa, Mycobacterium
TGQPRAV

SEQ ID NO: 1089171 - protein, 5 aa, Mycobacterium
TGRHN

SEQ ID NO: 1089172 - protein, 15 aa, Mycobacterium
TGRRPSNANDHAPMP

SEQ ID NO: 1089173 - protein, 16 aa, Mycobacterium
TGRRPSNANDHAPMPK

SEQ ID NO: 1089174 - protein, 11 aa, Mycobacterium
TGRSPGNIDDS

SEQ ID NO: 1089175 - protein, 8 aa, Mycobacterium
TGRSPTVA

SEQ ID NO: 1089176 - protein, 22 aa, Mycobacterium
TGSFNSGKFNTGDFNSGSMNTG

SEQ ID NO: 1089177 - protein, 8 aa, Mycobacterium
TGSGKSQT

SEQ ID NO: 1089178 - protein, 8 aa, Mycobacterium
TGSLGAAA

SEQ ID NO: 1089179 - protein, 5 aa, Mycobacterium
TGSLT

SEQ ID NO: 1089180 - protein, 7 aa, Mycobacterium
TGSTRAG

SEQ ID NO: 1089181 - protein, 12 aa, Mycobacterium
TGTADGSKVVDD

SEQ ID NO: 1089182 - protein, 5 aa, Mycobacterium
TGTGE

SEQ ID NO: 1089183 - protein, 14 aa, Mycobacterium
TGTITADGKVGPIG

SEQ ID NO: 1089184 - protein, 4 aa, Mycobacterium
TGTQ

SEQ ID NO: 1089185 - protein, 10 aa, Mycobacterium
TGVETSDRQL

SEQ ID NO: 1089186 - protein, 10 aa, Mycobacterium
TGVKNPDYSD

SEQ ID NO: 1089187 - protein, 10 aa, Mycobacterium
THDPATPYKA

SEQ ID NO: 1089188 - protein, 6 aa, Mycobacterium
THPPAA

SEQ ID NO: 1089189 - protein, 26 aa, Mycobacterium
THTTPTVSAQPPSTTTTPPPPPPIAP

SEQ ID NO: 1089190 - protein, 7 aa, Mycobacterium
TIDRESA

SEQ ID NO: 1089191 - protein, 10 aa, Mycobacterium
TKDPLGSVDE

SEQ ID NO: 1089192 - protein, 5 aa, Mycobacterium
TKKPQ

SEQ ID NO: 1089193 - protein, 19 aa, Mycobacterium
TKPADTKNPNSGQGTSQAD

SEQ ID NO: 1089194 - protein, 17 aa, Mycobacterium
TKPDLTPVTDADRAVET

SEQ ID NO: 1089195 - protein, 9 aa, Mycobacterium
TKPVGPGAD

SEQ ID NO: 1089196 - protein, 10 aa, Mycobacterium
TKQLPSSTPV

SEQ ID NO: 1089197 - protein, 5 aa, Mycobacterium
TKQPI

SEQ ID NO: 1089198 - protein, 6 aa, Mycobacterium
TKSRVR

SEQ ID NO: 1089199 - protein, 10 aa, Mycobacterium
TKSSPGPRVG

SEQ ID NO: 1089200 - protein, 12 aa, Mycobacterium
TKTGIDADGLGR

SEQ ID NO: 1089201 - protein, 6 aa, Mycobacterium
TKTNPQ

SEQ ID NO: 1089202 - protein, 9 aa, Mycobacterium
TLDDQSDDI

SEQ ID NO: 1089203 - protein, 6 aa, Mycobacterium
TLDTVS

SEQ ID NO: 1089204 - protein, 10 aa, Mycobacterium
TLGGSGAVNG

SEQ ID NO: 1089205 - protein, 9 aa, Mycobacterium
TLGRTTGSV

SEQ ID NO: 1089206 - protein, 6 aa, Mycobacterium
TLHDPY

SEQ ID NO: 1089207 - protein, 9 aa, Mycobacterium
TLKSSKPPL

SEQ ID NO: 1089208 - protein, 23 aa, Mycobacterium
TLPGPATGLTGDGHGKAYASARG

SEQ ID NO: 1089209 - protein, 7 aa, Mycobacterium
TLPPDAI

SEQ ID NO: 1089210 - protein, 23 aa, Mycobacterium
TLSDPGPGLAGAPLPPSQSDPEF

SEQ ID NO: 1089211 - protein, 7 aa, Mycobacterium
TLSGAGP

SEQ ID NO: 1089212 - protein, 5 aa, Mycobacterium
TMPEK

SEQ ID NO: 1089213 - protein, 21 aa, Mycobacterium
TMPPQKRSPIALSTQEGSPQV

SEQ ID NO: 1089214 - protein, 8 aa, Mycobacterium
TMPRRSSW

SEQ ID NO: 1089215 - protein, 5 aa, Mycobacterium
TNGTH

SEQ ID NO: 1089216 - protein, 6 aa, Mycobacterium
TNLGPA

SEQ ID NO: 1089217 - protein, 11 aa, Mycobacterium
TNLSNTPGSFG

SEQ ID NO: 1089218 - protein, 11 aa, Mycobacterium
TNNAASPAHQA

SEQ ID NO: 1089219 - protein, 7 aa, Mycobacterium
TNNGPID

SEQ ID NO: 1089220 - protein, 16 aa, Mycobacterium
TNPAPSRKPQADNKFQ

SEQ ID NO: 1089221 - protein, 8 aa, Mycobacterium
TNPEDDTQ

SEQ ID NO: 1089222 - protein, 10 aa, Mycobacterium
TNPGASDPAA

SEQ ID NO: 1089223 - protein, 7 aa, Mycobacterium
TNPPVEG

SEQ ID NO: 1089224 - protein, 13 aa, Mycobacterium
TNPQFTSTRHVNR

SEQ ID NO: 1089225 - protein, 7 aa, Mycobacterium
TNRRRNR

SEQ ID NO: 1089226 - protein, 5 aa, Mycobacterium
TNSDH

SEQ ID NO: 1089227 - protein, 6 aa, Mycobacterium
TNTAQD

SEQ ID NO: 1089228 - protein, 8 aa, Mycobacterium
TNTIGTDS

SEQ ID NO: 1089229 - protein, 6 aa, Mycobacterium
TNTLAD

SEQ ID NO: 1089230 - protein, 6 aa, Mycobacterium
TNTQEG

SEQ ID NO: 1089231 - protein, 11 aa, Mycobacterium
TPAAAEPETCP

SEQ ID NO: 1089232 - protein, 11 aa, Mycobacterium
TPAGASPGEVI

SEQ ID NO: 1089233 - protein, 13 aa, Mycobacterium
TPATQAKAETPVP

SEQ ID NO: 1089234 - protein, 8 aa, Mycobacterium
TPDANKDH

SEQ ID NO: 1089235 - protein, 16 aa, Mycobacterium
TPDPPPSATNVSRTDG

SEQ ID NO: 1089236 - protein, 6 aa, Mycobacterium
TPDQRT

SEQ ID NO: 1089237 - protein, 5 aa, Mycobacterium
TPEPK

SEQ ID NO: 1089238 - protein, 8 aa, Mycobacterium
TPGAGGAR

SEQ ID NO: 1089239 - protein, 9 aa, Mycobacterium
TPGDWNAPD

SEQ ID NO: 1089240 - protein, 9 aa, Mycobacterium
TPGLGPEGH

SEQ ID NO: 1089241 - protein, 5 aa, Mycobacterium
TPGNL

SEQ ID NO: 1089242 - protein, 7 aa, Mycobacterium
TPHPVDG

SEQ ID NO: 1089243 - protein, 13 aa, Mycobacterium
TPLATKPPSGPMV

SEQ ID NO: 1089244 - protein, 7 aa, Mycobacterium
TPLTSGA

SEQ ID NO: 1089245 - protein, 5 aa, Mycobacterium
TPPAA

SEQ ID NO: 1089246 - protein, 14 aa, Mycobacterium
TPPDPLPPGEPGDV

SEQ ID NO: 1089247 - protein, 8 aa, Mycobacterium
TPPEDPAA

SEQ ID NO: 1089248 - protein, 7 aa, Mycobacterium
TPPEHED

SEQ ID NO: 1089249 - protein, 16 aa, Mycobacterium
TPPGGLGRTAGPAQPV

SEQ ID NO: 1089250 - protein, 8 aa, Mycobacterium
TPPLSDLQ

SEQ ID NO: 1089251 - protein, 12 aa, Mycobacterium
TPPTAPPGTPGE

SEQ ID NO: 1089252 - protein, 8 aa, Mycobacterium
TPPYRGGP

SEQ ID NO: 1089253 - protein, 14 aa, Mycobacterium
TPPYSGGPTTASGA

SEQ ID NO: 1089254 - protein, 12 aa, Mycobacterium
TPQISEPQYPVE

SEQ ID NO: 1089255 - protein, 10 aa, Mycobacterium
TPSPPRTGMP

SEQ ID NO: 1089256 - protein, 6 aa, Mycobacterium
TPSSAA

SEQ ID NO: 1089257 - protein, 11 aa, Mycobacterium
TPSSGQTAAAT

SEQ ID NO: 1089258 - protein, 36 aa, Mycobacterium
TPTAAGHTPARAGAATAVAPQTPARAASPAAPAQAP

SEQ ID NO: 1089259 - protein, 5 aa, Mycobacterium
TPTDN

SEQ ID NO: 1089260 - protein, 10 aa, Mycobacterium
TPTGATRSRL

SEQ ID NO: 1089261 - protein, 8 aa, Mycobacterium
TPVATPQQ

SEQ ID NO: 1089262 - protein, 13 aa, Mycobacterium
TPVEAGTEIDSQT

SEQ ID NO: 1089263 - protein, 13 aa, Mycobacterium
TPYGGPRLPIEPP

SEQ ID NO: 1089264 - protein, 6 aa, Mycobacterium
TQAARD

SEQ ID NO: 1089265 - protein, 7 aa, Mycobacterium
TQAGVEA

SEQ ID NO: 1089266 - protein, 5 aa, Mycobacterium
TQDEP

SEQ ID NO: 1089267 - protein, 17 aa, Mycobacterium
TQGGPGSENSPIGAGTS

SEQ ID NO: 1089268 - protein, 4 aa, Mycobacterium
TQGN

SEQ ID NO: 1089269 - protein, 32 aa, Mycobacterium
TQLPAATSGSTAVGSSSDINPQDPATLEDGGD

SEQ ID NO: 1089270 - protein, 11 aa, Mycobacterium
TQPADPSDPPT

SEQ ID NO: 1089271 - protein, 7 aa, Mycobacterium
TQQTAAP

SEQ ID NO: 1089272 - protein, 7 aa, Mycobacterium
TQSPGTI

SEQ ID NO: 1089273 - protein, 6 aa, Mycobacterium
TQSPPA

SEQ ID NO: 1089274 - protein, 18 aa, Mycobacterium
TQTQTQPQPAISNPAAAE

SEQ ID NO: 1089275 - protein, 10 aa, Mycobacterium
TRAKSETASS

SEQ ID NO: 1089276 - protein, 4 aa, Mycobacterium
TRAQ

SEQ ID NO: 1089277 - protein, 5 aa, Mycobacterium
TRATQ

SEQ ID NO: 1089278 - protein, 14 aa, Mycobacterium
TRATRGADGNYTID

SEQ ID NO: 1089279 - protein, 9 aa, Mycobacterium
TRDGQPVTT

SEQ ID NO: 1089280 - protein, 4 aa, Mycobacterium
TRGG

SEQ ID NO: 1089281 - protein, 5 aa, Mycobacterium
TRGPL

SEQ ID NO: 1089282 - protein, 4 aa, Mycobacterium
TRIG

SEQ ID NO: 1089283 - protein, 4 aa, Mycobacterium
TRIN

SEQ ID NO: 1089284 - protein, 16 aa, Mycobacterium
TRISGSQLKAARPEAR

SEQ ID NO: 1089285 - protein, 9 aa, Mycobacterium
TRLPGRAPA

SEQ ID NO: 1089286 - protein, 5 aa, Mycobacterium
TRPDG

SEQ ID NO: 1089287 - protein, 11 aa, Mycobacterium
TRQANPKLPTL

SEQ ID NO: 1089288 - protein, 14 aa, Mycobacterium
TRQRDRDSTNEVSA

SEQ ID NO: 1089289 - protein, 6 aa, Mycobacterium
TRQRQG

SEQ ID NO: 1089290 - protein, 9 aa, Mycobacterium
TRRPSPVTA

SEQ ID NO: 1089291 - protein, 7 aa, Mycobacterium
TRSARPE

SEQ ID NO: 1089292 - protein, 8 aa, Mycobacterium
TRSDPSRP

SEQ ID NO: 1089293 - protein, 11 aa, Mycobacterium
TRSKAHAPASW

SEQ ID NO: 1089294 - protein, 8 aa, Mycobacterium
TRSPSTAY

SEQ ID NO: 1089295 - protein, 8 aa, Mycobacterium
TRTPPGVR

SEQ ID NO: 1089296 - protein, 7 aa, Mycobacterium
TSADYAA

SEQ ID NO: 1089297 - protein, 10 aa, Mycobacterium
TSAGRAAASQ

SEQ ID NO: 1089298 - protein, 38 aa, Mycobacterium; identical to SEQ ID NO: 920194

SEQ ID NO: 1089299 - protein, 16 aa, Mycobacterium
TSATTSTTATTAPPVP

SEQ ID NO: 1089300 - protein, 12 aa, Mycobacterium
TSDELRKAAEGY

SEQ ID NO: 1089301 - protein, 5 aa, Mycobacterium
TSDNM

SEQ ID NO: 1089302 - protein, 5 aa, Mycobacterium
TSGNL

SEQ ID NO: 1089303 - protein, 25 aa, Mycobacterium
TSGVANSGNNSSGGFNANPDQSGFF

SEQ ID NO: 1089304 - protein, 7 aa, Mycobacterium
TSIPSGS

SEQ ID NO: 1089305 - protein, 10 aa, Mycobacterium
TSKYPDEKQV

SEQ ID NO: 1089306 - protein, 21 aa, Mycobacterium
TSLSGEPKPPPQKQPKLPPPA

SEQ ID NO: 1089307 - protein, 6 aa, Mycobacterium
TSPSGN

SEQ ID NO: 1089308 - protein, 11 aa, Mycobacterium
TSQVQEAGDGW

SEQ ID NO: 1089309 - protein, 7 aa, Mycobacterium
TSRAPQR

SEQ ID NO: 1089310 - protein, 8 aa, Mycobacterium
TSSEAGLV

SEQ ID NO: 1089311 - protein, 5 aa, Mycobacterium
TSSPA

SEQ ID NO: 1089312 - protein, 19 aa, Mycobacterium
TSSSGGQRTENVTLAEGPP

SEQ ID NO: 1089313 - protein, 6 aa, Mycobacterium
TSSSQV

SEQ ID NO: 1089314 - protein, 9 aa, Mycobacterium
TSTANPAVP

SEQ ID NO: 1089315 - protein, 11 aa, Mycobacterium
TSTASAAPLGS

SEQ ID NO: 1089316 - protein, 13 aa, Mycobacterium
TSVAEYHSAAAFT

SEQ ID NO: 1089317 - protein, 6 aa, Mycobacterium
TTAEAV

SEQ ID NO: 1089318 - protein, 4 aa, Mycobacterium
TTAL

SEQ ID NO: 1089319 - protein, 9 aa, Mycobacterium
TTAPSAAPN

SEQ ID NO: 1089320 - protein, 15 aa, Mycobacterium
TTAQSQAVADAPATD

SEQ ID NO: 1089321 - protein, 10 aa, Mycobacterium
TTDDLGAQQV

SEQ ID NO: 1089322 - protein, 6 aa, Mycobacterium
TTDDVR

SEQ ID NO: 1089323 - protein, 9 aa, Mycobacterium
TTDKGVPGA

SEQ ID NO: 1089324 - protein, 8 aa, Mycobacterium
TTDPGSVL

SEQ ID NO: 1089325 - protein, 5 aa, Mycobacterium
TTDSG

SEQ ID NO: 1089326 - protein, 7 aa, Mycobacterium
TTEIRSS

SEQ ID NO: 1089327 - protein, 4 aa, Mycobacterium
TTEP

SEQ ID NO: 1089328 - protein, 9 aa, Mycobacterium
TTGAQPVTG

SEQ ID NO: 1089329 - protein, 4 aa, Mycobacterium
TTGD

SEQ ID NO: 1089330 - protein, 14 aa, Mycobacterium
TTGGGYPTGKEIYL

SEQ ID NO: 1089331 - protein, 4 aa, Mycobacterium
TTGP

SEQ ID NO: 1089332 - protein, 5 aa, Mycobacterium
TTGSL

SEQ ID NO: 1089333 - protein, 10 aa, Mycobacterium
TTKDTEVQGV

SEQ ID NO: 1089334 - protein, 5 aa, Mycobacterium
TTKER

SEQ ID NO: 1089335 - protein, 7 aa, Mycobacterium
TTKPAVE

SEQ ID NO: 1089336 - protein, 15 aa, Mycobacterium
TTPPHREQYSDPDQP

SEQ ID NO: 1089337 - protein, 5 aa, Mycobacterium
TTQLE

SEQ ID NO: 1089338 - protein, 9 aa, Mycobacterium
TTRGSQLTP

SEQ ID NO: 1089339 - protein, 6 aa, Mycobacterium
TTSAAA

SEQ ID NO: 1089340 - protein, 5 aa, Mycobacterium
TTSKV

SEQ ID NO: 1089341 - protein, 6 aa, Mycobacterium
TTSNPL

SEQ ID NO: 1089342 - protein, 15 aa, Mycobacterium
TTSQDHSELHSATQK

SEQ ID NO: 1089343 - protein, 7 aa, Mycobacterium
TTTEGYR

SEQ ID NO: 1089344 - protein, 23 aa, Mycobacterium
TTTHQAGQESTIAPPTKAATAVT

SEQ ID NO: 1089345 - protein, 5 aa, Mycobacterium
TTTPS

SEQ ID NO: 1089346 - protein, 10 aa, Mycobacterium
TTVAGTALPA

SEQ ID NO: 1089347 - protein, 8 aa, Mycobacterium
TTVGYQPK

SEQ ID NO: 1089348 - protein, 12 aa, Mycobacterium
TTVTPDKQIDGG

SEQ ID NO: 1089349 - protein, 7 aa, Mycobacterium
TVAQSGT

SEQ ID NO: 1089350 - protein, 14 aa, Mycobacterium
TVEASDALTGAEET

SEQ ID NO: 1089351 - protein, 12 aa, Mycobacterium
TVEEKQESARGL

SEQ ID NO: 1089352 - protein, 7 aa, Mycobacterium
TVGPIPD

SEQ ID NO: 1089353 - protein, 15 aa, Mycobacterium
TVPAQPASPGSSTQK

SEQ ID NO: 1089354 - protein, 5 aa, Mycobacterium
TVTAG

SEQ ID NO: 1089355 - protein, 13 aa, Mycobacterium
TVTDKSRAVGSSG

SEQ ID NO: 1089356 - protein, 4 aa, Mycobacterium
TVTP

SEQ ID NO: 1089357 - protein, 11 aa, Mycobacterium
TWSPPPKPADC

SEQ ID NO: 1089358 - protein, 5 aa, Mycobacterium
TWSSV

SEQ ID NO: 1089359 - protein, 6 aa, Mycobacterium
TYDPRR

SEQ ID NO: 1089360 - protein, 5 aa, Mycobacterium
TYPGT

SEQ ID NO: 1089361 - protein, 5 aa, Mycobacterium
TYSPP

SEQ ID NO: 1089362 - protein, 4 aa, Mycobacterium
VAAA

SEQ ID NO: 1089363 - protein, 14 aa, Mycobacterium
VAAAPPVAAAPAPS

SEQ ID NO: 1089364 - protein, 10 aa, Mycobacterium
VAAAQTTAVQ

SEQ ID NO: 1089365 - protein, 11 aa, Mycobacterium
VAADGKKMENA

SEQ ID NO: 1089366 - protein, 45 aa, Mycobacterium
VAAPAPVPAPAPAAAPAPEAAAPAPAPAPAPAAAPGFGPDAPPTQ

SEQ ID NO: 1089367 - protein, 31 aa, Mycobacterium
VAAPTPPSAPPSAASTVANAAPPPPPAPAAA

SEQ ID NO: 1089368 - protein, 16 aa, Mycobacterium
VADSKQHSLPQGDDTA

SEQ ID NO: 1089369 - protein, 7 aa, Mycobacterium
VAEESGA

SEQ ID NO: 1089370 - protein, 6 aa, Mycobacterium
VAEPVS

SEQ ID NO: 1089371 - protein, 13 aa, Mycobacterium
VAGEPGEGKPTTM

SEQ ID NO: 1089372 - protein, 10 aa, Mycobacterium
VAGGADPQAV

SEQ ID NO: 1089373 - protein, 15 aa, Mycobacterium
VAGGCGSLSSGHLRP

SEQ ID NO: 1089374 - protein, 12 aa, Mycobacterium
VAGTRTGYDPAD

SEQ ID NO: 1089375 - protein, 8 aa, Mycobacterium
VAKQTGDY

SEQ ID NO: 1089376 - protein, 7 aa, Mycobacterium
VAPAETV

SEQ ID NO: 1089377 - protein, 8 aa, Mycobacterium
VAPGDSVG

SEQ ID NO: 1089378 - protein, 21 aa, Mycobacterium
VAPPASAPVPHVPAPGAEPGT

SEQ ID NO: 1089379 - protein, 16 aa, Mycobacterium
VAPPASDTNDNGDFSR

SEQ ID NO: 1089380 - protein, 12 aa, Mycobacterium
VAPPDSGLYTSG

SEQ ID NO: 1089381 - protein, 5 aa, Mycobacterium
VAPRR

SEQ ID NO: 1089382 - protein, 7 aa, Mycobacterium
VARTGMH

SEQ ID NO: 1089383 - protein, 19 aa, Mycobacterium
VASGTDPDFGRGASAYDGY

SEQ ID NO: 1089384 - protein, 11 aa, Mycobacterium
VATQTRAVGER

SEQ ID NO: 1089385 - protein, 8 aa, Mycobacterium
VDAAPGRI

SEQ ID NO: 1089386 - protein, 6 aa, Mycobacterium
VDAETY

SEQ ID NO: 1089387 - protein, 8 aa, Mycobacterium
VDARPTRT

SEQ ID NO: 1089388 - protein, 12 aa, Mycobacterium
VDDATAKGAKVI

SEQ ID NO: 1089389 - protein, 5 aa, Mycobacterium
VDDSI

SEQ ID NO: 1089390 - protein, 9 aa, Mycobacterium
VDEDRRSRE

SEQ ID NO: 1089391 - protein, 16 aa, Mycobacterium
VDGGTGGAGGAGGAGG

SEQ ID NO: 1089392 - protein, 4 aa, Mycobacterium
VDNP

SEQ ID NO: 1089393 - protein, 14 aa, Mycobacterium
VDPATLGPNPPDEL

SEQ ID NO: 1089394 - protein, 7 aa, Mycobacterium
VDPGEWE

SEQ ID NO: 1089395 - protein, 10 aa, Mycobacterium
VDPNADPIEA

SEQ ID NO: 1089396 - protein, 8 aa, Mycobacterium
VDPPPGFG

SEQ ID NO: 1089397 - protein, 7 aa, Mycobacterium
VDPQRGR

SEQ ID NO: 1089398 - protein, 9 aa, Mycobacterium
VDPSQPLTS

SEQ ID NO: 1089399 - protein, 9 aa, Mycobacterium
VDRSSAGGH

SEQ ID NO: 1089400 - protein, 15 aa, Mycobacterium
VDSSYSSRNVLGGAN

SEQ ID NO: 1089401 - protein, 12 aa, Mycobacterium
VDTQPVQRGKLR

SEQ ID NO: 1089402 - protein, 9 aa, Mycobacterium
VEEGDDAEV

SEQ ID NO: 1089403 - protein, 5 aa, Mycobacterium
VEESE

SEQ ID NO: 1089404 - protein, 17 aa, Mycobacterium
VEGANGAQSDGFEATTD

SEQ ID NO: 1089405 - protein, 7 aa, Mycobacterium
VEKGQCT

SEQ ID NO: 1089406 - protein, 6 aa, Mycobacterium
VEPTGC

SEQ ID NO: 1089407 - protein, 6 aa, Mycobacterium
VGADPL

SEQ ID NO: 1089408 - protein, 13 aa, Mycobacterium
VGAGGAGGNGGAG

SEQ ID NO: 1089409 - protein, 9 aa, Mycobacterium
VGATSKGVC

SEQ ID NO: 1089410 - protein, 11 aa, Mycobacterium
VGDQDGSVRPS

SEQ ID NO: 1089411 - protein, 8 aa, Mycobacterium
VGDQGSYR

SEQ ID NO: 1089412 - protein, 13 aa, Mycobacterium
VGEPARAPGVPVG

SEQ ID NO: 1089413 - protein, 23 aa, Mycobacterium
VGGDGGAASSGIGGVGGAGGNAD

SEQ ID NO: 1089414 - protein, 18 aa, Mycobacterium
VGGEFRGGVGQGARGSAG

SEQ ID NO: 1089415 - protein, 8 aa, Mycobacterium
VGGGATPA

SEQ ID NO: 1089416 - protein, 8 aa, Mycobacterium
VGGGPEAP

SEQ ID NO: 1089417 - protein, 22 aa, Mycobacterium
VGGHGGDATTGIGGAGGAGGMA

SEQ ID NO: 1089418 - protein, 10 aa, Mycobacterium
VGGNSVYTSN

SEQ ID NO: 1089419 - protein, 10 aa, Mycobacterium
VGGPRPQTTY

SEQ ID NO: 1089420 - protein, 4 aa, Mycobacterium
VGGT

SEQ ID NO: 1089421 - protein, 11 aa, Mycobacterium
VGHDGKAIPVG

SEQ ID NO: 1089422 - protein, 11 aa, Mycobacterium
VGIGNNGNNNI

SEQ ID NO: 1089423 - protein, 4 aa, Mycobacterium
VGNP

SEQ ID NO: 1089424 - protein, 9 aa, Mycobacterium
VGPAGSPAT

SEQ ID NO: 1089425 - protein, 10 aa, Mycobacterium
VGPPLPPGLQ

SEQ ID NO: 1089426 - protein, 6 aa, Mycobacterium
VGPRGP

SEQ ID NO: 1089427 - protein, 5 aa, Mycobacterium
VGPTL

SEQ ID NO: 1089428 - protein, 11 aa, Mycobacterium
VGQRPDSVTCP

SEQ ID NO: 1089429 - protein, 10 aa, Mycobacterium
VGRQSEEGSG

SEQ ID NO: 1089430 - protein, 5 aa, Mycobacterium
VGSAS

SEQ ID NO: 1089431 - protein, 15 aa, Mycobacterium
VGSGTGGAGGLGGTG

SEQ ID NO: 1089432 - protein, 5 aa, Mycobacterium
VGSGY

SEQ ID NO: 1089433 - protein, 8 aa, Mycobacterium
VGSRGEVK

SEQ ID NO: 1089434 - protein, 16 aa, Mycobacterium
VGSSISAANAAAAAPT

SEQ ID NO: 1089435 - protein, 8 aa, Mycobacterium
VGTGKRAT

SEQ ID NO: 1089436 - protein, 10 aa, Mycobacterium
VGTGKRATSV

SEQ ID NO: 1089437 - protein, 4 aa, Mycobacterium
VGTQ

SEQ ID NO: 1089438 - protein, 8 aa, Mycobacterium
VHGRTGPI

SEQ ID NO: 1089439 - protein, 42 aa, Mycobacterium
VIGGDGQAGSAGEFPGDRGGSGGAGARGGNGGDGGAGGAGGH

SEQ ID NO: 1089440 - protein, 11 aa, Mycobacterium
VIGSSGTPGRR

SEQ ID NO: 1089441 - protein, 7 aa, Mycobacterium
VKQAGGK

SEQ ID NO: 1089442 - protein, 12 aa, Mycobacterium
VKSEGGRNSQAG

SEQ ID NO: 1089443 - protein, 5 aa, Mycobacterium
VKSGE

SEQ ID NO: 1089444 - protein, 5 aa, Mycobacterium
VNGGF

SEQ ID NO: 1089445 - protein, 9 aa, Mycobacterium
VNPAETAAI

SEQ ID NO: 1089446 - protein, 19 aa, Mycobacterium
VNPAPGSPPLGVPAPAAAP

SEQ ID NO: 1089447 - protein, 6 aa, Mycobacterium
VNPPGR

SEQ ID NO: 1089448 - protein, 11 aa, Mycobacterium
VNSGQSGLASA

SEQ ID NO: 1089449 - protein, 7 aa, Mycobacterium
VNTPTQA

SEQ ID NO: 1089450 - protein, 12 aa, Mycobacterium
VNVSADGESLVF

SEQ ID NO: 1089451 - protein, 13 aa, Mycobacterium
VPAASADSSRRDM

SEQ ID NO: 1089452 - protein, 13 aa, Mycobacterium
VPAGAGPAVPPTA

SEQ ID NO: 1089453 - protein, 54 aa, Mycobacterium
VPAGTTTAASTAIAAGSADNGGIRTRSSRHTVTTGTAGTAQRSVTANAARAMTA

SEQ ID NO: 1089454 - protein, 12 aa, Mycobacterium
VPAIPGVPGVPG

SEQ ID NO: 1089455 - protein, 74 aa, Mycobacterium
VPATTAPAQNGPPPPGTPGGVYGPGGWGGPGGPGGPPASGEPYGPYGPQGGAPGTPGWPGGIAGPTAAGGHAGM

SEQ ID NO: 1089456 - protein, 5 aa, Mycobacterium
VPDGA

SEQ ID NO: 1089457 - protein, 6 aa, Mycobacterium
VPDGAS

SEQ ID NO: 1089458 - protein, 7 aa, Mycobacterium
VPDPNVP

SEQ ID NO: 1089459 - protein, 5 aa, Mycobacterium
VPEPR

SEQ ID NO: 1089460 - protein, 6 aa, Mycobacterium
VPESLR

SEQ ID NO: 1089461 - protein, 4 aa, Mycobacterium
VPGQ

SEQ ID NO: 1089462 - protein, 7 aa, Mycobacterium
VPGSPTP

SEQ ID NO: 1089463 - protein, 4 aa, Mycobacterium
VPGV

SEQ ID NO: 1089464 - protein, 6 aa, Mycobacterium
VPHAQA

SEQ ID NO: 1089465 - protein, 16 aa, Mycobacterium
VPIDRTNSDAAQAALE

SEQ ID NO: 1089466 - protein, 8 aa, Mycobacterium
VPLPGPGY

SEQ ID NO: 1089467 - protein, 8 aa, Mycobacterium
VPPAAPAP

SEQ ID NO: 1089468 - protein, 6 aa, Mycobacterium
VPPAGA

SEQ ID NO: 1089469 - protein, 35 aa, Mycobacterium
VPPQPDMPPAEPPADVTVEPDPAAGLRGMMVPPGG

SEQ ID NO: 1089470 - protein, 17 aa, Mycobacterium
VPPRADGVYSRGGGPVQ

SEQ ID NO: 1089471 - protein, 8 aa, Mycobacterium
VPSDRDHD

SEQ ID NO: 1089472 - protein, 56 aa, Mycobacterium
VPSLTGGTGTGMSPGLTSPGLTSPGLTSPGLTSPGLTSPGLTSPGLTTPGLTPGMP

SEQ ID NO: 1089473 - protein, 7 aa, Mycobacterium
VPSPDLE

SEQ ID NO: 1089474 - protein, 7 aa, Mycobacterium
VPTATRR

SEQ ID NO: 1089475 - protein, 9 aa, Mycobacterium
VQGGPPRRI

SEQ ID NO: 1089476 - protein, 7 aa, Mycobacterium
VQGPRWG

SEQ ID NO: 1089477 - protein, 5 aa, Mycobacterium
VQGSR

SEQ ID NO: 1089478 - protein, 61 aa, Mycobacterium
VQKSSRAPDSPVAARQATVAGGPGRTGATGTAGTAAAQQPGRPAVPAGLTRRAGPAVAAVA

SEQ ID NO: 1089479 - protein, 14 aa, Mycobacterium
VQSPGAEHLGDPSY

SEQ ID NO: 1089480 - protein, 14 aa, Mycobacterium
VQSSNSGLQEDGAA

SEQ ID NO: 1089481 - protein, 24 aa, Mycobacterium
VRDPRRAPARGPVPGGADQPAGGC

SEQ ID NO: 1089482 - protein, 19 aa, Mycobacterium
VREEARRRRRKRKTERGYG

SEQ ID NO: 1089483 - protein, 5 aa, Mycobacterium
VRPGE

SEQ ID NO: 1089484 - protein, 6 aa, Mycobacterium
VRRGSL

SEQ ID NO: 1089485 - protein, 16 aa, Mycobacterium
VRRSRAGVADPNRPTG

SEQ ID NO: 1089486 - protein, 4 aa, Mycobacterium
VRSG

SEQ ID NO: 1089487 - protein, 8 aa, Mycobacterium
VRSSTAET

SEQ ID NO: 1089488 - protein, 7 aa, Mycobacterium
VRTGSGA

SEQ ID NO: 1089489 - protein, 15 aa, Mycobacterium
VRTSGMTPFVVRYIE

SEQ ID NO: 1089490 - protein, 6 aa, Mycobacterium
VSAEPK

SEQ ID NO: 1089491 - protein, 30 aa, Mycobacterium
VSANGHSGVRNSGDATNVGFSNSGSNNTGI

SEQ ID NO: 1089492 - protein, 17 aa, Mycobacterium
VSATGQRVCGKHLDDLP

SEQ ID NO: 1089493 - protein, 10 aa, Mycobacterium
VSDPGQQAAT

SEQ ID NO: 1089494 - protein, 7 aa, Mycobacterium
VSDQTVT

SEQ ID NO: 1089495 - protein, 7 aa, Mycobacterium
VSDTGSG

SEQ ID NO: 1089496 - protein, 17 aa, Mycobacterium
VSEPGPSAGKLKAGDAI

SEQ ID NO: 1089497 - protein, 4 aa, Mycobacterium
VSGH

SEQ ID NO: 1089498 - protein, 10 aa, Mycobacterium
VSGSGGIRGP

SEQ ID NO: 1089499 - protein, 8 aa, Mycobacterium
VSKDNGQN

SEQ ID NO: 1089500 - protein, 14 aa, Mycobacterium
VSKGDGQDNKVDTD

SEQ ID NO: 1089501 - protein, 5 aa, Mycobacterium
VSNGD

SEQ ID NO: 1089502 - protein, 10 aa, Mycobacterium
VSPPNNTGDG

SEQ ID NO: 1089503 - protein, 4 aa, Mycobacterium
VSPR

SEQ ID NO: 1089504 - protein, 11 aa, Mycobacterium
VSPRPDDAVGE

SEQ ID NO: 1089505 - protein, 14 aa, Mycobacterium
VSRPARTKDPRGLS

SEQ ID NO: 1089506 - protein, 9 aa, Mycobacterium
VSSRTPAGL

SEQ ID NO: 1089507 - protein, 11 aa, Mycobacterium
VSSTPATARTC

SEQ ID NO: 1089508 - protein, 5 aa, Mycobacterium
VTAGR

SEQ ID NO: 1089509 - protein, 37 aa, Mycobacterium
VTAGSTGLTGAARQTGAAIPAGTTAPAATPNSGVAPH

SEQ ID NO: 1089510 - protein, 10 aa, Mycobacterium
VTGKEPSEQA

SEQ ID NO: 1089511 - protein, 4 aa, Mycobacterium
VTGS

SEQ ID NO: 1089512 - protein, 10 aa, Mycobacterium
VTGSGGIRGP

SEQ ID NO: 1089513 - protein, 7 aa, Mycobacterium
VTLTQGT

SEQ ID NO: 1089514 - protein, 20 aa, Mycobacterium
VTPGDPVNRYSGSPISQPGF

SEQ ID NO: 1089515 - protein, 8 aa, Mycobacterium
VTPPGLRA

SEQ ID NO: 1089516 - protein, 9 aa, Mycobacterium
VTPRTDAAA

SEQ ID NO: 1089517 - protein, 12 aa, Mycobacterium
VTSKSPDEKQVL

SEQ ID NO: 1089518 - protein, 14 aa, Mycobacterium
VTSLSGPVTSSPHV

SEQ ID NO: 1089519 - protein, 15 aa, Mycobacterium
VTSPPPDNHTTTVTT

SEQ ID NO: 1089520 - protein, 5 aa, Mycobacterium
VTTET

SEQ ID NO: 1089521 - protein, 6 aa, Mycobacterium
VTTNPS

SEQ ID NO: 1089522 - protein, 4 aa, Mycobacterium
VTTP

SEQ ID NO: 1089523 - protein, 9 aa, Mycobacterium
VTTTPPVEG

SEQ ID NO: 1089524 - protein, 7 aa, Mycobacterium
VVPEQGR

SEQ ID NO: 1089525 - protein, 20 aa, Mycobacterium
VVPPRPGASTVTAATAVSAG

SEQ ID NO: 1089526 - protein, 12 aa, Mycobacterium
VYGPRQDPHGEA

SEQ ID NO: 1089527 - protein, 7 aa, Mycobacterium
VYQGDAS

SEQ ID NO: 1089528 - protein, 9 aa, Mycobacterium
VYSDGKQVT

SEQ ID NO: 1089529 - protein, 5 aa, Mycobacterium
WAPDG

SEQ ID NO: 1089530 - protein, 17 aa, Mycobacterium
WARSGHAGHQAGTQPVR

SEQ ID NO: 1089531 - protein, 5 aa, Mycobacterium
WARSN

SEQ ID NO: 1089532 - protein, 19 aa, Mycobacterium
WDSNPTHAGLRSAATRGAS

SEQ ID NO: 1089533 - protein, 11 aa, Mycobacterium
WESSPQDDPLN

SEQ ID NO: 1089534 - protein, 4 aa, Mycobacterium
WGAD

SEQ ID NO: 1089535 - protein, 9 aa, Mycobacterium
WGPGQDPGT

SEQ ID NO: 1089536 - protein, 12 aa, Mycobacterium
WGPSTDPAWKRN

SEQ ID NO: 1089537 - protein, 17 aa, Mycobacterium
WGPSTDPAWKRNDPTVN

SEQ ID NO: 1089538 - protein, 7 aa, Mycobacterium
WNGAGGV

SEQ ID NO: 1089539 - protein, 5 aa, Mycobacterium
WPGAQ

SEQ ID NO: 1089540 - protein, 12 aa, Mycobacterium
WPPSARAQPRTH

SEQ ID NO: 1089541 - protein, 11 aa, Mycobacterium
WQGTDQPAAQL

SEQ ID NO: 1089542 - protein, 9 aa, Mycobacterium
WQPTSSGSG

SEQ ID NO: 1089543 - protein, 4 aa, Mycobacterium
WRAR

SEQ ID NO: 1089544 - protein, 10 aa, Mycobacterium
WSDPGKRSTI

SEQ ID NO: 1089545 - protein, 9 aa, Mycobacterium
WSPGPDDTL

SEQ ID NO: 1089546 - protein, 8 aa, Mycobacterium
YAGAPPAD

SEQ ID NO: 1089547 - protein, 5 aa, Mycobacterium
YAGPP

SEQ ID NO: 1089548 - protein, 18 aa, Mycobacterium
YANPGTARDYNPDSNESL

SEQ ID NO: 1089549 - protein, 24 aa, Mycobacterium
YAPATEAAEPPATAPQPPRGKYDP

SEQ ID NO: 1089550 - protein, 6 aa, Mycobacterium
YASTRH

SEQ ID NO: 1089551 - protein, 8 aa, Mycobacterium
YAVSASKT

SEQ ID NO: 1089552 - protein, 13 aa, Mycobacterium
YCPGPAVGGSTSL

SEQ ID NO: 1089553 - protein, 4 aa, Mycobacterium
YDLE

SEQ ID NO: 1089554 - protein, 5 aa, Mycobacterium
YDLEG

SEQ ID NO: 1089555 - protein, 7 aa, Mycobacterium
YDPDGNR

SEQ ID NO: 1089556 - protein, 27 aa, Mycobacterium
YDRGPARKPGQLSWGTGSTPTYFGPTG

SEQ ID NO: 1089557 - protein, 9 aa, Mycobacterium
YDSNDPNSP

SEQ ID NO: 1089558 - protein, 10 aa, Mycobacterium
YDVDDRNQNP

SEQ ID NO: 1089559 - protein, 11 aa, Mycobacterium
YEAASDTPSGL

SEQ ID NO: 1089560 - protein, 36 aa, Mycobacterium
YEASPYGNGGNGVNGGSGGKGGSAGQVGGTPGQNGS

SEQ ID NO: 1089561 - protein, 9 aa, Mycobacterium
YEPKTDSAQ

SEQ ID NO: 1089562 - protein, 8 aa, Mycobacterium
YEPPRSTK

SEQ ID NO: 1089563 - protein, 5 aa, Mycobacterium
YGAQQ

SEQ ID NO: 1089564 - protein, 12 aa, Mycobacterium
YGEADQARNVTR

SEQ ID NO: 1089565 - protein, 5 aa, Mycobacterium
YGEKH

SEQ ID NO: 1089566 - protein, 9 aa, Mycobacterium
YGGAGGTIG

SEQ ID NO: 1089567 - protein, 9 aa, Mycobacterium
YGGAPQGSR

SEQ ID NO: 1089568 - protein, 10 aa, Mycobacterium
YGGSAAPLSV

SEQ ID NO: 1089569 - protein, 6 aa, Mycobacterium
YGGTAG

SEQ ID NO: 1089570 - protein, 24 aa, Mycobacterium
YGKPGGSAPSDCTRGYAGGVADAR

SEQ ID NO: 1089571 - protein, 25 aa, Mycobacterium
YGKPGGSAPSDFTRGRSGGVQDAQT

SEQ ID NO: 1089572 - protein, 5 aa, Mycobacterium
YGKTE

SEQ ID NO: 1089573 - protein, 8 aa, Mycobacterium
YGMTPPDV

SEQ ID NO: 1089574 - protein, 6 aa, Mycobacterium
YGNSPA

SEQ ID NO: 1089575 - protein, 11 aa, Mycobacterium
YGQTRETKRAG

SEQ ID NO: 1089576 - protein, 14 aa, Mycobacterium
YGTINGSSAESQQL

SEQ ID NO: 1089577 - protein, 15 aa, Mycobacterium
YGTPSHPPSAADYPE

SEQ ID NO: 1089578 - protein, 13 aa, Mycobacterium
YGVPVNSPNGYRT

SEQ ID NO: 1089579 - protein, 8 aa, Mycobacterium
YKPRPCDA

SEQ ID NO: 1089580 - protein, 8 aa, Mycobacterium
YLSTDPDE

SEQ ID NO: 1089581 - protein, 5 aa, Mycobacterium
YNQER

SEQ ID NO: 1089582 - protein, 8 aa, Mycobacterium
YPAGTTVS

SEQ ID NO: 1089583 - protein, 4 aa, Mycobacterium
YPAN

SEQ ID NO: 1089584 - protein, 9 aa, Mycobacterium
YPDAPTGTA

SEQ ID NO: 1089585 - protein, 6 aa, Mycobacterium
YPGEHT

SEQ ID NO: 1089586 - protein, 10 aa, Mycobacterium
YPGRTDTDMQ

SEQ ID NO: 1089587 - protein, 19 aa, Mycobacterium
YPNRETADSEADIQLPLRT

SEQ ID NO: 1089588 - protein, 27 aa, Mycobacterium
YPPGKSREEVDNANSADFKNSEESAEY

SEQ ID NO: 1089589 - protein, 7 aa, Mycobacterium
YPRDGRP

SEQ ID NO: 1089590 - protein, 8 aa, Mycobacterium
YPSARTAT

SEQ ID NO: 1089591 - protein, 8 aa, Mycobacterium
YPSPAQAI

SEQ ID NO: 1089592 - protein, 5 aa, Mycobacterium
YPTTV

SEQ ID NO: 1089593 - protein, 5 aa, Mycobacterium
YQSLS

SEQ ID NO: 1089594 - protein, 6 aa, Mycobacterium
YRAPTS

SEQ ID NO: 1089595 - protein, 18 aa, Mycobacterium
YRGNDNKMSTEEVDAERA

SEQ ID NO: 1089596 - protein, 8 aa, Mycobacterium
YRPTQDGA

SEQ ID NO: 1089597 - protein, 6 aa, Mycobacterium
YSDGTA

SEQ ID NO: 1089598 - protein, 10 aa, Mycobacterium
YSGDGSWGRA

SEQ ID NO: 1089599 - protein, 7 aa, Mycobacterium
YSGSQYN

SEQ ID NO: 1089600 - protein, 15 aa, Mycobacterium
YSPPTNCMLNRQYRC

SEQ ID NO: 1089601 - protein, 4 aa, Mycobacterium
YSQG

SEQ ID NO: 1089602 - protein, 10 aa, Mycobacterium
YSSPGSPVSI

SEQ ID NO: 1089603 - protein, 14 aa, Mycobacterium
YSTDLTARAREGKL

SEQ ID NO: 1089604 - protein, 15 aa, Mycobacterium
YTATAPLSATGREFT

SEQ ID NO: 1089605 - protein, 20 aa, Mycobacterium
YTPNPNDAPGGPLVERGDRQ

SEQ ID NO: 1089606 - protein, 9 aa, Mycobacterium
YYPAGTTVN

SEQ ID NO: 1089607 - protein, 18 aa, Mycobacterium
LILMRWSLDRVVLVHPGG

SEQ ID NO: 1089608 - protein, 22 aa, Mycobacterium
EGAMTPGALAIRERVRPPSMTR

SEQ ID NO: 1089609 - protein, 21 aa, Mycobacterium
GLGGLECLSGIPGSAGATPVQ

SEQ ID NO: 1089610 - protein, 18 aa, Mycobacterium
STLDELRIFVSQWDTRAR

SEQ ID NO: 1089611 - protein, 20 aa, Mycobacterium
VGARFKHIIMDSSTYGVPVN

SEQ ID NO: 1089612 - protein, 24 aa, Mycobacterium
AAAQSLAGLGERFGQSIVNGNSVL

SEQ ID NO: 1089613 - protein, 33 aa, Mycobacterium
AAKRCKGNPAWDLPLVFGPVALVYNLPGVQMLT

SEQ ID NO: 1089614 - protein, 17 aa, Mycobacterium
AALCGRHTVQNGQCTAG

SEQ ID NO: 1089615 - protein, 21 aa, Mycobacterium
AANAITVLWTYTPENMDTLAD

SEQ ID NO: 1089616 - protein, 17 aa, Mycobacterium
AAPIGRAVIEAALQGGA

SEQ ID NO: 1089617 - protein, 25 aa, Mycobacterium
AAQKGELPLLFSVTNIRPGTSGSAT

SEQ ID NO: 1089618 - protein, 17 aa, Mycobacterium
AAVGIPLLASDQVSPSA

SEQ ID NO: 1089619 - protein, 26 aa, Mycobacterium
ACAEFSRWRSAGVGLDALLRINVSPV

SEQ ID NO: 1089620 - protein, 24 aa, Mycobacterium
ADAEARVLLARRFHNDAVRDTLAL

SEQ ID NO: 1089621 - protein, 17 aa, Mycobacterium
ADALRSMAHSFGLDSNP

SEQ ID NO: 1089622 - protein, 25 aa, Mycobacterium
ADATYPPTWVLRGFFPLASAPLVPM

SEQ ID NO: 1089623 - protein, 19 aa, Mycobacterium
ADLNARMGSYFTAHVASSD

SEQ ID NO: 1089624 - protein, 17 aa, Mycobacterium
AEAAVVERLGRYGRTVS

SEQ ID NO: 1089625 - protein, 24 aa, Mycobacterium
AEGISVNVTLIFSVQRHREVIDAY

SEQ ID NO: 1089626 - protein, 36 aa, Mycobacterium
AELILAGPACARLFVASALARLGPLLVVTATGREAS

SEQ ID NO: 1089627 - protein, 18 aa, Mycobacterium
AEMEDAFGFTETVDQLTA

SEQ ID NO: 1089628 - protein, 20 aa, Mycobacterium
AEPARVGWQTVPGSRRAATS

SEQ ID NO: 1089629 - protein, 17 aa, Mycobacterium
AEYLRLLRRHNVAATLS

SEQ ID NO: 1089630 - protein, 23 aa, Mycobacterium
AEYPPRGSPLVVFIVTVKVTIGG

SEQ ID NO: 1089631 - protein, 24 aa, Mycobacterium
AFFDATKVASGWNIDTIKQSLKVV

SEQ ID NO: 1089632 - protein, 29 aa, Mycobacterium
AGAGKRLAAGIPKAFCELDGRTLVERAVV

SEQ ID NO: 1089633 - protein, 19 aa, Mycobacterium
AGDDIPVIAGRTSADDLAS

SEQ ID NO: 1089634 - protein, 22 aa, Mycobacterium
AGFPVTVKGLSRFTDAAESRAV

SEQ ID NO: 1089635 - protein, 18 aa, Mycobacterium
AGLKEVGVHLAIDDFGTG

SEQ ID NO: 1089636 - protein, 17 aa, Mycobacterium
AGLKLPRSSGEMYKVGQ

SEQ ID NO: 1089637 - protein, 19 aa, Mycobacterium
AGPDGGWNKPPTPLWPDKV

SEQ ID NO: 1089638 - protein, 17 aa, Mycobacterium
AGSVLVILANDYTGPGS

SEQ ID NO: 1089639 - protein, 18 aa, Mycobacterium
AGVVGWWINPQASGIDAC

SEQ ID NO: 1089640 - protein, 27 aa, Mycobacterium
AHPAGDANAIWCFNDKLCQGAIKAVYN

SEQ ID NO: 1089641 - protein, 24 aa, Mycobacterium
AIGCGLCLALAAAIRVVSTTSYFW

SEQ ID NO: 1089642 - protein, 18 aa, Mycobacterium
AIQRSVVISSGWNLMDFL

SEQ ID NO: 1089643 - protein, 20 aa, Mycobacterium
AKALGLGGVVNRQMTFQTSS

SEQ ID NO: 1089644 - protein, 22 aa, Mycobacterium
AKEIAGCCGAIFGKTGEAEFVG

SEQ ID NO: 1089645 - protein, 25 aa, Mycobacterium
AKGGIVFRIQRELGVPVKLVGLGEG

SEQ ID NO: 1089646 - protein, 20 aa, Mycobacterium
AKGVGAEFQGGVGEGVQKSA

SEQ ID NO: 1089647 - protein, 24 aa, Mycobacterium
AKQLPRLNLTVLRAAEYPPRGSPL

SEQ ID NO: 1089648 - protein, 18 aa, Mycobacterium
ALLTVPGISAFHAEIFYT

SEQ ID NO: 1089649 - protein, 23 aa, Mycobacterium
ALTPACVDLPASVPGTLSTRDKL

SEQ ID NO: 1089650 - protein, 27 aa, Mycobacterium
ANGILLLHGLVNWVMFSQLWCGFDHDE

SEQ ID NO: 1089651 - protein, 21 aa, Mycobacterium
ANGKPKWSVPLEFLAQTPPTV

SEQ ID NO: 1089652 - protein, 19 aa, Mycobacterium
ANMANALHPNASVSLHGDG

SEQ ID NO: 1089653 - protein, 17 aa, Mycobacterium
ANSPFWNAYTRFIDEGS

SEQ ID NO: 1089654 - protein, 21 aa, Mycobacterium
APDREQLVCWLLRELDARVGQ

SEQ ID NO: 1089655 - protein, 27 aa, Mycobacterium
APGLGLRPGLVGVLKGPLLDGVVIPGA

SEQ ID NO: 1089656 - protein, 20 aa, Mycobacterium
APGYLCWVAGVSLARQSSPN

SEQ ID NO: 1089657 - protein, 18 aa, Mycobacterium
APHIAMTVMMLRQAGVQV

SEQ ID NO: 1089658 - protein, 23 aa, Mycobacterium
APRDICALWPVPATSMPHPAPPV

SEQ ID NO: 1089659 - protein, 19 aa, Mycobacterium
APTLLRIATQANIPVVVVD

SEQ ID NO: 1089660 - protein, 28 aa, Mycobacterium
AQAVELWRIVDHPNLFIKIPATKAGLPA

SEQ ID NO: 1089661 - protein, 18 aa, Mycobacterium
AQLKCRLAGYGNLCIPPW

SEQ ID NO: 1089662 - protein, 30 aa, Mycobacterium
AQVDCGLAGTVLRFVPPLAALSANPVTFDG

SEQ ID NO: 1089663 - protein, 19 aa, Mycobacterium
ARAFSGVKIACVGEATADR

SEQ ID NO: 1089664 - protein, 24 aa, Mycobacterium
ARLEVAQIAAATWVPGMGGHGTPP

SEQ ID NO: 1089665 - protein, 19 aa, Mycobacterium
ARLIVRVVDALRAGHTAVV

SEQ ID NO: 1089666 - protein, 22 aa, Mycobacterium
ARRVADVLGIPFYVWDFAEKFQ

SEQ ID NO: 1089667 - protein, 17 aa, Mycobacterium
ASALFLLTLVYDQGSRY

SEQ ID NO: 1089668 - protein, 23 aa, Mycobacterium
ASRGRPGPLSGLDLADPERTVAL

SEQ ID NO: 1089669 - protein, 18 aa, Mycobacterium
ATDLCEFIEFPAELLQIC

SEQ ID NO: 1089670 - protein, 20 aa, Mycobacterium
ATDTFAVLALLARRLTNDEV

SEQ ID NO: 1089671 - protein, 23 aa, Mycobacterium
AVAAPCGRQSRYYRNCRPTTTVG

SEQ ID NO: 1089672 - protein, 17 aa, Mycobacterium
AVCCIRLDQRQCLVQEL

SEQ ID NO: 1089673 - protein, 20 aa, Mycobacterium
AVCGLLAFVVASARADSRGS

SEQ ID NO: 1089674 - protein, 45 aa, Mycobacterium
AVEPGDFVILNWRAVCGQCRACKRGRPSYCFDTFNAQQKMTLIDG

SEQ ID NO: 1089675 - protein, 20 aa, Mycobacterium
AVVMAHTFISLSFLGISHGD

SEQ ID NO: 1089676 - protein, 24 aa, Mycobacterium
AVVTAYAGAYARGLRDAGVLPVLK

SEQ ID NO: 1089677 - protein, 24 aa, Mycobacterium
AYSEARLQPPSGYKDTTVPGIWVP

SEQ ID NO: 1089678 - protein, 26 aa, Mycobacterium
CADLHGSDCDTVWPAFAAQLQDTIGV

SEQ ID NO: 1089679 - protein, 27 aa, Mycobacterium
CCRMQCCWRSRLSHIVCRTFVYPRHLS

SEQ ID NO: 1089680 - protein, 19 aa, Mycobacterium
CEWEASHGKDGRVSIEVDP

SEQ ID NO: 1089681 - protein, 25 aa, Mycobacterium
CNQRIKFSALSVRALMLGFDTVATG

SEQ ID NO: 1089682 - protein, 20 aa, Mycobacterium
CTVNSFASLTGQGFFNNTKC

SEQ ID NO: 1089683 - protein, 23 aa, Mycobacterium
DAEKYRRLHVIVGDSNMCETTTM

SEQ ID NO: 1089684 - protein, 24 aa, Mycobacterium
DAEPGRITAILGLHDLLSGGHTGQ

SEQ ID NO: 1089685 - protein, 29 aa, Mycobacterium
DAMQQGCGGSPCKGAVVALEPSTGKILAM

SEQ ID NO: 1089686 - protein, 17 aa, Mycobacterium
DDAGRALLIDHVVFVET

SEQ ID NO: 1089687 - protein, 24 aa, Mycobacterium
DDFSMLDGIFAMYATVGVTQDVES

SEQ ID NO: 1089688 - protein, 18 aa, Mycobacterium
DDGRAAAAKVEMPPWDQI

SEQ ID NO: 1089689 - protein, 25 aa, Mycobacterium
DDLTLGEALTLWLSGQEQLVPRDLI

SEQ ID NO: 1089690 - protein, 19 aa, Mycobacterium
DDTKLEWARTFGATHTVNA

SEQ ID NO: 1089691 - protein, 18 aa, Mycobacterium
DERFDYYVGVVIDVEHDR

SEQ ID NO: 1089692 - protein, 21 aa, Mycobacterium
DFCGGCLPKDIRAFMACAGEL

SEQ ID NO: 1089693 - protein, 19 aa, Mycobacterium
DGAAPCRLSTKHVLALTNR

SEQ ID NO: 1089694 - protein, 29 aa, Mycobacterium
DGQLKMVRYEGRWQVRWTATGLHPRLGEH

SEQ ID NO: 1089695 - protein, 19 aa, Mycobacterium
DGSHHLVRASIDLGSGSIQ

SEQ ID NO: 1089696 - protein, 18 aa, Mycobacterium
DGSIPAGSVLVILANDYT

SEQ ID NO: 1089697 - protein, 17 aa, Mycobacterium
DGTELTPALGIGAFADK

SEQ ID NO: 1089698 - protein, 19 aa, Mycobacterium
DGTPITWRDIDRQIHANSG

SEQ ID NO: 1089699 - protein, 18 aa, Mycobacterium
DGVGLPFQVQGSGSVAGG

SEQ ID NO: 1089700 - protein, 18 aa, Mycobacterium
DGYTRFTRYVAIGDSQTE

SEQ ID NO: 1089701 - protein, 26 aa, Mycobacterium
DHSRRLWTVLIFMLWHAIFIEHSVVP

SEQ ID NO: 1089702 - protein, 19 aa, Mycobacterium
DKLLWAEGFSLPLTQSPGD

SEQ ID NO: 1089703 - protein, 28 aa, Mycobacterium
DLLPGKRPAAGRSGLSVHGHARLLSEKD

SEQ ID NO: 1089704 - protein, 27 aa, Mycobacterium
DLPSSAQLPVWLSRSGADVVRTHPIVA

SEQ ID NO: 1089705 - protein, 23 aa, Mycobacterium
DMRRRTIMYWTYWTAGDSAIEMA

SEQ ID NO: 1089706 - protein, 23 aa, Mycobacterium
DNGRQRWCVRLVQGGGFGGPLFD

SEQ ID NO: 1089707 - protein, 19 aa, Mycobacterium
DNIVLRRSRPLQISLDGKD

SEQ ID NO: 1089708 - protein, 30 aa, Mycobacterium
DPENFWRSAGLPEFRFPDPNGTRFPNGAPP

SEQ ID NO: 1089709 - protein, 25 aa, Mycobacterium
DPKAKGSKLATVWIAQDGSHHLVRA

SEQ ID NO: 1089710 - protein, 22 aa, Mycobacterium
DPYLPPGVGHLSGFAVPSHGIV

SEQ ID NO: 1089711 - protein, 17 aa, Mycobacterium
DSLPTDRPIVYATLGTS

SEQ ID NO: 1089712 - protein, 23 aa, Mycobacterium
DSVTEQHRSGLLPTTQQAIQLSS

SEQ ID NO: 1089713 - protein, 17 aa, Mycobacterium
DVLGGTSVVVFRTPDAK

SEQ ID NO: 1089714 - protein, 18 aa, Mycobacterium
DVPVATWAWLSLATGVAV

SEQ ID NO: 1089715 - protein, 22 aa, Mycobacterium
DVQKLPLNVTWVNLTTGKSGSA

SEQ ID NO: 1089716 - protein, 17 aa, Mycobacterium
EAAESLTVIARFGGDEF

SEQ ID NO: 1089717 - protein, 35 aa, Mycobacterium
EADNIKAAVRLGSDMGEFYLPYPGTRINQETIPLH

SEQ ID NO: 1089718 - protein, 23 aa, Mycobacterium
EALLPVLCPDDYALLTDQFAADT

SEQ ID NO: 1089719 - protein, 24 aa, Mycobacterium
EANRLGYMVAELIELSRLQGAERL

SEQ ID NO: 1089720 - protein, 24 aa, Mycobacterium
EAVLALRVRKGMVLDAADHDTWSV

SEQ ID NO: 1089721 - protein, 20 aa, Mycobacterium
EFGVTCTFHGHRRLSPDEVA

SEQ ID NO: 1089722 - protein, 24 aa, Mycobacterium
EGLRAVAVFAVLCYLARLGNGNDR

SEQ ID NO: 1089723 - protein, 22 aa, Mycobacterium
EGRKKYADAVVRGVEGFLATQS

SEQ ID NO: 1089724 - protein, 19 aa, Mycobacterium
EGTESVTLYLGDEKMVEVG

SEQ ID NO: 1089725 - protein, 19 aa, Mycobacterium
EIEELLGPLDQARHDSALA

SEQ ID NO: 1089726 - protein, 19 aa, Mycobacterium
EKLPYLPINREDPVQRLQT

SEQ ID NO: 1089727 - protein, 25 aa, Mycobacterium
ELPKFVWPTMVVFRWPSFRHTTCGG

SEQ ID NO: 1089728 - protein, 22 aa, Mycobacterium
ELRKRLTGLLGAFRAFSYGSLY

SEQ ID NO: 1089729 - protein, 33 aa, Mycobacterium
ENLPRVNARGGPGGAPGCWQHITRDLWPTPELV

SEQ ID NO: 1089730 - protein, 22 aa, Mycobacterium
EPMSGADFPAGRQKLNGPQALS

SEQ ID NO: 1089731 - protein, 20 aa, Mycobacterium
ERLFGRRLADFFTGRDPRGG

SEQ ID NO: 1089732 - protein, 25 aa, Mycobacterium
ESAELCAQYLSPVLDAIKFNYFPFG

SEQ ID NO: 1089733 - protein, 27 aa, Mycobacterium
EVARYLFRRVVSWGRSSNVFLRNGARL

SEQ ID NO: 1089734 - protein, 19 aa, Mycobacterium
EVVDITGAVLTKLDGTAKG

SEQ ID NO: 1089735 - protein, 21 aa, Mycobacterium
EWRRRCLYTTLTVLATVGVVA

SEQ ID NO: 1089736 - protein, 29 aa, Mycobacterium
EYVIKRGGAQIGVPYSWGGGSLQGPSKGV

SEQ ID NO: 1089737 - protein, 18 aa, Mycobacterium
FAAQCVALKCALGPDPKS

SEQ ID NO: 1089738 - protein, 21 aa, Mycobacterium
FADRAGLPFAQIDTGSGGVPL

SEQ ID NO: 1089739 - protein, 32 aa, Mycobacterium
FAIYCLPLNWVRRKHGLPSLGSNIGCIYTDGD

SEQ ID NO: 1089740 - protein, 26 aa, Mycobacterium
FALTYPRRLGFGLGSSVVSLSWRTGD

SEQ ID NO: 1089741 - protein, 18 aa, Mycobacterium
FANAAFPAVVAPEAPTTS

SEQ ID NO: 1089742 - protein, 26 aa, Mycobacterium
FASGLARLAKQVTYRRPKQLGAGRLH

SEQ ID NO: 1089743 - protein, 18 aa, Mycobacterium
FAVTKDGRHSITHYDTLE

SEQ ID NO: 1089744 - protein, 17 aa, Mycobacterium
FDAVCFTSSSTVRNLVG

SEQ ID NO: 1089745 - protein, 18 aa, Mycobacterium
FDPAKVMPVAAYNGFVIS

SEQ ID NO: 1089746 - protein, 17 aa, Mycobacterium
FDPRNGHTLNSYPLPAA

SEQ ID NO: 1089747 - protein, 18 aa, Mycobacterium
FDPYQLSSTQGWQRNPER

SEQ ID NO: 1089748 - protein, 34 aa, Mycobacterium
FEGGQRYQTLMARGAQVQRPLWASTGVKNPDYAD

SEQ ID NO: 1089749 - protein, 25 aa, Mycobacterium
FFSHGGSLKSSWYGDCLPERDFPTL

SEQ ID NO: 1089750 - protein, 19 aa, Mycobacterium
FGFAGSLSGFVYPSSTNYN

SEQ ID NO: 1089751 - protein, 18 aa, Mycobacterium
FIDEGSHQLGVYINAVSA

SEQ ID NO: 1089752 - protein, 20 aa, Mycobacterium
FKLRGDFDPTQVIKHGNDDA

SEQ ID NO: 1089753 - protein, 19 aa, Mycobacterium
FLARFFGRIVNTHPALLPA

SEQ ID NO: 1089754 - protein, 19 aa, Mycobacterium
FNAIRCVDAPVPTDSASWV

SEQ ID NO: 1089755 - protein, 17 aa, Mycobacterium
FNIFHGRADQIHAFLTK

SEQ ID NO: 1089756 - protein, 22 aa, Mycobacterium
FPMTQWTRWRQPVIGMPSTPRF

SEQ ID NO: 1089757 - protein, 17 aa, Mycobacterium
FPSGDRVGTTMSLANAL

SEQ ID NO: 1089758 - protein, 25 aa, Mycobacterium
FQMPGGIYAPMIHPWSSGRDLYFNL

SEQ ID NO: 1089759 - protein, 22 aa, Mycobacterium
FSDWRIAAIRAGEAVLRRRIQS

SEQ ID NO: 1089760 - protein, 17 aa, Mycobacterium
FSRISDVLLPFLVTRQL

SEQ ID NO: 1089761 - protein, 23 aa, Mycobacterium
FSVELMDCLDCRAYATDAEVVLP

SEQ ID NO: 1089762 - protein, 26 aa, Mycobacterium
FTDNLPVCITKFIPLHTPAVVMSMNA

SEQ ID NO: 1089763 - protein, 17 aa, Mycobacterium
FVAQAFSVASWIAHADP

SEQ ID NO: 1089764 - protein, 18 aa, Mycobacterium
FVPASLPWPIHRSALANP

SEQ ID NO: 1089765 - protein, 21 aa, Mycobacterium
FWNREYDILVCTTIVETGLDI

SEQ ID NO: 1089766 - protein, 25 aa, Mycobacterium
GAGITGFDCSGLVLYSFAGVGIRLP

SEQ ID NO: 1089767 - protein, 18 aa, Mycobacterium
GAQAHLPTGIDPVHAAGP

SEQ ID NO: 1089768 - protein, 18 aa, Mycobacterium
GATAGPYGGPAFPAPIDV

SEQ ID NO: 1089769 - protein, 18 aa, Mycobacterium
GDAQRSTVLVALRDTGFI

SEQ ID NO: 1089770 - protein, 21 aa, Mycobacterium
GDCLPERDFPTLVDLYLQGRL

SEQ ID NO: 1089771 - protein, 19 aa, Mycobacterium
GEAVLRRRIQSLFDDVDVV

SEQ ID NO: 1089772 - protein, 18 aa, Mycobacterium
GFAVGECDDLYPAADVSV

SEQ ID NO: 1089773 - protein, 22 aa, Mycobacterium
GFSESHHKLTIGVSYPTANSPF

SEQ ID NO: 1089774 - protein, 19 aa, Mycobacterium
GGGSKFLALGGMPGNSVAQ

SEQ ID NO: 1089775 - protein, 18 aa, Mycobacterium
GGRGAGPLLIFAGGSNLV

SEQ ID NO: 1089776 - protein, 25 aa, Mycobacterium
GGRVSRLKSLIGMAPSARVLAQTST

SEQ ID NO: 1089777 - protein, 18 aa, Mycobacterium
GHAPRWWITVGGEVRPGE

SEQ ID NO: 1089778 - protein, 24 aa, Mycobacterium
GHFEWLDGDVVQWIPTKYWPAYTH

SEQ ID NO: 1089779 - protein, 18 aa, Mycobacterium
GHGASIYSACAVPPIIGY

SEQ ID NO: 1089780 - protein, 23 aa, Mycobacterium
GHPNGLCLQVTFSKIVLPPMVAA

SEQ ID NO: 1089781 - protein, 18 aa, Mycobacterium
GIETEFGVTCTFHGHRRL

SEQ ID NO: 1089782 - protein, 20 aa, Mycobacterium
GIIYRKRRLITVIMLTPVGV

SEQ ID NO: 1089783 - protein, 18 aa, Mycobacterium
GIMIGSWTDLSMLINGAL

SEQ ID NO: 1089784 - protein, 24 aa, Mycobacterium
GINDRYPFLLGHEAAGTVEVVGPG

SEQ ID NO: 1089785 - protein, 21 aa, Mycobacterium
GKLMTSPKCTPRLTWTNVSLR

SEQ ID NO: 1089786 - protein, 21 aa, Mycobacterium
GKSADTAACGGKRTMTAEGST

SEQ ID NO: 1089787 - protein, 24 aa, Mycobacterium
GKVGPIGGIAHKMAAARAAGATVF

SEQ ID NO: 1089788 - protein, 21 aa, Mycobacterium
GLERQWLHARSLSFAHPADGR

SEQ ID NO: 1089789 - protein, 25 aa, Mycobacterium
GLFARRWELPVPRWIENPLANWSAR

SEQ ID NO: 1089790 - protein, 17 aa, Mycobacterium
GLHPRLGEHQTFALRAN

SEQ ID NO: 1089791 - protein, 27 aa, Mycobacterium
GLIRILLILCGVFGLKLQRDRLSLEQH

SEQ ID NO: 1089792 - protein, 18 aa, Mycobacterium
GLPRPWNPLPCAGATAGP

SEQ ID NO: 1089793 - protein, 17 aa, Mycobacterium
GMPGMPVGTGKRATSVI

SEQ ID NO: 1089794 - protein, 25 aa, Mycobacterium
GNFTPKSKLTMLADRAGLVMDRGSK

SEQ ID NO: 1089795 - protein, 29 aa, Mycobacterium
GNGMWGAPQLGRWKWHDPYVHASLLAQNN

SEQ ID NO: 1089796 - protein, 19 aa, Mycobacterium
GPASGRGFHVIYSAPPLNP

SEQ ID NO: 1089797 - protein, 18 aa, Mycobacterium
GPFIGWLEITGALASETA

SEQ ID NO: 1089798 - protein, 24 aa, Mycobacterium
GPVELIKTSGGWRIDRLPNGVFLD

SEQ ID NO: 1089799 - protein, 18 aa, Mycobacterium
GQPRGCDMWLNRPQREEE

SEQ ID NO: 1089800 - protein, 20 aa, Mycobacterium
GRDFTVDWVHLKLNDQAQRT

SEQ ID NO: 1089801 - protein, 24 aa, Mycobacterium
GRIPRVYGGQAIEYVIKRGGAQIG

SEQ ID NO: 1089802 - protein, 21 aa, Mycobacterium
GRIPRVYGRQASEYVIRRGIS

SEQ ID NO: 1089803 - protein, 17 aa, Mycobacterium
GRLDRLRGRLARTQNAF

SEQ ID NO: 1089804 - protein, 25 aa, Mycobacterium
GRQKLNGPQALSFVRQRHELPRGDL

SEQ ID NO: 1089805 - protein, 32 aa, Mycobacterium
GRRVVLNLWASWCASCLGELPAMVEYQRRVGS

SEQ ID NO: 1089806 - protein, 26 aa, Mycobacterium
GRTTGNSCGVAWGMGETSGTLVMQVC

SEQ ID NO: 1089807 - protein, 24 aa, Mycobacterium
GRTVSGQLTLLVLFIDRVRARVDL

SEQ ID NO: 1089808 - protein, 17 aa, Mycobacterium
GSLLCLTSSNIFALISY

SEQ ID NO: 1089809 - protein, 30 aa, Mycobacterium
GSVRWVSACELRFGYRTSVFKQADPSGSQP

SEQ ID NO: 1089810 - protein, 25 aa, Mycobacterium
GTATEKASVLSFVLAGHEPLEVGKA

SEQ ID NO: 1089811 - protein, 28 aa, Mycobacterium
GTEILTRLRGMFAFALWDTIAHELFCAR

SEQ ID NO: 1089812 - protein, 24 aa, Mycobacterium
GTQLLRPGDSLPLGQSTTPYQSYD

SEQ ID NO: 1089813 - protein, 17 aa, Mycobacterium
GVADPYLPPGVGHLSGF

SEQ ID NO: 1089814 - protein, 21 aa, Mycobacterium
GVASDAAGVVGWWINPQASGI

SEQ ID NO: 1089815 - protein, 28 aa, Mycobacterium
GVPVVLCDPEPPPIWSSMATGGDHPSAD

SEQ ID NO: 1089816 - protein, 31 aa, Mycobacterium
GVSCGPGPTVSLSQAFAMSCNTAFVQLGLLI

SEQ ID NO: 1089817 - protein, 18 aa, Mycobacterium
GVTGFPPVLWAHQTTEIR

SEQ ID NO: 1089818 - protein, 23 aa, Mycobacterium
GWVGDAFPLSALTQIYQSDGESN

SEQ ID NO: 1089819 - protein, 23 aa, Mycobacterium
HCAQPVLRRLGLEATVRPSFAFY

SEQ ID NO: 1089820 - protein, 17 aa, Mycobacterium
HLVPRTWARAVVTCVKS

SEQ ID NO: 1089821 - protein, 21 aa, Mycobacterium
HMRADVTVGSFLSGGIDSTAI

SEQ ID NO: 1089822 - protein, 17 aa, Mycobacterium
HPAVLLIVGVNGTGKTT

SEQ ID NO: 1089823 - protein, 23 aa, Mycobacterium
HPDDARLGPPLQVVVTAVRSLLQ

SEQ ID NO: 1089824 - protein, 23 aa, Mycobacterium
HTPPHAWYIAFAPVQAPKVAVAV

SEQ ID NO: 1089825 - protein, 26 aa, Mycobacterium
IAHELFCARDPFGIKPLFMATGTNGT

SEQ ID NO: 1089826 - protein, 28 aa, Mycobacterium
IAKSGKYPTARLVAFKLRGDFDPTQVIK

SEQ ID NO: 1089827 - protein, 18 aa, Mycobacterium
IDCRDHYDRQKMRDQAQF

SEQ ID NO: 1089828 - protein, 17 aa, Mycobacterium
IDGCLAVPAVGRMRRLQ

SEQ ID NO: 1089829 - protein, 18 aa, Mycobacterium
IDGLATAVRFHWNGNAVE

SEQ ID NO: 1089830 - protein, 23 aa, Mycobacterium
IDSLRPMMRLVVTNGTAKEIAGC

SEQ ID NO: 1089831 - protein, 18 aa, Mycobacterium
IDTHVYEYLLPKTYTVPY

SEQ ID NO: 1089832 - protein, 32 aa, Mycobacterium
IGDELFVRLCEPLRGVARGQTLVLYRLDPDGD

SEQ ID NO: 1089833 - protein, 24 aa, Mycobacterium
IGGEQIYRLALPLATRCGVTEVDT

SEQ ID NO: 1089834 - protein, 22 aa, Mycobacterium
IGQSGLCGRSDLAGLNLAQYSS

SEQ ID NO: 1089835 - protein, 27 aa, Mycobacterium
IGRDGGMPWRVPEDLTRFKQLTMGHPV

SEQ ID NO: 1089836 - protein, 23 aa, Mycobacterium
IGSGPFFKVVLHNLAPYQILQPW

SEQ ID NO: 1089837 - protein, 23 aa, Mycobacterium
IGTGLRWRQLDVVTQTGSTNADL

SEQ ID NO: 1089838 - protein, 24 aa, Mycobacterium
IIVSAENWADCLVAMQQREIDAIS

SEQ ID NO: 1089839 - protein, 17 aa, Mycobacterium
IKATTVFGGKYVSLTTP

SEQ ID NO: 1089840 - protein, 29 aa, Mycobacterium
INALYTPVHWKYLTSGLLGLQRGTDAGDL

SEQ ID NO: 1089841 - protein, 24 aa, Mycobacterium
INDHVELLSGLGFLLNPTSAISII

SEQ ID NO: 1089842 - protein, 18 aa, Mycobacterium
INLAGLTAMVAGLIIVVT

SEQ ID NO: 1089843 - protein, 18 aa, Mycobacterium
INLVAYAWGGKHLQPGDE

SEQ ID NO: 1089844 - protein, 26 aa, Mycobacterium
INNGLKIVSCYQYGKGNTADWLGGAT

SEQ ID NO: 1089845 - protein, 36 aa, Mycobacterium
IPALKYLSYRLFMKRSAVRWLVTRMTTITSLDLTPQ

SEQ ID NO: 1089846 - protein, 17 aa, Mycobacterium
IPQGVPDTYGFNGIDPA

SEQ ID NO: 1089847 - protein, 21 aa, Mycobacterium
IPSARCATVSVPVDYNNPDGV

SEQ ID NO: 1089848 - protein, 17 aa, Mycobacterium
IPTPPGWSPYSNPNITP

SEQ ID NO: 1089849 - protein, 18 aa, Mycobacterium
IPVIAGRTSADDLASSTP

SEQ ID NO: 1089850 - protein, 26 aa, Mycobacterium
IQSTFVGAICRWQAANPASLIDITRF

SEQ ID NO: 1089851 - protein, 19 aa, Mycobacterium
IRQAAPFLNYGQFTGNAPR

SEQ ID NO: 1089852 - protein, 17 aa, Mycobacterium
IRWPEVSARILADKPGH

SEQ ID NO: 1089853 - protein, 17 aa, Mycobacterium
ISATAMPRVWVWILVRA

SEQ ID NO: 1089854 - protein, 22 aa, Mycobacterium
ISETYPPGSTFKVITTTAALQA

SEQ ID NO: 1089855 - protein, 19 aa, Mycobacterium
ISLTAAIAMLLVLVAGFAD

SEQ ID NO: 1089856 - protein, 28 aa, Mycobacterium
ITATPLRPGVWRAYADHRMAMAGAIVGL

SEQ ID NO: 1089857 - protein, 25 aa, Mycobacterium
ITNAVGGFSFVLPAGWVESEASHLD

SEQ ID NO: 1089858 - protein, 24 aa, Mycobacterium
ITVLQMLQRIIALMPLGAAVVDTY

SEQ ID NO: 1089859 - protein, 19 aa, Mycobacterium
ITVSLGFPSGDRVGTTMSL

SEQ ID NO: 1089860 - protein, 28 aa, Mycobacterium
IVTFAQPYAEWRGMFAGNGMLLPATMTA

SEQ ID NO: 1089861 - protein, 18 aa, Mycobacterium
IYAGSSWEYMPFLAEVVA

SEQ ID NO: 1089862 - protein, 25 aa, Mycobacterium
KATATHLVSVFAHRARLVLGQLAVA

SEQ ID NO: 1089863 - protein, 20 aa, Mycobacterium
KCRLAGYGNLCIPPWRSSCQ

SEQ ID NO: 1089864 - protein, 21 aa, Mycobacterium
KDEPVELVDIVIPDPGPGEAV

SEQ ID NO: 1089865 - protein, 28 aa, Mycobacterium
KDGRQLVIRYLFYDAQGSREFAQLAQHS

SEQ ID NO: 1089866 - protein, 17 aa, Mycobacterium
KDIGFVFGVGQLLATVP

SEQ ID NO: 1089867 - protein, 20 aa, Mycobacterium
KDIQQMAGFQIAFTDYAADC

SEQ ID NO: 1089868 - protein, 19 aa, Mycobacterium
KDLEIRGAGNVLGVEQSGH

SEQ ID NO: 1089869 - protein, 19 aa, Mycobacterium
KFHCARCNVAYTGALPDMP

SEQ ID NO: 1089870 - protein, 23 aa, Mycobacterium
KKTKPGEVVTIDFRRKNEPPGVV

SEQ ID NO: 1089871 - protein, 20 aa, Mycobacterium
KLGHPRIVYKSASVVPGSPT

SEQ ID NO: 1089872 - protein, 23 aa, Mycobacterium
KNPRLPEPLLHFGSQKVGKQCVD

SEQ ID NO: 1089873 - protein, 23 aa, Mycobacterium
KSEIEEALRYGVVKMNVDTDTQY

SEQ ID NO: 1089874 - protein, 25 aa, Mycobacterium
KTVVPDPRYVAVLGHDQLATELVSK

SEQ ID NO: 1089875 - protein, 23 aa, Mycobacterium
KVEALKIDGDHVVIKFSIGTNRI

SEQ ID NO: 1089876 - protein, 26 aa, Mycobacterium
KVGQKVLPRHARRGDLIFYGPEGTES

SEQ ID NO: 1089877 - protein, 24 aa, Mycobacterium
KVLQILQPRAAVLSAARVYRAMVS

SEQ ID NO: 1089878 - protein, 25 aa, Mycobacterium
KYHSRQTPLLARAWTSDAIGAGVLA

SEQ ID NO: 1089879 - protein, 20 aa, Mycobacterium
LAAAAARELAEETGLRVIPT

SEQ ID NO: 1089880 - protein, 18 aa, Mycobacterium
LAAAAGFGVWLLVREPDP

SEQ ID NO: 1089881 - protein, 24 aa, Mycobacterium
LACAEGVVIPTECEFFSLRGLALL

SEQ ID NO: 1089882 - protein, 18 aa, Mycobacterium
LADIPGVRLVGTATEKAS

SEQ ID NO: 1089883 - protein, 29 aa, Mycobacterium
LADLLVGILTCWRSPSSSRCVLTEPRYDY

SEQ ID NO: 1089884 - protein, 23 aa, Mycobacterium
LADVWFSAAALSWVGRGYAVVSA

SEQ ID NO: 1089885 - protein, 21 aa, Mycobacterium
LAEVVRPVIVVGVGLNVTQAP

SEQ ID NO: 1089886 - protein, 29 aa, Mycobacterium
LAIVLGTGITWTSFRSFEDGIFHMSAPSL

SEQ ID NO: 1089887 - protein, 18 aa, Mycobacterium
LALGLSGCSSTKPDAQEQ

SEQ ID NO: 1089888 - protein, 18 aa, Mycobacterium
LALSRGAVVIEVNPEPTP

SEQ ID NO: 1089889 - protein, 21 aa, Mycobacterium
LAPCHRTDPVGGQRTVYEVVL

SEQ ID NO: 1089890 - protein, 18 aa, Mycobacterium
LATGCARVNLGTAACENP

SEQ ID NO: 1089891 - protein, 20 aa, Mycobacterium
LDALGWKLNGQFREKDGRQL

SEQ ID NO: 1089892 - protein, 18 aa, Mycobacterium
LDGLGVRTALSRGDDTGL

SEQ ID NO: 1089893 - protein, 19 aa, Mycobacterium
LDRQGCSRFIVTDVTKDGT

SEQ ID NO: 1089894 - protein, 24 aa, Mycobacterium
LDRQHRVAAVFLRELLAGDLQPVV

SEQ ID NO: 1089895 - protein, 22 aa, Mycobacterium
LECASDGFAVDVARALAGRRVV

SEQ ID NO: 1089896 - protein, 25 aa, Mycobacterium
LEGRRLHAWNRIVIPTGPPPSKQQY

SEQ ID NO: 1089897 - protein, 17 aa, Mycobacterium
LFRLGAYQLLRTRVEAY

SEQ ID NO: 1089898 - protein, 23 aa, Mycobacterium
LGAALTEFGRRVLLVDIDPQGAL

SEQ ID NO: 1089899 - protein, 19 aa, Mycobacterium
LGADFFVFSGHKIYGPTGI

SEQ ID NO: 1089900 - protein, 25 aa, Mycobacterium
LGDNISVKLFDDWSNLGSISDLSTS

SEQ ID NO: 1089901 - protein, 23 aa, Mycobacterium
LGEALRYVERVGVQRIASHEQAL

SEQ ID NO: 1089902 - protein, 25 aa, Mycobacterium
LGERPTVVCLARLVPRKGQDMLIRA

SEQ ID NO: 1089903 - protein, 20 aa, Mycobacterium
LGGVDVCLKDAVFEPMSGAD

SEQ ID NO: 1089904 - protein, 23 aa, Mycobacterium
LGKQFLGRLGINFGGDPSNAATT

SEQ ID NO: 1089905 - protein, 21 aa, Mycobacterium
LGTIDGVVIAFTEGVPSENAN

SEQ ID NO: 1089906 - protein, 19 aa, Mycobacterium
LHPVLDRYDYVLIDCQPSL

SEQ ID NO: 1089907 - protein, 18 aa, Mycobacterium
LIMGGFMFFASRRQRRSM

SEQ ID NO: 1089908 - protein, 20 aa, Mycobacterium
LKPAGRGPVRIRIEDQDYSG

SEQ ID NO: 1089909 - protein, 24 aa, Mycobacterium
LLIAAPKKDLSWHDCTSRLFRDAG

SEQ ID NO: 1089910 - protein, 17 aa, Mycobacterium
LLLDDLFALLVNDFNRY

SEQ ID NO: 1089911 - protein, 24 aa, Mycobacterium
LLMSEFEDLLGPRTKLVAATQVSN

SEQ ID NO: 1089912 - protein, 25 aa, Mycobacterium
LLSEKDRRFAVVFVHDQSDYVRMEA

SEQ ID NO: 1089913 - protein, 25 aa, Mycobacterium
LLVDFPVCALIAAWVRGQSQLDASA

SEQ ID NO: 1089914 - protein, 18 aa, Mycobacterium
LNGQFREKDGRQLVIRYL

SEQ ID NO: 1089915 - protein, 21 aa, Mycobacterium
LPAPSRVGAPEFILVHDAARA

SEQ ID NO: 1089916 - protein, 18 aa, Mycobacterium
LPLGRLVARRLLRINNAI

SEQ ID NO: 1089917 - protein, 22 aa, Mycobacterium
LPPWLVALRCSNAFGRLGLIGR

SEQ ID NO: 1089918 - protein, 17 aa, Mycobacterium
LPTDRPIVYATLGTSGG

SEQ ID NO: 1089919 - protein, 24 aa, Mycobacterium
LPVDKLRYPVFSWQRITLHEMTHM

SEQ ID NO: 1089920 - protein, 19 aa, Mycobacterium
LRALQAIATLFAQLQARIV

SEQ ID NO: 1089921 - protein, 19 aa, Mycobacterium
LRGCGWEIEDVTAYRTVRA

SEQ ID NO: 1089922 - protein, 21 aa, Mycobacterium
LRGMTPRAALTKHLLDGDDSL

SEQ ID NO: 1089923 - protein, 22 aa, Mycobacterium
LRGVFGAAVAMFPSWETLPHER

SEQ ID NO: 1089924 - protein, 19 aa, Mycobacterium
LRIGPMAGTGTRTGDYGIG

SEQ ID NO: 1089925 - protein, 17 aa, Mycobacterium
LRMSRDPADIAAMRTIK

SEQ ID NO: 1089926 - protein, 22 aa, Mycobacterium
LSALLERLEPDWLITLIESLDV

SEQ ID NO: 1089927 - protein, 21 aa, Mycobacterium
LSSELPDWLATKRGLAPDGHA

SEQ ID NO: 1089928 - protein, 21 aa, Mycobacterium
LSSGALWRARVVLGGRTLRQP

SEQ ID NO: 1089929 - protein, 18 aa, Mycobacterium
LSTWSDPDIDGFSGGVAF

SEQ ID NO: 1089930 - protein, 24 aa, Mycobacterium
LTAEARSGVDVVRLVAGDPLTVDA

SEQ ID NO: 1089931 - protein, 17 aa, Mycobacterium
LTERPMHGYQMIQQIAE

SEQ ID NO: 1089932 - protein, 19 aa, Mycobacterium
LTNEVFNIFHGRADQIHAF

SEQ ID NO: 1089933 - protein, 18 aa, Mycobacterium
LTPDQAKRGDLIFYGPGG

SEQ ID NO: 1089934 - protein, 18 aa, Mycobacterium
LTRVGPYLHCNMLNLDEC

SEQ ID NO: 1089935 - protein, 18 aa, Mycobacterium
LTSSNIFALISYFHISNS

SEQ ID NO: 1089936 - protein, 18 aa, Mycobacterium
LTTLRVGPVAQRVITCAS

SEQ ID NO: 1089937 - protein, 25 aa, Mycobacterium
LVKAARRARQEWLVERLMTLNSDKR

SEQ ID NO: 1089938 - protein, 20 aa, Mycobacterium
LVLYSFAGVGIRLPHYSGSQ

SEQ ID NO: 1089939 - protein, 17 aa, Mycobacterium
LVPRKGQDMLIRALPSI

SEQ ID NO: 1089940 - protein, 25 aa, Mycobacterium
LVQGGGFGGPLFDGFENLYVGEPGT

SEQ ID NO: 1089941 - protein, 21 aa, Mycobacterium
LWRLVPELVEAAGFVAQQPLT

SEQ ID NO: 1089942 - protein, 17 aa, Mycobacterium
LWTRILGVRLVNILFRL

SEQ ID NO: 1089943 - protein, 19 aa, Mycobacterium
LYRPNTRLAVTIPTLDPHR

SEQ ID NO: 1089944 - protein, 18 aa, Mycobacterium
MAESRIGLVSNMTGKLPR

SEQ ID NO: 1089945 - protein, 21 aa, Mycobacterium
MDPDVLLREFFKATADPANRH

SEQ ID NO: 1089946 - protein, 23 aa, Mycobacterium
MGGHGTPPFGDRWEPGSPASAGP

SEQ ID NO: 1089947 - protein, 19 aa, Mycobacterium
MGPEHLVVRAVRRGLQAVG

SEQ ID NO: 1089948 - protein, 20 aa, Mycobacterium
MKSRVIDIIQENGFAVGECD

SEQ ID NO: 1089949 - protein, 17 aa, Mycobacterium
MKVTFHYQNKYKVPANA

SEQ ID NO: 1089950 - protein, 26 aa, Mycobacterium
MLSVRLARPPLLVPVLRTGLGMVDEG

SEQ ID NO: 1089951 - protein, 28 aa, Mycobacterium
MLVAALLLSSCGWRGISNVSIPGGPGSG

SEQ ID NO: 1089952 - protein, 20 aa, Mycobacterium
MPGVACNRGGGNVPVNVIGD

SEQ ID NO: 1089953 - protein, 24 aa, Mycobacterium
MQFICSAIQAGSRLGYQESAELCA

SEQ ID NO: 1089954 - protein, 17 aa, Mycobacterium
MRGFWNREYDILVCTTI

SEQ ID NO: 1089955 - protein, 24 aa, Mycobacterium
MRLLCLGMLFTGCAGVPNSSAPQA

SEQ ID NO: 1089956 - protein, 17 aa, Mycobacterium
MRVGQRLTEARDHIRSA

SEQ ID NO: 1089957 - protein, 18 aa, Mycobacterium
MSCNTAFVQLGLLIGADA

SEQ ID NO: 1089958 - protein, 17 aa, Mycobacterium
MSIDSRYKIPIDSAANV

SEQ ID NO: 1089959 - protein, 19 aa, Mycobacterium
MSNPIDCRDHYDRQKMRDQ

SEQ ID NO: 1089960 - protein, 19 aa, Mycobacterium
MSRAFASSCNTTFAELSSR

SEQ ID NO: 1089961 - protein, 21 aa, Mycobacterium
MTITCKRRKLVNFSTVYLDAK

SEQ ID NO: 1089962 - protein, 23 aa, Mycobacterium
MTQLEMHAVLACHKVTGSCNFTT

SEQ ID NO: 1089963 - protein, 17 aa, Mycobacterium
MYISLALAHSMNLYAAM

SEQ ID NO: 1089964 - protein, 19 aa, Mycobacterium
MYQAVRYLLVMAAIILMAV

SEQ ID NO: 1089965 - protein, 19 aa, Mycobacterium
NAGLDFCGGCLPKDIRAFM

SEQ ID NO: 1089966 - protein, 25 aa, Mycobacterium
NAMGRDIPVAFMAGGPHAVYLLDAF

SEQ ID NO: 1089967 - protein, 30 aa, Mycobacterium
NDYGSALDAALCWQRDGADWIHLVDLDAAF

SEQ ID NO: 1089968 - protein, 25 aa, Mycobacterium
NFGEPRSAMTMGHYVCPILAKSGGN

SEQ ID NO: 1089969 - protein, 28 aa, Mycobacterium
NGISIRRTPAPRWSHFTFNGAVGSILAD

SEQ ID NO: 1089970 - protein, 29 aa, Mycobacterium
NITGFDCSGLMRYAFAGVGVLIPRFSGDQ

SEQ ID NO: 1089971 - protein, 19 aa, Mycobacterium
NLCIPPWRSSCQGVAANLV

SEQ ID NO: 1089972 - protein, 17 aa, Mycobacterium
NLVRAEAGAVWDDVVVR

SEQ ID NO: 1089973 - protein, 27 aa, Mycobacterium
NNREVRWRPEHFWKSGTAVDVAVNTYG

SEQ ID NO: 1089974 - protein, 17 aa, Mycobacterium
NNWWAIYAGSSWEYMPF

SEQ ID NO: 1089975 - protein, 17 aa, Mycobacterium
NPLPCAGATAGPYGGPA

SEQ ID NO: 1089976 - protein, 24 aa, Mycobacterium
NRWQVRPGTVAARHWVVEPDLTNA

SEQ ID NO: 1089977 - protein, 24 aa, Mycobacterium
NSPNGYRADVDWATQLSYSGVFLH

SEQ ID NO: 1089978 - protein, 22 aa, Mycobacterium
NTQPGWIVAPGMQGQQVGPITA

SEQ ID NO: 1089979 - protein, 21 aa, Mycobacterium
NVWGQWCGPCRTEVTQLQQVY

SEQ ID NO: 1089980 - protein, 25 aa, Mycobacterium
PAAKHYEFKQAASIADLPGEVLDAI

SEQ ID NO: 1089981 - protein, 26 aa, Mycobacterium
PAARLSVVVDQLWRASALAEMISEAG

SEQ ID NO: 1089982 - protein, 26 aa, Mycobacterium
PAATREMIKTGGFDAVCFTSSSTVRN

SEQ ID NO: 1089983 - protein, 20 aa, Mycobacterium
PANHQYLGPVLWSPAGELPR

SEQ ID NO: 1089984 - protein, 26 aa, Mycobacterium
PAQDGVKLAAGWLVERAGFGKGYPDG

SEQ ID NO: 1089985 - protein, 19 aa, Mycobacterium
PCLTGFIPAAEWRSPADTS

SEQ ID NO: 1089986 - protein, 17 aa, Mycobacterium
PDDLAPFEPAVFVDALL

SEQ ID NO: 1089987 - protein, 23 aa, Mycobacterium
PDGLPLLPGIAIAGRPGDPAPNV

SEQ ID NO: 1089988 - protein, 25 aa, Mycobacterium
PEIGVDTLVAIACRELLLSDDVRAR

SEQ ID NO: 1089989 - protein, 20 aa, Mycobacterium
PEPTRWGLPVDKLRYPVFSW

SEQ ID NO: 1089990 - protein, 17 aa, Mycobacterium
PEVSARILADKPGHDHP

SEQ ID NO: 1089991 - protein, 24 aa, Mycobacterium
PIADPALVPLFFVAREARKHVKVV

SEQ ID NO: 1089992 - protein, 19 aa, Mycobacterium
PITRLVMDATLFLDAPTTV

SEQ ID NO: 1089993 - protein, 21 aa, Mycobacterium
PKLAKRLGLERQWLHARSLSF

SEQ ID NO: 1089994 - protein, 24 aa, Mycobacterium
PKTAETASEFGLRVDVQPETAAVG

SEQ ID NO: 1089995 - protein, 20 aa, Mycobacterium
PKVTSFLGGNGYSINDHVEL

SEQ ID NO: 1089996 - protein, 21 aa, Mycobacterium
PLFGSHMWDGSAIPIDENLAI

SEQ ID NO: 1089997 - protein, 19 aa, Mycobacterium
PMCHCIWVHVSALSCAQGE

SEQ ID NO: 1089998 - protein, 27 aa, Mycobacterium
PNDPKLKQPVLYPRGTLAMANSGPNTN

SEQ ID NO: 1089999 - protein, 17 aa, Mycobacterium
PNGRPRYVTAIDADTAT

SEQ ID NO: 1090000 - protein, 18 aa, Mycobacterium
PPGSPVFRCDALKRVTEI

SEQ ID NO: 1090001 - protein, 18 aa, Mycobacterium
PPQAFASGLARLAKQVTY

SEQ ID NO: 1090002 - protein, 19 aa, Mycobacterium
PQYLESIGVTGQQVAPSSL

SEQ ID NO: 1090003 - protein, 25 aa, Mycobacterium
PREAAEYGAANGFIIIKMTAGDEVC

SEQ ID NO: 1090004 - protein, 21 aa, Mycobacterium
PRLAKELYRGAPYGVGYFVGV

SEQ ID NO: 1090005 - protein, 19 aa, Mycobacterium
PTANVTYRGIAIGKVTDVE

SEQ ID NO: 1090006 - protein, 29 aa, Mycobacterium
PTITARLNFQLGFGMRVGQRLTEARDHIR

SEQ ID NO: 1090007 - protein, 24 aa, Mycobacterium
PTPDMRLDMPLLDFFSHGGSLKSS

SEQ ID NO: 1090008 - protein, 25 aa, Mycobacterium
PTTRAVLFHLGRFIPQGVPDTYGFN

SEQ ID NO: 1090009 - protein, 18 aa, Mycobacterium
PYLHCNMLNLDECQTPQA

SEQ ID NO: 1090010 - protein, 26 aa, Mycobacterium
PYPATYRLGERWTHPPILWAAIDEVV

SEQ ID NO: 1090011 - protein, 30 aa, Mycobacterium
QALACPLRELGRGAPYFIGAMKLILTQPYD

SEQ ID NO: 1090012 - protein, 17 aa, Mycobacterium
QALDGALARRAVVARAV

SEQ ID NO: 1090013 - protein, 19 aa, Mycobacterium
QCVALKCALGPDPKSAVTA

SEQ ID NO: 1090014 - protein, 23 aa, Mycobacterium
QFVFLCCWARLALAPTMGTGALT

SEQ ID NO: 1090015 - protein, 19 aa, Mycobacterium
QIWGKLCPDKTVSYNPTGS

SEQ ID NO: 1090016 - protein, 18 aa, Mycobacterium
QKHFFGVPHVGPLSVADP

SEQ ID NO: 1090017 - protein, 32 aa, Mycobacterium
QLASAICWHYWPGCCWQHVLGIELHYLALKRV

SEQ ID NO: 1090018 - protein, 21 aa, Mycobacterium
QLRVDSLRTLASMSGRSSPEG

SEQ ID NO: 1090019 - protein, 18 aa, Mycobacterium
QLVLFAILTVISLTVLGV

SEQ ID NO: 1090020 - protein, 25 aa, Mycobacterium
QNFPTQQLHWWLVAVSHTDLLANAD

SEQ ID NO: 1090021 - protein, 18 aa, Mycobacterium
QPGVPFRVLGDNISVKLF

SEQ ID NO: 1090022 - protein, 19 aa, Mycobacterium
QPLVSSFQMPGGIYAPMIH

SEQ ID NO: 1090023 - protein, 19 aa, Mycobacterium
QRACSVLATAMMLAACGHA

SEQ ID NO: 1090024 - protein, 26 aa, Mycobacterium
QRHELPRGDLDRVVRQQAVMASLVHR

SEQ ID NO: 1090025 - protein, 19 aa, Mycobacterium
QRLANEWAGITVLQMLQRI

SEQ ID NO: 1090026 - protein, 28 aa, Mycobacterium
QRNPERVWGWYLWRHYLVANVKPNDGHR

SEQ ID NO: 1090027 - protein, 30 aa, Mycobacterium
QSFTSVPILFARPSYYGQFTDTGGLNKGDK

SEQ ID NO: 1090028 - protein, 18 aa, Mycobacterium
QTQAGCSLMEWENNDNGR

SEQ ID NO: 1090029 - protein, 26 aa, Mycobacterium
QVMDLIKGVVMPAVMQGVQNGNVAGD

SEQ ID NO: 1090030 - protein, 24 aa, Mycobacterium
QVVIDRLSYFYAHENSNIHRAAHE

SEQ ID NO: 1090031 - protein, 20 aa, Mycobacterium
RAEAGAVWDDVVVRAIEHGL

SEQ ID NO: 1090032 - protein, 20 aa, Mycobacterium
RAGSIGQLSVPPSWAAPSSG

SEQ ID NO: 1090033 - protein, 28 aa, Mycobacterium
RAHFAELHRPCCGDLVYGADPKLAKRLG

SEQ ID NO: 1090034 - protein, 18 aa, Mycobacterium
RALAQRGVPFSWAGGGVS

SEQ ID NO: 1090035 - protein, 20 aa, Mycobacterium
RALPHADHPAVLLIVGVNGT

SEQ ID NO: 1090036 - protein, 24 aa, Mycobacterium
RANHRWLGILPLWVSYNAVSANNT

SEQ ID NO: 1090037 - protein, 18 aa, Mycobacterium
RAVWEKFGEFGLDARAFS

SEQ ID NO: 1090038 - protein, 19 aa, Mycobacterium
RDPETMIPDVRYTTNPNDA

SEQ ID NO: 1090039 - protein, 23 aa, Mycobacterium
RDPRSAQPWNPEPLAGNYNECAQ

SEQ ID NO: 1090040 - protein, 17 aa, Mycobacterium
RELRHWTRAGAVVFTAA

SEQ ID NO: 1090041 - protein, 22 aa, Mycobacterium
RFPGAIRWTLGALRQTRDYLSG

SEQ ID NO: 1090042 - protein, 24 aa, Mycobacterium
RGAPDMAASLWIGDLGGEAVQSAD

SEQ ID NO: 1090043 - protein, 25 aa, Mycobacterium
RGGCCALPRRSCRDSVGSYTKVNAL

SEQ ID NO: 1090044 - protein, 18 aa, Mycobacterium
RGHTWKFAVTKDGRHSIT

SEQ ID NO: 1090045 - protein, 23 aa, Mycobacterium
RGISQIGVPYSWGGGNAAGPSRG

SEQ ID NO: 1090046 - protein, 17 aa, Mycobacterium
RGLRDAGVLPVLKHFPG

SEQ ID NO: 1090047 - protein, 18 aa, Mycobacterium
RGPIEAHLAAAPRSSTGS

SEQ ID NO: 1090048 - protein, 30 aa, Mycobacterium; identical to SEQ ID NO: 143350

SEQ ID NO: 1090049 - protein, 21 aa, Mycobacterium
RISDVLLPFLVTRQLICGAGK

SEQ ID NO: 1090050 - protein, 19 aa, Mycobacterium
RKNEPPGVVQITLGANKDR

SEQ ID NO: 1090051 - protein, 20 aa, Mycobacterium
RLADPLPFWPYRRLLCRTEL

SEQ ID NO: 1090052 - protein, 24 aa, Mycobacterium
RLAELSMAVQMCGVPAVGVDAGAQ

SEQ ID NO: 1090053 - protein, 19 aa, Mycobacterium
RLALTDFPANFNILHIDGN

SEQ ID NO: 1090054 - protein, 20 aa, Mycobacterium
RLEGYRRLAAASSDTEVAAV

SEQ ID NO: 1090055 - protein, 20 aa, Mycobacterium
RLGLEATVRPSFAFYNTYEE

SEQ ID NO: 1090056 - protein, 20 aa, Mycobacterium
RLILDSPIALGIKTEAAAEQ

SEQ ID NO: 1090057 - protein, 28 aa, Mycobacterium
RLPAAREFPDYPTMFAALRAGQLTAGWT

SEQ ID NO: 1090058 - protein, 17 aa, Mycobacterium
RLRRWSSAALAAVLTVG

SEQ ID NO: 1090059 - protein, 21 aa, Mycobacterium
RLRSGLIGVLVVLLIIGVGQS

SEQ ID NO: 1090060 - protein, 19 aa, Mycobacterium
RLTSGAWLQVRLCEAPAPL

SEQ ID NO: 1090061 - protein, 17 aa, Mycobacterium
RNALCGMYDSVRDQRPD

SEQ ID NO: 1090062 - protein, 24 aa, Mycobacterium
RNRIERVIERIPLPPSSRSIEDPE

SEQ ID NO: 1090063 - protein, 18 aa, Mycobacterium
RPGPSAGPFIVSSLDRTT

SEQ ID NO: 1090064 - protein, 48 aa, Mycobacterium
RPTPDRVRELVVAWGKLYPEFGTVGALNLVKCVHWPTGTTPQPPKNLK

SEQ ID NO: 1090065 - protein, 25 aa, Mycobacterium
RRDGTWITLYRKWLTVLGPAPAPPT

SEQ ID NO: 1090066 - protein, 19 aa, Mycobacterium
RRELLRDGQAFYVHNRVSS

SEQ ID NO: 1090067 - protein, 18 aa, Mycobacterium
RRQIQGIAQLLYRRNQVL

SEQ ID NO: 1090068 - protein, 19 aa, Mycobacterium
RRVAAAFGVANVIPTTVVL

SEQ ID NO: 1090069 - protein, 21 aa, Mycobacterium
RSAADPLALTAGDLVVHDQHG

SEQ ID NO: 1090070 - protein, 19 aa, Mycobacterium
RSLPRHRALTAVSLGLSEL

SEQ ID NO: 1090071 - protein, 26 aa, Mycobacterium
RSNGIWRPSPGSVYPTLQLLSDKNLI

SEQ ID NO: 1090072 - protein, 24 aa, Mycobacterium
RSVISTLSGMYWWGPASAAMLAAT

SEQ ID NO: 1090073 - protein, 24 aa, Mycobacterium
RSVVISSGWNLMDFLKQLQSLADR

SEQ ID NO: 1090074 - protein, 22 aa, Mycobacterium
RTDPPSGLRVLGDQTLLVTALA

SEQ ID NO: 1090075 - protein, 24 aa, Mycobacterium
RTLQAGTDIALWVSTQTVPAVLDR

SEQ ID NO: 1090076 - protein, 21 aa, Mycobacterium
RVLNRLVKVMPTFTMAGYLAL

SEQ ID NO: 1090077 - protein, 25 aa, Mycobacterium
RVQPKAWRALLTLLVISVVMPGVAC

SEQ ID NO: 1090078 - protein, 31 aa, Mycobacterium
RYVEDTGTIAYRFTWHLPKNRTWSYDGQLKM

SEQ ID NO: 1090079 - protein, 24 aa, Mycobacterium
SATLLLLYWQWRAMSTGSFGGPEA

SEQ ID NO: 1090080 - protein, 22 aa, Mycobacterium
SCAPTHLAHRFRFLTKTIAAQC

SEQ ID NO: 1090081 - protein, 18 aa, Mycobacterium
SCQACADLHGSDCDTVWP

SEQ ID NO: 1090082 - protein, 18 aa, Mycobacterium
SDHVRAMVLDGAIDPSVS

SEQ ID NO: 1090083 - protein, 26 aa, Mycobacterium
SDIERLRNLWDVPALALIGIGNGAEV

SEQ ID NO: 1090084 - protein, 22 aa, Mycobacterium
SDPSGLVPIALDGKMLRGALRA

SEQ ID NO: 1090085 - protein, 25 aa, Mycobacterium
SFAGQGVGFGGWYSPVALHVDTASV

SEQ ID NO: 1090086 - protein, 19 aa, Mycobacterium
SGATIIWRLANAGALLATL

SEQ ID NO: 1090087 - protein, 22 aa, Mycobacterium
SGATLPSWLPFAVAAGTLLWLG

SEQ ID NO: 1090088 - protein, 17 aa, Mycobacterium
SGIDIDGAVLIAEHQTA

SEQ ID NO: 1090089 - protein, 20 aa, Mycobacterium
SGKLTLLRIIAGLDHPDTET

SEQ ID NO: 1090090 - protein, 21 aa, Mycobacterium
SGQRGIVGWPRPHVHPDDTDC

SEQ ID NO: 1090091 - protein, 18 aa, Mycobacterium
SHANHVGLFIAQYENSLF

SEQ ID NO: 1090092 - protein, 19 aa, Mycobacterium
SHMEYRILSTAARITALQK

SEQ ID NO: 1090093 - protein, 23 aa, Mycobacterium
SILADQGLRLAVSKGIDRRTIAK

SEQ ID NO: 1090094 - protein, 21 aa, Mycobacterium
SIYSACAVPPIIGYLTSGKLP

SEQ ID NO: 1090095 - protein, 22 aa, Mycobacterium
SKELGGLPIVVDGSIPAGSVLV

SEQ ID NO: 1090096 - protein, 23 aa, Mycobacterium
SKGKLAGILAEVVRPVIVVGVGL

SEQ ID NO: 1090097 - protein, 18 aa, Mycobacterium
SKIPIEIGPALDSVNRGL

SEQ ID NO: 1090098 - protein, 17 aa, Mycobacterium
SKRVMWQGIGHGASIYS

SEQ ID NO: 1090099 - protein, 19 aa, Mycobacterium
SLILRGGGIPNLETLTNEV

SEQ ID NO: 1090100 - protein, 20 aa, Mycobacterium
SMGGTCAVDLTVMHPDIFSA

SEQ ID NO: 1090101 - protein, 26 aa, Mycobacterium
SMGKPTRPTPIGKFTALSKERTVVMD

SEQ ID NO: 1090102 - protein, 17 aa, Mycobacterium
SNAGFAFLAVIKSNILF

SEQ ID NO: 1090103 - protein, 22 aa, Mycobacterium
SNPRRVAPVVARLSVVARSLSR

SEQ ID NO: 1090104 - protein, 29 aa, Mycobacterium
SPDGLRWSTTEPLGFNRCYTLSAKALGLG

SEQ ID NO: 1090105 - protein, 17 aa, Mycobacterium
SPIALGIKTEAAAEQQV

SEQ ID NO: 1090106 - protein, 26 aa, Mycobacterium
SPPSYWSADWYPCYVNGIDAPVAEKA

SEQ ID NO: 1090107 - protein, 18 aa, Mycobacterium
SQLPAGVVQINRHNYLMV

SEQ ID NO: 1090108 - protein, 20 aa, Mycobacterium
SQPPAVVLEVEFKLDASGQS

SEQ ID NO: 1090109 - protein, 25 aa, Mycobacterium
SQVKSDNAIERWVHNLNVLAAQSAR

SEQ ID NO: 1090110 - protein, 21 aa, Mycobacterium
SRQLLAAQIIWTLARADIRGP

SEQ ID NO: 1090111 - protein, 19 aa, Mycobacterium
SRYEVHFACDPRYNNLLGP

SEQ ID NO: 1090112 - protein, 23 aa, Mycobacterium
SRYTRSRVTAAFGPRAALEYLPP

SEQ ID NO: 1090113 - protein, 23 aa, Mycobacterium
SSGGTLGVPCIRDVELVQAVADL

SEQ ID NO: 1090114 - protein, 23 aa, Mycobacterium
SSIGRGSFWFAEMKQLGEVRDQR

SEQ ID NO: 1090115 - protein, 27 aa, Mycobacterium
SSLRLWPDRRLSRRGVEIVARRGPRGD

SEQ ID NO: 1090116 - protein, 25 aa, Mycobacterium
STASGYRAGLLASIAASCTASYTVA

SEQ ID NO: 1090117 - protein, 23 aa, Mycobacterium
STDMPRWQLGTDVLENVVSAAAA

SEQ ID NO: 1090118 - protein, 27 aa, Mycobacterium
STPDVGPSQRWFVVWLGTSNNPVDKGA

SEQ ID NO: 1090119 - protein, 30 aa, Mycobacterium
STTNGKFSIAIGDMITGVIVGLEPDASVVH

SEQ ID NO: 1090120 - protein, 17 aa, Mycobacterium
SVCSSGTVVGMVVPTHQ

SEQ ID NO: 1090121 - protein, 20 aa, Mycobacterium
SVPKLYGFGVIVITSAALLS

SEQ ID NO: 1090122 - protein, 24 aa, Mycobacterium
SVRYRRRRISLIFSSLSSGPSASD

SEQ ID NO: 1090123 - protein, 17 aa, Mycobacterium
SVTEPLSLVTLRPDDND

SEQ ID NO: 1090124 - protein, 24 aa, Mycobacterium
SVYRRMVVDVGKWPAMGQLHPVVY

SEQ ID NO: 1090125 - protein, 34 aa, Mycobacterium
SYDQPDYCAVPLRLHPDIHLFAAIPEERSSTAES

SEQ ID NO: 1090126 - protein, 34 aa, Mycobacterium
SYEQLRWMREIFMPWVWRWLRGKSSADGRVPKRP

SEQ ID NO: 1090127 - protein, 33 aa, Mycobacterium
SYKPDLVVLAGFMRILGPQFLARFFGRIVNTHP

SEQ ID NO: 1090128 - protein, 17 aa, Mycobacterium
TAGRGRHGRGWSASPRT

SEQ ID NO: 1090129 - protein, 19 aa, Mycobacterium
TALLHPRQQLRVDSLRTLA

SEQ ID NO: 1090130 - protein, 26 aa, Mycobacterium
TALNEGRGDFFAVLRSLALFVNALHT

SEQ ID NO: 1090131 - protein, 18 aa, Mycobacterium
TAMPRVWVWILVRAAQSS

SEQ ID NO: 1090132 - protein, 27 aa, Mycobacterium
TANPPVEGAFYWLNNREVRWRPEHFWK

SEQ ID NO: 1090133 - protein, 18 aa, Mycobacterium
TAVCVADLRPSDPMPDNS

SEQ ID NO: 1090134 - protein, 18 aa, Mycobacterium
TCPSEVPITTPISLDPGT

SEQ ID NO: 1090135 - protein, 17 aa, Mycobacterium
TCSNAGFAFLAVIKSNI

SEQ ID NO: 1090136 - protein, 17 aa, Mycobacterium
TDVRLSCDAHRDACPYE

SEQ ID NO: 1090137 - protein, 20 aa, Mycobacterium
TELTPALGIGAFADKTLVHS

SEQ ID NO: 1090138 - protein, 20 aa, Mycobacterium
TEMPPWQGGGNMIVDVTLER

SEQ ID NO: 1090139 - protein, 17 aa, Mycobacterium
TEVELHLAGMIDTDLVL

SEQ ID NO: 1090140 - protein, 19 aa, Mycobacterium
TFAAIKSFLTVAANDGQAG

SEQ ID NO: 1090141 - protein, 19 aa, Mycobacterium
TFINKGSWVLSRHSAMELL

SEQ ID NO: 1090142 - protein, 27 aa, Mycobacterium
TGADIFSRSGPYLARGAADLVPTAQLL

SEQ ID NO: 1090143 - protein, 19 aa, Mycobacterium
TGANYGAPPFNGPVFSDDV

SEQ ID NO: 1090144 - protein, 26 aa, Mycobacterium
TGRPPRAIPEPRPRSSHGPAKVVAMC

SEQ ID NO: 1090145 - protein, 19 aa, Mycobacterium
THNPKWWGTPPRLDSITYL

SEQ ID NO: 1090146 - protein, 23 aa, Mycobacterium
THRKGLWAILAIAVVASASAFTM

SEQ ID NO: 1090147 - protein, 28 aa, Mycobacterium
THRLLQTGVCWKDLGLVVVDEEQWFGVE

SEQ ID NO: 1090148 - protein, 17 aa, Mycobacterium
TIAQAVELWRIVDHPNL

SEQ ID NO: 1090149 - protein, 19 aa, Mycobacterium
TKRVFLRRGILADLSPVAT

SEQ ID NO: 1090150 - protein, 25 aa, Mycobacterium
TLAIASPCAYFLVYEPTASAKPAAK

SEQ ID NO: 1090151 - protein, 24 aa, Mycobacterium
TLARADIRGPYVINADGAPLDDRF

SEQ ID NO: 1090152 - protein, 19 aa, Mycobacterium
TLFYIGWRAAQAQANRPKT

SEQ ID NO: 1090153 - protein, 18 aa, Mycobacterium
TLLAAIYVAALRSYGFGA

SEQ ID NO: 1090154 - protein, 22 aa, Mycobacterium
TNLGVNCQYPPSADKAAKPVKP

SEQ ID NO: 1090155 - protein, 22 aa, Mycobacterium
TPDSSSGWVYIVANSFTRRDSV

SEQ ID NO: 1090156 - protein, 19 aa, Mycobacterium
TQITMSIGVSIADVPVATW

SEQ ID NO: 1090157 - protein, 17 aa, Mycobacterium
TRCLWSAALQLASAICW

SEQ ID NO: 1090158 - protein, 20 aa, Mycobacterium
TRFAQRWAVPSTFVVTLSTV

SEQ ID NO: 1090159 - protein, 32 aa, Mycobacterium
TRILGVRLVNILFRLYSPLIFAIYCLPLNWVR

SEQ ID NO: 1090160 - protein, 23 aa, Mycobacterium
TRLSCQISGRVAFQVLAGLVEPG

SEQ ID NO: 1090161 - protein, 23 aa, Mycobacterium
TSMMKATMPRAFIIGTDGSTTVD

SEQ ID NO: 1090162 - protein, 22 aa, Mycobacterium
TTSDLLRWADHAALSAKSDGSK

SEQ ID NO: 1090163 - protein, 20 aa, Mycobacterium
TVERRLRVGAGATLTAVQNA

SEQ ID NO: 1090164 - protein, 17 aa, Mycobacterium
TVLGVCFSACSKSPSKT

SEQ ID NO: 1090165 - protein, 31 aa, Mycobacterium
TVRNGRPVAEFTLDVYPRYLSLIPANVNADI

SEQ ID NO: 1090166 - protein, 21 aa, Mycobacterium
VAACLPPCWIVVGTGRADDVV

SEQ ID NO: 1090167 - protein, 18 aa, Mycobacterium
VAAGMRTSWVGFVQSVTS

SEQ ID NO: 1090168 - protein, 17 aa, Mycobacterium
VADGRRVVLGAADTFRA

SEQ ID NO: 1090169 - protein, 25 aa, Mycobacterium
VADRGDYQWRACAHLGGATVVAAGM

SEQ ID NO: 1090170 - protein, 17 aa, Mycobacterium
VALAYAASRPDRVARLI

SEQ ID NO: 1090171 - protein, 26 aa, Mycobacterium
VANGGLRYAPRADLATREEQIAVAEV

SEQ ID NO: 1090172 - protein, 38 aa, Mycobacterium
VAPRNSAPVLRPEWPYHVPSVSDLDWFDAVPAGVPGGD

SEQ ID NO: 1090173 - protein, 19 aa, Mycobacterium
VASVIGRLPGVVVTLQADL

SEQ ID NO: 1090174 - protein, 25 aa, Mycobacterium
VATDNRFRFLRVYPNPAVYAPITGF

SEQ ID NO: 1090175 - protein, 19 aa, Mycobacterium
VAVGVDLIDVFAVLEHEGV

SEQ ID NO: 1090176 - protein, 17 aa, Mycobacterium
VCSVLSLGVVVSSLLYS

SEQ ID NO: 1090177 - protein, 20 aa, Mycobacterium
VDALLLLAWMCNGRSHTVYS

SEQ ID NO: 1090178 - protein, 24 aa, Mycobacterium
VDHYAEIGLLGFALIVDALGGVDV

SEQ ID NO: 1090179 - protein, 17 aa, Mycobacterium
VDLIDVFAVLEHEGVQK

SEQ ID NO: 1090180 - protein, 27 aa, Mycobacterium
VDPPVCYCGGLIRPAIVWFGEPLPDEP

SEQ ID NO: 1090181 - protein, 23 aa, Mycobacterium
VDSAAVASRFPGPITDLQLSRDG

SEQ ID NO: 1090182 - protein, 18 aa, Mycobacterium
VDVARALAGRRVVLNLWA

SEQ ID NO: 1090183 - protein, 19 aa, Mycobacterium
VERFGDLVFDTVITRTVRF

SEQ ID NO: 1090184 - protein, 20 aa, Mycobacterium
VESFCAGIIGAGNNLGLLGA

SEQ ID NO: 1090185 - protein, 23 aa, Mycobacterium
VETGRKLLTYEVLQLAGDDLRDT

SEQ ID NO: 1090186 - protein, 18 aa, Mycobacterium
VFSGHKIYGPTGIGVLYG

SEQ ID NO: 1090187 - protein, 17 aa, Mycobacterium
VFTRFAQRWAVPSTFVV

SEQ ID NO: 1090188 - protein, 18 aa, Mycobacterium
VGHLSGFAVPSHGIVPTV

SEQ ID NO: 1090189 - protein, 21 aa, Mycobacterium
VGYRGDLAFAALIVGGGSSEY

SEQ ID NO: 1090190 - protein, 20 aa, Mycobacterium
VKPPRAGKVPTDPATVSASM

SEQ ID NO: 1090191 - protein, 17 aa, Mycobacterium
VLAELVLITSIAFAVCC

SEQ ID NO: 1090192 - protein, 26 aa, Mycobacterium
VLAQRWVRAEVVIRLDVNGYAALPGE

SEQ ID NO: 1090193 - protein, 22 aa, Mycobacterium
VLDAPWAPFVVDFNLANVGGPS

SEQ ID NO: 1090194 - protein, 36 aa, Mycobacterium
VLHRPKLGFPVPIRHWLRAGELLEWAYALVNSSQAE

SEQ ID NO: 1090195 - protein, 17 aa, Mycobacterium
VLIAHSIDHTGRYRGQA

SEQ ID NO: 1090196 - protein, 17 aa, Mycobacterium
VLLPGLPYLGLEHRAAW

SEQ ID NO: 1090197 - protein, 24 aa, Mycobacterium
VLWSPAGELPRWWDSLPTDRPIVY

SEQ ID NO: 1090198 - protein, 17 aa, Mycobacterium
VMDATLFLDAPTTVPGT

SEQ ID NO: 1090199 - protein, 18 aa, Mycobacterium
VMTMKSRVIDIIQENGFA

SEQ ID NO: 1090200 - protein, 18 aa, Mycobacterium
VPDTYGFNGIDPAQTTGD

SEQ ID NO: 1090201 - protein, 29 aa, Mycobacterium
VPPRWLPGPRELRAWILAAGVPEAANRYL

SEQ ID NO: 1090202 - protein, 27 aa, Mycobacterium
VQAAAIRSGHPWWTLSQLSDESALELD

SEQ ID NO: 1090203 - protein, 22 aa, Mycobacterium
VQEALPVLFGHVGEGNLHLNVL

SEQ ID NO: 1090204 - protein, 21 aa, Mycobacterium
VRGSRNIPCVDVPGKRAASPR

SEQ ID NO: 1090205 - protein, 21 aa, Mycobacterium
VRPGERLAAAAARELAEETGL

SEQ ID NO: 1090206 - protein, 18 aa, Mycobacterium
VRPSFAFYNTYEEIDVFI

SEQ ID NO: 1090207 - protein, 18 aa, Mycobacterium
VSDGSIWDAIAGCEAGGN

SEQ ID NO: 1090208 - protein, 20 aa, Mycobacterium
VSKLLAGPRPEMAHAVRNLL

SEQ ID NO: 1090209 - protein, 30 aa, Mycobacterium
VSLGAHWLEGGFGLAILYRKIHGQDPAERM

SEQ ID NO: 1090210 - protein, 22 aa, Mycobacterium
VSRPTARFVRPAIPSLVSAALL

SEQ ID NO: 1090211 - protein, 17 aa, Mycobacterium
VSTCSNAGFAFLAVIKS

SEQ ID NO: 1090212 - protein, 18 aa, Mycobacterium
VSVARFSAALAPHGSGTL

SEQ ID NO: 1090213 - protein, 19 aa, Mycobacterium
VTAEWRWDTLAARLADLLC

SEQ ID NO: 1090214 - protein, 18 aa, Mycobacterium
VTEISRATGKLASSSSDT

SEQ ID NO: 1090215 - protein, 19 aa, Mycobacterium
VTIDFRRKNEPPGVVQITL

SEQ ID NO: 1090216 - protein, 22 aa, Mycobacterium
VTPSVLPLPSFQPSTNLGVNCQ

SEQ ID NO: 1090217 - protein, 32 aa, Mycobacterium
VTSRARLNWWESRALYGWTVLVPRTKDQAGEM

SEQ ID NO: 1090218 - protein, 25 aa, Mycobacterium
VVAGLCFVAVIAVSGCTPRPNGPGP

SEQ ID NO: 1090219 - protein, 19 aa, Mycobacterium
VVGDARWSLSVSARLASIP

SEQ ID NO: 1090220 - protein, 18 aa, Mycobacterium
VVLEVEFKLDASGQSAPL

SEQ ID NO: 1090221 - protein, 21 aa, Mycobacterium
VVLPNLRIMPIYRADASGTTD

SEQ ID NO: 1090222 - protein, 17 aa, Mycobacterium
VVMGRRTWDSLPVGVRP

SEQ ID NO: 1090223 - protein, 23 aa, Mycobacterium
VVSLSWRTGDDIVVTRTDATHPV

SEQ ID NO: 1090224 - protein, 24 aa, Mycobacterium
VVTLCVLPEGLAAAGAAVQAPPAR

SEQ ID NO: 1090225 - protein, 18 aa, Mycobacterium
WLATKRGLAPDGHAAVGA

SEQ ID NO: 1090226 - protein, 19 aa, Mycobacterium
WQGWAAGPDGGWNKPPTPL

SEQ ID NO: 1090227 - protein, 25 aa, Mycobacterium
WRIDRLPNGVFLDWQQFQATYKRNT

SEQ ID NO: 1090228 - protein, 19 aa, Mycobacterium
WRWDTLAARLADLLCGNDS

SEQ ID NO: 1090229 - protein, 17 aa, Mycobacterium
WSAALQLASAICWHYWP

SEQ ID NO: 1090230 - protein, 29 aa, Mycobacterium
WSDPDIDGFSGGVAFGFNRLSIIDIAHSH

SEQ ID NO: 1090231 - protein, 17 aa, Mycobacterium
WSVPLEFLAQTPPTVTP

SEQ ID NO: 1090232 - protein, 19 aa, Mycobacterium
WTATATREGNQWKISNLLQ

SEQ ID NO: 1090233 - protein, 17 aa, Mycobacterium
WVDAAFKKRGIDPENFW

SEQ ID NO: 1090234 - protein, 20 aa, Mycobacterium
WVILLLRLVSGGSFTGAETL

SEQ ID NO: 1090235 - protein, 25 aa, Mycobacterium
WVVEPDLTNAVAFLAAAAVSGGTVR

SEQ ID NO: 1090236 - protein, 19 aa, Mycobacterium
WYPWAWLAHRDAQTTSTLK

SEQ ID NO: 1090237 - protein, 21 aa, Mycobacterium
YAASFRPGFDSPPQLVPVALR

SEQ ID NO: 1090238 - protein, 18 aa, Mycobacterium
YATPRLADIPGVRLVGTA

SEQ ID NO: 1090239 - protein, 17 aa, Mycobacterium
YDHVKRGDIVEVVNTVG

SEQ ID NO: 1090240 - protein, 19 aa, Mycobacterium
YDIGLSWGVVCESNVGVLK

SEQ ID NO: 1090241 - protein, 17 aa, Mycobacterium
YDPAMRTLIAFGDKYPT

SEQ ID NO: 1090242 - protein, 25 aa, Mycobacterium
YEARSDNRTGLRLVKVESLSQAVDA

SEQ ID NO: 1090243 - protein, 18 aa, Mycobacterium
YEYLLPKTYTVPYENSLP

SEQ ID NO: 1090244 - protein, 23 aa, Mycobacterium
YLQIPSLVGIGRYSLKAELSATG

SEQ ID NO: 1090245 - protein, 24 aa, Mycobacterium
YLSEARGPLHTDLQALACPLRELG

SEQ ID NO: 1090246 - protein, 22 aa, Mycobacterium
YNECAQLSAVIIKANTNAVNPT

SEQ ID NO: 1090247 - protein, 19 aa, Mycobacterium
YPARVVAVGVDRDCGATKI

SEQ ID NO: 1090248 - protein, 23 aa, Mycobacterium
YQAAARVCGLVPEARVVVAHGQM

SEQ ID NO: 1090249 - protein, 19 aa, Mycobacterium
YSPVLFTPIAMFLGSCGAY

SEQ ID NO: 1090250 - protein, 20 aa, Mycobacterium
YTVLKRAFKCRTVDKRYHAL

SEQ ID NO: 1090251 - protein, 25 aa, Mycobacterium
YVGEPGTIFSFPMTQWTRWRQPVIG

SEQ ID NO: 1090252 - protein, 20 aa, Mycobacterium
YVLHRAWVGPMILVVLDDPD

SEQ ID NO: 1090253 - protein, 23 aa, Mycobacterium
AAAACPDVQVVFARGTGEPPGLG

SEQ ID NO: 1090254 - protein, 19 aa, Mycobacterium
AAAAKYWRYQKYDDCLIMA

SEQ ID NO: 1090255 - protein, 19 aa, Mycobacterium
AAAAPRICADPAAVPAAMP

SEQ ID NO: 1090256 - protein, 20 aa, Mycobacterium
AAADRDTWGLVDMSVSAAQA

SEQ ID NO: 1090257 - protein, 19 aa, Mycobacterium
AAAEEAWAEVLALAPEADT

SEQ ID NO: 1090258 - protein, 20 aa, Mycobacterium
AAAGHWRDFAAALNGVQGAL

SEQ ID NO: 1090259 - protein, 20 aa, Mycobacterium
AAAGLVTWVATIALAPPALA

SEQ ID NO: 1090260 - protein, 18 aa, Mycobacterium
AAAHRAGVPVAEVSETMP

SEQ ID NO: 1090261 - protein, 17 aa, Mycobacterium
AAAPGLGLRPGLVGVLK

SEQ ID NO: 1090262 - protein, 17 aa, Mycobacterium
AAATAFETAFAVVVPPP

SEQ ID NO: 1090263 - protein, 18 aa, Mycobacterium
AADAIGILDAIRDVSYPI

SEQ ID NO: 1090264 - protein, 17 aa, Mycobacterium
AADPGWEIALRNMSKGY

SEQ ID NO: 1090265 - protein, 30 aa, Mycobacterium
AAGDEVSADIAALFSDHALQYQAVSAEAVA

SEQ ID NO: 1090266 - protein, 26 aa, Mycobacterium
AAGGNGGAGGWLFGNGGNGGHGGQGG

SEQ ID NO: 1090267 - protein, 30 aa, Mycobacterium
AAGGPGGAGGWLWGGGGAGGLGGPASGAGN

SEQ ID NO: 1090268 - protein, 19 aa, Mycobacterium
AAGLLRQGKLLGMYPEGTR

SEQ ID NO: 1090269 - protein, 19 aa, Mycobacterium
AAGNGWRVSGLLRIDEVAI

SEQ ID NO: 1090270 - protein, 27 aa, Mycobacterium
AAGTRGAFAAGAARATIAAVAVEPTVA

SEQ ID NO: 1090271 - protein, 17 aa, Mycobacterium
AAGVPVVQALPVGMNCS

SEQ ID NO: 1090272 - protein, 23 aa, Mycobacterium
AAGVRRLVLASSMVVYGQGHYDC

SEQ ID NO: 1090273 - protein, 19 aa, Mycobacterium
AAGVSVLQSAGADVMGALN

SEQ ID NO: 1090274 - protein, 23 aa, Mycobacterium
AAGYSNVYERWAVRISNNGEFIH

SEQ ID NO: 1090275 - protein, 18 aa, Mycobacterium
AAHWLLGDACELSLLESV

SEQ ID NO: 1090276 - protein, 17 aa, Mycobacterium
AAIATFAFAFAAAPVIG

SEQ ID NO: 1090277 - protein, 29 aa, Mycobacterium
AAKILEFAPGELKNLPGYEGSNNGSASTL

SEQ ID NO: 1090278 - protein, 19 aa, Mycobacterium
AALASRAGDHVDFLAHDRV

SEQ ID NO: 1090279 - protein, 19 aa, Mycobacterium
AALRSMAHAFGLDTPPSAI

SEQ ID NO: 1090280 - protein, 19 aa, Mycobacterium
AAPYAGWLSAAATRALGAA

SEQ ID NO: 1090281 - protein, 20 aa, Mycobacterium
AAQLAPWQQALRTLQNRVAG

SEQ ID NO: 1090282 - protein, 31 aa, Mycobacterium
AAQVLLELGCNRAQGFLLSRPVDGAAMESLL

SEQ ID NO: 1090283 - protein, 19 aa, Mycobacterium
AARDGGYLPMNFAANDLAW

SEQ ID NO: 1090284 - protein, 17 aa, Mycobacterium
AARLRRSGVEVVDAPPT

SEQ ID NO: 1090285 - protein, 17 aa, Mycobacterium
AARRAGDRAGRQARLGK

SEQ ID NO: 1090286 - protein, 25 aa, Mycobacterium
AARTQACKLWGITASAMDDASNLVA

SEQ ID NO: 1090287 - protein, 20 aa, Mycobacterium
AARVLSDFFHRVTLIERDEL

SEQ ID NO: 1090288 - protein, 18 aa, Mycobacterium
AATELKKFPSIAGTDSSG

SEQ ID NO: 1090289 - protein, 17 aa, Mycobacterium
AATRLIIQDGIYDEFLS

SEQ ID NO: 1090290 - protein, 19 aa, Mycobacterium
AAVALVIAAMGWVAPSGGA

SEQ ID NO: 1090291 - protein, 23 aa, Mycobacterium
AAVFGAFGLAGCTVDTWQDNAAP

SEQ ID NO: 1090292 - protein, 21 aa, Mycobacterium
AAVGIYGRYDWEDRSTAERAR

SEQ ID NO: 1090293 - protein, 24 aa, Mycobacterium
ADAEARVLLARRFHNDAVRDTLVL

SEQ ID NO: 1090294 - protein, 20 aa, Mycobacterium
ADAKAAILSPQLVTGRAIQL

SEQ ID NO: 1090295 - protein, 20 aa, Mycobacterium
ADAKAAILSPTLVTSRAIQL

SEQ ID NO: 1090296 - protein, 19 aa, Mycobacterium
ADARIRVVEAFGRSHPDIK

SEQ ID NO: 1090297 - protein, 46 aa, Mycobacterium
ADDVSAAIAALFNAHAEQYQALSVRVAEFHESFTRALTAGSTAYAT

SEQ ID NO: 1090298 - protein, 23 aa, Mycobacterium
ADEISAAMASLFTAHAQAYQGLS

SEQ ID NO: 1090299 - protein, 19 aa, Mycobacterium
ADEPIVFHRGAVRPVSPAP

SEQ ID NO: 1090300 - protein, 29 aa, Mycobacterium
ADEVSTAIAALFGWHAQTYQSLSAQATSF

SEQ ID NO: 1090301 - protein, 21 aa, Mycobacterium
ADFLRPGHVAPLLAEPHGVLA

SEQ ID NO: 1090302 - protein, 28 aa, Mycobacterium
ADGATVCGRVVVAACPPVYVPWTPDFAG

SEQ ID NO: 1090303 - protein, 18 aa, Mycobacterium
ADGQRGPVTLLFLGLDRL

SEQ ID NO: 1090304 - protein, 24 aa, Mycobacterium
ADGQRGPVTLLFLGLDRLKAVNDY

SEQ ID NO: 1090305 - protein, 19 aa, Mycobacterium
ADLNANFVVVDGELYATLT

SEQ ID NO: 1090306 - protein, 22 aa, Mycobacterium
ADNILNILFRLNVVVNQTDSFL

SEQ ID NO: 1090307 - protein, 23 aa, Mycobacterium
ADNILNILFRLNVVVNQTDSFLE

SEQ ID NO: 1090308 - protein, 17 aa, Mycobacterium
ADRRMRLTLRIYAYNSC

SEQ ID NO: 1090309 - protein, 20 aa, Mycobacterium
ADSAGLPFAQINNGISVVPL

SEQ ID NO: 1090310 - protein, 18 aa, Mycobacterium
ADVVITMLPNGAVVKRCY

SEQ ID NO: 1090311 - protein, 17 aa, Mycobacterium
ADYSGKPYDEWTAEDWP

SEQ ID NO: 1090312 - protein, 25 aa, Mycobacterium
ADYVRMWIQAAGVMGVYQACSTAAL

SEQ ID NO: 1090313 - protein, 25 aa, Mycobacterium
AEDEVSAAIAALFSGHGQAYQQIST

SEQ ID NO: 1090314 - protein, 24 aa, Mycobacterium
AEDHPDLFWALRGGGGGNFGVTTA

SEQ ID NO: 1090315 - protein, 17 aa, Mycobacterium
AEDWPHTYESVAYPNIF

SEQ ID NO: 1090316 - protein, 18 aa, Mycobacterium
AEGEALRHRGLALDALAA

SEQ ID NO: 1090317 - protein, 25 aa, Mycobacterium
AEGISVNVTLIFSVDRHRGVMDAYL

SEQ ID NO: 1090318 - protein, 17 aa, Mycobacterium
AEGLLMYLPPDAQDRLF

SEQ ID NO: 1090319 - protein, 18 aa, Mycobacterium
AEGVLVWSMGRSDWNCDY

SEQ ID NO: 1090320 - protein, 21 aa, Mycobacterium
AEIRARGRLIVGLEIGSNLFS

SEQ ID NO: 1090321 - protein, 17 aa, Mycobacterium
AELHEFNRLLSKFLTDI

SEQ ID NO: 1090322 - protein, 20 aa, Mycobacterium
AELMAAVFAEHGATEVFSTT

SEQ ID NO: 1090323 - protein, 18 aa, Mycobacterium
AELPAVVADATYAAAIDK

SEQ ID NO: 1090324 - protein, 21 aa, Mycobacterium
AELQADLGLAYLFISHDLAVV

SEQ ID NO: 1090325 - protein, 24 aa, Mycobacterium
AENIRYKAWLAEAALVCDEAAAAL

SEQ ID NO: 1090326 - protein, 17 aa, Mycobacterium
AEPVSGWSALASSIGGR

SEQ ID NO: 1090327 - protein, 26 aa, Mycobacterium
AEQDFIAAINRLRAPVKVAHDYSPEF

SEQ ID NO: 1090328 - protein, 24 aa, Mycobacterium
AEVKKAAAEHGLWYPPDPSSFEIC

SEQ ID NO: 1090329 - protein, 27 aa, Mycobacterium
AEVQYLRYLGFHFAAFVFDASDMDDTA

SEQ ID NO: 1090330 - protein, 23 aa, Mycobacterium
AEYAEMWAQDAAVMYQYSAASEA

SEQ ID NO: 1090331 - protein, 17 aa, Mycobacterium
AEYDLRLLSNSLIQAWH

SEQ ID NO: 1090332 - protein, 17 aa, Mycobacterium
AFALASLIAFEVNLSGA

SEQ ID NO: 1090333 - protein, 18 aa, Mycobacterium
AFALASLIAFEVNLSGAT

SEQ ID NO: 1090334 - protein, 27 aa, Mycobacterium
AFEPSRLGEWASRITSFPPDWSNVGFD

SEQ ID NO: 1090335 - protein, 26 aa, Mycobacterium
AFGAECRRVGIADAHCVLPLAHKVTQ

SEQ ID NO: 1090336 - protein, 25 aa, Mycobacterium
AFGQMAVLAVGGWMAAQGTITVGTF

SEQ ID NO: 1090337 - protein, 25 aa, Mycobacterium
AFHYLDPRGGYVNDHAWIVFDSAHL

SEQ ID NO: 1090338 - protein, 25 aa, Mycobacterium
AFRHRRYLHRGGVHYGNSPAQVLDV

SEQ ID NO: 1090339 - protein, 20 aa, Mycobacterium
AGADMLVRAWVRSYGVAATI

SEQ ID NO: 1090340 - protein, 20 aa, Mycobacterium
AGAGIKLPRSSGEMYKVGQK

SEQ ID NO: 1090341 - protein, 21 aa, Mycobacterium
AGAGIPRSSFYPNRETADSEA

SEQ ID NO: 1090342 - protein, 23 aa, Mycobacterium
AGARLQAQFPVSIVIDGVGVNLT

SEQ ID NO: 1090343 - protein, 26 aa, Mycobacterium
AGATPSFLGYHGFPASICASVNDRVV

SEQ ID NO: 1090344 - protein, 20 aa, Mycobacterium
AGDGWTCQRALTVRNNVAID

SEQ ID NO: 1090345 - protein, 25 aa, Mycobacterium
AGESWRARPKLAITREGLAIRGWLR

SEQ ID NO: 1090346 - protein, 20 aa, Mycobacterium
AGGAAGWLYGAGGSGGAGGA

SEQ ID NO: 1090347 - protein, 27 aa, Mycobacterium
AGGAGGNGGWLFGAGGNGGFGGAATGL

SEQ ID NO: 1090348 - protein, 24 aa, Mycobacterium
AGGKARPDVGPLFYEPTVLTDVTH

SEQ ID NO: 1090349 - protein, 17 aa, Mycobacterium
AGGLPAAAIGGGVSVGE

SEQ ID NO: 1090350 - protein, 18 aa, Mycobacterium
AGGSGGWLAGSGGNGGAG

SEQ ID NO: 1090351 - protein, 17 aa, Mycobacterium
AGIAWETGVLLGIADES

SEQ ID NO: 1090352 - protein, 18 aa, Mycobacterium
AGIFAFFGAVPRSDRCRQ

SEQ ID NO: 1090353 - protein, 23 aa, Mycobacterium
AGLACSGGSPGLRAVADTDATVV

SEQ ID NO: 1090354 - protein, 27 aa, Mycobacterium
AGLDARAYRLAWPSGSVVYEVDQPDVI

SEQ ID NO: 1090355 - protein, 20 aa, Mycobacterium
AGLLFSDAGVGGFGGFGGTG

SEQ ID NO: 1090356 - protein, 17 aa, Mycobacterium
AGLLKPRTVQALLPGIG

SEQ ID NO: 1090357 - protein, 19 aa, Mycobacterium
AGLTARLAAAHAVAAPAIT

SEQ ID NO: 1090358 - protein, 24 aa, Mycobacterium
AGNLHVRMGWAFAADIPVTSIKSA

SEQ ID NO: 1090359 - protein, 25 aa, Mycobacterium
AGNPEIRPAHLLMALLTQADGIAAP

SEQ ID NO: 1090360 - protein, 25 aa, Mycobacterium
AGRFWREVPEPIAIQAVADGSAEHP

SEQ ID NO: 1090361 - protein, 26 aa, Mycobacterium
AGRPDIKSVDAYSLLASRGATTEGPA

SEQ ID NO: 1090362 - protein, 17 aa, Mycobacterium
AGRVVVVNVWGQWCGPC

SEQ ID NO: 1090363 - protein, 23 aa, Mycobacterium
AGSADIFFLLGVTDHEALRWIDG

SEQ ID NO: 1090364 - protein, 30 aa, Mycobacterium
AGTYRSAGGDSCYWERLRGVGGTLDEVIAN

SEQ ID NO: 1090365 - protein, 25 aa, Mycobacterium
AGVGPTLAAAAAWDALAADLASAAQ

SEQ ID NO: 1090366 - protein, 17 aa, Mycobacterium
AGVLRRRLAAAGDLPTE

SEQ ID NO: 1090367 - protein, 18 aa, Mycobacterium
AGVRDLAEVIYLTNEYEL

SEQ ID NO: 1090368 - protein, 18 aa, Mycobacterium
AGVVGWWVNPQAPGIDAC

SEQ ID NO: 1090369 - protein, 17 aa, Mycobacterium
AHLRAAHHLSMCPQCAA

SEQ ID NO: 1090370 - protein, 19 aa, Mycobacterium
AHSFVDAWNYGALSTNAQL

SEQ ID NO: 1090371 - protein, 26 aa, Mycobacterium
AIAAFSAVKPSVAWAETYPGTLSYYL

SEQ ID NO: 1090372 - protein, 23 aa, Mycobacterium
AIAKSCGPAGISVSDVTLDTAGP

SEQ ID NO: 1090373 - protein, 17 aa, Mycobacterium
AIAPARERARGAGATIT

SEQ ID NO: 1090374 - protein, 30 aa, Mycobacterium; identical to SEQ ID NO: 968227

SEQ ID NO: 1090375 - protein, 29 aa, Mycobacterium
AICSLPFEHARPTAIMTWMRQHCGIENNL

SEQ ID NO: 1090376 - protein, 29 aa, Mycobacterium
AICSLPFEHARPTAIMTWMRQHCGIENSL

SEQ ID NO: 1090377 - protein, 17 aa, Mycobacterium
AIEVKIRPPDAASRLLE

SEQ ID NO: 1090378 - protein, 22 aa, Mycobacterium
AIHRHCDVFAFVEAMCCNALRL

SEQ ID NO: 1090379 - protein, 24 aa, Mycobacterium
AIMRDCKYTAIGVWSENSLDRTVV

SEQ ID NO: 1090380 - protein, 23 aa, Mycobacterium
AISVQPWRGAERIAHDDSEVGVP

SEQ ID NO: 1090381 - protein, 23 aa, Mycobacterium
AIYDAWASLSYERGPLGLPTSAE

SEQ ID NO: 1090382 - protein, 22 aa, Mycobacterium
AKDSKGCWQLSITESTDVSSAI

SEQ ID NO: 1090383 - protein, 17 aa, Mycobacterium
AKGTCWAVTVMGSSNTV

SEQ ID NO: 1090384 - protein, 18 aa, Mycobacterium
AKIAFSGAGVRGGIEVVE

SEQ ID NO: 1090385 - protein, 18 aa, Mycobacterium
ALAAGVAVGARLSQRLVR

SEQ ID NO: 1090386 - protein, 17 aa, Mycobacterium
ALAAPATGLLGVPAAAT

SEQ ID NO: 1090387 - protein, 19 aa, Mycobacterium
ALAKIFSGLIRTWDDPILL

SEQ ID NO: 1090388 - protein, 22 aa, Mycobacterium
ALALAARVVGAGALARNESRGC

SEQ ID NO: 1090389 - protein, 18 aa, Mycobacterium
ALASSIGGRVLLPSNGAS

SEQ ID NO: 1090390 - protein, 26 aa, Mycobacterium
ALAVASPCAYFLVYESTTETKPTEHH

SEQ ID NO: 1090391 - protein, 21 aa, Mycobacterium
ALCTPRDAISRDAGVPIANSR

SEQ ID NO: 1090392 - protein, 21 aa, Mycobacterium
ALEGLKAVALLANGADTYAPD

SEQ ID NO: 1090393 - protein, 18 aa, Mycobacterium
ALEGQGRIGMVCQNHNVR

SEQ ID NO: 1090394 - protein, 18 aa, Mycobacterium
ALEYLKYPDAVTVATVSE

SEQ ID NO: 1090395 - protein, 17 aa, Mycobacterium
ALFGRGLISNGAAGTAA

SEQ ID NO: 1090396 - protein, 24 aa, Mycobacterium
ALFPDYRGSALEAFMSTMHDGGLW

SEQ ID NO: 1090397 - protein, 21 aa, Mycobacterium
ALGGVDVCLNGPVYEPLSGAD

SEQ ID NO: 1090398 - protein, 22 aa, Mycobacterium
ALGVFSPFVCYGPLARSVRDLF

SEQ ID NO: 1090399 - protein, 17 aa, Mycobacterium
ALKADAAALGFPIRLPV

SEQ ID NO: 1090400 - protein, 25 aa, Mycobacterium
ALKRTDGSITYNEWSYAVGHQLNMA

SEQ ID NO: 1090401 - protein, 19 aa, Mycobacterium
ALLGHFCDPTVALVAPRIV

SEQ ID NO: 1090402 - protein, 25 aa, Mycobacterium
ALLQRARQDWQGCANRRYGFHSSNG

SEQ ID NO: 1090403 - protein, 23 aa, Mycobacterium
ALLSVSFGTDWSWVGPARDAGIH

SEQ ID NO: 1090404 - protein, 26 aa, Mycobacterium
ALLTLLPDNLRWLVTVDAMHTQVVTA

SEQ ID NO: 1090405 - protein, 18 aa, Mycobacterium
ALPKVPGLGGALGAIGSA

SEQ ID NO: 1090406 - protein, 18 aa, Mycobacterium
ALQTLGLRVDGTGSELTV

SEQ ID NO: 1090407 - protein, 20 aa, Mycobacterium
ALSVPVGWTTAAPAATGGAA

SEQ ID NO: 1090408 - protein, 37 aa, Mycobacterium; identical to SEQ ID NO: 924449

SEQ ID NO: 1090409 - protein, 33 aa, Mycobacterium; identical to SEQ ID NO: 924455

SEQ ID NO: 1090410 - protein, 21 aa, Mycobacterium
AMEQFVYAYIHACPGHTLDYN

SEQ ID NO: 1090411 - protein, 28 aa, Mycobacterium
AMKYMQRWPFRFFAERKWFTIAESIELP

SEQ ID NO: 1090412 - protein, 27 aa, Mycobacterium
AMQQGCGGPCKGAVVALEPSTGKILAL

SEQ ID NO: 1090413 - protein, 26 aa, Mycobacterium
ANEFDYLEMWAQDVAAMVGYHGGASS

SEQ ID NO: 1090414 - protein, 22 aa, Mycobacterium
ANEQWIPGGLLPTGASEAVVDG

SEQ ID NO: 1090415 - protein, 20 aa, Mycobacterium
ANGLAACYVSGFLATDPPPG

SEQ ID NO: 1090416 - protein, 19 aa, Mycobacterium
ANHQYLGPVLWSPAGELPR

SEQ ID NO: 1090417 - protein, 24 aa, Mycobacterium
ANIAPEYTGTGWINYLGHENPIEG

SEQ ID NO: 1090418 - protein, 22 aa, Mycobacterium
ANSQLRPGRVIGAAFDDDTDTW

SEQ ID NO: 1090419 - protein, 24 aa, Mycobacterium
ANSTLCLDVDWVLGSCMSVDPDHK

SEQ ID NO: 1090420 - protein, 24 aa, Mycobacterium
ANSVVRCVGNTLLLNGRTYSPPYI

SEQ ID NO: 1090421 - protein, 17 aa, Mycobacterium
ANTKPALDFDDLIDGFR

SEQ ID NO: 1090422 - protein, 21 aa, Mycobacterium
ANVAAALPTTGILAAGADDVS

SEQ ID NO: 1090423 - protein, 25 aa, Mycobacterium
APAEAFSRPGLPVEYLQVPSPSMGR

SEQ ID NO: 1090424 - protein, 18 aa, Mycobacterium
APALAAGCTVVLKPSDTT

SEQ ID NO: 1090425 - protein, 19 aa, Mycobacterium
APAPPNCTAADLAGVSAGV

SEQ ID NO: 1090426 - protein, 18 aa, Mycobacterium
APASWSLSEGTTLAYFPN

SEQ ID NO: 1090427 - protein, 20 aa, Mycobacterium
APDRFLLLVVEGTDEDPVAA

SEQ ID NO: 1090428 - protein, 46 aa, Mycobacterium; identical to SEQ ID NO: 924571

SEQ ID NO: 1090429 - protein, 20 aa, Mycobacterium
APEAPRLIFRPTDAAGDVLP

SEQ ID NO: 1090430 - protein, 17 aa, Mycobacterium
APFESLTGRELIGNGAA

SEQ ID NO: 1090431 - protein, 17 aa, Mycobacterium
APFSKALHETDRVATIA

SEQ ID NO: 1090432 - protein, 18 aa, Mycobacterium
APGACVVVNPCLSGGSLE

SEQ ID NO: 1090433 - protein, 19 aa, Mycobacterium
APGQAGGDGGLLYGNGGNG

SEQ ID NO: 1090434 - protein, 22 aa, Mycobacterium
APISVQIADGWFQRVTLTNPVG

SEQ ID NO: 1090435 - protein, 21 aa, Mycobacterium
APLGRPIICTEYLARSQDSSV

SEQ ID NO: 1090436 - protein, 33 aa, Mycobacterium; identical to SEQ ID NO: 635646

SEQ ID NO: 1090437 - protein, 23 aa, Mycobacterium
APPPPRRVRRGGGGIRRDVAGRL

SEQ ID NO: 1090438 - protein, 18 aa, Mycobacterium
APSPATAVTPSIPGVNAP

SEQ ID NO: 1090439 - protein, 24 aa, Mycobacterium
APTEALFGRPLIGDGADGQTVNGV

SEQ ID NO: 1090440 - protein, 26 aa, Mycobacterium
APTQALLARPLIGDGTNGAPGTGQAG

SEQ ID NO: 1090441 - protein, 21 aa, Mycobacterium
APVAACTRGTLARIEAALEEA

SEQ ID NO: 1090442 - protein, 28 aa, Mycobacterium
APVQELTGRPLIGNGLPGSAGSGAAGAP

SEQ ID NO: 1090443 - protein, 22 aa, Mycobacterium
APVVRLPGPVPRAPGPAPQAPG

SEQ ID NO: 1090444 - protein, 24 aa, Mycobacterium
APWRAEALVLLAFSAYVRGDGPLT

SEQ ID NO: 1090445 - protein, 20 aa, Mycobacterium
APYLRSWESVIGHQRTGVYA

SEQ ID NO: 1090446 - protein, 17 aa, Mycobacterium
AQCGGDPSIPFNEGKRC

SEQ ID NO: 1090447 - protein, 23 aa, Mycobacterium
AQDEVYAGTGWTAMRGQRMDDSV

SEQ ID NO: 1090448 - protein, 23 aa, Mycobacterium
AQEAHNWQRCNGRSITTTATSYP

SEQ ID NO: 1090449 - protein, 17 aa, Mycobacterium
AQLLVLIATNFFGQNTS

SEQ ID NO: 1090450 - protein, 23 aa, Mycobacterium
AQQEIEWAKWVIAGLDQRSGVAP

SEQ ID NO: 1090451 - protein, 26 aa, Mycobacterium
AQQFNQRWVRLGCDIDLSGLFYEGER

SEQ ID NO: 1090452 - protein, 21 aa, Mycobacterium
AQQMTEGWRAHGLDMDIAGLT

SEQ ID NO: 1090453 - protein, 21 aa, Mycobacterium
AQRSPERVLPLALDITEPDQI

SEQ ID NO: 1090454 - protein, 25 aa, Mycobacterium
AQVPRNAIPPPWRSEVHTGPASDSI

SEQ ID NO: 1090455 - protein, 19 aa, Mycobacterium
ARAALRAWIAQAVTWHDPA

SEQ ID NO: 1090456 - protein, 27 aa, Mycobacterium
ARACGVGLRAFELAVRYAQQRHTFGKP

SEQ ID NO: 1090457 - protein, 17 aa, Mycobacterium
ARAKAASTALRVLAETG

SEQ ID NO: 1090458 - protein, 22 aa, Mycobacterium
ARDCARPKVAPSGRIVLLTSGT

SEQ ID NO: 1090459 - protein, 21 aa, Mycobacterium
ARDRSGAALTGPATFAALTAG

SEQ ID NO: 1090460 - protein, 32 aa, Mycobacterium
AREGVCQDFARLAIACLRANGLAACYVSGFLA

SEQ ID NO: 1090461 - protein, 18 aa, Mycobacterium
ARERARGAGATITSGPTG

SEQ ID NO: 1090462 - protein, 20 aa, Mycobacterium
ARGHTKNCRLYWVQIIPTIA

SEQ ID NO: 1090463 - protein, 19 aa, Mycobacterium
ARGTGKCQQAWCPVCALTA

SEQ ID NO: 1090464 - protein, 20 aa, Mycobacterium
ARIFAGAGVGPTLAAAAAWD

SEQ ID NO: 1090465 - protein, 19 aa, Mycobacterium
ARLNLPPMCHHNPTHRVSV

SEQ ID NO: 1090466 - protein, 17 aa, Mycobacterium
ARPITPLLDALRGLGVP

SEQ ID NO: 1090467 - protein, 22 aa, Mycobacterium
ARPKLFAICKAMDIKCYANLAY

SEQ ID NO: 1090468 - protein, 22 aa, Mycobacterium
ARPPECTAAVLFKGSPLRPPGS

SEQ ID NO: 1090469 - protein, 21 aa, Mycobacterium
ARPTAWLAEGVRIGFLPPEAE

SEQ ID NO: 1090470 - protein, 22 aa, Mycobacterium
ARRPPVFAGSIWVQQGSQPLAE

SEQ ID NO: 1090471 - protein, 20 aa, Mycobacterium
ARRTGVERDGPTLFLPLTSL

SEQ ID NO: 1090472 - protein, 24 aa, Mycobacterium
ARSRRPGTFGVIFALIAVLASACQ

SEQ ID NO: 1090473 - protein, 20 aa, Mycobacterium
ARSSLGRKLGRRWHQETVYG

SEQ ID NO: 1090474 - protein, 18 aa, Mycobacterium
ARTAALAFEQAYAMTVPP

SEQ ID NO: 1090475 - protein, 18 aa, Mycobacterium
ARTAWQLHTAAGGGQGAP

SEQ ID NO: 1090476 - protein, 19 aa, Mycobacterium
ARVDAAGGTFVFLDAPAGT

SEQ ID NO: 1090477 - protein, 24 aa, Mycobacterium
ARVKSGEVGLAFIYFDDRTPPPPP

SEQ ID NO: 1090478 - protein, 24 aa, Mycobacterium
ARVPQRFVPDLTKYQYWNGDSNSW

SEQ ID NO: 1090479 - protein, 29 aa, Mycobacterium
ARWFPVFPAPAWLTRRLVTMLSSVAYIGS

SEQ ID NO: 1090480 - protein, 18 aa, Mycobacterium
ASAADCPDAEVVFPRGTS

SEQ ID NO: 1090481 - protein, 23 aa, Mycobacterium
ASAFSRPGLPVEYLQVPSVAMGR

SEQ ID NO: 1090482 - protein, 28 aa, Mycobacterium
ASALAPWKQVLRNLGIDIGKNGQINLGF

SEQ ID NO: 1090483 - protein, 24 aa, Mycobacterium
ASCAVPGAWPPVTIAGRRYMDGGV

SEQ ID NO: 1090484 - protein, 20 aa, Mycobacterium
ASCRAAGIDPVRQPIPVVPG

SEQ ID NO: 1090485 - protein, 23 aa, Mycobacterium
ASELIRLTADFGIKETALRVALT

SEQ ID NO: 1090486 - protein, 19 aa, Mycobacterium
ASGYSRFPVVQGDLDETFG

SEQ ID NO: 1090487 - protein, 23 aa, Mycobacterium
ASKQVYDGSGWVAAQTQALRDNT

SEQ ID NO: 1090488 - protein, 17 aa, Mycobacterium
ASLMRRSLQFGTLTAEE

SEQ ID NO: 1090489 - protein, 27 aa, Mycobacterium
ASMLGGLPLSGFGGRGFSEVPRYGFKP

SEQ ID NO: 1090490 - protein, 18 aa, Mycobacterium
ASQISDLLLLMGGAATEL

SEQ ID NO: 1090491 - protein, 28 aa, Mycobacterium
ASSNLALDRFADFPTLPLDPSAMVAQVG

SEQ ID NO: 1090492 - protein, 19 aa, Mycobacterium
ASSVGALSVPVGWTTAAPA

SEQ ID NO: 1090493 - protein, 20 aa, Mycobacterium
ASTIKVLLALVALDELNLNS

SEQ ID NO: 1090494 - protein, 20 aa, Mycobacterium
ASVARFAAALAPHGSGTVLA

SEQ ID NO: 1090495 - protein, 24 aa, Mycobacterium
ASYFWQHNWGSPKGYTHPAANLHQ

SEQ ID NO: 1090496 - protein, 17 aa, Mycobacterium
ASYSTAFGSMFDQPSIG

SEQ ID NO: 1090497 - protein, 25 aa, Mycobacterium
ATADLYPRYTCDYGTPSHPPSAADY

SEQ ID NO: 1090498 - protein, 24 aa, Mycobacterium
ATARASLYAATKFGIRGFALCLRD

SEQ ID NO: 1090499 - protein, 25 aa, Mycobacterium
ATEQPRIEPYLAMVQASESGVAGTW

SEQ ID NO: 1090500 - protein, 24 aa, Mycobacterium
ATGGIGFGCAAKFAEMSMAVVGTA

SEQ ID NO: 1090501 - protein, 27 aa, Mycobacterium
ATMAGWRTDFLNEMGLVVSEGIKPFAV

SEQ ID NO: 1090502 - protein, 18 aa, Mycobacterium
ATMTPVFTADGLRADPRN

SEQ ID NO: 1090503 - protein, 18 aa, Mycobacterium
ATQLLMAAAQAFAHNPAA

SEQ ID NO: 1090504 - protein, 23 aa, Mycobacterium
ATQPMPATVWIQETGDHQLAQIR

SEQ ID NO: 1090505 - protein, 18 aa, Mycobacterium
ATRRRGWVTTFGEIEPNT

SEQ ID NO: 1090506 - protein, 27 aa, Mycobacterium
ATSTSVLARIFAAGAAGAARAAGTTSP

SEQ ID NO: 1090507 - protein, 21 aa, Mycobacterium
ATSYPAQTWFVATVDNHDGML

SEQ ID NO: 1090508 - protein, 17 aa, Mycobacterium
ATTSLAEWVTGPDSPNK

SEQ ID NO: 1090509 - protein, 18 aa, Mycobacterium
ATVHPELVLANRNQLVSL

SEQ ID NO: 1090510 - protein, 18 aa, Mycobacterium
ATWRGKPVELARTVVDLT

SEQ ID NO: 1090511 - protein, 25 aa, Mycobacterium
AVAAAEVPLAFAVAAGSFRDATRVA

SEQ ID NO: 1090512 - protein, 24 aa, Mycobacterium
AVAARRWPLIAALGHAVTLTIRGG

SEQ ID NO: 1090513 - protein, 33 aa, Mycobacterium
AVAAVACAGRADAVGAFGTRRGATTAATAGPTD

SEQ ID NO: 1090514 - protein, 27 aa, Mycobacterium
AVADSFYLPLVVRRRITFLAKAEYFTG

SEQ ID NO: 1090515 - protein, 17 aa, Mycobacterium
AVAEPVSGWSALASSIG

SEQ ID NO: 1090516 - protein, 17 aa, Mycobacterium
AVAERGLSFDMWVYGHQ

SEQ ID NO: 1090517 - protein, 23 aa, Mycobacterium
AVALIVLSGFLVDLCNTTSQDHS

SEQ ID NO: 1090518 - protein, 17 aa, Mycobacterium
AVAQCNSQSLAEDLETD

SEQ ID NO: 1090519 - protein, 17 aa, Mycobacterium
AVARADVVITMLPNGAV

SEQ ID NO: 1090520 - protein, 29 aa, Mycobacterium
AVELWKIVDRPNLLIKIPATKAGLPAIAA

SEQ ID NO: 1090521 - protein, 18 aa, Mycobacterium
AVGSRLAADYGTINGSSA

SEQ ID NO: 1090522 - protein, 24 aa, Mycobacterium
AVHGFPNYFFICGPDVAAQISYVA

SEQ ID NO: 1090523 - protein, 22 aa, Mycobacterium
AVIPRQRTAVPVEWDDVRAQLA

SEQ ID NO: 1090524 - protein, 19 aa, Mycobacterium
AVLLAFPLVPKAAAACPDV

SEQ ID NO: 1090525 - protein, 25 aa, Mycobacterium
AVLPDMRARRSGAIVNISSIAVALT

SEQ ID NO: 1090526 - protein, 20 aa, Mycobacterium
AVLPGYGWIFPLGNGEVNIG

SEQ ID NO: 1090527 - protein, 17 aa, Mycobacterium
AVPELPAAAAAPAAAAP

SEQ ID NO: 1090528 - protein, 24 aa, Mycobacterium
AVRRRPYTVILFDEIEKAHPDVFD

SEQ ID NO: 1090529 - protein, 29 aa, Mycobacterium
AVSAEAVAFHGRFVQALTGGVQMYAAAET

SEQ ID NO: 1090530 - protein, 23 aa, Mycobacterium
AVSAIPAVRVRLVDLQRQMAEGR

SEQ ID NO: 1090531 - protein, 19 aa, Mycobacterium
AVSTTRLMAAAGDEVSADI

SEQ ID NO: 1090532 - protein, 19 aa, Mycobacterium
AVTRARFQALDLRVDTKPD

SEQ ID NO: 1090533 - protein, 20 aa, Mycobacterium
AVVAPELMRVAASDLANIGS

SEQ ID NO: 1090534 - protein, 18 aa, Mycobacterium
AVVAPVWFTSPPEVHSAL

SEQ ID NO: 1090535 - protein, 25 aa, Mycobacterium
AWLYSQRRFEVPSDKIANTMKLAIV

SEQ ID NO: 1090536 - protein, 25 aa, Mycobacterium
AWTVYSLPGAPAFDHYELADAEYAL

SEQ ID NO: 1090537 - protein, 25 aa, Mycobacterium
AWYPGMEAFLGVAVHGFPNYFFICG

SEQ ID NO: 1090538 - protein, 19 aa, Mycobacterium
AYCRLVLRCFGVRITVSGS

SEQ ID NO: 1090539 - protein, 24 aa, Mycobacterium
AYRAEGRILAAVAAVLAVAVPSTA

SEQ ID NO: 1090540 - protein, 20 aa, Mycobacterium
AYSGDGSWGRASHYPTRAAA

SEQ ID NO: 1090541 - protein, 24 aa, Mycobacterium
AYWSSHARRRFPLPDVLYTHLLGV

SEQ ID NO: 1090542 - protein, 17 aa, Mycobacterium
CGLLLLMVPPPSVNSLL

SEQ ID NO: 1090543 - protein, 26 aa, Mycobacterium
CGSILTGLTDLSWRGPASESMAASAA

SEQ ID NO: 1090544 - protein, 25 aa, Mycobacterium
CLAEAGWPVQLWAAAMPQQTTSAVA

SEQ ID NO: 1090545 - protein, 20 aa, Mycobacterium
CLLVGCSHGAAPSMTADISR

SEQ ID NO: 1090546 - protein, 17 aa, Mycobacterium
CLTLVSRPACDLAGMLT

SEQ ID NO: 1090547 - protein, 17 aa, Mycobacterium
CMVTFKTSYGVIQQSLY

SEQ ID NO: 1090548 - protein, 19 aa, Mycobacterium
CNPRSAAVRLRALQRTQHG

SEQ ID NO: 1090549 - protein, 20 aa, Mycobacterium
CPEDRPATRSARRVQPAPRS

SEQ ID NO: 1090550 - protein, 24 aa, Mycobacterium
CRASRYTLMMRSARNITMPPQKRS

SEQ ID NO: 1090551 - protein, 22 aa, Mycobacterium
CRCGGELNGALSAMSAQGSGVV

SEQ ID NO: 1090552 - protein, 17 aa, Mycobacterium
CRLYWVQIIPTIASESA

SEQ ID NO: 1090553 - protein, 17 aa, Mycobacterium
CRNGRNFVAAAFAAGLV

SEQ ID NO: 1090554 - protein, 18 aa, Mycobacterium
CRSPHPVSGCTFTAPEIR

SEQ ID NO: 1090555 - protein, 22 aa, Mycobacterium
CSTTVARCWPPLVPHSTARPTS

SEQ ID NO: 1090556 - protein, 24 aa, Mycobacterium
CTSELRIDPRLQLAAEWHTNDVLG

SEQ ID NO: 1090557 - protein, 25 aa, Mycobacterium
CVADLPPADLSRIYVTVTDCATTHL

SEQ ID NO: 1090558 - protein, 25 aa, Mycobacterium
CVFFESPRRLAACLRDAVEQLGGSR

SEQ ID NO: 1090559 - protein, 19 aa, Mycobacterium
CVGWLYRTAEQTQQAAIQA

SEQ ID NO: 1090560 - protein, 19 aa, Mycobacterium
DAAASLGWQAAPIPRNAPG

SEQ ID NO: 1090561 - protein, 24 aa, Mycobacterium
DAAPGRITTILALHDLINGGHPGQ

SEQ ID NO: 1090562 - protein, 31 aa, Mycobacterium
DADGAIWARYNVPWQPAWVFYRVDGSSTFVN

SEQ ID NO: 1090563 - protein, 23 aa, Mycobacterium
DAEPDLTNAVAFLAAAVVTGGTV

SEQ ID NO: 1090564 - protein, 23 aa, Mycobacterium
DALLRLARRSACSGAALSDAVGE

SEQ ID NO: 1090565 - protein, 21 aa, Mycobacterium
DALRPLNAVVRSARMAAISAI

SEQ ID NO: 1090566 - protein, 35 aa, Mycobacterium; identical to SEQ ID NO: 925525

SEQ ID NO: 1090567 - protein, 18 aa, Mycobacterium
DAQALIVSPNLVAARFIQ

SEQ ID NO: 1090568 - protein, 25 aa, Mycobacterium
DAQSGSIGLGFAIPVDQAKRIADEL

SEQ ID NO: 1090569 - protein, 23 aa, Mycobacterium
DARRWKTRWHCNGRSRTTPPTLR

SEQ ID NO: 1090570 - protein, 19 aa, Mycobacterium
DASRLDVTTLWAPRRRDDE

SEQ ID NO: 1090571 - protein, 21 aa, Mycobacterium
DDARFNISRAALLVVALTQRP

SEQ ID NO: 1090572 - protein, 18 aa, Mycobacterium
DDLIGIGALNSGAGNLGF

SEQ ID NO: 1090573 - protein, 19 aa, Mycobacterium
DDLLRPGVEVITPSPLSSG

SEQ ID NO: 1090574 - protein, 19 aa, Mycobacterium
DDLVLAWAAESGRYAGFDA

SEQ ID NO: 1090575 - protein, 18 aa, Mycobacterium
DDPTCLRLASIGDTSVYA

SEQ ID NO: 1090576 - protein, 17 aa, Mycobacterium
DDWPAALRHNGFDTTQP

SEQ ID NO: 1090577 - protein, 25 aa, Mycobacterium
DEPEPNARFVIWRKPNGAQLIADYL

SEQ ID NO: 1090578 - protein, 22 aa, Mycobacterium
DEVSGAIAALFGANAQEYQAAA

SEQ ID NO: 1090579 - protein, 33 aa, Mycobacterium; identical to SEQ ID NO: 925678

SEQ ID NO: 1090580 - protein, 19 aa, Mycobacterium
DFLLVRVGRRQVPLDAALR

SEQ ID NO: 1090581 - protein, 20 aa, Mycobacterium
DFTVVPAFTGEVLRALQPSA

SEQ ID NO: 1090582 - protein, 19 aa, Mycobacterium
DGADWVEWGGCGMVHPNVL

SEQ ID NO: 1090583 - protein, 18 aa, Mycobacterium
DGGHRGVWMIAFSKTMPR

SEQ ID NO: 1090584 - protein, 20 aa, Mycobacterium
DGLMALPYVEKSGDFSRIAW

SEQ ID NO: 1090585 - protein, 23 aa, Mycobacterium
DGSGADPLWFLSLLSQDAVDLLE

SEQ ID NO: 1090586 - protein, 25 aa, Mycobacterium
DGTQRPSTMWAQYGLAGVLEYEHFV

SEQ ID NO: 1090587 - protein, 28 aa, Mycobacterium
DHSRRLWTLLIFMLWHAIFIERSITPQI

SEQ ID NO: 1090588 - protein, 24 aa, Mycobacterium
DIAEVVSAWTGIPAGRMLEGETAK

SEQ ID NO: 1090589 - protein, 17 aa, Mycobacterium
DIEGLRFNRGSWARAQL

SEQ ID NO: 1090590 - protein, 26 aa, Mycobacterium
DISFVLGEVSWQWEGAGAESYVAENI

SEQ ID NO: 1090591 - protein, 20 aa, Mycobacterium
DITAYGWDETVFFHNGDPFI

SEQ ID NO: 1090592 - protein, 17 aa, Mycobacterium
DKMKVTFHYQNKYKVPA

SEQ ID NO: 1090593 - protein, 22 aa, Mycobacterium
DKNTSYRIGLKVANASVSRQII

SEQ ID NO: 1090594 - protein, 25 aa, Mycobacterium
DLAKGLEMVGAFLPSLNESIASGPF

SEQ ID NO: 1090595 - protein, 18 aa, Mycobacterium
DLDEVAAGLGFVRMVDTF

SEQ ID NO: 1090596 - protein, 19 aa, Mycobacterium
DLLDRFGSVSGLWNQVVAI

SEQ ID NO: 1090597 - protein, 20 aa, Mycobacterium
DLPTELMTALSQGLSSFGIN

SEQ ID NO: 1090598 - protein, 23 aa, Mycobacterium
DLPVCNNWADIGLPEVFNDPDLA

SEQ ID NO: 1090599 - protein, 21 aa, Mycobacterium
DLRLLSNSLIQAWHGNESELI

SEQ ID NO: 1090600 - protein, 24 aa, Mycobacterium
DLVLELNSIYGLRDPGAYPIMLAS

SEQ ID NO: 1090601 - protein, 25 aa, Mycobacterium
DLVVGDLRWSLSVSARLASIPYIAI

SEQ ID NO: 1090602 - protein, 21 aa, Mycobacterium
DNDAVFVLSRWDLGTDPLDVL

SEQ ID NO: 1090603 - protein, 22 aa, Mycobacterium
DNLPAKFLEGFVRTSNMKFQAA

SEQ ID NO: 1090604 - protein, 26 aa, Mycobacterium
DNVNYRILLKPGWGFTDGSPVTAHSF

SEQ ID NO: 1090605 - protein, 25 aa, Mycobacterium
DPAALPPPPGHRLGQIVNPRWSPTG

SEQ ID NO: 1090606 - protein, 19 aa, Mycobacterium
DPAAPKRSRTMTVKFASPT

SEQ ID NO: 1090607 - protein, 27 aa, Mycobacterium
DPADLLGPIWRRNEVFEFNGSKLDSEE

SEQ ID NO: 1090608 - protein, 28 aa, Mycobacterium
DPNIQPQGRFSWRTMPDNLSDAGISWKV

SEQ ID NO: 1090609 - protein, 30 aa, Mycobacterium
DPPPEGYEALLLMCIDPRFVHPTNEYMVQR

SEQ ID NO: 1090610 - protein, 23 aa, Mycobacterium
DPSDPPTIVAILSKLTGNVEAAK

SEQ ID NO: 1090611 - protein, 18 aa, Mycobacterium
DPSIPFNEGKRCRVNEQV

SEQ ID NO: 1090612 - protein, 23 aa, Mycobacterium
DPSRAAEVLGFRAAVEPLEGLRG

SEQ ID NO: 1090613 - protein, 25 aa, Mycobacterium
DPVAAFKWHARVAIEDPDRVQQQLA

SEQ ID NO: 1090614 - protein, 19 aa, Mycobacterium
DQSVRWRATVVQMDGRRID

SEQ ID NO: 1090615 - protein, 26 aa, Mycobacterium
DQVIGVHLRGHFLLTRNAATYWRQKA

SEQ ID NO: 1090616 - protein, 24 aa, Mycobacterium
DQWRPRPWPDLTRRRLFVRPDAAI

SEQ ID NO: 1090617 - protein, 22 aa, Mycobacterium
DRALRVNLEIPVQMTRELIPAF

SEQ ID NO: 1090618 - protein, 19 aa, Mycobacterium
DRGPARKPGQLSWGTGSTP

SEQ ID NO: 1090619 - protein, 20 aa, Mycobacterium
DRLDSLMAVARKDLVLSGGW

SEQ ID NO: 1090620 - protein, 20 aa, Mycobacterium
DRLRGVFGSDEIFSSTGSSV

SEQ ID NO: 1090621 - protein, 17 aa, Mycobacterium
DRYEVHHGVRITDSALV

SEQ ID NO: 1090622 - protein, 23 aa, Mycobacterium
DSAQWLAAHGWAVEPVRNTLELQ

SEQ ID NO: 1090623 - protein, 24 aa, Mycobacterium
DSYLRCLQVLMAGSGYPMVASHDP

SEQ ID NO: 1090624 - protein, 18 aa, Mycobacterium
DTAFRAGWQGDFPSMIEF

SEQ ID NO: 1090625 - protein, 23 aa, Mycobacterium
DTALRRHFDWVRSWYDFAVPGIG

SEQ ID NO: 1090626 - protein, 30 aa, Mycobacterium
DTDVIGAPGTEVWTFTALKPGTTTITTGYA

SEQ ID NO: 1090627 - protein, 22 aa, Mycobacterium
DTELLEYHWGAGLDGLGCPEDR

SEQ ID NO: 1090628 - protein, 17 aa, Mycobacterium
DTLRAIGEAGGLGLASR

SEQ ID NO: 1090629 - protein, 18 aa, Mycobacterium
DVGFPYRSALWPGRNAEI

SEQ ID NO: 1090630 - protein, 22 aa, Mycobacterium
DVPKGGSFPLYTAIDVNMTAQG

SEQ ID NO: 1090631 - protein, 20 aa, Mycobacterium
EAAADLAGVGSVIDAANTAA

SEQ ID NO: 1090632 - protein, 19 aa, Mycobacterium
EAALERLRSQPAFEDASAR

SEQ ID NO: 1090633 - protein, 26 aa, Mycobacterium
EAANAGPLQPLLDLINAPTQALLARP

SEQ ID NO: 1090634 - protein, 19 aa, Mycobacterium
EAANASFLQDPLQTALNAT

SEQ ID NO: 1090635 - protein, 25 aa, Mycobacterium
EAEAKLQAARLVAWSSAGAEGPPPG

SEQ ID NO: 1090636 - protein, 20 aa, Mycobacterium
EAEGGMGPHGLMIGMTGSGK

SEQ ID NO: 1090637 - protein, 17 aa, Mycobacterium
EAERIKVQGSRQVELLR

SEQ ID NO: 1090638 - protein, 18 aa, Mycobacterium
EAEVTGFVTAARQENLAA

SEQ ID NO: 1090639 - protein, 19 aa, Mycobacterium
EAGKARWAAQEEVVDLVAN

SEQ ID NO: 1090640 - protein, 17 aa, Mycobacterium
EAGRAATLRAVRALTGV

SEQ ID NO: 1090641 - protein, 22 aa, Mycobacterium
EAKGVNVNPFFAVLSGSRIPAP

SEQ ID NO: 1090642 - protein, 23 aa, Mycobacterium
EALIEVCGVLGYDARRDSDPVGA

SEQ ID NO: 1090643 - protein, 25 aa, Mycobacterium
EALSPRVAATIPQLVQLAPQAGQMA

SEQ ID NO: 1090644 - protein, 17 aa, Mycobacterium
EAWRVADRLLAGIDPAD

SEQ ID NO: 1090645 - protein, 18 aa, Mycobacterium
EDAPAGAPHRLVDPAALP

SEQ ID NO: 1090646 - protein, 23 aa, Mycobacterium
EDEVSAAIAALFGTFGQEYQGSG

SEQ ID NO: 1090647 - protein, 26 aa, Mycobacterium
EDGLPMLCRGAQGWQAGWFTGAGFFP

SEQ ID NO: 1090648 - protein, 18 aa, Mycobacterium
EDLVAFDLAFAAVFGALD

SEQ ID NO: 1090649 - protein, 19 aa, Mycobacterium
EELRSARTPQELVSLVRSS

SEQ ID NO: 1090650 - protein, 22 aa, Mycobacterium
EEPNPFGGFGCNCGPAESPIVP

SEQ ID NO: 1090651 - protein, 25 aa, Mycobacterium
EERFARRIAAHIVRRRAHTPFTSTA

SEQ ID NO: 1090652 - protein, 21 aa, Mycobacterium
EESRLPPIYPGTTVSIPPTTT

SEQ ID NO: 1090653 - protein, 24 aa, Mycobacterium
EEVFTRPGAQYTQRLLEAIPGGPV

SEQ ID NO: 1090654 - protein, 18 aa, Mycobacterium
EFAVAVVPVPSRLSLKAA

SEQ ID NO: 1090655 - protein, 19 aa, Mycobacterium
EFTPFPPPQQSWQLSKRTA

SEQ ID NO: 1090656 - protein, 23 aa, Mycobacterium
EGARGWACQHALTARNNIVIDIE

SEQ ID NO: 1090657 - protein, 19 aa, Mycobacterium
EGGAPRWWFTVGGEVGKGE

SEQ ID NO: 1090658 - protein, 20 aa, Mycobacterium
EGNPACLYSDGWQPTSSGSG

SEQ ID NO: 1090659 - protein, 24 aa, Mycobacterium
EGPFSVAAYCFDGNNLLSEADAFA

SEQ ID NO: 1090660 - protein, 19 aa, Mycobacterium
EGVAGRTADQLKEAGFNVT

SEQ ID NO: 1090661 - protein, 20 aa, Mycobacterium
EHHARIPGFPGTAHAESLQF

SEQ ID NO: 1090662 - protein, 20 aa, Mycobacterium
EHIADTFIAMGWELVDGPEV

SEQ ID NO: 1090663 - protein, 19 aa, Mycobacterium
EILALMAMGTGAPDPGDLS

SEQ ID NO: 1090664 - protein, 18 aa, Mycobacterium
EILPGASAIFLTELHRAH

SEQ ID NO: 1090665 - protein, 18 aa, Mycobacterium
EILTRYLNLVSFGNNSFG

SEQ ID NO: 1090666 - protein, 23 aa, Mycobacterium
EIPCVRALLTLLPGSLRWLVTVD

SEQ ID NO: 1090667 - protein, 26 aa, Mycobacterium
EIPLDDWLWTLGINLWGPIHGCHVFT

SEQ ID NO: 1090668 - protein, 20 aa, Mycobacterium
EIRARGRLIVGLEIGSNLFS

SEQ ID NO: 1090669 - protein, 19 aa, Mycobacterium
ELAELSALVIPRPKRKTRT

SEQ ID NO: 1090670 - protein, 17 aa, Mycobacterium
ELAKALAEFLFDDERAM

SEQ ID NO: 1090671 - protein, 28 aa, Mycobacterium
ELDPKTAVLTWRGDQYILFVQLSGSGAR

SEQ ID NO: 1090672 - protein, 21 aa, Mycobacterium
ELERRYVHGARWCDASDIAAL

SEQ ID NO: 1090673 - protein, 27 aa, Mycobacterium
ELGLARLIGFNSMRVFLHDQLWASDQR

SEQ ID NO: 1090674 - protein, 19 aa, Mycobacterium
ELKNIALYLNFDMLASPNP

SEQ ID NO: 1090675 - protein, 19 aa, Mycobacterium
ELRDWPETVGRPVAGCPVR

SEQ ID NO: 1090676 - protein, 19 aa, Mycobacterium
ELRLPAVTFATLPQLTEAS

SEQ ID NO: 1090677 - protein, 18 aa, Mycobacterium
ELSALAWTVYSLPGAPAF

SEQ ID NO: 1090678 - protein, 21 aa, Mycobacterium
ELSFLDCLYYSAVTLSTTGYG

SEQ ID NO: 1090679 - protein, 21 aa, Mycobacterium
ELTPPYRGGPVLQSHDTIGLT

SEQ ID NO: 1090680 - protein, 19 aa, Mycobacterium
ENLREHRKGLMVDLVTDIN

SEQ ID NO: 1090681 - protein, 21 aa, Mycobacterium
ENRPDCIYFAAAGHALGTGHT

SEQ ID NO: 1090682 - protein, 23 aa, Mycobacterium
EPFSEPEVFDFPDGIGPVECVNV

SEQ ID NO: 1090683 - protein, 21 aa, Mycobacterium
EPRAPKLWLPPLDESIQLTAI

SEQ ID NO: 1090684 - protein, 28 aa, Mycobacterium
EQAVQRSVVLSSGWNIIDFVQQLQQLTG

SEQ ID NO: 1090685 - protein, 18 aa, Mycobacterium
EQFYRSAIYGDPVEVTGS

SEQ ID NO: 1090686 - protein, 24 aa, Mycobacterium
EQHRPEVIFHLAAQIDVRHSVADP

SEQ ID NO: 1090687 - protein, 17 aa, Mycobacterium
EQTRSIGLFGLMIPEQY

SEQ ID NO: 1090688 - protein, 19 aa, Mycobacterium
EQVPMALFMQAWATSQDFM

SEQ ID NO: 1090689 - protein, 21 aa, Mycobacterium
ERAGLPPGLVHYHFASLNDLL

SEQ ID NO: 1090690 - protein, 19 aa, Mycobacterium
ERASTSLAWTGHSLQIFRE

SEQ ID NO: 1090691 - protein, 30 aa, Mycobacterium; identical to SEQ ID NO: 926753

SEQ ID NO: 1090692 - protein, 19 aa, Mycobacterium
ERIKVQGSRQVELLRTQLT

SEQ ID NO: 1090693 - protein, 23 aa, Mycobacterium
ERLPGAIRWSSGALRQARDYLSG

SEQ ID NO: 1090694 - protein, 20 aa, Mycobacterium
ERPDAEVLVSAPNVVPTSAF

SEQ ID NO: 1090695 - protein, 25 aa, Mycobacterium
ERTLVSYLRLSGKIAQDTSFDGRSD

SEQ ID NO: 1090696 - protein, 34 aa, Mycobacterium
ERVRLLAEGAPVLWDEMPTLPLYRQERTLLMSKK

SEQ ID NO: 1090697 - protein, 18 aa, Mycobacterium
ERYFRDAPLMIVGEGTNE

SEQ ID NO: 1090698 - protein, 18 aa, Mycobacterium
ESCCSTTVARCWPPLVPH

SEQ ID NO: 1090699 - protein, 29 aa, Mycobacterium
ESLPLASIFKLYVLHALAYAVRNGTVSWD

SEQ ID NO: 1090700 - protein, 20 aa, Mycobacterium
ESQRGTVIPVEITVYEDRSF

SEQ ID NO: 1090701 - protein, 23 aa, Mycobacterium
ETARSAVDAVTFASSGNDLVLEL

SEQ ID NO: 1090702 - protein, 24 aa, Mycobacterium
ETFLTREMPAWLQANKGVSPTGNA

SEQ ID NO: 1090703 - protein, 20 aa, Mycobacterium
ETGYSRFPVLGLDHHFIGYL

SEQ ID NO: 1090704 - protein, 19 aa, Mycobacterium
ETIVLRRSRPLEISLDGHQ

SEQ ID NO: 1090705 - protein, 21 aa, Mycobacterium
ETKQFVARCVGKMGKNFLENV

SEQ ID NO: 1090706 - protein, 25 aa, Mycobacterium
ETSRQALKIRRWRSRVRNHTVVIGY

SEQ ID NO: 1090707 - protein, 23 aa, Mycobacterium
ETSTGRWALTREGGHSRRRIVHA

SEQ ID NO: 1090708 - protein, 18 aa, Mycobacterium
EVIQQYLVRIRSVNPALN

SEQ ID NO: 1090709 - protein, 21 aa, Mycobacterium
EVLRGAAVLGARIMTRLASRP

SEQ ID NO: 1090710 - protein, 20 aa, Mycobacterium
EVNSALMFTGAGSAPTLAAA

SEQ ID NO: 1090711 - protein, 24 aa, Mycobacterium
EVQGPRWGAGNVVAYLESSPGKPL

SEQ ID NO: 1090712 - protein, 22 aa, Mycobacterium
EWLNRQLSPYANWARSNNSLLI

SEQ ID NO: 1090713 - protein, 19 aa, Mycobacterium
EYGHQCVVWQTAINPVVAL

SEQ ID NO: 1090714 - protein, 19 aa, Mycobacterium
FAAALAPHGSGTVLAGRDG

SEQ ID NO: 1090715 - protein, 18 aa, Mycobacterium
FAAVNTVFRDSRAFTSKT

SEQ ID NO: 1090716 - protein, 24 aa, Mycobacterium
FAKQRISPELIKSASYDGVVNYVS

SEQ ID NO: 1090717 - protein, 17 aa, Mycobacterium
FAPSFSIWTTIEECLNP

SEQ ID NO: 1090718 - protein, 18 aa, Mycobacterium
FATIPVLDGSGWSDDGMQ

SEQ ID NO: 1090719 - protein, 19 aa, Mycobacterium
FATPELVSAAAQDVANIGT

SEQ ID NO: 1090720 - protein, 21 aa, Mycobacterium
FAVVVPPPLIAANRSQVASLV

SEQ ID NO: 1090721 - protein, 27 aa, Mycobacterium
FCAGGKCPDVLMAWELSYAELADRGVF

SEQ ID NO: 1090722 - protein, 22 aa, Mycobacterium
FDASLRLPWRQLQPVDPATLGP

SEQ ID NO: 1090723 - protein, 19 aa, Mycobacterium
FDGLHWSTDEPLGYNRRYT

SEQ ID NO: 1090724 - protein, 19 aa, Mycobacterium
FDIFRERIPHISFAAGEHT

SEQ ID NO: 1090725 - protein, 24 aa, Mycobacterium
FDYAEGRLGWRTLDFDVEVLPIGD

SEQ ID NO: 1090726 - protein, 17 aa, Mycobacterium
FECLLSLAAIKDVDARP

SEQ ID NO: 1090727 - protein, 21 aa, Mycobacterium
FESLTGRELIGNGAAGVAGVD

SEQ ID NO: 1090728 - protein, 19 aa, Mycobacterium
FETAFAVVVPPPLIAANRS

SEQ ID NO: 1090729 - protein, 17 aa, Mycobacterium
FFAARKLPDGLTFDPAI

SEQ ID NO: 1090730 - protein, 17 aa, Mycobacterium
FFEKTFAPLGLKKIQGE

SEQ ID NO: 1090731 - protein, 26 aa, Mycobacterium
FFQDLGGAHPFTWHKAFNYNLGTKQP

SEQ ID NO: 1090732 - protein, 31 aa, Mycobacterium
FGDSHVDEWRATFNVNLFGAVALTLALLPAP

SEQ ID NO: 1090733 - protein, 18 aa, Mycobacterium
FGDTFGYCAVREHQWRYN

SEQ ID NO: 1090734 - protein, 23 aa, Mycobacterium
FGIRGFALCLRDDLRPAGVGVSV

SEQ ID NO: 1090735 - protein, 25 aa, Mycobacterium
FGLTGDHQFGFGGFNSGSGNVGIGN

SEQ ID NO: 1090736 - protein, 17 aa, Mycobacterium
FGRRLADFFTGRDPRGG

SEQ ID NO: 1090737 - protein, 19 aa, Mycobacterium
FGTPAEGVLVWSMGRSDWN

SEQ ID NO: 1090738 - protein, 18 aa, Mycobacterium
FGVTVSSIILGRIAEPAA

SEQ ID NO: 1090739 - protein, 18 aa, Mycobacterium
FHDMPTIPLWDYIAVVGW

SEQ ID NO: 1090740 - protein, 20 aa, Mycobacterium
FIWDRGRELGMVDRLQRVGP

SEQ ID NO: 1090741 - protein, 17 aa, Mycobacterium
FKTSGCQPWQSTPDADV

SEQ ID NO: 1090742 - protein, 23 aa, Mycobacterium
FLCGAIQSASRLGGEQAAKLCVQ

SEQ ID NO: 1090743 - protein, 19 aa, Mycobacterium
FLELLSAYGAPWGLQEVPA

SEQ ID NO: 1090744 - protein, 22 aa, Mycobacterium
FLSSELPDWLAANKGLAPGGHA

SEQ ID NO: 1090745 - protein, 21 aa, Mycobacterium
FLTEFPGLRLIGLDRDPSALD

SEQ ID NO: 1090746 - protein, 25 aa, Mycobacterium
FNFPTNGTHSWPYWNQQLVAMKGDI

SEQ ID NO: 1090747 - protein, 26 aa, Mycobacterium
FNHRRMQPADAWVAQLLAGWTEAEVT

SEQ ID NO: 1090748 - protein, 26 aa, Mycobacterium
FNQGIHWSPWLDLMVNYEETFVATMV

SEQ ID NO: 1090749 - protein, 25 aa, Mycobacterium
FPDYRPELPGGQPAGGRSLGPAAFE

SEQ ID NO: 1090750 - protein, 27 aa, Mycobacterium
FPKECPAPGVMQGCLDSTSGLIMGLDS

SEQ ID NO: 1090751 - protein, 20 aa, Mycobacterium
FPKETLTNWMRGDYANLTLI

SEQ ID NO: 1090752 - protein, 20 aa, Mycobacterium
FPSMIEFLAPLYGTGAGSND

SEQ ID NO: 1090753 - protein, 22 aa, Mycobacterium
FQTRLAQFVAIAARHGIKPLFV

SEQ ID NO: 1090754 - protein, 19 aa, Mycobacterium
FRALGLGLEIRPLRGNLDT

SEQ ID NO: 1090755 - protein, 17 aa, Mycobacterium
FRDQFPLPEKLWTIADL

SEQ ID NO: 1090756 - protein, 25 aa, Mycobacterium
FRNVQRLPLVGSWVRQGIDELSQRG

SEQ ID NO: 1090757 - protein, 19 aa, Mycobacterium
FRQLAPRPVTAAWGAAAGR

SEQ ID NO: 1090758 - protein, 25 aa, Mycobacterium
FRTAVPRAKVLAGLDEDTEVRPVGY

SEQ ID NO: 1090759 - protein, 18 aa, Mycobacterium
FRTLPVVRYDNIDGQDVN

SEQ ID NO: 1090760 - protein, 26 aa, Mycobacterium
FSDSLPTCITKYIPLHTPAVVMSMNA

SEQ ID NO: 1090761 - protein, 17 aa, Mycobacterium
FSHCGAYRAEGRILAAV

SEQ ID NO: 1090762 - protein, 18 aa, Mycobacterium
FSTLPWTRTITTTIPAII

SEQ ID NO: 1090763 - protein, 17 aa, Mycobacterium
FSVARRLALLLTYQRFL

SEQ ID NO: 1090764 - protein, 22 aa, Mycobacterium
FTGMSVDALRHLMIVIDEPDYD

SEQ ID NO: 1090765 - protein, 17 aa, Mycobacterium
FTGTGVKGWINRWFYSV

SEQ ID NO: 1090766 - protein, 26 aa, Mycobacterium
FTPIHGGWQLSQRTSEMLLAPGNSRG

SEQ ID NO: 1090767 - protein, 18 aa, Mycobacterium
FTSDELRKAAEGYLEAAT

SEQ ID NO: 1090768 - protein, 17 aa, Mycobacterium
FTVQRIRTFFGADGILV

SEQ ID NO: 1090769 - protein, 17 aa, Mycobacterium
FVADRWTPDKVYSGGYR

SEQ ID NO: 1090770 - protein, 19 aa, Mycobacterium
FVGDLWPNGDVAGLHAAAG

SEQ ID NO: 1090771 - protein, 23 aa, Mycobacterium
FYGPEGTQSVAMYLGNGQMLEVG

SEQ ID NO: 1090772 - protein, 20 aa, Mycobacterium
FYNTEGLPYFSVGMGNFGVQ

SEQ ID NO: 1090773 - protein, 29 aa, Mycobacterium
FYTPGNFFGTMCDFFGLSSFSAMDAAEDA

SEQ ID NO: 1090774 - protein, 24 aa, Mycobacterium
GAADAGGPLVTPGHAGNTGTGGTG

SEQ ID NO: 1090775 - protein, 23 aa, Mycobacterium
GAAGAPGGWLLGDGGAGGSAAAT

SEQ ID NO: 1090776 - protein, 18 aa, Mycobacterium
GAAGIALLASMAARPGER

SEQ ID NO: 1090777 - protein, 19 aa, Mycobacterium
GAAGLLLAGWAAMGVAAAD

SEQ ID NO: 1090778 - protein, 19 aa, Mycobacterium
GAAVKAFLATAVNSGQSGL

SEQ ID NO: 1090779 - protein, 20 aa, Mycobacterium
GADCGRCRRTVRAIIASSSG

SEQ ID NO: 1090780 - protein, 25 aa, Mycobacterium
GADEVSVAVARLFDGHGQAYQTISA

SEQ ID NO: 1090781 - protein, 24 aa, Mycobacterium
GAGADRGGVVGACAAVAAESAGAA

SEQ ID NO: 1090782 - protein, 28 aa, Mycobacterium
GAGGMATARIPAGINFNVGGAGGHGGAG

SEQ ID NO: 1090783 - protein, 32 aa, Mycobacterium; identical to SEQ ID NO: 927534

SEQ ID NO: 1090784 - protein, 21 aa, Mycobacterium
GALDRAAAAGLVIVHGDATKS

SEQ ID NO: 1090785 - protein, 17 aa, Mycobacterium
GAPDPGDLSFIMVGAPN

SEQ ID NO: 1090786 - protein, 19 aa, Mycobacterium
GAPEAPADRAVRAAPASTA

SEQ ID NO: 1090787 - protein, 17 aa, Mycobacterium
GAPQPTFAGLRTQITNR

SEQ ID NO: 1090788 - protein, 18 aa, Mycobacterium
GASFTTLLGIPDASRLDV

SEQ ID NO: 1090789 - protein, 25 aa, Mycobacterium
GATSMKVWFNAKAMWDWSKNISDKN

SEQ ID NO: 1090790 - protein, 30 aa, Mycobacterium; identical to SEQ ID NO: 927625

SEQ ID NO: 1090791 - protein, 27 aa, Mycobacterium
GAVVKRCYAEVLPAARSGALFIDSSTI

SEQ ID NO: 1090792 - protein, 19 aa, Mycobacterium
GAVVSWIERCGDRADYSAV

SEQ ID NO: 1090793 - protein, 19 aa, Mycobacterium
GAYVEFPSGAALEVQTAIS

SEQ ID NO: 1090794 - protein, 20 aa, Mycobacterium
GDAAITFGIGTLIPVDEALS

SEQ ID NO: 1090795 - protein, 19 aa, Mycobacterium
GDAQPVRVTACIRADGVGT

SEQ ID NO: 1090796 - protein, 24 aa, Mycobacterium
GDEVSHAIATMLRNHGAQYQALSA

SEQ ID NO: 1090797 - protein, 19 aa, Mycobacterium
GDFGFGLTGDHQFGFGGFN

SEQ ID NO: 1090798 - protein, 23 aa, Mycobacterium
GDFSRNQFLAGRMALFQSGTYSL

SEQ ID NO: 1090799 - protein, 17 aa, Mycobacterium
GDFWDPAWGQNWDMGHC

SEQ ID NO: 1090800 - protein, 35 aa, Mycobacterium
GDGGTRPKGTLFFRSGGDGGFGGWGGNGYGGVGGG

SEQ ID NO: 1090801 - protein, 17 aa, Mycobacterium
GDGLAWAPAAFFEQDGA

SEQ ID NO: 1090802 - protein, 19 aa, Mycobacterium
GDIMPADALAAGRVDDVIA

SEQ ID NO: 1090803 - protein, 18 aa, Mycobacterium
GDKMKVTFHYQNKYKVPA

SEQ ID NO: 1090804 - protein, 25 aa, Mycobacterium
GDLDPAEAISHGFVDSQNLLAWRTT

SEQ ID NO: 1090805 - protein, 29 aa, Mycobacterium
GDLIGLKDGRQWRIPMWQLNAGAQRGFLS

SEQ ID NO: 1090806 - protein, 17 aa, Mycobacterium
GDPHARCRLSSKHALAL

SEQ ID NO: 1090807 - protein, 21 aa, Mycobacterium
GDQRLRIDLSALRAIGDGLAW

SEQ ID NO: 1090808 - protein, 20 aa, Mycobacterium
GDRWLAQNVDPLRARVLPMT

SEQ ID NO: 1090809 - protein, 20 aa, Mycobacterium
GDYEWTRARTAYFMVGFSGP

SEQ ID NO: 1090810 - protein, 24 aa, Mycobacterium
GEAAEAFSSVTSGLASGSWQGPAA

SEQ ID NO: 1090811 - protein, 22 aa, Mycobacterium
GEAAPPMTHIVLLGGDFPAAAS

SEQ ID NO: 1090812 - protein, 23 aa, Mycobacterium
GEFPDGAAMFARLRDGRLTAAWT

SEQ ID NO: 1090813 - protein, 17 aa, Mycobacterium
GEGGLPLQSAAIIVNDL

SEQ ID NO: 1090814 - protein, 20 aa, Mycobacterium
GESLLTYALCVEELARGWMS

SEQ ID NO: 1090815 - protein, 25 aa, Mycobacterium
GESPPKRPAVEELLAPLEQARHDSA

SEQ ID NO: 1090816 - protein, 21 aa, Mycobacterium
GEVKADLNVDVFRRMIGEDFT

SEQ ID NO: 1090817 - protein, 18 aa, Mycobacterium
GFDAARPTAWLAEGVRIG

SEQ ID NO: 1090818 - protein, 19 aa, Mycobacterium
GFDASGLIQYAYAGAGIKL

SEQ ID NO: 1090819 - protein, 25 aa, Mycobacterium
GFDCSGLMRYAFAGVGVLIPRYSGD

SEQ ID NO: 1090820 - protein, 24 aa, Mycobacterium
GFGEVLPGLTIPGKIDKLGYKGID

SEQ ID NO: 1090821 - protein, 20 aa, Mycobacterium
GFPIRLPVLPDGWKANSGGR

SEQ ID NO: 1090822 - protein, 18 aa, Mycobacterium
GFSKQIISSIKWAPDETG

SEQ ID NO: 1090823 - protein, 21 aa, Mycobacterium
GGAALDWLLATFDRLHNQLGG

SEQ ID NO: 1090824 - protein, 22 aa, Mycobacterium
GGAGGTGGWLYGNGGNGGAAGW

SEQ ID NO: 1090825 - protein, 23 aa, Mycobacterium
GGAGQAGGWLFGDGGPGAAATAT

SEQ ID NO: 1090826 - protein, 22 aa, Mycobacterium
GGAIAKLPAIFTHRDVGNTDCP

SEQ ID NO: 1090827 - protein, 19 aa, Mycobacterium
GGANGLFEAAGSGGSGGAG

SEQ ID NO: 1090828 - protein, 17 aa, Mycobacterium
GGAPIAPSLVRRVKEAF

SEQ ID NO: 1090829 - protein, 19 aa, Mycobacterium
GGASDFQFAGSGGSGGTGG

SEQ ID NO: 1090830 - protein, 25 aa, Mycobacterium
GGATYQRWQELGAMNSVLGAPTSPE

SEQ ID NO: 1090831 - protein, 22 aa, Mycobacterium
GGDELRDLPEFSSANGVLDTEL

SEQ ID NO: 1090832 - protein, 23 aa, Mycobacterium
GGDGIAKLGFNVDGGAGGAGVNG

SEQ ID NO: 1090833 - protein, 22 aa, Mycobacterium
GGFAVSRVRGMFGSQQLPTYAD

SEQ ID NO: 1090834 - protein, 23 aa, Mycobacterium
GGFGGTGGNAGWLGSGGSGGAGG

SEQ ID NO: 1090835 - protein, 25 aa, Mycobacterium
GGGGNFGVTTAMTFETFPVADSDVV

SEQ ID NO: 1090836 - protein, 17 aa, Mycobacterium
GGGQRFNIGTGVETSDR

SEQ ID NO: 1090837 - protein, 17 aa, Mycobacterium
GGHALAEGFHDGAAGTG

SEQ ID NO: 1090838 - protein, 18 aa, Mycobacterium
GGISGLLLGADGFNAPAG

SEQ ID NO: 1090839 - protein, 20 aa, Mycobacterium
GGLFGGIFGAGGGDGGAGGF

SEQ ID NO: 1090840 - protein, 18 aa, Mycobacterium
GGLGESLLTYALCVEELA

SEQ ID NO: 1090841 - protein, 24 aa, Mycobacterium
GGLLYGDGETGGFGGDGGVGGAGG

SEQ ID NO: 1090842 - protein, 21 aa, Mycobacterium
GGLNLKWGHLGVDNTSLFLKD

SEQ ID NO: 1090843 - protein, 17 aa, Mycobacterium
GGNGGLLVGNGGAGGLL

SEQ ID NO: 1090844 - protein, 24 aa, Mycobacterium
GGNGGRAGLFGGAGGAGGMGATGG

SEQ ID NO: 1090845 - protein, 26 aa, Mycobacterium
GGNPAWDLPLVFGPIALVYNLPGVKT

SEQ ID NO: 1090846 - protein, 23 aa, Mycobacterium
GGPGGGWNKPPTPLWRDQVGEMS

SEQ ID NO: 1090847 - protein, 25 aa, Mycobacterium
GGRVSDALTGQVLWQQLDDVPLVPA

SEQ ID NO: 1090848 - protein, 22 aa, Mycobacterium
GGSAGLWGNCGAGGAGGNGGGA

SEQ ID NO: 1090849 - protein, 26 aa, Mycobacterium
GGSAYSGYVGIAFGQGGAGGIGGAAS

SEQ ID NO: 1090850 - protein, 21 aa, Mycobacterium
GGSGGRAGILYGDGGNGGAGG

SEQ ID NO: 1090851 - protein, 18 aa, Mycobacterium
GGSLEIFLTPQLPAPLVR

SEQ ID NO: 1090852 - protein, 22 aa, Mycobacterium
GGSRPAKPIPLAAPQVYQGDAS

SEQ ID NO: 1090853 - protein, 22 aa, Mycobacterium
GGTGGAGGWLYGNGGAGGTGGS

SEQ ID NO: 1090854 - protein, 20 aa, Mycobacterium
GGVADARTAWQLHTAAGGGQ

SEQ ID NO: 1090855 - protein, 25 aa, Mycobacterium
GGVGGSGGDGGWLLGNGGNGAEGGT

SEQ ID NO: 1090856 - protein, 18 aa, Mycobacterium
GGVPMLLIRGQMSDLVSQ

SEQ ID NO: 1090857 - protein, 19 aa, Mycobacterium
GGVVMRPYLVDGLKGPDLA

SEQ ID NO: 1090858 - protein, 17 aa, Mycobacterium
GHFGDSHVDEWRATFNV

SEQ ID NO: 1090859 - protein, 23 aa, Mycobacterium
GHGVGLGSGLGRSLDGYGTAALA

SEQ ID NO: 1090860 - protein, 23 aa, Mycobacterium
GHLDRFTGGATRFMPESNLDKYG

SEQ ID NO: 1090861 - protein, 25 aa, Mycobacterium
GHSGDPSWRSGGDGGNGGNGAYGGS

SEQ ID NO: 1090862 - protein, 25 aa, Mycobacterium
GIAQRDGTSFVMPKSEADAMIAGTG

SEQ ID NO: 1090863 - protein, 17 aa, Mycobacterium
GICALSMQLRCVDAARE

SEQ ID NO: 1090864 - protein, 23 aa, Mycobacterium
GIDPDIYSGFAFGMGLERTLQFR

SEQ ID NO: 1090865 - protein, 18 aa, Mycobacterium
GIDVCQWAAADGVIGSSG

SEQ ID NO: 1090866 - protein, 18 aa, Mycobacterium
GISWKVYQNKFFGHYINS

SEQ ID NO: 1090867 - protein, 18 aa, Mycobacterium
GIVLREMLGAVKANRRDI

SEQ ID NO: 1090868 - protein, 21 aa, Mycobacterium
GKAYASARGGYFVVDLPSGGV

SEQ ID NO: 1090869 - protein, 19 aa, Mycobacterium
GKPYDEWTAEDWPHTYESV

SEQ ID NO: 1090870 - protein, 21 aa, Mycobacterium
GKRPGGRSGLSVHGQARLLSE

SEQ ID NO: 1090871 - protein, 18 aa, Mycobacterium
GKSSWNLEPWRPVVDDAE

SEQ ID NO: 1090872 - protein, 19 aa, Mycobacterium
GLALPAVVLEVEFALDASG

SEQ ID NO: 1090873 - protein, 17 aa, Mycobacterium
GLALRGTLLPSRRRGQS

SEQ ID NO: 1090874 - protein, 19 aa, Mycobacterium
GLDGIRPAQAIGLVPLAGG

SEQ ID NO: 1090875 - protein, 21 aa, Mycobacterium
GLGGLVIGNGGNRGIGGAGDS

SEQ ID NO: 1090876 - protein, 17 aa, Mycobacterium
GLIFGFGGAGGTGGSGI

SEQ ID NO: 1090877 - protein, 18 aa, Mycobacterium
GLLSIPNFANPVQFICGG

SEQ ID NO: 1090878 - protein, 25 aa, Mycobacterium
GLPYLGLEHRAAWVEAEADGTITSM

SEQ ID NO: 1090879 - protein, 20 aa, Mycobacterium
GLRGNCLVEVEIAFFSVRGP

SEQ ID NO: 1090880 - protein, 26 aa, Mycobacterium
GLRTVVLEEGRRWTVREFRTTHPIDR

SEQ ID NO: 1090881 - protein, 25 aa, Mycobacterium
GLSSARMYFAYGLGNSVWFPLATGS

SEQ ID NO: 1090882 - protein, 17 aa, Mycobacterium
GLSSFGINLPPVPSLTG

SEQ ID NO: 1090883 - protein, 20 aa, Mycobacterium
GLTVSIPTPPGWSPYEGPKI

SEQ ID NO: 1090884 - protein, 19 aa, Mycobacterium
GLVAHRSRRLLAVATEAAQ

SEQ ID NO: 1090885 - protein, 19 aa, Mycobacterium
GLVRDAWPPSARAQPRTHP

SEQ ID NO: 1090886 - protein, 22 aa, Mycobacterium
GMGNFGVQMAKTLGLITQPAAA

SEQ ID NO: 1090887 - protein, 19 aa, Mycobacterium
GMPVRRARRVYQLTDAGRR

SEQ ID NO: 1090888 - protein, 24 aa, Mycobacterium
GMRAQFVCHWDFAEVTAPGKSSWN

SEQ ID NO: 1090889 - protein, 31 aa, Mycobacterium; identical to SEQ ID NO: 928268

SEQ ID NO: 1090890 - protein, 21 aa, Mycobacterium
GNGGAGLGILGEAGGNDGGGG

SEQ ID NO: 1090891 - protein, 30 aa, Mycobacterium; identical to SEQ ID NO: 928281

SEQ ID NO: 1090892 - protein, 27 aa, Mycobacterium
GNMIKPMLARGELRLVGATTLDEYRKH

SEQ ID NO: 1090893 - protein, 23 aa, Mycobacterium
GNQPLRPGGTLPLGQSTTPYQIY

SEQ ID NO: 1090894 - protein, 19 aa, Mycobacterium
GNTIAWLYSQRRFEVPSDK

SEQ ID NO: 1090895 - protein, 18 aa, Mycobacterium
GNVEAAKILEFAPGELKN

SEQ ID NO: 1090896 - protein, 27 aa, Mycobacterium
GPGGAGGYGGHGGWLYGSGGTGGDGGF

SEQ ID NO: 1090897 - protein, 22 aa, Mycobacterium
GPNARLAAIIGAIAKSCGPAGI

SEQ ID NO: 1090898 - protein, 22 aa, Mycobacterium
GPPLFMVLFRLSRADASQEQTD

SEQ ID NO: 1090899 - protein, 20 aa, Mycobacterium
GPYMYCDVLRLDECQTPQTQ

SEQ ID NO: 1090900 - protein, 20 aa, Mycobacterium
GQGGHGGWLGGSGGAGGTGG

SEQ ID NO: 1090901 - protein, 21 aa, Mycobacterium
GQRLAAFVVARPGCDIDADAI

SEQ ID NO: 1090902 - protein, 21 aa, Mycobacterium
GRAATLRAVRALTGVPIDYFA

SEQ ID NO: 1090903 - protein, 23 aa, Mycobacterium
GRAEAVGLARLGATVVVNDIGSA

SEQ ID NO: 1090904 - protein, 20 aa, Mycobacterium
GRAGVTVVHCSTTPPHREQY

SEQ ID NO: 1090905 - protein, 18 aa, Mycobacterium
GREMLYRLADYHLTHIVV

SEQ ID NO: 1090906 - protein, 20 aa, Mycobacterium
GRGGDARLIGNGGDGGAGAP

SEQ ID NO: 1090907 - protein, 24 aa, Mycobacterium
GRGIKEFAPLIGVRKAGLFTSSSF

SEQ ID NO: 1090908 - protein, 21 aa, Mycobacterium
GRGRWLAFTASLALSAAMIYA

SEQ ID NO: 1090909 - protein, 24 aa, Mycobacterium
GRIINISSVLGFLPAPYAALYAAS

SEQ ID NO: 1090910 - protein, 25 aa, Mycobacterium
GRKMLRFGRVIVRFGKPMDFSRFEG

SEQ ID NO: 1090911 - protein, 31 aa, Mycobacterium; identical to SEQ ID NO: 928507

SEQ ID NO: 1090912 - protein, 26 aa, Mycobacterium
GRQRLDAAQALAFVRQRHGLDNGDLD

SEQ ID NO: 1090913 - protein, 20 aa, Mycobacterium
GRRWDGWDPTLPQIPSANIP

SEQ ID NO: 1090914 - protein, 17 aa, Mycobacterium
GRTIARWNHNVASGTDP

SEQ ID NO: 1090915 - protein, 23 aa, Mycobacterium
GRTTGNSCGVTWGPGQDPGTILM

SEQ ID NO: 1090916 - protein, 18 aa, Mycobacterium
GRVSRLKSLLGGRGPSAR

SEQ ID NO: 1090917 - protein, 23 aa, Mycobacterium
GSAKWNLLAPYAVKSEGGRNSQA

SEQ ID NO: 1090918 - protein, 18 aa, Mycobacterium
GSAYLARVPQRFVPDLTK

SEQ ID NO: 1090919 - protein, 25 aa, Mycobacterium
GSGAELRTATPLGDVFVSIVPPSQR

SEQ ID NO: 1090920 - protein, 25 aa, Mycobacterium
GSGDAGGPGGLLFGNGGNGGSGSAG

SEQ ID NO: 1090921 - protein, 35 aa, Mycobacterium; identical to SEQ ID NO: 928589

SEQ ID NO: 1090922 - protein, 32 aa, Mycobacterium
GSGGIRGPIGLGYRVPCIVISPYSRGPLVVSD

SEQ ID NO: 1090923 - protein, 20 aa, Mycobacterium
GSGIEVWYFHEPRDMSKSGK

SEQ ID NO: 1090924 - protein, 20 aa, Mycobacterium
GSGPRYGFKPTVMARPLPAG

SEQ ID NO: 1090925 - protein, 26 aa, Mycobacterium
GSITNRFAPAPAQVPAPMQVPAATAA

SEQ ID NO: 1090926 - protein, 31 aa, Mycobacterium
GSLGAVGVSSRLRLTGVAAVAAGAPITPGAA

SEQ ID NO: 1090927 - protein, 21 aa, Mycobacterium
GSLRCASGISFLVDPVRANRV

SEQ ID NO: 1090928 - protein, 28 aa, Mycobacterium
GSRLAERAGRRLIGFSAELGGKNAMIVT

SEQ ID NO: 1090929 - protein, 25 aa, Mycobacterium
GSSADLRVGQPLLAIGSPLGLAGTV

SEQ ID NO: 1090930 - protein, 17 aa, Mycobacterium
GSSEGRHGPFFPQCGGV

SEQ ID NO: 1090931 - protein, 25 aa, Mycobacterium
GSTAELRTATPLGDVFVALRPPAGA

SEQ ID NO: 1090932 - protein, 24 aa, Mycobacterium
GSTVCSAGKYGRKHAPWVNFSNVP

SEQ ID NO: 1090933 - protein, 23 aa, Mycobacterium
GSVLAFWLSRYGFDVTVVERAPQ

SEQ ID NO: 1090934 - protein, 19 aa, Mycobacterium
GSVVFGFNRLSIIDIEHSH

SEQ ID NO: 1090935 - protein, 17 aa, Mycobacterium
GSWGPWYQAEYETAAPD

SEQ ID NO: 1090936 - protein, 23 aa, Mycobacterium
GTARPRLAPPVPSIPGRRGKPTI

SEQ ID NO: 1090937 - protein, 23 aa, Mycobacterium
GTGGMGGTGGWLMGNGGGGGVGG

SEQ ID NO: 1090938 - protein, 17 aa, Mycobacterium
GTIAKWDDPAIKALKAL

SEQ ID NO: 1090939 - protein, 18 aa, Mycobacterium
GTPGGVYGPGGWGGPGGP

SEQ ID NO: 1090940 - protein, 20 aa, Mycobacterium
GTPGRRWAWQTRAWSGHRIY

SEQ ID NO: 1090941 - protein, 22 aa, Mycobacterium
GTRKTVVLDDQWTVITADGSRA

SEQ ID NO: 1090942 - protein, 24 aa, Mycobacterium
GTSMPALFYAKAGSLYVSDPAGTP

SEQ ID NO: 1090943 - protein, 25 aa, Mycobacterium
GTSPNRLYWMSAWVDPNGEQGGPLL

SEQ ID NO: 1090944 - protein, 19 aa, Mycobacterium
GTVAKWRLQATKSRVRDVQ

SEQ ID NO: 1090945 - protein, 20 aa, Mycobacterium
GVAGCAAMDGTVLVNLIETK

SEQ ID NO: 1090946 - protein, 20 aa, Mycobacterium
GVASDAAGVVGWWVNPQAPG

SEQ ID NO: 1090947 - protein, 25 aa, Mycobacterium
GVAVAHSPIGIDIGIGGAGGHGGSG

SEQ ID NO: 1090948 - protein, 22 aa, Mycobacterium
GVAVGARLSQRLVRRRQQASTE

SEQ ID NO: 1090949 - protein, 18 aa, Mycobacterium
GVEAGLLGPESFPDTYPW

SEQ ID NO: 1090950 - protein, 25 aa, Mycobacterium
GVGNLARIGSSIGVANAAAAAATTT

SEQ ID NO: 1090951 - protein, 21 aa, Mycobacterium
GVIFLLLGWQALDSSGKAVDD

SEQ ID NO: 1090952 - protein, 19 aa, Mycobacterium
GVLAPALWSVVEAFVGDLW

SEQ ID NO: 1090953 - protein, 27 aa, Mycobacterium
GVLGPEAFDAVPFLELLSAYGAPWGLQ

SEQ ID NO: 1090954 - protein, 21 aa, Mycobacterium
GVRFEIAAGFPDYRPELPGGQ

SEQ ID NO: 1090955 - protein, 17 aa, Mycobacterium
GVRIATNTAQDWRLSAK

SEQ ID NO: 1090956 - protein, 19 aa, Mycobacterium
GVRIPPRIIKATIAADGTR

SEQ ID NO: 1090957 - protein, 54 aa, Mycobacterium; identical to SEQ ID NO: 1046866

SEQ ID NO: 1090958 - protein, 24 aa, Mycobacterium
GVSISEGIFAIDVNLGGAGGDGGT

SEQ ID NO: 1090959 - protein, 18 aa, Mycobacterium
GVYSRGGGPVQRWRRGTP

SEQ ID NO: 1090960 - protein, 17 aa, Mycobacterium
GWMSLAGAMGGHTVVAK

SEQ ID NO: 1090961 - protein, 18 aa, Mycobacterium
GWQAGWFTGAGFFPPRVI

SEQ ID NO: 1090962 - protein, 18 aa, Mycobacterium
GWQGDFPSMIEFLAPLYG

SEQ ID NO: 1090963 - protein, 22 aa, Mycobacterium
GWQPRAPGGVGFAGRQYGVPSL

SEQ ID NO: 1090964 - protein, 23 aa, Mycobacterium
GWQPRAPGGVGFAGRQYGVPSLM

SEQ ID NO: 1090965 - protein, 19 aa, Mycobacterium
GYFMRRLAERPANLGFFLR

SEQ ID NO: 1090966 - protein, 17 aa, Mycobacterium
GYLPMNFAANDLAWSAT

SEQ ID NO: 1090967 - protein, 17 aa, Mycobacterium
HALTARNNIVIDIEVCG

SEQ ID NO: 1090968 - protein, 31 aa, Mycobacterium
HAPQYRLNILSDINAIMGYFYVHGNYPDLMS

SEQ ID NO: 1090969 - protein, 17 aa, Mycobacterium
HAQRAYCRLVLRCFGVR

SEQ ID NO: 1090970 - protein, 18 aa, Mycobacterium
HARCRLSSKHALALTNRG

SEQ ID NO: 1090971 - protein, 18 aa, Mycobacterium
HDELKRLQQIVALGGAVV

SEQ ID NO: 1090972 - protein, 27 aa, Mycobacterium
HDYSPEFGCLFKGIGRGIKEFAPLIGV

SEQ ID NO: 1090973 - protein, 22 aa, Mycobacterium
HELREYGVRALLVEPSYTRTDF

SEQ ID NO: 1090974 - protein, 26 aa, Mycobacterium
HFSANWCGPCAAVRRVVDQVCEELPD

SEQ ID NO: 1090975 - protein, 25 aa, Mycobacterium
HGRIPRTGSVFGDALGVFSPFVCYG

SEQ ID NO: 1090976 - protein, 20 aa, Mycobacterium
HHRRLFAVLATLNTATAVIA

SEQ ID NO: 1090977 - protein, 24 aa, Mycobacterium
HHVRREHPYMLAITAGTDCGIFLV

SEQ ID NO: 1090978 - protein, 25 aa, Mycobacterium
HISPDQARRGDLIFYGPGGSQHVTM

SEQ ID NO: 1090979 - protein, 19 aa, Mycobacterium
HKWTRRPSPVTARELAEMP

SEQ ID NO: 1090980 - protein, 17 aa, Mycobacterium
HLTNAYVQIDMANQEAN

SEQ ID NO: 1090981 - protein, 22 aa, Mycobacterium
HMRADVTVGSFLSGGIDSTAIA

SEQ ID NO: 1090982 - protein, 23 aa, Mycobacterium
HNALRELSQVAGRLGDSRNDIFS

SEQ ID NO: 1090983 - protein, 24 aa, Mycobacterium
HNAVRVAFWGAEELGLIGSRNYVQ

SEQ ID NO: 1090984 - protein, 23 aa, Mycobacterium
HPEWALPTTWTVVAGRPVLEAVL

SEQ ID NO: 1090985 - protein, 23 aa, Mycobacterium
HPSEPNYLVALFAGTTFGLKKNT

SEQ ID NO: 1090986 - protein, 19 aa, Mycobacterium
HQWRYNTLFRSQDRNLADG

SEQ ID NO: 1090987 - protein, 18 aa, Mycobacterium
HRAAQYWVMKPTYHNSFW

SEQ ID NO: 1090988 - protein, 25 aa, Mycobacterium
HSADRLIVIYADFKGEAGADSFRNF

SEQ ID NO: 1090989 - protein, 18 aa, Mycobacterium
HSAELELGAKLAAQQAAE

SEQ ID NO: 1090990 - protein, 29 aa, Mycobacterium
HSGWGAGHGALFTRAPWVVSVDDHVDPVV

SEQ ID NO: 1090991 - protein, 21 aa, Mycobacterium
HSKKRSGLRAQSGRLRDSGDA

SEQ ID NO: 1090992 - protein, 22 aa, Mycobacterium
HTEWAQWGSLRGLRVFPTSAGR

SEQ ID NO: 1090993 - protein, 28 aa, Mycobacterium
HTGGFNRDAWGVAMIGNFDDVAPTPLQI

SEQ ID NO: 1090994 - protein, 20 aa, Mycobacterium
HTYESVAYPNIFAPGIAFAP

SEQ ID NO: 1090995 - protein, 32 aa, Mycobacterium
HVHPTMSAEGRWSIPWAWNSAGTYRVFADFVP

SEQ ID NO: 1090996 - protein, 18 aa, Mycobacterium
HVPYLTWLATTSADYAAT

SEQ ID NO: 1090997 - protein, 18 aa, Mycobacterium
HVVPCGRGLGSSAAVVRA

SEQ ID NO: 1090998 - protein, 24 aa, Mycobacterium
HYPTARLVVFLLRGNFDPADVARR

SEQ ID NO: 1090999 - protein, 17 aa, Mycobacterium
HYRPREYYPAGTTVNVD

SEQ ID NO: 1091000 - protein, 18 aa, Mycobacterium
IAAARWPERTAIVDDDGA

SEQ ID NO: 1091001 - protein, 17 aa, Mycobacterium
IAAMGWVAPSGGAVSTV

SEQ ID NO: 1091002 - protein, 25 aa, Mycobacterium
IAATEARYGEMWAQDASAMYGYAAS

SEQ ID NO: 1091003 - protein, 19 aa, Mycobacterium
IADKLPRMHLARYAGTARP

SEQ ID NO: 1091004 - protein, 21 aa, Mycobacterium
IAEQLMPHWLLALQDAAKRRG

SEQ ID NO: 1091005 - protein, 25 aa, Mycobacterium
IAESYWNWPEPLLTDEGWLDTRDRV

SEQ ID NO: 1091006 - protein, 30 aa, Mycobacterium
IAGPLGLCFLPAFVCLGIVPVLAGLAAKVL

SEQ ID NO: 1091007 - protein, 21 aa, Mycobacterium
IAHPISTSWARSGHAGHQAGT

SEQ ID NO: 1091008 - protein, 23 aa, Mycobacterium
IALSPWPPRAFGMLLLALAVAVA

SEQ ID NO: 1091009 - protein, 17 aa, Mycobacterium
IAPAAVLDNGIRKQTGL

SEQ ID NO: 1091010 - protein, 17 aa, Mycobacterium
IAPNGPMDRMLRPGGVV

SEQ ID NO: 1091011 - protein, 32 aa, Mycobacterium
IAPSLVRRVKEAFPRATVLNGYGMTESASLMT

SEQ ID NO: 1091012 - protein, 34 aa, Mycobacterium; identical to SEQ ID NO: 929227

SEQ ID NO: 1091013 - protein, 22 aa, Mycobacterium
IAYRLLLTLTQFRLVAKGEDGR

SEQ ID NO: 1091014 - protein, 17 aa, Mycobacterium
IDDDGWVTYACRADDTE

SEQ ID NO: 1091015 - protein, 17 aa, Mycobacterium
IDGAVLIAEHQTAGRGR

SEQ ID NO: 1091016 - protein, 21 aa, Mycobacterium
IDGFRPLFRALDPHQVNALSD

SEQ ID NO: 1091017 - protein, 25 aa, Mycobacterium
IDGGNGGYGGWGFNGGNGGNGGDGG

SEQ ID NO: 1091018 - protein, 19 aa, Mycobacterium
IDGNYHWQGTVLDPLPRDT

SEQ ID NO: 1091019 - protein, 25 aa, Mycobacterium
IDGYPQRFGIPDGLYAEPVAVKQGW

SEQ ID NO: 1091020 - protein, 18 aa, Mycobacterium
IDGYRVLTDPVWSDRCSP

SEQ ID NO: 1091021 - protein, 25 aa, Mycobacterium
IDIAQNLPLLLGLYIQPATLPIPPA

SEQ ID NO: 1091022 - protein, 18 aa, Mycobacterium
IDIGKNGQINLGFGNSGT

SEQ ID NO: 1091023 - protein, 17 aa, Mycobacterium
IDIIEWYGNGSWPSATT

SEQ ID NO: 1091024 - protein, 17 aa, Mycobacterium
IDITRFWFEQGSLANER

SEQ ID NO: 1091025 - protein, 20 aa, Mycobacterium
IDIVAGVPLAGISFGNELPA

SEQ ID NO: 1091026 - protein, 17 aa, Mycobacterium
IDLPKVLEFKARVLAEQ

SEQ ID NO: 1091027 - protein, 19 aa, Mycobacterium
IDNPGGAALDWLLATFDRL

SEQ ID NO: 1091028 - protein, 19 aa, Mycobacterium
IDPIPGNGFFLVGPDIATG

SEQ ID NO: 1091029 - protein, 18 aa, Mycobacterium
IDQIVYWSPYQAQVLFTM

SEQ ID NO: 1091030 - protein, 17 aa, Mycobacterium
IDSASWETGQPMTNVNV

SEQ ID NO: 1091031 - protein, 20 aa, Mycobacterium
IDYCGVCEVVRLTLVSHAMK

SEQ ID NO: 1091032 - protein, 18 aa, Mycobacterium
IEDLWAPLLAALGAADLA

SEQ ID NO: 1091033 - protein, 19 aa, Mycobacterium
IEHVSRQALLEVAQRDGQV

SEQ ID NO: 1091034 - protein, 19 aa, Mycobacterium
IEKFIPRQITNVLTGRRPK

SEQ ID NO: 1091035 - protein, 18 aa, Mycobacterium
IENSLHWIRDVTFDEDRQ

SEQ ID NO: 1091036 - protein, 17 aa, Mycobacterium
IENTKKLHLIVVRSDGT

SEQ ID NO: 1091037 - protein, 24 aa, Mycobacterium
IFLDIPRFVESAFHGLGATADYAT

SEQ ID NO: 1091038 - protein, 24 aa, Mycobacterium
IGAAFALELGRRGSAVVCSDIDEV

SEQ ID NO: 1091039 - protein, 29 aa, Mycobacterium
IGAIEFMVELVLFDWPTHIAQIIQALAQS

SEQ ID NO: 1091040 - protein, 27 aa, Mycobacterium
IGAKAGGLPGDLTFSWYAEDKTGQPWV

SEQ ID NO: 1091041 - protein, 19 aa, Mycobacterium
IGALKLILTQPFDIDAVPK

SEQ ID NO: 1091042 - protein, 21 aa, Mycobacterium
IGATDLCEFVEFPTELLQVCG

SEQ ID NO: 1091043 - protein, 23 aa, Mycobacterium
IGGAGGRGGNAGLLFSDAGVGGF

SEQ ID NO: 1091044 - protein, 17 aa, Mycobacterium
IGGDGGSRGLLLGEDGV

SEQ ID NO: 1091045 - protein, 20 aa, Mycobacterium
IGGLNAGIGNMGFGNAGDNN

SEQ ID NO: 1091046 - protein, 25 aa, Mycobacterium
IGIYGHSRACAWAVRDGVIGRAPAL

SEQ ID NO: 1091047 - protein, 22 aa, Mycobacterium
IGLPEVFNDPDLASFNGATTQT

SEQ ID NO: 1091048 - protein, 17 aa, Mycobacterium
IGLVMMAAPMAAAPGIA

SEQ ID NO: 1091049 - protein, 19 aa, Mycobacterium
IGNATLFWMIRNSKVRQPA

SEQ ID NO: 1091050 - protein, 21 aa, Mycobacterium
IGPHRRFAFASVPLADVKAVK

SEQ ID NO: 1091051 - protein, 27 aa, Mycobacterium
IGRAPALLISRLVSWVDDLWCRAIGAG

SEQ ID NO: 1091052 - protein, 17 aa, Mycobacterium
IGTNCLADGSNIIATAL

SEQ ID NO: 1091053 - protein, 18 aa, Mycobacterium
IHGGYGYSTEYDVERYFR

SEQ ID NO: 1091054 - protein, 18 aa, Mycobacterium
IHGSRAIQGYALLSRLAE

SEQ ID NO: 1091055 - protein, 25 aa, Mycobacterium
IKLSDDMPGFGLVMFGAIREAGAAA

SEQ ID NO: 1091056 - protein, 19 aa, Mycobacterium
IKLSQAFSALGDHSTDIFS

SEQ ID NO: 1091057 - protein, 18 aa, Mycobacterium
IKPLFVLFDSCWDPFPKL

SEQ ID NO: 1091058 - protein, 22 aa, Mycobacterium
ILMQVCGGPGDSGAPVTVNNML

SEQ ID NO: 1091059 - protein, 17 aa, Mycobacterium
ILTQPFDIDAVPKIFRG

SEQ ID NO: 1091060 - protein, 17 aa, Mycobacterium
INAGNYRGSMSVTDALA

SEQ ID NO: 1091061 - protein, 20 aa, Mycobacterium
INAIDAYPLLGTDAARPPDE

SEQ ID NO: 1091062 - protein, 23 aa, Mycobacterium
INNFPGAAVPFGMVQYSPDTTDN

SEQ ID NO: 1091063 - protein, 22 aa, Mycobacterium
IPDAVRYSVRLGKPVLLPATAG

SEQ ID NO: 1091064 - protein, 19 aa, Mycobacterium
IPGRWAVTCEGGHSRRRIV

SEQ ID NO: 1091065 - protein, 24 aa, Mycobacterium
IPNNGRSATAISIPRDSYVQAPGL

SEQ ID NO: 1091066 - protein, 26 aa, Mycobacterium
IPRDRLTRTFTRFVAAAVQAYCPTNQ

SEQ ID NO: 1091067 - protein, 20 aa, Mycobacterium
IPRVYGRQASEYVIRRGMAQ

SEQ ID NO: 1091068 - protein, 19 aa, Mycobacterium
IPSGGLFSGAEVKMTEEQA

SEQ ID NO: 1091069 - protein, 18 aa, Mycobacterium
IPTPPGWSPYEGPKINPE

SEQ ID NO: 1091070 - protein, 20 aa, Mycobacterium
IQALPGRVAAMATTGPAASA

SEQ ID NO: 1091071 - protein, 19 aa, Mycobacterium
IQEPLRITQNFQHGVLNFQ

SEQ ID NO: 1091072 - protein, 24 aa, Mycobacterium
IQPQLRVLVDLGYSDYGPGLSYAD

SEQ ID NO: 1091073 - protein, 26 aa, Mycobacterium
IQSTFVGAICRWQAANPAGLIDITRY

SEQ ID NO: 1091074 - protein, 19 aa, Mycobacterium
IRDEEQWRLVGAGSQVRVY

SEQ ID NO: 1091075 - protein, 18 aa, Mycobacterium
IRGVPVGKIVKIEPQPLR

SEQ ID NO: 1091076 - protein, 34 aa, Mycobacterium
IRPCPEARVDCGLAGTVLRFAPPLAALSAAPITF

SEQ ID NO: 1091077 - protein, 23 aa, Mycobacterium
IRPKGGYVEAEFTIDRKVKIPAD

SEQ ID NO: 1091078 - protein, 22 aa, Mycobacterium
IRPPAQALLGRPLVGNGAHGAP

SEQ ID NO: 1091079 - protein, 22 aa, Mycobacterium
IRRAPAPSWSHFTLNGAPGAVL

SEQ ID NO: 1091080 - protein, 17 aa, Mycobacterium
IRRSIRYALAALCAVTL

SEQ ID NO: 1091081 - protein, 20 aa, Mycobacterium
IRVAENVLRSQGIGAWPVCG

SEQ ID NO: 1091082 - protein, 24 aa, Mycobacterium
ISASAEPVVRVWAADVGIAADHVM

SEQ ID NO: 1091083 - protein, 21 aa, Mycobacterium
ISETYPPGSTFKVITTAAALQ

SEQ ID NO: 1091084 - protein, 20 aa, Mycobacterium
ISGKLSFDGLHWSTDEPLGY

SEQ ID NO: 1091085 - protein, 22 aa, Mycobacterium
ISGWALTAWVLLSLGTRATQLA

SEQ ID NO: 1091086 - protein, 21 aa, Mycobacterium
ISLAAVFLALAIGVVLGSGFF

SEQ ID NO: 1091087 - protein, 19 aa, Mycobacterium
ISRADWGADEALRCESPEY

SEQ ID NO: 1091088 - protein, 26 aa, Mycobacterium
ISSGDRLDPSLARRFMEAYGDVLYNL

SEQ ID NO: 1091089 - protein, 34 aa, Mycobacterium
ISTGRTGTRRRIRAVAAIARIPSLATVAAVTTGS

SEQ ID NO: 1091090 - protein, 20 aa, Mycobacterium
ISYPSARTATKMVAQEAHNW

SEQ ID NO: 1091091 - protein, 27 aa, Mycobacterium
ITATPLRPGSWRAYADHRMAMAGAIVG

SEQ ID NO: 1091092 - protein, 20 aa, Mycobacterium
ITPAQIRRYAAVGGDHNPIH

SEQ ID NO: 1091093 - protein, 29 aa, Mycobacterium
ITTKPAVEGAFYWLNNREVRWRPEHFWKS

SEQ ID NO: 1091094 - protein, 26 aa, Mycobacterium
ITVGTFVAFWSCLTLVSRPACDLAGM

SEQ ID NO: 1091095 - protein, 17 aa, Mycobacterium
ITVPWSALTDVLAPDMV

SEQ ID NO: 1091096 - protein, 17 aa, Mycobacterium
IVAAAALEGALLTQQQV

SEQ ID NO: 1091097 - protein, 18 aa, Mycobacterium
IVGIAAPVIIQFDAPITD

SEQ ID NO: 1091098 - protein, 19 aa, Mycobacterium
IVLGVVRGGQLLRIGAPEV

SEQ ID NO: 1091099 - protein, 17 aa, Mycobacterium
IVQRELAHQTGLGVAIL

SEQ ID NO: 1091100 - protein, 23 aa, Mycobacterium
IVRRRGDLPTGLRVDSSGNSETG

SEQ ID NO: 1091101 - protein, 24 aa, Mycobacterium
IVSRHCRRVVLVAAVIDGVVDWLR

SEQ ID NO: 1091102 - protein, 17 aa, Mycobacterium
IWAARAISVLFPQITTI

SEQ ID NO: 1091103 - protein, 31 aa, Mycobacterium; identical to SEQ ID NO: 929809

SEQ ID NO: 1091104 - protein, 18 aa, Mycobacterium
IYQRKGIVFHQALATAIR

SEQ ID NO: 1091105 - protein, 19 aa, Mycobacterium
IYSFLRLLLPAGLETTYRS

SEQ ID NO: 1091106 - protein, 19 aa, Mycobacterium
IYTYHSKTLGWCDIAYNAL

SEQ ID NO: 1091107 - protein, 19 aa, Mycobacterium
KAAGEPVGHAFQLLEYPQP

SEQ ID NO: 1091108 - protein, 22 aa, Mycobacterium
KADAAALGFPIRLPVLPDGWKA

SEQ ID NO: 1091109 - protein, 18 aa, Mycobacterium
KAEMLVPVETAFRQLAPR

SEQ ID NO: 1091110 - protein, 20 aa, Mycobacterium
KALAEFLFDDERAMVRIDMS

SEQ ID NO: 1091111 - protein, 19 aa, Mycobacterium
KAMWDWSKNISDKNCLAVD

SEQ ID NO: 1091112 - protein, 31 aa, Mycobacterium; identical to SEQ ID NO: 929864

SEQ ID NO: 1091113 - protein, 24 aa, Mycobacterium
KATATHLVSVFAHRARLVLGQLAV

SEQ ID NO: 1091114 - protein, 24 aa, Mycobacterium
KATATHLVSVFAHRARLVLGRLAV

SEQ ID NO: 1091115 - protein, 20 aa, Mycobacterium
KAYGAGPCSGHLTDIEHIVL

SEQ ID NO: 1091116 - protein, 27 aa, Mycobacterium
KCQQAWCPVCALTALVIGEQHPLLTVI

SEQ ID NO: 1091117 - protein, 25 aa, Mycobacterium
KDRMIGIDATHAWAAVWTPQQPGQF

SEQ ID NO: 1091118 - protein, 19 aa, Mycobacterium
KDTHAHAWALRMSPDGNVW

SEQ ID NO: 1091119 - protein, 23 aa, Mycobacterium
KDTKPGDVVVIDFRRKNEAPGVA

SEQ ID NO: 1091120 - protein, 34 aa, Mycobacterium; identical to SEQ ID NO: 929917

SEQ ID NO: 1091121 - protein, 18 aa, Mycobacterium
KEPPKRVVSAGFTEQDDL

SEQ ID NO: 1091122 - protein, 28 aa, Mycobacterium
KFDCLTAGCWPTWWLGNQDRGEIDIIEW

SEQ ID NO: 1091123 - protein, 23 aa, Mycobacterium
KFMFRHLRGYFTKDLDQLVREEP

SEQ ID NO: 1091124 - protein, 25 aa, Mycobacterium
KGEDGRFRPAAGLAVLGASFDHNVR

SEQ ID NO: 1091125 - protein, 25 aa, Mycobacterium
KGHRDWPHLGVALMRPRSRARVTLA

SEQ ID NO: 1091126 - protein, 19 aa, Mycobacterium
KGISIRRAPAPSWSHFTLN

SEQ ID NO: 1091127 - protein, 20 aa, Mycobacterium
KGMQAIRMVVVVLAAAFAVA

SEQ ID NO: 1091128 - protein, 25 aa, Mycobacterium
KLEAIGIDLSDVFDVLESEGVEKFE

SEQ ID NO: 1091129 - protein, 18 aa, Mycobacterium
KLGRRWHQETVYGVAARG

SEQ ID NO: 1091130 - protein, 17 aa, Mycobacterium
KLIVEWPPRDYVPDPDP

SEQ ID NO: 1091131 - protein, 17 aa, Mycobacterium
KLREIDGLLPTLIRGQG

SEQ ID NO: 1091132 - protein, 17 aa, Mycobacterium
KMAYFMVGFSGPIPDDK

SEQ ID NO: 1091133 - protein, 25 aa, Mycobacterium
KMQEIFPPGVCNLVCGDRDTGAALV

SEQ ID NO: 1091134 - protein, 30 aa, Mycobacterium
KPAVLWFWTPWCPFCNAEGPAASQVAAANP

SEQ ID NO: 1091135 - protein, 27 aa, Mycobacterium
KPESVTCPGDLPAKVGAQANCEMKVKD

SEQ ID NO: 1091136 - protein, 26 aa, Mycobacterium
KPITNGLMYNFTFNFEKAGQGSVMVP

SEQ ID NO: 1091137 - protein, 19 aa, Mycobacterium
KQYVVRFGLGYREEAKSDV

SEQ ID NO: 1091138 - protein, 23 aa, Mycobacterium
KRFAELREGVWLRPDNLDLELAA

SEQ ID NO: 1091139 - protein, 21 aa, Mycobacterium
KRIRAGFPADWRVIDKTGSGE

SEQ ID NO: 1091140 - protein, 25 aa, Mycobacterium
KRSGAQCFPCRRGLASAPAARSVPG

SEQ ID NO: 1091141 - protein, 20 aa, Mycobacterium
KSGSGHLVLISSVLASKGVP

SEQ ID NO: 1091142 - protein, 20 aa, Mycobacterium
KTGLARLALHTGVPVIPVAM

SEQ ID NO: 1091143 - protein, 25 aa, Mycobacterium
KTTLEELWWDRPFTLEGVDIGASVA

SEQ ID NO: 1091144 - protein, 18 aa, Mycobacterium
KTTYPVWTMNAIGDISFH

SEQ ID NO: 1091145 - protein, 23 aa, Mycobacterium
KVEGLRIDGDHIVMKFSIGTNTI

SEQ ID NO: 1091146 - protein, 19 aa, Mycobacterium
KVGQKVLPQQARKADLLFY

SEQ ID NO: 1091147 - protein, 21 aa, Mycobacterium
KWQGWAGGPGGGWNKPPTPLW

SEQ ID NO: 1091148 - protein, 22 aa, Mycobacterium
KWSVELFATEMMSHFQGQAQPA

SEQ ID NO: 1091149 - protein, 19 aa, Mycobacterium
KYDDCLIMAVADVVGQVTG

SEQ ID NO: 1091150 - protein, 20 aa, Mycobacterium
KYPDGSFWHQWMRTYMTGPQ

SEQ ID NO: 1091151 - protein, 18 aa, Mycobacterium
LAAAFDIYGRLYAWLLDT

SEQ ID NO: 1091152 - protein, 19 aa, Mycobacterium
LAACPEALTGEPSRQALIA

SEQ ID NO: 1091153 - protein, 17 aa, Mycobacterium
LAAERAESVLVVDHGVV

SEQ ID NO: 1091154 - protein, 17 aa, Mycobacterium
LAAGGWLMRALRGAPAA

SEQ ID NO: 1091155 - protein, 20 aa, Mycobacterium
LAALCAVTLVSSGCARFNDA

SEQ ID NO: 1091156 - protein, 18 aa, Mycobacterium
LAAMEAHTGVTLAVRTTR

SEQ ID NO: 1091157 - protein, 25 aa, Mycobacterium
LAANIVGGIDWDGHGLLGLEDSLDA

SEQ ID NO: 1091158 - protein, 18 aa, Mycobacterium
LACLARGILAFLANPELH

SEQ ID NO: 1091159 - protein, 21 aa, Mycobacterium
LAEEPRTCVFFESPRRLAACL

SEQ ID NO: 1091160 - protein, 17 aa, Mycobacterium
LAEPVQTLGQAWLASPA

SEQ ID NO: 1091161 - protein, 21 aa, Mycobacterium
LAEQGWVCLSIDYRVAPHHRW

SEQ ID NO: 1091162 - protein, 25 aa, Mycobacterium
LAERLTEFFGGIPILDGVGSTEVGQ

SEQ ID NO: 1091163 - protein, 18 aa, Mycobacterium
LAEVIYLTNEYELGDFGV

SEQ ID NO: 1091164 - protein, 25 aa, Mycobacterium
LAGAPRGQTGPAFAASSPSTGITAV

SEQ ID NO: 1091165 - protein, 19 aa, Mycobacterium
LAGCFGSGGRSAAPRLPNG

SEQ ID NO: 1091166 - protein, 17 aa, Mycobacterium
LAGQLWDLTGWAGVGDR

SEQ ID NO: 1091167 - protein, 17 aa, Mycobacterium
LAGRPALLIADEPTSAL

SEQ ID NO: 1091168 - protein, 17 aa, Mycobacterium
LAGSAVAGEPGWSTSQH

SEQ ID NO: 1091169 - protein, 25 aa, Mycobacterium
LAGVGAQCRKLAGALDDFADEVADT

SEQ ID NO: 1091170 - protein, 23 aa, Mycobacterium
LAHEFGHALQVMAKLVTRRDPTI

SEQ ID NO: 1091171 - protein, 26 aa, Mycobacterium
LAKAAELRYGRIPEMEKKLDAAVPHA

SEQ ID NO: 1091172 - protein, 25 aa, Mycobacterium
LALRVLCATALVVVRTEERRVRSVA

SEQ ID NO: 1091173 - protein, 26 aa, Mycobacterium
LANAKRWGVLHVIWRQKIYPGIVAPS

SEQ ID NO: 1091174 - protein, 19 aa, Mycobacterium
LAQGWPRTQIVDVAEHAND

SEQ ID NO: 1091175 - protein, 22 aa, Mycobacterium
LAQLRARLASLSVEDLEALLAY

SEQ ID NO: 1091176 - protein, 26 aa, Mycobacterium
LAQRLRAVVLFATWAGRVLDGAPQNR

SEQ ID NO: 1091177 - protein, 18 aa, Mycobacterium
LARHCDGLVVGKVGGGAT

SEQ ID NO: 1091178 - protein, 23 aa, Mycobacterium
LASEKKCLLGLVDLVGFDTEIDH

SEQ ID NO: 1091179 - protein, 24 aa, Mycobacterium
LASIFKLYVLHALADAIKSGTASW

SEQ ID NO: 1091180 - protein, 25 aa, Mycobacterium
LASYFWQHNWGSPKGYTHPAANLHQ

SEQ ID NO: 1091181 - protein, 19 aa, Mycobacterium
LATEIARAAGKLVSATSET

SEQ ID NO: 1091182 - protein, 28 aa, Mycobacterium
LATGGFEWDPVLVRAFLRGPMHGAVSPP

SEQ ID NO: 1091183 - protein, 19 aa, Mycobacterium
LATLPPPTITAWRDVDAVL

SEQ ID NO: 1091184 - protein, 30 aa, Mycobacterium; identical to SEQ ID NO: 930410

SEQ ID NO: 1091185 - protein, 22 aa, Mycobacterium
LAVGDCLKLAGPPDRPQATKAA

SEQ ID NO: 1091186 - protein, 17 aa, Mycobacterium
LAVLLVGLLAAGVVVLL

SEQ ID NO: 1091187 - protein, 26 aa, Mycobacterium
LAVTAAEVPLAFALAAGSFRDATRVA

SEQ ID NO: 1091188 - protein, 19 aa, Mycobacterium
LAYGLGLWYGVMRERNAGA

SEQ ID NO: 1091189 - protein, 23 aa, Mycobacterium
LDAGCELARALGLDPATVSIASA

SEQ ID NO: 1091190 - protein, 25 aa, Mycobacterium
LDALGWKLNGKFREKDGHQLVVRLL

SEQ ID NO: 1091191 - protein, 25 aa, Mycobacterium
LDAQPRLSILLGDYVVPAEGRVGLL

SEQ ID NO: 1091192 - protein, 26 aa, Mycobacterium
LDARPYRLPWPTGMRVYEIDQPEVIE

SEQ ID NO: 1091193 - protein, 28 aa, Mycobacterium
LDFDFAMLLPPFRGASLAAYDRDGNDIT

SEQ ID NO: 1091194 - protein, 18 aa, Mycobacterium
LDGLRWSPGPDDTLRALL

SEQ ID NO: 1091195 - protein, 22 aa, Mycobacterium
LDIRASHVALRILHDDTAVTGV

SEQ ID NO: 1091196 - protein, 25 aa, Mycobacterium
LDISRAEEVLGWRPQVELADGVRRT

SEQ ID NO: 1091197 - protein, 18 aa, Mycobacterium
LDLGYRPATKELPFGQNI

SEQ ID NO: 1091198 - protein, 23 aa, Mycobacterium
LDLHPDIHLFSAIPEVRSSTAET

SEQ ID NO: 1091199 - protein, 19 aa, Mycobacterium
LDPAKALALANQVDKLIWA

SEQ ID NO: 1091200 - protein, 26 aa, Mycobacterium
LDPDARLSALSNLYAPFVKLTAGTSI

SEQ ID NO: 1091201 - protein, 24 aa, Mycobacterium
LDRQHRVAAVFLRELLAEDLQPVV

SEQ ID NO: 1091202 - protein, 24 aa, Mycobacterium
LDSRAYRLKWPNGATVFEIDLPKV

SEQ ID NO: 1091203 - protein, 18 aa, Mycobacterium
LDTDLNFFLGQPGVTDIS

SEQ ID NO: 1091204 - protein, 18 aa, Mycobacterium
LDVAWMIFAHMVFEELAG

SEQ ID NO: 1091205 - protein, 18 aa, Mycobacterium
LDVPYTRIHEFRHFHPER

SEQ ID NO: 1091206 - protein, 22 aa, Mycobacterium
LEFIQFHPTMLFAAGTGTGGRR

SEQ ID NO: 1091207 - protein, 23 aa, Mycobacterium
LEFIQFHPTMLFYGSSGGRRPLI

SEQ ID NO: 1091208 - protein, 20 aa, Mycobacterium
LEGETAKLLRMEDELGHRVI

SEQ ID NO: 1091209 - protein, 23 aa, Mycobacterium
LEIAPNLWAGVGLVRGGAGTALV

SEQ ID NO: 1091210 - protein, 29 aa, Mycobacterium
LELDLHYIRRLDLVGGRGVTMCHGLGPDK

SEQ ID NO: 1091211 - protein, 17 aa, Mycobacterium
LELGVTYRDPRTTLADT

SEQ ID NO: 1091212 - protein, 19 aa, Mycobacterium
LELLASGTWSGRGVLGPEA

SEQ ID NO: 1091213 - protein, 17 aa, Mycobacterium
LENAAHVYAIIAVSSGL

SEQ ID NO: 1091214 - protein, 26 aa, Mycobacterium
LERLSEQTRLIFPKVWGGGPSPMLDE

SEQ ID NO: 1091215 - protein, 19 aa, Mycobacterium
LESGCYARIRPGCNPVVTR

SEQ ID NO: 1091216 - protein, 23 aa, Mycobacterium
LESSDWSWLKWLPHVDIPGQLDG

SEQ ID NO: 1091217 - protein, 17 aa, Mycobacterium
LFETHFFGTVALIKAVL

SEQ ID NO: 1091218 - protein, 25 aa, Mycobacterium
LGADTWHWHPMASFASSSKVGGLSV

SEQ ID NO: 1091219 - protein, 20 aa, Mycobacterium
LGAGMARAFAARGRDLALCA

SEQ ID NO: 1091220 - protein, 27 aa, Mycobacterium
LGAPQLDRIQSWLGLQGIDLTTPSGLL

SEQ ID NO: 1091221 - protein, 18 aa, Mycobacterium
LGDMVAELIELSRLQGAE

SEQ ID NO: 1091222 - protein, 27 aa, Mycobacterium
LGEARDWLSRFDIGSGFEVVLSSPEPL

SEQ ID NO: 1091223 - protein, 23 aa, Mycobacterium
LGEQLRTLITVPLFHVTGYNSQL

SEQ ID NO: 1091224 - protein, 17 aa, Mycobacterium
LGGLPVVADTSIPSGSV

SEQ ID NO: 1091225 - protein, 21 aa, Mycobacterium
LGGSEFERGSREPMLPATWGS

SEQ ID NO: 1091226 - protein, 22 aa, Mycobacterium
LGPDALMAYRHIAQRRDVEITD

SEQ ID NO: 1091227 - protein, 24 aa, Mycobacterium
LGQHGVNIMEFCKAYNAATESQRG

SEQ ID NO: 1091228 - protein, 25 aa, Mycobacterium
LGSGGYRITAIFANALNLNEHAKVK

SEQ ID NO: 1091229 - protein, 24 aa, Mycobacterium
LGSHPRLGRNLALHPATMLAGRFD

SEQ ID NO: 1091230 - protein, 22 aa, Mycobacterium
LGTAAARAAVTAAQANAAAAVF

SEQ ID NO: 1091231 - protein, 17 aa, Mycobacterium
LGTERPDAEVLVSAPNV

SEQ ID NO: 1091232 - protein, 23 aa, Mycobacterium
LGTYCGYGALRIARAAPQAKVYS

SEQ ID NO: 1091233 - protein, 17 aa, Mycobacterium
LGVELRATIAAPVAGLD

SEQ ID NO: 1091234 - protein, 17 aa, Mycobacterium
LGWRAQHSQSHYAAAKA

SEQ ID NO: 1091235 - protein, 23 aa, Mycobacterium
LHEVPVLSGLGLTMTGPRPGGFG

SEQ ID NO: 1091236 - protein, 18 aa, Mycobacterium
LHGPHRYNWNQFIGSLKY

SEQ ID NO: 1091237 - protein, 19 aa, Mycobacterium
LHNGTVWQWNRPVYDVQGG

SEQ ID NO: 1091238 - protein, 19 aa, Mycobacterium
LIASLWAATAFLTALLVVA

SEQ ID NO: 1091239 - protein, 22 aa, Mycobacterium
LIDEGPLPLSRLARLAHMDAGM

SEQ ID NO: 1091240 - protein, 24 aa, Mycobacterium
LIITPLRIAFLILLVGTTLEVVTE

SEQ ID NO: 1091241 - protein, 17 aa, Mycobacterium
LIWAEGFSLPLTQSPGT

SEQ ID NO: 1091242 - protein, 17 aa, Mycobacterium
LKDVAGLSLTKLFVGSE

SEQ ID NO: 1091243 - protein, 17 aa, Mycobacterium
LKELGRGSQYLIGALKL

SEQ ID NO: 1091244 - protein, 22 aa, Mycobacterium
LKLGRRRLLALGAGTLGLGALA

SEQ ID NO: 1091245 - protein, 17 aa, Mycobacterium
LKLSRLGAAILGGVAAL

SEQ ID NO: 1091246 - protein, 17 aa, Mycobacterium
LKPYFDEMFLGRGQVAT

SEQ ID NO: 1091247 - protein, 21 aa, Mycobacterium
LKTGACGRGPMEVQVNLRVGE

SEQ ID NO: 1091248 - protein, 17 aa, Mycobacterium
LLAEALAVTAAEVPLAF

SEQ ID NO: 1091249 - protein, 21 aa, Mycobacterium
LLERTRLRVGSRMTLATPMFH

SEQ ID NO: 1091250 - protein, 39 aa, Mycobacterium
LLKEPNFLPLQPFSWRIMPENLEDAGISWKVYQNKFFGH

SEQ ID NO: 1091251 - protein, 26 aa, Mycobacterium
LLKRFQLSMNNVWPATQSQLYSELNK

SEQ ID NO: 1091252 - protein, 24 aa, Mycobacterium
LLLGSCARSPAPVIVPVRSSPAAR

SEQ ID NO: 1091253 - protein, 18 aa, Mycobacterium
LLLPAGLETTYRSSGNLL

SEQ ID NO: 1091254 - protein, 18 aa, Mycobacterium
LLLSRRFTRSAGRRRVRQ

SEQ ID NO: 1091255 - protein, 24 aa, Mycobacterium
LLPAPRSARGQVVFINSGAGRNVS

SEQ ID NO: 1091256 - protein, 22 aa, Mycobacterium
LLPDNLRWLVTVDAMHTQVVTA

SEQ ID NO: 1091257 - protein, 22 aa, Mycobacterium
LLPDSLRWLVTVDAMHTQVVTA

SEQ ID NO: 1091258 - protein, 21 aa, Mycobacterium
LLPGSLRWLVTVDAMHTQVVT

SEQ ID NO: 1091259 - protein, 26 aa, Mycobacterium
LLSAALKLFAVKGYAATSVADIQRCS

SEQ ID NO: 1091260 - protein, 26 aa, Mycobacterium
LLSEEDRRFTVVFAYDQSDYARMEAT

SEQ ID NO: 1091261 - protein, 19 aa, Mycobacterium
LLSGMALASLAGRGATGAG

SEQ ID NO: 1091262 - protein, 24 aa, Mycobacterium
LLVATLLLLWSMNRQLKKIPASFD

SEQ ID NO: 1091263 - protein, 25 aa, Mycobacterium
LLVGNGGAGGLLFGQGGAGGANGLF

SEQ ID NO: 1091264 - protein, 17 aa, Mycobacterium
LNIQIGRRQVVKAEVSS

SEQ ID NO: 1091265 - protein, 17 aa, Mycobacterium
LNPGLNFYLGQPSVTLL

SEQ ID NO: 1091266 - protein, 26 aa, Mycobacterium
LPAAHITRLPVRYTFDNRYFSDTYEG

SEQ ID NO: 1091267 - protein, 19 aa, Mycobacterium
LPAKEWLAQRGFDPVYGAR

SEQ ID NO: 1091268 - protein, 20 aa, Mycobacterium
LPDPPPPVFFGGSSESAGAV

SEQ ID NO: 1091269 - protein, 23 aa, Mycobacterium
LPDSAPEHMAHRIVAGLEPVGTQ

SEQ ID NO: 1091270 - protein, 21 aa, Mycobacterium
LPGAECARLNLPPMCHHNPTH

SEQ ID NO: 1091271 - protein, 26 aa, Mycobacterium
LPGPGARLAPIFAYPLLAACPSITQG

SEQ ID NO: 1091272 - protein, 25 aa, Mycobacterium
LPIVNASGGPNCRGLPDIPTKQTGG

SEQ ID NO: 1091273 - protein, 19 aa, Mycobacterium
LPKRIDFACYSAIYYTLRR

SEQ ID NO: 1091274 - protein, 22 aa, Mycobacterium
LPKVLEFKARVLAEQGAIPNAG

SEQ ID NO: 1091275 - protein, 17 aa, Mycobacterium
LPLLLAAGAALAQTPRA

SEQ ID NO: 1091276 - protein, 19 aa, Mycobacterium
LPNLRKLVTGIARIAQERD

SEQ ID NO: 1091277 - protein, 19 aa, Mycobacterium
LPPTPGIPIPGRPGEPAPD

SEQ ID NO: 1091278 - protein, 20 aa, Mycobacterium
LPPTPIHVVFRSDQSGTTAN

SEQ ID NO: 1091279 - protein, 18 aa, Mycobacterium
LPPVPVVLPKPVRQLEQT

SEQ ID NO: 1091280 - protein, 23 aa, Mycobacterium
LPRGCIAAGDRAFFCDYVQEYLS

SEQ ID NO: 1091281 - protein, 17 aa, Mycobacterium
LPRMHLARYAGTARPRL

SEQ ID NO: 1091282 - protein, 28 aa, Mycobacterium
LPTARAVVLPQWLFSVLLTPAIRLTNGA

SEQ ID NO: 1091283 - protein, 25 aa, Mycobacterium
LPTNVDLRFGTSVSEVTHGDDRAVV

SEQ ID NO: 1091284 - protein, 17 aa, Mycobacterium
LPTTGILAAGADDVSTA

SEQ ID NO: 1091285 - protein, 17 aa, Mycobacterium
LPVDGYTAWLQNMAADD

SEQ ID NO: 1091286 - protein, 17 aa, Mycobacterium
LPVGTYCKIPMDTPANS

SEQ ID NO: 1091287 - protein, 17 aa, Mycobacterium
LPVPGLAGLPTLPEPAA

SEQ ID NO: 1091288 - protein, 21 aa, Mycobacterium
LPVVIKDVMQVAGLACSGGSP

SEQ ID NO: 1091289 - protein, 24 aa, Mycobacterium
LQAAARRSGVPVTEVTEMLPNDTD

SEQ ID NO: 1091290 - protein, 18 aa, Mycobacterium
LQASALVRGVRCIGAHSD

SEQ ID NO: 1091291 - protein, 25 aa, Mycobacterium
LQATKRIGKVFGEFDSDSSAMVALE

SEQ ID NO: 1091292 - protein, 18 aa, Mycobacterium
LQEAFGRVSRVDCLGITT

SEQ ID NO: 1091293 - protein, 18 aa, Mycobacterium
LQGPLGAAINQAADTLNG

SEQ ID NO: 1091294 - protein, 31 aa, Mycobacterium; identical to SEQ ID NO: 931123

SEQ ID NO: 1091295 - protein, 18 aa, Mycobacterium
LQLASAICRHYWPVTLIA

SEQ ID NO: 1091296 - protein, 21 aa, Mycobacterium
LQSLQCPLKELGRGSQYLIGA

SEQ ID NO: 1091297 - protein, 20 aa, Mycobacterium
LRAAHHLSMCPQCAAEVEDH

SEQ ID NO: 1091298 - protein, 21 aa, Mycobacterium
LRAGYPLAQITTALCDRWQPG

SEQ ID NO: 1091299 - protein, 18 aa, Mycobacterium
LRAQGAIVLGMTNVPEMS

SEQ ID NO: 1091300 - protein, 20 aa, Mycobacterium
LREPRIPGVDKIRLRLQRIG

SEQ ID NO: 1091301 - protein, 20 aa, Mycobacterium
LRGAGRLVIERMGLLEQMRQ

SEQ ID NO: 1091302 - protein, 25 aa, Mycobacterium
LRGARPRLTPIVGLLTPDGLVTNDA

SEQ ID NO: 1091303 - protein, 21 aa, Mycobacterium
LRGTLLPSRRRGQSARYLVVT

SEQ ID NO: 1091304 - protein, 21 aa, Mycobacterium
LRKRLTGLLGAFRAFSYGSLY

SEQ ID NO: 1091305 - protein, 20 aa, Mycobacterium
LRLSLTDFPPNFNILHIDGN

SEQ ID NO: 1091306 - protein, 17 aa, Mycobacterium
LRLVRELYRGGTNLYTP

SEQ ID NO: 1091307 - protein, 21 aa, Mycobacterium
LRPYVAITLTSERSGLVMDTG

SEQ ID NO: 1091308 - protein, 20 aa, Mycobacterium
LRRHPGIDVETWLMALDGTV

SEQ ID NO: 1091309 - protein, 17 aa, Mycobacterium
LRSQPAFEDASARAEGY

SEQ ID NO: 1091310 - protein, 17 aa, Mycobacterium
LRTRKGMVLDAADHDTW

SEQ ID NO: 1091311 - protein, 17 aa, Mycobacterium
LRVADHRVLRIVHRAPA

SEQ ID NO: 1091312 - protein, 20 aa, Mycobacterium
LRVALRIVWALLLMPGLPLL

SEQ ID NO: 1091313 - protein, 25 aa, Mycobacterium
LRVAVPSFLLLFLVACGGSGRVSHP

SEQ ID NO: 1091314 - protein, 21 aa, Mycobacterium
LRVPALKALFPDYRGSALEAF

SEQ ID NO: 1091315 - protein, 17 aa, Mycobacterium
LSAAPPGVETWYRGAAR

SEQ ID NO: 1091316 - protein, 38 aa, Mycobacterium; identical to SEQ ID NO: 931297

SEQ ID NO: 1091317 - protein, 19 aa, Mycobacterium
LSATWALGPVRGVRQRDLS

SEQ ID NO: 1091318 - protein, 17 aa, Mycobacterium
LSDRLVSITSDIGKVTM

SEQ ID NO: 1091319 - protein, 19 aa, Mycobacterium
LSGADFPAGRQKLTGPQAL

SEQ ID NO: 1091320 - protein, 26 aa, Mycobacterium
LSIAGDLRVDFAWLGTVVQAYLRRTL

SEQ ID NO: 1091321 - protein, 17 aa, Mycobacterium
LSICPPPPPDAEGNPAC

SEQ ID NO: 1091322 - protein, 41 aa, Mycobacterium
LSLLKLSGFCLLASIVAAALMFPFAGGIGLMSNRASEVVAN

SEQ ID NO: 1091323 - protein, 20 aa, Mycobacterium
LSNMPMKPGMNVRVFNDVNM

SEQ ID NO: 1091324 - protein, 20 aa, Mycobacterium
LSRIDAGFFTGTRWEGDLTE

SEQ ID NO: 1091325 - protein, 19 aa, Mycobacterium
LSSAAAMRAAVLAGAGPAA

SEQ ID NO: 1091326 - protein, 17 aa, Mycobacterium
LSSEEWMGPASATMAQA

SEQ ID NO: 1091327 - protein, 18 aa, Mycobacterium
LSSIAERIPLPGRRPARR

SEQ ID NO: 1091328 - protein, 26 aa, Mycobacterium
LSVPPSWSAPSARMVSALSPSGLTTI

SEQ ID NO: 1091329 - protein, 18 aa, Mycobacterium
LSYLRVPALKALFPDYRG

SEQ ID NO: 1091330 - protein, 33 aa, Mycobacterium; identical to SEQ ID NO: 1050420

SEQ ID NO: 1091331 - protein, 17 aa, Mycobacterium
LSYSDGDIWDWAVDWGT

SEQ ID NO: 1091332 - protein, 18 aa, Mycobacterium
LTAARLGGVAVILPALDL

SEQ ID NO: 1091333 - protein, 17 aa, Mycobacterium
LTILKPGQTIPLANTKP

SEQ ID NO: 1091334 - protein, 25 aa, Mycobacterium
LTMTGPRPGGFGALDDRTNEICAEG

SEQ ID NO: 1091335 - protein, 19 aa, Mycobacterium
LTPGMPGDLALPGTTLPPT

SEQ ID NO: 1091336 - protein, 24 aa, Mycobacterium
LTRSLSLLATFPFPNETFQNFQRG

SEQ ID NO: 1091337 - protein, 18 aa, Mycobacterium
LVAARFIQLTPVYTGGAV

SEQ ID NO: 1091338 - protein, 24 aa, Mycobacterium
LVACGGSGRVSHPAAHGSSSAQET

SEQ ID NO: 1091339 - protein, 17 aa, Mycobacterium
LVANNTRIWVYCGNGTP

SEQ ID NO: 1091340 - protein, 18 aa, Mycobacterium
LVDVLSRLADPNIPGDKK

SEQ ID NO: 1091341 - protein, 24 aa, Mycobacterium
LVGNGLKVVSCYQYGKGSTSDWLG

SEQ ID NO: 1091342 - protein, 20 aa, Mycobacterium
LVKAARRARQEWLTERLATL

SEQ ID NO: 1091343 - protein, 24 aa, Mycobacterium
LVLACALAGCAAPKSLPPTAAPDL

SEQ ID NO: 1091344 - protein, 23 aa, Mycobacterium
LVLSSCGWRGISNVAIPGAPGTG

SEQ ID NO: 1091345 - protein, 18 aa, Mycobacterium
LVNTEFRATALAAALEAH

SEQ ID NO: 1091346 - protein, 21 aa, Mycobacterium
LVPMSDWRLEFDLPARESISH

SEQ ID NO: 1091347 - protein, 27 aa, Mycobacterium
LVSSWQMPGGIYAPMMHPWSTGKDVYF

SEQ ID NO: 1091348 - protein, 18 aa, Mycobacterium
LWAGVAVSDLEFIQFHPT

SEQ ID NO: 1091349 - protein, 25 aa, Mycobacterium
LWLEELDRTPAFYFDSITQLQLDTW

SEQ ID NO: 1091350 - protein, 18 aa, Mycobacterium
LYATLTPSKWSDFGKASD

SEQ ID NO: 1091351 - protein, 18 aa, Mycobacterium
LYDGRTASFTVVGADPTS

SEQ ID NO: 1091352 - protein, 18 aa, Mycobacterium
LYTPLAIAAARWPERTAI

SEQ ID NO: 1091353 - protein, 23 aa, Mycobacterium
LYTSGPALLPWEAARPSGMQGAL

SEQ ID NO: 1091354 - protein, 23 aa, Mycobacterium
MAAAAQPLLAWLSYTAESSALAA

SEQ ID NO: 1091355 - protein, 17 aa, Mycobacterium
MAARPGERELVAATRRR

SEQ ID NO: 1091356 - protein, 21 aa, Mycobacterium
MAASAAPCVGWLYRTAEQTQQ

SEQ ID NO: 1091357 - protein, 27 aa, Mycobacterium
MAEAAGIPGQFALAAAMVRHLLSDPML

SEQ ID NO: 1091358 - protein, 22 aa, Mycobacterium
MAEGRGSVVVEGRDIGTVVLPD

SEQ ID NO: 1091359 - protein, 23 aa, Mycobacterium
MAEPKLGQPIQWSPCRSSNPNVK

SEQ ID NO: 1091360 - protein, 17 aa, Mycobacterium
MAIAATDTWVARPLTTA

SEQ ID NO: 1091361 - protein, 24 aa, Mycobacterium
MAPVLRRWVFVRIFDIRVKAPTSL

SEQ ID NO: 1091362 - protein, 17 aa, Mycobacterium
MASSCPNTKIVQGGYSQ

SEQ ID NO: 1091363 - protein, 23 aa, Mycobacterium
MATGELRATMALTEPGGGSDLQN

SEQ ID NO: 1091364 - protein, 19 aa, Mycobacterium
MDRMLRPGGVVDLLTAPGG

SEQ ID NO: 1091365 - protein, 20 aa, Mycobacterium
MDRVICGDVGYGKAEIAVRA

SEQ ID NO: 1091366 - protein, 19 aa, Mycobacterium
MDRVICGDVGYGKTEIAVR

SEQ ID NO: 1091367 - protein, 18 aa, Mycobacterium
MFHKSGSGHLVLISSVLA

SEQ ID NO: 1091368 - protein, 37 aa, Mycobacterium
MGARLDFGCVCGSTPIFRWLPRCRTAVSSTPATARTC

SEQ ID NO: 1091369 - protein, 17 aa, Mycobacterium
MGEAWWVPIVQIPNDTI

SEQ ID NO: 1091370 - protein, 26 aa, Mycobacterium
MGPHFSFSWYRGSPIGRERKTEELSR

SEQ ID NO: 1091371 - protein, 17 aa, Mycobacterium
MHSWNRIVIPTGPPPDN

SEQ ID NO: 1091372 - protein, 18 aa, Mycobacterium
MIDPLKLNAVLSAVAEGV

SEQ ID NO: 1091373 - protein, 24 aa, Mycobacterium
MLAHGVVKCAIRCAIRFCQHQHHH

SEQ ID NO: 1091374 - protein, 18 aa, Mycobacterium
MLPNGAVVKRCYAEVLPA

SEQ ID NO: 1091375 - protein, 18 aa, Mycobacterium
MMLMTGFGVLGAALPVPA

SEQ ID NO: 1091376 - protein, 23 aa, Mycobacterium
MNNRCPLTSYVLVGFSQGAVIAG

SEQ ID NO: 1091377 - protein, 19 aa, Mycobacterium
MPRRSSWQTAIGLMSLVVN

SEQ ID NO: 1091378 - protein, 26 aa, Mycobacterium
MPTIPLWDYIAVVGWSTEVSNVQVTW

SEQ ID NO: 1091379 - protein, 18 aa, Mycobacterium
MRANALDAQRRWQKILGP

SEQ ID NO: 1091380 - protein, 26 aa, Mycobacterium
MRAVSRRAWQGLALLMVALVLSSCGW

SEQ ID NO: 1091381 - protein, 17 aa, Mycobacterium
MRIRRSIRYALAALCAV

SEQ ID NO: 1091382 - protein, 19 aa, Mycobacterium
MTALSQGLSSFGINLPPVP

SEQ ID NO: 1091383 - protein, 19 aa, Mycobacterium
MTLNFQIGRRQIVKAEVPS

SEQ ID NO: 1091384 - protein, 21 aa, Mycobacterium
MVFGELVPKYLAVARPLPTAR

SEQ ID NO: 1091385 - protein, 20 aa, Mycobacterium
MVQIPRLVANNTRIWVYCGN

SEQ ID NO: 1091386 - protein, 27 aa, Mycobacterium
MVTFAKPYAEWRGMFAGNGMLLPSSMT

SEQ ID NO: 1091387 - protein, 30 aa, Mycobacterium; identical to SEQ ID NO: 702384

SEQ ID NO: 1091388 - protein, 22 aa, Mycobacterium
NAKPPCCVEPPAAAPVSPVSPA

SEQ ID NO: 1091389 - protein, 25 aa, Mycobacterium
NALNEKLRAANDFDNQMLGRIVHDA

SEQ ID NO: 1091390 - protein, 17 aa, Mycobacterium
NAPEIASRLGGGIAAKA

SEQ ID NO: 1091391 - protein, 20 aa, Mycobacterium
NATEFCRSADAIAISEHAIA

SEQ ID NO: 1091392 - protein, 18 aa, Mycobacterium
NDPGYRLVAACIEAGISV

SEQ ID NO: 1091393 - protein, 19 aa, Mycobacterium
NDVALPWSIEVETDAPSMV

SEQ ID NO: 1091394 - protein, 17 aa, Mycobacterium
NDVAVVWSPGGTPYVVA

SEQ ID NO: 1091395 - protein, 22 aa, Mycobacterium
NEIPCVCALLTLLPDNLRWLVT

SEQ ID NO: 1091396 - protein, 24 aa, Mycobacterium
NEIPCVRALLTLLPDSLRWLVTVD

SEQ ID NO: 1091397 - protein, 22 aa, Mycobacterium
NFSRWSGLRNVLRRGFGGNGHK

SEQ ID NO: 1091398 - protein, 24 aa, Mycobacterium
NGAGARPGPRYGVKPRVMPKKVLV

SEQ ID NO: 1091399 - protein, 19 aa, Mycobacterium
NGGFLFGSGGTGGFGGVGG

SEQ ID NO: 1091400 - protein, 19 aa, Mycobacterium
NGGSLNFGFGNGGVENMGH

SEQ ID NO: 1091401 - protein, 24 aa, Mycobacterium
NGHHPGDIVSISWTSSSGGQRTEN

SEQ ID NO: 1091402 - protein, 24 aa, Mycobacterium
NGVGGEFRGGVGQGARGSAGVITA

SEQ ID NO: 1091403 - protein, 17 aa, Mycobacterium
NGVKCLNYLGLDQQTAR

SEQ ID NO: 1091404 - protein, 26 aa, Mycobacterium
NHDIHATKLIVEWPPRDYVPDPDPIG

SEQ ID NO: 1091405 - protein, 23 aa, Mycobacterium
NKCANAILRIFGVQPKDELDITV

SEQ ID NO: 1091406 - protein, 22 aa, Mycobacterium
NKGLRFEFYANLETAYSDLLSG

SEQ ID NO: 1091407 - protein, 20 aa, Mycobacterium
NLFVELFVPYLLATGYTGSL

SEQ ID NO: 1091408 - protein, 19 aa, Mycobacterium
NLREGKLVRIAGVEVGKVE

SEQ ID NO: 1091409 - protein, 20 aa, Mycobacterium
NLRMLLKWLQGAVFISLYAF

SEQ ID NO: 1091410 - protein, 26 aa, Mycobacterium
NNREVRWRPEHFWKSGTSVDVAVNTY

SEQ ID NO: 1091411 - protein, 18 aa, Mycobacterium
NNTYTVYVAMKFNQPFIS

SEQ ID NO: 1091412 - protein, 24 aa, Mycobacterium
NPACGKAGCTTYKWETFLTSELPQ

SEQ ID NO: 1091413 - protein, 22 aa, Mycobacterium
NPILTEIWFLLTGQTVLPNNLG

SEQ ID NO: 1091414 - protein, 23 aa, Mycobacterium
NPPDELKYDFGLIDDALSKLADR

SEQ ID NO: 1091415 - protein, 23 aa, Mycobacterium
NPVQFICGGSFDTAAGKSAPDYY

SEQ ID NO: 1091416 - protein, 19 aa, Mycobacterium
NPYAVTWLIDSRQDRTGAD

SEQ ID NO: 1091417 - protein, 28 aa, Mycobacterium
NQFIGSLKYTLWRLQERVVGRGPGSPQL

SEQ ID NO: 1091418 - protein, 23 aa, Mycobacterium
NQIVPYLRAWESVIGHQRTGVYA

SEQ ID NO: 1091419 - protein, 25 aa, Mycobacterium
NRDEHRWQRPEVFDIFRERIPHISF

SEQ ID NO: 1091420 - protein, 22 aa, Mycobacterium
NRECAAAFAPYTGKAVDDNPYA

SEQ ID NO: 1091421 - protein, 19 aa, Mycobacterium
NRLPKVSWVVPNIIQSEHP

SEQ ID NO: 1091422 - protein, 20 aa, Mycobacterium
NRWFAAVLMASMVALVLTLG

SEQ ID NO: 1091423 - protein, 30 aa, Mycobacterium; identical to SEQ ID NO: 932212

SEQ ID NO: 1091424 - protein, 23 aa, Mycobacterium
NSDWPIGLVGVRTFASHDMVEIV

SEQ ID NO: 1091425 - protein, 23 aa, Mycobacterium
NSGDGNFGFAHAGSTNTGFWNSG

SEQ ID NO: 1091426 - protein, 24 aa, Mycobacterium
NSPNGYRTDVNWATQLSYSGVYVH

SEQ ID NO: 1091427 - protein, 18 aa, Mycobacterium
NTLHSFGIYGPQDYNAWL

SEQ ID NO: 1091428 - protein, 19 aa, Mycobacterium
NTLWASWAFVGPTHRAYFG

SEQ ID NO: 1091429 - protein, 24 aa, Mycobacterium
NTRSARPEVEFVLNDCGARIDLAP

SEQ ID NO: 1091430 - protein, 17 aa, Mycobacterium
NVLRRGFGGNGHKIAAV

SEQ ID NO: 1091431 - protein, 18 aa, Mycobacterium
NVYWITFAGLATVDNPRY

SEQ ID NO: 1091432 - protein, 18 aa, Mycobacterium
PADAAAIGESVWKVQMLS

SEQ ID NO: 1091433 - protein, 25 aa, Mycobacterium
PAEVQRLPLNVTWVNLTTGKSGSVT

SEQ ID NO: 1091434 - protein, 17 aa, Mycobacterium
PAFEWYYQSGISVAMPV

SEQ ID NO: 1091435 - protein, 20 aa, Mycobacterium
PAGELPRWWDSLPTDRPIVY

SEQ ID NO: 1091436 - protein, 18 aa, Mycobacterium
PAGTHWTPPTGVTMPGQA

SEQ ID NO: 1091437 - protein, 17 aa, Mycobacterium
PAIFTHRDVGNTDCPGN

SEQ ID NO: 1091438 - protein, 25 aa, Mycobacterium
PAKAGMQVSIPWPYSGNVHCEIDVD

SEQ ID NO: 1091439 - protein, 21 aa, Mycobacterium
PALLRLFPRASREFIGDPRYL

SEQ ID NO: 1091440 - protein, 20 aa, Mycobacterium
PALQRRWWAGRGQGAFTAVQ

SEQ ID NO: 1091441 - protein, 25 aa, Mycobacterium
PAPARRIGGHPAKRTFQALRIAVND

SEQ ID NO: 1091442 - protein, 25 aa, Mycobacterium
PAPDGVKLAAGWLLERAGFGKGYPG

SEQ ID NO: 1091443 - protein, 19 aa, Mycobacterium
PAPEPVAFEPPAPDVAPPP

SEQ ID NO: 1091444 - protein, 17 aa, Mycobacterium
PAPPAFLLLGPDALMAY

SEQ ID NO: 1091445 - protein, 26 aa, Mycobacterium
PARKLREIRMALTLDKTFTKPEILTR

SEQ ID NO: 1091446 - protein, 22 aa, Mycobacterium
PATELPRFAPPPDTTSVNAAGG

SEQ ID NO: 1091447 - protein, 20 aa, Mycobacterium
PAVVADATYAAAIDKRIKLR

SEQ ID NO: 1091448 - protein, 18 aa, Mycobacterium
PCDAPDWLDAALGNAPQG

SEQ ID NO: 1091449 - protein, 20 aa, Mycobacterium
PDAPVKIFLTASPETRARRR

SEQ ID NO: 1091450 - protein, 24 aa, Mycobacterium
PDDTPWGGKPVRKLQLPRDAVLVT

SEQ ID NO: 1091451 - protein, 28 aa, Mycobacterium
PDELVTFYSCLYRSLLHPNTFNDADGRY

SEQ ID NO: 1091452 - protein, 18 aa, Mycobacterium
PDMRTCLQESYQTRLAQL

SEQ ID NO: 1091453 - protein, 29 aa, Mycobacterium
PDMTKGYCPGGRWGWGELAVCDGEKYPDG

SEQ ID NO: 1091454 - protein, 25 aa, Mycobacterium
PDNLSDAGISWKVYQNKLLGALNNT

SEQ ID NO: 1091455 - protein, 23 aa, Mycobacterium
PDNPGRWDVNIGQLAGGDAGVRD

SEQ ID NO: 1091456 - protein, 27 aa, Mycobacterium
PDNPLPCAGVLEGPFGGFGFPAPLDGV

SEQ ID NO: 1091457 - protein, 17 aa, Mycobacterium
PDPGDLSFIMVGAPNNP

SEQ ID NO: 1091458 - protein, 24 aa, Mycobacterium
PDQPALRPLLDLLPIASGSGTLGE

SEQ ID NO: 1091459 - protein, 20 aa, Mycobacterium
PDRNLFMPMAFHLGYHSLPI

SEQ ID NO: 1091460 - protein, 20 aa, Mycobacterium
PDTLTAQVGIEFTSQDVTGA

SEQ ID NO: 1091461 - protein, 17 aa, Mycobacterium
PEAVEYGAANGFTITAM

SEQ ID NO: 1091462 - protein, 25 aa, Mycobacterium
PEFINRLDDVLIFDALNPDELVQIV

SEQ ID NO: 1091463 - protein, 17 aa, Mycobacterium
PEFLFVDLIDPCVVRNL

SEQ ID NO: 1091464 - protein, 21 aa, Mycobacterium
PEIASRLGGGIAAKAADEIAA

SEQ ID NO: 1091465 - protein, 17 aa, Mycobacterium
PEIYERLAAQTGESVPH

SEQ ID NO: 1091466 - protein, 24 aa, Mycobacterium
PEKLWTIADLGGWDTVDPQLFDKG

SEQ ID NO: 1091467 - protein, 21 aa, Mycobacterium
PEQWSGNFLFYNRGLFADGGV

SEQ ID NO: 1091468 - protein, 17 aa, Mycobacterium
PFGGFGFPAPLDGVESS

SEQ ID NO: 1091469 - protein, 24 aa, Mycobacterium
PFISYGAWDRYAVYAGVRGAHSRR

SEQ ID NO: 1091470 - protein, 20 aa, Mycobacterium
PFLYTYCRDDDPAVLIRGAR

SEQ ID NO: 1091471 - protein, 24 aa, Mycobacterium
PGAAAVGFPVLHIGNIGFANLSVG

SEQ ID NO: 1091472 - protein, 18 aa, Mycobacterium
PGAALALLAEAGEIDVLV

SEQ ID NO: 1091473 - protein, 20 aa, Mycobacterium
PGDEVRILGVPVGRIDSIEP

SEQ ID NO: 1091474 - protein, 20 aa, Mycobacterium
PGGLVPHVIPLASLGIAKGG

SEQ ID NO: 1091475 - protein, 26 aa, Mycobacterium
PGLPYLGLEHRAAWVEAEADGTITSM

SEQ ID NO: 1091476 - protein, 22 aa, Mycobacterium
PGMGSMVFPGYGTELLDWLDRA

SEQ ID NO: 1091477 - protein, 19 aa, Mycobacterium
PGNEALDFNPQRARQLWAQ

SEQ ID NO: 1091478 - protein, 23 aa, Mycobacterium
PGQIKKVCPWQSPPGHWVGGPHG

SEQ ID NO: 1091479 - protein, 20 aa, Mycobacterium
PGQPVPDWFCESTDLTELAT

SEQ ID NO: 1091480 - protein, 20 aa, Mycobacterium
PGSPCSYTPAADALPRPDNP

SEQ ID NO: 1091481 - protein, 23 aa, Mycobacterium
PGTEVPVVIDGSVWDAIAGCEAG

SEQ ID NO: 1091482 - protein, 17 aa, Mycobacterium
PGTPGWPGGIAGPTAAG

SEQ ID NO: 1091483 - protein, 19 aa, Mycobacterium
PHLRDGRPLAEPPAEESAR

SEQ ID NO: 1091484 - protein, 20 aa, Mycobacterium
PHPRKPRPAFQDASCPDVQL

SEQ ID NO: 1091485 - protein, 33 aa, Mycobacterium
PHPVSGCTFTAPEIRWFATRGAPGPAPPPILRG

SEQ ID NO: 1091486 - protein, 30 aa, Mycobacterium; identical to SEQ ID NO: 932821

SEQ ID NO: 1091487 - protein, 22 aa, Mycobacterium
PKRVRYEIFGAPGTIADINYMD

SEQ ID NO: 1091488 - protein, 18 aa, Mycobacterium
PKTTVTLYDGRTASFTVV

SEQ ID NO: 1091489 - protein, 18 aa, Mycobacterium
PKVKVVIPVDPAGDGGLM

SEQ ID NO: 1091490 - protein, 17 aa, Mycobacterium
PKWWGKKPRLHSITYLV

SEQ ID NO: 1091491 - protein, 18 aa, Mycobacterium
PLPVGTYCKIPMDTPANS

SEQ ID NO: 1091492 - protein, 24 aa, Mycobacterium
PLRYGELTAALGMNSGERGEPRAV

SEQ ID NO: 1091493 - protein, 19 aa, Mycobacterium
PLTLRIGYHGPNARLAAII

SEQ ID NO: 1091494 - protein, 23 aa, Mycobacterium
PNDYWDPSVNEIQLCYEDIQQSE

SEQ ID NO: 1091495 - protein, 18 aa, Mycobacterium
PNGAQLIADYLGWIGRCG

SEQ ID NO: 1091496 - protein, 17 aa, Mycobacterium
PNPEVYAPVTGFYSLRY

SEQ ID NO: 1091497 - protein, 17 aa, Mycobacterium
PNPQLPGLPALAQLSPI

SEQ ID NO: 1091498 - protein, 25 aa, Mycobacterium
PNTVRYRIRRVEKLLSTSFADPDVR

SEQ ID NO: 1091499 - protein, 26 aa, Mycobacterium
PNVPDAFAVIADRVGGNSVYTSNAQV

SEQ ID NO: 1091500 - protein, 18 aa, Mycobacterium
PPAPDAMIAPVDMPDGPA

SEQ ID NO: 1091501 - protein, 17 aa, Mycobacterium
PPASGWASALVDTLTGA

SEQ ID NO: 1091502 - protein, 23 aa, Mycobacterium
PPDTLVGPGCSAYAQQVPTGPGS

SEQ ID NO: 1091503 - protein, 19 aa, Mycobacterium
PPGVETWYRGAARISDLVD

SEQ ID NO: 1091504 - protein, 24 aa, Mycobacterium
PPIGYRLLLLVGVLALALTGCVGA

SEQ ID NO: 1091505 - protein, 19 aa, Mycobacterium
PPLGVPAPAAAPVEVAPPA

SEQ ID NO: 1091506 - protein, 21 aa, Mycobacterium
PPQAKRWLLGRIGAKRPRRAP

SEQ ID NO: 1091507 - protein, 18 aa, Mycobacterium
PPSDGRWWNTFSSAPDLI

SEQ ID NO: 1091508 - protein, 17 aa, Mycobacterium
PPSGPMVPPEHFSLPIH

SEQ ID NO: 1091509 - protein, 17 aa, Mycobacterium
PPVYVPWTPDFAGRNDF

SEQ ID NO: 1091510 - protein, 22 aa, Mycobacterium
PPYRVPFPQVMPSQETSPTRGI

SEQ ID NO: 1091511 - protein, 20 aa, Mycobacterium
PQLPGLPALAQLSPIIQQAA

SEQ ID NO: 1091512 - protein, 26 aa, Mycobacterium
PQPLRSKISFWFDRKYKVPADAKAAI

SEQ ID NO: 1091513 - protein, 21 aa, Mycobacterium
PQRQWRWPLGEIDKPFEMRRD

SEQ ID NO: 1091514 - protein, 38 aa, Mycobacterium; identical to SEQ ID NO: 933116

SEQ ID NO: 1091515 - protein, 25 aa, Mycobacterium
PQTLFFPFVMLLAATALYRGNDNKM

SEQ ID NO: 1091516 - protein, 20 aa, Mycobacterium
PRDDWVPFTGVPGYNHIKIK

SEQ ID NO: 1091517 - protein, 26 aa, Mycobacterium
PRGPYQWCPGEPVPAGGVNWDMNVCH

SEQ ID NO: 1091518 - protein, 17 aa, Mycobacterium
PRGTWAVGKPIQVTEAR

SEQ ID NO: 1091519 - protein, 18 aa, Mycobacterium
PRGTWAVGKPIQVTEARD

SEQ ID NO: 1091520 - protein, 19 aa, Mycobacterium
PRIRLLERLISGQVGNPAL

SEQ ID NO: 1091521 - protein, 21 aa, Mycobacterium
PRLRTLAIRPTLRRLAGLPTA

SEQ ID NO: 1091522 - protein, 25 aa, Mycobacterium
PRNAPGCAGCCQCAIGCPSNAKFGV

SEQ ID NO: 1091523 - protein, 20 aa, Mycobacterium
PRNEWLFTDAWGVDVAVSTP

SEQ ID NO: 1091524 - protein, 21 aa, Mycobacterium
PRQVTMFGCGQVQGIPDTLTA

SEQ ID NO: 1091525 - protein, 22 aa, Mycobacterium
PRRSSWQTAIGLMSLVVNNALG

SEQ ID NO: 1091526 - protein, 26 aa, Mycobacterium
PRSNMARYGIAPTYPLDFVADVASNR

SEQ ID NO: 1091527 - protein, 25 aa, Mycobacterium
PRTVFARAGSYYSDLAALSSGELAF

SEQ ID NO: 1091528 - protein, 26 aa, Mycobacterium
PRVYGRQALEYVIRRGGSQMGVPYSW

SEQ ID NO: 1091529 - protein, 20 aa, Mycobacterium
PRWEPDDLLRALGLRPPGHQ

SEQ ID NO: 1091530 - protein, 24 aa, Mycobacterium
PSGAMGRDIPVAFLAGGPHAAYLL

SEQ ID NO: 1091531 - protein, 18 aa, Mycobacterium
PSLAMSTKAQLVRATNPL

SEQ ID NO: 1091532 - protein, 20 aa, Mycobacterium
PSTAYKWSVELFATEMMSHF

SEQ ID NO: 1091533 - protein, 25 aa, Mycobacterium
PTATAFPWRRQSAVVQWYVETPSSG

SEQ ID NO: 1091534 - protein, 19 aa, Mycobacterium
PTGSFMFLGPTGVGKTELA

SEQ ID NO: 1091535 - protein, 26 aa, Mycobacterium
PTITARLNFQLAFGARVGQRLAEARE

SEQ ID NO: 1091536 - protein, 17 aa, Mycobacterium
PTITAWRDVDAVLSKTG

SEQ ID NO: 1091537 - protein, 22 aa, Mycobacterium
PTPDSPGGWVYIVADNFTRRDP

SEQ ID NO: 1091538 - protein, 23 aa, Mycobacterium
PTPGRYLLYLDFQVNGRVHTAQF

SEQ ID NO: 1091539 - protein, 20 aa, Mycobacterium
PTTSRLAVRAGLVSLAAASY

SEQ ID NO: 1091540 - protein, 19 aa, Mycobacterium
PTTYARCTARSAVAAPAAG

SEQ ID NO: 1091541 - protein, 24 aa, Mycobacterium
PVADPALVPLFFVAREARKHVKVV

SEQ ID NO: 1091542 - protein, 19 aa, Mycobacterium
PVAQYWPEFAANGKEKPTV

SEQ ID NO: 1091543 - protein, 18 aa, Mycobacterium
PVELARTVVDLTITGMTS

SEQ ID NO: 1091544 - protein, 22 aa, Mycobacterium
PVFAQRCVTLLAPALTRHHADG

SEQ ID NO: 1091545 - protein, 23 aa, Mycobacterium
PVGDGTCYWKRMSNPDGALIDNA

SEQ ID NO: 1091546 - protein, 23 aa, Mycobacterium
PVGELDLLAAYIAVAATASLSLS

SEQ ID NO: 1091547 - protein, 18 aa, Mycobacterium
PVIEKAYGAGPCSGHLTD

SEQ ID NO: 1091548 - protein, 24 aa, Mycobacterium
PVIEKAYGAGPCSGHLTDIEHFVF

SEQ ID NO: 1091549 - protein, 18 aa, Mycobacterium
PVINRRGVLAGGATLTVL

SEQ ID NO: 1091550 - protein, 19 aa, Mycobacterium
PVINRRGVLAGGATLTVLG

SEQ ID NO: 1091551 - protein, 17 aa, Mycobacterium
PVRAAALQDYWNYDSGV

SEQ ID NO: 1091552 - protein, 22 aa, Mycobacterium
PVVDVWKGWADRMGEVPWSADS

SEQ ID NO: 1091553 - protein, 17 aa, Mycobacterium
PYFDEMFLGRGQVATIL

SEQ ID NO: 1091554 - protein, 19 aa, Mycobacterium
PYGLAGSNQLAWVSQTAAN

SEQ ID NO: 1091555 - protein, 24 aa, Mycobacterium
QAAEVPRELGVPVAPVVPAVLVAP

SEQ ID NO: 1091556 - protein, 22 aa, Mycobacterium
QADCFAGVYLYWVAEGKSPRFR

SEQ ID NO: 1091557 - protein, 19 aa, Mycobacterium
QAGAIAFASPLSYPVVADE

SEQ ID NO: 1091558 - protein, 25 aa, Mycobacterium
QAIDLLKGVLVSSIMQAVQNGGAAA

SEQ ID NO: 1091559 - protein, 20 aa, Mycobacterium
QALFGRPLIGNGANGTATSP

SEQ ID NO: 1091560 - protein, 22 aa, Mycobacterium
QALLGRPLIGDGADGTAPGQAG

SEQ ID NO: 1091561 - protein, 27 aa, Mycobacterium
QAPEGPCETIGGLVLRQLGHIPVAGET

SEQ ID NO: 1091562 - protein, 17 aa, Mycobacterium
QAPRGPYQWCPGEPVPA

SEQ ID NO: 1091563 - protein, 24 aa, Mycobacterium
QARPVLEPMAGKIIHCGAAGAGQA

SEQ ID NO: 1091564 - protein, 17 aa, Mycobacterium
QASQLGRDWCAQGAQVE

SEQ ID NO: 1091565 - protein, 18 aa, Mycobacterium
QASVPIPSPRPDVVPGPV

SEQ ID NO: 1091566 - protein, 23 aa, Mycobacterium
QASVPIPSPRPDVVPGPVAPTPS

SEQ ID NO: 1091567 - protein, 25 aa, Mycobacterium
QAYQFPMGLGLVSQFFGKYFSPAEA

SEQ ID NO: 1091568 - protein, 24 aa, Mycobacterium
QDASMLMYPFSMAMSPLMNLMSSS

SEQ ID NO: 1091569 - protein, 34 aa, Mycobacterium
QDLLGMVNALAAAVLGRPLIGNGTNGAPGSGDAG

SEQ ID NO: 1091570 - protein, 26 aa, Mycobacterium
QFVQSMATSAWQWADRARQGVETLID

SEQ ID NO: 1091571 - protein, 18 aa, Mycobacterium
QGHYDCPEHGRIDPLPRR

SEQ ID NO: 1091572 - protein, 27 aa, Mycobacterium
QGIELHFFDYQFGHGLPVITVPWSALT

SEQ ID NO: 1091573 - protein, 25 aa, Mycobacterium
QGRLRKGSLIPLSRGGAYPSTEQTL

SEQ ID NO: 1091574 - protein, 17 aa, Mycobacterium
QHCPPWTLDSSAITTTT

SEQ ID NO: 1091575 - protein, 17 aa, Mycobacterium
QHIEKFIPRQITNVLTG

SEQ ID NO: 1091576 - protein, 20 aa, Mycobacterium
QIISSIKWAPDETGIIPTSG

SEQ ID NO: 1091577 - protein, 32 aa, Mycobacterium
QISTRVAEFHAQFERVFAAGVQAYSGAEAANA

SEQ ID NO: 1091578 - protein, 23 aa, Mycobacterium
QIVNPRWSPTGKQIAFLQNDSNG

SEQ ID NO: 1091579 - protein, 30 aa, Mycobacterium
QKKARVSFIPDRAGVDYAQLFTATSLMPSH

SEQ ID NO: 1091580 - protein, 20 aa, Mycobacterium
QKYEARLGVYVPGTDATAAV

SEQ ID NO: 1091581 - protein, 21 aa, Mycobacterium
QLAAPLRRLTGLSGTTGALAK

SEQ ID NO: 1091582 - protein, 18 aa, Mycobacterium
QLLDGLLLVSGNDAANTL

SEQ ID NO: 1091583 - protein, 27 aa, Mycobacterium
QLSGGMCQRALIAIGLAGRPALLIADE

SEQ ID NO: 1091584 - protein, 24 aa, Mycobacterium
QLSGLRLGTVLSISEGVGTRPSPG

SEQ ID NO: 1091585 - protein, 24 aa, Mycobacterium
QLTPAGLIVSEWAARLLEVAQEID

SEQ ID NO: 1091586 - protein, 22 aa, Mycobacterium
QMPLPVMIGLALLSAALSTAPA

SEQ ID NO: 1091587 - protein, 31 aa, Mycobacterium; identical to SEQ ID NO: 933668

SEQ ID NO: 1091588 - protein, 21 aa, Mycobacterium
QNSGFPMAEWAVTRRAQLDDR

SEQ ID NO: 1091589 - protein, 18 aa, Mycobacterium
QPEGLPAGAALVVMLHGG

SEQ ID NO: 1091590 - protein, 25 aa, Mycobacterium
QPRVVRCTQIEWYRTIQIGDQASGV

SEQ ID NO: 1091591 - protein, 18 aa, Mycobacterium
QQALRTLQNRVAGATTAL

SEQ ID NO: 1091592 - protein, 23 aa, Mycobacterium
QQSFRIHGGYGYSKEYEIERLMR

SEQ ID NO: 1091593 - protein, 25 aa, Mycobacterium
QQSWVVSFQLNWPRDHGPTVTSWML

SEQ ID NO: 1091594 - protein, 27 aa, Mycobacterium
QRDGLSLGEALTLWLSGQEQLVPRDLV

SEQ ID NO: 1091595 - protein, 21 aa, Mycobacterium
QRGPVTLLFLGLDRLKAVNDY

SEQ ID NO: 1091596 - protein, 26 aa, Mycobacterium
QRGVIPRDHIKEVLDSADVLIWLTES

SEQ ID NO: 1091597 - protein, 25 aa, Mycobacterium
QRHELPRGDLDRVVRQQAVMASLAH

SEQ ID NO: 1091598 - protein, 18 aa, Mycobacterium
QRLFGRRLADFFTGRDPR

SEQ ID NO: 1091599 - protein, 25 aa, Mycobacterium
QRRAVPMNAVYRWPALGAVATALTR

SEQ ID NO: 1091600 - protein, 25 aa, Mycobacterium
QRTRVTEVLSRIYGHPVTVQLQTDP

SEQ ID NO: 1091601 - protein, 22 aa, Mycobacterium
QRVGCGFITWSLARNPELLDLI

SEQ ID NO: 1091602 - protein, 25 aa, Mycobacterium
QSAKLCVQYLAPIIKNRQYNFLPFG

SEQ ID NO: 1091603 - protein, 30 aa, Mycobacterium; identical to SEQ ID NO: 933798

SEQ ID NO: 1091604 - protein, 18 aa, Mycobacterium
QSGWGAGHGGLFNRTSWV

SEQ ID NO: 1091605 - protein, 17 aa, Mycobacterium
QSNESFVYLARAVDPVI

SEQ ID NO: 1091606 - protein, 30 aa, Mycobacterium
QTISAQAAVFHGRFVAALDAAADSYAGAEA

SEQ ID NO: 1091607 - protein, 25 aa, Mycobacterium
QTPRATAVAGRWSAERANTWYQTQG

SEQ ID NO: 1091608 - protein, 30 aa, Mycobacterium
QTTYKAFNWDQAYRKPITWEKLWQPETDPL

SEQ ID NO: 1091609 - protein, 24 aa, Mycobacterium
QVEMPRWSTNRVVLVGDACSAGSP

SEQ ID NO: 1091610 - protein, 29 aa, Mycobacterium
QVLERLKYLPLDPFRISYAYTNFGVTAAA

SEQ ID NO: 1091611 - protein, 26 aa, Mycobacterium
QVLSAKAAEFHDRFVEILQTSAQAYG

SEQ ID NO: 1091612 - protein, 19 aa, Mycobacterium
QVRVLPPFLSRKHLPSRLA

SEQ ID NO: 1091613 - protein, 26 aa, Mycobacterium
QVSGRFGIGLVDWVMRSEAGLLEDAL

SEQ ID NO: 1091614 - protein, 17 aa, Mycobacterium
QVTCDDLVLAWAAESGR

SEQ ID NO: 1091615 - protein, 18 aa, Mycobacterium
QVVLDVFGAPGAVATINY

SEQ ID NO: 1091616 - protein, 20 aa, Mycobacterium
QYGAQGIRCNAVAPGVIQTA

SEQ ID NO: 1091617 - protein, 18 aa, Mycobacterium
QYNFLPFGQNLFVGASAR

SEQ ID NO: 1091618 - protein, 28 aa, Mycobacterium
QYTVEAQRLWAQAGFRPVDPAVVVEFRD

SEQ ID NO: 1091619 - protein, 17 aa, Mycobacterium
RAAAAGFRGDVAETVAI

SEQ ID NO: 1091620 - protein, 19 aa, Mycobacterium
RAAAQWSHPEPTALAGVPG

SEQ ID NO: 1091621 - protein, 23 aa, Mycobacterium
RAAEARYQRSFGIVDGYGGHGIG

SEQ ID NO: 1091622 - protein, 25 aa, Mycobacterium
RAAEPWEVAATIAFLASEYSSYLTG

SEQ ID NO: 1091623 - protein, 23 aa, Mycobacterium
RAALDRWGRIDFLINAAGEGSPK

SEQ ID NO: 1091624 - protein, 19 aa, Mycobacterium
RAALRDRFAGMGWLVPEVL

SEQ ID NO: 1091625 - protein, 19 aa, Mycobacterium
RAATPLILAIASLCALVAT

SEQ ID NO: 1091626 - protein, 21 aa, Mycobacterium
RADGLSVVPIMLARILDLPDQ

SEQ ID NO: 1091627 - protein, 21 aa, Mycobacterium
RAELPTHSFAFIGTETASATT

SEQ ID NO: 1091628 - protein, 23 aa, Mycobacterium
RAGDSRLATVLAELDDADTRAAV

SEQ ID NO: 1091629 - protein, 28 aa, Mycobacterium
RAGPPEHLKWIGQWGIFDALRSGSEVVR

SEQ ID NO: 1091630 - protein, 24 aa, Mycobacterium
RAGTGLPRQPRGAITAGAALTADA

SEQ ID NO: 1091631 - protein, 17 aa, Mycobacterium
RAIDPQFFAARKLPDGL

SEQ ID NO: 1091632 - protein, 28 aa, Mycobacterium
RAIGEAGGLGLASRTAIATGAAGSAGSA

SEQ ID NO: 1091633 - protein, 22 aa, Mycobacterium
RAIHFQEWWVRYRAELPTHSFA

SEQ ID NO: 1091634 - protein, 23 aa, Mycobacterium
RAIWVGGRVPPAGAIRELLSHIT

SEQ ID NO: 1091635 - protein, 26 aa, Mycobacterium
RAPAPSRFLGCVEVPLGHVDPEPPER

SEQ ID NO: 1091636 - protein, 21 aa, Mycobacterium
RARFVDFLERVVVKRSIKRHP

SEQ ID NO: 1091637 - protein, 20 aa, Mycobacterium
RARTAYFMVGFSGPIPDDKW

SEQ ID NO: 1091638 - protein, 26 aa, Mycobacterium
RATSLAEGWVPFGISLGEARDWLSRF

SEQ ID NO: 1091639 - protein, 25 aa, Mycobacterium
RAVIVSVNAEMIWGVTIDNKDEAGN

SEQ ID NO: 1091640 - protein, 18 aa, Mycobacterium
RCTEEVQTILRWAGANRV

SEQ ID NO: 1091641 - protein, 24 aa, Mycobacterium
RDAQLAFRCRIQPVFQNPYSSLDP

SEQ ID NO: 1091642 - protein, 24 aa, Mycobacterium
RDHLARALSGWSAAELHEFNRLLS

SEQ ID NO: 1091643 - protein, 24 aa, Mycobacterium
RDLTTRIYNDFTYRSGSTTVSTRV

SEQ ID NO: 1091644 - protein, 18 aa, Mycobacterium
RDRLRSGNLQELIDTKSV

SEQ ID NO: 1091645 - protein, 20 aa, Mycobacterium
RDVAVLQMRGAGGLPAAAIG

SEQ ID NO: 1091646 - protein, 21 aa, Mycobacterium
REAGRAVGPRGIINVASAAAF

SEQ ID NO: 1091647 - protein, 21 aa, Mycobacterium
REASEAICAGGSVTAVAPVAA

SEQ ID NO: 1091648 - protein, 21 aa, Mycobacterium
REEMRLLAWELLANRGGSRPA

SEQ ID NO: 1091649 - protein, 20 aa, Mycobacterium
REIDGLLPTLIRGQGTEFDS

SEQ ID NO: 1091650 - protein, 24 aa, Mycobacterium
RELFCARDPFGIKPLFMATGPGGT

SEQ ID NO: 1091651 - protein, 20 aa, Mycobacterium
RELLYLAAAFDIYGRLYAWL

SEQ ID NO: 1091652 - protein, 19 aa, Mycobacterium
RERIPHISFAAGEHTCLGL

SEQ ID NO: 1091653 - protein, 27 aa, Mycobacterium
RESRGAPWRRGEFRAVDSVSFRLRRAS

SEQ ID NO: 1091654 - protein, 25 aa, Mycobacterium
REVLPHLRPGSAIINITSTFAVVGG

SEQ ID NO: 1091655 - protein, 27 aa, Mycobacterium
RFAPLRWSVLRLALAFRTLLRTGQVGD

SEQ ID NO: 1091656 - protein, 18 aa, Mycobacterium
RFGDGNTYYAEFSNVSNL

SEQ ID NO: 1091657 - protein, 20 aa, Mycobacterium
RFGSGNIGFGNRFGDGNFGS

SEQ ID NO: 1091658 - protein, 22 aa, Mycobacterium
RFRMVITSTICTTVICTGATAI

SEQ ID NO: 1091659 - protein, 27 aa, Mycobacterium
RGAEDPRVGGLIARVQLPPAPIGAVQA

SEQ ID NO: 1091660 - protein, 25 aa, Mycobacterium
RGDERFAFCSTFKGLLGAAVLHRYS

SEQ ID NO: 1091661 - protein, 20 aa, Mycobacterium
RGDTLLALADMYMRRDSHGH

SEQ ID NO: 1091662 - protein, 23 aa, Mycobacterium
RGDVAALALIRFPATGDKIGSLV

SEQ ID NO: 1091663 - protein, 21 aa, Mycobacterium
RGGGPVQRWRRGTPFDLHLMM

SEQ ID NO: 1091664 - protein, 19 aa, Mycobacterium
RGGQLLRIGAPEVDAIEAN

SEQ ID NO: 1091665 - protein, 20 aa, Mycobacterium
RGIADAWAAEGIETHVFSRT

SEQ ID NO: 1091666 - protein, 21 aa, Mycobacterium
RGLRDAGLLPVLKHFPGHGRA

SEQ ID NO: 1091667 - protein, 17 aa, Mycobacterium
RGLRVFPTSAGRAAASQ

SEQ ID NO: 1091668 - protein, 17 aa, Mycobacterium
RGLSFDMWVYGHQLPDA

SEQ ID NO: 1091669 - protein, 27 aa, Mycobacterium
RGLSMAHLRGTLDIFARAEFGPSTRTR

SEQ ID NO: 1091670 - protein, 19 aa, Mycobacterium
RGMTPRAALTKHLLDGDDS

SEQ ID NO: 1091671 - protein, 29 aa, Mycobacterium
RGPMTLWADRIVLCAGAIGSAHLLMLSGI

SEQ ID NO: 1091672 - protein, 19 aa, Mycobacterium
RGSDGVVIPGSYRNRHKAV

SEQ ID NO: 1091673 - protein, 22 aa, Mycobacterium
RGTRLPVWLSKWGYQHPAEQSM

SEQ ID NO: 1091674 - protein, 20 aa, Mycobacterium
RGVASSRPALWCNSDADNDR

SEQ ID NO: 1091675 - protein, 20 aa, Mycobacterium
RHIHDVKAAIAWARANVDKF

SEQ ID NO: 1091676 - protein, 17 aa, Mycobacterium
RHLRDIVLGVVRGGQLL

SEQ ID NO: 1091677 - protein, 20 aa, Mycobacterium
RHRASVGAVGPPDCSATAGQ

SEQ ID NO: 1091678 - protein, 20 aa, Mycobacterium
RHRRPALHAVVAAFVLVCSA

SEQ ID NO: 1091679 - protein, 17 aa, Mycobacterium
RHYWPVTLIAVIVSRHC

SEQ ID NO: 1091680 - protein, 24 aa, Mycobacterium
RIGAKRPRRAPTIAASVIAALTPS

SEQ ID NO: 1091681 - protein, 26 aa, Mycobacterium
RIGELCAPGSRIAVGALGSRLDRKQL

SEQ ID NO: 1091682 - protein, 17 aa, Mycobacterium
RIIANSVVRCVGNTLLL

SEQ ID NO: 1091683 - protein, 20 aa, Mycobacterium
RIPGPPGPHVDDWANWHQVP

SEQ ID NO: 1091684 - protein, 29 aa, Mycobacterium
RIPHAIRRLAVPIVLLWLALAAITNASVP

SEQ ID NO: 1091685 - protein, 19 aa, Mycobacterium
RIRIAAGIAALAVAVSGCS

SEQ ID NO: 1091686 - protein, 21 aa, Mycobacterium
RIRPSMLEFMDSVAINAVEDT

SEQ ID NO: 1091687 - protein, 20 aa, Mycobacterium
RITSFPPDWSNVGFDAETRA

SEQ ID NO: 1091688 - protein, 21 aa, Mycobacterium
RKSGARRAWLASLAEEPRTCV

SEQ ID NO: 1091689 - protein, 19 aa, Mycobacterium
RLAPIPGVETLALDVTDDT

SEQ ID NO: 1091690 - protein, 30 aa, Mycobacterium; identical to SEQ ID NO: 934408

SEQ ID NO: 1091691 - protein, 19 aa, Mycobacterium
RLGGPRLKDVAGLSLTKLF

SEQ ID NO: 1091692 - protein, 25 aa, Mycobacterium
RLIETRFGVPVPNLTPWRRSVTEDM

SEQ ID NO: 1091693 - protein, 29 aa, Mycobacterium
RLLEQRFGVPVPNLTTWRRGVTGDMTSTF

SEQ ID NO: 1091694 - protein, 25 aa, Mycobacterium
RLLGKPAYHALTFGWLMSGLARAVT

SEQ ID NO: 1091695 - protein, 21 aa, Mycobacterium
RLLLRSMGYRDALIGGLLATA

SEQ ID NO: 1091696 - protein, 17 aa, Mycobacterium
RLLPARFNAALAQSEPI

SEQ ID NO: 1091697 - protein, 29 aa, Mycobacterium
RLLTRLSAFKVPHRFAVVERLPRTANGKL

SEQ ID NO: 1091698 - protein, 18 aa, Mycobacterium
RLNNFWVCLINGVSGVFG

SEQ ID NO: 1091699 - protein, 19 aa, Mycobacterium
RLRRSRLPASAARQRDRRG

SEQ ID NO: 1091700 - protein, 34 aa, Mycobacterium
RLSRSIRAGVGWRRGCVWCRRAGRHFAATARRAG

SEQ ID NO: 1091701 - protein, 20 aa, Mycobacterium
RLSVLSLPTTFIFDTDGRQR

SEQ ID NO: 1091702 - protein, 18 aa, Mycobacterium
RLTLRIYAYNSCCNDSYP

SEQ ID NO: 1091703 - protein, 20 aa, Mycobacterium
RLVAACIEAGISVTCLPGPS

SEQ ID NO: 1091704 - protein, 23 aa, Mycobacterium
RLVRAGKVAKDWDAAATRGIPFE

SEQ ID NO: 1091705 - protein, 19 aa, Mycobacterium
RLWTESLFRERGVKAITQA

SEQ ID NO: 1091706 - protein, 24 aa, Mycobacterium
RMATGESRGAFSMSEPELGSDVAA

SEQ ID NO: 1091707 - protein, 20 aa, Mycobacterium
RMIRFSWQSFLVDTDQFVGW

SEQ ID NO: 1091708 - protein, 25 aa, Mycobacterium
RMRPDLDVRLAFCELNSPGLVEVLN

SEQ ID NO: 1091709 - protein, 18 aa, Mycobacterium
RMSALGAEVVFVERSPGP

SEQ ID NO: 1091710 - protein, 23 aa, Mycobacterium
RNPLPCLRAVISSGDRLDPSLAR

SEQ ID NO: 1091711 - protein, 20 aa, Mycobacterium
RNRRAVALCTPRDAISRDAG

SEQ ID NO: 1091712 - protein, 17 aa, Mycobacterium
RNVGGKLLKARLREQIQ

SEQ ID NO: 1091713 - protein, 20 aa, Mycobacterium
RPATKELPFGQNISAVLISP

SEQ ID NO: 1091714 - protein, 25 aa, Mycobacterium
RPELGLRPRLAIGIHQPPVAARRPP

SEQ ID NO: 1091715 - protein, 19 aa, Mycobacterium
RPGTRGRALTYGRTHLLRL

SEQ ID NO: 1091716 - protein, 18 aa, Mycobacterium
RPRQDLFTDYGRVFPDAD

SEQ ID NO: 1091717 - protein, 23 aa, Mycobacterium
RPRREFSAMSFAAVNTVFRDSRA

SEQ ID NO: 1091718 - protein, 26 aa, Mycobacterium
RPSEVKASAPARVRLGEGWISDPVDL

SEQ ID NO: 1091719 - protein, 24 aa, Mycobacterium
RPYPIARAELQQMLMEAYGIDDIH

SEQ ID NO: 1091720 - protein, 20 aa, Mycobacterium
RQGNIPACMGYYTRADLPIH

SEQ ID NO: 1091721 - protein, 17 aa, Mycobacterium
RQHWGIENSLHWIRDVT

SEQ ID NO: 1091722 - protein, 24 aa, Mycobacterium
RQKIYPGIVAPSWTADYGSETLNH

SEQ ID NO: 1091723 - protein, 24 aa, Mycobacterium
RQKLTGPQALAFVRQRHELPRGDL

SEQ ID NO: 1091724 - protein, 24 aa, Mycobacterium
RQQEDPRWTCSHAMALQDSVLAEA

SEQ ID NO: 1091725 - protein, 26 aa, Mycobacterium
RQTTEIRSSNRLAYLGAHATSQFERV

SEQ ID NO: 1091726 - protein, 17 aa, Mycobacterium
RRAPARGPVPGGADQPA

SEQ ID NO: 1091727 - protein, 19 aa, Mycobacterium
RRARQEWLTERLATLDGDK

SEQ ID NO: 1091728 - protein, 26 aa, Mycobacterium
RRDDELRIPIGVTGTGEPLMFDLKDE

SEQ ID NO: 1091729 - protein, 30 aa, Mycobacterium
RRDVREPRWTWRLRRRCRRNWFVRQRSGRR

SEQ ID NO: 1091730 - protein, 27 aa, Mycobacterium
RRFCIPAVEAKGSLLLEDVGVPLPNLR

SEQ ID NO: 1091731 - protein, 17 aa, Mycobacterium
RRFGGGALAVYLDGQPV

SEQ ID NO: 1091732 - protein, 25 aa, Mycobacterium
RRGGSQMGVPYSWGGGSLQGPSKGV

SEQ ID NO: 1091733 - protein, 24 aa, Mycobacterium
RRGMAQIGVPYSWGGGNAAGPSKG

SEQ ID NO: 1091734 - protein, 25 aa, Mycobacterium
RRGRVCAGMAVLRIRRRGPKVRANL

SEQ ID NO: 1091735 - protein, 19 aa, Mycobacterium
RRGVVLATGGFEWDPVLVR

SEQ ID NO: 1091736 - protein, 19 aa, Mycobacterium
RRGWLEALLGHFCDPTVAL

SEQ ID NO: 1091737 - protein, 21 aa, Mycobacterium
RRKHYAIQAVVAFPSAHDASA

SEQ ID NO: 1091738 - protein, 17 aa, Mycobacterium
RRLALLLTYQRFLPTTG

SEQ ID NO: 1091739 - protein, 19 aa, Mycobacterium
RRNRLRRATVLTAAAALVL

SEQ ID NO: 1091740 - protein, 21 aa, Mycobacterium
RRRAGLPYGRIAKALEDRLCR

SEQ ID NO: 1091741 - protein, 27 aa, Mycobacterium
RRRGDRWYWHWDPRFISGTAAFLPIEV

SEQ ID NO: 1091742 - protein, 17 aa, Mycobacterium
RRRSLRFESSPHGKRID

SEQ ID NO: 1091743 - protein, 17 aa, Mycobacterium
RRSDAPRLVDLVRQSQS

SEQ ID NO: 1091744 - protein, 18 aa, Mycobacterium
RRSGLIALLCKTDPHATP

SEQ ID NO: 1091745 - protein, 20 aa, Mycobacterium
RRTEGRFALYSVSDPAESRE

SEQ ID NO: 1091746 - protein, 31 aa, Mycobacterium; identical to SEQ ID NO: 1054590

SEQ ID NO: 1091747 - protein, 19 aa, Mycobacterium
RSIGPLGLAGRQRSQVVPG

SEQ ID NO: 1091748 - protein, 24 aa, Mycobacterium
RSLQAGTDIALWVSTEEVPAVLDR

SEQ ID NO: 1091749 - protein, 18 aa, Mycobacterium
RSLRDFSNTYDAAARDIV

SEQ ID NO: 1091750 - protein, 20 aa, Mycobacterium
RSLSVMRIRRSIRYALAALC

SEQ ID NO: 1091751 - protein, 19 aa, Mycobacterium
RSNLARFGIAPTYPQDFVL

SEQ ID NO: 1091752 - protein, 20 aa, Mycobacterium
RSSGNLLYLLLAHPDQFMAV

SEQ ID NO: 1091753 - protein, 19 aa, Mycobacterium
RSWLAAILIPVAVLAVACG

SEQ ID NO: 1091754 - protein, 19 aa, Mycobacterium
RTDSIAALIADVARANQRL

SEQ ID NO: 1091755 - protein, 18 aa, Mycobacterium
RTHLLRLVAIKRLQGQGL

SEQ ID NO: 1091756 - protein, 20 aa, Mycobacterium
RTPAGLPIELPGHGPRFRLL

SEQ ID NO: 1091757 - protein, 19 aa, Mycobacterium
RTRIRPHFFPFTEPSAEVD

SEQ ID NO: 1091758 - protein, 19 aa, Mycobacterium
RTTVLLDEIVTLVGNDARL

SEQ ID NO: 1091759 - protein, 17 aa, Mycobacterium
RTYAQLFVLIGAANDVR

SEQ ID NO: 1091760 - protein, 22 aa, Mycobacterium
RVAELLPQVFQWAREVDPSQPL

SEQ ID NO: 1091761 - protein, 23 aa, Mycobacterium
RVFEELSLRGCVAALDGSDVIRA

SEQ ID NO: 1091762 - protein, 21 aa, Mycobacterium
RVGELPARVLAVTPGIDDLTP

SEQ ID NO: 1091763 - protein, 23 aa, Mycobacterium
RVHWRPREYYPAGTTVSVDAKLY

SEQ ID NO: 1091764 - protein, 27 aa, Mycobacterium
RVIAVEGAYLRRALPDHTPAAIRSGIE

SEQ ID NO: 1091765 - protein, 29 aa, Mycobacterium
RVKWMLRARPADYLLAMSVAGASLPVVGK

SEQ ID NO: 1091766 - protein, 17 aa, Mycobacterium
RVLAETGATVVLAASAA

SEQ ID NO: 1091767 - protein, 27 aa, Mycobacterium
RVLAGQGPAAWPKCSSAGGLPPVPVVL

SEQ ID NO: 1091768 - protein, 17 aa, Mycobacterium
RVNDPRNEWLFTDAWGV

SEQ ID NO: 1091769 - protein, 20 aa, Mycobacterium
RVQRPLWASTGVKNPDYSDT

SEQ ID NO: 1091770 - protein, 17 aa, Mycobacterium
RVVSLFDRVEALRVGAL

SEQ ID NO: 1091771 - protein, 28 aa, Mycobacterium
RWAWQTRAWSGHRIYPAAVLYQRVVSTK

SEQ ID NO: 1091772 - protein, 18 aa, Mycobacterium
RWRATVVQMDGRRIDLLE

SEQ ID NO: 1091773 - protein, 25 aa, Mycobacterium
RWSKCRRARRLAFAALAVLCVGLVA

SEQ ID NO: 1091774 - protein, 25 aa, Mycobacterium
RWVKAKRATFKYGLGTEFIEVLKTL

SEQ ID NO: 1091775 - protein, 18 aa, Mycobacterium
RYALAALCAVTLVSSGCA

SEQ ID NO: 1091776 - protein, 17 aa, Mycobacterium
RYEVHFACDPRYNNLLG

SEQ ID NO: 1091777 - protein, 17 aa, Mycobacterium
RYFEAWVNQTVSMLSQY

SEQ ID NO: 1091778 - protein, 17 aa, Mycobacterium
RYRAELPTHSFAFIGTE

SEQ ID NO: 1091779 - protein, 21 aa, Mycobacterium
SAAELSRWAFAGHIHYLLIDD

SEQ ID NO: 1091780 - protein, 22 aa, Mycobacterium
SAAQSFAAITVGLVGEAWQGAA

SEQ ID NO: 1091781 - protein, 24 aa, Mycobacterium
SADSARPAVATVLSGREASEAICA

SEQ ID NO: 1091782 - protein, 20 aa, Mycobacterium
SAFHTEFTRALAAAGAAYAQ

SEQ ID NO: 1091783 - protein, 19 aa, Mycobacterium
SAGEAFGRAAEPWEVAATI

SEQ ID NO: 1091784 - protein, 20 aa, Mycobacterium
SAGEFPGDRGGSGGAGARGG

SEQ ID NO: 1091785 - protein, 27 aa, Mycobacterium
SAGQRRKLLLARAVLSPARIVLLDEPT

SEQ ID NO: 1091786 - protein, 25 aa, Mycobacterium
SALGGRAGLFIGEPGTGWVADPGNG

SEQ ID NO: 1091787 - protein, 22 aa, Mycobacterium
SAPLFHNIAAWLMQRENVPLSA

SEQ ID NO: 1091788 - protein, 29 aa, Mycobacterium
SAPTLAAATAWDGLVAELGEAAEAFSSVT

SEQ ID NO: 1091789 - protein, 19 aa, Mycobacterium
SARPWRFGLGLVLSTQGHR

SEQ ID NO: 1091790 - protein, 24 aa, Mycobacterium
SARTPCLVTGWAIRADPSGTSLVP

SEQ ID NO: 1091791 - protein, 19 aa, Mycobacterium
SASAGVGAWLLARNSGPQR

SEQ ID NO: 1091792 - protein, 20 aa, Mycobacterium
SASRARGTWRATRASAGYSS

SEQ ID NO: 1091793 - protein, 31 aa, Mycobacterium; identical to SEQ ID NO: 935109

SEQ ID NO: 1091794 - protein, 17 aa, Mycobacterium
SATARRALAEGADVVIS

SEQ ID NO: 1091795 - protein, 27 aa, Mycobacterium
SATEAIEYSRFADWKFGSADVPAAPPD

SEQ ID NO: 1091796 - protein, 17 aa, Mycobacterium
SAVNTARPWSYSTNNDH

SEQ ID NO: 1091797 - protein, 19 aa, Mycobacterium
SAWNLPKGLVAVVTASTAA

SEQ ID NO: 1091798 - protein, 18 aa, Mycobacterium
SCAGAVRLNPLTRPSETT

SEQ ID NO: 1091799 - protein, 20 aa, Mycobacterium
SDAITVFLALVVVTSVSMVF

SEQ ID NO: 1091800 - protein, 23 aa, Mycobacterium
SDFLRPGHNVDLVLVAVNQSPDL

SEQ ID NO: 1091801 - protein, 26 aa, Mycobacterium
SDGEPATEWTLNWAHELIDKAPHPKH

SEQ ID NO: 1091802 - protein, 22 aa, Mycobacterium
SDPEFNVAGLFDRTGQLPEAAE

SEQ ID NO: 1091803 - protein, 23 aa, Mycobacterium
SDPSRPVDCIVRVRAKDGSETGR

SEQ ID NO: 1091804 - protein, 23 aa, Mycobacterium
SDRRPGGAWMLGKPIQIGEARDL

SEQ ID NO: 1091805 - protein, 19 aa, Mycobacterium
SDWRSMVATIARRTRRRSL

SEQ ID NO: 1091806 - protein, 21 aa, Mycobacterium
SEGRHGPFFPQCGGVSDQTVT

SEQ ID NO: 1091807 - protein, 21 aa, Mycobacterium
SEGWWPTLIGLAMNDSGGYNA

SEQ ID NO: 1091808 - protein, 30 aa, Mycobacterium
SESGVAGTWNMRWADLSLPPQAAVIVAAAA

SEQ ID NO: 1091809 - protein, 20 aa, Mycobacterium
SEVPRYGFKPTVVMHPPAAG

SEQ ID NO: 1091810 - protein, 35 aa, Mycobacterium; identical to SEQ ID NO: 1055226

SEQ ID NO: 1091811 - protein, 21 aa, Mycobacterium
SFADPDVRLVFSLGLRATDHS

SEQ ID NO: 1091812 - protein, 26 aa, Mycobacterium
SFAGQGVGFGGWYSPIALRVDTASVD

SEQ ID NO: 1091813 - protein, 24 aa, Mycobacterium
SFFARAAPEQGLRWAQQEIEWAKW

SEQ ID NO: 1091814 - protein, 23 aa, Mycobacterium
SFLCGAIQAASRLGYEQSAKLCV

SEQ ID NO: 1091815 - protein, 23 aa, Mycobacterium
SFNTVLFNTGFRTAGIANSATNG

SEQ ID NO: 1091816 - protein, 19 aa, Mycobacterium
SFVFRHRAGNAVILVLMLV

SEQ ID NO: 1091817 - protein, 17 aa, Mycobacterium
SFWFSSCMVTFKTSYGV

SEQ ID NO: 1091818 - protein, 17 aa, Mycobacterium
SGAEAANASFLQDPLQT

SEQ ID NO: 1091819 - protein, 26 aa, Mycobacterium
SGAGITGFDCSGLVLYSFAGVGIKLP

SEQ ID NO: 1091820 - protein, 19 aa, Mycobacterium
SGARALPLIEAQLNKVEEL

SEQ ID NO: 1091821 - protein, 24 aa, Mycobacterium
SGDQARLKLAIRSAEMHFIPSNAT

SEQ ID NO: 1091822 - protein, 21 aa, Mycobacterium
SGFRSMYFPGVIATVQGETPM

SEQ ID NO: 1091823 - protein, 29 aa, Mycobacterium
SGGAKGCPKDTWCVINAGNYRGSMSVTDA

SEQ ID NO: 1091824 - protein, 20 aa, Mycobacterium
SGGGTGFAIPIGQAMGIAGQ

SEQ ID NO: 1091825 - protein, 19 aa, Mycobacterium
SGGKGTFDGGAGGAGGDGG

SEQ ID NO: 1091826 - protein, 18 aa, Mycobacterium
SGGRRPLITEAIRGEGAI

SEQ ID NO: 1091827 - protein, 25 aa, Mycobacterium
SGIAELRQAFPGGIVALSKWAATPN

SEQ ID NO: 1091828 - protein, 23 aa, Mycobacterium
SGIPGDGTFRVGVDIKAGTYRSA

SEQ ID NO: 1091829 - protein, 26 aa, Mycobacterium
SGKSTLALLAMRCYDVTAGAVRVGGH

SEQ ID NO: 1091830 - protein, 22 aa, Mycobacterium
SGLQVKTIWAARAISVLFPQIT

SEQ ID NO: 1091831 - protein, 20 aa, Mycobacterium
SGPASSHFAGGAGGAGGHGG

SEQ ID NO: 1091832 - protein, 20 aa, Mycobacterium
SGPFFKVVIHNLVPGQILQP

SEQ ID NO: 1091833 - protein, 21 aa, Mycobacterium
SGPLCDRFAPSTVVDAADLFS

SEQ ID NO: 1091834 - protein, 21 aa, Mycobacterium
SGSGARYGRQGVEYWEHQGEV

SEQ ID NO: 1091835 - protein, 19 aa, Mycobacterium
SGSIGQLSVPPSWSAPSAR

SEQ ID NO: 1091836 - protein, 22 aa, Mycobacterium
SGSTKLALQWTRSVKGSLAAGP

SEQ ID NO: 1091837 - protein, 23 aa, Mycobacterium
SGSTKLALQWTRSVKGSLAAGPA

SEQ ID NO: 1091838 - protein, 17 aa, Mycobacterium
SGYDLLKRFQLSMNNVW

SEQ ID NO: 1091839 - protein, 19 aa, Mycobacterium
SIDLSRTAIPVEWDEVKES

SEQ ID NO: 1091840 - protein, 25 aa, Mycobacterium
SILDREWLHRGSIVVADNVKVPGAP

SEQ ID NO: 1091841 - protein, 24 aa, Mycobacterium
SIPNRWLVRPGALRPRHWDAEPDL

SEQ ID NO: 1091842 - protein, 20 aa, Mycobacterium
SKIHSVASFFVSRVDTEIDN

SEQ ID NO: 1091843 - protein, 19 aa, Mycobacterium
SKYRGEFEERLKAVLDDIK

SEQ ID NO: 1091844 - protein, 17 aa, Mycobacterium
SLAAIPPSAMPPGLGDP

SEQ ID NO: 1091845 - protein, 17 aa, Mycobacterium
SLAEARTTVLLDEIVTL

SEQ ID NO: 1091846 - protein, 24 aa, Mycobacterium
SLGAPCDNYERFIFGRGTSGQAEA

SEQ ID NO: 1091847 - protein, 25 aa, Mycobacterium
SLGIAKGGLLGGVYAYLDNNNQLVM

SEQ ID NO: 1091848 - protein, 18 aa, Mycobacterium
SLILRGGGIPNLEVLQNE

SEQ ID NO: 1091849 - protein, 21 aa, Mycobacterium
SLLRNSRVVLSAAIDVNDGID

SEQ ID NO: 1091850 - protein, 32 aa, Mycobacterium
SLLSRSNWELATALPAIDAFPADWNYDLWSDI

SEQ ID NO: 1091851 - protein, 18 aa, Mycobacterium
SLRRATSLAEGWVPFGIS

SEQ ID NO: 1091852 - protein, 24 aa, Mycobacterium
SLSDLQPGDVLTFYSDASHAGIYI

SEQ ID NO: 1091853 - protein, 24 aa, Mycobacterium
SNEIPCVRALFTLLPDNLRWLVTV

SEQ ID NO: 1091854 - protein, 17 aa, Mycobacterium
SNQLAWVSQTAANLVIG

SEQ ID NO: 1091855 - protein, 24 aa, Mycobacterium
SPACGKAGCQTYKWETFLTSELPQ

SEQ ID NO: 1091856 - protein, 31 aa, Mycobacterium
SPEDFWRSAGLPEYRFPDPKGTRFPNGAPPP

SEQ ID NO: 1091857 - protein, 19 aa, Mycobacterium
SPEEVPGVVMARKLAEQTG

SEQ ID NO: 1091858 - protein, 19 aa, Mycobacterium
SPGFPGMVAPPATRASGVL

SEQ ID NO: 1091859 - protein, 22 aa, Mycobacterium
SPGGTPGAQGFRAGDAGNGGVG

SEQ ID NO: 1091860 - protein, 25 aa, Mycobacterium
SPNIDLPVPDGWQLLPEGSGAPYGG

SEQ ID NO: 1091861 - protein, 23 aa, Mycobacterium
SPPAWWRPAGALFDQFLGAAETD

SEQ ID NO: 1091862 - protein, 17 aa, Mycobacterium
SPPRTGMPSGIMAKTVA

SEQ ID NO: 1091863 - protein, 24 aa, Mycobacterium
SQADIATLLAHYGIDAVLTNLDNA

SEQ ID NO: 1091864 - protein, 18 aa, Mycobacterium
SQHLCGSAPMGVDADPTA

SEQ ID NO: 1091865 - protein, 23 aa, Mycobacterium
SQHQFRGSAPILTGSTVTDQAGQ

SEQ ID NO: 1091866 - protein, 20 aa, Mycobacterium
SQLGRDWCAQGAQVEFWTNE

SEQ ID NO: 1091867 - protein, 24 aa, Mycobacterium
SRLARAACALDHMLAALSNPLDKR

SEQ ID NO: 1091868 - protein, 18 aa, Mycobacterium
SRPALWCNSDADNDRLRA

SEQ ID NO: 1091869 - protein, 18 aa, Mycobacterium
SRRAAVCRELTKVHEEVR

SEQ ID NO: 1091870 - protein, 23 aa, Mycobacterium
SRVTELKSSFGPDFKVSEIPPRA

SEQ ID NO: 1091871 - protein, 26 aa, Mycobacterium
SSARKEQAWEFVKFATGPAGQALIGE

SEQ ID NO: 1091872 - protein, 23 aa, Mycobacterium
SSFYRPTQDGAYPIVLVTYEIVC

SEQ ID NO: 1091873 - protein, 17 aa, Mycobacterium
SSGLGAGMARAFAARGR

SEQ ID NO: 1091874 - protein, 17 aa, Mycobacterium
SSGSGGLGRGGEQEGPL

SEQ ID NO: 1091875 - protein, 20 aa, Mycobacterium
SSTPVSLAFEQASFGYAAEH

SEQ ID NO: 1091876 - protein, 19 aa, Mycobacterium
SSWQTAIGLMSLVVNNALG

SEQ ID NO: 1091877 - protein, 29 aa, Mycobacterium
STFHTQFVRALNLSGGAYAAADVANASPL

SEQ ID NO: 1091878 - protein, 21 aa, Mycobacterium
STQCRLPITLSQAVGLAQAAQ

SEQ ID NO: 1091879 - protein, 20 aa, Mycobacterium
STVARWPRRRSLRFESSPHG

SEQ ID NO: 1091880 - protein, 24 aa, Mycobacterium
SVAGLPADLSVAFVEPAQNAALIL

SEQ ID NO: 1091881 - protein, 23 aa, Mycobacterium
SVARLVGAPPGYIGYDHGGQLTE

SEQ ID NO: 1091882 - protein, 22 aa, Mycobacterium
SVFTEPFQAYSVDLPVCNNWAD

SEQ ID NO: 1091883 - protein, 23 aa, Mycobacterium
SVTSELTSGSWLGPSAAAMMAVA

SEQ ID NO: 1091884 - protein, 18 aa, Mycobacterium
SVTVMALIVLLLLNATMT

SEQ ID NO: 1091885 - protein, 19 aa, Mycobacterium
SVVTRLLCVAVLSVTLGGI

SEQ ID NO: 1091886 - protein, 19 aa, Mycobacterium
SWNHCGGEYVWTNAKMAYF

SEQ ID NO: 1091887 - protein, 20 aa, Mycobacterium
SYFWQHNWGSPKGYTHPAAN

SEQ ID NO: 1091888 - protein, 24 aa, Mycobacterium
SYPRDGRPALLRVQSGASLAGNSR

SEQ ID NO: 1091889 - protein, 24 aa, Mycobacterium
TAALHLRRWLPRAHEIVVISPNAD

SEQ ID NO: 1091890 - protein, 17 aa, Mycobacterium
TAALMFAAIDGLVLHRV

SEQ ID NO: 1091891 - protein, 22 aa, Mycobacterium
TAFPRLYGVQTRFFDDFFSSAG

SEQ ID NO: 1091892 - protein, 22 aa, Mycobacterium
TAGAFSRPGLPVEYLQIPSAAM

SEQ ID NO: 1091893 - protein, 22 aa, Mycobacterium
TALCDRWQPGATLLPVSNDRCE

SEQ ID NO: 1091894 - protein, 19 aa, Mycobacterium
TALDGWKLEFDLPADESVT

SEQ ID NO: 1091895 - protein, 18 aa, Mycobacterium
TALSRYFGSNLSRLTQIR

SEQ ID NO: 1091896 - protein, 27 aa, Mycobacterium
TAMAAAARPYASWLGTAAARAAVTAAQ

SEQ ID NO: 1091897 - protein, 21 aa, Mycobacterium
TANGKLLRSALRGQTPAKPIW

SEQ ID NO: 1091898 - protein, 24 aa, Mycobacterium
TAPNRLYWLSAWIDRDGTNGGPLL

SEQ ID NO: 1091899 - protein, 17 aa, Mycobacterium
TASFTVVGADPTSDIAV

SEQ ID NO: 1091900 - protein, 18 aa, Mycobacterium
TATPARCATLADPGDGRD

SEQ ID NO: 1091901 - protein, 25 aa, Mycobacterium
TAVKLCGYSDCRVLTTFTACGAVAA

SEQ ID NO: 1091902 - protein, 19 aa, Mycobacterium
TAVLVSRRAPRRWAARDAI

SEQ ID NO: 1091903 - protein, 26 aa, Mycobacterium
TDADPAGWPRLDWSMDAALLLAALAS

SEQ ID NO: 1091904 - protein, 18 aa, Mycobacterium
TDLADWKLEFDLPAEESV

SEQ ID NO: 1091905 - protein, 30 aa, Mycobacterium; identical to SEQ ID NO: 936037

SEQ ID NO: 1091906 - protein, 18 aa, Mycobacterium
TELEHLCLHGSRWCDAND

SEQ ID NO: 1091907 - protein, 19 aa, Mycobacterium
TELEHLCLHGSRWCDANDI

SEQ ID NO: 1091908 - protein, 20 aa, Mycobacterium
TELPGLFAAGEVARTGMHGA

SEQ ID NO: 1091909 - protein, 17 aa, Mycobacterium
TERARIRTPVGLAIGAK

SEQ ID NO: 1091910 - protein, 18 aa, Mycobacterium
TFAARALFFDKFFADAIA

SEQ ID NO: 1091911 - protein, 25 aa, Mycobacterium
TFAYPGLGASPTWHGFAVDQSGIAF

SEQ ID NO: 1091912 - protein, 18 aa, Mycobacterium
TFELEWPKGSGRVREFPV

SEQ ID NO: 1091913 - protein, 27 aa, Mycobacterium
TFVGAAARNGRRLVIAMMYGLVKEGGP

SEQ ID NO: 1091914 - protein, 24 aa, Mycobacterium
TGANGAAGGWLLGNGGAGGSGAAG

SEQ ID NO: 1091915 - protein, 17 aa, Mycobacterium
TGCRTVWDSSTRSAALP

SEQ ID NO: 1091916 - protein, 23 aa, Mycobacterium
TGDAQLPAGGMLFIDTPDGQLVA

SEQ ID NO: 1091917 - protein, 19 aa, Mycobacterium
TGFDFPFAAMGSVHTENHI

SEQ ID NO: 1091918 - protein, 21 aa, Mycobacterium
TGGAAGRLIGNGGSGGQGGLA

SEQ ID NO: 1091919 - protein, 20 aa, Mycobacterium
TGGSGGRGGDARLIGNGGDG

SEQ ID NO: 1091920 - protein, 26 aa, Mycobacterium
TGGVGGANQFFGHAGDGGHGGTGGAG

SEQ ID NO: 1091921 - protein, 23 aa, Mycobacterium
TGKYLYEAWADRFAVTARLNNAL

SEQ ID NO: 1091922 - protein, 19 aa, Mycobacterium
TGLRVPETVGWDYGSISGL

SEQ ID NO: 1091923 - protein, 29 aa, Mycobacterium
TGLRYRNNVPLTYPFVLAFPSVMALVTGF

SEQ ID NO: 1091924 - protein, 26 aa, Mycobacterium
TGLSSKGAKTFAIDAASAYCPEYVTS

SEQ ID NO: 1091925 - protein, 25 aa, Mycobacterium
TGQPWVVSFQLNWPRDHGPNVTGWM

SEQ ID NO: 1091926 - protein, 33 aa, Mycobacterium
TGRTGDCALTAPSRVCSGDALATSVAEYHSAAA

SEQ ID NO: 1091927 - protein, 27 aa, Mycobacterium
TGSGRGGCALALARDWVHAQVIGEAML

SEQ ID NO: 1091928 - protein, 18 aa, Mycobacterium
TGTLRPYVAITLTSERSG

SEQ ID NO: 1091929 - protein, 26 aa, Mycobacterium
TGVAANWRAGGGWTDGRQRLGTSPEK

SEQ ID NO: 1091930 - protein, 19 aa, Mycobacterium
TGVKGWINRWFYSVSGQVP

SEQ ID NO: 1091931 - protein, 25 aa, Mycobacterium
TGVRRSELLALRWTDFDESKQTIAA

SEQ ID NO: 1091932 - protein, 19 aa, Mycobacterium
TGVYGGIDVCQWAAADGVI

SEQ ID NO: 1091933 - protein, 25 aa, Mycobacterium
THYERIRYAYDWAEDDDSFFARAAP

SEQ ID NO: 1091934 - protein, 23 aa, Mycobacterium
TILRGGLQLAVMASTLGANPVRD

SEQ ID NO: 1091935 - protein, 18 aa, Mycobacterium
TKERQCQFMPTIGSTVVP

SEQ ID NO: 1091936 - protein, 24 aa, Mycobacterium
TKNSEFSTVWTWPDKPGVAGCAAM

SEQ ID NO: 1091937 - protein, 26 aa, Mycobacterium
TLAAVSGCGWRGLNSLPLPGTEGNGP

SEQ ID NO: 1091938 - protein, 26 aa, Mycobacterium
TLAMPAMAPMAACYITLGTAGMAGVV

SEQ ID NO: 1091939 - protein, 20 aa, Mycobacterium
TLAQELPKRIDFACYSAIYY

SEQ ID NO: 1091940 - protein, 19 aa, Mycobacterium
TLASQAAHLVMLFQQNLAE

SEQ ID NO: 1091941 - protein, 17 aa, Mycobacterium
TLESRMGPASASMAAAA

SEQ ID NO: 1091942 - protein, 18 aa, Mycobacterium
TLGSGVLAPALWSVVEAF

SEQ ID NO: 1091943 - protein, 26 aa, Mycobacterium
TLLERELPVYVISIGRAFRTDEVDAT

SEQ ID NO: 1091944 - protein, 19 aa, Mycobacterium
TLLGGLSIAVGDEVIDGTL

SEQ ID NO: 1091945 - protein, 23 aa, Mycobacterium
TLPKRVHERFDLVGFDPRGVASS

SEQ ID NO: 1091946 - protein, 17 aa, Mycobacterium
TLQPGTYRIDGWSLTLF

SEQ ID NO: 1091947 - protein, 23 aa, Mycobacterium
TLRPRWPPIRPAAPNGPAIWYCG

SEQ ID NO: 1091948 - protein, 21 aa, Mycobacterium
TLVSRPACDLAGMLTTAQQAR

SEQ ID NO: 1091949 - protein, 21 aa, Mycobacterium
TNASPLEKAIGVFTAPAEGQA

SEQ ID NO: 1091950 - protein, 21 aa, Mycobacterium
TNGSGGRGGHGYTSTDPTLNG

SEQ ID NO: 1091951 - protein, 20 aa, Mycobacterium
TNLNPVWKVGFQIREALRAN

SEQ ID NO: 1091952 - protein, 19 aa, Mycobacterium
TNTAQDWRLSAKEDGDAND

SEQ ID NO: 1091953 - protein, 30 aa, Mycobacterium; identical to SEQ ID NO: 739348

SEQ ID NO: 1091954 - protein, 24 aa, Mycobacterium
TPAMVGPCRLPAAGEFPDGAAMFA

SEQ ID NO: 1091955 - protein, 23 aa, Mycobacterium
TPEGPTGFPPGLWARQTTEIRSS

SEQ ID NO: 1091956 - protein, 28 aa, Mycobacterium
TPFPTMYELFSVGWGQPDLREQWKQASA

SEQ ID NO: 1091957 - protein, 27 aa, Mycobacterium
TPFPTMYELFSVGWGQPDLRSQWKQAS

SEQ ID NO: 1091958 - protein, 28 aa, Mycobacterium
TPGAGGARWRRRCRRRDVREPRWTWRLR

SEQ ID NO: 1091959 - protein, 19 aa, Mycobacterium
TPGSLDFNGVVFNQDVTPG

SEQ ID NO: 1091960 - protein, 26 aa, Mycobacterium
TPNEGPPQRWFVVWLGTSNDPVDKGA

SEQ ID NO: 1091961 - protein, 22 aa, Mycobacterium
TPPHAWYIAFAPAQAPKVAVAV

SEQ ID NO: 1091962 - protein, 23 aa, Mycobacterium
TPRFRFEEICATPAFPDDIRKST

SEQ ID NO: 1091963 - protein, 20 aa, Mycobacterium
TPSGLRLVKVETLGQAVDAL

SEQ ID NO: 1091964 - protein, 21 aa, Mycobacterium
TPSRARLAAGAVLHSKNVSTE

SEQ ID NO: 1091965 - protein, 25 aa, Mycobacterium
TPSSAAQVLAGWQTWLAAADRDTWG

SEQ ID NO: 1091966 - protein, 19 aa, Mycobacterium
TPVPELTWIPAHPAPQPAP

SEQ ID NO: 1091967 - protein, 21 aa, Mycobacterium
TQDSMCVWFTYSTPDANKDHV

SEQ ID NO: 1091968 - protein, 36 aa, Mycobacterium
TQLGDLHWFYVYSGVMWACVFMRTGARRVHFGEVEK

SEQ ID NO: 1091969 - protein, 23 aa, Mycobacterium
TQLTRQLRLELGHESVRQASELV

SEQ ID NO: 1091970 - protein, 19 aa, Mycobacterium
TRAAPRIVAAAALEGALLT

SEQ ID NO: 1091971 - protein, 26 aa, Mycobacterium
TRALSFLPTYPFPKETLTNWMRGDYA

SEQ ID NO: 1091972 - protein, 22 aa, Mycobacterium
TRFWACPEALVSPRAHQRAVEA

SEQ ID NO: 1091973 - protein, 22 aa, Mycobacterium
TRGIPFESVVTLVVREGNPKNI

SEQ ID NO: 1091974 - protein, 17 aa, Mycobacterium
TRIPRVYGRQASEYVIR

SEQ ID NO: 1091975 - protein, 17 aa, Mycobacterium
TRLMRFADRVTLIHTRY

SEQ ID NO: 1091976 - protein, 19 aa, Mycobacterium
TRSIGLFGLMIPEQYGGLG

SEQ ID NO: 1091977 - protein, 17 aa, Mycobacterium
TRVGPYMYCDVLRLDEC

SEQ ID NO: 1091978 - protein, 23 aa, Mycobacterium
TRYERLRMGLAEILGDYRSTLRQ

SEQ ID NO: 1091979 - protein, 18 aa, Mycobacterium
TSGARDRSGAALTGPATF

SEQ ID NO: 1091980 - protein, 17 aa, Mycobacterium
TSIDQIVYWSPYQAQVL

SEQ ID NO: 1091981 - protein, 20 aa, Mycobacterium
TSIDQIVYWSPYQAQVLFTM

SEQ ID NO: 1091982 - protein, 23 aa, Mycobacterium
TSLDPHGPVAFWGYSQGGGAAAS

SEQ ID NO: 1091983 - protein, 24 aa, Mycobacterium
TSLTRLTPVLAHRSAEVALDRANA

SEQ ID NO: 1091984 - protein, 20 aa, Mycobacterium
TSMMSRVKWMLRARPADYLL

SEQ ID NO: 1091985 - protein, 21 aa, Mycobacterium
TSVYANSGWVAMRGNQMTSPN

SEQ ID NO: 1091986 - protein, 20 aa, Mycobacterium
TTATEVWPGPAATEDAVAPG

SEQ ID NO: 1091987 - protein, 20 aa, Mycobacterium
TTGLFPPGSTFKMVTAGAAI

SEQ ID NO: 1091988 - protein, 21 aa, Mycobacterium
TTGLFPPGSTFKMVTAGAAID

SEQ ID NO: 1091989 - protein, 20 aa, Mycobacterium
TTILPRFWCDSVDRQADRIE

SEQ ID NO: 1091990 - protein, 24 aa, Mycobacterium
TTITGWATSGGFCGKNNTYTVYVA

SEQ ID NO: 1091991 - protein, 26 aa, Mycobacterium
TTNPPVEGSWAWLPDEAKGARVHWRP

SEQ ID NO: 1091992 - protein, 24 aa, Mycobacterium
TTTEGYRAGLLASIAAYCAPCPTG

SEQ ID NO: 1091993 - protein, 27 aa, Mycobacterium
TTTPPVEGSWAWLPDEAKGARIHYRPR

SEQ ID NO: 1091994 - protein, 19 aa, Mycobacterium
TTWDLKRGVDLKHFPSSGP

SEQ ID NO: 1091995 - protein, 23 aa, Mycobacterium
TVASSGTSYWSAEATNVEQTLLN

SEQ ID NO: 1091996 - protein, 26 aa, Mycobacterium
TVCALTAFLLVAVFGQVRFGDGNTYY

SEQ ID NO: 1091997 - protein, 24 aa, Mycobacterium
TVGRPVAGCPVRIFDRNGRPVGAR

SEQ ID NO: 1091998 - protein, 21 aa, Mycobacterium
TVGSASDWTVWINNVPTQDSM

SEQ ID NO: 1091999 - protein, 23 aa, Mycobacterium
TVRLRAPTIDFMLSLGHSSFYPL

SEQ ID NO: 1092000 - protein, 18 aa, Mycobacterium
TVVIVSWVLTRPPPSTHE

SEQ ID NO: 1092001 - protein, 18 aa, Mycobacterium
TVVPPRPGASTVTAATAV

SEQ ID NO: 1092002 - protein, 20 aa, Mycobacterium
TVVSRLRAQGAIVLGMTNVP

SEQ ID NO: 1092003 - protein, 20 aa, Mycobacterium
TVYVAMKFNQPFISYGAWDR

SEQ ID NO: 1092004 - protein, 21 aa, Mycobacterium
TWAQYLRWVADRAGLEVVGGE

SEQ ID NO: 1092005 - protein, 19 aa, Mycobacterium
TYRIDGWSLTLFGFQLTPQ

SEQ ID NO: 1092006 - protein, 27 aa, Mycobacterium
TYSEDWLRPDYIPPQAIPPQQAPPAAA

SEQ ID NO: 1092007 - protein, 19 aa, Mycobacterium
VAAGLGFVRMVDTFAARAL

SEQ ID NO: 1092008 - protein, 24 aa, Mycobacterium
VAANRARLAALMATNIFGQNVPAI

SEQ ID NO: 1092009 - protein, 32 aa, Mycobacterium
VAAQVLLELGCNRAQGFLLSRPVDGAAMESLL

SEQ ID NO: 1092010 - protein, 25 aa, Mycobacterium
VAARREFAEEIGLPVPDGARIDLGS

SEQ ID NO: 1092011 - protein, 24 aa, Mycobacterium
VADQLSAFMLLAPGADGTPYPNGV

SEQ ID NO: 1092012 - protein, 18 aa, Mycobacterium
VADRVGVHRTIAYRLLLT

SEQ ID NO: 1092013 - protein, 23 aa, Mycobacterium
VADTRGGQLLVYGVDPLILRQAY

SEQ ID NO: 1092014 - protein, 24 aa, Mycobacterium
VAFPEGTTWCGLASGSFYPAMFQA

SEQ ID NO: 1092015 - protein, 22 aa, Mycobacterium
VAGGAGGWLFGNGGAGGAPAAR

SEQ ID NO: 1092016 - protein, 17 aa, Mycobacterium
VAGKLDYASLTLAQLRA

SEQ ID NO: 1092017 - protein, 20 aa, Mycobacterium
VAGMAAEPVAVAASNNPMLT

SEQ ID NO: 1092018 - protein, 18 aa, Mycobacterium
VAGSLLDLAGPYLPFDNP

SEQ ID NO: 1092019 - protein, 17 aa, Mycobacterium
VALELLASGTWSGRGVL

SEQ ID NO: 1092020 - protein, 24 aa, Mycobacterium
VALGMTGAGYWVAHGALTGITISQ

SEQ ID NO: 1092021 - protein, 24 aa, Mycobacterium
VANGGLRYAERADLATREEQIAVA

SEQ ID NO: 1092022 - protein, 26 aa, Mycobacterium
VAPGLTRTRGRVCSVTAATGAAPSPA

SEQ ID NO: 1092023 - protein, 17 aa, Mycobacterium
VAPRLATVLVTMVTLAA

SEQ ID NO: 1092024 - protein, 21 aa, Mycobacterium
VAPYLRSWESVIGHQRTGVYA

SEQ ID NO: 1092025 - protein, 17 aa, Mycobacterium
VAQEYFGEISVTGVLAH

SEQ ID NO: 1092026 - protein, 26 aa, Mycobacterium
VAQMLQRIVALMPMGVAVVDSHRDVV

SEQ ID NO: 1092027 - protein, 27 aa, Mycobacterium
VARDATFRWGVAMLPIGPAGRVSVTNG

SEQ ID NO: 1092028 - protein, 25 aa, Mycobacterium
VARGLSQRGVPFSWAGGGITGPSRG

SEQ ID NO: 1092029 - protein, 20 aa, Mycobacterium
VASAAAFGFIGAVGLAPMAS

SEQ ID NO: 1092030 - protein, 18 aa, Mycobacterium
VASQCFWIAHADPPAPGP

SEQ ID NO: 1092031 - protein, 27 aa, Mycobacterium
VAVKQGWMCCIGADWMHLSTGIIGSDR

SEQ ID NO: 1092032 - protein, 26 aa, Mycobacterium
VAVLDAPWAPFVVDFHLANVGGPSAG

SEQ ID NO: 1092033 - protein, 26 aa, Mycobacterium
VAVRPEPFGALLYHFGTRKLSFLKNR

SEQ ID NO: 1092034 - protein, 34 aa, Mycobacterium; identical to SEQ ID NO: 936952

SEQ ID NO: 1092035 - protein, 23 aa, Mycobacterium
VCAEAFNSILSRLARAACALDHM

SEQ ID NO: 1092036 - protein, 20 aa, Mycobacterium
VDAPLPWSFTITTTEPAVLG

SEQ ID NO: 1092037 - protein, 23 aa, Mycobacterium
VDEAISPANEWTMYVGDGKRVSA

SEQ ID NO: 1092038 - protein, 18 aa, Mycobacterium
VDGYDFAPSFSIWTTIEE

SEQ ID NO: 1092039 - protein, 17 aa, Mycobacterium
VDGYTAWLQNMAADDRI

SEQ ID NO: 1092040 - protein, 24 aa, Mycobacterium
VDHYAEIGLLGFALITDALGGVDV

SEQ ID NO: 1092041 - protein, 24 aa, Mycobacterium
VDQFTRNGVLWGVPQLTDAGIAVF

SEQ ID NO: 1092042 - protein, 17 aa, Mycobacterium
VDVFRRMIGEDFTAPRG

SEQ ID NO: 1092043 - protein, 17 aa, Mycobacterium
VDWKGTLTGLAGYASGD

SEQ ID NO: 1092044 - protein, 17 aa, Mycobacterium
VEDAWPFIEDIKAELAE

SEQ ID NO: 1092045 - protein, 17 aa, Mycobacterium
VEFRDQFPLPEKLWTIA

SEQ ID NO: 1092046 - protein, 21 aa, Mycobacterium
VEPQGPPLWEEVLKNPTVKSA

SEQ ID NO: 1092047 - protein, 17 aa, Mycobacterium
VETAFRQLAPRPVTAAW

SEQ ID NO: 1092048 - protein, 17 aa, Mycobacterium
VETIVWRTYAQTLPPDA

SEQ ID NO: 1092049 - protein, 22 aa, Mycobacterium
VEYGDRCLHDYCPPPCGETTPC

SEQ ID NO: 1092050 - protein, 27 aa, Mycobacterium
VFEHRCPLCAEPVRWRLVGEEAELRPR

SEQ ID NO: 1092051 - protein, 17 aa, Mycobacterium
VFGQVRFGDGNTYYAEF

SEQ ID NO: 1092052 - protein, 21 aa, Mycobacterium
VFPTPPALIVAAGTDALSVAI

SEQ ID NO: 1092053 - protein, 27 aa, Mycobacterium
VGAPPEPRLWGAFTERGLSNMPMKPGM

SEQ ID NO: 1092054 - protein, 19 aa, Mycobacterium
VGDAFPLSSLTQIYMSDGE

SEQ ID NO: 1092055 - protein, 23 aa, Mycobacterium
VGDTTRLLARFPALGGTDTSGRS

SEQ ID NO: 1092056 - protein, 31 aa, Mycobacterium; identical to SEQ ID NO: 937173

SEQ ID NO: 1092057 - protein, 20 aa, Mycobacterium
VGFVGWRLYQKLTNNTVVVY

SEQ ID NO: 1092058 - protein, 18 aa, Mycobacterium
VGGFSSVVPAGWVESDAS

SEQ ID NO: 1092059 - protein, 24 aa, Mycobacterium
VGHDLRYAIDPSLLYNELAWAPKH

SEQ ID NO: 1092060 - protein, 27 aa, Mycobacterium
VGIDLRDDWPSALRAAGFDAARPTAWL

SEQ ID NO: 1092061 - protein, 24 aa, Mycobacterium
VGLGSFGIRVVRDLIAAGYDVAVI

SEQ ID NO: 1092062 - protein, 22 aa, Mycobacterium
VGLGTSRFGGTGGDGGQGGLFG

SEQ ID NO: 1092063 - protein, 17 aa, Mycobacterium
VGLHGPHRYNWNQFIGS

SEQ ID NO: 1092064 - protein, 24 aa, Mycobacterium
VGNIVGAPMGWESVFTEPFQAYSV

SEQ ID NO: 1092065 - protein, 20 aa, Mycobacterium
VGNLARIGSSIGVANAAAAA

SEQ ID NO: 1092066 - protein, 24 aa, Mycobacterium
VGPERFYDMVGKFGLGQRTGVGLP

SEQ ID NO: 1092067 - protein, 19 aa, Mycobacterium
VGPIGGITHKMAAARAAGA

SEQ ID NO: 1092068 - protein, 23 aa, Mycobacterium
VGQAGGDGGFLWGNGGNGGDSTS

SEQ ID NO: 1092069 - protein, 19 aa, Mycobacterium
VGVSACTSVDIGVPNINAV

SEQ ID NO: 1092070 - protein, 24 aa, Mycobacterium
VGVVPDYLGNVWFATGSGVVGVAK

SEQ ID NO: 1092071 - protein, 22 aa, Mycobacterium
VGYPGSLLLDLLWPRGSSRPVA

SEQ ID NO: 1092072 - protein, 23 aa, Mycobacterium
VHGRTGPIPVRRIRDQTGVTQRF

SEQ ID NO: 1092073 - protein, 23 aa, Mycobacterium
VIDRLKDIINRGGENVSSVEVES

SEQ ID NO: 1092074 - protein, 23 aa, Mycobacterium
VIELLCRARDSLACNNSVAELVE

SEQ ID NO: 1092075 - protein, 22 aa, Mycobacterium
VIGEAMLKAGAVATWAVAVDSF

SEQ ID NO: 1092076 - protein, 23 aa, Mycobacterium
VIKDANAVAAAWNDVALDPDARL

SEQ ID NO: 1092077 - protein, 17 aa, Mycobacterium
VIVTRYLTVPAEDAAPR

SEQ ID NO: 1092078 - protein, 19 aa, Mycobacterium
VKAAIAWARANVDKFGGDR

SEQ ID NO: 1092079 - protein, 24 aa, Mycobacterium
VKGAVVLVDRGECQFAQKEDAAAQ

SEQ ID NO: 1092080 - protein, 26 aa, Mycobacterium
VKIPGGALCGKLAVPVDYRQPRGDVA

SEQ ID NO: 1092081 - protein, 42 aa, Mycobacterium; identical to SEQ ID NO: 937321

SEQ ID NO: 1092082 - protein, 22 aa, Mycobacterium
VKSTARGALSVRASVDRLVLGS

SEQ ID NO: 1092083 - protein, 22 aa, Mycobacterium
VLAATNWLGFNTPAIIDIEAAY

SEQ ID NO: 1092084 - protein, 20 aa, Mycobacterium
VLAIEPMLTLGTRKTVVLDD

SEQ ID NO: 1092085 - protein, 25 aa, Mycobacterium
VLALVVGFVGWRLYQKLTNNTVVVY

SEQ ID NO: 1092086 - protein, 18 aa, Mycobacterium
VLDGSGWSDDGMQSVVRV

SEQ ID NO: 1092087 - protein, 17 aa, Mycobacterium
VLERCPPSGDIYFGQVA

SEQ ID NO: 1092088 - protein, 27 aa, Mycobacterium
VLGAVLAHWLVRLIAARHLIAGGHVDR

SEQ ID NO: 1092089 - protein, 37 aa, Mycobacterium
VLHRPKLGFPVPIRHWLRAGELLEWAYAMVATSQAGH

SEQ ID NO: 1092090 - protein, 18 aa, Mycobacterium
VLNPNGWGIVSAPSVILA

SEQ ID NO: 1092091 - protein, 25 aa, Mycobacterium
VLPQQARKADLLFYGPEGTQSVAMY

SEQ ID NO: 1092092 - protein, 27 aa, Mycobacterium
VLSLMLRAPFRLTREVLPHLRPGSAII

SEQ ID NO: 1092093 - protein, 19 aa, Mycobacterium
VLWSPAGELPRWWDSLPTD

SEQ ID NO: 1092094 - protein, 32 aa, Mycobacterium
VMGALNAPTMAWLGRPLIGDGANGVDGTGGNG

SEQ ID NO: 1092095 - protein, 21 aa, Mycobacterium
VMTLALDCGALVLPAKSDEHD

SEQ ID NO: 1092096 - protein, 28 aa, Mycobacterium
VNAFFTSRCNMIAWDRGVFMPVAQEYFG

SEQ ID NO: 1092097 - protein, 17 aa, Mycobacterium
VNAPFESLTGRELIGNG

SEQ ID NO: 1092098 - protein, 18 aa, Mycobacterium
VNGWAAGGGHSLHVICDL

SEQ ID NO: 1092099 - protein, 24 aa, Mycobacterium
VNIDESRAAFVYTPEPNFVGIDTF

SEQ ID NO: 1092100 - protein, 18 aa, Mycobacterium
VNPQISIMALALAVADEV

SEQ ID NO: 1092101 - protein, 25 aa, Mycobacterium
VNSGTCFRPPLAVQQRWRDEFGLDL

SEQ ID NO: 1092102 - protein, 25 aa, Mycobacterium
VPAEGRVGLLRKVLDSAGSVNPIAV

SEQ ID NO: 1092103 - protein, 23 aa, Mycobacterium
VPDSRSALYWAARLTLVNRMEDL

SEQ ID NO: 1092104 - protein, 24 aa, Mycobacterium
VPEGAPPRALWHLGAGATATPARC

SEQ ID NO: 1092105 - protein, 20 aa, Mycobacterium
VPFTGVPGYNHIKIKEAYGL

SEQ ID NO: 1092106 - protein, 20 aa, Mycobacterium
VPGIRAALRATRAPIIGYSP

SEQ ID NO: 1092107 - protein, 20 aa, Mycobacterium
VPIPSPRPDVVPGPVAPTPS

SEQ ID NO: 1092108 - protein, 20 aa, Mycobacterium
VPLSACAKAASDQHLASTMA

SEQ ID NO: 1092109 - protein, 17 aa, Mycobacterium
VPLVMRDGFGLRLELKL

SEQ ID NO: 1092110 - protein, 17 aa, Mycobacterium
VPNLTPWRRSVTEDMTS

SEQ ID NO: 1092111 - protein, 20 aa, Mycobacterium
VPPLDQWSGSTFANLPIGQG

SEQ ID NO: 1092112 - protein, 19 aa, Mycobacterium
VPPTAPFVGGMTRVDVEPT

SEQ ID NO: 1092113 - protein, 18 aa, Mycobacterium
VPTLPGPGFPDFGAPDLP

SEQ ID NO: 1092114 - protein, 21 aa, Mycobacterium
VPVALVAKAEMLVPVETAFRQ

SEQ ID NO: 1092115 - protein, 21 aa, Mycobacterium
VPVDPPPGFGYTRTGVPVKSF

SEQ ID NO: 1092116 - protein, 27 aa, Mycobacterium
VPVFPSYRLDHRFEVIKLVGELSDVPV

SEQ ID NO: 1092117 - protein, 17 aa, Mycobacterium
VPVWASLIALLEDGVPS

SEQ ID NO: 1092118 - protein, 22 aa, Mycobacterium
VQDLTGRPLVGNGANGVPGTGA

SEQ ID NO: 1092119 - protein, 18 aa, Mycobacterium
VQTILRWAGANRVAVVTR

SEQ ID NO: 1092120 - protein, 23 aa, Mycobacterium
VRAYGDFFSYCLLAEGAIDIAAE

SEQ ID NO: 1092121 - protein, 22 aa, Mycobacterium
VRFVPGNENFQMGAFVKANDGY

SEQ ID NO: 1092122 - protein, 30 aa, Mycobacterium; identical to SEQ ID NO: 937625

SEQ ID NO: 1092123 - protein, 21 aa, Mycobacterium
VRSPPAVTWRDARPTRASRRD

SEQ ID NO: 1092124 - protein, 21 aa, Mycobacterium
VRVARLNAYFGPLLQSLPAFG

SEQ ID NO: 1092125 - protein, 25 aa, Mycobacterium
VRVYVPFGTQWYGYFMRRLAERPAN

SEQ ID NO: 1092126 - protein, 17 aa, Mycobacterium
VRYGFRYPVLTRPPSAG

SEQ ID NO: 1092127 - protein, 19 aa, Mycobacterium
VSAEPKVKVVIPVDPAGDG

SEQ ID NO: 1092128 - protein, 27 aa, Mycobacterium
VSAGIASLFGAHAYNYQVLSAKAAEFH

SEQ ID NO: 1092129 - protein, 19 aa, Mycobacterium
VSALNRPVSTTGESGNQNT

SEQ ID NO: 1092130 - protein, 20 aa, Mycobacterium
VSAVVAALFDAHAQAYQSLS

SEQ ID NO: 1092131 - protein, 18 aa, Mycobacterium
VSGGIAWIPAHQRSPDRD

SEQ ID NO: 1092132 - protein, 23 aa, Mycobacterium
VSGQLMLLVPFIERVRARVDLRE

SEQ ID NO: 1092133 - protein, 22 aa, Mycobacterium
VSIEVGNGWFQRVVLKNPSGKV

SEQ ID NO: 1092134 - protein, 23 aa, Mycobacterium
VSIGAILAVPGIRAALRATRAPI

SEQ ID NO: 1092135 - protein, 17 aa, Mycobacterium
VSLQCAVAGGIALENLN

SEQ ID NO: 1092136 - protein, 21 aa, Mycobacterium
VSPDTSWLALNRMIPPMVKST

SEQ ID NO: 1092137 - protein, 22 aa, Mycobacterium
VSRRAPRRWAARDAIADIERQS

SEQ ID NO: 1092138 - protein, 26 aa, Mycobacterium
VSSAARAHGGWTVGVIPKMLVHRELA

SEQ ID NO: 1092139 - protein, 23 aa, Mycobacterium
VTAAQRAGFGWIADLNDVGPDIA

SEQ ID NO: 1092140 - protein, 17 aa, Mycobacterium
VTELVGYGARFDESIPG

SEQ ID NO: 1092141 - protein, 20 aa, Mycobacterium
VTHRTEYRYSDIVTSSYGRG

SEQ ID NO: 1092142 - protein, 19 aa, Mycobacterium
VTIRLDAGVALPANATARI

SEQ ID NO: 1092143 - protein, 19 aa, Mycobacterium
VTKLIRWTGFSPDKVARIC

SEQ ID NO: 1092144 - protein, 18 aa, Mycobacterium
VTLIAVIVSRHCRRVVLV

SEQ ID NO: 1092145 - protein, 19 aa, Mycobacterium
VTRLRITDDVRLPRGSTAE

SEQ ID NO: 1092146 - protein, 24 aa, Mycobacterium
VTRTAVCQPGLFNAEVKKAAAEHG

SEQ ID NO: 1092147 - protein, 18 aa, Mycobacterium
VTTMKSRVIDIVQENGYS

SEQ ID NO: 1092148 - protein, 19 aa, Mycobacterium
VTYGEDWMRPDYVPPQPDM

SEQ ID NO: 1092149 - protein, 23 aa, Mycobacterium
VVAAFVLVCSAFLAAPTAHAAAI

SEQ ID NO: 1092150 - protein, 24 aa, Mycobacterium
VVAFLVVGCVRWSTQTQTQPQPAI

SEQ ID NO: 1092151 - protein, 20 aa, Mycobacterium
VVAFSIPRDDWVPFTGVPGY

SEQ ID NO: 1092152 - protein, 18 aa, Mycobacterium
VVAPEIYERLAAQTGESV

SEQ ID NO: 1092153 - protein, 27 aa, Mycobacterium
VVGCILLAGLVGMCSFQPGATKRGNVP

SEQ ID NO: 1092154 - protein, 18 aa, Mycobacterium
VVHREMAEPIELPSGQQL

SEQ ID NO: 1092155 - protein, 26 aa, Mycobacterium
VVIAGFAIYRLHGIFGSHNNASGANG

SEQ ID NO: 1092156 - protein, 24 aa, Mycobacterium
VVLDPWGHFDGLRAWLSELADTGY

SEQ ID NO: 1092157 - protein, 17 aa, Mycobacterium
VVLPDAPVKIFLTASPE

SEQ ID NO: 1092158 - protein, 17 aa, Mycobacterium
VVRSARMAAISAILHSA

SEQ ID NO: 1092159 - protein, 24 aa, Mycobacterium
VVSSPRAGLVMEKGAKVKYRGIQV

SEQ ID NO: 1092160 - protein, 23 aa, Mycobacterium
VVTSAAAFGLCPAAAADPAAPQP

SEQ ID NO: 1092161 - protein, 17 aa, Mycobacterium
VVVEFRDQFPLPEKLWT

SEQ ID NO: 1092162 - protein, 17 aa, Mycobacterium
VVWSMVMQLALDCGAVV

SEQ ID NO: 1092163 - protein, 23 aa, Mycobacterium
VWMAESISPFGPQVMSADLATAG

SEQ ID NO: 1092164 - protein, 18 aa, Mycobacterium
VYAPVTGFYSLRYSSTGL

SEQ ID NO: 1092165 - protein, 27 aa, Mycobacterium
VYGVDPLILRQAYPVSQDPYGLAGSNQ

SEQ ID NO: 1092166 - protein, 19 aa, Mycobacterium
WAAESGRYAGFDAATQAGY

SEQ ID NO: 1092167 - protein, 20 aa, Mycobacterium
WAGLGEKFALAAVDISFVLG

SEQ ID NO: 1092168 - protein, 17 aa, Mycobacterium
WDDPAIKALKALNTSIN

SEQ ID NO: 1092169 - protein, 21 aa, Mycobacterium
WDEVKESLTQLAVQLSPAAGE

SEQ ID NO: 1092170 - protein, 17 aa, Mycobacterium
WDGHGLLGLEDSLDAVL

SEQ ID NO: 1092171 - protein, 19 aa, Mycobacterium
WDMGASDWPAARRLRFAND

SEQ ID NO: 1092172 - protein, 19 aa, Mycobacterium
WDQAGSLFDWGFALNPQSG

SEQ ID NO: 1092173 - protein, 21 aa, Mycobacterium
WDVPPRADGVYSRGGGPVQRW

SEQ ID NO: 1092174 - protein, 24 aa, Mycobacterium
WECHLTELELQWGRTIGQFPSPCT

SEQ ID NO: 1092175 - protein, 19 aa, Mycobacterium
WGADEALRCESPEYDRTVR

SEQ ID NO: 1092176 - protein, 29 aa, Mycobacterium
WGADVLRRLRGMFAFALWDTVTRELFCAR

SEQ ID NO: 1092177 - protein, 25 aa, Mycobacterium
WGAGHGGLFNRTSWVLSVDDHVDPA

SEQ ID NO: 1092178 - protein, 17 aa, Mycobacterium
WGHLGVDNTSLFLKDES

SEQ ID NO: 1092179 - protein, 24 aa, Mycobacterium
WGPIHGCHVFTPILREAGRAVGPR

SEQ ID NO: 1092180 - protein, 20 aa, Mycobacterium
WGQWCGPCRAEITQLQQVYD

SEQ ID NO: 1092181 - protein, 25 aa, Mycobacterium
WHAKEELARYGVQPDWFQLGDRDLA

SEQ ID NO: 1092182 - protein, 17 aa, Mycobacterium
WIGAEVVLDGAADVALC

SEQ ID NO: 1092183 - protein, 19 aa, Mycobacterium
WIPLLILVVVAIAGFTVQR

SEQ ID NO: 1092184 - protein, 18 aa, Mycobacterium
WIPTSQGIELHFFDYQFG

SEQ ID NO: 1092185 - protein, 17 aa, Mycobacterium
WKAMTKTGLINHLLNPE

SEQ ID NO: 1092186 - protein, 17 aa, Mycobacterium
WKGTLTGLAGYASGDLD

SEQ ID NO: 1092187 - protein, 17 aa, Mycobacterium
WLALNRMIPPMVKSTAR

SEQ ID NO: 1092188 - protein, 18 aa, Mycobacterium
WLVPEVLERCPPSGDIYF

SEQ ID NO: 1092189 - protein, 17 aa, Mycobacterium
WMGKKALLLQGRLWQGN

SEQ ID NO: 1092190 - protein, 18 aa, Mycobacterium
WNAALLRIAVAGRDPDEL

SEQ ID NO: 1092191 - protein, 17 aa, Mycobacterium
WNIIDFVQQLQQLTGGN

SEQ ID NO: 1092192 - protein, 19 aa, Mycobacterium
WNLEPWRPVVDDAEMIASG

SEQ ID NO: 1092193 - protein, 19 aa, Mycobacterium
WPDKPGVAGCAAMDGTVLV

SEQ ID NO: 1092194 - protein, 20 aa, Mycobacterium
WPEPAESLPPPFDNRLAQPY

SEQ ID NO: 1092195 - protein, 22 aa, Mycobacterium
WPGRLRPGMVPATFDDMITKGV

SEQ ID NO: 1092196 - protein, 25 aa, Mycobacterium
WPGSGPRPLLRYAPGTVGQGDQCAL

SEQ ID NO: 1092197 - protein, 18 aa, Mycobacterium
WPLGEIDKPFEMRRDLLM

SEQ ID NO: 1092198 - protein, 20 aa, Mycobacterium
WPNARISVMGGEHTVFVLGT

SEQ ID NO: 1092199 - protein, 18 aa, Mycobacterium
WPNGATVFEIDLPKVLEF

SEQ ID NO: 1092200 - protein, 31 aa, Mycobacterium; identical to SEQ ID NO: 1058465

SEQ ID NO: 1092201 - protein, 18 aa, Mycobacterium
WQGNVIATMAGWRTDFLN

SEQ ID NO: 1092202 - protein, 26 aa, Mycobacterium
WQLSKRTADMLLEFGNSSGLTNPAPI

SEQ ID NO: 1092203 - protein, 20 aa, Mycobacterium
WRDEFGLDLADPDRLAGRLD

SEQ ID NO: 1092204 - protein, 27 aa, Mycobacterium
WRFGVPLVCLLAGLLLAATHGVSGGAE

SEQ ID NO: 1092205 - protein, 19 aa, Mycobacterium
WRLQATKSRVRDVQVGVDV

SEQ ID NO: 1092206 - protein, 26 aa, Mycobacterium
WRPISRSSVCAMRYAKRSGAQCFPCR

SEQ ID NO: 1092207 - protein, 17 aa, Mycobacterium
WSAEGLLMYLPPDAQDR

SEQ ID NO: 1092208 - protein, 17 aa, Mycobacterium
WSALTDVLAPDMVALAH

SEQ ID NO: 1092209 - protein, 17 aa, Mycobacterium
WSGRGVLGPEAFDAVPF

SEQ ID NO: 1092210 - protein, 18 aa, Mycobacterium
WSVVEAFVGDLWPNGDVA

SEQ ID NO: 1092211 - protein, 20 aa, Mycobacterium
WVEWGGCGMVHPNVLRATGI

SEQ ID NO: 1092212 - protein, 18 aa, Mycobacterium
WYRGAARISDLVDQIRRS

SEQ ID NO: 1092213 - protein, 18 aa, Mycobacterium
WYYQSGISVAMPVGGQSS

SEQ ID NO: 1092214 - protein, 18 aa, Mycobacterium
WYYQSGISVVMPVGGQSS

SEQ ID NO: 1092215 - protein, 20 aa, Mycobacterium
YAGAEAAGVSVLQSAGADVM

SEQ ID NO: 1092216 - protein, 30 aa, Mycobacterium; identical to SEQ ID NO: 965592

SEQ ID NO: 1092217 - protein, 28 aa, Mycobacterium
YCALACAELLYRAGLPRALYAIVPGPGS

SEQ ID NO: 1092218 - protein, 25 aa, Mycobacterium
YCMPQLDAKIGWNIKRMAPGTYTRA

SEQ ID NO: 1092219 - protein, 17 aa, Mycobacterium
YDPAMRTLIAFGGKYPT

SEQ ID NO: 1092220 - protein, 18 aa, Mycobacterium
YDPLVPWTQASQLGRDWC

SEQ ID NO: 1092221 - protein, 25 aa, Mycobacterium
YDRELGGAVAHRFDFESVRSTVELA

SEQ ID NO: 1092222 - protein, 23 aa, Mycobacterium
YDSFPRSDIVTVIIGAENWREDL

SEQ ID NO: 1092223 - protein, 17 aa, Mycobacterium
YDYRRAAFGAAWDDNND

SEQ ID NO: 1092224 - protein, 18 aa, Mycobacterium
YEGLPVDGYTAWLQNMAA

SEQ ID NO: 1092225 - protein, 23 aa, Mycobacterium
YEGNVVAVLGMPVGQVTKIRPKG

SEQ ID NO: 1092226 - protein, 18 aa, Mycobacterium
YEQMWALDVAAMAAYHAE

SEQ ID NO: 1092227 - protein, 21 aa, Mycobacterium
YFAQGELLPSFAGATQAQVPR

SEQ ID NO: 1092228 - protein, 20 aa, Mycobacterium
YFVAEVLRIISGGRIIWDPA

SEQ ID NO: 1092229 - protein, 25 aa, Mycobacterium
YGNGGNGGAAGWWGTGGAGRAGGAG

SEQ ID NO: 1092230 - protein, 18 aa, Mycobacterium
YGNTELPGLFAAGEVART

SEQ ID NO: 1092231 - protein, 18 aa, Mycobacterium
YITARFLPDKAIDLVDEA

SEQ ID NO: 1092232 - protein, 18 aa, Mycobacterium
YLLIGVLHVRPLASNYAL

SEQ ID NO: 1092233 - protein, 29 aa, Mycobacterium
YLMKESFMVLFGAARSRLVAGGMVAGAMF

SEQ ID NO: 1092234 - protein, 17 aa, Mycobacterium
YLSRAGISKEQLARGGY

SEQ ID NO: 1092235 - protein, 23 aa, Mycobacterium
YNHIKIKEAYGLTKQYVAQELID

SEQ ID NO: 1092236 - protein, 20 aa, Mycobacterium
YPASRLQLHGGDGANDVISH

SEQ ID NO: 1092237 - protein, 18 aa, Mycobacterium
YPEPFLYTYCRDDDPAVL

SEQ ID NO: 1092238 - protein, 19 aa, Mycobacterium
YPILGDPSLGYGPGTSSLG

SEQ ID NO: 1092239 - protein, 20 aa, Mycobacterium
YPTPEFAALGADTWHWHPMA

SEQ ID NO: 1092240 - protein, 17 aa, Mycobacterium
YQFLPQFGALLNENPSL

SEQ ID NO: 1092241 - protein, 19 aa, Mycobacterium
YQMLYGIRDEEQWRLVGAG

SEQ ID NO: 1092242 - protein, 22 aa, Mycobacterium
YRDFRPVAVLDWEMVTLGPREL

SEQ ID NO: 1092243 - protein, 20 aa, Mycobacterium
YRSALWPGRNAEIDERMIRF

SEQ ID NO: 1092244 - protein, 17 aa, Mycobacterium
YRTFTFDTGGGRRVQLA

SEQ ID NO: 1092245 - protein, 29 aa, Mycobacterium
YSDGDIWDWAVDWGTWLSMSALPAPSART

SEQ ID NO: 1092246 - protein, 27 aa, Mycobacterium
YSVATDGRFRFLRVYPNPEVYAPVTGF

SEQ ID NO: 1092247 - protein, 25 aa, Mycobacterium
YVAAHVPYLMWLMRASATSAQAAAQ

SEQ ID NO: 1092248 - protein, 23 aa, Mycobacterium
YVEAFTRLILCNKPNTMIAAEQA

SEQ ID NO: 1092249 - protein, 23 aa, Mycobacterium
YVPSRPHLEWQLRRRVLELDNIE

SEQ ID NO: 1092250 - protein, 17 aa, Mycobacterium
YVRAARPIIFLYNKCAN

SEQ ID NO: 1092251 - protein, 21 aa, Mycobacterium
YWFGEGVLPILERKRLWHRPH

SEQ ID NO: 1092252 - protein, 19 aa, Mycobacterium
GEALTLWLSGQEQLVPRDL

SEQ ID NO: 1092253 - protein, 19 aa, Mycobacterium
KLGFPVPIRHWLRAGELLE

SEQ ID NO: 1092254 - protein, 19 aa, Mycobacterium
PFEHARPTAIMTWMRQHCG

SEQ ID NO: 1092255 - protein, 18 aa, Mycobacterium
AALTEFGRRVLLVDIDPQ

SEQ ID NO: 1092256 - protein, 17 aa, Mycobacterium
AEFSRWRSAGVGLDALL

SEQ ID NO: 1092257 - protein, 18 aa, Mycobacterium
AELCAQYLSPVLDAIKFN

SEQ ID NO: 1092258 - protein, 21 aa, Mycobacterium
AELHRPCCGDLVYGADPKLAK

SEQ ID NO: 1092259 - protein, 19 aa, Mycobacterium
AIARWPLLAAIRARRTPAV

SEQ ID NO: 1092260 - protein, 22 aa, Mycobacterium
AIASPCAYFLVYEPTASAKPAA

SEQ ID NO: 1092261 - protein, 20 aa, Mycobacterium
AIGCGLCLALAAAIRVVSTT

SEQ ID NO: 1092262 - protein, 18 aa, Mycobacterium
AIRSGHPWWTLSQLSDES

SEQ ID NO: 1092263 - protein, 18 aa, Mycobacterium
AKHYEFKQAASIADLPGE

SEQ ID NO: 1092264 - protein, 20 aa, Mycobacterium
ALNLVKCVHWPTGTTPQPPK

SEQ ID NO: 1092265 - protein, 23 aa, Mycobacterium
ALTYPRRLGFGLGSSVVSLSWRT

SEQ ID NO: 1092266 - protein, 18 aa, Mycobacterium
ARSGVDVVRLVAGDPLTV

SEQ ID NO: 1092267 - protein, 17 aa, Mycobacterium
ASDGFAVDVARALAGRR

SEQ ID NO: 1092268 - protein, 24 aa, Mycobacterium
ATPLRPGVWRAYADHRMAMAGAIV

SEQ ID NO: 1092269 - protein, 24 aa, Mycobacterium
AVELWRIVDHPNLFIKIPATKAGL

SEQ ID NO: 1092270 - protein, 20 aa, Mycobacterium
AVGGFSFVLPAGWVESEASH

SEQ ID NO: 1092271 - protein, 22 aa, Mycobacterium
CKRGRPSYCFDTFNAQQKMTLI

SEQ ID NO: 1092272 - protein, 22 aa, Mycobacterium
DATYPPTWVLRGFFPLASAPLV

SEQ ID NO: 1092273 - protein, 18 aa, Mycobacterium
DCDTVWPAFAAQLQDTIG

SEQ ID NO: 1092274 - protein, 19 aa, Mycobacterium
DGGMPWRVPEDLTRFKQLT

SEQ ID NO: 1092275 - protein, 25 aa, Mycobacterium
DGLRWSTTEPLGFNRCYTLSAKALG

SEQ ID NO: 1092276 - protein, 21 aa, Mycobacterium
DHVELLSGLGFLLNPTSAISI

SEQ ID NO: 1092277 - protein, 23 aa, Mycobacterium
DVGPSQRWFVVWLGTSNNPVDKG

SEQ ID NO: 1092278 - protein, 18 aa, Mycobacterium
EGGQRYQTLMARGAQVQR

SEQ ID NO: 1092279 - protein, 22 aa, Mycobacterium
EGISVNVTLIFSVQRHREVIDA

SEQ ID NO: 1092280 - protein, 19 aa, Mycobacterium
EGVMMLKLFIADTMGQPTI

SEQ ID NO: 1092281 - protein, 25 aa, Mycobacterium
EILTRLRGMFAFALWDTIAHELFCA

SEQ ID NO: 1092282 - protein, 22 aa, Mycobacterium
FAQPYAEWRGMFAGNGMLLPAT

SEQ ID NO: 1092283 - protein, 19 aa, Mycobacterium
FDCSGLMRYAFAGVGVLIP

SEQ ID NO: 1092284 - protein, 17 aa, Mycobacterium
FMKRSAVRWLVTRMTTI

SEQ ID NO: 1092285 - protein, 17 aa, Mycobacterium
FSALSVRALMLGFDTVA

SEQ ID NO: 1092286 - protein, 17 aa, Mycobacterium
FSGGVAFGFNRLSIIDI

SEQ ID NO: 1092287 - protein, 27 aa, Mycobacterium
FTSVPILFARPSYYGQFTDTGGLNKGD

SEQ ID NO: 1092288 - protein, 20 aa, Mycobacterium
FVRLCEPLRGVARGQTLVLY

SEQ ID NO: 1092289 - protein, 18 aa, Mycobacterium
GCCWQHVLGIELHYLALK

SEQ ID NO: 1092290 - protein, 20 aa, Mycobacterium
GELPLLFSVTNIRPGTSGSA

SEQ ID NO: 1092291 - protein, 17 aa, Mycobacterium
GGVAFGFNRLSIIDIAH

SEQ ID NO: 1092292 - protein, 18 aa, Mycobacterium
GKLYPEFGTVGALNLVKC

SEQ ID NO: 1092293 - protein, 18 aa, Mycobacterium
GKPTRPTPIGKFTALSKE

SEQ ID NO: 1092294 - protein, 19 aa, Mycobacterium
GPACARLFVASALARLGPL

SEQ ID NO: 1092295 - protein, 18 aa, Mycobacterium
GPQALSFVRQRHELPRGD

SEQ ID NO: 1092296 - protein, 17 aa, Mycobacterium
GQLTLLVLFIDRVRARV

SEQ ID NO: 1092297 - protein, 24 aa, Mycobacterium
GRQLVIRYLFYDAQGSREFAQLAQ

SEQ ID NO: 1092298 - protein, 18 aa, Mycobacterium
GRQRWCVRLVQGGGFGGP

SEQ ID NO: 1092299 - protein, 20 aa, Mycobacterium
GRVSRLKSLIGMAPSARVLA

SEQ ID NO: 1092300 - protein, 19 aa, Mycobacterium
GTIFSFPMTQWTRWRQPVI

SEQ ID NO: 1092301 - protein, 17 aa, Mycobacterium
ICWHYWPGCCWQHVLGI

SEQ ID NO: 1092302 - protein, 18 aa, Mycobacterium
IEEALRYGVVKMNVDTDT

SEQ ID NO: 1092303 - protein, 18 aa, Mycobacterium
KAAVRLGSDMGEFYLPYP

SEQ ID NO: 1092304 - protein, 17 aa, Mycobacterium
KAKGSKLATVWIAQDGS

SEQ ID NO: 1092305 - protein, 24 aa, Mycobacterium
KGNPAWDLPLVFGPVALVYNLPGV

SEQ ID NO: 1092306 - protein, 19 aa, Mycobacterium
KQFLGRLGINFGGDPSNAA

SEQ ID NO: 1092307 - protein, 21 aa, Mycobacterium
KRGGAQIGVPYSWGGGSLQGP

SEQ ID NO: 1092308 - protein, 20 aa, Mycobacterium
KRLAAGIPKAFCELDGRTLV

SEQ ID NO: 1092309 - protein, 23 aa, Mycobacterium
KSGKYPTARLVAFKLRGDFDPTQ

SEQ ID NO: 1092310 - protein, 20 aa, Mycobacterium
KTKPGEVVTIDFRRKNEPPG

SEQ ID NO: 1092311 - protein, 20 aa, Mycobacterium
LAGTVLRFVPPLAALSANPV

SEQ ID NO: 1092312 - protein, 19 aa, Mycobacterium
LCVLPEGLAAAGAAVQAPP

SEQ ID NO: 1092313 - protein, 17 aa, Mycobacterium
LGLRPGLVGVLKGPLLD

SEQ ID NO: 1092314 - protein, 18 aa, Mycobacterium
LGYMVAELIELSRLQGAE

SEQ ID NO: 1092315 - protein, 18 aa, Mycobacterium
LKSLIGMAPSARVLAQTS

SEQ ID NO: 1092316 - protein, 21 aa, Mycobacterium
LRELGRGAPYFIGAMKLILTQ

SEQ ID NO: 1092317 - protein, 17 aa, Mycobacterium
LSSGALWRARVVLGGRT

SEQ ID NO: 1092318 - protein, 25 aa, Mycobacterium
LVAALLLSSCGWRGISNVSIPGGPG

SEQ ID NO: 1092319 - protein, 19 aa, Mycobacterium
LYFNLSLWSAYDVVLMHTV

SEQ ID NO: 1092320 - protein, 20 aa, Mycobacterium
LYTPVHWKYLTSGLLGLQRG

SEQ ID NO: 1092321 - protein, 25 aa, Mycobacterium
MQQGCGGSPCKGAVVALEPSTGKIL

SEQ ID NO: 1092322 - protein, 23 aa, Mycobacterium
MRLLCLGMLFTGCAGVPNSSAPQ

SEQ ID NO: 1092323 - protein, 19 aa, Mycobacterium
MTQWTRWRQPVIGMPSTPR

SEQ ID NO: 1092324 - protein, 20 aa, Mycobacterium
NDRYPFLLGHEAAGTVEVVG

SEQ ID NO: 1092325 - protein, 17 aa, Mycobacterium
NFWRSAGLPEFRFPDPN

SEQ ID NO: 1092326 - protein, 18 aa, Mycobacterium
NGGLRYAPRADLATREEQ

SEQ ID NO: 1092327 - protein, 17 aa, Mycobacterium
NGIWRPSPGSVYPTLQL

SEQ ID NO: 1092328 - protein, 17 aa, Mycobacterium
NLPVCITKFIPLHTPAV

SEQ ID NO: 1092329 - protein, 25 aa, Mycobacterium
NPERVWGWYLWRHYLVANVKPNDGH

SEQ ID NO: 1092330 - protein, 25 aa, Mycobacterium
NREVRWRPEHFWKSGTAVDVAVNTY

SEQ ID NO: 1092331 - protein, 18 aa, Mycobacterium
NSCGVAWGMGETSGTLVM

SEQ ID NO: 1092332 - protein, 22 aa, Mycobacterium
PAGDANAIWCFNDKLCQGAIKA

SEQ ID NO: 1092333 - protein, 18 aa, Mycobacterium
PGGIYAPMIHPWSSGRDL

SEQ ID NO: 1092334 - protein, 17 aa, Mycobacterium
PGYLCWVAGVSLARQSS

SEQ ID NO: 1092335 - protein, 18 aa, Mycobacterium
PSYWSADWYPCYVNGIDA

SEQ ID NO: 1092336 - protein, 18 aa, Mycobacterium
PTPIGKFTALSKERTVVM

SEQ ID NO: 1092337 - protein, 22 aa, Mycobacterium
PVCYCGGLIRPAIVWFGEPLPD

SEQ ID NO: 1092338 - protein, 18 aa, Mycobacterium
PVEGAFYWLNNREVRWRP

SEQ ID NO: 1092339 - protein, 19 aa, Mycobacterium
PVLRPEWPYHVPSVSDLDW

SEQ ID NO: 1092340 - protein, 20 aa, Mycobacterium
QAGTDIALWVSTQTVPAVLD

SEQ ID NO: 1092341 - protein, 22 aa, Mycobacterium
QFVFLCCWARLALAPTMGTGAL

SEQ ID NO: 1092342 - protein, 17 aa, Mycobacterium
QQLHWWLVAVSHTDLLA

SEQ ID NO: 1092343 - protein, 17 aa, Mycobacterium
QRACSVLATAMMLAACG

SEQ ID NO: 1092344 - protein, 19 aa, Mycobacterium
RGDYQWRACAHLGGATVVA

SEQ ID NO: 1092345 - protein, 18 aa, Mycobacterium
RLRSGLIGVLVVLLIIGV

SEQ ID NO: 1092346 - protein, 19 aa, Mycobacterium
RMQCCWRSRLSHIVCRTFV

SEQ ID NO: 1092347 - protein, 20 aa, Mycobacterium
RPVAEFTLDVYPRYLSLIPA

SEQ ID NO: 1092348 - protein, 23 aa, Mycobacterium
RWLPGPRELRAWILAAGVPEAAN

SEQ ID NO: 1092349 - protein, 19 aa, Mycobacterium
RWVRAEVVIRLDVNGYAAL

SEQ ID NO: 1092350 - protein, 18 aa, Mycobacterium
SADWYPCYVNGIDAPVAE

SEQ ID NO: 1092351 - protein, 17 aa, Mycobacterium
SDLLRWADHAALSAKSD

SEQ ID NO: 1092352 - protein, 20 aa, Mycobacterium
SDNAIERWVHNLNVLAAQSA

SEQ ID NO: 1092353 - protein, 21 aa, Mycobacterium
SEKDRRFAVVFVHDQSDYVRM

SEQ ID NO: 1092354 - protein, 18 aa, Mycobacterium
SGLARLAKQVTYRRPKQL

SEQ ID NO: 1092355 - protein, 17 aa, Mycobacterium
SGLCGRSDLAGLNLAQY

SEQ ID NO: 1092356 - protein, 17 aa, Mycobacterium
SGPYLARGAADLVPTAQ

SEQ ID NO: 1092357 - protein, 22 aa, Mycobacterium
SRRLWTVLIFMLWHAIFIEHSV

SEQ ID NO: 1092358 - protein, 20 aa, Mycobacterium
SSAQLPVWLSRSGADVVRTH

SEQ ID NO: 1092359 - protein, 23 aa, Mycobacterium
TATEKASVLSFVLAGHEPLEVGK

SEQ ID NO: 1092360 - protein, 24 aa, Mycobacterium
TGTIAYRFTWHLPKNRTWSYDGQL

SEQ ID NO: 1092361 - protein, 27 aa, Mycobacterium
TITARLNFQLGFGMRVGQRLTEARDHI

SEQ ID NO: 1092362 - protein, 24 aa, Mycobacterium
TNGKFSIAIGDMITGVIVGLEPDA

SEQ ID NO: 1092363 - protein, 17 aa, Mycobacterium
TRPTPIGKFTALSKERT

SEQ ID NO: 1092364 - protein, 30 aa, Mycobacterium
TSRARLNWWESRALYGWTVLVPRTKDQAGE

SEQ ID NO: 1092365 - protein, 24 aa, Mycobacterium
VARYLFRRVVSWGRSSNVFLRNGA

SEQ ID NO: 1092366 - protein, 17 aa, Mycobacterium
VASDAAGVVGWWINPQA

SEQ ID NO: 1092367 - protein, 17 aa, Mycobacterium
VEPDLTNAVAFLAAAAV

SEQ ID NO: 1092368 - protein, 19 aa, Mycobacterium
VGILTCWRSPSSSRCVLTE

SEQ ID NO: 1092369 - protein, 18 aa, Mycobacterium
VKLFDDWSNLGSISDLST

SEQ ID NO: 1092370 - protein, 25 aa, Mycobacterium
VLDEATGRWGLRVARVELRSIDPPP

SEQ ID NO: 1092371 - protein, 19 aa, Mycobacterium
VLGTGITWTSFRSFEDGIF

SEQ ID NO: 1092372 - protein, 25 aa, Mycobacterium
VMDLIKGVVMPAVMQGVQNGNVAGD

SEQ ID NO: 1092373 - protein, 18 aa, Mycobacterium
VNILFRLYSPLIFAIYCL

SEQ ID NO: 1092374 - protein, 23 aa, Mycobacterium
VPLRLHPDIHLFAAIPEERSSTA

SEQ ID NO: 1092375 - protein, 17 aa, Mycobacterium
VRNGRPVAEFTLDVYPR

SEQ ID NO: 1092376 - protein, 25 aa, Mycobacterium
VRWVSACELRFGYRTSVFKQADPSG

SEQ ID NO: 1092377 - protein, 21 aa, Mycobacterium
VSRPTARFVRPAIPSLVSAAL

SEQ ID NO: 1092378 - protein, 19 aa, Mycobacterium
VVISSGWNLMDFLKQLQSL

SEQ ID NO: 1092379 - protein, 18 aa, Mycobacterium
VVMAHTFISLSFLGISHG

SEQ ID NO: 1092380 - protein, 20 aa, Mycobacterium
VVPDPRYVAVLGHDQLATEL

SEQ ID NO: 1092381 - protein, 18 aa, Mycobacterium
VVVDQLWRASALAEMISE

SEQ ID NO: 1092382 - protein, 17 aa, Mycobacterium
VYGGQAIEYVIKRGGAQ

SEQ ID NO: 1092383 - protein, 19 aa, Mycobacterium
WASWCASCLGELPAMVEYQ

SEQ ID NO: 1092384 - protein, 18 aa, Mycobacterium
WVILLLRLVSGGSFTGAE

SEQ ID NO: 1092385 - protein, 17 aa, Mycobacterium
WYPWAWLAHRDAQTTST

SEQ ID NO: 1092386 - protein, 23 aa, Mycobacterium
YGSALDAALCWQRDGADWIHLVD

SEQ ID NO: 1092387 - protein, 17 aa, Mycobacterium
YLPPGVGHLSGFAVPSH

SEQ ID NO: 1092388 - protein, 18 aa, Mycobacterium
YQTLMARGAQVQRPLWAS

SEQ ID NO: 1092389 - protein, 18 aa, Mycobacterium
YRADVDWATQLSYSGVFL

SEQ ID NO: 1092390 - protein, 17 aa, Mycobacterium
YWPGCCWQHVLGIELHY

SEQ ID NO: 1092391 - protein, 19 aa, Mycobacterium
AAAGLVTWVATIALAPPAL

SEQ ID NO: 1092392 - protein, 18 aa, Mycobacterium
AAATAWDGLVAELGEAAE

SEQ ID NO: 1092393 - protein, 19 aa, Mycobacterium
AAEFHDRFVEILQTSAQAY

SEQ ID NO: 1092394 - protein, 17 aa, Mycobacterium
AAFSAVKPSVAWAETYP

SEQ ID NO: 1092395 - protein, 21 aa, Mycobacterium
AAHITRLPVRYTFDNRYFSDT

SEQ ID NO: 1092396 - protein, 19 aa, Mycobacterium
AAKLCVQYLAPILKNRQYN

SEQ ID NO: 1092397 - protein, 19 aa, Mycobacterium
AALKLFAVKGYAATSVADI

SEQ ID NO: 1092398 - protein, 19 aa, Mycobacterium
AAQALAFVRQRHGLDNGDL

SEQ ID NO: 1092399 - protein, 19 aa, Mycobacterium
AATEARYGEMWAQDASAMY

SEQ ID NO: 1092400 - protein, 23 aa, Mycobacterium
ADPAGWPRLDWSMDAALLLAALA

SEQ ID NO: 1092401 - protein, 19 aa, Mycobacterium
ADRGGVVGACAAVAAESAG

SEQ ID NO: 1092402 - protein, 17 aa, Mycobacterium
ADRLIVIYADFKGEAGA

SEQ ID NO: 1092403 - protein, 26 aa, Mycobacterium
ADVLRRLRGMFAFALWDTVTRELFCA

SEQ ID NO: 1092404 - protein, 20 aa, Mycobacterium
AEAFSRPGLPVEYLQVPSPS

SEQ ID NO: 1092405 - protein, 23 aa, Mycobacterium
AEDPRVGGLIARVQLPPAPIGAV

SEQ ID NO: 1092406 - protein, 19 aa, Mycobacterium
AEGRLGWRTLDFDVEVLPI

SEQ ID NO: 1092407 - protein, 17 aa, Mycobacterium
AELLYRAGLPRALYAIV

SEQ ID NO: 1092408 - protein, 19 aa, Mycobacterium
AERAGRRLIGFSAELGGKN

SEQ ID NO: 1092409 - protein, 17 aa, Mycobacterium
AEVPRELGVPVAPVVPA

SEQ ID NO: 1092410 - protein, 24 aa, Mycobacterium
AFFTSRCNMIAWDRGVFMPVAQEY

SEQ ID NO: 1092411 - protein, 18 aa, Mycobacterium
AGAPRGQTGPAFAASSPS

SEQ ID NO: 1092412 - protein, 27 aa, Mycobacterium
AGGPGGAGGWLWGGGGAGGLGGPASGA

SEQ ID NO: 1092413 - protein, 19 aa, Mycobacterium
AGHGALFTRAPWVVSVDDH

SEQ ID NO: 1092414 - protein, 19 aa, Mycobacterium
AGIASLFGAHAYNYQVLSA

SEQ ID NO: 1092415 - protein, 17 aa, Mycobacterium
AGLFGGAGGAGGMGATG

SEQ ID NO: 1092416 - protein, 18 aa, Mycobacterium
AGLFIGEPGTGWVADPGN

SEQ ID NO: 1092417 - protein, 19 aa, Mycobacterium
AGMQVSIPWPYSGNVHCEI

SEQ ID NO: 1092418 - protein, 17 aa, Mycobacterium
AIPPPWRSEVHTGPASD

SEQ ID NO: 1092419 - protein, 23 aa, Mycobacterium
AIRRLAVPIVLLWLALAAITNAS

SEQ ID NO: 1092420 - protein, 20 aa, Mycobacterium
AIVFLVWRYVVPPVRRMMAA

SEQ ID NO: 1092421 - protein, 18 aa, Mycobacterium
AKLCVQYLAPIIKNRQYN

SEQ ID NO: 1092422 - protein, 24 aa, Mycobacterium
ALAPWKQVLRNLGIDIGKNGQINL

SEQ ID NO: 1092423 - protein, 18 aa, Mycobacterium
ALGGRAGLFIGEPGTGWV

SEQ ID NO: 1092424 - protein, 18 aa, Mycobacterium
ALIEVCGVLGYDARRDSD

SEQ ID NO: 1092425 - protein, 19 aa, Mycobacterium
ALLARPLIGDGTNGAPGTG

SEQ ID NO: 1092426 - protein, 18 aa, Mycobacterium
ALLISRLVSWVDDLWCRA

SEQ ID NO: 1092427 - protein, 18 aa, Mycobacterium
ALTGQVLWQQLDDVPLVP

SEQ ID NO: 1092428 - protein, 24 aa, Mycobacterium
AMAAAARPYASWLGTAAARAAVTA

SEQ ID NO: 1092429 - protein, 24 aa, Mycobacterium
APGLTRTRGRVCSVTAATGAAPSP

SEQ ID NO: 1092430 - protein, 19 aa, Mycobacterium
APPEPRLWGAFTERGLSNM

SEQ ID NO: 1092431 - protein, 24 aa, Mycobacterium
APQLDRIQSWLGLQGIDLTTPSGL

SEQ ID NO: 1092432 - protein, 19 aa, Mycobacterium
AQMLQRIVALMPMGVAVVD

SEQ ID NO: 1092433 - protein, 24 aa, Mycobacterium
AQRLRAVVLFATWAGRVLDGAPQN

SEQ ID NO: 1092434 - protein, 18 aa, Mycobacterium
ARLKLAIRSAEMHFIPSN

SEQ ID NO: 1092435 - protein, 22 aa, Mycobacterium
ARPYRLPWPTGMRVYEIDQPEV

SEQ ID NO: 1092436 - protein, 20 aa, Mycobacterium
ARVDCGLAGTVLRFAPPLAA

SEQ ID NO: 1092437 - protein, 23 aa, Mycobacterium
ATPLRPGSWRAYADHRMAMAGAI

SEQ ID NO: 1092438 - protein, 18 aa, Mycobacterium
ATPSFLGYHGFPASICAS

SEQ ID NO: 1092439 - protein, 18 aa, Mycobacterium
AVEGAFYWLNNREVRWRP

SEQ ID NO: 1092440 - protein, 18 aa, Mycobacterium
AVGARLSQRLVRRRQQAS

SEQ ID NO: 1092441 - protein, 24 aa, Mycobacterium
AVTAAEVPLAFALAAGSFRDATRV

SEQ ID NO: 1092442 - protein, 20 aa, Mycobacterium
CGGPCKGAVVALEPSTGKIL

SEQ ID NO: 1092443 - protein, 22 aa, Mycobacterium
CGSEAWDLPVVFGPIAVTYNLK

SEQ ID NO: 1092444 - protein, 18 aa, Mycobacterium
CGYSDCRVLTTFTACGAV

SEQ ID NO: 1092445 - protein, 17 aa, Mycobacterium
CPGGRWGWGELAVCDGE

SEQ ID NO: 1092446 - protein, 19 aa, Mycobacterium
CPKDTWCVINAGNYRGSMS

SEQ ID NO: 1092447 - protein, 25 aa, Mycobacterium
CQQAWCPVCALTALVIGEQHPLLTV

SEQ ID NO: 1092448 - protein, 17 aa, Mycobacterium
DALGWKLNGKFREKDGH

SEQ ID NO: 1092449 - protein, 18 aa, Mycobacterium
DAQLPAGGMLFIDTPDGQ

SEQ ID NO: 1092450 - protein, 23 aa, Mycobacterium
DAQPRLSILLGDYVVPAEGRVGL

SEQ ID NO: 1092451 - protein, 22 aa, Mycobacterium
DEVSAAIAALFSGHGQAYQQIS

SEQ ID NO: 1092452 - protein, 26 aa, Mycobacterium
DEVSTAIAALFGWHAQTYQSLSAQAT

SEQ ID NO: 1092453 - protein, 21 aa, Mycobacterium
DEVSVAVARLFDGHGQAYQTI

SEQ ID NO: 1092454 - protein, 25 aa, Mycobacterium
DGGTRPKGTLFFRSGGDGGFGGWGG

SEQ ID NO: 1092455 - protein, 19 aa, Mycobacterium
DGLSLGEALTLWLSGQEQL

SEQ ID NO: 1092456 - protein, 21 aa, Mycobacterium
DGYPQRFGIPDGLYAEPVAVK

SEQ ID NO: 1092457 - protein, 23 aa, Mycobacterium
DISRAEEVLGWRPQVELADGVRR

SEQ ID NO: 1092458 - protein, 17 aa, Mycobacterium
DLFWALRGGGGGNFGVT

SEQ ID NO: 1092459 - protein, 19 aa, Mycobacterium
DQPFAVWPWAQPKLGAAQP

SEQ ID NO: 1092460 - protein, 17 aa, Mycobacterium
DSKGCWQLSITESTDVS

SEQ ID NO: 1092461 - protein, 23 aa, Mycobacterium
DVREPRWTWRLRRRCRRNWFVRQ

SEQ ID NO: 1092462 - protein, 18 aa, Mycobacterium
DWLRPDYIPPQAIPPQQA

SEQ ID NO: 1092463 - protein, 17 aa, Mycobacterium
EAMLKAGAVATWAVAVD

SEQ ID NO: 1092464 - protein, 17 aa, Mycobacterium
EDPRWTCSHAMALQDSV

SEQ ID NO: 1092465 - protein, 19 aa, Mycobacterium
EELARYGVQPDWFQLGDRD

SEQ ID NO: 1092466 - protein, 22 aa, Mycobacterium
EGISVNVTLIFSVDRHRGVMDA

SEQ ID NO: 1092467 - protein, 21 aa, Mycobacterium
EGPCETIGGLVLRQLGHIPVA

SEQ ID NO: 1092468 - protein, 24 aa, Mycobacterium
EHRCPLCAEPVRWRLVGEEAELRP

SEQ ID NO: 1092469 - protein, 18 aa, Mycobacterium
EKLWTIADLGGWDTVDPQ

SEQ ID NO: 1092470 - protein, 20 aa, Mycobacterium
ELGLRPRLAIGIHQPPVAAR

SEQ ID NO: 1092471 - protein, 19 aa, Mycobacterium
ELRIDPRLQLAAEWHTNDV

SEQ ID NO: 1092472 - protein, 17 aa, Mycobacterium
ERFAFCSTFKGLLGAAV

SEQ ID NO: 1092473 - protein, 18 aa, Mycobacterium
ERLTEFFGGIPILDGVGS

SEQ ID NO: 1092474 - protein, 24 aa, Mycobacterium
ESGVAGTWNMRWADLSLPPQAAVI

SEQ ID NO: 1092475 - protein, 20 aa, Mycobacterium
ESPPKRPAVEELLAPLEQAR

SEQ ID NO: 1092476 - protein, 19 aa, Mycobacterium
EVNSALMFTGAGSAPTLAA

SEQ ID NO: 1092477 - protein, 22 aa, Mycobacterium
FAKPYAEWRGMFAGNGMLLPSS

SEQ ID NO: 1092478 - protein, 18 aa, Mycobacterium
FAPAPAQVPAPMQVPAAT

SEQ ID NO: 1092479 - protein, 20 aa, Mycobacterium
FAPGELKNLPGYEGSNNGSA

SEQ ID NO: 1092480 - protein, 25 aa, Mycobacterium
FEEGLRTTIDWYRANESWWRPLKDA

SEQ ID NO: 1092481 - protein, 20 aa, Mycobacterium
FGVPLVCLLAGLLLAATHGV

SEQ ID NO: 1092482 - protein, 19 aa, Mycobacterium
FLRRFSLLDSLYIVPPPRL

SEQ ID NO: 1092483 - protein, 22 aa, Mycobacterium
FNRDAWGVAMIGNFDDVAPTPL

SEQ ID NO: 1092484 - protein, 21 aa, Mycobacterium
FPSYRLDHRFEVIKLVGELSD

SEQ ID NO: 1092485 - protein, 17 aa, Mycobacterium
FRGSAPILTGSTVTDQA

SEQ ID NO: 1092486 - protein, 19 aa, Mycobacterium
FSSLSGWAQLGLRGQFVDL

SEQ ID NO: 1092487 - protein, 25 aa, Mycobacterium
FTSVPMIFARPSYYGQFTDSGGINN

SEQ ID NO: 1092488 - protein, 19 aa, Mycobacterium
FYLPLVVRRRITFLAKAEY

SEQ ID NO: 1092489 - protein, 18 aa, Mycobacterium
GAAARNGRRLVIAMMYGL

SEQ ID NO: 1092490 - protein, 18 aa, Mycobacterium
GAECRRVGIADAHCVLPL

SEQ ID NO: 1092491 - protein, 17 aa, Mycobacterium
GAKRPRRAPTIAASVIA

SEQ ID NO: 1092492 - protein, 22 aa, Mycobacterium
GARPRLTPIVGLLTPDGLVTND

SEQ ID NO: 1092493 - protein, 19 aa, Mycobacterium
GATYQRWQELGAMNSVLGA

SEQ ID NO: 1092494 - protein, 17 aa, Mycobacterium
GAVAHRFDFESVRSTVE

SEQ ID NO: 1092495 - protein, 18 aa, Mycobacterium
GDAGGPGGLLFGNGGNGG

SEQ ID NO: 1092496 - protein, 24 aa, Mycobacterium
GDEVSADIAALFSDHALQYQAVSA

SEQ ID NO: 1092497 - protein, 19 aa, Mycobacterium
GDHQFGFGGFNSGSGNVGI

SEQ ID NO: 1092498 - protein, 23 aa, Mycobacterium
GDIWDWAVDWDTWVGMSALLSFP

SEQ ID NO: 1092499 - protein, 20 aa, Mycobacterium
GDLRVDFAWLGTVVQAYLRR

SEQ ID NO: 1092500 - protein, 20 aa, Mycobacterium
GDRWYWHWDPRFISGTAAFL

SEQ ID NO: 1092501 - protein, 17 aa, Mycobacterium
GEVSWQWEGAGAESYVA

SEQ ID NO: 1092502 - protein, 21 aa, Mycobacterium
GGAAPGGFDCSGLVMWAFQQA

SEQ ID NO: 1092503 - protein, 18 aa, Mycobacterium
GGAGGLLFGQGGAGGANG

SEQ ID NO: 1092504 - protein, 24 aa, Mycobacterium
GGAGGYGGHGGWLYGSGGTGGDGG

SEQ ID NO: 1092505 - protein, 26 aa, Mycobacterium
GGFVENFDFFGFGVAHGGDGGSGGAA

SEQ ID NO: 1092506 - protein, 23 aa, Mycobacterium
GGIRGPIGLGYRVPCFVISPYSR

SEQ ID NO: 1092507 - protein, 18 aa, Mycobacterium
GGKCPDVLMAWELSYAEL

SEQ ID NO: 1092508 - protein, 25 aa, Mycobacterium
GGMATARIPAGINFNVGGAGGHGGA

SEQ ID NO: 1092509 - protein, 22 aa, Mycobacterium
GGNGGAGGWLFGNGGNGGHGGQ

SEQ ID NO: 1092510 - protein, 22 aa, Mycobacterium
GGNGGYGGWGFNGGNGGNGGDG

SEQ ID NO: 1092511 - protein, 19 aa, Mycobacterium
GGSQMGVPYSWGGGSLQGP

SEQ ID NO: 1092512 - protein, 22 aa, Mycobacterium
GLARLIGFNSMRVFLHDQLWAS

SEQ ID NO: 1092513 - protein, 24 aa, Mycobacterium
GLLARFPGFYIPFLDVSFNGATPA

SEQ ID NO: 1092514 - protein, 18 aa, Mycobacterium
GNLARIGSSIGVANAAAA

SEQ ID NO: 1092515 - protein, 18 aa, Mycobacterium
GPIGLGYRVPCIVISPYS

SEQ ID NO: 1092516 - protein, 25 aa, Mycobacterium
GPPEHLKWIGQWGIFDALRSGSEVV

SEQ ID NO: 1092517 - protein, 20 aa, Mycobacterium
GPTLFLPLTSLRGLRRHSKK

SEQ ID NO: 1092518 - protein, 19 aa, Mycobacterium
GQGPAAWPKCSSAGGLPPV

SEQ ID NO: 1092519 - protein, 19 aa, Mycobacterium
GQLMLLVPFIERVRARVDL

SEQ ID NO: 1092520 - protein, 17 aa, Mycobacterium
GQMAVLAVGGWMAAQGT

SEQ ID NO: 1092521 - protein, 18 aa, Mycobacterium
GQTGPAFAASSPSTGITA

SEQ ID NO: 1092522 - protein, 17 aa, Mycobacterium
GRGRWLAFTASLALSAA

SEQ ID NO: 1092523 - protein, 17 aa, Mycobacterium
GRNGVPVIGDRTRHVLA

SEQ ID NO: 1092524 - protein, 24 aa, Mycobacterium
GSAYSGYVGIAFGQGGAGGIGGAA

SEQ ID NO: 1092525 - protein, 25 aa, Mycobacterium
GSCVAFDFVGFAAAHGGAGGTGGAA

SEQ ID NO: 1092526 - protein, 24 aa, Mycobacterium
GTGKRATSVIPRYGVRLTVMARPP

SEQ ID NO: 1092527 - protein, 23 aa, Mycobacterium
GTQRPSTMWAQYGLAGVLEYEHF

SEQ ID NO: 1092528 - protein, 27 aa, Mycobacterium
GTRRRIRAVAAIARIPSLATVAAVTTG

SEQ ID NO: 1092529 - protein, 20 aa, Mycobacterium
GVAANWRAGGGWTDGRQRLG

SEQ ID NO: 1092530 - protein, 19 aa, Mycobacterium
GVGLRAFELAVRYAQQRHT

SEQ ID NO: 1092531 - protein, 24 aa, Mycobacterium
GVSSRLRLTGVAAVAAGAPITPGA

SEQ ID NO: 1092532 - protein, 20 aa, Mycobacterium
GYEALLLMCIDPRFVHPTNE

SEQ ID NO: 1092533 - protein, 23 aa, Mycobacterium
HDIHATKLIVEWPPRDYVPDPDP

SEQ ID NO: 1092534 - protein, 20 aa, Mycobacterium
HGLPSLGFNLCRIFTDGDYT

SEQ ID NO: 1092535 - protein, 19 aa, Mycobacterium
HHRRLFAVLATLNTATAVI

SEQ ID NO: 1092536 - protein, 19 aa, Mycobacterium
HWQTAAVLFGVWWIGAEVV

SEQ ID NO: 1092537 - protein, 19 aa, Mycobacterium
HYERIRYAYDWAEDDDSFF

SEQ ID NO: 1092538 - protein, 22 aa, Mycobacterium
HYIRRLDLVGGRGVTMCHGLGP

SEQ ID NO: 1092539 - protein, 18 aa, Mycobacterium
IACLRANGLAACYVSGFL

SEQ ID NO: 1092540 - protein, 17 aa, Mycobacterium
IATLLAHYGIDAVLTNL

SEQ ID NO: 1092541 - protein, 18 aa, Mycobacterium
IAVEGAYLRRALPDHTPA

SEQ ID NO: 1092542 - protein, 18 aa, Mycobacterium
IDATHAWAAVWTPQQPGQ

SEQ ID NO: 1092543 - protein, 20 aa, Mycobacterium
IDLLKGVLVSSIMQAVQNGG

SEQ ID NO: 1092544 - protein, 17 aa, Mycobacterium
IDLPVPDGWQLLPEGSG

SEQ ID NO: 1092545 - protein, 22 aa, Mycobacterium
IGAPGTEVWTFTALKPGTTTIT

SEQ ID NO: 1092546 - protein, 18 aa, Mycobacterium
IHFQEWWVRYRAELPTHS

SEQ ID NO: 1092547 - protein, 18 aa, Mycobacterium
ILDREWLHRGSIVVADNV

SEQ ID NO: 1092548 - protein, 19 aa, Mycobacterium
ILLAGLVGMCSFQPGATKR

SEQ ID NO: 1092549 - protein, 19 aa, Mycobacterium
IMRDCKYTAIGVWSENSLD

SEQ ID NO: 1092550 - protein, 17 aa, Mycobacterium
IPLWDYIAVVGWSTEVS

SEQ ID NO: 1092551 - protein, 17 aa, Mycobacterium
ISRSSVCAMRYAKRSGA

SEQ ID NO: 1092552 - protein, 17 aa, Mycobacterium
ISSIKWAPDETGIIPTS

SEQ ID NO: 1092553 - protein, 24 aa, Mycobacterium
ISTRVAEFHAQFERVFAAGVQAYS

SEQ ID NO: 1092554 - protein, 21 aa, Mycobacterium
IWDWAVDWGTWLSMSALPAPS

SEQ ID NO: 1092555 - protein, 21 aa, Mycobacterium
KAAELRYGRIPEMEKKLDAAV

SEQ ID NO: 1092556 - protein, 17 aa, Mycobacterium
KEAFPRATVLNGYGMTE

SEQ ID NO: 1092557 - protein, 20 aa, Mycobacterium
KECPAPGVMQGCLDSTSGLI

SEQ ID NO: 1092558 - protein, 19 aa, Mycobacterium
KLQAARLVAWSSAGAEGPP

SEQ ID NO: 1092559 - protein, 17 aa, Mycobacterium
KRPRRAPTIAASVIAAL

SEQ ID NO: 1092560 - protein, 21 aa, Mycobacterium
KRSAVRWLVTRMTTITSLDLT

SEQ ID NO: 1092561 - protein, 22 aa, Mycobacterium
KRSAVRWLVTRMTTITSLDLTP

SEQ ID NO: 1092562 - protein, 25 aa, Mycobacterium
KRYDWRKFIGSLKFTLWRLQERVVG

SEQ ID NO: 1092563 - protein, 20 aa, Mycobacterium
KYMQRWPFRFFAERKWFTIA

SEQ ID NO: 1092564 - protein, 26 aa, Mycobacterium
LADPALRLAVCKGIDRRTIAKVALYG

SEQ ID NO: 1092565 - protein, 22 aa, Mycobacterium
LAEAGWPVQLWAAAMPQQTTSA

SEQ ID NO: 1092566 - protein, 20 aa, Mycobacterium
LAGTVLRFAPPLAALSAAPI

SEQ ID NO: 1092567 - protein, 23 aa, Mycobacterium
LAKGLEMVGAFLPSLNESIASGP

SEQ ID NO: 1092568 - protein, 24 aa, Mycobacterium
LANAKRWGVLHVIWRQKIYPGIVA

SEQ ID NO: 1092569 - protein, 17 aa, Mycobacterium
LASIVAAALMFPFAGGI

SEQ ID NO: 1092570 - protein, 17 aa, Mycobacterium
LDDVLIFDALNPDELVQ

SEQ ID NO: 1092571 - protein, 17 aa, Mycobacterium
LDIPRFVESAFHGLGAT

SEQ ID NO: 1092572 - protein, 18 aa, Mycobacterium
LDLLAAYIAVAATASLSL

SEQ ID NO: 1092573 - protein, 21 aa, Mycobacterium
LDPAEAISHGFVDSQNLLAWR

SEQ ID NO: 1092574 - protein, 18 aa, Mycobacterium
LDPSLARRFMEAYGDVLY

SEQ ID NO: 1092575 - protein, 19 aa, Mycobacterium
LEAIGIDLSDVFDVLESEG

SEQ ID NO: 1092576 - protein, 24 aa, Mycobacterium
LEDWRRDRPGLGFGGNLFDVATLF

SEQ ID NO: 1092577 - protein, 17 aa, Mycobacterium
LEMWAQDVAAMVGYHGG

SEQ ID NO: 1092578 - protein, 17 aa, Mycobacterium
LEPMAGKIIHCGAAGAG

SEQ ID NO: 1092579 - protein, 25 aa, Mycobacterium
LERLKYLPLDPFRISYAYTNFGVTA

SEQ ID NO: 1092580 - protein, 17 aa, Mycobacterium
LFGVWWIGAEVVLDGAA

SEQ ID NO: 1092581 - protein, 20 aa, Mycobacterium
LGGAHPFTWHKAFNYNLGTK

SEQ ID NO: 1092582 - protein, 23 aa, Mycobacterium
LGIAKGGLLGGVYAYLDNNNQLV

SEQ ID NO: 1092583 - protein, 20 aa, Mycobacterium
LGPVLRRLTANYPPFLFHPL

SEQ ID NO: 1092584 - protein, 25 aa, Mycobacterium
LGRYGVCANAICPRARTAMTADVFG

SEQ ID NO: 1092585 - protein, 20 aa, Mycobacterium
LGSDMGEFFMPYPGTRINQE

SEQ ID NO: 1092586 - protein, 17 aa, Mycobacterium
LGTVLSISEGVGTRPSP

SEQ ID NO: 1092587 - protein, 17 aa, Mycobacterium
LIASLWAATAFLTALLV

SEQ ID NO: 1092588 - protein, 18 aa, Mycobacterium
LKDGRQWRIPMWQLNAGA

SEQ ID NO: 1092589 - protein, 17 aa, Mycobacterium
LKIVSCYQYGKGNTADW

SEQ ID NO: 1092590 - protein, 19 aa, Mycobacterium
LKIVSCYQYGKGNTADWLG

SEQ ID NO: 1092591 - protein, 28 aa, Mycobacterium
LLGMVNALAAAVLGRPLIGNGTNGAPGS

SEQ ID NO: 1092592 - protein, 18 aa, Mycobacterium
LLLARAVLSPARIVLLDE

SEQ ID NO: 1092593 - protein, 19 aa, Mycobacterium
LLYRLERPLFFAFQCLPLN

SEQ ID NO: 1092594 - protein, 21 aa, Mycobacterium
LMLRAPFRLTREVLPHLRPGS

SEQ ID NO: 1092595 - protein, 17 aa, Mycobacterium
LNEKLRAANDFDNQMLG

SEQ ID NO: 1092596 - protein, 25 aa, Mycobacterium
LNTFRHLYGLECSHIAPANVYGPRQ

SEQ ID NO: 1092597 - protein, 26 aa, Mycobacterium
LPFPLSSAMLPRFLYTKEIGRRLNNF

SEQ ID NO: 1092598 - protein, 17 aa, Mycobacterium
LPGAPAFDHYELADAEY

SEQ ID NO: 1092599 - protein, 18 aa, Mycobacterium
LPLTSLRGLRRHSKKRSG

SEQ ID NO: 1092600 - protein, 21 aa, Mycobacterium
LQAGTDIALWVSTEEVPAVLD

SEQ ID NO: 1092601 - protein, 18 aa, Mycobacterium
LREIRMALTLDKTFTKPE

SEQ ID NO: 1092602 - protein, 17 aa, Mycobacterium
LRIPIGVTGTGEPLMFD

SEQ ID NO: 1092603 - protein, 17 aa, Mycobacterium
LRLGTVLSISEGVGTRP

SEQ ID NO: 1092604 - protein, 17 aa, Mycobacterium
LRRHFDWVRSWYDFAVP

SEQ ID NO: 1092605 - protein, 19 aa, Mycobacterium
LRTATPLGDVFVALRPPAG

SEQ ID NO: 1092606 - protein, 18 aa, Mycobacterium
LRTATPLGDVFVSIVPPS

SEQ ID NO: 1092607 - protein, 27 aa, Mycobacterium
LRWMREIFMPWVWRWLRGKSSADGRVP

SEQ ID NO: 1092608 - protein, 28 aa, Mycobacterium
LRWMREIFMPWVWRWLRGKSSADGRVPK

SEQ ID NO: 1092609 - protein, 21 aa, Mycobacterium
LSDDMPGFGLVMFGAIREAGA

SEQ ID NO: 1092610 - protein, 21 aa, Mycobacterium
LSDLQPGDVLTFYSDASHAGI

SEQ ID NO: 1092611 - protein, 18 aa, Mycobacterium
LSGLRLGTVLSISEGVGT

SEQ ID NO: 1092612 - protein, 25 aa, Mycobacterium
LSLLKLSGFCLLASIVAAALMFPFA

SEQ ID NO: 1092613 - protein, 21 aa, Mycobacterium
LSMAHLRGTLDIFARAEFGPS

SEQ ID NO: 1092614 - protein, 17 aa, Mycobacterium
LSPRVAATIPQLVQLAP

SEQ ID NO: 1092615 - protein, 18 aa, Mycobacterium
LSSCGWRGISNVAIPGAP

SEQ ID NO: 1092616 - protein, 21 aa, Mycobacterium
LTAGCWPTWWLGNQDRGEIDI

SEQ ID NO: 1092617 - protein, 18 aa, Mycobacterium
LTDLSWRGPASESMAASA

SEQ ID NO: 1092618 - protein, 19 aa, Mycobacterium
LVSYLRLSGKIAQDTSFDG

SEQ ID NO: 1092619 - protein, 17 aa, Mycobacterium
LVVGFVGWRLYQKLTNN

SEQ ID NO: 1092620 - protein, 17 aa, Mycobacterium
MGLGLVSQFFGKYFSPA

SEQ ID NO: 1092621 - protein, 19 aa, Mycobacterium
MPGGIYAPMMHPWSTGKDV

SEQ ID NO: 1092622 - protein, 18 aa, Mycobacterium
MQPADAWVAQLLAGWTEA

SEQ ID NO: 1092623 - protein, 19 aa, Mycobacterium
MVGPCRLPAAGEFPDGAAM

SEQ ID NO: 1092624 - protein, 17 aa, Mycobacterium
NAGPLQPLLDLINAPTQ

SEQ ID NO: 1092625 - protein, 25 aa, Mycobacterium
NALEITLPMPPRWTPVPDPNVPDAF

SEQ ID NO: 1092626 - protein, 19 aa, Mycobacterium
NAPGCAGCCQCAIGCPSNA

SEQ ID NO: 1092627 - protein, 25 aa, Mycobacterium
NAPTMAWLGRPLIGDGANGVDGTGG

SEQ ID NO: 1092628 - protein, 22 aa, Mycobacterium
NEGPPQRWFVVWLGTSNDPVDK

SEQ ID NO: 1092629 - protein, 19 aa, Mycobacterium
NGGAAGWWGTGGAGRAGGA

SEQ ID NO: 1092630 - protein, 17 aa, Mycobacterium
NGTHSWPYWNQQLVAMK

SEQ ID NO: 1092631 - protein, 24 aa, Mycobacterium
NIQPQGRFSWRTMPDNLSDAGISW

SEQ ID NO: 1092632 - protein, 18 aa, Mycobacterium
NLALDRFADFPTLPLDPS

SEQ ID NO: 1092633 - protein, 18 aa, Mycobacterium
NNRCPLTSYVLVGFSQGA

SEQ ID NO: 1092634 - protein, 21 aa, Mycobacterium
NPEIRPAHLLMALLTQADGIA

SEQ ID NO: 1092635 - protein, 22 aa, Mycobacterium
NPPVEGSWAWLPDEAKGARVHW

SEQ ID NO: 1092636 - protein, 24 aa, Mycobacterium
NREVRWRPEHFWKSGTSVDVAVNT

SEQ ID NO: 1092637 - protein, 20 aa, Mycobacterium
NRLYWMSAWVDPNGEQGGPL

SEQ ID NO: 1092638 - protein, 24 aa, Mycobacterium
NVNYRILLKPGWGFTDGSPVTAHS

SEQ ID NO: 1092639 - protein, 19 aa, Mycobacterium
NVPDAFAVIADRVGGNSVY

SEQ ID NO: 1092640 - protein, 18 aa, Mycobacterium
NVPLTYPFVLAFPSVMAL

SEQ ID NO: 1092641 - protein, 18 aa, Mycobacterium
NWDQAYRKPITWEKLWQP

SEQ ID NO: 1092642 - protein, 24 aa, Mycobacterium
PAEVQRLPLNVTWVNLTTGKSGSV

SEQ ID NO: 1092643 - protein, 19 aa, Mycobacterium
PAFTQRGSGHFVFVSSISG

SEQ ID NO: 1092644 - protein, 19 aa, Mycobacterium
PATEWTLNWAHELIDKAPH

SEQ ID NO: 1092645 - protein, 21 aa, Mycobacterium
PDIKSVDAYSLLASRGATTEG

SEQ ID NO: 1092646 - protein, 20 aa, Mycobacterium
PDMRARRSGAIVNISSIAVA

SEQ ID NO: 1092647 - protein, 20 aa, Mycobacterium
PEGAPPRALWHLGAGATATP

SEQ ID NO: 1092648 - protein, 19 aa, Mycobacterium
PEPNARFVIWRKPNGAQLI

SEQ ID NO: 1092649 - protein, 19 aa, Mycobacterium
PFEHARPTAIMAWMRQHWG

SEQ ID NO: 1092650 - protein, 24 aa, Mycobacterium
PGPGARLAPIFAYPLLAACPSITQ

SEQ ID NO: 1092651 - protein, 24 aa, Mycobacterium
PGRAAVPWWPWAPLVQLMRVLPPP

SEQ ID NO: 1092652 - protein, 23 aa, Mycobacterium
PGSGPRPLLRYAPGTVGQGDQCA

SEQ ID NO: 1092653 - protein, 17 aa, Mycobacterium
PHSWAMAAPEIRLAVES

SEQ ID NO: 1092654 - protein, 23 aa, Mycobacterium
PLRSKISFWFDRKYKVPADAKAA

SEQ ID NO: 1092655 - protein, 17 aa, Mycobacterium
PNIDLPVPDGWQLLPEG

SEQ ID NO: 1092656 - protein, 25 aa, Mycobacterium
PPATRASGVLPRYGVRLTVMAHPPA

SEQ ID NO: 1092657 - protein, 22 aa, Mycobacterium
PPIGYRLLLLVGVLALALTGCV

SEQ ID NO: 1092658 - protein, 18 aa, Mycobacterium
PPTIVAILSKLTGNVEAA

SEQ ID NO: 1092659 - protein, 24 aa, Mycobacterium
PQLGRWKWHDPWVHAALLAQNNTR

SEQ ID NO: 1092660 - protein, 20 aa, Mycobacterium
PRVAATIPQLVQLAPQAGQM

SEQ ID NO: 1092661 - protein, 17 aa, Mycobacterium
PTAIMAWMRQHWGIENS

SEQ ID NO: 1092662 - protein, 17 aa, Mycobacterium
PTARLVVFLLRGNFDPA

SEQ ID NO: 1092663 - protein, 20 aa, Mycobacterium
PTNVDLRFGTSVSEVTHGDD

SEQ ID NO: 1092664 - protein, 23 aa, Mycobacterium
QATKRIGKVFGEFDSDSSAMVAL

SEQ ID NO: 1092665 - protein, 17 aa, Mycobacterium
QCFPCRRGLASAPAARS

SEQ ID NO: 1092666 - protein, 17 aa, Mycobacterium
QEIFPPGVCNLVCGDRD

SEQ ID NO: 1092667 - protein, 24 aa, Mycobacterium
QELTGRPLIGNGLPGSAGSGAAGA

SEQ ID NO: 1092668 - protein, 17 aa, Mycobacterium
QFNQRWVRLGCDIDLSG

SEQ ID NO: 1092669 - protein, 17 aa, Mycobacterium
QGPRWGAGNVVAYLESS

SEQ ID NO: 1092670 - protein, 18 aa, Mycobacterium
QKIYPGIVAPSWTADYGS

SEQ ID NO: 1092671 - protein, 25 aa, Mycobacterium
QLSKRTADMLLEFGNSSGLTNPAPI

SEQ ID NO: 1092672 - protein, 23 aa, Mycobacterium
QPIWWLVRALEFGQDFQTFIKEL

SEQ ID NO: 1092673 - protein, 20 aa, Mycobacterium
QRLPLVGSWVRQGIDELSQR

SEQ ID NO: 1092674 - protein, 21 aa, Mycobacterium
QSGSIGLGFAIPVDQAKRIAD

SEQ ID NO: 1092675 - protein, 17 aa, Mycobacterium
QWIPGGLLPTGASEAVV

SEQ ID NO: 1092676 - protein, 17 aa, Mycobacterium
RAAFVYTPEPNFVGIDT

SEQ ID NO: 1092677 - protein, 18 aa, Mycobacterium
RANESWWRPLKDAAEARY

SEQ ID NO: 1092678 - protein, 17 aa, Mycobacterium
RAPRRWAARDAIADIER

SEQ ID NO: 1092679 - protein, 20 aa, Mycobacterium
RAVVLPQWLFSVLLTPAIRL

SEQ ID NO: 1092680 - protein, 19 aa, Mycobacterium
RAYRLKWPNGATVFEIDLP

SEQ ID NO: 1092681 - protein, 17 aa, Mycobacterium
RCTQIEWYRTIQIGDQA

SEQ ID NO: 1092682 - protein, 21 aa, Mycobacterium
RDATFRWGVAMLPIGPAGRVS

SEQ ID NO: 1092683 - protein, 17 aa, Mycobacterium
RDWPHLGVALMRPRSRA

SEQ ID NO: 1092684 - protein, 17 aa, Mycobacterium
REMPAWLQANKGVSPTG

SEQ ID NO: 1092685 - protein, 21 aa, Mycobacterium
RFWREVPEPIAIQAVADGSAE

SEQ ID NO: 1092686 - protein, 17 aa, Mycobacterium
RGDFFAVLRSLALFVNA

SEQ ID NO: 1092687 - protein, 22 aa, Mycobacterium
RGVIPRDHIKEVLDSADVLIWL

SEQ ID NO: 1092688 - protein, 19 aa, Mycobacterium
RHRRYLHRGGVHYGNSPAQ

SEQ ID NO: 1092689 - protein, 19 aa, Mycobacterium
RLSAFKVPHRFAVVERLPR

SEQ ID NO: 1092690 - protein, 18 aa, Mycobacterium
RLYWLSAWIDRDGTNGGP

SEQ ID NO: 1092691 - protein, 18 aa, Mycobacterium
RMYFAYGLGNSVWFPLAT

SEQ ID NO: 1092692 - protein, 17 aa, Mycobacterium
RPGTFGVIFALIAVLAS

SEQ ID NO: 1092693 - protein, 17 aa, Mycobacterium
RPLFFAFQCLPLNWVRR

SEQ ID NO: 1092694 - protein, 17 aa, Mycobacterium
RRKHGLPSLGFNLCRIF

SEQ ID NO: 1092695 - protein, 20 aa, Mycobacterium
RRLTANYPPFLFHPLNTITA

SEQ ID NO: 1092696 - protein, 19 aa, Mycobacterium
RRPGGAWMLGKPIQIGEAR

SEQ ID NO: 1092697 - protein, 19 aa, Mycobacterium
RRPYTVILFDEIEKAHPDV

SEQ ID NO: 1092698 - protein, 18 aa, Mycobacterium
RSELLALRWTDFDESKQT

SEQ ID NO: 1092699 - protein, 18 aa, Mycobacterium
RSRRPGTFGVIFALIAVL

SEQ ID NO: 1092700 - protein, 17 aa, Mycobacterium
RSSNRLAYLGAHATSQF

SEQ ID NO: 1092701 - protein, 25 aa, Mycobacterium
RTGDCALTAPSRVCSGDALATSVAE

SEQ ID NO: 1092702 - protein, 21 aa, Mycobacterium
RTPCLVTGWAIRADPSGTSLV

SEQ ID NO: 1092703 - protein, 18 aa, Mycobacterium
RTQACKLWGITASAMDDA

SEQ ID NO: 1092704 - protein, 19 aa, Mycobacterium
RVAVPSFLLLFLVACGGSG

SEQ ID NO: 1092705 - protein, 17 aa, Mycobacterium
RVCAGMAVLRIRRRGPK

SEQ ID NO: 1092706 - protein, 18 aa, Mycobacterium
RVSDALTGQVLWQQLDDV

SEQ ID NO: 1092707 - protein, 20 aa, Mycobacterium
RVTEVLSRIYGHPVTVQLQT

SEQ ID NO: 1092708 - protein, 19 aa, Mycobacterium
RVVCGGISIPGRWDTTPDP

SEQ ID NO: 1092709 - protein, 19 aa, Mycobacterium
RWFGDQPFAVWPWAQPKLG

SEQ ID NO: 1092710 - protein, 18 aa, Mycobacterium
RYNVPWQPAWVFYRVDGS

SEQ ID NO: 1092711 - protein, 18 aa, Mycobacterium
RYVVPPVRRMMAARQDTV

SEQ ID NO: 1092712 - protein, 20 aa, Mycobacterium
SEEDRRFTVVFAYDQSDYAR

SEQ ID NO: 1092713 - protein, 19 aa, Mycobacterium
SEQTRLIFPKVWGGGPSPM

SEQ ID NO: 1092714 - protein, 19 aa, Mycobacterium
SFVLGEVSWQWEGAGAESY

SEQ ID NO: 1092715 - protein, 18 aa, Mycobacterium
SGCGWRGLNSLPLPGTEG

SEQ ID NO: 1092716 - protein, 19 aa, Mycobacterium
SGCSGWRGLNSLPLPGVQG

SEQ ID NO: 1092717 - protein, 17 aa, Mycobacterium
SGDPSWRSGGDGGNGGN

SEQ ID NO: 1092718 - protein, 25 aa, Mycobacterium
SGFQAWQLGGSYTKNGKQRAVAQKT

SEQ ID NO: 1092719 - protein, 20 aa, Mycobacterium
SGGMCQRALIAIGLAGRPAL

SEQ ID NO: 1092720 - protein, 17 aa, Mycobacterium
SGGYRITAIFANALNLN

SEQ ID NO: 1092721 - protein, 22 aa, Mycobacterium
SGTCFRPPLAVQQRWRDEFGLD

SEQ ID NO: 1092722 - protein, 21 aa, Mycobacterium
SGVMWACVFMRTGARRVHFGE

SEQ ID NO: 1092723 - protein, 20 aa, Mycobacterium
SHVDEWRATFNVNLFGAVAL

SEQ ID NO: 1092724 - protein, 27 aa, Mycobacterium
SIRAGVGWRRGCVWCRRAGRHFAATAR

SEQ ID NO: 1092725 - protein, 17 aa, Mycobacterium
SITNRFAPAPAQVPAPM

SEQ ID NO: 1092726 - protein, 17 aa, Mycobacterium
SPDQARRGDLIFYGPGG

SEQ ID NO: 1092727 - protein, 18 aa, Mycobacterium
SPDTSWLALNRMIPPMVK

SEQ ID NO: 1092728 - protein, 20 aa, Mycobacterium
SPEFGCLFKGIGRGIKEFAP

SEQ ID NO: 1092729 - protein, 17 aa, Mycobacterium
SRACAWAVRDGVIGRAP

SEQ ID NO: 1092730 - protein, 20 aa, Mycobacterium
SRFLGCVEVPLGHVDPEPPE

SEQ ID NO: 1092731 - protein, 18 aa, Mycobacterium
SRQALKIRRWRSRVRNHT

SEQ ID NO: 1092732 - protein, 23 aa, Mycobacterium
SRRLWTLLIFMLWHAIFIERSIT

SEQ ID NO: 1092733 - protein, 17 aa, Mycobacterium
SRSNWELATALPAIDAF

SEQ ID NO: 1092734 - protein, 19 aa, Mycobacterium
SVAAYCFDGNNLLSEADAF

SEQ ID NO: 1092735 - protein, 20 aa, Mycobacterium
SVVLSSGWNIIDFVQQLQQL

SEQ ID NO: 1092736 - protein, 17 aa, Mycobacterium
TAAARAAVTAAQANAAA

SEQ ID NO: 1092737 - protein, 18 aa, Mycobacterium
TAPEIRWFATRGAPGPAP

SEQ ID NO: 1092738 - protein, 18 aa, Mycobacterium
TAVAGRWSAERANTWYQT

SEQ ID NO: 1092739 - protein, 18 aa, Mycobacterium
TDGSITYNEWSYAVGHQL

SEQ ID NO: 1092740 - protein, 18 aa, Mycobacterium
TEQPRIEPYLAMVQASES

SEQ ID NO: 1092741 - protein, 21 aa, Mycobacterium
TFVGAICRWQAANPAGLIDIT

SEQ ID NO: 1092742 - protein, 21 aa, Mycobacterium
TFVGAICRWQAANPASLIDIT

SEQ ID NO: 1092743 - protein, 26 aa, Mycobacterium
TISAQAAVFHGRFVAALDAAADSYAG

SEQ ID NO: 1092744 - protein, 24 aa, Mycobacterium
TITARLNFQLAFGARVGQRLAEAR

SEQ ID NO: 1092745 - protein, 18 aa, Mycobacterium
TKPGDVVVIDFRRKNEAP

SEQ ID NO: 1092746 - protein, 17 aa, Mycobacterium
TLEELWWDRPFTLEGVD

SEQ ID NO: 1092747 - protein, 25 aa, Mycobacterium
TMSAEGRWSIPWAWNSAGTYRVFAD

SEQ ID NO: 1092748 - protein, 20 aa, Mycobacterium
TMTGPRPGGFGALDDRTNEI

SEQ ID NO: 1092749 - protein, 25 aa, Mycobacterium
TPGNFFGTMCDFFGLSSFSAMDAAE

SEQ ID NO: 1092750 - protein, 22 aa, Mycobacterium
TPIHGGWQLSQRTSEMLLAPGN

SEQ ID NO: 1092751 - protein, 17 aa, Mycobacterium
TRGAFAAGAARATIAAV

SEQ ID NO: 1092752 - protein, 18 aa, Mycobacterium
TSLAEGWVPFGISLGEAR

SEQ ID NO: 1092753 - protein, 18 aa, Mycobacterium
TSPNRLYWMSAWVDPNGE

SEQ ID NO: 1092754 - protein, 18 aa, Mycobacterium
TSVLARIFAAGAAGAARA

SEQ ID NO: 1092755 - protein, 24 aa, Mycobacterium
TTPPVEGSWAWLPDEAKGARIHYR

SEQ ID NO: 1092756 - protein, 17 aa, Mycobacterium
TVARCWPPLVPHSTARP

SEQ ID NO: 1092757 - protein, 23 aa, Mycobacterium
TVCALTAFLLVAVFGQVRFGDGN

SEQ ID NO: 1092758 - protein, 20 aa, Mycobacterium
TVEAQRLWAQAGFRPVDPAV

SEQ ID NO: 1092759 - protein, 27 aa, Mycobacterium
TYRSAGGDSCYWERLRGVGGTLDEVIA

SEQ ID NO: 1092760 - protein, 24 aa, Mycobacterium
VACAGRADAVGAFGTRRGATTAAT

SEQ ID NO: 1092761 - protein, 21 aa, Mycobacterium
VAILLPAHWQTAAVLFGVWWI

SEQ ID NO: 1092762 - protein, 21 aa, Mycobacterium
VASPCAYFLVYESTTETKPTE

SEQ ID NO: 1092763 - protein, 19 aa, Mycobacterium
VATDGRFRFLRVYPNPEVY

SEQ ID NO: 1092764 - protein, 17 aa, Mycobacterium
VFPTPPALIVAAGTDAL

SEQ ID NO: 1092765 - protein, 18 aa, Mycobacterium
VGAICRWQAANPASLIDI

SEQ ID NO: 1092766 - protein, 19 aa, Mycobacterium
VGFAAIVFLVWRYVVPPVR

SEQ ID NO: 1092767 - protein, 18 aa, Mycobacterium
VGFGGWYSPIALRVDTAS

SEQ ID NO: 1092768 - protein, 26 aa, Mycobacterium
VGTGKRATSVILRYGVRLTVMARPPA

SEQ ID NO: 1092769 - protein, 17 aa, Mycobacterium
VHLRGHFLLTRNAATYW

SEQ ID NO: 1092770 - protein, 17 aa, Mycobacterium
VKKAAAEHGLWYPPDPS

SEQ ID NO: 1092771 - protein, 23 aa, Mycobacterium
VKQGWMCCIGADWMHLSTGIIGS

SEQ ID NO: 1092772 - protein, 18 aa, Mycobacterium
VLAVGGWMAAQGTITVGT

SEQ ID NO: 1092773 - protein, 19 aa, Mycobacterium
VLPHLRPGSAIINITSTFA

SEQ ID NO: 1092774 - protein, 17 aa, Mycobacterium
VNAEMIWGVTIDNKDEA

SEQ ID NO: 1092775 - protein, 17 aa, Mycobacterium
VPWQPAWVFYRVDGSST

SEQ ID NO: 1092776 - protein, 23 aa, Mycobacterium
VQSMATSAWQWADRARQGVETLI

SEQ ID NO: 1092777 - protein, 23 aa, Mycobacterium
VRPEPFGALLYHFGTRKLSFLKN

SEQ ID NO: 1092778 - protein, 21 aa, Mycobacterium
VSAAIAALFNAHAEQYQALSV

SEQ ID NO: 1092779 - protein, 23 aa, Mycobacterium
VSAEAVAFHGRFVQALTGGVQMY

SEQ ID NO: 1092780 - protein, 23 aa, Mycobacterium
VSGRFGIGLVDWVMRSEAGLLED

SEQ ID NO: 1092781 - protein, 22 aa, Mycobacterium
VSRRAWQGLALLMVALVLSSCG

SEQ ID NO: 1092782 - protein, 19 aa, Mycobacterium
VTCPGDLPAKVGAQANCEM

SEQ ID NO: 1092783 - protein, 22 aa, Mycobacterium
VTFYSCLYRSLLHPNTFNDADG

SEQ ID NO: 1092784 - protein, 17 aa, Mycobacterium
VVGCVRWSTQTQTQPQP

SEQ ID NO: 1092785 - protein, 19 aa, Mycobacterium
VVGDLRWSLSVSARLASIP

SEQ ID NO: 1092786 - protein, 17 aa, Mycobacterium
VVKRCYAEVLPAARSGA

SEQ ID NO: 1092787 - protein, 17 aa, Mycobacterium
VYAGTGWTAMRGQRMDD

SEQ ID NO: 1092788 - protein, 17 aa, Mycobacterium
VYDGSGWVAAQTQALRD

SEQ ID NO: 1092789 - protein, 17 aa, Mycobacterium
WAQAGFRPVDPAVVVEF

SEQ ID NO: 1092790 - protein, 17 aa, Mycobacterium
WDLPLVFGPIALVYNLP

SEQ ID NO: 1092791 - protein, 21 aa, Mycobacterium
WELATALPAIDAFPADWNYDL

SEQ ID NO: 1092792 - protein, 17 aa, Mycobacterium
WIPLLILVVVAIAGFTV

SEQ ID NO: 1092793 - protein, 18 aa, Mycobacterium
WLAAHGWAVEPVRNTLEL

SEQ ID NO: 1092794 - protein, 18 aa, Mycobacterium
WLHRGSIVVADNVKVPGA

SEQ ID NO: 1092795 - protein, 17 aa, Mycobacterium
WLSRFDIGSGFEVVLSS

SEQ ID NO: 1092796 - protein, 17 aa, Mycobacterium
WQTRAWSGHRIYPAAVL

SEQ ID NO: 1092797 - protein, 18 aa, Mycobacterium
WRAGGGWTDGRQRLGTSP

SEQ ID NO: 1092798 - protein, 20 aa, Mycobacterium
WRATFNVNLFGAVALTLALL

SEQ ID NO: 1092799 - protein, 18 aa, Mycobacterium
WRRGEFRAVDSVSFRLRR

SEQ ID NO: 1092800 - protein, 18 aa, Mycobacterium
WTVYSLPGAPAFDHYELA

SEQ ID NO: 1092801 - protein, 17 aa, Mycobacterium
WVRRKHGLPSLGFNLCR

SEQ ID NO: 1092802 - protein, 17 aa, Mycobacterium
WYRANESWWRPLKDAAE

SEQ ID NO: 1092803 - protein, 17 aa, Mycobacterium
YFPHPLRVVCGGISIPG

SEQ ID NO: 1092804 - protein, 20 aa, Mycobacterium
YGDFFAFYLCDVVLKVNGKG

SEQ ID NO: 1092805 - protein, 20 aa, Mycobacterium
YLRYLGFHFAAFVFDASDMD

SEQ ID NO: 1092806 - protein, 17 aa, Mycobacterium
YQALSVRVAEFHESFTR

SEQ ID NO: 1092807 - protein, 19 aa, Mycobacterium
YRPELPGGQPAGGRSLGPA

SEQ ID NO: 1092808 - protein, 24 aa, Mycobacterium
PANHQYLGPVLWSPAGELPRWWDS

SEQ ID NO: 1092809 - protein, 20 aa, Mycobacterium
VVRPFAVARLLDPSRYEVHF

SEQ ID NO: 1092810 - protein, 20 aa, Mycobacterium
AAAFVILLVIALETKDRASE

SEQ ID NO: 1092811 - protein, 19 aa, Mycobacterium
AACLPPCWIVVGTGRADDV

SEQ ID NO: 1092812 - protein, 25 aa, Mycobacterium
AAQKGELPLLFSVTNIRPGTSGSAT

SEQ ID NO: 1092813 - protein, 21 aa, Mycobacterium
AARALTPARLIVRVVDALRAG

SEQ ID NO: 1092814 - protein, 17 aa, Mycobacterium
AASCTASYTVALVSGGP

SEQ ID NO: 1092815 - protein, 27 aa, Mycobacterium
AASGCVLLPGLPYLGLEHRAAWVEAEA

SEQ ID NO: 1092816 - protein, 18 aa, Mycobacterium
ADFFVFSGHKIYGPTGIG

SEQ ID NO: 1092817 - protein, 27 aa, Mycobacterium
ADGQRGPVTLLFLGLDRLKAVNDYLGH

SEQ ID NO: 1092818 - protein, 25 aa, Mycobacterium
ADVPVATWAWLSLATGVAVLDTVAP

SEQ ID NO: 1092819 - protein, 27 aa, Mycobacterium
AEAMYQAVRYLLVMAAIILMAVAESGS

SEQ ID NO: 1092820 - protein, 20 aa, Mycobacterium
AELHRPCCGDLVYGADPKLA

SEQ ID NO: 1092821 - protein, 20 aa, Mycobacterium
AELILAGPACARLFVASALA

SEQ ID NO: 1092822 - protein, 24 aa, Mycobacterium
AELRNRYRLGERPTVVCLARLVPR

SEQ ID NO: 1092823 - protein, 26 aa, Mycobacterium
AFTDNLPVCITKFIPLHTPAVVMSMN

SEQ ID NO: 1092824 - protein, 19 aa, Mycobacterium
AGDLLGITLLVNANPAVPN

SEQ ID NO: 1092825 - protein, 17 aa, Mycobacterium
AGPLLIAAPKKDLSWHD

SEQ ID NO: 1092826 - protein, 18 aa, Mycobacterium
AGWLVERAGFGKGYPDGA

SEQ ID NO: 1092827 - protein, 19 aa, Mycobacterium
AHSHQPLRWGPPETPNRYI

SEQ ID NO: 1092828 - protein, 25 aa, Mycobacterium
AHWLEGGFGLAILYRKIHGQDPAER

SEQ ID NO: 1092829 - protein, 17 aa, Mycobacterium
AIGCGLCLALAAAIRVV

SEQ ID NO: 1092830 - protein, 17 aa, Mycobacterium
AILTFSIRGGCCALPRR

SEQ ID NO: 1092831 - protein, 21 aa, Mycobacterium
AINLKNWVATLTLGLNKDVQL

SEQ ID NO: 1092832 - protein, 23 aa, Mycobacterium
AINPVLLDLFRLGAYQLLRTRVE

SEQ ID NO: 1092833 - protein, 25 aa, Mycobacterium
AISERAYTVLKRAFKCRTVDKRYHA

SEQ ID NO: 1092834 - protein, 27 aa, Mycobacterium
ALAGRRVVLNLWASWCASCLGELPAMV

SEQ ID NO: 1092835 - protein, 23 aa, Mycobacterium
ALARLGPLLVVTATGREASNLTA

SEQ ID NO: 1092836 - protein, 25 aa, Mycobacterium
ALDQGALAAFLSWLESRPSPRTRRR

SEQ ID NO: 1092837 - protein, 18 aa, Mycobacterium
ALPDGSLLCRHSLARFDN

SEQ ID NO: 1092838 - protein, 24 aa, Mycobacterium
AMTVPPIVVAANRALLVALVASNI

SEQ ID NO: 1092839 - protein, 23 aa, Mycobacterium
ANHRWLGILPLWVSYNAVSANNT

SEQ ID NO: 1092840 - protein, 25 aa, Mycobacterium
APDREQLVCWLLRELDARVGQWRSA

SEQ ID NO: 1092841 - protein, 33 aa, Mycobacterium
AQRANGILLLHGLVNWVMFSQLWCGFDHDEVAD

SEQ ID NO: 1092842 - protein, 28 aa, Mycobacterium
AQRSTVLVALRDTGFITYQTYNRNDHLG

SEQ ID NO: 1092843 - protein, 17 aa, Mycobacterium
ARDPFGIKPLFMATGTN

SEQ ID NO: 1092844 - protein, 19 aa, Mycobacterium
ARLNFQLGFGMRVGQRLTE

SEQ ID NO: 1092845 - protein, 20 aa, Mycobacterium
ARTMLRDVLISELQPDMDRS

SEQ ID NO: 1092846 - protein, 24 aa, Mycobacterium
ASAEYLRLLRRHNVAATLSGAGPS

SEQ ID NO: 1092847 - protein, 23 aa, Mycobacterium
ASQTVVLDIWQPGAPTAGLIGLK

SEQ ID NO: 1092848 - protein, 24 aa, Mycobacterium
ASRIRRWMAPVLAQRWVRAEVVIR

SEQ ID NO: 1092849 - protein, 22 aa, Mycobacterium
ASRKPPYKLAGVGLLVVAVVIF

SEQ ID NO: 1092850 - protein, 23 aa, Mycobacterium
ATAMPRVWVWILVRAAQSSVSRL

SEQ ID NO: 1092851 - protein, 17 aa, Mycobacterium
ATDAEVVLPWNGQYHYL

SEQ ID NO: 1092852 - protein, 25 aa, Mycobacterium
ATDLCEFIEFPAELLQICGDSFAGQ

SEQ ID NO: 1092853 - protein, 24 aa, Mycobacterium
ATLPSWLPFAVAAGTLLWLGRVEI

SEQ ID NO: 1092854 - protein, 17 aa, Mycobacterium
ATPIPRTLEMSLAGIRE

SEQ ID NO: 1092855 - protein, 23 aa, Mycobacterium
ATQLSYSGVFLHSAPWSVGAQGH

SEQ ID NO: 1092856 - protein, 18 aa, Mycobacterium
AVGAIRYVSDPRGTWAVG

SEQ ID NO: 1092857 - protein, 24 aa, Mycobacterium
AVLVLFALIFFLNGVPYLAARCQD

SEQ ID NO: 1092858 - protein, 24 aa, Mycobacterium
AVRATQLYAASFRPGFDSPPQLVP

SEQ ID NO: 1092859 - protein, 36 aa, Mycobacterium
CAQYLSPVLDAIKFNYFPFGLNLFSTAEVLPKEVAY

SEQ ID NO: 1092860 - protein, 26 aa, Mycobacterium
CGLAGTVLRFVPPLAALSANPVTFDG

SEQ ID NO: 1092861 - protein, 19 aa, Mycobacterium
CVVVVFAVVLNAGGDGGAV

SEQ ID NO: 1092862 - protein, 26 aa, Mycobacterium
DAEPGRITAILGLHDLLSGGHTGQYG

SEQ ID NO: 1092863 - protein, 24 aa, Mycobacterium
DAGLKWPNDVLAGPPGSKGKLAGI

SEQ ID NO: 1092864 - protein, 23 aa, Mycobacterium
DASGLIQYAYAGAGLKLPRSSGE

SEQ ID NO: 1092865 - protein, 23 aa, Mycobacterium
DEHPVPPPIGLQASVPIPSPRPD

SEQ ID NO: 1092866 - protein, 23 aa, Mycobacterium
DEVARYLFRRVVSWGRSSNVFLR

SEQ ID NO: 1092867 - protein, 29 aa, Mycobacterium
DHSRRLWTVLIFMLWHAIFIEHSVVPQIS

SEQ ID NO: 1092868 - protein, 17 aa, Mycobacterium
DLIKGVVMPAVMQGVQN

SEQ ID NO: 1092869 - protein, 17 aa, Mycobacterium
DLRLHPAPAHRVTAVCG

SEQ ID NO: 1092870 - protein, 18 aa, Mycobacterium
DLTLGEALTLWLSGQEQL

SEQ ID NO: 1092871 - protein, 19 aa, Mycobacterium
DMITGVIVGLEPDASVVHN

SEQ ID NO: 1092872 - protein, 29 aa, Mycobacterium
DPHSRQLLAAQIIWTLARADIRGPYVINA

SEQ ID NO: 1092873 - protein, 28 aa, Mycobacterium
DPRHTPPHAWYIAFAPVQAPKVAVAVLV

SEQ ID NO: 1092874 - protein, 17 aa, Mycobacterium
DQGTWVANGGLRYAPRA

SEQ ID NO: 1092875 - protein, 25 aa, Mycobacterium
DRDYGFLGVAVLDAPWAPFVVDFNL

SEQ ID NO: 1092876 - protein, 25 aa, Mycobacterium
DTVGRPETWKQAFYARDLAGTVVLV

SEQ ID NO: 1092877 - protein, 26 aa, Mycobacterium
DVGPSQRWFVVWLGTSNNPVDKGAAK

SEQ ID NO: 1092878 - protein, 23 aa, Mycobacterium
DVLGIPFYVWDFAEKFQEDVIDN

SEQ ID NO: 1092879 - protein, 25 aa, Mycobacterium
EAAAFYRLSSLRLWPDRRLSRRGVE

SEQ ID NO: 1092880 - protein, 25 aa, Mycobacterium
EASWMGLPVDALLLLAWMCNGRSHT

SEQ ID NO: 1092881 - protein, 21 aa, Mycobacterium
EFFEGVMMLKLFIADTMGQPT

SEQ ID NO: 1092882 - protein, 18 aa, Mycobacterium
EFGTVGALNLVKCVHWPT

SEQ ID NO: 1092883 - protein, 17 aa, Mycobacterium
EGTLGVITALDLRLHPA

SEQ ID NO: 1092884 - protein, 17 aa, Mycobacterium
ELPVPRWIENPLANWSA

SEQ ID NO: 1092885 - protein, 25 aa, Mycobacterium
ELVVAWGKLYPEFGTVGALNLVKCV

SEQ ID NO: 1092886 - protein, 23 aa, Mycobacterium
EMAALLRLAQLGVRLPTLQDGRR

SEQ ID NO: 1092887 - protein, 27 aa, Mycobacterium
EMGLPRPWNPLPCAGATAGPYGGPAFP

SEQ ID NO: 1092888 - protein, 23 aa, Mycobacterium
EMLSVRLARPPLLVPVLRTGLGM

SEQ ID NO: 1092889 - protein, 17 aa, Mycobacterium
ENFWRSAGLPEFRFPDP

SEQ ID NO: 1092890 - protein, 22 aa, Mycobacterium
ENVVPLYRRNVLTDRQMLAINE

SEQ ID NO: 1092891 - protein, 33 aa, Mycobacterium
EPGTIFSFPMTQWTRWRQPVIGMPSTPRFLGNG

SEQ ID NO: 1092892 - protein, 28 aa, Mycobacterium
EQARARPITPLLDALRGLGVPVDGVGLP

SEQ ID NO: 1092893 - protein, 25 aa, Mycobacterium
EQTLASLSLILRGGGIPNLETLTNE

SEQ ID NO: 1092894 - protein, 25 aa, Mycobacterium
ESTLLAAIYVAALRSYGFGARGETG

SEQ ID NO: 1092895 - protein, 18 aa, Mycobacterium
EVVLPWNGQYHYLSAVYC

SEQ ID NO: 1092896 - protein, 24 aa, Mycobacterium
EWPDPAESLPPPYDNRLAQPYGGY

SEQ ID NO: 1092897 - protein, 20 aa, Mycobacterium
FARRWELPVPRWIENPLANW

SEQ ID NO: 1092898 - protein, 23 aa, Mycobacterium
FATELLWCAYQRGPHLDAVDFTD

SEQ ID NO: 1092899 - protein, 25 aa, Mycobacterium
FDCSGLMRYAFAGVGVLIPRFSGDQ

SEQ ID NO: 1092900 - protein, 21 aa, Mycobacterium
FDCSGLVLYSFAGVGIRLPHY

SEQ ID NO: 1092901 - protein, 21 aa, Mycobacterium
FDSPPQLVPVALRGSAPDTTT

SEQ ID NO: 1092902 - protein, 20 aa, Mycobacterium
FGRRVLLVDIDPQGALSAGL

SEQ ID NO: 1092903 - protein, 18 aa, Mycobacterium
FLVLVSWFVGLQVKPAQI

SEQ ID NO: 1092904 - protein, 18 aa, Mycobacterium
FPDYPTMFAALRAGQLTA

SEQ ID NO: 1092905 - protein, 24 aa, Mycobacterium
FPTQQLHWWLVAVSHTDLLANADA

SEQ ID NO: 1092906 - protein, 29 aa, Mycobacterium
FREKDGRQLVIRYLFYDAQGSREFAQLAQ

SEQ ID NO: 1092907 - protein, 19 aa, Mycobacterium
FRPGFDSPPQLVPVALRGS

SEQ ID NO: 1092908 - protein, 18 aa, Mycobacterium
FSIRGGCCALPRRSCRDS

SEQ ID NO: 1092909 - protein, 19 aa, Mycobacterium
FTMAGYLALVLVGAEVSAD

SEQ ID NO: 1092910 - protein, 19 aa, Mycobacterium
FWRSAGLPEFRFPDPNGTR

SEQ ID NO: 1092911 - protein, 31 aa, Mycobacterium
GEFSRISDVLLPFLVTRQLICGAGKVLQTPK

SEQ ID NO: 1092912 - protein, 23 aa, Mycobacterium
GEGNLHLNVLRCPPDREKTLTAA

SEQ ID NO: 1092913 - protein, 30 aa, Mycobacterium
GGEAELLVDFPVCALIAAWVRGQSQLDASA

SEQ ID NO: 1092914 - protein, 26 aa, Mycobacterium
GHEVGWSMLPVARSVLRRIGDVTDVV

SEQ ID NO: 1092915 - protein, 25 aa, Mycobacterium
GHHCAQPVLRRLGLEATVRPSFAFY

SEQ ID NO: 1092916 - protein, 20 aa, Mycobacterium
GIMIGSWTDLSMLINGALTD

SEQ ID NO: 1092917 - protein, 22 aa, Mycobacterium
GITPLDVVLVPHLPSAGAEPGA

SEQ ID NO: 1092918 - protein, 22 aa, Mycobacterium
GKDLPPVSGPAPAGPAAVTAGR

SEQ ID NO: 1092919 - protein, 20 aa, Mycobacterium
GLIRILLILCGVFGLKLQRD

SEQ ID NO: 1092920 - protein, 19 aa, Mycobacterium
GPGFDSIGLALSLCDEIVV

SEQ ID NO: 1092921 - protein, 20 aa, Mycobacterium
GPHAVYLLDAFNAALDVSNW

SEQ ID NO: 1092922 - protein, 23 aa, Mycobacterium
GPLATTGLFPPGSTFKMVTAGAA

SEQ ID NO: 1092923 - protein, 24 aa, Mycobacterium
GQSFTSVPILFARPSYYGQFTDTG

SEQ ID NO: 1092924 - protein, 20 aa, Mycobacterium
GRFQWVVFTSTNAVRAVWEK

SEQ ID NO: 1092925 - protein, 20 aa, Mycobacterium
GRKLLTYEVLQLAGDDLRDT

SEQ ID NO: 1092926 - protein, 24 aa, Mycobacterium
GRPTPEMLAYQYLQILPQMARGDA

SEQ ID NO: 1092927 - protein, 29 aa, Mycobacterium
GRTVSGQLTLLVLFIDRVRARVDLRERVV

SEQ ID NO: 1092928 - protein, 17 aa, Mycobacterium
GSDLLKPPLDPAALRAE

SEQ ID NO: 1092929 - protein, 24 aa, Mycobacterium
GSDMGEFYLPYPGTRINQETIPLH

SEQ ID NO: 1092930 - protein, 23 aa, Mycobacterium
GSKQWDTFLSSELPDWLATKRGL

SEQ ID NO: 1092931 - protein, 17 aa, Mycobacterium
GTWVANGGLRYAPRADL

SEQ ID NO: 1092932 - protein, 22 aa, Mycobacterium
GVLSQGLLAPLGLAGVVNGAAN

SEQ ID NO: 1092933 - protein, 25 aa, Mycobacterium
GVSYPTANSPFWNAYTRFIDEGSHQ

SEQ ID NO: 1092934 - protein, 22 aa, Mycobacterium
GYGNLCIPPWRSSCQGVAANLV

SEQ ID NO: 1092935 - protein, 22 aa, Mycobacterium
HAAGTWVTKVLAIAVALDGTPV

SEQ ID NO: 1092936 - protein, 22 aa, Mycobacterium
HHANIVPWQLLSSQTGAILKVA

SEQ ID NO: 1092937 - protein, 19 aa, Mycobacterium
HHGVEQMLVFLPQGASIAQ

SEQ ID NO: 1092938 - protein, 17 aa, Mycobacterium
HHLPIALRAHAIQLLNR

SEQ ID NO: 1092939 - protein, 22 aa, Mycobacterium
HRFDSFAAATYMNGPSGSYLTA

SEQ ID NO: 1092940 - protein, 21 aa, Mycobacterium
HSRQTPLLARAWTSDAIGAGV

SEQ ID NO: 1092941 - protein, 18 aa, Mycobacterium
HTIAAKYPINVALHTDHC

SEQ ID NO: 1092942 - protein, 17 aa, Mycobacterium
HTRSATILVAVTALLVG

SEQ ID NO: 1092943 - protein, 21 aa, Mycobacterium
HWVTAEWRWDTLAARLADLLC

SEQ ID NO: 1092944 - protein, 36 aa, Mycobacterium
IAQAVELWRIVDHPNLFIKIPATKAGLPAITAVLAE

SEQ ID NO: 1092945 - protein, 17 aa, Mycobacterium
ICRIAGLLRRGSVAADQ

SEQ ID NO: 1092946 - protein, 19 aa, Mycobacterium
IDAPIGRHRGHTWKFAVTK

SEQ ID NO: 1092947 - protein, 18 aa, Mycobacterium
IDVTGVDAGLKWPNDVLA

SEQ ID NO: 1092948 - protein, 25 aa, Mycobacterium
IGSGPFFKVVLHNLAPYQILQPWVD

SEQ ID NO: 1092949 - protein, 17 aa, Mycobacterium
IGTHRLLQTGVCWKDLG

SEQ ID NO: 1092950 - protein, 29 aa, Mycobacterium
IHPWSSGRDLYFNLSLWSAYDVVLMHTVL

SEQ ID NO: 1092951 - protein, 19 aa, Mycobacterium
IHTRVRYLDLVPSNIDLSA

SEQ ID NO: 1092952 - protein, 18 aa, Mycobacterium
ILGSVRYRRRRISLIFSS

SEQ ID NO: 1092953 - protein, 30 aa, Mycobacterium
INALYTPVHWKYLTSGLLGLQRGTDAGDLL

SEQ ID NO: 1092954 - protein, 19 aa, Mycobacterium
INQPPPCLTGFIPAAEWRS

SEQ ID NO: 1092955 - protein, 23 aa, Mycobacterium
ISRAPWRLLRIYEDPTGTTSTLY

SEQ ID NO: 1092956 - protein, 37 aa, Mycobacterium
ITANPPVEGAFYWLNNREVRWRPEHFWKSGTAVDVAV

SEQ ID NO: 1092957 - protein, 17 aa, Mycobacterium
ITTPISLDPGTDGTYPI

SEQ ID NO: 1092958 - protein, 21 aa, Mycobacterium
KDLSWHDCTSRLFRDAGVAAA

SEQ ID NO: 1092959 - protein, 20 aa, Mycobacterium
KFVWPTMVVFRWPSFRHTTC

SEQ ID NO: 1092960 - protein, 25 aa, Mycobacterium
KGGIVFRIQRELGVPVKLVGLGEGP

SEQ ID NO: 1092961 - protein, 26 aa, Mycobacterium
KGNPAWDLPLVFGPVALVYNLPGVQM

SEQ ID NO: 1092962 - protein, 25 aa, Mycobacterium
KGSKLATVWIAQDGSHHLVRASIDL

SEQ ID NO: 1092963 - protein, 25 aa, Mycobacterium
KQLQSLADRKVAFATIPVLDETGWS

SEQ ID NO: 1092964 - protein, 23 aa, Mycobacterium
KRLGLERQWLHARSLSFAHPADG

SEQ ID NO: 1092965 - protein, 21 aa, Mycobacterium
KTVPPRWLPGPRELRAWILAA

SEQ ID NO: 1092966 - protein, 19 aa, Mycobacterium
KVDPIKLNLTLSAAAQSLA

SEQ ID NO: 1092967 - protein, 18 aa, Mycobacterium
LAAVGYVPLPDTIKKRLV

SEQ ID NO: 1092968 - protein, 19 aa, Mycobacterium
LACPLRELGRGAPYFIGAM

SEQ ID NO: 1092969 - protein, 17 aa, Mycobacterium
LAGLVAPGLKPAGRGPV

SEQ ID NO: 1092970 - protein, 39 aa, Mycobacterium
LAGVGLLVVAVVIFGLVYGQFRGNFTPKSKLTMLADRAG

SEQ ID NO: 1092971 - protein, 18 aa, Mycobacterium
LALLAPCARKAGATRVLA

SEQ ID NO: 1092972 - protein, 20 aa, Mycobacterium
LAMLVTSILTCSLAYADSGT

SEQ ID NO: 1092973 - protein, 33 aa, Mycobacterium
LANEWAGITVLQMLQRIIALMPLGAAVVDTYRD

SEQ ID NO: 1092974 - protein, 19 aa, Mycobacterium
LCLFVAQAFSVASWIAHAD

SEQ ID NO: 1092975 - protein, 24 aa, Mycobacterium
LDAPWAPFVVDFNLANVGGPSAGL

SEQ ID NO: 1092976 - protein, 20 aa, Mycobacterium
LDGALARRAVVARAVAIDAY

SEQ ID NO: 1092977 - protein, 28 aa, Mycobacterium
LDGDVVQWIPTKYWPAYTHVSVEVQALT

SEQ ID NO: 1092978 - protein, 20 aa, Mycobacterium
LFLLIMGGFMFFASRRQRRS

SEQ ID NO: 1092979 - protein, 17 aa, Mycobacterium
LGEALTLWLSGQEQLVP

SEQ ID NO: 1092980 - protein, 18 aa, Mycobacterium
LGLRPGLVGVLKGPLLDG

SEQ ID NO: 1092981 - protein, 18 aa, Mycobacterium
LGPLPFPHHPIHTVPSEW

SEQ ID NO: 1092982 - protein, 27 aa, Mycobacterium
LGRGAPYFIGAMKLILTQPYDVDTVPK

SEQ ID NO: 1092983 - protein, 35 aa, Mycobacterium
LGVRLVNILFRLYSPLIFAIYCLPLNWVRRKHGLP

SEQ ID NO: 1092984 - protein, 18 aa, Mycobacterium
LKPPLDPAALRAELIGTG

SEQ ID NO: 1092985 - protein, 17 aa, Mycobacterium
LLARAWTSDAIGAGVLA

SEQ ID NO: 1092986 - protein, 25 aa, Mycobacterium
LLASATLLLLYWQWRAMSTGSFGGP

SEQ ID NO: 1092987 - protein, 20 aa, Mycobacterium
LLDEFPPYDSVFDPVNRVLL

SEQ ID NO: 1092988 - protein, 17 aa, Mycobacterium
LLGIPVVVVEQMCLDKS

SEQ ID NO: 1092989 - protein, 17 aa, Mycobacterium
LLLLNATVTQVFTADGL

SEQ ID NO: 1092990 - protein, 17 aa, Mycobacterium
LLPLVLPPWLVALRCSN

SEQ ID NO: 1092991 - protein, 17 aa, Mycobacterium
LLVVGLILTGCSASNRL

SEQ ID NO: 1092992 - protein, 17 aa, Mycobacterium
LMRVGIAPTLIGTRSGR

SEQ ID NO: 1092993 - protein, 26 aa, Mycobacterium
LNEGRGDFFAVLRSLALFVNALHTDD

SEQ ID NO: 1092994 - protein, 17 aa, Mycobacterium
LPAIADLAGVLAASGQI

SEQ ID NO: 1092995 - protein, 20 aa, Mycobacterium
LPAVVMLLAAAAGFGVWLLV

SEQ ID NO: 1092996 - protein, 17 aa, Mycobacterium
LPGRRNIVLSRQIDFMA

SEQ ID NO: 1092997 - protein, 17 aa, Mycobacterium
LPHADHPAVLLIVGVNG

SEQ ID NO: 1092998 - protein, 19 aa, Mycobacterium
LPLAATFAALVMVAAITAS

SEQ ID NO: 1092999 - protein, 29 aa, Mycobacterium
LPSLSNWPNILPDDFSMLDGIFAMYATVG

SEQ ID NO: 1093000 - protein, 25 aa, Mycobacterium
LQTNDLVPYRTLVADAPVGVMLGHL

SEQ ID NO: 1093001 - protein, 19 aa, Mycobacterium
LTNNTVVVYFPAATALYTG

SEQ ID NO: 1093002 - protein, 19 aa, Mycobacterium
LTSGAWLQVRLCEAPAPLE

SEQ ID NO: 1093003 - protein, 24 aa, Mycobacterium
LVFGVLLAVVTVPFVSLGPGPTFD

SEQ ID NO: 1093004 - protein, 17 aa, Mycobacterium
LVFLPQGASIAQTASAT

SEQ ID NO: 1093005 - protein, 19 aa, Mycobacterium
LVHDAARALTPARLIVRVV

SEQ ID NO: 1093006 - protein, 23 aa, Mycobacterium
LVPGYLHHYALDATLAGSSLIGT

SEQ ID NO: 1093007 - protein, 18 aa, Mycobacterium
LVVFIVTVKVTIGGAAIG

SEQ ID NO: 1093008 - protein, 21 aa, Mycobacterium
LVVIAALILGSVRYRRRRISL

SEQ ID NO: 1093009 - protein, 32 aa, Mycobacterium
LVVLGPERFPGAIRWTLGALRQTRDYLSGVTN

SEQ ID NO: 1093010 - protein, 23 aa, Mycobacterium
LVVLIDVGLALRLRACRFAASTG

SEQ ID NO: 1093011 - protein, 26 aa, Mycobacterium
MAHAVRNLLAPPLRLRGPVTRADGSK

SEQ ID NO: 1093012 - protein, 21 aa, Mycobacterium
MPKLGPLIASLFKPPAPNNHY

SEQ ID NO: 1093013 - protein, 24 aa, Mycobacterium
MQYSPVLFTPIAMFLGSCGAYFPG

SEQ ID NO: 1093014 - protein, 21 aa, Mycobacterium
MRLLCLGMLFTGCAGVPNSSA

SEQ ID NO: 1093015 - protein, 19 aa, Mycobacterium
MTMKSRVIDIIQENGFAVG

SEQ ID NO: 1093016 - protein, 18 aa, Mycobacterium
MTRLLADVWFSAAALSWV

SEQ ID NO: 1093017 - protein, 28 aa, Mycobacterium
NDHVELLSGLGFLLNPTSAISIIGAGVL

SEQ ID NO: 1093018 - protein, 19 aa, Mycobacterium
NDPKLKQPVLYPRGTLAMA

SEQ ID NO: 1093019 - protein, 19 aa, Mycobacterium
NDYLKQYIILYSNGDSNDV

SEQ ID NO: 1093020 - protein, 24 aa, Mycobacterium
NEVDKLLWAEGFSLPLTQSPGDVA

SEQ ID NO: 1093021 - protein, 24 aa, Mycobacterium
NISVKLFDDWSNLGSISDLSTSHV

SEQ ID NO: 1093022 - protein, 24 aa, Mycobacterium
NRIERVIERIPLPPSSRSIEDPEM

SEQ ID NO: 1093023 - protein, 18 aa, Mycobacterium
NRYHALIDPLVTKPGRTS

SEQ ID NO: 1093024 - protein, 24 aa, Mycobacterium
NTNGSQFFLVYHDSQLPPEYTVFG

SEQ ID NO: 1093025 - protein, 22 aa, Mycobacterium
NWQFIRAELIGELPMIMISGRF

SEQ ID NO: 1093026 - protein, 19 aa, Mycobacterium
PACARLFVASALARLGPLL

SEQ ID NO: 1093027 - protein, 26 aa, Mycobacterium
PASGRGFHVIYSAPPLNPVQAGPSVQ

SEQ ID NO: 1093028 - protein, 19 aa, Mycobacterium
PATLVRLLPLVAASGPTPS

SEQ ID NO: 1093029 - protein, 25 aa, Mycobacterium
PAVTPSVLPLPSFQPSTNLGVNCQY

SEQ ID NO: 1093030 - protein, 26 aa, Mycobacterium
PDVPEPVLALIGKDLPPVSGPAPAGP

SEQ ID NO: 1093031 - protein, 21 aa, Mycobacterium
PEIVWYLDEPIADPALVPLFF

SEQ ID NO: 1093032 - protein, 26 aa, Mycobacterium
PEPAQRLVAVAQLRLLCRGSGIIEVT

SEQ ID NO: 1093033 - protein, 28 aa, Mycobacterium
PERDFPTLVDLYLQGRLPLGKFVSERIG

SEQ ID NO: 1093034 - protein, 21 aa, Mycobacterium
PFGIKPLFMATGTNGTAVASE

SEQ ID NO: 1093035 - protein, 22 aa, Mycobacterium
PGDFVILNWRAVCGQCRACKRG

SEQ ID NO: 1093036 - protein, 17 aa, Mycobacterium
PGLTVSIPTPPGWSPYS

SEQ ID NO: 1093037 - protein, 20 aa, Mycobacterium
PGQWDPTLPAAVSAGAPGDP

SEQ ID NO: 1093038 - protein, 26 aa, Mycobacterium
PGRIDIGHRTILNYGGFDLGVVPMSR

SEQ ID NO: 1093039 - protein, 24 aa, Mycobacterium
PGSVYPTLQLLSDKNLITASATDG

SEQ ID NO: 1093040 - protein, 20 aa, Mycobacterium
PGVWRAYADHRMAMAGAIVG

SEQ ID NO: 1093041 - protein, 20 aa, Mycobacterium
PHIAMTVMMLRQAGVQVDDS

SEQ ID NO: 1093042 - protein, 18 aa, Mycobacterium
PILPKVIDSLRPMMRLVV

SEQ ID NO: 1093043 - protein, 21 aa, Mycobacterium
PILQPLVPGQVLRIGPMAGTG

SEQ ID NO: 1093044 - protein, 33 aa, Mycobacterium
PKDKLDSYVRPLLAISARRVATGKDPLFGSHMW

SEQ ID NO: 1093045 - protein, 19 aa, Mycobacterium
PLSLKPFDYLPGPLRRSMG

SEQ ID NO: 1093046 - protein, 31 aa, Mycobacterium
PMHGYELRKRLTGLLGAFRAFSYGSLYPALR

SEQ ID NO: 1093047 - protein, 19 aa, Mycobacterium
PMVLAELVLITSIAFAVCC

SEQ ID NO: 1093048 - protein, 17 aa, Mycobacterium
PNIPVPSPILTAGSDQP

SEQ ID NO: 1093049 - protein, 22 aa, Mycobacterium
PNVPGTPVPLPPNAPPGARTEQ

SEQ ID NO: 1093050 - protein, 19 aa, Mycobacterium
PPAIARWPLLAAIRARRTP

SEQ ID NO: 1093051 - protein, 19 aa, Mycobacterium
PPCLTGFIPAAEWRSPADT

SEQ ID NO: 1093052 - protein, 17 aa, Mycobacterium
PPTPLWPDKVGEMCIKQ

SEQ ID NO: 1093053 - protein, 35 aa, Mycobacterium
PPVCYCGGLIRPAIVWFGEPLPDEPWRRAVEATET

SEQ ID NO: 1093054 - protein, 24 aa, Mycobacterium
PSGNTRAFLSECIGIRRGSVVDAD

SEQ ID NO: 1093055 - protein, 21 aa, Mycobacterium
PTECEFFSLRGLALLTDTVDK

SEQ ID NO: 1093056 - protein, 19 aa, Mycobacterium
PTELSLVGVLLTALHVAYQ

SEQ ID NO: 1093057 - protein, 30 aa, Mycobacterium
PTPDMRLDMPLLDFFSHGGSLKSSWYGDCL

SEQ ID NO: 1093058 - protein, 19 aa, Mycobacterium
PVINRRGVLAGGATLTVLG

SEQ ID NO: 1093059 - protein, 17 aa, Mycobacterium
QAIRLGLHTAAAVVTLS

SEQ ID NO: 1093060 - protein, 24 aa, Mycobacterium
QGLSQFGINLPPVPSLTGTDDPGN

SEQ ID NO: 1093061 - protein, 40 aa, Mycobacterium
QLVLFAILTVISLTVLGVYYLQIPSLVGIGRYSLKAELSA

SEQ ID NO: 1093062 - protein, 25 aa, Mycobacterium
QPDYCAVPLRLHPDIHLFAAIPEER

SEQ ID NO: 1093063 - protein, 18 aa, Mycobacterium
QQVPTLPAPQQTPTHRAP

SEQ ID NO: 1093064 - protein, 17 aa, Mycobacterium
QRLWRVRESLAEVLGVY

SEQ ID NO: 1093065 - protein, 17 aa, Mycobacterium
QRTVLCKDPFRAVDERV

SEQ ID NO: 1093066 - protein, 17 aa, Mycobacterium
QVPIPRAGSSGGTLGVP

SEQ ID NO: 1093067 - protein, 20 aa, Mycobacterium
QVRLKRMYPGAQYRATAATV

SEQ ID NO: 1093068 - protein, 25 aa, Mycobacterium
QVTFPSIYDPAMRTLIAFGDKYPTT

SEQ ID NO: 1093069 - protein, 18 aa, Mycobacterium
RAHFAELHRPCCGDLVYG

SEQ ID NO: 1093070 - protein, 24 aa, Mycobacterium
RDGADWIHLVDLDAAFGRGSNREL

SEQ ID NO: 1093071 - protein, 25 aa, Mycobacterium
RDICALWPVPATSMPHPAPPVAPGK

SEQ ID NO: 1093072 - protein, 27 aa, Mycobacterium
RFVRPAIPSLVSAALLVSLPVLATADP

SEQ ID NO: 1093073 - protein, 23 aa, Mycobacterium
RGGKAMIVVLKPSTGQILAIAQN

SEQ ID NO: 1093074 - protein, 20 aa, Mycobacterium
RGQTLVLYRLDPDGDEVLGS

SEQ ID NO: 1093075 - protein, 18 aa, Mycobacterium
RIDRLPNGVFLDWQQFQA

SEQ ID NO: 1093076 - protein, 18 aa, Mycobacterium
RIVNTHPALLPAFPGTHG

SEQ ID NO: 1093077 - protein, 23 aa, Mycobacterium
RLHAWNRIVIPTGPPPSKQQYLV

SEQ ID NO: 1093078 - protein, 17 aa, Mycobacterium
RLRRWSSAALAAVLTVG

SEQ ID NO: 1093079 - protein, 25 aa, Mycobacterium
RLRSGLIGVLVVLLIIGVGQSFTSV

SEQ ID NO: 1093080 - protein, 18 aa, Mycobacterium
RQLRFASLAAAVDGRVVA

SEQ ID NO: 1093081 - protein, 18 aa, Mycobacterium
RRVADVLGIPFYVWDFAE

SEQ ID NO: 1093082 - protein, 29 aa, Mycobacterium
RRVQPKAWRALLTLLVISVVMPGVACNRG

SEQ ID NO: 1093083 - protein, 18 aa, Mycobacterium
RSGHPWWTLSQLSDESAL

SEQ ID NO: 1093084 - protein, 28 aa, Mycobacterium
RSHERGYAYFLYPPQAPLTEIAYDRLVT

SEQ ID NO: 1093085 - protein, 28 aa, Mycobacterium
RSVISTLSGMYWWGPASAAMLAATGPFI

SEQ ID NO: 1093086 - protein, 28 aa, Mycobacterium
RSVVISSGWNLMDFLKQLQSLADRKVAF

SEQ ID NO: 1093087 - protein, 21 aa, Mycobacterium
RTNGISIRRTPAPRWSHFTFN

SEQ ID NO: 1093088 - protein, 24 aa, Mycobacterium
RTPAPRWSHFTFNGAVGSILADQG

SEQ ID NO: 1093089 - protein, 33 aa, Mycobacterium
RTTQRIVLTHNPKWWGTPPRLDSITYLVLDDAA

SEQ ID NO: 1093090 - protein, 17 aa, Mycobacterium
RWIYASIVVWLCYARPL

SEQ ID NO: 1093091 - protein, 25 aa, Mycobacterium
RYEGRWQVRWTATGLHPRLGEHQTF

SEQ ID NO: 1093092 - protein, 25 aa, Mycobacterium
RYRRRRISLIFSSLSSGPSASDRSG

SEQ ID NO: 1093093 - protein, 17 aa, Mycobacterium
SAALQLASAICWHYWPG

SEQ ID NO: 1093094 - protein, 24 aa, Mycobacterium
SALDAALCWQRDGADWIHLVDLDA

SEQ ID NO: 1093095 - protein, 20 aa, Mycobacterium
SALLLLAYLDEAMTQQLLDI

SEQ ID NO: 1093096 - protein, 26 aa, Mycobacterium
SALLSLGLLLQPAMTPPVVGASPEQT

SEQ ID NO: 1093097 - protein, 17 aa, Mycobacterium
SAQVRLKRMYPGAQYRA

SEQ ID NO: 1093098 - protein, 22 aa, Mycobacterium
SCNTAFVQLGLLIGADALRSMA

SEQ ID NO: 1093099 - protein, 25 aa, Mycobacterium
SDGLIITATPLRPGVWRAYADHRMA

SEQ ID NO: 1093100 - protein, 28 aa, Mycobacterium
SDIERLRNLWDVPALALIGIGNGAEVAL

SEQ ID NO: 1093101 - protein, 20 aa, Mycobacterium
SELLLDDLFALLVNDFNRYP

SEQ ID NO: 1093102 - protein, 24 aa, Mycobacterium
SGAILALIHVLPVSAALCGRHTVQ

SEQ ID NO: 1093103 - protein, 27 aa, Mycobacterium
SGATIIWRLANAGALLATLLAGCSGRD

SEQ ID NO: 1093104 - protein, 26 aa, Mycobacterium
SGSVRWVSACELRFGYRTSVFKQADP

SEQ ID NO: 1093105 - protein, 25 aa, Mycobacterium
SHARRRLPLPDVLWTRILGVRLVNI

SEQ ID NO: 1093106 - protein, 32 aa, Mycobacterium
SHDDARFNVSRAALLVVALTERPDLLMAATED

SEQ ID NO: 1093107 - protein, 26 aa, Mycobacterium
SHSWFVGYRGDLAFAALIVGGGSSEY

SEQ ID NO: 1093108 - protein, 19 aa, Mycobacterium
SIAPTLLRIATQANIPVVV

SEQ ID NO: 1093109 - protein, 28 aa, Mycobacterium
SIYSACAVPPIIGYLTSGKLPATDTYCP

SEQ ID NO: 1093110 - protein, 19 aa, Mycobacterium
SLAPLTTLRVGPVAQRVIT

SEQ ID NO: 1093111 - protein, 18 aa, Mycobacterium
SLGLLDEFPPYDSVFDPV

SEQ ID NO: 1093112 - protein, 21 aa, Mycobacterium
SPALFAMIVRDAKLYLLGHFL

SEQ ID NO: 1093113 - protein, 38 aa, Mycobacterium
SPLTKNIPALKYLSYRLFMKRSAVRWLVTRMTTITSLD

SEQ ID NO: 1093114 - protein, 25 aa, Mycobacterium
SSPVDGDWLLLVELAADHDQTNRLA

SEQ ID NO: 1093115 - protein, 19 aa, Mycobacterium
STFTLSIPAAMPLYQDNDE

SEQ ID NO: 1093116 - protein, 19 aa, Mycobacterium
SVARFSAALAPHGSGTLLA

SEQ ID NO: 1093117 - protein, 32 aa, Mycobacterium
SYEQLRWMREIFMPWVWRWLRGKSSADGRVPK

SEQ ID NO: 1093118 - protein, 17 aa, Mycobacterium
TAYLERFSDHVRAMVLD

SEQ ID NO: 1093119 - protein, 27 aa, Mycobacterium
TGKVLQILQPRAAVLSAARVYRAMVSA

SEQ ID NO: 1093120 - protein, 26 aa, Mycobacterium
TGTIAYRFTWHLPKNRTWSYDGQLKM

SEQ ID NO: 1093121 - protein, 19 aa, Mycobacterium
THLAHRFRFLTKTIAAQCE

SEQ ID NO: 1093122 - protein, 25 aa, Mycobacterium
THRKGLWAILAIAVVASASAFTMPL

SEQ ID NO: 1093123 - protein, 23 aa, Mycobacterium
TITRVRLLERSSGSVRWVSACEL

SEQ ID NO: 1093124 - protein, 22 aa, Mycobacterium
TLGVITALDLRLHPAPAHRVTA

SEQ ID NO: 1093125 - protein, 17 aa, Mycobacterium
TMGHYVCPILAKSGGNF

SEQ ID NO: 1093126 - protein, 22 aa, Mycobacterium
TMRLSPIRLIDSAQVRLKRMYP

SEQ ID NO: 1093127 - protein, 21 aa, Mycobacterium
TPVGAMALLAEALLASADDAE

SEQ ID NO: 1093128 - protein, 27 aa, Mycobacterium
TQAGQFALTYPRRLGFGLGSSVVSLSW

SEQ ID NO: 1093129 - protein, 27 aa, Mycobacterium
TRGLRTYVQLFVLIAAANDVRCDVASN

SEQ ID NO: 1093130 - protein, 24 aa, Mycobacterium
TRLRGMFAFALWDTIAHELFCARD

SEQ ID NO: 1093131 - protein, 18 aa, Mycobacterium
TSGGWRIDRLPNGVFLDW

SEQ ID NO: 1093132 - protein, 33 aa, Mycobacterium
TSIDQIVYWSPYQAQVLFTMRTSPATGGPKRRQ

SEQ ID NO: 1093133 - protein, 23 aa, Mycobacterium
TTPDKPIPLPQYLESIGVTGQQV

SEQ ID NO: 1093134 - protein, 33 aa, Mycobacterium
TTTFPNVVQFLPLGRLVARRLLRINNAITAAAD

SEQ ID NO: 1093135 - protein, 31 aa, Mycobacterium
TVATLAIASPCAYFLVYEPTASAKPAAKHYE

SEQ ID NO: 1093136 - protein, 19 aa, Mycobacterium
TVPGIWVPDTPLSHRNTQP

SEQ ID NO: 1093137 - protein, 20 aa, Mycobacterium
VAAVFLRELLAGDLQPVVAR

SEQ ID NO: 1093138 - protein, 25 aa, Mycobacterium
VAEFTLDVYPRYLSLIPANVNADIK

SEQ ID NO: 1093139 - protein, 22 aa, Mycobacterium
VAFQVLAGLVEPGPRLAKELYR

SEQ ID NO: 1093140 - protein, 17 aa, Mycobacterium
VAMFPSWETLPHERLSP

SEQ ID NO: 1093141 - protein, 23 aa, Mycobacterium
VANARLAYAAYQKAFEGGQRYQT

SEQ ID NO: 1093142 - protein, 19 aa, Mycobacterium
VARLILDSPIALGIKTEAA

SEQ ID NO: 1093143 - protein, 37 aa, Mycobacterium
VATDNRFRFLRVYPNPAVYAPITGFYSLRYSSTGLEQ

SEQ ID NO: 1093144 - protein, 17 aa, Mycobacterium
VAVVTLCVLPEGLAAAG

SEQ ID NO: 1093145 - protein, 28 aa, Mycobacterium
VDHYAEIGLLGFALIVDALGGVDVCLKD

SEQ ID NO: 1093146 - protein, 19 aa, Mycobacterium
VEFDLLPGKRPAAGRSGLS

SEQ ID NO: 1093147 - protein, 25 aa, Mycobacterium
VGAFDIVQFGWVGDAFPLSALTQIY

SEQ ID NO: 1093148 - protein, 17 aa, Mycobacterium
VGQGRWVHRLVVSHVFH

SEQ ID NO: 1093149 - protein, 23 aa, Mycobacterium
VIGGEQIYRLALPLATRCGVTEV

SEQ ID NO: 1093150 - protein, 21 aa, Mycobacterium
VIGLEVALPDGSLLCRHSLAR

SEQ ID NO: 1093151 - protein, 18 aa, Mycobacterium
VIGMPSTPRFLGNGQLLV

SEQ ID NO: 1093152 - protein, 24 aa, Mycobacterium
VLDRYDYVLIDCQPSLGLLTVNGL

SEQ ID NO: 1093153 - protein, 17 aa, Mycobacterium
VLGIELHYLALKRVDYL

SEQ ID NO: 1093154 - protein, 25 aa, Mycobacterium
VLGVYGPPLKFDVSLPLSAISGFAK

SEQ ID NO: 1093155 - protein, 31 aa, Mycobacterium
VLHRPKLGFPVPIRHWLRAGELLEWAYALVN

SEQ ID NO: 1093156 - protein, 29 aa, Mycobacterium
VLRPEWPYHVPSVSDLDWFDAVPAGVPGG

SEQ ID NO: 1093157 - protein, 20 aa, Mycobacterium
VLRSLPRHRALTAVSLGLSE

SEQ ID NO: 1093158 - protein, 26 aa, Mycobacterium
VNPTTRAVLFHLGRFIPQGVPDTYGF

SEQ ID NO: 1093159 - protein, 18 aa, Mycobacterium
VQKLPLNVTWVNLTTGKS

SEQ ID NO: 1093160 - protein, 18 aa, Mycobacterium
VRAVRRGLQAVGVSAAGL

SEQ ID NO: 1093161 - protein, 28 aa, Mycobacterium
VRHQTWRGLVMLVAALLLSSCGWRGISN

SEQ ID NO: 1093162 - protein, 28 aa, Mycobacterium
VRWQHPTRGLLFPDSFIPVAESINLAGK

SEQ ID NO: 1093163 - protein, 31 aa, Mycobacterium
VTSRARLNWWESRALYGWTVLVPRTKDQAGE

SEQ ID NO: 1093164 - protein, 19 aa, Mycobacterium
VVERFDVVRLLPNPSRRGN

SEQ ID NO: 1093165 - protein, 22 aa, Mycobacterium
VVLPNLRIMPIYRADASGTTDN

SEQ ID NO: 1093166 - protein, 20 aa, Mycobacterium
VYEYLLPKTYTVPYENSLPV

SEQ ID NO: 1093167 - protein, 31 aa, Mycobacterium
WQRNPERVWGWYLWRHYLVANVKPNDGHRAI

SEQ ID NO: 1093168 - protein, 20 aa, Mycobacterium
WYPWAWLAHRDAQTTSTLKD

SEQ ID NO: 1093169 - protein, 17 aa, Mycobacterium
YAPMIHPWSSGRDLYFN

SEQ ID NO: 1093170 - protein, 22 aa, Mycobacterium
YARSVILLIKQQCPDVTTCRHS

SEQ ID NO: 1093171 - protein, 18 aa, Mycobacterium
YAVIKFDPAKVMPVAAYN

SEQ ID NO: 1093172 - protein, 39 aa, Mycobacterium
YKPDLVVLAGFMRILGPQFLARFFGRIVNTHPALLPAFP

SEQ ID NO: 1093173 - protein, 19 aa, Mycobacterium
YPEHTFTWDTALQVRAALD

SEQ ID NO: 1093174 - protein, 20 aa, Mycobacterium
YQTLMARGAQVQRPLWASTG

SEQ ID NO: 1093175 - protein, 17 aa, Mycobacterium
YVPLPDTIKKRLVSAIN

SEQ ID NO: 1093176 - protein, 27 aa, Mycobacterium
AAAAKYWRYQKYDDCLIMAVADVVGQV

SEQ ID NO: 1093177 - protein, 24 aa, Mycobacterium
AAAAPGRLLGKPAYHALTFGWLMS

SEQ ID NO: 1093178 - protein, 25 aa, Mycobacterium
AAAGIPGILTYLVVPAGRGPPSVPV

SEQ ID NO: 1093179 - protein, 26 aa, Mycobacterium
AAAGVLELLIVHPGGPFWARKDDGAW

SEQ ID NO: 1093180 - protein, 17 aa, Mycobacterium
AAAIPTTAIATAAADDV

SEQ ID NO: 1093181 - protein, 34 aa, Mycobacterium; identical to SEQ ID NO: 941997

SEQ ID NO: 1093182 - protein, 27 aa, Mycobacterium
AAAMMAVATQYMAWLGAAAAQAEQAAA

SEQ ID NO: 1093183 - protein, 25 aa, Mycobacterium
AAASLGWQAAPIPRNAPGCAGCCQC

SEQ ID NO: 1093184 - protein, 17 aa, Mycobacterium
AAAVLAALLTGCSGRDA

SEQ ID NO: 1093185 - protein, 29 aa, Mycobacterium
AADTHALIVLAVPMPALPAMLAHIRELAP

SEQ ID NO: 1093186 - protein, 19 aa, Mycobacterium
AAEDTRRVLTLAKALDISI

SEQ ID NO: 1093187 - protein, 19 aa, Mycobacterium
AAEVLGFRAAVEPLEGLRG

SEQ ID NO: 1093188 - protein, 23 aa, Mycobacterium
AAGGTFVFLDAPAGTHVCVELPL

SEQ ID NO: 1093189 - protein, 20 aa, Mycobacterium
AAGGWLLGNGGAGGSGAAGQ

SEQ ID NO: 1093190 - protein, 31 aa, Mycobacterium
AAGPDQPALRPLLDLLPIASGSGTLGERFLD

SEQ ID NO: 1093191 - protein, 22 aa, Mycobacterium
AAIATFAFAFAAAPVIGLGAPA

SEQ ID NO: 1093192 - protein, 18 aa, Mycobacterium
AAILVTTVSFTGTLRPYV

SEQ ID NO: 1093193 - protein, 33 aa, Mycobacterium
AAINAPVQELTGRPLIGNGLPGSAGSGAAGAPG

SEQ ID NO: 1093194 - protein, 23 aa, Mycobacterium
AAKAEPLGILPQPNELPRGCIAA

SEQ ID NO: 1093195 - protein, 21 aa, Mycobacterium
AALHLRRWLPRAHEIVVISPN

SEQ ID NO: 1093196 - protein, 17 aa, Mycobacterium
AALLTLDRQARISTRVV

SEQ ID NO: 1093197 - protein, 17 aa, Mycobacterium
AALTVDPMFANSPAADE

SEQ ID NO: 1093198 - protein, 17 aa, Mycobacterium
AALVPGLTWSMDVDSWN

SEQ ID NO: 1093199 - protein, 29 aa, Mycobacterium
AAMAAAAAPYAGWLSAAATRALGAATQAK

SEQ ID NO: 1093200 - protein, 20 aa, Mycobacterium
AANPASLIDITRFWFEQGSL

SEQ ID NO: 1093201 - protein, 26 aa, Mycobacterium
AAPGRITTILALHDLINGGHPGQYGT

SEQ ID NO: 1093202 - protein, 27 aa, Mycobacterium
AAQVLAGWQTWLAAADRDTWGLVDMSV

SEQ ID NO: 1093203 - protein, 18 aa, Mycobacterium
AARDALGGAPLTLRIGYH

SEQ ID NO: 1093204 - protein, 30 aa, Mycobacterium; identical to SEQ ID NO: 942183

SEQ ID NO: 1093205 - protein, 34 aa, Mycobacterium; identical to SEQ ID NO: 942197

SEQ ID NO: 1093206 - protein, 27 aa, Mycobacterium
AAVNGQLFIVYGPQVTLVAAPTAEHKF

SEQ ID NO: 1093207 - protein, 19 aa, Mycobacterium
AAYEQMWALDVAAMAAYHA

SEQ ID NO: 1093208 - protein, 18 aa, Mycobacterium
ACRTMAADPGWYGDNRDR

SEQ ID NO: 1093209 - protein, 18 aa, Mycobacterium
ADAAALLQRARQDWQGCA

SEQ ID NO: 1093210 - protein, 19 aa, Mycobacterium
ADEHVFYDLNIAKSVASLI

SEQ ID NO: 1093211 - protein, 32 aa, Mycobacterium; identical to SEQ ID NO: 942275

SEQ ID NO: 1093212 - protein, 24 aa, Mycobacterium
ADNVVPLYRRNALNERQLLAVNEV

SEQ ID NO: 1093213 - protein, 26 aa, Mycobacterium
ADTAGAAVAIPPAALAAGATDPAVAR

SEQ ID NO: 1093214 - protein, 19 aa, Mycobacterium
AEDICRVHLALQADAVGPA

SEQ ID NO: 1093215 - protein, 20 aa, Mycobacterium
AEGISVNVTLIFSVDRHRGV

SEQ ID NO: 1093216 - protein, 20 aa, Mycobacterium
AEHGLWYPPDPSSFEICSIG

SEQ ID NO: 1093217 - protein, 25 aa, Mycobacterium
AEKRRRGTRYWDPLATLSYLAARTQ

SEQ ID NO: 1093218 - protein, 28 aa, Mycobacterium
AELRQAFPGGIVALSKWAATPNPELGDI

SEQ ID NO: 1093219 - protein, 18 aa, Mycobacterium
AELSAPHGGVPHGLGDAG

SEQ ID NO: 1093220 - protein, 23 aa, Mycobacterium
AERLTEFFGGIPILDGVGSTEVG

SEQ ID NO: 1093221 - protein, 17 aa, Mycobacterium
AEVLRIISGGRIIWDPA

SEQ ID NO: 1093222 - protein, 27 aa, Mycobacterium
AEVRDLFETHFFGTVALIKAVLPDMRA

SEQ ID NO: 1093223 - protein, 25 aa, Mycobacterium
AFDAVPFLELLSAYGAPWGLQEVPA

SEQ ID NO: 1093224 - protein, 20 aa, Mycobacterium
AFDEGGAPRWWFTVGGEVGK

SEQ ID NO: 1093225 - protein, 26 aa, Mycobacterium
AFFTSRCNMIAWDRGVFMPVAQEYFG

SEQ ID NO: 1093226 - protein, 23 aa, Mycobacterium
AFIADLLLSRRFTRSAGRRRVRQ

SEQ ID NO: 1093227 - protein, 23 aa, Mycobacterium
AFKVPHRFAVVERLPRTANGKLL

SEQ ID NO: 1093228 - protein, 18 aa, Mycobacterium
AFPASKWRRYDKLDRFPA

SEQ ID NO: 1093229 - protein, 21 aa, Mycobacterium
AFSAALLFGSAAIAVADPPAN

SEQ ID NO: 1093230 - protein, 24 aa, Mycobacterium
AFTIEARALTFQPKRIRKQLEEAK

SEQ ID NO: 1093231 - protein, 20 aa, Mycobacterium
AFVAAVVAAAAFFTVGGRAA

SEQ ID NO: 1093232 - protein, 25 aa, Mycobacterium
AGAEGPPPGAMWDPGARPGNGRRWD

SEQ ID NO: 1093233 - protein, 22 aa, Mycobacterium
AGAVALLGIGLLGTGCTNTVAG

SEQ ID NO: 1093234 - protein, 23 aa, Mycobacterium
AGAWVGTRLAACPEALTGEPSRQ

SEQ ID NO: 1093235 - protein, 24 aa, Mycobacterium
AGGAGGLFGGIFGAGGGDGGAGGF

SEQ ID NO: 1093236 - protein, 21 aa, Mycobacterium
AGGHGGLLYGDGETGGFGGDG

SEQ ID NO: 1093237 - protein, 18 aa, Mycobacterium
AGGLLAGLVGAGGGDGGS

SEQ ID NO: 1093238 - protein, 18 aa, Mycobacterium
AGGLLIVAAADTGSVLSP

SEQ ID NO: 1093239 - protein, 25 aa, Mycobacterium
AGGNAGLIFGFGGAGGTGGSGINSF

SEQ ID NO: 1093240 - protein, 23 aa, Mycobacterium
AGGNGGWLFGAGGNGGFGGAATG

SEQ ID NO: 1093241 - protein, 26 aa, Mycobacterium
AGGPGGAGGWLWGGGGAGGLGGPASG

SEQ ID NO: 1093242 - protein, 24 aa, Mycobacterium
AGGQLQMNLGILNGLLAPNGQQVP

SEQ ID NO: 1093243 - protein, 19 aa, Mycobacterium
AGHGALFTRAPWVVSVDDH

SEQ ID NO: 1093244 - protein, 25 aa, Mycobacterium
AGIAGPALAFWLTHSGYQVVVTELA

SEQ ID NO: 1093245 - protein, 24 aa, Mycobacterium
AGIERTLVSYLRLSGKIAQDTSFD

SEQ ID NO: 1093246 - protein, 48 aa, Mycobacterium
AGIFDGLQQITPAGLLYLIGPMAWTLGYPIVPMLTPGSLDFNGVVFNQ

SEQ ID NO: 1093247 - protein, 33 aa, Mycobacterium; identical to SEQ ID NO: 790676

SEQ ID NO: 1093248 - protein, 24 aa, Mycobacterium
AGLDARAYRLAWPSGSVVYEVDQP

SEQ ID NO: 1093249 - protein, 25 aa, Mycobacterium
AGLPEYRFPDPKGTRFPNGAPPPGP

SEQ ID NO: 1093250 - protein, 39 aa, Mycobacterium; identical to SEQ ID NO: 942507

SEQ ID NO: 1093251 - protein, 27 aa, Mycobacterium
AGPTPPPSTFAPGLPPGPPAPPGPGPQ

SEQ ID NO: 1093252 - protein, 18 aa, Mycobacterium
AGPTTALAGALGADEVSV

SEQ ID NO: 1093253 - protein, 26 aa, Mycobacterium
AGRHARQLALLKRIAPAAVLDNGIRK

SEQ ID NO: 1093254 - protein, 26 aa, Mycobacterium
AGSLLDLAGPYLPFDNPFTAAGMQYY

SEQ ID NO: 1093255 - protein, 38 aa, Mycobacterium; identical to SEQ ID NO: 942537

SEQ ID NO: 1093256 - protein, 18 aa, Mycobacterium
AHLTMPYVSPADGEVVGV

SEQ ID NO: 1093257 - protein, 30 aa, Mycobacterium
AIAASTFHTQFVRALNLSGGAYAAADVANA

SEQ ID NO: 1093258 - protein, 23 aa, Mycobacterium
AIDGLVVGMQRYVRGQLTQLLGQ

SEQ ID NO: 1093259 - protein, 24 aa, Mycobacterium
AIEFMVELVLFDWPTHIAQIIQAL

SEQ ID NO: 1093260 - protein, 26 aa, Mycobacterium
AIHFQEWWVRYRAELPTHSFAFIGTE

SEQ ID NO: 1093261 - protein, 24 aa, Mycobacterium
AIRGWLRTQLLRPASIKIIRINEF

SEQ ID NO: 1093262 - protein, 23 aa, Mycobacterium
AKLCVQYLAPILKNRQYNFPPLG

SEQ ID NO: 1093263 - protein, 27 aa, Mycobacterium
AKRWGVLHVIWRQKIYPGIVAPSWTAD

SEQ ID NO: 1093264 - protein, 25 aa, Mycobacterium
ALAAAVLGRPLIGNGTNGAPGSGDA

SEQ ID NO: 1093265 - protein, 29 aa, Mycobacterium
ALAFGAEVQYLRYLGFHFAAFVFDASDMD

SEQ ID NO: 1093266 - protein, 19 aa, Mycobacterium
ALAHWLHRTGHTRTLIERA

SEQ ID NO: 1093267 - protein, 21 aa, Mycobacterium
ALAPTHTLLLAGRPSAQLDAV

SEQ ID NO: 1093268 - protein, 20 aa, Mycobacterium
ALDEGLLPVLPQLSAKHQVV

SEQ ID NO: 1093269 - protein, 19 aa, Mycobacterium
ALEDVSIPTLLLSLVHITG

SEQ ID NO: 1093270 - protein, 18 aa, Mycobacterium
ALFTPEQFWPVTPGLGNL

SEQ ID NO: 1093271 - protein, 23 aa, Mycobacterium
ALGADTWHWHPMASFASSSKVGG

SEQ ID NO: 1093272 - protein, 17 aa, Mycobacterium
ALGLDPIVHVSSFTALF

SEQ ID NO: 1093273 - protein, 40 aa, Mycobacterium; identical to SEQ ID NO: 942712

SEQ ID NO: 1093274 - protein, 17 aa, Mycobacterium
ALHVTLLALMVAIPGLA

SEQ ID NO: 1093275 - protein, 19 aa, Mycobacterium
ALLMLHPPSETMPSLPECT

SEQ ID NO: 1093276 - protein, 24 aa, Mycobacterium
ALMAALPMRLLLATMLVAGSLVIT

SEQ ID NO: 1093277 - protein, 17 aa, Mycobacterium
ALRLTPADIGLSSARMY

SEQ ID NO: 1093278 - protein, 18 aa, Mycobacterium
ALSRYFGSNLSRLTQIRQ

SEQ ID NO: 1093279 - protein, 20 aa, Mycobacterium
ALSVPHSWAMAAPEIRLAVE

SEQ ID NO: 1093280 - protein, 19 aa, Mycobacterium
ALTPDELVLYLPDYPVGHD

SEQ ID NO: 1093281 - protein, 22 aa, Mycobacterium
ALVGTRFWACPEALVSPRAHQR

SEQ ID NO: 1093282 - protein, 22 aa, Mycobacterium
ALVLAAYYPQQFPYAASLSGFL

SEQ ID NO: 1093283 - protein, 18 aa, Mycobacterium
ALVLLAFSAYVRGDGPLT

SEQ ID NO: 1093284 - protein, 18 aa, Mycobacterium
ALVRSPPAVTWRDARPTR

SEQ ID NO: 1093285 - protein, 19 aa, Mycobacterium
ALYSPNLWQHLTDGLTELT

SEQ ID NO: 1093286 - protein, 22 aa, Mycobacterium
AMAPVLRRWVFVRIFDIRVKAP

SEQ ID NO: 1093287 - protein, 26 aa, Mycobacterium
AMLAATGPFIGWLEITGALASETANQ

SEQ ID NO: 1093288 - protein, 26 aa, Mycobacterium
ANNDFKPGFATALMNKDLGLAMDAVT

SEQ ID NO: 1093289 - protein, 23 aa, Mycobacterium
ANPAGLIDITRYWFEQGSLSNER

SEQ ID NO: 1093290 - protein, 17 aa, Mycobacterium
ANPASLIDITRFWFEQG

SEQ ID NO: 1093291 - protein, 19 aa, Mycobacterium
ANQFIPPALLARASRVVGQ

SEQ ID NO: 1093292 - protein, 17 aa, Mycobacterium
ANRVLLMALVATNFFGQ

SEQ ID NO: 1093293 - protein, 25 aa, Mycobacterium
ANTGTSMPALFYAKAGSLYVSDPAG

SEQ ID NO: 1093294 - protein, 17 aa, Mycobacterium
ANYEPLQGTFRPVSKLV

SEQ ID NO: 1093295 - protein, 20 aa, Mycobacterium
APAAGLLGAPVAQALAAPAT

SEQ ID NO: 1093296 - protein, 31 aa, Mycobacterium
APAGAPHRLVDPAALPPPPGHRLGQIVNPRW

SEQ ID NO: 1093297 - protein, 22 aa, Mycobacterium
APALLISRLVSWVDDLWCRAIG

SEQ ID NO: 1093298 - protein, 20 aa, Mycobacterium
APCVGWLYRTAEQTQQAAIQ

SEQ ID NO: 1093299 - protein, 19 aa, Mycobacterium
APDGVKLAAGWLLERAGFG

SEQ ID NO: 1093300 - protein, 20 aa, Mycobacterium
APDLIRYYEMLLDGEGGLPL

SEQ ID NO: 1093301 - protein, 38 aa, Mycobacterium
APFMSYGKFTGHAPLGTCAFWPVPPTSKPHAVSVPGLV

SEQ ID NO: 1093302 - protein, 29 aa, Mycobacterium
APGGFDCSGLVMWAFQQAGIALPHSSQAL

SEQ ID NO: 1093303 - protein, 27 aa, Mycobacterium
APLDDAHLLFLFRTQEELRYHYRDVLR

SEQ ID NO: 1093304 - protein, 22 aa, Mycobacterium
APLTLRIGYHGPNARLAAIIGA

SEQ ID NO: 1093305 - protein, 30 aa, Mycobacterium
APRTRFNRRIGPHRRFAFASVPLADVKAVK

SEQ ID NO: 1093306 - protein, 20 aa, Mycobacterium
APSEPAQFTAPGAPGTLGSG

SEQ ID NO: 1093307 - protein, 20 aa, Mycobacterium
APTEALFGRGLISNGAAGTA

SEQ ID NO: 1093308 - protein, 18 aa, Mycobacterium
APTLLKKLQSNESFVYLA

SEQ ID NO: 1093309 - protein, 31 aa, Mycobacterium; identical to SEQ ID NO: 942937

SEQ ID NO: 1093310 - protein, 25 aa, Mycobacterium
AQEQTPARPITLPGPATGLTGDGHG

SEQ ID NO: 1093311 - protein, 22 aa, Mycobacterium
AQLAAPLRRLTGLSGTTGALAK

SEQ ID NO: 1093312 - protein, 24 aa, Mycobacterium
AQQRYPAWPASFDASLRLPWRQLQ

SEQ ID NO: 1093313 - protein, 33 aa, Mycobacterium
AQRPQGFNALEITLPMPPRWTPVPDPNVPDAFA

SEQ ID NO: 1093314 - protein, 17 aa, Mycobacterium
AQVAVAANSPFLLGRHA

SEQ ID NO: 1093315 - protein, 25 aa, Mycobacterium
AQVHQRIVQLLNSASGAYASAEAAN

SEQ ID NO: 1093316 - protein, 18 aa, Mycobacterium
AQVLSRIKIFARVDAVVT

SEQ ID NO: 1093317 - protein, 20 aa, Mycobacterium
AQWLAAHGWAVEPVRNTLEL

SEQ ID NO: 1093318 - protein, 17 aa, Mycobacterium
AQYNTYLKQYLVMYTNG

SEQ ID NO: 1093319 - protein, 26 aa, Mycobacterium
ARDGGYLPMNFAANDLAWSATNPCDV

SEQ ID NO: 1093320 - protein, 25 aa, Mycobacterium
ARDPFGIKPLFMATGPGGTALASEK

SEQ ID NO: 1093321 - protein, 18 aa, Mycobacterium
AREHGLQLLFFTDSATGR

SEQ ID NO: 1093322 - protein, 19 aa, Mycobacterium
ARFLLGAQRLLGLGQFATP

SEQ ID NO: 1093323 - protein, 20 aa, Mycobacterium
ARLAALMATNIFGQNVPAIA

SEQ ID NO: 1093324 - protein, 17 aa, Mycobacterium
ARLGGVAVILPALDLDQ

SEQ ID NO: 1093325 - protein, 17 aa, Mycobacterium
ARYAGTARPRLAPPVPS

SEQ ID NO: 1093326 - protein, 25 aa, Mycobacterium
ARYQALKERGARVQRPLWASTGVKN

SEQ ID NO: 1093327 - protein, 25 aa, Mycobacterium
ASAARFAVRAGTGLPRQPRGAITAG

SEQ ID NO: 1093328 - protein, 25 aa, Mycobacterium
ASADPLYPQPPSPAPAPAQAAVPPV

SEQ ID NO: 1093329 - protein, 26 aa, Mycobacterium
ASAEDHPDLFWALRGGGGGNFGVTTA

SEQ ID NO: 1093330 - protein, 26 aa, Mycobacterium
ASAEYLQLLRRHKVAATLSGAGPALI

SEQ ID NO: 1093331 - protein, 26 aa, Mycobacterium
ASAVAAQLAPWQQALRTLQNRVAGAT

SEQ ID NO: 1093332 - protein, 28 aa, Mycobacterium
ASGLDARPYRLPWPTGMRVYEIDQPEVI

SEQ ID NO: 1093333 - protein, 26 aa, Mycobacterium
ASGSRIEVLLRQQEDPRWTCSHAMAL

SEQ ID NO: 1093334 - protein, 25 aa, Mycobacterium
ASLAAGGWLMRALRGAPAALGADPA

SEQ ID NO: 1093335 - protein, 18 aa, Mycobacterium
ASMSSGMWQSMHGSDMAS

SEQ ID NO: 1093336 - protein, 24 aa, Mycobacterium
ASSMAPVVRLPGPVPRAPGPAPQA

SEQ ID NO: 1093337 - protein, 19 aa, Mycobacterium
ASVYVGSISMIYLTEAAHA

SEQ ID NO: 1093338 - protein, 44 aa, Mycobacterium
ATAEAANAGPLQPLLDLINAPTQALLARPLIGDGTNGAPGTGQA

SEQ ID NO: 1093339 - protein, 27 aa, Mycobacterium
ATAFETAFAVVVPPPLIAANRSQVASL

SEQ ID NO: 1093340 - protein, 24 aa, Mycobacterium
ATAFKNFQYTVEAQRLWAQAGFRP

SEQ ID NO: 1093341 - protein, 24 aa, Mycobacterium
ATALAVVVVLGTGLAWTNVRSFEG

SEQ ID NO: 1093342 - protein, 35 aa, Mycobacterium; identical to SEQ ID NO: 977145

SEQ ID NO: 1093343 - protein, 18 aa, Mycobacterium
ATIPQLVQLAPQAGQMAQ

SEQ ID NO: 1093344 - protein, 19 aa, Mycobacterium
ATMAGWRTDFLNEMGLVVS

SEQ ID NO: 1093345 - protein, 36 aa, Mycobacterium; identical to SEQ ID NO: 783034

SEQ ID NO: 1093346 - protein, 20 aa, Mycobacterium
ATPRHHGISIVLVEPGPGLN

SEQ ID NO: 1093347 - protein, 19 aa, Mycobacterium
ATRGAPGPAPPPILRGRRC

SEQ ID NO: 1093348 - protein, 22 aa, Mycobacterium
ATTLILVLVAGVIAAMRTAGDA

SEQ ID NO: 1093349 - protein, 26 aa, Mycobacterium
ATTTSGLPALDLPAPNLGIGNAGVGN

SEQ ID NO: 1093350 - protein, 23 aa, Mycobacterium
ATYQRWQELGAMNSVLGAPTSPE

SEQ ID NO: 1093351 - protein, 20 aa, Mycobacterium
ATYSAPGYAFFWNADEKKAE

SEQ ID NO: 1093352 - protein, 25 aa, Mycobacterium
AVAAPAITAVIPPAADPVSVRNAAG

SEQ ID NO: 1093353 - protein, 18 aa, Mycobacterium
AVAEVTRQRQGWGAWPVC

SEQ ID NO: 1093354 - protein, 25 aa, Mycobacterium
AVAFHGRFVQALTGGVQMYAAAETA

SEQ ID NO: 1093355 - protein, 25 aa, Mycobacterium
AVAIVKILRTLLSNPAVWEKTALII

SEQ ID NO: 1093356 - protein, 17 aa, Mycobacterium
AVASPCAYFLVYESTTE

SEQ ID NO: 1093357 - protein, 25 aa, Mycobacterium
AVDPRFVMPIFEGALAAGADYLDMA

SEQ ID NO: 1093358 - protein, 17 aa, Mycobacterium
AVFPPATHAAAAFGPLA

SEQ ID NO: 1093359 - protein, 17 aa, Mycobacterium
AVGPPLPPGLQGNMAAV

SEQ ID NO: 1093360 - protein, 25 aa, Mycobacterium
AVGRLRAISIPGLDLRRQLRAIWVG

SEQ ID NO: 1093361 - protein, 25 aa, Mycobacterium
AVHNAETIVLRRSRPLEISLDGHQV

SEQ ID NO: 1093362 - protein, 21 aa, Mycobacterium
AVKLCGYSDCRVLTTFTACGA

SEQ ID NO: 1093363 - protein, 17 aa, Mycobacterium
AVLADPALRLAVCKGID

SEQ ID NO: 1093364 - protein, 23 aa, Mycobacterium
AVLAHWLVRLIAARHLIAGGHVD

SEQ ID NO: 1093365 - protein, 21 aa, Mycobacterium
AVLLAFPLVPKAAAACPDVQV

SEQ ID NO: 1093366 - protein, 23 aa, Mycobacterium
AVQKRLPIWVGGRTLRSLRRATS

SEQ ID NO: 1093367 - protein, 24 aa, Mycobacterium
AVRPEPFGALLYHFGTRKLSFLKN

SEQ ID NO: 1093368 - protein, 19 aa, Mycobacterium
AVSGGIAWIPAHQRSPDRD

SEQ ID NO: 1093369 - protein, 23 aa, Mycobacterium
AVVAPELMRVAASDLANIGSTLS

SEQ ID NO: 1093370 - protein, 32 aa, Mycobacterium
AVVVEFRDQFPLPEKLWTIADLGGWDTVDPQL

SEQ ID NO: 1093371 - protein, 20 aa, Mycobacterium
AVVVTSAAAFGLCPAAAADP

SEQ ID NO: 1093372 - protein, 29 aa, Mycobacterium
AVWRVRAYGDFFSYCLLAEGAIDIAAEPE

SEQ ID NO: 1093373 - protein, 26 aa, Mycobacterium
AWSAEGLLMYLPPDAQDRLFDAISGL

SEQ ID NO: 1093374 - protein, 30 aa, Mycobacterium
AYARGLRDAGLLPVLKHFPGHGRASGDSHT

SEQ ID NO: 1093375 - protein, 19 aa, Mycobacterium
CATAAVGPPLPPGLQGNMA

SEQ ID NO: 1093376 - protein, 32 aa, Mycobacterium
CGGNPAWDLPLVFGPIALVYNLPGVKTLIVDA

SEQ ID NO: 1093377 - protein, 27 aa, Mycobacterium
CGLAGTVLRFAPPLAALSAAPITFDGD

SEQ ID NO: 1093378 - protein, 23 aa, Mycobacterium
CGLLLLMVPPPSVNSLLSRSNWE

SEQ ID NO: 1093379 - protein, 19 aa, Mycobacterium
CLGAIAPAMRISYEVAPVR

SEQ ID NO: 1093380 - protein, 21 aa, Mycobacterium
CPPVYVPWTPDFAGRNDFRGE

SEQ ID NO: 1093381 - protein, 25 aa, Mycobacterium
CQTYKWETFLTSELPQYLQSNKQIK

SEQ ID NO: 1093382 - protein, 18 aa, Mycobacterium
CQWFVVGAIGLLASGAAE

SEQ ID NO: 1093383 - protein, 23 aa, Mycobacterium
CSGDAVVTPLLLANGYHAGIDIP

SEQ ID NO: 1093384 - protein, 18 aa, Mycobacterium
CSLLVVLVIVASQCFWIA

SEQ ID NO: 1093385 - protein, 26 aa, Mycobacterium
CSWIVTLYISLCASLIRCLFARPPGL

SEQ ID NO: 1093386 - protein, 19 aa, Mycobacterium
CTAAVLFKGSPLRPPGSAD

SEQ ID NO: 1093387 - protein, 23 aa, Mycobacterium
CTFTAPEIRWFATRGAPGPAPPP

SEQ ID NO: 1093388 - protein, 17 aa, Mycobacterium
CTQIEWYRTIQIGDQAS

SEQ ID NO: 1093389 - protein, 17 aa, Mycobacterium
CVFFESPRRLAACLRDA

SEQ ID NO: 1093390 - protein, 20 aa, Mycobacterium
DAIAALVPGLTWSMDVDSWN

SEQ ID NO: 1093391 - protein, 22 aa, Mycobacterium
DALKPYFDEMFLGRGQVATILR

SEQ ID NO: 1093392 - protein, 24 aa, Mycobacterium
DANSSMIINWTVAPAGPGCSVTVK

SEQ ID NO: 1093393 - protein, 22 aa, Mycobacterium
DASGLIQYAYAGAGIKLPRSSG

SEQ ID NO: 1093394 - protein, 19 aa, Mycobacterium
DATFRWGVAMLPIGPAGRV

SEQ ID NO: 1093395 - protein, 26 aa, Mycobacterium
DAVNTPTQALFGRPLIGNGANGTATS

SEQ ID NO: 1093396 - protein, 20 aa, Mycobacterium
DCLGITTMLAKSAYQSARRS

SEQ ID NO: 1093397 - protein, 20 aa, Mycobacterium
DDDVYAWRGVLQSAAVHEFH

SEQ ID NO: 1093398 - protein, 23 aa, Mycobacterium
DDLAYGLGLWYGVMRERNAGALK

SEQ ID NO: 1093399 - protein, 24 aa, Mycobacterium
DDPEFHPPRLGDLKRSCLDISRAE

SEQ ID NO: 1093400 - protein, 24 aa, Mycobacterium
DDSIPNRWLVRPGALRPRHWDAEP

SEQ ID NO: 1093401 - protein, 19 aa, Mycobacterium
DELVLYLPDYPVGHDEPID

SEQ ID NO: 1093402 - protein, 28 aa, Mycobacterium
DEVSTAIAALFGWHAQTYQSLSAQATSF

SEQ ID NO: 1093403 - protein, 32 aa, Mycobacterium
DFDGAAIPGWSWSQVLPHFRAIETDLDFDTPV

SEQ ID NO: 1093404 - protein, 23 aa, Mycobacterium
DGAAKFTAIAANAYCPAILSGHG

SEQ ID NO: 1093405 - protein, 28 aa, Mycobacterium
DGAIWARYNVPWQPAWVFYRVDGSSTFV

SEQ ID NO: 1093406 - protein, 19 aa, Mycobacterium
DGALARRAVVARAVAIDAY

SEQ ID NO: 1093407 - protein, 23 aa, Mycobacterium
DGASLPWSLTLQTTAPSAAPNIL

SEQ ID NO: 1093408 - protein, 21 aa, Mycobacterium
DGGFGGWGGNGYGGVGGGNGG

SEQ ID NO: 1093409 - protein, 30 aa, Mycobacterium
DGGLLARFPGFYIPFLDVSFNGATPAANPY

SEQ ID NO: 1093410 - protein, 25 aa, Mycobacterium
DGGNGGYGGWGFNGGNGGNGGDGGT

SEQ ID NO: 1093411 - protein, 26 aa, Mycobacterium
DGGTRPKGTLFFRSGGDGGFGGWGGN

SEQ ID NO: 1093412 - protein, 24 aa, Mycobacterium
DGLGSYFWQHNWGSPKGYTHPAAN

SEQ ID NO: 1093413 - protein, 56 aa, Mycobacterium
DGQFQVLAEPVQTLGQAWLASPAGELLDPLVNAPFESLTGRELIGNGAAGVAGVDG

SEQ ID NO: 1093414 - protein, 19 aa, Mycobacterium
DGRFRFLRVYPNPEVYAPV

SEQ ID NO: 1093415 - protein, 26 aa, Mycobacterium
DGSGADPLWFLSLLSQDAVDLLELGL

SEQ ID NO: 1093416 - protein, 19 aa, Mycobacterium
DGTFRVGVDIKAGTYRSAG

SEQ ID NO: 1093417 - protein, 23 aa, Mycobacterium
DGVLGEITVVLAGAAPLHVDLQP

SEQ ID NO: 1093418 - protein, 17 aa, Mycobacterium
DHPYTKPPKVWFSDLLQ

SEQ ID NO: 1093419 - protein, 24 aa, Mycobacterium
DHVDPVVWSMVMQLALDCGAVVVP

SEQ ID NO: 1093420 - protein, 24 aa, Mycobacterium
DIATLLAHYGIDAVLTNLDNAPSN

SEQ ID NO: 1093421 - protein, 25 aa, Mycobacterium
DIGNATLFWMIRNSKVRQPAAGDWT

SEQ ID NO: 1093422 - protein, 26 aa, Mycobacterium
DIHATKLIVEWPPRDYVPDPDPIGVV

SEQ ID NO: 1093423 - protein, 24 aa, Mycobacterium
DISRAEEVLGWRPQVELADGVRRT

SEQ ID NO: 1093424 - protein, 18 aa, Mycobacterium
DITHPQRRTPWRPISRSS

SEQ ID NO: 1093425 - protein, 22 aa, Mycobacterium
DKIRLRLQRIGAVAPATETVSE

SEQ ID NO: 1093426 - protein, 21 aa, Mycobacterium
DLCEFVEFPTELLQVCGDSFA

SEQ ID NO: 1093427 - protein, 31 aa, Mycobacterium
DLDELKNIALYLNFDMLASPNPGIFTYDGDQ

SEQ ID NO: 1093428 - protein, 26 aa, Mycobacterium
DLDFDFAMLLPPFRGASLAAYDRDGN

SEQ ID NO: 1093429 - protein, 22 aa, Mycobacterium
DLKRAHLELGGKAPVVIFNDAD

SEQ ID NO: 1093430 - protein, 18 aa, Mycobacterium
DLPLVQPIRDIPYAGPPL

SEQ ID NO: 1093431 - protein, 17 aa, Mycobacterium
DLPPIPTLFVVADEFTL

SEQ ID NO: 1093432 - protein, 21 aa, Mycobacterium
DLVVGDLRWSLSVSARLASIP

SEQ ID NO: 1093433 - protein, 20 aa, Mycobacterium
DMLATLPTLSDPGPGLAGAP

SEQ ID NO: 1093434 - protein, 21 aa, Mycobacterium
DMMPYLVRIIGASQAPLQQTP

SEQ ID NO: 1093435 - protein, 20 aa, Mycobacterium
DNGYLPMTFTANNIAWSNKN

SEQ ID NO: 1093436 - protein, 20 aa, Mycobacterium
DNLSVLRTLLRMMDRDPDDF

SEQ ID NO: 1093437 - protein, 25 aa, Mycobacterium
DNMAQGRLFLYGPRTLRKYVEEDSK

SEQ ID NO: 1093438 - protein, 26 aa, Mycobacterium
DPAGWPRLDWSMDAALLLAALASRAG

SEQ ID NO: 1093439 - protein, 19 aa, Mycobacterium
DPDVRLVFSLGLRATDHSS

SEQ ID NO: 1093440 - protein, 18 aa, Mycobacterium
DPFLIISGGGRPMALRDA

SEQ ID NO: 1093441 - protein, 26 aa, Mycobacterium
DPGSPNIDLPVPDGWQLLPEGSGAPY

SEQ ID NO: 1093442 - protein, 24 aa, Mycobacterium
DPHGPVAFWGYSQGGGAAASAAEL

SEQ ID NO: 1093443 - protein, 18 aa, Mycobacterium
DPMYSVFRAIEEPLRIHR

SEQ ID NO: 1093444 - protein, 27 aa, Mycobacterium
DPPVGGRPVALPPPKPAGAPIEPTPRP

SEQ ID NO: 1093445 - protein, 29 aa, Mycobacterium
DPPVRNAALLRVFLLGQLDPSQAGSYLES

SEQ ID NO: 1093446 - protein, 27 aa, Mycobacterium
DPRHTPPHAWYIAFAPAQAPKVAVAVL

SEQ ID NO: 1093447 - protein, 23 aa, Mycobacterium
DPRNLHLAAFHPTGTAAAGADSQ

SEQ ID NO: 1093448 - protein, 37 aa, Mycobacterium; identical to SEQ ID NO: 944001

SEQ ID NO: 1093449 - protein, 19 aa, Mycobacterium
DQVMAAVRAAFKPEFINRL

SEQ ID NO: 1093450 - protein, 26 aa, Mycobacterium
DRDYGFMGVAVLDAPWAPFVVDFHLA

SEQ ID NO: 1093451 - protein, 17 aa, Mycobacterium
DRELGLARLIGFNSMRV

SEQ ID NO: 1093452 - protein, 24 aa, Mycobacterium
DRLTRTFTRFVAAAVQAYCPTNQD

SEQ ID NO: 1093453 - protein, 20 aa, Mycobacterium
DRSPLALARQALASLPKIDR

SEQ ID NO: 1093454 - protein, 25 aa, Mycobacterium
DRTRDVAVLQMRGAGGLPAAAIGGG

SEQ ID NO: 1093455 - protein, 18 aa, Mycobacterium
DRWQPGATLLPVSNDRCE

SEQ ID NO: 1093456 - protein, 34 aa, Mycobacterium; identical to SEQ ID NO: 944074

SEQ ID NO: 1093457 - protein, 23 aa, Mycobacterium
DSAFRPLLVQYDIPGMAVAVTVN

SEQ ID NO: 1093458 - protein, 31 aa, Mycobacterium; identical to SEQ ID NO: 944075

SEQ ID NO: 1093459 - protein, 22 aa, Mycobacterium
DSLDYAVIKFDPAKVTPVANFN

SEQ ID NO: 1093460 - protein, 23 aa, Mycobacterium
DTLTTLMELLGKIFSPTDPPTLS

SEQ ID NO: 1093461 - protein, 23 aa, Mycobacterium
DTPYSGVAAIFRSSLEKGEPPKV

SEQ ID NO: 1093462 - protein, 33 aa, Mycobacterium
DTTQVLERLKYLPLDPFRISYAYTNFGVTAAAD

SEQ ID NO: 1093463 - protein, 20 aa, Mycobacterium
DTTRLLARFPALGGTDTSGR

SEQ ID NO: 1093464 - protein, 24 aa, Mycobacterium
DVAPRRGWLEALLGHFCDPTVALV

SEQ ID NO: 1093465 - protein, 17 aa, Mycobacterium
DVGPLFYEPTVLTDVTH

SEQ ID NO: 1093466 - protein, 32 aa, Mycobacterium
DVMGALNAPTMAWLGRPLIGDGANGVDGTGGN

SEQ ID NO: 1093467 - protein, 17 aa, Mycobacterium
DVMPYTFGNNWFADAPA

SEQ ID NO: 1093468 - protein, 27 aa, Mycobacterium
DVRALELDLHYIRRLDLVGGRGVTMCH

SEQ ID NO: 1093469 - protein, 37 aa, Mycobacterium
DVREPRWTWRLRRRCRRNWFVRQRSGRRRRRYRGRWR

SEQ ID NO: 1093470 - protein, 28 aa, Mycobacterium
DVSAAIAALFNAHAEQYQALSVRVAEFH

SEQ ID NO: 1093471 - protein, 31 aa, Mycobacterium; identical to SEQ ID NO: 944169

SEQ ID NO: 1093472 - protein, 21 aa, Mycobacterium
DWPHLGVALMRPRSRARVTLA

SEQ ID NO: 1093473 - protein, 26 aa, Mycobacterium
DWTSTSPYLTPPAAAALAAACGDLAA

SEQ ID NO: 1093474 - protein, 19 aa, Mycobacterium
DYGGELWVLDLAEDAPAGA

SEQ ID NO: 1093475 - protein, 21 aa, Mycobacterium
EAALGVFQTLPKRVHERFDLV

SEQ ID NO: 1093476 - protein, 24 aa, Mycobacterium
EAANASFLQDPLQTALNATNKPVQ

SEQ ID NO: 1093477 - protein, 21 aa, Mycobacterium
EAAPPMTHIVLLGGDFPAAAS

SEQ ID NO: 1093478 - protein, 26 aa, Mycobacterium
EAVRRRPYTVILFDEIEKAHPDVFDV

SEQ ID NO: 1093479 - protein, 19 aa, Mycobacterium
EDLVLGVTLIADGRRQPGV

SEQ ID NO: 1093480 - protein, 24 aa, Mycobacterium
EDRRFTVVFAYDQSDYARMEATRR

SEQ ID NO: 1093481 - protein, 28 aa, Mycobacterium
EDVADQLSAFMLLAPGADGTPYPNGVRI

SEQ ID NO: 1093482 - protein, 20 aa, Mycobacterium
EELRYHYRDVLRQKELLREA

SEQ ID NO: 1093483 - protein, 24 aa, Mycobacterium
EETSFKFMFRHLRGYFTKDLDQLV

SEQ ID NO: 1093484 - protein, 24 aa, Mycobacterium
EGEALRHRGLALDALAAAEPEPTA

SEQ ID NO: 1093485 - protein, 18 aa, Mycobacterium
EGLALPAVVLEVEFALDA

SEQ ID NO: 1093486 - protein, 21 aa, Mycobacterium
EGRVGLLRKVLDSAGSVNPIA

SEQ ID NO: 1093487 - protein, 23 aa, Mycobacterium
EGYEALLLMCIDPRFVHPTNEYM

SEQ ID NO: 1093488 - protein, 17 aa, Mycobacterium
EHFLFAAPQLDQVAVIN

SEQ ID NO: 1093489 - protein, 24 aa, Mycobacterium
EIDERMIRFSWQSFLVDTDQFVGW

SEQ ID NO: 1093490 - protein, 25 aa, Mycobacterium
EIPCVCALLTLLPDNLRWLVTVDAM

SEQ ID NO: 1093491 - protein, 27 aa, Mycobacterium
EIPCVRALLTLLPDSLRWLVTVDAMHT

SEQ ID NO: 1093492 - protein, 28 aa, Mycobacterium
EIPCVRALLTLLPGSLRWLVTVDAMHTQ

SEQ ID NO: 1093493 - protein, 18 aa, Mycobacterium
EIYLNTFRHLYGLECSHI

SEQ ID NO: 1093494 - protein, 21 aa, Mycobacterium
EKDVGFPYRSALWPGRNAEID

SEQ ID NO: 1093495 - protein, 24 aa, Mycobacterium
EKLDDVVFPLFPQGGGFPRNNDDK

SEQ ID NO: 1093496 - protein, 20 aa, Mycobacterium
ELDLLAAYIAVAATASLSLS

SEQ ID NO: 1093497 - protein, 18 aa, Mycobacterium
ELDPPLLNALPRLPQCVP

SEQ ID NO: 1093498 - protein, 23 aa, Mycobacterium
ELQADLGLAYLFISHDLAVVRQI

SEQ ID NO: 1093499 - protein, 25 aa, Mycobacterium
ELVGDFTFEFPTRVIARLLGLPDED

SEQ ID NO: 1093500 - protein, 17 aa, Mycobacterium
ELWVLDLAEDAPAGAPH

SEQ ID NO: 1093501 - protein, 19 aa, Mycobacterium
EMLVLVVVGLVVLGPERLP

SEQ ID NO: 1093502 - protein, 19 aa, Mycobacterium
ENAGDINTGFWNGRDTNTG

SEQ ID NO: 1093503 - protein, 22 aa, Mycobacterium
ENVARETWWNSAGPAKVISVAE

SEQ ID NO: 1093504 - protein, 21 aa, Mycobacterium
EPAESLPPPFDNRLAQPYGGY

SEQ ID NO: 1093505 - protein, 25 aa, Mycobacterium
EPIGLLTYLLLKRIDDLAYGLGLWY

SEQ ID NO: 1093506 - protein, 19 aa, Mycobacterium
EPVWTTRLTGPQGPAQVAI

SEQ ID NO: 1093507 - protein, 28 aa, Mycobacterium
EQARARPIAPLLDALRGLGVPVDGAGLP

SEQ ID NO: 1093508 - protein, 27 aa, Mycobacterium
EQLARYEPRAPKLWLPPLDESIQLTAI

SEQ ID NO: 1093509 - protein, 24 aa, Mycobacterium
EQMLVSSWQMPGGIYAPMMHPWST

SEQ ID NO: 1093510 - protein, 23 aa, Mycobacterium
EQQPVLDRALATIPDALAVLNDE

SEQ ID NO: 1093511 - protein, 20 aa, Mycobacterium
EQTLAALSLVLNGGGLGQVQ

SEQ ID NO: 1093512 - protein, 18 aa, Mycobacterium
EQTLLNAINAPTEALFGR

SEQ ID NO: 1093513 - protein, 21 aa, Mycobacterium
ERFLTEFPGLRLIGLDRDPSA

SEQ ID NO: 1093514 - protein, 25 aa, Mycobacterium
ESFPDTYPWVPSLNPGLNFYLGQPS

SEQ ID NO: 1093515 - protein, 18 aa, Mycobacterium
ESTVARWPRRRSLRFESS

SEQ ID NO: 1093516 - protein, 19 aa, Mycobacterium
ETIVWRTYAQTLPPDAIET

SEQ ID NO: 1093517 - protein, 22 aa, Mycobacterium
ETPVPELTWIPAHPAPQPAPGN

SEQ ID NO: 1093518 - protein, 23 aa, Mycobacterium
ETQWVSALPFGIAGAPVLGAIVV

SEQ ID NO: 1093519 - protein, 19 aa, Mycobacterium
ETYFTSARPPECTAAVLFK

SEQ ID NO: 1093520 - protein, 30 aa, Mycobacterium
EVEDQLFRFSRILDAQPRLSILLGDYVVPA

SEQ ID NO: 1093521 - protein, 18 aa, Mycobacterium
EVFAFSTSLTRLTPVLAH

SEQ ID NO: 1093522 - protein, 20 aa, Mycobacterium
EVLLMPRWVKAKRATFKYGL

SEQ ID NO: 1093523 - protein, 24 aa, Mycobacterium
EVNSALMFTGAGSAPTLAAATAWD

SEQ ID NO: 1093524 - protein, 22 aa, Mycobacterium
EVRLGTLPLLDAVLAAVSVPVL

SEQ ID NO: 1093525 - protein, 40 aa, Mycobacterium; identical to SEQ ID NO: 944664

SEQ ID NO: 1093526 - protein, 17 aa, Mycobacterium
EVTLRLLPAQNAAAVVV

SEQ ID NO: 1093527 - protein, 18 aa, Mycobacterium
EYVIRRGMAQIGVPYSWG

SEQ ID NO: 1093528 - protein, 17 aa, Mycobacterium
FAALVMVAAITASTLMS

SEQ ID NO: 1093529 - protein, 24 aa, Mycobacterium
FAEVNLAGFYDLAQALGGVEVCLN

SEQ ID NO: 1093530 - protein, 25 aa, Mycobacterium
FAMTVPPPMIAANRALSASLVATNL

SEQ ID NO: 1093531 - protein, 27 aa, Mycobacterium
FATLGLLIPVLAWPPSAPLLLLPVLVS

SEQ ID NO: 1093532 - protein, 19 aa, Mycobacterium
FCSTFKGLLGAAVLHRYSI

SEQ ID NO: 1093533 - protein, 23 aa, Mycobacterium
FDASLRLPWRQLQPVDPATLGPN

SEQ ID NO: 1093534 - protein, 17 aa, Mycobacterium
FDAVQRLGLAYTPPEHE

SEQ ID NO: 1093535 - protein, 26 aa, Mycobacterium
FDCLTAGCWPTWWLGNQDRGEIDIIE

SEQ ID NO: 1093536 - protein, 26 aa, Mycobacterium
FDDLIDGFRPLFRALDPHQVNALSDQ

SEQ ID NO: 1093537 - protein, 18 aa, Mycobacterium
FDHLVREYPPLFPTLEAE

SEQ ID NO: 1093538 - protein, 17 aa, Mycobacterium
FEAAGSGGSGGAGGDGA

SEQ ID NO: 1093539 - protein, 18 aa, Mycobacterium
FECLLSLAAIKDVDARPT

SEQ ID NO: 1093540 - protein, 24 aa, Mycobacterium
FEWDPVLVRAFLRGPMHGAVSPPN

SEQ ID NO: 1093541 - protein, 22 aa, Mycobacterium
FEYQMLYGIRDEEQWRLVGAGS

SEQ ID NO: 1093542 - protein, 17 aa, Mycobacterium
FGATLVLACALAGCAAP

SEQ ID NO: 1093543 - protein, 20 aa, Mycobacterium
FGTMCDFFGLSSFSAMDAAE

SEQ ID NO: 1093544 - protein, 17 aa, Mycobacterium
FHNQFVQALTGAGGAYA

SEQ ID NO: 1093545 - protein, 26 aa, Mycobacterium
FKGLLGAAVLHRYSIAHLGTVITYNS

SEQ ID NO: 1093546 - protein, 18 aa, Mycobacterium
FLGLGHMGAPMSANLIGA

SEQ ID NO: 1093547 - protein, 19 aa, Mycobacterium
FLLRFAGLVLQPVCVAVVS

SEQ ID NO: 1093548 - protein, 19 aa, Mycobacterium
FLVSGAAVGLMASAGACSC

SEQ ID NO: 1093549 - protein, 19 aa, Mycobacterium
FLWMWPNARISVMGGEHTV

SEQ ID NO: 1093550 - protein, 17 aa, Mycobacterium
FMEAYGDVLYNLYGSTE

SEQ ID NO: 1093551 - protein, 24 aa, Mycobacterium
FNQTRLRENVLLQAKVCQSSNGGP

SEQ ID NO: 1093552 - protein, 24 aa, Mycobacterium
FSDSLPTCITKYIPLHTPAVVMSM

SEQ ID NO: 1093553 - protein, 18 aa, Mycobacterium
FSEVPRYGFKPTVVMHPP

SEQ ID NO: 1093554 - protein, 23 aa, Mycobacterium
FSKQIISSIKWAPDETGIIPTSG

SEQ ID NO: 1093555 - protein, 19 aa, Mycobacterium
FSTVWTWPDKPGVAGCAAM

SEQ ID NO: 1093556 - protein, 19 aa, Mycobacterium
FSVITAIPQPLRSLANTRG

SEQ ID NO: 1093557 - protein, 21 aa, Mycobacterium
FTPIHGGWQLSQRTSEMLLAP

SEQ ID NO: 1093558 - protein, 21 aa, Mycobacterium
FTRRDPVLLYRATPQTFIDRS

SEQ ID NO: 1093559 - protein, 19 aa, Mycobacterium
FTSIAISMYCPSVMANVTS

SEQ ID NO: 1093560 - protein, 17 aa, Mycobacterium
FVCLLASAGLTGCGSSS

SEQ ID NO: 1093561 - protein, 17 aa, Mycobacterium
FVCYGPLARSVRDLFLG

SEQ ID NO: 1093562 - protein, 23 aa, Mycobacterium
FVGAICRWQAANPASLIDITRFW

SEQ ID NO: 1093563 - protein, 25 aa, Mycobacterium
FVHTNVLGTFTILEAVRRHGVRLHH

SEQ ID NO: 1093564 - protein, 18 aa, Mycobacterium
FWRSAGLPEYRFPDPKGT

SEQ ID NO: 1093565 - protein, 17 aa, Mycobacterium
FYLVHRTSRFEPSLDGR

SEQ ID NO: 1093566 - protein, 17 aa, Mycobacterium
FYLVYRTRRFEPSTVGW

SEQ ID NO: 1093567 - protein, 18 aa, Mycobacterium
FYLVYRTRRFEPSTVGWT

SEQ ID NO: 1093568 - protein, 24 aa, Mycobacterium
GAAGLLLAGWAAMGVAAADPQPAP

SEQ ID NO: 1093569 - protein, 24 aa, Mycobacterium
GAAKAGITALTLSAARALGRYGVC

SEQ ID NO: 1093570 - protein, 24 aa, Mycobacterium
GAAVAPLASGALGAAGAGSGCAAG

SEQ ID NO: 1093571 - protein, 18 aa, Mycobacterium
GAGGWLYGNGGAGGTGGS

SEQ ID NO: 1093572 - protein, 18 aa, Mycobacterium
GAGMARAFAARGRDLALC

SEQ ID NO: 1093573 - protein, 23 aa, Mycobacterium
GAGSIFKIFTTAAALDMGMGISA

SEQ ID NO: 1093574 - protein, 22 aa, Mycobacterium
GAGVNGGFLFGSGGTGGFGGVG

SEQ ID NO: 1093575 - protein, 17 aa, Mycobacterium
GAIAPARERARGAGATI

SEQ ID NO: 1093576 - protein, 22 aa, Mycobacterium
GAIYDAWASLSYERGPLGLPTS

SEQ ID NO: 1093577 - protein, 22 aa, Mycobacterium
GAKSVEFIPPKTPSPTSLHPNA

SEQ ID NO: 1093578 - protein, 21 aa, Mycobacterium
GALRETGFITYQPSDHIGAAN

SEQ ID NO: 1093579 - protein, 20 aa, Mycobacterium
GAMGRDIPVAFLAGGPHAAY

SEQ ID NO: 1093580 - protein, 25 aa, Mycobacterium
GANEQWIPGGLLPTGASEAVVDGGK

SEQ ID NO: 1093581 - protein, 20 aa, Mycobacterium
GANGLFEAAGSGGSGGAGGD

SEQ ID NO: 1093582 - protein, 27 aa, Mycobacterium
GAPQLDRIQSWLGLQGIDLTTPSGLLA

SEQ ID NO: 1093583 - protein, 35 aa, Mycobacterium
GARLDFGCVCGSTPIFRWLPRCRTAVSSTPATART

SEQ ID NO: 1093584 - protein, 18 aa, Mycobacterium
GATRIPRVYGRQASEYVI

SEQ ID NO: 1093585 - protein, 26 aa, Mycobacterium
GAVATATVILFGAAILRGNSAAADPN

SEQ ID NO: 1093586 - protein, 23 aa, Mycobacterium
GCGGDYEWTRARTAYFMVGFSGP

SEQ ID NO: 1093587 - protein, 26 aa, Mycobacterium
GCTTYKWETFLTSELPQYLSANKGVK

SEQ ID NO: 1093588 - protein, 24 aa, Mycobacterium
GDAGGPGGLLFGNGGNGGSGSAGM

SEQ ID NO: 1093589 - protein, 26 aa, Mycobacterium
GDDVGFLVALQRIGITYPSPAQAIDA

SEQ ID NO: 1093590 - protein, 24 aa, Mycobacterium
GDELSFLDCLYYSAVTLSTTGYGD

SEQ ID NO: 1093591 - protein, 27 aa, Mycobacterium
GDIWDWAVDWDTWVGMSALLSFPTVHQ

SEQ ID NO: 1093592 - protein, 17 aa, Mycobacterium
GDRCLHDYCPPPCGETT

SEQ ID NO: 1093593 - protein, 25 aa, Mycobacterium
GDVAALALIRFPATGDKIGSLVINP

SEQ ID NO: 1093594 - protein, 25 aa, Mycobacterium
GEGVLPILERKRLWHRPHGSSPHSA

SEQ ID NO: 1093595 - protein, 21 aa, Mycobacterium
GELVPKYLAVARPLPTARAVV

SEQ ID NO: 1093596 - protein, 32 aa, Mycobacterium
GEQLRTLITVPLFHVTGYNSQLLTAARLGGVA

SEQ ID NO: 1093597 - protein, 17 aa, Mycobacterium
GETAAELSALGLGRVES

SEQ ID NO: 1093598 - protein, 32 aa, Mycobacterium; identical to SEQ ID NO: 941872

SEQ ID NO: 1093599 - protein, 26 aa, Mycobacterium
GFITWSLARNPELLDLILAANPAAIM

SEQ ID NO: 1093600 - protein, 17 aa, Mycobacterium
GFLQVAAATGLLASGVA

SEQ ID NO: 1093601 - protein, 18 aa, Mycobacterium
GFLSGIAELRQAFPGGIV

SEQ ID NO: 1093602 - protein, 18 aa, Mycobacterium
GFQTAVYGPIRAAGQAWI

SEQ ID NO: 1093603 - protein, 19 aa, Mycobacterium
GFSGPIPDDKWPQAVRIVK

SEQ ID NO: 1093604 - protein, 21 aa, Mycobacterium
GFTNTGFFNSGDLNTGMGSPE

SEQ ID NO: 1093605 - protein, 21 aa, Mycobacterium
GFYSLRYSSTGLERAEDPLLN

SEQ ID NO: 1093606 - protein, 25 aa, Mycobacterium
GGAGGAAGWLYGAGGSGGAGGAGTA

SEQ ID NO: 1093607 - protein, 23 aa, Mycobacterium
GGAGGWLFGNGGAGGAPAARHRA

SEQ ID NO: 1093608 - protein, 25 aa, Mycobacterium
GGAGQAGGWLFGDGGPGAAATATSA

SEQ ID NO: 1093609 - protein, 18 aa, Mycobacterium
GGDPGLHGPKRYDWRKFI

SEQ ID NO: 1093610 - protein, 21 aa, Mycobacterium
GGGAGLLYGYGGAGGAGGTGG

SEQ ID NO: 1093611 - protein, 24 aa, Mycobacterium
GGGISGLLLGADGFNAPAGSSPVH

SEQ ID NO: 1093612 - protein, 28 aa, Mycobacterium
GGHYPTARLVVFLLRGNFDPADVARRGN

SEQ ID NO: 1093613 - protein, 25 aa, Mycobacterium
GGIMGPHFSFSWYRGSPIGRERKTE

SEQ ID NO: 1093614 - protein, 19 aa, Mycobacterium
GGLGLASRTAIATGAAGSA

SEQ ID NO: 1093615 - protein, 23 aa, Mycobacterium
GGNAGLVINGTYEASPYGNGGNG

SEQ ID NO: 1093616 - protein, 26 aa, Mycobacterium
GGNGGAAGWWGTGGAGRAGGAGGASQ

SEQ ID NO: 1093617 - protein, 23 aa, Mycobacterium
GGSAESLFFSIGGAGGAGGDAST

SEQ ID NO: 1093618 - protein, 17 aa, Mycobacterium
GGSALVLAAYYPQQFPY

SEQ ID NO: 1093619 - protein, 23 aa, Mycobacterium
GGTGPRLAGAPRGQTGPAFAASS

SEQ ID NO: 1093620 - protein, 25 aa, Mycobacterium
GGVKGFFEKTFAPLGLKKIQGEVLA

SEQ ID NO: 1093621 - protein, 25 aa, Mycobacterium
GGVVRSVHLPAVNVAALLSAAGAPL

SEQ ID NO: 1093622 - protein, 19 aa, Mycobacterium
GGYDPWVDKVLAGRPDIKS

SEQ ID NO: 1093623 - protein, 25 aa, Mycobacterium
GHLQADIIAGQLFAKGPYAGIFDSE

SEQ ID NO: 1093624 - protein, 20 aa, Mycobacterium
GHVARIERQGWHALVTIRLD

SEQ ID NO: 1093625 - protein, 19 aa, Mycobacterium
GHWRYQTFDRADGLWFDVT

SEQ ID NO: 1093626 - protein, 23 aa, Mycobacterium
GIALDRNYWPYIGAKAGGLPGDL

SEQ ID NO: 1093627 - protein, 23 aa, Mycobacterium
GIEQLNPQRFLIDPQGAAETWKA

SEQ ID NO: 1093628 - protein, 25 aa, Mycobacterium
GIGREMHMDPFLPNEGAPGRGPTLV

SEQ ID NO: 1093629 - protein, 18 aa, Mycobacterium
GIGVGLWGAARPATEASA

SEQ ID NO: 1093630 - protein, 18 aa, Mycobacterium
GIISAPSVILATGGLGQL

SEQ ID NO: 1093631 - protein, 26 aa, Mycobacterium
GILSSALAHTGGLNPALAGGLTPTAA

SEQ ID NO: 1093632 - protein, 25 aa, Mycobacterium
GKGVPVAWLALGEPPARAKAASTAL

SEQ ID NO: 1093633 - protein, 23 aa, Mycobacterium
GKRATSVILRYGVRLTVMARPPA

SEQ ID NO: 1093634 - protein, 26 aa, Mycobacterium
GLAALLAVLGLLLPSIAAAPPRAYDG

SEQ ID NO: 1093635 - protein, 25 aa, Mycobacterium
GLADLPLPAPGLGSGGYRITAIFAN

SEQ ID NO: 1093636 - protein, 25 aa, Mycobacterium
GLDEYGYIPLPESFRSKLIPVVNAI

SEQ ID NO: 1093637 - protein, 24 aa, Mycobacterium
GLDSLPLPAPTLGSGGYTLTAVFA

SEQ ID NO: 1093638 - protein, 24 aa, Mycobacterium
GLDSRAYRLKWPNGATVFEIDLPK

SEQ ID NO: 1093639 - protein, 18 aa, Mycobacterium
GLGFVRMVDTFAARALFF

SEQ ID NO: 1093640 - protein, 18 aa, Mycobacterium
GLIGSALAAALRVADHRV

SEQ ID NO: 1093641 - protein, 23 aa, Mycobacterium
GLMRYAFAGVGVLIPRYSGDQYN

SEQ ID NO: 1093642 - protein, 20 aa, Mycobacterium
GLMTALSPHFGGKILNLCNT

SEQ ID NO: 1093643 - protein, 22 aa, Mycobacterium
GLPITPAWPKVHALMDRNFGPV

SEQ ID NO: 1093644 - protein, 18 aa, Mycobacterium
GLRLVKVETLGQAVDALH

SEQ ID NO: 1093645 - protein, 25 aa, Mycobacterium
GLRTTIDWYRANESWWRPLKDAAEA

SEQ ID NO: 1093646 - protein, 25 aa, Mycobacterium
GLRTYAQLFVLIGAANDVRCDIATN

SEQ ID NO: 1093647 - protein, 23 aa, Mycobacterium
GLSSFGINLPPVPSLTGGTGTGM

SEQ ID NO: 1093648 - protein, 17 aa, Mycobacterium
GLTVSIPTPPGWSPYEG

SEQ ID NO: 1093649 - protein, 18 aa, Mycobacterium
GLVVLGPERLPGAIRWSS

SEQ ID NO: 1093650 - protein, 19 aa, Mycobacterium
GMTGAGYWVAHGALTGITI

SEQ ID NO: 1093651 - protein, 27 aa, Mycobacterium
GMWGAPQLGRWKWHDPWVHAALLAQNN

SEQ ID NO: 1093652 - protein, 17 aa, Mycobacterium
GNAGWLGSGGSGGAGGG

SEQ ID NO: 1093653 - protein, 22 aa, Mycobacterium
GNGGAGGWLFGNGGNGGHGGQG

SEQ ID NO: 1093654 - protein, 28 aa, Mycobacterium
GNGGFVENFDFFGFGVAHGGDGGSGGAA

SEQ ID NO: 1093655 - protein, 18 aa, Mycobacterium
GNGGWGGVGGSGGDGGWL

SEQ ID NO: 1093656 - protein, 22 aa, Mycobacterium
GNGSQWMSPITNFNPLYKDRSI

SEQ ID NO: 1093657 - protein, 22 aa, Mycobacterium
GNLPLQGIPGVPAIPGVPGVPG

SEQ ID NO: 1093658 - protein, 29 aa, Mycobacterium
GNPEIRPAHLLMALLTQADGIAAPLLEAV

SEQ ID NO: 1093659 - protein, 25 aa, Mycobacterium
GNSSGGAVFPYTSGLFNSGNGSSGV

SEQ ID NO: 1093660 - protein, 40 aa, Mycobacterium; identical to SEQ ID NO: 356585

SEQ ID NO: 1093661 - protein, 25 aa, Mycobacterium
GPGARLAPIFAYPLLAACPSITQGT

SEQ ID NO: 1093662 - protein, 32 aa, Mycobacterium
GPGQILRVAVPSFLLLFLVACGGSGRVSHPAA

SEQ ID NO: 1093663 - protein, 19 aa, Mycobacterium
GPLAPPNPFMAPNGLASMH

SEQ ID NO: 1093664 - protein, 32 aa, Mycobacterium
GPLLKEPNFLPLQPFSWRIMPENLEDAGISWK

SEQ ID NO: 1093665 - protein, 23 aa, Mycobacterium
GPMTLWADRIVLCAGAIGSAHLL

SEQ ID NO: 1093666 - protein, 25 aa, Mycobacterium
GPNFTEIPFALRDGGIYSAAAPGGT

SEQ ID NO: 1093667 - protein, 22 aa, Mycobacterium
GQAGGAGGLLYGNGGNGAAGTN

SEQ ID NO: 1093668 - protein, 29 aa, Mycobacterium
GQLLVYGVDPLILRQAYPVSQDPYGLAGS

SEQ ID NO: 1093669 - protein, 24 aa, Mycobacterium
GQSFTSVPMIFARPSYYGQFTDSG

SEQ ID NO: 1093670 - protein, 20 aa, Mycobacterium
GRALSILNDPFRVGGLPATN

SEQ ID NO: 1093671 - protein, 24 aa, Mycobacterium
GRGTRLPVWLSKWGYQHPAEQSMD

SEQ ID NO: 1093672 - protein, 29 aa, Mycobacterium
GRIINISSVLGFLPAPYAALYAASKHAVE

SEQ ID NO: 1093673 - protein, 19 aa, Mycobacterium
GRQKLTGPQALAFVRQRHE

SEQ ID NO: 1093674 - protein, 20 aa, Mycobacterium
GRQLTLETFNGQLPGQGSGV

SEQ ID NO: 1093675 - protein, 25 aa, Mycobacterium
GRTAGPAQPVRRLRRSRLPASAARQ

SEQ ID NO: 1093676 - protein, 34 aa, Mycobacterium
GRTGTRRRIRAVAAIARIPSLATVAAVTTGSLGA

SEQ ID NO: 1093677 - protein, 19 aa, Mycobacterium
GRVLTFAFISNDAGPNGRN

SEQ ID NO: 1093678 - protein, 23 aa, Mycobacterium
GSDRRYIIVIESLQASDDATARE

SEQ ID NO: 1093679 - protein, 23 aa, Mycobacterium
GSGAAYLLPALGRPNLTLLEETR

SEQ ID NO: 1093680 - protein, 24 aa, Mycobacterium
GSGIEVWYFHEPRDMSKSGKVTAV

SEQ ID NO: 1093681 - protein, 32 aa, Mycobacterium; identical to SEQ ID NO: 146788

SEQ ID NO: 1093682 - protein, 17 aa, Mycobacterium
GSLGKVLPPYQIRVVAP

SEQ ID NO: 1093683 - protein, 21 aa, Mycobacterium
GSLSGFLYPSSTTTNGAILAG

SEQ ID NO: 1093684 - protein, 19 aa, Mycobacterium
GSPTPLYLAGARLQAQFPV

SEQ ID NO: 1093685 - protein, 21 aa, Mycobacterium
GSRVPLAGMALPVVSAKNVQI

SEQ ID NO: 1093686 - protein, 21 aa, Mycobacterium
GSTALDGWKLEFDLPADESVT

SEQ ID NO: 1093687 - protein, 22 aa, Mycobacterium
GSVLAFWLSRYGFDVTVVERAP

SEQ ID NO: 1093688 - protein, 18 aa, Mycobacterium
GSWRAYADHRMAMAGAIV

SEQ ID NO: 1093689 - protein, 17 aa, Mycobacterium
GTASMSSGMWQSMHGSD

SEQ ID NO: 1093690 - protein, 20 aa, Mycobacterium
GTEVWTFTALKPGTTTITTG

SEQ ID NO: 1093691 - protein, 24 aa, Mycobacterium
GTGGAGGLLFGPGGVGGAGGASFL

SEQ ID NO: 1093692 - protein, 20 aa, Mycobacterium
GTGGWLYGNGGNGGAAGWWG

SEQ ID NO: 1093693 - protein, 21 aa, Mycobacterium
GTPFTPVVFDGLMALPYVEKS

SEQ ID NO: 1093694 - protein, 34 aa, Mycobacterium
GTPGRRWAWQTRAWSGHRIYPAAVLYQRVVSTKS

SEQ ID NO: 1093695 - protein, 26 aa, Mycobacterium
GTRGLTIQQAWYPGMEAFLGVAVHGF

SEQ ID NO: 1093696 - protein, 26 aa, Mycobacterium
GTTKTLKFLVALRPGLVSPTLAAQMA

SEQ ID NO: 1093697 - protein, 21 aa, Mycobacterium
GVAVHGFPNYFFICGPDVAAQ

SEQ ID NO: 1093698 - protein, 17 aa, Mycobacterium
GVDKIRLRLQRIGAVAP

SEQ ID NO: 1093699 - protein, 22 aa, Mycobacterium
GVDVLLPAAHGPNPVLPPGCHR

SEQ ID NO: 1093700 - protein, 19 aa, Mycobacterium
GVDWKGTLTGLAGYASGDL

SEQ ID NO: 1093701 - protein, 24 aa, Mycobacterium
GVGGFGGFGGTGGNAGWLGSGGSG

SEQ ID NO: 1093702 - protein, 20 aa, Mycobacterium
GVGSGPRYGFKPTVMARPLP

SEQ ID NO: 1093703 - protein, 25 aa, Mycobacterium
GVHLRGHFLLTRNAATYWRQKAKAA

SEQ ID NO: 1093704 - protein, 28 aa, Mycobacterium
GVHRTIAYRLLLTLTQFRLVAKGEDGRF

SEQ ID NO: 1093705 - protein, 22 aa, Mycobacterium
GVIFLLLGWQALDSSGKAVDDS

SEQ ID NO: 1093706 - protein, 17 aa, Mycobacterium
GVNAPIPGLTAPAPAAP

SEQ ID NO: 1093707 - protein, 25 aa, Mycobacterium
GVRPDALRWHPNGLALDVMIPNPGS

SEQ ID NO: 1093708 - protein, 21 aa, Mycobacterium
GVTIPYRFDTTRGPLLNGACA

SEQ ID NO: 1093709 - protein, 19 aa, Mycobacterium
GVVKCAIRCAIRFCQHQHH

SEQ ID NO: 1093710 - protein, 26 aa, Mycobacterium
GWDETVFFHNGDPFIWDRGRELGMVD

SEQ ID NO: 1093711 - protein, 18 aa, Mycobacterium
GWLRAKTGSLTAINSLVG

SEQ ID NO: 1093712 - protein, 27 aa, Mycobacterium
GWQGDFPSMIEFLAPLYGTGAGSNDVG

SEQ ID NO: 1093713 - protein, 17 aa, Mycobacterium
GYAFFWNADEKKAEILG

SEQ ID NO: 1093714 - protein, 24 aa, Mycobacterium
GYLMKESFMVLFGAARSRLVAGGM

SEQ ID NO: 1093715 - protein, 20 aa, Mycobacterium
GYRVPCFVISPYSRGPLMVH

SEQ ID NO: 1093716 - protein, 19 aa, Mycobacterium
GYRVPCIVISPYSRGPLVV

SEQ ID NO: 1093717 - protein, 24 aa, Mycobacterium
GYSNYASFFYNTEGLPYFSVGMGN

SEQ ID NO: 1093718 - protein, 17 aa, Mycobacterium
HAFMVERVESGFGSLDE

SEQ ID NO: 1093719 - protein, 19 aa, Mycobacterium
HAHAWALRMSPDGNVWGAT

SEQ ID NO: 1093720 - protein, 25 aa, Mycobacterium
HAVVAAFVLVCSAFLAAPTAHAAAI

SEQ ID NO: 1093721 - protein, 19 aa, Mycobacterium
HCLTLRSAFVGPAVMIGTC

SEQ ID NO: 1093722 - protein, 22 aa, Mycobacterium
HDLAVIFRTAMANPVFAHITAE

SEQ ID NO: 1093723 - protein, 23 aa, Mycobacterium
HDLRYAIDPSLLYNELAWAPKHT

SEQ ID NO: 1093724 - protein, 18 aa, Mycobacterium
HDRFVEILQTSAQAYGST

SEQ ID NO: 1093725 - protein, 24 aa, Mycobacterium
HDTWAQYLRWVADRAGLEVVGGEV

SEQ ID NO: 1093726 - protein, 24 aa, Mycobacterium
HGEAGVVAIFAQALLSGKPTKVFG

SEQ ID NO: 1093727 - protein, 36 aa, Mycobacterium
HGPHRYNWNQFIGSLKYTLWRLQERVVGRGPGSPQL

SEQ ID NO: 1093728 - protein, 18 aa, Mycobacterium
HGVLMATNFFGINTIPIA

SEQ ID NO: 1093729 - protein, 24 aa, Mycobacterium
HHRRLFAVLATLNTATAVIAGCSS

SEQ ID NO: 1093730 - protein, 31 aa, Mycobacterium; identical to SEQ ID NO: 946057

SEQ ID NO: 1093731 - protein, 37 aa, Mycobacterium; identical to SEQ ID NO: 1073999

SEQ ID NO: 1093732 - protein, 17 aa, Mycobacterium
HQPPALLMLHPPSETTP

SEQ ID NO: 1093733 - protein, 24 aa, Mycobacterium
HRVAQFQYALQDELPLRQAQWLGT

SEQ ID NO: 1093734 - protein, 18 aa, Mycobacterium
HSHQPLRWGPPEAPDRYV

SEQ ID NO: 1093735 - protein, 26 aa, Mycobacterium
HTKNCRLYWVQIIPTIASESAPQQLL

SEQ ID NO: 1093736 - protein, 19 aa, Mycobacterium
HTYTARQLLDGLLLVSGND

SEQ ID NO: 1093737 - protein, 19 aa, Mycobacterium
HVALRILHDDTAVTGVLVL

SEQ ID NO: 1093738 - protein, 30 aa, Mycobacterium; identical to SEQ ID NO: 146813

SEQ ID NO: 1093739 - protein, 20 aa, Mycobacterium
HVYPPGWAWSPSNSAPPVLL

SEQ ID NO: 1093740 - protein, 20 aa, Mycobacterium
IAAKLFGFPTVIAHGMFSAA

SEQ ID NO: 1093741 - protein, 17 aa, Mycobacterium
IAANRVLLMALVATNFF

SEQ ID NO: 1093742 - protein, 24 aa, Mycobacterium
IADTELLEYHWGAGLDGLGCPEDR

SEQ ID NO: 1093743 - protein, 17 aa, Mycobacterium
IAKRRNVGAFNWGLVAG

SEQ ID NO: 1093744 - protein, 32 aa, Mycobacterium
IALSPWPPRAFGMLLLALAVAVAIDVALAASP

SEQ ID NO: 1093745 - protein, 27 aa, Mycobacterium
IAQNLPLLLGLYIQPATLPIPPADAGL

SEQ ID NO: 1093746 - protein, 19 aa, Mycobacterium
IASLSYALTLQALTGRSPG

SEQ ID NO: 1093747 - protein, 24 aa, Mycobacterium
IASLWAATAFLTALLVVAGCTTIA

SEQ ID NO: 1093748 - protein, 30 aa, Mycobacterium
IAWALQDGLASYFWQHNWGSPKGYTHPAAN

SEQ ID NO: 1093749 - protein, 22 aa, Mycobacterium
IEANDRLLYIRNTGALVAIASA

SEQ ID NO: 1093750 - protein, 19 aa, Mycobacterium
IEEAVAVGDLVRLMEFRKG

SEQ ID NO: 1093751 - protein, 30 aa, Mycobacterium; identical to SEQ ID NO: 946294

SEQ ID NO: 1093752 - protein, 17 aa, Mycobacterium
IETRFGVPVPNLTPWRR

SEQ ID NO: 1093753 - protein, 26 aa, Mycobacterium
IEVKIRPPDAASRLLELIVNTGGDAT

SEQ ID NO: 1093754 - protein, 17 aa, Mycobacterium
IEVLKTLRKLGLDRTEK

SEQ ID NO: 1093755 - protein, 18 aa, Mycobacterium
IFAGAGVGPTLAAAAAWD

SEQ ID NO: 1093756 - protein, 18 aa, Mycobacterium
IFLAIAQTGSLGAAAREL

SEQ ID NO: 1093757 - protein, 24 aa, Mycobacterium
IFMGWLFTLLGRPKVEGLEHIPSS

SEQ ID NO: 1093758 - protein, 21 aa, Mycobacterium
IGLFGLMIPEQYGGLGESLLT

SEQ ID NO: 1093759 - protein, 19 aa, Mycobacterium
IGLVMMAAPMAAAPGIAAA

SEQ ID NO: 1093760 - protein, 17 aa, Mycobacterium
IGVYAVNYPASRLQLHG

SEQ ID NO: 1093761 - protein, 25 aa, Mycobacterium
IHETKLIVEWPPRDYVPDPDPIGVV

SEQ ID NO: 1093762 - protein, 18 aa, Mycobacterium
IIDDLLILTQPPAQDPRA

SEQ ID NO: 1093763 - protein, 23 aa, Mycobacterium
IKEFAPLIGVRKAGLFTSSSFVL

SEQ ID NO: 1093764 - protein, 24 aa, Mycobacterium
ILAANPAAIMLSFGDPHNFAGPIH

SEQ ID NO: 1093765 - protein, 26 aa, Mycobacterium
INNTGSFNTVLFNTGFRTAGIANSAT

SEQ ID NO: 1093766 - protein, 20 aa, Mycobacterium
IPAERMIRYYTARGLLPRPG

SEQ ID NO: 1093767 - protein, 22 aa, Mycobacterium
IPALLILTTLGLGRLEVALSDD

SEQ ID NO: 1093768 - protein, 25 aa, Mycobacterium
IPCVRALFTLLPDNLRWLVTVDAMH

SEQ ID NO: 1093769 - protein, 25 aa, Mycobacterium
IPGRNAAWLIIDVRDVAAVHAALLE

SEQ ID NO: 1093770 - protein, 37 aa, Mycobacterium; identical to SEQ ID NO: 946466

SEQ ID NO: 1093771 - protein, 22 aa, Mycobacterium
IRAGVGWRRGCVWCRRAGRHFA

SEQ ID NO: 1093772 - protein, 19 aa, Mycobacterium
IRGQRFSRLPAGRAILLSD

SEQ ID NO: 1093773 - protein, 22 aa, Mycobacterium
IRIQALQRTSDFLRPGHNVDLV

SEQ ID NO: 1093774 - protein, 17 aa, Mycobacterium
ISLAAVFLALAIGVVLG

SEQ ID NO: 1093775 - protein, 23 aa, Mycobacterium
ISNDGITFFFSPGELLPEAAGAR

SEQ ID NO: 1093776 - protein, 24 aa, Mycobacterium
ISRAPWRLLQLYDDPTNTTAVIFR

SEQ ID NO: 1093777 - protein, 27 aa, Mycobacterium
ITGAKTWISNARRSGLIALLCKTDPHA

SEQ ID NO: 1093778 - protein, 17 aa, Mycobacterium
ITIALPAAGLVGCAPQT

SEQ ID NO: 1093779 - protein, 38 aa, Mycobacterium; identical to SEQ ID NO: 946545

SEQ ID NO: 1093780 - protein, 24 aa, Mycobacterium
ITVAQMLQRIVALMPMGVAVVDSH

SEQ ID NO: 1093781 - protein, 18 aa, Mycobacterium
IVAAITETFVTVPTAATA

SEQ ID NO: 1093782 - protein, 27 aa, Mycobacterium
IVKTTLEELWWDRPFTLEGVDIGASVA

SEQ ID NO: 1093783 - protein, 28 aa, Mycobacterium
IVREQQADCFAGVYLYWVAEGKSPRFRL

SEQ ID NO: 1093784 - protein, 19 aa, Mycobacterium
IVRRRGDLPTGLRVDSSGN

SEQ ID NO: 1093785 - protein, 17 aa, Mycobacterium
IVSISWTSSSGGQRTEN

SEQ ID NO: 1093786 - protein, 25 aa, Mycobacterium
IWAARAISVLFPQITTIGGFRQDPL

SEQ ID NO: 1093787 - protein, 17 aa, Mycobacterium
IYFDDRTPPPPPDAKYE

SEQ ID NO: 1093788 - protein, 28 aa, Mycobacterium
KADAAALGFPIRLPVLPDGWKANSGGRG

SEQ ID NO: 1093789 - protein, 23 aa, Mycobacterium
KAGMQVSIPWPYSGNVHCEIDVD

SEQ ID NO: 1093790 - protein, 24 aa, Mycobacterium
KANRRDIPLVLRVYDRELGGAVAH

SEQ ID NO: 1093791 - protein, 23 aa, Mycobacterium
KCQQAWCPVCALTALVIGEQHPL

SEQ ID NO: 1093792 - protein, 26 aa, Mycobacterium
KDKVAHIISNKLYQKVGQRPDSVTCP

SEQ ID NO: 1093793 - protein, 18 aa, Mycobacterium
KDLVLSGGWDEDLVRRMG

SEQ ID NO: 1093794 - protein, 24 aa, Mycobacterium
KDQEGNDLPWSILKHLHAGDSDQG

SEQ ID NO: 1093795 - protein, 24 aa, Mycobacterium
KFNQPFISYGAWDRYAVYAGVRGA

SEQ ID NO: 1093796 - protein, 26 aa, Mycobacterium
KFRTDGYMIDFWGVGYQAAKRMGIED

SEQ ID NO: 1093797 - protein, 26 aa, Mycobacterium
KGLLHLEDWRRDRPGLGFGGNLFDVA

SEQ ID NO: 1093798 - protein, 22 aa, Mycobacterium
KGMQAIRMVVVVLAAAFAVASA

SEQ ID NO: 1093799 - protein, 25 aa, Mycobacterium
KGRSFRIHILFASQTLDFGKIKDID

SEQ ID NO: 1093800 - protein, 32 aa, Mycobacterium
KIFSGLIRTWDDPILLGLNPGVALPNAPIAPV

SEQ ID NO: 1093801 - protein, 19 aa, Mycobacterium
KLQSNESFVYLARAVDPVI

SEQ ID NO: 1093802 - protein, 17 aa, Mycobacterium
KLREIDGLLPTLIRGQG

SEQ ID NO: 1093803 - protein, 29 aa, Mycobacterium
KLRVAVQAIGRLLFAAGAVEVLTGLPGAP

SEQ ID NO: 1093804 - protein, 29 aa, Mycobacterium
KLSEEAIYSFLRLLLPAGLETTYRSSGNL

SEQ ID NO: 1093805 - protein, 18 aa, Mycobacterium
KLSGFCLLASIVAAALMF

SEQ ID NO: 1093806 - protein, 23 aa, Mycobacterium
KNAMEQFVYAYIHACPGHTLDYN

SEQ ID NO: 1093807 - protein, 25 aa, Mycobacterium
KPAYHALTFGWLMSGLARAVTGKDM

SEQ ID NO: 1093808 - protein, 24 aa, Mycobacterium
KPEFINRLDDVLIFDALNPDELVQ

SEQ ID NO: 1093809 - protein, 25 aa, Mycobacterium
KPITNGLMYNFTFNFEKAGQGSVMV

SEQ ID NO: 1093810 - protein, 20 aa, Mycobacterium
KPPKVWFSDLLQPDGRPYRE

SEQ ID NO: 1093811 - protein, 18 aa, Mycobacterium
KPRNKGLRFEFYANLETA

SEQ ID NO: 1093812 - protein, 17 aa, Mycobacterium
KRRNVGAFNWGLVAGKT

SEQ ID NO: 1093813 - protein, 17 aa, Mycobacterium
KRWRTALHVTLLALMVA

SEQ ID NO: 1093814 - protein, 18 aa, Mycobacterium
KSGLLTIGPGPRAGELQV

SEQ ID NO: 1093815 - protein, 27 aa, Mycobacterium
KSRAQQYAQLSGLRLGTVLSISEGVGT

SEQ ID NO: 1093816 - protein, 31 aa, Mycobacterium
KTAPLVISGWALTAWVLLSLGTRATQLASLI

SEQ ID NO: 1093817 - protein, 27 aa, Mycobacterium
KVLAESIRPWMPPPAPAPAPAPGEPAP

SEQ ID NO: 1093818 - protein, 18 aa, Mycobacterium
KVLIPLKPIYQRKGIVFH

SEQ ID NO: 1093819 - protein, 20 aa, Mycobacterium
LAAGWLLERAGFGKGYPGDP

SEQ ID NO: 1093820 - protein, 20 aa, Mycobacterium
LAAVFLALAIGVVLGSGFFS

SEQ ID NO: 1093821 - protein, 23 aa, Mycobacterium
LAEAGWPVQLWAAAMPQQTTSAV

SEQ ID NO: 1093822 - protein, 21 aa, Mycobacterium
LAEPVQTLGQAWLASPAGELL

SEQ ID NO: 1093823 - protein, 17 aa, Mycobacterium
LAEQGWVCLSIDYRVAP

SEQ ID NO: 1093824 - protein, 18 aa, Mycobacterium
LAGIAWETGVLLGIADES

SEQ ID NO: 1093825 - protein, 21 aa, Mycobacterium
LAGMSLLASAIGLAAFAAAGA

SEQ ID NO: 1093826 - protein, 24 aa, Mycobacterium
LAHDPRVLSIAQFWHRAAQHERIV

SEQ ID NO: 1093827 - protein, 18 aa, Mycobacterium
LAILLLGSCARSPAPVIV

SEQ ID NO: 1093828 - protein, 28 aa, Mycobacterium
LALANQVDKLIWAEGFSLPLTQSPGTIA

SEQ ID NO: 1093829 - protein, 19 aa, Mycobacterium
LALLAMRCYDVTAGAVRVG

SEQ ID NO: 1093830 - protein, 18 aa, Mycobacterium
LALRVLCATALVVVRTEE

SEQ ID NO: 1093831 - protein, 18 aa, Mycobacterium
LALVCVLVLGCGSSGSGG

SEQ ID NO: 1093832 - protein, 24 aa, Mycobacterium
LAPLTTLRVGPVARTLVTCDTTDQ

SEQ ID NO: 1093833 - protein, 22 aa, Mycobacterium
LASGSWQGPAAAAMAAAAAPYA

SEQ ID NO: 1093834 - protein, 27 aa, Mycobacterium
LASPAGELLDPLVNAPFELLTGRELIG

SEQ ID NO: 1093835 - protein, 20 aa, Mycobacterium
LAVLLVGLLAAGVVVLLRTT

SEQ ID NO: 1093836 - protein, 25 aa, Mycobacterium
LAVVALAGAGWWRMGADDDPMTVTA

SEQ ID NO: 1093837 - protein, 20 aa, Mycobacterium
LCVQYLAPIIKNRQYNFLPF

SEQ ID NO: 1093838 - protein, 25 aa, Mycobacterium
LDAPWAPFVVDFHLANVGGPSAGLM

SEQ ID NO: 1093839 - protein, 20 aa, Mycobacterium
LDAQRRWQKILGPQRLGELR

SEQ ID NO: 1093840 - protein, 24 aa, Mycobacterium
LDNGTTQVWSFDGPAPTATDAAWT

SEQ ID NO: 1093841 - protein, 17 aa, Mycobacterium
LDNLLNTLPDRYQALVR

SEQ ID NO: 1093842 - protein, 32 aa, Mycobacterium; identical to SEQ ID NO: 832086

SEQ ID NO: 1093843 - protein, 22 aa, Mycobacterium
LDRLHVRYDLSWQALDGALARR

SEQ ID NO: 1093844 - protein, 36 aa, Mycobacterium
LDRSAQRIVLIRNPKWWGKKPRLHSITYLVLDDAAR

SEQ ID NO: 1093845 - protein, 19 aa, Mycobacterium
LDRYFDYAEGRLGWRTLDF

SEQ ID NO: 1093846 - protein, 18 aa, Mycobacterium
LDVWRRDDLPTEPAPVLI

SEQ ID NO: 1093847 - protein, 28 aa, Mycobacterium
LEAAPLVVLYKQYVVRFGLGYREEAKSD

SEQ ID NO: 1093848 - protein, 24 aa, Mycobacterium
LESSDWSWLKWLPHVDIPGQLDGV

SEQ ID NO: 1093849 - protein, 25 aa, Mycobacterium
LEVNTLFQSLIDLLHKIDPVELNGT

SEQ ID NO: 1093850 - protein, 20 aa, Mycobacterium
LEWQLRRRVLELDNIEIVRG

SEQ ID NO: 1093851 - protein, 17 aa, Mycobacterium
LFGIIAALFMVDGTVSV

SEQ ID NO: 1093852 - protein, 29 aa, Mycobacterium
LGASNPILTEIWFLLTGQTVLPNNLGTFM

SEQ ID NO: 1093853 - protein, 22 aa, Mycobacterium
LGEALTLWLSGQEQLVPRDLVY

SEQ ID NO: 1093854 - protein, 20 aa, Mycobacterium
LGELPVGSLVGTSSPRRAAQ

SEQ ID NO: 1093855 - protein, 24 aa, Mycobacterium
LGERFLDRATNLGPAGWLRAKTGS

SEQ ID NO: 1093856 - protein, 22 aa, Mycobacterium
LGLAWITLAVAALMVVVSAPAD

SEQ ID NO: 1093857 - protein, 18 aa, Mycobacterium
LGQDYQLFGAQLAQFHQR

SEQ ID NO: 1093858 - protein, 31 aa, Mycobacterium; identical to SEQ ID NO: 947212

SEQ ID NO: 1093859 - protein, 23 aa, Mycobacterium
LGRNLALHPATMLAGRFDDDVYA

SEQ ID NO: 1093860 - protein, 18 aa, Mycobacterium
LGRYGVCANAICPRARTA

SEQ ID NO: 1093861 - protein, 25 aa, Mycobacterium
LGSDMGEFFMPYPGTRINQETIPLN

SEQ ID NO: 1093862 - protein, 17 aa, Mycobacterium
LHAAAGHWRDFAAALNG

SEQ ID NO: 1093863 - protein, 17 aa, Mycobacterium
LHVLGDQTLLVTALANL

SEQ ID NO: 1093864 - protein, 17 aa, Mycobacterium
LIADYLGWIGRCGSYRV

SEQ ID NO: 1093865 - protein, 17 aa, Mycobacterium
LIDITRFWFEQGSLANE

SEQ ID NO: 1093866 - protein, 18 aa, Mycobacterium
LIGFNSMRVFLHDQLWAS

SEQ ID NO: 1093867 - protein, 23 aa, Mycobacterium
LIIDMTLSRIDAGFFTGTRWEGD

SEQ ID NO: 1093868 - protein, 17 aa, Mycobacterium
LILVAVLLAFLAPRFLP

SEQ ID NO: 1093869 - protein, 27 aa, Mycobacterium
LKDGRQWRIPMWQLNAGAQRGFLSGIA

SEQ ID NO: 1093870 - protein, 18 aa, Mycobacterium
LKFATVTPGLLGLGVAAA

SEQ ID NO: 1093871 - protein, 20 aa, Mycobacterium
LKLGRRRLLALGAGTLGLGA

SEQ ID NO: 1093872 - protein, 24 aa, Mycobacterium
LKTPVGAMALLAEALLASADDSDT

SEQ ID NO: 1093873 - protein, 28 aa, Mycobacterium
LLASIVAAALMFPFAGGIGLMSNRASEV

SEQ ID NO: 1093874 - protein, 19 aa, Mycobacterium
LLEQRFGVPVPNLTTWRRG

SEQ ID NO: 1093875 - protein, 17 aa, Mycobacterium
LLERLISGQVGNPALDI

SEQ ID NO: 1093876 - protein, 18 aa, Mycobacterium
LLGLGVTASLVASPALAN

SEQ ID NO: 1093877 - protein, 20 aa, Mycobacterium
LLGSGLLSPSSPAAALRLVR

SEQ ID NO: 1093878 - protein, 17 aa, Mycobacterium
LLIAANAFFVGAEFALI

SEQ ID NO: 1093879 - protein, 18 aa, Mycobacterium
LLNRYSQFALAGAAAGAV

SEQ ID NO: 1093880 - protein, 19 aa, Mycobacterium
LLPVLPQLSAKHQVVVAAV

SEQ ID NO: 1093881 - protein, 18 aa, Mycobacterium
LLQTLLAAVGRSTAAAPP

SEQ ID NO: 1093882 - protein, 18 aa, Mycobacterium
LLRFAGLVLQPVCVAVVS

SEQ ID NO: 1093883 - protein, 17 aa, Mycobacterium
LLSVLGATGVAACGTDH

SEQ ID NO: 1093884 - protein, 24 aa, Mycobacterium
LLVAGIALTYLSYTSAFTPTDTVV

SEQ ID NO: 1093885 - protein, 19 aa, Mycobacterium
LLVATLLLLWSMNRQLKKI

SEQ ID NO: 1093886 - protein, 20 aa, Mycobacterium
LLVGLALAGGYAVSASKTVT

SEQ ID NO: 1093887 - protein, 27 aa, Mycobacterium
LLVGNGGAGGLLFGQGGAGGANGLFEA

SEQ ID NO: 1093888 - protein, 29 aa, Mycobacterium
LLYLAAAFDIYGRLYAWLLDTSKDHKTIR

SEQ ID NO: 1093889 - protein, 20 aa, Mycobacterium
LMLTFLPSPTSAAASNTATT

SEQ ID NO: 1093890 - protein, 26 aa, Mycobacterium
LNAINAPTEALFGRPLIGDGADGQTV

SEQ ID NO: 1093891 - protein, 26 aa, Mycobacterium
LNLINAPTQALFGRPLIGNGADGAPG

SEQ ID NO: 1093892 - protein, 22 aa, Mycobacterium
LNRLHVRYDLSWQALDGALARR

SEQ ID NO: 1093893 - protein, 23 aa, Mycobacterium
LPAPWRAEALVLLAFSAYVRGDG

SEQ ID NO: 1093894 - protein, 18 aa, Mycobacterium
LPAVVLEVEFALDASGRS

SEQ ID NO: 1093895 - protein, 26 aa, Mycobacterium
LPLASIFKLYVLHALAYAVRNGTVSW

SEQ ID NO: 1093896 - protein, 17 aa, Mycobacterium
LPLLLAAGAALAQTPRA

SEQ ID NO: 1093897 - protein, 21 aa, Mycobacterium
LPRMHLARYAGTARPRLAPPV

SEQ ID NO: 1093898 - protein, 27 aa, Mycobacterium
LPTEPAPVLIFVPGGAWIHGSRAIQGY

SEQ ID NO: 1093899 - protein, 28 aa, Mycobacterium
LQDSDLVPYRTLVTQTPVAVMLGHLQVP

SEQ ID NO: 1093900 - protein, 26 aa, Mycobacterium
LQPDRNLFMPMAFHLGYHSLPIGNVM

SEQ ID NO: 1093901 - protein, 18 aa, Mycobacterium
LQVKTIWAARAISVLFPQ

SEQ ID NO: 1093902 - protein, 17 aa, Mycobacterium
LRGATLGGSGAVNGGYF

SEQ ID NO: 1093903 - protein, 17 aa, Mycobacterium
LRLVRELYRGGTNLYTP

SEQ ID NO: 1093904 - protein, 20 aa, Mycobacterium
LRNVLRRGFGGNGHKIAAVG

SEQ ID NO: 1093905 - protein, 26 aa, Mycobacterium
LRRLRGMFAFALWDTVTRELFCARDP

SEQ ID NO: 1093906 - protein, 30 aa, Mycobacterium
LRVALRIVWALLLMPGLPLLGVPVPGRSHA

SEQ ID NO: 1093907 - protein, 30 aa, Mycobacterium; identical to SEQ ID NO: 947587

SEQ ID NO: 1093908 - protein, 19 aa, Mycobacterium
LRYTTALAGLGAASAACGM

SEQ ID NO: 1093909 - protein, 23 aa, Mycobacterium
LSAQAALFHEQFVQALNAGAGSY

SEQ ID NO: 1093910 - protein, 28 aa, Mycobacterium
LSDPMLPEELLPAKWPGAQLRSAYHDFA

SEQ ID NO: 1093911 - protein, 19 aa, Mycobacterium
LSFGYRTSVLKQAEGLALP

SEQ ID NO: 1093912 - protein, 31 aa, Mycobacterium
LSGGSLEIFLTPQLPAPLVRIYGATPIAEAL

SEQ ID NO: 1093913 - protein, 20 aa, Mycobacterium
LSGLGLTMTGPRPGGFGALD

SEQ ID NO: 1093914 - protein, 17 aa, Mycobacterium
LSGMALASLAGRGATGA

SEQ ID NO: 1093915 - protein, 27 aa, Mycobacterium
LSIAGDLRVDFAWLGTVVQAYLRRTLD

SEQ ID NO: 1093916 - protein, 18 aa, Mycobacterium
LSLLKLSGFCLLASIVAA

SEQ ID NO: 1093917 - protein, 25 aa, Mycobacterium
LSPEHVVTLVQFLASPAAAAVNGQL

SEQ ID NO: 1093918 - protein, 20 aa, Mycobacterium
LSQLWPSLLQAHYGRGFSVA

SEQ ID NO: 1093919 - protein, 33 aa, Mycobacterium; identical to SEQ ID NO: 947627

SEQ ID NO: 1093920 - protein, 24 aa, Mycobacterium
LSSGWNIIDFVQQLQQLTGGNVAF

SEQ ID NO: 1093921 - protein, 23 aa, Mycobacterium
LSVVPIMLARILDLPDQVRARNP

SEQ ID NO: 1093922 - protein, 26 aa, Mycobacterium
LSYYLATAFREIWMQPSGEAGLIGFA

SEQ ID NO: 1093923 - protein, 18 aa, Mycobacterium
LTAQFYNELDPKTAVLTW

SEQ ID NO: 1093924 - protein, 25 aa, Mycobacterium
LTEWNFVWDELLARGLRVIAFDQRG

SEQ ID NO: 1093925 - protein, 17 aa, Mycobacterium
LTQIRQRYDPSRLMYSG

SEQ ID NO: 1093926 - protein, 28 aa, Mycobacterium
LTQSPPAWWRPAGALFDQFLGAAETDPV

SEQ ID NO: 1093927 - protein, 25 aa, Mycobacterium
LTYGRTHLLRLVAIKRLQGQGLSLG

SEQ ID NO: 1093928 - protein, 27 aa, Mycobacterium
LVAANRAQLLVLIATNFFGQNTSAIAA

SEQ ID NO: 1093929 - protein, 23 aa, Mycobacterium
LVAARFIQLTPVYTGGAVVPDGA

SEQ ID NO: 1093930 - protein, 17 aa, Mycobacterium
LVGTTKTLKFLVALRPG

SEQ ID NO: 1093931 - protein, 17 aa, Mycobacterium
LVIAAMGWVAPSGGAVS

SEQ ID NO: 1093932 - protein, 20 aa, Mycobacterium
LVRVGRRQVPLDAALRVKDT

SEQ ID NO: 1093933 - protein, 34 aa, Mycobacterium; identical to SEQ ID NO: 947742

SEQ ID NO: 1093934 - protein, 19 aa, Mycobacterium
LVTLLAERISLLVTVPAVY

SEQ ID NO: 1093935 - protein, 25 aa, Mycobacterium
LVTVPAVYSLLLRHKDFGAADVSGV

SEQ ID NO: 1093936 - protein, 19 aa, Mycobacterium
LVVPPPRPPTVKPAVTAVA

SEQ ID NO: 1093937 - protein, 17 aa, Mycobacterium
LWFDVTALPLGPNGRAA

SEQ ID NO: 1093938 - protein, 18 aa, Mycobacterium
LWLPPLDESIQLTAILAS

SEQ ID NO: 1093939 - protein, 26 aa, Mycobacterium
LWSVVEAFVGDLWPNGDVAGLHAAAG

SEQ ID NO: 1093940 - protein, 17 aa, Mycobacterium
LYTYCRDDDPAVLIRGA

SEQ ID NO: 1093941 - protein, 17 aa, Mycobacterium
LYWAARLTLVNRMEDLV

SEQ ID NO: 1093942 - protein, 25 aa, Mycobacterium
MAAALPYCDLFLPAHSLTGVQQLLR

SEQ ID NO: 1093943 - protein, 17 aa, Mycobacterium
MAAFYTAAPLDDAHLLF

SEQ ID NO: 1093944 - protein, 19 aa, Mycobacterium
MAATFTSIAISMYCPSVMA

SEQ ID NO: 1093945 - protein, 20 aa, Mycobacterium
MAGAFHYLDPRGGYVNDHAW

SEQ ID NO: 1093946 - protein, 25 aa, Mycobacterium
MALPYVEKSGDFSRIAWSFRASDMR

SEQ ID NO: 1093947 - protein, 21 aa, Mycobacterium
MATARIPAGINFNVGGAGGHG

SEQ ID NO: 1093948 - protein, 19 aa, Mycobacterium
MDGTYPILGDPSLGYGPGT

SEQ ID NO: 1093949 - protein, 22 aa, Mycobacterium
MGEAWWVPIVQIPNDTIDGKQR

SEQ ID NO: 1093950 - protein, 19 aa, Mycobacterium
MIDMPQYLDYLTARLAAAG

SEQ ID NO: 1093951 - protein, 20 aa, Mycobacterium
MIRYYTARGLLPRPGTRGRA

SEQ ID NO: 1093952 - protein, 25 aa, Mycobacterium
MLAATGPFIGWLEITGALASETANQ

SEQ ID NO: 1093953 - protein, 20 aa, Mycobacterium
MLRPGGVVDLLTAPGGLLDR

SEQ ID NO: 1093954 - protein, 22 aa, Mycobacterium
MLVGMIHGAFSDSLPTCITKYI

SEQ ID NO: 1093955 - protein, 17 aa, Mycobacterium
MMDAKLLEAVAAQVNDT

SEQ ID NO: 1093956 - protein, 17 aa, Mycobacterium
MMLMTGFGVLGAALPVP

SEQ ID NO: 1093957 - protein, 24 aa, Mycobacterium
MRALAERLLPARFNAALAQSEPIG

SEQ ID NO: 1093958 - protein, 19 aa, Mycobacterium
MRPDYVPPQPDMPPAEPPA

SEQ ID NO: 1093959 - protein, 20 aa, Mycobacterium
MRQHWGIENSLHWIRDVTFD

SEQ ID NO: 1093960 - protein, 19 aa, Mycobacterium
MSETVTWMLRDLGVYAIKL

SEQ ID NO: 1093961 - protein, 29 aa, Mycobacterium
MSMTSMMSRVKWMLRARPADYLLAMSVAG

SEQ ID NO: 1093962 - protein, 18 aa, Mycobacterium
MSVRVRSLWISVTDPDAL

SEQ ID NO: 1093963 - protein, 19 aa, Mycobacterium
MTVPPPLVAANRAQLLVLI

SEQ ID NO: 1093964 - protein, 27 aa, Mycobacterium
MVRAFRLGGRAPLPAYFEIAERPQAQA

SEQ ID NO: 1093965 - protein, 24 aa, Mycobacterium
MYDQWRPRPWPDLTRRRLFVRPDA

SEQ ID NO: 1093966 - protein, 17 aa, Mycobacterium
MYPMTLASQAAHLVMLF

SEQ ID NO: 1093967 - protein, 45 aa, Mycobacterium; identical to SEQ ID NO: 947954

SEQ ID NO: 1093968 - protein, 32 aa, Mycobacterium; identical to SEQ ID NO: 947958

SEQ ID NO: 1093969 - protein, 18 aa, Mycobacterium
NAVRSHGINFASPQAAIM

SEQ ID NO: 1093970 - protein, 24 aa, Mycobacterium
NDHAWIVFDSAHLQRYGFLGIEPG

SEQ ID NO: 1093971 - protein, 22 aa, Mycobacterium
NDPQAIYLNYIGSAGGVFMRDN

SEQ ID NO: 1093972 - protein, 23 aa, Mycobacterium
NDPRNEWLFTDAWGVDVAVSTPR

SEQ ID NO: 1093973 - protein, 24 aa, Mycobacterium
NEESRLPPIYPGTTVSIPPTTTSA

SEQ ID NO: 1093974 - protein, 24 aa, Mycobacterium
NEPARTWFTALKPIATDFGEVQLP

SEQ ID NO: 1093975 - protein, 21 aa, Mycobacterium
NETAFPRLYGVQTRFFDDFFS

SEQ ID NO: 1093976 - protein, 22 aa, Mycobacterium
NFSRWSGLRNVLRRGFGGNGHK

SEQ ID NO: 1093977 - protein, 22 aa, Mycobacterium
NGGAGLGILGEAGGNDGGGGAG

SEQ ID NO: 1093978 - protein, 23 aa, Mycobacterium
NGGANSPALYLLDGLRAQDDFSG

SEQ ID NO: 1093979 - protein, 17 aa, Mycobacterium
NGGLLVGNGGAGGLLFG

SEQ ID NO: 1093980 - protein, 21 aa, Mycobacterium
NGHHPGDIVSISWTSSSGGQR

SEQ ID NO: 1093981 - protein, 17 aa, Mycobacterium
NGKLLRSALRGQTPAKP

SEQ ID NO: 1093982 - protein, 36 aa, Mycobacterium; identical to SEQ ID NO: 948065

SEQ ID NO: 1093983 - protein, 22 aa, Mycobacterium
NGTHSWPYWNQQLVAMKGDILK

SEQ ID NO: 1093984 - protein, 21 aa, Mycobacterium
NISAVLISPPQAPAGTHWTPP

SEQ ID NO: 1093985 - protein, 20 aa, Mycobacterium
NLGPAGWLRAKTGSLTAINS

SEQ ID NO: 1093986 - protein, 26 aa, Mycobacterium
NLKGVVGATLRCQLIDGSKTYGVNVT

SEQ ID NO: 1093987 - protein, 19 aa, Mycobacterium
NLVEITLPDDTPWGGKPVR

SEQ ID NO: 1093988 - protein, 21 aa, Mycobacterium
NNMVLAVQQIAIGEAFVLAEN

SEQ ID NO: 1093989 - protein, 27 aa, Mycobacterium
NNTLWASWAFVGPTHRAYFGGDTGYTK

SEQ ID NO: 1093990 - protein, 18 aa, Mycobacterium
NNTRVWVWSPTNPGASDP

SEQ ID NO: 1093991 - protein, 24 aa, Mycobacterium
NNYIQPLFSGAIPQALFTPEQFWP

SEQ ID NO: 1093992 - protein, 21 aa, Mycobacterium
NPPVEGSWAWLPDEAKGARVH

SEQ ID NO: 1093993 - protein, 26 aa, Mycobacterium
NPVAAKRLSVLSLPTTFIFDTDGRQR

SEQ ID NO: 1093994 - protein, 20 aa, Mycobacterium
NQIVPYLRAWESVIGHQRTG

SEQ ID NO: 1093995 - protein, 18 aa, Mycobacterium
NQRWVRLGCDIDLSGLFY

SEQ ID NO: 1093996 - protein, 19 aa, Mycobacterium
NQTPIAVSALDDLLLDVSQ

SEQ ID NO: 1093997 - protein, 25 aa, Mycobacterium
NTERFGMQDAIWRGVYYTPTGATRS

SEQ ID NO: 1093998 - protein, 28 aa, Mycobacterium
NTNIEDLWAPLLAALGAADLALATVNDL

SEQ ID NO: 1093999 - protein, 17 aa, Mycobacterium
NVDAKLYGLPFGDGAYG

SEQ ID NO: 1094000 - protein, 20 aa, Mycobacterium
NVTLIFSVDRHRGVMDAYLT

SEQ ID NO: 1094001 - protein, 25 aa, Mycobacterium
NVVDLLNMIDPLKLNAVLSAVAEGV

SEQ ID NO: 1094002 - protein, 17 aa, Mycobacterium
PAADRIIELLNRARDSL

SEQ ID NO: 1094003 - protein, 21 aa, Mycobacterium
PAAISIPTPVGELDLLAAYIA

SEQ ID NO: 1094004 - protein, 23 aa, Mycobacterium
PAAQLTRDVLLPAAASGLDAWGV

SEQ ID NO: 1094005 - protein, 17 aa, Mycobacterium
PAEGRVGLLRKVLDSAG

SEQ ID NO: 1094006 - protein, 17 aa, Mycobacterium
PAGINFNVGGAGGHGGA

SEQ ID NO: 1094007 - protein, 19 aa, Mycobacterium
PAGLPGAPGPAPEGTPPGG

SEQ ID NO: 1094008 - protein, 20 aa, Mycobacterium
PAGLVMLTDGKPALIRADNV

SEQ ID NO: 1094009 - protein, 24 aa, Mycobacterium
PAGLWCEDAWLTTAMLVGTTKTLK

SEQ ID NO: 1094010 - protein, 20 aa, Mycobacterium
PALADPIDPIPGNGFFLVGP

SEQ ID NO: 1094011 - protein, 19 aa, Mycobacterium
PALLMLHPPSETTPSLPEC

SEQ ID NO: 1094012 - protein, 39 aa, Mycobacterium
PALLRLFPRASREFIGDPRYLLDRYLPVDYLQDSSPVGV

SEQ ID NO: 1094013 - protein, 19 aa, Mycobacterium
PALPAMLAHIRELAPNCPL

SEQ ID NO: 1094014 - protein, 23 aa, Mycobacterium
PASMTPFPTMYELFSVGWGQPDL

SEQ ID NO: 1094015 - protein, 25 aa, Mycobacterium
PASMTPFPTMYELFSVGWGQPDLRE

SEQ ID NO: 1094016 - protein, 24 aa, Mycobacterium
PATRASGVLPRYGVRLTVMAHPPA

SEQ ID NO: 1094017 - protein, 26 aa, Mycobacterium
PATVIDLALVRPLPQLAKSLPLPDAL

SEQ ID NO: 1094018 - protein, 20 aa, Mycobacterium
PAVTWRDARPTRASRRDAVC

SEQ ID NO: 1094019 - protein, 18 aa, Mycobacterium
PDAPGTPVPLPPDAPPGA

SEQ ID NO: 1094020 - protein, 24 aa, Mycobacterium
PDDLLNAVINFLASIRNGVVPILE

SEQ ID NO: 1094021 - protein, 28 aa, Mycobacterium
PEEADFSTLPWTRTITTTIPAIIANIVA

SEQ ID NO: 1094022 - protein, 19 aa, Mycobacterium
PEIVWYLDEPVADPALVPL

SEQ ID NO: 1094023 - protein, 25 aa, Mycobacterium
PELSALAWTVYSLPGAPAFDHYELA

SEQ ID NO: 1094024 - protein, 25 aa, Mycobacterium
PEQWSGNFLFYNRGLFADGGVPPPP

SEQ ID NO: 1094025 - protein, 23 aa, Mycobacterium
PERLPGAIRWSSGALRQARDYLS

SEQ ID NO: 1094026 - protein, 25 aa, Mycobacterium
PESVRVSFWYDSKYIVPADAKAAIL

SEQ ID NO: 1094027 - protein, 23 aa, Mycobacterium
PEVYAPVTGFYSLRYSSTGLERA

SEQ ID NO: 1094028 - protein, 18 aa, Mycobacterium
PGFDSLGLALSLYDEIVL

SEQ ID NO: 1094029 - protein, 28 aa, Mycobacterium
PGHRLGQIVNPRWSPTGKQIAFLQNDSN

SEQ ID NO: 1094030 - protein, 25 aa, Mycobacterium
PGQIKKVCPWQSPPGHWVGGPHGIP

SEQ ID NO: 1094031 - protein, 30 aa, Mycobacterium
PGRAAVPWWPWAPLVQLMRVLPPPIAKKFA

SEQ ID NO: 1094032 - protein, 17 aa, Mycobacterium
PGTLGSGVLAPALWSVV

SEQ ID NO: 1094033 - protein, 18 aa, Mycobacterium
PGTPVPLPPDAPPGARTE

SEQ ID NO: 1094034 - protein, 19 aa, Mycobacterium
PHHRWPRHIHDVKAAIAWA

SEQ ID NO: 1094035 - protein, 21 aa, Mycobacterium
PHVHNAVRVAFWGAEELGLIG

SEQ ID NO: 1094036 - protein, 26 aa, Mycobacterium
PIIKNRQYNFLPFGQNLFVGASARPN

SEQ ID NO: 1094037 - protein, 20 aa, Mycobacterium
PILKNRQYNFPPLGENLFVG

SEQ ID NO: 1094038 - protein, 17 aa, Mycobacterium
PIQTACMVLMDNKIMQG

SEQ ID NO: 1094039 - protein, 18 aa, Mycobacterium
PIVFHRGAVRPVSPAPVG

SEQ ID NO: 1094040 - protein, 27 aa, Mycobacterium
PIVHVSSFTALFHPGLQTLSADLPVVG

SEQ ID NO: 1094041 - protein, 19 aa, Mycobacterium
PKGGSFPLYTAIDVNMTAQ

SEQ ID NO: 1094042 - protein, 27 aa, Mycobacterium
PKRIDFACYSAIYYTLRREYLVDVTEV

SEQ ID NO: 1094043 - protein, 27 aa, Mycobacterium
PLARSVRDLFLGLSIMNGPDLADPYTA

SEQ ID NO: 1094044 - protein, 17 aa, Mycobacterium
PLCAEPVRWRLVGEEAE

SEQ ID NO: 1094045 - protein, 17 aa, Mycobacterium
PLFHNIAAWLMQRENVP

SEQ ID NO: 1094046 - protein, 18 aa, Mycobacterium
PLGDVFVALRPPAGAGTE

SEQ ID NO: 1094047 - protein, 29 aa, Mycobacterium
PLGLCFLPAFVCLGIVPVLAGLAAKVLDS

SEQ ID NO: 1094048 - protein, 19 aa, Mycobacterium
PLLSVHGLQVRFGTDEPVV

SEQ ID NO: 1094049 - protein, 33 aa, Mycobacterium; identical to SEQ ID NO: 948671

SEQ ID NO: 1094050 - protein, 18 aa, Mycobacterium
PLSSAMLPRFLYTKEIGR

SEQ ID NO: 1094051 - protein, 17 aa, Mycobacterium
PMFHAFPASKWRRYDKL

SEQ ID NO: 1094052 - protein, 28 aa, Mycobacterium
PMFHGLGFGMLVLTISLGGTVLTRRHFD

SEQ ID NO: 1094053 - protein, 33 aa, Mycobacterium; identical to SEQ ID NO: 146912

SEQ ID NO: 1094054 - protein, 20 aa, Mycobacterium
PNADWNWIPSNIWVGVGRME

SEQ ID NO: 1094055 - protein, 22 aa, Mycobacterium
PNARFVIWRKPNGAQLIADYLG

SEQ ID NO: 1094056 - protein, 27 aa, Mycobacterium
PNEGPPQRWFVVWLGTSNDPVDKGAAK

SEQ ID NO: 1094057 - protein, 23 aa, Mycobacterium
PNNTNIAVPDWLRAIPGTTTSYP

SEQ ID NO: 1094058 - protein, 19 aa, Mycobacterium
PNPTQQLPGLPALAQLSPI

SEQ ID NO: 1094059 - protein, 21 aa, Mycobacterium
PNPTQQLPGLPALAQLSPIVQ

SEQ ID NO: 1094060 - protein, 17 aa, Mycobacterium
PPALLARASRVVGQLSV

SEQ ID NO: 1094061 - protein, 29 aa, Mycobacterium
PPAPGPAPILPPLAPGQVLRMGPTAGTGT

SEQ ID NO: 1094062 - protein, 25 aa, Mycobacterium
PPGGKIVVTVRLWAAPIAAAYQQSF

SEQ ID NO: 1094063 - protein, 24 aa, Mycobacterium
PPIGYRLLLLVGVLALALTGCVGA

SEQ ID NO: 1094064 - protein, 21 aa, Mycobacterium
PPLLNALPRLPQCVPNAVLGS

SEQ ID NO: 1094065 - protein, 25 aa, Mycobacterium
PPQAKRWLLGRIGAKRPRRAPTIAA

SEQ ID NO: 1094066 - protein, 21 aa, Mycobacterium
PPSAPLLLLPVLVSALIIRVR

SEQ ID NO: 1094067 - protein, 19 aa, Mycobacterium
PQVDLWLEELDRTPAFYFD

SEQ ID NO: 1094068 - protein, 24 aa, Mycobacterium
PRDVTFYCLDYGGGQLRAIQDLLH

SEQ ID NO: 1094069 - protein, 30 aa, Mycobacterium; identical to SEQ ID NO: 948815

SEQ ID NO: 1094070 - protein, 35 aa, Mycobacterium; identical to SEQ ID NO: 948821

SEQ ID NO: 1094071 - protein, 17 aa, Mycobacterium
PRRYMVGGHRIPVPELA

SEQ ID NO: 1094072 - protein, 27 aa, Mycobacterium
PSALPVPPSAPLPPPEALVDVLSRLAD

SEQ ID NO: 1094073 - protein, 24 aa, Mycobacterium
PSDGRWWNTFSSAPDLIRYYEMLL

SEQ ID NO: 1094074 - protein, 23 aa, Mycobacterium
PSEPNYLVALFAGTTFGLKKNTC

SEQ ID NO: 1094075 - protein, 28 aa, Mycobacterium
PSIAESYWNWPEPLLTDEGWLDTRDRVC

SEQ ID NO: 1094076 - protein, 17 aa, Mycobacterium
PSRAAEVLGFRAAVEPL

SEQ ID NO: 1094077 - protein, 29 aa, Mycobacterium
PSSTPPPPPPLPPTPFPKECPAPGVMQGC

SEQ ID NO: 1094078 - protein, 24 aa, Mycobacterium
PSTGKYLYEAWADRFAVTARLNNA

SEQ ID NO: 1094079 - protein, 24 aa, Mycobacterium
PTATAFPWRRQSAVVQWYVETPSS

SEQ ID NO: 1094080 - protein, 18 aa, Mycobacterium
PTPEFAALGADTWHWHPM

SEQ ID NO: 1094081 - protein, 22 aa, Mycobacterium
PTPIDYFVAEVLRIISGGRIIW

SEQ ID NO: 1094082 - protein, 28 aa, Mycobacterium
PTPTITARLNFQLAFGARVGQRLAEARE

SEQ ID NO: 1094083 - protein, 20 aa, Mycobacterium
PTRPALVVLAAGLTGIATHA

SEQ ID NO: 1094084 - protein, 17 aa, Mycobacterium
PVANVVITPAREAVVRV

SEQ ID NO: 1094085 - protein, 18 aa, Mycobacterium
PVEGSWAWLPDEAKGARI

SEQ ID NO: 1094086 - protein, 22 aa, Mycobacterium
PVLWDEMPTLPLYRQERTLLMS

SEQ ID NO: 1094087 - protein, 24 aa, Mycobacterium
PVQRWRRGTPFDLHLMMFGDSTAC

SEQ ID NO: 1094088 - protein, 20 aa, Mycobacterium
PVSLATALPIGIPAYLADQS

SEQ ID NO: 1094089 - protein, 17 aa, Mycobacterium
PVWASLIALLEDGVPSI

SEQ ID NO: 1094090 - protein, 21 aa, Mycobacterium
PWPGSGPRPLLRYAPGTVGQG

SEQ ID NO: 1094091 - protein, 17 aa, Mycobacterium
PWYQAEYETAAPDEQGA

SEQ ID NO: 1094092 - protein, 33 aa, Mycobacterium
PYCALACAELLYRAGLPRALYAIVPGPGSVVGT

SEQ ID NO: 1094093 - protein, 17 aa, Mycobacterium
PYRVPYPQVPPTQETTP

SEQ ID NO: 1094094 - protein, 33 aa, Mycobacterium
QAAAQDMLTAIRPPAQALLGRPLVGNGAHGAPG

SEQ ID NO: 1094095 - protein, 19 aa, Mycobacterium
QAADFLRPGHVAPLLAEPH

SEQ ID NO: 1094096 - protein, 25 aa, Mycobacterium
QDPRFTIAAIPPRQDPRDAVVARDG

SEQ ID NO: 1094097 - protein, 18 aa, Mycobacterium
QEHWPSEVAAREPVLLWG

SEQ ID NO: 1094098 - protein, 28 aa, Mycobacterium
QFQDDFIEWSVSFNQKPFPPPCDVAREL

SEQ ID NO: 1094099 - protein, 23 aa, Mycobacterium
QGARPMIAKSVRITNLGGFTGMY

SEQ ID NO: 1094100 - protein, 35 aa, Mycobacterium; identical to SEQ ID NO: 848800

SEQ ID NO: 1094101 - protein, 17 aa, Mycobacterium
QGLRWAQQEIEWAKWVI

SEQ ID NO: 1094102 - protein, 17 aa, Mycobacterium
QGVGFGGWYSPIALRVD

SEQ ID NO: 1094103 - protein, 26 aa, Mycobacterium
QGYTYKWETFLTREMPAWLQANKGVS

SEQ ID NO: 1094104 - protein, 24 aa, Mycobacterium
QHRPEVIFHLAAQIDVRHSVADPQ

SEQ ID NO: 1094105 - protein, 26 aa, Mycobacterium
QIGQKFAREIFLLGRAYTAEQMHHMG

SEQ ID NO: 1094106 - protein, 18 aa, Mycobacterium
QKQPKLPPPAAVLRITPA

SEQ ID NO: 1094107 - protein, 21 aa, Mycobacterium
QLAAQRPVLDKALRTIPDALT

SEQ ID NO: 1094108 - protein, 21 aa, Mycobacterium
QLDLHPDIHLFSAIPEVRSST

SEQ ID NO: 1094109 - protein, 18 aa, Mycobacterium
QLKNWVATLTLGIDQGVK

SEQ ID NO: 1094110 - protein, 25 aa, Mycobacterium
QLLQREVIVTRYLTVPAEDAAPRIR

SEQ ID NO: 1094111 - protein, 17 aa, Mycobacterium
QMAVLAVGGWMAAQGTI

SEQ ID NO: 1094112 - protein, 24 aa, Mycobacterium
QMPLPVMIGLALLSAALSTAPAAH

SEQ ID NO: 1094113 - protein, 21 aa, Mycobacterium
QMTRELIPAFTQRGSGHFVFV

SEQ ID NO: 1094114 - protein, 20 aa, Mycobacterium
QMYGLPKTGFAANAPAIADI

SEQ ID NO: 1094115 - protein, 28 aa, Mycobacterium
QNRLQIPLLERGILQRLLRSRTIAVLFG

SEQ ID NO: 1094116 - protein, 19 aa, Mycobacterium
QNVRPKILSPQYSEYQVLE

SEQ ID NO: 1094117 - protein, 24 aa, Mycobacterium
QPKGVVGVISPWNYPMTLTASDSV

SEQ ID NO: 1094118 - protein, 25 aa, Mycobacterium
QPNPNPQLPGLPALAQLSPIIQQAA

SEQ ID NO: 1094119 - protein, 30 aa, Mycobacterium
QPPRGKYDPLPWPQDFDLPPMPTPVEPQGP

SEQ ID NO: 1094120 - protein, 26 aa, Mycobacterium
QPQQQQLIELLLRAITPPEDPAALLP

SEQ ID NO: 1094121 - protein, 31 aa, Mycobacterium; identical to SEQ ID NO: 366599

SEQ ID NO: 1094122 - protein, 23 aa, Mycobacterium
QQSWVVSFQLNWPRDHGPTVTSW

SEQ ID NO: 1094123 - protein, 17 aa, Mycobacterium
QRHVYPPGWAWSPSNSA

SEQ ID NO: 1094124 - protein, 18 aa, Mycobacterium
QRLPLVGSWVRQGIDELS

SEQ ID NO: 1094125 - protein, 18 aa, Mycobacterium
QRRWWAGRGQGAFTAVQG

SEQ ID NO: 1094126 - protein, 24 aa, Mycobacterium
QSGGANSPALYLLDGMRAQDDFSG

SEQ ID NO: 1094127 - protein, 25 aa, Mycobacterium
QSGSIGLGFAIPVDQAKRIADELIS

SEQ ID NO: 1094128 - protein, 24 aa, Mycobacterium
QSMQIDHIVPLSYAWDMGASDWPA

SEQ ID NO: 1094129 - protein, 28 aa, Mycobacterium
QSYVDAHVPYLTWLATTSADYAATAIEH

SEQ ID NO: 1094130 - protein, 20 aa, Mycobacterium
QTACMVLMDNKIMQGNITGI

SEQ ID NO: 1094131 - protein, 29 aa, Mycobacterium
QTIAEQLMPHWLLALQDAAKRRGTTAPQV

SEQ ID NO: 1094132 - protein, 24 aa, Mycobacterium
QTLASISLILRGGGIPNLEVLQNE

SEQ ID NO: 1094133 - protein, 33 aa, Mycobacterium
QTLEQDLLGVLNAPTQALLGGPLIGDGADGTAP

SEQ ID NO: 1094134 - protein, 25 aa, Mycobacterium
QVLSYVKWFMTQFTTLDPYHANDYV

SEQ ID NO: 1094135 - protein, 26 aa, Mycobacterium
QVLSYVKWFMTQFTTLDPYHANDYVA

SEQ ID NO: 1094136 - protein, 22 aa, Mycobacterium
QVPMALFMQAWATSQDFMAVTT

SEQ ID NO: 1094137 - protein, 23 aa, Mycobacterium
QVPRPVRIALAELAAALAVADDE

SEQ ID NO: 1094138 - protein, 19 aa, Mycobacterium
QVQNFLTYGLPTPDNNYAG

SEQ ID NO: 1094139 - protein, 23 aa, Mycobacterium
QVRVLPPFLSRKHLPSRLAKLRE

SEQ ID NO: 1094140 - protein, 19 aa, Mycobacterium
QVTCDDLVLAWAAESGRYA

SEQ ID NO: 1094141 - protein, 25 aa, Mycobacterium
QVVDAPLPWSFTITTTEPAVLGNMV

SEQ ID NO: 1094142 - protein, 26 aa, Mycobacterium
RAAQYWVMKPTYHNSFWFSSCMVTFK

SEQ ID NO: 1094143 - protein, 17 aa, Mycobacterium
RAGYFVGVSIAAYCPRH

SEQ ID NO: 1094144 - protein, 32 aa, Mycobacterium; identical to SEQ ID NO: 949451

SEQ ID NO: 1094145 - protein, 24 aa, Mycobacterium
RAVDSVSFRLRRASTLAIVGESGS

SEQ ID NO: 1094146 - protein, 32 aa, Mycobacterium; identical to SEQ ID NO: 949467

SEQ ID NO: 1094147 - protein, 28 aa, Mycobacterium
RCGSEAWDLPVVFGPIAVTYNLKGVSAL

SEQ ID NO: 1094148 - protein, 25 aa, Mycobacterium
RDPDELVTFYSCLYRSLLHPNTFND

SEQ ID NO: 1094149 - protein, 21 aa, Mycobacterium
RDPYLMNLLANPGTSLNETAF

SEQ ID NO: 1094150 - protein, 23 aa, Mycobacterium
RDRFAGMGWLVPEVLERCPPSGD

SEQ ID NO: 1094151 - protein, 21 aa, Mycobacterium
RDTDLMIEALQTLGLRVDGTG

SEQ ID NO: 1094152 - protein, 23 aa, Mycobacterium
RDTWNRVALQWFRGINSVLGVQR

SEQ ID NO: 1094153 - protein, 24 aa, Mycobacterium
REAGATPSFLGYHGFPASICASVN

SEQ ID NO: 1094154 - protein, 17 aa, Mycobacterium
REFPVAGSARHPAGPQA

SEQ ID NO: 1094155 - protein, 30 aa, Mycobacterium; identical to SEQ ID NO: 949532

SEQ ID NO: 1094156 - protein, 36 aa, Mycobacterium; identical to SEQ ID NO: 949546

SEQ ID NO: 1094157 - protein, 24 aa, Mycobacterium
REVRSQLLSLLSDALFGSPDTKRY

SEQ ID NO: 1094158 - protein, 29 aa, Mycobacterium
RFAPLRWSVLRLALAFRTLLRTGQVGDGR

SEQ ID NO: 1094159 - protein, 18 aa, Mycobacterium
RFLYTKEIGRRLNNFWVC

SEQ ID NO: 1094160 - protein, 18 aa, Mycobacterium
RFVDFLERVVVKRSIKRH

SEQ ID NO: 1094161 - protein, 18 aa, Mycobacterium
RGEFEERLKAVLDDIKNS

SEQ ID NO: 1094162 - protein, 29 aa, Mycobacterium
RGFSVARRLALLLTYQRFLPTTGPVAMRS

SEQ ID NO: 1094163 - protein, 25 aa, Mycobacterium
RGGTNLYTPLAIAAARWPERTAIVD

SEQ ID NO: 1094164 - protein, 18 aa, Mycobacterium
RGIDGFASRFPTVTAACR

SEQ ID NO: 1094165 - protein, 30 aa, Mycobacterium
RGIENLWVVDGSILPLIPSRGPHATIVMLG

SEQ ID NO: 1094166 - protein, 19 aa, Mycobacterium
RGLMPRSFGMYRLGARRRN

SEQ ID NO: 1094167 - protein, 22 aa, Mycobacterium
RGLMPRSFGMYRLGARRRNNTG

SEQ ID NO: 1094168 - protein, 18 aa, Mycobacterium
RGMAQIGVPYSWGGGNAA

SEQ ID NO: 1094169 - protein, 31 aa, Mycobacterium; identical to SEQ ID NO: 949626

SEQ ID NO: 1094170 - protein, 18 aa, Mycobacterium
RGVPVWASLIALLEDGVP

SEQ ID NO: 1094171 - protein, 26 aa, Mycobacterium
RHGIKPLFVLFDSCWDPFPKLGQQRA

SEQ ID NO: 1094172 - protein, 26 aa, Mycobacterium
RHIHRRLLTRLSAFKVPHRFAVVERL

SEQ ID NO: 1094173 - protein, 18 aa, Mycobacterium
RIDGWSLTLFGFQLTPQQ

SEQ ID NO: 1094174 - protein, 21 aa, Mycobacterium
RIIDRLFAGLVSYDAKGKPSL

SEQ ID NO: 1094175 - protein, 19 aa, Mycobacterium
RIRIAAGIAALAVAVSGCS

SEQ ID NO: 1094176 - protein, 19 aa, Mycobacterium
RIRPRRRPRRVVLLCDVSR

SEQ ID NO: 1094177 - protein, 24 aa, Mycobacterium
RKLQLPRDAVLVTILRGPRVIVPQ

SEQ ID NO: 1094178 - protein, 19 aa, Mycobacterium
RLARLTRLAGLTGGSAGAR

SEQ ID NO: 1094179 - protein, 19 aa, Mycobacterium
RLFASFTQQWRQCEGRTVT

SEQ ID NO: 1094180 - protein, 19 aa, Mycobacterium
RLHNGTVWQWNRPVYDVQG

SEQ ID NO: 1094181 - protein, 19 aa, Mycobacterium
RLHVRYDLSWQALDGALAR

SEQ ID NO: 1094182 - protein, 20 aa, Mycobacterium
RLPRTANGKLLRSALRGQTP

SEQ ID NO: 1094183 - protein, 20 aa, Mycobacterium
RLRIDLSALRAIGDGLAWAP

SEQ ID NO: 1094184 - protein, 23 aa, Mycobacterium
RLRKGSLIPLSRGGAYPSTEQTL

SEQ ID NO: 1094185 - protein, 27 aa, Mycobacterium
RLSALSNLYAPFVKLTAGTSISGSAGI

SEQ ID NO: 1094186 - protein, 21 aa, Mycobacterium
RNGRRLVIAMMYGLVKEGGPT

SEQ ID NO: 1094187 - protein, 18 aa, Mycobacterium
RPAVSPPISQPPAGVVRP

SEQ ID NO: 1094188 - protein, 24 aa, Mycobacterium
RPDYIPPQAIPPQQAPPAAAPPAQ

SEQ ID NO: 1094189 - protein, 30 aa, Mycobacterium; identical to SEQ ID NO: 949840

SEQ ID NO: 1094190 - protein, 18 aa, Mycobacterium
RPTGSFMFLGPTGVGKTE

SEQ ID NO: 1094191 - protein, 29 aa, Mycobacterium
RPVGYPGSLLLDLLWPRGSSRPVAASVPE

SEQ ID NO: 1094192 - protein, 18 aa, Mycobacterium
RQLRAIWVGGRVPPAGAI

SEQ ID NO: 1094193 - protein, 22 aa, Mycobacterium
RRGLFAALVAVGLPGLALVTVA

SEQ ID NO: 1094194 - protein, 25 aa, Mycobacterium
RRHFDWVRSWYDFAVPGIGNSALIE

SEQ ID NO: 1094195 - protein, 17 aa, Mycobacterium
RRRDVREPRWTWRLRRR

SEQ ID NO: 1094196 - protein, 20 aa, Mycobacterium
RRRFRGLVRDAWPPSARAQP

SEQ ID NO: 1094197 - protein, 30 aa, Mycobacterium
RRRGAHRVVVAPWFLAHGRLPDRVQRFAAD

SEQ ID NO: 1094198 - protein, 19 aa, Mycobacterium
RRSIRYALAALCAVTLVSS

SEQ ID NO: 1094199 - protein, 18 aa, Mycobacterium
RRTPILRGATLGGSGAVN

SEQ ID NO: 1094200 - protein, 26 aa, Mycobacterium
RSAQPSYFAFWEAKGVNVNPFFAVLS

SEQ ID NO: 1094201 - protein, 26 aa, Mycobacterium
RSLFDTNFFGLIRLTNEVLPHMRRRG

SEQ ID NO: 1094202 - protein, 25 aa, Mycobacterium
RSMQPYAAIYLHLMRALVARQPGIR

SEQ ID NO: 1094203 - protein, 21 aa, Mycobacterium
RSRKNFVVLVSWFSEADQAVD

SEQ ID NO: 1094204 - protein, 26 aa, Mycobacterium
RSSGNLLYLLLAHPDQFMAVRAHREL

SEQ ID NO: 1094205 - protein, 25 aa, Mycobacterium
RSVFAGVAVLVSAALVVTGCSRSIG

SEQ ID NO: 1094206 - protein, 23 aa, Mycobacterium
RSWLAAILIPVAVLAVACGGSSA

SEQ ID NO: 1094207 - protein, 18 aa, Mycobacterium
RTFFIALSAIVTTAGFGS

SEQ ID NO: 1094208 - protein, 18 aa, Mycobacterium
RTKGISIRRAPAPSWSHF

SEQ ID NO: 1094209 - protein, 17 aa, Mycobacterium
RTQQTAAPLAALYGITD

SEQ ID NO: 1094210 - protein, 26 aa, Mycobacterium
RTVSGQLMLLVPFIERVRARVDLRER

SEQ ID NO: 1094211 - protein, 27 aa, Mycobacterium
RVAEFHAQFERVFAAGVQAYSGAEAAN

SEQ ID NO: 1094212 - protein, 46 aa, Mycobacterium
RVAGATTALPPPGPAAAAALPGAAAVGFPVLHIGNIGFANLSVGNI

SEQ ID NO: 1094213 - protein, 27 aa, Mycobacterium
RVARLNAYFGPLLQSLPAFGQMAVLAV

SEQ ID NO: 1094214 - protein, 18 aa, Mycobacterium
RVDPADLLGPIWRRNEVF

SEQ ID NO: 1094215 - protein, 18 aa, Mycobacterium
RVFNQGIHWSPWLDLMVN

SEQ ID NO: 1094216 - protein, 25 aa, Mycobacterium
RVGGLIARVQLPPAPIGAVQALREA

SEQ ID NO: 1094217 - protein, 17 aa, Mycobacterium
RVHTNAPPFLVIHGSRD

SEQ ID NO: 1094218 - protein, 26 aa, Mycobacterium
RVIAVEGAYLRRALPDHTPAAIRSGI

SEQ ID NO: 1094219 - protein, 26 aa, Mycobacterium
RVIDPRLRTLAIRPTLRRLAGLPTAQ

SEQ ID NO: 1094220 - protein, 17 aa, Mycobacterium
RVLELDNIEIVRGLVIE

SEQ ID NO: 1094221 - protein, 19 aa, Mycobacterium
RVLLMALVATNFFGQNTPA

SEQ ID NO: 1094222 - protein, 18 aa, Mycobacterium
RVSGLLRIDEVAIAIGHQ

SEQ ID NO: 1094223 - protein, 19 aa, Mycobacterium
RVWVWSPTNPGASDPAAMI

SEQ ID NO: 1094224 - protein, 17 aa, Mycobacterium
RWDGWDPTLPQIPSANI

SEQ ID NO: 1094225 - protein, 19 aa, Mycobacterium
RYFVPRFAATPITSATERA

SEQ ID NO: 1094226 - protein, 23 aa, Mycobacterium
RYITARFLPDKAIDLVDEAASRL

SEQ ID NO: 1094227 - protein, 28 aa, Mycobacterium
SAAASALAPWKQVLRNLGIDIGKNGQIN

SEQ ID NO: 1094228 - protein, 22 aa, Mycobacterium
SAAIATLAFRPGAAVPGDQRSG

SEQ ID NO: 1094229 - protein, 24 aa, Mycobacterium
SAAPPGVETWYRGAARISDLVDQI

SEQ ID NO: 1094230 - protein, 18 aa, Mycobacterium
SAARALGRYGVCANAICP

SEQ ID NO: 1094231 - protein, 21 aa, Mycobacterium
SADDIFWLSNAYLAAYADSGR

SEQ ID NO: 1094232 - protein, 27 aa, Mycobacterium
SADIAALFSDHALQYQAVSAEAVAFHG

SEQ ID NO: 1094233 - protein, 29 aa, Mycobacterium
SADLRVGQPLLAIGSPLGLAGTVTTGIVS

SEQ ID NO: 1094234 - protein, 22 aa, Mycobacterium
SAEGRWSIPWAWNSAGTYRVFA

SEQ ID NO: 1094235 - protein, 30 aa, Mycobacterium; identical to SEQ ID NO: 859375

SEQ ID NO: 1094236 - protein, 25 aa, Mycobacterium
SAGGLPPVPVVLPKPVRQLEQTVTQ

SEQ ID NO: 1094237 - protein, 19 aa, Mycobacterium
SAMTFFDFAAAHAAAAQGG

SEQ ID NO: 1094238 - protein, 24 aa, Mycobacterium
SAPTLAAATAWDGLVAELGEAAEA

SEQ ID NO: 1094239 - protein, 21 aa, Mycobacterium
SARWFPVFPAPAWLTRRLVTM

SEQ ID NO: 1094240 - protein, 25 aa, Mycobacterium
SATSTSVLARIFAAGAAGAARAAGT

SEQ ID NO: 1094241 - protein, 33 aa, Mycobacterium; identical to SEQ ID NO: 950228

SEQ ID NO: 1094242 - protein, 21 aa, Mycobacterium
SAVLLAWPAAAEPPSCASLGG

SEQ ID NO: 1094243 - protein, 18 aa, Mycobacterium
SCLGLLSDRILSAELGLA

SEQ ID NO: 1094244 - protein, 20 aa, Mycobacterium
SCYWERLRGVGGTLDEVIAN

SEQ ID NO: 1094245 - protein, 17 aa, Mycobacterium
SDAAGVVGWWINPQASG

SEQ ID NO: 1094246 - protein, 19 aa, Mycobacterium
SDAAGVVGWWVNPQAPGID

SEQ ID NO: 1094247 - protein, 25 aa, Mycobacterium
SDDMPGFGLVMFGAIREAGAAAGPA

SEQ ID NO: 1094248 - protein, 34 aa, Mycobacterium
SDGDIWDWAVDWGTWLSMSALPAPSARTPGTQIP

SEQ ID NO: 1094249 - protein, 21 aa, Mycobacterium
SDHPEWALPTTWTVVAGRPVL

SEQ ID NO: 1094250 - protein, 30 aa, Mycobacterium; identical to SEQ ID NO: 950252

SEQ ID NO: 1094251 - protein, 19 aa, Mycobacterium
SDTAPPPSPILTAGSDQPE

SEQ ID NO: 1094252 - protein, 25 aa, Mycobacterium
SDYDGFTLAGIPSGGLFSGAEVKMT

SEQ ID NO: 1094253 - protein, 18 aa, Mycobacterium
SEDWLRPDYIPPQAIPPQ

SEQ ID NO: 1094254 - protein, 24 aa, Mycobacterium
SEGIQQLIFSPKGPLADVRNRRAV

SEQ ID NO: 1094255 - protein, 36 aa, Mycobacterium; identical to SEQ ID NO: 950284

SEQ ID NO: 1094256 - protein, 37 aa, Mycobacterium; identical to SEQ ID NO: 950285

SEQ ID NO: 1094257 - protein, 17 aa, Mycobacterium
SEPEVFDFPDGIGPVEC

SEQ ID NO: 1094258 - protein, 24 aa, Mycobacterium
SEQTRLIFPKVWGGGPSPMLDEPG

SEQ ID NO: 1094259 - protein, 18 aa, Mycobacterium
SEVAAREPVLLWGDARVG

SEQ ID NO: 1094260 - protein, 23 aa, Mycobacterium
SEVVTKLIRWTGFSPDKVARICL

SEQ ID NO: 1094261 - protein, 27 aa, Mycobacterium
SFAAITVGLVGEAWQGAAATAMAAAAR

SEQ ID NO: 1094262 - protein, 20 aa, Mycobacterium
SFGTDWSWVGPARDAGIHTV

SEQ ID NO: 1094263 - protein, 31 aa, Mycobacterium
SFVFRHRAGNAVILVLMLVAATQLFVLQVSN

SEQ ID NO: 1094264 - protein, 25 aa, Mycobacterium
SGAAGAPGGWLLGDGGAGGSAAATP

SEQ ID NO: 1094265 - protein, 27 aa, Mycobacterium
SGAALTGPATFAALTAGAAVAALAAGA

SEQ ID NO: 1094266 - protein, 23 aa, Mycobacterium
SGCSGWRGLNSLPLPGVQGGGPG

SEQ ID NO: 1094267 - protein, 31 aa, Mycobacterium
SGDFSMLTYNIAGLPFPLSSAMLPRFLYTKE

SEQ ID NO: 1094268 - protein, 20 aa, Mycobacterium
SGGLQFTASTWRASGGAGSA

SEQ ID NO: 1094269 - protein, 26 aa, Mycobacterium
SGGSCVAFDFVGFAAAHGGAGGTGGA

SEQ ID NO: 1094270 - protein, 18 aa, Mycobacterium
SGLPAVGLPLTPGNLPVA

SEQ ID NO: 1094271 - protein, 26 aa, Mycobacterium
SGLYTSGPALLPWEAARPSGMQGALA

SEQ ID NO: 1094272 - protein, 20 aa, Mycobacterium
SGTTPLFGAYSGGAGGDGGA

SEQ ID NO: 1094273 - protein, 27 aa, Mycobacterium
SGVAGTWNMRWADLSLPPQAAVIVAAA

SEQ ID NO: 1094274 - protein, 23 aa, Mycobacterium
SGVAPKMFLPNLAGLNEGPGFPN

SEQ ID NO: 1094275 - protein, 23 aa, Mycobacterium
SGVVLYLQPPGPPRACGLFASDE

SEQ ID NO: 1094276 - protein, 19 aa, Mycobacterium
SGYVGIAFGQGGAGGIGGA

SEQ ID NO: 1094277 - protein, 39 aa, Mycobacterium
SHVDEWRATFNVNLFGAVALTLALLPAPRSARGQVVFIN

SEQ ID NO: 1094278 - protein, 18 aa, Mycobacterium
SIITIQISNGIPPAPPPP

SEQ ID NO: 1094279 - protein, 24 aa, Mycobacterium
SITREYVLGGPVTRRYAGYVNYNG

SEQ ID NO: 1094280 - protein, 20 aa, Mycobacterium
SIVAILVLTLGTAVFVGAEF

SEQ ID NO: 1094281 - protein, 26 aa, Mycobacterium
SIVVLDPWGHFDGLRAWLSELADTGY

SEQ ID NO: 1094282 - protein, 20 aa, Mycobacterium
SLIDITRFWFEQGSLANERK

SEQ ID NO: 1094283 - protein, 19 aa, Mycobacterium
SLLPGAAQPGAVPGAAQPG

SEQ ID NO: 1094284 - protein, 19 aa, Mycobacterium
SLMAVARKDLVLSGGWDED

SEQ ID NO: 1094285 - protein, 30 aa, Mycobacterium
SLPLQDASMLMYPFSMAMSPLMNLMSSSLR

SEQ ID NO: 1094286 - protein, 27 aa, Mycobacterium
SLQGKPAVLWFWTPWCPFCNAEGPAAS

SEQ ID NO: 1094287 - protein, 29 aa, Mycobacterium
SLQTLGQDLLGMVNALAAAVLGRPLIGNG

SEQ ID NO: 1094288 - protein, 19 aa, Mycobacterium
SLRQRGIAWIRADGRRRAE

SEQ ID NO: 1094289 - protein, 20 aa, Mycobacterium
SLSVMRIRRSIRYALAALCA

SEQ ID NO: 1094290 - protein, 18 aa, Mycobacterium
SLVIALAGPAALRGIIAT

SEQ ID NO: 1094291 - protein, 25 aa, Mycobacterium
SNAMFLCDALDKVGIEAQFVARGEY

SEQ ID NO: 1094292 - protein, 23 aa, Mycobacterium
SNHISWLDVFAIGAVLPGSFVAR

SEQ ID NO: 1094293 - protein, 24 aa, Mycobacterium
SNVGLGNAGLLNTGSFNSGKFNTG

SEQ ID NO: 1094294 - protein, 19 aa, Mycobacterium
SPEDFWRSAGLPEYRFPDP

SEQ ID NO: 1094295 - protein, 26 aa, Mycobacterium
SPQAQRMLKFAFNLLDDGLVGQQLFA

SEQ ID NO: 1094296 - protein, 18 aa, Mycobacterium
SPQLLIDGLSMQRVMVHQ

SEQ ID NO: 1094297 - protein, 24 aa, Mycobacterium
SQAAHLVMLFQQNLAELVIKGDST

SEQ ID NO: 1094298 - protein, 25 aa, Mycobacterium
SQAGDLLGIALLTSAKPDPAAGPGV

SEQ ID NO: 1094299 - protein, 24 aa, Mycobacterium
SQAPLQQTPLPQTPLRQAPLQQVP

SEQ ID NO: 1094300 - protein, 26 aa, Mycobacterium
SQPSYVLLRVLIDEGPLPLSRLARLA

SEQ ID NO: 1094301 - protein, 24 aa, Mycobacterium
SQTYHVMFYALRGVVLECATNLTG

SEQ ID NO: 1094302 - protein, 26 aa, Mycobacterium
SRRPGTFGVIFALIAVLASACQGGPS

SEQ ID NO: 1094303 - protein, 41 aa, Mycobacterium
SRTTPPTLRPRWPPIRPAAPNGPAIWYCGPVSAATSSTPRT

SEQ ID NO: 1094304 - protein, 26 aa, Mycobacterium
SSAIVTVLLALVFGPANAAAADDKVP

SEQ ID NO: 1094305 - protein, 26 aa, Mycobacterium
SSIAERIPLPGRRPARRSSSRPVRSQ

SEQ ID NO: 1094306 - protein, 31 aa, Mycobacterium
SSNLALDRFADFPTLPLDPSAMVAQVGPQVV

SEQ ID NO: 1094307 - protein, 31 aa, Mycobacterium; identical to SEQ ID NO: 950637

SEQ ID NO: 1094308 - protein, 18 aa, Mycobacterium
SSQFVSGLLLSGASFTDG

SEQ ID NO: 1094309 - protein, 25 aa, Mycobacterium
STAAAAILGLLAPGGRITAGRIIFD

SEQ ID NO: 1094310 - protein, 24 aa, Mycobacterium
STEYDVERYFRDAPLMIVGEGTNE

SEQ ID NO: 1094311 - protein, 24 aa, Mycobacterium
STGDGIALALWAGVAVSDLEFIQF

SEQ ID NO: 1094312 - protein, 17 aa, Mycobacterium
STLCLDVDWVLGSCMSV

SEQ ID NO: 1094313 - protein, 27 aa, Mycobacterium
STRTRIRPHFFPFTEPSAEVDVWFASK

SEQ ID NO: 1094314 - protein, 28 aa, Mycobacterium
STTTTPPPPPPIAPAALAGLLLDTDTIN

SEQ ID NO: 1094315 - protein, 25 aa, Mycobacterium
SVAAALVPFSLPPVDLAGLASQIGT

SEQ ID NO: 1094316 - protein, 25 aa, Mycobacterium
SVAWAETYPGTLSYYLATAFREIWM

SEQ ID NO: 1094317 - protein, 27 aa, Mycobacterium
SVEATMEGLWWDRPFALDSVDISASVA

SEQ ID NO: 1094318 - protein, 27 aa, Mycobacterium
SVFGDALGVFSPFVCYGPLARSVRDLF

SEQ ID NO: 1094319 - protein, 24 aa, Mycobacterium
SVGALSVPVGWTTAAPAATGGAAS

SEQ ID NO: 1094320 - protein, 23 aa, Mycobacterium
SVLAIEPMLTLGTRKTVVLDDQW

SEQ ID NO: 1094321 - protein, 21 aa, Mycobacterium
SVLGVERIGIYGHSRACAWAV

SEQ ID NO: 1094322 - protein, 21 aa, Mycobacterium
SVLPPLPPQFAADLLVKTVAM

SEQ ID NO: 1094323 - protein, 18 aa, Mycobacterium
SVLRILRTDIYAPTGAVM

SEQ ID NO: 1094324 - protein, 19 aa, Mycobacterium
SVNRDLAFSELGFDSQMTV

SEQ ID NO: 1094325 - protein, 25 aa, Mycobacterium
SVPNPFAVSYYLLKGSLQAPYGAAV

SEQ ID NO: 1094326 - protein, 27 aa, Mycobacterium
SVTVMALIVLLLLNATMTPVFTADGLR

SEQ ID NO: 1094327 - protein, 22 aa, Mycobacterium
SWLEVPLVMRDGFGLRLELKLP

SEQ ID NO: 1094328 - protein, 23 aa, Mycobacterium
SYAWDMGASDWPAARRLRFANDP

SEQ ID NO: 1094329 - protein, 25 aa, Mycobacterium
TAAELNFRPWRAGLSYIATGNGCAL

SEQ ID NO: 1094330 - protein, 21 aa, Mycobacterium
TAAEVPLAFALAAGSFRDATR

SEQ ID NO: 1094331 - protein, 24 aa, Mycobacterium
TAAPLPGLGFTQPLPAQAAQHVAA

SEQ ID NO: 1094332 - protein, 17 aa, Mycobacterium
TAARLGGVAVILPALDL

SEQ ID NO: 1094333 - protein, 22 aa, Mycobacterium
TAASLGLAALGFAATATATAGS

SEQ ID NO: 1094334 - protein, 26 aa, Mycobacterium
TADATIATIVSIGTGLRTGSTGGAVP

SEQ ID NO: 1094335 - protein, 17 aa, Mycobacterium
TADLYPRYTCDYGTPSH

SEQ ID NO: 1094336 - protein, 26 aa, Mycobacterium
TADRDGLARRDWLVEQLDALVGRAAI

SEQ ID NO: 1094337 - protein, 19 aa, Mycobacterium
TAFAAVVPPPLIATNLAEL

SEQ ID NO: 1094338 - protein, 17 aa, Mycobacterium
TAFAMTVPPPMIAANRA

SEQ ID NO: 1094339 - protein, 26 aa, Mycobacterium
TAIALGWGQSLFRNVQRLPLVGSWVR

SEQ ID NO: 1094340 - protein, 17 aa, Mycobacterium
TAIATAAADDVSAAIAA

SEQ ID NO: 1094341 - protein, 25 aa, Mycobacterium
TAIVNILRILLSNPAVWEKTALIVS

SEQ ID NO: 1094342 - protein, 22 aa, Mycobacterium
TALVAKLLVGAAVAVGFGVSAA

SEQ ID NO: 1094343 - protein, 17 aa, Mycobacterium
TAMLRRARELASEADMD

SEQ ID NO: 1094344 - protein, 23 aa, Mycobacterium
TAPNRLYWLSAWIDRDGTNGGPL

SEQ ID NO: 1094345 - protein, 19 aa, Mycobacterium
TARLLLRSMGYRDALIGGL

SEQ ID NO: 1094346 - protein, 23 aa, Mycobacterium
TARPRLAPPVPSIPGRRGKPTIA

SEQ ID NO: 1094347 - protein, 32 aa, Mycobacterium
TASLSMAAAAQPLLAWLSYTAESSALAAAQAA

SEQ ID NO: 1094348 - protein, 28 aa, Mycobacterium
TAVESPAPPAFLLLGPDALMAYRHIAQR

SEQ ID NO: 1094349 - protein, 33 aa, Mycobacterium; identical to SEQ ID NO: 864943

SEQ ID NO: 1094350 - protein, 23 aa, Mycobacterium
TDLQSLFVPQAPGPTPGSPPGYG

SEQ ID NO: 1094351 - protein, 24 aa, Mycobacterium
TEEQRQRFLPRMATGESRGAFSMS

SEQ ID NO: 1094352 - protein, 20 aa, Mycobacterium
TEILTWYREGARRPVRVNLA

SEQ ID NO: 1094353 - protein, 24 aa, Mycobacterium
TEPPTPGRYLLYLDFQVNGRVHTA

SEQ ID NO: 1094354 - protein, 23 aa, Mycobacterium
TETLEPVQMLPAPAQGALAIECR

SEQ ID NO: 1094355 - protein, 24 aa, Mycobacterium
TETPTLLRRSGLGSHPRLGRNLAL

SEQ ID NO: 1094356 - protein, 17 aa, Mycobacterium
TFAKPYAEWRGMFAGNG

SEQ ID NO: 1094357 - protein, 19 aa, Mycobacterium
TFNHMELVKYLAGGSSASS

SEQ ID NO: 1094358 - protein, 23 aa, Mycobacterium
TFVGAICRWQAANPAGLIDITRY

SEQ ID NO: 1094359 - protein, 22 aa, Mycobacterium
TGDGIALALWAGVTVSDLEFIQ

SEQ ID NO: 1094360 - protein, 25 aa, Mycobacterium
TGEAIKDVLLDSAALAKILGQDFTA

SEQ ID NO: 1094361 - protein, 18 aa, Mycobacterium
TGLAMAAHPWVRTVWWPR

SEQ ID NO: 1094362 - protein, 18 aa, Mycobacterium
TGLPMWQVEVLDGDPAAP

SEQ ID NO: 1094363 - protein, 26 aa, Mycobacterium
TGNTDYYMYLTQDLPLVQPIRDIPYA

SEQ ID NO: 1094364 - protein, 20 aa, Mycobacterium
TGPPLFMVLFRLSRADASQE

SEQ ID NO: 1094365 - protein, 24 aa, Mycobacterium
TGQPWVVSFQLNWPRDHGPNVTGW

SEQ ID NO: 1094366 - protein, 29 aa, Mycobacterium
TGSGLLVPIHWGTFRLAPHPWAEPVERLL

SEQ ID NO: 1094367 - protein, 17 aa, Mycobacterium
TGTGWINYLGHENPIEG

SEQ ID NO: 1094368 - protein, 35 aa, Mycobacterium; identical to SEQ ID NO: 951007

SEQ ID NO: 1094369 - protein, 19 aa, Mycobacterium
THARTIIPKAWDVPPRADG

SEQ ID NO: 1094370 - protein, 31 aa, Mycobacterium
TIAWALQDGLASYFWQHNWGSPKGYTHPAAN

SEQ ID NO: 1094371 - protein, 18 aa, Mycobacterium
TICDDYYCSMLTGTAPNR

SEQ ID NO: 1094372 - protein, 19 aa, Mycobacterium
TIKVLLALVALDELNLNST

SEQ ID NO: 1094373 - protein, 23 aa, Mycobacterium
TILRGGVPMLLIRGQMSDLVSQE

SEQ ID NO: 1094374 - protein, 19 aa, Mycobacterium
TISFIDWTGLVRSEGTVIK

SEQ ID NO: 1094375 - protein, 26 aa, Mycobacterium
TITVGTFVAFWSCLTLVSRPACDLAG

SEQ ID NO: 1094376 - protein, 23 aa, Mycobacterium
TLAAAAAWDALAADLASAAQSFA

SEQ ID NO: 1094377 - protein, 24 aa, Mycobacterium
TLGPIDSAPFYAVPIRVGAMGTKG

SEQ ID NO: 1094378 - protein, 24 aa, Mycobacterium
TLGSGVLAPALWSVVEAFVGDLWP

SEQ ID NO: 1094379 - protein, 19 aa, Mycobacterium
TLLADIYVAALRSYGFPAR

SEQ ID NO: 1094380 - protein, 17 aa, Mycobacterium
TLQPYLGAYGHLVVLRE

SEQ ID NO: 1094381 - protein, 19 aa, Mycobacterium
TMCRISMQPLIEQVGQRPY

SEQ ID NO: 1094382 - protein, 19 aa, Mycobacterium
TNFYNIYDPAQGTLNGLLS

SEQ ID NO: 1094383 - protein, 29 aa, Mycobacterium
TNNSVFSFPMEFTPFPPPQQSWQLSKRTA

SEQ ID NO: 1094384 - protein, 22 aa, Mycobacterium
TNTDTIILVRIPNNGRSATAIS

SEQ ID NO: 1094385 - protein, 28 aa, Mycobacterium
TNTNQPLPLASIFKLYVLHALADAIKSG

SEQ ID NO: 1094386 - protein, 39 aa, Mycobacterium
TPAEGVLVWSMGRSDWNCDYGLAVVPRAALVISACDQNS

SEQ ID NO: 1094387 - protein, 24 aa, Mycobacterium
TPASSYWMVEKMQEIFPPGVCNLV

SEQ ID NO: 1094388 - protein, 19 aa, Mycobacterium
TPGNLPVAAGPLPGPARAN

SEQ ID NO: 1094389 - protein, 24 aa, Mycobacterium
TPPDGVTGPLLLAPSDDSPGCTPS

SEQ ID NO: 1094390 - protein, 24 aa, Mycobacterium
TQLGDLHWFYVYSGVMWACVFMRT

SEQ ID NO: 1094391 - protein, 24 aa, Mycobacterium
TQRPSTMWAQYGLAGVLEYEHFVR

SEQ ID NO: 1094392 - protein, 25 aa, Mycobacterium
TQTYLPWDSWDHPYTKPPKVWFSDL

SEQ ID NO: 1094393 - protein, 21 aa, Mycobacterium
TQVGTPYAWGGAAPGGFDCSG

SEQ ID NO: 1094394 - protein, 18 aa, Mycobacterium
TRMYNWECWIYGSDTTAN

SEQ ID NO: 1094395 - protein, 25 aa, Mycobacterium
TRQDQPIHYLLADTFTICDGYHCSL

SEQ ID NO: 1094396 - protein, 17 aa, Mycobacterium
TRQRQGWGAWPVCSGRA

SEQ ID NO: 1094397 - protein, 19 aa, Mycobacterium
TRRVLTLAKALDISIGGRV

SEQ ID NO: 1094398 - protein, 23 aa, Mycobacterium
TRSAIVALALAWAAAVVAAQCWL

SEQ ID NO: 1094399 - protein, 19 aa, Mycobacterium
TSCPFAEQVRLAYGAGAPA

SEQ ID NO: 1094400 - protein, 25 aa, Mycobacterium
TSNPLTAIPPLGQPYIQAALDAAAP

SEQ ID NO: 1094401 - protein, 23 aa, Mycobacterium
TSPNRLYWMSAWVDPNGEQGGPL

SEQ ID NO: 1094402 - protein, 25 aa, Mycobacterium
TSSYGRGFLTPRDSLRQRCVTHQIT

SEQ ID NO: 1094403 - protein, 24 aa, Mycobacterium
TSTAELVALLYQAIPAPARRIGGH

SEQ ID NO: 1094404 - protein, 17 aa, Mycobacterium
TSVIPRYGVRLTVMARP

SEQ ID NO: 1094405 - protein, 23 aa, Mycobacterium
TTEGYRAGLLASIAAYCAPCPTG

SEQ ID NO: 1094406 - protein, 25 aa, Mycobacterium
TTGAKRIRAGFPADWRVIDKTGSGE

SEQ ID NO: 1094407 - protein, 17 aa, Mycobacterium
TTGILAAGADDVSTAIA

SEQ ID NO: 1094408 - protein, 24 aa, Mycobacterium
TTHAMLRSLFRVGLDPRNVAVIGK

SEQ ID NO: 1094409 - protein, 23 aa, Mycobacterium
TTNAIGSGFYTPGNFFGTMCDFF

SEQ ID NO: 1094410 - protein, 32 aa, Mycobacterium
TTNLRRRGDRWYWHWDPRFISGTAAFLPIEVT

SEQ ID NO: 1094411 - protein, 25 aa, Mycobacterium
TTSGFYHELGHATLSIYELAFTGRE

SEQ ID NO: 1094412 - protein, 25 aa, Mycobacterium
TTVLLAQMFAAGVRRLVLASSMVVY

SEQ ID NO: 1094413 - protein, 20 aa, Mycobacterium
TVCALTAFLLVAVFGQVRFG

SEQ ID NO: 1094414 - protein, 24 aa, Mycobacterium
TVGLNGWYLMYQAPGGLNASMRPS

SEQ ID NO: 1094415 - protein, 23 aa, Mycobacterium
TVPPYRVPFPQVMPSQETSPTRG

SEQ ID NO: 1094416 - protein, 19 aa, Mycobacterium
TVTSWMLQLAKQVFALFAP

SEQ ID NO: 1094417 - protein, 18 aa, Mycobacterium
TVVAKLLMLFGTDEQKST

SEQ ID NO: 1094418 - protein, 18 aa, Mycobacterium
TVVLPDAPVKIFLTASPE

SEQ ID NO: 1094419 - protein, 18 aa, Mycobacterium
TVVVPWSPPSPSAAEVAA

SEQ ID NO: 1094420 - protein, 23 aa, Mycobacterium
TYQYLDMHMAIASALSMYDNVLA

SEQ ID NO: 1094421 - protein, 21 aa, Mycobacterium
VAAALPTTGILAAGADDVSTA

SEQ ID NO: 1094422 - protein, 17 aa, Mycobacterium
VAALTAGGGLYSSAEAA

SEQ ID NO: 1094423 - protein, 18 aa, Mycobacterium
VAALVGGLYVLFSGGESG

SEQ ID NO: 1094424 - protein, 22 aa, Mycobacterium
VAAPPVRLLPANLAPDAVGALY

SEQ ID NO: 1094425 - protein, 22 aa, Mycobacterium
VAARRWPLIAALGHAVTLTIRG

SEQ ID NO: 1094426 - protein, 22 aa, Mycobacterium
VAATIAERLAIIDPAHAAEYRT

SEQ ID NO: 1094427 - protein, 18 aa, Mycobacterium
VAAVFLRELLAEDLQPVV

SEQ ID NO: 1094428 - protein, 25 aa, Mycobacterium
VAENIRYKAWLAEAALVCDEAAAAL

SEQ ID NO: 1094429 - protein, 21 aa, Mycobacterium
VAGAMFLGAAGFASAVAGADP

SEQ ID NO: 1094430 - protein, 17 aa, Mycobacterium
VAGPNWMLIGDAAACVN

SEQ ID NO: 1094431 - protein, 26 aa, Mycobacterium
VAKLSYLRVPALKALFPDYRGSALEA

SEQ ID NO: 1094432 - protein, 30 aa, Mycobacterium; identical to SEQ ID NO: 951580

SEQ ID NO: 1094433 - protein, 22 aa, Mycobacterium
VASITWQAMLLRGARPRLTPIV

SEQ ID NO: 1094434 - protein, 18 aa, Mycobacterium
VAVLIAMLSAPDAAADAG

SEQ ID NO: 1094435 - protein, 24 aa, Mycobacterium
VAVLLAFLAPRFLPRGPRGALASG

SEQ ID NO: 1094436 - protein, 27 aa, Mycobacterium
VAVMRRMRATLAVVAVLLAVSPVAACG

SEQ ID NO: 1094437 - protein, 29 aa, Mycobacterium
VAVSDLEFIQFHPTMLFAAGTGTGGRRPL

SEQ ID NO: 1094438 - protein, 21 aa, Mycobacterium
VAYLLIGVLHVRPLASNYALT

SEQ ID NO: 1094439 - protein, 20 aa, Mycobacterium
VAYQLAFHEGSRYPLDRGAA

SEQ ID NO: 1094440 - protein, 21 aa, Mycobacterium
VCKFALAPALFGLGTLAESVD

SEQ ID NO: 1094441 - protein, 25 aa, Mycobacterium
VCVELPLKLVPSPAPDRHPPAGATS

SEQ ID NO: 1094442 - protein, 25 aa, Mycobacterium
VDAKGNTIAWLYSQRRFEVPSDKIA

SEQ ID NO: 1094443 - protein, 21 aa, Mycobacterium
VDAMFVARPPPDATIIIIGAN

SEQ ID NO: 1094444 - protein, 17 aa, Mycobacterium
VDCGLAGTVLRFAPPLA

SEQ ID NO: 1094445 - protein, 25 aa, Mycobacterium
VDDNPYAVTWLIDSRQDRTGADPTP

SEQ ID NO: 1094446 - protein, 29 aa, Mycobacterium
VDHYAEIGLLGFALITDALGGVDVCLNGP

SEQ ID NO: 1094447 - protein, 17 aa, Mycobacterium
VDMAIKLGLRSYANPGT

SEQ ID NO: 1094448 - protein, 18 aa, Mycobacterium
VDRYLSQLPTTSRLAVRA

SEQ ID NO: 1094449 - protein, 20 aa, Mycobacterium
VDTSSFYRPTQDGAYPIVLV

SEQ ID NO: 1094450 - protein, 25 aa, Mycobacterium
VEAAKILEFAPGELKNLPGYEGSNN

SEQ ID NO: 1094451 - protein, 24 aa, Mycobacterium
VEAQRLWAQAGFRPVDPAVVVEFR

SEQ ID NO: 1094452 - protein, 24 aa, Mycobacterium
VEKAVAFAAANKLKIAPRGGGHSY

SEQ ID NO: 1094453 - protein, 25 aa, Mycobacterium
VEQIARLWNTTWDLKRGVDLKHFPS

SEQ ID NO: 1094454 - protein, 18 aa, Mycobacterium
VETAFRQLAPRPVTAAWG

SEQ ID NO: 1094455 - protein, 17 aa, Mycobacterium
VFDFPDGIGPVECVNVE

SEQ ID NO: 1094456 - protein, 21 aa, Mycobacterium
VFEHRCPLCAEPVRWRLVGEE

SEQ ID NO: 1094457 - protein, 28 aa, Mycobacterium
VFGVLLAVVTVPFVSLGPGPTFDTLGEV

SEQ ID NO: 1094458 - protein, 21 aa, Mycobacterium
VFLAVLVIFAIIVVAKSVALI

SEQ ID NO: 1094459 - protein, 22 aa, Mycobacterium
VFPTPPALIVAAGTDALSVAIN

SEQ ID NO: 1094460 - protein, 27 aa, Mycobacterium
VGAFDIALFGWVGDAFPLSSLTQIYMS

SEQ ID NO: 1094461 - protein, 17 aa, Mycobacterium
VGAICRWQAANPASLID

SEQ ID NO: 1094462 - protein, 29 aa, Mycobacterium
VGFAAIVFLVWRYVVPPVRRMMAARQDTV

SEQ ID NO: 1094463 - protein, 17 aa, Mycobacterium
VGFVGWRLYQKLTNNTV

SEQ ID NO: 1094464 - protein, 22 aa, Mycobacterium
VGHAFQLLEYPQPVSQPVAEPA

SEQ ID NO: 1094465 - protein, 18 aa, Mycobacterium
VGLPLTPGNLPVAAGPLP

SEQ ID NO: 1094466 - protein, 25 aa, Mycobacterium
VGRLKRPWLEGYLGPDVMDLNRRIK

SEQ ID NO: 1094467 - protein, 25 aa, Mycobacterium
VGSTQQIAWVRYYSQMRDLVATLQA

SEQ ID NO: 1094468 - protein, 23 aa, Mycobacterium
VGVSSRLRLTGVAAVAAGAPITP

SEQ ID NO: 1094469 - protein, 24 aa, Mycobacterium
VIAARLPCHDWPDRALRVTAIDVS

SEQ ID NO: 1094470 - protein, 25 aa, Mycobacterium
VIATEPVVHYLLAASGLVNRTPAAF

SEQ ID NO: 1094471 - protein, 24 aa, Mycobacterium
VIQQYLVRIRSVNPALNALVEAED

SEQ ID NO: 1094472 - protein, 17 aa, Mycobacterium
VITDLDKRTRQQIDTGV

SEQ ID NO: 1094473 - protein, 18 aa, Mycobacterium
VITELFLDALREPRIPGV

SEQ ID NO: 1094474 - protein, 26 aa, Mycobacterium
VIVTEPVVHYLLQASGLVNRTPPAFT

SEQ ID NO: 1094475 - protein, 19 aa, Mycobacterium
VKAGHTYTARQLLDGLLLV

SEQ ID NO: 1094476 - protein, 20 aa, Mycobacterium
VKIPGGALCGKLAVPVDYRQ

SEQ ID NO: 1094477 - protein, 18 aa, Mycobacterium
VKSGEVGLAFIYFDDRTP

SEQ ID NO: 1094478 - protein, 21 aa, Mycobacterium
VLALVVGFVGWRLYQKLTNNT

SEQ ID NO: 1094479 - protein, 20 aa, Mycobacterium
VLAVPMPALPSMLTHIRELA

SEQ ID NO: 1094480 - protein, 17 aa, Mycobacterium
VLGAVLAHWLVRLIAAR

SEQ ID NO: 1094481 - protein, 34 aa, Mycobacterium
VLHRPKLGFPVPIRHWLRAGELLEWAYAMVATSQ

SEQ ID NO: 1094482 - protein, 24 aa, Mycobacterium
VLPGLTIPGKIDKLGYKGIDTTEV

SEQ ID NO: 1094483 - protein, 29 aa, Mycobacterium
VLTWRGDQYILFVQLSGSGARYGRQGVEY

SEQ ID NO: 1094484 - protein, 26 aa, Mycobacterium
VLVANDRWWGAKAITKRVIVRPQGAD

SEQ ID NO: 1094485 - protein, 18 aa, Mycobacterium
VMHFSANWCGPCAAVRRV

SEQ ID NO: 1094486 - protein, 26 aa, Mycobacterium
VNNGSEWICYFPHPLRVVCGGISIPG

SEQ ID NO: 1094487 - protein, 26 aa, Mycobacterium
VNWDMNVCHTWYWVDYGFQANRGGFV

SEQ ID NO: 1094488 - protein, 19 aa, Mycobacterium
VNYRILLKPGWGFTDGSPV

SEQ ID NO: 1094489 - protein, 24 aa, Mycobacterium
VPATLSMPFSAFPTPADYARLPTV

SEQ ID NO: 1094490 - protein, 19 aa, Mycobacterium
VPDYLGNVWFATGSGVVGV

SEQ ID NO: 1094491 - protein, 18 aa, Mycobacterium
VPFNPKQVTYEVFGPSGT

SEQ ID NO: 1094492 - protein, 19 aa, Mycobacterium
VPQRQWRWPLGEIDKPFEM

SEQ ID NO: 1094493 - protein, 17 aa, Mycobacterium
VQFDQGTWVANGGLRYA

SEQ ID NO: 1094494 - protein, 18 aa, Mycobacterium
VRAAFKPEFINRLDDVLI

SEQ ID NO: 1094495 - protein, 17 aa, Mycobacterium
VRALTGVPIDYFAEVNL

SEQ ID NO: 1094496 - protein, 31 aa, Mycobacterium
VRMVDTFAARALFFDKFFADAIAAGLRQVVI

SEQ ID NO: 1094497 - protein, 20 aa, Mycobacterium
VRPLFGQHVVLTNPGLQQLF

SEQ ID NO: 1094498 - protein, 23 aa, Mycobacterium
VRRRAQLLVCLNPRAAQSDFEPL

SEQ ID NO: 1094499 - protein, 25 aa, Mycobacterium
VRVAEFHESFTRALTAGSTAYATAE

SEQ ID NO: 1094500 - protein, 18 aa, Mycobacterium
VRVAFWGAEELGLIGSRN

SEQ ID NO: 1094501 - protein, 20 aa, Mycobacterium
VRVLPGLLGSRRVPAVDGTT

SEQ ID NO: 1094502 - protein, 24 aa, Mycobacterium
VSAGTLAMPAMAPMAACYITLGTA

SEQ ID NO: 1094503 - protein, 17 aa, Mycobacterium
VSALDDLLLDVSQIDSA

SEQ ID NO: 1094504 - protein, 18 aa, Mycobacterium
VSELTKIYRESRGAPWRR

SEQ ID NO: 1094505 - protein, 18 aa, Mycobacterium
VSIRALLDHGALAQRLRA

SEQ ID NO: 1094506 - protein, 24 aa, Mycobacterium
VSISEGIFAIDVNLGGAGGDGGTA

SEQ ID NO: 1094507 - protein, 24 aa, Mycobacterium
VSPDTSWLALNRMIPPMVKSTARG

SEQ ID NO: 1094508 - protein, 43 aa, Mycobacterium
VSVAVARLFDGHGQAYQTISAQAAVFHGRFVAALDAAADSYAG

SEQ ID NO: 1094509 - protein, 24 aa, Mycobacterium
VSVDAKLYGLPFGDGAYGAQDMTL

SEQ ID NO: 1094510 - protein, 17 aa, Mycobacterium
VSVFAHRARLVLGQLAV

SEQ ID NO: 1094511 - protein, 18 aa, Mycobacterium
VSVFAHRARLVLGQLAVA

SEQ ID NO: 1094512 - protein, 32 aa, Mycobacterium
VTANRGLMQVLAATNWLGFNTPAIIDIEAAYE

SEQ ID NO: 1094513 - protein, 29 aa, Mycobacterium
VTGQTRRRAAGTRGAFAAGAARATIAAVA

SEQ ID NO: 1094514 - protein, 32 aa, Mycobacterium; identical to SEQ ID NO: 952187

SEQ ID NO: 1094515 - protein, 24 aa, Mycobacterium
VTVAPLRQRALARFAANAPEIASR

SEQ ID NO: 1094516 - protein, 32 aa, Mycobacterium
VTVSDLEFIQFHPTMLFYGSSGGRRPLITEAI

SEQ ID NO: 1094517 - protein, 19 aa, Mycobacterium
VVARDGLVLGELPVGSLVG

SEQ ID NO: 1094518 - protein, 19 aa, Mycobacterium
VVDLLTAPGGLLDRVTAEG

SEQ ID NO: 1094519 - protein, 20 aa, Mycobacterium
VVGCILLAGLVGMCSFQPGA

SEQ ID NO: 1094520 - protein, 23 aa, Mycobacterium
VVIAGFAIYRLHGIFGSHNNASG

SEQ ID NO: 1094521 - protein, 18 aa, Mycobacterium
VVMRPYLVDGLKGPDLAN

SEQ ID NO: 1094522 - protein, 20 aa, Mycobacterium
VVRAVVLALADLFECEPSAA

SEQ ID NO: 1094523 - protein, 18 aa, Mycobacterium
VVTRYFVPRFAATPITSA

SEQ ID NO: 1094524 - protein, 19 aa, Mycobacterium
VVVAACPPVYVPWTPDFAG

SEQ ID NO: 1094525 - protein, 20 aa, Mycobacterium
VYVAMKFNQPFISYGAWDRY

SEQ ID NO: 1094526 - protein, 19 aa, Mycobacterium
VYVCTHMQVVYPGVNLTSP

SEQ ID NO: 1094527 - protein, 17 aa, Mycobacterium
VYVVACDRSASLVVAAT

SEQ ID NO: 1094528 - protein, 24 aa, Mycobacterium
WDINTPAFEWYYQSGISVAMPVGG

SEQ ID NO: 1094529 - protein, 21 aa, Mycobacterium
WDQPWSFAEFLDTGPARSPSA

SEQ ID NO: 1094530 - protein, 19 aa, Mycobacterium
WGIVSAPSVILASGGLGHL

SEQ ID NO: 1094531 - protein, 17 aa, Mycobacterium
WGPWYQAEYETAAPDEQ

SEQ ID NO: 1094532 - protein, 17 aa, Mycobacterium
WIAQAVTWHDPALLGVA

SEQ ID NO: 1094533 - protein, 21 aa, Mycobacterium
WIPLLILVVVAIAGFTVQRIR

SEQ ID NO: 1094534 - protein, 20 aa, Mycobacterium
WLMQRENVPLSADPGPPLLL

SEQ ID NO: 1094535 - protein, 17 aa, Mycobacterium
WNRIVIPTGPPPDNQRY

SEQ ID NO: 1094536 - protein, 17 aa, Mycobacterium
WPSALRAAGFDAARPTA

SEQ ID NO: 1094537 - protein, 22 aa, Mycobacterium
WRFGVPLVCLLAGLLLAATHGV

SEQ ID NO: 1094538 - protein, 25 aa, Mycobacterium
WSKCRRARRLAFAALAVLCVGLVAS

SEQ ID NO: 1094539 - protein, 21 aa, Mycobacterium
YAALEYLKYPDAVTVATVSEP

SEQ ID NO: 1094540 - protein, 26 aa, Mycobacterium
YAGLYPGMYNALRQTLQAYFGVGIGN

SEQ ID NO: 1094541 - protein, 29 aa, Mycobacterium
YDDYVNAAQPIWWLVRALEFGQDFQTFIK

SEQ ID NO: 1094542 - protein, 23 aa, Mycobacterium
YDMVGKFGLGQRTGVGLPGESAG

SEQ ID NO: 1094543 - protein, 29 aa, Mycobacterium
YEDRSFTFALKTPPAAKLLLKAAGVAKGS

SEQ ID NO: 1094544 - protein, 23 aa, Mycobacterium
YETAFVMTVPPPVIAANRVLLMA

SEQ ID NO: 1094545 - protein, 24 aa, Mycobacterium
YGAVSFLPERPLVEALRDLTTRIY

SEQ ID NO: 1094546 - protein, 27 aa, Mycobacterium
YGRGAASPLLPSLWQTNCFAPVGENRM

SEQ ID NO: 1094547 - protein, 17 aa, Mycobacterium
YGYAASCAGAVRLNPLT

SEQ ID NO: 1094548 - protein, 19 aa, Mycobacterium
YIGQRPWTNLIGLLGQAGD

SEQ ID NO: 1094549 - protein, 28 aa, Mycobacterium
YKADGDPYQFLLLPLARVSGIEDQALQE

SEQ ID NO: 1094550 - protein, 20 aa, Mycobacterium
YKSATFLQRNLPRGTTQGQA

SEQ ID NO: 1094551 - protein, 21 aa, Mycobacterium
YLFNHPDVNDFFTGLRGQDRD

SEQ ID NO: 1094552 - protein, 26 aa, Mycobacterium
YLGAYGHLVVLREGDLAYLHAHPENG

SEQ ID NO: 1094553 - protein, 18 aa, Mycobacterium
YLSARPWRFGLGLVLSTQ

SEQ ID NO: 1094554 - protein, 20 aa, Mycobacterium
YPEPFLYTYCRDDDPAVLIR

SEQ ID NO: 1094555 - protein, 18 aa, Mycobacterium
YPILGDPSLGYGPGTSSL

SEQ ID NO: 1094556 - protein, 17 aa, Mycobacterium
YPQQFPYAASLSGFLNP

SEQ ID NO: 1094557 - protein, 21 aa, Mycobacterium
YQLFGAQLAQFHQRFVQILDA

SEQ ID NO: 1094558 - protein, 23 aa, Mycobacterium
YREPLSLKPFDYLPRPLRRSMGK

SEQ ID NO: 1094559 - protein, 25 aa, Mycobacterium
YSGVMWACVFMRTGARRVHFGEVEK

SEQ ID NO: 1094560 - protein, 28 aa, Mycobacterium
YSKEYEIERLMRDAPFLLIGEGTSEIQK

SEQ ID NO: 1094561 - protein, 26 aa, Mycobacterium
YTRADLPIHYMLADIFTICDDYYCSM

SEQ ID NO: 1094562 - protein, 23 aa, Mycobacterium
YTYHSKTLGWCDIAYNALVDKYG

SEQ ID NO: 1094563 - protein, 22 aa, Mycobacterium
YVEAFTRLILCNKPNTMIAAEQ

SEQ ID NO: 1094564 - protein, 17 aa, Mycobacterium
AGRRVVLNLWASWCASC

SEQ ID NO: 1094565 - protein, 20 aa, Mycobacterium
CAVPPIIGYLTSGKLPATDT

SEQ ID NO: 1094566 - protein, 20 aa, Mycobacterium
DGQRGPVTLLFLGLDRLKAV

SEQ ID NO: 1094567 - protein, 21 aa, Mycobacterium
DGRQLVIRYLFYDAQGSREFA

SEQ ID NO: 1094568 - protein, 18 aa, Mycobacterium
EIGLLGFALIVDALGGVD

SEQ ID NO: 1094569 - protein, 18 aa, Mycobacterium
EVGWSMLPVARSVLRRIG

SEQ ID NO: 1094570 - protein, 20 aa, Mycobacterium
GQLTLLVLFIDRVRARVDLR

SEQ ID NO: 1094571 - protein, 22 aa, Mycobacterium
GSVRWVSACELRFGYRTSVFKQ

SEQ ID NO: 1094572 - protein, 24 aa, Mycobacterium
HERGYAYFLYPPQAPLTEIAYDRL

SEQ ID NO: 1094573 - protein, 22 aa, Mycobacterium
HSRQLLAAQIIWTLARADIRGP

SEQ ID NO: 1094574 - protein, 17 aa, Mycobacterium
ICALWPVPATSMPHPAP

SEQ ID NO: 1094575 - protein, 17 aa, Mycobacterium
ILLLHGLVNWVMFSQLW

SEQ ID NO: 1094576 - protein, 23 aa, Mycobacterium
ISTLSGMYWWGPASAAMLAATGP

SEQ ID NO: 1094577 - protein, 18 aa, Mycobacterium
LFLLIMGGFMFFASRRQR

SEQ ID NO: 1094578 - protein, 19 aa, Mycobacterium
LLSGLGFLLNPTSAISIIG

SEQ ID NO: 1094579 - protein, 18 aa, Mycobacterium
LRNLWDVPALALIGIGNG

SEQ ID NO: 1094580 - protein, 17 aa, Mycobacterium
MYQAVRYLLVMAAIILM

SEQ ID NO: 1094581 - protein, 22 aa, Mycobacterium
PERVWGWYLWRHYLVANVKPND

SEQ ID NO: 1094582 - protein, 19 aa, Mycobacterium
PKAWRALLTLLVISVVMPG

SEQ ID NO: 1094583 - protein, 20 aa, Mycobacterium
PSQRWFVVWLGTSNNPVDKG

SEQ ID NO: 1094584 - protein, 25 aa, Mycobacterium
PVLDAIKFNYFPFGLNLFSTAEVLP

SEQ ID NO: 1094585 - protein, 18 aa, Mycobacterium
PVTLLFLGLDRLKAVNDY

SEQ ID NO: 1094586 - protein, 26 aa, Mycobacterium
QLRWMREIFMPWVWRWLRGKSSADGR

SEQ ID NO: 1094587 - protein, 18 aa, Mycobacterium
QRIVLTHNPKWWGTPPRL

SEQ ID NO: 1094588 - protein, 18 aa, Mycobacterium
RAFLSECIGIRRGSVVDA

SEQ ID NO: 1094589 - protein, 20 aa, Mycobacterium
RGLVMLVAALLLSSCGWRGI

SEQ ID NO: 1094590 - protein, 19 aa, Mycobacterium
RLDMPLLDFFSHGGSLKSS

SEQ ID NO: 1094591 - protein, 18 aa, Mycobacterium
RPWNPLPCAGATAGPYGG

SEQ ID NO: 1094592 - protein, 22 aa, Mycobacterium
SRRLWTVLIFMLWHAIFIEHSV

SEQ ID NO: 1094593 - protein, 17 aa, Mycobacterium
VSGQLTLLVLFIDRVRA

SEQ ID NO: 1094594 - protein, 17 aa, Mycobacterium
WRIVDHPNLFIKIPATK

SEQ ID NO: 1094595 - protein, 22 aa, Mycobacterium
YTPVHWKYLTSGLLGLQRGTDA

SEQ ID NO: 1094596 - protein, 21 aa, Mycobacterium
AAAAPYAGWLSAAATRALGAA

SEQ ID NO: 1094597 - protein, 21 aa, Mycobacterium
AAAAQPLLAWLSYTAESSALA

SEQ ID NO: 1094598 - protein, 25 aa, Mycobacterium
AAAQDMLTAIRPPAQALLGRPLVGN

SEQ ID NO: 1094599 - protein, 21 aa, Mycobacterium
AAKYWRYQKYDDCLIMAVADV

SEQ ID NO: 1094600 - protein, 19 aa, Mycobacterium
AALMFPFAGGIGLMSNRAS

SEQ ID NO: 1094601 - protein, 17 aa, Mycobacterium
ACYSAIYYTLRREYLVD

SEQ ID NO: 1094602 - protein, 24 aa, Mycobacterium
ADGDPYQFLLLPLARVSGIEDQAL

SEQ ID NO: 1094603 - protein, 19 aa, Mycobacterium
AETIVLRRSRPLEISLDGH

SEQ ID NO: 1094604 - protein, 20 aa, Mycobacterium
AGAVALLGIGLLGTGCTNTV

SEQ ID NO: 1094605 - protein, 18 aa, Mycobacterium
AGGWLFGDGGPGAAATAT

SEQ ID NO: 1094606 - protein, 18 aa, Mycobacterium
AGLLLAGWAAMGVAAADP

SEQ ID NO: 1094607 - protein, 19 aa, Mycobacterium
ALFFDKFFADAIAAGLRQV

SEQ ID NO: 1094608 - protein, 25 aa, Mycobacterium
AMAAAARPYASWLGTAAARAAVTAA

SEQ ID NO: 1094609 - protein, 36 aa, Mycobacterium
ANAGPLQPLLDLINAPTQALLARPLIGDGTNGAPGT

SEQ ID NO: 1094610 - protein, 27 aa, Mycobacterium
ANVLIITPLRIAFLILLVGTTLEVVTE

SEQ ID NO: 1094611 - protein, 21 aa, Mycobacterium
AQLAPWQQAIQALPGRVAAMA

SEQ ID NO: 1094612 - protein, 24 aa, Mycobacterium
ASNPILTEIWFLLTGQTVLPNNLG

SEQ ID NO: 1094613 - protein, 20 aa, Mycobacterium
ATEPVVHYLLAASGLVNRTP

SEQ ID NO: 1094614 - protein, 17 aa, Mycobacterium
ATIVSIGTGLRTGSTGG

SEQ ID NO: 1094615 - protein, 24 aa, Mycobacterium
ATTALPPPGPAAAAALPGAAAVGF

SEQ ID NO: 1094616 - protein, 19 aa, Mycobacterium
ATVILFGAAILRGNSAAAD

SEQ ID NO: 1094617 - protein, 18 aa, Mycobacterium
CAELLYRAGLPRALYAIV

SEQ ID NO: 1094618 - protein, 17 aa, Mycobacterium
CGLLLLMVPPPSVNSLL

SEQ ID NO: 1094619 - protein, 18 aa, Mycobacterium
CVCGSTPIFRWLPRCRTA

SEQ ID NO: 1094620 - protein, 20 aa, Mycobacterium
DAHVPYLTWLATTSADYAAT

SEQ ID NO: 1094621 - protein, 25 aa, Mycobacterium
DESLDYVLSLMLRAPFRLTREVLPH

SEQ ID NO: 1094622 - protein, 20 aa, Mycobacterium
DGGYLPMNFAANDLAWSATN

SEQ ID NO: 1094623 - protein, 22 aa, Mycobacterium
DLRVGQPLLAIGSPLGLAGTVT

SEQ ID NO: 1094624 - protein, 23 aa, Mycobacterium
DRPNLLIKIPATKAGLPAIAAVL

SEQ ID NO: 1094625 - protein, 24 aa, Mycobacterium
DRSAQRIVLIRNPKWWGKKPRLHS

SEQ ID NO: 1094626 - protein, 25 aa, Mycobacterium
EDQLFRFSRILDAQPRLSILLGDYV

SEQ ID NO: 1094627 - protein, 17 aa, Mycobacterium
EFFMPYPGTRINQETIP

SEQ ID NO: 1094628 - protein, 17 aa, Mycobacterium
EFIQFHPTMLFAAGTGT

SEQ ID NO: 1094629 - protein, 17 aa, Mycobacterium
EFIQFHPTMLFYGSSGG

SEQ ID NO: 1094630 - protein, 23 aa, Mycobacterium
EGPPQRWFVVWLGTSNDPVDKGA

SEQ ID NO: 1094631 - protein, 21 aa, Mycobacterium
EQLMPHWLLALQDAAKRRGTT

SEQ ID NO: 1094632 - protein, 25 aa, Mycobacterium
EVSTAIAALFGWHAQTYQSLSAQAT

SEQ ID NO: 1094633 - protein, 20 aa, Mycobacterium
FDCSGLVMWAFQQAGIALPH

SEQ ID NO: 1094634 - protein, 21 aa, Mycobacterium
FDFAMLLPPFRGASLAAYDRD

SEQ ID NO: 1094635 - protein, 17 aa, Mycobacterium
FDFVGFAAAHGGAGGTG

SEQ ID NO: 1094636 - protein, 18 aa, Mycobacterium
FGAVALTLALLPAPRSAR

SEQ ID NO: 1094637 - protein, 18 aa, Mycobacterium
FHDMPTIPLWDYIAVVGW

SEQ ID NO: 1094638 - protein, 20 aa, Mycobacterium
FNRRIGPHRRFAFASVPLAD

SEQ ID NO: 1094639 - protein, 17 aa, Mycobacterium
GAAGLLLAGWAAMGVAA

SEQ ID NO: 1094640 - protein, 17 aa, Mycobacterium
GAAGWLYGAGGSGGAGG

SEQ ID NO: 1094641 - protein, 26 aa, Mycobacterium
GAAYYVHYWQYQFLPQFGALLNENPS

SEQ ID NO: 1094642 - protein, 19 aa, Mycobacterium
GAGGLLFGPGGVGGAGGAS

SEQ ID NO: 1094643 - protein, 17 aa, Mycobacterium
GATSMKVWFNAKAMWDW

SEQ ID NO: 1094644 - protein, 18 aa, Mycobacterium
GDQYILFVQLSGSGARYG

SEQ ID NO: 1094645 - protein, 24 aa, Mycobacterium
GFNALEITLPMPPRWTPVPDPNVP

SEQ ID NO: 1094646 - protein, 17 aa, Mycobacterium
GFPVLHIGNIGFANLSV

SEQ ID NO: 1094647 - protein, 18 aa, Mycobacterium
GFPVPIRHWLRAGELLEW

SEQ ID NO: 1094648 - protein, 17 aa, Mycobacterium
GFVNAWSLLFYPPQGWE

SEQ ID NO: 1094649 - protein, 20 aa, Mycobacterium
GGAGGWLWGGGGAGGLGGPA

SEQ ID NO: 1094650 - protein, 25 aa, Mycobacterium
GLDARPYRLPWPTGMRVYEIDQPEV

SEQ ID NO: 1094651 - protein, 24 aa, Mycobacterium
GPKRYDWRKFIGSLKFTLWRLQER

SEQ ID NO: 1094652 - protein, 22 aa, Mycobacterium
GSRIEVLLRQQEDPRWTCSHAM

SEQ ID NO: 1094653 - protein, 21 aa, Mycobacterium
GTRPKGTLFFRSGGDGGFGGW

SEQ ID NO: 1094654 - protein, 17 aa, Mycobacterium
GTVLRFAPPLAALSAAP

SEQ ID NO: 1094655 - protein, 28 aa, Mycobacterium
GVERDGPTLFLPLTSLRGLRRHSKKRSG

SEQ ID NO: 1094656 - protein, 21 aa, Mycobacterium
GVIFLLLGWQALDSSGKAVDD

SEQ ID NO: 1094657 - protein, 25 aa, Mycobacterium
GYPGSLLLDLLWPRGSSRPVAASVP

SEQ ID NO: 1094658 - protein, 18 aa, Mycobacterium
HAQFERVFAAGVQAYSGA

SEQ ID NO: 1094659 - protein, 19 aa, Mycobacterium
HHRRLFAVLATLNTATAVI

SEQ ID NO: 1094660 - protein, 18 aa, Mycobacterium
HPNLFIKIPATKAGLPAI

SEQ ID NO: 1094661 - protein, 19 aa, Mycobacterium
HPNLFIKIPATKAGLPAIT

SEQ ID NO: 1094662 - protein, 25 aa, Mycobacterium
HWIKVLLHYLFIYKAKARPFWWLIP

SEQ ID NO: 1094663 - protein, 25 aa, Mycobacterium
HYPTARLVVFLLRGNFDPADVARRG

SEQ ID NO: 1094664 - protein, 18 aa, Mycobacterium
IAGLPFPLSSAMLPRFLY

SEQ ID NO: 1094665 - protein, 17 aa, Mycobacterium
IAVTRWFGDQPFAVWPW

SEQ ID NO: 1094666 - protein, 20 aa, Mycobacterium
IEDLWAPLLAALGAADLALA

SEQ ID NO: 1094667 - protein, 20 aa, Mycobacterium
IFMGWLFTLLGRPKVEGLEH

SEQ ID NO: 1094668 - protein, 25 aa, Mycobacterium
IGEIPLDDWLWTLGINLWGPIHGCH

SEQ ID NO: 1094669 - protein, 21 aa, Mycobacterium
IRAVGRLLGWRLGIAEVDPKS

SEQ ID NO: 1094670 - protein, 26 aa, Mycobacterium
ISPQTLFFPFVMLLAATALYRGNDNK

SEQ ID NO: 1094671 - protein, 18 aa, Mycobacterium
ITVPLFHVTGYNSQLLTA

SEQ ID NO: 1094672 - protein, 19 aa, Mycobacterium
IWDWAVDWGTWLSMSALPA

SEQ ID NO: 1094673 - protein, 17 aa, Mycobacterium
LAALLAVLGLLLPSIAA

SEQ ID NO: 1094674 - protein, 23 aa, Mycobacterium
LAESIRPWMPPPAPAPAPAPGEP

SEQ ID NO: 1094675 - protein, 18 aa, Mycobacterium
LAGWQTWLAAADRDTWGL

SEQ ID NO: 1094676 - protein, 24 aa, Mycobacterium
LARFPGFYIPFLDVSFNGATPAAN

SEQ ID NO: 1094677 - protein, 17 aa, Mycobacterium
LAVLLVGLLAAGVVVLL

SEQ ID NO: 1094678 - protein, 19 aa, Mycobacterium
LAWTVYSLPGAPAFDHYEL

SEQ ID NO: 1094679 - protein, 18 aa, Mycobacterium
LFDTNFFGLIRLTNEVLP

SEQ ID NO: 1094680 - protein, 18 aa, Mycobacterium
LFETHFFGTVALIKAVLP

SEQ ID NO: 1094681 - protein, 17 aa, Mycobacterium
LGLAWITLAVAALMVVV

SEQ ID NO: 1094682 - protein, 18 aa, Mycobacterium
LLAVLGLLLPSIAAAPPR

SEQ ID NO: 1094683 - protein, 17 aa, Mycobacterium
LLLLMVPPPSVNSLLSR

SEQ ID NO: 1094684 - protein, 19 aa, Mycobacterium
LLVGLALAGGYAVSASKTV

SEQ ID NO: 1094685 - protein, 19 aa, Mycobacterium
LLVPAYLPYVRAARPIIFL

SEQ ID NO: 1094686 - protein, 20 aa, Mycobacterium
LLVPIHWGTFRLAPHPWAEP

SEQ ID NO: 1094687 - protein, 19 aa, Mycobacterium
LLYRAGLPRALYAIVPGPG

SEQ ID NO: 1094688 - protein, 18 aa, Mycobacterium
LMLTFLPSPTSAAASNTA

SEQ ID NO: 1094689 - protein, 19 aa, Mycobacterium
LPLLLGLYIQPATLPIPPA

SEQ ID NO: 1094690 - protein, 24 aa, Mycobacterium
LQGKPAVLWFWTPWCPFCNAEGPA

SEQ ID NO: 1094691 - protein, 21 aa, Mycobacterium
LQIPLLERGILQRLLRSRTIA

SEQ ID NO: 1094692 - protein, 17 aa, Mycobacterium
LRFAPPLAALSAAPITF

SEQ ID NO: 1094693 - protein, 26 aa, Mycobacterium
LRVALRIVWALLLMPGLPLLGVPVPG

SEQ ID NO: 1094694 - protein, 25 aa, Mycobacterium
LRVAVPSFLLLFLVACGGSGRVSHP

SEQ ID NO: 1094695 - protein, 18 aa, Mycobacterium
LSALAWTVYSLPGAPAFD

SEQ ID NO: 1094696 - protein, 23 aa, Mycobacterium
LTANYPPFLFHPLNTITAYKGQI

SEQ ID NO: 1094697 - protein, 20 aa, Mycobacterium
LTGRPLIGNGLPGSAGSGAA

SEQ ID NO: 1094698 - protein, 20 aa, Mycobacterium
LVANDRWWGAKAITKRVIVR

SEQ ID NO: 1094699 - protein, 17 aa, Mycobacterium
LVDPAALPPPPGHRLGQ

SEQ ID NO: 1094700 - protein, 18 aa, Mycobacterium
LVSQFFGKYFSPAEARQL

SEQ ID NO: 1094701 - protein, 19 aa, Mycobacterium
LVVLYKQYVVRFGLGYREE

SEQ ID NO: 1094702 - protein, 18 aa, Mycobacterium
MEGLWWDRPFALDSVDIS

SEQ ID NO: 1094703 - protein, 27 aa, Mycobacterium
MGALNAPTMAWLGRPLIGDGANGVDGT

SEQ ID NO: 1094704 - protein, 17 aa, Mycobacterium
MGVAVLDAPWAPFVVDF

SEQ ID NO: 1094705 - protein, 22 aa, Mycobacterium
MGVPPTLWQKSLLPIVRTVMKL

SEQ ID NO: 1094706 - protein, 26 aa, Mycobacterium
MKYMQRWPFRFFAERKWFTIAESIEL

SEQ ID NO: 1094707 - protein, 20 aa, Mycobacterium
MQVLAATNWLGFNTPAIIDI

SEQ ID NO: 1094708 - protein, 17 aa, Mycobacterium
NAGLIFGFGGAGGTGGS

SEQ ID NO: 1094709 - protein, 22 aa, Mycobacterium
NIALYLNFDMLASPNPGIFTYD

SEQ ID NO: 1094710 - protein, 23 aa, Mycobacterium
NNTGSFNTVLFNTGFRTAGIANS

SEQ ID NO: 1094711 - protein, 21 aa, Mycobacterium
NVHGLFWTLNAALPALRQSEP

SEQ ID NO: 1094712 - protein, 24 aa, Mycobacterium
NVVNAPTQALLGRPLIGDGADGTA

SEQ ID NO: 1094713 - protein, 21 aa, Mycobacterium
PACGCYFDNVYWITFAGLATV

SEQ ID NO: 1094714 - protein, 18 aa, Mycobacterium
PAVPAGLTRRAGPAVAAV

SEQ ID NO: 1094715 - protein, 17 aa, Mycobacterium
PCVRALLTLLPDSLRWL

SEQ ID NO: 1094716 - protein, 23 aa, Mycobacterium
PCVRALLTLLPGSLRWLVTVDAM

SEQ ID NO: 1094717 - protein, 22 aa, Mycobacterium
PDRNLFMPMAFHLGYHSLPIGN

SEQ ID NO: 1094718 - protein, 29 aa, Mycobacterium
PHAIRRLAVPIVLLWLALAAITNASVPQL

SEQ ID NO: 1094719 - protein, 18 aa, Mycobacterium
PHRLVDPAALPPPPGHRL

SEQ ID NO: 1094720 - protein, 19 aa, Mycobacterium
PIFRWLPRCRTAVSSTPAT

SEQ ID NO: 1094721 - protein, 18 aa, Mycobacterium
PLGTCAFWPVPPTSKPHA

SEQ ID NO: 1094722 - protein, 17 aa, Mycobacterium
PMNFAANDLAWSATNPC

SEQ ID NO: 1094723 - protein, 22 aa, Mycobacterium
PPIGYRLLLLVGVLALALTGCV

SEQ ID NO: 1094724 - protein, 17 aa, Mycobacterium
PPPPIAPAALAGLLLDT

SEQ ID NO: 1094725 - protein, 25 aa, Mycobacterium
PPTLRPRWPPIRPAAPNGPAIWYCG

SEQ ID NO: 1094726 - protein, 25 aa, Mycobacterium
PQDDPLNPLTFPKALLLKVTGPIST

SEQ ID NO: 1094727 - protein, 26 aa, Mycobacterium
PRWTWRLRRRCRRNWFVRQRSGRRRR

SEQ ID NO: 1094728 - protein, 30 aa, Mycobacterium; identical to SEQ ID NO: 953540

SEQ ID NO: 1094729 - protein, 18 aa, Mycobacterium
QADCFAGVYLYWVAEGKS

SEQ ID NO: 1094730 - protein, 17 aa, Mycobacterium
QFFGKYFSPAEARQLIA

SEQ ID NO: 1094731 - protein, 20 aa, Mycobacterium
QGLALLMVALVLSSCGWRGI

SEQ ID NO: 1094732 - protein, 17 aa, Mycobacterium
QLAPWQQALRTLQNRVA

SEQ ID NO: 1094733 - protein, 18 aa, Mycobacterium
QLLVLIATNFFGQNTSAI

SEQ ID NO: 1094734 - protein, 24 aa, Mycobacterium
QPALRPLLDLLPIASGSGTLGERF

SEQ ID NO: 1094735 - protein, 22 aa, Mycobacterium
QSPPAWWRPAGALFDQFLGAAE

SEQ ID NO: 1094736 - protein, 24 aa, Mycobacterium
QVLAEPVQTLGQAWLASPAGELLD

SEQ ID NO: 1094737 - protein, 21 aa, Mycobacterium
QWYGYFMRRLAERPANLGFFL

SEQ ID NO: 1094738 - protein, 25 aa, Mycobacterium
RFAPLRWSVLRLALAFRTLLRTGQV

SEQ ID NO: 1094739 - protein, 19 aa, Mycobacterium
RHRAGNAVILVLMLVAATQ

SEQ ID NO: 1094740 - protein, 17 aa, Mycobacterium
RHTPPHAWYIAFAPAQA

SEQ ID NO: 1094741 - protein, 17 aa, Mycobacterium
RIPHAIRRLAVPIVLLW

SEQ ID NO: 1094742 - protein, 20 aa, Mycobacterium
RIRAVAAIARIPSLATVAAV

SEQ ID NO: 1094743 - protein, 18 aa, Mycobacterium
RQWRIPMWQLNAGAQRGF

SEQ ID NO: 1094744 - protein, 18 aa, Mycobacterium
RRAAGTRGAFAAGAARAT

SEQ ID NO: 1094745 - protein, 21 aa, Mycobacterium
RSWLAAILIPVAVLAVACGGS

SEQ ID NO: 1094746 - protein, 26 aa, Mycobacterium
SEEAIYSFLRLLLPAGLETTYRSSGN

SEQ ID NO: 1094747 - protein, 20 aa, Mycobacterium
SEWICYFPHPLRVVCGGISI

SEQ ID NO: 1094748 - protein, 21 aa, Mycobacterium
SGCVLLPGLPYLGLEHRAAWV

SEQ ID NO: 1094749 - protein, 22 aa, Mycobacterium
SGCVLLPGLPYLGLEHRAAWVE

SEQ ID NO: 1094750 - protein, 20 aa, Mycobacterium
SLEIFLTPQLPAPLVRIYGA

SEQ ID NO: 1094751 - protein, 25 aa, Mycobacterium
SLGAFIEDIIFLDIPRFVESAFHGL

SEQ ID NO: 1094752 - protein, 20 aa, Mycobacterium
SLLATFPFPNETFQNFQRGD

SEQ ID NO: 1094753 - protein, 17 aa, Mycobacterium
SPAPPAFLLLGPDALMA

SEQ ID NO: 1094754 - protein, 24 aa, Mycobacterium
SRRLWTLLIFMLWHAIFIERSITP

SEQ ID NO: 1094755 - protein, 24 aa, Mycobacterium
STFHTQFVRALNLSGGAYAAADVA

SEQ ID NO: 1094756 - protein, 25 aa, Mycobacterium
SVTVMALIVLLLLNATMTPVFTADG

SEQ ID NO: 1094757 - protein, 17 aa, Mycobacterium
TEALFGRPLIGDGADGQ

SEQ ID NO: 1094758 - protein, 24 aa, Mycobacterium
TEPAPVLIFVPGGAWIHGSRAIQG

SEQ ID NO: 1094759 - protein, 26 aa, Mycobacterium
TPAGLLYLIGPMAWTLGYPIVPMLTP

SEQ ID NO: 1094760 - protein, 24 aa, Mycobacterium
TRALSFLPTYPFPKETLTNWMRGD

SEQ ID NO: 1094761 - protein, 23 aa, Mycobacterium
TRIRPHFFPFTEPSAEVDVWFAS

SEQ ID NO: 1094762 - protein, 19 aa, Mycobacterium
TRSLSLLATFPFPNETFQN

SEQ ID NO: 1094763 - protein, 25 aa, Mycobacterium
TTQVLERLKYLPLDPFRISYAYTNF

SEQ ID NO: 1094764 - protein, 24 aa, Mycobacterium
TVSGQLMLLVPFIERVRARVDLRE

SEQ ID NO: 1094765 - protein, 20 aa, Mycobacterium
VAAHVPYLMWLMRASATSAQ

SEQ ID NO: 1094766 - protein, 19 aa, Mycobacterium
VAAKRLSVLSLPTTFIFDT

SEQ ID NO: 1094767 - protein, 22 aa, Mycobacterium
VAGTWNMRWADLSLPPQAAVIV

SEQ ID NO: 1094768 - protein, 17 aa, Mycobacterium
VENFDFFGFGVAHGGDG

SEQ ID NO: 1094769 - protein, 17 aa, Mycobacterium
VFPTPPALIVAAGTDAL

SEQ ID NO: 1094770 - protein, 25 aa, Mycobacterium
VGFAAIVFLVWRYVVPPVRRMMAAR

SEQ ID NO: 1094771 - protein, 22 aa, Mycobacterium
VGGRPVALPPPKPAGAPIEPTP

SEQ ID NO: 1094772 - protein, 17 aa, Mycobacterium
VHYLLQASGLVNRTPPA

SEQ ID NO: 1094773 - protein, 24 aa, Mycobacterium
VIDPRLRTLAIRPTLRRLAGLPTA

SEQ ID NO: 1094774 - protein, 17 aa, Mycobacterium
VKLLYRLERPLFFAFQC

SEQ ID NO: 1094775 - protein, 25 aa, Mycobacterium
VLAEWFLRRFSLLDSLYIVPPPRLI

SEQ ID NO: 1094776 - protein, 18 aa, Mycobacterium
VLHVIWRQKIYPGIVAPS

SEQ ID NO: 1094777 - protein, 17 aa, Mycobacterium
VMWAFQQAGIALPHSSQ

SEQ ID NO: 1094778 - protein, 23 aa, Mycobacterium
VNGQLFIVYGPQVTLVAAPTAEH

SEQ ID NO: 1094779 - protein, 17 aa, Mycobacterium
VNTLFQSLIDLLHKIDP

SEQ ID NO: 1094780 - protein, 17 aa, Mycobacterium
VRNAALLRVFLLGQLDP

SEQ ID NO: 1094781 - protein, 20 aa, Mycobacterium
VTEPVVHYLLQASGLVNRTP

SEQ ID NO: 1094782 - protein, 26 aa, Mycobacterium
VVVEFRDQFPLPEKLWTIADLGGWDT

SEQ ID NO: 1094783 - protein, 18 aa, Mycobacterium
WARYNVPWQPAWVFYRVD

SEQ ID NO: 1094784 - protein, 18 aa, Mycobacterium
WASWAFVGPTHRAYFGGD

SEQ ID NO: 1094785 - protein, 24 aa, Mycobacterium
WFGDQPFAVWPWAQPKLGAAQPVV

SEQ ID NO: 1094786 - protein, 17 aa, Mycobacterium
WGTWLSMSALPAPSART

SEQ ID NO: 1094787 - protein, 18 aa, Mycobacterium
WIPLLILVVVAIAGFTVQ

SEQ ID NO: 1094788 - protein, 26 aa, Mycobacterium
WLASPAGELLDPLVNAPFESLTGREL

SEQ ID NO: 1094789 - protein, 18 aa, Mycobacterium
WRFGVPLVCLLAGLLLAA

SEQ ID NO: 1094790 - protein, 23 aa, Mycobacterium
WTLGYPIVPMLTPGSLDFNGVVF

SEQ ID NO: 1094791 - protein, 24 aa, Mycobacterium
YAEIGLLGFALITDALGGVDVCLN

SEQ ID NO: 1094792 - protein, 18 aa, Mycobacterium
YLMKESFMVLFGAARSRL

SEQ ID NO: 1094793 - protein, 17 aa, Mycobacterium
YQKYDDCLIMAVADVVG

SEQ ID NO: 1094794 - protein, 20 aa, Mycobacterium
YWVMKPTYHNSFWFSSCMVT

SEQ ID NO: 1094795 - protein, 4 aa, Mycobacterium
AGTA

SEQ ID NO: 1094796 - protein, 5 aa, Mycobacterium
DPANG

SEQ ID NO: 1094797 - protein, 5 aa, Mycobacterium
EGMPR

SEQ ID NO: 1094798 - protein, 10 aa, Mycobacterium
GVNDAPALAQ

SEQ ID NO: 1094799 - protein, 7 aa, Mycobacterium
SCPPPRH

SEQ ID NO: 1094800 - protein, 4 aa, Mycobacterium
SERP

SEQ ID NO: 1094801 - protein, 5 aa, Mycobacterium
SRTIR

SEQ ID NO: 1094802 - protein, 9 aa, Mycobacterium
ADLSGAGAA

SEQ ID NO: 1094803 - protein, 4 aa, Mycobacterium
LRPE

SEQ ID NO: 1094804 - protein, 4 aa, Mycobacterium
PSDG

SEQ ID NO: 1094805 - protein, 5 aa, Mycobacterium
RTRRG

SEQ ID NO: 1094806 - protein, 6 aa, Mycobacterium
AALGDT

SEQ ID NO: 1094807 - protein, 4 aa, Mycobacterium
AENP

SEQ ID NO: 1094808 - protein, 4 aa, Mycobacterium
ATGF

SEQ ID NO: 1094809 - protein, 5 aa, Mycobacterium
DATPQ

SEQ ID NO: 1094810 - protein, 5 aa, Mycobacterium
DPRVT

SEQ ID NO: 1094811 - protein, 4 aa, Mycobacterium
DRLG

SEQ ID NO: 1094812 - protein, 4 aa, Mycobacterium
GEWG

SEQ ID NO: 1094813 - protein, 4 aa, Mycobacterium
GGST

SEQ ID NO: 1094814 - protein, 4 aa, Mycobacterium
GPAI

SEQ ID NO: 1094815 - protein, 4 aa, Mycobacterium
GRIG

SEQ ID NO: 1094816 - protein, 8 aa, Mycobacterium
LGTTPTGT

SEQ ID NO: 1094817 - protein, 4 aa, Mycobacterium
PAAL

SEQ ID NO: 1094818 - protein, 4 aa, Mycobacterium
PVTT

SEQ ID NO: 1094819 - protein, 4 aa, Mycobacterium
RSDR

SEQ ID NO: 1094820 - protein, 20 aa, Mycobacterium
SGMPTDRAGAAAAITSTSRQ

SEQ ID NO: 1094821 - protein, 7 aa, Mycobacterium
STAGWRD

SEQ ID NO: 1094822 - protein, 9 aa, Mycobacterium
TSKRALRSA

SEQ ID NO: 1094823 - protein, 4 aa, Mycobacterium
AAPI

SEQ ID NO: 1094824 - protein, 4 aa, Mycobacterium
AGAS

SEQ ID NO: 1094825 - protein, 4 aa, Mycobacterium
AGVG

SEQ ID NO: 1094826 - protein, 4 aa, Mycobacterium
APGA

SEQ ID NO: 1094827 - protein, 5 aa, Mycobacterium
ASLAP

SEQ ID NO: 1094828 - protein, 11 aa, Mycobacterium
EDVESAPSEDI

SEQ ID NO: 1094829 - protein, 4 aa, Mycobacterium
EPAG

SEQ ID NO: 1094830 - protein, 4 aa, Mycobacterium
ERGE

SEQ ID NO: 1094831 - protein, 6 aa, Mycobacterium
ERSQQV

SEQ ID NO: 1094832 - protein, 4 aa, Mycobacterium
ETLG

SEQ ID NO: 1094833 - protein, 4 aa, Mycobacterium
GAAL

SEQ ID NO: 1094834 - protein, 4 aa, Mycobacterium
GAGT

SEQ ID NO: 1094835 - protein, 4 aa, Mycobacterium
GEPV

SEQ ID NO: 1094836 - protein, 4 aa, Mycobacterium
GGSH

SEQ ID NO: 1094837 - protein, 4 aa, Mycobacterium
GTPV

SEQ ID NO: 1094838 - protein, 9 aa, Mycobacterium
GVNDAPALA

SEQ ID NO: 1094839 - protein, 8 aa, Mycobacterium
INDAPALA

SEQ ID NO: 1094840 - protein, 4 aa, Mycobacterium
IPGG

SEQ ID NO: 1094841 - protein, 12 aa, Mycobacterium
ITGNPGDPRYPY

SEQ ID NO: 1094842 - protein, 8 aa, Mycobacterium
KTGTLTEN

SEQ ID NO: 1094843 - protein, 10 aa, Mycobacterium
KTGTLTRNQP

SEQ ID NO: 1094844 - protein, 4 aa, Mycobacterium
NGPV

SEQ ID NO: 1094845 - protein, 4 aa, Mycobacterium
PAGQ

SEQ ID NO: 1094846 - protein, 5 aa, Mycobacterium
PVNEA

SEQ ID NO: 1094847 - protein, 5 aa, Mycobacterium
RLPRQ

SEQ ID NO: 1094848 - protein, 13 aa, Mycobacterium
RVNAKGGPEGRPG

SEQ ID NO: 1094849 - protein, 5 aa, Mycobacterium
TGRGA

SEQ ID NO: 1094850 - protein, 4 aa, Mycobacterium
TGTG

SEQ ID NO: 1094851 - protein, 5 aa, Mycobacterium
TLAPA

SEQ ID NO: 1094852 - protein, 4 aa, Mycobacterium
VPGA

SEQ ID NO: 1094853 - protein, 6 aa, Mycobacterium
AADAGI

SEQ ID NO: 1094854 - protein, 7 aa, Mycobacterium
AASRTDT

SEQ ID NO: 1094855 - protein, 4 aa, Mycobacterium
ADGA

SEQ ID NO: 1094856 - protein, 4 aa, Mycobacterium
AGPL

SEQ ID NO: 1094857 - protein, 7 aa, Mycobacterium
AQTTSAL

SEQ ID NO: 1094858 - protein, 5 aa, Mycobacterium
DDATA

SEQ ID NO: 1094859 - protein, 4 aa, Mycobacterium
DLRN

SEQ ID NO: 1094860 - protein, 4 aa, Mycobacterium
DPGL

SEQ ID NO: 1094861 - protein, 7 aa, Mycobacterium
EARSEHP

SEQ ID NO: 1094862 - protein, 7 aa, Mycobacterium
ERAARGG

SEQ ID NO: 1094863 - protein, 4 aa, Mycobacterium
EVGA

SEQ ID NO: 1094864 - protein, 5 aa, Mycobacterium
GDREA

SEQ ID NO: 1094865 - protein, 6 aa, Mycobacterium
GERDPK

SEQ ID NO: 1094866 - protein, 4 aa, Mycobacterium
GGGD

SEQ ID NO: 1094867 - protein, 4 aa, Mycobacterium
GGTL

SEQ ID NO: 1094868 - protein, 9 aa, Mycobacterium
HLPGRPKTD

SEQ ID NO: 1094869 - protein, 8 aa, Mycobacterium
IGAGATAQ

SEQ ID NO: 1094870 - protein, 5 aa, Mycobacterium
INGTG

SEQ ID NO: 1094871 - protein, 6 aa, Mycobacterium
INTTGT

SEQ ID NO: 1094872 - protein, 4 aa, Mycobacterium
LGAK

SEQ ID NO: 1094873 - protein, 9 aa, Mycobacterium
LNPETKRRN

SEQ ID NO: 1094874 - protein, 4 aa, Mycobacterium
LTGG

SEQ ID NO: 1094875 - protein, 5 aa, Mycobacterium
PDAQT

SEQ ID NO: 1094876 - protein, 4 aa, Mycobacterium
PGKQ

SEQ ID NO: 1094877 - protein, 7 aa, Mycobacterium
PGKRAPT

SEQ ID NO: 1094878 - protein, 4 aa, Mycobacterium
PGQP

SEQ ID NO: 1094879 - protein, 7 aa, Mycobacterium
PGRGTRR

SEQ ID NO: 1094880 - protein, 4 aa, Mycobacterium
PKET

SEQ ID NO: 1094881 - protein, 5 aa, Mycobacterium
PPPPI

SEQ ID NO: 1094882 - protein, 4 aa, Mycobacterium
PRAA

SEQ ID NO: 1094883 - protein, 4 aa, Mycobacterium
QGSG

SEQ ID NO: 1094884 - protein, 7 aa, Mycobacterium
RGGANDA

SEQ ID NO: 1094885 - protein, 4 aa, Mycobacterium
RPSF

SEQ ID NO: 1094886 - protein, 7 aa, Mycobacterium
RRRGNKR

SEQ ID NO: 1094887 - protein, 7 aa, Mycobacterium
RTAERNR

SEQ ID NO: 1094888 - protein, 4 aa, Mycobacterium
RTTG

SEQ ID NO: 1094889 - protein, 10 aa, Mycobacterium
SAATAVADGR

SEQ ID NO: 1094890 - protein, 6 aa, Mycobacterium
SATPPR

SEQ ID NO: 1094891 - protein, 4 aa, Mycobacterium
SGPD

SEQ ID NO: 1094892 - protein, 21 aa, Mycobacterium
SPGIQSSAGKTKGTASTGHGN

SEQ ID NO: 1094893 - protein, 6 aa, Mycobacterium
SSDPRS

SEQ ID NO: 1094894 - protein, 5 aa, Mycobacterium
STHST

SEQ ID NO: 1094895 - protein, 4 aa, Mycobacterium
SYRK

SEQ ID NO: 1094896 - protein, 4 aa, Mycobacterium
TAPA

SEQ ID NO: 1094897 - protein, 5 aa, Mycobacterium
TEATA

SEQ ID NO: 1094898 - protein, 12 aa, Mycobacterium
TGTLTKGEPEVT

SEQ ID NO: 1094899 - protein, 5 aa, Mycobacterium
TPGEF

SEQ ID NO: 1094900 - protein, 4 aa, Mycobacterium
TSGR

SEQ ID NO: 1094901 - protein, 9 aa, Mycobacterium
TSGSTGSPK

SEQ ID NO: 1094902 - protein, 4 aa, Mycobacterium
VRPG

SEQ ID NO: 1094903 - protein, 9 aa, Mycobacterium
YGATSGQAL

SEQ ID NO: 1094904 - protein, 4 aa, Mycobacterium
AAAG

SEQ ID NO: 1094905 - protein, 6 aa, Mycobacterium
AADRKR

SEQ ID NO: 1094906 - protein, 6 aa, Mycobacterium
AADSSL

SEQ ID NO: 1094907 - protein, 9 aa, Mycobacterium
AAGGDPEAM

SEQ ID NO: 1094908 - protein, 8 aa, Mycobacterium
AAGKVPPA

SEQ ID NO: 1094909 - protein, 4 aa, Mycobacterium
AAGM

SEQ ID NO: 1094910 - protein, 4 aa, Mycobacterium
AAGP

SEQ ID NO: 1094911 - protein, 8 aa, Mycobacterium
AAGPGEKA

SEQ ID NO: 1094912 - protein, 6 aa, Mycobacterium
AAGSAA

SEQ ID NO: 1094913 - protein, 15 aa, Mycobacterium
AAGTGGGYGPEGVNG

SEQ ID NO: 1094914 - protein, 5 aa, Mycobacterium
AAGYG

SEQ ID NO: 1094915 - protein, 19 aa, Mycobacterium
AAKAEAKAARKAASKQRRS

SEQ ID NO: 1094916 - protein, 8 aa, Mycobacterium
AAPDPGRW

SEQ ID NO: 1094917 - protein, 6 aa, Mycobacterium
AAPTPV

SEQ ID NO: 1094918 - protein, 4 aa, Mycobacterium
AARY

SEQ ID NO: 1094919 - protein, 4 aa, Mycobacterium
AATG

SEQ ID NO: 1094920 - protein, 4 aa, Mycobacterium
AATN

SEQ ID NO: 1094921 - protein, 10 aa, Mycobacterium
AATTTPAGVG

SEQ ID NO: 1094922 - protein, 8 aa, Mycobacterium
AAVSAGQR

SEQ ID NO: 1094923 - protein, 5 aa, Mycobacterium
ACTAA

SEQ ID NO: 1094924 - protein, 5 aa, Mycobacterium
ADDST

SEQ ID NO: 1094925 - protein, 5 aa, Mycobacterium
ADEAG

SEQ ID NO: 1094926 - protein, 5 aa, Mycobacterium
ADEMG

SEQ ID NO: 1094927 - protein, 6 aa, Mycobacterium
ADGGDA

SEQ ID NO: 1094928 - protein, 6 aa, Mycobacterium
ADGQTV

SEQ ID NO: 1094929 - protein, 10 aa, Mycobacterium
ADGYSRSGAG

SEQ ID NO: 1094930 - protein, 10 aa, Mycobacterium
ADLSGAGTAF

SEQ ID NO: 1094931 - protein, 18 aa, Mycobacterium
ADRPTHEGPVATVEALDF

SEQ ID NO: 1094932 - protein, 8 aa, Mycobacterium
ADSDAPRK

SEQ ID NO: 1094933 - protein, 4 aa, Mycobacterium
AEPG

SEQ ID NO: 1094934 - protein, 5 aa, Mycobacterium
AERTG

SEQ ID NO: 1094935 - protein, 9 aa, Mycobacterium
AERVARTDD

SEQ ID NO: 1094936 - protein, 4 aa, Mycobacterium
AEVA

SEQ ID NO: 1094937 - protein, 10 aa, Mycobacterium
AEVSHPAKQG

SEQ ID NO: 1094938 - protein, 8 aa, Mycobacterium
AEYQESDQ

SEQ ID NO: 1094939 - protein, 12 aa, Mycobacterium
AFRKPKSRNAAT

SEQ ID NO: 1094940 - protein, 5 aa, Mycobacterium
AGANT

SEQ ID NO: 1094941 - protein, 8 aa, Mycobacterium
AGAPEKAA

SEQ ID NO: 1094942 - protein, 6 aa, Mycobacterium
AGASAG

SEQ ID NO: 1094943 - protein, 4 aa, Mycobacterium
AGEA

SEQ ID NO: 1094944 - protein, 6 aa, Mycobacterium
AGETVS

SEQ ID NO: 1094945 - protein, 8 aa, Mycobacterium
AGGEYGGG

SEQ ID NO: 1094946 - protein, 4 aa, Mycobacterium
AGGG

SEQ ID NO: 1094947 - protein, 8 aa, Mycobacterium
AGGPSEPP

SEQ ID NO: 1094948 - protein, 8 aa, Mycobacterium
AGGTSTAT

SEQ ID NO: 1094949 - protein, 8 aa, Mycobacterium
AGHGPGAN

SEQ ID NO: 1094950 - protein, 6 aa, Mycobacterium
AGKGTH

SEQ ID NO: 1094951 - protein, 8 aa, Mycobacterium
AGPNPGHT

SEQ ID NO: 1094952 - protein, 6 aa, Mycobacterium
AGPPTV

SEQ ID NO: 1094953 - protein, 7 aa, Mycobacterium
AGPTGVE

SEQ ID NO: 1094954 - protein, 6 aa, Mycobacterium
AGQSYF

SEQ ID NO: 1094955 - protein, 4 aa, Mycobacterium
AGTR

SEQ ID NO: 1094956 - protein, 6 aa, Mycobacterium
AHRTGT

SEQ ID NO: 1094957 - protein, 6 aa, Mycobacterium
AKGLTR

SEQ ID NO: 1094958 - protein, 5 aa, Mycobacterium
AKITS

SEQ ID NO: 1094959 - protein, 13 aa, Mycobacterium
AKNPDNRYQTAAE

SEQ ID NO: 1094960 - protein, 6 aa, Mycobacterium
ALETSA

SEQ ID NO: 1094961 - protein, 10 aa, Mycobacterium
ALPAAGGGYT

SEQ ID NO: 1094962 - protein, 6 aa, Mycobacterium
ALTTGT

SEQ ID NO: 1094963 - protein, 11 aa, Mycobacterium
ANDPNQNGGYP

SEQ ID NO: 1094964 - protein, 11 aa, Mycobacterium
ANGGNVEGTVK

SEQ ID NO: 1094965 - protein, 8 aa, Mycobacterium
ANNEDSVY

SEQ ID NO: 1094966 - protein, 8 aa, Mycobacterium
ANPAARQQ

SEQ ID NO: 1094967 - protein, 9 aa, Mycobacterium
ANRQKTPNE

SEQ ID NO: 1094968 - protein, 8 aa, Mycobacterium
APAAAAGA

SEQ ID NO: 1094969 - protein, 6 aa, Mycobacterium
APGVGK

SEQ ID NO: 1094970 - protein, 5 aa, Mycobacterium
APIAG

SEQ ID NO: 1094971 - protein, 6 aa, Mycobacterium
APNRRR

SEQ ID NO: 1094972 - protein, 6 aa, Mycobacterium
APPDAV

SEQ ID NO: 1094973 - protein, 4 aa, Mycobacterium
APPW

SEQ ID NO: 1094974 - protein, 5 aa, Mycobacterium
APSNE

SEQ ID NO: 1094975 - protein, 8 aa, Mycobacterium
AQAHEAAN

SEQ ID NO: 1094976 - protein, 11 aa, Mycobacterium
AQERKGAGQRL

SEQ ID NO: 1094977 - protein, 8 aa, Mycobacterium
AQSAGTQV

SEQ ID NO: 1094978 - protein, 4 aa, Mycobacterium
ARDP

SEQ ID NO: 1094979 - protein, 11 aa, Mycobacterium
ARGATASSEAA

SEQ ID NO: 1094980 - protein, 8 aa, Mycobacterium
ARHASETR

SEQ ID NO: 1094981 - protein, 6 aa, Mycobacterium
ARTDGF

SEQ ID NO: 1094982 - protein, 10 aa, Mycobacterium
ARYGGATPGV

SEQ ID NO: 1094983 - protein, 4 aa, Mycobacterium
ASAA

SEQ ID NO: 1094984 - protein, 11 aa, Mycobacterium
ASAAPTPGGVG

SEQ ID NO: 1094985 - protein, 8 aa, Mycobacterium
ASGVTGAD

SEQ ID NO: 1094986 - protein, 6 aa, Mycobacterium
ASGYAG

SEQ ID NO: 1094987 - protein, 7 aa, Mycobacterium
ASKSAPV

SEQ ID NO: 1094988 - protein, 6 aa, Mycobacterium
ASPKTR

SEQ ID NO: 1094989 - protein, 13 aa, Mycobacterium
ASPSISGRYPNLG

SEQ ID NO: 1094990 - protein, 9 aa, Mycobacterium
ASSDPETYG

SEQ ID NO: 1094991 - protein, 5 aa, Mycobacterium
ASSPA

SEQ ID NO: 1094992 - protein, 16 aa, Mycobacterium
ASTTAAGPISQTAYGA

SEQ ID NO: 1094993 - protein, 4 aa, Mycobacterium
ATAG

SEQ ID NO: 1094994 - protein, 7 aa, Mycobacterium
ATAPAVD

SEQ ID NO: 1094995 - protein, 6 aa, Mycobacterium
ATGEFE

SEQ ID NO: 1094996 - protein, 9 aa, Mycobacterium
ATKDQAEPE

SEQ ID NO: 1094997 - protein, 5 aa, Mycobacterium
ATKPQ

SEQ ID NO: 1094998 - protein, 11 aa, Mycobacterium
ATPEDPASARF

SEQ ID NO: 1094999 - protein, 4 aa, Mycobacterium
ATTA

SEQ ID NO: 1095000 - protein, 7 aa, Mycobacterium
ATVDAYD

SEQ ID NO: 1095001 - protein, 10 aa, Mycobacterium
ATVGAGATAE

SEQ ID NO: 1095002 - protein, 5 aa, Mycobacterium
AVPPQ

SEQ ID NO: 1095003 - protein, 13 aa, Mycobacterium
AYEDRAKKTTKAV

SEQ ID NO: 1095004 - protein, 9 aa, Mycobacterium
AYPSGGGDY

SEQ ID NO: 1095005 - protein, 5 aa, Mycobacterium
DAAAA

SEQ ID NO: 1095006 - protein, 7 aa, Mycobacterium
DAAPVTQ

SEQ ID NO: 1095007 - protein, 6 aa, Mycobacterium
DAASQR

SEQ ID NO: 1095008 - protein, 8 aa, Mycobacterium
DAGARTAG

SEQ ID NO: 1095009 - protein, 8 aa, Mycobacterium
DASNYNNT

SEQ ID NO: 1095010 - protein, 6 aa, Mycobacterium
DDAETR

SEQ ID NO: 1095011 - protein, 9 aa, Mycobacterium
DDDEPGGDL

SEQ ID NO: 1095012 - protein, 4 aa, Mycobacterium
DDER

SEQ ID NO: 1095013 - protein, 6 aa, Mycobacterium
DDPDSR

SEQ ID NO: 1095014 - protein, 7 aa, Mycobacterium
DDPNLSE

SEQ ID NO: 1095015 - protein, 5 aa, Mycobacterium
DEIDP

SEQ ID NO: 1095016 - protein, 4 aa, Mycobacterium
DEIP

SEQ ID NO: 1095017 - protein, 4 aa, Mycobacterium
DELA

SEQ ID NO: 1095018 - protein, 7 aa, Mycobacterium
DESPHSV

SEQ ID NO: 1095019 - protein, 10 aa, Mycobacterium
DEYDTDEVAP

SEQ ID NO: 1095020 - protein, 5 aa, Mycobacterium
DGEER

SEQ ID NO: 1095021 - protein, 4 aa, Mycobacterium
DGEV

SEQ ID NO: 1095022 - protein, 6 aa, Mycobacterium
DGFGPK

SEQ ID NO: 1095023 - protein, 14 aa, Mycobacterium
DGHVTGVGAASGAI

SEQ ID NO: 1095024 - protein, 4 aa, Mycobacterium
DGVA

SEQ ID NO: 1095025 - protein, 6 aa, Mycobacterium
DHAEAN

SEQ ID NO: 1095026 - protein, 10 aa, Mycobacterium
DHHANPTRRY

SEQ ID NO: 1095027 - protein, 6 aa, Mycobacterium
DPADRV

SEQ ID NO: 1095028 - protein, 10 aa, Mycobacterium
DPATNQPTDI

SEQ ID NO: 1095029 - protein, 4 aa, Mycobacterium
DPLS

SEQ ID NO: 1095030 - protein, 13 aa, Mycobacterium
DPSRVRRSGGTGL

SEQ ID NO: 1095031 - protein, 4 aa, Mycobacterium
DPTG

SEQ ID NO: 1095032 - protein, 6 aa, Mycobacterium
DQPGAE

SEQ ID NO: 1095033 - protein, 6 aa, Mycobacterium
DQPGGL

SEQ ID NO: 1095034 - protein, 8 aa, Mycobacterium
DRAEPARE

SEQ ID NO: 1095035 - protein, 6 aa, Mycobacterium
DRDTVT

SEQ ID NO: 1095036 - protein, 7 aa, Mycobacterium
DRGAGVP

SEQ ID NO: 1095037 - protein, 8 aa, Mycobacterium
DRGGRERH

SEQ ID NO: 1095038 - protein, 6 aa, Mycobacterium
DRGRTV

SEQ ID NO: 1095039 - protein, 4 aa, Mycobacterium
DRIG

SEQ ID NO: 1095040 - protein, 7 aa, Mycobacterium
DRPGPAA

SEQ ID NO: 1095041 - protein, 8 aa, Mycobacterium
DRTATGEG

SEQ ID NO: 1095042 - protein, 6 aa, Mycobacterium
DSDPTK

SEQ ID NO: 1095043 - protein, 10 aa, Mycobacterium
DSYPTAPAPV

SEQ ID NO: 1095044 - protein, 6 aa, Mycobacterium
DTADEI

SEQ ID NO: 1095045 - protein, 5 aa, Mycobacterium
DTPEF

SEQ ID NO: 1095046 - protein, 16 aa, Mycobacterium
DTVNPAASEDPGSPIA

SEQ ID NO: 1095047 - protein, 5 aa, Mycobacterium
EAEGE

SEQ ID NO: 1095048 - protein, 4 aa, Mycobacterium
EAEN

SEQ ID NO: 1095049 - protein, 15 aa, Mycobacterium
EAGPAEDKDYGEHRE

SEQ ID NO: 1095050 - protein, 7 aa, Mycobacterium
EAQNAAA

SEQ ID NO: 1095051 - protein, 6 aa, Mycobacterium
EAQQEG

SEQ ID NO: 1095052 - protein, 7 aa, Mycobacterium
EATPEDK

SEQ ID NO: 1095053 - protein, 7 aa, Mycobacterium
EDEDAAE

SEQ ID NO: 1095054 - protein, 7 aa, Mycobacterium
EDGRTSV

SEQ ID NO: 1095055 - protein, 8 aa, Mycobacterium
EDPAEDAV

SEQ ID NO: 1095056 - protein, 6 aa, Mycobacterium
EENRSL

SEQ ID NO: 1095057 - protein, 8 aa, Mycobacterium
EEPGHTVP

SEQ ID NO: 1095058 - protein, 6 aa, Mycobacterium
EERPGA

SEQ ID NO: 1095059 - protein, 6 aa, Mycobacterium
EESDTP

SEQ ID NO: 1095060 - protein, 10 aa, Mycobacterium
EGAPNLPSGY

SEQ ID NO: 1095061 - protein, 7 aa, Mycobacterium
EGPPGLR

SEQ ID NO: 1095062 - protein, 8 aa, Mycobacterium
EGYDTEAA

SEQ ID NO: 1095063 - protein, 5 aa, Mycobacterium
EIAPA

SEQ ID NO: 1095064 - protein, 5 aa, Mycobacterium
EIPAG

SEQ ID NO: 1095065 - protein, 8 aa, Mycobacterium
EIREGRSF

SEQ ID NO: 1095066 - protein, 5 aa, Mycobacterium
EITRD

SEQ ID NO: 1095067 - protein, 9 aa, Mycobacterium
EKPGPRPGA

SEQ ID NO: 1095068 - protein, 6 aa, Mycobacterium
EKRSLA

SEQ ID NO: 1095069 - protein, 7 aa, Mycobacterium
ELRPEAA

SEQ ID NO: 1095070 - protein, 8 aa, Mycobacterium
ENARQAGQ

SEQ ID NO: 1095071 - protein, 6 aa, Mycobacterium
ENTPDG

SEQ ID NO: 1095072 - protein, 6 aa, Mycobacterium
EPDSNA

SEQ ID NO: 1095073 - protein, 5 aa, Mycobacterium
EPEPP

SEQ ID NO: 1095074 - protein, 8 aa, Mycobacterium
EPERENGR

SEQ ID NO: 1095075 - protein, 6 aa, Mycobacterium
EPKDEL

SEQ ID NO: 1095076 - protein, 7 aa, Mycobacterium
EPKKAAA

SEQ ID NO: 1095077 - protein, 7 aa, Mycobacterium
EPTGGPL

SEQ ID NO: 1095078 - protein, 8 aa, Mycobacterium
ERAPEELR

SEQ ID NO: 1095079 - protein, 9 aa, Mycobacterium
ERGEGSMSK

SEQ ID NO: 1095080 - protein, 7 aa, Mycobacterium
ERGLSAV

SEQ ID NO: 1095081 - protein, 5 aa, Mycobacterium
ERRQA

SEQ ID NO: 1095082 - protein, 7 aa, Mycobacterium
ERSPDIP

SEQ ID NO: 1095083 - protein, 7 aa, Mycobacterium
ERTGAKI

SEQ ID NO: 1095084 - protein, 11 aa, Mycobacterium
ESDGDGTTVES

SEQ ID NO: 1095085 - protein, 6 aa, Mycobacterium
ESESRR

SEQ ID NO: 1095086 - protein, 9 aa, Mycobacterium
ESGREHKGE

SEQ ID NO: 1095087 - protein, 4 aa, Mycobacterium
ESLA

SEQ ID NO: 1095088 - protein, 12 aa, Mycobacterium
ESPQGLAAEASS

SEQ ID NO: 1095089 - protein, 7 aa, Mycobacterium
ESRERQA

SEQ ID NO: 1095090 - protein, 6 aa, Mycobacterium
ETGPEV

SEQ ID NO: 1095091 - protein, 7 aa, Mycobacterium
ETIGGPV

SEQ ID NO: 1095092 - protein, 16 aa, Mycobacterium
ETKGNPWGQNAKDRTN

SEQ ID NO: 1095093 - protein, 13 aa, Mycobacterium
ETPPPLPADLPPN

SEQ ID NO: 1095094 - protein, 11 aa, Mycobacterium
EVEEAAASLGA

SEQ ID NO: 1095095 - protein, 7 aa, Mycobacterium
EVSEREG

SEQ ID NO: 1095096 - protein, 6 aa, Mycobacterium
EYGGDP

SEQ ID NO: 1095097 - protein, 47 aa, Mycobacterium
EYGPLGGEDPVGFTPNGVSDTLEPAEPVAANPGTVNSDGPVDKPNIG

SEQ ID NO: 1095098 - protein, 4 aa, Mycobacterium
FGDR

SEQ ID NO: 1095099 - protein, 8 aa, Mycobacterium
FGQAQNQA

SEQ ID NO: 1095100 - protein, 5 aa, Mycobacterium
FGSTS

SEQ ID NO: 1095101 - protein, 11 aa, Mycobacterium
FPKGPARNAAT

SEQ ID NO: 1095102 - protein, 4 aa, Mycobacterium
FPPA

SEQ ID NO: 1095103 - protein, 6 aa, Mycobacterium
FRGKSA

SEQ ID NO: 1095104 - protein, 6 aa, Mycobacterium
FRSGEK

SEQ ID NO: 1095105 - protein, 6 aa, Mycobacterium
FSGPQI

SEQ ID NO: 1095106 - protein, 4 aa, Mycobacterium
FTGP

SEQ ID NO: 1095107 - protein, 4 aa, Mycobacterium
GAAA

SEQ ID NO: 1095108 - protein, 5 aa, Mycobacterium
GAAGS

SEQ ID NO: 1095109 - protein, 7 aa, Mycobacterium
GADAARE

SEQ ID NO: 1095110 - protein, 7 aa, Mycobacterium
GAEANSP

SEQ ID NO: 1095111 - protein, 8 aa, Mycobacterium
GAEFGAGP

SEQ ID NO: 1095112 - protein, 6 aa, Mycobacterium
GAGDAI

SEQ ID NO: 1095113 - protein, 9 aa, Mycobacterium
GAGIGDGIA

SEQ ID NO: 1095114 - protein, 4 aa, Mycobacterium
GAPE

SEQ ID NO: 1095115 - protein, 4 aa, Mycobacterium
GAPF

SEQ ID NO: 1095116 - protein, 5 aa, Mycobacterium
GDDPF

SEQ ID NO: 1095117 - protein, 4 aa, Mycobacterium
GDGV

SEQ ID NO: 1095118 - protein, 5 aa, Mycobacterium
GDPKV

SEQ ID NO: 1095119 - protein, 13 aa, Mycobacterium
GDRTEASIKTTSV

SEQ ID NO: 1095120 - protein, 8 aa, Mycobacterium
GELGTPRA

SEQ ID NO: 1095121 - protein, 14 aa, Mycobacterium
GETCNGDSARRSGN

SEQ ID NO: 1095122 - protein, 4 aa, Mycobacterium
GEVA

SEQ ID NO: 1095123 - protein, 12 aa, Mycobacterium
GFGGGSATTTYA

SEQ ID NO: 1095124 - protein, 5 aa, Mycobacterium
GGAGH

SEQ ID NO: 1095125 - protein, 4 aa, Mycobacterium
GGAL

SEQ ID NO: 1095126 - protein, 6 aa, Mycobacterium
GGANAR

SEQ ID NO: 1095127 - protein, 4 aa, Mycobacterium
GGAP

SEQ ID NO: 1095128 - protein, 9 aa, Mycobacterium
GGGDEPPPA

SEQ ID NO: 1095129 - protein, 4 aa, Mycobacterium
GGLG

SEQ ID NO: 1095130 - protein, 6 aa, Mycobacterium
GGPGFC

SEQ ID NO: 1095131 - protein, 5 aa, Mycobacterium
GGPGS

SEQ ID NO: 1095132 - protein, 4 aa, Mycobacterium
GGPT

SEQ ID NO: 1095133 - protein, 7 aa, Mycobacterium
GGSGSVV

SEQ ID NO: 1095134 - protein, 6 aa, Mycobacterium
GGSLSA

SEQ ID NO: 1095135 - protein, 4 aa, Mycobacterium
GGSR

SEQ ID NO: 1095136 - protein, 5 aa, Mycobacterium
GGSTT

SEQ ID NO: 1095137 - protein, 4 aa, Mycobacterium
GGSV

SEQ ID NO: 1095138 - protein, 6 aa, Mycobacterium
GGTAPA

SEQ ID NO: 1095139 - protein, 6 aa, Mycobacterium
GGTPGL

SEQ ID NO: 1095140 - protein, 4 aa, Mycobacterium
GGTR

SEQ ID NO: 1095141 - protein, 4 aa, Mycobacterium
GGTT

SEQ ID NO: 1095142 - protein, 7 aa, Mycobacterium
GGVPENF

SEQ ID NO: 1095143 - protein, 5 aa, Mycobacterium
GHPPG

SEQ ID NO: 1095144 - protein, 5 aa, Mycobacterium
GHTHG

SEQ ID NO: 1095145 - protein, 5 aa, Mycobacterium
GIASA

SEQ ID NO: 1095146 - protein, 7 aa, Mycobacterium
GKLPDSL

SEQ ID NO: 1095147 - protein, 4 aa, Mycobacterium
GLDG

SEQ ID NO: 1095148 - protein, 8 aa, Mycobacterium
GLDTGQLS

SEQ ID NO: 1095149 - protein, 7 aa, Mycobacterium
GLGQGTA

SEQ ID NO: 1095150 - protein, 4 aa, Mycobacterium
GLPG

SEQ ID NO: 1095151 - protein, 9 aa, Mycobacterium
GLQPGGPVR

SEQ ID NO: 1095152 - protein, 8 aa, Mycobacterium
GLTDQEAR

SEQ ID NO: 1095153 - protein, 4 aa, Mycobacterium
GLTV

SEQ ID NO: 1095154 - protein, 11 aa, Mycobacterium
GNGRDDGALAN

SEQ ID NO: 1095155 - protein, 10 aa, Mycobacterium
GNKSRGGTAV

SEQ ID NO: 1095156 - protein, 6 aa, Mycobacterium
GNTAAN

SEQ ID NO: 1095157 - protein, 5 aa, Mycobacterium
GPAAG

SEQ ID NO: 1095158 - protein, 5 aa, Mycobacterium
GPAAL

SEQ ID NO: 1095159 - protein, 9 aa, Mycobacterium
GPDDSARAV

SEQ ID NO: 1095160 - protein, 11 aa, Mycobacterium
GPDGQNPPDEV

SEQ ID NO: 1095161 - protein, 4 aa, Mycobacterium
GPGT

SEQ ID NO: 1095162 - protein, 8 aa, Mycobacterium
GPPGTGKT

SEQ ID NO: 1095163 - protein, 7 aa, Mycobacterium
GPRLTPG

SEQ ID NO: 1095164 - protein, 10 aa, Mycobacterium
GPSGAGKSTF

SEQ ID NO: 1095165 - protein, 8 aa, Mycobacterium
GPSGRAAA

SEQ ID NO: 1095166 - protein, 6 aa, Mycobacterium
GPSGRG

SEQ ID NO: 1095167 - protein, 9 aa, Mycobacterium
GPTGAGKTT

SEQ ID NO: 1095168 - protein, 5 aa, Mycobacterium
GPTGI

SEQ ID NO: 1095169 - protein, 8 aa, Mycobacterium
GQAASPEQ

SEQ ID NO: 1095170 - protein, 6 aa, Mycobacterium
GQGGTI

SEQ ID NO: 1095171 - protein, 5 aa, Mycobacterium
GQGNK

SEQ ID NO: 1095172 - protein, 4 aa, Mycobacterium
GQGS

SEQ ID NO: 1095173 - protein, 6 aa, Mycobacterium
GQIGDK

SEQ ID NO: 1095174 - protein, 9 aa, Mycobacterium
GQTSIADRA

SEQ ID NO: 1095175 - protein, 7 aa, Mycobacterium
GQVNGPK

SEQ ID NO: 1095176 - protein, 7 aa, Mycobacterium
GRDNQNR

SEQ ID NO: 1095177 - protein, 7 aa, Mycobacterium
GRDPKTD

SEQ ID NO: 1095178 - protein, 8 aa, Mycobacterium
GRGWPKPV

SEQ ID NO: 1095179 - protein, 13 aa, Mycobacterium
GRIPGTAAGPSRR

SEQ ID NO: 1095180 - protein, 13 aa, Mycobacterium
GRITAEEAHSHPQ

SEQ ID NO: 1095181 - protein, 8 aa, Mycobacterium
GRPSAGLA

SEQ ID NO: 1095182 - protein, 6 aa, Mycobacterium
GRSDLS

SEQ ID NO: 1095183 - protein, 6 aa, Mycobacterium
GRTGGH

SEQ ID NO: 1095184 - protein, 15 aa, Mycobacterium
GRVPSDKPPIKTPGE

SEQ ID NO: 1095185 - protein, 6 aa, Mycobacterium
GSFGGE

SEQ ID NO: 1095186 - protein, 6 aa, Mycobacterium
GSFNYG

SEQ ID NO: 1095187 - protein, 7 aa, Mycobacterium
GSGAEEY

SEQ ID NO: 1095188 - protein, 7 aa, Mycobacterium
GSGKSQT

SEQ ID NO: 1095189 - protein, 10 aa, Mycobacterium
GSGPEQATRP

SEQ ID NO: 1095190 - protein, 5 aa, Mycobacterium
GSHTG

SEQ ID NO: 1095191 - protein, 10 aa, Mycobacterium
GSNNAAGYQL

SEQ ID NO: 1095192 - protein, 10 aa, Mycobacterium
GSPTDAGTPI

SEQ ID NO: 1095193 - protein, 4 aa, Mycobacterium
GSSG

SEQ ID NO: 1095194 - protein, 6 aa, Mycobacterium
GSTGGV

SEQ ID NO: 1095195 - protein, 10 aa, Mycobacterium
GSTGSGKSSF

SEQ ID NO: 1095196 - protein, 9 aa, Mycobacterium
GSTGSGKST

SEQ ID NO: 1095197 - protein, 8 aa, Mycobacterium
GSTNGTYL

SEQ ID NO: 1095198 - protein, 4 aa, Mycobacterium
GTAT

SEQ ID NO: 1095199 - protein, 8 aa, Mycobacterium
GTATTGRL

SEQ ID NO: 1095200 - protein, 5 aa, Mycobacterium
GTGTD

SEQ ID NO: 1095201 - protein, 12 aa, Mycobacterium
GTLGDPTAAESV

SEQ ID NO: 1095202 - protein, 12 aa, Mycobacterium
GTPDYGAPARLD

SEQ ID NO: 1095203 - protein, 5 aa, Mycobacterium
GTPGD

SEQ ID NO: 1095204 - protein, 6 aa, Mycobacterium
GTRDFS

SEQ ID NO: 1095205 - protein, 10 aa, Mycobacterium
GTTGAGKTTI

SEQ ID NO: 1095206 - protein, 4 aa, Mycobacterium
GVGD

SEQ ID NO: 1095207 - protein, 7 aa, Mycobacterium
GVNDAAA

SEQ ID NO: 1095208 - protein, 16 aa, Mycobacterium
GVNGSPRVPAEPGGDF

SEQ ID NO: 1095209 - protein, 11 aa, Mycobacterium
GVTRPTGERLD

SEQ ID NO: 1095210 - protein, 6 aa, Mycobacterium
GYGPTV

SEQ ID NO: 1095211 - protein, 5 aa, Mycobacterium
HAAAS

SEQ ID NO: 1095212 - protein, 10 aa, Mycobacterium
HAPKPDPSIG

SEQ ID NO: 1095213 - protein, 5 aa, Mycobacterium
HDPYS

SEQ ID NO: 1095214 - protein, 7 aa, Mycobacterium
HDTGNAM

SEQ ID NO: 1095215 - protein, 4 aa, Mycobacterium
HEGG

SEQ ID NO: 1095216 - protein, 4 aa, Mycobacterium
HELR

SEQ ID NO: 1095217 - protein, 9 aa, Mycobacterium
HGTNDAQKT

SEQ ID NO: 1095218 - protein, 4 aa, Mycobacterium
HHPD

SEQ ID NO: 1095219 - protein, 5 aa, Mycobacterium
HPERS

SEQ ID NO: 1095220 - protein, 4 aa, Mycobacterium
HPLR

SEQ ID NO: 1095221 - protein, 4 aa, Mycobacterium
HRRS

SEQ ID NO: 1095222 - protein, 7 aa, Mycobacterium
HSPGAGG

SEQ ID NO: 1095223 - protein, 8 aa, Mycobacterium
HSRGEGQT

SEQ ID NO: 1095224 - protein, 5 aa, Mycobacterium
HTEGR

SEQ ID NO: 1095225 - protein, 5 aa, Mycobacterium
IASPT

SEQ ID NO: 1095226 - protein, 7 aa, Mycobacterium
IATTGAA

SEQ ID NO: 1095227 - protein, 5 aa, Mycobacterium
IGEQG

SEQ ID NO: 1095228 - protein, 6 aa, Mycobacterium
IKGDAS

SEQ ID NO: 1095229 - protein, 4 aa, Mycobacterium
IPEA

SEQ ID NO: 1095230 - protein, 6 aa, Mycobacterium
IPGKSA

SEQ ID NO: 1095231 - protein, 7 aa, Mycobacterium
IPTGAET

SEQ ID NO: 1095232 - protein, 8 aa, Mycobacterium
ITNKESGV

SEQ ID NO: 1095233 - protein, 9 aa, Mycobacterium
ITNTGGASY

SEQ ID NO: 1095234 - protein, 5 aa, Mycobacterium
ITPRE

SEQ ID NO: 1095235 - protein, 8 aa, Mycobacterium
KAATVGKV

SEQ ID NO: 1095236 - protein, 7 aa, Mycobacterium
KAQIQES

SEQ ID NO: 1095237 - protein, 5 aa, Mycobacterium
KARAA

SEQ ID NO: 1095238 - protein, 11 aa, Mycobacterium
KATTVLGERSN

SEQ ID NO: 1095239 - protein, 5 aa, Mycobacterium
KDRVD

SEQ ID NO: 1095240 - protein, 8 aa, Mycobacterium
KESRDRLK

SEQ ID NO: 1095241 - protein, 7 aa, Mycobacterium
KFATGAG

SEQ ID NO: 1095242 - protein, 10 aa, Mycobacterium
KGAAGVGNAV

SEQ ID NO: 1095243 - protein, 6 aa, Mycobacterium
KGEAGA

SEQ ID NO: 1095244 - protein, 6 aa, Mycobacterium
KGGGLS

SEQ ID NO: 1095245 - protein, 8 aa, Mycobacterium
KKDQLGEG

SEQ ID NO: 1095246 - protein, 5 aa, Mycobacterium
KKGLT

SEQ ID NO: 1095247 - protein, 9 aa, Mycobacterium
KLDSDLPAA

SEQ ID NO: 1095248 - protein, 11 aa, Mycobacterium
KLSGGQRKRAS

SEQ ID NO: 1095249 - protein, 12 aa, Mycobacterium
KMAKAGRAAQAL

SEQ ID NO: 1095250 - protein, 5 aa, Mycobacterium
KNDSL

SEQ ID NO: 1095251 - protein, 8 aa, Mycobacterium
KPGPPPLT

SEQ ID NO: 1095252 - protein, 4 aa, Mycobacterium
KRPR

SEQ ID NO: 1095253 - protein, 6 aa, Mycobacterium
KSAQVP

SEQ ID NO: 1095254 - protein, 4 aa, Mycobacterium
KSST

SEQ ID NO: 1095255 - protein, 4 aa, Mycobacterium
KTGQ

SEQ ID NO: 1095256 - protein, 11 aa, Mycobacterium
KTQKTKTRAEV

SEQ ID NO: 1095257 - protein, 8 aa, Mycobacterium
KVKTSGDS

SEQ ID NO: 1095258 - protein, 4 aa, Mycobacterium
KYGR

SEQ ID NO: 1095259 - protein, 6 aa, Mycobacterium
LAASTM

SEQ ID NO: 1095260 - protein, 6 aa, Mycobacterium
LAEEAS

SEQ ID NO: 1095261 - protein, 10 aa, Mycobacterium
LAEETHDPER

SEQ ID NO: 1095262 - protein, 4 aa, Mycobacterium
LAGG

SEQ ID NO: 1095263 - protein, 4 aa, Mycobacterium
LAPG

SEQ ID NO: 1095264 - protein, 6 aa, Mycobacterium
LDEAER

SEQ ID NO: 1095265 - protein, 7 aa, Mycobacterium
LEPPPGV

SEQ ID NO: 1095266 - protein, 10 aa, Mycobacterium
LEREDKPSWR

SEQ ID NO: 1095267 - protein, 5 aa, Mycobacterium
LGATA

SEQ ID NO: 1095268 - protein, 6 aa, Mycobacterium
LGGSPT

SEQ ID NO: 1095269 - protein, 9 aa, Mycobacterium
LGGSTVPAA

SEQ ID NO: 1095270 - protein, 13 aa, Mycobacterium
LGNGQPGTVPAAS

SEQ ID NO: 1095271 - protein, 5 aa, Mycobacterium
LGPAG

SEQ ID NO: 1095272 - protein, 8 aa, Mycobacterium
LGPGPRDG

SEQ ID NO: 1095273 - protein, 7 aa, Mycobacterium
LGSEPAV

SEQ ID NO: 1095274 - protein, 4 aa, Mycobacterium
LNPD

SEQ ID NO: 1095275 - protein, 7 aa, Mycobacterium
LNQRDAQ

SEQ ID NO: 1095276 - protein, 4 aa, Mycobacterium
LPPR

SEQ ID NO: 1095277 - protein, 4 aa, Mycobacterium
LPSA

SEQ ID NO: 1095278 - protein, 12 aa, Mycobacterium
LPTRTSGKVDRD

SEQ ID NO: 1095279 - protein, 7 aa, Mycobacterium
LQDTPDD

SEQ ID NO: 1095280 - protein, 4 aa, Mycobacterium
LQEP

SEQ ID NO: 1095281 - protein, 8 aa, Mycobacterium
LRPEGQIA

SEQ ID NO: 1095282 - protein, 6 aa, Mycobacterium
LRPGEE

SEQ ID NO: 1095283 - protein, 7 aa, Mycobacterium
LSDAPPS

SEQ ID NO: 1095284 - protein, 8 aa, Mycobacterium
LSDPVSHD

SEQ ID NO: 1095285 - protein, 5 aa, Mycobacterium
LSGGQ

SEQ ID NO: 1095286 - protein, 8 aa, Mycobacterium
LSGGQRQR

SEQ ID NO: 1095287 - protein, 7 aa, Mycobacterium
LSPDGKT

SEQ ID NO: 1095288 - protein, 5 aa, Mycobacterium
LTGTP

SEQ ID NO: 1095289 - protein, 12 aa, Mycobacterium
LTPGRGFRNGPF

SEQ ID NO: 1095290 - protein, 12 aa, Mycobacterium
LVRSESAKHRQA

SEQ ID NO: 1095291 - protein, 7 aa, Mycobacterium
MEGPTPV

SEQ ID NO: 1095292 - protein, 4 aa, Mycobacterium
MGAG

SEQ ID NO: 1095293 - protein, 9 aa, Mycobacterium
MGGHAAGEV

SEQ ID NO: 1095294 - protein, 6 aa, Mycobacterium
MNGEDT

SEQ ID NO: 1095295 - protein, 7 aa, Mycobacterium
MPPTGGL

SEQ ID NO: 1095296 - protein, 5 aa, Mycobacterium
MRDST

SEQ ID NO: 1095297 - protein, 5 aa, Mycobacterium
MSTAN

SEQ ID NO: 1095298 - protein, 4 aa, Mycobacterium
MSTS

SEQ ID NO: 1095299 - protein, 8 aa, Mycobacterium
NASGGPVG

SEQ ID NO: 1095300 - protein, 20 aa, Mycobacterium
NATGGPAGVGEAVGRATRTS

SEQ ID NO: 1095301 - protein, 5 aa, Mycobacterium
NDPAA

SEQ ID NO: 1095302 - protein, 17 aa, Mycobacterium
NDYSDGIRGTDDVRSGP

SEQ ID NO: 1095303 - protein, 7 aa, Mycobacterium
NGEGEVP

SEQ ID NO: 1095304 - protein, 8 aa, Mycobacterium
NGKSPCTV

SEQ ID NO: 1095305 - protein, 7 aa, Mycobacterium
NGSGKST

SEQ ID NO: 1095306 - protein, 8 aa, Mycobacterium
NGSHAPAG

SEQ ID NO: 1095307 - protein, 8 aa, Mycobacterium
NKTTLKPA

SEQ ID NO: 1095308 - protein, 8 aa, Mycobacterium
NLGPTAGL

SEQ ID NO: 1095309 - protein, 4 aa, Mycobacterium
NPGA

SEQ ID NO: 1095310 - protein, 4 aa, Mycobacterium
NPPD

SEQ ID NO: 1095311 - protein, 6 aa, Mycobacterium
NPSRYQ

SEQ ID NO: 1095312 - protein, 6 aa, Mycobacterium
NPTGDQ

SEQ ID NO: 1095313 - protein, 6 aa, Mycobacterium
NPVGGE

SEQ ID NO: 1095314 - protein, 5 aa, Mycobacterium
NPWPT

SEQ ID NO: 1095315 - protein, 5 aa, Mycobacterium
NRDDT

SEQ ID NO: 1095316 - protein, 5 aa, Mycobacterium
NRPDI

SEQ ID NO: 1095317 - protein, 9 aa, Mycobacterium
NRQRSNPST

SEQ ID NO: 1095318 - protein, 6 aa, Mycobacterium
NSPDEE

SEQ ID NO: 1095319 - protein, 6 aa, Mycobacterium
NSSDDG

SEQ ID NO: 1095320 - protein, 6 aa, Mycobacterium
NTADDG

SEQ ID NO: 1095321 - protein, 5 aa, Mycobacterium
NTESA

SEQ ID NO: 1095322 - protein, 6 aa, Mycobacterium
NTGPHG

SEQ ID NO: 1095323 - protein, 4 aa, Mycobacterium
NTGR

SEQ ID NO: 1095324 - protein, 10 aa, Mycobacterium
NTSVNPARST

SEQ ID NO: 1095325 - protein, 5 aa, Mycobacterium
NTTIA

SEQ ID NO: 1095326 - protein, 13 aa, Mycobacterium
NYPPDRGRQLTAT

SEQ ID NO: 1095327 - protein, 4 aa, Mycobacterium
PAAA

SEQ ID NO: 1095328 - protein, 7 aa, Mycobacterium
PAGGAEL

SEQ ID NO: 1095329 - protein, 8 aa, Mycobacterium
PAGRRGET

SEQ ID NO: 1095330 - protein, 4 aa, Mycobacterium
PASP

SEQ ID NO: 1095331 - protein, 6 aa, Mycobacterium
PATGAI

SEQ ID NO: 1095332 - protein, 17 aa, Mycobacterium
PDEVAPGPTDSSIPQGR

SEQ ID NO: 1095333 - protein, 9 aa, Mycobacterium
PDGQTRTQT

SEQ ID NO: 1095334 - protein, 6 aa, Mycobacterium
PDLGQT

SEQ ID NO: 1095335 - protein, 4 aa, Mycobacterium
PEDP

SEQ ID NO: 1095336 - protein, 4 aa, Mycobacterium
PEPL

SEQ ID NO: 1095337 - protein, 9 aa, Mycobacterium
PGINDPTTA

SEQ ID NO: 1095338 - protein, 5 aa, Mycobacterium
PGPLR

SEQ ID NO: 1095339 - protein, 7 aa, Mycobacterium
PGPNNQQ

SEQ ID NO: 1095340 - protein, 5 aa, Mycobacterium
PGQRF

SEQ ID NO: 1095341 - protein, 7 aa, Mycobacterium
PGRPAPR

SEQ ID NO: 1095342 - protein, 6 aa, Mycobacterium
PGVGPV

SEQ ID NO: 1095343 - protein, 5 aa, Mycobacterium
PHDSM

SEQ ID NO: 1095344 - protein, 6 aa, Mycobacterium
PHPGPV

SEQ ID NO: 1095345 - protein, 11 aa, Mycobacterium
PINGQTTGDVT

SEQ ID NO: 1095346 - protein, 12 aa, Mycobacterium
PIPAPGETVTND

SEQ ID NO: 1095347 - protein, 11 aa, Mycobacterium
PISQSEVGSVQ

SEQ ID NO: 1095348 - protein, 9 aa, Mycobacterium
PKKHGRDSR

SEQ ID NO: 1095349 - protein, 5 aa, Mycobacterium
PKPVT

SEQ ID NO: 1095350 - protein, 4 aa, Mycobacterium
PLGG

SEQ ID NO: 1095351 - protein, 4 aa, Mycobacterium
PLRV

SEQ ID NO: 1095352 - protein, 12 aa, Mycobacterium
PLSGDGSDTDTV

SEQ ID NO: 1095353 - protein, 7 aa, Mycobacterium
PLTPPET

SEQ ID NO: 1095354 - protein, 4 aa, Mycobacterium
PPAP

SEQ ID NO: 1095355 - protein, 7 aa, Mycobacterium
PPDARGR

SEQ ID NO: 1095356 - protein, 6 aa, Mycobacterium
PPDEND

SEQ ID NO: 1095357 - protein, 5 aa, Mycobacterium
PPEAN

SEQ ID NO: 1095358 - protein, 5 aa, Mycobacterium
PPEDR

SEQ ID NO: 1095359 - protein, 7 aa, Mycobacterium
PPGTTPY

SEQ ID NO: 1095360 - protein, 6 aa, Mycobacterium
PPNASP

SEQ ID NO: 1095361 - protein, 4 aa, Mycobacterium
PPPD

SEQ ID NO: 1095362 - protein, 8 aa, Mycobacterium
PPRTPDRP

SEQ ID NO: 1095363 - protein, 5 aa, Mycobacterium
PPRVP

SEQ ID NO: 1095364 - protein, 6 aa, Mycobacterium
PQLGPT

SEQ ID NO: 1095365 - protein, 7 aa, Mycobacterium
PQTRSTR

SEQ ID NO: 1095366 - protein, 15 aa, Mycobacterium
PRERAGAAAAVSETA

SEQ ID NO: 1095367 - protein, 7 aa, Mycobacterium
PRNPTGK

SEQ ID NO: 1095368 - protein, 7 aa, Mycobacterium
PRTRNPV

SEQ ID NO: 1095369 - protein, 4 aa, Mycobacterium
PSVV

SEQ ID NO: 1095370 - protein, 8 aa, Mycobacterium
PTADSPPV

SEQ ID NO: 1095371 - protein, 6 aa, Mycobacterium
PTANGD

SEQ ID NO: 1095372 - protein, 10 aa, Mycobacterium
PTDMRTGKGL

SEQ ID NO: 1095373 - protein, 4 aa, Mycobacterium
PTGN

SEQ ID NO: 1095374 - protein, 5 aa, Mycobacterium
PTNAT

SEQ ID NO: 1095375 - protein, 4 aa, Mycobacterium
PTPW

SEQ ID NO: 1095376 - protein, 8 aa, Mycobacterium
PTSGLDPA

SEQ ID NO: 1095377 - protein, 5 aa, Mycobacterium
PTSTA

SEQ ID NO: 1095378 - protein, 5 aa, Mycobacterium
PTYSN

SEQ ID NO: 1095379 - protein, 7 aa, Mycobacterium
PVDGPEA

SEQ ID NO: 1095380 - protein, 4 aa, Mycobacterium
PVNE

SEQ ID NO: 1095381 - protein, 4 aa, Mycobacterium
PWGY

SEQ ID NO: 1095382 - protein, 14 aa, Mycobacterium
PYPRTGQGGDPKLT

SEQ ID NO: 1095383 - protein, 4 aa, Mycobacterium
QAAY

SEQ ID NO: 1095384 - protein, 8 aa, Mycobacterium
QAGAESAP

SEQ ID NO: 1095385 - protein, 5 aa, Mycobacterium
QALGA

SEQ ID NO: 1095386 - protein, 5 aa, Mycobacterium
QAYAR

SEQ ID NO: 1095387 - protein, 8 aa, Mycobacterium
QEKKRTAR

SEQ ID NO: 1095388 - protein, 5 aa, Mycobacterium
QGAAR

SEQ ID NO: 1095389 - protein, 9 aa, Mycobacterium
QGAQLGAGP

SEQ ID NO: 1095390 - protein, 5 aa, Mycobacterium
QGSAT

SEQ ID NO: 1095391 - protein, 15 aa, Mycobacterium
QKSVYRKAEGQTGAA

SEQ ID NO: 1095392 - protein, 10 aa, Mycobacterium
QLASGAQALA

SEQ ID NO: 1095393 - protein, 5 aa, Mycobacterium
QLGAE

SEQ ID NO: 1095394 - protein, 7 aa, Mycobacterium
QPPQPSL

SEQ ID NO: 1095395 - protein, 4 aa, Mycobacterium
QPSE

SEQ ID NO: 1095396 - protein, 5 aa, Mycobacterium
QRGNY

SEQ ID NO: 1095397 - protein, 5 aa, Mycobacterium
QRPSV

SEQ ID NO: 1095398 - protein, 9 aa, Mycobacterium
QRRAQVPAD

SEQ ID NO: 1095399 - protein, 4 aa, Mycobacterium
QRSQ

SEQ ID NO: 1095400 - protein, 15 aa, Mycobacterium
QSGADSTVVTSETAG

SEQ ID NO: 1095401 - protein, 7 aa, Mycobacterium
QSNSMAS

SEQ ID NO: 1095402 - protein, 4 aa, Mycobacterium
QSSM

SEQ ID NO: 1095403 - protein, 15 aa, Mycobacterium
QTDASINHGNSGGPL

SEQ ID NO: 1095404 - protein, 5 aa, Mycobacterium
QTPDF

SEQ ID NO: 1095405 - protein, 4 aa, Mycobacterium
QTSV

SEQ ID NO: 1095406 - protein, 9 aa, Mycobacterium
RAEEESGAA

SEQ ID NO: 1095407 - protein, 4 aa, Mycobacterium
RAGD

SEQ ID NO: 1095408 - protein, 8 aa, Mycobacterium
RAGRDDRV

SEQ ID NO: 1095409 - protein, 5 aa, Mycobacterium
RAQRR

SEQ ID NO: 1095410 - protein, 8 aa, Mycobacterium
RARTPGEL

SEQ ID NO: 1095411 - protein, 5 aa, Mycobacterium
RASQL

SEQ ID NO: 1095412 - protein, 6 aa, Mycobacterium
RATRPD

SEQ ID NO: 1095413 - protein, 8 aa, Mycobacterium
RATSADGH

SEQ ID NO: 1095414 - protein, 8 aa, Mycobacterium
RDDPAGQA

SEQ ID NO: 1095415 - protein, 5 aa, Mycobacterium
RDPLT

SEQ ID NO: 1095416 - protein, 9 aa, Mycobacterium
RDRVAGPGC

SEQ ID NO: 1095417 - protein, 8 aa, Mycobacterium
RDSPTWSP

SEQ ID NO: 1095418 - protein, 5 aa, Mycobacterium
REGPT

SEQ ID NO: 1095419 - protein, 6 aa, Mycobacterium
RGAGQT

SEQ ID NO: 1095420 - protein, 8 aa, Mycobacterium
RGAPRGGA

SEQ ID NO: 1095421 - protein, 10 aa, Mycobacterium
RGDATDDELR

SEQ ID NO: 1095422 - protein, 8 aa, Mycobacterium
RGGGPDNV

SEQ ID NO: 1095423 - protein, 5 aa, Mycobacterium
RGQLT

SEQ ID NO: 1095424 - protein, 6 aa, Mycobacterium
RGRYQG

SEQ ID NO: 1095425 - protein, 8 aa, Mycobacterium
RGSATDSE

SEQ ID NO: 1095426 - protein, 12 aa, Mycobacterium
RGSTASHSGSGL

SEQ ID NO: 1095427 - protein, 4 aa, Mycobacterium
RGTH

SEQ ID NO: 1095428 - protein, 7 aa, Mycobacterium
RGVPDGG

SEQ ID NO: 1095429 - protein, 4 aa, Mycobacterium
RGVT

SEQ ID NO: 1095430 - protein, 8 aa, Mycobacterium
RIASKSSA

SEQ ID NO: 1095431 - protein, 6 aa, Mycobacterium
RKPTGG

SEQ ID NO: 1095432 - protein, 4 aa, Mycobacterium
RPAG

SEQ ID NO: 1095433 - protein, 8 aa, Mycobacterium
RPDGEEPE

SEQ ID NO: 1095434 - protein, 7 aa, Mycobacterium
RPEFGTP

SEQ ID NO: 1095435 - protein, 4 aa, Mycobacterium
RPEP

SEQ ID NO: 1095436 - protein, 5 aa, Mycobacterium
RPLGR

SEQ ID NO: 1095437 - protein, 4 aa, Mycobacterium
RPRD

SEQ ID NO: 1095438 - protein, 4 aa, Mycobacterium
RPRE

SEQ ID NO: 1095439 - protein, 6 aa, Mycobacterium
RPRTLP

SEQ ID NO: 1095440 - protein, 7 aa, Mycobacterium
RQPEAQG

SEQ ID NO: 1095441 - protein, 6 aa, Mycobacterium
RQPIAP

SEQ ID NO: 1095442 - protein, 5 aa, Mycobacterium
RQRGE

SEQ ID NO: 1095443 - protein, 5 aa, Mycobacterium
RRAEI

SEQ ID NO: 1095444 - protein, 6 aa, Mycobacterium
RRGDDM

SEQ ID NO: 1095445 - protein, 4 aa, Mycobacterium
RRGF

SEQ ID NO: 1095446 - protein, 8 aa, Mycobacterium
RRGRGTPT

SEQ ID NO: 1095447 - protein, 4 aa, Mycobacterium
RRNG

SEQ ID NO: 1095448 - protein, 4 aa, Mycobacterium
RRRR

SEQ ID NO: 1095449 - protein, 7 aa, Mycobacterium
RRSGAYT

SEQ ID NO: 1095450 - protein, 7 aa, Mycobacterium
RSGARTR

SEQ ID NO: 1095451 - protein, 4 aa, Mycobacterium
RSGT

SEQ ID NO: 1095452 - protein, 9 aa, Mycobacterium
RSPQSPNGT

SEQ ID NO: 1095453 - protein, 18 aa, Mycobacterium
RSREYQADQSGAELTGDP

SEQ ID NO: 1095454 - protein, 4 aa, Mycobacterium
RSRV

SEQ ID NO: 1095455 - protein, 4 aa, Mycobacterium
RSTA

SEQ ID NO: 1095456 - protein, 6 aa, Mycobacterium
RSVSTD

SEQ ID NO: 1095457 - protein, 5 aa, Mycobacterium
RTERY

SEQ ID NO: 1095458 - protein, 4 aa, Mycobacterium
RTIR

SEQ ID NO: 1095459 - protein, 4 aa, Mycobacterium
RTPW

SEQ ID NO: 1095460 - protein, 5 aa, Mycobacterium
RTQSR

SEQ ID NO: 1095461 - protein, 4 aa, Mycobacterium
RTSQ

SEQ ID NO: 1095462 - protein, 7 aa, Mycobacterium
RTTTPYT

SEQ ID NO: 1095463 - protein, 8 aa, Mycobacterium
RVGSDTQL

SEQ ID NO: 1095464 - protein, 7 aa, Mycobacterium
RVGTGNI

SEQ ID NO: 1095465 - protein, 5 aa, Mycobacterium
RVSGT

SEQ ID NO: 1095466 - protein, 6 aa, Mycobacterium
RYTPEA

SEQ ID NO: 1095467 - protein, 5 aa, Mycobacterium
SAAAE

SEQ ID NO: 1095468 - protein, 5 aa, Mycobacterium
SADES

SEQ ID NO: 1095469 - protein, 7 aa, Mycobacterium
SAGTADR

SEQ ID NO: 1095470 - protein, 5 aa, Mycobacterium
SAPGA

SEQ ID NO: 1095471 - protein, 7 aa, Mycobacterium
SAPLPTG

SEQ ID NO: 1095472 - protein, 6 aa, Mycobacterium
SAPPVT

SEQ ID NO: 1095473 - protein, 4 aa, Mycobacterium
SAST

SEQ ID NO: 1095474 - protein, 7 aa, Mycobacterium
SATESGL

SEQ ID NO: 1095475 - protein, 6 aa, Mycobacterium
SATGNP

SEQ ID NO: 1095476 - protein, 10 aa, Mycobacterium
SDGTGTAFDP

SEQ ID NO: 1095477 - protein, 5 aa, Mycobacterium
SDPAV

SEQ ID NO: 1095478 - protein, 7 aa, Mycobacterium
SDRDPLT

SEQ ID NO: 1095479 - protein, 4 aa, Mycobacterium
SDRF

SEQ ID NO: 1095480 - protein, 5 aa, Mycobacterium
SEDKT

SEQ ID NO: 1095481 - protein, 10 aa, Mycobacterium
SEPEGGSDVR

SEQ ID NO: 1095482 - protein, 17 aa, Mycobacterium
SERTDPQVGQPGTPALP

SEQ ID NO: 1095483 - protein, 14 aa, Mycobacterium
SGAYRATKVGREAY

SEQ ID NO: 1095484 - protein, 4 aa, Mycobacterium
SGEE

SEQ ID NO: 1095485 - protein, 8 aa, Mycobacterium
SGGPVGVG

SEQ ID NO: 1095486 - protein, 4 aa, Mycobacterium
SGGV

SEQ ID NO: 1095487 - protein, 10 aa, Mycobacterium
SGGVSVDEAH

SEQ ID NO: 1095488 - protein, 4 aa, Mycobacterium
SGIG

SEQ ID NO: 1095489 - protein, 7 aa, Mycobacterium
SGLRPRY

SEQ ID NO: 1095490 - protein, 8 aa, Mycobacterium
SGPAPPGL

SEQ ID NO: 1095491 - protein, 4 aa, Mycobacterium
SGPI

SEQ ID NO: 1095492 - protein, 5 aa, Mycobacterium
SGPRT

SEQ ID NO: 1095493 - protein, 4 aa, Mycobacterium
SGPT

SEQ ID NO: 1095494 - protein, 8 aa, Mycobacterium
SGSGTADV

SEQ ID NO: 1095495 - protein, 10 aa, Mycobacterium
SGSTSAPKGV

SEQ ID NO: 1095496 - protein, 5 aa, Mycobacterium
SGTGL

SEQ ID NO: 1095497 - protein, 9 aa, Mycobacterium
SGTTRDPKG

SEQ ID NO: 1095498 - protein, 6 aa, Mycobacterium
SGVGAA

SEQ ID NO: 1095499 - protein, 6 aa, Mycobacterium
SKESLA

SEQ ID NO: 1095500 - protein, 5 aa, Mycobacterium
SKTDG

SEQ ID NO: 1095501 - protein, 4 aa, Mycobacterium
SLGG

SEQ ID NO: 1095502 - protein, 9 aa, Mycobacterium
SLSGGQRQR

SEQ ID NO: 1095503 - protein, 5 aa, Mycobacterium
SPAAF

SEQ ID NO: 1095504 - protein, 4 aa, Mycobacterium
SPAT

SEQ ID NO: 1095505 - protein, 5 aa, Mycobacterium
SPDGK

SEQ ID NO: 1095506 - protein, 7 aa, Mycobacterium
SPGEQQR

SEQ ID NO: 1095507 - protein, 7 aa, Mycobacterium
SPKGKRI

SEQ ID NO: 1095508 - protein, 4 aa, Mycobacterium
SPNP

SEQ ID NO: 1095509 - protein, 6 aa, Mycobacterium
SPPEPV

SEQ ID NO: 1095510 - protein, 6 aa, Mycobacterium
SQEFTE

SEQ ID NO: 1095511 - protein, 6 aa, Mycobacterium
SRAEAA

SEQ ID NO: 1095512 - protein, 8 aa, Mycobacterium
SRLKAGQD

SEQ ID NO: 1095513 - protein, 9 aa, Mycobacterium
SSEAETVSA

SEQ ID NO: 1095514 - protein, 4 aa, Mycobacterium
SSET

SEQ ID NO: 1095515 - protein, 9 aa, Mycobacterium
SSGKSYSAY

SEQ ID NO: 1095516 - protein, 8 aa, Mycobacterium
SSGTTPKL

SEQ ID NO: 1095517 - protein, 4 aa, Mycobacterium
SSLG

SEQ ID NO: 1095518 - protein, 5 aa, Mycobacterium
SSPTA

SEQ ID NO: 1095519 - protein, 14 aa, Mycobacterium
SSSITTTDARRRTV

SEQ ID NO: 1095520 - protein, 5 aa, Mycobacterium
SSSSH

SEQ ID NO: 1095521 - protein, 4 aa, Mycobacterium
STAS

SEQ ID NO: 1095522 - protein, 9 aa, Mycobacterium
STGGEYGGA

SEQ ID NO: 1095523 - protein, 7 aa, Mycobacterium
SVDGSLT

SEQ ID NO: 1095524 - protein, 33 aa, Mycobacterium; identical to SEQ ID NO: 288220

SEQ ID NO: 1095525 - protein, 4 aa, Mycobacterium
TAAA

SEQ ID NO: 1095526 - protein, 5 aa, Mycobacterium
TAATA

SEQ ID NO: 1095527 - protein, 12 aa, Mycobacterium
TAGKSLSDSASG

SEQ ID NO: 1095528 - protein, 9 aa, Mycobacterium
TAGPNDPIA

SEQ ID NO: 1095529 - protein, 7 aa, Mycobacterium
TAKEARR

SEQ ID NO: 1095530 - protein, 9 aa, Mycobacterium
TAPSTRRDH

SEQ ID NO: 1095531 - protein, 8 aa, Mycobacterium
TAQADERG

SEQ ID NO: 1095532 - protein, 14 aa, Mycobacterium
TASLTSALADRDQA

SEQ ID NO: 1095533 - protein, 9 aa, Mycobacterium
TATAEDSTY

SEQ ID NO: 1095534 - protein, 8 aa, Mycobacterium
TDPRPEVA

SEQ ID NO: 1095535 - protein, 6 aa, Mycobacterium
TDPSSP

SEQ ID NO: 1095536 - protein, 7 aa, Mycobacterium
TDRSRAA

SEQ ID NO: 1095537 - protein, 7 aa, Mycobacterium
TDTAVSQ

SEQ ID NO: 1095538 - protein, 5 aa, Mycobacterium
TEDIG

SEQ ID NO: 1095539 - protein, 5 aa, Mycobacterium
TELQG

SEQ ID NO: 1095540 - protein, 6 aa, Mycobacterium
TERSPL

SEQ ID NO: 1095541 - protein, 4 aa, Mycobacterium
TGAI

SEQ ID NO: 1095542 - protein, 10 aa, Mycobacterium
TGCTRGPTVT

SEQ ID NO: 1095543 - protein, 4 aa, Mycobacterium
TGEY

SEQ ID NO: 1095544 - protein, 9 aa, Mycobacterium
TGGPESETL

SEQ ID NO: 1095545 - protein, 4 aa, Mycobacterium
TGGR

SEQ ID NO: 1095546 - protein, 5 aa, Mycobacterium
TGKAH

SEQ ID NO: 1095547 - protein, 7 aa, Mycobacterium
TGKPLSP

SEQ ID NO: 1095548 - protein, 7 aa, Mycobacterium
TGNTRDA

SEQ ID NO: 1095549 - protein, 5 aa, Mycobacterium
TGTAA

SEQ ID NO: 1095550 - protein, 6 aa, Mycobacterium
TKRQTL

SEQ ID NO: 1095551 - protein, 7 aa, Mycobacterium
TLGNGGW

SEQ ID NO: 1095552 - protein, 6 aa, Mycobacterium
TPAPYG

SEQ ID NO: 1095553 - protein, 4 aa, Mycobacterium
TPEY

SEQ ID NO: 1095554 - protein, 8 aa, Mycobacterium
TPGESSSV

SEQ ID NO: 1095555 - protein, 7 aa, Mycobacterium
TPGGAAD

SEQ ID NO: 1095556 - protein, 5 aa, Mycobacterium
TQAST

SEQ ID NO: 1095557 - protein, 5 aa, Mycobacterium
TQSAA

SEQ ID NO: 1095558 - protein, 5 aa, Mycobacterium
TQTGI

SEQ ID NO: 1095559 - protein, 12 aa, Mycobacterium
TRGGKPFTGAGY

SEQ ID NO: 1095560 - protein, 5 aa, Mycobacterium
TRPWN

SEQ ID NO: 1095561 - protein, 4 aa, Mycobacterium
TRRT

SEQ ID NO: 1095562 - protein, 7 aa, Mycobacterium
TRTTNDV

SEQ ID NO: 1095563 - protein, 12 aa, Mycobacterium
TSASGSSGGELV

SEQ ID NO: 1095564 - protein, 6 aa, Mycobacterium
TSATSG

SEQ ID NO: 1095565 - protein, 6 aa, Mycobacterium
TSGRLT

SEQ ID NO: 1095566 - protein, 4 aa, Mycobacterium
TSKL

SEQ ID NO: 1095567 - protein, 8 aa, Mycobacterium
TSPDGSVA

SEQ ID NO: 1095568 - protein, 4 aa, Mycobacterium
TSRT

SEQ ID NO: 1095569 - protein, 7 aa, Mycobacterium
TSSLDIP

SEQ ID NO: 1095570 - protein, 8 aa, Mycobacterium
TSSSESAL

SEQ ID NO: 1095571 - protein, 5 aa, Mycobacterium
TTARA

SEQ ID NO: 1095572 - protein, 4 aa, Mycobacterium
TTAS

SEQ ID NO: 1095573 - protein, 8 aa, Mycobacterium
TTGSGKSE

SEQ ID NO: 1095574 - protein, 4 aa, Mycobacterium
TTLS

SEQ ID NO: 1095575 - protein, 4 aa, Mycobacterium
TTLT

SEQ ID NO: 1095576 - protein, 9 aa, Mycobacterium
TTRGAGTLA

SEQ ID NO: 1095577 - protein, 7 aa, Mycobacterium
TTRSSQL

SEQ ID NO: 1095578 - protein, 16 aa, Mycobacterium
TTSSAESKAVIGTPEA

SEQ ID NO: 1095579 - protein, 6 aa, Mycobacterium
TTTGTG

SEQ ID NO: 1095580 - protein, 5 aa, Mycobacterium
TVGMS

SEQ ID NO: 1095581 - protein, 5 aa, Mycobacterium
TVTGD

SEQ ID NO: 1095582 - protein, 6 aa, Mycobacterium
VAESAD

SEQ ID NO: 1095583 - protein, 6 aa, Mycobacterium
VANGSR

SEQ ID NO: 1095584 - protein, 7 aa, Mycobacterium
VAPDAPV

SEQ ID NO: 1095585 - protein, 6 aa, Mycobacterium
VAPPRV

SEQ ID NO: 1095586 - protein, 10 aa, Mycobacterium
VASEGTGSAL

SEQ ID NO: 1095587 - protein, 4 aa, Mycobacterium
VASG

SEQ ID NO: 1095588 - protein, 6 aa, Mycobacterium
VEAAGD

SEQ ID NO: 1095589 - protein, 7 aa, Mycobacterium
VEATPAS

SEQ ID NO: 1095590 - protein, 5 aa, Mycobacterium
VEPGE

SEQ ID NO: 1095591 - protein, 10 aa, Mycobacterium
VERTTSPYQL

SEQ ID NO: 1095592 - protein, 6 aa, Mycobacterium
VETGSN

SEQ ID NO: 1095593 - protein, 8 aa, Mycobacterium
VGGPRRKS

SEQ ID NO: 1095594 - protein, 10 aa, Mycobacterium
VGPSEGSKAR

SEQ ID NO: 1095595 - protein, 4 aa, Mycobacterium
VGSR

SEQ ID NO: 1095596 - protein, 8 aa, Mycobacterium
VGTPSRLS

SEQ ID NO: 1095597 - protein, 4 aa, Mycobacterium
VGTQ

SEQ ID NO: 1095598 - protein, 7 aa, Mycobacterium
VGTQTET

SEQ ID NO: 1095599 - protein, 9 aa, Mycobacterium
VNTTDGTTV

SEQ ID NO: 1095600 - protein, 8 aa, Mycobacterium
VPGETEVS

SEQ ID NO: 1095601 - protein, 6 aa, Mycobacterium
VPNTDR

SEQ ID NO: 1095602 - protein, 4 aa, Mycobacterium
VPSE

SEQ ID NO: 1095603 - protein, 4 aa, Mycobacterium
VPTT

SEQ ID NO: 1095604 - protein, 4 aa, Mycobacterium
VPVA

SEQ ID NO: 1095605 - protein, 10 aa, Mycobacterium
VQSSLSGSTV

SEQ ID NO: 1095606 - protein, 8 aa, Mycobacterium
VRAGRAPQ

SEQ ID NO: 1095607 - protein, 6 aa, Mycobacterium
VRHQDQ

SEQ ID NO: 1095608 - protein, 4 aa, Mycobacterium
VSGG

SEQ ID NO: 1095609 - protein, 8 aa, Mycobacterium
VSGGESGQ

SEQ ID NO: 1095610 - protein, 5 aa, Mycobacterium
VSGTW

SEQ ID NO: 1095611 - protein, 7 aa, Mycobacterium
VSLAGGG

SEQ ID NO: 1095612 - protein, 8 aa, Mycobacterium
VSRSGATI

SEQ ID NO: 1095613 - protein, 9 aa, Mycobacterium
VSRSTNDVE

SEQ ID NO: 1095614 - protein, 7 aa, Mycobacterium
VSTPRSY

SEQ ID NO: 1095615 - protein, 9 aa, Mycobacterium
VSTSARTIT

SEQ ID NO: 1095616 - protein, 9 aa, Mycobacterium
VTGTKAPGD

SEQ ID NO: 1095617 - protein, 7 aa, Mycobacterium
VTQGEAV

SEQ ID NO: 1095618 - protein, 4 aa, Mycobacterium
VTSA

SEQ ID NO: 1095619 - protein, 9 aa, Mycobacterium
VTTASSAGA

SEQ ID NO: 1095620 - protein, 12 aa, Mycobacterium
VTVGTDDDGPGL

SEQ ID NO: 1095621 - protein, 4 aa, Mycobacterium
YART

SEQ ID NO: 1095622 - protein, 6 aa, Mycobacterium
YASTRH

SEQ ID NO: 1095623 - protein, 11 aa, Mycobacterium
YGEESKDPKRI

SEQ ID NO: 1095624 - protein, 8 aa, Mycobacterium
YGTEHGDP

SEQ ID NO: 1095625 - protein, 5 aa, Mycobacterium
YKEDM

SEQ ID NO: 1095626 - protein, 12 aa, Mycobacterium
YKPSQVSAGSQP

SEQ ID NO: 1095627 - protein, 4 aa, Mycobacterium
YPGP

SEQ ID NO: 1095628 - protein, 7 aa, Mycobacterium
YPQAAGA

SEQ ID NO: 1095629 - protein, 18 aa, Mycobacterium
YRGTDNKMRTEEVDAERA

SEQ ID NO: 1095630 - protein, 8 aa, Mycobacterium
YRREPRNQ

SEQ ID NO: 1095631 - protein, 4 aa, Mycobacterium
YRSA

SEQ ID NO: 1095632 - protein, 15 aa, Mycobacterium
YSNEAGQGTGPHAAA

SEQ ID NO: 1095633 - protein, 8 aa, Mycobacterium
AAAAAGGG

SEQ ID NO: 1095634 - protein, 24 aa, Mycobacterium
AAAADEAPVRERTDEGLPVRDPGA

SEQ ID NO: 1095635 - protein, 9 aa, Mycobacterium
AAAAGYGVA

SEQ ID NO: 1095636 - protein, 15 aa, Mycobacterium
AAAAQDRAARAAAER

SEQ ID NO: 1095637 - protein, 6 aa, Mycobacterium
AAAASY

SEQ ID NO: 1095638 - protein, 8 aa, Mycobacterium
AAAATGVG

SEQ ID NO: 1095639 - protein, 17 aa, Mycobacterium
AAADGGEPLPDGRALQG

SEQ ID NO: 1095640 - protein, 10 aa, Mycobacterium
AAAEAPTGMA

SEQ ID NO: 1095641 - protein, 7 aa, Mycobacterium
AAAEPLR

SEQ ID NO: 1095642 - protein, 9 aa, Mycobacterium
AAAESGDAT

SEQ ID NO: 1095643 - protein, 9 aa, Mycobacterium
AAAGAGAAN

SEQ ID NO: 1095644 - protein, 6 aa, Mycobacterium
AAAGGI

SEQ ID NO: 1095645 - protein, 20 aa, Mycobacterium
AAAGPGVPADSTDHLWLTRR

SEQ ID NO: 1095646 - protein, 8 aa, Mycobacterium
AAAGPVGR

SEQ ID NO: 1095647 - protein, 8 aa, Mycobacterium
AAAGVSGP

SEQ ID NO: 1095648 - protein, 8 aa, Mycobacterium
AAAKTQLT

SEQ ID NO: 1095649 - protein, 8 aa, Mycobacterium
AAAPGANI

SEQ ID NO: 1095650 - protein, 15 aa, Mycobacterium
AAAPTGTTPVAHTGA

SEQ ID NO: 1095651 - protein, 10 aa, Mycobacterium
AAAPTTAPAP

SEQ ID NO: 1095652 - protein, 15 aa, Mycobacterium
AAAQGPEADRYTTAN

SEQ ID NO: 1095653 - protein, 10 aa, Mycobacterium
AAAQRSREMG

SEQ ID NO: 1095654 - protein, 5 aa, Mycobacterium
AAARE

SEQ ID NO: 1095655 - protein, 9 aa, Mycobacterium
AAASRRRDY

SEQ ID NO: 1095656 - protein, 8 aa, Mycobacterium
AAASSSAV

SEQ ID NO: 1095657 - protein, 14 aa, Mycobacterium
AAATGHPADGLTTD

SEQ ID NO: 1095658 - protein, 6 aa, Mycobacterium
AAATRE

SEQ ID NO: 1095659 - protein, 14 aa, Mycobacterium
AAAVTGPGAPAAQR

SEQ ID NO: 1095660 - protein, 9 aa, Mycobacterium
AADAEQSSL

SEQ ID NO: 1095661 - protein, 11 aa, Mycobacterium
AADDSRPNASM

SEQ ID NO: 1095662 - protein, 13 aa, Mycobacterium
AADGLNDAAAPRQ

SEQ ID NO: 1095663 - protein, 8 aa, Mycobacterium
AADGPSLR

SEQ ID NO: 1095664 - protein, 31 aa, Mycobacterium
AADNPDAARVEGSAGAPSAAAPAGDVGWGTR

SEQ ID NO: 1095665 - protein, 4 aa, Mycobacterium
AADP

SEQ ID NO: 1095666 - protein, 7 aa, Mycobacterium
AADPRAK

SEQ ID NO: 1095667 - protein, 9 aa, Mycobacterium
AADQGPTLA

SEQ ID NO: 1095668 - protein, 8 aa, Mycobacterium
AADQPPSV

SEQ ID NO: 1095669 - protein, 14 aa, Mycobacterium
AADTRRAEERVPAP

SEQ ID NO: 1095670 - protein, 11 aa, Mycobacterium
AADVEGGPSDP

SEQ ID NO: 1095671 - protein, 7 aa, Mycobacterium
AAEAAHR

SEQ ID NO: 1095672 - protein, 8 aa, Mycobacterium
AAEADGGE

SEQ ID NO: 1095673 - protein, 5 aa, Mycobacterium
AAEAV

SEQ ID NO: 1095674 - protein, 6 aa, Mycobacterium
AAEPLG

SEQ ID NO: 1095675 - protein, 5 aa, Mycobacterium
AAEPQ

SEQ ID NO: 1095676 - protein, 8 aa, Mycobacterium
AAEPRTVS

SEQ ID NO: 1095677 - protein, 14 aa, Mycobacterium
AAEPSRVTSVPPAT

SEQ ID NO: 1095678 - protein, 13 aa, Mycobacterium
AAEPVTARPLTTA

SEQ ID NO: 1095679 - protein, 9 aa, Mycobacterium
AAEQGGKVR

SEQ ID NO: 1095680 - protein, 17 aa, Mycobacterium
AAEQPPRPKTVRGTPKW

SEQ ID NO: 1095681 - protein, 8 aa, Mycobacterium
AAERGQLP

SEQ ID NO: 1095682 - protein, 16 aa, Mycobacterium
AAESADPERAVSKAAN

SEQ ID NO: 1095683 - protein, 10 aa, Mycobacterium
AAESALSQAS

SEQ ID NO: 1095684 - protein, 9 aa, Mycobacterium
AAESDSEHP

SEQ ID NO: 1095685 - protein, 8 aa, Mycobacterium
AAESVGRA

SEQ ID NO: 1095686 - protein, 6 aa, Mycobacterium
AAETNE

SEQ ID NO: 1095687 - protein, 7 aa, Mycobacterium
AAETSED

SEQ ID NO: 1095688 - protein, 11 aa, Mycobacterium
AAEWSGTTTTI

SEQ ID NO: 1095689 - protein, 5 aa, Mycobacterium
AAFDG

SEQ ID NO: 1095690 - protein, 5 aa, Mycobacterium
AAGAY

SEQ ID NO: 1095691 - protein, 8 aa, Mycobacterium
AAGEPGAA

SEQ ID NO: 1095692 - protein, 6 aa, Mycobacterium
AAGESH

SEQ ID NO: 1095693 - protein, 11 aa, Mycobacterium
AAGGPEAGPGL

SEQ ID NO: 1095694 - protein, 17 aa, Mycobacterium
AAGGSDAAAAAPAAVAG

SEQ ID NO: 1095695 - protein, 5 aa, Mycobacterium
AAGNG

SEQ ID NO: 1095696 - protein, 26 aa, Mycobacterium
AAGNSQITTGPLSEPVDGQPRSAALT

SEQ ID NO: 1095697 - protein, 19 aa, Mycobacterium
AAGPGADEPPRAAQPPTVS

SEQ ID NO: 1095698 - protein, 7 aa, Mycobacterium
AAGPGEK

SEQ ID NO: 1095699 - protein, 7 aa, Mycobacterium
AAGPTGA

SEQ ID NO: 1095700 - protein, 22 aa, Mycobacterium
AAGPTPGHASGVPRAATGWAEV

SEQ ID NO: 1095701 - protein, 8 aa, Mycobacterium
AAGRAGAV

SEQ ID NO: 1095702 - protein, 15 aa, Mycobacterium
AAGSAQIDQRTGDLD

SEQ ID NO: 1095703 - protein, 10 aa, Mycobacterium
AAGSNSASGR

SEQ ID NO: 1095704 - protein, 8 aa, Mycobacterium
AAGTAGSY

SEQ ID NO: 1095705 - protein, 6 aa, Mycobacterium
AAGVTG

SEQ ID NO: 1095706 - protein, 7 aa, Mycobacterium
AAHASHR

SEQ ID NO: 1095707 - protein, 5 aa, Mycobacterium
AAHQP

SEQ ID NO: 1095708 - protein, 16 aa, Mycobacterium
AAKAGERKDVDPDIGD

SEQ ID NO: 1095709 - protein, 8 aa, Mycobacterium
AAKATAPW

SEQ ID NO: 1095710 - protein, 4 aa, Mycobacterium
AAKD

SEQ ID NO: 1095711 - protein, 9 aa, Mycobacterium
AAKSGPHDV

SEQ ID NO: 1095712 - protein, 11 aa, Mycobacterium
AALAAEPGVTD

SEQ ID NO: 1095713 - protein, 18 aa, Mycobacterium
AALPRRAANPLDDVDDET

SEQ ID NO: 1095714 - protein, 8 aa, Mycobacterium
AALPRSQS

SEQ ID NO: 1095715 - protein, 7 aa, Mycobacterium
AALTTGE

SEQ ID NO: 1095716 - protein, 16 aa, Mycobacterium
AANTGTMSSSPLSNNT

SEQ ID NO: 1095717 - protein, 21 aa, Mycobacterium
AAPAAKAAAPVEHKPAKQPMS

SEQ ID NO: 1095718 - protein, 5 aa, Mycobacterium
AAPDF

SEQ ID NO: 1095719 - protein, 25 aa, Mycobacterium
AAPEPVTAEPVAEPVPGEPDPALDP

SEQ ID NO: 1095720 - protein, 4 aa, Mycobacterium
AAPG

SEQ ID NO: 1095721 - protein, 8 aa, Mycobacterium
AAPGGTYV

SEQ ID NO: 1095722 - protein, 12 aa, Mycobacterium
AAPLTASVGTAS

SEQ ID NO: 1095723 - protein, 12 aa, Mycobacterium
AAPNTTPEDSAV

SEQ ID NO: 1095724 - protein, 5 aa, Mycobacterium
AAPPF

SEQ ID NO: 1095725 - protein, 8 aa, Mycobacterium
AAPPRDAA

SEQ ID NO: 1095726 - protein, 10 aa, Mycobacterium
AAPQTRKAGA

SEQ ID NO: 1095727 - protein, 4 aa, Mycobacterium
AAPR

SEQ ID NO: 1095728 - protein, 9 aa, Mycobacterium
AAPSRGLDS

SEQ ID NO: 1095729 - protein, 4 aa, Mycobacterium
AAQA

SEQ ID NO: 1095730 - protein, 8 aa, Mycobacterium
AAQAGSQN

SEQ ID NO: 1095731 - protein, 6 aa, Mycobacterium
AAQASA

SEQ ID NO: 1095732 - protein, 5 aa, Mycobacterium
AAQDP

SEQ ID NO: 1095733 - protein, 9 aa, Mycobacterium
AAQSGYSRK

SEQ ID NO: 1095734 - protein, 6 aa, Mycobacterium
AAQTSL

SEQ ID NO: 1095735 - protein, 7 aa, Mycobacterium
AAQYSAA

SEQ ID NO: 1095736 - protein, 12 aa, Mycobacterium
AARASEGAAAQG

SEQ ID NO: 1095737 - protein, 7 aa, Mycobacterium
AARATTA

SEQ ID NO: 1095738 - protein, 5 aa, Mycobacterium
AARFT

SEQ ID NO: 1095739 - protein, 15 aa, Mycobacterium
AARGGGREMAVPLEV

SEQ ID NO: 1095740 - protein, 10 aa, Mycobacterium
AARGGPPPSV

SEQ ID NO: 1095741 - protein, 12 aa, Mycobacterium
AARGLRTAPPTA

SEQ ID NO: 1095742 - protein, 7 aa, Mycobacterium
AARGNAR

SEQ ID NO: 1095743 - protein, 6 aa, Mycobacterium
AARIGV

SEQ ID NO: 1095744 - protein, 10 aa, Mycobacterium
AARPTGADDT

SEQ ID NO: 1095745 - protein, 9 aa, Mycobacterium
AARSGPTAW

SEQ ID NO: 1095746 - protein, 9 aa, Mycobacterium
AARSSSQSP

SEQ ID NO: 1095747 - protein, 4 aa, Mycobacterium
AART

SEQ ID NO: 1095748 - protein, 9 aa, Mycobacterium
AARTAGTDY

SEQ ID NO: 1095749 - protein, 8 aa, Mycobacterium
AARTAGVK

SEQ ID NO: 1095750 - protein, 5 aa, Mycobacterium
AARTG

SEQ ID NO: 1095751 - protein, 6 aa, Mycobacterium
AARTLR

SEQ ID NO: 1095752 - protein, 13 aa, Mycobacterium
AASATPHESTSET

SEQ ID NO: 1095753 - protein, 32 aa, Mycobacterium
AASAVGDDRIQEAATGRVNPESWTHGSSEQRQ

SEQ ID NO: 1095754 - protein, 4 aa, Mycobacterium
AASD

SEQ ID NO: 1095755 - protein, 9 aa, Mycobacterium
AASGAENLA

SEQ ID NO: 1095756 - protein, 8 aa, Mycobacterium
AASGTGPV

SEQ ID NO: 1095757 - protein, 4 aa, Mycobacterium
AASK

SEQ ID NO: 1095758 - protein, 43 aa, Mycobacterium
AASKAAEEAAARSNGANGSSGANGSPNGAPNGATQPDYGAPAG

SEQ ID NO: 1095759 - protein, 6 aa, Mycobacterium
AASRGV

SEQ ID NO: 1095760 - protein, 13 aa, Mycobacterium
AASRPPIRSLTAG

SEQ ID NO: 1095761 - protein, 11 aa, Mycobacterium
AASSPDAKSEL

SEQ ID NO: 1095762 - protein, 6 aa, Mycobacterium
AASTGW

SEQ ID NO: 1095763 - protein, 9 aa, Mycobacterium
AASVSGDRA

SEQ ID NO: 1095764 - protein, 17 aa, Mycobacterium
AATAGAPDSDPGQQAVK

SEQ ID NO: 1095765 - protein, 8 aa, Mycobacterium
AATAGASG

SEQ ID NO: 1095766 - protein, 11 aa, Mycobacterium
AATARSSSVEA

SEQ ID NO: 1095767 - protein, 9 aa, Mycobacterium
AATDSVKGI

SEQ ID NO: 1095768 - protein, 13 aa, Mycobacterium
AATEEIEQARNTV

SEQ ID NO: 1095769 - protein, 20 aa, Mycobacterium
AATGLDATADPAQTPDPRGA

SEQ ID NO: 1095770 - protein, 7 aa, Mycobacterium
AATGPVA

SEQ ID NO: 1095771 - protein, 10 aa, Mycobacterium
AATKTDSKLA

SEQ ID NO: 1095772 - protein, 4 aa, Mycobacterium
AATP

SEQ ID NO: 1095773 - protein, 8 aa, Mycobacterium
AATPPRVT

SEQ ID NO: 1095774 - protein, 5 aa, Mycobacterium
AATPR

SEQ ID NO: 1095775 - protein, 8 aa, Mycobacterium
AATRAPLG

SEQ ID NO: 1095776 - protein, 6 aa, Mycobacterium
AATVGS

SEQ ID NO: 1095777 - protein, 5 aa, Mycobacterium
AATYR

SEQ ID NO: 1095778 - protein, 6 aa, Mycobacterium
AAVSRE

SEQ ID NO: 1095779 - protein, 6 aa, Mycobacterium
AAVTGA

SEQ ID NO: 1095780 - protein, 14 aa, Mycobacterium
AAYEADPAADPQDL

SEQ ID NO: 1095781 - protein, 5 aa, Mycobacterium
AAYGE

SEQ ID NO: 1095782 - protein, 7 aa, Mycobacterium
AAYRPSY

SEQ ID NO: 1095783 - protein, 5 aa, Mycobacterium
AAYSV

SEQ ID NO: 1095784 - protein, 6 aa, Mycobacterium
ACPPDL

SEQ ID NO: 1095785 - protein, 6 aa, Mycobacterium
ACPTDS

SEQ ID NO: 1095786 - protein, 15 aa, Mycobacterium
ADAAEQAREDSVAAA

SEQ ID NO: 1095787 - protein, 6 aa, Mycobacterium
ADAAGA

SEQ ID NO: 1095788 - protein, 6 aa, Mycobacterium
ADAGEP

SEQ ID NO: 1095789 - protein, 6 aa, Mycobacterium
ADAGRY

SEQ ID NO: 1095790 - protein, 9 aa, Mycobacterium
ADAQDPDAL

SEQ ID NO: 1095791 - protein, 4 aa, Mycobacterium
ADAV

SEQ ID NO: 1095792 - protein, 7 aa, Mycobacterium
ADDAGAS

SEQ ID NO: 1095793 - protein, 11 aa, Mycobacterium
ADDAGGGLTQT

SEQ ID NO: 1095794 - protein, 17 aa, Mycobacterium
ADDDADSDEQGLPPEDV

SEQ ID NO: 1095795 - protein, 12 aa, Mycobacterium
ADDDDKDRIRDS

SEQ ID NO: 1095796 - protein, 8 aa, Mycobacterium
ADDEIDRD

SEQ ID NO: 1095797 - protein, 8 aa, Mycobacterium
ADDIPDVA

SEQ ID NO: 1095798 - protein, 6 aa, Mycobacterium
ADDTAL

SEQ ID NO: 1095799 - protein, 7 aa, Mycobacterium
ADDVTAQ

SEQ ID NO: 1095800 - protein, 7 aa, Mycobacterium
ADEASSR

SEQ ID NO: 1095801 - protein, 10 aa, Mycobacterium
ADEGAANVPP

SEQ ID NO: 1095802 - protein, 10 aa, Mycobacterium
ADEPEDGRRG

SEQ ID NO: 1095803 - protein, 28 aa, Mycobacterium
ADEPHGAPAPPPVPPGPPPLPAPPPPPG

SEQ ID NO: 1095804 - protein, 7 aa, Mycobacterium
ADEQRKE

SEQ ID NO: 1095805 - protein, 8 aa, Mycobacterium
ADESQSAL

SEQ ID NO: 1095806 - protein, 7 aa, Mycobacterium
ADGAIDD

SEQ ID NO: 1095807 - protein, 7 aa, Mycobacterium
ADGARRL

SEQ ID NO: 1095808 - protein, 5 aa, Mycobacterium
ADGAV

SEQ ID NO: 1095809 - protein, 11 aa, Mycobacterium
ADGDTSTTDLA

SEQ ID NO: 1095810 - protein, 10 aa, Mycobacterium
ADGELGDRRP

SEQ ID NO: 1095811 - protein, 6 aa, Mycobacterium
ADGFSG

SEQ ID NO: 1095812 - protein, 8 aa, Mycobacterium
ADGHKRPL

SEQ ID NO: 1095813 - protein, 11 aa, Mycobacterium
ADGLTPGSPEL

SEQ ID NO: 1095814 - protein, 7 aa, Mycobacterium
ADGPNKP

SEQ ID NO: 1095815 - protein, 7 aa, Mycobacterium
ADGQAAA

SEQ ID NO: 1095816 - protein, 9 aa, Mycobacterium
ADGRAPGLA

SEQ ID NO: 1095817 - protein, 21 aa, Mycobacterium
ADGRRESGVGQTVGPTPPGVG

SEQ ID NO: 1095818 - protein, 12 aa, Mycobacterium
ADGTADDRMPNS

SEQ ID NO: 1095819 - protein, 6 aa, Mycobacterium
ADGVGG

SEQ ID NO: 1095820 - protein, 8 aa, Mycobacterium
ADLPTPRE

SEQ ID NO: 1095821 - protein, 8 aa, Mycobacterium
ADLSPDHG

SEQ ID NO: 1095822 - protein, 12 aa, Mycobacterium
ADLSPSLGNVTK

SEQ ID NO: 1095823 - protein, 9 aa, Mycobacterium
ADLSRGDEV

SEQ ID NO: 1095824 - protein, 9 aa, Mycobacterium
ADLTGRPGL

SEQ ID NO: 1095825 - protein, 7 aa, Mycobacterium
ADMPETA

SEQ ID NO: 1095826 - protein, 6 aa, Mycobacterium
ADNPVA

SEQ ID NO: 1095827 - protein, 6 aa, Mycobacterium
ADPANT

SEQ ID NO: 1095828 - protein, 6 aa, Mycobacterium
ADPATA

SEQ ID NO: 1095829 - protein, 10 aa, Mycobacterium
ADPDSTAHGP

SEQ ID NO: 1095830 - protein, 8 aa, Mycobacterium
ADPEGAGY

SEQ ID NO: 1095831 - protein, 9 aa, Mycobacterium
ADPELEGMG

SEQ ID NO: 1095832 - protein, 7 aa, Mycobacterium
ADPGRAG

SEQ ID NO: 1095833 - protein, 7 aa, Mycobacterium
ADPPRNR

SEQ ID NO: 1095834 - protein, 21 aa, Mycobacterium
ADPQPSDEHDAAISDPDAESD

SEQ ID NO: 1095835 - protein, 5 aa, Mycobacterium
ADPRP

SEQ ID NO: 1095836 - protein, 6 aa, Mycobacterium
ADPSFQ

SEQ ID NO: 1095837 - protein, 4 aa, Mycobacterium
ADPT

SEQ ID NO: 1095838 - protein, 6 aa, Mycobacterium
ADPVGA

SEQ ID NO: 1095839 - protein, 19 aa, Mycobacterium
ADQDDHPASGYAEGERAGR

SEQ ID NO: 1095840 - protein, 4 aa, Mycobacterium
ADQE

SEQ ID NO: 1095841 - protein, 10 aa, Mycobacterium
ADQLSESSGP

SEQ ID NO: 1095842 - protein, 5 aa, Mycobacterium
ADQNS

SEQ ID NO: 1095843 - protein, 6 aa, Mycobacterium
ADRAER

SEQ ID NO: 1095844 - protein, 8 aa, Mycobacterium
ADRDPIGT

SEQ ID NO: 1095845 - protein, 6 aa, Mycobacterium
ADRHRR

SEQ ID NO: 1095846 - protein, 6 aa, Mycobacterium
ADRLSD

SEQ ID NO: 1095847 - protein, 10 aa, Mycobacterium
ADRPVRDETL

SEQ ID NO: 1095848 - protein, 8 aa, Mycobacterium
ADRQPPDL

SEQ ID NO: 1095849 - protein, 9 aa, Mycobacterium
ADRQRGDGA

SEQ ID NO: 1095850 - protein, 6 aa, Mycobacterium
ADRSGW

SEQ ID NO: 1095851 - protein, 8 aa, Mycobacterium
ADRTGAHT

SEQ ID NO: 1095852 - protein, 8 aa, Mycobacterium
ADRVGPIG

SEQ ID NO: 1095853 - protein, 9 aa, Mycobacterium
ADSAPSSIG

SEQ ID NO: 1095854 - protein, 6 aa, Mycobacterium
ADSATT

SEQ ID NO: 1095855 - protein, 7 aa, Mycobacterium
ADSGARR

SEQ ID NO: 1095856 - protein, 16 aa, Mycobacterium
ADSPSTAAAIESGRAT

SEQ ID NO: 1095857 - protein, 17 aa, Mycobacterium
ADSRRRPPVRVEAAAST

SEQ ID NO: 1095858 - protein, 9 aa, Mycobacterium
ADSSSVTQT

SEQ ID NO: 1095859 - protein, 9 aa, Mycobacterium
ADSSVGAAA

SEQ ID NO: 1095860 - protein, 7 aa, Mycobacterium
ADTAAQA

SEQ ID NO: 1095861 - protein, 11 aa, Mycobacterium
ADTASDGLPAP

SEQ ID NO: 1095862 - protein, 6 aa, Mycobacterium
ADTEGA

SEQ ID NO: 1095863 - protein, 7 aa, Mycobacterium
ADTNQDF

SEQ ID NO: 1095864 - protein, 8 aa, Mycobacterium
ADTPVGPG

SEQ ID NO: 1095865 - protein, 10 aa, Mycobacterium
ADVSGAGAAL

SEQ ID NO: 1095866 - protein, 17 aa, Mycobacterium
AEAAEPQDKRRRLRRPG

SEQ ID NO: 1095867 - protein, 11 aa, Mycobacterium
AEAARARAERL

SEQ ID NO: 1095868 - protein, 12 aa, Mycobacterium
AEAARRARLPDP

SEQ ID NO: 1095869 - protein, 11 aa, Mycobacterium
AEAATGAEGGV

SEQ ID NO: 1095870 - protein, 12 aa, Mycobacterium
AEAPRDPARRNQ

SEQ ID NO: 1095871 - protein, 10 aa, Mycobacterium
AEARRGPQVG

SEQ ID NO: 1095872 - protein, 5 aa, Mycobacterium
AEATF

SEQ ID NO: 1095873 - protein, 7 aa, Mycobacterium
AEDARAG

SEQ ID NO: 1095874 - protein, 8 aa, Mycobacterium
AEDEPHRR

SEQ ID NO: 1095875 - protein, 12 aa, Mycobacterium
AEEAKDPSRNVP

SEQ ID NO: 1095876 - protein, 11 aa, Mycobacterium
AEEARAVPDDD

SEQ ID NO: 1095877 - protein, 16 aa, Mycobacterium
AEEERRRRAAENQGKG

SEQ ID NO: 1095878 - protein, 11 aa, Mycobacterium
AEEIRNPSKVY

SEQ ID NO: 1095879 - protein, 21 aa, Mycobacterium
AEEQRAVEEARAARSAPDASP

SEQ ID NO: 1095880 - protein, 9 aa, Mycobacterium
AEERRGWPA

SEQ ID NO: 1095881 - protein, 21 aa, Mycobacterium
AEESTQAEGFGRVEQPAQGGK

SEQ ID NO: 1095882 - protein, 7 aa, Mycobacterium
AEETPAF

SEQ ID NO: 1095883 - protein, 6 aa, Mycobacterium
AEEVGT

SEQ ID NO: 1095884 - protein, 11 aa, Mycobacterium
AEEVKEPRRNV

SEQ ID NO: 1095885 - protein, 5 aa, Mycobacterium
AEGEP

SEQ ID NO: 1095886 - protein, 6 aa, Mycobacterium
AEGSAY

SEQ ID NO: 1095887 - protein, 5 aa, Mycobacterium
AEHGA

SEQ ID NO: 1095888 - protein, 6 aa, Mycobacterium
AEIKPQ

SEQ ID NO: 1095889 - protein, 10 aa, Mycobacterium
AELPGSAGEV

SEQ ID NO: 1095890 - protein, 10 aa, Mycobacterium
AELSDAQRTR

SEQ ID NO: 1095891 - protein, 5 aa, Mycobacterium
AEPAQ

SEQ ID NO: 1095892 - protein, 9 aa, Mycobacterium
AEPASDEAF

SEQ ID NO: 1095893 - protein, 10 aa, Mycobacterium
AEPDKPTGAQ

SEQ ID NO: 1095894 - protein, 6 aa, Mycobacterium
AEPGST

SEQ ID NO: 1095895 - protein, 5 aa, Mycobacterium
AEPHA

SEQ ID NO: 1095896 - protein, 7 aa, Mycobacterium
AEPHRRG

SEQ ID NO: 1095897 - protein, 15 aa, Mycobacterium
AEPYTTQYPEQTGVA

SEQ ID NO: 1095898 - protein, 8 aa, Mycobacterium
AEQGKNSA

SEQ ID NO: 1095899 - protein, 6 aa, Mycobacterium
AEQPSA

SEQ ID NO: 1095900 - protein, 10 aa, Mycobacterium
AEQRNRPRDG

SEQ ID NO: 1095901 - protein, 9 aa, Mycobacterium
AEQSPADKV

SEQ ID NO: 1095902 - protein, 24 aa, Mycobacterium
AEQTRQIDAGDEAPDVEVRGASEA

SEQ ID NO: 1095903 - protein, 7 aa, Mycobacterium
AERAGLP

SEQ ID NO: 1095904 - protein, 9 aa, Mycobacterium
AERANPRRL

SEQ ID NO: 1095905 - protein, 11 aa, Mycobacterium
AERDDPDGGTA

SEQ ID NO: 1095906 - protein, 4 aa, Mycobacterium
AERR

SEQ ID NO: 1095907 - protein, 8 aa, Mycobacterium
AERRAKYD

SEQ ID NO: 1095908 - protein, 12 aa, Mycobacterium
AERTPPERRAEV

SEQ ID NO: 1095909 - protein, 19 aa, Mycobacterium
AERYGAPVSPANVEKAAVT

SEQ ID NO: 1095910 - protein, 10 aa, Mycobacterium
AESAAGSRTP

SEQ ID NO: 1095911 - protein, 12 aa, Mycobacterium
AESERNARTKEL

SEQ ID NO: 1095912 - protein, 5 aa, Mycobacterium
AESGR

SEQ ID NO: 1095913 - protein, 9 aa, Mycobacterium
AETAAANGI

SEQ ID NO: 1095914 - protein, 5 aa, Mycobacterium
AETGY

SEQ ID NO: 1095915 - protein, 7 aa, Mycobacterium
AETMDED

SEQ ID NO: 1095916 - protein, 8 aa, Mycobacterium
AETPRDAV

SEQ ID NO: 1095917 - protein, 7 aa, Mycobacterium
AETTSDR

SEQ ID NO: 1095918 - protein, 5 aa, Mycobacterium
AETWS

SEQ ID NO: 1095919 - protein, 4 aa, Mycobacterium
AEVG

SEQ ID NO: 1095920 - protein, 8 aa, Mycobacterium
AEVTEART

SEQ ID NO: 1095921 - protein, 10 aa, Mycobacterium
AEVTGGPAFG

SEQ ID NO: 1095922 - protein, 9 aa, Mycobacterium
AEYASAAAE

SEQ ID NO: 1095923 - protein, 4 aa, Mycobacterium
AEYG

SEQ ID NO: 1095924 - protein, 18 aa, Mycobacterium
AFGPPEGAEGKDTAQDEW

SEQ ID NO: 1095925 - protein, 7 aa, Mycobacterium
AFGPTRG

SEQ ID NO: 1095926 - protein, 6 aa, Mycobacterium
AFNSGD

SEQ ID NO: 1095927 - protein, 9 aa, Mycobacterium
AFPGDPDRA

SEQ ID NO: 1095928 - protein, 10 aa, Mycobacterium
AFPPQKPPHR

SEQ ID NO: 1095929 - protein, 8 aa, Mycobacterium
AFTGPQNG

SEQ ID NO: 1095930 - protein, 4 aa, Mycobacterium
AFTP

SEQ ID NO: 1095931 - protein, 8 aa, Mycobacterium
AGAAGSVT

SEQ ID NO: 1095932 - protein, 23 aa, Mycobacterium
AGAAPAATSGRGVGADSAGPGIV

SEQ ID NO: 1095933 - protein, 16 aa, Mycobacterium
AGAAPGGVEGEDRRTR

SEQ ID NO: 1095934 - protein, 7 aa, Mycobacterium
AGADEAV

SEQ ID NO: 1095935 - protein, 14 aa, Mycobacterium
AGADSAADAERRRG

SEQ ID NO: 1095936 - protein, 9 aa, Mycobacterium
AGAEGPRSH

SEQ ID NO: 1095937 - protein, 13 aa, Mycobacterium
AGAGAEPAAPTYL

SEQ ID NO: 1095938 - protein, 9 aa, Mycobacterium
AGAGDITRK

SEQ ID NO: 1095939 - protein, 6 aa, Mycobacterium
AGAGNG

SEQ ID NO: 1095940 - protein, 13 aa, Mycobacterium
AGAGSGVYNATRQ

SEQ ID NO: 1095941 - protein, 13 aa, Mycobacterium
AGAHHDTATRIRG

SEQ ID NO: 1095942 - protein, 43 aa, Mycobacterium
AGAKRPGAKKTATEKTTAAPEAKAETAGTTEAPAEAKPEPEVK

SEQ ID NO: 1095943 - protein, 4 aa, Mycobacterium
AGAL

SEQ ID NO: 1095944 - protein, 7 aa, Mycobacterium
AGALSGV

SEQ ID NO: 1095945 - protein, 17 aa, Mycobacterium
AGAPDRTHILRSRRRRA

SEQ ID NO: 1095946 - protein, 8 aa, Mycobacterium
AGAPFGPH

SEQ ID NO: 1095947 - protein, 8 aa, Mycobacterium
AGAPGSHW

SEQ ID NO: 1095948 - protein, 7 aa, Mycobacterium
AGARPVV

SEQ ID NO: 1095949 - protein, 5 aa, Mycobacterium
AGASF

SEQ ID NO: 1095950 - protein, 6 aa, Mycobacterium
AGASIG

SEQ ID NO: 1095951 - protein, 6 aa, Mycobacterium
AGAYAD

SEQ ID NO: 1095952 - protein, 5 aa, Mycobacterium
AGDPT

SEQ ID NO: 1095953 - protein, 4 aa, Mycobacterium
AGDV

SEQ ID NO: 1095954 - protein, 6 aa, Mycobacterium
AGEQER

SEQ ID NO: 1095955 - protein, 6 aa, Mycobacterium
AGERDR

SEQ ID NO: 1095956 - protein, 6 aa, Mycobacterium
AGESAA

SEQ ID NO: 1095957 - protein, 4 aa, Mycobacterium
AGET

SEQ ID NO: 1095958 - protein, 11 aa, Mycobacterium
AGGAAAATVAA

SEQ ID NO: 1095959 - protein, 7 aa, Mycobacterium
AGGAGQP

SEQ ID NO: 1095960 - protein, 26 aa, Mycobacterium
AGGAHRKKRKPEVSPRQDVDDAERSM

SEQ ID NO: 1095961 - protein, 7 aa, Mycobacterium
AGGDKEA

SEQ ID NO: 1095962 - protein, 5 aa, Mycobacterium
AGGDL

SEQ ID NO: 1095963 - protein, 6 aa, Mycobacterium
AGGEIA

SEQ ID NO: 1095964 - protein, 8 aa, Mycobacterium
AGGEYGSG

SEQ ID NO: 1095965 - protein, 21 aa, Mycobacterium
AGGGGPGGGPGGGPGDGPGRG

SEQ ID NO: 1095966 - protein, 5 aa, Mycobacterium
AGGGV

SEQ ID NO: 1095967 - protein, 21 aa, Mycobacterium
AGGLTTGAPVRVSGAPAGQVQ

SEQ ID NO: 1095968 - protein, 10 aa, Mycobacterium
AGGPLDAKRA

SEQ ID NO: 1095969 - protein, 6 aa, Mycobacterium
AGGPSG

SEQ ID NO: 1095970 - protein, 7 aa, Mycobacterium
AGGRIGA

SEQ ID NO: 1095971 - protein, 9 aa, Mycobacterium
AGGRLAPER

SEQ ID NO: 1095972 - protein, 6 aa, Mycobacterium
AGGTQA

SEQ ID NO: 1095973 - protein, 11 aa, Mycobacterium
AGGVSGSTDVG

SEQ ID NO: 1095974 - protein, 4 aa, Mycobacterium
AGHG

SEQ ID NO: 1095975 - protein, 10 aa, Mycobacterium
AGIEEGARTG

SEQ ID NO: 1095976 - protein, 4 aa, Mycobacterium
AGIP

SEQ ID NO: 1095977 - protein, 6 aa, Mycobacterium
AGITAG

SEQ ID NO: 1095978 - protein, 14 aa, Mycobacterium
AGKAQKFEAATPLR

SEQ ID NO: 1095979 - protein, 10 aa, Mycobacterium
AGKGKPPGPR

SEQ ID NO: 1095980 - protein, 5 aa, Mycobacterium
AGKPL

SEQ ID NO: 1095981 - protein, 11 aa, Mycobacterium
AGKSLSDSASG

SEQ ID NO: 1095982 - protein, 11 aa, Mycobacterium
AGKTGTAQQIN

SEQ ID NO: 1095983 - protein, 7 aa, Mycobacterium
AGKTNAE

SEQ ID NO: 1095984 - protein, 11 aa, Mycobacterium
AGLAGPANTGR

SEQ ID NO: 1095985 - protein, 5 aa, Mycobacterium
AGLGQ

SEQ ID NO: 1095986 - protein, 7 aa, Mycobacterium
AGLPAER

SEQ ID NO: 1095987 - protein, 9 aa, Mycobacterium
AGLPPAQAG

SEQ ID NO: 1095988 - protein, 12 aa, Mycobacterium
AGLQADPGARGP

SEQ ID NO: 1095989 - protein, 7 aa, Mycobacterium
AGLRAPG

SEQ ID NO: 1095990 - protein, 14 aa, Mycobacterium
AGLTGRPNLRPDRN

SEQ ID NO: 1095991 - protein, 4 aa, Mycobacterium
AGMS

SEQ ID NO: 1095992 - protein, 31 aa, Mycobacterium
AGNDRAGMNTGSACESNPPGDAARPDDPRNW

SEQ ID NO: 1095993 - protein, 13 aa, Mycobacterium
AGNQGEALANESV

SEQ ID NO: 1095994 - protein, 6 aa, Mycobacterium
AGNRQP

SEQ ID NO: 1095995 - protein, 12 aa, Mycobacterium
AGNRTAAVGEGV

SEQ ID NO: 1095996 - protein, 7 aa, Mycobacterium
AGNTGAS

SEQ ID NO: 1095997 - protein, 5 aa, Mycobacterium
AGNTP

SEQ ID NO: 1095998 - protein, 8 aa, Mycobacterium
AGNTVDGT

SEQ ID NO: 1095999 - protein, 5 aa, Mycobacterium
AGPAA

SEQ ID NO: 1096000 - protein, 7 aa, Mycobacterium
AGPAGLG

SEQ ID NO: 1096001 - protein, 6 aa, Mycobacterium
AGPATI

SEQ ID NO: 1096002 - protein, 5 aa, Mycobacterium
AGPES

SEQ ID NO: 1096003 - protein, 6 aa, Mycobacterium
AGPGGL

SEQ ID NO: 1096004 - protein, 41 aa, Mycobacterium
AGPGQPATMGSSTTAAGDGGAAAPSGSAPAERTGAPGEPVN

SEQ ID NO: 1096005 - protein, 10 aa, Mycobacterium
AGPHGDPAAM

SEQ ID NO: 1096006 - protein, 9 aa, Mycobacterium
AGPQAANGR

SEQ ID NO: 1096007 - protein, 9 aa, Mycobacterium
AGPQRSGRI

SEQ ID NO: 1096008 - protein, 33 aa, Mycobacterium
AGPRDGAVTAGRPTIAGGGGALDETPEAPATGD

SEQ ID NO: 1096009 - protein, 5 aa, Mycobacterium
AGPSA

SEQ ID NO: 1096010 - protein, 8 aa, Mycobacterium
AGPTLSRD

SEQ ID NO: 1096011 - protein, 5 aa, Mycobacterium
AGQAA

SEQ ID NO: 1096012 - protein, 5 aa, Mycobacterium
AGQAS

SEQ ID NO: 1096013 - protein, 6 aa, Mycobacterium
AGQGGA

SEQ ID NO: 1096014 - protein, 9 aa, Mycobacterium
AGQNPEDRS

SEQ ID NO: 1096015 - protein, 9 aa, Mycobacterium
AGQPGFGGP

SEQ ID NO: 1096016 - protein, 9 aa, Mycobacterium
AGQSGENRG

SEQ ID NO: 1096017 - protein, 6 aa, Mycobacterium
AGQVQG

SEQ ID NO: 1096018 - protein, 7 aa, Mycobacterium
AGQYTST

SEQ ID NO: 1096019 - protein, 16 aa, Mycobacterium
AGRAPSGALAAGGPST

SEQ ID NO: 1096020 - protein, 5 aa, Mycobacterium
AGRDA

SEQ ID NO: 1096021 - protein, 7 aa, Mycobacterium
AGRDHRE

SEQ ID NO: 1096022 - protein, 10 aa, Mycobacterium
AGRGGDEAHP

SEQ ID NO: 1096023 - protein, 10 aa, Mycobacterium
AGRGTPAALG

SEQ ID NO: 1096024 - protein, 6 aa, Mycobacterium
AGRNED

SEQ ID NO: 1096025 - protein, 16 aa, Mycobacterium
AGRPATAAPVMPGEPE

SEQ ID NO: 1096026 - protein, 6 aa, Mycobacterium
AGRPGC

SEQ ID NO: 1096027 - protein, 10 aa, Mycobacterium
AGRPHRDPSP

SEQ ID NO: 1096028 - protein, 6 aa, Mycobacterium
AGRPVQ

SEQ ID NO: 1096029 - protein, 15 aa, Mycobacterium
AGRRGLRGDFRGGRG

SEQ ID NO: 1096030 - protein, 4 aa, Mycobacterium
AGRS

SEQ ID NO: 1096031 - protein, 8 aa, Mycobacterium
AGRSFSGG

SEQ ID NO: 1096032 - protein, 20 aa, Mycobacterium
AGRSSVTREQLPGPNRDGDE

SEQ ID NO: 1096033 - protein, 4 aa, Mycobacterium
AGRV

SEQ ID NO: 1096034 - protein, 9 aa, Mycobacterium
AGSAYGTGP

SEQ ID NO: 1096035 - protein, 9 aa, Mycobacterium
AGSERTDQE

SEQ ID NO: 1096036 - protein, 11 aa, Mycobacterium
AGSGAGRLTAK

SEQ ID NO: 1096037 - protein, 8 aa, Mycobacterium
AGSGSDGG

SEQ ID NO: 1096038 - protein, 9 aa, Mycobacterium
AGSGSRELG

SEQ ID NO: 1096039 - protein, 10 aa, Mycobacterium
AGSPERNQTF

SEQ ID NO: 1096040 - protein, 5 aa, Mycobacterium
AGSRS

SEQ ID NO: 1096041 - protein, 4 aa, Mycobacterium
AGST

SEQ ID NO: 1096042 - protein, 15 aa, Mycobacterium
AGTDGSVTYDRGSDG

SEQ ID NO: 1096043 - protein, 9 aa, Mycobacterium
AGTPAAGGE

SEQ ID NO: 1096044 - protein, 5 aa, Mycobacterium
AGTPH

SEQ ID NO: 1096045 - protein, 10 aa, Mycobacterium
AGTTGESAFT

SEQ ID NO: 1096046 - protein, 11 aa, Mycobacterium
AGTVQYGPHPK

SEQ ID NO: 1096047 - protein, 12 aa, Mycobacterium
AGVAGYRRRDLV

SEQ ID NO: 1096048 - protein, 6 aa, Mycobacterium
AGVGQA

SEQ ID NO: 1096049 - protein, 8 aa, Mycobacterium
AGVPPNSL

SEQ ID NO: 1096050 - protein, 23 aa, Mycobacterium
AGVQGGGPDGAPAEEVQVKTILL

SEQ ID NO: 1096051 - protein, 11 aa, Mycobacterium
AGVRPGRLTGQ

SEQ ID NO: 1096052 - protein, 17 aa, Mycobacterium
AGVRSQAANRSPSNRPH

SEQ ID NO: 1096053 - protein, 4 aa, Mycobacterium
AGVT

SEQ ID NO: 1096054 - protein, 4 aa, Mycobacterium
AGYG

SEQ ID NO: 1096055 - protein, 13 aa, Mycobacterium
AGYSRNDDPLTAP

SEQ ID NO: 1096056 - protein, 7 aa, Mycobacterium
AHAGGVA

SEQ ID NO: 1096057 - protein, 7 aa, Mycobacterium
AHAGPKA

SEQ ID NO: 1096058 - protein, 7 aa, Mycobacterium
AHANAGK

SEQ ID NO: 1096059 - protein, 8 aa, Mycobacterium
AHATSTTA

SEQ ID NO: 1096060 - protein, 7 aa, Mycobacterium
AHDEAKN

SEQ ID NO: 1096061 - protein, 11 aa, Mycobacterium
AHEAGRMSAPE

SEQ ID NO: 1096062 - protein, 6 aa, Mycobacterium
AHPAGS

SEQ ID NO: 1096063 - protein, 9 aa, Mycobacterium
AHPFENPTT

SEQ ID NO: 1096064 - protein, 12 aa, Mycobacterium
AHPRPASGPSHR

SEQ ID NO: 1096065 - protein, 9 aa, Mycobacterium
AHQASEQRQ

SEQ ID NO: 1096066 - protein, 6 aa, Mycobacterium
AHRGAD

SEQ ID NO: 1096067 - protein, 7 aa, Mycobacterium
AHTGESD

SEQ ID NO: 1096068 - protein, 5 aa, Mycobacterium
AHYTA

SEQ ID NO: 1096069 - protein, 11 aa, Mycobacterium
AIADTEAPETI

SEQ ID NO: 1096070 - protein, 12 aa, Mycobacterium
AIDAGQTLIAPV

SEQ ID NO: 1096071 - protein, 12 aa, Mycobacterium
AIEQEGAPGAKV

SEQ ID NO: 1096072 - protein, 9 aa, Mycobacterium
AIEQSRSQL

SEQ ID NO: 1096073 - protein, 6 aa, Mycobacterium
AIGPGK

SEQ ID NO: 1096074 - protein, 8 aa, Mycobacterium
AIGPSQEW

SEQ ID NO: 1096075 - protein, 11 aa, Mycobacterium
AIQSGPGLRPL

SEQ ID NO: 1096076 - protein, 14 aa, Mycobacterium
AITGSARGDDQDVQ

SEQ ID NO: 1096077 - protein, 13 aa, Mycobacterium
AKADRELDAQTEA

SEQ ID NO: 1096078 - protein, 7 aa, Mycobacterium
AKAEESV

SEQ ID NO: 1096079 - protein, 7 aa, Mycobacterium
AKDDSWK

SEQ ID NO: 1096080 - protein, 7 aa, Mycobacterium
AKDLSGK

SEQ ID NO: 1096081 - protein, 8 aa, Mycobacterium
AKDPAARF

SEQ ID NO: 1096082 - protein, 7 aa, Mycobacterium
AKEPGRY

SEQ ID NO: 1096083 - protein, 10 aa, Mycobacterium
AKERLSTDTV

SEQ ID NO: 1096084 - protein, 21 aa, Mycobacterium
AKGPLQINGQPPVPPPDIPEE

SEQ ID NO: 1096085 - protein, 7 aa, Mycobacterium
AKGQLTA

SEQ ID NO: 1096086 - protein, 4 aa, Mycobacterium
AKGR

SEQ ID NO: 1096087 - protein, 11 aa, Mycobacterium
AKGRQAGERAR

SEQ ID NO: 1096088 - protein, 6 aa, Mycobacterium
AKIPTK

SEQ ID NO: 1096089 - protein, 8 aa, Mycobacterium
AKKGPQSF

SEQ ID NO: 1096090 - protein, 11 aa, Mycobacterium
AKKPERRYQSA

SEQ ID NO: 1096091 - protein, 11 aa, Mycobacterium
AKMDGATPAQA

SEQ ID NO: 1096092 - protein, 8 aa, Mycobacterium
AKNPDERF

SEQ ID NO: 1096093 - protein, 19 aa, Mycobacterium
AKPGEQYGQAQGDNPAWKR

SEQ ID NO: 1096094 - protein, 13 aa, Mycobacterium
AKPRGPDDKGPQL

SEQ ID NO: 1096095 - protein, 7 aa, Mycobacterium
AKQNSPS

SEQ ID NO: 1096096 - protein, 12 aa, Mycobacterium
AKRADDRPQGPP

SEQ ID NO: 1096097 - protein, 16 aa, Mycobacterium
AKRAGGNKCHHLGEPY

SEQ ID NO: 1096098 - protein, 9 aa, Mycobacterium
AKRAGGNQV

SEQ ID NO: 1096099 - protein, 6 aa, Mycobacterium
AKRASV

SEQ ID NO: 1096100 - protein, 8 aa, Mycobacterium
AKRDSYVN

SEQ ID NO: 1096101 - protein, 8 aa, Mycobacterium
AKRQSGAA

SEQ ID NO: 1096102 - protein, 5 aa, Mycobacterium
AKRRR

SEQ ID NO: 1096103 - protein, 7 aa, Mycobacterium
AKRTEPF

SEQ ID NO: 1096104 - protein, 12 aa, Mycobacterium
AKSDQEGSQGSG

SEQ ID NO: 1096105 - protein, 8 aa, Mycobacterium
AKSKGYTF

SEQ ID NO: 1096106 - protein, 6 aa, Mycobacterium
AKSNEQ

SEQ ID NO: 1096107 - protein, 8 aa, Mycobacterium
AKSPDKRF

SEQ ID NO: 1096108 - protein, 14 aa, Mycobacterium
AKSVSNDVASGAQV

SEQ ID NO: 1096109 - protein, 9 aa, Mycobacterium
AKTGGAAYT

SEQ ID NO: 1096110 - protein, 27 aa, Mycobacterium
AKTTDKTSRDARKAVRGQRKRLSRMVS

SEQ ID NO: 1096111 - protein, 9 aa, Mycobacterium
AKWSPPGGR

SEQ ID NO: 1096112 - protein, 13 aa, Mycobacterium
ALAASSADLTRRA

SEQ ID NO: 1096113 - protein, 7 aa, Mycobacterium
ALAATGT

SEQ ID NO: 1096114 - protein, 5 aa, Mycobacterium
ALAGS

SEQ ID NO: 1096115 - protein, 11 aa, Mycobacterium
ALASAQGSVGV

SEQ ID NO: 1096116 - protein, 12 aa, Mycobacterium
ALDDPAAGGTLT

SEQ ID NO: 1096117 - protein, 6 aa, Mycobacterium
ALDDRA

SEQ ID NO: 1096118 - protein, 6 aa, Mycobacterium
ALDPDE

SEQ ID NO: 1096119 - protein, 10 aa, Mycobacterium
ALDPRGDEIT

SEQ ID NO: 1096120 - protein, 5 aa, Mycobacterium
ALGAG

SEQ ID NO: 1096121 - protein, 15 aa, Mycobacterium
ALGARGEGTSGEAYP

SEQ ID NO: 1096122 - protein, 8 aa, Mycobacterium
ALGASRGE

SEQ ID NO: 1096123 - protein, 23 aa, Mycobacterium
ALGPDLSEAQALDDGNAANVPVD

SEQ ID NO: 1096124 - protein, 9 aa, Mycobacterium
ALGPSGADL

SEQ ID NO: 1096125 - protein, 5 aa, Mycobacterium
ALNPA

SEQ ID NO: 1096126 - protein, 6 aa, Mycobacterium
ALPDGR

SEQ ID NO: 1096127 - protein, 9 aa, Mycobacterium
ALPETGGGG

SEQ ID NO: 1096128 - protein, 4 aa, Mycobacterium
ALPP

SEQ ID NO: 1096129 - protein, 17 aa, Mycobacterium
ALPPGDPTRSDAAAPGN

SEQ ID NO: 1096130 - protein, 12 aa, Mycobacterium
ALPRGQAEAASA

SEQ ID NO: 1096131 - protein, 7 aa, Mycobacterium
ALQAPSG

SEQ ID NO: 1096132 - protein, 14 aa, Mycobacterium
ALRATDPELSPSAA

SEQ ID NO: 1096133 - protein, 8 aa, Mycobacterium
ALRDGGET

SEQ ID NO: 1096134 - protein, 15 aa, Mycobacterium
ALSGAGPHRGRPQKG

SEQ ID NO: 1096135 - protein, 7 aa, Mycobacterium
ALTGDRD

SEQ ID NO: 1096136 - protein, 5 aa, Mycobacterium
ALTGT

SEQ ID NO: 1096137 - protein, 7 aa, Mycobacterium
ALTQPGT

SEQ ID NO: 1096138 - protein, 20 aa, Mycobacterium
ALVGGSDAQARDISSAASRD

SEQ ID NO: 1096139 - protein, 13 aa, Mycobacterium
AMPGEGKSILDSR

SEQ ID NO: 1096140 - protein, 4 aa, Mycobacterium
AMRD

SEQ ID NO: 1096141 - protein, 15 aa, Mycobacterium
ANAAALRSGLSDSSC

SEQ ID NO: 1096142 - protein, 21 aa, Mycobacterium
ANASGAPESDQADTAGAPRST

SEQ ID NO: 1096143 - protein, 13 aa, Mycobacterium
ANGAQQRGWTTHQ

SEQ ID NO: 1096144 - protein, 9 aa, Mycobacterium
ANGDLDRDD

SEQ ID NO: 1096145 - protein, 6 aa, Mycobacterium
ANGEEF

SEQ ID NO: 1096146 - protein, 7 aa, Mycobacterium
ANGGDNI

SEQ ID NO: 1096147 - protein, 7 aa, Mycobacterium
ANGKERI

SEQ ID NO: 1096148 - protein, 11 aa, Mycobacterium
ANHHAGPLDQR

SEQ ID NO: 1096149 - protein, 5 aa, Mycobacterium
ANLTG

SEQ ID NO: 1096150 - protein, 9 aa, Mycobacterium
ANPAQYGNQ

SEQ ID NO: 1096151 - protein, 7 aa, Mycobacterium
ANPATPR

SEQ ID NO: 1096152 - protein, 6 aa, Mycobacterium
ANPKAA

SEQ ID NO: 1096153 - protein, 6 aa, Mycobacterium
ANPNPL

SEQ ID NO: 1096154 - protein, 11 aa, Mycobacterium
ANPPASVRDAS

SEQ ID NO: 1096155 - protein, 9 aa, Mycobacterium
ANPPTGPTG

SEQ ID NO: 1096156 - protein, 5 aa, Mycobacterium
ANPSL

SEQ ID NO: 1096157 - protein, 15 aa, Mycobacterium
ANPSTGSFADYSRNA

SEQ ID NO: 1096158 - protein, 6 aa, Mycobacterium
ANRGLP

SEQ ID NO: 1096159 - protein, 7 aa, Mycobacterium
ANTGSGG

SEQ ID NO: 1096160 - protein, 4 aa, Mycobacterium
ANTH

SEQ ID NO: 1096161 - protein, 11 aa, Mycobacterium
ANTPDGQTDSL

SEQ ID NO: 1096162 - protein, 7 aa, Mycobacterium
ANVDPPT

SEQ ID NO: 1096163 - protein, 68 aa, Mycobacterium
APAAPVRTPERTEAPRPEAYASELPDLSGPVPRPPQRKPATDRPATEAPARPAARTQVGQRPARGPVR

SEQ ID NO: 1096164 - protein, 15 aa, Mycobacterium
APADRTGDVAGRRGQ

SEQ ID NO: 1096165 - protein, 6 aa, Mycobacterium
APAEAP

SEQ ID NO: 1096166 - protein, 6 aa, Mycobacterium
APAEDG

SEQ ID NO: 1096167 - protein, 8 aa, Mycobacterium
APAEGRDA

SEQ ID NO: 1096168 - protein, 6 aa, Mycobacterium
APAGAI

SEQ ID NO: 1096169 - protein, 5 aa, Mycobacterium
APAGP

SEQ ID NO: 1096170 - protein, 6 aa, Mycobacterium
APAGRR

SEQ ID NO: 1096171 - protein, 9 aa, Mycobacterium
APAMTDDPE

SEQ ID NO: 1096172 - protein, 9 aa, Mycobacterium
APAPASRAA

SEQ ID NO: 1096173 - protein, 7 aa, Mycobacterium
APAPVRP

SEQ ID NO: 1096174 - protein, 7 aa, Mycobacterium
APASTVD

SEQ ID NO: 1096175 - protein, 23 aa, Mycobacterium
APAYVPPPAPVAPAYTPPQAGYV

SEQ ID NO: 1096176 - protein, 5 aa, Mycobacterium
APDAS

SEQ ID NO: 1096177 - protein, 9 aa, Mycobacterium
APDDAETAA

SEQ ID NO: 1096178 - protein, 11 aa, Mycobacterium
APDDELEPSGE

SEQ ID NO: 1096179 - protein, 14 aa, Mycobacterium
APDGALTGPGAAVG

SEQ ID NO: 1096180 - protein, 7 aa, Mycobacterium
APDGRDL

SEQ ID NO: 1096181 - protein, 5 aa, Mycobacterium
APDPW

SEQ ID NO: 1096182 - protein, 4 aa, Mycobacterium
APDR

SEQ ID NO: 1096183 - protein, 8 aa, Mycobacterium
APDVDGDD

SEQ ID NO: 1096184 - protein, 5 aa, Mycobacterium
APENL

SEQ ID NO: 1096185 - protein, 6 aa, Mycobacterium
APEQLR

SEQ ID NO: 1096186 - protein, 12 aa, Mycobacterium
APGAPPAPADVS

SEQ ID NO: 1096187 - protein, 10 aa, Mycobacterium
APGAQYGASL

SEQ ID NO: 1096188 - protein, 11 aa, Mycobacterium
APGDPTPSAQP

SEQ ID NO: 1096189 - protein, 4 aa, Mycobacterium
APGE

SEQ ID NO: 1096190 - protein, 26 aa, Mycobacterium
APGENITSVSNGPDGGLANGLPNDRD

SEQ ID NO: 1096191 - protein, 8 aa, Mycobacterium
APGEQVTT

SEQ ID NO: 1096192 - protein, 4 aa, Mycobacterium
APGG

SEQ ID NO: 1096193 - protein, 11 aa, Mycobacterium
APGGVNSAAPQ

SEQ ID NO: 1096194 - protein, 8 aa, Mycobacterium
APGQAART

SEQ ID NO: 1096195 - protein, 8 aa, Mycobacterium
APGREPTE

SEQ ID NO: 1096196 - protein, 4 aa, Mycobacterium
APGV

SEQ ID NO: 1096197 - protein, 9 aa, Mycobacterium
APHPGRTEP

SEQ ID NO: 1096198 - protein, 4 aa, Mycobacterium
APKA

SEQ ID NO: 1096199 - protein, 5 aa, Mycobacterium
APKHA

SEQ ID NO: 1096200 - protein, 4 aa, Mycobacterium
APLG

SEQ ID NO: 1096201 - protein, 8 aa, Mycobacterium
APLGLRST

SEQ ID NO: 1096202 - protein, 7 aa, Mycobacterium
APLRPYP

SEQ ID NO: 1096203 - protein, 19 aa, Mycobacterium
APLTAAAPAAFENAESGTF

SEQ ID NO: 1096204 - protein, 5 aa, Mycobacterium
APNDE

SEQ ID NO: 1096205 - protein, 6 aa, Mycobacterium
APPAAG

SEQ ID NO: 1096206 - protein, 7 aa, Mycobacterium
APPAGST

SEQ ID NO: 1096207 - protein, 10 aa, Mycobacterium
APPASTAGAA

SEQ ID NO: 1096208 - protein, 11 aa, Mycobacterium
APPDAESHHAH

SEQ ID NO: 1096209 - protein, 6 aa, Mycobacterium
APPETG

SEQ ID NO: 1096210 - protein, 7 aa, Mycobacterium
APPGGTA

SEQ ID NO: 1096211 - protein, 8 aa, Mycobacterium
APPGGVAA

SEQ ID NO: 1096212 - protein, 8 aa, Mycobacterium
APPGHAPV

SEQ ID NO: 1096213 - protein, 6 aa, Mycobacterium
APPGTD

SEQ ID NO: 1096214 - protein, 7 aa, Mycobacterium
APPKPGT

SEQ ID NO: 1096215 - protein, 14 aa, Mycobacterium
APPPDWTAADTERI

SEQ ID NO: 1096216 - protein, 8 aa, Mycobacterium
APPPGIGP

SEQ ID NO: 1096217 - protein, 4 aa, Mycobacterium
APPQ

SEQ ID NO: 1096218 - protein, 12 aa, Mycobacterium
APQGQRIDEGAN

SEQ ID NO: 1096219 - protein, 8 aa, Mycobacterium
APQLGEGT

SEQ ID NO: 1096220 - protein, 4 aa, Mycobacterium
APQN

SEQ ID NO: 1096221 - protein, 6 aa, Mycobacterium
APQPEW

SEQ ID NO: 1096222 - protein, 16 aa, Mycobacterium
APQPGAAPAATSEPRL

SEQ ID NO: 1096223 - protein, 5 aa, Mycobacterium
APQTV

SEQ ID NO: 1096224 - protein, 5 aa, Mycobacterium
APRGE

SEQ ID NO: 1096225 - protein, 10 aa, Mycobacterium
APRGGAGSEW

SEQ ID NO: 1096226 - protein, 8 aa, Mycobacterium
APRHSAQH

SEQ ID NO: 1096227 - protein, 6 aa, Mycobacterium
APRPAI

SEQ ID NO: 1096228 - protein, 12 aa, Mycobacterium
APRPQVERGAKV

SEQ ID NO: 1096229 - protein, 11 aa, Mycobacterium
APSADQHTGGH

SEQ ID NO: 1096230 - protein, 12 aa, Mycobacterium
APSARGADETPV

SEQ ID NO: 1096231 - protein, 5 aa, Mycobacterium
APSGK

SEQ ID NO: 1096232 - protein, 6 aa, Mycobacterium
APSNTA

SEQ ID NO: 1096233 - protein, 7 aa, Mycobacterium
APSTRAL

SEQ ID NO: 1096234 - protein, 4 aa, Mycobacterium
APSV

SEQ ID NO: 1096235 - protein, 8 aa, Mycobacterium
APSWAADA

SEQ ID NO: 1096236 - protein, 4 aa, Mycobacterium
APTE

SEQ ID NO: 1096237 - protein, 6 aa, Mycobacterium
APTPFN

SEQ ID NO: 1096238 - protein, 5 aa, Mycobacterium
APTTS

SEQ ID NO: 1096239 - protein, 8 aa, Mycobacterium
APVATGGA

SEQ ID NO: 1096240 - protein, 7 aa, Mycobacterium
APVESQY

SEQ ID NO: 1096241 - protein, 6 aa, Mycobacterium
APVPAP

SEQ ID NO: 1096242 - protein, 16 aa, Mycobacterium
APVTVTPGDSPRPLGG

SEQ ID NO: 1096243 - protein, 25 aa, Mycobacterium
APYNRRAEQADGTLYPEDDPDRADA

SEQ ID NO: 1096244 - protein, 27 aa, Mycobacterium
AQAAANGAHERPEPEPVANPNAGADDA

SEQ ID NO: 1096245 - protein, 7 aa, Mycobacterium
AQADAEV

SEQ ID NO: 1096246 - protein, 4 aa, Mycobacterium
AQAE

SEQ ID NO: 1096247 - protein, 13 aa, Mycobacterium
AQAGGEWPPPPTE

SEQ ID NO: 1096248 - protein, 4 aa, Mycobacterium
AQAY

SEQ ID NO: 1096249 - protein, 17 aa, Mycobacterium
AQDADEMPDPESHTPRA

SEQ ID NO: 1096250 - protein, 8 aa, Mycobacterium
AQDPNTAT

SEQ ID NO: 1096251 - protein, 8 aa, Mycobacterium
AQDQSGHV

SEQ ID NO: 1096252 - protein, 7 aa, Mycobacterium
AQDRGAG

SEQ ID NO: 1096253 - protein, 12 aa, Mycobacterium
AQDRRSRELREQ

SEQ ID NO: 1096254 - protein, 13 aa, Mycobacterium
AQGDGYSSRAGSA

SEQ ID NO: 1096255 - protein, 8 aa, Mycobacterium
AQGDSQQV

SEQ ID NO: 1096256 - protein, 13 aa, Mycobacterium
AQGNAIDSRYHPS

SEQ ID NO: 1096257 - protein, 13 aa, Mycobacterium
AQINRDSSESITS

SEQ ID NO: 1096258 - protein, 7 aa, Mycobacterium
AQLRGDD

SEQ ID NO: 1096259 - protein, 12 aa, Mycobacterium
AQNATPAGLDPV

SEQ ID NO: 1096260 - protein, 10 aa, Mycobacterium
AQNDALQRED

SEQ ID NO: 1096261 - protein, 12 aa, Mycobacterium
AQNSKAPGQRLA

SEQ ID NO: 1096262 - protein, 30 aa, Mycobacterium
AQPAAARDGQQPAQPAQPGQPQQAPGLPGL

SEQ ID NO: 1096263 - protein, 6 aa, Mycobacterium
AQPDVR

SEQ ID NO: 1096264 - protein, 9 aa, Mycobacterium
AQPEAANDP

SEQ ID NO: 1096265 - protein, 14 aa, Mycobacterium
AQPEEPVKKPRSKR

SEQ ID NO: 1096266 - protein, 27 aa, Mycobacterium
AQPEPEPSPSPSTVTAAPPPPPPPRTV

SEQ ID NO: 1096267 - protein, 6 aa, Mycobacterium
AQPETL

SEQ ID NO: 1096268 - protein, 4 aa, Mycobacterium
AQPK

SEQ ID NO: 1096269 - protein, 4 aa, Mycobacterium
AQPL

SEQ ID NO: 1096270 - protein, 8 aa, Mycobacterium
AQQARADE

SEQ ID NO: 1096271 - protein, 14 aa, Mycobacterium
AQQATTNSLQAAQD

SEQ ID NO: 1096272 - protein, 9 aa, Mycobacterium
AQQEDESDD

SEQ ID NO: 1096273 - protein, 19 aa, Mycobacterium
AQQQESDAGPAAPKSTLRQ

SEQ ID NO: 1096274 - protein, 6 aa, Mycobacterium
AQRDEI

SEQ ID NO: 1096275 - protein, 4 aa, Mycobacterium
AQRG

SEQ ID NO: 1096276 - protein, 6 aa, Mycobacterium
AQRPTA

SEQ ID NO: 1096277 - protein, 21 aa, Mycobacterium
AQRRQRDWGDASDRAAAPAAL

SEQ ID NO: 1096278 - protein, 31 aa, Mycobacterium
AQRSAARCGRHSGRHSRQRSADMTRDLARSG

SEQ ID NO: 1096279 - protein, 7 aa, Mycobacterium
AQSGPLA

SEQ ID NO: 1096280 - protein, 13 aa, Mycobacterium
AQSPTFEGRPDRL

SEQ ID NO: 1096281 - protein, 5 aa, Mycobacterium
AQSRR

SEQ ID NO: 1096282 - protein, 9 aa, Mycobacterium
AQSSDDGYN

SEQ ID NO: 1096283 - protein, 5 aa, Mycobacterium
AQTGD

SEQ ID NO: 1096284 - protein, 5 aa, Mycobacterium
AQTKG

SEQ ID NO: 1096285 - protein, 7 aa, Mycobacterium
AQTNTEL

SEQ ID NO: 1096286 - protein, 8 aa, Mycobacterium
AQYGPKAP

SEQ ID NO: 1096287 - protein, 9 aa, Mycobacterium
ARAAETAWS

SEQ ID NO: 1096288 - protein, 8 aa, Mycobacterium
ARAAGEPV

SEQ ID NO: 1096289 - protein, 10 aa, Mycobacterium
ARAEESSASM

SEQ ID NO: 1096290 - protein, 9 aa, Mycobacterium
ARAEPGLGT

SEQ ID NO: 1096291 - protein, 4 aa, Mycobacterium
ARAH

SEQ ID NO: 1096292 - protein, 7 aa, Mycobacterium
ARAIGPA

SEQ ID NO: 1096293 - protein, 8 aa, Mycobacterium
ARAMPGSG

SEQ ID NO: 1096294 - protein, 18 aa, Mycobacterium
ARAQEDPEGPTGGGVRTE

SEQ ID NO: 1096295 - protein, 11 aa, Mycobacterium
ARATRKDGSEM

SEQ ID NO: 1096296 - protein, 9 aa, Mycobacterium
ARDPQAPAD

SEQ ID NO: 1096297 - protein, 10 aa, Mycobacterium
ARDRTGEISK

SEQ ID NO: 1096298 - protein, 7 aa, Mycobacterium
AREAGAR

SEQ ID NO: 1096299 - protein, 8 aa, Mycobacterium
AREAVGDR

SEQ ID NO: 1096300 - protein, 7 aa, Mycobacterium
AREDGRL

SEQ ID NO: 1096301 - protein, 8 aa, Mycobacterium
AREEADPE

SEQ ID NO: 1096302 - protein, 8 aa, Mycobacterium
AREEPTEV

SEQ ID NO: 1096303 - protein, 13 aa, Mycobacterium
AREEQSATGLPGG

SEQ ID NO: 1096304 - protein, 4 aa, Mycobacterium
AREK

SEQ ID NO: 1096305 - protein, 7 aa, Mycobacterium
ARENGTV

SEQ ID NO: 1096306 - protein, 10 aa, Mycobacterium
ARERGGGTRF

SEQ ID NO: 1096307 - protein, 18 aa, Mycobacterium
ARERQRQDIAPAQVVPAT

SEQ ID NO: 1096308 - protein, 9 aa, Mycobacterium
ARESANEVV

SEQ ID NO: 1096309 - protein, 4 aa, Mycobacterium
ARFA

SEQ ID NO: 1096310 - protein, 25 aa, Mycobacterium
ARFTDESHADVGQLGARAQELVRTW

SEQ ID NO: 1096311 - protein, 12 aa, Mycobacterium
ARGAPDQPLERA

SEQ ID NO: 1096312 - protein, 11 aa, Mycobacterium
ARGAQPNTTLA

SEQ ID NO: 1096313 - protein, 11 aa, Mycobacterium
ARGATESELSR

SEQ ID NO: 1096314 - protein, 15 aa, Mycobacterium
ARGEAAGAEAQASVA

SEQ ID NO: 1096315 - protein, 7 aa, Mycobacterium
ARGLSTA

SEQ ID NO: 1096316 - protein, 5 aa, Mycobacterium
ARGPA

SEQ ID NO: 1096317 - protein, 15 aa, Mycobacterium
ARGPERVRVIDDRLR

SEQ ID NO: 1096318 - protein, 16 aa, Mycobacterium
ARGQAKGFAALANENP

SEQ ID NO: 1096319 - protein, 16 aa, Mycobacterium
ARGVADRNRVRRAAGQ

SEQ ID NO: 1096320 - protein, 9 aa, Mycobacterium
ARHASGRTL

SEQ ID NO: 1096321 - protein, 7 aa, Mycobacterium
ARHEPDA

SEQ ID NO: 1096322 - protein, 8 aa, Mycobacterium
ARHGRDRP

SEQ ID NO: 1096323 - protein, 6 aa, Mycobacterium
ARKDST

SEQ ID NO: 1096324 - protein, 14 aa, Mycobacterium
ARKQPGADQPEVQE

SEQ ID NO: 1096325 - protein, 13 aa, Mycobacterium
ARLADQAKASDER

SEQ ID NO: 1096326 - protein, 9 aa, Mycobacterium
ARLDGRSPV

SEQ ID NO: 1096327 - protein, 6 aa, Mycobacterium
ARPDRD

SEQ ID NO: 1096328 - protein, 7 aa, Mycobacterium
ARPEPGL

SEQ ID NO: 1096329 - protein, 8 aa, Mycobacterium
ARPGDRRP

SEQ ID NO: 1096330 - protein, 15 aa, Mycobacterium
ARPGPDGAPVPAGRV

SEQ ID NO: 1096331 - protein, 7 aa, Mycobacterium
ARPPLNN

SEQ ID NO: 1096332 - protein, 7 aa, Mycobacterium
ARPPVST

SEQ ID NO: 1096333 - protein, 4 aa, Mycobacterium
ARPQ

SEQ ID NO: 1096334 - protein, 10 aa, Mycobacterium
ARPVAGQQTE

SEQ ID NO: 1096335 - protein, 33 aa, Mycobacterium
ARRAAGGALGPLGAKDGPQYKIGEDGVGQNYTG

SEQ ID NO: 1096336 - protein, 6 aa, Mycobacterium
ARRADK

SEQ ID NO: 1096337 - protein, 12 aa, Mycobacterium
ARRATNAGTPTE

SEQ ID NO: 1096338 - protein, 26 aa, Mycobacterium
ARRDGAYSDVQADATPEEIQQTAHAT

SEQ ID NO: 1096339 - protein, 18 aa, Mycobacterium
ARREASGIRDEARGEGRK

SEQ ID NO: 1096340 - protein, 14 aa, Mycobacterium
ARRGARVTGVDPSD

SEQ ID NO: 1096341 - protein, 11 aa, Mycobacterium
ARRLDADGMAT

SEQ ID NO: 1096342 - protein, 7 aa, Mycobacterium
ARRPGYQ

SEQ ID NO: 1096343 - protein, 6 aa, Mycobacterium
ARRPLT

SEQ ID NO: 1096344 - protein, 7 aa, Mycobacterium
ARRPQPV

SEQ ID NO: 1096345 - protein, 8 aa, Mycobacterium
ARRQLRDK

SEQ ID NO: 1096346 - protein, 4 aa, Mycobacterium
ARRR

SEQ ID NO: 1096347 - protein, 10 aa, Mycobacterium
ARRRGAPQVA

SEQ ID NO: 1096348 - protein, 17 aa, Mycobacterium
ARRRGRMGAAGGVAPNR

SEQ ID NO: 1096349 - protein, 6 aa, Mycobacterium
ARRRPD

SEQ ID NO: 1096350 - protein, 7 aa, Mycobacterium
ARRRRKV

SEQ ID NO: 1096351 - protein, 8 aa, Mycobacterium
ARRTPDRN

SEQ ID NO: 1096352 - protein, 7 aa, Mycobacterium
ARSAPRS

SEQ ID NO: 1096353 - protein, 11 aa, Mycobacterium
ARSESGTDPTV

SEQ ID NO: 1096354 - protein, 6 aa, Mycobacterium
ARSGRL

SEQ ID NO: 1096355 - protein, 8 aa, Mycobacterium
ARSKGLAP

SEQ ID NO: 1096356 - protein, 7 aa, Mycobacterium
ARSPRLP

SEQ ID NO: 1096357 - protein, 11 aa, Mycobacterium
ARSRADAVPDA

SEQ ID NO: 1096358 - protein, 10 aa, Mycobacterium
ARTDNSGWGE

SEQ ID NO: 1096359 - protein, 9 aa, Mycobacterium
ARTDTGPPW

SEQ ID NO: 1096360 - protein, 27 aa, Mycobacterium
ARTEAAQAAAGADADCAGSCASCVLSC

SEQ ID NO: 1096361 - protein, 23 aa, Mycobacterium
ARTGTEWNRPVDPEQFTLPVEAR

SEQ ID NO: 1096362 - protein, 15 aa, Mycobacterium
ARTPDGSPPSRESLA

SEQ ID NO: 1096363 - protein, 8 aa, Mycobacterium
ARTREEST

SEQ ID NO: 1096364 - protein, 16 aa, Mycobacterium
ARVGPPSAASGLGAGS

SEQ ID NO: 1096365 - protein, 13 aa, Mycobacterium
ARYPDAPAIDDGT

SEQ ID NO: 1096366 - protein, 5 aa, Mycobacterium
ARYSS

SEQ ID NO: 1096367 - protein, 6 aa, Mycobacterium
ASAAAL

SEQ ID NO: 1096368 - protein, 13 aa, Mycobacterium
ASADDGSDEPIKS

SEQ ID NO: 1096369 - protein, 5 aa, Mycobacterium
ASADL

SEQ ID NO: 1096370 - protein, 9 aa, Mycobacterium
ASANPTQPA

SEQ ID NO: 1096371 - protein, 20 aa, Mycobacterium
ASANSAATAAQHETAAAAYT

SEQ ID NO: 1096372 - protein, 10 aa, Mycobacterium
ASAPGQGPTV

SEQ ID NO: 1096373 - protein, 10 aa, Mycobacterium
ASAQPAAGPW

SEQ ID NO: 1096374 - protein, 4 aa, Mycobacterium
ASAR

SEQ ID NO: 1096375 - protein, 11 aa, Mycobacterium
ASASAASGPAI

SEQ ID NO: 1096376 - protein, 6 aa, Mycobacterium
ASASAQ

SEQ ID NO: 1096377 - protein, 8 aa, Mycobacterium
ASASSVEL

SEQ ID NO: 1096378 - protein, 9 aa, Mycobacterium
ASATTASMG

SEQ ID NO: 1096379 - protein, 7 aa, Mycobacterium
ASATVTA

SEQ ID NO: 1096380 - protein, 8 aa, Mycobacterium
ASAVPGVR

SEQ ID NO: 1096381 - protein, 8 aa, Mycobacterium
ASDAFEGG

SEQ ID NO: 1096382 - protein, 9 aa, Mycobacterium
ASDPDGANQ

SEQ ID NO: 1096383 - protein, 5 aa, Mycobacterium
ASDRV

SEQ ID NO: 1096384 - protein, 8 aa, Mycobacterium
ASEPVLTQ

SEQ ID NO: 1096385 - protein, 6 aa, Mycobacterium
ASEVED

SEQ ID NO: 1096386 - protein, 13 aa, Mycobacterium
ASGATPAEATRTV

SEQ ID NO: 1096387 - protein, 8 aa, Mycobacterium
ASGESKSK

SEQ ID NO: 1096388 - protein, 11 aa, Mycobacterium
ASGGGGWGPIT

SEQ ID NO: 1096389 - protein, 11 aa, Mycobacterium
ASGGPAGVGEA

SEQ ID NO: 1096390 - protein, 9 aa, Mycobacterium
ASGLESAAT

SEQ ID NO: 1096391 - protein, 6 aa, Mycobacterium
ASGNPL

SEQ ID NO: 1096392 - protein, 13 aa, Mycobacterium
ASGQGGQAGEIAS

SEQ ID NO: 1096393 - protein, 9 aa, Mycobacterium
ASGRRRTQR

SEQ ID NO: 1096394 - protein, 4 aa, Mycobacterium
ASGS

SEQ ID NO: 1096395 - protein, 7 aa, Mycobacterium
ASGSTYP

SEQ ID NO: 1096396 - protein, 5 aa, Mycobacterium
ASGTP

SEQ ID NO: 1096397 - protein, 4 aa, Mycobacterium
ASHD

SEQ ID NO: 1096398 - protein, 8 aa, Mycobacterium
ASHRAAGW

SEQ ID NO: 1096399 - protein, 12 aa, Mycobacterium
ASIGTSAVAAGS

SEQ ID NO: 1096400 - protein, 9 aa, Mycobacterium
ASLAPGGRL

SEQ ID NO: 1096401 - protein, 7 aa, Mycobacterium
ASLQGGI

SEQ ID NO: 1096402 - protein, 4 aa, Mycobacterium
ASPA

SEQ ID NO: 1096403 - protein, 5 aa, Mycobacterium
ASPAD

SEQ ID NO: 1096404 - protein, 13 aa, Mycobacterium
ASPGTSDAASTYP

SEQ ID NO: 1096405 - protein, 9 aa, Mycobacterium
ASPHEEDDA

SEQ ID NO: 1096406 - protein, 9 aa, Mycobacterium
ASPPGEGTE

SEQ ID NO: 1096407 - protein, 10 aa, Mycobacterium
ASPSSGSAEV

SEQ ID NO: 1096408 - protein, 9 aa, Mycobacterium
ASPWATPPA

SEQ ID NO: 1096409 - protein, 7 aa, Mycobacterium
ASQRQST

SEQ ID NO: 1096410 - protein, 11 aa, Mycobacterium
ASRAAREQLDE

SEQ ID NO: 1096411 - protein, 9 aa, Mycobacterium
ASRGNHEST

SEQ ID NO: 1096412 - protein, 5 aa, Mycobacterium
ASRPE

SEQ ID NO: 1096413 - protein, 18 aa, Mycobacterium
ASRPGAPMDPQSTSPDGV

SEQ ID NO: 1096414 - protein, 5 aa, Mycobacterium
ASRTD

SEQ ID NO: 1096415 - protein, 6 aa, Mycobacterium
ASRTLD

SEQ ID NO: 1096416 - protein, 8 aa, Mycobacterium
ASSGANAG

SEQ ID NO: 1096417 - protein, 14 aa, Mycobacterium
ASSHRRGHSDRVAR

SEQ ID NO: 1096418 - protein, 18 aa, Mycobacterium
ASSLGEETVEPRRTAPKA

SEQ ID NO: 1096419 - protein, 42 aa, Mycobacterium
ASSSPGADQFEPSEGERRFTAPSGFDAGSTQKIDPPPDPATE

SEQ ID NO: 1096420 - protein, 6 aa, Mycobacterium
ASSTLR

SEQ ID NO: 1096421 - protein, 7 aa, Mycobacterium
ASSYLAG

SEQ ID NO: 1096422 - protein, 11 aa, Mycobacterium
ASTDDTADVAQ

SEQ ID NO: 1096423 - protein, 8 aa, Mycobacterium
ASTDGTPD

SEQ ID NO: 1096424 - protein, 4 aa, Mycobacterium
ASTL

SEQ ID NO: 1096425 - protein, 4 aa, Mycobacterium
ASTP

SEQ ID NO: 1096426 - protein, 6 aa, Mycobacterium
ASTPMS

SEQ ID NO: 1096427 - protein, 6 aa, Mycobacterium
ASVAQA

SEQ ID NO: 1096428 - protein, 18 aa, Mycobacterium
ASVDDVGAAAGRATAKAA

SEQ ID NO: 1096429 - protein, 4 aa, Mycobacterium
ATAA

SEQ ID NO: 1096430 - protein, 10 aa, Mycobacterium
ATAANLATAT

SEQ ID NO: 1096431 - protein, 12 aa, Mycobacterium
ATADGADKSGLT

SEQ ID NO: 1096432 - protein, 17 aa, Mycobacterium
ATADRYPGQLSGGQQQR

SEQ ID NO: 1096433 - protein, 7 aa, Mycobacterium
ATAGALS

SEQ ID NO: 1096434 - protein, 5 aa, Mycobacterium
ATAGE

SEQ ID NO: 1096435 - protein, 18 aa, Mycobacterium
ATAGEIQEGYGPRTEPDR

SEQ ID NO: 1096436 - protein, 8 aa, Mycobacterium
ATAGGGAR

SEQ ID NO: 1096437 - protein, 12 aa, Mycobacterium
ATAGRFAPRSRE

SEQ ID NO: 1096438 - protein, 8 aa, Mycobacterium
ATAKRPNV

SEQ ID NO: 1096439 - protein, 12 aa, Mycobacterium
ATALPSGNTTLH

SEQ ID NO: 1096440 - protein, 4 aa, Mycobacterium
ATAN

SEQ ID NO: 1096441 - protein, 9 aa, Mycobacterium
ATAPPPPNL

SEQ ID NO: 1096442 - protein, 9 aa, Mycobacterium
ATATEPPAH

SEQ ID NO: 1096443 - protein, 6 aa, Mycobacterium
ATATRN

SEQ ID NO: 1096444 - protein, 7 aa, Mycobacterium
ATDATKV

SEQ ID NO: 1096445 - protein, 6 aa, Mycobacterium
ATDRDH

SEQ ID NO: 1096446 - protein, 9 aa, Mycobacterium
ATDSIADAS

SEQ ID NO: 1096447 - protein, 5 aa, Mycobacterium
ATDTT

SEQ ID NO: 1096448 - protein, 7 aa, Mycobacterium
ATEPSPL

SEQ ID NO: 1096449 - protein, 5 aa, Mycobacterium
ATERA

SEQ ID NO: 1096450 - protein, 8 aa, Mycobacterium
ATESSDSI

SEQ ID NO: 1096451 - protein, 4 aa, Mycobacterium
ATGA

SEQ ID NO: 1096452 - protein, 8 aa, Mycobacterium
ATGAGKGS

SEQ ID NO: 1096453 - protein, 11 aa, Mycobacterium
ATGALKPKTAV

SEQ ID NO: 1096454 - protein, 11 aa, Mycobacterium
ATGDGATVDSG

SEQ ID NO: 1096455 - protein, 13 aa, Mycobacterium
ATGEAAVGTAPPV

SEQ ID NO: 1096456 - protein, 16 aa, Mycobacterium
ATGGGQSSGQQNSGIS

SEQ ID NO: 1096457 - protein, 11 aa, Mycobacterium
ATGGPAGVGEA

SEQ ID NO: 1096458 - protein, 5 aa, Mycobacterium
ATGGV

SEQ ID NO: 1096459 - protein, 6 aa, Mycobacterium
ATGGVI

SEQ ID NO: 1096460 - protein, 12 aa, Mycobacterium
ATGLPDPGPVTT

SEQ ID NO: 1096461 - protein, 6 aa, Mycobacterium
ATGPDT

SEQ ID NO: 1096462 - protein, 8 aa, Mycobacterium
ATGRPRNE

SEQ ID NO: 1096463 - protein, 8 aa, Mycobacterium
ATGRPSPR

SEQ ID NO: 1096464 - protein, 8 aa, Mycobacterium
ATGRTAEA

SEQ ID NO: 1096465 - protein, 8 aa, Mycobacterium
ATGSGKSE

SEQ ID NO: 1096466 - protein, 4 aa, Mycobacterium
ATGT

SEQ ID NO: 1096467 - protein, 11 aa, Mycobacterium
ATGTDDGSAGV

SEQ ID NO: 1096468 - protein, 4 aa, Mycobacterium
ATGW

SEQ ID NO: 1096469 - protein, 27 aa, Mycobacterium
ATGYTATLPTPEPEEPEPRGEPDEAAA

SEQ ID NO: 1096470 - protein, 4 aa, Mycobacterium
ATHA

SEQ ID NO: 1096471 - protein, 13 aa, Mycobacterium
ATNPPANQTSAIT

SEQ ID NO: 1096472 - protein, 10 aa, Mycobacterium
ATPADELPEA

SEQ ID NO: 1096473 - protein, 6 aa, Mycobacterium
ATPAGQ

SEQ ID NO: 1096474 - protein, 7 aa, Mycobacterium
ATPASSA

SEQ ID NO: 1096475 - protein, 5 aa, Mycobacterium
ATPDE

SEQ ID NO: 1096476 - protein, 7 aa, Mycobacterium
ATPDRKG

SEQ ID NO: 1096477 - protein, 7 aa, Mycobacterium
ATPLEPE

SEQ ID NO: 1096478 - protein, 22 aa, Mycobacterium
ATPPGQAPAPGAPGAQPPAAGA

SEQ ID NO: 1096479 - protein, 17 aa, Mycobacterium
ATPRKAKAGSSWLGSPP

SEQ ID NO: 1096480 - protein, 5 aa, Mycobacterium
ATPTR

SEQ ID NO: 1096481 - protein, 4 aa, Mycobacterium
ATPY

SEQ ID NO: 1096482 - protein, 5 aa, Mycobacterium
ATQDT

SEQ ID NO: 1096483 - protein, 6 aa, Mycobacterium
ATRAAA

SEQ ID NO: 1096484 - protein, 8 aa, Mycobacterium
ATRAGVAQ

SEQ ID NO: 1096485 - protein, 7 aa, Mycobacterium
ATRGDRP

SEQ ID NO: 1096486 - protein, 6 aa, Mycobacterium
ATRPGG

SEQ ID NO: 1096487 - protein, 7 aa, Mycobacterium
ATRQAYG

SEQ ID NO: 1096488 - protein, 6 aa, Mycobacterium
ATSAQL

SEQ ID NO: 1096489 - protein, 6 aa, Mycobacterium
ATSAYA

SEQ ID NO: 1096490 - protein, 5 aa, Mycobacterium
ATSGV

SEQ ID NO: 1096491 - protein, 6 aa, Mycobacterium
ATSPAV

SEQ ID NO: 1096492 - protein, 6 aa, Mycobacterium
ATSPGG

SEQ ID NO: 1096493 - protein, 6 aa, Mycobacterium
ATSREN

SEQ ID NO: 1096494 - protein, 7 aa, Mycobacterium
ATSSARL

SEQ ID NO: 1096495 - protein, 7 aa, Mycobacterium
ATSSEPL

SEQ ID NO: 1096496 - protein, 8 aa, Mycobacterium
ATSSVDTR

SEQ ID NO: 1096497 - protein, 11 aa, Mycobacterium
ATSTTINDRQR

SEQ ID NO: 1096498 - protein, 4 aa, Mycobacterium
ATTD

SEQ ID NO: 1096499 - protein, 9 aa, Mycobacterium
ATTPAAELP

SEQ ID NO: 1096500 - protein, 11 aa, Mycobacterium
ATTQRGSIPAT

SEQ ID NO: 1096501 - protein, 5 aa, Mycobacterium
ATTSM

SEQ ID NO: 1096502 - protein, 13 aa, Mycobacterium
ATVVGDAKGVSGE

SEQ ID NO: 1096503 - protein, 5 aa, Mycobacterium
AVADR

SEQ ID NO: 1096504 - protein, 7 aa, Mycobacterium
AVADSKQ

SEQ ID NO: 1096505 - protein, 6 aa, Mycobacterium
AVAPGR

SEQ ID NO: 1096506 - protein, 11 aa, Mycobacterium
AVDGSTGRVTD

SEQ ID NO: 1096507 - protein, 16 aa, Mycobacterium
AVDPGDSTNYMSDGSG

SEQ ID NO: 1096508 - protein, 13 aa, Mycobacterium
AVEESARALGSHS

SEQ ID NO: 1096509 - protein, 14 aa, Mycobacterium
AVEPTERGAKATMS

SEQ ID NO: 1096510 - protein, 5 aa, Mycobacterium
AVGER

SEQ ID NO: 1096511 - protein, 6 aa, Mycobacterium
AVGQVG

SEQ ID NO: 1096512 - protein, 29 aa, Mycobacterium
AVGSVDPGLEQDAEPHADDQDETPGRKHS

SEQ ID NO: 1096513 - protein, 9 aa, Mycobacterium
AVKPDGASE

SEQ ID NO: 1096514 - protein, 6 aa, Mycobacterium
AVPDGP

SEQ ID NO: 1096515 - protein, 8 aa, Mycobacterium
AVPGPDGR

SEQ ID NO: 1096516 - protein, 7 aa, Mycobacterium
AVPGSRT

SEQ ID NO: 1096517 - protein, 17 aa, Mycobacterium
AVPGTPEDGAAEGTSVG

SEQ ID NO: 1096518 - protein, 5 aa, Mycobacterium
AVPTR

SEQ ID NO: 1096519 - protein, 8 aa, Mycobacterium
AVQSAGAA

SEQ ID NO: 1096520 - protein, 29 aa, Mycobacterium
AVRGAVNTATTPRAPRPTGPAPKREEREI

SEQ ID NO: 1096521 - protein, 11 aa, Mycobacterium
AVRGPDDDHTA

SEQ ID NO: 1096522 - protein, 5 aa, Mycobacterium
AVRPD

SEQ ID NO: 1096523 - protein, 12 aa, Mycobacterium
AVRSSGRGGLND

SEQ ID NO: 1096524 - protein, 10 aa, Mycobacterium
AVRTAGPTPL

SEQ ID NO: 1096525 - protein, 8 aa, Mycobacterium
AVRTSSNE

SEQ ID NO: 1096526 - protein, 4 aa, Mycobacterium
AVSP

SEQ ID NO: 1096527 - protein, 8 aa, Mycobacterium
AVSPNDFE

SEQ ID NO: 1096528 - protein, 8 aa, Mycobacterium
AVSPTTAD

SEQ ID NO: 1096529 - protein, 9 aa, Mycobacterium
AVTAAESAA

SEQ ID NO: 1096530 - protein, 8 aa, Mycobacterium
AVTGNSAV

SEQ ID NO: 1096531 - protein, 7 aa, Mycobacterium
AVTGQGM

SEQ ID NO: 1096532 - protein, 6 aa, Mycobacterium
AVTPGD

SEQ ID NO: 1096533 - protein, 8 aa, Mycobacterium
AVTPGRRG

SEQ ID NO: 1096534 - protein, 5 aa, Mycobacterium
AVTPQ

SEQ ID NO: 1096535 - protein, 5 aa, Mycobacterium
AVTRA

SEQ ID NO: 1096536 - protein, 9 aa, Mycobacterium
AVTRSSDTA

SEQ ID NO: 1096537 - protein, 5 aa, Mycobacterium
AWGPN

SEQ ID NO: 1096538 - protein, 7 aa, Mycobacterium
AWRQAGE

SEQ ID NO: 1096539 - protein, 6 aa, Mycobacterium
AYAAPE

SEQ ID NO: 1096540 - protein, 5 aa, Mycobacterium
AYAYT

SEQ ID NO: 1096541 - protein, 9 aa, Mycobacterium
AYDPAADTW

SEQ ID NO: 1096542 - protein, 6 aa, Mycobacterium
AYDPTT

SEQ ID NO: 1096543 - protein, 4 aa, Mycobacterium
AYES

SEQ ID NO: 1096544 - protein, 31 aa, Mycobacterium
AYPGGYPPPPQGAYGGYPGGYPMQTAPKNGL

SEQ ID NO: 1096545 - protein, 7 aa, Mycobacterium
AYPPPVY

SEQ ID NO: 1096546 - protein, 6 aa, Mycobacterium
AYPTRT

SEQ ID NO: 1096547 - protein, 22 aa, Mycobacterium
AYPVGRPPSHTAAAAVDSPDDV

SEQ ID NO: 1096548 - protein, 9 aa, Mycobacterium
AYSGESTQG

SEQ ID NO: 1096549 - protein, 4 aa, Mycobacterium
AYSV

SEQ ID NO: 1096550 - protein, 7 aa, Mycobacterium
AYTTGRA

SEQ ID NO: 1096551 - protein, 15 aa, Mycobacterium
CAPPGVESASALPTN

SEQ ID NO: 1096552 - protein, 7 aa, Mycobacterium
CATSPGL

SEQ ID NO: 1096553 - protein, 8 aa, Mycobacterium
CDTATDPD

SEQ ID NO: 1096554 - protein, 4 aa, Mycobacterium
CEPD

SEQ ID NO: 1096555 - protein, 9 aa, Mycobacterium
CESGGSPAA

SEQ ID NO: 1096556 - protein, 4 aa, Mycobacterium
CGPA

SEQ ID NO: 1096557 - protein, 8 aa, Mycobacterium
CGPGTAAR

SEQ ID NO: 1096558 - protein, 14 aa, Mycobacterium
CGPPSEIGRSMGTT

SEQ ID NO: 1096559 - protein, 8 aa, Mycobacterium
CKTGADAN

SEQ ID NO: 1096560 - protein, 14 aa, Mycobacterium
CNNGESPEVKKGAT

SEQ ID NO: 1096561 - protein, 7 aa, Mycobacterium
CNTAHSG

SEQ ID NO: 1096562 - protein, 21 aa, Mycobacterium
CPDPAAVATSPTAKNLHATPG

SEQ ID NO: 1096563 - protein, 5 aa, Mycobacterium
CPGDQ

SEQ ID NO: 1096564 - protein, 5 aa, Mycobacterium
CPPTE

SEQ ID NO: 1096565 - protein, 40 aa, Mycobacterium
CQYPKGDLPAGAPVTPPRTGRVPTDPAKISASVSTSQGNI

SEQ ID NO: 1096566 - protein, 6 aa, Mycobacterium
CSNANS

SEQ ID NO: 1096567 - protein, 7 aa, Mycobacterium
DAAGSSM

SEQ ID NO: 1096568 - protein, 18 aa, Mycobacterium
DAAREDTDGARKDTVPER

SEQ ID NO: 1096569 - protein, 7 aa, Mycobacterium
DAASQAS

SEQ ID NO: 1096570 - protein, 9 aa, Mycobacterium
DADDAEEQA

SEQ ID NO: 1096571 - protein, 9 aa, Mycobacterium
DADDPDERA

SEQ ID NO: 1096572 - protein, 14 aa, Mycobacterium
DADGGGRASAIGGT

SEQ ID NO: 1096573 - protein, 8 aa, Mycobacterium
DADGHAAG

SEQ ID NO: 1096574 - protein, 8 aa, Mycobacterium
DADGNPLP

SEQ ID NO: 1096575 - protein, 10 aa, Mycobacterium
DADRAPQRRS

SEQ ID NO: 1096576 - protein, 6 aa, Mycobacterium
DADSRN

SEQ ID NO: 1096577 - protein, 17 aa, Mycobacterium
DAEPVPAGKEPLRENGT

SEQ ID NO: 1096578 - protein, 6 aa, Mycobacterium
DAERTS

SEQ ID NO: 1096579 - protein, 29 aa, Mycobacterium
DAGEPVPGAEAKTEKLPAQRPTDLPPDRP

SEQ ID NO: 1096580 - protein, 5 aa, Mycobacterium
DAGGS

SEQ ID NO: 1096581 - protein, 5 aa, Mycobacterium
DAGME

SEQ ID NO: 1096582 - protein, 7 aa, Mycobacterium
DAGNATA

SEQ ID NO: 1096583 - protein, 5 aa, Mycobacterium
DAGNV

SEQ ID NO: 1096584 - protein, 10 aa, Mycobacterium
DAGPNTTFER

SEQ ID NO: 1096585 - protein, 14 aa, Mycobacterium
DAGQPPDDAGPRAE

SEQ ID NO: 1096586 - protein, 12 aa, Mycobacterium
DAGRSTDADGLT

SEQ ID NO: 1096587 - protein, 5 aa, Mycobacterium
DAGSS

SEQ ID NO: 1096588 - protein, 8 aa, Mycobacterium
DAHAAGPD

SEQ ID NO: 1096589 - protein, 6 aa, Mycobacterium
DAHGPS

SEQ ID NO: 1096590 - protein, 6 aa, Mycobacterium
DAIDST

SEQ ID NO: 1096591 - protein, 6 aa, Mycobacterium
DAKPGN

SEQ ID NO: 1096592 - protein, 9 aa, Mycobacterium
DALEGSTIK

SEQ ID NO: 1096593 - protein, 7 aa, Mycobacterium
DALGSAR

SEQ ID NO: 1096594 - protein, 8 aa, Mycobacterium
DALSSSLS

SEQ ID NO: 1096595 - protein, 5 aa, Mycobacterium
DALTG

SEQ ID NO: 1096596 - protein, 6 aa, Mycobacterium
DANPSC

SEQ ID NO: 1096597 - protein, 14 aa, Mycobacterium
DANQTLSDTALDAG

SEQ ID NO: 1096598 - protein, 5 aa, Mycobacterium
DAPAI

SEQ ID NO: 1096599 - protein, 8 aa, Mycobacterium
DAPDTQGE

SEQ ID NO: 1096600 - protein, 7 aa, Mycobacterium
DAPGSAT

SEQ ID NO: 1096601 - protein, 10 aa, Mycobacterium
DAPMPTQQAP

SEQ ID NO: 1096602 - protein, 8 aa, Mycobacterium
DAPPGDYT

SEQ ID NO: 1096603 - protein, 20 aa, Mycobacterium
DAPPPAPDEEPTDFAAQTRL

SEQ ID NO: 1096604 - protein, 9 aa, Mycobacterium
DAPPPGLDD

SEQ ID NO: 1096605 - protein, 8 aa, Mycobacterium
DAPPTDAE

SEQ ID NO: 1096606 - protein, 16 aa, Mycobacterium
DAPREPAIEAATSDED

SEQ ID NO: 1096607 - protein, 7 aa, Mycobacterium
DAPSGRH

SEQ ID NO: 1096608 - protein, 9 aa, Mycobacterium
DAPSSERTQ

SEQ ID NO: 1096609 - protein, 24 aa, Mycobacterium
DAQDAQHPEGQSARPVESSGQNPA

SEQ ID NO: 1096610 - protein, 9 aa, Mycobacterium
DAQSIAPER

SEQ ID NO: 1096611 - protein, 7 aa, Mycobacterium
DARAGTR

SEQ ID NO: 1096612 - protein, 10 aa, Mycobacterium
DARKNGLSPD

SEQ ID NO: 1096613 - protein, 8 aa, Mycobacterium
DARPADPD

SEQ ID NO: 1096614 - protein, 6 aa, Mycobacterium
DASAEL

SEQ ID NO: 1096615 - protein, 8 aa, Mycobacterium
DASGARND

SEQ ID NO: 1096616 - protein, 5 aa, Mycobacterium
DASGQ

SEQ ID NO: 1096617 - protein, 4 aa, Mycobacterium
DAST

SEQ ID NO: 1096618 - protein, 5 aa, Mycobacterium
DATGS

SEQ ID NO: 1096619 - protein, 8 aa, Mycobacterium
DATLPDER

SEQ ID NO: 1096620 - protein, 8 aa, Mycobacterium
DATPGPVK

SEQ ID NO: 1096621 - protein, 7 aa, Mycobacterium
DATSQVS

SEQ ID NO: 1096622 - protein, 5 aa, Mycobacterium
DAVGR

SEQ ID NO: 1096623 - protein, 5 aa, Mycobacterium
DAVHG

SEQ ID NO: 1096624 - protein, 24 aa, Mycobacterium
DAVPPQPDAGWPADDIGNPRGRID

SEQ ID NO: 1096625 - protein, 11 aa, Mycobacterium
DAVPRKATGKV

SEQ ID NO: 1096626 - protein, 13 aa, Mycobacterium
DAVTAGTVATDSG

SEQ ID NO: 1096627 - protein, 7 aa, Mycobacterium
DAWPAGR

SEQ ID NO: 1096628 - protein, 5 aa, Mycobacterium
DAYDD

SEQ ID NO: 1096629 - protein, 7 aa, Mycobacterium
DAYPADP

SEQ ID NO: 1096630 - protein, 12 aa, Mycobacterium
DCTTSPHGREIS

SEQ ID NO: 1096631 - protein, 5 aa, Mycobacterium
DDAAT

SEQ ID NO: 1096632 - protein, 5 aa, Mycobacterium
DDADT

SEQ ID NO: 1096633 - protein, 7 aa, Mycobacterium
DDAQDAE

SEQ ID NO: 1096634 - protein, 6 aa, Mycobacterium
DDAYDG

SEQ ID NO: 1096635 - protein, 9 aa, Mycobacterium
DDDEEPADL

SEQ ID NO: 1096636 - protein, 7 aa, Mycobacterium
DDDSGLG

SEQ ID NO: 1096637 - protein, 6 aa, Mycobacterium
DDEGEM

SEQ ID NO: 1096638 - protein, 11 aa, Mycobacterium
DDEHDTESTAD

SEQ ID NO: 1096639 - protein, 4 aa, Mycobacterium
DDFA

SEQ ID NO: 1096640 - protein, 19 aa, Mycobacterium
DDGAGGAGDAGEGAGISGM

SEQ ID NO: 1096641 - protein, 94 aa, Mycobacterium
DDGDAPATTDTTTPVTTTTEGPAPAAPPPVDNPEPQAPAPETVTQQAPPPAATEAPPPPPAQEPPPPPPAEEPPPPPPAEEPPPPPPTTQPPPV

SEQ ID NO: 1096642 - protein, 4 aa, Mycobacterium
DDGM

SEQ ID NO: 1096643 - protein, 5 aa, Mycobacterium
DDGQT

SEQ ID NO: 1096644 - protein, 16 aa, Mycobacterium
DDGSTRSAAPPSGDRL

SEQ ID NO: 1096645 - protein, 8 aa, Mycobacterium
DDGTVAEV

SEQ ID NO: 1096646 - protein, 18 aa, Mycobacterium
DDIDGARRGVRPVTGRSA

SEQ ID NO: 1096647 - protein, 9 aa, Mycobacterium
DDLDPALRR

SEQ ID NO: 1096648 - protein, 5 aa, Mycobacterium
DDLDR

SEQ ID NO: 1096649 - protein, 7 aa, Mycobacterium
DDLGSHA

SEQ ID NO: 1096650 - protein, 4 aa, Mycobacterium
DDLR

SEQ ID NO: 1096651 - protein, 15 aa, Mycobacterium
DDMGGPVRRDGDPRL

SEQ ID NO: 1096652 - protein, 11 aa, Mycobacterium
DDNGSGVPEQE

SEQ ID NO: 1096653 - protein, 12 aa, Mycobacterium
DDPAEGPAAAAA

SEQ ID NO: 1096654 - protein, 7 aa, Mycobacterium
DDPELEG

SEQ ID NO: 1096655 - protein, 11 aa, Mycobacterium
DDPLTDNEATG

SEQ ID NO: 1096656 - protein, 9 aa, Mycobacterium
DDPPPPLRE

SEQ ID NO: 1096657 - protein, 8 aa, Mycobacterium
DDPPPPVT

SEQ ID NO: 1096658 - protein, 12 aa, Mycobacterium
DDPRHHETGVPA

SEQ ID NO: 1096659 - protein, 8 aa, Mycobacterium
DDPSSTLR

SEQ ID NO: 1096660 - protein, 6 aa, Mycobacterium
DDPTWR

SEQ ID NO: 1096661 - protein, 12 aa, Mycobacterium
DDPVRDRGRTQM

SEQ ID NO: 1096662 - protein, 4 aa, Mycobacterium
DDQS

SEQ ID NO: 1096663 - protein, 7 aa, Mycobacterium
DDRTRTA

SEQ ID NO: 1096664 - protein, 8 aa, Mycobacterium
DDSGPGPA

SEQ ID NO: 1096665 - protein, 12 aa, Mycobacterium
DDTGKSVAEKLS

SEQ ID NO: 1096666 - protein, 4 aa, Mycobacterium
DDTT

SEQ ID NO: 1096667 - protein, 8 aa, Mycobacterium
DDVDGSDP

SEQ ID NO: 1096668 - protein, 52 aa, Mycobacterium
DDVDSSSQQSEPDYSQTEQTQQTQTEQTQHGPQPAAAPPSEAPAPPPGDGNT

SEQ ID NO: 1096669 - protein, 7 aa, Mycobacterium
DDYKAAG

SEQ ID NO: 1096670 - protein, 9 aa, Mycobacterium
DEAEGGMGP

SEQ ID NO: 1096671 - protein, 7 aa, Mycobacterium
DEAGVAD

SEQ ID NO: 1096672 - protein, 8 aa, Mycobacterium
DEAPTGDV

SEQ ID NO: 1096673 - protein, 5 aa, Mycobacterium
DEARS

SEQ ID NO: 1096674 - protein, 11 aa, Mycobacterium
DEARSDAEKIA

SEQ ID NO: 1096675 - protein, 17 aa, Mycobacterium
DEASAKETAAAIEAAGG

SEQ ID NO: 1096676 - protein, 7 aa, Mycobacterium
DEASGLS

SEQ ID NO: 1096677 - protein, 15 aa, Mycobacterium
DEAVGRPNDAPAVGD

SEQ ID NO: 1096678 - protein, 5 aa, Mycobacterium
DEDTV

SEQ ID NO: 1096679 - protein, 11 aa, Mycobacterium
DEGRDEPTQVA

SEQ ID NO: 1096680 - protein, 8 aa, Mycobacterium
DELRDAAT

SEQ ID NO: 1096681 - protein, 6 aa, Mycobacterium
DELTPG

SEQ ID NO: 1096682 - protein, 8 aa, Mycobacterium
DENAHTAS

SEQ ID NO: 1096683 - protein, 8 aa, Mycobacterium
DEPTPGRT

SEQ ID NO: 1096684 - protein, 8 aa, Mycobacterium
DEPYRPEF

SEQ ID NO: 1096685 - protein, 11 aa, Mycobacterium
DEQRRKDREQL

SEQ ID NO: 1096686 - protein, 6 aa, Mycobacterium
DERIGN

SEQ ID NO: 1096687 - protein, 8 aa, Mycobacterium
DERPDPTV

SEQ ID NO: 1096688 - protein, 7 aa, Mycobacterium
DERTGLT

SEQ ID NO: 1096689 - protein, 11 aa, Mycobacterium
DERTVGSPLTE

SEQ ID NO: 1096690 - protein, 11 aa, Mycobacterium
DESAITGESAP

SEQ ID NO: 1096691 - protein, 8 aa, Mycobacterium
DESGPARR

SEQ ID NO: 1096692 - protein, 7 aa, Mycobacterium
DESGQEL

SEQ ID NO: 1096693 - protein, 11 aa, Mycobacterium
DESNGYGAKNV

SEQ ID NO: 1096694 - protein, 12 aa, Mycobacterium
DETPGPLRDDSG

SEQ ID NO: 1096695 - protein, 13 aa, Mycobacterium
DEVPASTRWQGNP

SEQ ID NO: 1096696 - protein, 4 aa, Mycobacterium
DEVR

SEQ ID NO: 1096697 - protein, 7 aa, Mycobacterium
DEVYRGD

SEQ ID NO: 1096698 - protein, 4 aa, Mycobacterium
DEYP

SEQ ID NO: 1096699 - protein, 5 aa, Mycobacterium
DFGTG

SEQ ID NO: 1096700 - protein, 5 aa, Mycobacterium
DFPGR

SEQ ID NO: 1096701 - protein, 14 aa, Mycobacterium
DFPGRDGNPPYPIE

SEQ ID NO: 1096702 - protein, 10 aa, Mycobacterium
DFPRTASGKV

SEQ ID NO: 1096703 - protein, 8 aa, Mycobacterium
DFSGTGAA

SEQ ID NO: 1096704 - protein, 4 aa, Mycobacterium
DFTQ

SEQ ID NO: 1096705 - protein, 4 aa, Mycobacterium
DGAH

SEQ ID NO: 1096706 - protein, 11 aa, Mycobacterium
DGAKAAPTVGR

SEQ ID NO: 1096707 - protein, 8 aa, Mycobacterium
DGAKVNEL

SEQ ID NO: 1096708 - protein, 12 aa, Mycobacterium
DGAQPALKKQNP

SEQ ID NO: 1096709 - protein, 6 aa, Mycobacterium
DGASAV

SEQ ID NO: 1096710 - protein, 9 aa, Mycobacterium
DGDASTRDV

SEQ ID NO: 1096711 - protein, 13 aa, Mycobacterium
DGDESDAAAHAED

SEQ ID NO: 1096712 - protein, 8 aa, Mycobacterium
DGDETRAE

SEQ ID NO: 1096713 - protein, 8 aa, Mycobacterium
DGDFPGQD

SEQ ID NO: 1096714 - protein, 6 aa, Mycobacterium
DGDPAL

SEQ ID NO: 1096715 - protein, 7 aa, Mycobacterium
DGEGAEF

SEQ ID NO: 1096716 - protein, 5 aa, Mycobacterium
DGELT

SEQ ID NO: 1096717 - protein, 7 aa, Mycobacterium
DGETGSY

SEQ ID NO: 1096718 - protein, 7 aa, Mycobacterium
DGGDRRT

SEQ ID NO: 1096719 - protein, 12 aa, Mycobacterium
DGGHATPMPNPG

SEQ ID NO: 1096720 - protein, 4 aa, Mycobacterium
DGGP

SEQ ID NO: 1096721 - protein, 9 aa, Mycobacterium
DGGRFGGGA

SEQ ID NO: 1096722 - protein, 7 aa, Mycobacterium
DGGSDRL

SEQ ID NO: 1096723 - protein, 11 aa, Mycobacterium
DGHATSVGAAS

SEQ ID NO: 1096724 - protein, 5 aa, Mycobacterium
DGHTA

SEQ ID NO: 1096725 - protein, 7 aa, Mycobacterium
DGIDPDA

SEQ ID NO: 1096726 - protein, 16 aa, Mycobacterium
DGIGPARLAKLRDLVH

SEQ ID NO: 1096727 - protein, 45 aa, Mycobacterium
DGIPPPPPQGYYPPPPGNYPPPYYDPSAPYGRHPMTGEPYSDKSK

SEQ ID NO: 1096728 - protein, 4 aa, Mycobacterium
DGKV

SEQ ID NO: 1096729 - protein, 13 aa, Mycobacterium
DGLDTTGFGGDEG

SEQ ID NO: 1096730 - protein, 8 aa, Mycobacterium
DGLGEARQ

SEQ ID NO: 1096731 - protein, 12 aa, Mycobacterium
DGLTGVSAPEMG

SEQ ID NO: 1096732 - protein, 7 aa, Mycobacterium
DGPLTGA

SEQ ID NO: 1096733 - protein, 17 aa, Mycobacterium
DGPPGMSPMGPRGQFER

SEQ ID NO: 1096734 - protein, 15 aa, Mycobacterium
DGPSVGESVDVGTPN

SEQ ID NO: 1096735 - protein, 8 aa, Mycobacterium
DGQDPDMR

SEQ ID NO: 1096736 - protein, 5 aa, Mycobacterium
DGQEL

SEQ ID NO: 1096737 - protein, 7 aa, Mycobacterium
DGQEMNR

SEQ ID NO: 1096738 - protein, 4 aa, Mycobacterium
DGQQ

SEQ ID NO: 1096739 - protein, 23 aa, Mycobacterium
DGQTITKSTVPSEVGPALDAANE

SEQ ID NO: 1096740 - protein, 8 aa, Mycobacterium
DGRADQYS

SEQ ID NO: 1096741 - protein, 5 aa, Mycobacterium
DGRAE

SEQ ID NO: 1096742 - protein, 18 aa, Mycobacterium
DGRGGAAIADDDNATGLR

SEQ ID NO: 1096743 - protein, 17 aa, Mycobacterium
DGRGKEARGTGNAAATV

SEQ ID NO: 1096744 - protein, 15 aa, Mycobacterium
DGRGSFQDTSGCNGS

SEQ ID NO: 1096745 - protein, 9 aa, Mycobacterium
DGRPLEREP

SEQ ID NO: 1096746 - protein, 6 aa, Mycobacterium
DGRPTE

SEQ ID NO: 1096747 - protein, 24 aa, Mycobacterium
DGRRSAAEVAQEVSSSTGRTVSED

SEQ ID NO: 1096748 - protein, 7 aa, Mycobacterium
DGRTDQY

SEQ ID NO: 1096749 - protein, 4 aa, Mycobacterium
DGRW

SEQ ID NO: 1096750 - protein, 8 aa, Mycobacterium
DGSGEYDY

SEQ ID NO: 1096751 - protein, 5 aa, Mycobacterium
DGSGP

SEQ ID NO: 1096752 - protein, 7 aa, Mycobacterium
DGSPGLT

SEQ ID NO: 1096753 - protein, 4 aa, Mycobacterium
DGSW

SEQ ID NO: 1096754 - protein, 6 aa, Mycobacterium
DGTAKG

SEQ ID NO: 1096755 - protein, 24 aa, Mycobacterium
DGTAPDMSGLRTDTADDEPPRLPE

SEQ ID NO: 1096756 - protein, 9 aa, Mycobacterium
DGTGPVPAL

SEQ ID NO: 1096757 - protein, 7 aa, Mycobacterium
DGTGSVT

SEQ ID NO: 1096758 - protein, 6 aa, Mycobacterium
DGTKRE

SEQ ID NO: 1096759 - protein, 8 aa, Mycobacterium
DGTSHRGA

SEQ ID NO: 1096760 - protein, 7 aa, Mycobacterium
DGTSYRA

SEQ ID NO: 1096761 - protein, 10 aa, Mycobacterium
DGTTTNAAPA

SEQ ID NO: 1096762 - protein, 6 aa, Mycobacterium
DGVDRD

SEQ ID NO: 1096763 - protein, 6 aa, Mycobacterium
DGVGGT

SEQ ID NO: 1096764 - protein, 10 aa, Mycobacterium
DGVGIPPGRL

SEQ ID NO: 1096765 - protein, 11 aa, Mycobacterium
DGVGVPEEERT

SEQ ID NO: 1096766 - protein, 6 aa, Mycobacterium
DGVRRV

SEQ ID NO: 1096767 - protein, 28 aa, Mycobacterium
DGWRSNSGGRSGIEGGAADPGTGAPTRA

SEQ ID NO: 1096768 - protein, 19 aa, Mycobacterium
DGYATNVSDDGGSISAGEK

SEQ ID NO: 1096769 - protein, 10 aa, Mycobacterium
DGYRDTQTDG

SEQ ID NO: 1096770 - protein, 7 aa, Mycobacterium
DGYRPVA

SEQ ID NO: 1096771 - protein, 9 aa, Mycobacterium
DHAGTASAI

SEQ ID NO: 1096772 - protein, 5 aa, Mycobacterium
DHDQM

SEQ ID NO: 1096773 - protein, 5 aa, Mycobacterium
DHDTD

SEQ ID NO: 1096774 - protein, 6 aa, Mycobacterium
DHGTGS

SEQ ID NO: 1096775 - protein, 5 aa, Mycobacterium
DHPDQ

SEQ ID NO: 1096776 - protein, 7 aa, Mycobacterium
DHSGLTG

SEQ ID NO: 1096777 - protein, 11 aa, Mycobacterium
DIAPTDAAGAS

SEQ ID NO: 1096778 - protein, 5 aa, Mycobacterium
DIATQ

SEQ ID NO: 1096779 - protein, 9 aa, Mycobacterium
DIDKNTSYR

SEQ ID NO: 1096780 - protein, 4 aa, Mycobacterium
DIDP

SEQ ID NO: 1096781 - protein, 8 aa, Mycobacterium
DIESNPKN

SEQ ID NO: 1096782 - protein, 10 aa, Mycobacterium
DIPAESVTSN

SEQ ID NO: 1096783 - protein, 6 aa, Mycobacterium
DIPAGE

SEQ ID NO: 1096784 - protein, 5 aa, Mycobacterium
DIPDP

SEQ ID NO: 1096785 - protein, 13 aa, Mycobacterium
DIPGEADGVGPAR

SEQ ID NO: 1096786 - protein, 10 aa, Mycobacterium
DIPTDRESGK

SEQ ID NO: 1096787 - protein, 9 aa, Mycobacterium
DISDAAGTV

SEQ ID NO: 1096788 - protein, 7 aa, Mycobacterium
DITPATR

SEQ ID NO: 1096789 - protein, 13 aa, Mycobacterium
DKAGSAGESSVDE

SEQ ID NO: 1096790 - protein, 10 aa, Mycobacterium
DKELNEESNF

SEQ ID NO: 1096791 - protein, 8 aa, Mycobacterium
DKKADPKL

SEQ ID NO: 1096792 - protein, 4 aa, Mycobacterium
DKPL

SEQ ID NO: 1096793 - protein, 9 aa, Mycobacterium
DKPMAEKPA

SEQ ID NO: 1096794 - protein, 6 aa, Mycobacterium
DKRPQV

SEQ ID NO: 1096795 - protein, 7 aa, Mycobacterium
DKSLPAG

SEQ ID NO: 1096796 - protein, 9 aa, Mycobacterium
DKTAGQATS

SEQ ID NO: 1096797 - protein, 12 aa, Mycobacterium
DKTFTTVPPELA

SEQ ID NO: 1096798 - protein, 5 aa, Mycobacterium
DKVPA

SEQ ID NO: 1096799 - protein, 5 aa, Mycobacterium
DKVTG

SEQ ID NO: 1096800 - protein, 14 aa, Mycobacterium
DLAETSGISSRKTD

SEQ ID NO: 1096801 - protein, 10 aa, Mycobacterium
DLAPLGKQTW

SEQ ID NO: 1096802 - protein, 26 aa, Mycobacterium
DLARRGKDADTATIDEHDDEDELDEH

SEQ ID NO: 1096803 - protein, 10 aa, Mycobacterium
DLDDKDDRER

SEQ ID NO: 1096804 - protein, 14 aa, Mycobacterium
DLDPTLSGEAGAGD

SEQ ID NO: 1096805 - protein, 4 aa, Mycobacterium
DLDT

SEQ ID NO: 1096806 - protein, 4 aa, Mycobacterium
DLEG

SEQ ID NO: 1096807 - protein, 5 aa, Mycobacterium
DLPEE

SEQ ID NO: 1096808 - protein, 4 aa, Mycobacterium
DLPG

SEQ ID NO: 1096809 - protein, 10 aa, Mycobacterium
DLPGPSLRSR

SEQ ID NO: 1096810 - protein, 4 aa, Mycobacterium
DLPI

SEQ ID NO: 1096811 - protein, 4 aa, Mycobacterium
DLPP

SEQ ID NO: 1096812 - protein, 7 aa, Mycobacterium
DLPPETE

SEQ ID NO: 1096813 - protein, 8 aa, Mycobacterium
DLPPRTPV

SEQ ID NO: 1096814 - protein, 20 aa, Mycobacterium
DLRDDTRDDLRDDDVEAGGR

SEQ ID NO: 1096815 - protein, 7 aa, Mycobacterium
DLRPGRV

SEQ ID NO: 1096816 - protein, 10 aa, Mycobacterium
DLSEGEAFTA

SEQ ID NO: 1096817 - protein, 4 aa, Mycobacterium
DLSP

SEQ ID NO: 1096818 - protein, 9 aa, Mycobacterium
DLYSSNTRS

SEQ ID NO: 1096819 - protein, 8 aa, Mycobacterium
DMGTGNDA

SEQ ID NO: 1096820 - protein, 7 aa, Mycobacterium
DMPHPDE

SEQ ID NO: 1096821 - protein, 10 aa, Mycobacterium
DMPTPRGSYG

SEQ ID NO: 1096822 - protein, 5 aa, Mycobacterium
DMTGA

SEQ ID NO: 1096823 - protein, 7 aa, Mycobacterium
DNDTAGR

SEQ ID NO: 1096824 - protein, 6 aa, Mycobacterium
DNEAVA

SEQ ID NO: 1096825 - protein, 6 aa, Mycobacterium
DNEYTA

SEQ ID NO: 1096826 - protein, 7 aa, Mycobacterium
DNGEGIA

SEQ ID NO: 1096827 - protein, 9 aa, Mycobacterium
DNGQATSFS

SEQ ID NO: 1096828 - protein, 7 aa, Mycobacterium
DNGTIGS

SEQ ID NO: 1096829 - protein, 5 aa, Mycobacterium
DNLGP

SEQ ID NO: 1096830 - protein, 7 aa, Mycobacterium
DNPDLAE

SEQ ID NO: 1096831 - protein, 7 aa, Mycobacterium
DNPEDPN

SEQ ID NO: 1096832 - protein, 4 aa, Mycobacterium
DNPG

SEQ ID NO: 1096833 - protein, 7 aa, Mycobacterium
DNPLTAR

SEQ ID NO: 1096834 - protein, 7 aa, Mycobacterium
DNPQKSI

SEQ ID NO: 1096835 - protein, 6 aa, Mycobacterium
DNSGSA

SEQ ID NO: 1096836 - protein, 6 aa, Mycobacterium
DNVPAR

SEQ ID NO: 1096837 - protein, 6 aa, Mycobacterium
DPAAAT

SEQ ID NO: 1096838 - protein, 11 aa, Mycobacterium
DPAAEQGWGSY

SEQ ID NO: 1096839 - protein, 13 aa, Mycobacterium
DPAGDAGYSEHPQ

SEQ ID NO: 1096840 - protein, 5 aa, Mycobacterium
DPARP

SEQ ID NO: 1096841 - protein, 9 aa, Mycobacterium
DPASPVEGR

SEQ ID NO: 1096842 - protein, 10 aa, Mycobacterium
DPASRVSHGD

SEQ ID NO: 1096843 - protein, 6 aa, Mycobacterium
DPDADV

SEQ ID NO: 1096844 - protein, 7 aa, Mycobacterium
DPDGDGL

SEQ ID NO: 1096845 - protein, 5 aa, Mycobacterium
DPDKT

SEQ ID NO: 1096846 - protein, 13 aa, Mycobacterium
DPDMRSAGSRADR

SEQ ID NO: 1096847 - protein, 9 aa, Mycobacterium
DPDNDPSKM

SEQ ID NO: 1096848 - protein, 5 aa, Mycobacterium
DPDRM

SEQ ID NO: 1096849 - protein, 6 aa, Mycobacterium
DPDTFD

SEQ ID NO: 1096850 - protein, 12 aa, Mycobacterium
DPDTGAPVAAGE

SEQ ID NO: 1096851 - protein, 10 aa, Mycobacterium
DPDTYRRPTP

SEQ ID NO: 1096852 - protein, 10 aa, Mycobacterium
DPEDKGARET

SEQ ID NO: 1096853 - protein, 7 aa, Mycobacterium
DPEDPTP

SEQ ID NO: 1096854 - protein, 7 aa, Mycobacterium
DPEEHTR

SEQ ID NO: 1096855 - protein, 5 aa, Mycobacterium
DPEEI

SEQ ID NO: 1096856 - protein, 8 aa, Mycobacterium
DPGAPPEI

SEQ ID NO: 1096857 - protein, 6 aa, Mycobacterium
DPGDFD

SEQ ID NO: 1096858 - protein, 22 aa, Mycobacterium
DPGDTGADRRFATTTGDPNAPS

SEQ ID NO: 1096859 - protein, 15 aa, Mycobacterium
DPGIGAEEVPADPQF

SEQ ID NO: 1096860 - protein, 13 aa, Mycobacterium
DPGNSITVDKPPA

SEQ ID NO: 1096861 - protein, 6 aa, Mycobacterium
DPGPVQ

SEQ ID NO: 1096862 - protein, 12 aa, Mycobacterium
DPGRHETETERL

SEQ ID NO: 1096863 - protein, 6 aa, Mycobacterium
DPKGKF

SEQ ID NO: 1096864 - protein, 7 aa, Mycobacterium
DPKGYQP

SEQ ID NO: 1096865 - protein, 5 aa, Mycobacterium
DPKQR

SEQ ID NO: 1096866 - protein, 7 aa, Mycobacterium
DPLGSQA

SEQ ID NO: 1096867 - protein, 5 aa, Mycobacterium
DPNAD

SEQ ID NO: 1096868 - protein, 8 aa, Mycobacterium
DPNEVGQK

SEQ ID NO: 1096869 - protein, 11 aa, Mycobacterium
DPNPTASSFQP

SEQ ID NO: 1096870 - protein, 5 aa, Mycobacterium
DPNTD

SEQ ID NO: 1096871 - protein, 4 aa, Mycobacterium
DPPA

SEQ ID NO: 1096872 - protein, 7 aa, Mycobacterium
DPPEHTR

SEQ ID NO: 1096873 - protein, 6 aa, Mycobacterium
DPPPVV

SEQ ID NO: 1096874 - protein, 4 aa, Mycobacterium
DPPR

SEQ ID NO: 1096875 - protein, 10 aa, Mycobacterium
DPPRAAATPA

SEQ ID NO: 1096876 - protein, 5 aa, Mycobacterium
DPPTC

SEQ ID NO: 1096877 - protein, 11 aa, Mycobacterium
DPQSSTSIEDS

SEQ ID NO: 1096878 - protein, 8 aa, Mycobacterium
DPQVNNPL

SEQ ID NO: 1096879 - protein, 4 aa, Mycobacterium
DPRA

SEQ ID NO: 1096880 - protein, 8 aa, Mycobacterium
DPRSGTWE

SEQ ID NO: 1096881 - protein, 6 aa, Mycobacterium
DPRSRR

SEQ ID NO: 1096882 - protein, 7 aa, Mycobacterium
DPTELAD

SEQ ID NO: 1096883 - protein, 5 aa, Mycobacterium
DPTID

SEQ ID NO: 1096884 - protein, 7 aa, Mycobacterium
DPTPRRI

SEQ ID NO: 1096885 - protein, 5 aa, Mycobacterium
DPTRG

SEQ ID NO: 1096886 - protein, 4 aa, Mycobacterium
DPTS

SEQ ID NO: 1096887 - protein, 11 aa, Mycobacterium
DPTSGAVTLDG

SEQ ID NO: 1096888 - protein, 5 aa, Mycobacterium
DPVET

SEQ ID NO: 1096889 - protein, 4 aa, Mycobacterium
DPVG

SEQ ID NO: 1096890 - protein, 5 aa, Mycobacterium
DPVGP

SEQ ID NO: 1096891 - protein, 11 aa, Mycobacterium
DPVPTPADGSQ

SEQ ID NO: 1096892 - protein, 5 aa, Mycobacterium
DPWGY

SEQ ID NO: 1096893 - protein, 6 aa, Mycobacterium
DPYRYP

SEQ ID NO: 1096894 - protein, 6 aa, Mycobacterium
DQAEAL

SEQ ID NO: 1096895 - protein, 8 aa, Mycobacterium
DQAGETTR

SEQ ID NO: 1096896 - protein, 9 aa, Mycobacterium
DQENTGTAC

SEQ ID NO: 1096897 - protein, 9 aa, Mycobacterium
DQGPGIPEA

SEQ ID NO: 1096898 - protein, 6 aa, Mycobacterium
DQITNR

SEQ ID NO: 1096899 - protein, 4 aa, Mycobacterium
DQPV

SEQ ID NO: 1096900 - protein, 7 aa, Mycobacterium
DQQGRDG

SEQ ID NO: 1096901 - protein, 7 aa, Mycobacterium
DQRRRTG

SEQ ID NO: 1096902 - protein, 16 aa, Mycobacterium
DQSPTGGRRLPEPSPV

SEQ ID NO: 1096903 - protein, 7 aa, Mycobacterium
DQVKVGG

SEQ ID NO: 1096904 - protein, 6 aa, Mycobacterium
DQVSDT

SEQ ID NO: 1096905 - protein, 11 aa, Mycobacterium
DQYNENAAPVG

SEQ ID NO: 1096906 - protein, 6 aa, Mycobacterium
DRAATP

SEQ ID NO: 1096907 - protein, 16 aa, Mycobacterium
DRADREDLAREAARSG

SEQ ID NO: 1096908 - protein, 8 aa, Mycobacterium
DRAGRKTT

SEQ ID NO: 1096909 - protein, 28 aa, Mycobacterium
DRAGTRPEAFEPDGLAPADPAEPTVSRR

SEQ ID NO: 1096910 - protein, 9 aa, Mycobacterium
DRATRRKLT

SEQ ID NO: 1096911 - protein, 4 aa, Mycobacterium
DRDD

SEQ ID NO: 1096912 - protein, 6 aa, Mycobacterium
DRDDGE

SEQ ID NO: 1096913 - protein, 7 aa, Mycobacterium
DRDEPAQ

SEQ ID NO: 1096914 - protein, 18 aa, Mycobacterium
DREAEPVLPSSNDVGPVP

SEQ ID NO: 1096915 - protein, 14 aa, Mycobacterium
DREPARPLRGEPGA

SEQ ID NO: 1096916 - protein, 5 aa, Mycobacterium
DRFGP

SEQ ID NO: 1096917 - protein, 6 aa, Mycobacterium
DRGEYD

SEQ ID NO: 1096918 - protein, 16 aa, Mycobacterium
DRGGPPGFGRDGTAAE

SEQ ID NO: 1096919 - protein, 8 aa, Mycobacterium
DRGRANAQ

SEQ ID NO: 1096920 - protein, 5 aa, Mycobacterium
DRGRT

SEQ ID NO: 1096921 - protein, 4 aa, Mycobacterium
DRGV

SEQ ID NO: 1096922 - protein, 5 aa, Mycobacterium
DRGYG

SEQ ID NO: 1096923 - protein, 20 aa, Mycobacterium
DRHDGASPEIQRKTAAANLT

SEQ ID NO: 1096924 - protein, 10 aa, Mycobacterium
DRHGHASGDA

SEQ ID NO: 1096925 - protein, 4 aa, Mycobacterium
DRIP

SEQ ID NO: 1096926 - protein, 13 aa, Mycobacterium
DRIPESVGLSKQA

SEQ ID NO: 1096927 - protein, 8 aa, Mycobacterium
DRISASGF

SEQ ID NO: 1096928 - protein, 6 aa, Mycobacterium
DRLDEG

SEQ ID NO: 1096929 - protein, 12 aa, Mycobacterium
DRLQEERRDAET

SEQ ID NO: 1096930 - protein, 7 aa, Mycobacterium
DRPADAN

SEQ ID NO: 1096931 - protein, 4 aa, Mycobacterium
DRPD

SEQ ID NO: 1096932 - protein, 13 aa, Mycobacterium
DRPPRRAEEPRRF

SEQ ID NO: 1096933 - protein, 8 aa, Mycobacterium
DRRAGAGA

SEQ ID NO: 1096934 - protein, 5 aa, Mycobacterium
DRRAP

SEQ ID NO: 1096935 - protein, 19 aa, Mycobacterium
DRRDPGTPEVEPRYDGGRT

SEQ ID NO: 1096936 - protein, 6 aa, Mycobacterium
DRRGRK

SEQ ID NO: 1096937 - protein, 7 aa, Mycobacterium
DRRGTAG

SEQ ID NO: 1096938 - protein, 10 aa, Mycobacterium
DRRGYGAPRA

SEQ ID NO: 1096939 - protein, 15 aa, Mycobacterium
DRRPSVSAATAVPAR

SEQ ID NO: 1096940 - protein, 18 aa, Mycobacterium
DRSRGPAAARNTGAAACS

SEQ ID NO: 1096941 - protein, 9 aa, Mycobacterium
DRSRGSRAA

SEQ ID NO: 1096942 - protein, 14 aa, Mycobacterium
DRSTGRFSTEPANL

SEQ ID NO: 1096943 - protein, 19 aa, Mycobacterium
DRTDQRRNLASSAPSSSNK

SEQ ID NO: 1096944 - protein, 15 aa, Mycobacterium
DRTPQVGLPAEQSGG

SEQ ID NO: 1096945 - protein, 5 aa, Mycobacterium
DRTTV

SEQ ID NO: 1096946 - protein, 4 aa, Mycobacterium
DRVG

SEQ ID NO: 1096947 - protein, 5 aa, Mycobacterium
DRVGT

SEQ ID NO: 1096948 - protein, 6 aa, Mycobacterium
DRYGRR

SEQ ID NO: 1096949 - protein, 8 aa, Mycobacterium
DSAASDIR

SEQ ID NO: 1096950 - protein, 9 aa, Mycobacterium
DSAQATAAE

SEQ ID NO: 1096951 - protein, 13 aa, Mycobacterium
DSARARQNGGAGI

SEQ ID NO: 1096952 - protein, 7 aa, Mycobacterium
DSAYGNS

SEQ ID NO: 1096953 - protein, 7 aa, Mycobacterium
DSDIYSS

SEQ ID NO: 1096954 - protein, 5 aa, Mycobacterium
DSDVT

SEQ ID NO: 1096955 - protein, 6 aa, Mycobacterium
DSEPGA

SEQ ID NO: 1096956 - protein, 8 aa, Mycobacterium
DSGEIAYP

SEQ ID NO: 1096957 - protein, 10 aa, Mycobacterium
DSGPNKGANT

SEQ ID NO: 1096958 - protein, 6 aa, Mycobacterium
DSGRYE

SEQ ID NO: 1096959 - protein, 6 aa, Mycobacterium
DSHDSN

SEQ ID NO: 1096960 - protein, 6 aa, Mycobacterium
DSHGTL

SEQ ID NO: 1096961 - protein, 6 aa, Mycobacterium
DSKPLD

SEQ ID NO: 1096962 - protein, 6 aa, Mycobacterium
DSLGRR

SEQ ID NO: 1096963 - protein, 6 aa, Mycobacterium
DSLPQT

SEQ ID NO: 1096964 - protein, 17 aa, Mycobacterium
DSNPSHARSTTTGGSTF

SEQ ID NO: 1096965 - protein, 5 aa, Mycobacterium
DSPGH

SEQ ID NO: 1096966 - protein, 8 aa, Mycobacterium
DSPGSTRI

SEQ ID NO: 1096967 - protein, 6 aa, Mycobacterium
DSPLGG

SEQ ID NO: 1096968 - protein, 12 aa, Mycobacterium
DSRPYIGGSQHN

SEQ ID NO: 1096969 - protein, 9 aa, Mycobacterium
DSRYSSTPT

SEQ ID NO: 1096970 - protein, 7 aa, Mycobacterium
DSSTGQF

SEQ ID NO: 1096971 - protein, 10 aa, Mycobacterium
DSTALNNRIG

SEQ ID NO: 1096972 - protein, 7 aa, Mycobacterium
DSTSDTV

SEQ ID NO: 1096973 - protein, 8 aa, Mycobacterium
DSTTRAGG

SEQ ID NO: 1096974 - protein, 6 aa, Mycobacterium
DSVRAP

SEQ ID NO: 1096975 - protein, 9 aa, Mycobacterium
DSYDPRLTN

SEQ ID NO: 1096976 - protein, 6 aa, Mycobacterium
DTAAEL

SEQ ID NO: 1096977 - protein, 5 aa, Mycobacterium
DTAAR

SEQ ID NO: 1096978 - protein, 7 aa, Mycobacterium
DTAAVAG

SEQ ID NO: 1096979 - protein, 8 aa, Mycobacterium
DTADGGHA

SEQ ID NO: 1096980 - protein, 7 aa, Mycobacterium
DTAGDKN

SEQ ID NO: 1096981 - protein, 6 aa, Mycobacterium
DTAKQA

SEQ ID NO: 1096982 - protein, 17 aa, Mycobacterium
DTANPNAFATGRNPRNS

SEQ ID NO: 1096983 - protein, 6 aa, Mycobacterium
DTASVS

SEQ ID NO: 1096984 - protein, 10 aa, Mycobacterium
DTDETGSGAV

SEQ ID NO: 1096985 - protein, 6 aa, Mycobacterium
DTDLPD

SEQ ID NO: 1096986 - protein, 6 aa, Mycobacterium
DTDTPT

SEQ ID NO: 1096987 - protein, 13 aa, Mycobacterium
DTGPGIPPGGQDR

SEQ ID NO: 1096988 - protein, 6 aa, Mycobacterium
DTGPGS

SEQ ID NO: 1096989 - protein, 8 aa, Mycobacterium
DTGPGVPE

SEQ ID NO: 1096990 - protein, 12 aa, Mycobacterium
DTGSTPAPLPED

SEQ ID NO: 1096991 - protein, 6 aa, Mycobacterium
DTGVGI

SEQ ID NO: 1096992 - protein, 5 aa, Mycobacterium
DTHTD

SEQ ID NO: 1096993 - protein, 5 aa, Mycobacterium
DTKPD

SEQ ID NO: 1096994 - protein, 6 aa, Mycobacterium
DTLERE

SEQ ID NO: 1096995 - protein, 5 aa, Mycobacterium
DTNAG

SEQ ID NO: 1096996 - protein, 11 aa, Mycobacterium
DTNATLGNTDL

SEQ ID NO: 1096997 - protein, 5 aa, Mycobacterium
DTNET

SEQ ID NO: 1096998 - protein, 7 aa, Mycobacterium
DTPDFEE

SEQ ID NO: 1096999 - protein, 5 aa, Mycobacterium
DTPLD

SEQ ID NO: 1097000 - protein, 14 aa, Mycobacterium
DTPRRPLGERIGSS

SEQ ID NO: 1097001 - protein, 19 aa, Mycobacterium
DTPSGRHVPESRGTVGDTL

SEQ ID NO: 1097002 - protein, 5 aa, Mycobacterium
DTPVP

SEQ ID NO: 1097003 - protein, 19 aa, Mycobacterium
DTPYPTAPQPYSKGPSQTG

SEQ ID NO: 1097004 - protein, 10 aa, Mycobacterium
DTRCGPATSA

SEQ ID NO: 1097005 - protein, 17 aa, Mycobacterium
DTRPEDYEDAEISDGAG

SEQ ID NO: 1097006 - protein, 4 aa, Mycobacterium
DTSA

SEQ ID NO: 1097007 - protein, 17 aa, Mycobacterium
DTSAERHRRLTGRLAGS

SEQ ID NO: 1097008 - protein, 14 aa, Mycobacterium
DTSGAPSAKGAPGR

SEQ ID NO: 1097009 - protein, 28 aa, Mycobacterium
DTSGTPRQVTGPGTGPSPDTAETTSADR

SEQ ID NO: 1097010 - protein, 8 aa, Mycobacterium
DTSPPAPK

SEQ ID NO: 1097011 - protein, 8 aa, Mycobacterium
DTVARVGG

SEQ ID NO: 1097012 - protein, 12 aa, Mycobacterium
DTVPGGNPPGTS

SEQ ID NO: 1097013 - protein, 17 aa, Mycobacterium
DVAGKGELVGSQPHRRG

SEQ ID NO: 1097014 - protein, 11 aa, Mycobacterium
DVDADGLTSLG

SEQ ID NO: 1097015 - protein, 19 aa, Mycobacterium
DVGSAPHGELTPEQERGLR

SEQ ID NO: 1097016 - protein, 4 aa, Mycobacterium
DVMP

SEQ ID NO: 1097017 - protein, 13 aa, Mycobacterium
DVPAGTRAANDEA

SEQ ID NO: 1097018 - protein, 8 aa, Mycobacterium
DVPPEKGV

SEQ ID NO: 1097019 - protein, 16 aa, Mycobacterium
DVPRSGTDVASGPATF

SEQ ID NO: 1097020 - protein, 6 aa, Mycobacterium
DVPSAQ

SEQ ID NO: 1097021 - protein, 9 aa, Mycobacterium
DWDASTNSV

SEQ ID NO: 1097022 - protein, 7 aa, Mycobacterium
DWPDRPD

SEQ ID NO: 1097023 - protein, 8 aa, Mycobacterium
DYADLPTS

SEQ ID NO: 1097024 - protein, 11 aa, Mycobacterium
DYGQAERRSAR

SEQ ID NO: 1097025 - protein, 9 aa, Mycobacterium
DYGSGPDRY

SEQ ID NO: 1097026 - protein, 22 aa, Mycobacterium
DYPGNAPATAQQVAADRSTTSN

SEQ ID NO: 1097027 - protein, 5 aa, Mycobacterium
DYPPD

SEQ ID NO: 1097028 - protein, 6 aa, Mycobacterium
DYPQQA

SEQ ID NO: 1097029 - protein, 4 aa, Mycobacterium
DYTG

SEQ ID NO: 1097030 - protein, 5 aa, Mycobacterium
DYVPT

SEQ ID NO: 1097031 - protein, 8 aa, Mycobacterium
EAAAEGRM

SEQ ID NO: 1097032 - protein, 7 aa, Mycobacterium
EAAAERG

SEQ ID NO: 1097033 - protein, 9 aa, Mycobacterium
EAAEAEGRT

SEQ ID NO: 1097034 - protein, 9 aa, Mycobacterium
EAAGGAVDG

SEQ ID NO: 1097035 - protein, 8 aa, Mycobacterium
EAAGVPSS

SEQ ID NO: 1097036 - protein, 22 aa, Mycobacterium
EAAIEEDVERAKALRRSRGRDD

SEQ ID NO: 1097037 - protein, 9 aa, Mycobacterium
EAANNPAKY

SEQ ID NO: 1097038 - protein, 27 aa, Mycobacterium
EAAPAGRHRGGEDGKSSAGLPVSAVPR

SEQ ID NO: 1097039 - protein, 11 aa, Mycobacterium
EAASGATRLQD

SEQ ID NO: 1097040 - protein, 8 aa, Mycobacterium
EAATPRRR

SEQ ID NO: 1097041 - protein, 17 aa, Mycobacterium
EADEDIRTAEALPDGSR

SEQ ID NO: 1097042 - protein, 7 aa, Mycobacterium
EADPKHV

SEQ ID NO: 1097043 - protein, 5 aa, Mycobacterium
EADRY

SEQ ID NO: 1097044 - protein, 10 aa, Mycobacterium
EAEARSAAAL

SEQ ID NO: 1097045 - protein, 13 aa, Mycobacterium
EAEHAAAAEERDL

SEQ ID NO: 1097046 - protein, 12 aa, Mycobacterium
EAERDGAPGETA

SEQ ID NO: 1097047 - protein, 13 aa, Mycobacterium
EAGEAADEEPPVT

SEQ ID NO: 1097048 - protein, 9 aa, Mycobacterium
EAGETGVAT

SEQ ID NO: 1097049 - protein, 8 aa, Mycobacterium
EAGGGRLG

SEQ ID NO: 1097050 - protein, 10 aa, Mycobacterium
EAGKVPPDQI

SEQ ID NO: 1097051 - protein, 9 aa, Mycobacterium
EAGRPPRRL

SEQ ID NO: 1097052 - protein, 5 aa, Mycobacterium
EAHES

SEQ ID NO: 1097053 - protein, 15 aa, Mycobacterium
EAHRSPTASPRTRRA

SEQ ID NO: 1097054 - protein, 10 aa, Mycobacterium
EAIPGGRTQI

SEQ ID NO: 1097055 - protein, 23 aa, Mycobacterium
EAKSKSVGTLGEAGLESVSGDTA

SEQ ID NO: 1097056 - protein, 9 aa, Mycobacterium
EALGDKATL

SEQ ID NO: 1097057 - protein, 9 aa, Mycobacterium
EALPVPDAS

SEQ ID NO: 1097058 - protein, 10 aa, Mycobacterium
EANRAGDAQL

SEQ ID NO: 1097059 - protein, 8 aa, Mycobacterium
EAPAVNGA

SEQ ID NO: 1097060 - protein, 8 aa, Mycobacterium
EAPGRPTT

SEQ ID NO: 1097061 - protein, 12 aa, Mycobacterium
EAPNTDRRAARS

SEQ ID NO: 1097062 - protein, 12 aa, Mycobacterium
EAPPEQNPRGAL

SEQ ID NO: 1097063 - protein, 19 aa, Mycobacterium
EAPPLAAPPIPDAGAPPRF

SEQ ID NO: 1097064 - protein, 5 aa, Mycobacterium
EAPQE

SEQ ID NO: 1097065 - protein, 5 aa, Mycobacterium
EAPVT

SEQ ID NO: 1097066 - protein, 10 aa, Mycobacterium
EAQAAAGVQD

SEQ ID NO: 1097067 - protein, 14 aa, Mycobacterium
EAQNSSSRAQRLAD

SEQ ID NO: 1097068 - protein, 10 aa, Mycobacterium
EAQSGKAEVQ

SEQ ID NO: 1097069 - protein, 8 aa, Mycobacterium
EARGGERG

SEQ ID NO: 1097070 - protein, 11 aa, Mycobacterium
EARGLGEDKET

SEQ ID NO: 1097071 - protein, 11 aa, Mycobacterium
EARKRGQSLSL

SEQ ID NO: 1097072 - protein, 7 aa, Mycobacterium
EARSDGI

SEQ ID NO: 1097073 - protein, 11 aa, Mycobacterium
EARTAGEDRES

SEQ ID NO: 1097074 - protein, 8 aa, Mycobacterium
EARTDAQK

SEQ ID NO: 1097075 - protein, 7 aa, Mycobacterium
EASPAAL

SEQ ID NO: 1097076 - protein, 6 aa, Mycobacterium
EATASF

SEQ ID NO: 1097077 - protein, 8 aa, Mycobacterium
EATDEDVR

SEQ ID NO: 1097078 - protein, 7 aa, Mycobacterium
EATGERI

SEQ ID NO: 1097079 - protein, 5 aa, Mycobacterium
EATQT

SEQ ID NO: 1097080 - protein, 10 aa, Mycobacterium
EATRRELGET

SEQ ID NO: 1097081 - protein, 15 aa, Mycobacterium
EATTHGDSKADAALT

SEQ ID NO: 1097082 - protein, 14 aa, Mycobacterium
EAVGSASDLRGAGH

SEQ ID NO: 1097083 - protein, 7 aa, Mycobacterium
EAVRRTS

SEQ ID NO: 1097084 - protein, 20 aa, Mycobacterium
EAVSGLPEALTGARARNRRR

SEQ ID NO: 1097085 - protein, 6 aa, Mycobacterium
EAYTGY

SEQ ID NO: 1097086 - protein, 38 aa, Mycobacterium
EDADVSARPRAPHPPRRRVPPGTPSAPGGSAPNPPRSP

SEQ ID NO: 1097087 - protein, 5 aa, Mycobacterium
EDAMD

SEQ ID NO: 1097088 - protein, 10 aa, Mycobacterium
EDDADAQVTA

SEQ ID NO: 1097089 - protein, 7 aa, Mycobacterium
EDDDGYS

SEQ ID NO: 1097090 - protein, 6 aa, Mycobacterium
EDDLGG

SEQ ID NO: 1097091 - protein, 8 aa, Mycobacterium
EDDPRDAD

SEQ ID NO: 1097092 - protein, 19 aa, Mycobacterium
EDELTERTDEARAVTVGSE

SEQ ID NO: 1097093 - protein, 4 aa, Mycobacterium
EDGA

SEQ ID NO: 1097094 - protein, 11 aa, Mycobacterium
EDKPGSGEATA

SEQ ID NO: 1097095 - protein, 6 aa, Mycobacterium
EDMQTT

SEQ ID NO: 1097096 - protein, 15 aa, Mycobacterium
EDNDANLNRLSGGAH

SEQ ID NO: 1097097 - protein, 14 aa, Mycobacterium
EDNHTYDLTGQSGP

SEQ ID NO: 1097098 - protein, 10 aa, Mycobacterium
EDPARQDEAR

SEQ ID NO: 1097099 - protein, 9 aa, Mycobacterium
EDPETTRLG

SEQ ID NO: 1097100 - protein, 19 aa, Mycobacterium
EDPGDRVPPYRVGDGGTVV

SEQ ID NO: 1097101 - protein, 23 aa, Mycobacterium
EDPKFASSVRGGTLRAPSARRRL

SEQ ID NO: 1097102 - protein, 15 aa, Mycobacterium
EDPVPPSQRHEGVSR

SEQ ID NO: 1097103 - protein, 12 aa, Mycobacterium
EDTANSSGTIGS

SEQ ID NO: 1097104 - protein, 10 aa, Mycobacterium
EDTDRPCPDP

SEQ ID NO: 1097105 - protein, 6 aa, Mycobacterium
EDTPKD

SEQ ID NO: 1097106 - protein, 14 aa, Mycobacterium
EDTPTPAPTPGAVP

SEQ ID NO: 1097107 - protein, 9 aa, Mycobacterium
EEAASDAKK

SEQ ID NO: 1097108 - protein, 12 aa, Mycobacterium
EEAHDPARDIPK

SEQ ID NO: 1097109 - protein, 5 aa, Mycobacterium
EEANS

SEQ ID NO: 1097110 - protein, 7 aa, Mycobacterium
EEARRAR

SEQ ID NO: 1097111 - protein, 19 aa, Mycobacterium
EEATAALSAEADALTEGNA

SEQ ID NO: 1097112 - protein, 11 aa, Mycobacterium
EEATQKAASER

SEQ ID NO: 1097113 - protein, 17 aa, Mycobacterium
EEDSGALPIGSAADQPF

SEQ ID NO: 1097114 - protein, 10 aa, Mycobacterium
EEEREAADRL

SEQ ID NO: 1097115 - protein, 22 aa, Mycobacterium
EEESADPMRDLPASGRTGPGRV

SEQ ID NO: 1097116 - protein, 9 aa, Mycobacterium
EEEVAGPLR

SEQ ID NO: 1097117 - protein, 8 aa, Mycobacterium
EEGDSDSN

SEQ ID NO: 1097118 - protein, 7 aa, Mycobacterium
EEGGGGN

SEQ ID NO: 1097119 - protein, 28 aa, Mycobacterium
EELAASAQDAPGDDVADIDEGGETDASA

SEQ ID NO: 1097120 - protein, 15 aa, Mycobacterium
EEPGRGVTATVEGQR

SEQ ID NO: 1097121 - protein, 7 aa, Mycobacterium
EEPIDHT

SEQ ID NO: 1097122 - protein, 6 aa, Mycobacterium
EEPLGD

SEQ ID NO: 1097123 - protein, 7 aa, Mycobacterium
EEPSGGT

SEQ ID NO: 1097124 - protein, 5 aa, Mycobacterium
EERER

SEQ ID NO: 1097125 - protein, 6 aa, Mycobacterium
EERGLT

SEQ ID NO: 1097126 - protein, 8 aa, Mycobacterium
EESRDGIR

SEQ ID NO: 1097127 - protein, 6 aa, Mycobacterium
EETDGA

SEQ ID NO: 1097128 - protein, 10 aa, Mycobacterium
EETTPAGTAS

SEQ ID NO: 1097129 - protein, 5 aa, Mycobacterium
EEVEH

SEQ ID NO: 1097130 - protein, 4 aa, Mycobacterium
EFPG

SEQ ID NO: 1097131 - protein, 12 aa, Mycobacterium
EFQESAKHAGIG

SEQ ID NO: 1097132 - protein, 6 aa, Mycobacterium
EFTPAA

SEQ ID NO: 1097133 - protein, 10 aa, Mycobacterium
EGAAEGAASL

SEQ ID NO: 1097134 - protein, 8 aa, Mycobacterium
EGAAPLTD

SEQ ID NO: 1097135 - protein, 10 aa, Mycobacterium
EGASVDEDAI

SEQ ID NO: 1097136 - protein, 17 aa, Mycobacterium
EGATLGQEVKDPKRQIP

SEQ ID NO: 1097137 - protein, 6 aa, Mycobacterium
EGATVN

SEQ ID NO: 1097138 - protein, 9 aa, Mycobacterium
EGDDCPDST

SEQ ID NO: 1097139 - protein, 8 aa, Mycobacterium
EGDPEEPI

SEQ ID NO: 1097140 - protein, 13 aa, Mycobacterium
EGETKRRTAEQLG

SEQ ID NO: 1097141 - protein, 8 aa, Mycobacterium
EGFTSGQT

SEQ ID NO: 1097142 - protein, 6 aa, Mycobacterium
EGGERI

SEQ ID NO: 1097143 - protein, 5 aa, Mycobacterium
EGGPA

SEQ ID NO: 1097144 - protein, 12 aa, Mycobacterium
EGHDPTDRDTKG

SEQ ID NO: 1097145 - protein, 8 aa, Mycobacterium
EGIARTGE

SEQ ID NO: 1097146 - protein, 4 aa, Mycobacterium
EGIP

SEQ ID NO: 1097147 - protein, 7 aa, Mycobacterium
EGITQTV

SEQ ID NO: 1097148 - protein, 13 aa, Mycobacterium
EGKHQVGKRGAGT

SEQ ID NO: 1097149 - protein, 6 aa, Mycobacterium
EGLPLG

SEQ ID NO: 1097150 - protein, 8 aa, Mycobacterium
EGLSNDAT

SEQ ID NO: 1097151 - protein, 14 aa, Mycobacterium
EGLSSGLQKTLGAT

SEQ ID NO: 1097152 - protein, 6 aa, Mycobacterium
EGMPNG

SEQ ID NO: 1097153 - protein, 7 aa, Mycobacterium
EGNPGRV

SEQ ID NO: 1097154 - protein, 5 aa, Mycobacterium
EGPEV

SEQ ID NO: 1097155 - protein, 10 aa, Mycobacterium
EGPGMTEEDA

SEQ ID NO: 1097156 - protein, 6 aa, Mycobacterium
EGPGRR

SEQ ID NO: 1097157 - protein, 8 aa, Mycobacterium
EGPMPPKR

SEQ ID NO: 1097158 - protein, 5 aa, Mycobacterium
EGQAL

SEQ ID NO: 1097159 - protein, 10 aa, Mycobacterium
EGQPDGAEAA

SEQ ID NO: 1097160 - protein, 13 aa, Mycobacterium
EGQQTEREAAEEI

SEQ ID NO: 1097161 - protein, 6 aa, Mycobacterium
EGQSHG

SEQ ID NO: 1097162 - protein, 7 aa, Mycobacterium
EGRAEDV

SEQ ID NO: 1097163 - protein, 7 aa, Mycobacterium
EGREAWR

SEQ ID NO: 1097164 - protein, 12 aa, Mycobacterium
EGRNAGGDDDVR

SEQ ID NO: 1097165 - protein, 4 aa, Mycobacterium
EGRQ

SEQ ID NO: 1097166 - protein, 9 aa, Mycobacterium
EGRQDRRRA

SEQ ID NO: 1097167 - protein, 6 aa, Mycobacterium
EGRSDD

SEQ ID NO: 1097168 - protein, 11 aa, Mycobacterium
EGSATSNAADQ

SEQ ID NO: 1097169 - protein, 8 aa, Mycobacterium
EGSRVSSS

SEQ ID NO: 1097170 - protein, 12 aa, Mycobacterium
EGSTQRNATLGD

SEQ ID NO: 1097171 - protein, 10 aa, Mycobacterium
EGSTRTFAPG

SEQ ID NO: 1097172 - protein, 5 aa, Mycobacterium
EGTQR

SEQ ID NO: 1097173 - protein, 14 aa, Mycobacterium
EGTYERDGRPRATW

SEQ ID NO: 1097174 - protein, 7 aa, Mycobacterium
EGVGPEE

SEQ ID NO: 1097175 - protein, 14 aa, Mycobacterium
EGVPGQAQGAIQGA

SEQ ID NO: 1097176 - protein, 10 aa, Mycobacterium
EHAGDGPHTH

SEQ ID NO: 1097177 - protein, 8 aa, Mycobacterium
EHAQPGDR

SEQ ID NO: 1097178 - protein, 7 aa, Mycobacterium
EHATESE

SEQ ID NO: 1097179 - protein, 7 aa, Mycobacterium
EHDAPEV

SEQ ID NO: 1097180 - protein, 21 aa, Mycobacterium
EHEATEDACADPRFVTSEAER

SEQ ID NO: 1097181 - protein, 7 aa, Mycobacterium
EHPEATA

SEQ ID NO: 1097182 - protein, 8 aa, Mycobacterium
EHRPSAKA

SEQ ID NO: 1097183 - protein, 7 aa, Mycobacterium
EHSEPDD

SEQ ID NO: 1097184 - protein, 5 aa, Mycobacterium
EHTSG

SEQ ID NO: 1097185 - protein, 6 aa, Mycobacterium
EHTSPY

SEQ ID NO: 1097186 - protein, 4 aa, Mycobacterium
EIGA

SEQ ID NO: 1097187 - protein, 5 aa, Mycobacterium
EIPAA

SEQ ID NO: 1097188 - protein, 9 aa, Mycobacterium
EIPDGSEVR

SEQ ID NO: 1097189 - protein, 5 aa, Mycobacterium
EISGG

SEQ ID NO: 1097190 - protein, 5 aa, Mycobacterium
EISGR

SEQ ID NO: 1097191 - protein, 12 aa, Mycobacterium
EKEEEAKKVEAL

SEQ ID NO: 1097192 - protein, 12 aa, Mycobacterium
EKEQIELGGEER

SEQ ID NO: 1097193 - protein, 10 aa, Mycobacterium
EKGEAEPQVT

SEQ ID NO: 1097194 - protein, 6 aa, Mycobacterium
EKGRGR

SEQ ID NO: 1097195 - protein, 13 aa, Mycobacterium
EKHRERGADLPPL

SEQ ID NO: 1097196 - protein, 5 aa, Mycobacterium
EKKTY

SEQ ID NO: 1097197 - protein, 12 aa, Mycobacterium
EKQLRQSTDPSI

SEQ ID NO: 1097198 - protein, 6 aa, Mycobacterium
EKRWGP

SEQ ID NO: 1097199 - protein, 9 aa, Mycobacterium
EKSPSGVSS

SEQ ID NO: 1097200 - protein, 10 aa, Mycobacterium
EKTDTKPDLS

SEQ ID NO: 1097201 - protein, 8 aa, Mycobacterium
ELAASGRT

SEQ ID NO: 1097202 - protein, 5 aa, Mycobacterium
ELAPK

SEQ ID NO: 1097203 - protein, 7 aa, Mycobacterium
ELDRGKE

SEQ ID NO: 1097204 - protein, 7 aa, Mycobacterium
ELERGRQ

SEQ ID NO: 1097205 - protein, 19 aa, Mycobacterium
ELGKSPGAMPQDSDTPTEV

SEQ ID NO: 1097206 - protein, 8 aa, Mycobacterium
ELGTNGGG

SEQ ID NO: 1097207 - protein, 15 aa, Mycobacterium
ELHGGTASLETSPMG

SEQ ID NO: 1097208 - protein, 16 aa, Mycobacterium
ELHGGTATLESSPLGG

SEQ ID NO: 1097209 - protein, 8 aa, Mycobacterium
ELPAGSAP

SEQ ID NO: 1097210 - protein, 4 aa, Mycobacterium
ELPG

SEQ ID NO: 1097211 - protein, 5 aa, Mycobacterium
ELPGR

SEQ ID NO: 1097212 - protein, 7 aa, Mycobacterium
ELPGSPR

SEQ ID NO: 1097213 - protein, 22 aa, Mycobacterium
ELQASDELRQAAETLSKSPASL

SEQ ID NO: 1097214 - protein, 7 aa, Mycobacterium
ELRDPRH

SEQ ID NO: 1097215 - protein, 8 aa, Mycobacterium
ELSGTGEA

SEQ ID NO: 1097216 - protein, 6 aa, Mycobacterium
ELSPAD

SEQ ID NO: 1097217 - protein, 6 aa, Mycobacterium
ELSPEQ

SEQ ID NO: 1097218 - protein, 17 aa, Mycobacterium
ELTANTAETDTDSLNRS

SEQ ID NO: 1097219 - protein, 8 aa, Mycobacterium
EMKAPTGV

SEQ ID NO: 1097220 - protein, 8 aa, Mycobacterium
ENARARSL

SEQ ID NO: 1097221 - protein, 5 aa, Mycobacterium
ENDER

SEQ ID NO: 1097222 - protein, 8 aa, Mycobacterium
ENEQELAP

SEQ ID NO: 1097223 - protein, 10 aa, Mycobacterium
ENGKEVPRGE

SEQ ID NO: 1097224 - protein, 11 aa, Mycobacterium
ENGSDKTQEFK

SEQ ID NO: 1097225 - protein, 4 aa, Mycobacterium
ENIP

SEQ ID NO: 1097226 - protein, 5 aa, Mycobacterium
ENQPV

SEQ ID NO: 1097227 - protein, 6 aa, Mycobacterium
ENRPGL

SEQ ID NO: 1097228 - protein, 5 aa, Mycobacterium
ENTHG

SEQ ID NO: 1097229 - protein, 4 aa, Mycobacterium
ENTL

SEQ ID NO: 1097230 - protein, 8 aa, Mycobacterium
ENVETKLR

SEQ ID NO: 1097231 - protein, 27 aa, Mycobacterium
EPAHQEHATGHSIQADSAAHGGNVGEH

SEQ ID NO: 1097232 - protein, 6 aa, Mycobacterium
EPAPTT

SEQ ID NO: 1097233 - protein, 12 aa, Mycobacterium
EPDAGSDVGAGV

SEQ ID NO: 1097234 - protein, 15 aa, Mycobacterium
EPDPISSDPAVQKTN

SEQ ID NO: 1097235 - protein, 21 aa, Mycobacterium
EPDPSLDPSPQTAETEAAAQA

SEQ ID NO: 1097236 - protein, 7 aa, Mycobacterium
EPDRDRI

SEQ ID NO: 1097237 - protein, 5 aa, Mycobacterium
EPDSA

SEQ ID NO: 1097238 - protein, 6 aa, Mycobacterium
EPDSEP

SEQ ID NO: 1097239 - protein, 6 aa, Mycobacterium
EPFPER

SEQ ID NO: 1097240 - protein, 4 aa, Mycobacterium
EPGR

SEQ ID NO: 1097241 - protein, 10 aa, Mycobacterium
EPGSGTGERH

SEQ ID NO: 1097242 - protein, 8 aa, Mycobacterium
EPGYSSLS

SEQ ID NO: 1097243 - protein, 14 aa, Mycobacterium
EPHEPPYTGMPAAG

SEQ ID NO: 1097244 - protein, 13 aa, Mycobacterium
EPHTRNGSSSHHP

SEQ ID NO: 1097245 - protein, 21 aa, Mycobacterium
EPIEPPSAVSSPSRSTIHDES

SEQ ID NO: 1097246 - protein, 9 aa, Mycobacterium
EPKGSRRLG

SEQ ID NO: 1097247 - protein, 7 aa, Mycobacterium
EPPFVGD

SEQ ID NO: 1097248 - protein, 8 aa, Mycobacterium
EPPGYDRT

SEQ ID NO: 1097249 - protein, 21 aa, Mycobacterium
EPPHVGGARAEHGPAAEPDYD

SEQ ID NO: 1097250 - protein, 7 aa, Mycobacterium
EPQWGPP

SEQ ID NO: 1097251 - protein, 12 aa, Mycobacterium
EPRSPADPEDFP

SEQ ID NO: 1097252 - protein, 7 aa, Mycobacterium
EPTPAHR

SEQ ID NO: 1097253 - protein, 6 aa, Mycobacterium
EPTPRM

SEQ ID NO: 1097254 - protein, 12 aa, Mycobacterium
EPTTAGQLTPAD

SEQ ID NO: 1097255 - protein, 13 aa, Mycobacterium
EPTTGAVSDIQQA

SEQ ID NO: 1097256 - protein, 4 aa, Mycobacterium
EPYI

SEQ ID NO: 1097257 - protein, 12 aa, Mycobacterium
EQAGAEPTEVGP

SEQ ID NO: 1097258 - protein, 6 aa, Mycobacterium
EQANAR

SEQ ID NO: 1097259 - protein, 7 aa, Mycobacterium
EQARALP

SEQ ID NO: 1097260 - protein, 6 aa, Mycobacterium
EQATAE

SEQ ID NO: 1097261 - protein, 6 aa, Mycobacterium
EQDRTE

SEQ ID NO: 1097262 - protein, 13 aa, Mycobacterium
EQDRTKAALASAR

SEQ ID NO: 1097263 - protein, 20 aa, Mycobacterium
EQDTVEQDTVGAEDMSPDPL

SEQ ID NO: 1097264 - protein, 14 aa, Mycobacterium
EQEGRRSDAAGVGY

SEQ ID NO: 1097265 - protein, 7 aa, Mycobacterium
EQGLDRA

SEQ ID NO: 1097266 - protein, 5 aa, Mycobacterium
EQHQE

SEQ ID NO: 1097267 - protein, 10 aa, Mycobacterium
EQIDNAGNAA

SEQ ID NO: 1097268 - protein, 8 aa, Mycobacterium
EQNATRQH

SEQ ID NO: 1097269 - protein, 15 aa, Mycobacterium
EQPRETGPDFGKASP

SEQ ID NO: 1097270 - protein, 8 aa, Mycobacterium
EQRETVPD

SEQ ID NO: 1097271 - protein, 8 aa, Mycobacterium
EQRQPVPV

SEQ ID NO: 1097272 - protein, 12 aa, Mycobacterium
EQSRKGASQRLA

SEQ ID NO: 1097273 - protein, 13 aa, Mycobacterium
EQVRAARRRGTQD

SEQ ID NO: 1097274 - protein, 11 aa, Mycobacterium
EQWPAPSTHAR

SEQ ID NO: 1097275 - protein, 6 aa, Mycobacterium
EQYSQL

SEQ ID NO: 1097276 - protein, 13 aa, Mycobacterium
ERADPQERSHWSA

SEQ ID NO: 1097277 - protein, 9 aa, Mycobacterium
ERAGEAQVQ

SEQ ID NO: 1097278 - protein, 10 aa, Mycobacterium
ERATSRRAAT

SEQ ID NO: 1097279 - protein, 4 aa, Mycobacterium
ERDA

SEQ ID NO: 1097280 - protein, 10 aa, Mycobacterium
ERDEDDPERL

SEQ ID NO: 1097281 - protein, 13 aa, Mycobacterium
EREARQAAEQQQG

SEQ ID NO: 1097282 - protein, 5 aa, Mycobacterium
EREEM

SEQ ID NO: 1097283 - protein, 11 aa, Mycobacterium
EREGAGGTASL

SEQ ID NO: 1097284 - protein, 9 aa, Mycobacterium
ERFGPGDYR

SEQ ID NO: 1097285 - protein, 7 aa, Mycobacterium
ERFSATP

SEQ ID NO: 1097286 - protein, 7 aa, Mycobacterium
ERGYSAM

SEQ ID NO: 1097287 - protein, 4 aa, Mycobacterium
ERLS

SEQ ID NO: 1097288 - protein, 4 aa, Mycobacterium
ERNA

SEQ ID NO: 1097289 - protein, 10 aa, Mycobacterium
ERNDETSEVE

SEQ ID NO: 1097290 - protein, 5 aa, Mycobacterium
ERNPR

SEQ ID NO: 1097291 - protein, 5 aa, Mycobacterium
ERPHH

SEQ ID NO: 1097292 - protein, 9 aa, Mycobacterium
ERPSGGQGG

SEQ ID NO: 1097293 - protein, 12 aa, Mycobacterium
ERQRNSSAEQGA

SEQ ID NO: 1097294 - protein, 4 aa, Mycobacterium
ERQV

SEQ ID NO: 1097295 - protein, 5 aa, Mycobacterium
ERRGA

SEQ ID NO: 1097296 - protein, 20 aa, Mycobacterium
ERSRRGTDTPSGGRHSRRDG

SEQ ID NO: 1097297 - protein, 66 aa, Mycobacterium
ERSRTPAAKTAGATGTADHAPDDEFDADYPDEPGDYEADDTQAAAERNPDVDNHTGTDSDADTRAV

SEQ ID NO: 1097298 - protein, 9 aa, Mycobacterium
ERTGARPAD

SEQ ID NO: 1097299 - protein, 9 aa, Mycobacterium
ERTPTRADQ

SEQ ID NO: 1097300 - protein, 5 aa, Mycobacterium
ERTRA

SEQ ID NO: 1097301 - protein, 18 aa, Mycobacterium
ERTSAQVDQETGASTRIP

SEQ ID NO: 1097302 - protein, 8 aa, Mycobacterium
ERVEANTS

SEQ ID NO: 1097303 - protein, 11 aa, Mycobacterium
ERVTGAPASVA

SEQ ID NO: 1097304 - protein, 9 aa, Mycobacterium
ESAADDRPA

SEQ ID NO: 1097305 - protein, 9 aa, Mycobacterium
ESAAGTASG

SEQ ID NO: 1097306 - protein, 9 aa, Mycobacterium
ESAATDTRL

SEQ ID NO: 1097307 - protein, 9 aa, Mycobacterium
ESADALGRE

SEQ ID NO: 1097308 - protein, 10 aa, Mycobacterium
ESAGGSTFQQ

SEQ ID NO: 1097309 - protein, 6 aa, Mycobacterium
ESAHTY

SEQ ID NO: 1097310 - protein, 24 aa, Mycobacterium
ESALTGESAPVTKAEARLPEATPV

SEQ ID NO: 1097311 - protein, 4 aa, Mycobacterium
ESAT

SEQ ID NO: 1097312 - protein, 24 aa, Mycobacterium
ESEGSGTLDRDQPIPTSRTSSPFS

SEQ ID NO: 1097313 - protein, 5 aa, Mycobacterium
ESERP

SEQ ID NO: 1097314 - protein, 6 aa, Mycobacterium
ESETAR

SEQ ID NO: 1097315 - protein, 5 aa, Mycobacterium
ESFDP

SEQ ID NO: 1097316 - protein, 43 aa, Mycobacterium
ESFDPEHPEPDQAVDDGTVDLGGDPGAGPRSVAENGNPPRESG

SEQ ID NO: 1097317 - protein, 6 aa, Mycobacterium
ESGGRV

SEQ ID NO: 1097318 - protein, 6 aa, Mycobacterium
ESGTPI

SEQ ID NO: 1097319 - protein, 10 aa, Mycobacterium
ESITSKDHPL

SEQ ID NO: 1097320 - protein, 12 aa, Mycobacterium
ESLGGPADSDLG

SEQ ID NO: 1097321 - protein, 11 aa, Mycobacterium
ESLPPLPRATT

SEQ ID NO: 1097322 - protein, 11 aa, Mycobacterium
ESMSGHPAESV

SEQ ID NO: 1097323 - protein, 7 aa, Mycobacterium
ESPDFDD

SEQ ID NO: 1097324 - protein, 4 aa, Mycobacterium
ESPE

SEQ ID NO: 1097325 - protein, 5 aa, Mycobacterium
ESPEF

SEQ ID NO: 1097326 - protein, 6 aa, Mycobacterium
ESPEFD

SEQ ID NO: 1097327 - protein, 6 aa, Mycobacterium
ESPSAG

SEQ ID NO: 1097328 - protein, 6 aa, Mycobacterium
ESPSVG

SEQ ID NO: 1097329 - protein, 12 aa, Mycobacterium
ESQSVGADVGGR

SEQ ID NO: 1097330 - protein, 12 aa, Mycobacterium
ESRKTPPPGGYG

SEQ ID NO: 1097331 - protein, 26 aa, Mycobacterium
ESRSRGGSRSTSVAGYEPASASPTVE

SEQ ID NO: 1097332 - protein, 7 aa, Mycobacterium
ESRTSTL

SEQ ID NO: 1097333 - protein, 6 aa, Mycobacterium
ESSPAH

SEQ ID NO: 1097334 - protein, 30 aa, Mycobacterium
ESVEVTGSGYAPDGSLLTPEGAVASPDGNA

SEQ ID NO: 1097335 - protein, 29 aa, Mycobacterium
ESVGGPEGDLGFPTSSEADGGLGSNSRIS

SEQ ID NO: 1097336 - protein, 13 aa, Mycobacterium
ESVPVEKGPGDDV

SEQ ID NO: 1097337 - protein, 13 aa, Mycobacterium
ESVSGKRPFTGDG

SEQ ID NO: 1097338 - protein, 24 aa, Mycobacterium
ETAQQTEAETDRAPVERRTPVETT

SEQ ID NO: 1097339 - protein, 12 aa, Mycobacterium
ETDGSGEPRMTY

SEQ ID NO: 1097340 - protein, 15 aa, Mycobacterium
ETDRVASSPLREAAT

SEQ ID NO: 1097341 - protein, 21 aa, Mycobacterium
ETERTTASASALAAQENERQR

SEQ ID NO: 1097342 - protein, 7 aa, Mycobacterium
ETGDTSV

SEQ ID NO: 1097343 - protein, 10 aa, Mycobacterium
ETGRRVQGSA

SEQ ID NO: 1097344 - protein, 6 aa, Mycobacterium
ETGTTV

SEQ ID NO: 1097345 - protein, 5 aa, Mycobacterium
ETHKE

SEQ ID NO: 1097346 - protein, 11 aa, Mycobacterium
ETLSNDEASEL

SEQ ID NO: 1097347 - protein, 7 aa, Mycobacterium
ETPGQSW

SEQ ID NO: 1097348 - protein, 4 aa, Mycobacterium
ETPQ

SEQ ID NO: 1097349 - protein, 6 aa, Mycobacterium
ETPWGP

SEQ ID NO: 1097350 - protein, 15 aa, Mycobacterium
ETRDPAATVPPDAPP

SEQ ID NO: 1097351 - protein, 21 aa, Mycobacterium
ETRGADLTDAGRLPRGAAAAD

SEQ ID NO: 1097352 - protein, 24 aa, Mycobacterium
ETRPRSSTEHTQARPLGPEAGGEV

SEQ ID NO: 1097353 - protein, 7 aa, Mycobacterium
ETSDPAL

SEQ ID NO: 1097354 - protein, 10 aa, Mycobacterium
ETSIEESGAE

SEQ ID NO: 1097355 - protein, 10 aa, Mycobacterium
ETSPPSIRGR

SEQ ID NO: 1097356 - protein, 9 aa, Mycobacterium
ETSPRSGRI

SEQ ID NO: 1097357 - protein, 5 aa, Mycobacterium
ETTSE

SEQ ID NO: 1097358 - protein, 9 aa, Mycobacterium
ETTSNTASA

SEQ ID NO: 1097359 - protein, 4 aa, Mycobacterium
ETTT

SEQ ID NO: 1097360 - protein, 7 aa, Mycobacterium
ETVEGRG

SEQ ID NO: 1097361 - protein, 5 aa, Mycobacterium
ETVGA

SEQ ID NO: 1097362 - protein, 8 aa, Mycobacterium
ETWQDGTA

SEQ ID NO: 1097363 - protein, 9 aa, Mycobacterium
ETWSDGDRA

SEQ ID NO: 1097364 - protein, 5 aa, Mycobacterium
ETYGQ

SEQ ID NO: 1097365 - protein, 9 aa, Mycobacterium
EVAGTPPVG

SEQ ID NO: 1097366 - protein, 8 aa, Mycobacterium
EVAPPPAP

SEQ ID NO: 1097367 - protein, 17 aa, Mycobacterium
EVDGQLDGDEPEPPPLR

SEQ ID NO: 1097368 - protein, 4 aa, Mycobacterium
EVDP

SEQ ID NO: 1097369 - protein, 7 aa, Mycobacterium
EVEETAA

SEQ ID NO: 1097370 - protein, 10 aa, Mycobacterium
EVERAKATSY

SEQ ID NO: 1097371 - protein, 9 aa, Mycobacterium
EVKGANPAF

SEQ ID NO: 1097372 - protein, 6 aa, Mycobacterium
EVPSGA

SEQ ID NO: 1097373 - protein, 13 aa, Mycobacterium
EVRGGSDDSRSDR

SEQ ID NO: 1097374 - protein, 5 aa, Mycobacterium
EVTER

SEQ ID NO: 1097375 - protein, 13 aa, Mycobacterium
EVTPKEAGGSPRH

SEQ ID NO: 1097376 - protein, 10 aa, Mycobacterium
EYGPETAKTR

SEQ ID NO: 1097377 - protein, 7 aa, Mycobacterium
EYPEQAD

SEQ ID NO: 1097378 - protein, 7 aa, Mycobacterium
EYPQVGG

SEQ ID NO: 1097379 - protein, 7 aa, Mycobacterium
EYSTDPE

SEQ ID NO: 1097380 - protein, 8 aa, Mycobacterium
FADKPWPN

SEQ ID NO: 1097381 - protein, 16 aa, Mycobacterium
FAKPETPADASPALAN

SEQ ID NO: 1097382 - protein, 5 aa, Mycobacterium
FANPT

SEQ ID NO: 1097383 - protein, 17 aa, Mycobacterium
FARQGRTPESVGTLPTH

SEQ ID NO: 1097384 - protein, 23 aa, Mycobacterium
FASPDRRRDQGEYTPTNQPPGPL

SEQ ID NO: 1097385 - protein, 10 aa, Mycobacterium
FDETRPGRAL

SEQ ID NO: 1097386 - protein, 8 aa, Mycobacterium
FDGRAPDL

SEQ ID NO: 1097387 - protein, 7 aa, Mycobacterium
FDPGGEQ

SEQ ID NO: 1097388 - protein, 5 aa, Mycobacterium
FDPNS

SEQ ID NO: 1097389 - protein, 7 aa, Mycobacterium
FEETDGD

SEQ ID NO: 1097390 - protein, 30 aa, Mycobacterium
FEPEATAVEEPTAESSTADEPAAAPAVATR

SEQ ID NO: 1097391 - protein, 6 aa, Mycobacterium
FGAGPL

SEQ ID NO: 1097392 - protein, 7 aa, Mycobacterium
FGETDAG

SEQ ID NO: 1097393 - protein, 5 aa, Mycobacterium
FGGAI

SEQ ID NO: 1097394 - protein, 5 aa, Mycobacterium
FGGDT

SEQ ID NO: 1097395 - protein, 5 aa, Mycobacterium
FGGGN

SEQ ID NO: 1097396 - protein, 8 aa, Mycobacterium
FGKPNGYL

SEQ ID NO: 1097397 - protein, 12 aa, Mycobacterium
FGNTGGDVLERG

SEQ ID NO: 1097398 - protein, 6 aa, Mycobacterium
FGPTQH

SEQ ID NO: 1097399 - protein, 10 aa, Mycobacterium
FGQPGHDGPV

SEQ ID NO: 1097400 - protein, 7 aa, Mycobacterium
FGRPGEG

SEQ ID NO: 1097401 - protein, 9 aa, Mycobacterium
FGSSGGPFA

SEQ ID NO: 1097402 - protein, 24 aa, Mycobacterium
FGTGPLPDLPAEGIREDSDTVEAV

SEQ ID NO: 1097403 - protein, 11 aa, Mycobacterium
FGTPGGPAAAG

SEQ ID NO: 1097404 - protein, 8 aa, Mycobacterium
FNGSGPEL

SEQ ID NO: 1097405 - protein, 8 aa, Mycobacterium
FPDQGASP

SEQ ID NO: 1097406 - protein, 8 aa, Mycobacterium
FPEQTAPP

SEQ ID NO: 1097407 - protein, 13 aa, Mycobacterium
FPGALPPEPEQDT

SEQ ID NO: 1097408 - protein, 4 aa, Mycobacterium
FPSA

SEQ ID NO: 1097409 - protein, 13 aa, Mycobacterium
FPSGRTGSPSDVR

SEQ ID NO: 1097410 - protein, 7 aa, Mycobacterium
FPTTDSS

SEQ ID NO: 1097411 - protein, 12 aa, Mycobacterium
FQGSGNTLGDLG

SEQ ID NO: 1097412 - protein, 7 aa, Mycobacterium
FQQSESD

SEQ ID NO: 1097413 - protein, 7 aa, Mycobacterium
FRPEGAT

SEQ ID NO: 1097414 - protein, 11 aa, Mycobacterium
FRPQDRPAELT

SEQ ID NO: 1097415 - protein, 5 aa, Mycobacterium
FRRPT

SEQ ID NO: 1097416 - protein, 11 aa, Mycobacterium
FRTQPQAEEDE

SEQ ID NO: 1097417 - protein, 7 aa, Mycobacterium
FSADDEY

SEQ ID NO: 1097418 - protein, 6 aa, Mycobacterium
FSGGSE

SEQ ID NO: 1097419 - protein, 9 aa, Mycobacterium
FSSTKTPVT

SEQ ID NO: 1097420 - protein, 19 aa, Mycobacterium
FSTSNDDASRFDPETVRSD

SEQ ID NO: 1097421 - protein, 5 aa, Mycobacterium
FTADS

SEQ ID NO: 1097422 - protein, 8 aa, Mycobacterium
FTAGGGLY

SEQ ID NO: 1097423 - protein, 14 aa, Mycobacterium
FTANTADTDTATLN

SEQ ID NO: 1097424 - protein, 11 aa, Mycobacterium
FTGSDASPTLA

SEQ ID NO: 1097425 - protein, 6 aa, Mycobacterium
FTGTGT

SEQ ID NO: 1097426 - protein, 7 aa, Mycobacterium
FTPAQAT

SEQ ID NO: 1097427 - protein, 12 aa, Mycobacterium
FTPQASAVPGSV

SEQ ID NO: 1097428 - protein, 4 aa, Mycobacterium
FTPR

SEQ ID NO: 1097429 - protein, 7 aa, Mycobacterium
FTTQPTA

SEQ ID NO: 1097430 - protein, 23 aa, Mycobacterium
FTTREGVSQPTQPERSGSPASFA

SEQ ID NO: 1097431 - protein, 5 aa, Mycobacterium
FYSNP

SEQ ID NO: 1097432 - protein, 5 aa, Mycobacterium
GAAAA

SEQ ID NO: 1097433 - protein, 9 aa, Mycobacterium
GAAAAGAAS

SEQ ID NO: 1097434 - protein, 7 aa, Mycobacterium
GAAANGL

SEQ ID NO: 1097435 - protein, 13 aa, Mycobacterium
GAAAPAAGDGDTP

SEQ ID NO: 1097436 - protein, 9 aa, Mycobacterium
GAADGAPPL

SEQ ID NO: 1097437 - protein, 13 aa, Mycobacterium
GAAGYDGATPVKD

SEQ ID NO: 1097438 - protein, 4 aa, Mycobacterium
GAAH

SEQ ID NO: 1097439 - protein, 7 aa, Mycobacterium
GAANGTP

SEQ ID NO: 1097440 - protein, 7 aa, Mycobacterium
GAAPASL

SEQ ID NO: 1097441 - protein, 16 aa, Mycobacterium
GAARGGGRGTPVPVEV

SEQ ID NO: 1097442 - protein, 9 aa, Mycobacterium
GAARTSTSE

SEQ ID NO: 1097443 - protein, 6 aa, Mycobacterium
GAASAA

SEQ ID NO: 1097444 - protein, 6 aa, Mycobacterium
GAASGL

SEQ ID NO: 1097445 - protein, 7 aa, Mycobacterium
GAASGTA

SEQ ID NO: 1097446 - protein, 15 aa, Mycobacterium
GAASRRREARHAARE

SEQ ID NO: 1097447 - protein, 11 aa, Mycobacterium
GAATAKANPGQ

SEQ ID NO: 1097448 - protein, 7 aa, Mycobacterium
GAATPVL

SEQ ID NO: 1097449 - protein, 5 aa, Mycobacterium
GAATS

SEQ ID NO: 1097450 - protein, 6 aa, Mycobacterium
GAATTV

SEQ ID NO: 1097451 - protein, 14 aa, Mycobacterium
GAAVGGASSASSNT

SEQ ID NO: 1097452 - protein, 7 aa, Mycobacterium
GADDPAV

SEQ ID NO: 1097453 - protein, 7 aa, Mycobacterium
GADEERH

SEQ ID NO: 1097454 - protein, 5 aa, Mycobacterium
GADGG

SEQ ID NO: 1097455 - protein, 8 aa, Mycobacterium
GADRLDEQ

SEQ ID NO: 1097456 - protein, 5 aa, Mycobacterium
GADTS

SEQ ID NO: 1097457 - protein, 8 aa, Mycobacterium
GAEIGDPW

SEQ ID NO: 1097458 - protein, 5 aa, Mycobacterium
GAENR

SEQ ID NO: 1097459 - protein, 6 aa, Mycobacterium
GAEPAV

SEQ ID NO: 1097460 - protein, 9 aa, Mycobacterium
GAEPDEGSV

SEQ ID NO: 1097461 - protein, 6 aa, Mycobacterium
GAESGD

SEQ ID NO: 1097462 - protein, 6 aa, Mycobacterium
GAETEI

SEQ ID NO: 1097463 - protein, 5 aa, Mycobacterium
GAFEN

SEQ ID NO: 1097464 - protein, 6 aa, Mycobacterium
GAGATS

SEQ ID NO: 1097465 - protein, 4 aa, Mycobacterium
GAGG

SEQ ID NO: 1097466 - protein, 6 aa, Mycobacterium
GAGLGG

SEQ ID NO: 1097467 - protein, 8 aa, Mycobacterium
GAGPGDPL

SEQ ID NO: 1097468 - protein, 15 aa, Mycobacterium
GAGPHAGDKSIEQPV

SEQ ID NO: 1097469 - protein, 11 aa, Mycobacterium
GAGRPDRDQLP

SEQ ID NO: 1097470 - protein, 4 aa, Mycobacterium
GAGS

SEQ ID NO: 1097471 - protein, 10 aa, Mycobacterium
GAGSRPRDRL

SEQ ID NO: 1097472 - protein, 8 aa, Mycobacterium
GAGTTAQL

SEQ ID NO: 1097473 - protein, 6 aa, Mycobacterium
GAIASG

SEQ ID NO: 1097474 - protein, 8 aa, Mycobacterium
GAKERQIS

SEQ ID NO: 1097475 - protein, 8 aa, Mycobacterium
GALDAPGT

SEQ ID NO: 1097476 - protein, 17 aa, Mycobacterium
GALGGKTGFTDDAGQTF

SEQ ID NO: 1097477 - protein, 5 aa, Mycobacterium
GALPA

SEQ ID NO: 1097478 - protein, 5 aa, Mycobacterium
GALPS

SEQ ID NO: 1097479 - protein, 6 aa, Mycobacterium
GAMTAG

SEQ ID NO: 1097480 - protein, 8 aa, Mycobacterium
GANGSGKT

SEQ ID NO: 1097481 - protein, 8 aa, Mycobacterium
GANNTGSV

SEQ ID NO: 1097482 - protein, 8 aa, Mycobacterium
GANVTPAE

SEQ ID NO: 1097483 - protein, 4 aa, Mycobacterium
GANY

SEQ ID NO: 1097484 - protein, 9 aa, Mycobacterium
GAPAGTATA

SEQ ID NO: 1097485 - protein, 5 aa, Mycobacterium
GAPAI

SEQ ID NO: 1097486 - protein, 7 aa, Mycobacterium
GAPDGPA

SEQ ID NO: 1097487 - protein, 7 aa, Mycobacterium
GAPDTLG

SEQ ID NO: 1097488 - protein, 6 aa, Mycobacterium
GAPHQS

SEQ ID NO: 1097489 - protein, 7 aa, Mycobacterium
GAPINGL

SEQ ID NO: 1097490 - protein, 7 aa, Mycobacterium
GAPLPKR

SEQ ID NO: 1097491 - protein, 4 aa, Mycobacterium
GAPM

SEQ ID NO: 1097492 - protein, 6 aa, Mycobacterium
GAPNLP

SEQ ID NO: 1097493 - protein, 14 aa, Mycobacterium
GAPPDITVVSLSPN

SEQ ID NO: 1097494 - protein, 4 aa, Mycobacterium
GAPQ

SEQ ID NO: 1097495 - protein, 61 aa, Mycobacterium
GAPVPPRPRPPHDPTHPGVEGRVGPTRIPPGPPRLNGPSVAGTSRIPTNRPAPGHEPPTTR

SEQ ID NO: 1097496 - protein, 7 aa, Mycobacterium
GAPVTPE

SEQ ID NO: 1097497 - protein, 14 aa, Mycobacterium
GAQAQASESGSALN

SEQ ID NO: 1097498 - protein, 5 aa, Mycobacterium
GAQTA

SEQ ID NO: 1097499 - protein, 13 aa, Mycobacterium
GARCNQPVHPGRN

SEQ ID NO: 1097500 - protein, 4 aa, Mycobacterium
GARD

SEQ ID NO: 1097501 - protein, 19 aa, Mycobacterium
GARDAGAECDRIPDATPGV

SEQ ID NO: 1097502 - protein, 7 aa, Mycobacterium
GARDRPD

SEQ ID NO: 1097503 - protein, 5 aa, Mycobacterium
GARPF

SEQ ID NO: 1097504 - protein, 4 aa, Mycobacterium
GART

SEQ ID NO: 1097505 - protein, 6 aa, Mycobacterium
GARWDE

SEQ ID NO: 1097506 - protein, 5 aa, Mycobacterium
GARYQ

SEQ ID NO: 1097507 - protein, 4 aa, Mycobacterium
GASG

SEQ ID NO: 1097508 - protein, 11 aa, Mycobacterium
GASGAKLTEMP

SEQ ID NO: 1097509 - protein, 23 aa, Mycobacterium
GASGDADQTTRLPRQTPGRHRDE

SEQ ID NO: 1097510 - protein, 12 aa, Mycobacterium
GASGSALTSQAS

SEQ ID NO: 1097511 - protein, 8 aa, Mycobacterium
GASGTSAD

SEQ ID NO: 1097512 - protein, 9 aa, Mycobacterium
GASLQTRRV

SEQ ID NO: 1097513 - protein, 6 aa, Mycobacterium
GASPAW

SEQ ID NO: 1097514 - protein, 6 aa, Mycobacterium
GATGDE

SEQ ID NO: 1097515 - protein, 9 aa, Mycobacterium
GATGSGKSS

SEQ ID NO: 1097516 - protein, 10 aa, Mycobacterium
GATPTTPRPI

SEQ ID NO: 1097517 - protein, 5 aa, Mycobacterium
GATRG

SEQ ID NO: 1097518 - protein, 4 aa, Mycobacterium
GATT

SEQ ID NO: 1097519 - protein, 8 aa, Mycobacterium
GAVGEDAG

SEQ ID NO: 1097520 - protein, 6 aa, Mycobacterium
GAVPAE

SEQ ID NO: 1097521 - protein, 4 aa, Mycobacterium
GAVR

SEQ ID NO: 1097522 - protein, 10 aa, Mycobacterium
GAVRDPDTGA

SEQ ID NO: 1097523 - protein, 6 aa, Mycobacterium
GAVSPN

SEQ ID NO: 1097524 - protein, 10 aa, Mycobacterium
GAWEGPSAEQ

SEQ ID NO: 1097525 - protein, 6 aa, Mycobacterium
GDAAPD

SEQ ID NO: 1097526 - protein, 9 aa, Mycobacterium
GDAPAAESR

SEQ ID NO: 1097527 - protein, 7 aa, Mycobacterium
GDAPVSD

SEQ ID NO: 1097528 - protein, 10 aa, Mycobacterium
GDDEFTSGKT

SEQ ID NO: 1097529 - protein, 9 aa, Mycobacterium
GDDERGRRD

SEQ ID NO: 1097530 - protein, 6 aa, Mycobacterium
GDDEST

SEQ ID NO: 1097531 - protein, 12 aa, Mycobacterium
GDDGVSAPGADV

SEQ ID NO: 1097532 - protein, 9 aa, Mycobacterium
GDDPDRGTW

SEQ ID NO: 1097533 - protein, 10 aa, Mycobacterium
GDDPGRTADE

SEQ ID NO: 1097534 - protein, 7 aa, Mycobacterium
GDDRAGT

SEQ ID NO: 1097535 - protein, 4 aa, Mycobacterium
GDEA

SEQ ID NO: 1097536 - protein, 9 aa, Mycobacterium
GDEEVRKQS

SEQ ID NO: 1097537 - protein, 6 aa, Mycobacterium
GDEFTG

SEQ ID NO: 1097538 - protein, 15 aa, Mycobacterium
GDEPRDDQDGPARPG

SEQ ID NO: 1097539 - protein, 8 aa, Mycobacterium
GDEPTPEQ

SEQ ID NO: 1097540 - protein, 4 aa, Mycobacterium
GDER

SEQ ID NO: 1097541 - protein, 17 aa, Mycobacterium
GDFGTTITGQPVSDELG

SEQ ID NO: 1097542 - protein, 8 aa, Mycobacterium
GDGAGGPR

SEQ ID NO: 1097543 - protein, 7 aa, Mycobacterium
GDGDTRG

SEQ ID NO: 1097544 - protein, 5 aa, Mycobacterium
GDGLA

SEQ ID NO: 1097545 - protein, 17 aa, Mycobacterium
GDGPRAATAAGPVSQVP

SEQ ID NO: 1097546 - protein, 7 aa, Mycobacterium
GDGTPLR

SEQ ID NO: 1097547 - protein, 11 aa, Mycobacterium
GDGVNDAPALR

SEQ ID NO: 1097548 - protein, 6 aa, Mycobacterium
GDGYNG

SEQ ID NO: 1097549 - protein, 8 aa, Mycobacterium
GDKTAPRT

SEQ ID NO: 1097550 - protein, 4 aa, Mycobacterium
GDLT

SEQ ID NO: 1097551 - protein, 4 aa, Mycobacterium
GDNA

SEQ ID NO: 1097552 - protein, 9 aa, Mycobacterium
GDNEATAKR

SEQ ID NO: 1097553 - protein, 9 aa, Mycobacterium
GDNRRAAQA

SEQ ID NO: 1097554 - protein, 4 aa, Mycobacterium
GDPA

SEQ ID NO: 1097555 - protein, 8 aa, Mycobacterium
GDPEAGTI

SEQ ID NO: 1097556 - protein, 4 aa, Mycobacterium
GDPL

SEQ ID NO: 1097557 - protein, 5 aa, Mycobacterium
GDPLS

SEQ ID NO: 1097558 - protein, 5 aa, Mycobacterium
GDPLT

SEQ ID NO: 1097559 - protein, 8 aa, Mycobacterium
GDPLTPEG

SEQ ID NO: 1097560 - protein, 13 aa, Mycobacterium
GDPPKLRSTANDR

SEQ ID NO: 1097561 - protein, 10 aa, Mycobacterium
GDPSLPEINQ

SEQ ID NO: 1097562 - protein, 13 aa, Mycobacterium
GDPTGEGTGGPGY

SEQ ID NO: 1097563 - protein, 14 aa, Mycobacterium
GDPTGTGAGGPGYR

SEQ ID NO: 1097564 - protein, 6 aa, Mycobacterium
GDPTLT

SEQ ID NO: 1097565 - protein, 12 aa, Mycobacterium
GDPVGDPKAWPQ

SEQ ID NO: 1097566 - protein, 9 aa, Mycobacterium
GDPVGPGTL

SEQ ID NO: 1097567 - protein, 8 aa, Mycobacterium
GDPYDGAA

SEQ ID NO: 1097568 - protein, 8 aa, Mycobacterium
GDQAPRTT

SEQ ID NO: 1097569 - protein, 10 aa, Mycobacterium
GDQDTTSGVG

SEQ ID NO: 1097570 - protein, 7 aa, Mycobacterium
GDQPADR

SEQ ID NO: 1097571 - protein, 7 aa, Mycobacterium
GDQVSGV

SEQ ID NO: 1097572 - protein, 18 aa, Mycobacterium
GDQYDAGRKVPPSQAKRG

SEQ ID NO: 1097573 - protein, 7 aa, Mycobacterium
GDRATAT

SEQ ID NO: 1097574 - protein, 7 aa, Mycobacterium
GDRHDLA

SEQ ID NO: 1097575 - protein, 4 aa, Mycobacterium
GDRT

SEQ ID NO: 1097576 - protein, 6 aa, Mycobacterium
GDSNRL

SEQ ID NO: 1097577 - protein, 5 aa, Mycobacterium
GDTDA

SEQ ID NO: 1097578 - protein, 12 aa, Mycobacterium
GDTGLDSGRPQN

SEQ ID NO: 1097579 - protein, 5 aa, Mycobacterium
GDTIG

SEQ ID NO: 1097580 - protein, 7 aa, Mycobacterium
GDTTTSK

SEQ ID NO: 1097581 - protein, 6 aa, Mycobacterium
GDVAED

SEQ ID NO: 1097582 - protein, 7 aa, Mycobacterium
GDVDVKG

SEQ ID NO: 1097583 - protein, 19 aa, Mycobacterium
GDVTSGPTEQLFPGVPNQP

SEQ ID NO: 1097584 - protein, 8 aa, Mycobacterium
GEAAERAR

SEQ ID NO: 1097585 - protein, 5 aa, Mycobacterium
GEDGR

SEQ ID NO: 1097586 - protein, 4 aa, Mycobacterium
GEDP

SEQ ID NO: 1097587 - protein, 8 aa, Mycobacterium
GEDPAPLQ

SEQ ID NO: 1097588 - protein, 4 aa, Mycobacterium
GEEK

SEQ ID NO: 1097589 - protein, 15 aa, Mycobacterium
GEEQQRTKAALESAR

SEQ ID NO: 1097590 - protein, 22 aa, Mycobacterium
GEETPVDDRRGRRYRDDGDAAP

SEQ ID NO: 1097591 - protein, 13 aa, Mycobacterium
GEEWPQPKPEPAF

SEQ ID NO: 1097592 - protein, 7 aa, Mycobacterium
GEFDPGA

SEQ ID NO: 1097593 - protein, 18 aa, Mycobacterium
GEFDSPSVPAGTNPDEAN

SEQ ID NO: 1097594 - protein, 5 aa, Mycobacterium
GEFPA

SEQ ID NO: 1097595 - protein, 8 aa, Mycobacterium
GEFTGVAP

SEQ ID NO: 1097596 - protein, 11 aa, Mycobacterium
GEGGLAPVPAA

SEQ ID NO: 1097597 - protein, 17 aa, Mycobacterium
GEGGRVSGRHEGYDPAI

SEQ ID NO: 1097598 - protein, 9 aa, Mycobacterium
GEGTPETRR

SEQ ID NO: 1097599 - protein, 5 aa, Mycobacterium
GEIGH

SEQ ID NO: 1097600 - protein, 9 aa, Mycobacterium
GEKARGREW

SEQ ID NO: 1097601 - protein, 8 aa, Mycobacterium
GEKGRRGL

SEQ ID NO: 1097602 - protein, 7 aa, Mycobacterium
GEKIATD

SEQ ID NO: 1097603 - protein, 16 aa, Mycobacterium
GELGGPLPPSVTQDTT

SEQ ID NO: 1097604 - protein, 13 aa, Mycobacterium
GELTGRGLGGTAN

SEQ ID NO: 1097605 - protein, 8 aa, Mycobacterium
GELTTAED

SEQ ID NO: 1097606 - protein, 11 aa, Mycobacterium
GENGTPREYDY

SEQ ID NO: 1097607 - protein, 4 aa, Mycobacterium
GEPG

SEQ ID NO: 1097608 - protein, 10 aa, Mycobacterium
GEPLPTEHGY

SEQ ID NO: 1097609 - protein, 13 aa, Mycobacterium
GEPTEDGEGKANL

SEQ ID NO: 1097610 - protein, 6 aa, Mycobacterium
GEPVRS

SEQ ID NO: 1097611 - protein, 8 aa, Mycobacterium
GEPVSDQV

SEQ ID NO: 1097612 - protein, 5 aa, Mycobacterium
GEPYT

SEQ ID NO: 1097613 - protein, 6 aa, Mycobacterium
GEQPVY

SEQ ID NO: 1097614 - protein, 7 aa, Mycobacterium
GEQYQAD

SEQ ID NO: 1097615 - protein, 8 aa, Mycobacterium
GERADEAV

SEQ ID NO: 1097616 - protein, 5 aa, Mycobacterium
GERAE

SEQ ID NO: 1097617 - protein, 6 aa, Mycobacterium
GERDTT

SEQ ID NO: 1097618 - protein, 6 aa, Mycobacterium
GERVAT

SEQ ID NO: 1097619 - protein, 6 aa, Mycobacterium
GESADT

SEQ ID NO: 1097620 - protein, 8 aa, Mycobacterium
GESETGAV

SEQ ID NO: 1097621 - protein, 6 aa, Mycobacterium
GESGVG

SEQ ID NO: 1097622 - protein, 5 aa, Mycobacterium
GESSV

SEQ ID NO: 1097623 - protein, 11 aa, Mycobacterium
GETDMDGEGRT

SEQ ID NO: 1097624 - protein, 9 aa, Mycobacterium
GETNRAPFD

SEQ ID NO: 1097625 - protein, 5 aa, Mycobacterium
GEVPA

SEQ ID NO: 1097626 - protein, 5 aa, Mycobacterium
GEVSA

SEQ ID NO: 1097627 - protein, 13 aa, Mycobacterium
GEVTSTNGDQVST

SEQ ID NO: 1097628 - protein, 4 aa, Mycobacterium
GFAA

SEQ ID NO: 1097629 - protein, 7 aa, Mycobacterium
GFAGPQT

SEQ ID NO: 1097630 - protein, 10 aa, Mycobacterium
GFAPVDETTR

SEQ ID NO: 1097631 - protein, 4 aa, Mycobacterium
GFAQ

SEQ ID NO: 1097632 - protein, 8 aa, Mycobacterium
GFGPTSEG

SEQ ID NO: 1097633 - protein, 15 aa, Mycobacterium
GFRTQGGTPPPSDVT

SEQ ID NO: 1097634 - protein, 12 aa, Mycobacterium
GFSEVSAGRPAA

SEQ ID NO: 1097635 - protein, 8 aa, Mycobacterium
GFTTTQKR

SEQ ID NO: 1097636 - protein, 8 aa, Mycobacterium
GGAAPEID

SEQ ID NO: 1097637 - protein, 8 aa, Mycobacterium
GGAERDGR

SEQ ID NO: 1097638 - protein, 8 aa, Mycobacterium
GGAGAAGY

SEQ ID NO: 1097639 - protein, 12 aa, Mycobacterium
GGALAGTSTDFA

SEQ ID NO: 1097640 - protein, 8 aa, Mycobacterium
GGAPTTGV

SEQ ID NO: 1097641 - protein, 4 aa, Mycobacterium
GGAR

SEQ ID NO: 1097642 - protein, 10 aa, Mycobacterium
GGASGEANTL

SEQ ID NO: 1097643 - protein, 7 aa, Mycobacterium
GGASSPV

SEQ ID NO: 1097644 - protein, 15 aa, Mycobacterium
GGATGDGAVTASAES

SEQ ID NO: 1097645 - protein, 6 aa, Mycobacterium
GGAVSP

SEQ ID NO: 1097646 - protein, 6 aa, Mycobacterium
GGDEHT

SEQ ID NO: 1097647 - protein, 6 aa, Mycobacterium
GGDEVR

SEQ ID NO: 1097648 - protein, 9 aa, Mycobacterium
GGDPDGSAA

SEQ ID NO: 1097649 - protein, 45 aa, Mycobacterium
GGDSGSVSATVGTSAQSRPPATATAPHDTSAALPPPTASLAPETI

SEQ ID NO: 1097650 - protein, 10 aa, Mycobacterium
GGDTTPGAGE

SEQ ID NO: 1097651 - protein, 5 aa, Mycobacterium
GGDTV

SEQ ID NO: 1097652 - protein, 9 aa, Mycobacterium
GGDVGDTAE

SEQ ID NO: 1097653 - protein, 34 aa, Mycobacterium
GGDVPQGAQLASARDAASAAVATAQQSGSTDPLG

SEQ ID NO: 1097654 - protein, 7 aa, Mycobacterium
GGEEPTR

SEQ ID NO: 1097655 - protein, 10 aa, Mycobacterium
GGEESRSLDS

SEQ ID NO: 1097656 - protein, 8 aa, Mycobacterium
GGEGGPAL

SEQ ID NO: 1097657 - protein, 7 aa, Mycobacterium
GGEHGDV

SEQ ID NO: 1097658 - protein, 9 aa, Mycobacterium
GGEITSASL

SEQ ID NO: 1097659 - protein, 7 aa, Mycobacterium
GGEKQGN

SEQ ID NO: 1097660 - protein, 4 aa, Mycobacterium
GGEL

SEQ ID NO: 1097661 - protein, 7 aa, Mycobacterium
GGEPDRD

SEQ ID NO: 1097662 - protein, 8 aa, Mycobacterium
GGESAGQV

SEQ ID NO: 1097663 - protein, 8 aa, Mycobacterium
GGEVPEPE

SEQ ID NO: 1097664 - protein, 9 aa, Mycobacterium
GGFEKPPSW

SEQ ID NO: 1097665 - protein, 11 aa, Mycobacterium
GGFSQPDPVTP

SEQ ID NO: 1097666 - protein, 9 aa, Mycobacterium
GGGADTGTL

SEQ ID NO: 1097667 - protein, 10 aa, Mycobacterium
GGGAPTLEEA

SEQ ID NO: 1097668 - protein, 8 aa, Mycobacterium
GGGARSAL

SEQ ID NO: 1097669 - protein, 13 aa, Mycobacterium
GGGAVKKYGPPAV

SEQ ID NO: 1097670 - protein, 8 aa, Mycobacterium
GGGDRSAT

SEQ ID NO: 1097671 - protein, 12 aa, Mycobacterium
GGGEGMGLRSGG

SEQ ID NO: 1097672 - protein, 6 aa, Mycobacterium
GGGGQA

SEQ ID NO: 1097673 - protein, 6 aa, Mycobacterium
GGGPEG

SEQ ID NO: 1097674 - protein, 7 aa, Mycobacterium
GGGRSVV

SEQ ID NO: 1097675 - protein, 6 aa, Mycobacterium
GGGRTR

SEQ ID NO: 1097676 - protein, 4 aa, Mycobacterium
GGGS

SEQ ID NO: 1097677 - protein, 16 aa, Mycobacterium
GGGSGAKRVPEINADR

SEQ ID NO: 1097678 - protein, 10 aa, Mycobacterium
GGGSGGGTVD

SEQ ID NO: 1097679 - protein, 6 aa, Mycobacterium
GGGSHR

SEQ ID NO: 1097680 - protein, 7 aa, Mycobacterium
GGGTELA

SEQ ID NO: 1097681 - protein, 5 aa, Mycobacterium
GGGTI

SEQ ID NO: 1097682 - protein, 6 aa, Mycobacterium
GGHPSL

SEQ ID NO: 1097683 - protein, 11 aa, Mycobacterium
GGIAGGNDVTV

SEQ ID NO: 1097684 - protein, 10 aa, Mycobacterium
GGLAAGNDVK

SEQ ID NO: 1097685 - protein, 11 aa, Mycobacterium
GGLESVSTAER

SEQ ID NO: 1097686 - protein, 10 aa, Mycobacterium
GGLGAGSTRV

SEQ ID NO: 1097687 - protein, 9 aa, Mycobacterium
GGMAGEPEE

SEQ ID NO: 1097688 - protein, 16 aa, Mycobacterium
GGMPPGGPRGDRDDAA

SEQ ID NO: 1097689 - protein, 7 aa, Mycobacterium
GGMPRPE

SEQ ID NO: 1097690 - protein, 6 aa, Mycobacterium
GGNAGA

SEQ ID NO: 1097691 - protein, 7 aa, Mycobacterium
GGNGVTA

SEQ ID NO: 1097692 - protein, 7 aa, Mycobacterium
GGNPNQL

SEQ ID NO: 1097693 - protein, 8 aa, Mycobacterium
GGNRNAAE

SEQ ID NO: 1097694 - protein, 8 aa, Mycobacterium
GGPAGETE

SEQ ID NO: 1097695 - protein, 6 aa, Mycobacterium
GGPALG

SEQ ID NO: 1097696 - protein, 6 aa, Mycobacterium
GGPGGD

SEQ ID NO: 1097697 - protein, 7 aa, Mycobacterium
GGPGIAS

SEQ ID NO: 1097698 - protein, 7 aa, Mycobacterium
GGPGVAT

SEQ ID NO: 1097699 - protein, 10 aa, Mycobacterium
GGPKSGKSTA

SEQ ID NO: 1097700 - protein, 14 aa, Mycobacterium
GGPPDPSKGRCSEN

SEQ ID NO: 1097701 - protein, 5 aa, Mycobacterium
GGPRP

SEQ ID NO: 1097702 - protein, 19 aa, Mycobacterium
GGPSGGGGAVAQAPPGGQF

SEQ ID NO: 1097703 - protein, 6 aa, Mycobacterium
GGPTVA

SEQ ID NO: 1097704 - protein, 13 aa, Mycobacterium
GGRAGFPADGRAG

SEQ ID NO: 1097705 - protein, 4 aa, Mycobacterium
GGRE

SEQ ID NO: 1097706 - protein, 6 aa, Mycobacterium
GGRGEV

SEQ ID NO: 1097707 - protein, 5 aa, Mycobacterium
GGRHS

SEQ ID NO: 1097708 - protein, 7 aa, Mycobacterium
GGRLDDP

SEQ ID NO: 1097709 - protein, 4 aa, Mycobacterium
GGRS

SEQ ID NO: 1097710 - protein, 5 aa, Mycobacterium
GGRSM

SEQ ID NO: 1097711 - protein, 5 aa, Mycobacterium
GGRTP

SEQ ID NO: 1097712 - protein, 8 aa, Mycobacterium
GGRWRSDR

SEQ ID NO: 1097713 - protein, 6 aa, Mycobacterium
GGSADR

SEQ ID NO: 1097714 - protein, 7 aa, Mycobacterium
GGSAGGH

SEQ ID NO: 1097715 - protein, 13 aa, Mycobacterium
GGSDANGADADEE

SEQ ID NO: 1097716 - protein, 7 aa, Mycobacterium
GGSGTSI

SEQ ID NO: 1097717 - protein, 8 aa, Mycobacterium
GGSGTSIT

SEQ ID NO: 1097718 - protein, 8 aa, Mycobacterium
GGSKPYGY

SEQ ID NO: 1097719 - protein, 8 aa, Mycobacterium
GGTGEELT

SEQ ID NO: 1097720 - protein, 5 aa, Mycobacterium
GGTGK

SEQ ID NO: 1097721 - protein, 6 aa, Mycobacterium
GGTGSV

SEQ ID NO: 1097722 - protein, 4 aa, Mycobacterium
GGTK

SEQ ID NO: 1097723 - protein, 5 aa, Mycobacterium
GGTST

SEQ ID NO: 1097724 - protein, 12 aa, Mycobacterium
GGVMGGRRRPMM

SEQ ID NO: 1097725 - protein, 6 aa, Mycobacterium
GGWPAS

SEQ ID NO: 1097726 - protein, 4 aa, Mycobacterium
GGYE

SEQ ID NO: 1097727 - protein, 9 aa, Mycobacterium
GGYRGKTGD

SEQ ID NO: 1097728 - protein, 4 aa, Mycobacterium
GHAA

SEQ ID NO: 1097729 - protein, 5 aa, Mycobacterium
GHAHP

SEQ ID NO: 1097730 - protein, 9 aa, Mycobacterium
GHDATAASD

SEQ ID NO: 1097731 - protein, 13 aa, Mycobacterium
GHDEPTTLALLAD

SEQ ID NO: 1097732 - protein, 11 aa, Mycobacterium
GHDPNDGVGGD

SEQ ID NO: 1097733 - protein, 4 aa, Mycobacterium
GHDR

SEQ ID NO: 1097734 - protein, 15 aa, Mycobacterium
GHGGDTSGAVRPDAV

SEQ ID NO: 1097735 - protein, 7 aa, Mycobacterium
GHHGGGH

SEQ ID NO: 1097736 - protein, 10 aa, Mycobacterium
GHPGTAEAIG

SEQ ID NO: 1097737 - protein, 5 aa, Mycobacterium
GHPIR

SEQ ID NO: 1097738 - protein, 6 aa, Mycobacterium
GHPVGS

SEQ ID NO: 1097739 - protein, 6 aa, Mycobacterium
GHRPRG

SEQ ID NO: 1097740 - protein, 7 aa, Mycobacterium
GHSLDTT

SEQ ID NO: 1097741 - protein, 12 aa, Mycobacterium
GHSSSGGAHDLA

SEQ ID NO: 1097742 - protein, 12 aa, Mycobacterium
GHSSSGGSHDIA

SEQ ID NO: 1097743 - protein, 6 aa, Mycobacterium
GIAPTT

SEQ ID NO: 1097744 - protein, 12 aa, Mycobacterium
GIATKDHTPKVD

SEQ ID NO: 1097745 - protein, 8 aa, Mycobacterium
GIETTTRQ

SEQ ID NO: 1097746 - protein, 4 aa, Mycobacterium
GIGA

SEQ ID NO: 1097747 - protein, 7 aa, Mycobacterium
GIKGGDG

SEQ ID NO: 1097748 - protein, 10 aa, Mycobacterium
GIRDGDGRQP

SEQ ID NO: 1097749 - protein, 7 aa, Mycobacterium
GIRESGT

SEQ ID NO: 1097750 - protein, 6 aa, Mycobacterium
GIRPLE

SEQ ID NO: 1097751 - protein, 7 aa, Mycobacterium
GISPVSD

SEQ ID NO: 1097752 - protein, 6 aa, Mycobacterium
GISTGA

SEQ ID NO: 1097753 - protein, 12 aa, Mycobacterium
GISVGPSETVDA

SEQ ID NO: 1097754 - protein, 20 aa, Mycobacterium
GITALDREQGSAWRVPEPAA

SEQ ID NO: 1097755 - protein, 6 aa, Mycobacterium
GITPEA

SEQ ID NO: 1097756 - protein, 7 aa, Mycobacterium
GITSQPE

SEQ ID NO: 1097757 - protein, 7 aa, Mycobacterium
GKAAQFG

SEQ ID NO: 1097758 - protein, 6 aa, Mycobacterium
GKDQTE

SEQ ID NO: 1097759 - protein, 29 aa, Mycobacterium
GKETVPSNPDNPKGAFTAARTAKDQGVPI

SEQ ID NO: 1097760 - protein, 6 aa, Mycobacterium
GKEVPA

SEQ ID NO: 1097761 - protein, 10 aa, Mycobacterium
GKHQRDTSRA

SEQ ID NO: 1097762 - protein, 7 aa, Mycobacterium
GKISDTA

SEQ ID NO: 1097763 - protein, 5 aa, Mycobacterium
GKLAP

SEQ ID NO: 1097764 - protein, 25 aa, Mycobacterium
GKLGGRDTRVATPSGLDGPGMSTSA

SEQ ID NO: 1097765 - protein, 9 aa, Mycobacterium
GKNGSATPF

SEQ ID NO: 1097766 - protein, 8 aa, Mycobacterium
GKPPFETG

SEQ ID NO: 1097767 - protein, 10 aa, Mycobacterium
GKQEPAPEPF

SEQ ID NO: 1097768 - protein, 14 aa, Mycobacterium
GKRAVGPDAPRDGL

SEQ ID NO: 1097769 - protein, 7 aa, Mycobacterium
GKSAAPL

SEQ ID NO: 1097770 - protein, 7 aa, Mycobacterium
GKSSNVG

SEQ ID NO: 1097771 - protein, 7 aa, Mycobacterium
GKTAPAS

SEQ ID NO: 1097772 - protein, 4 aa, Mycobacterium
GKTT

SEQ ID NO: 1097773 - protein, 5 aa, Mycobacterium
GKTVP

SEQ ID NO: 1097774 - protein, 9 aa, Mycobacterium
GLAAGGVAA

SEQ ID NO: 1097775 - protein, 7 aa, Mycobacterium
GLAGAAG

SEQ ID NO: 1097776 - protein, 13 aa, Mycobacterium
GLAGPQAAPQPHL

SEQ ID NO: 1097777 - protein, 15 aa, Mycobacterium
GLANNGTATLEPAAD

SEQ ID NO: 1097778 - protein, 10 aa, Mycobacterium
GLANTSSVAA

SEQ ID NO: 1097779 - protein, 9 aa, Mycobacterium
GLASRPGQS

SEQ ID NO: 1097780 - protein, 8 aa, Mycobacterium
GLENQRGQ

SEQ ID NO: 1097781 - protein, 5 aa, Mycobacterium
GLGGF

SEQ ID NO: 1097782 - protein, 7 aa, Mycobacterium
GLGGNRP

SEQ ID NO: 1097783 - protein, 13 aa, Mycobacterium
GLGQPKTSTLTGA

SEQ ID NO: 1097784 - protein, 11 aa, Mycobacterium
GLNGEQAERAR

SEQ ID NO: 1097785 - protein, 7 aa, Mycobacterium
GLPDAGD

SEQ ID NO: 1097786 - protein, 13 aa, Mycobacterium
GLPQNNPTGLPSG

SEQ ID NO: 1097787 - protein, 7 aa, Mycobacterium
GLPTGSS

SEQ ID NO: 1097788 - protein, 6 aa, Mycobacterium
GLQRAD

SEQ ID NO: 1097789 - protein, 14 aa, Mycobacterium
GLREAAADGLPGDL

SEQ ID NO: 1097790 - protein, 6 aa, Mycobacterium
GLRGPD

SEQ ID NO: 1097791 - protein, 5 aa, Mycobacterium
GLRPD

SEQ ID NO: 1097792 - protein, 11 aa, Mycobacterium
GLSAAKTLKRA

SEQ ID NO: 1097793 - protein, 7 aa, Mycobacterium
GLSPFSP

SEQ ID NO: 1097794 - protein, 8 aa, Mycobacterium
GLTSSSSY

SEQ ID NO: 1097795 - protein, 12 aa, Mycobacterium
GLVERTASSDMP

SEQ ID NO: 1097796 - protein, 15 aa, Mycobacterium
GMEERDTGGLSGGEL

SEQ ID NO: 1097797 - protein, 9 aa, Mycobacterium
GMPGPETSG

SEQ ID NO: 1097798 - protein, 11 aa, Mycobacterium
GMSPDGSTSGI

SEQ ID NO: 1097799 - protein, 10 aa, Mycobacterium
GNAGTNDTYT

SEQ ID NO: 1097800 - protein, 6 aa, Mycobacterium
GNDGVY

SEQ ID NO: 1097801 - protein, 7 aa, Mycobacterium
GNGATTA

SEQ ID NO: 1097802 - protein, 6 aa, Mycobacterium
GNGISA

SEQ ID NO: 1097803 - protein, 5 aa, Mycobacterium
GNGLG

SEQ ID NO: 1097804 - protein, 18 aa, Mycobacterium
GNGPQARRLSGDGDTETI

SEQ ID NO: 1097805 - protein, 22 aa, Mycobacterium
GNIEDSAARQAAGEALTDDLRG

SEQ ID NO: 1097806 - protein, 12 aa, Mycobacterium
GNPPHERKADED

SEQ ID NO: 1097807 - protein, 6 aa, Mycobacterium
GNPPVI

SEQ ID NO: 1097808 - protein, 10 aa, Mycobacterium
GNPQDSGKLR

SEQ ID NO: 1097809 - protein, 25 aa, Mycobacterium
GNPYVPATTVQEDGEVKPRQSTRNR

SEQ ID NO: 1097810 - protein, 4 aa, Mycobacterium
GNRE

SEQ ID NO: 1097811 - protein, 8 aa, Mycobacterium
GNREGTNP

SEQ ID NO: 1097812 - protein, 7 aa, Mycobacterium
GNRETPA

SEQ ID NO: 1097813 - protein, 4 aa, Mycobacterium
GNSY

SEQ ID NO: 1097814 - protein, 8 aa, Mycobacterium
GNTGGEVF

SEQ ID NO: 1097815 - protein, 24 aa, Mycobacterium
GNTGQDCSQNPPPDPAVPTDPRGW

SEQ ID NO: 1097816 - protein, 5 aa, Mycobacterium
GNTLP

SEQ ID NO: 1097817 - protein, 21 aa, Mycobacterium
GNTSSPLDFQSDPGAKSDGIG

SEQ ID NO: 1097818 - protein, 23 aa, Mycobacterium
GNVGGPGQCPTQNATQPGRPDWQ

SEQ ID NO: 1097819 - protein, 11 aa, Mycobacterium
GNVSGSSARRT

SEQ ID NO: 1097820 - protein, 6 aa, Mycobacterium
GPAATV

SEQ ID NO: 1097821 - protein, 8 aa, Mycobacterium
GPAPTTDA

SEQ ID NO: 1097822 - protein, 8 aa, Mycobacterium
GPATPVLP

SEQ ID NO: 1097823 - protein, 5 aa, Mycobacterium
GPDGA

SEQ ID NO: 1097824 - protein, 13 aa, Mycobacterium
GPDLRGSLSGSAS

SEQ ID NO: 1097825 - protein, 4 aa, Mycobacterium
GPDP

SEQ ID NO: 1097826 - protein, 6 aa, Mycobacterium
GPDRAR

SEQ ID NO: 1097827 - protein, 5 aa, Mycobacterium
GPDVT

SEQ ID NO: 1097828 - protein, 4 aa, Mycobacterium
GPDY

SEQ ID NO: 1097829 - protein, 8 aa, Mycobacterium
GPESDQLS

SEQ ID NO: 1097830 - protein, 6 aa, Mycobacterium
GPGAAR

SEQ ID NO: 1097831 - protein, 7 aa, Mycobacterium
GPGAPVD

SEQ ID NO: 1097832 - protein, 4 aa, Mycobacterium
GPGD

SEQ ID NO: 1097833 - protein, 4 aa, Mycobacterium
GPIT

SEQ ID NO: 1097834 - protein, 5 aa, Mycobacterium
GPKST

SEQ ID NO: 1097835 - protein, 4 aa, Mycobacterium
GPLA

SEQ ID NO: 1097836 - protein, 5 aa, Mycobacterium
GPLAE

SEQ ID NO: 1097837 - protein, 4 aa, Mycobacterium
GPLG

SEQ ID NO: 1097838 - protein, 5 aa, Mycobacterium
GPLGP

SEQ ID NO: 1097839 - protein, 9 aa, Mycobacterium
GPLNAAGEA

SEQ ID NO: 1097840 - protein, 11 aa, Mycobacterium
GPLTPKDSHWE

SEQ ID NO: 1097841 - protein, 7 aa, Mycobacterium
GPMSPAQ

SEQ ID NO: 1097842 - protein, 10 aa, Mycobacterium
GPNGCGKSTT

SEQ ID NO: 1097843 - protein, 22 aa, Mycobacterium
GPPAAPDPATVHEEESIDVPAS

SEQ ID NO: 1097844 - protein, 7 aa, Mycobacterium
GPPGWKP

SEQ ID NO: 1097845 - protein, 5 aa, Mycobacterium
GPPLD

SEQ ID NO: 1097846 - protein, 4 aa, Mycobacterium
GPPN

SEQ ID NO: 1097847 - protein, 7 aa, Mycobacterium
GPPPPPL

SEQ ID NO: 1097848 - protein, 6 aa, Mycobacterium
GPPRGL

SEQ ID NO: 1097849 - protein, 26 aa, Mycobacterium
GPQEHDSEPAPPSKPDDEELAPLSFA

SEQ ID NO: 1097850 - protein, 4 aa, Mycobacterium
GPQR

SEQ ID NO: 1097851 - protein, 8 aa, Mycobacterium
GPQSGSGF

SEQ ID NO: 1097852 - protein, 8 aa, Mycobacterium
GPRDTNGL

SEQ ID NO: 1097853 - protein, 15 aa, Mycobacterium
GPRPEEAKWQENSSP

SEQ ID NO: 1097854 - protein, 7 aa, Mycobacterium
GPRPERP

SEQ ID NO: 1097855 - protein, 9 aa, Mycobacterium
GPRPPLAGE

SEQ ID NO: 1097856 - protein, 5 aa, Mycobacterium
GPRQR

SEQ ID NO: 1097857 - protein, 8 aa, Mycobacterium
GPRSGMSS

SEQ ID NO: 1097858 - protein, 9 aa, Mycobacterium
GPRTVGRQN

SEQ ID NO: 1097859 - protein, 4 aa, Mycobacterium
GPSA

SEQ ID NO: 1097860 - protein, 6 aa, Mycobacterium
GPSDTL

SEQ ID NO: 1097861 - protein, 23 aa, Mycobacterium
GPSGNPPVRGRTKAGETTTADPL

SEQ ID NO: 1097862 - protein, 11 aa, Mycobacterium
GPSPTPAEQQA

SEQ ID NO: 1097863 - protein, 5 aa, Mycobacterium
GPSTW

SEQ ID NO: 1097864 - protein, 11 aa, Mycobacterium
GPTRAPTSTRR

SEQ ID NO: 1097865 - protein, 5 aa, Mycobacterium
GPTRD

SEQ ID NO: 1097866 - protein, 14 aa, Mycobacterium
GPVADSCSQPPSLS

SEQ ID NO: 1097867 - protein, 4 aa, Mycobacterium
GPYP

SEQ ID NO: 1097868 - protein, 11 aa, Mycobacterium
GQASEAGVRAA

SEQ ID NO: 1097869 - protein, 5 aa, Mycobacterium
GQAVP

SEQ ID NO: 1097870 - protein, 7 aa, Mycobacterium
GQDDKQL

SEQ ID NO: 1097871 - protein, 15 aa, Mycobacterium
GQDLAKTGDPVQSSK

SEQ ID NO: 1097872 - protein, 67 aa, Mycobacterium
GQDSTPTARTTLTPTTAPYDESIPTTTESTTPSTTPSTTSTTPSTTSTSPSTSTTAPAGVSGADGQG

SEQ ID NO: 1097873 - protein, 10 aa, Mycobacterium
GQEPGSPTAG

SEQ ID NO: 1097874 - protein, 5 aa, Mycobacterium
GQFTG

SEQ ID NO: 1097875 - protein, 4 aa, Mycobacterium
GQGA

SEQ ID NO: 1097876 - protein, 6 aa, Mycobacterium
GQGGTL

SEQ ID NO: 1097877 - protein, 6 aa, Mycobacterium
GQPATG

SEQ ID NO: 1097878 - protein, 25 aa, Mycobacterium
GQPDGRPDVEPPPPGEGACAVENQN

SEQ ID NO: 1097879 - protein, 30 aa, Mycobacterium
GQPDPADLDRPKRAVADRTHEAHAPTDPLD

SEQ ID NO: 1097880 - protein, 41 aa, Mycobacterium
GQPDRGDEPVSEPWPPQAEDEAPPPAPAAAAPAPAPAGPKL

SEQ ID NO: 1097881 - protein, 14 aa, Mycobacterium
GQPGADGFSGVAPG

SEQ ID NO: 1097882 - protein, 20 aa, Mycobacterium
GQPGKRAATAEQCASDKPFE

SEQ ID NO: 1097883 - protein, 13 aa, Mycobacterium
GQPGVQGVQNQKD

SEQ ID NO: 1097884 - protein, 6 aa, Mycobacterium
GQPRAT

SEQ ID NO: 1097885 - protein, 7 aa, Mycobacterium
GQPVPGV

SEQ ID NO: 1097886 - protein, 8 aa, Mycobacterium
GQQADLST

SEQ ID NO: 1097887 - protein, 7 aa, Mycobacterium
GQQPKKQ

SEQ ID NO: 1097888 - protein, 13 aa, Mycobacterium
GQRATQAEETLRQ

SEQ ID NO: 1097889 - protein, 8 aa, Mycobacterium
GQRGTKAE

SEQ ID NO: 1097890 - protein, 9 aa, Mycobacterium
GQSGTGKTT

SEQ ID NO: 1097891 - protein, 6 aa, Mycobacterium
GQSSAV

SEQ ID NO: 1097892 - protein, 8 aa, Mycobacterium
GQTLGGVT

SEQ ID NO: 1097893 - protein, 4 aa, Mycobacterium
GQTW

SEQ ID NO: 1097894 - protein, 12 aa, Mycobacterium
GQWPPKDLKEGG

SEQ ID NO: 1097895 - protein, 16 aa, Mycobacterium
GRAADRALSAKDRVPE

SEQ ID NO: 1097896 - protein, 15 aa, Mycobacterium
GRAASETEQTQASTA

SEQ ID NO: 1097897 - protein, 10 aa, Mycobacterium
GRADEAIETP

SEQ ID NO: 1097898 - protein, 6 aa, Mycobacterium
GRADMD

SEQ ID NO: 1097899 - protein, 13 aa, Mycobacterium
GRAHSREVRGTDL

SEQ ID NO: 1097900 - protein, 5 aa, Mycobacterium
GRAHT

SEQ ID NO: 1097901 - protein, 13 aa, Mycobacterium
GRAKRGEATNGGV

SEQ ID NO: 1097902 - protein, 6 aa, Mycobacterium
GRASDN

SEQ ID NO: 1097903 - protein, 4 aa, Mycobacterium
GRDA

SEQ ID NO: 1097904 - protein, 19 aa, Mycobacterium
GRDEGAYEEKLEAELAERV

SEQ ID NO: 1097905 - protein, 8 aa, Mycobacterium
GRDMTEQP

SEQ ID NO: 1097906 - protein, 9 aa, Mycobacterium
GRDPEAREK

SEQ ID NO: 1097907 - protein, 7 aa, Mycobacterium
GRDPQRV

SEQ ID NO: 1097908 - protein, 10 aa, Mycobacterium
GRDRLRRQRS

SEQ ID NO: 1097909 - protein, 8 aa, Mycobacterium
GRDVPENE

SEQ ID NO: 1097910 - protein, 13 aa, Mycobacterium
GREHGTPESGNAF

SEQ ID NO: 1097911 - protein, 10 aa, Mycobacterium
GREIGGPTAQ

SEQ ID NO: 1097912 - protein, 4 aa, Mycobacterium
GREP

SEQ ID NO: 1097913 - protein, 4 aa, Mycobacterium
GREQ

SEQ ID NO: 1097914 - protein, 6 aa, Mycobacterium
GRETLT

SEQ ID NO: 1097915 - protein, 4 aa, Mycobacterium
GREV

SEQ ID NO: 1097916 - protein, 6 aa, Mycobacterium
GRFDPG

SEQ ID NO: 1097917 - protein, 5 aa, Mycobacterium
GRFGA

SEQ ID NO: 1097918 - protein, 9 aa, Mycobacterium
GRGDQLAAQ

SEQ ID NO: 1097919 - protein, 10 aa, Mycobacterium
GRGGTEVAKD

SEQ ID NO: 1097920 - protein, 9 aa, Mycobacterium
GRGPGGRDA

SEQ ID NO: 1097921 - protein, 23 aa, Mycobacterium
GRGPTEGPAPAHDAASALQADAD

SEQ ID NO: 1097922 - protein, 8 aa, Mycobacterium
GRGSPTDG

SEQ ID NO: 1097923 - protein, 4 aa, Mycobacterium
GRHG

SEQ ID NO: 1097924 - protein, 16 aa, Mycobacterium
GRHRDELSRAAAAPLA

SEQ ID NO: 1097925 - protein, 7 aa, Mycobacterium
GRIESPQ

SEQ ID NO: 1097926 - protein, 20 aa, Mycobacterium
GRINNSEPSGSEAELQPSAQ

SEQ ID NO: 1097927 - protein, 7 aa, Mycobacterium
GRIPGTA

SEQ ID NO: 1097928 - protein, 8 aa, Mycobacterium
GRKQRESG

SEQ ID NO: 1097929 - protein, 14 aa, Mycobacterium
GRLPDGSGAKTSVS

SEQ ID NO: 1097930 - protein, 6 aa, Mycobacterium
GRLTRE

SEQ ID NO: 1097931 - protein, 27 aa, Mycobacterium
GRMPARRNEAQAPNKPADFDEAQTDAL

SEQ ID NO: 1097932 - protein, 9 aa, Mycobacterium
GRNGALTRS

SEQ ID NO: 1097933 - protein, 10 aa, Mycobacterium
GRNNYRNPET

SEQ ID NO: 1097934 - protein, 10 aa, Mycobacterium
GRNPDKALES

SEQ ID NO: 1097935 - protein, 6 aa, Mycobacterium
GRPAQQ

SEQ ID NO: 1097936 - protein, 9 aa, Mycobacterium
GRPDATEAQ

SEQ ID NO: 1097937 - protein, 5 aa, Mycobacterium
GRPMS

SEQ ID NO: 1097938 - protein, 12 aa, Mycobacterium
GRPSAPRRHRTT

SEQ ID NO: 1097939 - protein, 18 aa, Mycobacterium
GRPSRYRSEPHRQHVATA

SEQ ID NO: 1097940 - protein, 6 aa, Mycobacterium
GRRGAA

SEQ ID NO: 1097941 - protein, 4 aa, Mycobacterium
GRRN

SEQ ID NO: 1097942 - protein, 9 aa, Mycobacterium
GRRSGRAAM

SEQ ID NO: 1097943 - protein, 10 aa, Mycobacterium
GRSDISEQDR

SEQ ID NO: 1097944 - protein, 6 aa, Mycobacterium
GRSGEP

SEQ ID NO: 1097945 - protein, 12 aa, Mycobacterium
GRSHRDGQTPHF

SEQ ID NO: 1097946 - protein, 11 aa, Mycobacterium
GRSSKLSSDTS

SEQ ID NO: 1097947 - protein, 9 aa, Mycobacterium
GRSVDQTEL

SEQ ID NO: 1097948 - protein, 10 aa, Mycobacterium
GRSYGDGAND

SEQ ID NO: 1097949 - protein, 11 aa, Mycobacterium
GRTAGAADSGR

SEQ ID NO: 1097950 - protein, 5 aa, Mycobacterium
GRTGR

SEQ ID NO: 1097951 - protein, 15 aa, Mycobacterium
GRTPPPPPGRQPTPV

SEQ ID NO: 1097952 - protein, 6 aa, Mycobacterium
GRVNAS

SEQ ID NO: 1097953 - protein, 14 aa, Mycobacterium
GRYNSSRGPSYSSY

SEQ ID NO: 1097954 - protein, 5 aa, Mycobacterium
GRYTG

SEQ ID NO: 1097955 - protein, 4 aa, Mycobacterium
GSAA

SEQ ID NO: 1097956 - protein, 9 aa, Mycobacterium
GSAARLGDT

SEQ ID NO: 1097957 - protein, 6 aa, Mycobacterium
GSAATT

SEQ ID NO: 1097958 - protein, 8 aa, Mycobacterium
GSADGRDR

SEQ ID NO: 1097959 - protein, 7 aa, Mycobacterium
GSAGAFG

SEQ ID NO: 1097960 - protein, 5 aa, Mycobacterium
GSAGL

SEQ ID NO: 1097961 - protein, 7 aa, Mycobacterium
GSALAES

SEQ ID NO: 1097962 - protein, 8 aa, Mycobacterium
GSASSRAG

SEQ ID NO: 1097963 - protein, 6 aa, Mycobacterium
GSASWT

SEQ ID NO: 1097964 - protein, 6 aa, Mycobacterium
GSATIG

SEQ ID NO: 1097965 - protein, 6 aa, Mycobacterium
GSATPI

SEQ ID NO: 1097966 - protein, 12 aa, Mycobacterium
GSDLPGDTSATS

SEQ ID NO: 1097967 - protein, 5 aa, Mycobacterium
GSDTV

SEQ ID NO: 1097968 - protein, 7 aa, Mycobacterium
GSEDSYT

SEQ ID NO: 1097969 - protein, 8 aa, Mycobacterium
GSEGAADA

SEQ ID NO: 1097970 - protein, 6 aa, Mycobacterium
GSESVT

SEQ ID NO: 1097971 - protein, 10 aa, Mycobacterium
GSGDSATPRY

SEQ ID NO: 1097972 - protein, 7 aa, Mycobacterium
GSGGAEL

SEQ ID NO: 1097973 - protein, 12 aa, Mycobacterium
GSGGNADQSGAL

SEQ ID NO: 1097974 - protein, 6 aa, Mycobacterium
GSGHSG

SEQ ID NO: 1097975 - protein, 4 aa, Mycobacterium
GSGI

SEQ ID NO: 1097976 - protein, 6 aa, Mycobacterium
GSGPGF

SEQ ID NO: 1097977 - protein, 9 aa, Mycobacterium
GSGSPATRA

SEQ ID NO: 1097978 - protein, 9 aa, Mycobacterium
GSGVGKPGA

SEQ ID NO: 1097979 - protein, 10 aa, Mycobacterium
GSGVTGVDTA

SEQ ID NO: 1097980 - protein, 4 aa, Mycobacterium
GSGY

SEQ ID NO: 1097981 - protein, 8 aa, Mycobacterium
GSIGAGGV

SEQ ID NO: 1097982 - protein, 5 aa, Mycobacterium
GSLER

SEQ ID NO: 1097983 - protein, 13 aa, Mycobacterium
GSLPNTPNNTSTS

SEQ ID NO: 1097984 - protein, 5 aa, Mycobacterium
GSMAG

SEQ ID NO: 1097985 - protein, 10 aa, Mycobacterium
GSMNGAGTGR

SEQ ID NO: 1097986 - protein, 6 aa, Mycobacterium
GSNGAS

SEQ ID NO: 1097987 - protein, 11 aa, Mycobacterium
GSNSKNPEATS

SEQ ID NO: 1097988 - protein, 6 aa, Mycobacterium
GSPCGR

SEQ ID NO: 1097989 - protein, 6 aa, Mycobacterium
GSPDAS

SEQ ID NO: 1097990 - protein, 5 aa, Mycobacterium
GSPFP

SEQ ID NO: 1097991 - protein, 9 aa, Mycobacterium
GSPMSGTTT

SEQ ID NO: 1097992 - protein, 5 aa, Mycobacterium
GSPWE

SEQ ID NO: 1097993 - protein, 8 aa, Mycobacterium
GSPYSTPT

SEQ ID NO: 1097994 - protein, 4 aa, Mycobacterium
GSQL

SEQ ID NO: 1097995 - protein, 10 aa, Mycobacterium
GSQPELRGQG

SEQ ID NO: 1097996 - protein, 8 aa, Mycobacterium
GSREGVTR

SEQ ID NO: 1097997 - protein, 7 aa, Mycobacterium
GSRFSRE

SEQ ID NO: 1097998 - protein, 10 aa, Mycobacterium
GSSGAGKSTI

SEQ ID NO: 1097999 - protein, 6 aa, Mycobacterium
GSSGAL

SEQ ID NO: 1098000 - protein, 7 aa, Mycobacterium
GSSGPVQ

SEQ ID NO: 1098001 - protein, 9 aa, Mycobacterium
GSSLAGSIT

SEQ ID NO: 1098002 - protein, 7 aa, Mycobacterium
GSSTPYT

SEQ ID NO: 1098003 - protein, 12 aa, Mycobacterium
GSTDGLTDCDGH

SEQ ID NO: 1098004 - protein, 31 aa, Mycobacterium
GSTEHPSITGSRPTAPEDKRLYTDGDPRPGV

SEQ ID NO: 1098005 - protein, 8 aa, Mycobacterium
GSTGSGKS

SEQ ID NO: 1098006 - protein, 8 aa, Mycobacterium
GSTGVPKG

SEQ ID NO: 1098007 - protein, 6 aa, Mycobacterium
GSTQTT

SEQ ID NO: 1098008 - protein, 5 aa, Mycobacterium
GSTSA

SEQ ID NO: 1098009 - protein, 8 aa, Mycobacterium
GSVEGPLR

SEQ ID NO: 1098010 - protein, 12 aa, Mycobacterium
GSVNPQTAADPN

SEQ ID NO: 1098011 - protein, 15 aa, Mycobacterium
GTAPRVSDAGQPDIG

SEQ ID NO: 1098012 - protein, 4 aa, Mycobacterium
GTDA

SEQ ID NO: 1098013 - protein, 11 aa, Mycobacterium
GTDAAAEAGIS

SEQ ID NO: 1098014 - protein, 6 aa, Mycobacterium
GTDETN

SEQ ID NO: 1098015 - protein, 7 aa, Mycobacterium
GTDPRGA

SEQ ID NO: 1098016 - protein, 12 aa, Mycobacterium
GTDQEEAASTLG

SEQ ID NO: 1098017 - protein, 5 aa, Mycobacterium
GTDTL

SEQ ID NO: 1098018 - protein, 9 aa, Mycobacterium
GTEPRDVRQ

SEQ ID NO: 1098019 - protein, 8 aa, Mycobacterium
GTEPSTVS

SEQ ID NO: 1098020 - protein, 6 aa, Mycobacterium
GTESVA

SEQ ID NO: 1098021 - protein, 7 aa, Mycobacterium
GTFRNDT

SEQ ID NO: 1098022 - protein, 13 aa, Mycobacterium
GTGKKPPDGAGRG

SEQ ID NO: 1098023 - protein, 7 aa, Mycobacterium
GTGPDGR

SEQ ID NO: 1098024 - protein, 11 aa, Mycobacterium
GTGPGAADEAS

SEQ ID NO: 1098025 - protein, 8 aa, Mycobacterium
GTGPSKAL

SEQ ID NO: 1098026 - protein, 6 aa, Mycobacterium
GTGSQS

SEQ ID NO: 1098027 - protein, 8 aa, Mycobacterium
GTGSTAAQ

SEQ ID NO: 1098028 - protein, 10 aa, Mycobacterium
GTGTDAAIEA

SEQ ID NO: 1098029 - protein, 7 aa, Mycobacterium
GTITLGN

SEQ ID NO: 1098030 - protein, 7 aa, Mycobacterium
GTKGRTA

SEQ ID NO: 1098031 - protein, 22 aa, Mycobacterium
GTKTFGDIGPNTPVTVEDEAGK

SEQ ID NO: 1098032 - protein, 6 aa, Mycobacterium
GTLDGR

SEQ ID NO: 1098033 - protein, 6 aa, Mycobacterium
GTLGPS

SEQ ID NO: 1098034 - protein, 22 aa, Mycobacterium
GTLPPTPGWTSGAASVPARQVG

SEQ ID NO: 1098035 - protein, 28 aa, Mycobacterium
GTLSARSTHRTEPVTAAQPAAASGSRAA

SEQ ID NO: 1098036 - protein, 16 aa, Mycobacterium
GTNPDNSEPSESDAQT

SEQ ID NO: 1098037 - protein, 4 aa, Mycobacterium
GTNY

SEQ ID NO: 1098038 - protein, 5 aa, Mycobacterium
GTPAA

SEQ ID NO: 1098039 - protein, 6 aa, Mycobacterium
GTPEQR

SEQ ID NO: 1098040 - protein, 8 aa, Mycobacterium
GTPPFTHT

SEQ ID NO: 1098041 - protein, 8 aa, Mycobacterium
GTPTWRGQ

SEQ ID NO: 1098042 - protein, 11 aa, Mycobacterium
GTQESAAAGGH

SEQ ID NO: 1098043 - protein, 5 aa, Mycobacterium
GTQGL

SEQ ID NO: 1098044 - protein, 14 aa, Mycobacterium
GTQQKLTEKYNEGL

SEQ ID NO: 1098045 - protein, 12 aa, Mycobacterium
GTRVTGQTQDAP

SEQ ID NO: 1098046 - protein, 5 aa, Mycobacterium
GTSNH

SEQ ID NO: 1098047 - protein, 6 aa, Mycobacterium
GTSTAA

SEQ ID NO: 1098048 - protein, 13 aa, Mycobacterium
GTTGPVKNMDGTQ

SEQ ID NO: 1098049 - protein, 8 aa, Mycobacterium
GTTGSADL

SEQ ID NO: 1098050 - protein, 13 aa, Mycobacterium
GTTPQVGQGTTKN

SEQ ID NO: 1098051 - protein, 8 aa, Mycobacterium
GTTPSNRD

SEQ ID NO: 1098052 - protein, 22 aa, Mycobacterium
GTVAPQRLSNTRNSGAGAAERN

SEQ ID NO: 1098053 - protein, 20 aa, Mycobacterium
GTVGEKSEQGFAARKDSGLL

SEQ ID NO: 1098054 - protein, 5 aa, Mycobacterium
GTVLP

SEQ ID NO: 1098055 - protein, 18 aa, Mycobacterium
GTVPDEPMRDTGATRRGV

SEQ ID NO: 1098056 - protein, 13 aa, Mycobacterium
GTVTANDTPGGGL

SEQ ID NO: 1098057 - protein, 5 aa, Mycobacterium
GTVTM

SEQ ID NO: 1098058 - protein, 11 aa, Mycobacterium
GTYADGTSTPF

SEQ ID NO: 1098059 - protein, 13 aa, Mycobacterium
GTYSTGVQQESRL

SEQ ID NO: 1098060 - protein, 11 aa, Mycobacterium
GVAGQQAPVPA

SEQ ID NO: 1098061 - protein, 7 aa, Mycobacterium
GVDATRP

SEQ ID NO: 1098062 - protein, 8 aa, Mycobacterium
GVEAPSNA

SEQ ID NO: 1098063 - protein, 11 aa, Mycobacterium
GVENAETAERL

SEQ ID NO: 1098064 - protein, 15 aa, Mycobacterium
GVGAGDDAVKESGRD

SEQ ID NO: 1098065 - protein, 7 aa, Mycobacterium
GVGKGSR

SEQ ID NO: 1098066 - protein, 7 aa, Mycobacterium
GVHPTKE

SEQ ID NO: 1098067 - protein, 16 aa, Mycobacterium
GVKPGPRLPNVEPGGD

SEQ ID NO: 1098068 - protein, 5 aa, Mycobacterium
GVLGD

SEQ ID NO: 1098069 - protein, 10 aa, Mycobacterium
GVNDAPALAT

SEQ ID NO: 1098070 - protein, 8 aa, Mycobacterium
GVNDASDT

SEQ ID NO: 1098071 - protein, 5 aa, Mycobacterium
GVPDS

SEQ ID NO: 1098072 - protein, 5 aa, Mycobacterium
GVPEF

SEQ ID NO: 1098073 - protein, 8 aa, Mycobacterium
GVPEPASA

SEQ ID NO: 1098074 - protein, 8 aa, Mycobacterium
GVPRGRTG

SEQ ID NO: 1098075 - protein, 15 aa, Mycobacterium
GVRSPALDRQSRITT

SEQ ID NO: 1098076 - protein, 6 aa, Mycobacterium
GVSNHS

SEQ ID NO: 1098077 - protein, 11 aa, Mycobacterium
GVSPGDRVDVG

SEQ ID NO: 1098078 - protein, 4 aa, Mycobacterium
GVSR

SEQ ID NO: 1098079 - protein, 13 aa, Mycobacterium
GVTGQVAANDPQV

SEQ ID NO: 1098080 - protein, 8 aa, Mycobacterium
GVTTTGAP

SEQ ID NO: 1098081 - protein, 15 aa, Mycobacterium
GVYSAGRAKIPQRTL

SEQ ID NO: 1098082 - protein, 6 aa, Mycobacterium
GVYSGD

SEQ ID NO: 1098083 - protein, 8 aa, Mycobacterium
GWADPSSG

SEQ ID NO: 1098084 - protein, 14 aa, Mycobacterium
GWPPQQQPSGQQGG

SEQ ID NO: 1098085 - protein, 5 aa, Mycobacterium
GWTPG

SEQ ID NO: 1098086 - protein, 4 aa, Mycobacterium
GYAA

SEQ ID NO: 1098087 - protein, 22 aa, Mycobacterium
GYDPEAEGLGGTIEDEILKGHT

SEQ ID NO: 1098088 - protein, 17 aa, Mycobacterium
GYDTDVAKRGGRLSAGQ

SEQ ID NO: 1098089 - protein, 8 aa, Mycobacterium
GYGADESM

SEQ ID NO: 1098090 - protein, 11 aa, Mycobacterium
GYGGSNAQQPI

SEQ ID NO: 1098091 - protein, 5 aa, Mycobacterium
GYGQP

SEQ ID NO: 1098092 - protein, 14 aa, Mycobacterium
GYGYPAPPPQPPKK

SEQ ID NO: 1098093 - protein, 6 aa, Mycobacterium
GYKPGE

SEQ ID NO: 1098094 - protein, 5 aa, Mycobacterium
GYNDG

SEQ ID NO: 1098095 - protein, 5 aa, Mycobacterium
GYNGS

SEQ ID NO: 1098096 - protein, 8 aa, Mycobacterium
GYTGGGHK

SEQ ID NO: 1098097 - protein, 6 aa, Mycobacterium
HAAEQR

SEQ ID NO: 1098098 - protein, 12 aa, Mycobacterium
HAATTKDEAVLD

SEQ ID NO: 1098099 - protein, 5 aa, Mycobacterium
HADEA

SEQ ID NO: 1098100 - protein, 8 aa, Mycobacterium
HAGRERSQ

SEQ ID NO: 1098101 - protein, 9 aa, Mycobacterium
HAPGTPSPF

SEQ ID NO: 1098102 - protein, 12 aa, Mycobacterium
HAVQPDGGIRSA

SEQ ID NO: 1098103 - protein, 8 aa, Mycobacterium
HDADAERA

SEQ ID NO: 1098104 - protein, 6 aa, Mycobacterium
HDATGW

SEQ ID NO: 1098105 - protein, 18 aa, Mycobacterium
HDGFTAGTPVEALTDSRD

SEQ ID NO: 1098106 - protein, 5 aa, Mycobacterium
HDHPE

SEQ ID NO: 1098107 - protein, 7 aa, Mycobacterium
HDPTTRE

SEQ ID NO: 1098108 - protein, 21 aa, Mycobacterium
HDRPPSLDNPRAPKRAGGMPN

SEQ ID NO: 1098109 - protein, 14 aa, Mycobacterium
HDRQSDETETRKAE

SEQ ID NO: 1098110 - protein, 15 aa, Mycobacterium
HEAAQKELDKPIYPR

SEQ ID NO: 1098111 - protein, 6 aa, Mycobacterium
HEAPGT

SEQ ID NO: 1098112 - protein, 13 aa, Mycobacterium
HEDEDTLAGDRET

SEQ ID NO: 1098113 - protein, 6 aa, Mycobacterium
HEDHES

SEQ ID NO: 1098114 - protein, 4 aa, Mycobacterium
HEDP

SEQ ID NO: 1098115 - protein, 13 aa, Mycobacterium
HERTTARRLNESE

SEQ ID NO: 1098116 - protein, 6 aa, Mycobacterium
HEVTDE

SEQ ID NO: 1098117 - protein, 8 aa, Mycobacterium
HGARGGGV

SEQ ID NO: 1098118 - protein, 16 aa, Mycobacterium
HGGTIAADSAGAGRGT

SEQ ID NO: 1098119 - protein, 4 aa, Mycobacterium
HGGV

SEQ ID NO: 1098120 - protein, 4 aa, Mycobacterium
HGRQ

SEQ ID NO: 1098121 - protein, 9 aa, Mycobacterium
HGSVDPGDA

SEQ ID NO: 1098122 - protein, 6 aa, Mycobacterium
HGTAPR

SEQ ID NO: 1098123 - protein, 5 aa, Mycobacterium
HGTDS

SEQ ID NO: 1098124 - protein, 7 aa, Mycobacterium
HHKHGSP

SEQ ID NO: 1098125 - protein, 10 aa, Mycobacterium
HHPDHEASTE

SEQ ID NO: 1098126 - protein, 5 aa, Mycobacterium
HHSSE

SEQ ID NO: 1098127 - protein, 20 aa, Mycobacterium
HHTPAGAEVPHPSAEHAEAH

SEQ ID NO: 1098128 - protein, 4 aa, Mycobacterium
HITG

SEQ ID NO: 1098129 - protein, 12 aa, Mycobacterium
HLASPGGDDDVT

SEQ ID NO: 1098130 - protein, 16 aa, Mycobacterium
HLPGADEVDPDQPSGV

SEQ ID NO: 1098131 - protein, 4 aa, Mycobacterium
HLPS

SEQ ID NO: 1098132 - protein, 8 aa, Mycobacterium
HLSPDTQR

SEQ ID NO: 1098133 - protein, 9 aa, Mycobacterium
HNEAAGTAA

SEQ ID NO: 1098134 - protein, 5 aa, Mycobacterium
HNGTA

SEQ ID NO: 1098135 - protein, 25 aa, Mycobacterium
HPAARGVRRPVDARRPRAGRPAGAA

SEQ ID NO: 1098136 - protein, 11 aa, Mycobacterium
HPAPKGSEGGL

SEQ ID NO: 1098137 - protein, 18 aa, Mycobacterium
HPASGPGTMSGPARGDAF

SEQ ID NO: 1098138 - protein, 19 aa, Mycobacterium
HPDAGHAGTQADAVSGERV

SEQ ID NO: 1098139 - protein, 11 aa, Mycobacterium
HPDDPAPQKIR

SEQ ID NO: 1098140 - protein, 7 aa, Mycobacterium
HPDGGVD

SEQ ID NO: 1098141 - protein, 6 aa, Mycobacterium
HPDGQR

SEQ ID NO: 1098142 - protein, 9 aa, Mycobacterium
HPEETPSPW

SEQ ID NO: 1098143 - protein, 6 aa, Mycobacterium
HPGAPA

SEQ ID NO: 1098144 - protein, 4 aa, Mycobacterium
HPGQ

SEQ ID NO: 1098145 - protein, 5 aa, Mycobacterium
HPMPT

SEQ ID NO: 1098146 - protein, 4 aa, Mycobacterium
HPPM

SEQ ID NO: 1098147 - protein, 6 aa, Mycobacterium
HPRALG

SEQ ID NO: 1098148 - protein, 5 aa, Mycobacterium
HPRSF

SEQ ID NO: 1098149 - protein, 4 aa, Mycobacterium
HPSP

SEQ ID NO: 1098150 - protein, 7 aa, Mycobacterium
HPTSPYP

SEQ ID NO: 1098151 - protein, 6 aa, Mycobacterium
HQETSA

SEQ ID NO: 1098152 - protein, 9 aa, Mycobacterium
HQRPKVERY

SEQ ID NO: 1098153 - protein, 14 aa, Mycobacterium
HRAADGSPGSSAAP

SEQ ID NO: 1098154 - protein, 9 aa, Mycobacterium
HRARTARVS

SEQ ID NO: 1098155 - protein, 5 aa, Mycobacterium
HRGDA

SEQ ID NO: 1098156 - protein, 7 aa, Mycobacterium
HRGGRRD

SEQ ID NO: 1098157 - protein, 7 aa, Mycobacterium
HRKTQRE

SEQ ID NO: 1098158 - protein, 10 aa, Mycobacterium
HRNPEPGPWD

SEQ ID NO: 1098159 - protein, 14 aa, Mycobacterium
HRPPPPRRTFSSGQ

SEQ ID NO: 1098160 - protein, 4 aa, Mycobacterium
HRRR

SEQ ID NO: 1098161 - protein, 8 aa, Mycobacterium
HRSAARAA

SEQ ID NO: 1098162 - protein, 4 aa, Mycobacterium
HRSR

SEQ ID NO: 1098163 - protein, 4 aa, Mycobacterium
HRTD

SEQ ID NO: 1098164 - protein, 7 aa, Mycobacterium
HSATPRD

SEQ ID NO: 1098165 - protein, 4 aa, Mycobacterium
HSAV

SEQ ID NO: 1098166 - protein, 8 aa, Mycobacterium
HSDQGRQF

SEQ ID NO: 1098167 - protein, 8 aa, Mycobacterium
HSEPGPPV

SEQ ID NO: 1098168 - protein, 6 aa, Mycobacterium
HSGTIE

SEQ ID NO: 1098169 - protein, 7 aa, Mycobacterium
HSPNRER

SEQ ID NO: 1098170 - protein, 4 aa, Mycobacterium
HSPR

SEQ ID NO: 1098171 - protein, 8 aa, Mycobacterium
HSSRSRRG

SEQ ID NO: 1098172 - protein, 8 aa, Mycobacterium
HSSSHQPK

SEQ ID NO: 1098173 - protein, 5 aa, Mycobacterium
HSTGE

SEQ ID NO: 1098174 - protein, 7 aa, Mycobacterium
HSTGTRD

SEQ ID NO: 1098175 - protein, 11 aa, Mycobacterium
HSTNASYATRL

SEQ ID NO: 1098176 - protein, 4 aa, Mycobacterium
HSVG

SEQ ID NO: 1098177 - protein, 9 aa, Mycobacterium
HTDPGQIGG

SEQ ID NO: 1098178 - protein, 14 aa, Mycobacterium
HTEVADTGRNRALA

SEQ ID NO: 1098179 - protein, 5 aa, Mycobacterium
HTGNG

SEQ ID NO: 1098180 - protein, 14 aa, Mycobacterium
HTKAAAEDRKRGSG

SEQ ID NO: 1098181 - protein, 13 aa, Mycobacterium
HTNADAARDGRNT

SEQ ID NO: 1098182 - protein, 13 aa, Mycobacterium
HTNTPGSRNAKRW

SEQ ID NO: 1098183 - protein, 7 aa, Mycobacterium
HTPAGTT

SEQ ID NO: 1098184 - protein, 7 aa, Mycobacterium
HTPEGGR

SEQ ID NO: 1098185 - protein, 7 aa, Mycobacterium
HTPTTSE

SEQ ID NO: 1098186 - protein, 5 aa, Mycobacterium
HTRGD

SEQ ID NO: 1098187 - protein, 4 aa, Mycobacterium
HTSA

SEQ ID NO: 1098188 - protein, 11 aa, Mycobacterium
HTTAREKEVQK

SEQ ID NO: 1098189 - protein, 9 aa, Mycobacterium
HVPGQPDPL

SEQ ID NO: 1098190 - protein, 8 aa, Mycobacterium
HVPSPAVD

SEQ ID NO: 1098191 - protein, 9 aa, Mycobacterium
IADRPRPAT

SEQ ID NO: 1098192 - protein, 9 aa, Mycobacterium
IAEAQDRGD

SEQ ID NO: 1098193 - protein, 4 aa, Mycobacterium
IAGD

SEQ ID NO: 1098194 - protein, 5 aa, Mycobacterium
IAGDS

SEQ ID NO: 1098195 - protein, 10 aa, Mycobacterium
IAGSEAARAG

SEQ ID NO: 1098196 - protein, 5 aa, Mycobacterium
IAGTG

SEQ ID NO: 1098197 - protein, 8 aa, Mycobacterium
IAPPGTTA

SEQ ID NO: 1098198 - protein, 9 aa, Mycobacterium
IATGAPRED

SEQ ID NO: 1098199 - protein, 5 aa, Mycobacterium
IATSP

SEQ ID NO: 1098200 - protein, 6 aa, Mycobacterium
IDAARD

SEQ ID NO: 1098201 - protein, 21 aa, Mycobacterium
IDEGPGRVGPDSRNATFSAAD

SEQ ID NO: 1098202 - protein, 6 aa, Mycobacterium
IDETGL

SEQ ID NO: 1098203 - protein, 5 aa, Mycobacterium
IDGAN

SEQ ID NO: 1098204 - protein, 11 aa, Mycobacterium
IDGEEPGEFRD

SEQ ID NO: 1098205 - protein, 9 aa, Mycobacterium
IDNPDQRIQ

SEQ ID NO: 1098206 - protein, 8 aa, Mycobacterium
IDPATSLA

SEQ ID NO: 1098207 - protein, 6 aa, Mycobacterium
IDPKPV

SEQ ID NO: 1098208 - protein, 18 aa, Mycobacterium
IDTQQGGVDLAGEGSNEE

SEQ ID NO: 1098209 - protein, 6 aa, Mycobacterium
IEAGPV

SEQ ID NO: 1098210 - protein, 5 aa, Mycobacterium
IEEGS

SEQ ID NO: 1098211 - protein, 9 aa, Mycobacterium
IEPGENGQT

SEQ ID NO: 1098212 - protein, 13 aa, Mycobacterium
IEPKGEEKPAADD

SEQ ID NO: 1098213 - protein, 7 aa, Mycobacterium
IEPPPEL

SEQ ID NO: 1098214 - protein, 6 aa, Mycobacterium
IEPSRQ

SEQ ID NO: 1098215 - protein, 7 aa, Mycobacterium
IERGGAG

SEQ ID NO: 1098216 - protein, 16 aa, Mycobacterium
IETAAKEAVKGTPLEG

SEQ ID NO: 1098217 - protein, 9 aa, Mycobacterium
IGAGTTAQL

SEQ ID NO: 1098218 - protein, 14 aa, Mycobacterium
IGANPEDPHGGPFD

SEQ ID NO: 1098219 - protein, 16 aa, Mycobacterium
IGAPGEHELGADSTMT

SEQ ID NO: 1098220 - protein, 8 aa, Mycobacterium
IGDLSSPL

SEQ ID NO: 1098221 - protein, 25 aa, Mycobacterium
IGEDGQPSEQAISDSAVSETWGGQI

SEQ ID NO: 1098222 - protein, 6 aa, Mycobacterium
IGEGTP

SEQ ID NO: 1098223 - protein, 5 aa, Mycobacterium
IGEPI

SEQ ID NO: 1098224 - protein, 6 aa, Mycobacterium
IGETGN

SEQ ID NO: 1098225 - protein, 12 aa, Mycobacterium
IGGGERDPETPI

SEQ ID NO: 1098226 - protein, 18 aa, Mycobacterium
IGGGNAAALAGASLRPGR

SEQ ID NO: 1098227 - protein, 5 aa, Mycobacterium
IGPEG

SEQ ID NO: 1098228 - protein, 4 aa, Mycobacterium
IGQE

SEQ ID NO: 1098229 - protein, 4 aa, Mycobacterium
IGRG

SEQ ID NO: 1098230 - protein, 5 aa, Mycobacterium
IGRGD

SEQ ID NO: 1098231 - protein, 6 aa, Mycobacterium
IGRGGG

SEQ ID NO: 1098232 - protein, 4 aa, Mycobacterium
IGRK

SEQ ID NO: 1098233 - protein, 8 aa, Mycobacterium
IGRPTRRD

SEQ ID NO: 1098234 - protein, 8 aa, Mycobacterium
IGRSGGEE

SEQ ID NO: 1098235 - protein, 21 aa, Mycobacterium
IGSDDAAMETVSSKAAALPRH

SEQ ID NO: 1098236 - protein, 11 aa, Mycobacterium
IGSSRDETATP

SEQ ID NO: 1098237 - protein, 4 aa, Mycobacterium
IGTS

SEQ ID NO: 1098238 - protein, 11 aa, Mycobacterium
IKPDDDDRGAD

SEQ ID NO: 1098239 - protein, 10 aa, Mycobacterium
IKPKSEISPE

SEQ ID NO: 1098240 - protein, 9 aa, Mycobacterium
IKQTGEQGA

SEQ ID NO: 1098241 - protein, 7 aa, Mycobacterium
INAQTEK

SEQ ID NO: 1098242 - protein, 4 aa, Mycobacterium
INDG

SEQ ID NO: 1098243 - protein, 11 aa, Mycobacterium
INDNGQPSNFS

SEQ ID NO: 1098244 - protein, 10 aa, Mycobacterium
INHGNSGGPL

SEQ ID NO: 1098245 - protein, 8 aa, Mycobacterium
INKTGDTR

SEQ ID NO: 1098246 - protein, 15 aa, Mycobacterium
INQPDPTPKVAEGAA

SEQ ID NO: 1098247 - protein, 16 aa, Mycobacterium
INSDNVKSAQIDDREQ

SEQ ID NO: 1098248 - protein, 19 aa, Mycobacterium
IPAAEGSALGGRVAGTQPA

SEQ ID NO: 1098249 - protein, 13 aa, Mycobacterium
IPAPSGAAVATTA

SEQ ID NO: 1098250 - protein, 6 aa, Mycobacterium
IPARGG

SEQ ID NO: 1098251 - protein, 8 aa, Mycobacterium
IPATVAGS

SEQ ID NO: 1098252 - protein, 12 aa, Mycobacterium
IPDAKRYLKMRR

SEQ ID NO: 1098253 - protein, 12 aa, Mycobacterium
IPITTSGKVRRA

SEQ ID NO: 1098254 - protein, 15 aa, Mycobacterium
IPPAESGEGGTGTEQ

SEQ ID NO: 1098255 - protein, 6 aa, Mycobacterium
IPPSGI

SEQ ID NO: 1098256 - protein, 11 aa, Mycobacterium
IPSANGVATAR

SEQ ID NO: 1098257 - protein, 6 aa, Mycobacterium
IPSDRI

SEQ ID NO: 1098258 - protein, 8 aa, Mycobacterium
IPTFGDET

SEQ ID NO: 1098259 - protein, 16 aa, Mycobacterium
IQPAEGGGTYPGDEQL

SEQ ID NO: 1098260 - protein, 13 aa, Mycobacterium
IRAQSASLGHADE

SEQ ID NO: 1098261 - protein, 4 aa, Mycobacterium
IRDC

SEQ ID NO: 1098262 - protein, 13 aa, Mycobacterium
IRDGEIGDGPGRL

SEQ ID NO: 1098263 - protein, 17 aa, Mycobacterium
IRESGGDRSAVTGGTTV

SEQ ID NO: 1098264 - protein, 29 aa, Mycobacterium
IRGPQKTIESVKETREALTPGHDKAPKAV

SEQ ID NO: 1098265 - protein, 12 aa, Mycobacterium
IRGTDPLTAAPG

SEQ ID NO: 1098266 - protein, 7 aa, Mycobacterium
IRSDNPA

SEQ ID NO: 1098267 - protein, 9 aa, Mycobacterium
IRSPTDEAI

SEQ ID NO: 1098268 - protein, 5 aa, Mycobacterium
ISASS

SEQ ID NO: 1098269 - protein, 9 aa, Mycobacterium
ISATPAGVL

SEQ ID NO: 1098270 - protein, 13 aa, Mycobacterium
ISDNVGNKEPQTV

SEQ ID NO: 1098271 - protein, 4 aa, Mycobacterium
ISDP

SEQ ID NO: 1098272 - protein, 8 aa, Mycobacterium
ISETPGVV

SEQ ID NO: 1098273 - protein, 7 aa, Mycobacterium
ISGESLA

SEQ ID NO: 1098274 - protein, 17 aa, Mycobacterium
ISGGVEAAPLPPQPQLA

SEQ ID NO: 1098275 - protein, 7 aa, Mycobacterium
ISPDGHS

SEQ ID NO: 1098276 - protein, 15 aa, Mycobacterium
ISPNPQQPPPQPDRP

SEQ ID NO: 1098277 - protein, 12 aa, Mycobacterium
ISPPPPPGTPPQ

SEQ ID NO: 1098278 - protein, 18 aa, Mycobacterium
ISTTDSRSARGAGAESLK

SEQ ID NO: 1098279 - protein, 9 aa, Mycobacterium
ISVDGDSRT

SEQ ID NO: 1098280 - protein, 4 aa, Mycobacterium
ITAG

SEQ ID NO: 1098281 - protein, 20 aa, Mycobacterium
ITARGGTGQISAAPSGPRAR

SEQ ID NO: 1098282 - protein, 12 aa, Mycobacterium
ITDGQKTGDPSG

SEQ ID NO: 1098283 - protein, 5 aa, Mycobacterium
ITDGR

SEQ ID NO: 1098284 - protein, 18 aa, Mycobacterium
ITDTHSDKTRESLGQGAA

SEQ ID NO: 1098285 - protein, 5 aa, Mycobacterium
ITGDS

SEQ ID NO: 1098286 - protein, 16 aa, Mycobacterium
ITGESVPVEAGPGDEV

SEQ ID NO: 1098287 - protein, 5 aa, Mycobacterium
ITLTP

SEQ ID NO: 1098288 - protein, 8 aa, Mycobacterium
ITPGGAAD

SEQ ID NO: 1098289 - protein, 4 aa, Mycobacterium
ITQQ

SEQ ID NO: 1098290 - protein, 6 aa, Mycobacterium
ITRGGA

SEQ ID NO: 1098291 - protein, 5 aa, Mycobacterium
ITRGQ

SEQ ID NO: 1098292 - protein, 12 aa, Mycobacterium
ITRPDGKPISNT

SEQ ID NO: 1098293 - protein, 14 aa, Mycobacterium
ITRPQGKPLENATI

SEQ ID NO: 1098294 - protein, 6 aa, Mycobacterium
ITTQTQ

SEQ ID NO: 1098295 - protein, 20 aa, Mycobacterium
ITTSDGTVLSSNTGNAAQTS

SEQ ID NO: 1098296 - protein, 27 aa, Mycobacterium
ITTTTPPPPPPPPPTTEPPPPPPPETV

SEQ ID NO: 1098297 - protein, 5 aa, Mycobacterium
KAAEL

SEQ ID NO: 1098298 - protein, 5 aa, Mycobacterium
KAATL

SEQ ID NO: 1098299 - protein, 7 aa, Mycobacterium
KAATRRY

SEQ ID NO: 1098300 - protein, 5 aa, Mycobacterium
KAAVA

SEQ ID NO: 1098301 - protein, 11 aa, Mycobacterium
KAAVSSLRSDE

SEQ ID NO: 1098302 - protein, 6 aa, Mycobacterium
KADADL

SEQ ID NO: 1098303 - protein, 12 aa, Mycobacterium
KADAGSGPAGAY

SEQ ID NO: 1098304 - protein, 18 aa, Mycobacterium
KADEFTEANERNSGKNVG

SEQ ID NO: 1098305 - protein, 8 aa, Mycobacterium
KADGRLDR

SEQ ID NO: 1098306 - protein, 10 aa, Mycobacterium
KAEGGPDHRG

SEQ ID NO: 1098307 - protein, 5 aa, Mycobacterium
KAETE

SEQ ID NO: 1098308 - protein, 8 aa, Mycobacterium
KAGGAAHT

SEQ ID NO: 1098309 - protein, 15 aa, Mycobacterium
KAGLPPDSVGTELPR

SEQ ID NO: 1098310 - protein, 10 aa, Mycobacterium
KAGNPGVPDS

SEQ ID NO: 1098311 - protein, 5 aa, Mycobacterium
KAPCT

SEQ ID NO: 1098312 - protein, 14 aa, Mycobacterium
KAQAADGLEGETPQ

SEQ ID NO: 1098313 - protein, 19 aa, Mycobacterium
KATYQAGEVGGKLDEASTL

SEQ ID NO: 1098314 - protein, 9 aa, Mycobacterium
KAVEQSDGT

SEQ ID NO: 1098315 - protein, 16 aa, Mycobacterium
KAYDANYDGEEDVNGL

SEQ ID NO: 1098316 - protein, 8 aa, Mycobacterium
KDGAPVPF

SEQ ID NO: 1098317 - protein, 4 aa, Mycobacterium
KDGH

SEQ ID NO: 1098318 - protein, 31 aa, Mycobacterium
KDIDPDAPVKGAHKAGEPIRNQPPRSAREDL

SEQ ID NO: 1098319 - protein, 7 aa, Mycobacterium
KDLEPDK

SEQ ID NO: 1098320 - protein, 5 aa, Mycobacterium
KDLPP

SEQ ID NO: 1098321 - protein, 6 aa, Mycobacterium
KDPLGR

SEQ ID NO: 1098322 - protein, 5 aa, Mycobacterium
KDPSW

SEQ ID NO: 1098323 - protein, 124 aa, Mycobacterium
KDQPGTIPTTSGTPPTTSTGVATSTTVAPSTTAPSTSAPPTVSGTSQAPTTAGETAVETAAETATTDPSTASTSAPATAESSAPSEPTATSDPTADGTTSGDTSGATSGDTSADTGTSDGTATT

SEQ ID NO: 1098324 - protein, 6 aa, Mycobacterium
KDRKTG

SEQ ID NO: 1098325 - protein, 8 aa, Mycobacterium
KDRQRFAG

SEQ ID NO: 1098326 - protein, 8 aa, Mycobacterium
KDTAPQEY

SEQ ID NO: 1098327 - protein, 10 aa, Mycobacterium
KDVAGKDAFP

SEQ ID NO: 1098328 - protein, 7 aa, Mycobacterium
KEAAPPH

SEQ ID NO: 1098329 - protein, 6 aa, Mycobacterium
KEANDR

SEQ ID NO: 1098330 - protein, 8 aa, Mycobacterium
KEAQGLGV

SEQ ID NO: 1098331 - protein, 12 aa, Mycobacterium
KEGQAGQSKMTQ

SEQ ID NO: 1098332 - protein, 6 aa, Mycobacterium
KEKVRT

SEQ ID NO: 1098333 - protein, 4 aa, Mycobacterium
KENP

SEQ ID NO: 1098334 - protein, 6 aa, Mycobacterium
KENQPL

SEQ ID NO: 1098335 - protein, 7 aa, Mycobacterium
KEQAGGK

SEQ ID NO: 1098336 - protein, 5 aa, Mycobacterium
KERAV

SEQ ID NO: 1098337 - protein, 14 aa, Mycobacterium
KESGEVSTSPLKDA

SEQ ID NO: 1098338 - protein, 34 aa, Mycobacterium
KESPLENTPEGGLGEELRGEKESEKHSHDHVPES

SEQ ID NO: 1098339 - protein, 6 aa, Mycobacterium
KESQTL

SEQ ID NO: 1098340 - protein, 9 aa, Mycobacterium
KFPGNTESG

SEQ ID NO: 1098341 - protein, 8 aa, Mycobacterium
KFTPAQAT

SEQ ID NO: 1098342 - protein, 10 aa, Mycobacterium
KGAAGVTGAG

SEQ ID NO: 1098343 - protein, 14 aa, Mycobacterium
KGGDVQNSGQRTNA

SEQ ID NO: 1098344 - protein, 6 aa, Mycobacterium
KGGMEL

SEQ ID NO: 1098345 - protein, 6 aa, Mycobacterium
KGLHEP

SEQ ID NO: 1098346 - protein, 9 aa, Mycobacterium
KGLRGAPRD

SEQ ID NO: 1098347 - protein, 5 aa, Mycobacterium
KGPGL

SEQ ID NO: 1098348 - protein, 8 aa, Mycobacterium
KGPHPASY

SEQ ID NO: 1098349 - protein, 6 aa, Mycobacterium
KGRSTF

SEQ ID NO: 1098350 - protein, 6 aa, Mycobacterium
KGVPPA

SEQ ID NO: 1098351 - protein, 4 aa, Mycobacterium
KGVS

SEQ ID NO: 1098352 - protein, 7 aa, Mycobacterium
KHAGASQ

SEQ ID NO: 1098353 - protein, 7 aa, Mycobacterium
KHGDATQ

SEQ ID NO: 1098354 - protein, 7 aa, Mycobacterium
KHGGATR

SEQ ID NO: 1098355 - protein, 17 aa, Mycobacterium
KHHAESHAAGPEAEPTG

SEQ ID NO: 1098356 - protein, 17 aa, Mycobacterium
KHTARAGEKLSKARTDM

SEQ ID NO: 1098357 - protein, 10 aa, Mycobacterium
KHTPQNYSRD

SEQ ID NO: 1098358 - protein, 13 aa, Mycobacterium
KINRPRRENSPRT

SEQ ID NO: 1098359 - protein, 6 aa, Mycobacterium
KKAESL

SEQ ID NO: 1098360 - protein, 9 aa, Mycobacterium
KKASDTELP

SEQ ID NO: 1098361 - protein, 8 aa, Mycobacterium
KKDLPAST

SEQ ID NO: 1098362 - protein, 12 aa, Mycobacterium
KKMKRTARRPLA

SEQ ID NO: 1098363 - protein, 16 aa, Mycobacterium
KKQADEVTPAAPRTVE

SEQ ID NO: 1098364 - protein, 8 aa, Mycobacterium
KKYGKDRQ

SEQ ID NO: 1098365 - protein, 22 aa, Mycobacterium
KLDGAKGPLGAPMADQTENGDV

SEQ ID NO: 1098366 - protein, 7 aa, Mycobacterium
KLGPGQR

SEQ ID NO: 1098367 - protein, 13 aa, Mycobacterium
KLGSGGAPGSGSF

SEQ ID NO: 1098368 - protein, 17 aa, Mycobacterium
KLPPGSTIPKQNTQPAL

SEQ ID NO: 1098369 - protein, 9 aa, Mycobacterium
KLPPGTETV

SEQ ID NO: 1098370 - protein, 18 aa, Mycobacterium
KLSPGGFENPSAESSRAT

SEQ ID NO: 1098371 - protein, 8 aa, Mycobacterium
KLSPRGYY

SEQ ID NO: 1098372 - protein, 14 aa, Mycobacterium
KLSVPKPEQGGRGA

SEQ ID NO: 1098373 - protein, 16 aa, Mycobacterium
KMSDAFKGAEETNTSN

SEQ ID NO: 1098374 - protein, 4 aa, Mycobacterium
KNGL

SEQ ID NO: 1098375 - protein, 9 aa, Mycobacterium
KNIGGGLDQ

SEQ ID NO: 1098376 - protein, 14 aa, Mycobacterium
KNPAIRKPNNPREP

SEQ ID NO: 1098377 - protein, 16 aa, Mycobacterium
KNSGDGFQRGGGAGHG

SEQ ID NO: 1098378 - protein, 15 aa, Mycobacterium
KNTETNGKSRSASKE

SEQ ID NO: 1098379 - protein, 15 aa, Mycobacterium
KNTTTSRENDQIARS

SEQ ID NO: 1098380 - protein, 10 aa, Mycobacterium
KNVETAGGAH

SEQ ID NO: 1098381 - protein, 4 aa, Mycobacterium
KPAL

SEQ ID NO: 1098382 - protein, 5 aa, Mycobacterium
KPAVG

SEQ ID NO: 1098383 - protein, 31 aa, Mycobacterium
KPDTPDTALPPTAVPPTSVPSTGKPRPEFQD

SEQ ID NO: 1098384 - protein, 9 aa, Mycobacterium
KPEENQQRR

SEQ ID NO: 1098385 - protein, 7 aa, Mycobacterium
KPEQTEE

SEQ ID NO: 1098386 - protein, 4 aa, Mycobacterium
KPLP

SEQ ID NO: 1098387 - protein, 12 aa, Mycobacterium
KPNAAQKESEYI

SEQ ID NO: 1098388 - protein, 6 aa, Mycobacterium
KPPGLA

SEQ ID NO: 1098389 - protein, 8 aa, Mycobacterium
KPQVSNGG

SEQ ID NO: 1098390 - protein, 4 aa, Mycobacterium
KPRA

SEQ ID NO: 1098391 - protein, 12 aa, Mycobacterium
KPRDGGDFGTTE

SEQ ID NO: 1098392 - protein, 13 aa, Mycobacterium
KPRGATPPAAPQF

SEQ ID NO: 1098393 - protein, 6 aa, Mycobacterium
KPSEAS

SEQ ID NO: 1098394 - protein, 8 aa, Mycobacterium
KPSQQAGV

SEQ ID NO: 1098395 - protein, 9 aa, Mycobacterium
KPSRAGRNL

SEQ ID NO: 1098396 - protein, 7 aa, Mycobacterium
KPSSPMS

SEQ ID NO: 1098397 - protein, 11 aa, Mycobacterium
KPTSSVKDGKL

SEQ ID NO: 1098398 - protein, 6 aa, Mycobacterium
KPVAPR

SEQ ID NO: 1098399 - protein, 5 aa, Mycobacterium
KPVTA

SEQ ID NO: 1098400 - protein, 4 aa, Mycobacterium
KQAI

SEQ ID NO: 1098401 - protein, 11 aa, Mycobacterium
KQEGDAATDPP

SEQ ID NO: 1098402 - protein, 4 aa, Mycobacterium
KQGN

SEQ ID NO: 1098403 - protein, 8 aa, Mycobacterium
KQKKAGLD

SEQ ID NO: 1098404 - protein, 6 aa, Mycobacterium
KQMPPK

SEQ ID NO: 1098405 - protein, 9 aa, Mycobacterium
KQNQEEGQG

SEQ ID NO: 1098406 - protein, 7 aa, Mycobacterium
KQPEMAP

SEQ ID NO: 1098407 - protein, 6 aa, Mycobacterium
KQPTPP

SEQ ID NO: 1098408 - protein, 8 aa, Mycobacterium
KQRVSRAD

SEQ ID NO: 1098409 - protein, 5 aa, Mycobacterium
KQSDA

SEQ ID NO: 1098410 - protein, 15 aa, Mycobacterium
KRAAAAEAGPTPADQ

SEQ ID NO: 1098411 - protein, 16 aa, Mycobacterium
KRAGGNQFRHDDRSAC

SEQ ID NO: 1098412 - protein, 5 aa, Mycobacterium
KRFPG

SEQ ID NO: 1098413 - protein, 23 aa, Mycobacterium
KRGDSDRKMPSGGTIPVERTEPA

SEQ ID NO: 1098414 - protein, 9 aa, Mycobacterium
KRGDTDEDV

SEQ ID NO: 1098415 - protein, 7 aa, Mycobacterium
KRGEPVK

SEQ ID NO: 1098416 - protein, 22 aa, Mycobacterium
KRKAKREAAETVPEDEAAPIGG

SEQ ID NO: 1098417 - protein, 8 aa, Mycobacterium
KRKGQESF

SEQ ID NO: 1098418 - protein, 19 aa, Mycobacterium
KRKLERQLERRAEKARKRR

SEQ ID NO: 1098419 - protein, 7 aa, Mycobacterium
KRPSTAT

SEQ ID NO: 1098420 - protein, 6 aa, Mycobacterium
KRQDDK

SEQ ID NO: 1098421 - protein, 17 aa, Mycobacterium
KRRGGNQIQHAGDARTP

SEQ ID NO: 1098422 - protein, 8 aa, Mycobacterium
KRRNEKRH

SEQ ID NO: 1098423 - protein, 11 aa, Mycobacterium
KRRPPAGLTPA

SEQ ID NO: 1098424 - protein, 10 aa, Mycobacterium
KRSKRQAGAA

SEQ ID NO: 1098425 - protein, 7 aa, Mycobacterium
KRSPRRG

SEQ ID NO: 1098426 - protein, 7 aa, Mycobacterium
KRSQGKP

SEQ ID NO: 1098427 - protein, 7 aa, Mycobacterium
KRSRTEG

SEQ ID NO: 1098428 - protein, 9 aa, Mycobacterium
KRTGEDGRG

SEQ ID NO: 1098429 - protein, 5 aa, Mycobacterium
KRTPR

SEQ ID NO: 1098430 - protein, 6 aa, Mycobacterium
KSDEHG

SEQ ID NO: 1098431 - protein, 40 aa, Mycobacterium
KSDSSDTTASAQTPTPTSGAPAQPAADGGLPAFAPPAGLG

SEQ ID NO: 1098432 - protein, 7 aa, Mycobacterium
KSDSTTA

SEQ ID NO: 1098433 - protein, 12 aa, Mycobacterium
KSGNGETEDSDK

SEQ ID NO: 1098434 - protein, 5 aa, Mycobacterium
KSKDL

SEQ ID NO: 1098435 - protein, 10 aa, Mycobacterium
KSKSVGTITE

SEQ ID NO: 1098436 - protein, 6 aa, Mycobacterium
KSLGRS

SEQ ID NO: 1098437 - protein, 8 aa, Mycobacterium
KSMSTGGV

SEQ ID NO: 1098438 - protein, 7 aa, Mycobacterium
KSPETAR

SEQ ID NO: 1098439 - protein, 14 aa, Mycobacterium
KSPPEPPEDPDPSS

SEQ ID NO: 1098440 - protein, 40 aa, Mycobacterium
KSRAEAAERERAEQAARAAAAKREREERARTEKQRRIDTL

SEQ ID NO: 1098441 - protein, 8 aa, Mycobacterium
KSSAGDYD

SEQ ID NO: 1098442 - protein, 13 aa, Mycobacterium
KSSNAGAPEQPPR

SEQ ID NO: 1098443 - protein, 6 aa, Mycobacterium
KSSPTC

SEQ ID NO: 1098444 - protein, 14 aa, Mycobacterium
KSSSFTNSLADNNQ

SEQ ID NO: 1098445 - protein, 10 aa, Mycobacterium
KSVGPAPTLA

SEQ ID NO: 1098446 - protein, 7 aa, Mycobacterium
KSVRRGE

SEQ ID NO: 1098447 - protein, 6 aa, Mycobacterium
KSYAEG

SEQ ID NO: 1098448 - protein, 6 aa, Mycobacterium
KTAATA

SEQ ID NO: 1098449 - protein, 4 aa, Mycobacterium
KTAS

SEQ ID NO: 1098450 - protein, 9 aa, Mycobacterium
KTDGPTSVA

SEQ ID NO: 1098451 - protein, 23 aa, Mycobacterium
KTDTDQLATPATTTTTPPPPVQD

SEQ ID NO: 1098452 - protein, 13 aa, Mycobacterium
KTFRAQSSAPRSS

SEQ ID NO: 1098453 - protein, 6 aa, Mycobacterium
KTGAGR

SEQ ID NO: 1098454 - protein, 6 aa, Mycobacterium
KTGALS

SEQ ID NO: 1098455 - protein, 10 aa, Mycobacterium
KTGTLTANRP

SEQ ID NO: 1098456 - protein, 7 aa, Mycobacterium
KTHATNP

SEQ ID NO: 1098457 - protein, 5 aa, Mycobacterium
KTMTR

SEQ ID NO: 1098458 - protein, 6 aa, Mycobacterium
KTPAQM

SEQ ID NO: 1098459 - protein, 20 aa, Mycobacterium
KTPDEPRKRHGEDDDRADTD

SEQ ID NO: 1098460 - protein, 9 aa, Mycobacterium
KTTANDEGV

SEQ ID NO: 1098461 - protein, 5 aa, Mycobacterium
KTYGG

SEQ ID NO: 1098462 - protein, 12 aa, Mycobacterium
KVAAENATSNWS

SEQ ID NO: 1098463 - protein, 8 aa, Mycobacterium
KVGPATGL

SEQ ID NO: 1098464 - protein, 5 aa, Mycobacterium
KVGRK

SEQ ID NO: 1098465 - protein, 6 aa, Mycobacterium
KVGSGH

SEQ ID NO: 1098466 - protein, 6 aa, Mycobacterium
KVTSST

SEQ ID NO: 1098467 - protein, 10 aa, Mycobacterium
KWADTGNPAR

SEQ ID NO: 1098468 - protein, 10 aa, Mycobacterium
KYAAKGKTAT

SEQ ID NO: 1098469 - protein, 5 aa, Mycobacterium
KYPTG

SEQ ID NO: 1098470 - protein, 9 aa, Mycobacterium
LAAAAKNAG

SEQ ID NO: 1098471 - protein, 5 aa, Mycobacterium
LAAES

SEQ ID NO: 1098472 - protein, 8 aa, Mycobacterium
LAAGADRD

SEQ ID NO: 1098473 - protein, 4 aa, Mycobacterium
LAAP

SEQ ID NO: 1098474 - protein, 5 aa, Mycobacterium
LAARD

SEQ ID NO: 1098475 - protein, 4 aa, Mycobacterium
LAAS

SEQ ID NO: 1098476 - protein, 6 aa, Mycobacterium
LADGAG

SEQ ID NO: 1098477 - protein, 5 aa, Mycobacterium
LADGG

SEQ ID NO: 1098478 - protein, 7 aa, Mycobacterium
LADPDRA

SEQ ID NO: 1098479 - protein, 5 aa, Mycobacterium
LADQP

SEQ ID NO: 1098480 - protein, 15 aa, Mycobacterium
LADRAQTSELGTQPY

SEQ ID NO: 1098481 - protein, 5 aa, Mycobacterium
LADSF

SEQ ID NO: 1098482 - protein, 9 aa, Mycobacterium
LAENNNSAA

SEQ ID NO: 1098483 - protein, 8 aa, Mycobacterium
LAEPSDTE

SEQ ID NO: 1098484 - protein, 30 aa, Mycobacterium
LAGDATPPAAAQEVATPVAGGDGDAPRPQV

SEQ ID NO: 1098485 - protein, 8 aa, Mycobacterium
LAGDPDAV

SEQ ID NO: 1098486 - protein, 6 aa, Mycobacterium
LAGERT

SEQ ID NO: 1098487 - protein, 11 aa, Mycobacterium
LAGGSGEREKL

SEQ ID NO: 1098488 - protein, 9 aa, Mycobacterium
LAGNDDPNL

SEQ ID NO: 1098489 - protein, 14 aa, Mycobacterium
LAGNGIDARPSRSF

SEQ ID NO: 1098490 - protein, 12 aa, Mycobacterium
LAGPNPARPPSD

SEQ ID NO: 1098491 - protein, 7 aa, Mycobacterium
LAGQTGG

SEQ ID NO: 1098492 - protein, 4 aa, Mycobacterium
LAGR

SEQ ID NO: 1098493 - protein, 4 aa, Mycobacterium
LAGV

SEQ ID NO: 1098494 - protein, 9 aa, Mycobacterium
LAKRTGHDV

SEQ ID NO: 1098495 - protein, 10 aa, Mycobacterium
LANPKSWTHN

SEQ ID NO: 1098496 - protein, 17 aa, Mycobacterium
LAPARSEPALRDAERQL

SEQ ID NO: 1098497 - protein, 12 aa, Mycobacterium
LAPCGSPSAGQV

SEQ ID NO: 1098498 - protein, 5 aa, Mycobacterium
LAPDD

SEQ ID NO: 1098499 - protein, 7 aa, Mycobacterium
LAPEDRP

SEQ ID NO: 1098500 - protein, 10 aa, Mycobacterium
LAPEPGDNQA

SEQ ID NO: 1098501 - protein, 6 aa, Mycobacterium
LAPHGI

SEQ ID NO: 1098502 - protein, 7 aa, Mycobacterium
LAPPGAG

SEQ ID NO: 1098503 - protein, 12 aa, Mycobacterium
LAPSRSAAAPRS

SEQ ID NO: 1098504 - protein, 6 aa, Mycobacterium
LAPTGQ

SEQ ID NO: 1098505 - protein, 18 aa, Mycobacterium
LAQGKESFGAAKNPDQMN

SEQ ID NO: 1098506 - protein, 16 aa, Mycobacterium
LARRTETAAATATGGL

SEQ ID NO: 1098507 - protein, 5 aa, Mycobacterium
LASPR

SEQ ID NO: 1098508 - protein, 8 aa, Mycobacterium
LASTSVGA

SEQ ID NO: 1098509 - protein, 11 aa, Mycobacterium
LATPDADGELG

SEQ ID NO: 1098510 - protein, 8 aa, Mycobacterium
LATRTASQ

SEQ ID NO: 1098511 - protein, 5 aa, Mycobacterium
LATTG

SEQ ID NO: 1098512 - protein, 13 aa, Mycobacterium
LDADGNPSLPGAS

SEQ ID NO: 1098513 - protein, 8 aa, Mycobacterium
LDAGYQTR

SEQ ID NO: 1098514 - protein, 10 aa, Mycobacterium
LDAPAHASAR

SEQ ID NO: 1098515 - protein, 8 aa, Mycobacterium
LDDDTPPK

SEQ ID NO: 1098516 - protein, 12 aa, Mycobacterium
LDDGSPGAATAA

SEQ ID NO: 1098517 - protein, 6 aa, Mycobacterium
LDDPGG

SEQ ID NO: 1098518 - protein, 5 aa, Mycobacterium
LDDPN

SEQ ID NO: 1098519 - protein, 8 aa, Mycobacterium
LDDRGRRR

SEQ ID NO: 1098520 - protein, 6 aa, Mycobacterium
LDEEKD

SEQ ID NO: 1098521 - protein, 5 aa, Mycobacterium
LDEHG

SEQ ID NO: 1098522 - protein, 9 aa, Mycobacterium
LDEPNGVQN

SEQ ID NO: 1098523 - protein, 24 aa, Mycobacterium
LDEPTPSGYQYDPPPGVGAGAGRV

SEQ ID NO: 1098524 - protein, 4 aa, Mycobacterium
LDES

SEQ ID NO: 1098525 - protein, 6 aa, Mycobacterium
LDGDGI

SEQ ID NO: 1098526 - protein, 8 aa, Mycobacterium
LDNGTSSL

SEQ ID NO: 1098527 - protein, 10 aa, Mycobacterium
LDPESSRSAR

SEQ ID NO: 1098528 - protein, 13 aa, Mycobacterium
LDPGIRPARKGRK

SEQ ID NO: 1098529 - protein, 90 aa, Mycobacterium
LDPHTPKAEDMQADGQDAGRQGGLGGGRHEDTRHGGPQQGATQYPGGAQQSGYNQQPGYSQQPGGTQQPGYPQQPGAGPDNGRTATDRPT

SEQ ID NO: 1098530 - protein, 4 aa, Mycobacterium
LDQA

SEQ ID NO: 1098531 - protein, 6 aa, Mycobacterium
LDQAGP

SEQ ID NO: 1098532 - protein, 9 aa, Mycobacterium
LDQESRDIV

SEQ ID NO: 1098533 - protein, 6 aa, Mycobacterium
LDRNSP

SEQ ID NO: 1098534 - protein, 6 aa, Mycobacterium
LDRSGP

SEQ ID NO: 1098535 - protein, 7 aa, Mycobacterium
LDSDRDR

SEQ ID NO: 1098536 - protein, 4 aa, Mycobacterium
LDSP

SEQ ID NO: 1098537 - protein, 31 aa, Mycobacterium
LDSPAEAQKGLRDVRQGADRLASGSRQVAGG

SEQ ID NO: 1098538 - protein, 12 aa, Mycobacterium
LDSPAQAPLPGD

SEQ ID NO: 1098539 - protein, 5 aa, Mycobacterium
LDTDT

SEQ ID NO: 1098540 - protein, 4 aa, Mycobacterium
LDTG

SEQ ID NO: 1098541 - protein, 15 aa, Mycobacterium
LEAATDQKTVSDSRT

SEQ ID NO: 1098542 - protein, 9 aa, Mycobacterium
LEASPDVAG

SEQ ID NO: 1098543 - protein, 7 aa, Mycobacterium
LEERTDV

SEQ ID NO: 1098544 - protein, 31 aa, Mycobacterium
LEESSTAANKVAQADQQHAKAVEEAKADARR

SEQ ID NO: 1098545 - protein, 11 aa, Mycobacterium
LENRNDAATKI

SEQ ID NO: 1098546 - protein, 5 aa, Mycobacterium
LEPEG

SEQ ID NO: 1098547 - protein, 6 aa, Mycobacterium
LEPPQN

SEQ ID NO: 1098548 - protein, 5 aa, Mycobacterium
LEPTT

SEQ ID NO: 1098549 - protein, 13 aa, Mycobacterium
LERRKKEAEEALQ

SEQ ID NO: 1098550 - protein, 6 aa, Mycobacterium
LERRTG

SEQ ID NO: 1098551 - protein, 9 aa, Mycobacterium
LESHSRDTA

SEQ ID NO: 1098552 - protein, 6 aa, Mycobacterium
LESTRK

SEQ ID NO: 1098553 - protein, 16 aa, Mycobacterium
LETEPVPAPPAPPPDL

SEQ ID NO: 1098554 - protein, 12 aa, Mycobacterium
LGAAASQAIKTD

SEQ ID NO: 1098555 - protein, 6 aa, Mycobacterium
LGAGRV

SEQ ID NO: 1098556 - protein, 19 aa, Mycobacterium
LGAGSAQGFSPNGIPSDIS

SEQ ID NO: 1098557 - protein, 7 aa, Mycobacterium
LGAPGQP

SEQ ID NO: 1098558 - protein, 18 aa, Mycobacterium
LGAQNTSQHLASAASAPV

SEQ ID NO: 1098559 - protein, 6 aa, Mycobacterium
LGARPS

SEQ ID NO: 1098560 - protein, 4 aa, Mycobacterium
LGAS

SEQ ID NO: 1098561 - protein, 7 aa, Mycobacterium
LGASPTR

SEQ ID NO: 1098562 - protein, 6 aa, Mycobacterium
LGAVGG

SEQ ID NO: 1098563 - protein, 9 aa, Mycobacterium
LGDAPDVPG

SEQ ID NO: 1098564 - protein, 7 aa, Mycobacterium
LGDPADS

SEQ ID NO: 1098565 - protein, 8 aa, Mycobacterium
LGDSYSDD

SEQ ID NO: 1098566 - protein, 20 aa, Mycobacterium
LGDTDSDYARTARAKGLSEG

SEQ ID NO: 1098567 - protein, 9 aa, Mycobacterium
LGEGPDDLA

SEQ ID NO: 1098568 - protein, 6 aa, Mycobacterium
LGGDDR

SEQ ID NO: 1098569 - protein, 5 aa, Mycobacterium
LGGGD

SEQ ID NO: 1098570 - protein, 5 aa, Mycobacterium
LGGSA

SEQ ID NO: 1098571 - protein, 8 aa, Mycobacterium
LGGSTDLP

SEQ ID NO: 1098572 - protein, 4 aa, Mycobacterium
LGHR

SEQ ID NO: 1098573 - protein, 7 aa, Mycobacterium
LGHSAGN

SEQ ID NO: 1098574 - protein, 7 aa, Mycobacterium
LGKPPES

SEQ ID NO: 1098575 - protein, 8 aa, Mycobacterium
LGKRGGDQ

SEQ ID NO: 1098576 - protein, 6 aa, Mycobacterium
LGNRGF

SEQ ID NO: 1098577 - protein, 5 aa, Mycobacterium
LGPAA

SEQ ID NO: 1098578 - protein, 10 aa, Mycobacterium
LGPDPDGEGD

SEQ ID NO: 1098579 - protein, 5 aa, Mycobacterium
LGPER

SEQ ID NO: 1098580 - protein, 10 aa, Mycobacterium
LGPGRAAGTA

SEQ ID NO: 1098581 - protein, 5 aa, Mycobacterium
LGPPR

SEQ ID NO: 1098582 - protein, 14 aa, Mycobacterium
LGPPSERTARTGPA

SEQ ID NO: 1098583 - protein, 7 aa, Mycobacterium
LGPRGTT

SEQ ID NO: 1098584 - protein, 8 aa, Mycobacterium
LGPSNTAP

SEQ ID NO: 1098585 - protein, 9 aa, Mycobacterium
LGQAEAARS

SEQ ID NO: 1098586 - protein, 5 aa, Mycobacterium
LGQAP

SEQ ID NO: 1098587 - protein, 12 aa, Mycobacterium
LGQGGTVSGSTL

SEQ ID NO: 1098588 - protein, 10 aa, Mycobacterium
LGRDDEEPEF

SEQ ID NO: 1098589 - protein, 14 aa, Mycobacterium
LGRDEADIGESPAA

SEQ ID NO: 1098590 - protein, 12 aa, Mycobacterium
LGRPPERSGIDR

SEQ ID NO: 1098591 - protein, 7 aa, Mycobacterium
LGSDRDD

SEQ ID NO: 1098592 - protein, 7 aa, Mycobacterium
LGSPTSR

SEQ ID NO: 1098593 - protein, 16 aa, Mycobacterium
LGSTTRSGLWSPAPLR

SEQ ID NO: 1098594 - protein, 13 aa, Mycobacterium
LGTGEDDSTPAFD

SEQ ID NO: 1098595 - protein, 12 aa, Mycobacterium
LGTGSAGADTAT

SEQ ID NO: 1098596 - protein, 4 aa, Mycobacterium
LGTP

SEQ ID NO: 1098597 - protein, 9 aa, Mycobacterium
LGTTSTGTI

SEQ ID NO: 1098598 - protein, 5 aa, Mycobacterium
LGVSG

SEQ ID NO: 1098599 - protein, 8 aa, Mycobacterium
LHDAPERS

SEQ ID NO: 1098600 - protein, 7 aa, Mycobacterium
LHKRATR

SEQ ID NO: 1098601 - protein, 11 aa, Mycobacterium
LHPDGDRTRVT

SEQ ID NO: 1098602 - protein, 4 aa, Mycobacterium
LHST

SEQ ID NO: 1098603 - protein, 12 aa, Mycobacterium
LKARAEAGDHAA

SEQ ID NO: 1098604 - protein, 8 aa, Mycobacterium
LKDEGDAT

SEQ ID NO: 1098605 - protein, 9 aa, Mycobacterium
LKGDTDDEI

SEQ ID NO: 1098606 - protein, 9 aa, Mycobacterium
LKPERPEKV

SEQ ID NO: 1098607 - protein, 11 aa, Mycobacterium
LKPGKDTVAGL

SEQ ID NO: 1098608 - protein, 5 aa, Mycobacterium
LKQGK

SEQ ID NO: 1098609 - protein, 8 aa, Mycobacterium
LKYPDAEN

SEQ ID NO: 1098610 - protein, 11 aa, Mycobacterium
LNADPAAGPEV

SEQ ID NO: 1098611 - protein, 20 aa, Mycobacterium
LNAPTTSEEAEGGSTAPGNV

SEQ ID NO: 1098612 - protein, 7 aa, Mycobacterium
LNASPSQ

SEQ ID NO: 1098613 - protein, 9 aa, Mycobacterium
LNDSHGHAI

SEQ ID NO: 1098614 - protein, 11 aa, Mycobacterium
LNDTQGHAAGD

SEQ ID NO: 1098615 - protein, 4 aa, Mycobacterium
LNPE

SEQ ID NO: 1098616 - protein, 6 aa, Mycobacterium
LNPPTA

SEQ ID NO: 1098617 - protein, 9 aa, Mycobacterium
LNSADGIRA

SEQ ID NO: 1098618 - protein, 28 aa, Mycobacterium
LPAAPAAEVKPKRKKAAQEKKPVEDQDT

SEQ ID NO: 1098619 - protein, 5 aa, Mycobacterium
LPAGA

SEQ ID NO: 1098620 - protein, 6 aa, Mycobacterium
LPAGSR

SEQ ID NO: 1098621 - protein, 9 aa, Mycobacterium
LPANEGYAA

SEQ ID NO: 1098622 - protein, 24 aa, Mycobacterium
LPANPNPRKVGEDGPVAGARPGGS

SEQ ID NO: 1098623 - protein, 5 aa, Mycobacterium
LPANS

SEQ ID NO: 1098624 - protein, 6 aa, Mycobacterium
LPAPGF

SEQ ID NO: 1098625 - protein, 5 aa, Mycobacterium
LPDEP

SEQ ID NO: 1098626 - protein, 8 aa, Mycobacterium
LPDERKRP

SEQ ID NO: 1098627 - protein, 6 aa, Mycobacterium
LPDGDT

SEQ ID NO: 1098628 - protein, 4 aa, Mycobacterium
LPDH

SEQ ID NO: 1098629 - protein, 7 aa, Mycobacterium
LPEETES

SEQ ID NO: 1098630 - protein, 11 aa, Mycobacterium
LPEGAEPGSQW

SEQ ID NO: 1098631 - protein, 4 aa, Mycobacterium
LPET

SEQ ID NO: 1098632 - protein, 4 aa, Mycobacterium
LPGA

SEQ ID NO: 1098633 - protein, 5 aa, Mycobacterium
LPGAD

SEQ ID NO: 1098634 - protein, 9 aa, Mycobacterium
LPGETNTYP

SEQ ID NO: 1098635 - protein, 7 aa, Mycobacterium
LPGGSLD

SEQ ID NO: 1098636 - protein, 6 aa, Mycobacterium
LPGRTR

SEQ ID NO: 1098637 - protein, 7 aa, Mycobacterium
LPGSAPR

SEQ ID NO: 1098638 - protein, 6 aa, Mycobacterium
LPGTFG

SEQ ID NO: 1098639 - protein, 6 aa, Mycobacterium
LPGTGG

SEQ ID NO: 1098640 - protein, 4 aa, Mycobacterium
LPKR

SEQ ID NO: 1098641 - protein, 10 aa, Mycobacterium
LPKTKPKACN

SEQ ID NO: 1098642 - protein, 9 aa, Mycobacterium
LPKTPSRKT

SEQ ID NO: 1098643 - protein, 4 aa, Mycobacterium
LPLP

SEQ ID NO: 1098644 - protein, 11 aa, Mycobacterium
LPPDPVVPTRD

SEQ ID NO: 1098645 - protein, 11 aa, Mycobacterium
LPPDTTREDRE

SEQ ID NO: 1098646 - protein, 6 aa, Mycobacterium
LPPEKS

SEQ ID NO: 1098647 - protein, 58 aa, Mycobacterium
LPPELPSSTPPSPSETSSTRGRSTTQEEESEESEEESSPRTTTRNRPRLNETRTLYPR

SEQ ID NO: 1098648 - protein, 18 aa, Mycobacterium
LPPGWKPGSKAAPAPELP

SEQ ID NO: 1098649 - protein, 15 aa, Mycobacterium
LPPPPPQPGTTCRAA

SEQ ID NO: 1098650 - protein, 7 aa, Mycobacterium
LPPRDTR

SEQ ID NO: 1098651 - protein, 5 aa, Mycobacterium
LPPTT

SEQ ID NO: 1098652 - protein, 12 aa, Mycobacterium
LPQSASAHEVGD

SEQ ID NO: 1098653 - protein, 13 aa, Mycobacterium
LPQSSSARQVGDE

SEQ ID NO: 1098654 - protein, 4 aa, Mycobacterium
LPRA

SEQ ID NO: 1098655 - protein, 4 aa, Mycobacterium
LPRE

SEQ ID NO: 1098656 - protein, 13 aa, Mycobacterium
LPRRPSGRIERDA

SEQ ID NO: 1098657 - protein, 8 aa, Mycobacterium
LPRSGGLY

SEQ ID NO: 1098658 - protein, 6 aa, Mycobacterium
LPRTGA

SEQ ID NO: 1098659 - protein, 9 aa, Mycobacterium
LPSLSEPRD

SEQ ID NO: 1098660 - protein, 16 aa, Mycobacterium
LPTADGDASIAGTSYA

SEQ ID NO: 1098661 - protein, 7 aa, Mycobacterium
LPTATSG

SEQ ID NO: 1098662 - protein, 15 aa, Mycobacterium
LPVSNAEQYPADAAT

SEQ ID NO: 1098663 - protein, 6 aa, Mycobacterium
LQADGV

SEQ ID NO: 1098664 - protein, 6 aa, Mycobacterium
LQAESA

SEQ ID NO: 1098665 - protein, 8 aa, Mycobacterium
LQAQGAGQ

SEQ ID NO: 1098666 - protein, 7 aa, Mycobacterium
LQAQGVS

SEQ ID NO: 1098667 - protein, 14 aa, Mycobacterium
LQGGGALGSAVTPG

SEQ ID NO: 1098668 - protein, 13 aa, Mycobacterium
LQGMSDTDTLEGA

SEQ ID NO: 1098669 - protein, 10 aa, Mycobacterium
LQGVQDRGPS

SEQ ID NO: 1098670 - protein, 4 aa, Mycobacterium
LQPA

SEQ ID NO: 1098671 - protein, 4 aa, Mycobacterium
LQPV

SEQ ID NO: 1098672 - protein, 6 aa, Mycobacterium
LQQPGV

SEQ ID NO: 1098673 - protein, 11 aa, Mycobacterium
LQSGGEVTPYT

SEQ ID NO: 1098674 - protein, 7 aa, Mycobacterium
LRDPARA

SEQ ID NO: 1098675 - protein, 12 aa, Mycobacterium
LREANRGALDDP

SEQ ID NO: 1098676 - protein, 6 aa, Mycobacterium
LRETTR

SEQ ID NO: 1098677 - protein, 9 aa, Mycobacterium
LRGNPDSAM

SEQ ID NO: 1098678 - protein, 4 aa, Mycobacterium
LRGP

SEQ ID NO: 1098679 - protein, 16 aa, Mycobacterium
LRNASRDAFRQARKDM

SEQ ID NO: 1098680 - protein, 6 aa, Mycobacterium
LRPEAA

SEQ ID NO: 1098681 - protein, 7 aa, Mycobacterium
LRPEDKA

SEQ ID NO: 1098682 - protein, 4 aa, Mycobacterium
LRPG

SEQ ID NO: 1098683 - protein, 6 aa, Mycobacterium
LRPPGG

SEQ ID NO: 1098684 - protein, 8 aa, Mycobacterium
LRPTERTR

SEQ ID NO: 1098685 - protein, 11 aa, Mycobacterium
LRRAPQADGRE

SEQ ID NO: 1098686 - protein, 4 aa, Mycobacterium
LRRS

SEQ ID NO: 1098687 - protein, 9 aa, Mycobacterium
LRSAAEEAV

SEQ ID NO: 1098688 - protein, 4 aa, Mycobacterium
LRSG

SEQ ID NO: 1098689 - protein, 16 aa, Mycobacterium
LRSPSGPGRDAVSRPF

SEQ ID NO: 1098690 - protein, 36 aa, Mycobacterium
LRSRPGKPAAPRAAKPARAPRRPKPPAAEDRVRGSR

SEQ ID NO: 1098691 - protein, 15 aa, Mycobacterium
LRTEREDARVAEQRA

SEQ ID NO: 1098692 - protein, 16 aa, Mycobacterium
LRTGPERTSAQDPEYG

SEQ ID NO: 1098693 - protein, 9 aa, Mycobacterium
LRTTGHGGW

SEQ ID NO: 1098694 - protein, 6 aa, Mycobacterium
LSAGES

SEQ ID NO: 1098695 - protein, 19 aa, Mycobacterium
LSAGGFQDPTSESARATQT

SEQ ID NO: 1098696 - protein, 15 aa, Mycobacterium
LSAGHAKRTETGTPL

SEQ ID NO: 1098697 - protein, 7 aa, Mycobacterium
LSAGSAM

SEQ ID NO: 1098698 - protein, 5 aa, Mycobacterium
LSATR

SEQ ID NO: 1098699 - protein, 8 aa, Mycobacterium
LSDDNPTL

SEQ ID NO: 1098700 - protein, 13 aa, Mycobacterium
LSEDGQGGPPNNG

SEQ ID NO: 1098701 - protein, 9 aa, Mycobacterium
LSEDQNNEV

SEQ ID NO: 1098702 - protein, 11 aa, Mycobacterium
LSEEHRRPGGL

SEQ ID NO: 1098703 - protein, 7 aa, Mycobacterium
LSEGSVR

SEQ ID NO: 1098704 - protein, 21 aa, Mycobacterium
LSESTAGKGAELAEKAHESGG

SEQ ID NO: 1098705 - protein, 18 aa, Mycobacterium
LSGAQQTIPGGPVASQEA

SEQ ID NO: 1098706 - protein, 8 aa, Mycobacterium
LSGKSGDA

SEQ ID NO: 1098707 - protein, 9 aa, Mycobacterium
LSKTEAQPI

SEQ ID NO: 1098708 - protein, 8 aa, Mycobacterium
LSMDPGAK

SEQ ID NO: 1098709 - protein, 16 aa, Mycobacterium
LSPEQARGEKVDARSD

SEQ ID NO: 1098710 - protein, 4 aa, Mycobacterium
LSPN

SEQ ID NO: 1098711 - protein, 7 aa, Mycobacterium
LSPPPGV

SEQ ID NO: 1098712 - protein, 6 aa, Mycobacterium
LSPPRG

SEQ ID NO: 1098713 - protein, 9 aa, Mycobacterium
LSPTASAEE

SEQ ID NO: 1098714 - protein, 7 aa, Mycobacterium
LSPTESA

SEQ ID NO: 1098715 - protein, 7 aa, Mycobacterium
LSQPYSV

SEQ ID NO: 1098716 - protein, 7 aa, Mycobacterium
LSQRGAT

SEQ ID NO: 1098717 - protein, 8 aa, Mycobacterium
LSRGSRVV

SEQ ID NO: 1098718 - protein, 9 aa, Mycobacterium
LSRPRRPRL

SEQ ID NO: 1098719 - protein, 17 aa, Mycobacterium
LSRSSDDDALVGRTGGE

SEQ ID NO: 1098720 - protein, 11 aa, Mycobacterium
LSRTETGLRAP

SEQ ID NO: 1098721 - protein, 11 aa, Mycobacterium
LSSATADSNEV

SEQ ID NO: 1098722 - protein, 6 aa, Mycobacterium
LSSGAG

SEQ ID NO: 1098723 - protein, 8 aa, Mycobacterium
LSSGSATT

SEQ ID NO: 1098724 - protein, 6 aa, Mycobacterium
LSSPGP

SEQ ID NO: 1098725 - protein, 5 aa, Mycobacterium
LSSSG

SEQ ID NO: 1098726 - protein, 9 aa, Mycobacterium
LSSTSGGAV

SEQ ID NO: 1098727 - protein, 8 aa, Mycobacterium
LSTEDAAP

SEQ ID NO: 1098728 - protein, 9 aa, Mycobacterium
LSVGGGPPY

SEQ ID NO: 1098729 - protein, 13 aa, Mycobacterium
LTAASGGRVPNPY

SEQ ID NO: 1098730 - protein, 5 aa, Mycobacterium
LTAEQ

SEQ ID NO: 1098731 - protein, 7 aa, Mycobacterium
LTAGSGA

SEQ ID NO: 1098732 - protein, 10 aa, Mycobacterium
LTATAEALDG

SEQ ID NO: 1098733 - protein, 12 aa, Mycobacterium
LTATAQALDGLG

SEQ ID NO: 1098734 - protein, 7 aa, Mycobacterium
LTATYDP

SEQ ID NO: 1098735 - protein, 10 aa, Mycobacterium
LTDDAGARPF

SEQ ID NO: 1098736 - protein, 4 aa, Mycobacterium
LTDG

SEQ ID NO: 1098737 - protein, 11 aa, Mycobacterium
LTDPQRYPPTE

SEQ ID NO: 1098738 - protein, 6 aa, Mycobacterium
LTEEAA

SEQ ID NO: 1098739 - protein, 6 aa, Mycobacterium
LTGDDA

SEQ ID NO: 1098740 - protein, 10 aa, Mycobacterium
LTGDEPGGLG

SEQ ID NO: 1098741 - protein, 10 aa, Mycobacterium
LTGGPSHGGT

SEQ ID NO: 1098742 - protein, 12 aa, Mycobacterium
LTGNGGAADNAE

SEQ ID NO: 1098743 - protein, 16 aa, Mycobacterium
LTGRENSDDVAAGRSK

SEQ ID NO: 1098744 - protein, 10 aa, Mycobacterium
LTKGDTRTPF

SEQ ID NO: 1098745 - protein, 11 aa, Mycobacterium
LTNSDGNHHPW

SEQ ID NO: 1098746 - protein, 6 aa, Mycobacterium
LTPPGA

SEQ ID NO: 1098747 - protein, 6 aa, Mycobacterium
LTPTHP

SEQ ID NO: 1098748 - protein, 10 aa, Mycobacterium
LTSPAQASTT

SEQ ID NO: 1098749 - protein, 11 aa, Mycobacterium
LTSPDDEDPTI

SEQ ID NO: 1098750 - protein, 6 aa, Mycobacterium
LTSRNT

SEQ ID NO: 1098751 - protein, 11 aa, Mycobacterium
LTSSDQPSLAA

SEQ ID NO: 1098752 - protein, 6 aa, Mycobacterium
LTSSGR

SEQ ID NO: 1098753 - protein, 5 aa, Mycobacterium
LTSSN

SEQ ID NO: 1098754 - protein, 7 aa, Mycobacterium
LTSTGAV

SEQ ID NO: 1098755 - protein, 11 aa, Mycobacterium
LTSTGQPSDFT

SEQ ID NO: 1098756 - protein, 6 aa, Mycobacterium
LTTGTE

SEQ ID NO: 1098757 - protein, 4 aa, Mycobacterium
LTTP

SEQ ID NO: 1098758 - protein, 7 aa, Mycobacterium
LTTTGRT

SEQ ID NO: 1098759 - protein, 5 aa, Mycobacterium
LYPGP

SEQ ID NO: 1098760 - protein, 6 aa, Mycobacterium
MADGVD

SEQ ID NO: 1098761 - protein, 11 aa, Mycobacterium
MAEETKDPVKT

SEQ ID NO: 1098762 - protein, 12 aa, Mycobacterium
MAKGPASPTLSA

SEQ ID NO: 1098763 - protein, 10 aa, Mycobacterium
MASAQDHVRT

SEQ ID NO: 1098764 - protein, 6 aa, Mycobacterium
MDDPAA

SEQ ID NO: 1098765 - protein, 7 aa, Mycobacterium
MDGAGPW

SEQ ID NO: 1098766 - protein, 16 aa, Mycobacterium
MDPAPLSSTPAQVAEA

SEQ ID NO: 1098767 - protein, 4 aa, Mycobacterium
METQ

SEQ ID NO: 1098768 - protein, 10 aa, Mycobacterium
METTDEEGRI

SEQ ID NO: 1098769 - protein, 7 aa, Mycobacterium
MGDEYRD

SEQ ID NO: 1098770 - protein, 9 aa, Mycobacterium
MGDSDKLQV

SEQ ID NO: 1098771 - protein, 13 aa, Mycobacterium
MGEETDDPRRNIP

SEQ ID NO: 1098772 - protein, 11 aa, Mycobacterium
MGGTEDNVGEA

SEQ ID NO: 1098773 - protein, 16 aa, Mycobacterium
MGPTAAPRSGDAGNLA

SEQ ID NO: 1098774 - protein, 9 aa, Mycobacterium
MGTSSDYSH

SEQ ID NO: 1098775 - protein, 5 aa, Mycobacterium
MHSGE

SEQ ID NO: 1098776 - protein, 17 aa, Mycobacterium
MKPEPSPLPPSVEVTPK

SEQ ID NO: 1098777 - protein, 8 aa, Mycobacterium
MNKARSER

SEQ ID NO: 1098778 - protein, 4 aa, Mycobacterium
MPAD

SEQ ID NO: 1098779 - protein, 11 aa, Mycobacterium
MPDATPEDDIR

SEQ ID NO: 1098780 - protein, 4 aa, Mycobacterium
MPER

SEQ ID NO: 1098781 - protein, 7 aa, Mycobacterium
MPHTGGA

SEQ ID NO: 1098782 - protein, 8 aa, Mycobacterium
MPKQPMEA

SEQ ID NO: 1098783 - protein, 4 aa, Mycobacterium
MPRD

SEQ ID NO: 1098784 - protein, 14 aa, Mycobacterium
MPTPRQMSAAASDD

SEQ ID NO: 1098785 - protein, 12 aa, Mycobacterium
MQADGSPRPVDR

SEQ ID NO: 1098786 - protein, 5 aa, Mycobacterium
MQEGN

SEQ ID NO: 1098787 - protein, 10 aa, Mycobacterium
MQNGTPEVTA

SEQ ID NO: 1098788 - protein, 7 aa, Mycobacterium
MRESERA

SEQ ID NO: 1098789 - protein, 31 aa, Mycobacterium
MRGGFGGGGFGPGSFGGSGGGGGGMFGGGGR

SEQ ID NO: 1098790 - protein, 8 aa, Mycobacterium
MSADSPVT

SEQ ID NO: 1098791 - protein, 9 aa, Mycobacterium
MSKAPNVAT

SEQ ID NO: 1098792 - protein, 7 aa, Mycobacterium
MSPNDAP

SEQ ID NO: 1098793 - protein, 17 aa, Mycobacterium
MSQPNPGSGGSAAKVGA

SEQ ID NO: 1098794 - protein, 14 aa, Mycobacterium
MSREPADRYASAEE

SEQ ID NO: 1098795 - protein, 4 aa, Mycobacterium
MSRS

SEQ ID NO: 1098796 - protein, 7 aa, Mycobacterium
MSTNQGN

SEQ ID NO: 1098797 - protein, 14 aa, Mycobacterium
MTASGSQSNDGKAA

SEQ ID NO: 1098798 - protein, 8 aa, Mycobacterium
MTDEQRKE

SEQ ID NO: 1098799 - protein, 9 aa, Mycobacterium
MTDPAQGAT

SEQ ID NO: 1098800 - protein, 9 aa, Mycobacterium
MTGRDGDDV

SEQ ID NO: 1098801 - protein, 9 aa, Mycobacterium
MTPANTEQS

SEQ ID NO: 1098802 - protein, 7 aa, Mycobacterium
NAAAEAL

SEQ ID NO: 1098803 - protein, 7 aa, Mycobacterium
NAAQSGV

SEQ ID NO: 1098804 - protein, 10 aa, Mycobacterium
NADATDDFTG

SEQ ID NO: 1098805 - protein, 9 aa, Mycobacterium
NAEARGTGG

SEQ ID NO: 1098806 - protein, 8 aa, Mycobacterium
NAEDPAAT

SEQ ID NO: 1098807 - protein, 16 aa, Mycobacterium
NAEGGAVTTEAGQVRA

SEQ ID NO: 1098808 - protein, 15 aa, Mycobacterium
NAEIPKSGEDPCFNG

SEQ ID NO: 1098809 - protein, 8 aa, Mycobacterium
NAEQQTTT

SEQ ID NO: 1098810 - protein, 12 aa, Mycobacterium
NAGAPVAGTDTK

SEQ ID NO: 1098811 - protein, 7 aa, Mycobacterium
NAGGGNI

SEQ ID NO: 1098812 - protein, 9 aa, Mycobacterium
NAGPNTNGS

SEQ ID NO: 1098813 - protein, 7 aa, Mycobacterium
NAGPTHQ

SEQ ID NO: 1098814 - protein, 5 aa, Mycobacterium
NAGPW

SEQ ID NO: 1098815 - protein, 6 aa, Mycobacterium
NANYDE

SEQ ID NO: 1098816 - protein, 7 aa, Mycobacterium
NAPEEPE

SEQ ID NO: 1098817 - protein, 12 aa, Mycobacterium
NAPRPPGFRADS

SEQ ID NO: 1098818 - protein, 7 aa, Mycobacterium
NAPTDAE

SEQ ID NO: 1098819 - protein, 9 aa, Mycobacterium
NAVREGNSA

SEQ ID NO: 1098820 - protein, 7 aa, Mycobacterium
NAVTTAD

SEQ ID NO: 1098821 - protein, 5 aa, Mycobacterium
NDAAH

SEQ ID NO: 1098822 - protein, 8 aa, Mycobacterium
NDDQATAY

SEQ ID NO: 1098823 - protein, 8 aa, Mycobacterium
NDDRTGAA

SEQ ID NO: 1098824 - protein, 5 aa, Mycobacterium
NDGNT

SEQ ID NO: 1098825 - protein, 9 aa, Mycobacterium
NDGPAPARQ

SEQ ID NO: 1098826 - protein, 7 aa, Mycobacterium
NDGPKSI

SEQ ID NO: 1098827 - protein, 8 aa, Mycobacterium
NDGSTDGT

SEQ ID NO: 1098828 - protein, 9 aa, Mycobacterium
NDPDGGANF

SEQ ID NO: 1098829 - protein, 9 aa, Mycobacterium
NDVPPPSSV

SEQ ID NO: 1098830 - protein, 5 aa, Mycobacterium
NEAPA

SEQ ID NO: 1098831 - protein, 10 aa, Mycobacterium
NEAPKTGLPD

SEQ ID NO: 1098832 - protein, 15 aa, Mycobacterium
NEATEGRSLPAADDA

SEQ ID NO: 1098833 - protein, 5 aa, Mycobacterium
NEEST

SEQ ID NO: 1098834 - protein, 6 aa, Mycobacterium
NEGAGD

SEQ ID NO: 1098835 - protein, 5 aa, Mycobacterium
NEHRE

SEQ ID NO: 1098836 - protein, 5 aa, Mycobacterium
NEPAP

SEQ ID NO: 1098837 - protein, 16 aa, Mycobacterium
NEYPTNQYQPDDPALG

SEQ ID NO: 1098838 - protein, 8 aa, Mycobacterium
NEYPTSQY

SEQ ID NO: 1098839 - protein, 8 aa, Mycobacterium
NFSGGQRQ

SEQ ID NO: 1098840 - protein, 7 aa, Mycobacterium
NGAGPDF

SEQ ID NO: 1098841 - protein, 29 aa, Mycobacterium
NGDGSAPAELTPKRRRAEPEPEPPAPETE

SEQ ID NO: 1098842 - protein, 6 aa, Mycobacterium
NGDPVT

SEQ ID NO: 1098843 - protein, 12 aa, Mycobacterium
NGEDYDPSTPDA

SEQ ID NO: 1098844 - protein, 6 aa, Mycobacterium
NGESGF

SEQ ID NO: 1098845 - protein, 6 aa, Mycobacterium
NGGNGY

SEQ ID NO: 1098846 - protein, 10 aa, Mycobacterium
NGGPAAPDAQ

SEQ ID NO: 1098847 - protein, 28 aa, Mycobacterium
NGGRDADESAPSAGGAVGTARTATRTPP

SEQ ID NO: 1098848 - protein, 9 aa, Mycobacterium
NGGRIDPRS

SEQ ID NO: 1098849 - protein, 8 aa, Mycobacterium
NGKPPTAS

SEQ ID NO: 1098850 - protein, 5 aa, Mycobacterium
NGLTA

SEQ ID NO: 1098851 - protein, 26 aa, Mycobacterium
NGPPPDQLATEDEPSNLGEPSKTSLR

SEQ ID NO: 1098852 - protein, 15 aa, Mycobacterium
NGRADTSERVLEYYS

SEQ ID NO: 1098853 - protein, 6 aa, Mycobacterium
NGSAVD

SEQ ID NO: 1098854 - protein, 5 aa, Mycobacterium
NGSPE

SEQ ID NO: 1098855 - protein, 9 aa, Mycobacterium
NGTATVDTL

SEQ ID NO: 1098856 - protein, 10 aa, Mycobacterium
NGTDPAPTLE

SEQ ID NO: 1098857 - protein, 10 aa, Mycobacterium
NGTGKTTTVG

SEQ ID NO: 1098858 - protein, 7 aa, Mycobacterium
NGTPAQE

SEQ ID NO: 1098859 - protein, 14 aa, Mycobacterium
NGVGSLGAPQLAGA

SEQ ID NO: 1098860 - protein, 25 aa, Mycobacterium
NGYDPAEVTAPATQAAFGGAADPVS

SEQ ID NO: 1098861 - protein, 9 aa, Mycobacterium
NHGGSGVSG

SEQ ID NO: 1098862 - protein, 6 aa, Mycobacterium
NHNGSA

SEQ ID NO: 1098863 - protein, 4 aa, Mycobacterium
NHPG

SEQ ID NO: 1098864 - protein, 7 aa, Mycobacterium
NHYPDDI

SEQ ID NO: 1098865 - protein, 5 aa, Mycobacterium
NIGGA

SEQ ID NO: 1098866 - protein, 17 aa, Mycobacterium
NIQSPGPWRRNATPQKV

SEQ ID NO: 1098867 - protein, 4 aa, Mycobacterium
NKAI

SEQ ID NO: 1098868 - protein, 4 aa, Mycobacterium
NKGL

SEQ ID NO: 1098869 - protein, 7 aa, Mycobacterium
NKPLDTG

SEQ ID NO: 1098870 - protein, 8 aa, Mycobacterium
NKTAETVQ

SEQ ID NO: 1098871 - protein, 6 aa, Mycobacterium
NKTAKT

SEQ ID NO: 1098872 - protein, 13 aa, Mycobacterium
NLDPGGPPSATYT

SEQ ID NO: 1098873 - protein, 6 aa, Mycobacterium
NLGEPA

SEQ ID NO: 1098874 - protein, 10 aa, Mycobacterium
NLPDTTEELA

SEQ ID NO: 1098875 - protein, 8 aa, Mycobacterium
NLPGDAQR

SEQ ID NO: 1098876 - protein, 9 aa, Mycobacterium
NMEDSAERL

SEQ ID NO: 1098877 - protein, 10 aa, Mycobacterium
NNPQPGTDYD

SEQ ID NO: 1098878 - protein, 21 aa, Mycobacterium
NNSPTKQGKHDEMAGGTQVVK

SEQ ID NO: 1098879 - protein, 6 aa, Mycobacterium
NNSSGY

SEQ ID NO: 1098880 - protein, 9 aa, Mycobacterium
NNTGATDVA

SEQ ID NO: 1098881 - protein, 31 aa, Mycobacterium
NNVTQSGFYDEGSQSVQASVAGDEVYGRDRT

SEQ ID NO: 1098882 - protein, 10 aa, Mycobacterium
NPAALERARN

SEQ ID NO: 1098883 - protein, 28 aa, Mycobacterium
NPAATGFTPYPPAAPRPPAKPQAKKNTA

SEQ ID NO: 1098884 - protein, 8 aa, Mycobacterium
NPAPDGKQ

SEQ ID NO: 1098885 - protein, 4 aa, Mycobacterium
NPDA

SEQ ID NO: 1098886 - protein, 9 aa, Mycobacterium
NPDERADEM

SEQ ID NO: 1098887 - protein, 8 aa, Mycobacterium
NPDGRVAR

SEQ ID NO: 1098888 - protein, 6 aa, Mycobacterium
NPDTPD

SEQ ID NO: 1098889 - protein, 8 aa, Mycobacterium
NPEDVNGL

SEQ ID NO: 1098890 - protein, 6 aa, Mycobacterium
NPESAG

SEQ ID NO: 1098891 - protein, 6 aa, Mycobacterium
NPFSPE

SEQ ID NO: 1098892 - protein, 7 aa, Mycobacterium
NPGISNA

SEQ ID NO: 1098893 - protein, 5 aa, Mycobacterium
NPGLE

SEQ ID NO: 1098894 - protein, 8 aa, Mycobacterium
NPGSPDER

SEQ ID NO: 1098895 - protein, 8 aa, Mycobacterium
NPGTPVAV

SEQ ID NO: 1098896 - protein, 6 aa, Mycobacterium
NPIGAP

SEQ ID NO: 1098897 - protein, 11 aa, Mycobacterium
NPMGDAPNEPG

SEQ ID NO: 1098898 - protein, 7 aa, Mycobacterium
NPPKISN

SEQ ID NO: 1098899 - protein, 11 aa, Mycobacterium
NPPPPPPDDAT

SEQ ID NO: 1098900 - protein, 7 aa, Mycobacterium
NPQAKGV

SEQ ID NO: 1098901 - protein, 5 aa, Mycobacterium
NPRKP

SEQ ID NO: 1098902 - protein, 9 aa, Mycobacterium
NPSATLGTA

SEQ ID NO: 1098903 - protein, 8 aa, Mycobacterium
NPWRGPPV

SEQ ID NO: 1098904 - protein, 5 aa, Mycobacterium
NPYRG

SEQ ID NO: 1098905 - protein, 5 aa, Mycobacterium
NQDET

SEQ ID NO: 1098906 - protein, 6 aa, Mycobacterium
NQEQGI

SEQ ID NO: 1098907 - protein, 12 aa, Mycobacterium
NQGEALANESVK

SEQ ID NO: 1098908 - protein, 10 aa, Mycobacterium
NQGKKHALTD

SEQ ID NO: 1098909 - protein, 24 aa, Mycobacterium
NQPVPSPWPSPGPGLPPKAPEPTS

SEQ ID NO: 1098910 - protein, 6 aa, Mycobacterium
NQSSRL

SEQ ID NO: 1098911 - protein, 9 aa, Mycobacterium
NQTTRSLNE

SEQ ID NO: 1098912 - protein, 8 aa, Mycobacterium
NRADPIAS

SEQ ID NO: 1098913 - protein, 15 aa, Mycobacterium
NRAGARRLDASRRRT

SEQ ID NO: 1098914 - protein, 11 aa, Mycobacterium
NRDGSDALSGD

SEQ ID NO: 1098915 - protein, 8 aa, Mycobacterium
NRDNIGKA

SEQ ID NO: 1098916 - protein, 7 aa, Mycobacterium
NRDVADA

SEQ ID NO: 1098917 - protein, 12 aa, Mycobacterium
NRGGAKAVGNAV

SEQ ID NO: 1098918 - protein, 5 aa, Mycobacterium
NRGRD

SEQ ID NO: 1098919 - protein, 20 aa, Mycobacterium
NRGVSPTSAPKRAAAYTTAR

SEQ ID NO: 1098920 - protein, 4 aa, Mycobacterium
NRPA

SEQ ID NO: 1098921 - protein, 5 aa, Mycobacterium
NRPAE

SEQ ID NO: 1098922 - protein, 5 aa, Mycobacterium
NRPRK

SEQ ID NO: 1098923 - protein, 5 aa, Mycobacterium
NRPYP

SEQ ID NO: 1098924 - protein, 13 aa, Mycobacterium
NRQAGDASATPQL

SEQ ID NO: 1098925 - protein, 27 aa, Mycobacterium
NRQENRDRVSLDEDRRRAAQTKADTEY

SEQ ID NO: 1098926 - protein, 12 aa, Mycobacterium
NRRGGHRQEPAE

SEQ ID NO: 1098927 - protein, 6 aa, Mycobacterium
NRRGQR

SEQ ID NO: 1098928 - protein, 13 aa, Mycobacterium
NRRKDGGPDPEGN

SEQ ID NO: 1098929 - protein, 7 aa, Mycobacterium
NRSGKTT

SEQ ID NO: 1098930 - protein, 4 aa, Mycobacterium
NRSQ

SEQ ID NO: 1098931 - protein, 21 aa, Mycobacterium
NRTDHITADDDEAPAEPTSRP

SEQ ID NO: 1098932 - protein, 6 aa, Mycobacterium
NRTEGN

SEQ ID NO: 1098933 - protein, 10 aa, Mycobacterium
NRTHSADSRA

SEQ ID NO: 1098934 - protein, 17 aa, Mycobacterium
NSADGRARAEGAAGAQL

SEQ ID NO: 1098935 - protein, 7 aa, Mycobacterium
NSDAMNV

SEQ ID NO: 1098936 - protein, 4 aa, Mycobacterium
NSDG

SEQ ID NO: 1098937 - protein, 5 aa, Mycobacterium
NSESL

SEQ ID NO: 1098938 - protein, 7 aa, Mycobacterium
NSGMSGR

SEQ ID NO: 1098939 - protein, 7 aa, Mycobacterium
NSGNAYF

SEQ ID NO: 1098940 - protein, 6 aa, Mycobacterium
NSGQSA

SEQ ID NO: 1098941 - protein, 12 aa, Mycobacterium
NSGTPAAKEAGN

SEQ ID NO: 1098942 - protein, 4 aa, Mycobacterium
NSKD

SEQ ID NO: 1098943 - protein, 9 aa, Mycobacterium
NSLTNLPSG

SEQ ID NO: 1098944 - protein, 16 aa, Mycobacterium
NSPGMGPDATRVTDTG

SEQ ID NO: 1098945 - protein, 20 aa, Mycobacterium
NSPRFSPVNPGEDPAVSRAA

SEQ ID NO: 1098946 - protein, 9 aa, Mycobacterium
NSRDGGRVG

SEQ ID NO: 1098947 - protein, 21 aa, Mycobacterium
NSSDIDPLANPDAGAQISTAA

SEQ ID NO: 1098948 - protein, 5 aa, Mycobacterium
NSSGP

SEQ ID NO: 1098949 - protein, 8 aa, Mycobacterium
NSSRQQTV

SEQ ID NO: 1098950 - protein, 8 aa, Mycobacterium
NTGDPTAG

SEQ ID NO: 1098951 - protein, 8 aa, Mycobacterium
NTGELGAN

SEQ ID NO: 1098952 - protein, 9 aa, Mycobacterium
NTGPGTNGS

SEQ ID NO: 1098953 - protein, 6 aa, Mycobacterium
NTNVGS

SEQ ID NO: 1098954 - protein, 5 aa, Mycobacterium
NTPAS

SEQ ID NO: 1098955 - protein, 26 aa, Mycobacterium
NTPDGAPKGTDAPGHGGVPGQPTDAE

SEQ ID NO: 1098956 - protein, 10 aa, Mycobacterium
NTPGGGFAGG

SEQ ID NO: 1098957 - protein, 6 aa, Mycobacterium
NTPPPL

SEQ ID NO: 1098958 - protein, 14 aa, Mycobacterium
NTPPPRLGDTRPEL

SEQ ID NO: 1098959 - protein, 7 aa, Mycobacterium
NTVGRTG

SEQ ID NO: 1098960 - protein, 6 aa, Mycobacterium
NTVQTA

SEQ ID NO: 1098961 - protein, 6 aa, Mycobacterium
NVARGG

SEQ ID NO: 1098962 - protein, 8 aa, Mycobacterium
NVEGNSCG

SEQ ID NO: 1098963 - protein, 6 aa, Mycobacterium
NVGTQT

SEQ ID NO: 1098964 - protein, 7 aa, Mycobacterium
NVPGPRT

SEQ ID NO: 1098965 - protein, 26 aa, Mycobacterium
NVSRTGADEPGPGREALGEILRRLER

SEQ ID NO: 1098966 - protein, 7 aa, Mycobacterium
NVTEPTV

SEQ ID NO: 1098967 - protein, 8 aa, Mycobacterium
NVTPDTDG

SEQ ID NO: 1098968 - protein, 18 aa, Mycobacterium
NYATEQATVSYPDTVRPE

SEQ ID NO: 1098969 - protein, 19 aa, Mycobacterium
PAAAEVSATGYAKEMGEDY

SEQ ID NO: 1098970 - protein, 5 aa, Mycobacterium
PAAAH

SEQ ID NO: 1098971 - protein, 9 aa, Mycobacterium
PAAATGVRS

SEQ ID NO: 1098972 - protein, 10 aa, Mycobacterium
PAAETTPAEP

SEQ ID NO: 1098973 - protein, 5 aa, Mycobacterium
PAAGG

SEQ ID NO: 1098974 - protein, 8 aa, Mycobacterium
PAAGGTEI

SEQ ID NO: 1098975 - protein, 8 aa, Mycobacterium
PAAKRRDR

SEQ ID NO: 1098976 - protein, 10 aa, Mycobacterium
PAAKTNFEAG

SEQ ID NO: 1098977 - protein, 13 aa, Mycobacterium
PAALAGSTAPLAD

SEQ ID NO: 1098978 - protein, 10 aa, Mycobacterium
PAAPAPAPEV

SEQ ID NO: 1098979 - protein, 14 aa, Mycobacterium
PAAQTGGTAETAAE

SEQ ID NO: 1098980 - protein, 7 aa, Mycobacterium
PADDDAQ

SEQ ID NO: 1098981 - protein, 7 aa, Mycobacterium
PADNSPD

SEQ ID NO: 1098982 - protein, 6 aa, Mycobacterium
PADRVG

SEQ ID NO: 1098983 - protein, 8 aa, Mycobacterium
PADSISGG

SEQ ID NO: 1098984 - protein, 12 aa, Mycobacterium
PADVPHDGRPRR

SEQ ID NO: 1098985 - protein, 7 aa, Mycobacterium
PADVRES

SEQ ID NO: 1098986 - protein, 7 aa, Mycobacterium
PAEAEKA

SEQ ID NO: 1098987 - protein, 4 aa, Mycobacterium
PAED

SEQ ID NO: 1098988 - protein, 14 aa, Mycobacterium
PAEDSAQVKRAAPT

SEQ ID NO: 1098989 - protein, 8 aa, Mycobacterium
PAEPPNTG

SEQ ID NO: 1098990 - protein, 5 aa, Mycobacterium
PAEPY

SEQ ID NO: 1098991 - protein, 7 aa, Mycobacterium
PAGAQVD

SEQ ID NO: 1098992 - protein, 20 aa, Mycobacterium
PAGLTKEQAVEAARARGDST

SEQ ID NO: 1098993 - protein, 7 aa, Mycobacterium
PAGNDTA

SEQ ID NO: 1098994 - protein, 7 aa, Mycobacterium
PAGPGTV

SEQ ID NO: 1098995 - protein, 10 aa, Mycobacterium
PAGPTGLAGR

SEQ ID NO: 1098996 - protein, 6 aa, Mycobacterium
PAGRGP

SEQ ID NO: 1098997 - protein, 10 aa, Mycobacterium
PAGSAGTDTV

SEQ ID NO: 1098998 - protein, 9 aa, Mycobacterium
PAGVPRPAG

SEQ ID NO: 1098999 - protein, 7 aa, Mycobacterium
PAHAAAG

SEQ ID NO: 1099000 - protein, 12 aa, Mycobacterium
PAHARPKAASTR

SEQ ID NO: 1099001 - protein, 11 aa, Mycobacterium
PAISPKKSWEG

SEQ ID NO: 1099002 - protein, 11 aa, Mycobacterium
PAKLPGKLAEQ

SEQ ID NO: 1099003 - protein, 12 aa, Mycobacterium
PALDSPGVQSSD

SEQ ID NO: 1099004 - protein, 5 aa, Mycobacterium
PALPE

SEQ ID NO: 1099005 - protein, 7 aa, Mycobacterium
PALTDAA

SEQ ID NO: 1099006 - protein, 9 aa, Mycobacterium
PANAQPPAV

SEQ ID NO: 1099007 - protein, 15 aa, Mycobacterium
PANQPTTQFSAPTQH

SEQ ID NO: 1099008 - protein, 7 aa, Mycobacterium
PAPDDAH

SEQ ID NO: 1099009 - protein, 9 aa, Mycobacterium
PAPDPLSTV

SEQ ID NO: 1099010 - protein, 12 aa, Mycobacterium
PAPEAVHTPPIS

SEQ ID NO: 1099011 - protein, 24 aa, Mycobacterium
PAPGPPGTAVYNPASGEVVGPDGV

SEQ ID NO: 1099012 - protein, 14 aa, Mycobacterium
PAPPIPAGVAPGGV

SEQ ID NO: 1099013 - protein, 5 aa, Mycobacterium
PAPPV

SEQ ID NO: 1099014 - protein, 7 aa, Mycobacterium
PAPRAQR

SEQ ID NO: 1099015 - protein, 25 aa, Mycobacterium
PAPSMPEPTATTSERPTTTSRIPTP

SEQ ID NO: 1099016 - protein, 8 aa, Mycobacterium
PAPTVRTP

SEQ ID NO: 1099017 - protein, 18 aa, Mycobacterium
PARGSARGQQPPNEEEQA

SEQ ID NO: 1099018 - protein, 5 aa, Mycobacterium
PARTI

SEQ ID NO: 1099019 - protein, 6 aa, Mycobacterium
PARTPV

SEQ ID NO: 1099020 - protein, 10 aa, Mycobacterium
PARTTHDPSA

SEQ ID NO: 1099021 - protein, 11 aa, Mycobacterium
PASAHTEVGQL

SEQ ID NO: 1099022 - protein, 11 aa, Mycobacterium
PASARGAASGV

SEQ ID NO: 1099023 - protein, 4 aa, Mycobacterium
PASM

SEQ ID NO: 1099024 - protein, 4 aa, Mycobacterium
PASQ

SEQ ID NO: 1099025 - protein, 8 aa, Mycobacterium
PASRGGKV

SEQ ID NO: 1099026 - protein, 6 aa, Mycobacterium
PASVSS

SEQ ID NO: 1099027 - protein, 6 aa, Mycobacterium
PATEMT

SEQ ID NO: 1099028 - protein, 10 aa, Mycobacterium
PATPLGGDAL

SEQ ID NO: 1099029 - protein, 8 aa, Mycobacterium
PATPPELA

SEQ ID NO: 1099030 - protein, 6 aa, Mycobacterium
PATSRR

SEQ ID NO: 1099031 - protein, 7 aa, Mycobacterium
PATTPDC

SEQ ID NO: 1099032 - protein, 14 aa, Mycobacterium
PAVDSSSGLRTNLT

SEQ ID NO: 1099033 - protein, 6 aa, Mycobacterium
PAVPQE

SEQ ID NO: 1099034 - protein, 8 aa, Mycobacterium
PAYEEQHR

SEQ ID NO: 1099035 - protein, 7 aa, Mycobacterium
PDAFDGQ

SEQ ID NO: 1099036 - protein, 7 aa, Mycobacterium
PDAGVDR

SEQ ID NO: 1099037 - protein, 6 aa, Mycobacterium
PDAPTA

SEQ ID NO: 1099038 - protein, 7 aa, Mycobacterium
PDARLGE

SEQ ID NO: 1099039 - protein, 9 aa, Mycobacterium
PDATDDRRV

SEQ ID NO: 1099040 - protein, 5 aa, Mycobacterium
PDDAT

SEQ ID NO: 1099041 - protein, 19 aa, Mycobacterium
PDDDTARTLGVGSSPVPAP

SEQ ID NO: 1099042 - protein, 5 aa, Mycobacterium
PDDHQ

SEQ ID NO: 1099043 - protein, 13 aa, Mycobacterium
PDDLDRPDRPWGT

SEQ ID NO: 1099044 - protein, 6 aa, Mycobacterium
PDDTED

SEQ ID NO: 1099045 - protein, 19 aa, Mycobacterium
PDEKQGVASAVNDATREVG

SEQ ID NO: 1099046 - protein, 4 aa, Mycobacterium
PDEP

SEQ ID NO: 1099047 - protein, 7 aa, Mycobacterium
PDGATPA

SEQ ID NO: 1099048 - protein, 22 aa, Mycobacterium
PDGLSDLTARGPHTADSAPSGP

SEQ ID NO: 1099049 - protein, 7 aa, Mycobacterium
PDGTRPC

SEQ ID NO: 1099050 - protein, 7 aa, Mycobacterium
PDHRDTY

SEQ ID NO: 1099051 - protein, 13 aa, Mycobacterium
PDMPRPYRTPGGV

SEQ ID NO: 1099052 - protein, 9 aa, Mycobacterium
PDMTGPRRG

SEQ ID NO: 1099053 - protein, 10 aa, Mycobacterium
PDPAAAGSSD

SEQ ID NO: 1099054 - protein, 18 aa, Mycobacterium
PDPDDPRKPESPTDLTKP

SEQ ID NO: 1099055 - protein, 7 aa, Mycobacterium
PDPDTPV

SEQ ID NO: 1099056 - protein, 4 aa, Mycobacterium
PDPL

SEQ ID NO: 1099057 - protein, 15 aa, Mycobacterium
PDPPVVAPDTDQERA

SEQ ID NO: 1099058 - protein, 7 aa, Mycobacterium
PDPQDGP

SEQ ID NO: 1099059 - protein, 10 aa, Mycobacterium
PDQCDGLRSG

SEQ ID NO: 1099060 - protein, 11 aa, Mycobacterium
PDQETDSEAAK

SEQ ID NO: 1099061 - protein, 13 aa, Mycobacterium
PDRALRKEATARG

SEQ ID NO: 1099062 - protein, 7 aa, Mycobacterium
PDRDRGQ

SEQ ID NO: 1099063 - protein, 8 aa, Mycobacterium
PDRPYTER

SEQ ID NO: 1099064 - protein, 6 aa, Mycobacterium
PDRTPV

SEQ ID NO: 1099065 - protein, 7 aa, Mycobacterium
PDSGGAE

SEQ ID NO: 1099066 - protein, 4 aa, Mycobacterium
PDSL

SEQ ID NO: 1099067 - protein, 9 aa, Mycobacterium
PDSPSRVAN

SEQ ID NO: 1099068 - protein, 4 aa, Mycobacterium
PDTL

SEQ ID NO: 1099069 - protein, 4 aa, Mycobacterium
PDVR

SEQ ID NO: 1099070 - protein, 8 aa, Mycobacterium
PDYPSAGA

SEQ ID NO: 1099071 - protein, 6 aa, Mycobacterium
PDYTRP

SEQ ID NO: 1099072 - protein, 10 aa, Mycobacterium
PEADARTAVG

SEQ ID NO: 1099073 - protein, 5 aa, Mycobacterium
PEAQR

SEQ ID NO: 1099074 - protein, 12 aa, Mycobacterium
PEATEKAREQAG

SEQ ID NO: 1099075 - protein, 9 aa, Mycobacterium
PEDLDAGGM

SEQ ID NO: 1099076 - protein, 6 aa, Mycobacterium
PEDTEA

SEQ ID NO: 1099077 - protein, 7 aa, Mycobacterium
PEEEYAV

SEQ ID NO: 1099078 - protein, 8 aa, Mycobacterium
PEEGGPVS

SEQ ID NO: 1099079 - protein, 8 aa, Mycobacterium
PEFAPSTT

SEQ ID NO: 1099080 - protein, 7 aa, Mycobacterium
PEGDYET

SEQ ID NO: 1099081 - protein, 10 aa, Mycobacterium
PEGGGGPDGV

SEQ ID NO: 1099082 - protein, 4 aa, Mycobacterium
PEGK

SEQ ID NO: 1099083 - protein, 4 aa, Mycobacterium
PEGL

SEQ ID NO: 1099084 - protein, 7 aa, Mycobacterium
PEGPTAI

SEQ ID NO: 1099085 - protein, 4 aa, Mycobacterium
PEGQ

SEQ ID NO: 1099086 - protein, 10 aa, Mycobacterium
PEGSAPLTEQ

SEQ ID NO: 1099087 - protein, 6 aa, Mycobacterium
PEKDRR

SEQ ID NO: 1099088 - protein, 4 aa, Mycobacterium
PEKG

SEQ ID NO: 1099089 - protein, 4 aa, Mycobacterium
PELA

SEQ ID NO: 1099090 - protein, 4 aa, Mycobacterium
PELS

SEQ ID NO: 1099091 - protein, 24 aa, Mycobacterium
PELTQPPAEQTEPAPAPAPRPDQQ

SEQ ID NO: 1099092 - protein, 16 aa, Mycobacterium
PELTRKPAQRRDSGVA

SEQ ID NO: 1099093 - protein, 11 aa, Mycobacterium
PENGPTEEATA

SEQ ID NO: 1099094 - protein, 24 aa, Mycobacterium
PENPPITAPAVPRAGGRGAVAGHP

SEQ ID NO: 1099095 - protein, 10 aa, Mycobacterium
PENVADGDDI

SEQ ID NO: 1099096 - protein, 8 aa, Mycobacterium
PEPGGAQT

SEQ ID NO: 1099097 - protein, 6 aa, Mycobacterium
PEPPLG

SEQ ID NO: 1099098 - protein, 7 aa, Mycobacterium
PEPVTAS

SEQ ID NO: 1099099 - protein, 6 aa, Mycobacterium
PERAPE

SEQ ID NO: 1099100 - protein, 19 aa, Mycobacterium
PERGTTAAAPAPDDDPALR

SEQ ID NO: 1099101 - protein, 8 aa, Mycobacterium
PERTRAPR

SEQ ID NO: 1099102 - protein, 12 aa, Mycobacterium
PERVSGAPASVA

SEQ ID NO: 1099103 - protein, 12 aa, Mycobacterium
PESARASITEDG

SEQ ID NO: 1099104 - protein, 9 aa, Mycobacterium
PESGRTTDV

SEQ ID NO: 1099105 - protein, 10 aa, Mycobacterium
PESQPGYADT

SEQ ID NO: 1099106 - protein, 6 aa, Mycobacterium
PESTPV

SEQ ID NO: 1099107 - protein, 6 aa, Mycobacterium
PESYSD

SEQ ID NO: 1099108 - protein, 11 aa, Mycobacterium
PETAAPVPAGR

SEQ ID NO: 1099109 - protein, 7 aa, Mycobacterium
PETDQLP

SEQ ID NO: 1099110 - protein, 25 aa, Mycobacterium
PETGVPSGLAPADRDPAGDPLEPRA

SEQ ID NO: 1099111 - protein, 13 aa, Mycobacterium
PETWDDKPRQRRA

SEQ ID NO: 1099112 - protein, 5 aa, Mycobacterium
PEVAG

SEQ ID NO: 1099113 - protein, 5 aa, Mycobacterium
PFGTE

SEQ ID NO: 1099114 - protein, 8 aa, Mycobacterium
PGAAGTLS

SEQ ID NO: 1099115 - protein, 5 aa, Mycobacterium
PGAAV

SEQ ID NO: 1099116 - protein, 11 aa, Mycobacterium
PGAEGDNTRMG

SEQ ID NO: 1099117 - protein, 6 aa, Mycobacterium
PGAGRR

SEQ ID NO: 1099118 - protein, 13 aa, Mycobacterium
PGAPDYANQDALA

SEQ ID NO: 1099119 - protein, 6 aa, Mycobacterium
PGAPER

SEQ ID NO: 1099120 - protein, 8 aa, Mycobacterium
PGAPNTFG

SEQ ID NO: 1099121 - protein, 17 aa, Mycobacterium
PGAPPLKADESLDDAGV

SEQ ID NO: 1099122 - protein, 22 aa, Mycobacterium
PGAPPPPRARRRPLGPTPRYPT

SEQ ID NO: 1099123 - protein, 6 aa, Mycobacterium
PGATGA

SEQ ID NO: 1099124 - protein, 23 aa, Mycobacterium
PGAVAPGSRPADEQPNAPSGQPW

SEQ ID NO: 1099125 - protein, 7 aa, Mycobacterium
PGEAGRA

SEQ ID NO: 1099126 - protein, 5 aa, Mycobacterium
PGEDA

SEQ ID NO: 1099127 - protein, 10 aa, Mycobacterium
PGENRTRLDK

SEQ ID NO: 1099128 - protein, 5 aa, Mycobacterium
PGGAY

SEQ ID NO: 1099129 - protein, 12 aa, Mycobacterium
PGGGDFTATPAR

SEQ ID NO: 1099130 - protein, 7 aa, Mycobacterium
PGGKTAF

SEQ ID NO: 1099131 - protein, 10 aa, Mycobacterium
PGGPGQPSWG

SEQ ID NO: 1099132 - protein, 6 aa, Mycobacterium
PGGSQH

SEQ ID NO: 1099133 - protein, 10 aa, Mycobacterium
PGGSVPADGR

SEQ ID NO: 1099134 - protein, 8 aa, Mycobacterium
PGGVRGTY

SEQ ID NO: 1099135 - protein, 10 aa, Mycobacterium
PGHPGTEEEV

SEQ ID NO: 1099136 - protein, 5 aa, Mycobacterium
PGLDE

SEQ ID NO: 1099137 - protein, 21 aa, Mycobacterium
PGLSPAAATQARDSLAAATDV

SEQ ID NO: 1099138 - protein, 12 aa, Mycobacterium
PGMRYRSGGPFA

SEQ ID NO: 1099139 - protein, 13 aa, Mycobacterium
PGNDGNEARNLGQ

SEQ ID NO: 1099140 - protein, 10 aa, Mycobacterium
PGNEQAAATV

SEQ ID NO: 1099141 - protein, 7 aa, Mycobacterium
PGNRAAR

SEQ ID NO: 1099142 - protein, 12 aa, Mycobacterium
PGNVAANVSAGA

SEQ ID NO: 1099143 - protein, 12 aa, Mycobacterium
PGPDGRPTATIT

SEQ ID NO: 1099144 - protein, 61 aa, Mycobacterium
PGPDQPEREGGRHSAPDEATEQVGAAEQPAAATGATEAYSQAYSAPESEQFSSGPYVPADP

SEQ ID NO: 1099145 - protein, 10 aa, Mycobacterium
PGPGTQLDDQ

SEQ ID NO: 1099146 - protein, 6 aa, Mycobacterium
PGPIRP

SEQ ID NO: 1099147 - protein, 5 aa, Mycobacterium
PGQNV

SEQ ID NO: 1099148 - protein, 6 aa, Mycobacterium
PGQRDG

SEQ ID NO: 1099149 - protein, 11 aa, Mycobacterium
PGRAPEAPAGA

SEQ ID NO: 1099150 - protein, 7 aa, Mycobacterium
PGRDGRQ

SEQ ID NO: 1099151 - protein, 11 aa, Mycobacterium
PGRFEEAASAA

SEQ ID NO: 1099152 - protein, 5 aa, Mycobacterium
PGRHR

SEQ ID NO: 1099153 - protein, 4 aa, Mycobacterium
PGRT

SEQ ID NO: 1099154 - protein, 5 aa, Mycobacterium
PGRYG

SEQ ID NO: 1099155 - protein, 6 aa, Mycobacterium
PGSAQH

SEQ ID NO: 1099156 - protein, 6 aa, Mycobacterium
PGSDER

SEQ ID NO: 1099157 - protein, 5 aa, Mycobacterium
PGSDP

SEQ ID NO: 1099158 - protein, 17 aa, Mycobacterium
PGSEYGPDAEPPSPARI

SEQ ID NO: 1099159 - protein, 18 aa, Mycobacterium
PGSPSGGSGGSPGGPDGS

SEQ ID NO: 1099160 - protein, 4 aa, Mycobacterium
PGTG

SEQ ID NO: 1099161 - protein, 10 aa, Mycobacterium
PGTGPADRHD

SEQ ID NO: 1099162 - protein, 6 aa, Mycobacterium
PGTGRW

SEQ ID NO: 1099163 - protein, 7 aa, Mycobacterium
PGTPGVS

SEQ ID NO: 1099164 - protein, 13 aa, Mycobacterium
PGTRRQWERDPRD

SEQ ID NO: 1099165 - protein, 10 aa, Mycobacterium
PGTSTDPKRR

SEQ ID NO: 1099166 - protein, 4 aa, Mycobacterium
PGTT

SEQ ID NO: 1099167 - protein, 5 aa, Mycobacterium
PGVAR

SEQ ID NO: 1099168 - protein, 10 aa, Mycobacterium
PGVGGNGGEP

SEQ ID NO: 1099169 - protein, 22 aa, Mycobacterium
PGVHGDAGGDGRVDTACGAERG

SEQ ID NO: 1099170 - protein, 5 aa, Mycobacterium
PGWTG

SEQ ID NO: 1099171 - protein, 13 aa, Mycobacterium
PHALPKSGTQRPW

SEQ ID NO: 1099172 - protein, 6 aa, Mycobacterium
PHAPGW

SEQ ID NO: 1099173 - protein, 7 aa, Mycobacterium
PHFSPNT

SEQ ID NO: 1099174 - protein, 5 aa, Mycobacterium
PHIDT

SEQ ID NO: 1099175 - protein, 7 aa, Mycobacterium
PHNDPTV

SEQ ID NO: 1099176 - protein, 4 aa, Mycobacterium
PHPE

SEQ ID NO: 1099177 - protein, 15 aa, Mycobacterium
PHRRPALAHADAEGQ

SEQ ID NO: 1099178 - protein, 9 aa, Mycobacterium
PHSTYTGET

SEQ ID NO: 1099179 - protein, 12 aa, Mycobacterium
PIAGEPTTSPHA

SEQ ID NO: 1099180 - protein, 7 aa, Mycobacterium
PIATGGM

SEQ ID NO: 1099181 - protein, 13 aa, Mycobacterium
PIETGTAETHGPL

SEQ ID NO: 1099182 - protein, 7 aa, Mycobacterium
PKAWRAR

SEQ ID NO: 1099183 - protein, 5 aa, Mycobacterium
PKDKI

SEQ ID NO: 1099184 - protein, 5 aa, Mycobacterium
PKEPD

SEQ ID NO: 1099185 - protein, 11 aa, Mycobacterium
PKEPFEASEVD

SEQ ID NO: 1099186 - protein, 27 aa, Mycobacterium
PKISSSLGGNGYSLNTHSEALGAGNPY

SEQ ID NO: 1099187 - protein, 15 aa, Mycobacterium
PKNAEQGRDLLARLT

SEQ ID NO: 1099188 - protein, 10 aa, Mycobacterium
PKPVTGRGED

SEQ ID NO: 1099189 - protein, 9 aa, Mycobacterium
PKQAPKAVD

SEQ ID NO: 1099190 - protein, 12 aa, Mycobacterium
PKQHLSSRKARR

SEQ ID NO: 1099191 - protein, 15 aa, Mycobacterium
PKRSENPRGRSPRGP

SEQ ID NO: 1099192 - protein, 8 aa, Mycobacterium
PKSERNKA

SEQ ID NO: 1099193 - protein, 5 aa, Mycobacterium
PKSIT

SEQ ID NO: 1099194 - protein, 20 aa, Mycobacterium
PKTQGGYATFGTGAAGYGAQ

SEQ ID NO: 1099195 - protein, 8 aa, Mycobacterium
PKTRQEAT

SEQ ID NO: 1099196 - protein, 4 aa, Mycobacterium
PKWP

SEQ ID NO: 1099197 - protein, 6 aa, Mycobacterium
PLAPGD

SEQ ID NO: 1099198 - protein, 13 aa, Mycobacterium
PLDDNDVYEPGDQ

SEQ ID NO: 1099199 - protein, 11 aa, Mycobacterium
PLFSDSSAAQL

SEQ ID NO: 1099200 - protein, 21 aa, Mycobacterium
PLGGTGNLEEHHEESRLAQRR

SEQ ID NO: 1099201 - protein, 9 aa, Mycobacterium
PLGPSGTYT

SEQ ID NO: 1099202 - protein, 13 aa, Mycobacterium
PLGSGEATATMSR

SEQ ID NO: 1099203 - protein, 7 aa, Mycobacterium
PLGTRQA

SEQ ID NO: 1099204 - protein, 6 aa, Mycobacterium
PLHSPE

SEQ ID NO: 1099205 - protein, 13 aa, Mycobacterium
PLPDTDPRGTGLA

SEQ ID NO: 1099206 - protein, 7 aa, Mycobacterium
PLPHTAA

SEQ ID NO: 1099207 - protein, 21 aa, Mycobacterium
PLPPTSAGPVPRGRPRRTRAL

SEQ ID NO: 1099208 - protein, 8 aa, Mycobacterium
PLSDSTDS

SEQ ID NO: 1099209 - protein, 9 aa, Mycobacterium
PLSEEATKE

SEQ ID NO: 1099210 - protein, 4 aa, Mycobacterium
PLSG

SEQ ID NO: 1099211 - protein, 16 aa, Mycobacterium
PLSGTGAGGQGSATNV

SEQ ID NO: 1099212 - protein, 4 aa, Mycobacterium
PLSR

SEQ ID NO: 1099213 - protein, 10 aa, Mycobacterium
PLSVGDDAAR

SEQ ID NO: 1099214 - protein, 8 aa, Mycobacterium
PLTGGASS

SEQ ID NO: 1099215 - protein, 8 aa, Mycobacterium
PLTGTQRY

SEQ ID NO: 1099216 - protein, 4 aa, Mycobacterium
PLTP

SEQ ID NO: 1099217 - protein, 7 aa, Mycobacterium
PNAQFGD

SEQ ID NO: 1099218 - protein, 5 aa, Mycobacterium
PNGLP

SEQ ID NO: 1099219 - protein, 4 aa, Mycobacterium
PNGR

SEQ ID NO: 1099220 - protein, 7 aa, Mycobacterium
PNKDGQL

SEQ ID NO: 1099221 - protein, 7 aa, Mycobacterium
PNNERAH

SEQ ID NO: 1099222 - protein, 7 aa, Mycobacterium
PNPTGAL

SEQ ID NO: 1099223 - protein, 8 aa, Mycobacterium
PNQRSGGA

SEQ ID NO: 1099224 - protein, 7 aa, Mycobacterium
PNRQRSV

SEQ ID NO: 1099225 - protein, 8 aa, Mycobacterium
PNRVGPKG

SEQ ID NO: 1099226 - protein, 5 aa, Mycobacterium
PNVQQ

SEQ ID NO: 1099227 - protein, 9 aa, Mycobacterium
PPADAGPGY

SEQ ID NO: 1099228 - protein, 16 aa, Mycobacterium
PPAGTYPDADERRKNQ

SEQ ID NO: 1099229 - protein, 14 aa, Mycobacterium
PPALRGGLGAGATA

SEQ ID NO: 1099230 - protein, 4 aa, Mycobacterium
PPAT

SEQ ID NO: 1099231 - protein, 8 aa, Mycobacterium
PPATGSEM

SEQ ID NO: 1099232 - protein, 11 aa, Mycobacterium
PPDQRGRPGAR

SEQ ID NO: 1099233 - protein, 8 aa, Mycobacterium
PPGGIAAG

SEQ ID NO: 1099234 - protein, 6 aa, Mycobacterium
PPGPID

SEQ ID NO: 1099235 - protein, 10 aa, Mycobacterium
PPGPVATADY

SEQ ID NO: 1099236 - protein, 8 aa, Mycobacterium
PPGTKTDV

SEQ ID NO: 1099237 - protein, 14 aa, Mycobacterium
PPGWSDAGPRAPSW

SEQ ID NO: 1099238 - protein, 4 aa, Mycobacterium
PPHL

SEQ ID NO: 1099239 - protein, 7 aa, Mycobacterium
PPKAGKS

SEQ ID NO: 1099240 - protein, 5 aa, Mycobacterium
PPLAL

SEQ ID NO: 1099241 - protein, 7 aa, Mycobacterium
PPLPDTV

SEQ ID NO: 1099242 - protein, 18 aa, Mycobacterium
PPLPQPRSDFGAASADGR

SEQ ID NO: 1099243 - protein, 8 aa, Mycobacterium
PPLSAPGV

SEQ ID NO: 1099244 - protein, 6 aa, Mycobacterium
PPNELT

SEQ ID NO: 1099245 - protein, 54 aa, Mycobacterium
PPPATTSRRPPPPPPPSPTESAATSAVPRPGTSPAPETPTTVTPPPPPPSPTVT

SEQ ID NO: 1099246 - protein, 8 aa, Mycobacterium
PPPEPYVP

SEQ ID NO: 1099247 - protein, 5 aa, Mycobacterium
PPPGH

SEQ ID NO: 1099248 - protein, 6 aa, Mycobacterium
PPPIPP

SEQ ID NO: 1099249 - protein, 7 aa, Mycobacterium
PPPPPSR

SEQ ID NO: 1099250 - protein, 6 aa, Mycobacterium
PPPRPS

SEQ ID NO: 1099251 - protein, 23 aa, Mycobacterium
PPPSPNPGWGEPPRQQQPYPPYQ

SEQ ID NO: 1099252 - protein, 5 aa, Mycobacterium
PPPVA

SEQ ID NO: 1099253 - protein, 5 aa, Mycobacterium
PPQEA

SEQ ID NO: 1099254 - protein, 10 aa, Mycobacterium
PPQETPPPKR

SEQ ID NO: 1099255 - protein, 6 aa, Mycobacterium
PPQQQT

SEQ ID NO: 1099256 - protein, 7 aa, Mycobacterium
PPREDAG

SEQ ID NO: 1099257 - protein, 6 aa, Mycobacterium
PPRGYG

SEQ ID NO: 1099258 - protein, 10 aa, Mycobacterium
PPRPPRAEAA

SEQ ID NO: 1099259 - protein, 5 aa, Mycobacterium
PPRQL

SEQ ID NO: 1099260 - protein, 24 aa, Mycobacterium
PPSAPPPAPGPPPDGAAEKPERNR

SEQ ID NO: 1099261 - protein, 10 aa, Mycobacterium
PPTPNHDSSG

SEQ ID NO: 1099262 - protein, 31 aa, Mycobacterium
PPVGAIEPPSIDPAALPPDQTGPDSPTEQRR

SEQ ID NO: 1099263 - protein, 13 aa, Mycobacterium
PPVRPAQNPAQQV

SEQ ID NO: 1099264 - protein, 6 aa, Mycobacterium
PPVTAT

SEQ ID NO: 1099265 - protein, 4 aa, Mycobacterium
PPWA

SEQ ID NO: 1099266 - protein, 8 aa, Mycobacterium
PQAASEAL

SEQ ID NO: 1099267 - protein, 4 aa, Mycobacterium
PQAN

SEQ ID NO: 1099268 - protein, 10 aa, Mycobacterium
PQDEEPTATA

SEQ ID NO: 1099269 - protein, 4 aa, Mycobacterium
PQDV

SEQ ID NO: 1099270 - protein, 11 aa, Mycobacterium
PQDVGTVDAQR

SEQ ID NO: 1099271 - protein, 4 aa, Mycobacterium
PQET

SEQ ID NO: 1099272 - protein, 5 aa, Mycobacterium
PQFPE

SEQ ID NO: 1099273 - protein, 10 aa, Mycobacterium
PQGAGPGTKG

SEQ ID NO: 1099274 - protein, 9 aa, Mycobacterium
PQGDDVTPA

SEQ ID NO: 1099275 - protein, 7 aa, Mycobacterium
PQGGLGD

SEQ ID NO: 1099276 - protein, 6 aa, Mycobacterium
PQGTKV

SEQ ID NO: 1099277 - protein, 8 aa, Mycobacterium
PQHQRPKA

SEQ ID NO: 1099278 - protein, 5 aa, Mycobacterium
PQIGG

SEQ ID NO: 1099279 - protein, 11 aa, Mycobacterium
PQIRREGSAHR

SEQ ID NO: 1099280 - protein, 4 aa, Mycobacterium
PQLG

SEQ ID NO: 1099281 - protein, 17 aa, Mycobacterium
PQLRSDGVSSFAPQPDC

SEQ ID NO: 1099282 - protein, 9 aa, Mycobacterium
PQNAENPLP

SEQ ID NO: 1099283 - protein, 5 aa, Mycobacterium
PQPRR

SEQ ID NO: 1099284 - protein, 4 aa, Mycobacterium
PQQG

SEQ ID NO: 1099285 - protein, 70 aa, Mycobacterium
PQQPGQPEQAPPPAAPPAETPPAPQPRPYPQQPAPSPTEPSPAPAPPAPAGPATPAPSPTPGPPNKRADL

SEQ ID NO: 1099286 - protein, 5 aa, Mycobacterium
PQRTL

SEQ ID NO: 1099287 - protein, 13 aa, Mycobacterium
PQSAPGDARRGFL

SEQ ID NO: 1099288 - protein, 4 aa, Mycobacterium
PQST

SEQ ID NO: 1099289 - protein, 9 aa, Mycobacterium
PQTRRELSA

SEQ ID NO: 1099290 - protein, 13 aa, Mycobacterium
PQVNYTEEEAKAG

SEQ ID NO: 1099291 - protein, 7 aa, Mycobacterium
PQYNGAK

SEQ ID NO: 1099292 - protein, 8 aa, Mycobacterium
PRAAASAA

SEQ ID NO: 1099293 - protein, 9 aa, Mycobacterium
PRAAGTGSA

SEQ ID NO: 1099294 - protein, 10 aa, Mycobacterium
PRADASYDDM

SEQ ID NO: 1099295 - protein, 5 aa, Mycobacterium
PRADQ

SEQ ID NO: 1099296 - protein, 5 aa, Mycobacterium
PRARR

SEQ ID NO: 1099297 - protein, 10 aa, Mycobacterium
PRDDNATPAE

SEQ ID NO: 1099298 - protein, 9 aa, Mycobacterium
PRDLRTPQA

SEQ ID NO: 1099299 - protein, 5 aa, Mycobacterium
PREAS

SEQ ID NO: 1099300 - protein, 12 aa, Mycobacterium
PREESRYQMALE

SEQ ID NO: 1099301 - protein, 24 aa, Mycobacterium
PRGPELSRAAASVTRDAVGVAAPV

SEQ ID NO: 1099302 - protein, 19 aa, Mycobacterium
PRGREDPATLRSDVDEEVE

SEQ ID NO: 1099303 - protein, 5 aa, Mycobacterium
PRGWP

SEQ ID NO: 1099304 - protein, 13 aa, Mycobacterium
PRLAAGIPGGTTP

SEQ ID NO: 1099305 - protein, 9 aa, Mycobacterium
PRPARLRPA

SEQ ID NO: 1099306 - protein, 7 aa, Mycobacterium
PRPDDAQ

SEQ ID NO: 1099307 - protein, 5 aa, Mycobacterium
PRPEP

SEQ ID NO: 1099308 - protein, 6 aa, Mycobacterium
PRPESR

SEQ ID NO: 1099309 - protein, 6 aa, Mycobacterium
PRPRPT

SEQ ID NO: 1099310 - protein, 12 aa, Mycobacterium
PRQDSAAPDEQW

SEQ ID NO: 1099311 - protein, 8 aa, Mycobacterium
PRQNAERR

SEQ ID NO: 1099312 - protein, 7 aa, Mycobacterium
PRRAAYG

SEQ ID NO: 1099313 - protein, 4 aa, Mycobacterium
PRRL

SEQ ID NO: 1099314 - protein, 5 aa, Mycobacterium
PRRST

SEQ ID NO: 1099315 - protein, 9 aa, Mycobacterium
PRSADPRQQ

SEQ ID NO: 1099316 - protein, 41 aa, Mycobacterium
PRSEGGLPGSGTDPFAAQKAAGPQVIPPRGDAPRPPQQGRR

SEQ ID NO: 1099317 - protein, 13 aa, Mycobacterium
PRSEGTNGPGLSA

SEQ ID NO: 1099318 - protein, 10 aa, Mycobacterium
PRSGNADASY

SEQ ID NO: 1099319 - protein, 7 aa, Mycobacterium
PRSREEE

SEQ ID NO: 1099320 - protein, 5 aa, Mycobacterium
PRSTL

SEQ ID NO: 1099321 - protein, 24 aa, Mycobacterium
PRTITETPAPGAGPLPSPGLPPPL

SEQ ID NO: 1099322 - protein, 7 aa, Mycobacterium
PRTKESG

SEQ ID NO: 1099323 - protein, 33 aa, Mycobacterium
PRVAGGRDRSAPPVGGGARQKRPKGSGGGSFTS

SEQ ID NO: 1099324 - protein, 13 aa, Mycobacterium
PRYDAAKGAPAPP

SEQ ID NO: 1099325 - protein, 8 aa, Mycobacterium
PSAATAAK

SEQ ID NO: 1099326 - protein, 14 aa, Mycobacterium
PSADAQGSGYQARQ

SEQ ID NO: 1099327 - protein, 9 aa, Mycobacterium
PSADPATPD

SEQ ID NO: 1099328 - protein, 14 aa, Mycobacterium
PSAGQQQARTPHRR

SEQ ID NO: 1099329 - protein, 11 aa, Mycobacterium
PSAPSGSSAPA

SEQ ID NO: 1099330 - protein, 16 aa, Mycobacterium
PSAQAEGTVQAGDPAQ

SEQ ID NO: 1099331 - protein, 8 aa, Mycobacterium
PSDEEDVP

SEQ ID NO: 1099332 - protein, 8 aa, Mycobacterium
PSDRPTAA

SEQ ID NO: 1099333 - protein, 5 aa, Mycobacterium
PSEFG

SEQ ID NO: 1099334 - protein, 13 aa, Mycobacterium
PSEPGAESAAETL

SEQ ID NO: 1099335 - protein, 8 aa, Mycobacterium
PSFQPPSQ

SEQ ID NO: 1099336 - protein, 21 aa, Mycobacterium
PSGLTDPTRVIGPSDKTAELQ

SEQ ID NO: 1099337 - protein, 8 aa, Mycobacterium
PSGNAYNK

SEQ ID NO: 1099338 - protein, 7 aa, Mycobacterium
PSGPDAQ

SEQ ID NO: 1099339 - protein, 5 aa, Mycobacterium
PSHGA

SEQ ID NO: 1099340 - protein, 6 aa, Mycobacterium
PSIAET

SEQ ID NO: 1099341 - protein, 7 aa, Mycobacterium
PSLAATL

SEQ ID NO: 1099342 - protein, 5 aa, Mycobacterium
PSLQG

SEQ ID NO: 1099343 - protein, 5 aa, Mycobacterium
PSPAA

SEQ ID NO: 1099344 - protein, 9 aa, Mycobacterium
PSPELRPGR

SEQ ID NO: 1099345 - protein, 5 aa, Mycobacterium
PSPLP

SEQ ID NO: 1099346 - protein, 7 aa, Mycobacterium
PSPTATL

SEQ ID NO: 1099347 - protein, 7 aa, Mycobacterium
PSRFGAG

SEQ ID NO: 1099348 - protein, 6 aa, Mycobacterium
PSRRQS

SEQ ID NO: 1099349 - protein, 12 aa, Mycobacterium
PSSHARSVGTSP

SEQ ID NO: 1099350 - protein, 14 aa, Mycobacterium
PSSPVAEQAEDIGS

SEQ ID NO: 1099351 - protein, 4 aa, Mycobacterium
PSTI

SEQ ID NO: 1099352 - protein, 4 aa, Mycobacterium
PSTL

SEQ ID NO: 1099353 - protein, 5 aa, Mycobacterium
PSTRG

SEQ ID NO: 1099354 - protein, 10 aa, Mycobacterium
PSYAGTYSST

SEQ ID NO: 1099355 - protein, 4 aa, Mycobacterium
PTAD

SEQ ID NO: 1099356 - protein, 7 aa, Mycobacterium
PTADDTA

SEQ ID NO: 1099357 - protein, 4 aa, Mycobacterium
PTAR

SEQ ID NO: 1099358 - protein, 8 aa, Mycobacterium
PTARGRAR

SEQ ID NO: 1099359 - protein, 24 aa, Mycobacterium
PTDDTIAEEARPATPPPPAAAPVA

SEQ ID NO: 1099360 - protein, 16 aa, Mycobacterium
PTEPEHDDETEPEERG

SEQ ID NO: 1099361 - protein, 4 aa, Mycobacterium
PTES

SEQ ID NO: 1099362 - protein, 6 aa, Mycobacterium
PTGDEM

SEQ ID NO: 1099363 - protein, 9 aa, Mycobacterium
PTGKPDYPA

SEQ ID NO: 1099364 - protein, 6 aa, Mycobacterium
PTGTRT

SEQ ID NO: 1099365 - protein, 7 aa, Mycobacterium
PTKGERL

SEQ ID NO: 1099366 - protein, 12 aa, Mycobacterium
PTLRAADEQRPA

SEQ ID NO: 1099367 - protein, 4 aa, Mycobacterium
PTMA

SEQ ID NO: 1099368 - protein, 10 aa, Mycobacterium
PTNSDSGFPR

SEQ ID NO: 1099369 - protein, 5 aa, Mycobacterium
PTPPA

SEQ ID NO: 1099370 - protein, 12 aa, Mycobacterium
PTPPAYPGLTPP

SEQ ID NO: 1099371 - protein, 6 aa, Mycobacterium
PTPQPT

SEQ ID NO: 1099372 - protein, 10 aa, Mycobacterium
PTPRPERATT

SEQ ID NO: 1099373 - protein, 4 aa, Mycobacterium
PTPY

SEQ ID NO: 1099374 - protein, 39 aa, Mycobacterium
PTQPLGNGYQGQPDPAYANQAPYGPAYQPPAAPNPTEQL

SEQ ID NO: 1099375 - protein, 7 aa, Mycobacterium
PTQSSAR

SEQ ID NO: 1099376 - protein, 7 aa, Mycobacterium
PTQTGYG

SEQ ID NO: 1099377 - protein, 6 aa, Mycobacterium
PTRDGR

SEQ ID NO: 1099378 - protein, 7 aa, Mycobacterium
PTRTAAR

SEQ ID NO: 1099379 - protein, 5 aa, Mycobacterium
PTRTE

SEQ ID NO: 1099380 - protein, 13 aa, Mycobacterium
PTRVTAGPWPDLP

SEQ ID NO: 1099381 - protein, 10 aa, Mycobacterium
PTSALDPERV

SEQ ID NO: 1099382 - protein, 21 aa, Mycobacterium
PTSQPVNYRPAPTGSGLPAGA

SEQ ID NO: 1099383 - protein, 6 aa, Mycobacterium
PTTNEY

SEQ ID NO: 1099384 - protein, 11 aa, Mycobacterium
PTTNREATKTA

SEQ ID NO: 1099385 - protein, 22 aa, Mycobacterium
PTTPRSSTAPSTPPPSESTETV

SEQ ID NO: 1099386 - protein, 6 aa, Mycobacterium
PTVPGD

SEQ ID NO: 1099387 - protein, 5 aa, Mycobacterium
PTYTP

SEQ ID NO: 1099388 - protein, 4 aa, Mycobacterium
PVAE

SEQ ID NO: 1099389 - protein, 9 aa, Mycobacterium
PVAPQQPRL

SEQ ID NO: 1099390 - protein, 11 aa, Mycobacterium
PVDDAPPTTDL

SEQ ID NO: 1099391 - protein, 5 aa, Mycobacterium
PVETA

SEQ ID NO: 1099392 - protein, 9 aa, Mycobacterium
PVGDGATRG

SEQ ID NO: 1099393 - protein, 8 aa, Mycobacterium
PVGSPPNL

SEQ ID NO: 1099394 - protein, 4 aa, Mycobacterium
PVPA

SEQ ID NO: 1099395 - protein, 5 aa, Mycobacterium
PVPAE

SEQ ID NO: 1099396 - protein, 19 aa, Mycobacterium
PVPGPDGGPALAPPPDPQL

SEQ ID NO: 1099397 - protein, 21 aa, Mycobacterium
PVQPDRNPRRGGRERQPAGET

SEQ ID NO: 1099398 - protein, 6 aa, Mycobacterium
PVQPMD

SEQ ID NO: 1099399 - protein, 6 aa, Mycobacterium
PVRDGD

SEQ ID NO: 1099400 - protein, 8 aa, Mycobacterium
PVRDGNER

SEQ ID NO: 1099401 - protein, 18 aa, Mycobacterium
PVRDLGSARRRRGGESRW

SEQ ID NO: 1099402 - protein, 14 aa, Mycobacterium
PVREPADPDRQDTE

SEQ ID NO: 1099403 - protein, 8 aa, Mycobacterium
PVSGEGDG

SEQ ID NO: 1099404 - protein, 11 aa, Mycobacterium
PVTDREPAGPL

SEQ ID NO: 1099405 - protein, 11 aa, Mycobacterium
PVTPADGGADI

SEQ ID NO: 1099406 - protein, 143 aa, Mycobacterium
PWAGQQPDAGTDQPAGDPSNNQWQSPGQGGEQGTSETPQWQQPPAYTPQQYPQYQQPTGQQPQYQPYPPTEQYGQPQQYGQPQYGQPGQYGQPQYGQPQYGQQPQYGQQPPYGQQPQYGQPGQTGQYGSFPPPGSEDGSKRSL

SEQ ID NO: 1099407 - protein, 6 aa, Mycobacterium
PWPEDV

SEQ ID NO: 1099408 - protein, 8 aa, Mycobacterium
PWYGDPNQ

SEQ ID NO: 1099409 - protein, 10 aa, Mycobacterium
PYADADQYGF

SEQ ID NO: 1099410 - protein, 6 aa, Mycobacterium
PYGSEG

SEQ ID NO: 1099411 - protein, 8 aa, Mycobacterium
PYPAPANR

SEQ ID NO: 1099412 - protein, 7 aa, Mycobacterium
PYQPNTE

SEQ ID NO: 1099413 - protein, 6 aa, Mycobacterium
PYRASA

SEQ ID NO: 1099414 - protein, 5 aa, Mycobacterium
PYRGT

SEQ ID NO: 1099415 - protein, 15 aa, Mycobacterium
QAAAEVSAAVAAGPR

SEQ ID NO: 1099416 - protein, 5 aa, Mycobacterium
QAAPA

SEQ ID NO: 1099417 - protein, 9 aa, Mycobacterium
QAAPALAEA

SEQ ID NO: 1099418 - protein, 6 aa, Mycobacterium
QAAQNL

SEQ ID NO: 1099419 - protein, 10 aa, Mycobacterium
QADGAGPNVD

SEQ ID NO: 1099420 - protein, 5 aa, Mycobacterium
QADGQ

SEQ ID NO: 1099421 - protein, 11 aa, Mycobacterium
QADPAKASGLD

SEQ ID NO: 1099422 - protein, 5 aa, Mycobacterium
QADWG

SEQ ID NO: 1099423 - protein, 9 aa, Mycobacterium
QADYPAPAG

SEQ ID NO: 1099424 - protein, 10 aa, Mycobacterium
QAENAAVDGT

SEQ ID NO: 1099425 - protein, 8 aa, Mycobacterium
QAEPGLPT

SEQ ID NO: 1099426 - protein, 13 aa, Mycobacterium
QAERDFVRVIDSE

SEQ ID NO: 1099427 - protein, 12 aa, Mycobacterium
QAERSSDPKRRE

SEQ ID NO: 1099428 - protein, 8 aa, Mycobacterium
QAGASTMT

SEQ ID NO: 1099429 - protein, 11 aa, Mycobacterium
QAGEDLSTGTW

SEQ ID NO: 1099430 - protein, 9 aa, Mycobacterium
QAGNGMSDC

SEQ ID NO: 1099431 - protein, 6 aa, Mycobacterium
QAGRRA

SEQ ID NO: 1099432 - protein, 6 aa, Mycobacterium
QAGTQN

SEQ ID NO: 1099433 - protein, 11 aa, Mycobacterium
QAMPTRSAAVG

SEQ ID NO: 1099434 - protein, 19 aa, Mycobacterium
QANGGGPVVPRDENGEIAN

SEQ ID NO: 1099435 - protein, 13 aa, Mycobacterium
QANPTGGGRRRRE

SEQ ID NO: 1099436 - protein, 13 aa, Mycobacterium
QANSGKSSAINNG

SEQ ID NO: 1099437 - protein, 12 aa, Mycobacterium
QAPGAPRLPEEE

SEQ ID NO: 1099438 - protein, 7 aa, Mycobacterium
QAPPSRA

SEQ ID NO: 1099439 - protein, 7 aa, Mycobacterium
QAPSVQR

SEQ ID NO: 1099440 - protein, 7 aa, Mycobacterium
QAQAADE

SEQ ID NO: 1099441 - protein, 12 aa, Mycobacterium
QAQSVGGGSQAA

SEQ ID NO: 1099442 - protein, 10 aa, Mycobacterium
QARAERDPAH

SEQ ID NO: 1099443 - protein, 10 aa, Mycobacterium
QARELGNEGR

SEQ ID NO: 1099444 - protein, 4 aa, Mycobacterium
QARR

SEQ ID NO: 1099445 - protein, 13 aa, Mycobacterium
QARYTDPSARSFT

SEQ ID NO: 1099446 - protein, 6 aa, Mycobacterium
QASEAS

SEQ ID NO: 1099447 - protein, 48 aa, Mycobacterium
QATGSPAAPPSLATAPPGPVGPPPGVSYPGPPISAPPAQPQMGAAGPP

SEQ ID NO: 1099448 - protein, 12 aa, Mycobacterium
QCSPTRDIAAFS

SEQ ID NO: 1099449 - protein, 7 aa, Mycobacterium
QDADTSS

SEQ ID NO: 1099450 - protein, 12 aa, Mycobacterium
QDDDGTYEVGRP

SEQ ID NO: 1099451 - protein, 7 aa, Mycobacterium
QDDENST

SEQ ID NO: 1099452 - protein, 34 aa, Mycobacterium
QDDTTSDEPVPYTGDDAYEPYNPFGPAPTGARPE

SEQ ID NO: 1099453 - protein, 4 aa, Mycobacterium
QDDV

SEQ ID NO: 1099454 - protein, 7 aa, Mycobacterium
QDETDPV

SEQ ID NO: 1099455 - protein, 13 aa, Mycobacterium
QDPASADNSGPDT

SEQ ID NO: 1099456 - protein, 7 aa, Mycobacterium
QDRGLGP

SEQ ID NO: 1099457 - protein, 15 aa, Mycobacterium
QDRKDRQLPPPTVTN

SEQ ID NO: 1099458 - protein, 9 aa, Mycobacterium
QDSKTGSLL

SEQ ID NO: 1099459 - protein, 8 aa, Mycobacterium
QDSPIGVR

SEQ ID NO: 1099460 - protein, 9 aa, Mycobacterium
QDSPISVRG

SEQ ID NO: 1099461 - protein, 7 aa, Mycobacterium
QDTPGRR

SEQ ID NO: 1099462 - protein, 9 aa, Mycobacterium
QDTRADTPL

SEQ ID NO: 1099463 - protein, 8 aa, Mycobacterium
QDVPGCGA

SEQ ID NO: 1099464 - protein, 13 aa, Mycobacterium
QEAARKGGATTNE

SEQ ID NO: 1099465 - protein, 8 aa, Mycobacterium
QEKDAAAQ

SEQ ID NO: 1099466 - protein, 4 aa, Mycobacterium
QEQC

SEQ ID NO: 1099467 - protein, 6 aa, Mycobacterium
QETVRR

SEQ ID NO: 1099468 - protein, 7 aa, Mycobacterium
QFGQQAA

SEQ ID NO: 1099469 - protein, 11 aa, Mycobacterium
QFPGPGRTEKN

SEQ ID NO: 1099470 - protein, 7 aa, Mycobacterium
QGAPTPV

SEQ ID NO: 1099471 - protein, 9 aa, Mycobacterium
QGDEAHTDA

SEQ ID NO: 1099472 - protein, 9 aa, Mycobacterium
QGEEGGGTA

SEQ ID NO: 1099473 - protein, 9 aa, Mycobacterium
QGELSTAAD

SEQ ID NO: 1099474 - protein, 4 aa, Mycobacterium
QGFD

SEQ ID NO: 1099475 - protein, 8 aa, Mycobacterium
QGGAGVPG

SEQ ID NO: 1099476 - protein, 12 aa, Mycobacterium
QGGRDDGSGEQG

SEQ ID NO: 1099477 - protein, 12 aa, Mycobacterium
QGIDTKPYTERL

SEQ ID NO: 1099478 - protein, 55 aa, Mycobacterium
QGIPPDDRVDSDEQLYGPVGGTPMPPPSPEPAPAPGGPAVAPSAFTPGESGGPSV

SEQ ID NO: 1099479 - protein, 6 aa, Mycobacterium
QGKDGW

SEQ ID NO: 1099480 - protein, 7 aa, Mycobacterium
QGPGFAQ

SEQ ID NO: 1099481 - protein, 12 aa, Mycobacterium
QGPHTDRTLDGA

SEQ ID NO: 1099482 - protein, 8 aa, Mycobacterium
QGPRDVRS

SEQ ID NO: 1099483 - protein, 7 aa, Mycobacterium
QGRDPIA

SEQ ID NO: 1099484 - protein, 7 aa, Mycobacterium
QGRRTTD

SEQ ID NO: 1099485 - protein, 6 aa, Mycobacterium
QGSPHS

SEQ ID NO: 1099486 - protein, 5 aa, Mycobacterium
QGTGE

SEQ ID NO: 1099487 - protein, 5 aa, Mycobacterium
QGVGG

SEQ ID NO: 1099488 - protein, 4 aa, Mycobacterium
QGVT

SEQ ID NO: 1099489 - protein, 16 aa, Mycobacterium
QHDPTKPRSRPRAKSR

SEQ ID NO: 1099490 - protein, 8 aa, Mycobacterium
QHNPSTPY

SEQ ID NO: 1099491 - protein, 16 aa, Mycobacterium
QHPDLTAPPRGSRRAA

SEQ ID NO: 1099492 - protein, 6 aa, Mycobacterium
QHTPKH

SEQ ID NO: 1099493 - protein, 8 aa, Mycobacterium
QIAEQGPR

SEQ ID NO: 1099494 - protein, 8 aa, Mycobacterium
QIDGRPAP

SEQ ID NO: 1099495 - protein, 12 aa, Mycobacterium
QIPDGPAVNGPY

SEQ ID NO: 1099496 - protein, 8 aa, Mycobacterium
QIPQPEST

SEQ ID NO: 1099497 - protein, 16 aa, Mycobacterium
QKAAAQIKEANGNGDL

SEQ ID NO: 1099498 - protein, 16 aa, Mycobacterium
QKGMQDQATAMQGDTT

SEQ ID NO: 1099499 - protein, 6 aa, Mycobacterium
QKKAMQ

SEQ ID NO: 1099500 - protein, 6 aa, Mycobacterium
QKLGGS

SEQ ID NO: 1099501 - protein, 8 aa, Mycobacterium
QKNPPEFL

SEQ ID NO: 1099502 - protein, 6 aa, Mycobacterium
QKPGDS

SEQ ID NO: 1099503 - protein, 9 aa, Mycobacterium
QKSSGPTPI

SEQ ID NO: 1099504 - protein, 13 aa, Mycobacterium
QLAPVSSAAAAPP

SEQ ID NO: 1099505 - protein, 7 aa, Mycobacterium
QLASTIP

SEQ ID NO: 1099506 - protein, 9 aa, Mycobacterium
QLDETARRS

SEQ ID NO: 1099507 - protein, 4 aa, Mycobacterium
QLDG

SEQ ID NO: 1099508 - protein, 5 aa, Mycobacterium
QLDSG

SEQ ID NO: 1099509 - protein, 13 aa, Mycobacterium
QLGAQASQAAVAA

SEQ ID NO: 1099510 - protein, 5 aa, Mycobacterium
QLGPT

SEQ ID NO: 1099511 - protein, 6 aa, Mycobacterium
QLPDGA

SEQ ID NO: 1099512 - protein, 10 aa, Mycobacterium
QLPGLRPGTG

SEQ ID NO: 1099513 - protein, 6 aa, Mycobacterium
QLPTGD

SEQ ID NO: 1099514 - protein, 8 aa, Mycobacterium
QLQDPRRG

SEQ ID NO: 1099515 - protein, 7 aa, Mycobacterium
QLSGSPF

SEQ ID NO: 1099516 - protein, 7 aa, Mycobacterium
QLSPESA

SEQ ID NO: 1099517 - protein, 8 aa, Mycobacterium
QMGPQGEQ

SEQ ID NO: 1099518 - protein, 4 aa, Mycobacterium
QMTR

SEQ ID NO: 1099519 - protein, 5 aa, Mycobacterium
QNDPE

SEQ ID NO: 1099520 - protein, 8 aa, Mycobacterium
QNDSRDAE

SEQ ID NO: 1099521 - protein, 6 aa, Mycobacterium
QNPNQG

SEQ ID NO: 1099522 - protein, 5 aa, Mycobacterium
QPAEN

SEQ ID NO: 1099523 - protein, 23 aa, Mycobacterium
QPALGSKDAGGQNKTWQDLLPTG

SEQ ID NO: 1099524 - protein, 8 aa, Mycobacterium
QPDTGPRT

SEQ ID NO: 1099525 - protein, 13 aa, Mycobacterium
QPECVSGDAESAV

SEQ ID NO: 1099526 - protein, 5 aa, Mycobacterium
QPERR

SEQ ID NO: 1099527 - protein, 10 aa, Mycobacterium
QPGAGHPHHG

SEQ ID NO: 1099528 - protein, 7 aa, Mycobacterium
QPGARAA

SEQ ID NO: 1099529 - protein, 15 aa, Mycobacterium
QPGETRVAATPQTVG

SEQ ID NO: 1099530 - protein, 6 aa, Mycobacterium
QPGPTL

SEQ ID NO: 1099531 - protein, 8 aa, Mycobacterium
QPGTYRRG

SEQ ID NO: 1099532 - protein, 6 aa, Mycobacterium
QPIGAG

SEQ ID NO: 1099533 - protein, 6 aa, Mycobacterium
QPLPPS

SEQ ID NO: 1099534 - protein, 5 aa, Mycobacterium
QPPPC

SEQ ID NO: 1099535 - protein, 8 aa, Mycobacterium
QPPPSPAW

SEQ ID NO: 1099536 - protein, 23 aa, Mycobacterium
QPPTAVTTKPFDTRRGEMAPQAS

SEQ ID NO: 1099537 - protein, 9 aa, Mycobacterium
QPRTGSAPY

SEQ ID NO: 1099538 - protein, 6 aa, Mycobacterium
QPTDVR

SEQ ID NO: 1099539 - protein, 4 aa, Mycobacterium
QPTL

SEQ ID NO: 1099540 - protein, 6 aa, Mycobacterium
QPTTIS

SEQ ID NO: 1099541 - protein, 11 aa, Mycobacterium
QPYGGSPTGWG

SEQ ID NO: 1099542 - protein, 9 aa, Mycobacterium
QQAAPTADQ

SEQ ID NO: 1099543 - protein, 11 aa, Mycobacterium
QQASPSTPELK

SEQ ID NO: 1099544 - protein, 8 aa, Mycobacterium
QQATRDDQ

SEQ ID NO: 1099545 - protein, 8 aa, Mycobacterium
QQDETVDP

SEQ ID NO: 1099546 - protein, 7 aa, Mycobacterium
QQGALQT

SEQ ID NO: 1099547 - protein, 13 aa, Mycobacterium
QQIAGDASAAAAV

SEQ ID NO: 1099548 - protein, 9 aa, Mycobacterium
QQPDAAGDV

SEQ ID NO: 1099549 - protein, 9 aa, Mycobacterium
QQPDGWSSL

SEQ ID NO: 1099550 - protein, 7 aa, Mycobacterium
QQPPTTE

SEQ ID NO: 1099551 - protein, 13 aa, Mycobacterium
QQQIGTEGVQAPG

SEQ ID NO: 1099552 - protein, 7 aa, Mycobacterium
QQRSMES

SEQ ID NO: 1099553 - protein, 10 aa, Mycobacterium
QQRTDGTVDD

SEQ ID NO: 1099554 - protein, 9 aa, Mycobacterium
QQSAATMAA

SEQ ID NO: 1099555 - protein, 23 aa, Mycobacterium
QQSEAEARAAAAEAEAKAAEAAR

SEQ ID NO: 1099556 - protein, 9 aa, Mycobacterium
QQSSETLRP

SEQ ID NO: 1099557 - protein, 7 aa, Mycobacterium
QQSVSEA

SEQ ID NO: 1099558 - protein, 26 aa, Mycobacterium
QQVPAPAAMAPSAPVTAPTGPSTAQR

SEQ ID NO: 1099559 - protein, 5 aa, Mycobacterium
QRDGL

SEQ ID NO: 1099560 - protein, 6 aa, Mycobacterium
QRDTGR

SEQ ID NO: 1099561 - protein, 7 aa, Mycobacterium
QRGKERF

SEQ ID NO: 1099562 - protein, 6 aa, Mycobacterium
QRGQRV

SEQ ID NO: 1099563 - protein, 11 aa, Mycobacterium
QRGSTTSAGAA

SEQ ID NO: 1099564 - protein, 8 aa, Mycobacterium
QRLEPSTL

SEQ ID NO: 1099565 - protein, 6 aa, Mycobacterium
QRLGDE

SEQ ID NO: 1099566 - protein, 31 aa, Mycobacterium
QRPDDPARPTSASLVDPEDDLPSPNYGGDFE

SEQ ID NO: 1099567 - protein, 5 aa, Mycobacterium
QRPLE

SEQ ID NO: 1099568 - protein, 90 aa, Mycobacterium
QRPLTDHDRTVADRDHTLTDRDHTLTDRDHTGATHTGAQPMAAAPAAQTGPQPMAQTGPQPMAQTGPQPMAAPGNAPTEAVQPAAGQRKR

SEQ ID NO: 1099569 - protein, 28 aa, Mycobacterium
QRRRDKAAADSTAPATPEDKLADRYGRR

SEQ ID NO: 1099570 - protein, 15 aa, Mycobacterium
QRSENALTGEDESAI

SEQ ID NO: 1099571 - protein, 8 aa, Mycobacterium
QRSSDPKI

SEQ ID NO: 1099572 - protein, 10 aa, Mycobacterium
QRTADPATTW

SEQ ID NO: 1099573 - protein, 9 aa, Mycobacterium
QRTETEALE

SEQ ID NO: 1099574 - protein, 10 aa, Mycobacterium
QRTGADPQGV

SEQ ID NO: 1099575 - protein, 5 aa, Mycobacterium
QRTKE

SEQ ID NO: 1099576 - protein, 13 aa, Mycobacterium
QSAEQDAALRSGL

SEQ ID NO: 1099577 - protein, 4 aa, Mycobacterium
QSAG

SEQ ID NO: 1099578 - protein, 15 aa, Mycobacterium
QSAPAPELGADSARN

SEQ ID NO: 1099579 - protein, 10 aa, Mycobacterium
QSDHDQAKAR

SEQ ID NO: 1099580 - protein, 4 aa, Mycobacterium
QSFT

SEQ ID NO: 1099581 - protein, 5 aa, Mycobacterium
QSHQT

SEQ ID NO: 1099582 - protein, 6 aa, Mycobacterium
QSHRPD

SEQ ID NO: 1099583 - protein, 13 aa, Mycobacterium
QSIADTDEPGTRL

SEQ ID NO: 1099584 - protein, 11 aa, Mycobacterium
QSPGQISPDTK

SEQ ID NO: 1099585 - protein, 8 aa, Mycobacterium
QSPNPQYA

SEQ ID NO: 1099586 - protein, 8 aa, Mycobacterium
QSQGAAAP

SEQ ID NO: 1099587 - protein, 5 aa, Mycobacterium
QSQGV

SEQ ID NO: 1099588 - protein, 10 aa, Mycobacterium
QSRAGVTGND

SEQ ID NO: 1099589 - protein, 9 aa, Mycobacterium
QSSAGQAGL

SEQ ID NO: 1099590 - protein, 10 aa, Mycobacterium
QSTDTWQDGL

SEQ ID NO: 1099591 - protein, 11 aa, Mycobacterium
QSTFSGELDQG

SEQ ID NO: 1099592 - protein, 6 aa, Mycobacterium
QSTGTY

SEQ ID NO: 1099593 - protein, 11 aa, Mycobacterium
QSTREFRETRS

SEQ ID NO: 1099594 - protein, 9 aa, Mycobacterium
QSTSFPSGH

SEQ ID NO: 1099595 - protein, 7 aa, Mycobacterium
QSVPGMG

SEQ ID NO: 1099596 - protein, 12 aa, Mycobacterium
QSVPPPARDGLA

SEQ ID NO: 1099597 - protein, 30 aa, Mycobacterium
QSVSDTAAAGAKVTEVKQGEPAEKAGIKDG

SEQ ID NO: 1099598 - protein, 4 aa, Mycobacterium
QSWP

SEQ ID NO: 1099599 - protein, 5 aa, Mycobacterium
QSWTQ

SEQ ID NO: 1099600 - protein, 9 aa, Mycobacterium
QTADTDEQR

SEQ ID NO: 1099601 - protein, 15 aa, Mycobacterium
QTAELPTGAVENTID

SEQ ID NO: 1099602 - protein, 7 aa, Mycobacterium
QTARRAH

SEQ ID NO: 1099603 - protein, 8 aa, Mycobacterium
QTDDGSVT

SEQ ID NO: 1099604 - protein, 5 aa, Mycobacterium
QTDGP

SEQ ID NO: 1099605 - protein, 5 aa, Mycobacterium
QTDPV

SEQ ID NO: 1099606 - protein, 7 aa, Mycobacterium
QTDSAAT

SEQ ID NO: 1099607 - protein, 17 aa, Mycobacterium
QTGDPQIDSFGDNVVER

SEQ ID NO: 1099608 - protein, 16 aa, Mycobacterium
QTGDPTKCDTFATNDL

SEQ ID NO: 1099609 - protein, 8 aa, Mycobacterium
QTGEHGTP

SEQ ID NO: 1099610 - protein, 9 aa, Mycobacterium
QTGPQNMPK

SEQ ID NO: 1099611 - protein, 4 aa, Mycobacterium
QTLG

SEQ ID NO: 1099612 - protein, 4 aa, Mycobacterium
QTLT

SEQ ID NO: 1099613 - protein, 9 aa, Mycobacterium
QTNQSQADC

SEQ ID NO: 1099614 - protein, 9 aa, Mycobacterium
QTPPPGTGV

SEQ ID NO: 1099615 - protein, 5 aa, Mycobacterium
QTPSA

SEQ ID NO: 1099616 - protein, 12 aa, Mycobacterium
QTREKPTEKRNW

SEQ ID NO: 1099617 - protein, 5 aa, Mycobacterium
QTTAE

SEQ ID NO: 1099618 - protein, 5 aa, Mycobacterium
QTTFG

SEQ ID NO: 1099619 - protein, 12 aa, Mycobacterium
QTTGGGSADQRV

SEQ ID NO: 1099620 - protein, 6 aa, Mycobacterium
QTTRDT

SEQ ID NO: 1099621 - protein, 6 aa, Mycobacterium
QTTSPL

SEQ ID NO: 1099622 - protein, 13 aa, Mycobacterium
QTVGVSRNNPTGM

SEQ ID NO: 1099623 - protein, 10 aa, Mycobacterium
QVADAKGVPV

SEQ ID NO: 1099624 - protein, 16 aa, Mycobacterium
QVEQNTGSGLTFCVGM

SEQ ID NO: 1099625 - protein, 8 aa, Mycobacterium
QVGSGTEI

SEQ ID NO: 1099626 - protein, 8 aa, Mycobacterium
QVNSGDNI

SEQ ID NO: 1099627 - protein, 11 aa, Mycobacterium
QVPEDATSAIA

SEQ ID NO: 1099628 - protein, 6 aa, Mycobacterium
QVPEPE

SEQ ID NO: 1099629 - protein, 18 aa, Mycobacterium
QVPTGLEEASRSLGRSPT

SEQ ID NO: 1099630 - protein, 15 aa, Mycobacterium
QVRPEARTTDRGTTY

SEQ ID NO: 1099631 - protein, 14 aa, Mycobacterium
QVRPGAAGAPPRLP

SEQ ID NO: 1099632 - protein, 9 aa, Mycobacterium
QVSPGGATS

SEQ ID NO: 1099633 - protein, 5 aa, Mycobacterium
QVTAA

SEQ ID NO: 1099634 - protein, 7 aa, Mycobacterium
QVTESEQ

SEQ ID NO: 1099635 - protein, 7 aa, Mycobacterium
QWSRQAN

SEQ ID NO: 1099636 - protein, 9 aa, Mycobacterium
QYGPAEADY

SEQ ID NO: 1099637 - protein, 5 aa, Mycobacterium
QYKGS

SEQ ID NO: 1099638 - protein, 27 aa, Mycobacterium
QYPASGAASKPVEPPRTGQVPTDPAEV

SEQ ID NO: 1099639 - protein, 8 aa, Mycobacterium
RAAAKRSS

SEQ ID NO: 1099640 - protein, 5 aa, Mycobacterium
RAADE

SEQ ID NO: 1099641 - protein, 21 aa, Mycobacterium
RAAERARREKNEQPWTAARRR

SEQ ID NO: 1099642 - protein, 10 aa, Mycobacterium
RAAGNARTGL

SEQ ID NO: 1099643 - protein, 9 aa, Mycobacterium
RAAGSAQRI

SEQ ID NO: 1099644 - protein, 8 aa, Mycobacterium
RAARNADL

SEQ ID NO: 1099645 - protein, 17 aa, Mycobacterium
RAARPAALTPSEQGPAR

SEQ ID NO: 1099646 - protein, 7 aa, Mycobacterium
RAASGRM

SEQ ID NO: 1099647 - protein, 7 aa, Mycobacterium
RAASPAL

SEQ ID NO: 1099648 - protein, 4 aa, Mycobacterium
RADE

SEQ ID NO: 1099649 - protein, 11 aa, Mycobacterium
RADGEGADRHA

SEQ ID NO: 1099650 - protein, 6 aa, Mycobacterium
RADGTL

SEQ ID NO: 1099651 - protein, 5 aa, Mycobacterium
RADKV

SEQ ID NO: 1099652 - protein, 17 aa, Mycobacterium
RADNPTTVKTSEIDQFP

SEQ ID NO: 1099653 - protein, 9 aa, Mycobacterium
RADNRITDT

SEQ ID NO: 1099654 - protein, 9 aa, Mycobacterium
RADNSGVPT

SEQ ID NO: 1099655 - protein, 12 aa, Mycobacterium
RADPSKATGLDG

SEQ ID NO: 1099656 - protein, 8 aa, Mycobacterium
RADRDPLT

SEQ ID NO: 1099657 - protein, 5 aa, Mycobacterium
RADTA

SEQ ID NO: 1099658 - protein, 8 aa, Mycobacterium
RADTHSDK

SEQ ID NO: 1099659 - protein, 5 aa, Mycobacterium
RADVS

SEQ ID NO: 1099660 - protein, 4 aa, Mycobacterium
RADY

SEQ ID NO: 1099661 - protein, 7 aa, Mycobacterium
RAEADRV

SEQ ID NO: 1099662 - protein, 12 aa, Mycobacterium
RAEASGLRGDGG

SEQ ID NO: 1099663 - protein, 12 aa, Mycobacterium
RAEDEAEGDPAD

SEQ ID NO: 1099664 - protein, 5 aa, Mycobacterium
RAEDV

SEQ ID NO: 1099665 - protein, 7 aa, Mycobacterium
RAEEAGL

SEQ ID NO: 1099666 - protein, 14 aa, Mycobacterium
RAEGGLTASFTVPV

SEQ ID NO: 1099667 - protein, 6 aa, Mycobacterium
RAEGRG

SEQ ID NO: 1099668 - protein, 7 aa, Mycobacterium
RAEGWRR

SEQ ID NO: 1099669 - protein, 4 aa, Mycobacterium
RAEH

SEQ ID NO: 1099670 - protein, 4 aa, Mycobacterium
RAEL

SEQ ID NO: 1099671 - protein, 9 aa, Mycobacterium
RAEPTEGNV

SEQ ID NO: 1099672 - protein, 8 aa, Mycobacterium
RAERTGRR

SEQ ID NO: 1099673 - protein, 9 aa, Mycobacterium
RAESEGRNM

SEQ ID NO: 1099674 - protein, 17 aa, Mycobacterium
RAESTSVAVGPQPPGVL

SEQ ID NO: 1099675 - protein, 14 aa, Mycobacterium
RAGAASAVTSTSRQ

SEQ ID NO: 1099676 - protein, 11 aa, Mycobacterium
RAGAEPGPVPP

SEQ ID NO: 1099677 - protein, 7 aa, Mycobacterium
RAGAGAL

SEQ ID NO: 1099678 - protein, 8 aa, Mycobacterium
RAGAGEGA

SEQ ID NO: 1099679 - protein, 5 aa, Mycobacterium
RAGDR

SEQ ID NO: 1099680 - protein, 9 aa, Mycobacterium
RAGEPNTVG

SEQ ID NO: 1099681 - protein, 27 aa, Mycobacterium
RAGGDLPPLETRPDATEATEPVPAAAR

SEQ ID NO: 1099682 - protein, 7 aa, Mycobacterium
RAGGNQA

SEQ ID NO: 1099683 - protein, 6 aa, Mycobacterium
RAGGSL

SEQ ID NO: 1099684 - protein, 12 aa, Mycobacterium
RAGKTNSGKGAA

SEQ ID NO: 1099685 - protein, 5 aa, Mycobacterium
RAGLD

SEQ ID NO: 1099686 - protein, 6 aa, Mycobacterium
RAGQPN

SEQ ID NO: 1099687 - protein, 7 aa, Mycobacterium
RAGQSTT

SEQ ID NO: 1099688 - protein, 17 aa, Mycobacterium
RAGRDAQQAADAAMATS

SEQ ID NO: 1099689 - protein, 8 aa, Mycobacterium
RAGRGVPG

SEQ ID NO: 1099690 - protein, 12 aa, Mycobacterium
RAGSEVVDPSNA

SEQ ID NO: 1099691 - protein, 4 aa, Mycobacterium
RAGT

SEQ ID NO: 1099692 - protein, 9 aa, Mycobacterium
RAIDGAATG

SEQ ID NO: 1099693 - protein, 13 aa, Mycobacterium
RAINAQSKPEEVQ

SEQ ID NO: 1099694 - protein, 8 aa, Mycobacterium
RAINEPDK

SEQ ID NO: 1099695 - protein, 12 aa, Mycobacterium
RAKQGASYGHTK

SEQ ID NO: 1099696 - protein, 13 aa, Mycobacterium
RALDAAATRRASH

SEQ ID NO: 1099697 - protein, 8 aa, Mycobacterium
RANGAELA

SEQ ID NO: 1099698 - protein, 7 aa, Mycobacterium
RANGPWG

SEQ ID NO: 1099699 - protein, 9 aa, Mycobacterium
RANPGLPTD

SEQ ID NO: 1099700 - protein, 10 aa, Mycobacterium
RANSTGEANY

SEQ ID NO: 1099701 - protein, 14 aa, Mycobacterium
RAPADTSMKELPSG

SEQ ID NO: 1099702 - protein, 12 aa, Mycobacterium
RAPARPGAGGRI

SEQ ID NO: 1099703 - protein, 8 aa, Mycobacterium
RAPDDPPR

SEQ ID NO: 1099704 - protein, 6 aa, Mycobacterium
RAPDGR

SEQ ID NO: 1099705 - protein, 4 aa, Mycobacterium
RAPG

SEQ ID NO: 1099706 - protein, 11 aa, Mycobacterium
RAPNPGGGYGA

SEQ ID NO: 1099707 - protein, 11 aa, Mycobacterium
RAPRMSPPPVM

SEQ ID NO: 1099708 - protein, 4 aa, Mycobacterium
RAQH

SEQ ID NO: 1099709 - protein, 8 aa, Mycobacterium
RAQPARPR

SEQ ID NO: 1099710 - protein, 6 aa, Mycobacterium
RAQSVG

SEQ ID NO: 1099711 - protein, 9 aa, Mycobacterium
RAQTGKAEV

SEQ ID NO: 1099712 - protein, 6 aa, Mycobacterium
RARAGA

SEQ ID NO: 1099713 - protein, 8 aa, Mycobacterium
RAREGDPV

SEQ ID NO: 1099714 - protein, 4 aa, Mycobacterium
RARR

SEQ ID NO: 1099715 - protein, 9 aa, Mycobacterium
RARRGDPKF

SEQ ID NO: 1099716 - protein, 8 aa, Mycobacterium
RARSPRVI

SEQ ID NO: 1099717 - protein, 15 aa, Mycobacterium
RARTDLAASGHTRAP

SEQ ID NO: 1099718 - protein, 8 aa, Mycobacterium
RARTDQQL

SEQ ID NO: 1099719 - protein, 8 aa, Mycobacterium
RARTPSVA

SEQ ID NO: 1099720 - protein, 16 aa, Mycobacterium
RASAPDLARRPPPTPV

SEQ ID NO: 1099721 - protein, 15 aa, Mycobacterium
RASDAPRQSPSPKPN

SEQ ID NO: 1099722 - protein, 17 aa, Mycobacterium
RASDTREERADETARIP

SEQ ID NO: 1099723 - protein, 11 aa, Mycobacterium
RASPLAGAASD

SEQ ID NO: 1099724 - protein, 15 aa, Mycobacterium
RASRREIRRTQPHRR

SEQ ID NO: 1099725 - protein, 9 aa, Mycobacterium
RASSGLTDE

SEQ ID NO: 1099726 - protein, 9 aa, Mycobacterium
RASSPALAS

SEQ ID NO: 1099727 - protein, 4 aa, Mycobacterium
RATA

SEQ ID NO: 1099728 - protein, 5 aa, Mycobacterium
RATAS

SEQ ID NO: 1099729 - protein, 5 aa, Mycobacterium
RATGA

SEQ ID NO: 1099730 - protein, 12 aa, Mycobacterium
RATGFSSAPAVG

SEQ ID NO: 1099731 - protein, 7 aa, Mycobacterium
RATGSAH

SEQ ID NO: 1099732 - protein, 23 aa, Mycobacterium
RATISQPAEQAVPDPEPAADVPS

SEQ ID NO: 1099733 - protein, 6 aa, Mycobacterium
RATPIS

SEQ ID NO: 1099734 - protein, 13 aa, Mycobacterium
RATRPARQKAGAA

SEQ ID NO: 1099735 - protein, 6 aa, Mycobacterium
RAVGGA

SEQ ID NO: 1099736 - protein, 7 aa, Mycobacterium
RAVPPRR

SEQ ID NO: 1099737 - protein, 16 aa, Mycobacterium
RAVRESTRFPVSDYAF

SEQ ID NO: 1099738 - protein, 5 aa, Mycobacterium
RAYTR

SEQ ID NO: 1099739 - protein, 5 aa, Mycobacterium
RCGED

SEQ ID NO: 1099740 - protein, 5 aa, Mycobacterium
RDAAG

SEQ ID NO: 1099741 - protein, 8 aa, Mycobacterium
RDAATDSL

SEQ ID NO: 1099742 - protein, 7 aa, Mycobacterium
RDADGNL

SEQ ID NO: 1099743 - protein, 5 aa, Mycobacterium
RDAGM

SEQ ID NO: 1099744 - protein, 9 aa, Mycobacterium
RDAGRIEDE

SEQ ID NO: 1099745 - protein, 9 aa, Mycobacterium
RDAGSGANL

SEQ ID NO: 1099746 - protein, 8 aa, Mycobacterium
RDAGVSNP

SEQ ID NO: 1099747 - protein, 9 aa, Mycobacterium
RDAKERLSA

SEQ ID NO: 1099748 - protein, 8 aa, Mycobacterium
RDDAELRD

SEQ ID NO: 1099749 - protein, 26 aa, Mycobacterium
RDDAGSEAARPVGQTQPTQETQPGWQ

SEQ ID NO: 1099750 - protein, 21 aa, Mycobacterium
RDDGAPQAAGPLTDASARTAI

SEQ ID NO: 1099751 - protein, 8 aa, Mycobacterium
RDDQGGTS

SEQ ID NO: 1099752 - protein, 6 aa, Mycobacterium
RDEAGG

SEQ ID NO: 1099753 - protein, 8 aa, Mycobacterium
RDEAPNAV

SEQ ID NO: 1099754 - protein, 16 aa, Mycobacterium
RDGDDAPRLRSDRESA

SEQ ID NO: 1099755 - protein, 9 aa, Mycobacterium
RDGEDYGTG

SEQ ID NO: 1099756 - protein, 7 aa, Mycobacterium
RDGGEAA

SEQ ID NO: 1099757 - protein, 16 aa, Mycobacterium
RDGQSLNIGNPDGPQL

SEQ ID NO: 1099758 - protein, 7 aa, Mycobacterium
RDGTRSE

SEQ ID NO: 1099759 - protein, 6 aa, Mycobacterium
RDKGPV

SEQ ID NO: 1099760 - protein, 7 aa, Mycobacterium
RDLPAAP

SEQ ID NO: 1099761 - protein, 6 aa, Mycobacterium
RDLRNP

SEQ ID NO: 1099762 - protein, 6 aa, Mycobacterium
RDNAER

SEQ ID NO: 1099763 - protein, 10 aa, Mycobacterium
RDNTDTFNTR

SEQ ID NO: 1099764 - protein, 7 aa, Mycobacterium
RDPADRY

SEQ ID NO: 1099765 - protein, 6 aa, Mycobacterium
RDPEYL

SEQ ID NO: 1099766 - protein, 10 aa, Mycobacterium
RDPHGRHRPA

SEQ ID NO: 1099767 - protein, 4 aa, Mycobacterium
RDPV

SEQ ID NO: 1099768 - protein, 7 aa, Mycobacterium
RDQETAV

SEQ ID NO: 1099769 - protein, 7 aa, Mycobacterium
RDQIPTD

SEQ ID NO: 1099770 - protein, 13 aa, Mycobacterium
RDQRRRRAYTPDD

SEQ ID NO: 1099771 - protein, 12 aa, Mycobacterium
RDRHGHAEPGAR

SEQ ID NO: 1099772 - protein, 6 aa, Mycobacterium
RDRNRG

SEQ ID NO: 1099773 - protein, 6 aa, Mycobacterium
RDRPDR

SEQ ID NO: 1099774 - protein, 6 aa, Mycobacterium
RDRSAA

SEQ ID NO: 1099775 - protein, 10 aa, Mycobacterium
RDSERAAEMS

SEQ ID NO: 1099776 - protein, 7 aa, Mycobacterium
RDSGHID

SEQ ID NO: 1099777 - protein, 31 aa, Mycobacterium
RDSTSSSVGGRSAPTPDAEREEHTDHVPVRV

SEQ ID NO: 1099778 - protein, 13 aa, Mycobacterium
RDSVPTDVRRQAT

SEQ ID NO: 1099779 - protein, 12 aa, Mycobacterium
RDTDHEDDGDNA

SEQ ID NO: 1099780 - protein, 8 aa, Mycobacterium
RDTETERG

SEQ ID NO: 1099781 - protein, 10 aa, Mycobacterium
RDTSPDDDGR

SEQ ID NO: 1099782 - protein, 7 aa, Mycobacterium
RDTVPTR

SEQ ID NO: 1099783 - protein, 12 aa, Mycobacterium
RDVEADRAHPTK

SEQ ID NO: 1099784 - protein, 11 aa, Mycobacterium
REAEAERERRA

SEQ ID NO: 1099785 - protein, 13 aa, Mycobacterium
REAGLSDDRGTFP

SEQ ID NO: 1099786 - protein, 17 aa, Mycobacterium
REAGRGPLVGERPARRS

SEQ ID NO: 1099787 - protein, 6 aa, Mycobacterium
REAPPS

SEQ ID NO: 1099788 - protein, 7 aa, Mycobacterium
REAQSAT

SEQ ID NO: 1099789 - protein, 10 aa, Mycobacterium
REASAERAYQ

SEQ ID NO: 1099790 - protein, 8 aa, Mycobacterium
REAYSGTG

SEQ ID NO: 1099791 - protein, 16 aa, Mycobacterium
REDAPEGHLSSTAPAA

SEQ ID NO: 1099792 - protein, 20 aa, Mycobacterium
REDEDTGIDETEHAETAYEL

SEQ ID NO: 1099793 - protein, 19 aa, Mycobacterium
REDGDAGTGDPQAVTPPGR

SEQ ID NO: 1099794 - protein, 18 aa, Mycobacterium
REDGPPTHHKKRGTPSMG

SEQ ID NO: 1099795 - protein, 6 aa, Mycobacterium
REEDLA

SEQ ID NO: 1099796 - protein, 11 aa, Mycobacterium
REETPDHGTRQ

SEQ ID NO: 1099797 - protein, 4 aa, Mycobacterium
REFG

SEQ ID NO: 1099798 - protein, 10 aa, Mycobacterium
REGGRGTAIG

SEQ ID NO: 1099799 - protein, 23 aa, Mycobacterium
REGWTATGNMAANGYANHSPAGY

SEQ ID NO: 1099800 - protein, 6 aa, Mycobacterium
REIGGE

SEQ ID NO: 1099801 - protein, 16 aa, Mycobacterium
REITDGPRNDTPRGGR

SEQ ID NO: 1099802 - protein, 4 aa, Mycobacterium
RENQ

SEQ ID NO: 1099803 - protein, 8 aa, Mycobacterium
RENRPPYP

SEQ ID NO: 1099804 - protein, 7 aa, Mycobacterium
REPDPLA

SEQ ID NO: 1099805 - protein, 18 aa, Mycobacterium
REPEPYDQPNPGPPVPGD

SEQ ID NO: 1099806 - protein, 5 aa, Mycobacterium
REPNR

SEQ ID NO: 1099807 - protein, 11 aa, Mycobacterium
REPPGRDRTSS

SEQ ID NO: 1099808 - protein, 5 aa, Mycobacterium
REPRR

SEQ ID NO: 1099809 - protein, 8 aa, Mycobacterium
REPSPRPA

SEQ ID NO: 1099810 - protein, 14 aa, Mycobacterium
REPTAGTVERPGAV

SEQ ID NO: 1099811 - protein, 4 aa, Mycobacterium
RERE

SEQ ID NO: 1099812 - protein, 13 aa, Mycobacterium
RERGKVEQAQDTE

SEQ ID NO: 1099813 - protein, 24 aa, Mycobacterium
RERQGTNGSNGAANGDGDGSPNGH

SEQ ID NO: 1099814 - protein, 13 aa, Mycobacterium
RERRAAAHATAGR

SEQ ID NO: 1099815 - protein, 5 aa, Mycobacterium
RERSH

SEQ ID NO: 1099816 - protein, 6 aa, Mycobacterium
RESFSS

SEQ ID NO: 1099817 - protein, 5 aa, Mycobacterium
RESPV

SEQ ID NO: 1099818 - protein, 17 aa, Mycobacterium
RESQPHATMVPRSMRRG

SEQ ID NO: 1099819 - protein, 7 aa, Mycobacterium
RESVRNG

SEQ ID NO: 1099820 - protein, 7 aa, Mycobacterium
RETPDAP

SEQ ID NO: 1099821 - protein, 9 aa, Mycobacterium
REVGAGQEA

SEQ ID NO: 1099822 - protein, 6 aa, Mycobacterium
RFDDRT

SEQ ID NO: 1099823 - protein, 18 aa, Mycobacterium
RFGGGDAGLTDADRHRRR

SEQ ID NO: 1099824 - protein, 11 aa, Mycobacterium
RFGGKQAGDAV

SEQ ID NO: 1099825 - protein, 12 aa, Mycobacterium
RFPGRNGPVQDA

SEQ ID NO: 1099826 - protein, 8 aa, Mycobacterium
RFPPPPGF

SEQ ID NO: 1099827 - protein, 4 aa, Mycobacterium
RGAA

SEQ ID NO: 1099828 - protein, 30 aa, Mycobacterium
RGADEDDQRSEYRSRPRARRSWDADAWEYD

SEQ ID NO: 1099829 - protein, 13 aa, Mycobacterium
RGAEQSGSRAAAD

SEQ ID NO: 1099830 - protein, 8 aa, Mycobacterium
RGAGDPRR

SEQ ID NO: 1099831 - protein, 8 aa, Mycobacterium
RGAPPNPA

SEQ ID NO: 1099832 - protein, 11 aa, Mycobacterium
RGASRKLTTKQ

SEQ ID NO: 1099833 - protein, 10 aa, Mycobacterium
RGATGSGDIG

SEQ ID NO: 1099834 - protein, 5 aa, Mycobacterium
RGDAR

SEQ ID NO: 1099835 - protein, 9 aa, Mycobacterium
RGDGTADGM

SEQ ID NO: 1099836 - protein, 10 aa, Mycobacterium
RGDLDRERAQ

SEQ ID NO: 1099837 - protein, 8 aa, Mycobacterium
RGDPDNNT

SEQ ID NO: 1099838 - protein, 15 aa, Mycobacterium
RGDPRGTYGRYMPPR

SEQ ID NO: 1099839 - protein, 15 aa, Mycobacterium
RGDSSRSRRGGSTGL

SEQ ID NO: 1099840 - protein, 7 aa, Mycobacterium
RGEADEL

SEQ ID NO: 1099841 - protein, 8 aa, Mycobacterium
RGEEEAGR

SEQ ID NO: 1099842 - protein, 8 aa, Mycobacterium
RGEKVKAP

SEQ ID NO: 1099843 - protein, 8 aa, Mycobacterium
RGESTRPA

SEQ ID NO: 1099844 - protein, 6 aa, Mycobacterium
RGGLEQ

SEQ ID NO: 1099845 - protein, 4 aa, Mycobacterium
RGGM

SEQ ID NO: 1099846 - protein, 8 aa, Mycobacterium
RGGPPLGG

SEQ ID NO: 1099847 - protein, 9 aa, Mycobacterium
RGGPQPGAR

SEQ ID NO: 1099848 - protein, 20 aa, Mycobacterium
RGGPYKTTGQTLTQKPECET

SEQ ID NO: 1099849 - protein, 4 aa, Mycobacterium
RGGR

SEQ ID NO: 1099850 - protein, 5 aa, Mycobacterium
RGGRN

SEQ ID NO: 1099851 - protein, 5 aa, Mycobacterium
RGHAE

SEQ ID NO: 1099852 - protein, 6 aa, Mycobacterium
RGHDET

SEQ ID NO: 1099853 - protein, 10 aa, Mycobacterium
RGHEPGAPIG

SEQ ID NO: 1099854 - protein, 5 aa, Mycobacterium
RGIGN

SEQ ID NO: 1099855 - protein, 7 aa, Mycobacterium
RGINESV

SEQ ID NO: 1099856 - protein, 6 aa, Mycobacterium
RGLAPA

SEQ ID NO: 1099857 - protein, 6 aa, Mycobacterium
RGLSAV

SEQ ID NO: 1099858 - protein, 8 aa, Mycobacterium
RGLSERAA

SEQ ID NO: 1099859 - protein, 7 aa, Mycobacterium
RGLSPER

SEQ ID NO: 1099860 - protein, 6 aa, Mycobacterium
RGNARL

SEQ ID NO: 1099861 - protein, 7 aa, Mycobacterium
RGPGAAG

SEQ ID NO: 1099862 - protein, 15 aa, Mycobacterium
RGPGGAAKPTASQSA

SEQ ID NO: 1099863 - protein, 5 aa, Mycobacterium
RGPLP

SEQ ID NO: 1099864 - protein, 8 aa, Mycobacterium
RGPMPPHA

SEQ ID NO: 1099865 - protein, 9 aa, Mycobacterium
RGQSPAEAS

SEQ ID NO: 1099866 - protein, 12 aa, Mycobacterium
RGRADPDGSTRG

SEQ ID NO: 1099867 - protein, 5 aa, Mycobacterium
RGRAG

SEQ ID NO: 1099868 - protein, 13 aa, Mycobacterium
RGRPGGVAAAAGS

SEQ ID NO: 1099869 - protein, 7 aa, Mycobacterium
RGRTVER

SEQ ID NO: 1099870 - protein, 4 aa, Mycobacterium
RGRY

SEQ ID NO: 1099871 - protein, 5 aa, Mycobacterium
RGSAG

SEQ ID NO: 1099872 - protein, 10 aa, Mycobacterium
RGSASPARTY

SEQ ID NO: 1099873 - protein, 20 aa, Mycobacterium
RGSNDRVPREDSSLPSGSGL

SEQ ID NO: 1099874 - protein, 5 aa, Mycobacterium
RGSRE

SEQ ID NO: 1099875 - protein, 12 aa, Mycobacterium
RGSTAAPGGSGL

SEQ ID NO: 1099876 - protein, 12 aa, Mycobacterium
RGSTASRSGSGL

SEQ ID NO: 1099877 - protein, 9 aa, Mycobacterium
RGSTLGAEV

SEQ ID NO: 1099878 - protein, 7 aa, Mycobacterium
RGSTPLD

SEQ ID NO: 1099879 - protein, 21 aa, Mycobacterium
RGSVGEADAGEDVDPEAPSDW

SEQ ID NO: 1099880 - protein, 4 aa, Mycobacterium
RGSY

SEQ ID NO: 1099881 - protein, 5 aa, Mycobacterium
RGTAV

SEQ ID NO: 1099882 - protein, 8 aa, Mycobacterium
RGTDDRDG

SEQ ID NO: 1099883 - protein, 5 aa, Mycobacterium
RGTGG

SEQ ID NO: 1099884 - protein, 23 aa, Mycobacterium
RGVAGGADDGKPAAEVKIISARL

SEQ ID NO: 1099885 - protein, 7 aa, Mycobacterium
RGVGPGD

SEQ ID NO: 1099886 - protein, 5 aa, Mycobacterium
RGVPA

SEQ ID NO: 1099887 - protein, 4 aa, Mycobacterium
RGVS

SEQ ID NO: 1099888 - protein, 46 aa, Mycobacterium
RGYRDEDYDEYDDYDDEYDADDPDSAAPEDFSDGYYDDPATSRDEQ

SEQ ID NO: 1099889 - protein, 14 aa, Mycobacterium
RGYSTKPGDGKAHH

SEQ ID NO: 1099890 - protein, 16 aa, Mycobacterium
RHEDEVGSEHPEEPTT

SEQ ID NO: 1099891 - protein, 7 aa, Mycobacterium
RHEPPQR

SEQ ID NO: 1099892 - protein, 7 aa, Mycobacterium
RHESREA

SEQ ID NO: 1099893 - protein, 6 aa, Mycobacterium
RHGDPT

SEQ ID NO: 1099894 - protein, 7 aa, Mycobacterium
RHGGTVT

SEQ ID NO: 1099895 - protein, 8 aa, Mycobacterium
RHGTPHRA

SEQ ID NO: 1099896 - protein, 9 aa, Mycobacterium
RHHEPPPAF

SEQ ID NO: 1099897 - protein, 7 aa, Mycobacterium
RHKGPWD

SEQ ID NO: 1099898 - protein, 14 aa, Mycobacterium
RHPASRDAEHSGPG

SEQ ID NO: 1099899 - protein, 4 aa, Mycobacterium
RHPG

SEQ ID NO: 1099900 - protein, 4 aa, Mycobacterium
RHPH

SEQ ID NO: 1099901 - protein, 23 aa, Mycobacterium
RHRNRSSAAPAAPNDGTDENQDR

SEQ ID NO: 1099902 - protein, 9 aa, Mycobacterium
RHSDALPGD

SEQ ID NO: 1099903 - protein, 5 aa, Mycobacterium
RHTTD

SEQ ID NO: 1099904 - protein, 18 aa, Mycobacterium
RIDPDDELDTDDSAATEV

SEQ ID NO: 1099905 - protein, 22 aa, Mycobacterium
RIGENSGMGAGTTDDAAGARSD

SEQ ID NO: 1099906 - protein, 5 aa, Mycobacterium
RIGGG

SEQ ID NO: 1099907 - protein, 4 aa, Mycobacterium
RIGR

SEQ ID NO: 1099908 - protein, 16 aa, Mycobacterium
RIQRRDPERDALRRAG

SEQ ID NO: 1099909 - protein, 8 aa, Mycobacterium
RITTDASV

SEQ ID NO: 1099910 - protein, 16 aa, Mycobacterium
RKAAKRAGIAAPPIEP

SEQ ID NO: 1099911 - protein, 7 aa, Mycobacterium
RKAESAD

SEQ ID NO: 1099912 - protein, 15 aa, Mycobacterium
RKALPADSESNRAYQ

SEQ ID NO: 1099913 - protein, 4 aa, Mycobacterium
RKAP

SEQ ID NO: 1099914 - protein, 8 aa, Mycobacterium
RKGAASSV

SEQ ID NO: 1099915 - protein, 4 aa, Mycobacterium
RKIT

SEQ ID NO: 1099916 - protein, 10 aa, Mycobacterium
RKNWGGREHP

SEQ ID NO: 1099917 - protein, 8 aa, Mycobacterium
RKPDTTPR

SEQ ID NO: 1099918 - protein, 7 aa, Mycobacterium
RKQDNPG

SEQ ID NO: 1099919 - protein, 18 aa, Mycobacterium
RKTTRTDGEVTEVSAEKG

SEQ ID NO: 1099920 - protein, 11 aa, Mycobacterium
RLAEAPDAAAL

SEQ ID NO: 1099921 - protein, 8 aa, Mycobacterium
RLASSGQL

SEQ ID NO: 1099922 - protein, 12 aa, Mycobacterium
RLDNDRQRHRGP

SEQ ID NO: 1099923 - protein, 6 aa, Mycobacterium
RLEEPY

SEQ ID NO: 1099924 - protein, 12 aa, Mycobacterium
RLEGRPVPVTGD

SEQ ID NO: 1099925 - protein, 5 aa, Mycobacterium
RLGKD

SEQ ID NO: 1099926 - protein, 15 aa, Mycobacterium
RLGRREPAVYGSTTH

SEQ ID NO: 1099927 - protein, 10 aa, Mycobacterium
RLGSDSTAHI

SEQ ID NO: 1099928 - protein, 7 aa, Mycobacterium
RLKAGES

SEQ ID NO: 1099929 - protein, 10 aa, Mycobacterium
RLNSSSAQIA

SEQ ID NO: 1099930 - protein, 19 aa, Mycobacterium
RLPAGAPLPEPSSAPPPPV

SEQ ID NO: 1099931 - protein, 5 aa, Mycobacterium
RLPEG

SEQ ID NO: 1099932 - protein, 6 aa, Mycobacterium
RLPGPG

SEQ ID NO: 1099933 - protein, 7 aa, Mycobacterium
RLPTSGG

SEQ ID NO: 1099934 - protein, 8 aa, Mycobacterium
RLSPRGSE

SEQ ID NO: 1099935 - protein, 6 aa, Mycobacterium
RLTGAE

SEQ ID NO: 1099936 - protein, 34 aa, Mycobacterium
RLVPGGAHRGDDSEEQVASAAGDDTPPRRDPEAI

SEQ ID NO: 1099937 - protein, 9 aa, Mycobacterium
RMSRSQTDR

SEQ ID NO: 1099938 - protein, 8 aa, Mycobacterium
RNAAADDI

SEQ ID NO: 1099939 - protein, 10 aa, Mycobacterium
RNAAPTPPVR

SEQ ID NO: 1099940 - protein, 11 aa, Mycobacterium
RNAQDEPAPLT

SEQ ID NO: 1099941 - protein, 6 aa, Mycobacterium
RNDTAV

SEQ ID NO: 1099942 - protein, 23 aa, Mycobacterium
RNEHADESPVPVGADHGDDAPTQ

SEQ ID NO: 1099943 - protein, 9 aa, Mycobacterium
RNGGDQTVK

SEQ ID NO: 1099944 - protein, 14 aa, Mycobacterium
RNGITVKDPDGKLR

SEQ ID NO: 1099945 - protein, 16 aa, Mycobacterium
RNKQHTGHHTSAPQDL

SEQ ID NO: 1099946 - protein, 5 aa, Mycobacterium
RNNPD

SEQ ID NO: 1099947 - protein, 17 aa, Mycobacterium
RNNQERLTSGALSTAGT

SEQ ID NO: 1099948 - protein, 6 aa, Mycobacterium
RNPGSP

SEQ ID NO: 1099949 - protein, 7 aa, Mycobacterium
RNPKATL

SEQ ID NO: 1099950 - protein, 12 aa, Mycobacterium
RNPRPPQSTIDA

SEQ ID NO: 1099951 - protein, 7 aa, Mycobacterium
RNRADDV

SEQ ID NO: 1099952 - protein, 7 aa, Mycobacterium
RNRGGSI

SEQ ID NO: 1099953 - protein, 8 aa, Mycobacterium
RNSTRAGA

SEQ ID NO: 1099954 - protein, 18 aa, Mycobacterium
RNTDRIGTATLNTNQNIA

SEQ ID NO: 1099955 - protein, 7 aa, Mycobacterium
RNTDRVR

SEQ ID NO: 1099956 - protein, 5 aa, Mycobacterium
RPADA

SEQ ID NO: 1099957 - protein, 7 aa, Mycobacterium
RPAEDRA

SEQ ID NO: 1099958 - protein, 15 aa, Mycobacterium
RPAESVPADQPGRGL

SEQ ID NO: 1099959 - protein, 10 aa, Mycobacterium
RPAGEPGATT

SEQ ID NO: 1099960 - protein, 12 aa, Mycobacterium
RPAGPPPPPKKS

SEQ ID NO: 1099961 - protein, 20 aa, Mycobacterium
RPALTASGDDAGERGSGADT

SEQ ID NO: 1099962 - protein, 8 aa, Mycobacterium
RPAPAGAT

SEQ ID NO: 1099963 - protein, 20 aa, Mycobacterium
RPDATAPADPELLKRIHTGT

SEQ ID NO: 1099964 - protein, 12 aa, Mycobacterium
RPDAYTAAGKLT

SEQ ID NO: 1099965 - protein, 8 aa, Mycobacterium
RPDDQTTF

SEQ ID NO: 1099966 - protein, 12 aa, Mycobacterium
RPDGQFAYRGDG

SEQ ID NO: 1099967 - protein, 8 aa, Mycobacterium
RPDGSYQA

SEQ ID NO: 1099968 - protein, 5 aa, Mycobacterium
RPDLK

SEQ ID NO: 1099969 - protein, 5 aa, Mycobacterium
RPDNA

SEQ ID NO: 1099970 - protein, 6 aa, Mycobacterium
RPDRDP

SEQ ID NO: 1099971 - protein, 11 aa, Mycobacterium
RPDTGGPDSLD

SEQ ID NO: 1099972 - protein, 7 aa, Mycobacterium
RPDTPHR

SEQ ID NO: 1099973 - protein, 4 aa, Mycobacterium
RPDV

SEQ ID NO: 1099974 - protein, 4 aa, Mycobacterium
RPEA

SEQ ID NO: 1099975 - protein, 8 aa, Mycobacterium
RPEAADRV

SEQ ID NO: 1099976 - protein, 8 aa, Mycobacterium
RPEAEEND

SEQ ID NO: 1099977 - protein, 4 aa, Mycobacterium
RPED

SEQ ID NO: 1099978 - protein, 13 aa, Mycobacterium
RPEDLQKNPATVG

SEQ ID NO: 1099979 - protein, 6 aa, Mycobacterium
RPEEPL

SEQ ID NO: 1099980 - protein, 4 aa, Mycobacterium
RPEL

SEQ ID NO: 1099981 - protein, 9 aa, Mycobacterium
RPEPAPKPV

SEQ ID NO: 1099982 - protein, 6 aa, Mycobacterium
RPGAKA

SEQ ID NO: 1099983 - protein, 21 aa, Mycobacterium
RPGGQDGRDGHDDSPTTEQQR

SEQ ID NO: 1099984 - protein, 5 aa, Mycobacterium
RPGIA

SEQ ID NO: 1099985 - protein, 8 aa, Mycobacterium
RPGKPTAD

SEQ ID NO: 1099986 - protein, 7 aa, Mycobacterium
RPGPEPN

SEQ ID NO: 1099987 - protein, 8 aa, Mycobacterium
RPGQTDAD

SEQ ID NO: 1099988 - protein, 6 aa, Mycobacterium
RPGVGT

SEQ ID NO: 1099989 - protein, 17 aa, Mycobacterium
RPHDDGDRDDPAPQPAR

SEQ ID NO: 1099990 - protein, 7 aa, Mycobacterium
RPHEPSM

SEQ ID NO: 1099991 - protein, 8 aa, Mycobacterium
RPLGEVPP

SEQ ID NO: 1099992 - protein, 4 aa, Mycobacterium
RPLP

SEQ ID NO: 1099993 - protein, 17 aa, Mycobacterium
RPLTPGGNGTAPVPAAQ

SEQ ID NO: 1099994 - protein, 5 aa, Mycobacterium
RPMGP

SEQ ID NO: 1099995 - protein, 7 aa, Mycobacterium
RPNPGIG

SEQ ID NO: 1099996 - protein, 10 aa, Mycobacterium
RPNRLGSTEY

SEQ ID NO: 1099997 - protein, 10 aa, Mycobacterium
RPPAHAPTRA

SEQ ID NO: 1099998 - protein, 8 aa, Mycobacterium
RPPAPAVA

SEQ ID NO: 1099999 - protein, 5 aa, Mycobacterium
RPPEQ

SEQ ID NO: 1100000 - protein, 16 aa, Mycobacterium
RPPEVGVPSENPRLDE

SEQ ID NO: 1100001 - protein, 4 aa, Mycobacterium
RPPL

SEQ ID NO: 1100002 - protein, 8 aa, Mycobacterium
RPPPPPWY

SEQ ID NO: 1100003 - protein, 9 aa, Mycobacterium
RPPPTPRPV

SEQ ID NO: 1100004 - protein, 18 aa, Mycobacterium
RPPSYDAAAQAGAKDTAC

SEQ ID NO: 1100005 - protein, 5 aa, Mycobacterium
RPPVD

SEQ ID NO: 1100006 - protein, 8 aa, Mycobacterium
RPRDAPVR

SEQ ID NO: 1100007 - protein, 13 aa, Mycobacterium
RPRGPGPSRMTGE

SEQ ID NO: 1100008 - protein, 9 aa, Mycobacterium
RPRPAGPVE

SEQ ID NO: 1100009 - protein, 6 aa, Mycobacterium
RPRRRT

SEQ ID NO: 1100010 - protein, 4 aa, Mycobacterium
RPSA

SEQ ID NO: 1100011 - protein, 18 aa, Mycobacterium
RPSGDASVDRASRPDLAR

SEQ ID NO: 1100012 - protein, 5 aa, Mycobacterium
RPSGL

SEQ ID NO: 1100013 - protein, 6 aa, Mycobacterium
RPSSGV

SEQ ID NO: 1100014 - protein, 13 aa, Mycobacterium
RPTADQRPSPAEA

SEQ ID NO: 1100015 - protein, 6 aa, Mycobacterium
RPTAVQ

SEQ ID NO: 1100016 - protein, 6 aa, Mycobacterium
RPTTVG

SEQ ID NO: 1100017 - protein, 9 aa, Mycobacterium
RPVRGGLGG

SEQ ID NO: 1100018 - protein, 10 aa, Mycobacterium
RPVTAPGHAD

SEQ ID NO: 1100019 - protein, 4 aa, Mycobacterium
RPWQ

SEQ ID NO: 1100020 - protein, 11 aa, Mycobacterium
RPYPADSLEEQ

SEQ ID NO: 1100021 - protein, 10 aa, Mycobacterium
RQADGGVPKG

SEQ ID NO: 1100022 - protein, 10 aa, Mycobacterium
RQAGAGGTVP

SEQ ID NO: 1100023 - protein, 13 aa, Mycobacterium
RQAGDASGLTGTN

SEQ ID NO: 1100024 - protein, 16 aa, Mycobacterium
RQGDRQDSRDADGGDL

SEQ ID NO: 1100025 - protein, 4 aa, Mycobacterium
RQIG

SEQ ID NO: 1100026 - protein, 9 aa, Mycobacterium
RQLSPEEKR

SEQ ID NO: 1100027 - protein, 6 aa, Mycobacterium
RQPALD

SEQ ID NO: 1100028 - protein, 4 aa, Mycobacterium
RQPP

SEQ ID NO: 1100029 - protein, 12 aa, Mycobacterium
RQPVDNPDQRIQ

SEQ ID NO: 1100030 - protein, 9 aa, Mycobacterium
RQQQSAEFE

SEQ ID NO: 1100031 - protein, 9 aa, Mycobacterium
RQRDPGSPQ

SEQ ID NO: 1100032 - protein, 12 aa, Mycobacterium
RQRPATTGSLIR

SEQ ID NO: 1100033 - protein, 5 aa, Mycobacterium
RQRPR

SEQ ID NO: 1100034 - protein, 11 aa, Mycobacterium
RQRSESAGRSL

SEQ ID NO: 1100035 - protein, 10 aa, Mycobacterium
RQSRPVGTSA

SEQ ID NO: 1100036 - protein, 9 aa, Mycobacterium
RQTEEQSRR

SEQ ID NO: 1100037 - protein, 5 aa, Mycobacterium
RQTEK

SEQ ID NO: 1100038 - protein, 11 aa, Mycobacterium
RQVDPSDPNAL

SEQ ID NO: 1100039 - protein, 24 aa, Mycobacterium
RQVETGANGIADNLESAGDQTKDV

SEQ ID NO: 1100040 - protein, 10 aa, Mycobacterium
RRAADREVAT

SEQ ID NO: 1100041 - protein, 5 aa, Mycobacterium
RRAGA

SEQ ID NO: 1100042 - protein, 9 aa, Mycobacterium
RRAGGNQAR

SEQ ID NO: 1100043 - protein, 9 aa, Mycobacterium
RRAGRDSAR

SEQ ID NO: 1100044 - protein, 8 aa, Mycobacterium
RRAGRELG

SEQ ID NO: 1100045 - protein, 12 aa, Mycobacterium
RRAGSLQPGELA

SEQ ID NO: 1100046 - protein, 5 aa, Mycobacterium
RRALT

SEQ ID NO: 1100047 - protein, 8 aa, Mycobacterium
RRATGGGP

SEQ ID NO: 1100048 - protein, 7 aa, Mycobacterium
RRDAPRT

SEQ ID NO: 1100049 - protein, 15 aa, Mycobacterium
RRDARQNPDPDRRSD

SEQ ID NO: 1100050 - protein, 8 aa, Mycobacterium
RRDDRDHH

SEQ ID NO: 1100051 - protein, 9 aa, Mycobacterium
RRDEDLPAT

SEQ ID NO: 1100052 - protein, 10 aa, Mycobacterium
RRDGDEAARQ

SEQ ID NO: 1100053 - protein, 12 aa, Mycobacterium
RRDGVGRPGQLR

SEQ ID NO: 1100054 - protein, 10 aa, Mycobacterium
RRDRTVPHGP

SEQ ID NO: 1100055 - protein, 7 aa, Mycobacterium
RRDTGEL

SEQ ID NO: 1100056 - protein, 8 aa, Mycobacterium
RREGDGRA

SEQ ID NO: 1100057 - protein, 15 aa, Mycobacterium
RRGADENRSAPAEVA

SEQ ID NO: 1100058 - protein, 5 aa, Mycobacterium
RRGAR

SEQ ID NO: 1100059 - protein, 5 aa, Mycobacterium
RRGDQ

SEQ ID NO: 1100060 - protein, 12 aa, Mycobacterium
RRGNTDDDTKQV

SEQ ID NO: 1100061 - protein, 7 aa, Mycobacterium
RRGPRRH

SEQ ID NO: 1100062 - protein, 4 aa, Mycobacterium
RRGR

SEQ ID NO: 1100063 - protein, 22 aa, Mycobacterium
RRGRRPTEEDPPTLQPAATQEM

SEQ ID NO: 1100064 - protein, 12 aa, Mycobacterium
RRGSIGPEARTR

SEQ ID NO: 1100065 - protein, 6 aa, Mycobacterium
RRGYPI

SEQ ID NO: 1100066 - protein, 66 aa, Mycobacterium
RRKPGRRSAAVTAPVDDDTVADEPEKVTAASAPVTSAPADKPAPGAKPSRPTSRPSRPTGKRTSRG

SEQ ID NO: 1100067 - protein, 9 aa, Mycobacterium
RRKSTPRAE

SEQ ID NO: 1100068 - protein, 6 aa, Mycobacterium
RRNEMN

SEQ ID NO: 1100069 - protein, 19 aa, Mycobacterium
RRNLDPRVANPDVEGRPRP

SEQ ID NO: 1100070 - protein, 4 aa, Mycobacterium
RRNT

SEQ ID NO: 1100071 - protein, 9 aa, Mycobacterium
RRPASKVRG

SEQ ID NO: 1100072 - protein, 8 aa, Mycobacterium
RRPDTTQS

SEQ ID NO: 1100073 - protein, 12 aa, Mycobacterium
RRPFPERLGPKG

SEQ ID NO: 1100074 - protein, 4 aa, Mycobacterium
RRPG

SEQ ID NO: 1100075 - protein, 6 aa, Mycobacterium
RRPGEV

SEQ ID NO: 1100076 - protein, 24 aa, Mycobacterium
RRPISTKPVTQTPIAAASTEVIDK

SEQ ID NO: 1100077 - protein, 10 aa, Mycobacterium
RRPKAERTPF

SEQ ID NO: 1100078 - protein, 10 aa, Mycobacterium
RRPPLTPGRT

SEQ ID NO: 1100079 - protein, 13 aa, Mycobacterium
RRPRQPTGGPGAR

SEQ ID NO: 1100080 - protein, 15 aa, Mycobacterium
RRPTKAGVTGTGKPH

SEQ ID NO: 1100081 - protein, 6 aa, Mycobacterium
RRQVEQ

SEQ ID NO: 1100082 - protein, 21 aa, Mycobacterium
RRQYDDGTLPSTGDRPDAPAI

SEQ ID NO: 1100083 - protein, 12 aa, Mycobacterium
RRRAEENESGIE

SEQ ID NO: 1100084 - protein, 6 aa, Mycobacterium
RRRAHP

SEQ ID NO: 1100085 - protein, 21 aa, Mycobacterium
RRRDTEDAGEKAADGKDGIEA

SEQ ID NO: 1100086 - protein, 5 aa, Mycobacterium
RRREQ

SEQ ID NO: 1100087 - protein, 9 aa, Mycobacterium
RRRGAVNEQ

SEQ ID NO: 1100088 - protein, 9 aa, Mycobacterium
RRRGGAGRL

SEQ ID NO: 1100089 - protein, 14 aa, Mycobacterium
RRRGIPKSETPVAV

SEQ ID NO: 1100090 - protein, 23 aa, Mycobacterium
RRRKKSEPVPAQPDPQPEKVGAP

SEQ ID NO: 1100091 - protein, 11 aa, Mycobacterium
RRRKRRAAEIE

SEQ ID NO: 1100092 - protein, 6 aa, Mycobacterium
RRRPNG

SEQ ID NO: 1100093 - protein, 6 aa, Mycobacterium
RRRPRG

SEQ ID NO: 1100094 - protein, 9 aa, Mycobacterium
RRRPSNRTL

SEQ ID NO: 1100095 - protein, 9 aa, Mycobacterium
RRRRARAGE

SEQ ID NO: 1100096 - protein, 11 aa, Mycobacterium
RRRSDSGAARA

SEQ ID NO: 1100097 - protein, 4 aa, Mycobacterium
RRRT

SEQ ID NO: 1100098 - protein, 7 aa, Mycobacterium
RRRTDGQ

SEQ ID NO: 1100099 - protein, 15 aa, Mycobacterium
RRRTGPAQGQHLRPS

SEQ ID NO: 1100100 - protein, 26 aa, Mycobacterium
RRRTPRERTSTTPAEHVDRDESKSSS

SEQ ID NO: 1100101 - protein, 13 aa, Mycobacterium
RRSASVDDANLLK

SEQ ID NO: 1100102 - protein, 13 aa, Mycobacterium
RRSRRGPAPLDTE

SEQ ID NO: 1100103 - protein, 6 aa, Mycobacterium
RRSRSL

SEQ ID NO: 1100104 - protein, 12 aa, Mycobacterium
RRTAERGRDARR

SEQ ID NO: 1100105 - protein, 21 aa, Mycobacterium
RRTAGEASESPQVPPGDHALQ

SEQ ID NO: 1100106 - protein, 10 aa, Mycobacterium
RRTASSGGEW

SEQ ID NO: 1100107 - protein, 10 aa, Mycobacterium
RRTDERSRVA

SEQ ID NO: 1100108 - protein, 12 aa, Mycobacterium
RRVPQRDPRTEV

SEQ ID NO: 1100109 - protein, 4 aa, Mycobacterium
RRVT

SEQ ID NO: 1100110 - protein, 7 aa, Mycobacterium
RRYADDP

SEQ ID NO: 1100111 - protein, 4 aa, Mycobacterium
RSAG

SEQ ID NO: 1100112 - protein, 8 aa, Mycobacterium
RSAGDPAR

SEQ ID NO: 1100113 - protein, 15 aa, Mycobacterium
RSAGEPGMTTAGSTL

SEQ ID NO: 1100114 - protein, 7 aa, Mycobacterium
RSASGLD

SEQ ID NO: 1100115 - protein, 9 aa, Mycobacterium
RSDQDTKER

SEQ ID NO: 1100116 - protein, 4 aa, Mycobacterium
RSDS

SEQ ID NO: 1100117 - protein, 7 aa, Mycobacterium
RSDYPRS

SEQ ID NO: 1100118 - protein, 9 aa, Mycobacterium
RSEDDKFGV

SEQ ID NO: 1100119 - protein, 7 aa, Mycobacterium
RSEGPAV

SEQ ID NO: 1100120 - protein, 12 aa, Mycobacterium
RSGATRPRKDEA

SEQ ID NO: 1100121 - protein, 5 aa, Mycobacterium
RSGED

SEQ ID NO: 1100122 - protein, 6 aa, Mycobacterium
RSGHET

SEQ ID NO: 1100123 - protein, 9 aa, Mycobacterium
RSGLDTSRF

SEQ ID NO: 1100124 - protein, 10 aa, Mycobacterium
RSGTQAPANL

SEQ ID NO: 1100125 - protein, 12 aa, Mycobacterium
RSHAERVATEAS

SEQ ID NO: 1100126 - protein, 10 aa, Mycobacterium
RSLNDRDETL

SEQ ID NO: 1100127 - protein, 5 aa, Mycobacterium
RSLNE

SEQ ID NO: 1100128 - protein, 10 aa, Mycobacterium
RSLNNRNESL

SEQ ID NO: 1100129 - protein, 16 aa, Mycobacterium
RSLPESVAGRTRTPTR

SEQ ID NO: 1100130 - protein, 7 aa, Mycobacterium
RSLTPET

SEQ ID NO: 1100131 - protein, 5 aa, Mycobacterium
RSNAE

SEQ ID NO: 1100132 - protein, 9 aa, Mycobacterium
RSNDESADF

SEQ ID NO: 1100133 - protein, 9 aa, Mycobacterium
RSPAQSVGS

SEQ ID NO: 1100134 - protein, 44 aa, Mycobacterium
RSPASRPGKPGGANRGRPKGTSTPRREPRAIEAKPASEQPYAES

SEQ ID NO: 1100135 - protein, 5 aa, Mycobacterium
RSPVD

SEQ ID NO: 1100136 - protein, 16 aa, Mycobacterium
RSQDIPAVAPDAVAAA

SEQ ID NO: 1100137 - protein, 7 aa, Mycobacterium
RSQSTNL

SEQ ID NO: 1100138 - protein, 7 aa, Mycobacterium
RSRGAAS

SEQ ID NO: 1100139 - protein, 11 aa, Mycobacterium
RSRPATGDDLT

SEQ ID NO: 1100140 - protein, 8 aa, Mycobacterium
RSRQRTGA

SEQ ID NO: 1100141 - protein, 26 aa, Mycobacterium
RSRRRRPAARDRDDRSGARSSSNEGA

SEQ ID NO: 1100142 - protein, 6 aa, Mycobacterium
RSRSTA

SEQ ID NO: 1100143 - protein, 10 aa, Mycobacterium
RSSETAPLQT

SEQ ID NO: 1100144 - protein, 8 aa, Mycobacterium
RSSGYSIG

SEQ ID NO: 1100145 - protein, 4 aa, Mycobacterium
RSSP

SEQ ID NO: 1100146 - protein, 7 aa, Mycobacterium
RSTDYSR

SEQ ID NO: 1100147 - protein, 7 aa, Mycobacterium
RSTVEQH

SEQ ID NO: 1100148 - protein, 9 aa, Mycobacterium
RSWAQAPRQ

SEQ ID NO: 1100149 - protein, 6 aa, Mycobacterium
RSWTRP

SEQ ID NO: 1100150 - protein, 8 aa, Mycobacterium
RTAADVTE

SEQ ID NO: 1100151 - protein, 25 aa, Mycobacterium
RTADPPRDPTRRPRHASGREPDRRT

SEQ ID NO: 1100152 - protein, 15 aa, Mycobacterium
RTARAAGITPAATGA

SEQ ID NO: 1100153 - protein, 6 aa, Mycobacterium
RTATEA

SEQ ID NO: 1100154 - protein, 6 aa, Mycobacterium
RTATGA

SEQ ID NO: 1100155 - protein, 10 aa, Mycobacterium
RTATNHRGAQ

SEQ ID NO: 1100156 - protein, 5 aa, Mycobacterium
RTDDD

SEQ ID NO: 1100157 - protein, 8 aa, Mycobacterium
RTDGQGRN

SEQ ID NO: 1100158 - protein, 10 aa, Mycobacterium
RTDRGEPSLY

SEQ ID NO: 1100159 - protein, 9 aa, Mycobacterium
RTGAEGPDV

SEQ ID NO: 1100160 - protein, 4 aa, Mycobacterium
RTGG

SEQ ID NO: 1100161 - protein, 5 aa, Mycobacterium
RTGRS

SEQ ID NO: 1100162 - protein, 22 aa, Mycobacterium
RTGTRRTCPPSEPKAESAPSTS

SEQ ID NO: 1100163 - protein, 4 aa, Mycobacterium
RTGV

SEQ ID NO: 1100164 - protein, 4 aa, Mycobacterium
RTGW

SEQ ID NO: 1100165 - protein, 7 aa, Mycobacterium
RTPDSEL

SEQ ID NO: 1100166 - protein, 5 aa, Mycobacterium
RTPGF

SEQ ID NO: 1100167 - protein, 5 aa, Mycobacterium
RTPPT

SEQ ID NO: 1100168 - protein, 6 aa, Mycobacterium
RTPPYK

SEQ ID NO: 1100169 - protein, 5 aa, Mycobacterium
RTPRT

SEQ ID NO: 1100170 - protein, 9 aa, Mycobacterium
RTPRTDTTR

SEQ ID NO: 1100171 - protein, 12 aa, Mycobacterium
RTRDGELAYPSG

SEQ ID NO: 1100172 - protein, 13 aa, Mycobacterium
RTRGVKVGERVHD

SEQ ID NO: 1100173 - protein, 7 aa, Mycobacterium
RTRIGDP

SEQ ID NO: 1100174 - protein, 6 aa, Mycobacterium
RTSEGE

SEQ ID NO: 1100175 - protein, 18 aa, Mycobacterium
RTSPERSAPPVAPDEPAT

SEQ ID NO: 1100176 - protein, 7 aa, Mycobacterium
RTSPGAM

SEQ ID NO: 1100177 - protein, 11 aa, Mycobacterium
RTTAAATPPHG

SEQ ID NO: 1100178 - protein, 9 aa, Mycobacterium
RTTARRDGD

SEQ ID NO: 1100179 - protein, 10 aa, Mycobacterium
RTTEDTAQLS

SEQ ID NO: 1100180 - protein, 10 aa, Mycobacterium
RTTPPRTSAS

SEQ ID NO: 1100181 - protein, 17 aa, Mycobacterium
RTTRPHAGETMKDTKNM

SEQ ID NO: 1100182 - protein, 8 aa, Mycobacterium
RTVPARTA

SEQ ID NO: 1100183 - protein, 8 aa, Mycobacterium
RVAPSRAV

SEQ ID NO: 1100184 - protein, 9 aa, Mycobacterium
RVDDPAGGV

SEQ ID NO: 1100185 - protein, 6 aa, Mycobacterium
RVDGAG

SEQ ID NO: 1100186 - protein, 8 aa, Mycobacterium
RVDGAGPV

SEQ ID NO: 1100187 - protein, 11 aa, Mycobacterium
RVDGTDAERPR

SEQ ID NO: 1100188 - protein, 4 aa, Mycobacterium
RVDV

SEQ ID NO: 1100189 - protein, 8 aa, Mycobacterium
RVEKSQRA

SEQ ID NO: 1100190 - protein, 24 aa, Mycobacterium
RVEPEPDTVIPSSAPEAEAAPPRK

SEQ ID NO: 1100191 - protein, 7 aa, Mycobacterium
RVGADTQ

SEQ ID NO: 1100192 - protein, 14 aa, Mycobacterium
RVGPPTAATGVRDG

SEQ ID NO: 1100193 - protein, 5 aa, Mycobacterium
RVGSK

SEQ ID NO: 1100194 - protein, 15 aa, Mycobacterium
RVNDPTAAALRATNS

SEQ ID NO: 1100195 - protein, 8 aa, Mycobacterium
RVPAESRA

SEQ ID NO: 1100196 - protein, 8 aa, Mycobacterium
RVRGAGRA

SEQ ID NO: 1100197 - protein, 4 aa, Mycobacterium
RVRR

SEQ ID NO: 1100198 - protein, 5 aa, Mycobacterium
RVRTS

SEQ ID NO: 1100199 - protein, 5 aa, Mycobacterium
RVSAT

SEQ ID NO: 1100200 - protein, 11 aa, Mycobacterium
RYNPESGRAEL

SEQ ID NO: 1100201 - protein, 9 aa, Mycobacterium
RYPESGGTY

SEQ ID NO: 1100202 - protein, 5 aa, Mycobacterium
RYPQN

SEQ ID NO: 1100203 - protein, 7 aa, Mycobacterium
RYQSGQL

SEQ ID NO: 1100204 - protein, 21 aa, Mycobacterium
RYRPSDGGPSDDGEGADEHGR

SEQ ID NO: 1100205 - protein, 6 aa, Mycobacterium
SAAAAS

SEQ ID NO: 1100206 - protein, 9 aa, Mycobacterium
SAAASGGGL

SEQ ID NO: 1100207 - protein, 14 aa, Mycobacterium
SAADAAARAIGTAG

SEQ ID NO: 1100208 - protein, 15 aa, Mycobacterium
SAADAKRSTNPSEAI

SEQ ID NO: 1100209 - protein, 10 aa, Mycobacterium
SAAERPGHNY

SEQ ID NO: 1100210 - protein, 10 aa, Mycobacterium
SAALASQAYN

SEQ ID NO: 1100211 - protein, 7 aa, Mycobacterium
SAAPTEW

SEQ ID NO: 1100212 - protein, 9 aa, Mycobacterium
SAARTAELE

SEQ ID NO: 1100213 - protein, 8 aa, Mycobacterium
SAATSAAL

SEQ ID NO: 1100214 - protein, 9 aa, Mycobacterium
SADDEYRQR

SEQ ID NO: 1100215 - protein, 8 aa, Mycobacterium
SADENSAA

SEQ ID NO: 1100216 - protein, 6 aa, Mycobacterium
SADGAA

SEQ ID NO: 1100217 - protein, 13 aa, Mycobacterium
SADPAGTSPTGLT

SEQ ID NO: 1100218 - protein, 9 aa, Mycobacterium
SADPDRRDM

SEQ ID NO: 1100219 - protein, 6 aa, Mycobacterium
SADPSF

SEQ ID NO: 1100220 - protein, 4 aa, Mycobacterium
SADT

SEQ ID NO: 1100221 - protein, 7 aa, Mycobacterium
SADTSSA

SEQ ID NO: 1100222 - protein, 5 aa, Mycobacterium
SAEDR

SEQ ID NO: 1100223 - protein, 10 aa, Mycobacterium
SAEDTARFGA

SEQ ID NO: 1100224 - protein, 5 aa, Mycobacterium
SAEKV

SEQ ID NO: 1100225 - protein, 6 aa, Mycobacterium
SAELGQ

SEQ ID NO: 1100226 - protein, 4 aa, Mycobacterium
SAEM

SEQ ID NO: 1100227 - protein, 4 aa, Mycobacterium
SAER

SEQ ID NO: 1100228 - protein, 8 aa, Mycobacterium
SAERSGED

SEQ ID NO: 1100229 - protein, 6 aa, Mycobacterium
SAERVR

SEQ ID NO: 1100230 - protein, 17 aa, Mycobacterium
SAEVPRTAKSAALGRQL

SEQ ID NO: 1100231 - protein, 9 aa, Mycobacterium
SAEVTLSPG

SEQ ID NO: 1100232 - protein, 7 aa, Mycobacterium
SAFGGTA

SEQ ID NO: 1100233 - protein, 6 aa, Mycobacterium
SAFGRG

SEQ ID NO: 1100234 - protein, 9 aa, Mycobacterium
SAGAGLASP

SEQ ID NO: 1100235 - protein, 15 aa, Mycobacterium
SAGAPELPADTADAA

SEQ ID NO: 1100236 - protein, 10 aa, Mycobacterium
SAGAVEPDQV

SEQ ID NO: 1100237 - protein, 16 aa, Mycobacterium
SAGGRHELPESPGAHR

SEQ ID NO: 1100238 - protein, 6 aa, Mycobacterium
SAGIGA

SEQ ID NO: 1100239 - protein, 7 aa, Mycobacterium
SAGNGAN

SEQ ID NO: 1100240 - protein, 10 aa, Mycobacterium
SAGNNNGSAF

SEQ ID NO: 1100241 - protein, 6 aa, Mycobacterium
SAGPPT

SEQ ID NO: 1100242 - protein, 8 aa, Mycobacterium
SAGPRRST

SEQ ID NO: 1100243 - protein, 9 aa, Mycobacterium
SAHAPDFEA

SEQ ID NO: 1100244 - protein, 10 aa, Mycobacterium
SAHPEPTATA

SEQ ID NO: 1100245 - protein, 8 aa, Mycobacterium
SAKAGLDG

SEQ ID NO: 1100246 - protein, 10 aa, Mycobacterium
SAKALNGSAY

SEQ ID NO: 1100247 - protein, 9 aa, Mycobacterium
SAKSGSADV

SEQ ID NO: 1100248 - protein, 9 aa, Mycobacterium
SAKTYRKVR

SEQ ID NO: 1100249 - protein, 10 aa, Mycobacterium
SALDKPSAED

SEQ ID NO: 1100250 - protein, 7 aa, Mycobacterium
SALTGEP

SEQ ID NO: 1100251 - protein, 14 aa, Mycobacterium
SANDPTCDEDPCQS

SEQ ID NO: 1100252 - protein, 7 aa, Mycobacterium
SANEKIE

SEQ ID NO: 1100253 - protein, 10 aa, Mycobacterium
SAPAHPGHRP

SEQ ID NO: 1100254 - protein, 5 aa, Mycobacterium
SAPEI

SEQ ID NO: 1100255 - protein, 13 aa, Mycobacterium
SAPLDSAESEAQL

SEQ ID NO: 1100256 - protein, 6 aa, Mycobacterium
SAPMST

SEQ ID NO: 1100257 - protein, 39 aa, Mycobacterium
SAPPSTPPPDSTQQQPYPQQQQPYPQQPPYPPPPQQPYQ

SEQ ID NO: 1100258 - protein, 9 aa, Mycobacterium
SAPRSGSVS

SEQ ID NO: 1100259 - protein, 4 aa, Mycobacterium
SAPT

SEQ ID NO: 1100260 - protein, 9 aa, Mycobacterium
SAQDKAGGW

SEQ ID NO: 1100261 - protein, 37 aa, Mycobacterium
SAQSAEPSSLESTTEMTPSTPLSTGNNTIEVSDASPT

SEQ ID NO: 1100262 - protein, 6 aa, Mycobacterium
SAQTSR

SEQ ID NO: 1100263 - protein, 8 aa, Mycobacterium
SARDSARV

SEQ ID NO: 1100264 - protein, 6 aa, Mycobacterium
SARGSV

SEQ ID NO: 1100265 - protein, 9 aa, Mycobacterium
SARQPQQSC

SEQ ID NO: 1100266 - protein, 6 aa, Mycobacterium
SARRDG

SEQ ID NO: 1100267 - protein, 10 aa, Mycobacterium
SARTPSATRS

SEQ ID NO: 1100268 - protein, 4 aa, Mycobacterium
SASE

SEQ ID NO: 1100269 - protein, 6 aa, Mycobacterium
SASEHP

SEQ ID NO: 1100270 - protein, 11 aa, Mycobacterium
SASPKPAPDQP

SEQ ID NO: 1100271 - protein, 8 aa, Mycobacterium
SASPLGRD

SEQ ID NO: 1100272 - protein, 7 aa, Mycobacterium
SASSALE

SEQ ID NO: 1100273 - protein, 6 aa, Mycobacterium
SASTDS

SEQ ID NO: 1100274 - protein, 27 aa, Mycobacterium
SATAAAAVASKPIAAPPNPPVPDHTPR

SEQ ID NO: 1100275 - protein, 9 aa, Mycobacterium
SATADSDAP

SEQ ID NO: 1100276 - protein, 9 aa, Mycobacterium
SATDGASVA

SEQ ID NO: 1100277 - protein, 9 aa, Mycobacterium
SATEIRATP

SEQ ID NO: 1100278 - protein, 11 aa, Mycobacterium
SATGAVDDQPV

SEQ ID NO: 1100279 - protein, 4 aa, Mycobacterium
SATR

SEQ ID NO: 1100280 - protein, 5 aa, Mycobacterium
SATWS

SEQ ID NO: 1100281 - protein, 11 aa, Mycobacterium
SAVDPEMSNDQ

SEQ ID NO: 1100282 - protein, 4 aa, Mycobacterium
SAVG

SEQ ID NO: 1100283 - protein, 7 aa, Mycobacterium
SAVGGGR

SEQ ID NO: 1100284 - protein, 7 aa, Mycobacterium
SAVGTPE

SEQ ID NO: 1100285 - protein, 12 aa, Mycobacterium
SAYTGNAGFPGQ

SEQ ID NO: 1100286 - protein, 8 aa, Mycobacterium
SDAANAIT

SEQ ID NO: 1100287 - protein, 9 aa, Mycobacterium
SDADPGRGM

SEQ ID NO: 1100288 - protein, 10 aa, Mycobacterium
SDAPSSVAAQ

SEQ ID NO: 1100289 - protein, 17 aa, Mycobacterium
SDARAGAVSSAQTERHR

SEQ ID NO: 1100290 - protein, 14 aa, Mycobacterium
SDDGAQSPAATAVG

SEQ ID NO: 1100291 - protein, 9 aa, Mycobacterium
SDDGGPERF

SEQ ID NO: 1100292 - protein, 20 aa, Mycobacterium
SDDRDAKRLDRAAERDHDAD

SEQ ID NO: 1100293 - protein, 8 aa, Mycobacterium
SDDVEGNS

SEQ ID NO: 1100294 - protein, 7 aa, Mycobacterium
SDEAGYT

SEQ ID NO: 1100295 - protein, 8 aa, Mycobacterium
SDEDAAAN

SEQ ID NO: 1100296 - protein, 4 aa, Mycobacterium
SDEN

SEQ ID NO: 1100297 - protein, 10 aa, Mycobacterium
SDEPVDASDI

SEQ ID NO: 1100298 - protein, 8 aa, Mycobacterium
SDESERQL

SEQ ID NO: 1100299 - protein, 17 aa, Mycobacterium
SDETARKASTEIHQDET

SEQ ID NO: 1100300 - protein, 5 aa, Mycobacterium
SDETG

SEQ ID NO: 1100301 - protein, 4 aa, Mycobacterium
SDGF

SEQ ID NO: 1100302 - protein, 21 aa, Mycobacterium
SDGPHSAGTMDDKAISPSTTA

SEQ ID NO: 1100303 - protein, 6 aa, Mycobacterium
SDGQNI

SEQ ID NO: 1100304 - protein, 5 aa, Mycobacterium
SDGRA

SEQ ID NO: 1100305 - protein, 17 aa, Mycobacterium
SDGRDSPESRRATTNIT

SEQ ID NO: 1100306 - protein, 4 aa, Mycobacterium
SDGS

SEQ ID NO: 1100307 - protein, 6 aa, Mycobacterium
SDGSEI

SEQ ID NO: 1100308 - protein, 6 aa, Mycobacterium
SDNADL

SEQ ID NO: 1100309 - protein, 11 aa, Mycobacterium
SDNGDPVTDQQ

SEQ ID NO: 1100310 - protein, 9 aa, Mycobacterium
SDPADDNVV

SEQ ID NO: 1100311 - protein, 7 aa, Mycobacterium
SDPDSGH

SEQ ID NO: 1100312 - protein, 8 aa, Mycobacterium
SDPESVER

SEQ ID NO: 1100313 - protein, 5 aa, Mycobacterium
SDPGL

SEQ ID NO: 1100314 - protein, 5 aa, Mycobacterium
SDPHH

SEQ ID NO: 1100315 - protein, 8 aa, Mycobacterium
SDPNPFPN

SEQ ID NO: 1100316 - protein, 8 aa, Mycobacterium
SDPSRVGN

SEQ ID NO: 1100317 - protein, 9 aa, Mycobacterium
SDQSPDQPL

SEQ ID NO: 1100318 - protein, 8 aa, Mycobacterium
SDQWDGRS

SEQ ID NO: 1100319 - protein, 4 aa, Mycobacterium
SDRA

SEQ ID NO: 1100320 - protein, 8 aa, Mycobacterium
SDRADGGA

SEQ ID NO: 1100321 - protein, 10 aa, Mycobacterium
SDRGPGVPQA

SEQ ID NO: 1100322 - protein, 7 aa, Mycobacterium
SDRISSY

SEQ ID NO: 1100323 - protein, 7 aa, Mycobacterium
SDRLRGR

SEQ ID NO: 1100324 - protein, 9 aa, Mycobacterium
SDRVADGLN

SEQ ID NO: 1100325 - protein, 7 aa, Mycobacterium
SDSPIED

SEQ ID NO: 1100326 - protein, 8 aa, Mycobacterium
SDSTGRSL

SEQ ID NO: 1100327 - protein, 4 aa, Mycobacterium
SDTH

SEQ ID NO: 1100328 - protein, 15 aa, Mycobacterium
SDTSGAEAANNQGVA

SEQ ID NO: 1100329 - protein, 9 aa, Mycobacterium
SDVDAAGPT

SEQ ID NO: 1100330 - protein, 11 aa, Mycobacterium
SDVGNGRGPID

SEQ ID NO: 1100331 - protein, 15 aa, Mycobacterium
SDVPVDDPAAPGTVT

SEQ ID NO: 1100332 - protein, 8 aa, Mycobacterium
SDVRAGRV

SEQ ID NO: 1100333 - protein, 9 aa, Mycobacterium
SDYNRDDYV

SEQ ID NO: 1100334 - protein, 9 aa, Mycobacterium
SEAAPRALP

SEQ ID NO: 1100335 - protein, 10 aa, Mycobacterium
SEAARSLGAG

SEQ ID NO: 1100336 - protein, 7 aa, Mycobacterium
SEAKTNV

SEQ ID NO: 1100337 - protein, 6 aa, Mycobacterium
SEASAN

SEQ ID NO: 1100338 - protein, 11 aa, Mycobacterium
SEDDDGARFTP

SEQ ID NO: 1100339 - protein, 6 aa, Mycobacterium
SEDDEV

SEQ ID NO: 1100340 - protein, 7 aa, Mycobacterium
SEDGDTG

SEQ ID NO: 1100341 - protein, 28 aa, Mycobacterium
SEELNRMSKGQPIGIPGAPYATPVSGAA

SEQ ID NO: 1100342 - protein, 6 aa, Mycobacterium
SEEPTR

SEQ ID NO: 1100343 - protein, 8 aa, Mycobacterium
SEGGKAAM

SEQ ID NO: 1100344 - protein, 9 aa, Mycobacterium
SEGGSVPAE

SEQ ID NO: 1100345 - protein, 11 aa, Mycobacterium
SEHHDPDPDPD

SEQ ID NO: 1100346 - protein, 8 aa, Mycobacterium
SEIRSRKP

SEQ ID NO: 1100347 - protein, 11 aa, Mycobacterium
SELAGSADEAL

SEQ ID NO: 1100348 - protein, 6 aa, Mycobacterium
SELDER

SEQ ID NO: 1100349 - protein, 12 aa, Mycobacterium
SELTDPVEQRRR

SEQ ID NO: 1100350 - protein, 10 aa, Mycobacterium
SENGGKTDVR

SEQ ID NO: 1100351 - protein, 9 aa, Mycobacterium
SEPDPEARP

SEQ ID NO: 1100352 - protein, 6 aa, Mycobacterium
SEPEPG

SEQ ID NO: 1100353 - protein, 4 aa, Mycobacterium
SEPR

SEQ ID NO: 1100354 - protein, 5 aa, Mycobacterium
SEPYP

SEQ ID NO: 1100355 - protein, 11 aa, Mycobacterium
SEQAGSQGSGV

SEQ ID NO: 1100356 - protein, 7 aa, Mycobacterium
SEQGYTE

SEQ ID NO: 1100357 - protein, 9 aa, Mycobacterium
SEQTANDFS

SEQ ID NO: 1100358 - protein, 11 aa, Mycobacterium
SERGPIKTQSR

SEQ ID NO: 1100359 - protein, 8 aa, Mycobacterium
SERGQPEA

SEQ ID NO: 1100360 - protein, 10 aa, Mycobacterium
SERGTIKPTR

SEQ ID NO: 1100361 - protein, 4 aa, Mycobacterium
SERQ

SEQ ID NO: 1100362 - protein, 10 aa, Mycobacterium
SERSDAASAR

SEQ ID NO: 1100363 - protein, 16 aa, Mycobacterium
SESAEPEYAEPVAARP

SEQ ID NO: 1100364 - protein, 6 aa, Mycobacterium
SESRLS

SEQ ID NO: 1100365 - protein, 4 aa, Mycobacterium
SESS

SEQ ID NO: 1100366 - protein, 5 aa, Mycobacterium
SETTA

SEQ ID NO: 1100367 - protein, 5 aa, Mycobacterium
SEVPD

SEQ ID NO: 1100368 - protein, 12 aa, Mycobacterium
SFTGPTPNPRTV

SEQ ID NO: 1100369 - protein, 18 aa, Mycobacterium
SGAAAGRSNPVRSPGPLG

SEQ ID NO: 1100370 - protein, 5 aa, Mycobacterium
SGAAL

SEQ ID NO: 1100371 - protein, 6 aa, Mycobacterium
SGAATS

SEQ ID NO: 1100372 - protein, 6 aa, Mycobacterium
SGAENG

SEQ ID NO: 1100373 - protein, 9 aa, Mycobacterium
SGAGKAREI

SEQ ID NO: 1100374 - protein, 9 aa, Mycobacterium
SGAGMDPET

SEQ ID NO: 1100375 - protein, 7 aa, Mycobacterium
SGAGPAV

SEQ ID NO: 1100376 - protein, 11 aa, Mycobacterium
SGAGVASSFPD

SEQ ID NO: 1100377 - protein, 19 aa, Mycobacterium
SGAPTSEANNRKDNLGKRI

SEQ ID NO: 1100378 - protein, 32 aa, Mycobacterium
SGASAIAKASLDASLQDDLPEESRASAFGRSE

SEQ ID NO: 1100379 - protein, 8 aa, Mycobacterium
SGATAGAA

SEQ ID NO: 1100380 - protein, 17 aa, Mycobacterium
SGATASSAPEDEMTGTQ

SEQ ID NO: 1100381 - protein, 7 aa, Mycobacterium
SGATNQA

SEQ ID NO: 1100382 - protein, 27 aa, Mycobacterium
SGDGGSTAASPTTPSPTRTADPRAEAD

SEQ ID NO: 1100383 - protein, 6 aa, Mycobacterium
SGDVDP

SEQ ID NO: 1100384 - protein, 7 aa, Mycobacterium
SGEDDPL

SEQ ID NO: 1100385 - protein, 8 aa, Mycobacterium
SGEEPDPV

SEQ ID NO: 1100386 - protein, 9 aa, Mycobacterium
SGEPPEAPK

SEQ ID NO: 1100387 - protein, 18 aa, Mycobacterium
SGEQIANASSGLDNQRGE

SEQ ID NO: 1100388 - protein, 8 aa, Mycobacterium
SGEVTSNS

SEQ ID NO: 1100389 - protein, 4 aa, Mycobacterium
SGGA

SEQ ID NO: 1100390 - protein, 4 aa, Mycobacterium
SGGD

SEQ ID NO: 1100391 - protein, 8 aa, Mycobacterium
SGGGLGGA

SEQ ID NO: 1100392 - protein, 8 aa, Mycobacterium
SGGPGFST

SEQ ID NO: 1100393 - protein, 11 aa, Mycobacterium
SGGPGQPQLAA

SEQ ID NO: 1100394 - protein, 8 aa, Mycobacterium
SGGPSGVG

SEQ ID NO: 1100395 - protein, 10 aa, Mycobacterium
SGGPVGPPAD

SEQ ID NO: 1100396 - protein, 4 aa, Mycobacterium
SGGT

SEQ ID NO: 1100397 - protein, 5 aa, Mycobacterium
SGIRQ

SEQ ID NO: 1100398 - protein, 13 aa, Mycobacterium
SGITQPGRKVPDD

SEQ ID NO: 1100399 - protein, 12 aa, Mycobacterium
SGKETRGNGNAA

SEQ ID NO: 1100400 - protein, 10 aa, Mycobacterium
SGLAETIGNS

SEQ ID NO: 1100401 - protein, 7 aa, Mycobacterium
SGMSEAA

SEQ ID NO: 1100402 - protein, 9 aa, Mycobacterium
SGNGTAIAA

SEQ ID NO: 1100403 - protein, 9 aa, Mycobacterium
SGPPNLGQG

SEQ ID NO: 1100404 - protein, 5 aa, Mycobacterium
SGPPS

SEQ ID NO: 1100405 - protein, 8 aa, Mycobacterium
SGPQTRAV

SEQ ID NO: 1100406 - protein, 18 aa, Mycobacterium
SGPRGPGLDQLYTWWSSH

SEQ ID NO: 1100407 - protein, 5 aa, Mycobacterium
SGPTT

SEQ ID NO: 1100408 - protein, 4 aa, Mycobacterium
SGQG

SEQ ID NO: 1100409 - protein, 5 aa, Mycobacterium
SGQGA

SEQ ID NO: 1100410 - protein, 8 aa, Mycobacterium
SGRAEALG

SEQ ID NO: 1100411 - protein, 8 aa, Mycobacterium
SGSGFDEA

SEQ ID NO: 1100412 - protein, 24 aa, Mycobacterium
SGSPEAEARARDFDHSNGSNGHGR

SEQ ID NO: 1100413 - protein, 7 aa, Mycobacterium
SGSPIDG

SEQ ID NO: 1100414 - protein, 8 aa, Mycobacterium
SGSRTAQA

SEQ ID NO: 1100415 - protein, 8 aa, Mycobacterium
SGSSATVQ

SEQ ID NO: 1100416 - protein, 8 aa, Mycobacterium
SGSSAVDQ

SEQ ID NO: 1100417 - protein, 10 aa, Mycobacterium
SGSSGPPKGV

SEQ ID NO: 1100418 - protein, 4 aa, Mycobacterium
SGTA

SEQ ID NO: 1100419 - protein, 24 aa, Mycobacterium
SGTEIDTGFRGDDRTKYDRWLEEV

SEQ ID NO: 1100420 - protein, 24 aa, Mycobacterium
SGTGTPGPSAAAPVPPTAPADDPP

SEQ ID NO: 1100421 - protein, 8 aa, Mycobacterium
SGTPPTVA

SEQ ID NO: 1100422 - protein, 10 aa, Mycobacterium
SGTPVPENVT

SEQ ID NO: 1100423 - protein, 9 aa, Mycobacterium
SGTQGIAGS

SEQ ID NO: 1100424 - protein, 4 aa, Mycobacterium
SGTS

SEQ ID NO: 1100425 - protein, 16 aa, Mycobacterium
SGVAPTGYPVKADTRT

SEQ ID NO: 1100426 - protein, 9 aa, Mycobacterium
SGVEGDKRV

SEQ ID NO: 1100427 - protein, 4 aa, Mycobacterium
SGVT

SEQ ID NO: 1100428 - protein, 5 aa, Mycobacterium
SGWAN

SEQ ID NO: 1100429 - protein, 13 aa, Mycobacterium
SGWGEKRGALQPG

SEQ ID NO: 1100430 - protein, 5 aa, Mycobacterium
SHAEG

SEQ ID NO: 1100431 - protein, 7 aa, Mycobacterium
SHAEPEL

SEQ ID NO: 1100432 - protein, 19 aa, Mycobacterium
SHDASDSIDDALESSAAGV

SEQ ID NO: 1100433 - protein, 4 aa, Mycobacterium
SHEN

SEQ ID NO: 1100434 - protein, 6 aa, Mycobacterium
SHGESL

SEQ ID NO: 1100435 - protein, 41 aa, Mycobacterium
SHHRPEPPAAPPSDTAPLGTIPQAPAPVDTPPAHDEHGEHA

SEQ ID NO: 1100436 - protein, 10 aa, Mycobacterium
SHRRRPITPA

SEQ ID NO: 1100437 - protein, 13 aa, Mycobacterium
SHSKESKTKAISY

SEQ ID NO: 1100438 - protein, 5 aa, Mycobacterium
SHTGA

SEQ ID NO: 1100439 - protein, 8 aa, Mycobacterium
SIASPETY

SEQ ID NO: 1100440 - protein, 4 aa, Mycobacterium
SIGD

SEQ ID NO: 1100441 - protein, 11 aa, Mycobacterium
SIPRDQAEPVP

SEQ ID NO: 1100442 - protein, 17 aa, Mycobacterium
SIPVSPDTYADAVRPRA

SEQ ID NO: 1100443 - protein, 7 aa, Mycobacterium
SISADPD

SEQ ID NO: 1100444 - protein, 6 aa, Mycobacterium
SKAPHG

SEQ ID NO: 1100445 - protein, 9 aa, Mycobacterium
SKDGEEFSG

SEQ ID NO: 1100446 - protein, 20 aa, Mycobacterium
SKDQIGECTGPGPAAQAGIQ

SEQ ID NO: 1100447 - protein, 10 aa, Mycobacterium
SKGTRSEKIR

SEQ ID NO: 1100448 - protein, 11 aa, Mycobacterium
SKHETSRAGNT

SEQ ID NO: 1100449 - protein, 7 aa, Mycobacterium
SKMGEEI

SEQ ID NO: 1100450 - protein, 4 aa, Mycobacterium
SKNP

SEQ ID NO: 1100451 - protein, 16 aa, Mycobacterium
SLAADPGKAIEGTAYS

SEQ ID NO: 1100452 - protein, 10 aa, Mycobacterium
SLAEGGRGVA

SEQ ID NO: 1100453 - protein, 8 aa, Mycobacterium
SLARETKS

SEQ ID NO: 1100454 - protein, 8 aa, Mycobacterium
SLATASGN

SEQ ID NO: 1100455 - protein, 7 aa, Mycobacterium
SLEEQAR

SEQ ID NO: 1100456 - protein, 4 aa, Mycobacterium
SLET

SEQ ID NO: 1100457 - protein, 7 aa, Mycobacterium
SLGTSVS

SEQ ID NO: 1100458 - protein, 9 aa, Mycobacterium
SLKTSSKTS

SEQ ID NO: 1100459 - protein, 4 aa, Mycobacterium
SLNT

SEQ ID NO: 1100460 - protein, 7 aa, Mycobacterium
SLNTGGV

SEQ ID NO: 1100461 - protein, 7 aa, Mycobacterium
SLPANGK

SEQ ID NO: 1100462 - protein, 6 aa, Mycobacterium
SLPPEP

SEQ ID NO: 1100463 - protein, 8 aa, Mycobacterium
SLPPGRSV

SEQ ID NO: 1100464 - protein, 9 aa, Mycobacterium
SLPSPGVNY

SEQ ID NO: 1100465 - protein, 5 aa, Mycobacterium
SLQAN

SEQ ID NO: 1100466 - protein, 9 aa, Mycobacterium
SLRDTRDYY

SEQ ID NO: 1100467 - protein, 4 aa, Mycobacterium
SLSP

SEQ ID NO: 1100468 - protein, 10 aa, Mycobacterium
SLSSSGSART

SEQ ID NO: 1100469 - protein, 7 aa, Mycobacterium
SLTPTEA

SEQ ID NO: 1100470 - protein, 4 aa, Mycobacterium
SMEP

SEQ ID NO: 1100471 - protein, 7 aa, Mycobacterium
SMPRGGL

SEQ ID NO: 1100472 - protein, 8 aa, Mycobacterium
SMSEQNGA

SEQ ID NO: 1100473 - protein, 23 aa, Mycobacterium
SMTTRSSSATTSTTTTRISPPLT

SEQ ID NO: 1100474 - protein, 6 aa, Mycobacterium
SNAGTV

SEQ ID NO: 1100475 - protein, 8 aa, Mycobacterium
SNDDAQLD

SEQ ID NO: 1100476 - protein, 8 aa, Mycobacterium
SNGDDEEI

SEQ ID NO: 1100477 - protein, 7 aa, Mycobacterium
SNLGGPL

SEQ ID NO: 1100478 - protein, 8 aa, Mycobacterium
SNLPTQPV

SEQ ID NO: 1100479 - protein, 14 aa, Mycobacterium
SNPATARPAPLPTA

SEQ ID NO: 1100480 - protein, 6 aa, Mycobacterium
SNPGNP

SEQ ID NO: 1100481 - protein, 13 aa, Mycobacterium
SNRAPGGRLPAPN

SEQ ID NO: 1100482 - protein, 13 aa, Mycobacterium
SNSRGPSGTTKTN

SEQ ID NO: 1100483 - protein, 11 aa, Mycobacterium
SNSSKSRGDAI

SEQ ID NO: 1100484 - protein, 8 aa, Mycobacterium
SPAAATRA

SEQ ID NO: 1100485 - protein, 8 aa, Mycobacterium
SPAESAAA

SEQ ID NO: 1100486 - protein, 23 aa, Mycobacterium
SPAGGADSPDQAGNAIDGNSTTV

SEQ ID NO: 1100487 - protein, 25 aa, Mycobacterium
SPAGTFAGGRQTGPPSAPTGTADGS

SEQ ID NO: 1100488 - protein, 8 aa, Mycobacterium
SPANTVRG

SEQ ID NO: 1100489 - protein, 19 aa, Mycobacterium
SPATDPAEIARDTAPPWEG

SEQ ID NO: 1100490 - protein, 6 aa, Mycobacterium
SPDLRA

SEQ ID NO: 1100491 - protein, 8 aa, Mycobacterium
SPDPGSVT

SEQ ID NO: 1100492 - protein, 7 aa, Mycobacterium
SPDPRYG

SEQ ID NO: 1100493 - protein, 6 aa, Mycobacterium
SPDRRR

SEQ ID NO: 1100494 - protein, 10 aa, Mycobacterium
SPEEMGSTAQ

SEQ ID NO: 1100495 - protein, 7 aa, Mycobacterium
SPEEPVN

SEQ ID NO: 1100496 - protein, 5 aa, Mycobacterium
SPEFQ

SEQ ID NO: 1100497 - protein, 5 aa, Mycobacterium
SPENA

SEQ ID NO: 1100498 - protein, 6 aa, Mycobacterium
SPENEV

SEQ ID NO: 1100499 - protein, 4 aa, Mycobacterium
SPEQ

SEQ ID NO: 1100500 - protein, 15 aa, Mycobacterium
SPEQRAQDPGRPLPE

SEQ ID NO: 1100501 - protein, 6 aa, Mycobacterium
SPETLD

SEQ ID NO: 1100502 - protein, 14 aa, Mycobacterium
SPEVQSAVGTPSDI

SEQ ID NO: 1100503 - protein, 6 aa, Mycobacterium
SPITGE

SEQ ID NO: 1100504 - protein, 5 aa, Mycobacterium
SPITT

SEQ ID NO: 1100505 - protein, 14 aa, Mycobacterium
SPLAGREGLQPGTI

SEQ ID NO: 1100506 - protein, 4 aa, Mycobacterium
SPLG

SEQ ID NO: 1100507 - protein, 6 aa, Mycobacterium
SPLGFG

SEQ ID NO: 1100508 - protein, 5 aa, Mycobacterium
SPLPR

SEQ ID NO: 1100509 - protein, 9 aa, Mycobacterium
SPLSETQRR

SEQ ID NO: 1100510 - protein, 5 aa, Mycobacterium
SPLTP

SEQ ID NO: 1100511 - protein, 4 aa, Mycobacterium
SPNG

SEQ ID NO: 1100512 - protein, 14 aa, Mycobacterium
SPPDAADPAGVDES

SEQ ID NO: 1100513 - protein, 8 aa, Mycobacterium
SPPDAITT

SEQ ID NO: 1100514 - protein, 6 aa, Mycobacterium
SPPESM

SEQ ID NO: 1100515 - protein, 8 aa, Mycobacterium
SPPFPHSN

SEQ ID NO: 1100516 - protein, 5 aa, Mycobacterium
SPPGC

SEQ ID NO: 1100517 - protein, 7 aa, Mycobacterium
SPPGKEG

SEQ ID NO: 1100518 - protein, 7 aa, Mycobacterium
SPQTEQQ

SEQ ID NO: 1100519 - protein, 14 aa, Mycobacterium
SPRGAMADPARAVG

SEQ ID NO: 1100520 - protein, 5 aa, Mycobacterium
SPRRL

SEQ ID NO: 1100521 - protein, 7 aa, Mycobacterium
SPRSRTN

SEQ ID NO: 1100522 - protein, 5 aa, Mycobacterium
SPSIS

SEQ ID NO: 1100523 - protein, 11 aa, Mycobacterium
SPSPGTDAGPW

SEQ ID NO: 1100524 - protein, 6 aa, Mycobacterium
SPSRAV

SEQ ID NO: 1100525 - protein, 14 aa, Mycobacterium
SPSSPWNQAGPGGW

SEQ ID NO: 1100526 - protein, 6 aa, Mycobacterium
SPSTEI

SEQ ID NO: 1100527 - protein, 6 aa, Mycobacterium
SPTAAV

SEQ ID NO: 1100528 - protein, 13 aa, Mycobacterium
SPVGQTTAPTDYP

SEQ ID NO: 1100529 - protein, 7 aa, Mycobacterium
SPVSGEQ

SEQ ID NO: 1100530 - protein, 4 aa, Mycobacterium
SPWG

SEQ ID NO: 1100531 - protein, 7 aa, Mycobacterium
SQDGANQ

SEQ ID NO: 1100532 - protein, 16 aa, Mycobacterium
SQDPEEGTTAGSSYAA

SEQ ID NO: 1100533 - protein, 15 aa, Mycobacterium
SQGKPMAGDADLDGL

SEQ ID NO: 1100534 - protein, 8 aa, Mycobacterium
SQGQSGSA

SEQ ID NO: 1100535 - protein, 5 aa, Mycobacterium
SQGSP

SEQ ID NO: 1100536 - protein, 10 aa, Mycobacterium
SQGSPPSPLQ

SEQ ID NO: 1100537 - protein, 6 aa, Mycobacterium
SQIAQT

SEQ ID NO: 1100538 - protein, 8 aa, Mycobacterium
SQKFTGGQ

SEQ ID NO: 1100539 - protein, 14 aa, Mycobacterium
SQLDSPVAPPRGKW

SEQ ID NO: 1100540 - protein, 6 aa, Mycobacterium
SQLPPG

SEQ ID NO: 1100541 - protein, 24 aa, Mycobacterium
SQPPDQQATTDTTARPPASAPRQH

SEQ ID NO: 1100542 - protein, 9 aa, Mycobacterium
SQRDYPGAT

SEQ ID NO: 1100543 - protein, 4 aa, Mycobacterium
SQSE

SEQ ID NO: 1100544 - protein, 16 aa, Mycobacterium
SQWRSPEDMTTVDTPD

SEQ ID NO: 1100545 - protein, 10 aa, Mycobacterium
SQYGNDSQVA

SEQ ID NO: 1100546 - protein, 6 aa, Mycobacterium
SRAEKN

SEQ ID NO: 1100547 - protein, 8 aa, Mycobacterium
SRAGAYRS

SEQ ID NO: 1100548 - protein, 33 aa, Mycobacterium
SRASAESAATLQKTNEELSRQGQQTAAELQSSI

SEQ ID NO: 1100549 - protein, 6 aa, Mycobacterium
SRASRS

SEQ ID NO: 1100550 - protein, 13 aa, Mycobacterium
SRAYRSRHDGFAR

SEQ ID NO: 1100551 - protein, 9 aa, Mycobacterium
SRDAGEIPR

SEQ ID NO: 1100552 - protein, 6 aa, Mycobacterium
SREECF

SEQ ID NO: 1100553 - protein, 6 aa, Mycobacterium
SREPRE

SEQ ID NO: 1100554 - protein, 17 aa, Mycobacterium
SRFSRDPKTPRSTDNAA

SEQ ID NO: 1100555 - protein, 9 aa, Mycobacterium
SRGDSPRAL

SEQ ID NO: 1100556 - protein, 4 aa, Mycobacterium
SRGS

SEQ ID NO: 1100557 - protein, 6 aa, Mycobacterium
SRGYDD

SEQ ID NO: 1100558 - protein, 10 aa, Mycobacterium
SRHSSAERSV

SEQ ID NO: 1100559 - protein, 6 aa, Mycobacterium
SRIGPK

SEQ ID NO: 1100560 - protein, 6 aa, Mycobacterium
SRKAPT

SEQ ID NO: 1100561 - protein, 6 aa, Mycobacterium
SRKQGA

SEQ ID NO: 1100562 - protein, 6 aa, Mycobacterium
SRLDGL

SEQ ID NO: 1100563 - protein, 21 aa, Mycobacterium
SRLEDAAAASAAARAALRSAG

SEQ ID NO: 1100564 - protein, 5 aa, Mycobacterium
SRLGE

SEQ ID NO: 1100565 - protein, 8 aa, Mycobacterium
SRPGAGAA

SEQ ID NO: 1100566 - protein, 5 aa, Mycobacterium
SRPMR

SEQ ID NO: 1100567 - protein, 13 aa, Mycobacterium
SRPPDTARGRTGE

SEQ ID NO: 1100568 - protein, 5 aa, Mycobacterium
SRPVG

SEQ ID NO: 1100569 - protein, 10 aa, Mycobacterium
SRQPAFSSGR

SEQ ID NO: 1100570 - protein, 12 aa, Mycobacterium
SRQQTGDTKPFP

SEQ ID NO: 1100571 - protein, 17 aa, Mycobacterium
SRRARDRAADALRTATR

SEQ ID NO: 1100572 - protein, 4 aa, Mycobacterium
SRRF

SEQ ID NO: 1100573 - protein, 15 aa, Mycobacterium
SRRKSAARRVERPET

SEQ ID NO: 1100574 - protein, 4 aa, Mycobacterium
SRRN

SEQ ID NO: 1100575 - protein, 10 aa, Mycobacterium
SRRPMTTADE

SEQ ID NO: 1100576 - protein, 7 aa, Mycobacterium
SRRQTPA

SEQ ID NO: 1100577 - protein, 4 aa, Mycobacterium
SRRS

SEQ ID NO: 1100578 - protein, 8 aa, Mycobacterium
SRSGSRAE

SEQ ID NO: 1100579 - protein, 11 aa, Mycobacterium
SRSLDAGEEQR

SEQ ID NO: 1100580 - protein, 8 aa, Mycobacterium
SRSRDDDQ

SEQ ID NO: 1100581 - protein, 7 aa, Mycobacterium
SRSTAVG

SEQ ID NO: 1100582 - protein, 9 aa, Mycobacterium
SRTGATEKY

SEQ ID NO: 1100583 - protein, 12 aa, Mycobacterium
SRTPANENPERI

SEQ ID NO: 1100584 - protein, 10 aa, Mycobacterium
SRTSSPYSLT

SEQ ID NO: 1100585 - protein, 7 aa, Mycobacterium
SRVTGGP

SEQ ID NO: 1100586 - protein, 7 aa, Mycobacterium
SSADRRE

SEQ ID NO: 1100587 - protein, 9 aa, Mycobacterium
SSAFDARGR

SEQ ID NO: 1100588 - protein, 13 aa, Mycobacterium
SSAKRRGFSGSVP

SEQ ID NO: 1100589 - protein, 31 aa, Mycobacterium
SSAPAQEPVSTSTTLPPPPPSTTPPPPPSSV

SEQ ID NO: 1100590 - protein, 14 aa, Mycobacterium
SSASIGTQPQKKIT

SEQ ID NO: 1100591 - protein, 13 aa, Mycobacterium
SSDRLTPGQAGRI

SEQ ID NO: 1100592 - protein, 13 aa, Mycobacterium
SSDTVKAATDAER

SEQ ID NO: 1100593 - protein, 7 aa, Mycobacterium
SSERAYD

SEQ ID NO: 1100594 - protein, 19 aa, Mycobacterium
SSGAGTPDADGVTRAPNPA

SEQ ID NO: 1100595 - protein, 14 aa, Mycobacterium
SSGAPPVAAESPQA

SEQ ID NO: 1100596 - protein, 10 aa, Mycobacterium
SSGKTAPRTV

SEQ ID NO: 1100597 - protein, 5 aa, Mycobacterium
SSGLG

SEQ ID NO: 1100598 - protein, 9 aa, Mycobacterium
SSGPGPGSL

SEQ ID NO: 1100599 - protein, 8 aa, Mycobacterium
SSGSGKST

SEQ ID NO: 1100600 - protein, 6 aa, Mycobacterium
SSHDEP

SEQ ID NO: 1100601 - protein, 10 aa, Mycobacterium
SSHKSVTDTL

SEQ ID NO: 1100602 - protein, 5 aa, Mycobacterium
SSIGG

SEQ ID NO: 1100603 - protein, 15 aa, Mycobacterium
SSISSLAEKESELRS

SEQ ID NO: 1100604 - protein, 5 aa, Mycobacterium
SSITG

SEQ ID NO: 1100605 - protein, 11 aa, Mycobacterium
SSLADETPEGR

SEQ ID NO: 1100606 - protein, 7 aa, Mycobacterium
SSLRPGS

SEQ ID NO: 1100607 - protein, 17 aa, Mycobacterium
SSNKFGAADDPGVTGYG

SEQ ID NO: 1100608 - protein, 13 aa, Mycobacterium
SSPENPVPQRISS

SEQ ID NO: 1100609 - protein, 21 aa, Mycobacterium
SSPERKARELRRSRTAPPYLT

SEQ ID NO: 1100610 - protein, 8 aa, Mycobacterium
SSPFEPGS

SEQ ID NO: 1100611 - protein, 8 aa, Mycobacterium
SSPSGRPA

SEQ ID NO: 1100612 - protein, 20 aa, Mycobacterium
SSQPAPRRHVTTGGETPRVG

SEQ ID NO: 1100613 - protein, 6 aa, Mycobacterium
SSQYSP

SEQ ID NO: 1100614 - protein, 20 aa, Mycobacterium
SSRDRSPTLADPNPNDERGT

SEQ ID NO: 1100615 - protein, 6 aa, Mycobacterium
SSRDYA

SEQ ID NO: 1100616 - protein, 8 aa, Mycobacterium
SSRNRDDD

SEQ ID NO: 1100617 - protein, 14 aa, Mycobacterium
SSRPGITGTARVDR

SEQ ID NO: 1100618 - protein, 13 aa, Mycobacterium
SSRPYIGGSTDNS

SEQ ID NO: 1100619 - protein, 9 aa, Mycobacterium
SSRRRGKGL

SEQ ID NO: 1100620 - protein, 13 aa, Mycobacterium
SSRSGRHSARSAR

SEQ ID NO: 1100621 - protein, 42 aa, Mycobacterium
SSSINAYTASQAASSSSSSSSSSGSSFSGGGGGGGGGGGGGS

SEQ ID NO: 1100622 - protein, 5 aa, Mycobacterium
SSSMD

SEQ ID NO: 1100623 - protein, 8 aa, Mycobacterium
SSSTDSAN

SEQ ID NO: 1100624 - protein, 20 aa, Mycobacterium
SSTPSGSSFTGGSDGGGGFE

SEQ ID NO: 1100625 - protein, 4 aa, Mycobacterium
SSTR

SEQ ID NO: 1100626 - protein, 14 aa, Mycobacterium
SSTSTYQGSWAQPQ

SEQ ID NO: 1100627 - protein, 13 aa, Mycobacterium
SSVPEGQSEASTA

SEQ ID NO: 1100628 - protein, 7 aa, Mycobacterium
SSVQTGQ

SEQ ID NO: 1100629 - protein, 9 aa, Mycobacterium
SSVRTEPRQ

SEQ ID NO: 1100630 - protein, 16 aa, Mycobacterium
SSWRSPDDESDIDTPD

SEQ ID NO: 1100631 - protein, 16 aa, Mycobacterium
SSWTPDKPRHAKAGNL

SEQ ID NO: 1100632 - protein, 7 aa, Mycobacterium
STAGGAW

SEQ ID NO: 1100633 - protein, 10 aa, Mycobacterium
STAGNLTGPA

SEQ ID NO: 1100634 - protein, 4 aa, Mycobacterium
STAT

SEQ ID NO: 1100635 - protein, 6 aa, Mycobacterium
STAVPP

SEQ ID NO: 1100636 - protein, 5 aa, Mycobacterium
STDGQ

SEQ ID NO: 1100637 - protein, 11 aa, Mycobacterium
STELAQQATAG

SEQ ID NO: 1100638 - protein, 8 aa, Mycobacterium
STETAAPV

SEQ ID NO: 1100639 - protein, 5 aa, Mycobacterium
STGLA

SEQ ID NO: 1100640 - protein, 9 aa, Mycobacterium
STGNPGQYF

SEQ ID NO: 1100641 - protein, 10 aa, Mycobacterium
STGPEQREVP

SEQ ID NO: 1100642 - protein, 11 aa, Mycobacterium
STGSGAIVGRT

SEQ ID NO: 1100643 - protein, 17 aa, Mycobacterium
STHREAVDTSRQELDER

SEQ ID NO: 1100644 - protein, 13 aa, Mycobacterium
STNEQAKVTNTTQ

SEQ ID NO: 1100645 - protein, 25 aa, Mycobacterium
STPPAGDSPAVDPATQRAFGRPDGI

SEQ ID NO: 1100646 - protein, 15 aa, Mycobacterium
STPPAPSEPAVGSTV

SEQ ID NO: 1100647 - protein, 12 aa, Mycobacterium
STPVPDLRPEGI

SEQ ID NO: 1100648 - protein, 6 aa, Mycobacterium
STQGRT

SEQ ID NO: 1100649 - protein, 5 aa, Mycobacterium
STRRR

SEQ ID NO: 1100650 - protein, 7 aa, Mycobacterium
STRVPAR

SEQ ID NO: 1100651 - protein, 7 aa, Mycobacterium
STSALDE

SEQ ID NO: 1100652 - protein, 8 aa, Mycobacterium
STSALDEG

SEQ ID NO: 1100653 - protein, 8 aa, Mycobacterium
STSGRAMH

SEQ ID NO: 1100654 - protein, 4 aa, Mycobacterium
STSP

SEQ ID NO: 1100655 - protein, 16 aa, Mycobacterium
STSPEANTEADAGEEI

SEQ ID NO: 1100656 - protein, 7 aa, Mycobacterium
STSPTLG

SEQ ID NO: 1100657 - protein, 8 aa, Mycobacterium
STSPTTGQ

SEQ ID NO: 1100658 - protein, 9 aa, Mycobacterium
STSRKLKNG

SEQ ID NO: 1100659 - protein, 7 aa, Mycobacterium
STTGDVS

SEQ ID NO: 1100660 - protein, 7 aa, Mycobacterium
STTGSFQ

SEQ ID NO: 1100661 - protein, 6 aa, Mycobacterium
STTQTW

SEQ ID NO: 1100662 - protein, 16 aa, Mycobacterium
STTSSSGGGRGGGRGI

SEQ ID NO: 1100663 - protein, 7 aa, Mycobacterium
STYAEAQ

SEQ ID NO: 1100664 - protein, 6 aa, Mycobacterium
SVAPTT

SEQ ID NO: 1100665 - protein, 16 aa, Mycobacterium
SVARQTPEAAANPQTA

SEQ ID NO: 1100666 - protein, 11 aa, Mycobacterium
SVDEPNPTSDD

SEQ ID NO: 1100667 - protein, 10 aa, Mycobacterium
SVESGQLEAS

SEQ ID NO: 1100668 - protein, 6 aa, Mycobacterium
SVGAGS

SEQ ID NO: 1100669 - protein, 8 aa, Mycobacterium
SVGSGAAR

SEQ ID NO: 1100670 - protein, 17 aa, Mycobacterium
SVKGATRSDDRRQRAAS

SEQ ID NO: 1100671 - protein, 12 aa, Mycobacterium
SVQEGGSEDPSV

SEQ ID NO: 1100672 - protein, 14 aa, Mycobacterium
SVREAPDPDAMQRG

SEQ ID NO: 1100673 - protein, 5 aa, Mycobacterium
SVRRG

SEQ ID NO: 1100674 - protein, 6 aa, Mycobacterium
SVRSSI

SEQ ID NO: 1100675 - protein, 9 aa, Mycobacterium
SVSAPTGTY

SEQ ID NO: 1100676 - protein, 9 aa, Mycobacterium
SVSDPEADV

SEQ ID NO: 1100677 - protein, 20 aa, Mycobacterium
SVSEATATFSPQSPTASIDR

SEQ ID NO: 1100678 - protein, 7 aa, Mycobacterium
SVTEQAA

SEQ ID NO: 1100679 - protein, 5 aa, Mycobacterium
SVTGY

SEQ ID NO: 1100680 - protein, 5 aa, Mycobacterium
SWPNA

SEQ ID NO: 1100681 - protein, 12 aa, Mycobacterium
SWSGGTGLGDDT

SEQ ID NO: 1100682 - protein, 5 aa, Mycobacterium
SWSTR

SEQ ID NO: 1100683 - protein, 15 aa, Mycobacterium
SYAAGDGDPRTAWTA

SEQ ID NO: 1100684 - protein, 8 aa, Mycobacterium
SYDSGEAE

SEQ ID NO: 1100685 - protein, 9 aa, Mycobacterium
SYKGDIEDV

SEQ ID NO: 1100686 - protein, 8 aa, Mycobacterium
SYNKTYGT

SEQ ID NO: 1100687 - protein, 9 aa, Mycobacterium
SYRAAEPGL

SEQ ID NO: 1100688 - protein, 10 aa, Mycobacterium
SYSPSAVTDD

SEQ ID NO: 1100689 - protein, 6 aa, Mycobacterium
SYTPSC

SEQ ID NO: 1100690 - protein, 10 aa, Mycobacterium
TAAEPYPGPG

SEQ ID NO: 1100691 - protein, 7 aa, Mycobacterium
TAAGAGA

SEQ ID NO: 1100692 - protein, 7 aa, Mycobacterium
TAAGEKA

SEQ ID NO: 1100693 - protein, 8 aa, Mycobacterium
TAAHGPRL

SEQ ID NO: 1100694 - protein, 8 aa, Mycobacterium
TAAHPEKA

SEQ ID NO: 1100695 - protein, 14 aa, Mycobacterium
TAAKEAIKGTPLEG

SEQ ID NO: 1100696 - protein, 9 aa, Mycobacterium
TAAPVPPDL

SEQ ID NO: 1100697 - protein, 4 aa, Mycobacterium
TAAT

SEQ ID NO: 1100698 - protein, 6 aa, Mycobacterium
TADAPR

SEQ ID NO: 1100699 - protein, 11 aa, Mycobacterium
TADAVGGLGPS

SEQ ID NO: 1100700 - protein, 5 aa, Mycobacterium
TADLK

SEQ ID NO: 1100701 - protein, 5 aa, Mycobacterium
TADPG

SEQ ID NO: 1100702 - protein, 5 aa, Mycobacterium
TADPR

SEQ ID NO: 1100703 - protein, 6 aa, Mycobacterium
TADQGV

SEQ ID NO: 1100704 - protein, 7 aa, Mycobacterium
TADSARE

SEQ ID NO: 1100705 - protein, 8 aa, Mycobacterium
TADTAIEV

SEQ ID NO: 1100706 - protein, 17 aa, Mycobacterium
TADTDRDGVPDVYQSQR

SEQ ID NO: 1100707 - protein, 16 aa, Mycobacterium
TAEDVGNDPEDTRVSS

SEQ ID NO: 1100708 - protein, 13 aa, Mycobacterium
TAEETKNPQRDVP

SEQ ID NO: 1100709 - protein, 7 aa, Mycobacterium
TAERSRE

SEQ ID NO: 1100710 - protein, 7 aa, Mycobacterium
TAGGASG

SEQ ID NO: 1100711 - protein, 10 aa, Mycobacterium
TAGNQIRDAK

SEQ ID NO: 1100712 - protein, 4 aa, Mycobacterium
TAGP

SEQ ID NO: 1100713 - protein, 4 aa, Mycobacterium
TAGR

SEQ ID NO: 1100714 - protein, 5 aa, Mycobacterium
TAGRS

SEQ ID NO: 1100715 - protein, 11 aa, Mycobacterium
TAGVDRQRRRE

SEQ ID NO: 1100716 - protein, 7 aa, Mycobacterium
TAHEESV

SEQ ID NO: 1100717 - protein, 9 aa, Mycobacterium
TAHRPPAGW

SEQ ID NO: 1100718 - protein, 7 aa, Mycobacterium
TALSPRS

SEQ ID NO: 1100719 - protein, 19 aa, Mycobacterium
TANQQGQTLPLGEAEKDVI

SEQ ID NO: 1100720 - protein, 26 aa, Mycobacterium
TAPAPRATAGPAPEVAPSAPTPRQQV

SEQ ID NO: 1100721 - protein, 11 aa, Mycobacterium
TAPEDPDGASG

SEQ ID NO: 1100722 - protein, 8 aa, Mycobacterium
TAPGPIDE

SEQ ID NO: 1100723 - protein, 8 aa, Mycobacterium
TAPGTQVP

SEQ ID NO: 1100724 - protein, 9 aa, Mycobacterium
TAPLGESGR

SEQ ID NO: 1100725 - protein, 87 aa, Mycobacterium
TAPPAPAPPPEPGTPLPPPPPVTPVTTTPTTTTTTTTTTTTTTTTTTTTTTQPTTTTTQPTTTQPTTTQPTTTQPPVTTTTQPPVTT

SEQ ID NO: 1100726 - protein, 7 aa, Mycobacterium
TAPPEVA

SEQ ID NO: 1100727 - protein, 8 aa, Mycobacterium
TAPQRPAE

SEQ ID NO: 1100728 - protein, 12 aa, Mycobacterium
TAPVSPPPRPAT

SEQ ID NO: 1100729 - protein, 4 aa, Mycobacterium
TAQA

SEQ ID NO: 1100730 - protein, 6 aa, Mycobacterium
TAQQAE

SEQ ID NO: 1100731 - protein, 8 aa, Mycobacterium
TARASGVT

SEQ ID NO: 1100732 - protein, 10 aa, Mycobacterium
TARHPGGGVD

SEQ ID NO: 1100733 - protein, 9 aa, Mycobacterium
TARHRDVGG

SEQ ID NO: 1100734 - protein, 7 aa, Mycobacterium
TARPGTL

SEQ ID NO: 1100735 - protein, 4 aa, Mycobacterium
TARQ

SEQ ID NO: 1100736 - protein, 6 aa, Mycobacterium
TASDDI

SEQ ID NO: 1100737 - protein, 13 aa, Mycobacterium
TASLDSASEAAVQ

SEQ ID NO: 1100738 - protein, 12 aa, Mycobacterium
TASPGAERIGAH

SEQ ID NO: 1100739 - protein, 4 aa, Mycobacterium
TATA

SEQ ID NO: 1100740 - protein, 4 aa, Mycobacterium
TATH

SEQ ID NO: 1100741 - protein, 6 aa, Mycobacterium
TATKSH

SEQ ID NO: 1100742 - protein, 8 aa, Mycobacterium
TATNNPSA

SEQ ID NO: 1100743 - protein, 13 aa, Mycobacterium
TATPGPNDPATEA

SEQ ID NO: 1100744 - protein, 7 aa, Mycobacterium
TATSPGE

SEQ ID NO: 1100745 - protein, 7 aa, Mycobacterium
TATSVGG

SEQ ID NO: 1100746 - protein, 9 aa, Mycobacterium
TDAAEGTVE

SEQ ID NO: 1100747 - protein, 13 aa, Mycobacterium
TDADLTELSSAAG

SEQ ID NO: 1100748 - protein, 15 aa, Mycobacterium
TDAGGVDPAGTAAVG

SEQ ID NO: 1100749 - protein, 5 aa, Mycobacterium
TDASL

SEQ ID NO: 1100750 - protein, 11 aa, Mycobacterium
TDDGPGIPPSL

SEQ ID NO: 1100751 - protein, 7 aa, Mycobacterium
TDDGTEL

SEQ ID NO: 1100752 - protein, 8 aa, Mycobacterium
TDDPAPLA

SEQ ID NO: 1100753 - protein, 7 aa, Mycobacterium
TDDYDGD

SEQ ID NO: 1100754 - protein, 14 aa, Mycobacterium
TDEGGADPEAGGSV

SEQ ID NO: 1100755 - protein, 9 aa, Mycobacterium
TDELPAKSE

SEQ ID NO: 1100756 - protein, 4 aa, Mycobacterium
TDFR

SEQ ID NO: 1100757 - protein, 19 aa, Mycobacterium
TDGAALSPADIAATEAARG

SEQ ID NO: 1100758 - protein, 17 aa, Mycobacterium
TDGFGGNRGHCQGTPGM

SEQ ID NO: 1100759 - protein, 5 aa, Mycobacterium
TDGNR

SEQ ID NO: 1100760 - protein, 13 aa, Mycobacterium
TDKNTKLTTSTKA

SEQ ID NO: 1100761 - protein, 9 aa, Mycobacterium
TDLGKSTDL

SEQ ID NO: 1100762 - protein, 16 aa, Mycobacterium
TDLPDELDALPGREGS

SEQ ID NO: 1100763 - protein, 9 aa, Mycobacterium
TDLPPGDST

SEQ ID NO: 1100764 - protein, 30 aa, Mycobacterium
TDNTGAVQTEDRADPVPDGATGWHTVVFHV

SEQ ID NO: 1100765 - protein, 7 aa, Mycobacterium
TDPASRT

SEQ ID NO: 1100766 - protein, 10 aa, Mycobacterium
TDPDRTRRVT

SEQ ID NO: 1100767 - protein, 6 aa, Mycobacterium
TDPLGR

SEQ ID NO: 1100768 - protein, 16 aa, Mycobacterium
TDRAERAMEDEYQRSE

SEQ ID NO: 1100769 - protein, 4 aa, Mycobacterium
TDRD

SEQ ID NO: 1100770 - protein, 9 aa, Mycobacterium
TDRGGPAPV

SEQ ID NO: 1100771 - protein, 4 aa, Mycobacterium
TDSG

SEQ ID NO: 1100772 - protein, 4 aa, Mycobacterium
TDSK

SEQ ID NO: 1100773 - protein, 14 aa, Mycobacterium
TDSSRARESGGTGL

SEQ ID NO: 1100774 - protein, 19 aa, Mycobacterium
TDTDGYGQRADRRPPGAER

SEQ ID NO: 1100775 - protein, 9 aa, Mycobacterium
TDTGGVPQT

SEQ ID NO: 1100776 - protein, 74 aa, Mycobacterium
TDTGRQPHLPPTAPPQAAAPARHHRPEPAGDLNGHSDLAAGGLPQRNPGASGIAGTAGEQTDPRRAVPAPTNTS

SEQ ID NO: 1100777 - protein, 31 aa, Mycobacterium
TDTPTARETDYGRVDDHSSAIRTPDDPRNTF

SEQ ID NO: 1100778 - protein, 9 aa, Mycobacterium
TDTRAPKGF

SEQ ID NO: 1100779 - protein, 13 aa, Mycobacterium
TDTTPMPDADRDA

SEQ ID NO: 1100780 - protein, 5 aa, Mycobacterium
TDVAT

SEQ ID NO: 1100781 - protein, 7 aa, Mycobacterium
TDVDSGS

SEQ ID NO: 1100782 - protein, 7 aa, Mycobacterium
TDVPPSR

SEQ ID NO: 1100783 - protein, 13 aa, Mycobacterium
TEAGALSGDGKAA

SEQ ID NO: 1100784 - protein, 10 aa, Mycobacterium
TEAGRTNTVV

SEQ ID NO: 1100785 - protein, 10 aa, Mycobacterium
TEAGTTLPIG

SEQ ID NO: 1100786 - protein, 6 aa, Mycobacterium
TEASRT

SEQ ID NO: 1100787 - protein, 16 aa, Mycobacterium
TEDDRHTDTRVPEGRP

SEQ ID NO: 1100788 - protein, 10 aa, Mycobacterium
TEGANTKVAT

SEQ ID NO: 1100789 - protein, 8 aa, Mycobacterium
TEGDPIPA

SEQ ID NO: 1100790 - protein, 8 aa, Mycobacterium
TEGDPTAE

SEQ ID NO: 1100791 - protein, 25 aa, Mycobacterium
TEGPDDVDPGEEPGGPLRGERGGYD

SEQ ID NO: 1100792 - protein, 9 aa, Mycobacterium
TEHLDADDA

SEQ ID NO: 1100793 - protein, 4 aa, Mycobacterium
TELP

SEQ ID NO: 1100794 - protein, 10 aa, Mycobacterium
TENGAEATMS

SEQ ID NO: 1100795 - protein, 5 aa, Mycobacterium
TENSV

SEQ ID NO: 1100796 - protein, 13 aa, Mycobacterium
TEPALSSASQSGL

SEQ ID NO: 1100797 - protein, 5 aa, Mycobacterium
TEPLE

SEQ ID NO: 1100798 - protein, 40 aa, Mycobacterium
TEPPPPPPSAEAPPPPPPETTTPPPPPPPTTTTPAGPRQV

SEQ ID NO: 1100799 - protein, 16 aa, Mycobacterium
TEPRIKSGSANPAPKL

SEQ ID NO: 1100800 - protein, 17 aa, Mycobacterium
TEQTSKLSTGTDEMPEV

SEQ ID NO: 1100801 - protein, 9 aa, Mycobacterium
TERLDGRGM

SEQ ID NO: 1100802 - protein, 10 aa, Mycobacterium
TERLEDGRIG

SEQ ID NO: 1100803 - protein, 7 aa, Mycobacterium
TERPHPY

SEQ ID NO: 1100804 - protein, 20 aa, Mycobacterium
TERTDGQYTVATTESAVTES

SEQ ID NO: 1100805 - protein, 8 aa, Mycobacterium
TERTERSL

SEQ ID NO: 1100806 - protein, 18 aa, Mycobacterium
TESLGGTAELGAQVQPKP

SEQ ID NO: 1100807 - protein, 10 aa, Mycobacterium
TETAKPGRRG

SEQ ID NO: 1100808 - protein, 6 aa, Mycobacterium
TETDPA

SEQ ID NO: 1100809 - protein, 7 aa, Mycobacterium
TFGGGDP

SEQ ID NO: 1100810 - protein, 9 aa, Mycobacterium
TFGSDRALT

SEQ ID NO: 1100811 - protein, 8 aa, Mycobacterium
TGAAPRVD

SEQ ID NO: 1100812 - protein, 10 aa, Mycobacterium
TGAGSGIGRE

SEQ ID NO: 1100813 - protein, 19 aa, Mycobacterium
TGAITDAEYAAKRQQIIEA

SEQ ID NO: 1100814 - protein, 22 aa, Mycobacterium
TGAKVAERPAEQLGGAPEGYQQ

SEQ ID NO: 1100815 - protein, 5 aa, Mycobacterium
TGAPS

SEQ ID NO: 1100816 - protein, 14 aa, Mycobacterium
TGAPTDQSTATAAD

SEQ ID NO: 1100817 - protein, 5 aa, Mycobacterium
TGART

SEQ ID NO: 1100818 - protein, 9 aa, Mycobacterium
TGASSQRGT

SEQ ID NO: 1100819 - protein, 4 aa, Mycobacterium
TGDD

SEQ ID NO: 1100820 - protein, 6 aa, Mycobacterium
TGDDVP

SEQ ID NO: 1100821 - protein, 5 aa, Mycobacterium
TGDES

SEQ ID NO: 1100822 - protein, 13 aa, Mycobacterium
TGDGTNDAPALAQ

SEQ ID NO: 1100823 - protein, 15 aa, Mycobacterium
TGDLGTSYRTRHPVA

SEQ ID NO: 1100824 - protein, 10 aa, Mycobacterium
TGDPALSSKK

SEQ ID NO: 1100825 - protein, 6 aa, Mycobacterium
TGDPDN

SEQ ID NO: 1100826 - protein, 6 aa, Mycobacterium
TGDRFG

SEQ ID NO: 1100827 - protein, 5 aa, Mycobacterium
TGDRG

SEQ ID NO: 1100828 - protein, 16 aa, Mycobacterium
TGEADPIAKDAGDPVM

SEQ ID NO: 1100829 - protein, 11 aa, Mycobacterium
TGEAETPAGPL

SEQ ID NO: 1100830 - protein, 12 aa, Mycobacterium
TGETSPDAVGGP

SEQ ID NO: 1100831 - protein, 7 aa, Mycobacterium
TGFGRTP

SEQ ID NO: 1100832 - protein, 10 aa, Mycobacterium
TGGDPGVTST

SEQ ID NO: 1100833 - protein, 5 aa, Mycobacterium
TGGEN

SEQ ID NO: 1100834 - protein, 14 aa, Mycobacterium
TGGESGAQKHAKEL

SEQ ID NO: 1100835 - protein, 10 aa, Mycobacterium
TGGEYGTSAT

SEQ ID NO: 1100836 - protein, 16 aa, Mycobacterium
TGGSALAADQQIAGDR

SEQ ID NO: 1100837 - protein, 14 aa, Mycobacterium
TGGSEVPGEIPEEP

SEQ ID NO: 1100838 - protein, 6 aa, Mycobacterium
TGGTGI

SEQ ID NO: 1100839 - protein, 5 aa, Mycobacterium
TGGYS

SEQ ID NO: 1100840 - protein, 9 aa, Mycobacterium
TGHTSGADG

SEQ ID NO: 1100841 - protein, 12 aa, Mycobacterium
TGKRGSRPGSTV

SEQ ID NO: 1100842 - protein, 9 aa, Mycobacterium
TGLEPADEV

SEQ ID NO: 1100843 - protein, 9 aa, Mycobacterium
TGLGGSNGL

SEQ ID NO: 1100844 - protein, 13 aa, Mycobacterium
TGLPEPAKALEGK

SEQ ID NO: 1100845 - protein, 4 aa, Mycobacterium
TGNA

SEQ ID NO: 1100846 - protein, 6 aa, Mycobacterium
TGNNPF

SEQ ID NO: 1100847 - protein, 4 aa, Mycobacterium
TGNS

SEQ ID NO: 1100848 - protein, 9 aa, Mycobacterium
TGNTGHGPT

SEQ ID NO: 1100849 - protein, 8 aa, Mycobacterium
TGPAGATF

SEQ ID NO: 1100850 - protein, 8 aa, Mycobacterium
TGPAGRPV

SEQ ID NO: 1100851 - protein, 7 aa, Mycobacterium
TGPANAS

SEQ ID NO: 1100852 - protein, 9 aa, Mycobacterium
TGPAPPGMS

SEQ ID NO: 1100853 - protein, 5 aa, Mycobacterium
TGPDW

SEQ ID NO: 1100854 - protein, 4 aa, Mycobacterium
TGPG

SEQ ID NO: 1100855 - protein, 9 aa, Mycobacterium
TGPGLTPFT

SEQ ID NO: 1100856 - protein, 9 aa, Mycobacterium
TGPRPGGFG

SEQ ID NO: 1100857 - protein, 17 aa, Mycobacterium
TGPTPADDLPITLRTLT

SEQ ID NO: 1100858 - protein, 11 aa, Mycobacterium
TGPTVDQGGEL

SEQ ID NO: 1100859 - protein, 4 aa, Mycobacterium
TGQR

SEQ ID NO: 1100860 - protein, 10 aa, Mycobacterium
TGQRKARDAR

SEQ ID NO: 1100861 - protein, 6 aa, Mycobacterium
TGRGAQ

SEQ ID NO: 1100862 - protein, 23 aa, Mycobacterium
TGRGGALSSGKYAPELQASPAQV

SEQ ID NO: 1100863 - protein, 13 aa, Mycobacterium
TGRLRPAPTAVTG

SEQ ID NO: 1100864 - protein, 5 aa, Mycobacterium
TGRYL

SEQ ID NO: 1100865 - protein, 17 aa, Mycobacterium
TGSAAPAGYQTGQPVRR

SEQ ID NO: 1100866 - protein, 8 aa, Mycobacterium
TGSGVSNQ

SEQ ID NO: 1100867 - protein, 7 aa, Mycobacterium
TGSPPIY

SEQ ID NO: 1100868 - protein, 7 aa, Mycobacterium
TGSRQTP

SEQ ID NO: 1100869 - protein, 14 aa, Mycobacterium
TGSSQFEEPTGSIA

SEQ ID NO: 1100870 - protein, 17 aa, Mycobacterium
TGTAPGAADARATGLTT

SEQ ID NO: 1100871 - protein, 6 aa, Mycobacterium
TGTEFE

SEQ ID NO: 1100872 - protein, 10 aa, Mycobacterium
TGTLTKGEPT

SEQ ID NO: 1100873 - protein, 23 aa, Mycobacterium
TGTSAPEQVADEEGPVQGPPTIG

SEQ ID NO: 1100874 - protein, 7 aa, Mycobacterium
TGTVTTG

SEQ ID NO: 1100875 - protein, 8 aa, Mycobacterium
TGTVTTGQ

SEQ ID NO: 1100876 - protein, 5 aa, Mycobacterium
TGVAT

SEQ ID NO: 1100877 - protein, 21 aa, Mycobacterium
TGVNRHEAGQSIGEDSAWPIP

SEQ ID NO: 1100878 - protein, 5 aa, Mycobacterium
THGGA

SEQ ID NO: 1100879 - protein, 9 aa, Mycobacterium
THGRAKTAE

SEQ ID NO: 1100880 - protein, 13 aa, Mycobacterium
THLPSHSEALSGQ

SEQ ID NO: 1100881 - protein, 7 aa, Mycobacterium
THPTAGS

SEQ ID NO: 1100882 - protein, 11 aa, Mycobacterium
THRASAGLSRT

SEQ ID NO: 1100883 - protein, 17 aa, Mycobacterium
TIEQTSIRPPVGGESAE

SEQ ID NO: 1100884 - protein, 5 aa, Mycobacterium
TIGPR

SEQ ID NO: 1100885 - protein, 10 aa, Mycobacterium
TIPKSPNNQD

SEQ ID NO: 1100886 - protein, 12 aa, Mycobacterium
TIRPPAPAAVRW

SEQ ID NO: 1100887 - protein, 11 aa, Mycobacterium
TISAADADEME

SEQ ID NO: 1100888 - protein, 4 aa, Mycobacterium
TISG

SEQ ID NO: 1100889 - protein, 5 aa, Mycobacterium
TISGG

SEQ ID NO: 1100890 - protein, 13 aa, Mycobacterium
TITETTPYQSPAA

SEQ ID NO: 1100891 - protein, 16 aa, Mycobacterium
TITNQGDDIRDPRRNI

SEQ ID NO: 1100892 - protein, 15 aa, Mycobacterium
TKDAPLDSVDTLQQA

SEQ ID NO: 1100893 - protein, 7 aa, Mycobacterium
TKESPRT

SEQ ID NO: 1100894 - protein, 5 aa, Mycobacterium
TKGKI

SEQ ID NO: 1100895 - protein, 17 aa, Mycobacterium
TKLGPAAMPKGPMPAQA

SEQ ID NO: 1100896 - protein, 4 aa, Mycobacterium
TKLS

SEQ ID NO: 1100897 - protein, 7 aa, Mycobacterium
TKPESVV

SEQ ID NO: 1100898 - protein, 5 aa, Mycobacterium
TKPGL

SEQ ID NO: 1100899 - protein, 5 aa, Mycobacterium
TLDRD

SEQ ID NO: 1100900 - protein, 10 aa, Mycobacterium
TLEQGSTADF

SEQ ID NO: 1100901 - protein, 4 aa, Mycobacterium
TLGA

SEQ ID NO: 1100902 - protein, 13 aa, Mycobacterium
TLGPRGNDTFNHA

SEQ ID NO: 1100903 - protein, 7 aa, Mycobacterium
TLGTSDE

SEQ ID NO: 1100904 - protein, 7 aa, Mycobacterium
TLKQGTA

SEQ ID NO: 1100905 - protein, 9 aa, Mycobacterium
TLPAGSGRS

SEQ ID NO: 1100906 - protein, 7 aa, Mycobacterium
TLPDRSS

SEQ ID NO: 1100907 - protein, 7 aa, Mycobacterium
TLPQSRS

SEQ ID NO: 1100908 - protein, 4 aa, Mycobacterium
TLRD

SEQ ID NO: 1100909 - protein, 9 aa, Mycobacterium
TLRETTRQN

SEQ ID NO: 1100910 - protein, 12 aa, Mycobacterium
TLRRTDKQQDNG

SEQ ID NO: 1100911 - protein, 13 aa, Mycobacterium
TLSEEARDARRDV

SEQ ID NO: 1100912 - protein, 10 aa, Mycobacterium
TLSSSADPGE

SEQ ID NO: 1100913 - protein, 9 aa, Mycobacterium
TLSTDGTTV

SEQ ID NO: 1100914 - protein, 7 aa, Mycobacterium
TLTPAPQ

SEQ ID NO: 1100915 - protein, 8 aa, Mycobacterium
TLTTESRQ

SEQ ID NO: 1100916 - protein, 7 aa, Mycobacterium
TMRPGES

SEQ ID NO: 1100917 - protein, 4 aa, Mycobacterium
TMSA

SEQ ID NO: 1100918 - protein, 13 aa, Mycobacterium
TMSPTGPYDPDRE

SEQ ID NO: 1100919 - protein, 6 aa, Mycobacterium
TNEAYS

SEQ ID NO: 1100920 - protein, 5 aa, Mycobacterium
TNFSG

SEQ ID NO: 1100921 - protein, 6 aa, Mycobacterium
TNNATF

SEQ ID NO: 1100922 - protein, 5 aa, Mycobacterium
TNPAI

SEQ ID NO: 1100923 - protein, 7 aa, Mycobacterium
TNPPPRL

SEQ ID NO: 1100924 - protein, 7 aa, Mycobacterium
TNPVDAP

SEQ ID NO: 1100925 - protein, 15 aa, Mycobacterium
TNSYGLNQPPRLGAD

SEQ ID NO: 1100926 - protein, 8 aa, Mycobacterium
TNTRINEQ

SEQ ID NO: 1100927 - protein, 6 aa, Mycobacterium
TNTSDV

SEQ ID NO: 1100928 - protein, 13 aa, Mycobacterium
TPAAKQKQVKTSA

SEQ ID NO: 1100929 - protein, 9 aa, Mycobacterium
TPAEFGDDY

SEQ ID NO: 1100930 - protein, 6 aa, Mycobacterium
TPAEGF

SEQ ID NO: 1100931 - protein, 7 aa, Mycobacterium
TPALEQD

SEQ ID NO: 1100932 - protein, 7 aa, Mycobacterium
TPAQGAE

SEQ ID NO: 1100933 - protein, 6 aa, Mycobacterium
TPDADT

SEQ ID NO: 1100934 - protein, 9 aa, Mycobacterium
TPDPRPAAV

SEQ ID NO: 1100935 - protein, 13 aa, Mycobacterium
TPEHTPDNPVSTN

SEQ ID NO: 1100936 - protein, 4 aa, Mycobacterium
TPER

SEQ ID NO: 1100937 - protein, 15 aa, Mycobacterium
TPESPAPAANLDEAE

SEQ ID NO: 1100938 - protein, 7 aa, Mycobacterium
TPFNGDS

SEQ ID NO: 1100939 - protein, 12 aa, Mycobacterium
TPGVGGHGQPHL

SEQ ID NO: 1100940 - protein, 4 aa, Mycobacterium
TPMP

SEQ ID NO: 1100941 - protein, 17 aa, Mycobacterium
TPNDPQYQPGFEDADTS

SEQ ID NO: 1100942 - protein, 4 aa, Mycobacterium
TPNL

SEQ ID NO: 1100943 - protein, 8 aa, Mycobacterium
TPNSPARN

SEQ ID NO: 1100944 - protein, 13 aa, Mycobacterium
TPPDGEKVDNPEW

SEQ ID NO: 1100945 - protein, 13 aa, Mycobacterium
TPPHREQYPNPER

SEQ ID NO: 1100946 - protein, 9 aa, Mycobacterium
TPPLPNRRN

SEQ ID NO: 1100947 - protein, 4 aa, Mycobacterium
TPPT

SEQ ID NO: 1100948 - protein, 124 aa, Mycobacterium
TPPTPRPKYDQQQQYGQYGGPGPYYGQPHSGAHQPQQLHTGSHQQAPQQQRPGYPSQYGGGYPGAGGPSTGGFQSSGQQSGPPTPPTGFPTYGQPQQQQGGGSGQGGSGQGQQPPTSQQSGQNP

SEQ ID NO: 1100949 - protein, 4 aa, Mycobacterium
TPQN

SEQ ID NO: 1100950 - protein, 8 aa, Mycobacterium
TPQTGANV

SEQ ID NO: 1100951 - protein, 4 aa, Mycobacterium
TPRD

SEQ ID NO: 1100952 - protein, 7 aa, Mycobacterium
TPRPELS

SEQ ID NO: 1100953 - protein, 7 aa, Mycobacterium
TPRSPRR

SEQ ID NO: 1100954 - protein, 5 aa, Mycobacterium
TPSAH

SEQ ID NO: 1100955 - protein, 7 aa, Mycobacterium
TPSGAAD

SEQ ID NO: 1100956 - protein, 11 aa, Mycobacterium
TPSKTEPPAHP

SEQ ID NO: 1100957 - protein, 5 aa, Mycobacterium
TPTQS

SEQ ID NO: 1100958 - protein, 6 aa, Mycobacterium
TPVEPG

SEQ ID NO: 1100959 - protein, 14 aa, Mycobacterium
TPVPSRLDAGDNAR

SEQ ID NO: 1100960 - protein, 6 aa, Mycobacterium
TPVTAT

SEQ ID NO: 1100961 - protein, 6 aa, Mycobacterium
TPYAQA

SEQ ID NO: 1100962 - protein, 14 aa, Mycobacterium
TPYEADRFGDDDPF

SEQ ID NO: 1100963 - protein, 5 aa, Mycobacterium
TPYPS

SEQ ID NO: 1100964 - protein, 21 aa, Mycobacterium
TQGQQTESALAEYDTAKATLR

SEQ ID NO: 1100965 - protein, 16 aa, Mycobacterium
TQGSSGSTPLSDATIA

SEQ ID NO: 1100966 - protein, 5 aa, Mycobacterium
TQITK

SEQ ID NO: 1100967 - protein, 12 aa, Mycobacterium
TQNNNSMIATCT

SEQ ID NO: 1100968 - protein, 8 aa, Mycobacterium
TQPDPSTR

SEQ ID NO: 1100969 - protein, 17 aa, Mycobacterium
TQPGRTYDVSSPDLPTV

SEQ ID NO: 1100970 - protein, 10 aa, Mycobacterium
TQQDGQPRTY

SEQ ID NO: 1100971 - protein, 8 aa, Mycobacterium
TQQYPGSQ

SEQ ID NO: 1100972 - protein, 4 aa, Mycobacterium
TQRA

SEQ ID NO: 1100973 - protein, 9 aa, Mycobacterium
TQSNADEDK

SEQ ID NO: 1100974 - protein, 10 aa, Mycobacterium
TQSVPGQPVD

SEQ ID NO: 1100975 - protein, 5 aa, Mycobacterium
TQTAS

SEQ ID NO: 1100976 - protein, 5 aa, Mycobacterium
TQTPS

SEQ ID NO: 1100977 - protein, 11 aa, Mycobacterium
TQVPESDTESA

SEQ ID NO: 1100978 - protein, 9 aa, Mycobacterium
TRADEGRAW

SEQ ID NO: 1100979 - protein, 6 aa, Mycobacterium
TRARRA

SEQ ID NO: 1100980 - protein, 7 aa, Mycobacterium
TRATGAQ

SEQ ID NO: 1100981 - protein, 4 aa, Mycobacterium
TRDL

SEQ ID NO: 1100982 - protein, 6 aa, Mycobacterium
TRESPY

SEQ ID NO: 1100983 - protein, 6 aa, Mycobacterium
TREVRD

SEQ ID NO: 1100984 - protein, 14 aa, Mycobacterium
TRGAPSRREDERIA

SEQ ID NO: 1100985 - protein, 9 aa, Mycobacterium
TRGGPRKRA

SEQ ID NO: 1100986 - protein, 14 aa, Mycobacterium
TRGKQIACEEHRAG

SEQ ID NO: 1100987 - protein, 12 aa, Mycobacterium
TRGSSEQAADRV

SEQ ID NO: 1100988 - protein, 7 aa, Mycobacterium
TRHTETV

SEQ ID NO: 1100989 - protein, 19 aa, Mycobacterium
TRIQGPDLTRTSDKTAPRV

SEQ ID NO: 1100990 - protein, 13 aa, Mycobacterium
TRMSGVDTGGHRL

SEQ ID NO: 1100991 - protein, 7 aa, Mycobacterium
TRNSSTM

SEQ ID NO: 1100992 - protein, 7 aa, Mycobacterium
TRPGFRG

SEQ ID NO: 1100993 - protein, 17 aa, Mycobacterium
TRPGIDTPPDAVRPDAV

SEQ ID NO: 1100994 - protein, 6 aa, Mycobacterium
TRPNAQ

SEQ ID NO: 1100995 - protein, 10 aa, Mycobacterium
TRPPRDPAQP

SEQ ID NO: 1100996 - protein, 7 aa, Mycobacterium
TRPTGEM

SEQ ID NO: 1100997 - protein, 6 aa, Mycobacterium
TRPTIT

SEQ ID NO: 1100998 - protein, 4 aa, Mycobacterium
TRPV

SEQ ID NO: 1100999 - protein, 13 aa, Mycobacterium
TRQSGRLPDTPHY

SEQ ID NO: 1101000 - protein, 5 aa, Mycobacterium
TRRPL

SEQ ID NO: 1101001 - protein, 7 aa, Mycobacterium
TRRRNSA

SEQ ID NO: 1101002 - protein, 5 aa, Mycobacterium
TRRRP

SEQ ID NO: 1101003 - protein, 8 aa, Mycobacterium
TRRTPEGR

SEQ ID NO: 1101004 - protein, 4 aa, Mycobacterium
TRSS

SEQ ID NO: 1101005 - protein, 5 aa, Mycobacterium
TRTGE

SEQ ID NO: 1101006 - protein, 6 aa, Mycobacterium
TRVPAG

SEQ ID NO: 1101007 - protein, 8 aa, Mycobacterium
TRVRPDAP

SEQ ID NO: 1101008 - protein, 9 aa, Mycobacterium
TRVTSSAAA

SEQ ID NO: 1101009 - protein, 13 aa, Mycobacterium
TRYPVTGSGPDDV

SEQ ID NO: 1101010 - protein, 8 aa, Mycobacterium
TSAAERVP

SEQ ID NO: 1101011 - protein, 12 aa, Mycobacterium
TSAGENPVETQR

SEQ ID NO: 1101012 - protein, 6 aa, Mycobacterium
TSAMSQ

SEQ ID NO: 1101013 - protein, 6 aa, Mycobacterium
TSAPGA

SEQ ID NO: 1101014 - protein, 8 aa, Mycobacterium
TSASTASR

SEQ ID NO: 1101015 - protein, 7 aa, Mycobacterium
TSATQSQ

SEQ ID NO: 1101016 - protein, 7 aa, Mycobacterium
TSDPPVI

SEQ ID NO: 1101017 - protein, 5 aa, Mycobacterium
TSDRS

SEQ ID NO: 1101018 - protein, 6 aa, Mycobacterium
TSDSDN

SEQ ID NO: 1101019 - protein, 27 aa, Mycobacterium
TSEAFQPVGARQDPNDPNTTQTAGSLR

SEQ ID NO: 1101020 - protein, 12 aa, Mycobacterium
TSFTTDPQGIAD

SEQ ID NO: 1101021 - protein, 10 aa, Mycobacterium
TSGDPAKAPV

SEQ ID NO: 1101022 - protein, 7 aa, Mycobacterium
TSGEDTA

SEQ ID NO: 1101023 - protein, 10 aa, Mycobacterium
TSGGALEPAG

SEQ ID NO: 1101024 - protein, 7 aa, Mycobacterium
TSGGGSL

SEQ ID NO: 1101025 - protein, 7 aa, Mycobacterium
TSGPVRD

SEQ ID NO: 1101026 - protein, 5 aa, Mycobacterium
TSGQL

SEQ ID NO: 1101027 - protein, 10 aa, Mycobacterium
TSGSTRTPAG

SEQ ID NO: 1101028 - protein, 8 aa, Mycobacterium
TSKDGKAW

SEQ ID NO: 1101029 - protein, 9 aa, Mycobacterium
TSLSSTSGS

SEQ ID NO: 1101030 - protein, 8 aa, Mycobacterium
TSNEDGTF

SEQ ID NO: 1101031 - protein, 9 aa, Mycobacterium
TSNGAPARL

SEQ ID NO: 1101032 - protein, 14 aa, Mycobacterium
TSPASPDAVASRAG

SEQ ID NO: 1101033 - protein, 5 aa, Mycobacterium
TSPDY

SEQ ID NO: 1101034 - protein, 5 aa, Mycobacterium
TSPMG

SEQ ID NO: 1101035 - protein, 5 aa, Mycobacterium
TSPSA

SEQ ID NO: 1101036 - protein, 36 aa, Mycobacterium
TSRDDLGGWPPQEYQPVSGRTETVDGALPVGPQSPS

SEQ ID NO: 1101037 - protein, 17 aa, Mycobacterium
TSRGMDATPDTTTRLPT

SEQ ID NO: 1101038 - protein, 7 aa, Mycobacterium
TSRPASE

SEQ ID NO: 1101039 - protein, 5 aa, Mycobacterium
TSSAA

SEQ ID NO: 1101040 - protein, 13 aa, Mycobacterium
TSSNQWQSAEDGG

SEQ ID NO: 1101041 - protein, 11 aa, Mycobacterium
TSTDDAGTTTE

SEQ ID NO: 1101042 - protein, 7 aa, Mycobacterium
TSTGVPN

SEQ ID NO: 1101043 - protein, 12 aa, Mycobacterium
TSTSADSTPVTE

SEQ ID NO: 1101044 - protein, 16 aa, Mycobacterium
TSTVTNAAGADKQPRA

SEQ ID NO: 1101045 - protein, 12 aa, Mycobacterium
TSVQTANEQIDS

SEQ ID NO: 1101046 - protein, 7 aa, Mycobacterium
TSWDGPA

SEQ ID NO: 1101047 - protein, 4 aa, Mycobacterium
TTAI

SEQ ID NO: 1101048 - protein, 6 aa, Mycobacterium
TTAPYG

SEQ ID NO: 1101049 - protein, 7 aa, Mycobacterium
TTASDPV

SEQ ID NO: 1101050 - protein, 21 aa, Mycobacterium
TTDAIPAAVTSAADAQRSSAI

SEQ ID NO: 1101051 - protein, 4 aa, Mycobacterium
TTDL

SEQ ID NO: 1101052 - protein, 9 aa, Mycobacterium
TTDPGSVDL

SEQ ID NO: 1101053 - protein, 7 aa, Mycobacterium
TTDPPTF

SEQ ID NO: 1101054 - protein, 9 aa, Mycobacterium
TTDRTDEKA

SEQ ID NO: 1101055 - protein, 5 aa, Mycobacterium
TTEAA

SEQ ID NO: 1101056 - protein, 5 aa, Mycobacterium
TTEAI

SEQ ID NO: 1101057 - protein, 10 aa, Mycobacterium
TTEINGDYGR

SEQ ID NO: 1101058 - protein, 4 aa, Mycobacterium
TTEM

SEQ ID NO: 1101059 - protein, 6 aa, Mycobacterium
TTENNL

SEQ ID NO: 1101060 - protein, 7 aa, Mycobacterium
TTEPQDV

SEQ ID NO: 1101061 - protein, 5 aa, Mycobacterium
TTEQQ

SEQ ID NO: 1101062 - protein, 5 aa, Mycobacterium
TTGDR

SEQ ID NO: 1101063 - protein, 10 aa, Mycobacterium
TTGGLPGGYT

SEQ ID NO: 1101064 - protein, 10 aa, Mycobacterium
TTGRDRSTGQ

SEQ ID NO: 1101065 - protein, 17 aa, Mycobacterium
TTGYADEYGNETPRTDD

SEQ ID NO: 1101066 - protein, 7 aa, Mycobacterium
TTIPGSA

SEQ ID NO: 1101067 - protein, 11 aa, Mycobacterium
TTPDDYPSALT

SEQ ID NO: 1101068 - protein, 5 aa, Mycobacterium
TTPGV

SEQ ID NO: 1101069 - protein, 11 aa, Mycobacterium
TTPPDPVPQRI

SEQ ID NO: 1101070 - protein, 19 aa, Mycobacterium
TTPTVSTAVDASGHADHGG

SEQ ID NO: 1101071 - protein, 8 aa, Mycobacterium
TTQESTGV

SEQ ID NO: 1101072 - protein, 12 aa, Mycobacterium
TTRGGPGTETQT

SEQ ID NO: 1101073 - protein, 4 aa, Mycobacterium
TTRR

SEQ ID NO: 1101074 - protein, 13 aa, Mycobacterium
TTSGLQGTITGIT

SEQ ID NO: 1101075 - protein, 4 aa, Mycobacterium
TTST

SEQ ID NO: 1101076 - protein, 5 aa, Mycobacterium
TTTPS

SEQ ID NO: 1101077 - protein, 16 aa, Mycobacterium
TTTSKENPDGAYAASS

SEQ ID NO: 1101078 - protein, 18 aa, Mycobacterium
TTTTSKTPDGKKTIESGN

SEQ ID NO: 1101079 - protein, 12 aa, Mycobacterium
TTVGDGPEQEPR

SEQ ID NO: 1101080 - protein, 9 aa, Mycobacterium
TTVPGEGVR

SEQ ID NO: 1101081 - protein, 11 aa, Mycobacterium
TTWAAKPKFNG

SEQ ID NO: 1101082 - protein, 9 aa, Mycobacterium
TVEDNRKAA

SEQ ID NO: 1101083 - protein, 12 aa, Mycobacterium
TVGEPVTLSPDR

SEQ ID NO: 1101084 - protein, 12 aa, Mycobacterium
TVGGRSGTNGVA

SEQ ID NO: 1101085 - protein, 4 aa, Mycobacterium
TVGR

SEQ ID NO: 1101086 - protein, 8 aa, Mycobacterium
TVGSADAR

SEQ ID NO: 1101087 - protein, 13 aa, Mycobacterium
TVGSEPPTNTASS

SEQ ID NO: 1101088 - protein, 5 aa, Mycobacterium
TVGSS

SEQ ID NO: 1101089 - protein, 5 aa, Mycobacterium
TVGTL

SEQ ID NO: 1101090 - protein, 4 aa, Mycobacterium
TVLG

SEQ ID NO: 1101091 - protein, 18 aa, Mycobacterium
TVNGESRTDISEITLKGT

SEQ ID NO: 1101092 - protein, 5 aa, Mycobacterium
TVNST

SEQ ID NO: 1101093 - protein, 8 aa, Mycobacterium
TVPAPSPR

SEQ ID NO: 1101094 - protein, 5 aa, Mycobacterium
TVQPA

SEQ ID NO: 1101095 - protein, 8 aa, Mycobacterium
TVRAGGEA

SEQ ID NO: 1101096 - protein, 5 aa, Mycobacterium
TVRGR

SEQ ID NO: 1101097 - protein, 12 aa, Mycobacterium
TVSGPIPGGGTA

SEQ ID NO: 1101098 - protein, 5 aa, Mycobacterium
TVSGQ

SEQ ID NO: 1101099 - protein, 10 aa, Mycobacterium
TVSPDDRVSG

SEQ ID NO: 1101100 - protein, 20 aa, Mycobacterium
TVSTSGFTGLPDANSSGNVE

SEQ ID NO: 1101101 - protein, 5 aa, Mycobacterium
TVTAT

SEQ ID NO: 1101102 - protein, 11 aa, Mycobacterium
TVTDTPERPRR

SEQ ID NO: 1101103 - protein, 17 aa, Mycobacterium
TVTPGTDEAPDPVPYEK

SEQ ID NO: 1101104 - protein, 8 aa, Mycobacterium
TVTPPDDL

SEQ ID NO: 1101105 - protein, 6 aa, Mycobacterium
TVYPSE

SEQ ID NO: 1101106 - protein, 8 aa, Mycobacterium
TWPPPPVQ

SEQ ID NO: 1101107 - protein, 8 aa, Mycobacterium
TWTAPREA

SEQ ID NO: 1101108 - protein, 4 aa, Mycobacterium
TYDD

SEQ ID NO: 1101109 - protein, 8 aa, Mycobacterium
TYGGETRA

SEQ ID NO: 1101110 - protein, 9 aa, Mycobacterium
TYRADAARS

SEQ ID NO: 1101111 - protein, 9 aa, Mycobacterium
TYSQAGEGY

SEQ ID NO: 1101112 - protein, 8 aa, Mycobacterium
VAADGGKL

SEQ ID NO: 1101113 - protein, 19 aa, Mycobacterium
VAAGQSNDVPTRAARTTGE

SEQ ID NO: 1101114 - protein, 11 aa, Mycobacterium
VAAPTPSGSPV

SEQ ID NO: 1101115 - protein, 8 aa, Mycobacterium
VAATEADG

SEQ ID NO: 1101116 - protein, 8 aa, Mycobacterium
VAATRNVE

SEQ ID NO: 1101117 - protein, 13 aa, Mycobacterium
VADAASDPDRSKR

SEQ ID NO: 1101118 - protein, 5 aa, Mycobacterium
VADPA

SEQ ID NO: 1101119 - protein, 15 aa, Mycobacterium
VADVEGAARGSQPGD

SEQ ID NO: 1101120 - protein, 10 aa, Mycobacterium
VAEEPPSEYV

SEQ ID NO: 1101121 - protein, 21 aa, Mycobacterium
VAEGRGKAQAETLRKTKADTM

SEQ ID NO: 1101122 - protein, 12 aa, Mycobacterium
VAETAPSPIGGA

SEQ ID NO: 1101123 - protein, 6 aa, Mycobacterium
VAETTY

SEQ ID NO: 1101124 - protein, 6 aa, Mycobacterium
VAGGAW

SEQ ID NO: 1101125 - protein, 7 aa, Mycobacterium
VAGNVDA

SEQ ID NO: 1101126 - protein, 8 aa, Mycobacterium
VAGQSDSG

SEQ ID NO: 1101127 - protein, 5 aa, Mycobacterium
VAGRL

SEQ ID NO: 1101128 - protein, 20 aa, Mycobacterium
VAGRRIDDPVETDQTTETEL

SEQ ID NO: 1101129 - protein, 4 aa, Mycobacterium
VAGT

SEQ ID NO: 1101130 - protein, 11 aa, Mycobacterium
VAKDATGAKWP

SEQ ID NO: 1101131 - protein, 4 aa, Mycobacterium
VAKG

SEQ ID NO: 1101132 - protein, 8 aa, Mycobacterium
VAKGDTGT

SEQ ID NO: 1101133 - protein, 4 aa, Mycobacterium
VAPD

SEQ ID NO: 1101134 - protein, 8 aa, Mycobacterium
VAPGGVGS

SEQ ID NO: 1101135 - protein, 12 aa, Mycobacterium
VAPLPTATHPDR

SEQ ID NO: 1101136 - protein, 7 aa, Mycobacterium
VAPPDAV

SEQ ID NO: 1101137 - protein, 10 aa, Mycobacterium
VAPSNSDSVA

SEQ ID NO: 1101138 - protein, 8 aa, Mycobacterium
VAPTPRLT

SEQ ID NO: 1101139 - protein, 4 aa, Mycobacterium
VAQA

SEQ ID NO: 1101140 - protein, 14 aa, Mycobacterium
VAQDSPPAWSGRTP

SEQ ID NO: 1101141 - protein, 8 aa, Mycobacterium
VARAGGAL

SEQ ID NO: 1101142 - protein, 6 aa, Mycobacterium
VARRPA

SEQ ID NO: 1101143 - protein, 7 aa, Mycobacterium
VARRQNA

SEQ ID NO: 1101144 - protein, 14 aa, Mycobacterium
VASAGSTHTNGKDY

SEQ ID NO: 1101145 - protein, 17 aa, Mycobacterium
VASSESSADAARTSEER

SEQ ID NO: 1101146 - protein, 4 aa, Mycobacterium
VATA

SEQ ID NO: 1101147 - protein, 11 aa, Mycobacterium
VATGEENAGSV

SEQ ID NO: 1101148 - protein, 9 aa, Mycobacterium
VDAPDAALA

SEQ ID NO: 1101149 - protein, 7 aa, Mycobacterium
VDARSDI

SEQ ID NO: 1101150 - protein, 7 aa, Mycobacterium
VDASGKV

SEQ ID NO: 1101151 - protein, 13 aa, Mycobacterium
VDDGAKVSQVEFV

SEQ ID NO: 1101152 - protein, 9 aa, Mycobacterium
VDEKGAQFD

SEQ ID NO: 1101153 - protein, 10 aa, Mycobacterium
VDEPNSGTTV

SEQ ID NO: 1101154 - protein, 11 aa, Mycobacterium
VDETAAPVPHP

SEQ ID NO: 1101155 - protein, 6 aa, Mycobacterium
VDGAPE

SEQ ID NO: 1101156 - protein, 5 aa, Mycobacterium
VDGQT

SEQ ID NO: 1101157 - protein, 5 aa, Mycobacterium
VDKTP

SEQ ID NO: 1101158 - protein, 4 aa, Mycobacterium
VDND

SEQ ID NO: 1101159 - protein, 14 aa, Mycobacterium
VDPERDHIRGDPDA

SEQ ID NO: 1101160 - protein, 4 aa, Mycobacterium
VDPG

SEQ ID NO: 1101161 - protein, 17 aa, Mycobacterium
VDPPRRSDRVDDRGSGD

SEQ ID NO: 1101162 - protein, 11 aa, Mycobacterium
VDPRRVDSAQS

SEQ ID NO: 1101163 - protein, 17 aa, Mycobacterium
VDPSAAETRTGPSTSAV

SEQ ID NO: 1101164 - protein, 6 aa, Mycobacterium
VDQAGE

SEQ ID NO: 1101165 - protein, 27 aa, Mycobacterium
VDRPDGGTPSRFRGEPDDDPEAQARRK

SEQ ID NO: 1101166 - protein, 8 aa, Mycobacterium
VDSAPGRT

SEQ ID NO: 1101167 - protein, 7 aa, Mycobacterium
VDSPDGV

SEQ ID NO: 1101168 - protein, 8 aa, Mycobacterium
VDTPDRPS

SEQ ID NO: 1101169 - protein, 8 aa, Mycobacterium
VDTQRGPL

SEQ ID NO: 1101170 - protein, 10 aa, Mycobacterium
VEAKGAQAAP

SEQ ID NO: 1101171 - protein, 6 aa, Mycobacterium
VEARAD

SEQ ID NO: 1101172 - protein, 7 aa, Mycobacterium
VEDNPGY

SEQ ID NO: 1101173 - protein, 9 aa, Mycobacterium
VEDTSRQQE

SEQ ID NO: 1101174 - protein, 6 aa, Mycobacterium
VEEGRG

SEQ ID NO: 1101175 - protein, 5 aa, Mycobacterium
VEEVT

SEQ ID NO: 1101176 - protein, 9 aa, Mycobacterium
VENTEDPEL

SEQ ID NO: 1101177 - protein, 4 aa, Mycobacterium
VEPA

SEQ ID NO: 1101178 - protein, 15 aa, Mycobacterium
VEPPGETDCNCESND

SEQ ID NO: 1101179 - protein, 20 aa, Mycobacterium
VEPPGGSQRPTSPAFAELPL

SEQ ID NO: 1101180 - protein, 8 aa, Mycobacterium
VEQGPPER

SEQ ID NO: 1101181 - protein, 13 aa, Mycobacterium
VEQSEQRFGSAAR

SEQ ID NO: 1101182 - protein, 10 aa, Mycobacterium
VERADEAEAV

SEQ ID NO: 1101183 - protein, 6 aa, Mycobacterium
VERGGV

SEQ ID NO: 1101184 - protein, 6 aa, Mycobacterium
VERPPA

SEQ ID NO: 1101185 - protein, 11 aa, Mycobacterium
VERTVTSEELV

SEQ ID NO: 1101186 - protein, 8 aa, Mycobacterium
VESMTEDS

SEQ ID NO: 1101187 - protein, 8 aa, Mycobacterium
VESPSNAD

SEQ ID NO: 1101188 - protein, 11 aa, Mycobacterium
VESPTRTARSG

SEQ ID NO: 1101189 - protein, 8 aa, Mycobacterium
VESTRDPK

SEQ ID NO: 1101190 - protein, 19 aa, Mycobacterium
VESVTESEGLGSVEGDEVA

SEQ ID NO: 1101191 - protein, 8 aa, Mycobacterium
VFTSPNSA

SEQ ID NO: 1101192 - protein, 6 aa, Mycobacterium
VGAPGA

SEQ ID NO: 1101193 - protein, 9 aa, Mycobacterium
VGAPPKGLT

SEQ ID NO: 1101194 - protein, 11 aa, Mycobacterium
VGAPPRARTGQ

SEQ ID NO: 1101195 - protein, 4 aa, Mycobacterium
VGDE

SEQ ID NO: 1101196 - protein, 10 aa, Mycobacterium
VGDEGELPNT

SEQ ID NO: 1101197 - protein, 5 aa, Mycobacterium
VGDPR

SEQ ID NO: 1101198 - protein, 7 aa, Mycobacterium
VGEAGQA

SEQ ID NO: 1101199 - protein, 12 aa, Mycobacterium
VGGDRSTRDGVT

SEQ ID NO: 1101200 - protein, 7 aa, Mycobacterium
VGGEGEA

SEQ ID NO: 1101201 - protein, 7 aa, Mycobacterium
VGGEPRF

SEQ ID NO: 1101202 - protein, 13 aa, Mycobacterium
VGGGAKGVGTGVN

SEQ ID NO: 1101203 - protein, 6 aa, Mycobacterium
VGGGDT

SEQ ID NO: 1101204 - protein, 6 aa, Mycobacterium
VGGGGL

SEQ ID NO: 1101205 - protein, 10 aa, Mycobacterium
VGGGLTAAST

SEQ ID NO: 1101206 - protein, 12 aa, Mycobacterium
VGGGPAGVGNAV

SEQ ID NO: 1101207 - protein, 27 aa, Mycobacterium
VGGKGTPLVGDESRQSWPATYKVRERR

SEQ ID NO: 1101208 - protein, 8 aa, Mycobacterium
VGGNGPLS

SEQ ID NO: 1101209 - protein, 6 aa, Mycobacterium
VGGPTA

SEQ ID NO: 1101210 - protein, 13 aa, Mycobacterium
VGNDAKVADVEFV

SEQ ID NO: 1101211 - protein, 8 aa, Mycobacterium
VGNDPRAR

SEQ ID NO: 1101212 - protein, 10 aa, Mycobacterium
VGNGKKTTAG

SEQ ID NO: 1101213 - protein, 8 aa, Mycobacterium
VGNPAAPH

SEQ ID NO: 1101214 - protein, 13 aa, Mycobacterium
VGNTARVPTGVCV

SEQ ID NO: 1101215 - protein, 7 aa, Mycobacterium
VGPSGVP

SEQ ID NO: 1101216 - protein, 8 aa, Mycobacterium
VGPVTSEF

SEQ ID NO: 1101217 - protein, 8 aa, Mycobacterium
VGQAYPGS

SEQ ID NO: 1101218 - protein, 9 aa, Mycobacterium
VGRDDEAQP

SEQ ID NO: 1101219 - protein, 4 aa, Mycobacterium
VGRG

SEQ ID NO: 1101220 - protein, 6 aa, Mycobacterium
VGRHGE

SEQ ID NO: 1101221 - protein, 19 aa, Mycobacterium
VGRQRGAGLGGGHDEREQT

SEQ ID NO: 1101222 - protein, 12 aa, Mycobacterium
VGRQTNNPAYTS

SEQ ID NO: 1101223 - protein, 5 aa, Mycobacterium
VGSED

SEQ ID NO: 1101224 - protein, 10 aa, Mycobacterium
VGSGPDAREL

SEQ ID NO: 1101225 - protein, 6 aa, Mycobacterium
VGSGTG

SEQ ID NO: 1101226 - protein, 7 aa, Mycobacterium
VGSMGSA

SEQ ID NO: 1101227 - protein, 9 aa, Mycobacterium
VGSPLTAGV

SEQ ID NO: 1101228 - protein, 6 aa, Mycobacterium
VGSPTA

SEQ ID NO: 1101229 - protein, 8 aa, Mycobacterium
VGSRTSER

SEQ ID NO: 1101230 - protein, 7 aa, Mycobacterium
VGSSYGN

SEQ ID NO: 1101231 - protein, 12 aa, Mycobacterium
VGSTAVPLAPER

SEQ ID NO: 1101232 - protein, 11 aa, Mycobacterium
VGTADTGTSPV

SEQ ID NO: 1101233 - protein, 6 aa, Mycobacterium
VGTDTG

SEQ ID NO: 1101234 - protein, 6 aa, Mycobacterium
VGTIPG

SEQ ID NO: 1101235 - protein, 4 aa, Mycobacterium
VGTP

SEQ ID NO: 1101236 - protein, 5 aa, Mycobacterium
VGTPA

SEQ ID NO: 1101237 - protein, 8 aa, Mycobacterium
VHSPGPGG

SEQ ID NO: 1101238 - protein, 10 aa, Mycobacterium
VHTRDGKAHP

SEQ ID NO: 1101239 - protein, 7 aa, Mycobacterium
VIPGDGE

SEQ ID NO: 1101240 - protein, 7 aa, Mycobacterium
VKAGPSS

SEQ ID NO: 1101241 - protein, 11 aa, Mycobacterium
VKAGSAAERAG

SEQ ID NO: 1101242 - protein, 4 aa, Mycobacterium
VKDR

SEQ ID NO: 1101243 - protein, 4 aa, Mycobacterium
VKGR

SEQ ID NO: 1101244 - protein, 8 aa, Mycobacterium
VKNPGTQA

SEQ ID NO: 1101245 - protein, 7 aa, Mycobacterium
VKPDVPA

SEQ ID NO: 1101246 - protein, 9 aa, Mycobacterium
VKPEQADET

SEQ ID NO: 1101247 - protein, 14 aa, Mycobacterium
VKPPKRPGEESYSA

SEQ ID NO: 1101248 - protein, 14 aa, Mycobacterium
VKQQAKDKVDETKH

SEQ ID NO: 1101249 - protein, 11 aa, Mycobacterium
VKTAGTETAPQ

SEQ ID NO: 1101250 - protein, 15 aa, Mycobacterium
VNAGQPPDNAGPRAE

SEQ ID NO: 1101251 - protein, 9 aa, Mycobacterium
VNAGTGPGL

SEQ ID NO: 1101252 - protein, 14 aa, Mycobacterium
VNAPASPEAPRPLT

SEQ ID NO: 1101253 - protein, 24 aa, Mycobacterium
VNDETDPDTPAPESPLRSGGPQSL

SEQ ID NO: 1101254 - protein, 21 aa, Mycobacterium
VNDGPDAGPTTPTRPGTGQEA

SEQ ID NO: 1101255 - protein, 19 aa, Mycobacterium
VNGATQEQETVTEPAPEDV

SEQ ID NO: 1101256 - protein, 9 aa, Mycobacterium
VNGGRDTTV

SEQ ID NO: 1101257 - protein, 9 aa, Mycobacterium
VNGRPAQEP

SEQ ID NO: 1101258 - protein, 6 aa, Mycobacterium
VNGTST

SEQ ID NO: 1101259 - protein, 5 aa, Mycobacterium
VPAGG

SEQ ID NO: 1101260 - protein, 9 aa, Mycobacterium
VPAGPSAPR

SEQ ID NO: 1101261 - protein, 34 aa, Mycobacterium
VPAPGAPATPGTAPAGSSAAAPAAPAPAAAAAAP

SEQ ID NO: 1101262 - protein, 10 aa, Mycobacterium
VPAPPAEAPP

SEQ ID NO: 1101263 - protein, 7 aa, Mycobacterium
VPAPRNL

SEQ ID NO: 1101264 - protein, 8 aa, Mycobacterium
VPAPTSVQ

SEQ ID NO: 1101265 - protein, 6 aa, Mycobacterium
VPDEEL

SEQ ID NO: 1101266 - protein, 14 aa, Mycobacterium
VPDPGSPPQDLRPY

SEQ ID NO: 1101267 - protein, 14 aa, Mycobacterium
VPDSADLSGTSAIG

SEQ ID NO: 1101268 - protein, 5 aa, Mycobacterium
VPEAD

SEQ ID NO: 1101269 - protein, 4 aa, Mycobacterium
VPEG

SEQ ID NO: 1101270 - protein, 14 aa, Mycobacterium
VPEQPAAGEGPNKL

SEQ ID NO: 1101271 - protein, 8 aa, Mycobacterium
VPESAARL

SEQ ID NO: 1101272 - protein, 5 aa, Mycobacterium
VPGAQ

SEQ ID NO: 1101273 - protein, 11 aa, Mycobacterium
VPGASVPVPSG

SEQ ID NO: 1101274 - protein, 23 aa, Mycobacterium
VPGEDVPNAPAEPQSSAAEDDGE

SEQ ID NO: 1101275 - protein, 9 aa, Mycobacterium
VPGPPAGSA

SEQ ID NO: 1101276 - protein, 11 aa, Mycobacterium
VPKPSDTDPRL

SEQ ID NO: 1101277 - protein, 8 aa, Mycobacterium
VPLRPSTT

SEQ ID NO: 1101278 - protein, 4 aa, Mycobacterium
VPNR

SEQ ID NO: 1101279 - protein, 9 aa, Mycobacterium
VPPDTSKPV

SEQ ID NO: 1101280 - protein, 5 aa, Mycobacterium
VPPEA

SEQ ID NO: 1101281 - protein, 10 aa, Mycobacterium
VPPGPTDPPT

SEQ ID NO: 1101282 - protein, 10 aa, Mycobacterium
VPPPATRKGT

SEQ ID NO: 1101283 - protein, 8 aa, Mycobacterium
VPPPDRGP

SEQ ID NO: 1101284 - protein, 5 aa, Mycobacterium
VPQAA

SEQ ID NO: 1101285 - protein, 8 aa, Mycobacterium
VPQANADD

SEQ ID NO: 1101286 - protein, 6 aa, Mycobacterium
VPQRET

SEQ ID NO: 1101287 - protein, 4 aa, Mycobacterium
VPRA

SEQ ID NO: 1101288 - protein, 11 aa, Mycobacterium
VPREAESKPFS

SEQ ID NO: 1101289 - protein, 5 aa, Mycobacterium
VPRHG

SEQ ID NO: 1101290 - protein, 8 aa, Mycobacterium
VPRPPTAD

SEQ ID NO: 1101291 - protein, 7 aa, Mycobacterium
VPRPRAD

SEQ ID NO: 1101292 - protein, 8 aa, Mycobacterium
VPTADGPK

SEQ ID NO: 1101293 - protein, 12 aa, Mycobacterium
VPTGDGPAATPV

SEQ ID NO: 1101294 - protein, 13 aa, Mycobacterium
VPTQSAPTVERPQ

SEQ ID NO: 1101295 - protein, 7 aa, Mycobacterium
VPTTADL

SEQ ID NO: 1101296 - protein, 7 aa, Mycobacterium
VQAGGAH

SEQ ID NO: 1101297 - protein, 8 aa, Mycobacterium
VQASAQGV

SEQ ID NO: 1101298 - protein, 7 aa, Mycobacterium
VQGASNP

SEQ ID NO: 1101299 - protein, 9 aa, Mycobacterium
VQGGPKGVG

SEQ ID NO: 1101300 - protein, 8 aa, Mycobacterium
VQPGATGF

SEQ ID NO: 1101301 - protein, 7 aa, Mycobacterium
VQREYPS

SEQ ID NO: 1101302 - protein, 10 aa, Mycobacterium
VQSSQDGRVE

SEQ ID NO: 1101303 - protein, 8 aa, Mycobacterium
VQYDPDTQ

SEQ ID NO: 1101304 - protein, 18 aa, Mycobacterium
VRAGESGDLEDAPDVVPT

SEQ ID NO: 1101305 - protein, 8 aa, Mycobacterium
VRATRQGA

SEQ ID NO: 1101306 - protein, 11 aa, Mycobacterium
VRETADSTAVY

SEQ ID NO: 1101307 - protein, 6 aa, Mycobacterium
VRGEDD

SEQ ID NO: 1101308 - protein, 7 aa, Mycobacterium
VRGERER

SEQ ID NO: 1101309 - protein, 18 aa, Mycobacterium
VRGGVNAAAEALGPGALG

SEQ ID NO: 1101310 - protein, 12 aa, Mycobacterium
VRGPEGADPASV

SEQ ID NO: 1101311 - protein, 10 aa, Mycobacterium
VRGPGSSRGW

SEQ ID NO: 1101312 - protein, 11 aa, Mycobacterium
VRGTAGKSRWA

SEQ ID NO: 1101313 - protein, 5 aa, Mycobacterium
VRGVD

SEQ ID NO: 1101314 - protein, 4 aa, Mycobacterium
VRKT

SEQ ID NO: 1101315 - protein, 7 aa, Mycobacterium
VRPDARD

SEQ ID NO: 1101316 - protein, 6 aa, Mycobacterium
VRPDQK

SEQ ID NO: 1101317 - protein, 18 aa, Mycobacterium
VRPEDKAAKVSGLQREGR

SEQ ID NO: 1101318 - protein, 12 aa, Mycobacterium
VRQGNSGGPMIN

SEQ ID NO: 1101319 - protein, 12 aa, Mycobacterium
VRRNPDHELRRS

SEQ ID NO: 1101320 - protein, 13 aa, Mycobacterium
VRSGEISTPLGSE

SEQ ID NO: 1101321 - protein, 14 aa, Mycobacterium
VRSGLADAARGALP

SEQ ID NO: 1101322 - protein, 7 aa, Mycobacterium
VRSGQLS

SEQ ID NO: 1101323 - protein, 52 aa, Mycobacterium
VRSGRRPPRPNQAPSIGRATPAAVPSAAQARAAADLTGRAPVTAARARPTGA

SEQ ID NO: 1101324 - protein, 10 aa, Mycobacterium
VRTDGAPSEF

SEQ ID NO: 1101325 - protein, 7 aa, Mycobacterium
VRTPAGK

SEQ ID NO: 1101326 - protein, 5 aa, Mycobacterium
VRTQT

SEQ ID NO: 1101327 - protein, 4 aa, Mycobacterium
VSAA

SEQ ID NO: 1101328 - protein, 5 aa, Mycobacterium
VSADD

SEQ ID NO: 1101329 - protein, 10 aa, Mycobacterium
VSAPAGGRTL

SEQ ID NO: 1101330 - protein, 6 aa, Mycobacterium
VSASTA

SEQ ID NO: 1101331 - protein, 11 aa, Mycobacterium
VSDDDNRSATV

SEQ ID NO: 1101332 - protein, 11 aa, Mycobacterium
VSDQPEHRRGS

SEQ ID NO: 1101333 - protein, 11 aa, Mycobacterium
VSDTLAQRAGQ

SEQ ID NO: 1101334 - protein, 7 aa, Mycobacterium
VSGAGAG

SEQ ID NO: 1101335 - protein, 29 aa, Mycobacterium
VSGDDDQPPPNTAAGRASAFNPKRNAPKR

SEQ ID NO: 1101336 - protein, 11 aa, Mycobacterium
VSGDDGKSVGC

SEQ ID NO: 1101337 - protein, 5 aa, Mycobacterium
VSGDS

SEQ ID NO: 1101338 - protein, 15 aa, Mycobacterium
VSGEGPYAAAPGQRP

SEQ ID NO: 1101339 - protein, 20 aa, Mycobacterium
VSGENAGQPQRTGYSDPNLR

SEQ ID NO: 1101340 - protein, 16 aa, Mycobacterium
VSGGAAAVRRTSSGTP

SEQ ID NO: 1101341 - protein, 13 aa, Mycobacterium
VSGGGAKAVGNAV

SEQ ID NO: 1101342 - protein, 17 aa, Mycobacterium
VSGGVPADTTETPARSL

SEQ ID NO: 1101343 - protein, 7 aa, Mycobacterium
VSGPGAA

SEQ ID NO: 1101344 - protein, 7 aa, Mycobacterium
VSGPPVA

SEQ ID NO: 1101345 - protein, 7 aa, Mycobacterium
VSGPTGA

SEQ ID NO: 1101346 - protein, 5 aa, Mycobacterium
VSGQA

SEQ ID NO: 1101347 - protein, 7 aa, Mycobacterium
VSGSGSV

SEQ ID NO: 1101348 - protein, 8 aa, Mycobacterium
VSGTATSM

SEQ ID NO: 1101349 - protein, 6 aa, Mycobacterium
VSKTRW

SEQ ID NO: 1101350 - protein, 7 aa, Mycobacterium
VSLETSG

SEQ ID NO: 1101351 - protein, 18 aa, Mycobacterium
VSNSTGQTGLGATTAEEL

SEQ ID NO: 1101352 - protein, 8 aa, Mycobacterium
VSNTSPPT

SEQ ID NO: 1101353 - protein, 14 aa, Mycobacterium
VSPAAETPAAPGTA

SEQ ID NO: 1101354 - protein, 7 aa, Mycobacterium
VSPAAGL

SEQ ID NO: 1101355 - protein, 10 aa, Mycobacterium
VSPDEEEQGI

SEQ ID NO: 1101356 - protein, 5 aa, Mycobacterium
VSPER

SEQ ID NO: 1101357 - protein, 5 aa, Mycobacterium
VSPGE

SEQ ID NO: 1101358 - protein, 20 aa, Mycobacterium
VSPKGRVKNAIGSAQRHATT

SEQ ID NO: 1101359 - protein, 5 aa, Mycobacterium
VSPQR

SEQ ID NO: 1101360 - protein, 5 aa, Mycobacterium
VSPST

SEQ ID NO: 1101361 - protein, 8 aa, Mycobacterium
VSPTGNAG

SEQ ID NO: 1101362 - protein, 5 aa, Mycobacterium
VSRPA

SEQ ID NO: 1101363 - protein, 5 aa, Mycobacterium
VSRRP

SEQ ID NO: 1101364 - protein, 4 aa, Mycobacterium
VSRT

SEQ ID NO: 1101365 - protein, 9 aa, Mycobacterium
VSRTGGAPT

SEQ ID NO: 1101366 - protein, 18 aa, Mycobacterium
VSSPTTGPTIVTAVLPCA

SEQ ID NO: 1101367 - protein, 6 aa, Mycobacterium
VSSRAG

SEQ ID NO: 1101368 - protein, 4 aa, Mycobacterium
VSSS

SEQ ID NO: 1101369 - protein, 14 aa, Mycobacterium
VSSTARDDEAEGRF

SEQ ID NO: 1101370 - protein, 9 aa, Mycobacterium
VSSTGTSVQ

SEQ ID NO: 1101371 - protein, 6 aa, Mycobacterium
VSTLGD

SEQ ID NO: 1101372 - protein, 11 aa, Mycobacterium
VSTNPSAGTIE

SEQ ID NO: 1101373 - protein, 11 aa, Mycobacterium
VSTSPVSKNVP

SEQ ID NO: 1101374 - protein, 8 aa, Mycobacterium
VTADGDPI

SEQ ID NO: 1101375 - protein, 7 aa, Mycobacterium
VTAGSGA

SEQ ID NO: 1101376 - protein, 7 aa, Mycobacterium
VTAPSGQ

SEQ ID NO: 1101377 - protein, 4 aa, Mycobacterium
VTAR

SEQ ID NO: 1101378 - protein, 6 aa, Mycobacterium
VTDDTA

SEQ ID NO: 1101379 - protein, 14 aa, Mycobacterium
VTDGGETATVDRGR

SEQ ID NO: 1101380 - protein, 25 aa, Mycobacterium
VTDSHPDMRQPSKRKWGVRESGATI

SEQ ID NO: 1101381 - protein, 12 aa, Mycobacterium
VTDTEREREQAA

SEQ ID NO: 1101382 - protein, 7 aa, Mycobacterium
VTEAAGR

SEQ ID NO: 1101383 - protein, 11 aa, Mycobacterium
VTEAPDASAAR

SEQ ID NO: 1101384 - protein, 7 aa, Mycobacterium
VTEPTTG

SEQ ID NO: 1101385 - protein, 8 aa, Mycobacterium
VTESDDQQ

SEQ ID NO: 1101386 - protein, 8 aa, Mycobacterium
VTGDPTEA

SEQ ID NO: 1101387 - protein, 6 aa, Mycobacterium
VTGGPL

SEQ ID NO: 1101388 - protein, 10 aa, Mycobacterium
VTGPSGSGKT

SEQ ID NO: 1101389 - protein, 9 aa, Mycobacterium
VTGRGRGRR

SEQ ID NO: 1101390 - protein, 14 aa, Mycobacterium
VTGSEALGASDEPL

SEQ ID NO: 1101391 - protein, 4 aa, Mycobacterium
VTPA

SEQ ID NO: 1101392 - protein, 7 aa, Mycobacterium
VTPAKLA

SEQ ID NO: 1101393 - protein, 11 aa, Mycobacterium
VTPDADDSSLQ

SEQ ID NO: 1101394 - protein, 17 aa, Mycobacterium
VTPDAKDAAGTPGMGSS

SEQ ID NO: 1101395 - protein, 20 aa, Mycobacterium
VTPEQGTEVPPIGPAPTETV

SEQ ID NO: 1101396 - protein, 6 aa, Mycobacterium
VTPNKV

SEQ ID NO: 1101397 - protein, 5 aa, Mycobacterium
VTPPA

SEQ ID NO: 1101398 - protein, 13 aa, Mycobacterium
VTPRPPAAPSPDT

SEQ ID NO: 1101399 - protein, 7 aa, Mycobacterium
VTPRPVS

SEQ ID NO: 1101400 - protein, 9 aa, Mycobacterium
VTPSATAVG

SEQ ID NO: 1101401 - protein, 15 aa, Mycobacterium
VTPSGPSLPLGPAAE

SEQ ID NO: 1101402 - protein, 34 aa, Mycobacterium
VTPTAPPSPSASATPDPAPSAVAPPPPAAATPRA

SEQ ID NO: 1101403 - protein, 11 aa, Mycobacterium
VTQEGTSEPKA

SEQ ID NO: 1101404 - protein, 4 aa, Mycobacterium
VTQT

SEQ ID NO: 1101405 - protein, 9 aa, Mycobacterium
VTRDGAPEP

SEQ ID NO: 1101406 - protein, 7 aa, Mycobacterium
VTRRGGA

SEQ ID NO: 1101407 - protein, 5 aa, Mycobacterium
VTSAA

SEQ ID NO: 1101408 - protein, 26 aa, Mycobacterium
VTSESNPGGAVQKPRAIEDDQPPTNI

SEQ ID NO: 1101409 - protein, 12 aa, Mycobacterium
VTSKPESPGGRG

SEQ ID NO: 1101410 - protein, 9 aa, Mycobacterium
VTSPDLAGR

SEQ ID NO: 1101411 - protein, 8 aa, Mycobacterium
VTTAPGQG

SEQ ID NO: 1101412 - protein, 14 aa, Mycobacterium
VTTARTLNEQRANL

SEQ ID NO: 1101413 - protein, 14 aa, Mycobacterium
VTTARTLNEQRGNL

SEQ ID NO: 1101414 - protein, 21 aa, Mycobacterium
VTTNEESVESQVASARSERDR

SEQ ID NO: 1101415 - protein, 6 aa, Mycobacterium
VTTSPL

SEQ ID NO: 1101416 - protein, 8 aa, Mycobacterium
VTTSTRTT

SEQ ID NO: 1101417 - protein, 19 aa, Mycobacterium
VVTGDGSTVAGRDPATGDT

SEQ ID NO: 1101418 - protein, 4 aa, Mycobacterium
WAET

SEQ ID NO: 1101419 - protein, 15 aa, Mycobacterium
WAPDNETTGRVSSSR

SEQ ID NO: 1101420 - protein, 7 aa, Mycobacterium
WDSATDT

SEQ ID NO: 1101421 - protein, 4 aa, Mycobacterium
WEPG

SEQ ID NO: 1101422 - protein, 7 aa, Mycobacterium
WGEPGNG

SEQ ID NO: 1101423 - protein, 4 aa, Mycobacterium
WGHG

SEQ ID NO: 1101424 - protein, 12 aa, Mycobacterium
WGVGPSKKDSGA

SEQ ID NO: 1101425 - protein, 9 aa, Mycobacterium
WKNEGAAAG

SEQ ID NO: 1101426 - protein, 8 aa, Mycobacterium
WKSGEPLP

SEQ ID NO: 1101427 - protein, 5 aa, Mycobacterium
WLPDD

SEQ ID NO: 1101428 - protein, 6 aa, Mycobacterium
WNDNGS

SEQ ID NO: 1101429 - protein, 19 aa, Mycobacterium
WNPDSEPDQPAEGQEGGPR

SEQ ID NO: 1101430 - protein, 20 aa, Mycobacterium
WNPETGAYGPITDPESPMYG

SEQ ID NO: 1101431 - protein, 11 aa, Mycobacterium
WNQPATLASAS

SEQ ID NO: 1101432 - protein, 17 aa, Mycobacterium
WNQPEQLSRPGVNGSTV

SEQ ID NO: 1101433 - protein, 8 aa, Mycobacterium
WPADDAAG

SEQ ID NO: 1101434 - protein, 13 aa, Mycobacterium
WPAEPRVDNGPTA

SEQ ID NO: 1101435 - protein, 8 aa, Mycobacterium
WPGSDDGF

SEQ ID NO: 1101436 - protein, 24 aa, Mycobacterium
WPSGSPMDNYPLDPQDADAPTLPE

SEQ ID NO: 1101437 - protein, 8 aa, Mycobacterium
WPSQRQSA

SEQ ID NO: 1101438 - protein, 15 aa, Mycobacterium
WPVPGTRAEKRAERS

SEQ ID NO: 1101439 - protein, 8 aa, Mycobacterium
WQRSKGRI

SEQ ID NO: 1101440 - protein, 6 aa, Mycobacterium
WRASGR

SEQ ID NO: 1101441 - protein, 7 aa, Mycobacterium
WRNEPGA

SEQ ID NO: 1101442 - protein, 7 aa, Mycobacterium
WSAASAG

SEQ ID NO: 1101443 - protein, 12 aa, Mycobacterium
WSGGGPAAPPSR

SEQ ID NO: 1101444 - protein, 7 aa, Mycobacterium
WSPGLAA

SEQ ID NO: 1101445 - protein, 7 aa, Mycobacterium
WSPPKRV

SEQ ID NO: 1101446 - protein, 10 aa, Mycobacterium
WSPQSTDLSA

SEQ ID NO: 1101447 - protein, 10 aa, Mycobacterium
WSQRPAQQRP

SEQ ID NO: 1101448 - protein, 6 aa, Mycobacterium
WSSLRT

SEQ ID NO: 1101449 - protein, 10 aa, Mycobacterium
WSTGGPEVQD

SEQ ID NO: 1101450 - protein, 6 aa, Mycobacterium
WSTPEG

SEQ ID NO: 1101451 - protein, 7 aa, Mycobacterium
WTAAQDK

SEQ ID NO: 1101452 - protein, 10 aa, Mycobacterium
WTESGPAAER

SEQ ID NO: 1101453 - protein, 13 aa, Mycobacterium
YAASASPDGLDAT

SEQ ID NO: 1101454 - protein, 10 aa, Mycobacterium
YAGDRGRARA

SEQ ID NO: 1101455 - protein, 11 aa, Mycobacterium
YALGSDTTAHI

SEQ ID NO: 1101456 - protein, 6 aa, Mycobacterium
YAPTAE

SEQ ID NO: 1101457 - protein, 9 aa, Mycobacterium
YATGTPWAK

SEQ ID NO: 1101458 - protein, 6 aa, Mycobacterium
YAVGGP

SEQ ID NO: 1101459 - protein, 12 aa, Mycobacterium
YAYRGQSDPRDA

SEQ ID NO: 1101460 - protein, 10 aa, Mycobacterium
YDATVADTNN

SEQ ID NO: 1101461 - protein, 7 aa, Mycobacterium
YDEPSNS

SEQ ID NO: 1101462 - protein, 21 aa, Mycobacterium
YDGQPVNALQGQDGPIPIGGT

SEQ ID NO: 1101463 - protein, 9 aa, Mycobacterium
YDIGPTPSW

SEQ ID NO: 1101464 - protein, 10 aa, Mycobacterium
YDPAAPPPDE

SEQ ID NO: 1101465 - protein, 9 aa, Mycobacterium
YDPAVSRSS

SEQ ID NO: 1101466 - protein, 16 aa, Mycobacterium
YDPQGYYEKAGAEGPF

SEQ ID NO: 1101467 - protein, 14 aa, Mycobacterium
YDPQTGKYATPDGK

SEQ ID NO: 1101468 - protein, 24 aa, Mycobacterium
YDPYATGQYGPGGPQQPPPEGPKS

SEQ ID NO: 1101469 - protein, 8 aa, Mycobacterium
YEPPRAER

SEQ ID NO: 1101470 - protein, 15 aa, Mycobacterium
YEPVSDVGEEQAPPR

SEQ ID NO: 1101471 - protein, 12 aa, Mycobacterium
YGDEPTPTQEQI

SEQ ID NO: 1101472 - protein, 9 aa, Mycobacterium
YGDKLDERG

SEQ ID NO: 1101473 - protein, 11 aa, Mycobacterium
YGDRPGTEAAY

SEQ ID NO: 1101474 - protein, 15 aa, Mycobacterium
YGDTQSSQTRLATGT

SEQ ID NO: 1101475 - protein, 8 aa, Mycobacterium
YGEDDGTP

SEQ ID NO: 1101476 - protein, 8 aa, Mycobacterium
YGEPQLSD

SEQ ID NO: 1101477 - protein, 7 aa, Mycobacterium
YGEQDGT

SEQ ID NO: 1101478 - protein, 10 aa, Mycobacterium
YGGRGGGGNM

SEQ ID NO: 1101479 - protein, 5 aa, Mycobacterium
YGHQV

SEQ ID NO: 1101480 - protein, 8 aa, Mycobacterium
YGPDKAAK

SEQ ID NO: 1101481 - protein, 7 aa, Mycobacterium
YGPTEAT

SEQ ID NO: 1101482 - protein, 5 aa, Mycobacterium
YGQTA

SEQ ID NO: 1101483 - protein, 6 aa, Mycobacterium
YGRPPD

SEQ ID NO: 1101484 - protein, 8 aa, Mycobacterium
YGSPDSPA

SEQ ID NO: 1101485 - protein, 5 aa, Mycobacterium
YGSPE

SEQ ID NO: 1101486 - protein, 26 aa, Mycobacterium
YHGGSGGLRRERPSERSGKARQPLGR

SEQ ID NO: 1101487 - protein, 11 aa, Mycobacterium
YKTNYNDRNYL

SEQ ID NO: 1101488 - protein, 15 aa, Mycobacterium
YLPPDNSVRQAQEDF

SEQ ID NO: 1101489 - protein, 17 aa, Mycobacterium
YNEPGSDQAGVAAEATS

SEQ ID NO: 1101490 - protein, 8 aa, Mycobacterium
YNRGAEYG

SEQ ID NO: 1101491 - protein, 10 aa, Mycobacterium
YNRGASCDAQ

SEQ ID NO: 1101492 - protein, 8 aa, Mycobacterium
YNSGPLPR

SEQ ID NO: 1101493 - protein, 5 aa, Mycobacterium
YPAGA

SEQ ID NO: 1101494 - protein, 9 aa, Mycobacterium
YPAPSSKRP

SEQ ID NO: 1101495 - protein, 9 aa, Mycobacterium
YPASPPALS

SEQ ID NO: 1101496 - protein, 7 aa, Mycobacterium
YPDEPQR

SEQ ID NO: 1101497 - protein, 8 aa, Mycobacterium
YPDGMPAD

SEQ ID NO: 1101498 - protein, 5 aa, Mycobacterium
YPDGP

SEQ ID NO: 1101499 - protein, 6 aa, Mycobacterium
YPGRTV

SEQ ID NO: 1101500 - protein, 7 aa, Mycobacterium
YPNGMPP

SEQ ID NO: 1101501 - protein, 5 aa, Mycobacterium
YPNHP

SEQ ID NO: 1101502 - protein, 11 aa, Mycobacterium
YPNPEQNNSDN

SEQ ID NO: 1101503 - protein, 11 aa, Mycobacterium
YPNTGQDALGP

SEQ ID NO: 1101504 - protein, 5 aa, Mycobacterium
YPPGW

SEQ ID NO: 1101505 - protein, 4 aa, Mycobacterium
YPRE

SEQ ID NO: 1101506 - protein, 12 aa, Mycobacterium
YPRVGESERLPE

SEQ ID NO: 1101507 - protein, 4 aa, Mycobacterium
YPVA

SEQ ID NO: 1101508 - protein, 9 aa, Mycobacterium
YQANKSDQI

SEQ ID NO: 1101509 - protein, 7 aa, Mycobacterium
YRDGRRA

SEQ ID NO: 1101510 - protein, 7 aa, Mycobacterium
YRGQGAN

SEQ ID NO: 1101511 - protein, 11 aa, Mycobacterium
YRLGRGGRIRT

SEQ ID NO: 1101512 - protein, 7 aa, Mycobacterium
YRPKTTA

SEQ ID NO: 1101513 - protein, 5 aa, Mycobacterium
YRSLG

SEQ ID NO: 1101514 - protein, 8 aa, Mycobacterium
YRTNYNDR

SEQ ID NO: 1101515 - protein, 13 aa, Mycobacterium
YRTPPRGVGDTES

SEQ ID NO: 1101516 - protein, 5 aa, Mycobacterium
YSAPE

SEQ ID NO: 1101517 - protein, 8 aa, Mycobacterium
YSAPGGPD

SEQ ID NO: 1101518 - protein, 8 aa, Mycobacterium
YSDPDKAH

SEQ ID NO: 1101519 - protein, 7 aa, Mycobacterium
YSDSYND

SEQ ID NO: 1101520 - protein, 8 aa, Mycobacterium
YSENPAGS

SEQ ID NO: 1101521 - protein, 12 aa, Mycobacterium
YSKAVSQAKPEL

SEQ ID NO: 1101522 - protein, 7 aa, Mycobacterium
YSNSNGG

SEQ ID NO: 1101523 - protein, 7 aa, Mycobacterium
YSPDRPV

SEQ ID NO: 1101524 - protein, 8 aa, Mycobacterium
YSPPTSQV

SEQ ID NO: 1101525 - protein, 4 aa, Mycobacterium
YTAA

SEQ ID NO: 1101526 - protein, 5 aa, Mycobacterium
YTEGT

SEQ ID NO: 1101527 - protein, 5 aa, Mycobacterium
YTGSG

SEQ ID NO: 1101528 - protein, 6 aa, Mycobacterium
YTGTGG

SEQ ID NO: 1101529 - protein, 12 aa, Mycobacterium
YTKRASDTSPTD

SEQ ID NO: 1101530 - protein, 8 aa, Mycobacterium
YTPGGASK

SEQ ID NO: 1101531 - protein, 10 aa, Mycobacterium
YTRDGHSDYG

SEQ ID NO: 1101532 - protein, 6 aa, Mycobacterium
YTSADG

SEQ ID NO: 1101533 - protein, 9 aa, Mycobacterium
YTSLSGPSV

SEQ ID NO: 1101534 - protein, 9 aa, Mycobacterium
YTTGKYPQG

SEQ ID NO: 1101535 - protein, 6 aa, Mycobacterium
YTTPVD

SEQ ID NO: 1101536 - protein, 15 aa, Mycobacterium
YVSTGDGTDDCDGHG

SEQ ID NO: 1101537 - protein, 12 aa, Mycobacterium
YYGEDAAEREKA

SEQ ID NO: 1101538 - protein, 18 aa, Mycobacterium
AAAAASAHAALSGDPHNE

SEQ ID NO: 1101539 - protein, 19 aa, Mycobacterium
AAAANIDTSGLGLSDTGPT

SEQ ID NO: 1101540 - protein, 8 aa, Mycobacterium
AAAEDAHT

SEQ ID NO: 1101541 - protein, 10 aa, Mycobacterium
AAAEKSCRTS

SEQ ID NO: 1101542 - protein, 8 aa, Mycobacterium
AAAEPEAL

SEQ ID NO: 1101543 - protein, 14 aa, Mycobacterium
AAAESGPVAPVPTE

SEQ ID NO: 1101544 - protein, 5 aa, Mycobacterium
AAAGA

SEQ ID NO: 1101545 - protein, 12 aa, Mycobacterium
AAAGARNVGDTT

SEQ ID NO: 1101546 - protein, 5 aa, Mycobacterium
AAAGL

SEQ ID NO: 1101547 - protein, 8 aa, Mycobacterium
AAAGPTPG

SEQ ID NO: 1101548 - protein, 7 aa, Mycobacterium
AAAKPGE

SEQ ID NO: 1101549 - protein, 14 aa, Mycobacterium
AAAPGIGNLACATI

SEQ ID NO: 1101550 - protein, 34 aa, Mycobacterium
AAAPHTGAIPSVGPARGGFGGPPGLLSSPEPGEQ

SEQ ID NO: 1101551 - protein, 8 aa, Mycobacterium
AAAQEKFR

SEQ ID NO: 1101552 - protein, 13 aa, Mycobacterium
AAASPDGAPVTDG

SEQ ID NO: 1101553 - protein, 7 aa, Mycobacterium
AAASPEL

SEQ ID NO: 1101554 - protein, 9 aa, Mycobacterium
AAATARAAA

SEQ ID NO: 1101555 - protein, 10 aa, Mycobacterium
AADAAPAMSG

SEQ ID NO: 1101556 - protein, 11 aa, Mycobacterium
AADGEGELGDT

SEQ ID NO: 1101557 - protein, 7 aa, Mycobacterium
AADRYAQ

SEQ ID NO: 1101558 - protein, 12 aa, Mycobacterium
AADVEDPDFEDY

SEQ ID NO: 1101559 - protein, 10 aa, Mycobacterium
AADVGNLPYG

SEQ ID NO: 1101560 - protein, 12 aa, Mycobacterium
AAEGARPDTTLA

SEQ ID NO: 1101561 - protein, 9 aa, Mycobacterium
AAEGNSGIT

SEQ ID NO: 1101562 - protein, 4 aa, Mycobacterium
AAEI

SEQ ID NO: 1101563 - protein, 38 aa, Mycobacterium
AAEPDYTAPDYTAPDYAEPEYTEPEFSEPEYTAPLPDD

SEQ ID NO: 1101564 - protein, 6 aa, Mycobacterium
AAEPGR

SEQ ID NO: 1101565 - protein, 8 aa, Mycobacterium
AAESADGR

SEQ ID NO: 1101566 - protein, 7 aa, Mycobacterium
AAESPTR

SEQ ID NO: 1101567 - protein, 9 aa, Mycobacterium
AAETDSEHP

SEQ ID NO: 1101568 - protein, 11 aa, Mycobacterium
AAETGWSAPAV

SEQ ID NO: 1101569 - protein, 5 aa, Mycobacterium
AAGAE

SEQ ID NO: 1101570 - protein, 5 aa, Mycobacterium
AAGAP

SEQ ID NO: 1101571 - protein, 82 aa, Mycobacterium
AAGAPEFDAEPEDDVDDETDDVAADSDDAESVDDGTEDEYEYVPDSSGIETPADDERAEPADDALGAARRRRYESKTAEAVS

SEQ ID NO: 1101572 - protein, 12 aa, Mycobacterium
AAGDAPAAADVT

SEQ ID NO: 1101573 - protein, 8 aa, Mycobacterium
AAGDPRAA

SEQ ID NO: 1101574 - protein, 12 aa, Mycobacterium
AAGEIDGQVSDS

SEQ ID NO: 1101575 - protein, 25 aa, Mycobacterium
AAGGGGGSGGGAAAAPRGPAPEVPA

SEQ ID NO: 1101576 - protein, 40 aa, Mycobacterium
AAGPTSAQATSTAPPRPAGPTPTKHSYDDTHTGQQPEVAN

SEQ ID NO: 1101577 - protein, 5 aa, Mycobacterium
AAGRG

SEQ ID NO: 1101578 - protein, 11 aa, Mycobacterium
AAGRSGSPLCR

SEQ ID NO: 1101579 - protein, 8 aa, Mycobacterium
AAGSDVAL

SEQ ID NO: 1101580 - protein, 9 aa, Mycobacterium
AAGTDYADL

SEQ ID NO: 1101581 - protein, 9 aa, Mycobacterium
AAKTLPDGY

SEQ ID NO: 1101582 - protein, 19 aa, Mycobacterium
AALPPDGPPSPNQEMRQNG

SEQ ID NO: 1101583 - protein, 5 aa, Mycobacterium
AAPAA

SEQ ID NO: 1101584 - protein, 15 aa, Mycobacterium
AAPAPQKVAAVEKAA

SEQ ID NO: 1101585 - protein, 9 aa, Mycobacterium
AAPDDGDPM

SEQ ID NO: 1101586 - protein, 8 aa, Mycobacterium
AAPKRVHG

SEQ ID NO: 1101587 - protein, 30 aa, Mycobacterium
AAPPAPPQRTEQRAECSGAERDRDPPADAR

SEQ ID NO: 1101588 - protein, 12 aa, Mycobacterium
AAPQAPVPAGPP

SEQ ID NO: 1101589 - protein, 15 aa, Mycobacterium
AAQKASAEWSHPDPD

SEQ ID NO: 1101590 - protein, 8 aa, Mycobacterium
AAQQGMGP

SEQ ID NO: 1101591 - protein, 4 aa, Mycobacterium
AAQT

SEQ ID NO: 1101592 - protein, 4 aa, Mycobacterium
AAQV

SEQ ID NO: 1101593 - protein, 8 aa, Mycobacterium
AARAQSRR

SEQ ID NO: 1101594 - protein, 12 aa, Mycobacterium
AARGDGTRAGAA

SEQ ID NO: 1101595 - protein, 5 aa, Mycobacterium
AARGT

SEQ ID NO: 1101596 - protein, 6 aa, Mycobacterium
AARGTF

SEQ ID NO: 1101597 - protein, 8 aa, Mycobacterium
AARPEPTL

SEQ ID NO: 1101598 - protein, 11 aa, Mycobacterium
AARRARPRASS

SEQ ID NO: 1101599 - protein, 15 aa, Mycobacterium
AASGSNDQAAIENAQ

SEQ ID NO: 1101600 - protein, 4 aa, Mycobacterium
AASI

SEQ ID NO: 1101601 - protein, 5 aa, Mycobacterium
AASRH

SEQ ID NO: 1101602 - protein, 8 aa, Mycobacterium
AASRQGAL

SEQ ID NO: 1101603 - protein, 9 aa, Mycobacterium
AASSRGAGA

SEQ ID NO: 1101604 - protein, 18 aa, Mycobacterium
AATELDENATAISDPGYS

SEQ ID NO: 1101605 - protein, 70 aa, Mycobacterium
AATGGWTPSAPPPPPAPPMSRPQPRYPTGAQPHYPSGPQPHHPTGTHPPMRPPSTGAALSPPLSGQAGLE

SEQ ID NO: 1101606 - protein, 22 aa, Mycobacterium
AATGRSKSRGTTDLEQSKKPPL

SEQ ID NO: 1101607 - protein, 8 aa, Mycobacterium
AATPVPQG

SEQ ID NO: 1101608 - protein, 7 aa, Mycobacterium
AATRVTG

SEQ ID NO: 1101609 - protein, 10 aa, Mycobacterium
AAVAESGGEP

SEQ ID NO: 1101610 - protein, 5 aa, Mycobacterium
AAVEE

SEQ ID NO: 1101611 - protein, 7 aa, Mycobacterium
AAVPPSQ

SEQ ID NO: 1101612 - protein, 11 aa, Mycobacterium
ADAAPRRPGGP

SEQ ID NO: 1101613 - protein, 35 aa, Mycobacterium
ADAGEAADREPLTTAGAVEGAEEAEAVAEGGLDED

SEQ ID NO: 1101614 - protein, 27 aa, Mycobacterium
ADAGEPESQPEPVPEVEAGEAADREAL

SEQ ID NO: 1101615 - protein, 6 aa, Mycobacterium
ADAGID

SEQ ID NO: 1101616 - protein, 16 aa, Mycobacterium
ADAKTPAAGAEGTDKA

SEQ ID NO: 1101617 - protein, 19 aa, Mycobacterium
ADAVRQAAPPEDAAAPYRV

SEQ ID NO: 1101618 - protein, 8 aa, Mycobacterium
ADDDSITT

SEQ ID NO: 1101619 - protein, 9 aa, Mycobacterium
ADEAEEGLT

SEQ ID NO: 1101620 - protein, 7 aa, Mycobacterium
ADEEAVA

SEQ ID NO: 1101621 - protein, 6 aa, Mycobacterium
ADFTGR

SEQ ID NO: 1101622 - protein, 43 aa, Mycobacterium
ADGDLTAAAEEAAAQAKAAVATASNPVAGPAPVPVDGPDQSRL

SEQ ID NO: 1101623 - protein, 26 aa, Mycobacterium
ADGERVEVSGTAAGQLAGVPADEVPR

SEQ ID NO: 1101624 - protein, 10 aa, Mycobacterium
ADGGDATTCG

SEQ ID NO: 1101625 - protein, 5 aa, Mycobacterium
ADGPR

SEQ ID NO: 1101626 - protein, 4 aa, Mycobacterium
ADGQ

SEQ ID NO: 1101627 - protein, 17 aa, Mycobacterium
ADGQSDYGQSWASGRYA

SEQ ID NO: 1101628 - protein, 9 aa, Mycobacterium
ADIGSAEIH

SEQ ID NO: 1101629 - protein, 11 aa, Mycobacterium
ADLPGGRVPSE

SEQ ID NO: 1101630 - protein, 8 aa, Mycobacterium
ADNASRIS

SEQ ID NO: 1101631 - protein, 7 aa, Mycobacterium
ADPAGGV

SEQ ID NO: 1101632 - protein, 22 aa, Mycobacterium
ADPDNNRRPRQEVQPTEDETVE

SEQ ID NO: 1101633 - protein, 7 aa, Mycobacterium
ADPEHRG

SEQ ID NO: 1101634 - protein, 10 aa, Mycobacterium
ADQDGTLKAS

SEQ ID NO: 1101635 - protein, 7 aa, Mycobacterium
ADQTTAY

SEQ ID NO: 1101636 - protein, 10 aa, Mycobacterium
ADRAASSKAA

SEQ ID NO: 1101637 - protein, 6 aa, Mycobacterium
ADRSTN

SEQ ID NO: 1101638 - protein, 25 aa, Mycobacterium
ADTASLDRPDPSDNRRKQNYDYRGG

SEQ ID NO: 1101639 - protein, 7 aa, Mycobacterium
ADTITST

SEQ ID NO: 1101640 - protein, 7 aa, Mycobacterium
ADTMGAA

SEQ ID NO: 1101641 - protein, 6 aa, Mycobacterium
ADYRVG

SEQ ID NO: 1101642 - protein, 5 aa, Mycobacterium
AEAGI

SEQ ID NO: 1101643 - protein, 9 aa, Mycobacterium
AEAPATVED

SEQ ID NO: 1101644 - protein, 4 aa, Mycobacterium
AEAS

SEQ ID NO: 1101645 - protein, 7 aa, Mycobacterium
AEAVANS

SEQ ID NO: 1101646 - protein, 11 aa, Mycobacterium
AEDNTGLTSSN

SEQ ID NO: 1101647 - protein, 8 aa, Mycobacterium
AEDRGLTV

SEQ ID NO: 1101648 - protein, 10 aa, Mycobacterium
AEEEADADAA

SEQ ID NO: 1101649 - protein, 5 aa, Mycobacterium
AEGKT

SEQ ID NO: 1101650 - protein, 11 aa, Mycobacterium
AEGLRAEAAGQ

SEQ ID NO: 1101651 - protein, 50 aa, Mycobacterium
AEGQFADDEPVEDRDAEAVAGEVGAAEAEALEDSAVEQETAPDETAEPVV

SEQ ID NO: 1101652 - protein, 30 aa, Mycobacterium
AEGRSKRAQTTGQPMGSAPTSVGRAKTSTW

SEQ ID NO: 1101653 - protein, 10 aa, Mycobacterium
AEHGEPCDGT

SEQ ID NO: 1101654 - protein, 18 aa, Mycobacterium
AEHHTAPHGDAPVEGTVT

SEQ ID NO: 1101655 - protein, 14 aa, Mycobacterium
AEHRTTAEQYAASG

SEQ ID NO: 1101656 - protein, 10 aa, Mycobacterium
AEISSTTAFG

SEQ ID NO: 1101657 - protein, 5 aa, Mycobacterium
AENDL

SEQ ID NO: 1101658 - protein, 4 aa, Mycobacterium
AENT

SEQ ID NO: 1101659 - protein, 25 aa, Mycobacterium
AEPGGVAHRGHQGADPVGQPDRRPI

SEQ ID NO: 1101660 - protein, 50 aa, Mycobacterium
AEPQPPEPDLVPPPGFGGAHRRPSEAEPPTEEPPRRRRRRAEEAPPVAEA

SEQ ID NO: 1101661 - protein, 8 aa, Mycobacterium
AEPRGVRR

SEQ ID NO: 1101662 - protein, 7 aa, Mycobacterium
AEPTEIG

SEQ ID NO: 1101663 - protein, 7 aa, Mycobacterium
AEQRRER

SEQ ID NO: 1101664 - protein, 13 aa, Mycobacterium
AEQSRKGASQRLA

SEQ ID NO: 1101665 - protein, 6 aa, Mycobacterium
AERDPR

SEQ ID NO: 1101666 - protein, 4 aa, Mycobacterium
AERL

SEQ ID NO: 1101667 - protein, 4 aa, Mycobacterium
AESA

SEQ ID NO: 1101668 - protein, 10 aa, Mycobacterium
AETAAPSALG

SEQ ID NO: 1101669 - protein, 7 aa, Mycobacterium
AETRLDD

SEQ ID NO: 1101670 - protein, 10 aa, Mycobacterium
AEVAGDPQQV

SEQ ID NO: 1101671 - protein, 8 aa, Mycobacterium
AEVDTEDV

SEQ ID NO: 1101672 - protein, 4 aa, Mycobacterium
AGAA

SEQ ID NO: 1101673 - protein, 9 aa, Mycobacterium
AGAAEGVAT

SEQ ID NO: 1101674 - protein, 8 aa, Mycobacterium
AGADRPGR

SEQ ID NO: 1101675 - protein, 10 aa, Mycobacterium
AGANGRAQAA

SEQ ID NO: 1101676 - protein, 14 aa, Mycobacterium
AGAPGASTAQGGID

SEQ ID NO: 1101677 - protein, 19 aa, Mycobacterium
AGAPRPEPEPEGNEPTTAI

SEQ ID NO: 1101678 - protein, 12 aa, Mycobacterium
AGAQRSGRLPEQ

SEQ ID NO: 1101679 - protein, 4 aa, Mycobacterium
AGAT

SEQ ID NO: 1101680 - protein, 8 aa, Mycobacterium
AGATTAQR

SEQ ID NO: 1101681 - protein, 8 aa, Mycobacterium
AGATTLAD

SEQ ID NO: 1101682 - protein, 5 aa, Mycobacterium
AGAYG

SEQ ID NO: 1101683 - protein, 9 aa, Mycobacterium
AGDDRGERI

SEQ ID NO: 1101684 - protein, 7 aa, Mycobacterium
AGDKASV

SEQ ID NO: 1101685 - protein, 6 aa, Mycobacterium
AGDPPR

SEQ ID NO: 1101686 - protein, 6 aa, Mycobacterium
AGDSTL

SEQ ID NO: 1101687 - protein, 5 aa, Mycobacterium
AGDTV

SEQ ID NO: 1101688 - protein, 6 aa, Mycobacterium
AGETTR

SEQ ID NO: 1101689 - protein, 11 aa, Mycobacterium
AGFSGLGSADG

SEQ ID NO: 1101690 - protein, 9 aa, Mycobacterium
AGGASGGTI

SEQ ID NO: 1101691 - protein, 6 aa, Mycobacterium
AGGDRR

SEQ ID NO: 1101692 - protein, 10 aa, Mycobacterium
AGGDVPTGPT

SEQ ID NO: 1101693 - protein, 9 aa, Mycobacterium
AGGLGSPVA

SEQ ID NO: 1101694 - protein, 6 aa, Mycobacterium
AGGREQ

SEQ ID NO: 1101695 - protein, 15 aa, Mycobacterium
AGHGEAPPQSRTESR

SEQ ID NO: 1101696 - protein, 9 aa, Mycobacterium
AGLAGQRSA

SEQ ID NO: 1101697 - protein, 12 aa, Mycobacterium
AGNDAAAQQECQ

SEQ ID NO: 1101698 - protein, 6 aa, Mycobacterium
AGPEEG

SEQ ID NO: 1101699 - protein, 10 aa, Mycobacterium
AGPKSKAGDF

SEQ ID NO: 1101700 - protein, 37 aa, Mycobacterium
AGPPVADPGPNLEPAPSHDPVPPPEPTPVSAPTYEPQ

SEQ ID NO: 1101701 - protein, 7 aa, Mycobacterium
AGQPKDI

SEQ ID NO: 1101702 - protein, 14 aa, Mycobacterium
AGQPWTGEQYPSGP

SEQ ID NO: 1101703 - protein, 11 aa, Mycobacterium
AGQRGTTARIT

SEQ ID NO: 1101704 - protein, 7 aa, Mycobacterium
AGRGVKP

SEQ ID NO: 1101705 - protein, 8 aa, Mycobacterium
AGRPGVLP

SEQ ID NO: 1101706 - protein, 6 aa, Mycobacterium
AGRQDT

SEQ ID NO: 1101707 - protein, 8 aa, Mycobacterium
AGRRGTAV

SEQ ID NO: 1101708 - protein, 16 aa, Mycobacterium
AGRSALDTSAITGESV

SEQ ID NO: 1101709 - protein, 6 aa, Mycobacterium
AGRSQD

SEQ ID NO: 1101710 - protein, 19 aa, Mycobacterium
AGSAGTGGGWALVDALKTL

SEQ ID NO: 1101711 - protein, 5 aa, Mycobacterium
AGSIA

SEQ ID NO: 1101712 - protein, 6 aa, Mycobacterium
AGSIAE

SEQ ID NO: 1101713 - protein, 26 aa, Mycobacterium
AGSPPNDSAPNDSPPNDSAPTDGEPR

SEQ ID NO: 1101714 - protein, 17 aa, Mycobacterium
AGSRTARRRQRTAGQLP

SEQ ID NO: 1101715 - protein, 4 aa, Mycobacterium
AGTD

SEQ ID NO: 1101716 - protein, 8 aa, Mycobacterium
AGTDEDGL

SEQ ID NO: 1101717 - protein, 15 aa, Mycobacterium
AGTIGRQDAESAAAQ

SEQ ID NO: 1101718 - protein, 8 aa, Mycobacterium
AGYPSGRC

SEQ ID NO: 1101719 - protein, 8 aa, Mycobacterium
AHHATDDA

SEQ ID NO: 1101720 - protein, 7 aa, Mycobacterium
AHPGTTT

SEQ ID NO: 1101721 - protein, 6 aa, Mycobacterium
AHVTGT

SEQ ID NO: 1101722 - protein, 7 aa, Mycobacterium
AIGPEAA

SEQ ID NO: 1101723 - protein, 9 aa, Mycobacterium
AINSPGAGA

SEQ ID NO: 1101724 - protein, 12 aa, Mycobacterium
AIRGSASEREGC

SEQ ID NO: 1101725 - protein, 10 aa, Mycobacterium
AKDASGAKNV

SEQ ID NO: 1101726 - protein, 16 aa, Mycobacterium
AKGGPGGKPSCGSLPD

SEQ ID NO: 1101727 - protein, 8 aa, Mycobacterium
AKPDYPNQ

SEQ ID NO: 1101728 - protein, 8 aa, Mycobacterium
AKPDYPTS

SEQ ID NO: 1101729 - protein, 5 aa, Mycobacterium
AKPRA

SEQ ID NO: 1101730 - protein, 43 aa, Mycobacterium
AKQPGDRFPTAGDLAKAASAAAMQPAAPAAGAAAAAPPNSTRQ

SEQ ID NO: 1101731 - protein, 8 aa, Mycobacterium
AKSQNALG

SEQ ID NO: 1101732 - protein, 11 aa, Mycobacterium
AKTRAEADGKT

SEQ ID NO: 1101733 - protein, 9 aa, Mycobacterium
AKTTAANLE

SEQ ID NO: 1101734 - protein, 12 aa, Mycobacterium
ALAQSRAMNHEW

SEQ ID NO: 1101735 - protein, 32 aa, Mycobacterium
ALDPATRTPNGRNTGNSGRNADNDQQRPTAGT

SEQ ID NO: 1101736 - protein, 18 aa, Mycobacterium
ALEDTDNESFPKPEEIGG

SEQ ID NO: 1101737 - protein, 7 aa, Mycobacterium
ALGGDTR

SEQ ID NO: 1101738 - protein, 9 aa, Mycobacterium
ALGNPADLA

SEQ ID NO: 1101739 - protein, 6 aa, Mycobacterium
ALHNSE

SEQ ID NO: 1101740 - protein, 8 aa, Mycobacterium
ANQAQNAI

SEQ ID NO: 1101741 - protein, 7 aa, Mycobacterium
ANQYAQS

SEQ ID NO: 1101742 - protein, 6 aa, Mycobacterium
ANRAAA

SEQ ID NO: 1101743 - protein, 5 aa, Mycobacterium
ANRMN

SEQ ID NO: 1101744 - protein, 10 aa, Mycobacterium
ANSSTSQVRA

SEQ ID NO: 1101745 - protein, 22 aa, Mycobacterium
ANYPSDGGTYRRPRRQPTPSAN

SEQ ID NO: 1101746 - protein, 4 aa, Mycobacterium
APAA

SEQ ID NO: 1101747 - protein, 25 aa, Mycobacterium
APAARDITPAATTPADTGAWGPDRR

SEQ ID NO: 1101748 - protein, 6 aa, Mycobacterium
APAGEW

SEQ ID NO: 1101749 - protein, 11 aa, Mycobacterium
APAGQENRRDL

SEQ ID NO: 1101750 - protein, 9 aa, Mycobacterium
APAPAAPRT

SEQ ID NO: 1101751 - protein, 7 aa, Mycobacterium
APAPSLT

SEQ ID NO: 1101752 - protein, 6 aa, Mycobacterium
APATPV

SEQ ID NO: 1101753 - protein, 6 aa, Mycobacterium
APCDER

SEQ ID NO: 1101754 - protein, 11 aa, Mycobacterium
APDARAGGPTR

SEQ ID NO: 1101755 - protein, 16 aa, Mycobacterium
APDDGTYKVARLDQVT

SEQ ID NO: 1101756 - protein, 8 aa, Mycobacterium
APDVGQAV

SEQ ID NO: 1101757 - protein, 8 aa, Mycobacterium
APETESDD

SEQ ID NO: 1101758 - protein, 12 aa, Mycobacterium
APGAQPPAPGPV

SEQ ID NO: 1101759 - protein, 8 aa, Mycobacterium
APGEQITS

SEQ ID NO: 1101760 - protein, 13 aa, Mycobacterium
APGGFARRRGTAS

SEQ ID NO: 1101761 - protein, 4 aa, Mycobacterium
APGI

SEQ ID NO: 1101762 - protein, 5 aa, Mycobacterium
APLSA

SEQ ID NO: 1101763 - protein, 4 aa, Mycobacterium
APNE

SEQ ID NO: 1101764 - protein, 7 aa, Mycobacterium
APNRPNR

SEQ ID NO: 1101765 - protein, 7 aa, Mycobacterium
APPARGL

SEQ ID NO: 1101766 - protein, 4 aa, Mycobacterium
APPD

SEQ ID NO: 1101767 - protein, 11 aa, Mycobacterium
APPDAVSATAV

SEQ ID NO: 1101768 - protein, 7 aa, Mycobacterium
APPELPR

SEQ ID NO: 1101769 - protein, 9 aa, Mycobacterium
APPFQNSRP

SEQ ID NO: 1101770 - protein, 6 aa, Mycobacterium
APPPQV

SEQ ID NO: 1101771 - protein, 7 aa, Mycobacterium
APPPTND

SEQ ID NO: 1101772 - protein, 23 aa, Mycobacterium
APPPVAPPRAAPAAAPVGRRRTG

SEQ ID NO: 1101773 - protein, 13 aa, Mycobacterium
APPTGGRRGGASL

SEQ ID NO: 1101774 - protein, 11 aa, Mycobacterium
APQPEPTAEPV

SEQ ID NO: 1101775 - protein, 10 aa, Mycobacterium
APQRDTEPDY

SEQ ID NO: 1101776 - protein, 4 aa, Mycobacterium
APRA

SEQ ID NO: 1101777 - protein, 5 aa, Mycobacterium
APSLG

SEQ ID NO: 1101778 - protein, 20 aa, Mycobacterium
APSVPPVDPTPSGATQIRWL

SEQ ID NO: 1101779 - protein, 7 aa, Mycobacterium
APTAGRA

SEQ ID NO: 1101780 - protein, 7 aa, Mycobacterium
APTARTA

SEQ ID NO: 1101781 - protein, 6 aa, Mycobacterium
APTISN

SEQ ID NO: 1101782 - protein, 12 aa, Mycobacterium
APTSAADPSGTV

SEQ ID NO: 1101783 - protein, 33 aa, Mycobacterium
APVPAAPPAPAPLPAAPPAPVPAPIPAAPVPAP

SEQ ID NO: 1101784 - protein, 7 aa, Mycobacterium
AQASESA

SEQ ID NO: 1101785 - protein, 5 aa, Mycobacterium
AQDDQ

SEQ ID NO: 1101786 - protein, 10 aa, Mycobacterium
AQDGKTAADR

SEQ ID NO: 1101787 - protein, 18 aa, Mycobacterium
AQDKDTPGSAQAQGGDVG

SEQ ID NO: 1101788 - protein, 4 aa, Mycobacterium
AQDV

SEQ ID NO: 1101789 - protein, 13 aa, Mycobacterium
AQEVPAATAWRGE

SEQ ID NO: 1101790 - protein, 15 aa, Mycobacterium
AQGEGQTASPAESLG

SEQ ID NO: 1101791 - protein, 5 aa, Mycobacterium
AQGKT

SEQ ID NO: 1101792 - protein, 14 aa, Mycobacterium
AQLAERPTDTGPSR

SEQ ID NO: 1101793 - protein, 11 aa, Mycobacterium
AQLPSPDRDLT

SEQ ID NO: 1101794 - protein, 11 aa, Mycobacterium
AQNSKAPGQRF

SEQ ID NO: 1101795 - protein, 14 aa, Mycobacterium
AQPGPDGFSGVAPE

SEQ ID NO: 1101796 - protein, 8 aa, Mycobacterium
AQPHPGEF

SEQ ID NO: 1101797 - protein, 15 aa, Mycobacterium
AQPPGPATAATERIA

SEQ ID NO: 1101798 - protein, 7 aa, Mycobacterium
AQRDPDD

SEQ ID NO: 1101799 - protein, 30 aa, Mycobacterium
AQRDPLRAQRDPLAADSGRARSNRDDRRQW

SEQ ID NO: 1101800 - protein, 9 aa, Mycobacterium
AQRPPGTRS

SEQ ID NO: 1101801 - protein, 6 aa, Mycobacterium
AQRRST

SEQ ID NO: 1101802 - protein, 10 aa, Mycobacterium
AQSAPAGPPV

SEQ ID NO: 1101803 - protein, 11 aa, Mycobacterium
AQTKTTSTQRF

SEQ ID NO: 1101804 - protein, 7 aa, Mycobacterium
AQWGPVG

SEQ ID NO: 1101805 - protein, 20 aa, Mycobacterium
ARADPRDDSVDDSHGYDDDD

SEQ ID NO: 1101806 - protein, 8 aa, Mycobacterium
ARAGGSRR

SEQ ID NO: 1101807 - protein, 5 aa, Mycobacterium
ARDAG

SEQ ID NO: 1101808 - protein, 9 aa, Mycobacterium
ARDFATSGL

SEQ ID NO: 1101809 - protein, 10 aa, Mycobacterium
ARDFATSGLE

SEQ ID NO: 1101810 - protein, 6 aa, Mycobacterium
ARDNTA

SEQ ID NO: 1101811 - protein, 10 aa, Mycobacterium
ARDRSHGGAG

SEQ ID NO: 1101812 - protein, 17 aa, Mycobacterium
AREAVEGARKSGSAALG

SEQ ID NO: 1101813 - protein, 13 aa, Mycobacterium
ARGTQRGAEVERH

SEQ ID NO: 1101814 - protein, 13 aa, Mycobacterium
ARIGSGAQRAATP

SEQ ID NO: 1101815 - protein, 4 aa, Mycobacterium
ARLD

SEQ ID NO: 1101816 - protein, 10 aa, Mycobacterium
ARPDRPSGVP

SEQ ID NO: 1101817 - protein, 23 aa, Mycobacterium
ARREAKRRATSGPVREATPIPRR

SEQ ID NO: 1101818 - protein, 8 aa, Mycobacterium
ARRMDDAQ

SEQ ID NO: 1101819 - protein, 10 aa, Mycobacterium
ARRRAETRPG

SEQ ID NO: 1101820 - protein, 4 aa, Mycobacterium
ARRS

SEQ ID NO: 1101821 - protein, 48 aa, Mycobacterium
ARRTPVKPPRADKAKREAPSTAARREPDFGGAAAPAPVVPRPAQRREV

SEQ ID NO: 1101822 - protein, 6 aa, Mycobacterium
ARSEHP

SEQ ID NO: 1101823 - protein, 5 aa, Mycobacterium
ARSPL

SEQ ID NO: 1101824 - protein, 12 aa, Mycobacterium
ARSYDSADNGAE

SEQ ID NO: 1101825 - protein, 27 aa, Mycobacterium
ARTTGGQYQNLATSDSPELTAAITTLL

SEQ ID NO: 1101826 - protein, 17 aa, Mycobacterium
ARVGETAHHRCRDSGRA

SEQ ID NO: 1101827 - protein, 10 aa, Mycobacterium
ASAGAPGDPV

SEQ ID NO: 1101828 - protein, 34 aa, Mycobacterium
ASAGTLDTTDEHRHDPHTDPVRASKSAETEQRPM

SEQ ID NO: 1101829 - protein, 9 aa, Mycobacterium
ASAPGAPVS

SEQ ID NO: 1101830 - protein, 8 aa, Mycobacterium
ASAPPVTR

SEQ ID NO: 1101831 - protein, 19 aa, Mycobacterium
ASASPTPQSARQMQPPRRG

SEQ ID NO: 1101832 - protein, 6 aa, Mycobacterium
ASEGAV

SEQ ID NO: 1101833 - protein, 6 aa, Mycobacterium
ASGDRR

SEQ ID NO: 1101834 - protein, 19 aa, Mycobacterium
ASGRDDDEVPTNNGADVDE

SEQ ID NO: 1101835 - protein, 7 aa, Mycobacterium
ASGTAAT

SEQ ID NO: 1101836 - protein, 6 aa, Mycobacterium
ASIANK

SEQ ID NO: 1101837 - protein, 17 aa, Mycobacterium
ASKVAGDANAVSDQTRQ

SEQ ID NO: 1101838 - protein, 10 aa, Mycobacterium
ASLAAKGDVT

SEQ ID NO: 1101839 - protein, 7 aa, Mycobacterium
ASNGLRG

SEQ ID NO: 1101840 - protein, 14 aa, Mycobacterium
ASNRDLAGASASVD

SEQ ID NO: 1101841 - protein, 5 aa, Mycobacterium
ASPAL

SEQ ID NO: 1101842 - protein, 8 aa, Mycobacterium
ASPNGNRD

SEQ ID NO: 1101843 - protein, 7 aa, Mycobacterium
ASRADWD

SEQ ID NO: 1101844 - protein, 11 aa, Mycobacterium
ASTEVAPAGET

SEQ ID NO: 1101845 - protein, 13 aa, Mycobacterium
ASTGDDPADPPVD

SEQ ID NO: 1101846 - protein, 5 aa, Mycobacterium
ASVSR

SEQ ID NO: 1101847 - protein, 13 aa, Mycobacterium
ASVTSGTVTGHAK

SEQ ID NO: 1101848 - protein, 5 aa, Mycobacterium
ATAHL

SEQ ID NO: 1101849 - protein, 14 aa, Mycobacterium
ATAPEVSAVTPPAV

SEQ ID NO: 1101850 - protein, 8 aa, Mycobacterium
ATATDNSL

SEQ ID NO: 1101851 - protein, 24 aa, Mycobacterium
ATDDEGDGDAPSTSRTQSLARAAE

SEQ ID NO: 1101852 - protein, 34 aa, Mycobacterium
ATDEGAGVPGPGSHQPFGPPPGGFGGPGAPPPPQ

SEQ ID NO: 1101853 - protein, 15 aa, Mycobacterium
ATEKATVTVPEGYDP

SEQ ID NO: 1101854 - protein, 16 aa, Mycobacterium
ATERRETWTGTEHSDG

SEQ ID NO: 1101855 - protein, 7 aa, Mycobacterium
ATGAHRR

SEQ ID NO: 1101856 - protein, 7 aa, Mycobacterium
ATGAPAE

SEQ ID NO: 1101857 - protein, 8 aa, Mycobacterium
ATGDDTAL

SEQ ID NO: 1101858 - protein, 8 aa, Mycobacterium
ATGDDTTL

SEQ ID NO: 1101859 - protein, 5 aa, Mycobacterium
ATGEP

SEQ ID NO: 1101860 - protein, 10 aa, Mycobacterium
ATGGDDPVAT

SEQ ID NO: 1101861 - protein, 8 aa, Mycobacterium
ATGGPNCR

SEQ ID NO: 1101862 - protein, 5 aa, Mycobacterium
ATGLD

SEQ ID NO: 1101863 - protein, 10 aa, Mycobacterium
ATGMPGPSVD

SEQ ID NO: 1101864 - protein, 6 aa, Mycobacterium
ATGTLD

SEQ ID NO: 1101865 - protein, 20 aa, Mycobacterium
ATKSRPRPAQQPAPAPHDEG

SEQ ID NO: 1101866 - protein, 7 aa, Mycobacterium
ATLNPPY

SEQ ID NO: 1101867 - protein, 7 aa, Mycobacterium
ATNDPRE

SEQ ID NO: 1101868 - protein, 5 aa, Mycobacterium
ATPDS

SEQ ID NO: 1101869 - protein, 11 aa, Mycobacterium
ATPNRAESTDI

SEQ ID NO: 1101870 - protein, 22 aa, Mycobacterium
ATPTHRAPPLDSSVTDVPEPIS

SEQ ID NO: 1101871 - protein, 5 aa, Mycobacterium
ATRAA

SEQ ID NO: 1101872 - protein, 5 aa, Mycobacterium
ATRIR

SEQ ID NO: 1101873 - protein, 13 aa, Mycobacterium
ATRTLSGRTEVDG

SEQ ID NO: 1101874 - protein, 8 aa, Mycobacterium
ATSDGGET

SEQ ID NO: 1101875 - protein, 8 aa, Mycobacterium
ATSRQRRR

SEQ ID NO: 1101876 - protein, 14 aa, Mycobacterium
ATSSAKKAKATVPL

SEQ ID NO: 1101877 - protein, 7 aa, Mycobacterium
ATSTGKT

SEQ ID NO: 1101878 - protein, 4 aa, Mycobacterium
ATSV

SEQ ID NO: 1101879 - protein, 11 aa, Mycobacterium
ATTDGDRGQMT

SEQ ID NO: 1101880 - protein, 12 aa, Mycobacterium
ATTLSGAEFPGR

SEQ ID NO: 1101881 - protein, 8 aa, Mycobacterium
ATVGTSPL

SEQ ID NO: 1101882 - protein, 11 aa, Mycobacterium
ATVPPDTTADF

SEQ ID NO: 1101883 - protein, 7 aa, Mycobacterium
ATVPTRR

SEQ ID NO: 1101884 - protein, 9 aa, Mycobacterium
ATVTDDGSV

SEQ ID NO: 1101885 - protein, 12 aa, Mycobacterium
AVADGNARRDDL

SEQ ID NO: 1101886 - protein, 15 aa, Mycobacterium
AVAGADGVSIGDGRE

SEQ ID NO: 1101887 - protein, 9 aa, Mycobacterium
AVAGPGEPH

SEQ ID NO: 1101888 - protein, 6 aa, Mycobacterium
AVDTGA

SEQ ID NO: 1101889 - protein, 7 aa, Mycobacterium
AVGRRAD

SEQ ID NO: 1101890 - protein, 13 aa, Mycobacterium
AVPAPDKTVPAPE

SEQ ID NO: 1101891 - protein, 40 aa, Mycobacterium
AVPEPPRVRHPGGPAPGPAPAYPGGAPYGAPLYGPGGTPL

SEQ ID NO: 1101892 - protein, 14 aa, Mycobacterium
AVTGAGLTGRRDGH

SEQ ID NO: 1101893 - protein, 12 aa, Mycobacterium
AVTPQGAGSSTV

SEQ ID NO: 1101894 - protein, 65 aa, Mycobacterium
AWAAPTPEPPPEPTPEPEPKPEPEPESDADLDTDPGISRLSEEPTSWDRPAPTPEPEPEPEPVGG

SEQ ID NO: 1101895 - protein, 8 aa, Mycobacterium
AWRSPPQD

SEQ ID NO: 1101896 - protein, 12 aa, Mycobacterium
AYEDGDTATALT

SEQ ID NO: 1101897 - protein, 6 aa, Mycobacterium
AYNSSN

SEQ ID NO: 1101898 - protein, 7 aa, Mycobacterium
AYNSSNQ

SEQ ID NO: 1101899 - protein, 6 aa, Mycobacterium
AYRSAA

SEQ ID NO: 1101900 - protein, 19 aa, Mycobacterium
CAGGCPTELTDGQQITAEI

SEQ ID NO: 1101901 - protein, 7 aa, Mycobacterium
CDAETRM

SEQ ID NO: 1101902 - protein, 13 aa, Mycobacterium
CVDGSRGNSARHL

SEQ ID NO: 1101903 - protein, 5 aa, Mycobacterium
DAAPD

SEQ ID NO: 1101904 - protein, 7 aa, Mycobacterium
DAAPSGD

SEQ ID NO: 1101905 - protein, 5 aa, Mycobacterium
DAAQL

SEQ ID NO: 1101906 - protein, 13 aa, Mycobacterium
DADTADALGADAD

SEQ ID NO: 1101907 - protein, 5 aa, Mycobacterium
DAEPS

SEQ ID NO: 1101908 - protein, 13 aa, Mycobacterium
DAGEAADREPLTT

SEQ ID NO: 1101909 - protein, 21 aa, Mycobacterium
DAGEPEPEGEPESVAEPEAVA

SEQ ID NO: 1101910 - protein, 4 aa, Mycobacterium
DAGN

SEQ ID NO: 1101911 - protein, 6 aa, Mycobacterium
DAGPRR

SEQ ID NO: 1101912 - protein, 7 aa, Mycobacterium
DAGQSVT

SEQ ID NO: 1101913 - protein, 13 aa, Mycobacterium
DAGRLDGPLPVRD

SEQ ID NO: 1101914 - protein, 7 aa, Mycobacterium
DAGSETE

SEQ ID NO: 1101915 - protein, 11 aa, Mycobacterium
DAIPETPTQRR

SEQ ID NO: 1101916 - protein, 10 aa, Mycobacterium
DAKPAGGGYD

SEQ ID NO: 1101917 - protein, 9 aa, Mycobacterium
DANGQEDTA

SEQ ID NO: 1101918 - protein, 8 aa, Mycobacterium
DANPEAAR

SEQ ID NO: 1101919 - protein, 6 aa, Mycobacterium
DAPATR

SEQ ID NO: 1101920 - protein, 7 aa, Mycobacterium
DAPPGMT

SEQ ID NO: 1101921 - protein, 14 aa, Mycobacterium
DAPPPVPRPTGGHP

SEQ ID NO: 1101922 - protein, 7 aa, Mycobacterium
DAPPRRP

SEQ ID NO: 1101923 - protein, 5 aa, Mycobacterium
DAPST

SEQ ID NO: 1101924 - protein, 9 aa, Mycobacterium
DAQDSPPQG

SEQ ID NO: 1101925 - protein, 9 aa, Mycobacterium
DASEPSQAG

SEQ ID NO: 1101926 - protein, 8 aa, Mycobacterium
DASQPSTL

SEQ ID NO: 1101927 - protein, 15 aa, Mycobacterium
DASRTDDDRPRRRLI

SEQ ID NO: 1101928 - protein, 17 aa, Mycobacterium
DAVEPGDTDEDDAATTA

SEQ ID NO: 1101929 - protein, 6 aa, Mycobacterium
DDDEYY

SEQ ID NO: 1101930 - protein, 5 aa, Mycobacterium
DDDSR

SEQ ID NO: 1101931 - protein, 45 aa, Mycobacterium
DDEPERPSWPNPWQPKPQTPPKQDDDYWPQRPTVPTVPQAPKPVV

SEQ ID NO: 1101932 - protein, 7 aa, Mycobacterium
DDFSDDD

SEQ ID NO: 1101933 - protein, 15 aa, Mycobacterium
DDNGGYIQLAAPPDG

SEQ ID NO: 1101934 - protein, 8 aa, Mycobacterium
DDPEPFDP

SEQ ID NO: 1101935 - protein, 5 aa, Mycobacterium
DDPIQ

SEQ ID NO: 1101936 - protein, 35 aa, Mycobacterium
DDPTPCSPAPDDTLDVGTDKGAGGAGADSEDTEVV

SEQ ID NO: 1101937 - protein, 16 aa, Mycobacterium
DDRKGQPATTASNQGY

SEQ ID NO: 1101938 - protein, 17 aa, Mycobacterium
DDRPSYAPYSGADHPGY

SEQ ID NO: 1101939 - protein, 17 aa, Mycobacterium
DDRTYQPADAPANQGFA

SEQ ID NO: 1101940 - protein, 5 aa, Mycobacterium
DDSMN

SEQ ID NO: 1101941 - protein, 9 aa, Mycobacterium
DDTRAGRVA

SEQ ID NO: 1101942 - protein, 10 aa, Mycobacterium
DEADGGNGPH

SEQ ID NO: 1101943 - protein, 9 aa, Mycobacterium
DEAEKIDGD

SEQ ID NO: 1101944 - protein, 16 aa, Mycobacterium
DEAEKIDGDRTVTVSP

SEQ ID NO: 1101945 - protein, 4 aa, Mycobacterium
DEAV

SEQ ID NO: 1101946 - protein, 8 aa, Mycobacterium
DEDGEPTV

SEQ ID NO: 1101947 - protein, 7 aa, Mycobacterium
DEETRDR

SEQ ID NO: 1101948 - protein, 25 aa, Mycobacterium
DEIDRRDESLEDVSEGESEGAVQSR

SEQ ID NO: 1101949 - protein, 10 aa, Mycobacterium
DEKKSDYYET

SEQ ID NO: 1101950 - protein, 9 aa, Mycobacterium
DELASTGRT

SEQ ID NO: 1101951 - protein, 22 aa, Mycobacterium
DELDDGAERAAGWTDDDARERI

SEQ ID NO: 1101952 - protein, 4 aa, Mycobacterium
DEPA

SEQ ID NO: 1101953 - protein, 5 aa, Mycobacterium
DEQPV

SEQ ID NO: 1101954 - protein, 5 aa, Mycobacterium
DERAA

SEQ ID NO: 1101955 - protein, 7 aa, Mycobacterium
DERKADV

SEQ ID NO: 1101956 - protein, 7 aa, Mycobacterium
DESLSDS

SEQ ID NO: 1101957 - protein, 8 aa, Mycobacterium
DETETPIG

SEQ ID NO: 1101958 - protein, 13 aa, Mycobacterium
DEVADDTAEPVAG

SEQ ID NO: 1101959 - protein, 7 aa, Mycobacterium
DFDTSRS

SEQ ID NO: 1101960 - protein, 4 aa, Mycobacterium
DGAG

SEQ ID NO: 1101961 - protein, 9 aa, Mycobacterium
DGAPAAREL

SEQ ID NO: 1101962 - protein, 7 aa, Mycobacterium
DGAPTSQ

SEQ ID NO: 1101963 - protein, 8 aa, Mycobacterium
DGATTSVD

SEQ ID NO: 1101964 - protein, 10 aa, Mycobacterium
DGDSTTAIGQ

SEQ ID NO: 1101965 - protein, 7 aa, Mycobacterium
DGDTTKP

SEQ ID NO: 1101966 - protein, 8 aa, Mycobacterium
DGEGPSAS

SEQ ID NO: 1101967 - protein, 5 aa, Mycobacterium
DGGGL

SEQ ID NO: 1101968 - protein, 5 aa, Mycobacterium
DGGLP

SEQ ID NO: 1101969 - protein, 5 aa, Mycobacterium
DGGPV

SEQ ID NO: 1101970 - protein, 10 aa, Mycobacterium
DGKALGVQGT

SEQ ID NO: 1101971 - protein, 10 aa, Mycobacterium
DGPGTPEVVG

SEQ ID NO: 1101972 - protein, 8 aa, Mycobacterium
DGQASMDD

SEQ ID NO: 1101973 - protein, 5 aa, Mycobacterium
DGQPR

SEQ ID NO: 1101974 - protein, 9 aa, Mycobacterium
DGQPTADGL

SEQ ID NO: 1101975 - protein, 5 aa, Mycobacterium
DGRAA

SEQ ID NO: 1101976 - protein, 7 aa, Mycobacterium
DGRADMD

SEQ ID NO: 1101977 - protein, 8 aa, Mycobacterium
DGRGLPAE

SEQ ID NO: 1101978 - protein, 9 aa, Mycobacterium
DGRTSRRSF

SEQ ID NO: 1101979 - protein, 10 aa, Mycobacterium
DGTKPLENQW

SEQ ID NO: 1101980 - protein, 8 aa, Mycobacterium
DGTNTPAI

SEQ ID NO: 1101981 - protein, 7 aa, Mycobacterium
DGTSGPL

SEQ ID NO: 1101982 - protein, 12 aa, Mycobacterium
DGVARGLADRRR

SEQ ID NO: 1101983 - protein, 18 aa, Mycobacterium
DGVRGQGERMGQATTDAN

SEQ ID NO: 1101984 - protein, 7 aa, Mycobacterium
DGVSGGE

SEQ ID NO: 1101985 - protein, 13 aa, Mycobacterium
DHHADEPKPIDAS

SEQ ID NO: 1101986 - protein, 7 aa, Mycobacterium
DHHGKSP

SEQ ID NO: 1101987 - protein, 9 aa, Mycobacterium
DHPSPQRLN

SEQ ID NO: 1101988 - protein, 13 aa, Mycobacterium
DIDESESRTEESP

SEQ ID NO: 1101989 - protein, 11 aa, Mycobacterium
DIGTPQEGAPD

SEQ ID NO: 1101990 - protein, 10 aa, Mycobacterium
DIQGGSTITQ

SEQ ID NO: 1101991 - protein, 7 aa, Mycobacterium
DKGTQMT

SEQ ID NO: 1101992 - protein, 15 aa, Mycobacterium
DKSHPSAGMAQQSTA

SEQ ID NO: 1101993 - protein, 19 aa, Mycobacterium
DLDEPARERSQTDDDELPS

SEQ ID NO: 1101994 - protein, 7 aa, Mycobacterium
DLPPSPV

SEQ ID NO: 1101995 - protein, 8 aa, Mycobacterium
DLPRDGRA

SEQ ID NO: 1101996 - protein, 8 aa, Mycobacterium
DLRPEDKA

SEQ ID NO: 1101997 - protein, 12 aa, Mycobacterium
DLTPNTGTKEQT

SEQ ID NO: 1101998 - protein, 4 aa, Mycobacterium
DMRN

SEQ ID NO: 1101999 - protein, 7 aa, Mycobacterium
DNAAAAR

SEQ ID NO: 1102000 - protein, 11 aa, Mycobacterium
DNASADATPRI

SEQ ID NO: 1102001 - protein, 7 aa, Mycobacterium
DNEDVKT

SEQ ID NO: 1102002 - protein, 8 aa, Mycobacterium
DNEQELAP

SEQ ID NO: 1102003 - protein, 7 aa, Mycobacterium
DNGDGIA

SEQ ID NO: 1102004 - protein, 5 aa, Mycobacterium
DNGHM

SEQ ID NO: 1102005 - protein, 11 aa, Mycobacterium
DNGSTDETAQI

SEQ ID NO: 1102006 - protein, 11 aa, Mycobacterium
DNHRRDPRREL

SEQ ID NO: 1102007 - protein, 9 aa, Mycobacterium
DNPKASEQA

SEQ ID NO: 1102008 - protein, 8 aa, Mycobacterium
DNQATADR

SEQ ID NO: 1102009 - protein, 5 aa, Mycobacterium
DNRRA

SEQ ID NO: 1102010 - protein, 19 aa, Mycobacterium
DNTFDPSQDIGKQDNRQIG

SEQ ID NO: 1102011 - protein, 16 aa, Mycobacterium
DNTVKDRQALEDVTGA

SEQ ID NO: 1102012 - protein, 7 aa, Mycobacterium
DNYPEQP

SEQ ID NO: 1102013 - protein, 7 aa, Mycobacterium
DPANDDE

SEQ ID NO: 1102014 - protein, 17 aa, Mycobacterium
DPATALPAIDPDARRRR

SEQ ID NO: 1102015 - protein, 33 aa, Mycobacterium
DPATGEYLTPDGRLERQTNSALRAPKSWQDLLP

SEQ ID NO: 1102016 - protein, 7 aa, Mycobacterium
DPAVGQE

SEQ ID NO: 1102017 - protein, 6 aa, Mycobacterium
DPDARG

SEQ ID NO: 1102018 - protein, 6 aa, Mycobacterium
DPDLHP

SEQ ID NO: 1102019 - protein, 12 aa, Mycobacterium
DPEKDAEKYAPM

SEQ ID NO: 1102020 - protein, 6 aa, Mycobacterium
DPGSLS

SEQ ID NO: 1102021 - protein, 19 aa, Mycobacterium
DPKNGGVKAYYGGSDANGF

SEQ ID NO: 1102022 - protein, 5 aa, Mycobacterium
DPLDE

SEQ ID NO: 1102023 - protein, 34 aa, Mycobacterium
DPLPGEKNPDNVPGTPESTTADPEVAATESGGAE

SEQ ID NO: 1102024 - protein, 15 aa, Mycobacterium
DPMGEQQGTGPAAAV

SEQ ID NO: 1102025 - protein, 35 aa, Mycobacterium
DPPAAPSPDPDPGSSSAADSEPPPPPPDSEPPVSN

SEQ ID NO: 1102026 - protein, 8 aa, Mycobacterium
DPQPPEAV

SEQ ID NO: 1102027 - protein, 4 aa, Mycobacterium
DPRQ

SEQ ID NO: 1102028 - protein, 6 aa, Mycobacterium
DPSMDN

SEQ ID NO: 1102029 - protein, 8 aa, Mycobacterium
DPSTEPVS

SEQ ID NO: 1102030 - protein, 4 aa, Mycobacterium
DPSY

SEQ ID NO: 1102031 - protein, 8 aa, Mycobacterium
DPTTLDPA

SEQ ID NO: 1102032 - protein, 14 aa, Mycobacterium
DPVTKTQAVSADGK

SEQ ID NO: 1102033 - protein, 7 aa, Mycobacterium
DQAEKQM

SEQ ID NO: 1102034 - protein, 15 aa, Mycobacterium
DQAGALSAAQRGEVQ

SEQ ID NO: 1102035 - protein, 8 aa, Mycobacterium
DQDLRSPR

SEQ ID NO: 1102036 - protein, 8 aa, Mycobacterium
DQKTSHRR

SEQ ID NO: 1102037 - protein, 4 aa, Mycobacterium
DQLG

SEQ ID NO: 1102038 - protein, 17 aa, Mycobacterium
DQLTPARDVESVPGAGL

SEQ ID NO: 1102039 - protein, 8 aa, Mycobacterium
DQPDPDTQ

SEQ ID NO: 1102040 - protein, 8 aa, Mycobacterium
DQSAAVEN

SEQ ID NO: 1102041 - protein, 4 aa, Mycobacterium
DQTG

SEQ ID NO: 1102042 - protein, 6 aa, Mycobacterium
DQTPLR

SEQ ID NO: 1102043 - protein, 38 aa, Mycobacterium
DQTQATNFADTDGDTETGGEAGTEGGTTARAGINGSRA

SEQ ID NO: 1102044 - protein, 17 aa, Mycobacterium
DQVEQDLTAASDRMTGE

SEQ ID NO: 1102045 - protein, 4 aa, Mycobacterium
DRAG

SEQ ID NO: 1102046 - protein, 8 aa, Mycobacterium
DRAGAGAL

SEQ ID NO: 1102047 - protein, 8 aa, Mycobacterium
DRAPAEIR

SEQ ID NO: 1102048 - protein, 23 aa, Mycobacterium
DRAPSSVAGVKTAERRQQRAQTI

SEQ ID NO: 1102049 - protein, 6 aa, Mycobacterium
DRDPEV

SEQ ID NO: 1102050 - protein, 7 aa, Mycobacterium
DRESELS

SEQ ID NO: 1102051 - protein, 13 aa, Mycobacterium
DRHPYPGIQRHAR

SEQ ID NO: 1102052 - protein, 8 aa, Mycobacterium
DRKERLDR

SEQ ID NO: 1102053 - protein, 7 aa, Mycobacterium
DRLGETP

SEQ ID NO: 1102054 - protein, 4 aa, Mycobacterium
DRPA

SEQ ID NO: 1102055 - protein, 7 aa, Mycobacterium
DRPDLDP

SEQ ID NO: 1102056 - protein, 5 aa, Mycobacterium
DRPRQ

SEQ ID NO: 1102057 - protein, 20 aa, Mycobacterium
DRRGNPIGAADAGENRGRTV

SEQ ID NO: 1102058 - protein, 4 aa, Mycobacterium
DRST

SEQ ID NO: 1102059 - protein, 8 aa, Mycobacterium
DRTGNDLA

SEQ ID NO: 1102060 - protein, 8 aa, Mycobacterium
DRTQKPTF

SEQ ID NO: 1102061 - protein, 9 aa, Mycobacterium
DRTTNPGIA

SEQ ID NO: 1102062 - protein, 8 aa, Mycobacterium
DSAPPAYA

SEQ ID NO: 1102063 - protein, 18 aa, Mycobacterium
DSDALADHSRSNEGEGRP

SEQ ID NO: 1102064 - protein, 7 aa, Mycobacterium
DSDGVPV

SEQ ID NO: 1102065 - protein, 10 aa, Mycobacterium
DSGDLTDEQI

SEQ ID NO: 1102066 - protein, 6 aa, Mycobacterium
DSGPAL

SEQ ID NO: 1102067 - protein, 10 aa, Mycobacterium
DSGQLRANQS

SEQ ID NO: 1102068 - protein, 4 aa, Mycobacterium
DSHG

SEQ ID NO: 1102069 - protein, 12 aa, Mycobacterium
DSPEERASARQR

SEQ ID NO: 1102070 - protein, 5 aa, Mycobacterium
DSSLA

SEQ ID NO: 1102071 - protein, 9 aa, Mycobacterium
DSTPGVPPE

SEQ ID NO: 1102072 - protein, 6 aa, Mycobacterium
DSVDAS

SEQ ID NO: 1102073 - protein, 9 aa, Mycobacterium
DTAARRVGT

SEQ ID NO: 1102074 - protein, 7 aa, Mycobacterium
DTAESDD

SEQ ID NO: 1102075 - protein, 8 aa, Mycobacterium
DTAGGATI

SEQ ID NO: 1102076 - protein, 13 aa, Mycobacterium
DTAGPDRDYATHP

SEQ ID NO: 1102077 - protein, 12 aa, Mycobacterium
DTARDREHGGAG

SEQ ID NO: 1102078 - protein, 9 aa, Mycobacterium
DTATPTGPG

SEQ ID NO: 1102079 - protein, 7 aa, Mycobacterium
DTGEGIA

SEQ ID NO: 1102080 - protein, 9 aa, Mycobacterium
DTGGLTPAD

SEQ ID NO: 1102081 - protein, 9 aa, Mycobacterium
DTPAPRSID

SEQ ID NO: 1102082 - protein, 9 aa, Mycobacterium
DTPESTSER

SEQ ID NO: 1102083 - protein, 19 aa, Mycobacterium
DTPESTSERIAAAGQRRGV

SEQ ID NO: 1102084 - protein, 6 aa, Mycobacterium
DTPRSA

SEQ ID NO: 1102085 - protein, 8 aa, Mycobacterium
DTSPKVPA

SEQ ID NO: 1102086 - protein, 16 aa, Mycobacterium
DTSPTCDADPECVQSR

SEQ ID NO: 1102087 - protein, 11 aa, Mycobacterium
DTTESAHSMPR

SEQ ID NO: 1102088 - protein, 9 aa, Mycobacterium
DTTGPGRSR

SEQ ID NO: 1102089 - protein, 8 aa, Mycobacterium
DTTSPYAH

SEQ ID NO: 1102090 - protein, 6 aa, Mycobacterium
DTTVAP

SEQ ID NO: 1102091 - protein, 8 aa, Mycobacterium
DTVPGGSD

SEQ ID NO: 1102092 - protein, 25 aa, Mycobacterium
DVPASALPAGGRALRASSALPGVNA

SEQ ID NO: 1102093 - protein, 12 aa, Mycobacterium
DVTGNVAGADAQ

SEQ ID NO: 1102094 - protein, 12 aa, Mycobacterium
DVTGTKAGRTEV

SEQ ID NO: 1102095 - protein, 7 aa, Mycobacterium
DYEPYEP

SEQ ID NO: 1102096 - protein, 5 aa, Mycobacterium
DYRIG

SEQ ID NO: 1102097 - protein, 26 aa, Mycobacterium
DYTGSSGSAGVSGGGAVAGSSTGADD

SEQ ID NO: 1102098 - protein, 5 aa, Mycobacterium
EAAER

SEQ ID NO: 1102099 - protein, 22 aa, Mycobacterium
EAARSAPQARAPFGGRLSDSKP

SEQ ID NO: 1102100 - protein, 11 aa, Mycobacterium
EAARSVGESSI

SEQ ID NO: 1102101 - protein, 10 aa, Mycobacterium
EAASATEVQR

SEQ ID NO: 1102102 - protein, 5 aa, Mycobacterium
EADEL

SEQ ID NO: 1102103 - protein, 6 aa, Mycobacterium
EADPIS

SEQ ID NO: 1102104 - protein, 12 aa, Mycobacterium
EAGEAGDREPLT

SEQ ID NO: 1102105 - protein, 9 aa, Mycobacterium
EAGGPPAEA

SEQ ID NO: 1102106 - protein, 8 aa, Mycobacterium
EAGPASVE

SEQ ID NO: 1102107 - protein, 7 aa, Mycobacterium
EAGQPVV

SEQ ID NO: 1102108 - protein, 12 aa, Mycobacterium
EAPGEREAADEV

SEQ ID NO: 1102109 - protein, 15 aa, Mycobacterium
EAQNSSSRAQRLADK

SEQ ID NO: 1102110 - protein, 12 aa, Mycobacterium
EARQAGESREDA

SEQ ID NO: 1102111 - protein, 5 aa, Mycobacterium
EASQL

SEQ ID NO: 1102112 - protein, 10 aa, Mycobacterium
EATGDDDGDT

SEQ ID NO: 1102113 - protein, 13 aa, Mycobacterium
EAVPTPADDENRK

SEQ ID NO: 1102114 - protein, 4 aa, Mycobacterium
EAVS

SEQ ID NO: 1102115 - protein, 9 aa, Mycobacterium
ECSGQQPNP

SEQ ID NO: 1102116 - protein, 10 aa, Mycobacterium
EDAGLPAESV

SEQ ID NO: 1102117 - protein, 7 aa, Mycobacterium
EDDKAAI

SEQ ID NO: 1102118 - protein, 10 aa, Mycobacterium
EDDPDEPPIV

SEQ ID NO: 1102119 - protein, 8 aa, Mycobacterium
EDGHHAGD

SEQ ID NO: 1102120 - protein, 12 aa, Mycobacterium
EDGTPLGPDQPG

SEQ ID NO: 1102121 - protein, 5 aa, Mycobacterium
EDHRD

SEQ ID NO: 1102122 - protein, 16 aa, Mycobacterium
EDPSVHRSTDAGARDQ

SEQ ID NO: 1102123 - protein, 9 aa, Mycobacterium
EDTGTTSLA

SEQ ID NO: 1102124 - protein, 13 aa, Mycobacterium
EDVESAPSEDIAE

SEQ ID NO: 1102125 - protein, 12 aa, Mycobacterium
EDVETKPPGKPA

SEQ ID NO: 1102126 - protein, 10 aa, Mycobacterium
EEAEAEAAEA

SEQ ID NO: 1102127 - protein, 8 aa, Mycobacterium
EEALEDPA

SEQ ID NO: 1102128 - protein, 9 aa, Mycobacterium
EEGNPDGPT

SEQ ID NO: 1102129 - protein, 11 aa, Mycobacterium
EEIDDDGRPAA

SEQ ID NO: 1102130 - protein, 46 aa, Mycobacterium
EEPTPPPAAPPAEDPTAPAPSADDEEDREGPRRRARREREQRRAVK

SEQ ID NO: 1102131 - protein, 8 aa, Mycobacterium
EEQERQRF

SEQ ID NO: 1102132 - protein, 7 aa, Mycobacterium
EEQSDHP

SEQ ID NO: 1102133 - protein, 10 aa, Mycobacterium
EGAGGPRPDP

SEQ ID NO: 1102134 - protein, 29 aa, Mycobacterium
EGEDAVAAEESAEEAHEAAVEGAAEAEAL

SEQ ID NO: 1102135 - protein, 7 aa, Mycobacterium
EGEEVPA

SEQ ID NO: 1102136 - protein, 7 aa, Mycobacterium
EGHPAVR

SEQ ID NO: 1102137 - protein, 13 aa, Mycobacterium
EGLDDRQSLNSTV

SEQ ID NO: 1102138 - protein, 10 aa, Mycobacterium
EGLRGNGDDM

SEQ ID NO: 1102139 - protein, 8 aa, Mycobacterium
EGMSATGP

SEQ ID NO: 1102140 - protein, 4 aa, Mycobacterium
EGRG

SEQ ID NO: 1102141 - protein, 5 aa, Mycobacterium
EGSSR

SEQ ID NO: 1102142 - protein, 15 aa, Mycobacterium
EGTDAEAALQSGAMT

SEQ ID NO: 1102143 - protein, 7 aa, Mycobacterium
EGTGSVD

SEQ ID NO: 1102144 - protein, 17 aa, Mycobacterium
EGVAGPEAANNASAAGT

SEQ ID NO: 1102145 - protein, 14 aa, Mycobacterium
EHGERVKAATHAAT

SEQ ID NO: 1102146 - protein, 5 aa, Mycobacterium
EHQRR

SEQ ID NO: 1102147 - protein, 6 aa, Mycobacterium
EIGDGE

SEQ ID NO: 1102148 - protein, 5 aa, Mycobacterium
EILSR

SEQ ID NO: 1102149 - protein, 9 aa, Mycobacterium
EIRPESREA

SEQ ID NO: 1102150 - protein, 7 aa, Mycobacterium
EKADGVT

SEQ ID NO: 1102151 - protein, 44 aa, Mycobacterium
EKEPDAEPEGEAQAAEPEVEAETADGAGESDAAGESEGEPEPEP

SEQ ID NO: 1102152 - protein, 11 aa, Mycobacterium
EKLGKKAAARL

SEQ ID NO: 1102153 - protein, 4 aa, Mycobacterium
EKNV

SEQ ID NO: 1102154 - protein, 6 aa, Mycobacterium
EKPAEG

SEQ ID NO: 1102155 - protein, 6 aa, Mycobacterium
EKRSQT

SEQ ID NO: 1102156 - protein, 10 aa, Mycobacterium
ELGRNGDHRE

SEQ ID NO: 1102157 - protein, 10 aa, Mycobacterium
ELPSPARSSA

SEQ ID NO: 1102158 - protein, 7 aa, Mycobacterium
ELQRQGK

SEQ ID NO: 1102159 - protein, 6 aa, Mycobacterium
ELQSAT

SEQ ID NO: 1102160 - protein, 8 aa, Mycobacterium
ELRPEAPE

SEQ ID NO: 1102161 - protein, 8 aa, Mycobacterium
ELRPEDKA

SEQ ID NO: 1102162 - protein, 4 aa, Mycobacterium
ELRT

SEQ ID NO: 1102163 - protein, 6 aa, Mycobacterium
EMEKSV

SEQ ID NO: 1102164 - protein, 16 aa, Mycobacterium
EMPSAQGGAPRGEGAV

SEQ ID NO: 1102165 - protein, 7 aa, Mycobacterium
ENASEHP

SEQ ID NO: 1102166 - protein, 7 aa, Mycobacterium
ENGAVSN

SEQ ID NO: 1102167 - protein, 7 aa, Mycobacterium
ENGNAPV

SEQ ID NO: 1102168 - protein, 5 aa, Mycobacterium
ENKDA

SEQ ID NO: 1102169 - protein, 8 aa, Mycobacterium
ENMRSAPQ

SEQ ID NO: 1102170 - protein, 22 aa, Mycobacterium
ENRDGDDGNLPIDGSVPRRREA

SEQ ID NO: 1102171 - protein, 11 aa, Mycobacterium
ENVKAGAKPDT

SEQ ID NO: 1102172 - protein, 9 aa, Mycobacterium
EPAATDRRR

SEQ ID NO: 1102173 - protein, 17 aa, Mycobacterium
EPAPGEPTAAPEPVNGG

SEQ ID NO: 1102174 - protein, 5 aa, Mycobacterium
EPAPV

SEQ ID NO: 1102175 - protein, 55 aa, Mycobacterium
EPFSTAPSPQPSSTSTPAPAPTSTPSSAIEQPQDGSGDKEQKKEEKKREGRGNGN

SEQ ID NO: 1102176 - protein, 4 aa, Mycobacterium
EPGI

SEQ ID NO: 1102177 - protein, 7 aa, Mycobacterium
EPHAADD

SEQ ID NO: 1102178 - protein, 11 aa, Mycobacterium
EPPAPPPPDNR

SEQ ID NO: 1102179 - protein, 4 aa, Mycobacterium
EPPT

SEQ ID NO: 1102180 - protein, 8 aa, Mycobacterium
EPRAGTPV

SEQ ID NO: 1102181 - protein, 33 aa, Mycobacterium
EPTEPSAAGGPGDQTGPDDATRPSPTADHEPAT

SEQ ID NO: 1102182 - protein, 12 aa, Mycobacterium
EQARKGSSQRLA

SEQ ID NO: 1102183 - protein, 6 aa, Mycobacterium
EQEELE

SEQ ID NO: 1102184 - protein, 5 aa, Mycobacterium
EQKGQ

SEQ ID NO: 1102185 - protein, 8 aa, Mycobacterium
EQPPPAGL

SEQ ID NO: 1102186 - protein, 31 aa, Mycobacterium
EQPQAPVVENKKPKGNGNGKGNGNGKGNGKG

SEQ ID NO: 1102187 - protein, 6 aa, Mycobacterium
EQSTAL

SEQ ID NO: 1102188 - protein, 15 aa, Mycobacterium
EQTGDAAKVSDVQLV

SEQ ID NO: 1102189 - protein, 17 aa, Mycobacterium
ERAARAVEAAAQQDKFE

SEQ ID NO: 1102190 - protein, 11 aa, Mycobacterium
ERAPRIPGSGE

SEQ ID NO: 1102191 - protein, 11 aa, Mycobacterium
ERGTELGGQER

SEQ ID NO: 1102192 - protein, 8 aa, Mycobacterium
ERNPDGAQ

SEQ ID NO: 1102193 - protein, 8 aa, Mycobacterium
ERNQRKAK

SEQ ID NO: 1102194 - protein, 13 aa, Mycobacterium
ERNSGQRPAPQPR

SEQ ID NO: 1102195 - protein, 25 aa, Mycobacterium
ERPALEYPTRPAPQPDITGEEPDAA

SEQ ID NO: 1102196 - protein, 4 aa, Mycobacterium
ERPG

SEQ ID NO: 1102197 - protein, 12 aa, Mycobacterium
ERPGIKDPTDPV

SEQ ID NO: 1102198 - protein, 4 aa, Mycobacterium
ERQS

SEQ ID NO: 1102199 - protein, 80 aa, Mycobacterium
ERRAANAPAPGAKPKRTRKAQEAADAGADAVDGSVTDAAGADEAAGGPAAKASGNGAAKPSGGQAVSRTPKPGARPKKRK

SEQ ID NO: 1102200 - protein, 11 aa, Mycobacterium
ERSGAGESAAP

SEQ ID NO: 1102201 - protein, 10 aa, Mycobacterium
ERSQTGKVSR

SEQ ID NO: 1102202 - protein, 10 aa, Mycobacterium
ERYKESKGDF

SEQ ID NO: 1102203 - protein, 16 aa, Mycobacterium
ESAGRPLAATVAADVR

SEQ ID NO: 1102204 - protein, 7 aa, Mycobacterium
ESASEHP

SEQ ID NO: 1102205 - protein, 8 aa, Mycobacterium
ESASQHPI

SEQ ID NO: 1102206 - protein, 10 aa, Mycobacterium
ESGDQPPAGA

SEQ ID NO: 1102207 - protein, 13 aa, Mycobacterium
ESLPVSKAPDSKV

SEQ ID NO: 1102208 - protein, 14 aa, Mycobacterium
ESMTDTVHTDPAGP

SEQ ID NO: 1102209 - protein, 6 aa, Mycobacterium
ESNVGA

SEQ ID NO: 1102210 - protein, 7 aa, Mycobacterium
ESPAREA

SEQ ID NO: 1102211 - protein, 11 aa, Mycobacterium
ESPGKPSPLAA

SEQ ID NO: 1102212 - protein, 12 aa, Mycobacterium
ESQDIDGAGPAR

SEQ ID NO: 1102213 - protein, 7 aa, Mycobacterium
ESRFRRG

SEQ ID NO: 1102214 - protein, 6 aa, Mycobacterium
ESTNPI

SEQ ID NO: 1102215 - protein, 5 aa, Mycobacterium
ESVRT

SEQ ID NO: 1102216 - protein, 4 aa, Mycobacterium
ETAA

SEQ ID NO: 1102217 - protein, 24 aa, Mycobacterium
ETAEPPAPPAASPSPTVDAAAQTE

SEQ ID NO: 1102218 - protein, 8 aa, Mycobacterium
ETDRAATT

SEQ ID NO: 1102219 - protein, 9 aa, Mycobacterium
ETDRAATTL

SEQ ID NO: 1102220 - protein, 9 aa, Mycobacterium
ETDRRAEVR

SEQ ID NO: 1102221 - protein, 9 aa, Mycobacterium
ETEASSEAV

SEQ ID NO: 1102222 - protein, 10 aa, Mycobacterium
ETEEPDDVDV

SEQ ID NO: 1102223 - protein, 7 aa, Mycobacterium
ETERLTR

SEQ ID NO: 1102224 - protein, 8 aa, Mycobacterium
ETESEHPL

SEQ ID NO: 1102225 - protein, 7 aa, Mycobacterium
ETGGPRR

SEQ ID NO: 1102226 - protein, 8 aa, Mycobacterium
ETGGPRRA

SEQ ID NO: 1102227 - protein, 8 aa, Mycobacterium
ETGNQIKG

SEQ ID NO: 1102228 - protein, 8 aa, Mycobacterium
ETKAESRG

SEQ ID NO: 1102229 - protein, 7 aa, Mycobacterium
ETKSATM

SEQ ID NO: 1102230 - protein, 12 aa, Mycobacterium
ETPEDGSSPDAR

SEQ ID NO: 1102231 - protein, 16 aa, Mycobacterium
ETQSEWGEQQTPADSR

SEQ ID NO: 1102232 - protein, 7 aa, Mycobacterium
ETRSEHP

SEQ ID NO: 1102233 - protein, 5 aa, Mycobacterium
ETSLA

SEQ ID NO: 1102234 - protein, 4 aa, Mycobacterium
ETVG

SEQ ID NO: 1102235 - protein, 7 aa, Mycobacterium
ETVGSGP

SEQ ID NO: 1102236 - protein, 21 aa, Mycobacterium
EVAAEDRAQETPAEAPSVKPS

SEQ ID NO: 1102237 - protein, 7 aa, Mycobacterium
EVKGRGY

SEQ ID NO: 1102238 - protein, 17 aa, Mycobacterium
EVTQGANTLADSSRQLA

SEQ ID NO: 1102239 - protein, 4 aa, Mycobacterium
EWGG

SEQ ID NO: 1102240 - protein, 7 aa, Mycobacterium
EYAGDRA

SEQ ID NO: 1102241 - protein, 8 aa, Mycobacterium
EYGPPIPV

SEQ ID NO: 1102242 - protein, 5 aa, Mycobacterium
EYPGD

SEQ ID NO: 1102243 - protein, 5 aa, Mycobacterium
EYRIG

SEQ ID NO: 1102244 - protein, 11 aa, Mycobacterium
FAGTGAAYGTV

SEQ ID NO: 1102245 - protein, 6 aa, Mycobacterium
FANGTN

SEQ ID NO: 1102246 - protein, 4 aa, Mycobacterium
FANP

SEQ ID NO: 1102247 - protein, 17 aa, Mycobacterium
FDATTGSLAPQAAVPPG

SEQ ID NO: 1102248 - protein, 5 aa, Mycobacterium
FDQGD

SEQ ID NO: 1102249 - protein, 12 aa, Mycobacterium
FEDRKEPGSVGC

SEQ ID NO: 1102250 - protein, 9 aa, Mycobacterium
FESDNSGIA

SEQ ID NO: 1102251 - protein, 13 aa, Mycobacterium
FGAPTAAPTWQAS

SEQ ID NO: 1102252 - protein, 22 aa, Mycobacterium
FGDEDDDAGDAPVTVSAGGTTS

SEQ ID NO: 1102253 - protein, 4 aa, Mycobacterium
FGDG

SEQ ID NO: 1102254 - protein, 7 aa, Mycobacterium
FGEQGSK

SEQ ID NO: 1102255 - protein, 32 aa, Mycobacterium
FGFGSASADEPPVPPPPAPADGPPPLGTPGRA

SEQ ID NO: 1102256 - protein, 26 aa, Mycobacterium
FGPGQPGMQTPQQTQPGSPATTAPAR

SEQ ID NO: 1102257 - protein, 8 aa, Mycobacterium
FKSAVGPS

SEQ ID NO: 1102258 - protein, 9 aa, Mycobacterium
FPDADPTRV

SEQ ID NO: 1102259 - protein, 19 aa, Mycobacterium
FPEVGSERQDIRQYPGGSL

SEQ ID NO: 1102260 - protein, 4 aa, Mycobacterium
FPGL

SEQ ID NO: 1102261 - protein, 7 aa, Mycobacterium
FPPGADT

SEQ ID NO: 1102262 - protein, 9 aa, Mycobacterium
FPQDNPAAV

SEQ ID NO: 1102263 - protein, 5 aa, Mycobacterium
FPTRS

SEQ ID NO: 1102264 - protein, 8 aa, Mycobacterium
FQESDSTS

SEQ ID NO: 1102265 - protein, 8 aa, Mycobacterium
FQNTPPDL

SEQ ID NO: 1102266 - protein, 6 aa, Mycobacterium
FSADDR

SEQ ID NO: 1102267 - protein, 4 aa, Mycobacterium
FSGG

SEQ ID NO: 1102268 - protein, 9 aa, Mycobacterium
FSTSDNDYS

SEQ ID NO: 1102269 - protein, 5 aa, Mycobacterium
FTPRE

SEQ ID NO: 1102270 - protein, 6 aa, Mycobacterium
FTSTDT

SEQ ID NO: 1102271 - protein, 5 aa, Mycobacterium
GAAAL

SEQ ID NO: 1102272 - protein, 8 aa, Mycobacterium
GAAERSYQ

SEQ ID NO: 1102273 - protein, 4 aa, Mycobacterium
GAAG

SEQ ID NO: 1102274 - protein, 6 aa, Mycobacterium
GAALEG

SEQ ID NO: 1102275 - protein, 15 aa, Mycobacterium
GAAPATATPPRPATK

SEQ ID NO: 1102276 - protein, 25 aa, Mycobacterium
GAAPDTPGPRRTAPTPQASPPPATL

SEQ ID NO: 1102277 - protein, 12 aa, Mycobacterium
GAASNNKDIKEL

SEQ ID NO: 1102278 - protein, 14 aa, Mycobacterium
GAASPDNHDGEQAR

SEQ ID NO: 1102279 - protein, 13 aa, Mycobacterium
GAATQSGTRTVDA

SEQ ID NO: 1102280 - protein, 67 aa, Mycobacterium
GADATATGPAPANLPDGQPAAQPPNGQQPAAQTPGNQAGRAPTPPPAAIPSGPSGPQQLSEAKAAAL

SEQ ID NO: 1102281 - protein, 9 aa, Mycobacterium
GADTGTPAR

SEQ ID NO: 1102282 - protein, 10 aa, Mycobacterium
GAEATPPRSG

SEQ ID NO: 1102283 - protein, 16 aa, Mycobacterium
GAEEEPDHDGARPDTA

SEQ ID NO: 1102284 - protein, 13 aa, Mycobacterium
GAERDERERGPEK

SEQ ID NO: 1102285 - protein, 8 aa, Mycobacterium
GAGGDAEY

SEQ ID NO: 1102286 - protein, 4 aa, Mycobacterium
GAGL

SEQ ID NO: 1102287 - protein, 5 aa, Mycobacterium
GAGPA

SEQ ID NO: 1102288 - protein, 7 aa, Mycobacterium
GAGQARS

SEQ ID NO: 1102289 - protein, 7 aa, Mycobacterium
GAGRLPE

SEQ ID NO: 1102290 - protein, 7 aa, Mycobacterium
GAGSVDP

SEQ ID NO: 1102291 - protein, 5 aa, Mycobacterium
GAGVP

SEQ ID NO: 1102292 - protein, 8 aa, Mycobacterium
GAHTAGGS

SEQ ID NO: 1102293 - protein, 8 aa, Mycobacterium
GAINGGGA

SEQ ID NO: 1102294 - protein, 16 aa, Mycobacterium
GAIPPNPSELLGSQSA

SEQ ID NO: 1102295 - protein, 6 aa, Mycobacterium
GAITPT

SEQ ID NO: 1102296 - protein, 14 aa, Mycobacterium
GAKEKRVSAEATVP

SEQ ID NO: 1102297 - protein, 7 aa, Mycobacterium
GAKSSDQ

SEQ ID NO: 1102298 - protein, 5 aa, Mycobacterium
GALQS

SEQ ID NO: 1102299 - protein, 9 aa, Mycobacterium
GANGNAEVT

SEQ ID NO: 1102300 - protein, 12 aa, Mycobacterium
GAPFGPSAGEAE

SEQ ID NO: 1102301 - protein, 4 aa, Mycobacterium
GAPL

SEQ ID NO: 1102302 - protein, 9 aa, Mycobacterium
GAREAEELS

SEQ ID NO: 1102303 - protein, 5 aa, Mycobacterium
GARGE

SEQ ID NO: 1102304 - protein, 22 aa, Mycobacterium
GARRPGAKKAPAKASPNEGAAT

SEQ ID NO: 1102305 - protein, 66 aa, Mycobacterium
GARRPGAKKKPAAPAAAPAKPAEPEPQAQPEAQAEPAPEPEPEAPSQPASGNGDARVVGDEPPVKG

SEQ ID NO: 1102306 - protein, 4 aa, Mycobacterium
GASA

SEQ ID NO: 1102307 - protein, 6 aa, Mycobacterium
GASDPD

SEQ ID NO: 1102308 - protein, 16 aa, Mycobacterium
GASQVTPDNQGNTSNF

SEQ ID NO: 1102309 - protein, 6 aa, Mycobacterium
GATGPG

SEQ ID NO: 1102310 - protein, 4 aa, Mycobacterium
GATL

SEQ ID NO: 1102311 - protein, 8 aa, Mycobacterium
GATTPAHG

SEQ ID NO: 1102312 - protein, 4 aa, Mycobacterium
GATV

SEQ ID NO: 1102313 - protein, 7 aa, Mycobacterium
GAVGTSA

SEQ ID NO: 1102314 - protein, 6 aa, Mycobacterium
GAVQPT

SEQ ID NO: 1102315 - protein, 7 aa, Mycobacterium
GDAGPGI

SEQ ID NO: 1102316 - protein, 27 aa, Mycobacterium
GDAPKATTAPTTEAATAAAQPAAGDSV

SEQ ID NO: 1102317 - protein, 7 aa, Mycobacterium
GDARDKA

SEQ ID NO: 1102318 - protein, 7 aa, Mycobacterium
GDDGGRL

SEQ ID NO: 1102319 - protein, 4 aa, Mycobacterium
GDET

SEQ ID NO: 1102320 - protein, 10 aa, Mycobacterium
GDGANDAAAI

SEQ ID NO: 1102321 - protein, 15 aa, Mycobacterium
GDGPDRVAARGEPDH

SEQ ID NO: 1102322 - protein, 8 aa, Mycobacterium
GDIDEDEF

SEQ ID NO: 1102323 - protein, 18 aa, Mycobacterium
GDKLNRSLEAERSEQSVP

SEQ ID NO: 1102324 - protein, 9 aa, Mycobacterium
GDLDEESWE

SEQ ID NO: 1102325 - protein, 4 aa, Mycobacterium
GDMA

SEQ ID NO: 1102326 - protein, 10 aa, Mycobacterium
GDNARTAEAV

SEQ ID NO: 1102327 - protein, 9 aa, Mycobacterium
GDNERTARA

SEQ ID NO: 1102328 - protein, 7 aa, Mycobacterium
GDNQRVA

SEQ ID NO: 1102329 - protein, 5 aa, Mycobacterium
GDPEL

SEQ ID NO: 1102330 - protein, 6 aa, Mycobacterium
GDPPTL

SEQ ID NO: 1102331 - protein, 5 aa, Mycobacterium
GDPTL

SEQ ID NO: 1102332 - protein, 16 aa, Mycobacterium
GDPVGGSGHATPLPAS

SEQ ID NO: 1102333 - protein, 15 aa, Mycobacterium
GDRYDPASNATVAGT

SEQ ID NO: 1102334 - protein, 15 aa, Mycobacterium
GDRYDPATNATVGGT

SEQ ID NO: 1102335 - protein, 7 aa, Mycobacterium
GDRYGRR

SEQ ID NO: 1102336 - protein, 15 aa, Mycobacterium
GDRYPEAAVPSLADA

SEQ ID NO: 1102337 - protein, 15 aa, Mycobacterium
GDTIRADERRARATQ

SEQ ID NO: 1102338 - protein, 24 aa, Mycobacterium
GEDRTGECETPEARATPEDPQVTA

SEQ ID NO: 1102339 - protein, 48 aa, Mycobacterium
GEEATGQQARHGLPTETRVEKSSPSSATSAQGDSEVAEPAGTRQTRET

SEQ ID NO: 1102340 - protein, 14 aa, Mycobacterium
GEGSARRLAARSAG

SEQ ID NO: 1102341 - protein, 20 aa, Mycobacterium
GEGTDRPCPNPELPLPTKHS

SEQ ID NO: 1102342 - protein, 18 aa, Mycobacterium
GEIDEDEYQRRMTLLREH

SEQ ID NO: 1102343 - protein, 8 aa, Mycobacterium
GEISETQY

SEQ ID NO: 1102344 - protein, 17 aa, Mycobacterium
GEKIATDGEVVSGTSAV

SEQ ID NO: 1102345 - protein, 11 aa, Mycobacterium
GELEETQETVR

SEQ ID NO: 1102346 - protein, 9 aa, Mycobacterium
GENGESVPP

SEQ ID NO: 1102347 - protein, 10 aa, Mycobacterium
GEPDGGAPVR

SEQ ID NO: 1102348 - protein, 10 aa, Mycobacterium
GEPDTTGSAA

SEQ ID NO: 1102349 - protein, 13 aa, Mycobacterium
GEPTVTVDDETAV

SEQ ID NO: 1102350 - protein, 6 aa, Mycobacterium
GEPVEI

SEQ ID NO: 1102351 - protein, 10 aa, Mycobacterium
GEPVETPTAE

SEQ ID NO: 1102352 - protein, 6 aa, Mycobacterium
GEPVPA

SEQ ID NO: 1102353 - protein, 4 aa, Mycobacterium
GEQL

SEQ ID NO: 1102354 - protein, 7 aa, Mycobacterium
GEQPPAI

SEQ ID NO: 1102355 - protein, 9 aa, Mycobacterium
GEQVDGRSD

SEQ ID NO: 1102356 - protein, 8 aa, Mycobacterium
GERAATDG

SEQ ID NO: 1102357 - protein, 17 aa, Mycobacterium
GERAATDGTIRSGQTSL

SEQ ID NO: 1102358 - protein, 4 aa, Mycobacterium
GERI

SEQ ID NO: 1102359 - protein, 6 aa, Mycobacterium
GERIAT

SEQ ID NO: 1102360 - protein, 6 aa, Mycobacterium
GEYSPE

SEQ ID NO: 1102361 - protein, 7 aa, Mycobacterium
GFDSPGM

SEQ ID NO: 1102362 - protein, 5 aa, Mycobacterium
GFRDS

SEQ ID NO: 1102363 - protein, 7 aa, Mycobacterium
GGAAVEE

SEQ ID NO: 1102364 - protein, 75 aa, Mycobacterium
GGADSDEESTVAPTPSSTVAPSPSPSRTSEPPPPPPPPPPPPPPPPSAEAPVNTGPTWRPTQRPSQTKKPEIGVT

SEQ ID NO: 1102365 - protein, 8 aa, Mycobacterium
GGANPLGS

SEQ ID NO: 1102366 - protein, 25 aa, Mycobacterium
GGAPADPPVPADAVTASGSGLDPHI

SEQ ID NO: 1102367 - protein, 8 aa, Mycobacterium
GGASLSEA

SEQ ID NO: 1102368 - protein, 32 aa, Mycobacterium
GGCNPHTPTGAATEAAQNTGLSSTTPPSDKRA

SEQ ID NO: 1102369 - protein, 6 aa, Mycobacterium
GGDGVE

SEQ ID NO: 1102370 - protein, 12 aa, Mycobacterium
GGDKAPAPKVTK

SEQ ID NO: 1102371 - protein, 9 aa, Mycobacterium
GGDRPGSAD

SEQ ID NO: 1102372 - protein, 10 aa, Mycobacterium
GGEEPESSPL

SEQ ID NO: 1102373 - protein, 22 aa, Mycobacterium
GGESSSQSPVSVPTDAESAKVN

SEQ ID NO: 1102374 - protein, 6 aa, Mycobacterium
GGFDGD

SEQ ID NO: 1102375 - protein, 4 aa, Mycobacterium
GGGA

SEQ ID NO: 1102376 - protein, 13 aa, Mycobacterium
GGGGHRDRTRTHL

SEQ ID NO: 1102377 - protein, 10 aa, Mycobacterium
GGGGLRGRHS

SEQ ID NO: 1102378 - protein, 13 aa, Mycobacterium
GGGHGSSGPPIEL

SEQ ID NO: 1102379 - protein, 20 aa, Mycobacterium
GGGSAGVNGAVNKATNSDAF

SEQ ID NO: 1102380 - protein, 8 aa, Mycobacterium
GGLQAGAP

SEQ ID NO: 1102381 - protein, 9 aa, Mycobacterium
GGPDAGTTV

SEQ ID NO: 1102382 - protein, 9 aa, Mycobacterium
GGPFTEAGA

SEQ ID NO: 1102383 - protein, 6 aa, Mycobacterium
GGPGPV

SEQ ID NO: 1102384 - protein, 5 aa, Mycobacterium
GGPIR

SEQ ID NO: 1102385 - protein, 10 aa, Mycobacterium
GGPRSGKSTA

SEQ ID NO: 1102386 - protein, 6 aa, Mycobacterium
GGREFG

SEQ ID NO: 1102387 - protein, 15 aa, Mycobacterium
GGRNGHGDGNGSTVR

SEQ ID NO: 1102388 - protein, 10 aa, Mycobacterium
GGSALAAGNS

SEQ ID NO: 1102389 - protein, 10 aa, Mycobacterium
GGSALAARNS

SEQ ID NO: 1102390 - protein, 31 aa, Mycobacterium
GGSGAETKNADKQSVAEAAPTPLPGENPEVK

SEQ ID NO: 1102391 - protein, 18 aa, Mycobacterium
GGSLTGPSRGVDQGAGTV

SEQ ID NO: 1102392 - protein, 5 aa, Mycobacterium
GGTTF

SEQ ID NO: 1102393 - protein, 6 aa, Mycobacterium
GGVGRA

SEQ ID NO: 1102394 - protein, 4 aa, Mycobacterium
GGVI

SEQ ID NO: 1102395 - protein, 10 aa, Mycobacterium
GGVPADEGGK

SEQ ID NO: 1102396 - protein, 7 aa, Mycobacterium
GGVPGVS

SEQ ID NO: 1102397 - protein, 8 aa, Mycobacterium
GGWDDPAS

SEQ ID NO: 1102398 - protein, 9 aa, Mycobacterium
GHADERKER

SEQ ID NO: 1102399 - protein, 5 aa, Mycobacterium
GHELR

SEQ ID NO: 1102400 - protein, 14 aa, Mycobacterium
GHGHSHGADGGGFS

SEQ ID NO: 1102401 - protein, 6 aa, Mycobacterium
GHGPHR

SEQ ID NO: 1102402 - protein, 67 aa, Mycobacterium
GHHSPTSADGGHHRTAPENGHSDHHGTGAGDAPADHHGTSAEPAEGDQHGTSAEHAHNPDSTHESAV

SEQ ID NO: 1102403 - protein, 8 aa, Mycobacterium
GHKKDSLE

SEQ ID NO: 1102404 - protein, 14 aa, Mycobacterium
GIAGGQPSTTRVNG

SEQ ID NO: 1102405 - protein, 26 aa, Mycobacterium
GINDERGDKLKDDIKGCDSDKGGAMH

SEQ ID NO: 1102406 - protein, 7 aa, Mycobacterium
GITPAGV

SEQ ID NO: 1102407 - protein, 7 aa, Mycobacterium
GKEDNPE

SEQ ID NO: 1102408 - protein, 8 aa, Mycobacterium
GKGAPTQG

SEQ ID NO: 1102409 - protein, 19 aa, Mycobacterium
GKPEATDDEVRAAAQAVGA

SEQ ID NO: 1102410 - protein, 4 aa, Mycobacterium
GKSI

SEQ ID NO: 1102411 - protein, 11 aa, Mycobacterium
GKTSDDDMAGY

SEQ ID NO: 1102412 - protein, 25 aa, Mycobacterium
GKVEPTTGAAEPPDVPVDPAPRPRR

SEQ ID NO: 1102413 - protein, 7 aa, Mycobacterium
GLAGNRP

SEQ ID NO: 1102414 - protein, 4 aa, Mycobacterium
GLGA

SEQ ID NO: 1102415 - protein, 15 aa, Mycobacterium
GLPAPQTVYAVEIPR

SEQ ID NO: 1102416 - protein, 5 aa, Mycobacterium
GLPAT

SEQ ID NO: 1102417 - protein, 10 aa, Mycobacterium
GLPDSGPGSM

SEQ ID NO: 1102418 - protein, 10 aa, Mycobacterium
GLPHSSNEQF

SEQ ID NO: 1102419 - protein, 5 aa, Mycobacterium
GLQPI

SEQ ID NO: 1102420 - protein, 21 aa, Mycobacterium
GLRDQADGSLLEQDGKPLGSS

SEQ ID NO: 1102421 - protein, 15 aa, Mycobacterium
GLSRSQAQERREQFG

SEQ ID NO: 1102422 - protein, 9 aa, Mycobacterium
GLSTSAAGT

SEQ ID NO: 1102423 - protein, 15 aa, Mycobacterium
GLTSCPDDSPTCRPK

SEQ ID NO: 1102424 - protein, 4 aa, Mycobacterium
GLTT

SEQ ID NO: 1102425 - protein, 6 aa, Mycobacterium
GMESDD

SEQ ID NO: 1102426 - protein, 8 aa, Mycobacterium
GNATGTSA

SEQ ID NO: 1102427 - protein, 6 aa, Mycobacterium
GNAVEY

SEQ ID NO: 1102428 - protein, 25 aa, Mycobacterium
GNIGENNCDSNPLTDPNRPDDPRNW

SEQ ID NO: 1102429 - protein, 12 aa, Mycobacterium
GNNVGELDKPRF

SEQ ID NO: 1102430 - protein, 6 aa, Mycobacterium
GNSVGK

SEQ ID NO: 1102431 - protein, 5 aa, Mycobacterium
GNTGE

SEQ ID NO: 1102432 - protein, 7 aa, Mycobacterium
GNVGAKE

SEQ ID NO: 1102433 - protein, 7 aa, Mycobacterium
GPAPTLD

SEQ ID NO: 1102434 - protein, 5 aa, Mycobacterium
GPDVE

SEQ ID NO: 1102435 - protein, 10 aa, Mycobacterium
GPEPDGPRRG

SEQ ID NO: 1102436 - protein, 4 aa, Mycobacterium
GPGA

SEQ ID NO: 1102437 - protein, 6 aa, Mycobacterium
GPGAGV

SEQ ID NO: 1102438 - protein, 5 aa, Mycobacterium
GPGEL

SEQ ID NO: 1102439 - protein, 19 aa, Mycobacterium
GPGQQPSPTTTPAVPTTPQ

SEQ ID NO: 1102440 - protein, 5 aa, Mycobacterium
GPGSW

SEQ ID NO: 1102441 - protein, 18 aa, Mycobacterium
GPLGGTDPRGFSPDGVPD

SEQ ID NO: 1102442 - protein, 5 aa, Mycobacterium
GPLNT

SEQ ID NO: 1102443 - protein, 7 aa, Mycobacterium
GPLPVRQ

SEQ ID NO: 1102444 - protein, 5 aa, Mycobacterium
GPPDQ

SEQ ID NO: 1102445 - protein, 8 aa, Mycobacterium
GPPGIGKS

SEQ ID NO: 1102446 - protein, 47 aa, Mycobacterium
GPPTTVPVGPPPPVGQPVPAPAPAPGVPLPPQPVAPGVPVPPGPPPP

SEQ ID NO: 1102447 - protein, 33 aa, Mycobacterium; identical to SEQ ID NO: 240601

SEQ ID NO: 1102448 - protein, 10 aa, Mycobacterium
GPQPSWAKPA

SEQ ID NO: 1102449 - protein, 16 aa, Mycobacterium
GPQRSTPPSATKLNSP

SEQ ID NO: 1102450 - protein, 18 aa, Mycobacterium
GPRHTGAHPPGPGPARAE

SEQ ID NO: 1102451 - protein, 5 aa, Mycobacterium
GPRKG

SEQ ID NO: 1102452 - protein, 5 aa, Mycobacterium
GPRRE

SEQ ID NO: 1102453 - protein, 17 aa, Mycobacterium
GPSAGLGIKPDKQRGAA

SEQ ID NO: 1102454 - protein, 15 aa, Mycobacterium
GPSTQSTSGTAGARC

SEQ ID NO: 1102455 - protein, 6 aa, Mycobacterium
GPTRYN

SEQ ID NO: 1102456 - protein, 5 aa, Mycobacterium
GPVNK

SEQ ID NO: 1102457 - protein, 5 aa, Mycobacterium
GQGGA

SEQ ID NO: 1102458 - protein, 5 aa, Mycobacterium
GQPWT

SEQ ID NO: 1102459 - protein, 10 aa, Mycobacterium
GQQPDSATKE

SEQ ID NO: 1102460 - protein, 15 aa, Mycobacterium
GQRAAQAEETLRNTG

SEQ ID NO: 1102461 - protein, 4 aa, Mycobacterium
GQTT

SEQ ID NO: 1102462 - protein, 6 aa, Mycobacterium
GRDRPV

SEQ ID NO: 1102463 - protein, 8 aa, Mycobacterium
GRGETDDG

SEQ ID NO: 1102464 - protein, 14 aa, Mycobacterium
GRGLSGAGATLTTR

SEQ ID NO: 1102465 - protein, 9 aa, Mycobacterium
GRIGKRTRG

SEQ ID NO: 1102466 - protein, 14 aa, Mycobacterium
GRLQPQQPTVDVAT

SEQ ID NO: 1102467 - protein, 10 aa, Mycobacterium
GRPDATEDEV

SEQ ID NO: 1102468 - protein, 10 aa, Mycobacterium
GRPEPTPKSV

SEQ ID NO: 1102469 - protein, 46 aa, Mycobacterium
GRPPYAGADSLQRHPADSGALDAERAGDTGDVEPDPWRDPNAPVAL

SEQ ID NO: 1102470 - protein, 24 aa, Mycobacterium
GRPSAAGDGYDPLSSGATNLGPED

SEQ ID NO: 1102471 - protein, 6 aa, Mycobacterium
GRPTDH

SEQ ID NO: 1102472 - protein, 11 aa, Mycobacterium
GRQVDASTPWH

SEQ ID NO: 1102473 - protein, 39 aa, Mycobacterium
GRRQPGDESDPVGRRQPGDESDPGGRRGAEPVARPEADP

SEQ ID NO: 1102474 - protein, 150 aa, Mycobacterium
GRSAPAPAASISRPDQPRPAGAFPYSDGRSARPVRRSRGPATGRYDPPVRGTPVHGAGAERWRGPAVSDDSAGDSAAAPDSASTTRISRPAADTHTRPAAETHSRPAADDFQPDVPETPSAPADRSATAEMPTSGRPPADYGGDPTRESL

SEQ ID NO: 1102475 - protein, 15 aa, Mycobacterium
GRTRQDGTVPAPRVR

SEQ ID NO: 1102476 - protein, 13 aa, Mycobacterium
GRTRRGTAGRREI

SEQ ID NO: 1102477 - protein, 19 aa, Mycobacterium
GSDTHSHDTHGHDGHGGDH

SEQ ID NO: 1102478 - protein, 7 aa, Mycobacterium
GSGKSTL

SEQ ID NO: 1102479 - protein, 12 aa, Mycobacterium
GSGLTAAQPPRF

SEQ ID NO: 1102480 - protein, 9 aa, Mycobacterium
GSIEAPAGA

SEQ ID NO: 1102481 - protein, 5 aa, Mycobacterium
GSLDD

SEQ ID NO: 1102482 - protein, 19 aa, Mycobacterium
GSLSGGGFRDPESDSARAS

SEQ ID NO: 1102483 - protein, 4 aa, Mycobacterium
GSPA

SEQ ID NO: 1102484 - protein, 10 aa, Mycobacterium
GSPLDGDRDP

SEQ ID NO: 1102485 - protein, 6 aa, Mycobacterium
GSRPRP

SEQ ID NO: 1102486 - protein, 6 aa, Mycobacterium
GSRTEM

SEQ ID NO: 1102487 - protein, 4 aa, Mycobacterium
GSTG

SEQ ID NO: 1102488 - protein, 7 aa, Mycobacterium
GSTGGVV

SEQ ID NO: 1102489 - protein, 6 aa, Mycobacterium
GSTQLE

SEQ ID NO: 1102490 - protein, 4 aa, Mycobacterium
GSVE

SEQ ID NO: 1102491 - protein, 5 aa, Mycobacterium
GSVRE

SEQ ID NO: 1102492 - protein, 5 aa, Mycobacterium
GTAGM

SEQ ID NO: 1102493 - protein, 14 aa, Mycobacterium
GTAPPTTEDEEVPS

SEQ ID NO: 1102494 - protein, 18 aa, Mycobacterium
GTDPGPVRPTATGTRSSG

SEQ ID NO: 1102495 - protein, 6 aa, Mycobacterium
GTDPSV

SEQ ID NO: 1102496 - protein, 7 aa, Mycobacterium
GTDTTAT

SEQ ID NO: 1102497 - protein, 8 aa, Mycobacterium
GTERGHPS

SEQ ID NO: 1102498 - protein, 19 aa, Mycobacterium
GTGNDAETDGVDDTRGQTA

SEQ ID NO: 1102499 - protein, 24 aa, Mycobacterium
GTGTHNVTTDTQYRENAANRYIDP

SEQ ID NO: 1102500 - protein, 8 aa, Mycobacterium
GTHDDEAI

SEQ ID NO: 1102501 - protein, 7 aa, Mycobacterium
GTHRRST

SEQ ID NO: 1102502 - protein, 12 aa, Mycobacterium
GTMGYSKNGTRS

SEQ ID NO: 1102503 - protein, 8 aa, Mycobacterium
GTNQDIPA

SEQ ID NO: 1102504 - protein, 10 aa, Mycobacterium
GTPADTGTAQ

SEQ ID NO: 1102505 - protein, 93 aa, Mycobacterium
GTPLPPGAVPAGTPPVAPPPGAPAPATTPVPAGPPAPAAAPAAVAPPPPPGNSINGTPLPPVPPAAAEVPPSGGAVPAAPSAFGGNGTGGPSL

SEQ ID NO: 1102506 - protein, 21 aa, Mycobacterium
GTRLQPGIKGRGTVQLPDGSF

SEQ ID NO: 1102507 - protein, 11 aa, Mycobacterium
GTSPTAGENVP

SEQ ID NO: 1102508 - protein, 5 aa, Mycobacterium
GTSYA

SEQ ID NO: 1102509 - protein, 10 aa, Mycobacterium
GTTEPALRGE

SEQ ID NO: 1102510 - protein, 8 aa, Mycobacterium
GTTIAGSA

SEQ ID NO: 1102511 - protein, 4 aa, Mycobacterium
GTVR

SEQ ID NO: 1102512 - protein, 10 aa, Mycobacterium
GVAPDSASPG

SEQ ID NO: 1102513 - protein, 32 aa, Mycobacterium
GVDEERSAAVASRPSEEGAGAVGEPEAAHTEH

SEQ ID NO: 1102514 - protein, 22 aa, Mycobacterium
GVGTPPPPQDGDGNSQAARTDA

SEQ ID NO: 1102515 - protein, 12 aa, Mycobacterium
GVHPFDGARTDT

SEQ ID NO: 1102516 - protein, 4 aa, Mycobacterium
GVND

SEQ ID NO: 1102517 - protein, 10 aa, Mycobacterium
GVNDAPAMAG

SEQ ID NO: 1102518 - protein, 10 aa, Mycobacterium
GVPCTSEDGC

SEQ ID NO: 1102519 - protein, 23 aa, Mycobacterium
GVPQAPPPRPTQTSTLVPTPSET

SEQ ID NO: 1102520 - protein, 24 aa, Mycobacterium
GVTPQPRLPNLNPGGDYIDPPANG

SEQ ID NO: 1102521 - protein, 12 aa, Mycobacterium
GVTTSSPRSTTH

SEQ ID NO: 1102522 - protein, 11 aa, Mycobacterium
GWTPVDDQAGA

SEQ ID NO: 1102523 - protein, 6 aa, Mycobacterium
GYATDG

SEQ ID NO: 1102524 - protein, 6 aa, Mycobacterium
GYDAEG

SEQ ID NO: 1102525 - protein, 5 aa, Mycobacterium
GYETR

SEQ ID NO: 1102526 - protein, 7 aa, Mycobacterium
GYNPKDG

SEQ ID NO: 1102527 - protein, 5 aa, Mycobacterium
GYRRT

SEQ ID NO: 1102528 - protein, 5 aa, Mycobacterium
HADKP

SEQ ID NO: 1102529 - protein, 6 aa, Mycobacterium
HAGTGT

SEQ ID NO: 1102530 - protein, 7 aa, Mycobacterium
HARGGDL

SEQ ID NO: 1102531 - protein, 7 aa, Mycobacterium
HASRHPR

SEQ ID NO: 1102532 - protein, 6 aa, Mycobacterium
HASSSQ

SEQ ID NO: 1102533 - protein, 9 aa, Mycobacterium
HDAFEGGPR

SEQ ID NO: 1102534 - protein, 9 aa, Mycobacterium
HDRADGTRD

SEQ ID NO: 1102535 - protein, 14 aa, Mycobacterium
HEESAQLAENEAAA

SEQ ID NO: 1102536 - protein, 4 aa, Mycobacterium
HEET

SEQ ID NO: 1102537 - protein, 7 aa, Mycobacterium
HEHHGGK

SEQ ID NO: 1102538 - protein, 9 aa, Mycobacterium
HELPNTPGV

SEQ ID NO: 1102539 - protein, 12 aa, Mycobacterium
HELPSRPPRRPL

SEQ ID NO: 1102540 - protein, 6 aa, Mycobacterium
HEPPPH

SEQ ID NO: 1102541 - protein, 27 aa, Mycobacterium
HEPQTSYIEPPAVEDGAQTSYIPRPRP

SEQ ID NO: 1102542 - protein, 12 aa, Mycobacterium
HERDGADHQHGH

SEQ ID NO: 1102543 - protein, 4 aa, Mycobacterium
HFPP

SEQ ID NO: 1102544 - protein, 5 aa, Mycobacterium
HGAAQ

SEQ ID NO: 1102545 - protein, 5 aa, Mycobacterium
HGAGA

SEQ ID NO: 1102546 - protein, 7 aa, Mycobacterium
HGAPSRI

SEQ ID NO: 1102547 - protein, 9 aa, Mycobacterium
HGATDPSGV

SEQ ID NO: 1102548 - protein, 9 aa, Mycobacterium
HGTETTVAP

SEQ ID NO: 1102549 - protein, 9 aa, Mycobacterium
HGTGADVTR

SEQ ID NO: 1102550 - protein, 12 aa, Mycobacterium
HHHGGSAPPMPT

SEQ ID NO: 1102551 - protein, 8 aa, Mycobacterium
HHRSSGGH

SEQ ID NO: 1102552 - protein, 8 aa, Mycobacterium
HIDGRADQ

SEQ ID NO: 1102553 - protein, 12 aa, Mycobacterium
HIPDGKSVKGTG

SEQ ID NO: 1102554 - protein, 6 aa, Mycobacterium
HKMTQD

SEQ ID NO: 1102555 - protein, 10 aa, Mycobacterium
HNAARSPSNL

SEQ ID NO: 1102556 - protein, 39 aa, Mycobacterium
HNHDPEPTSSPPAVRPVEAPAPGAGSGGAPEQATPVPIS

SEQ ID NO: 1102557 - protein, 39 aa, Mycobacterium
HPASVSTGTVAASARTISAPAGITATGVAPPRPTPAGVV

SEQ ID NO: 1102558 - protein, 4 aa, Mycobacterium
HPEP

SEQ ID NO: 1102559 - protein, 6 aa, Mycobacterium
HPGKTA

SEQ ID NO: 1102560 - protein, 7 aa, Mycobacterium
HPGKTAP

SEQ ID NO: 1102561 - protein, 9 aa, Mycobacterium
HPPTSGSVD

SEQ ID NO: 1102562 - protein, 11 aa, Mycobacterium
HPRSVGDELTS

SEQ ID NO: 1102563 - protein, 4 aa, Mycobacterium
HPSS

SEQ ID NO: 1102564 - protein, 5 aa, Mycobacterium
HPSSA

SEQ ID NO: 1102565 - protein, 13 aa, Mycobacterium
HQGSAGRPPQTTA

SEQ ID NO: 1102566 - protein, 5 aa, Mycobacterium
HQPGE

SEQ ID NO: 1102567 - protein, 4 aa, Mycobacterium
HRAA

SEQ ID NO: 1102568 - protein, 5 aa, Mycobacterium
HRAAA

SEQ ID NO: 1102569 - protein, 19 aa, Mycobacterium
HRRRPPRRAPARPAPGPQL

SEQ ID NO: 1102570 - protein, 6 aa, Mycobacterium
HSDDAA

SEQ ID NO: 1102571 - protein, 11 aa, Mycobacterium
HSTEGHERAPV

SEQ ID NO: 1102572 - protein, 10 aa, Mycobacterium
HTPAPRQARR

SEQ ID NO: 1102573 - protein, 8 aa, Mycobacterium
HTPARGRV

SEQ ID NO: 1102574 - protein, 9 aa, Mycobacterium
HTQANLAEG

SEQ ID NO: 1102575 - protein, 16 aa, Mycobacterium
HTTRHDPRIRGDESLR

SEQ ID NO: 1102576 - protein, 35 aa, Mycobacterium
HVGGQRSATRRTGQDQQGRRGQQGRRARPREGQRY

SEQ ID NO: 1102577 - protein, 16 aa, Mycobacterium
HVRSKGAPTARADRCD

SEQ ID NO: 1102578 - protein, 5 aa, Mycobacterium
HWDSP

SEQ ID NO: 1102579 - protein, 13 aa, Mycobacterium
HYPDRATGESTAS

SEQ ID NO: 1102580 - protein, 6 aa, Mycobacterium
IAAAGA

SEQ ID NO: 1102581 - protein, 8 aa, Mycobacterium
IAGGGRTV

SEQ ID NO: 1102582 - protein, 9 aa, Mycobacterium
IAKRVGESL

SEQ ID NO: 1102583 - protein, 15 aa, Mycobacterium
IAPDGTRTEEERPEG

SEQ ID NO: 1102584 - protein, 4 aa, Mycobacterium
IAPE

SEQ ID NO: 1102585 - protein, 7 aa, Mycobacterium
IARRAKR

SEQ ID NO: 1102586 - protein, 17 aa, Mycobacterium
IASPKGRHSVSTEESNH

SEQ ID NO: 1102587 - protein, 5 aa, Mycobacterium
IATRT

SEQ ID NO: 1102588 - protein, 8 aa, Mycobacterium
ICSPSQPA

SEQ ID NO: 1102589 - protein, 11 aa, Mycobacterium
IDGNNQPSQPY

SEQ ID NO: 1102590 - protein, 7 aa, Mycobacterium
IDGRADQ

SEQ ID NO: 1102591 - protein, 12 aa, Mycobacterium
IDPKAQRAAEEA

SEQ ID NO: 1102592 - protein, 10 aa, Mycobacterium
IDPPGDRGEW

SEQ ID NO: 1102593 - protein, 6 aa, Mycobacterium
IEGPPR

SEQ ID NO: 1102594 - protein, 18 aa, Mycobacterium
IEGVAGPEAANNASAAGT

SEQ ID NO: 1102595 - protein, 11 aa, Mycobacterium
IESAEPSVDEN

SEQ ID NO: 1102596 - protein, 6 aa, Mycobacterium
IGADTQ

SEQ ID NO: 1102597 - protein, 8 aa, Mycobacterium
IGAGTTAQ

SEQ ID NO: 1102598 - protein, 5 aa, Mycobacterium
IGPER

SEQ ID NO: 1102599 - protein, 8 aa, Mycobacterium
IGQNSLPQ

SEQ ID NO: 1102600 - protein, 17 aa, Mycobacterium
IGSEDTAAPPAQDSADS

SEQ ID NO: 1102601 - protein, 6 aa, Mycobacterium
IGSRTS

SEQ ID NO: 1102602 - protein, 5 aa, Mycobacterium
IIPGN

SEQ ID NO: 1102603 - protein, 18 aa, Mycobacterium
IKPTQTRSPGDAPNPVAT

SEQ ID NO: 1102604 - protein, 6 aa, Mycobacterium
INAEGA

SEQ ID NO: 1102605 - protein, 7 aa, Mycobacterium
INGPAGS

SEQ ID NO: 1102606 - protein, 6 aa, Mycobacterium
INGTGA

SEQ ID NO: 1102607 - protein, 6 aa, Mycobacterium
INNPQG

SEQ ID NO: 1102608 - protein, 8 aa, Mycobacterium
INPNRADD

SEQ ID NO: 1102609 - protein, 8 aa, Mycobacterium
IPADTDTA

SEQ ID NO: 1102610 - protein, 13 aa, Mycobacterium
IPAGTETEDAAAG

SEQ ID NO: 1102611 - protein, 37 aa, Mycobacterium
IPAPSINNGMNPLPADQLPQPPSPVSDPLSPPGQGRV

SEQ ID NO: 1102612 - protein, 7 aa, Mycobacterium
IPDNTQY

SEQ ID NO: 1102613 - protein, 5 aa, Mycobacterium
IPGGA

SEQ ID NO: 1102614 - protein, 8 aa, Mycobacterium
IPKAANSQ

SEQ ID NO: 1102615 - protein, 7 aa, Mycobacterium
IPNAPSR

SEQ ID NO: 1102616 - protein, 8 aa, Mycobacterium
IPNDPAPY

SEQ ID NO: 1102617 - protein, 6 aa, Mycobacterium
IPPAAT

SEQ ID NO: 1102618 - protein, 6 aa, Mycobacterium
IPPGDP

SEQ ID NO: 1102619 - protein, 7 aa, Mycobacterium
IPPGQSG

SEQ ID NO: 1102620 - protein, 12 aa, Mycobacterium
IPRTPSGKADLG

SEQ ID NO: 1102621 - protein, 17 aa, Mycobacterium
IPVDGTVEDGHSEVDES

SEQ ID NO: 1102622 - protein, 10 aa, Mycobacterium
IQGSPGAQPV

SEQ ID NO: 1102623 - protein, 8 aa, Mycobacterium
IRNAESSA

SEQ ID NO: 1102624 - protein, 6 aa, Mycobacterium
IRSRKP

SEQ ID NO: 1102625 - protein, 10 aa, Mycobacterium
ISGSPETDVD

SEQ ID NO: 1102626 - protein, 4 aa, Mycobacterium
ISTE

SEQ ID NO: 1102627 - protein, 37 aa, Mycobacterium
ISTRPEVGADDSVTTPLATRGRRAEAAAEPSGADDPW

SEQ ID NO: 1102628 - protein, 12 aa, Mycobacterium
ITAAGAQSVDGK

SEQ ID NO: 1102629 - protein, 17 aa, Mycobacterium
ITDTANTARPNTSLADA

SEQ ID NO: 1102630 - protein, 13 aa, Mycobacterium
ITGESVPVEAEPG

SEQ ID NO: 1102631 - protein, 7 aa, Mycobacterium
ITKAADT

SEQ ID NO: 1102632 - protein, 18 aa, Mycobacterium
ITNTANTARPNTSLSDAT

SEQ ID NO: 1102633 - protein, 16 aa, Mycobacterium
ITPPVTAASDCRGSAG

SEQ ID NO: 1102634 - protein, 7 aa, Mycobacterium
ITPVTEG

SEQ ID NO: 1102635 - protein, 5 aa, Mycobacterium
ITRGR

SEQ ID NO: 1102636 - protein, 25 aa, Mycobacterium
IVPPPQQAPPPTPTPTAAIAPPPVL

SEQ ID NO: 1102637 - protein, 10 aa, Mycobacterium
KAGPTAETRP

SEQ ID NO: 1102638 - protein, 15 aa, Mycobacterium
KANLEAARSSALQAK

SEQ ID NO: 1102639 - protein, 38 aa, Mycobacterium
KAPAAGAATSRPYATNSAELNRPYTPGESAAEQKEAAE

SEQ ID NO: 1102640 - protein, 6 aa, Mycobacterium
KARRGM

SEQ ID NO: 1102641 - protein, 7 aa, Mycobacterium
KATEEQL

SEQ ID NO: 1102642 - protein, 7 aa, Mycobacterium
KAVNDTR

SEQ ID NO: 1102643 - protein, 8 aa, Mycobacterium
KDADFSNL

SEQ ID NO: 1102644 - protein, 11 aa, Mycobacterium
KDDLPQSTTDN

SEQ ID NO: 1102645 - protein, 7 aa, Mycobacterium
KDEASSV

SEQ ID NO: 1102646 - protein, 7 aa, Mycobacterium
KDPAHRF

SEQ ID NO: 1102647 - protein, 8 aa, Mycobacterium
KDPSNSAA

SEQ ID NO: 1102648 - protein, 13 aa, Mycobacterium
KDSQLPPSGSVPP

SEQ ID NO: 1102649 - protein, 7 aa, Mycobacterium
KEKRSDL

SEQ ID NO: 1102650 - protein, 5 aa, Mycobacterium
KFTGD

SEQ ID NO: 1102651 - protein, 5 aa, Mycobacterium
KGHAL

SEQ ID NO: 1102652 - protein, 7 aa, Mycobacterium
KGIENGA

SEQ ID NO: 1102653 - protein, 7 aa, Mycobacterium
KGRDTGL

SEQ ID NO: 1102654 - protein, 30 aa, Mycobacterium
KGTGGTSRYAAPSARRATATKQEDKGEPMS

SEQ ID NO: 1102655 - protein, 7 aa, Mycobacterium
KHNADGS

SEQ ID NO: 1102656 - protein, 5 aa, Mycobacterium
KIDGV

SEQ ID NO: 1102657 - protein, 19 aa, Mycobacterium
KIPVDGTVAEGTSDVDESM

SEQ ID NO: 1102658 - protein, 8 aa, Mycobacterium
KKKVGTQL

SEQ ID NO: 1102659 - protein, 21 aa, Mycobacterium
KKRGEAPAKKKKAARDPEDSA

SEQ ID NO: 1102660 - protein, 7 aa, Mycobacterium
KLGQSDW

SEQ ID NO: 1102661 - protein, 12 aa, Mycobacterium
KLGTPTAAPVAA

SEQ ID NO: 1102662 - protein, 10 aa, Mycobacterium
KLPDAARSLG

SEQ ID NO: 1102663 - protein, 10 aa, Mycobacterium
KLPDRNAVSG

SEQ ID NO: 1102664 - protein, 12 aa, Mycobacterium
KLTDGADQLAGG

SEQ ID NO: 1102665 - protein, 18 aa, Mycobacterium
KLVDDKGAVNEAAVTKSN

SEQ ID NO: 1102666 - protein, 44 aa, Mycobacterium
KNADVAAGSAVTGKVKNGQYWTGSPAAKSGKARHPWPGHRPPRA

SEQ ID NO: 1102667 - protein, 4 aa, Mycobacterium
KNQG

SEQ ID NO: 1102668 - protein, 6 aa, Mycobacterium
KPAPAI

SEQ ID NO: 1102669 - protein, 7 aa, Mycobacterium
KPATPAL

SEQ ID NO: 1102670 - protein, 8 aa, Mycobacterium
KPEEPSLV

SEQ ID NO: 1102671 - protein, 11 aa, Mycobacterium
KPLPPAPQQFG

SEQ ID NO: 1102672 - protein, 4 aa, Mycobacterium
KPRE

SEQ ID NO: 1102673 - protein, 5 aa, Mycobacterium
KPVTN

SEQ ID NO: 1102674 - protein, 8 aa, Mycobacterium
KQGKVADD

SEQ ID NO: 1102675 - protein, 16 aa, Mycobacterium
KQMSYNDSRAEGTQAA

SEQ ID NO: 1102676 - protein, 6 aa, Mycobacterium
KRAATI

SEQ ID NO: 1102677 - protein, 14 aa, Mycobacterium
KRGIGEPKSDRTRR

SEQ ID NO: 1102678 - protein, 12 aa, Mycobacterium
KRGSVGRASGGA

SEQ ID NO: 1102679 - protein, 13 aa, Mycobacterium
KRNGLDTRRAGRA

SEQ ID NO: 1102680 - protein, 6 aa, Mycobacterium
KRPPQL

SEQ ID NO: 1102681 - protein, 8 aa, Mycobacterium
KRPPSAVN

SEQ ID NO: 1102682 - protein, 4 aa, Mycobacterium
KSAG

SEQ ID NO: 1102683 - protein, 110 aa, Mycobacterium
KSGVTLPEKGTAAKEAEERAAVRAEETAAAAPAPEKAPEKEPEAPAEAPAAKASTATESKPAAAAPAKGLGIAGGAKRPGAKKTATEKTAAAPAEAKAEAPAAAPAKGLG

SEQ ID NO: 1102684 - protein, 5 aa, Mycobacterium
KSMGN

SEQ ID NO: 1102685 - protein, 5 aa, Mycobacterium
KSQGD

SEQ ID NO: 1102686 - protein, 8 aa, Mycobacterium
KSTAGKPL

SEQ ID NO: 1102687 - protein, 4 aa, Mycobacterium
KSVE

SEQ ID NO: 1102688 - protein, 9 aa, Mycobacterium
KSVGEGVTN

SEQ ID NO: 1102689 - protein, 22 aa, Mycobacterium
KTDTATPVDRSGGYTASSGITF

SEQ ID NO: 1102690 - protein, 6 aa, Mycobacterium
KTEDLS

SEQ ID NO: 1102691 - protein, 11 aa, Mycobacterium
KTIETGETGHR

SEQ ID NO: 1102692 - protein, 6 aa, Mycobacterium
KTLDPE

SEQ ID NO: 1102693 - protein, 7 aa, Mycobacterium
KTSRGRG

SEQ ID NO: 1102694 - protein, 5 aa, Mycobacterium
KVDTT

SEQ ID NO: 1102695 - protein, 5 aa, Mycobacterium
KWNNS

SEQ ID NO: 1102696 - protein, 5 aa, Mycobacterium
KYPSP

SEQ ID NO: 1102697 - protein, 8 aa, Mycobacterium
LADSPLAD

SEQ ID NO: 1102698 - protein, 12 aa, Mycobacterium
LAGENHSEAPDF

SEQ ID NO: 1102699 - protein, 11 aa, Mycobacterium
LANAATTVSTV

SEQ ID NO: 1102700 - protein, 7 aa, Mycobacterium
LAPPERV

SEQ ID NO: 1102701 - protein, 4 aa, Mycobacterium
LAPS

SEQ ID NO: 1102702 - protein, 18 aa, Mycobacterium
LAQDARKLAGDPGTPLDP

SEQ ID NO: 1102703 - protein, 10 aa, Mycobacterium
LARSDYDAST

SEQ ID NO: 1102704 - protein, 7 aa, Mycobacterium
LASGPLA

SEQ ID NO: 1102705 - protein, 6 aa, Mycobacterium
LATGTP

SEQ ID NO: 1102706 - protein, 7 aa, Mycobacterium
LDDPATH

SEQ ID NO: 1102707 - protein, 5 aa, Mycobacterium
LDDPI

SEQ ID NO: 1102708 - protein, 4 aa, Mycobacterium
LDDV

SEQ ID NO: 1102709 - protein, 14 aa, Mycobacterium
LDGPPRNTSQIGQP

SEQ ID NO: 1102710 - protein, 76 aa, Mycobacterium
LDPERTKPAASQSNPDEGQSGTPGTGQSGSSIPERTTPSTKPTETSTPTETTESTTSTSPTTSTPTTSTPTTTSTV

SEQ ID NO: 1102711 - protein, 20 aa, Mycobacterium
LEADEGPRIQAEPDDVEEKV

SEQ ID NO: 1102712 - protein, 28 aa, Mycobacterium
LEGDTQGAAQHADSAHSHAQRARDATHS

SEQ ID NO: 1102713 - protein, 31 aa, Mycobacterium
LEGTPPQKPPPPRGPGGGGDGPSGPPPGGHP

SEQ ID NO: 1102714 - protein, 7 aa, Mycobacterium
LERAGKS

SEQ ID NO: 1102715 - protein, 12 aa, Mycobacterium
LERGTELGGQER

SEQ ID NO: 1102716 - protein, 12 aa, Mycobacterium
LERSGRSPWNPK

SEQ ID NO: 1102717 - protein, 6 aa, Mycobacterium
LGARRA

SEQ ID NO: 1102718 - protein, 5 aa, Mycobacterium
LGDPE

SEQ ID NO: 1102719 - protein, 19 aa, Mycobacterium
LGESDIGSHAQAVSGAVPQ

SEQ ID NO: 1102720 - protein, 15 aa, Mycobacterium
LGGGAAGGRGGAGRM

SEQ ID NO: 1102721 - protein, 5 aa, Mycobacterium
LGGSW

SEQ ID NO: 1102722 - protein, 6 aa, Mycobacterium
LGGTPF

SEQ ID NO: 1102723 - protein, 20 aa, Mycobacterium
LGNAPNSGLVNGQPSNQEPL

SEQ ID NO: 1102724 - protein, 6 aa, Mycobacterium
LGPRKG

SEQ ID NO: 1102725 - protein, 10 aa, Mycobacterium
LGQNGPYGQV

SEQ ID NO: 1102726 - protein, 15 aa, Mycobacterium
LGQRTGVGLPGESAG

SEQ ID NO: 1102727 - protein, 13 aa, Mycobacterium
LGSQLQNTEGYQT

SEQ ID NO: 1102728 - protein, 13 aa, Mycobacterium
LHDTGRKSSLASQ

SEQ ID NO: 1102729 - protein, 6 aa, Mycobacterium
LHPDPD

SEQ ID NO: 1102730 - protein, 9 aa, Mycobacterium
LNAQTGSLS

SEQ ID NO: 1102731 - protein, 9 aa, Mycobacterium
LNNKPDAKT

SEQ ID NO: 1102732 - protein, 13 aa, Mycobacterium
LNQDPVKSVPGQP

SEQ ID NO: 1102733 - protein, 9 aa, Mycobacterium
LNTAGGQLG

SEQ ID NO: 1102734 - protein, 5 aa, Mycobacterium
LPAGD

SEQ ID NO: 1102735 - protein, 8 aa, Mycobacterium
LPAGGSDQ

SEQ ID NO: 1102736 - protein, 11 aa, Mycobacterium
LPDLPSKQYGG

SEQ ID NO: 1102737 - protein, 7 aa, Mycobacterium
LPDSAIK

SEQ ID NO: 1102738 - protein, 49 aa, Mycobacterium
LPEPPTETAPPRAPERPVAEPEPAPEPEPTPEPIPEPEPAPEPEPEPAE

SEQ ID NO: 1102739 - protein, 9 aa, Mycobacterium
LPGSPAYTF

SEQ ID NO: 1102740 - protein, 10 aa, Mycobacterium
LPGTEPPTVH

SEQ ID NO: 1102741 - protein, 12 aa, Mycobacterium
LPLPGDGEPKTV

SEQ ID NO: 1102742 - protein, 5 aa, Mycobacterium
LPPGR

SEQ ID NO: 1102743 - protein, 111 aa, Mycobacterium
LPPPPPKPLKPKAQTRRGRRKAQEAAPEDTADSEDTEETTEEAERSESDDPVTESVDTESGDTDAADETEETEAADEEPVASSGGLRNRRPSGKGDSSRRRRRLRGGIAVE

SEQ ID NO: 1102744 - protein, 9 aa, Mycobacterium
LPSTAGPNV

SEQ ID NO: 1102745 - protein, 12 aa, Mycobacterium
LPTNGRAATSPA

SEQ ID NO: 1102746 - protein, 6 aa, Mycobacterium
LPYGPS

SEQ ID NO: 1102747 - protein, 13 aa, Mycobacterium
LQDAQRSGNFAEY

SEQ ID NO: 1102748 - protein, 7 aa, Mycobacterium
LQDEGKK

SEQ ID NO: 1102749 - protein, 13 aa, Mycobacterium
LQNDDATIQRAEN

SEQ ID NO: 1102750 - protein, 17 aa, Mycobacterium
LQNSARAAQDSDSSSGF

SEQ ID NO: 1102751 - protein, 17 aa, Mycobacterium
LQNSSRAAADSDSSSGF

SEQ ID NO: 1102752 - protein, 6 aa, Mycobacterium
LQPDPV

SEQ ID NO: 1102753 - protein, 9 aa, Mycobacterium
LQTGNAPVQ

SEQ ID NO: 1102754 - protein, 9 aa, Mycobacterium
LQTNPTALD

SEQ ID NO: 1102755 - protein, 5 aa, Mycobacterium
LREGQ

SEQ ID NO: 1102756 - protein, 4 aa, Mycobacterium
LRGQ

SEQ ID NO: 1102757 - protein, 7 aa, Mycobacterium
LRPEAAD

SEQ ID NO: 1102758 - protein, 6 aa, Mycobacterium
LRRQGR

SEQ ID NO: 1102759 - protein, 24 aa, Mycobacterium
LRRSRRRSGLDQLGDSSDPRVSKT

SEQ ID NO: 1102760 - protein, 10 aa, Mycobacterium
LRTDAQKAHD

SEQ ID NO: 1102761 - protein, 9 aa, Mycobacterium
LRTPGSTAT

SEQ ID NO: 1102762 - protein, 6 aa, Mycobacterium
LSAPDG

SEQ ID NO: 1102763 - protein, 11 aa, Mycobacterium
LSAPRVRNDES

SEQ ID NO: 1102764 - protein, 8 aa, Mycobacterium
LSDPGPFT

SEQ ID NO: 1102765 - protein, 7 aa, Mycobacterium
LSDSESV

SEQ ID NO: 1102766 - protein, 9 aa, Mycobacterium
LSGLNSAPE

SEQ ID NO: 1102767 - protein, 11 aa, Mycobacterium
LSPDAFGTGPV

SEQ ID NO: 1102768 - protein, 7 aa, Mycobacterium
LSPKQQR

SEQ ID NO: 1102769 - protein, 4 aa, Mycobacterium
LSRD

SEQ ID NO: 1102770 - protein, 22 aa, Mycobacterium
LSRGTAKTDDALTRSDRRDAQR

SEQ ID NO: 1102771 - protein, 10 aa, Mycobacterium
LSTPEDTDDQ

SEQ ID NO: 1102772 - protein, 8 aa, Mycobacterium
LSTTGYGD

SEQ ID NO: 1102773 - protein, 13 aa, Mycobacterium
LSTTISGLNTDTV

SEQ ID NO: 1102774 - protein, 16 aa, Mycobacterium
LTARDDATGLGSTADL

SEQ ID NO: 1102775 - protein, 12 aa, Mycobacterium
LTATAAQGAVTD

SEQ ID NO: 1102776 - protein, 8 aa, Mycobacterium
LTDDDDGV

SEQ ID NO: 1102777 - protein, 5 aa, Mycobacterium
LTDRS

SEQ ID NO: 1102778 - protein, 11 aa, Mycobacterium
LTEEAGRAEAI

SEQ ID NO: 1102779 - protein, 13 aa, Mycobacterium
LTESDMPAPQRHN

SEQ ID NO: 1102780 - protein, 4 aa, Mycobacterium
LTGD

SEQ ID NO: 1102781 - protein, 13 aa, Mycobacterium
LTGSIGEDQKRAE

SEQ ID NO: 1102782 - protein, 10 aa, Mycobacterium
LTPEGQPSGF

SEQ ID NO: 1102783 - protein, 4 aa, Mycobacterium
LTPR

SEQ ID NO: 1102784 - protein, 7 aa, Mycobacterium
LTPSGAL

SEQ ID NO: 1102785 - protein, 4 aa, Mycobacterium
LTPT

SEQ ID NO: 1102786 - protein, 12 aa, Mycobacterium
LTPTSDKKPAPL

SEQ ID NO: 1102787 - protein, 6 aa, Mycobacterium
LTRSQR

SEQ ID NO: 1102788 - protein, 6 aa, Mycobacterium
LTTAGS

SEQ ID NO: 1102789 - protein, 40 aa, Mycobacterium
LTTGTSKKTTARDADTDDKATDEAEPSKPSEQAADADAAT

SEQ ID NO: 1102790 - protein, 19 aa, Mycobacterium
MAAKEAAALDEDRPPEPDL

SEQ ID NO: 1102791 - protein, 12 aa, Mycobacterium
MAAQTGSTPTIE

SEQ ID NO: 1102792 - protein, 8 aa, Mycobacterium
MAGQDTSR

SEQ ID NO: 1102793 - protein, 23 aa, Mycobacterium
MAPSDAALDDAVGSRMRSTSRES

SEQ ID NO: 1102794 - protein, 5 aa, Mycobacterium
MEEPN

SEQ ID NO: 1102795 - protein, 6 aa, Mycobacterium
MGASAT

SEQ ID NO: 1102796 - protein, 22 aa, Mycobacterium
MGPGGAWPGQQTPTTTAPTTPR

SEQ ID NO: 1102797 - protein, 29 aa, Mycobacterium
MGPGGPGGMMGPGGPGGMMGPGSWGPGGM

SEQ ID NO: 1102798 - protein, 7 aa, Mycobacterium
MGTGSDV

SEQ ID NO: 1102799 - protein, 13 aa, Mycobacterium
MGTPKGQAAYRAA

SEQ ID NO: 1102800 - protein, 11 aa, Mycobacterium
MPGADVTQQQL

SEQ ID NO: 1102801 - protein, 10 aa, Mycobacterium
MPGAESSEQM

SEQ ID NO: 1102802 - protein, 4 aa, Mycobacterium
MPYT

SEQ ID NO: 1102803 - protein, 6 aa, Mycobacterium
MQQAGA

SEQ ID NO: 1102804 - protein, 22 aa, Mycobacterium
MRATDVSPSRLAAAQEASKQFA

SEQ ID NO: 1102805 - protein, 9 aa, Mycobacterium
MRTPPAGAL

SEQ ID NO: 1102806 - protein, 8 aa, Mycobacterium
MSGNGQGL

SEQ ID NO: 1102807 - protein, 7 aa, Mycobacterium
MSPRAAA

SEQ ID NO: 1102808 - protein, 11 aa, Mycobacterium
MSSAKAAKPIR

SEQ ID NO: 1102809 - protein, 8 aa, Mycobacterium
MTGGSTGR

SEQ ID NO: 1102810 - protein, 16 aa, Mycobacterium
MTNASSVPAGHGHNYG

SEQ ID NO: 1102811 - protein, 12 aa, Mycobacterium
MTPDPPQRFGSA

SEQ ID NO: 1102812 - protein, 8 aa, Mycobacterium
MTRDPAHR

SEQ ID NO: 1102813 - protein, 10 aa, Mycobacterium
NAAGTSAADV

SEQ ID NO: 1102814 - protein, 7 aa, Mycobacterium
NAMGPEG

SEQ ID NO: 1102815 - protein, 8 aa, Mycobacterium
NANHTEGA

SEQ ID NO: 1102816 - protein, 6 aa, Mycobacterium
NAPTLS

SEQ ID NO: 1102817 - protein, 9 aa, Mycobacterium
NASKATGVL

SEQ ID NO: 1102818 - protein, 8 aa, Mycobacterium
NDATIGAR

SEQ ID NO: 1102819 - protein, 6 aa, Mycobacterium
NDDNTV

SEQ ID NO: 1102820 - protein, 4 aa, Mycobacterium
NDPC

SEQ ID NO: 1102821 - protein, 4 aa, Mycobacterium
NDPQ

SEQ ID NO: 1102822 - protein, 39 aa, Mycobacterium
NDSPSVIAPDSETTNAPSTTPTTTTTTAVPTYPTTTVEG

SEQ ID NO: 1102823 - protein, 12 aa, Mycobacterium
NDTGQPEKARAY

SEQ ID NO: 1102824 - protein, 9 aa, Mycobacterium
NDTTSPPRT

SEQ ID NO: 1102825 - protein, 6 aa, Mycobacterium
NEAAEQ

SEQ ID NO: 1102826 - protein, 11 aa, Mycobacterium
NEARATPAGAH

SEQ ID NO: 1102827 - protein, 7 aa, Mycobacterium
NEHTPIR

SEQ ID NO: 1102828 - protein, 19 aa, Mycobacterium
NEPADEPAPPEETPAPPAV

SEQ ID NO: 1102829 - protein, 10 aa, Mycobacterium
NEPCASTDRP

SEQ ID NO: 1102830 - protein, 5 aa, Mycobacterium
NESDG

SEQ ID NO: 1102831 - protein, 10 aa, Mycobacterium
NETPAPLRDA

SEQ ID NO: 1102832 - protein, 4 aa, Mycobacterium
NGAG

SEQ ID NO: 1102833 - protein, 7 aa, Mycobacterium
NGEPQDD

SEQ ID NO: 1102834 - protein, 5 aa, Mycobacterium
NGGGA

SEQ ID NO: 1102835 - protein, 15 aa, Mycobacterium
NGGILSEQTTLILEG

SEQ ID NO: 1102836 - protein, 14 aa, Mycobacterium
NGGYALGSNSRGAI

SEQ ID NO: 1102837 - protein, 7 aa, Mycobacterium
NGKGGQP

SEQ ID NO: 1102838 - protein, 99 aa, Mycobacterium
NGKRNPGRIEHEADSSSSSGGSGGAGPDGGGDDGGGPSGPVSVGDPAAGAPTGGHAAGPDNTSGNSDPAEAAPRTGSHRDPQPEPAGARSDNSRTKDTL

SEQ ID NO: 1102839 - protein, 6 aa, Mycobacterium
NGNTPA

SEQ ID NO: 1102840 - protein, 53 aa, Mycobacterium
NGPPPPPGAPAPPPPAPEAAPPPPPAPAPPPPPPPAPAPPVEPVPPPPPPPPG

SEQ ID NO: 1102841 - protein, 9 aa, Mycobacterium
NGPQDVADA

SEQ ID NO: 1102842 - protein, 5 aa, Mycobacterium
NGRMP

SEQ ID NO: 1102843 - protein, 6 aa, Mycobacterium
NHNGYG

SEQ ID NO: 1102844 - protein, 6 aa, Mycobacterium
NHPTAR

SEQ ID NO: 1102845 - protein, 7 aa, Mycobacterium
NIRTADA

SEQ ID NO: 1102846 - protein, 78 aa, Mycobacterium
NKRNQSRHDEAETIRSEARDENRRVAQREARAEETAAKARAVQAEADVKTAQAKGLQQEAAGHRHEATNSRDELNEQF

SEQ ID NO: 1102847 - protein, 6 aa, Mycobacterium
NKTAAL

SEQ ID NO: 1102848 - protein, 8 aa, Mycobacterium
NLDPGTKV

SEQ ID NO: 1102849 - protein, 7 aa, Mycobacterium
NLPGTSQ

SEQ ID NO: 1102850 - protein, 17 aa, Mycobacterium
NNVETRNYTYTGSGGVP

SEQ ID NO: 1102851 - protein, 6 aa, Mycobacterium
NPAADL

SEQ ID NO: 1102852 - protein, 5 aa, Mycobacterium
NPAAV

SEQ ID NO: 1102853 - protein, 6 aa, Mycobacterium
NPADAD

SEQ ID NO: 1102854 - protein, 8 aa, Mycobacterium
NPADAEAI

SEQ ID NO: 1102855 - protein, 15 aa, Mycobacterium
NPAGTEPPDPEDLQS

SEQ ID NO: 1102856 - protein, 5 aa, Mycobacterium
NPDAS

SEQ ID NO: 1102857 - protein, 6 aa, Mycobacterium
NPEEFS

SEQ ID NO: 1102858 - protein, 8 aa, Mycobacterium
NPGRRDAD

SEQ ID NO: 1102859 - protein, 17 aa, Mycobacterium
NPHTTSTSGVTAQPQGG

SEQ ID NO: 1102860 - protein, 18 aa, Mycobacterium
NPPPPAPAAEPPPPTLGK

SEQ ID NO: 1102861 - protein, 20 aa, Mycobacterium
NPQAAAPPPPAAEPEPARQR

SEQ ID NO: 1102862 - protein, 10 aa, Mycobacterium
NPTAGQARAS

SEQ ID NO: 1102863 - protein, 7 aa, Mycobacterium
NPTLPRR

SEQ ID NO: 1102864 - protein, 9 aa, Mycobacterium
NPTTDFRNS

SEQ ID NO: 1102865 - protein, 4 aa, Mycobacterium
NPVN

SEQ ID NO: 1102866 - protein, 11 aa, Mycobacterium
NRAADPHLART

SEQ ID NO: 1102867 - protein, 11 aa, Mycobacterium
NRAQTLTTEAY

SEQ ID NO: 1102868 - protein, 4 aa, Mycobacterium
NRDN

SEQ ID NO: 1102869 - protein, 4 aa, Mycobacterium
NRLP

SEQ ID NO: 1102870 - protein, 5 aa, Mycobacterium
NRREA

SEQ ID NO: 1102871 - protein, 8 aa, Mycobacterium
NRREFGPA

SEQ ID NO: 1102872 - protein, 8 aa, Mycobacterium
NSCREGGF

SEQ ID NO: 1102873 - protein, 5 aa, Mycobacterium
NSFSG

SEQ ID NO: 1102874 - protein, 19 aa, Mycobacterium
NSIGTSQATAAQSVSAATE

SEQ ID NO: 1102875 - protein, 10 aa, Mycobacterium
NSNDFAGEGV

SEQ ID NO: 1102876 - protein, 4 aa, Mycobacterium
NSQG

SEQ ID NO: 1102877 - protein, 9 aa, Mycobacterium
NSRDRETTV

SEQ ID NO: 1102878 - protein, 12 aa, Mycobacterium
NSRRLTNVPNSD

SEQ ID NO: 1102879 - protein, 11 aa, Mycobacterium
NTAGPEQTAAA

SEQ ID NO: 1102880 - protein, 6 aa, Mycobacterium
NTEIPE

SEQ ID NO: 1102881 - protein, 5 aa, Mycobacterium
NTTID

SEQ ID NO: 1102882 - protein, 16 aa, Mycobacterium
NYATEKAKVDYPNSVD

SEQ ID NO: 1102883 - protein, 6 aa, Mycobacterium
NYPSVG

SEQ ID NO: 1102884 - protein, 16 aa, Mycobacterium
PAARAARERAGLAPQT

SEQ ID NO: 1102885 - protein, 9 aa, Mycobacterium
PAARTGIAG

SEQ ID NO: 1102886 - protein, 8 aa, Mycobacterium
PADGDQAT

SEQ ID NO: 1102887 - protein, 4 aa, Mycobacterium
PAEQ

SEQ ID NO: 1102888 - protein, 12 aa, Mycobacterium
PAGLTPAAQQRY

SEQ ID NO: 1102889 - protein, 7 aa, Mycobacterium
PAGSGGD

SEQ ID NO: 1102890 - protein, 5 aa, Mycobacterium
PAGVD

SEQ ID NO: 1102891 - protein, 7 aa, Mycobacterium
PAKLNET

SEQ ID NO: 1102892 - protein, 18 aa, Mycobacterium
PALTPDQVAKAPKSEAIP

SEQ ID NO: 1102893 - protein, 8 aa, Mycobacterium
PANSRSRR

SEQ ID NO: 1102894 - protein, 18 aa, Mycobacterium
PAPAPPRPAAQAGAPRVV

SEQ ID NO: 1102895 - protein, 16 aa, Mycobacterium
PAPGTGPSEQTRERGH

SEQ ID NO: 1102896 - protein, 12 aa, Mycobacterium
PAPTNRDATEDE

SEQ ID NO: 1102897 - protein, 6 aa, Mycobacterium
PAQGTV

SEQ ID NO: 1102898 - protein, 27 aa, Mycobacterium
PARQPDQEEHPQTDTTDTTDTPFDGCE

SEQ ID NO: 1102899 - protein, 7 aa, Mycobacterium
PARRFDS

SEQ ID NO: 1102900 - protein, 10 aa, Mycobacterium
PARSSAESAR

SEQ ID NO: 1102901 - protein, 7 aa, Mycobacterium
PATADAH

SEQ ID NO: 1102902 - protein, 102 aa, Mycobacterium
PATAGSPQPGYSPGGGQQGAGQYGYTEGAPRYSNEPQYQSDPRYPSAPQYPNDPGGRTSPTGPPTGPYPTGQPTGYDDPSGGRHTGMPGGQQYPYGGDRGGQ

SEQ ID NO: 1102903 - protein, 8 aa, Mycobacterium
PATAPPGA

SEQ ID NO: 1102904 - protein, 18 aa, Mycobacterium
PCSAPPHTATATGVATRP

SEQ ID NO: 1102905 - protein, 9 aa, Mycobacterium
PDAASATVQ

SEQ ID NO: 1102906 - protein, 7 aa, Mycobacterium
PDAPPAV

SEQ ID NO: 1102907 - protein, 15 aa, Mycobacterium
PDGGSYNEGTPQRES

SEQ ID NO: 1102908 - protein, 5 aa, Mycobacterium
PDGKA

SEQ ID NO: 1102909 - protein, 16 aa, Mycobacterium
PDGNPASAAAKEPTLE

SEQ ID NO: 1102910 - protein, 16 aa, Mycobacterium
PDLSHAKARAQAQGKT

SEQ ID NO: 1102911 - protein, 4 aa, Mycobacterium
PDRQ

SEQ ID NO: 1102912 - protein, 9 aa, Mycobacterium
PDSRGCGQV

SEQ ID NO: 1102913 - protein, 12 aa, Mycobacterium
PDVESAKGKAVV

SEQ ID NO: 1102914 - protein, 8 aa, Mycobacterium
PDYGPPTL

SEQ ID NO: 1102915 - protein, 7 aa, Mycobacterium
PEDERAE

SEQ ID NO: 1102916 - protein, 5 aa, Mycobacterium
PEDFR

SEQ ID NO: 1102917 - protein, 5 aa, Mycobacterium
PEKVN

SEQ ID NO: 1102918 - protein, 11 aa, Mycobacterium
PEPPARPEAEP

SEQ ID NO: 1102919 - protein, 4 aa, Mycobacterium
PEQP

SEQ ID NO: 1102920 - protein, 9 aa, Mycobacterium
PERLGPKGN

SEQ ID NO: 1102921 - protein, 20 aa, Mycobacterium
PESNRGPGGPGQPPNEYPGQ

SEQ ID NO: 1102922 - protein, 7 aa, Mycobacterium
PFTTGQE

SEQ ID NO: 1102923 - protein, 8 aa, Mycobacterium
PGAAAADN

SEQ ID NO: 1102924 - protein, 5 aa, Mycobacterium
PGAEL

SEQ ID NO: 1102925 - protein, 6 aa, Mycobacterium
PGAEPV

SEQ ID NO: 1102926 - protein, 9 aa, Mycobacterium
PGAGQNSDE

SEQ ID NO: 1102927 - protein, 7 aa, Mycobacterium
PGDGTGV

SEQ ID NO: 1102928 - protein, 13 aa, Mycobacterium
PGDHVTGATVNAG

SEQ ID NO: 1102929 - protein, 8 aa, Mycobacterium
PGDKAAKI

SEQ ID NO: 1102930 - protein, 7 aa, Mycobacterium
PGDKSAE

SEQ ID NO: 1102931 - protein, 5 aa, Mycobacterium
PGGCD

SEQ ID NO: 1102932 - protein, 6 aa, Mycobacterium
PGGPQT

SEQ ID NO: 1102933 - protein, 6 aa, Mycobacterium
PGGPYT

SEQ ID NO: 1102934 - protein, 7 aa, Mycobacterium
PGGRSID

SEQ ID NO: 1102935 - protein, 10 aa, Mycobacterium
PGGSIPADGK

SEQ ID NO: 1102936 - protein, 7 aa, Mycobacterium
PGLTDTG

SEQ ID NO: 1102937 - protein, 7 aa, Mycobacterium
PGPLAGD

SEQ ID NO: 1102938 - protein, 13 aa, Mycobacterium
PGPTLSKADALVA

SEQ ID NO: 1102939 - protein, 8 aa, Mycobacterium
PGQLGPGA

SEQ ID NO: 1102940 - protein, 23 aa, Mycobacterium
PGQPPYGQQPYGQPAYGQPAYGQ

SEQ ID NO: 1102941 - protein, 6 aa, Mycobacterium
PGRATT

SEQ ID NO: 1102942 - protein, 13 aa, Mycobacterium
PGVQPGPGPAPHA

SEQ ID NO: 1102943 - protein, 7 aa, Mycobacterium
PGYGRES

SEQ ID NO: 1102944 - protein, 9 aa, Mycobacterium
PHASTSDGA

SEQ ID NO: 1102945 - protein, 6 aa, Mycobacterium
PHPARP

SEQ ID NO: 1102946 - protein, 9 aa, Mycobacterium
PIEAGPGDA

SEQ ID NO: 1102947 - protein, 4 aa, Mycobacterium
PIPG

SEQ ID NO: 1102948 - protein, 19 aa, Mycobacterium
PIPGRAGTARTPESRETTD

SEQ ID NO: 1102949 - protein, 11 aa, Mycobacterium
PIPPAGPVSEL

SEQ ID NO: 1102950 - protein, 5 aa, Mycobacterium
PKDEA

SEQ ID NO: 1102951 - protein, 6 aa, Mycobacterium
PKDTCP

SEQ ID NO: 1102952 - protein, 7 aa, Mycobacterium
PKLPTLQ

SEQ ID NO: 1102953 - protein, 24 aa, Mycobacterium
PKVKNSAADDDEASAGPSDGENAE

SEQ ID NO: 1102954 - protein, 12 aa, Mycobacterium
PLASRSPTTPAH

SEQ ID NO: 1102955 - protein, 15 aa, Mycobacterium
PLDPSPDQPARRITN

SEQ ID NO: 1102956 - protein, 4 aa, Mycobacterium
PLDT

SEQ ID NO: 1102957 - protein, 33 aa, Mycobacterium
PLPAPPPGGPPPGPPAPWPTGQQPTAQPTPSPV

SEQ ID NO: 1102958 - protein, 41 aa, Mycobacterium
PLPDGDPPAMPGLPPPSPESAESDPRPPQPRSAAPGAYADS

SEQ ID NO: 1102959 - protein, 5 aa, Mycobacterium
PLPGD

SEQ ID NO: 1102960 - protein, 13 aa, Mycobacterium
PLPPARSRASRRL

SEQ ID NO: 1102961 - protein, 11 aa, Mycobacterium
PLPTPTSPGAQ

SEQ ID NO: 1102962 - protein, 50 aa, Mycobacterium
PLRPTGKRTRRAAVETDAESEATELTESAGTENGSGTKKKTAKKEPGRYP

SEQ ID NO: 1102963 - protein, 9 aa, Mycobacterium
PMRSPANVA

SEQ ID NO: 1102964 - protein, 4 aa, Mycobacterium
PNAP

SEQ ID NO: 1102965 - protein, 5 aa, Mycobacterium
PNDNL

SEQ ID NO: 1102966 - protein, 13 aa, Mycobacterium
PNGLSPDDEQTYE

SEQ ID NO: 1102967 - protein, 12 aa, Mycobacterium
PNLQDPALGESS

SEQ ID NO: 1102968 - protein, 10 aa, Mycobacterium
PNPGDIRTNQ

SEQ ID NO: 1102969 - protein, 5 aa, Mycobacterium
PNRPE

SEQ ID NO: 1102970 - protein, 12 aa, Mycobacterium
PNSNGPNDSMPY

SEQ ID NO: 1102971 - protein, 7 aa, Mycobacterium
PNSPRIR

SEQ ID NO: 1102972 - protein, 26 aa, Mycobacterium
PPAASPHPDPAPTDTEDDRTTGRGRG

SEQ ID NO: 1102973 - protein, 6 aa, Mycobacterium
PPAAVA

SEQ ID NO: 1102974 - protein, 7 aa, Mycobacterium
PPAAVAT

SEQ ID NO: 1102975 - protein, 4 aa, Mycobacterium
PPAL

SEQ ID NO: 1102976 - protein, 14 aa, Mycobacterium
PPAQPRPMPRPDFS

SEQ ID NO: 1102977 - protein, 5 aa, Mycobacterium
PPAVG

SEQ ID NO: 1102978 - protein, 9 aa, Mycobacterium
PPAYPRTTN

SEQ ID NO: 1102979 - protein, 7 aa, Mycobacterium
PPDTGTK

SEQ ID NO: 1102980 - protein, 15 aa, Mycobacterium
PPEGGASDSLSPGSS

SEQ ID NO: 1102981 - protein, 19 aa, Mycobacterium
PPENAQQTSLRPGAEVQAS

SEQ ID NO: 1102982 - protein, 11 aa, Mycobacterium
PPERASKSMLR

SEQ ID NO: 1102983 - protein, 12 aa, Mycobacterium
PPERLNKAGPAP

SEQ ID NO: 1102984 - protein, 9 aa, Mycobacterium
PPGPAAPPV

SEQ ID NO: 1102985 - protein, 21 aa, Mycobacterium
PPGWTPEKTERLRPVLHSDEN

SEQ ID NO: 1102986 - protein, 11 aa, Mycobacterium
PPLPDAPDDYI

SEQ ID NO: 1102987 - protein, 14 aa, Mycobacterium
PPLSETGRGASTPV

SEQ ID NO: 1102988 - protein, 5 aa, Mycobacterium
PPPCT

SEQ ID NO: 1102989 - protein, 28 aa, Mycobacterium
PPPPPPPRPVVPPPPPPAPRVPRERSEG

SEQ ID NO: 1102990 - protein, 6 aa, Mycobacterium
PPPPVP

SEQ ID NO: 1102991 - protein, 10 aa, Mycobacterium
PPVRREGADY

SEQ ID NO: 1102992 - protein, 4 aa, Mycobacterium
PPYA

SEQ ID NO: 1102993 - protein, 67 aa, Mycobacterium
PPYGRPAPAPPPPPPSLAPPPPADAPPVPAPEPAPGPGPLPGRLPGPLPAEAPMASGPTTATYDSRT

SEQ ID NO: 1102994 - protein, 5 aa, Mycobacterium
PQDTP

SEQ ID NO: 1102995 - protein, 18 aa, Mycobacterium
PQEWSGPAPKEAKPRVLQ

SEQ ID NO: 1102996 - protein, 5 aa, Mycobacterium
PQGAT

SEQ ID NO: 1102997 - protein, 32 aa, Mycobacterium
PQGSWPPGNMGPSGPWGPGQSQPPTTTPTTPR

SEQ ID NO: 1102998 - protein, 6 aa, Mycobacterium
PQLPTD

SEQ ID NO: 1102999 - protein, 56 aa, Mycobacterium
PQMRSDDAATRQVASASDQAKAAVDAPAPEALPKAAPKPAAPPPPPEAPPAPPPEA

SEQ ID NO: 1103000 - protein, 5 aa, Mycobacterium
PQPVN

SEQ ID NO: 1103001 - protein, 5 aa, Mycobacterium
PQRWR

SEQ ID NO: 1103002 - protein, 6 aa, Mycobacterium
PQSTLA

SEQ ID NO: 1103003 - protein, 18 aa, Mycobacterium
PQSVEQQLGAAKEQLTGT

SEQ ID NO: 1103004 - protein, 6 aa, Mycobacterium
PQTPYV

SEQ ID NO: 1103005 - protein, 8 aa, Mycobacterium
PQTRGKTL

SEQ ID NO: 1103006 - protein, 9 aa, Mycobacterium
PRADTRSAL

SEQ ID NO: 1103007 - protein, 14 aa, Mycobacterium
PRASGFSSSPAVGV

SEQ ID NO: 1103008 - protein, 6 aa, Mycobacterium
PRPEAS

SEQ ID NO: 1103009 - protein, 13 aa, Mycobacterium
PRQRRARVNPDGT

SEQ ID NO: 1103010 - protein, 13 aa, Mycobacterium
PRRAATSNSYQSG

SEQ ID NO: 1103011 - protein, 34 aa, Mycobacterium
PRRARGPKAASAQGRPAKARRTRKAVAGESGLRS

SEQ ID NO: 1103012 - protein, 5 aa, Mycobacterium
PRRPR

SEQ ID NO: 1103013 - protein, 4 aa, Mycobacterium
PRSE

SEQ ID NO: 1103014 - protein, 8 aa, Mycobacterium
PRSPRARV

SEQ ID NO: 1103015 - protein, 11 aa, Mycobacterium
PRTAKKTDSRL

SEQ ID NO: 1103016 - protein, 11 aa, Mycobacterium
PRTGQGGEPRL

SEQ ID NO: 1103017 - protein, 18 aa, Mycobacterium
PRVPPLAEQPPGVVVAVT

SEQ ID NO: 1103018 - protein, 15 aa, Mycobacterium
PSALDPAVDPEGAAD

SEQ ID NO: 1103019 - protein, 5 aa, Mycobacterium
PSDLA

SEQ ID NO: 1103020 - protein, 5 aa, Mycobacterium
PSDTG

SEQ ID NO: 1103021 - protein, 7 aa, Mycobacterium
PSGAELT

SEQ ID NO: 1103022 - protein, 6 aa, Mycobacterium
PSHHAG

SEQ ID NO: 1103023 - protein, 5 aa, Mycobacterium
PSLPH

SEQ ID NO: 1103024 - protein, 5 aa, Mycobacterium
PSPAR

SEQ ID NO: 1103025 - protein, 11 aa, Mycobacterium
PSRGDDRTRAD

SEQ ID NO: 1103026 - protein, 37 aa, Mycobacterium
PSTTAPPTSVPPPPSSAPTSAPSSSAAAEPGTTTRAP

SEQ ID NO: 1103027 - protein, 4 aa, Mycobacterium
PTAL

SEQ ID NO: 1103028 - protein, 9 aa, Mycobacterium
PTATAGSTL

SEQ ID NO: 1103029 - protein, 4 aa, Mycobacterium
PTDG

SEQ ID NO: 1103030 - protein, 5 aa, Mycobacterium
PTGAA

SEQ ID NO: 1103031 - protein, 5 aa, Mycobacterium
PTGEL

SEQ ID NO: 1103032 - protein, 14 aa, Mycobacterium
PTKPKYEKRVPRAD

SEQ ID NO: 1103033 - protein, 24 aa, Mycobacterium
PTPQPDAKSSTTSPAKSAANLQRR

SEQ ID NO: 1103034 - protein, 7 aa, Mycobacterium
PTPRETA

SEQ ID NO: 1103035 - protein, 15 aa, Mycobacterium
PTRGAGPVGGPPERG

SEQ ID NO: 1103036 - protein, 12 aa, Mycobacterium
PTTADGHPDPGV

SEQ ID NO: 1103037 - protein, 5 aa, Mycobacterium
PVAPS

SEQ ID NO: 1103038 - protein, 14 aa, Mycobacterium
PVASGGERARPLAD

SEQ ID NO: 1103039 - protein, 15 aa, Mycobacterium
PVAVGPPRRGMSRSD

SEQ ID NO: 1103040 - protein, 10 aa, Mycobacterium
PVDPEGDLDL

SEQ ID NO: 1103041 - protein, 11 aa, Mycobacterium
PVEPPSPAQIN

SEQ ID NO: 1103042 - protein, 8 aa, Mycobacterium
PVGAEHDY

SEQ ID NO: 1103043 - protein, 8 aa, Mycobacterium
PVGDAPQY

SEQ ID NO: 1103044 - protein, 4 aa, Mycobacterium
PVGG

SEQ ID NO: 1103045 - protein, 15 aa, Mycobacterium
PVGGRRRRRRGNADA

SEQ ID NO: 1103046 - protein, 8 aa, Mycobacterium
PVGTGEPV

SEQ ID NO: 1103047 - protein, 6 aa, Mycobacterium
PVIPKT

SEQ ID NO: 1103048 - protein, 6 aa, Mycobacterium
PVKTAR

SEQ ID NO: 1103049 - protein, 4 aa, Mycobacterium
PVNK

SEQ ID NO: 1103050 - protein, 13 aa, Mycobacterium
PVPGRTATELAND

SEQ ID NO: 1103051 - protein, 13 aa, Mycobacterium
PVPPPLPAPAPDH

SEQ ID NO: 1103052 - protein, 5 aa, Mycobacterium
PVRTE

SEQ ID NO: 1103053 - protein, 17 aa, Mycobacterium
PVSATDTEPEPEPEPEV

SEQ ID NO: 1103054 - protein, 9 aa, Mycobacterium
PVYGSGLPS

SEQ ID NO: 1103055 - protein, 5 aa, Mycobacterium
PWAQS

SEQ ID NO: 1103056 - protein, 25 aa, Mycobacterium
PWATGPAPDSDADRDDGAPAADPVA

SEQ ID NO: 1103057 - protein, 11 aa, Mycobacterium
PWGAPPGTADE

SEQ ID NO: 1103058 - protein, 11 aa, Mycobacterium
QADEWPPPPTE

SEQ ID NO: 1103059 - protein, 10 aa, Mycobacterium
QADRLATTGP

SEQ ID NO: 1103060 - protein, 10 aa, Mycobacterium
QAEEGPGAVT

SEQ ID NO: 1103061 - protein, 4 aa, Mycobacterium
QAPT

SEQ ID NO: 1103062 - protein, 16 aa, Mycobacterium
QAQEQGIDTVPDAPAS

SEQ ID NO: 1103063 - protein, 23 aa, Mycobacterium
QAQSTSEGTVTSAGLESREGDTA

SEQ ID NO: 1103064 - protein, 11 aa, Mycobacterium
QDASGGGKRGF

SEQ ID NO: 1103065 - protein, 6 aa, Mycobacterium
QDGRRP

SEQ ID NO: 1103066 - protein, 8 aa, Mycobacterium
QDPAKDTL

SEQ ID NO: 1103067 - protein, 16 aa, Mycobacterium
QDRIPADQPGRGINSA

SEQ ID NO: 1103068 - protein, 4 aa, Mycobacterium
QDTA

SEQ ID NO: 1103069 - protein, 10 aa, Mycobacterium
QDVPPKADNV

SEQ ID NO: 1103070 - protein, 4 aa, Mycobacterium
QEPV

SEQ ID NO: 1103071 - protein, 7 aa, Mycobacterium
QEQTQVG

SEQ ID NO: 1103072 - protein, 6 aa, Mycobacterium
QESNAT

SEQ ID NO: 1103073 - protein, 7 aa, Mycobacterium
QGDGDSI

SEQ ID NO: 1103074 - protein, 6 aa, Mycobacterium
QGENVD

SEQ ID NO: 1103075 - protein, 5 aa, Mycobacterium
QGGAV

SEQ ID NO: 1103076 - protein, 16 aa, Mycobacterium
QGGNGGQERSDPGDGT

SEQ ID NO: 1103077 - protein, 10 aa, Mycobacterium
QGLAGRGEKF

SEQ ID NO: 1103078 - protein, 5 aa, Mycobacterium
QGLRP

SEQ ID NO: 1103079 - protein, 6 aa, Mycobacterium
QGRRGV

SEQ ID NO: 1103080 - protein, 9 aa, Mycobacterium
QGSGAGQQL

SEQ ID NO: 1103081 - protein, 10 aa, Mycobacterium
QHRGAGGQDC

SEQ ID NO: 1103082 - protein, 5 aa, Mycobacterium
QHTGE

SEQ ID NO: 1103083 - protein, 8 aa, Mycobacterium
QIGDPRPI

SEQ ID NO: 1103084 - protein, 5 aa, Mycobacterium
QIPGV

SEQ ID NO: 1103085 - protein, 14 aa, Mycobacterium
QKRSQGVPGLDDGF

SEQ ID NO: 1103086 - protein, 6 aa, Mycobacterium
QKVDHR

SEQ ID NO: 1103087 - protein, 17 aa, Mycobacterium
QLEEARAKSEEAPDPKR

SEQ ID NO: 1103088 - protein, 5 aa, Mycobacterium
QLPGD

SEQ ID NO: 1103089 - protein, 10 aa, Mycobacterium
QLPQDLGGER

SEQ ID NO: 1103090 - protein, 16 aa, Mycobacterium
QLTSKNVSAQASTVSA

SEQ ID NO: 1103091 - protein, 18 aa, Mycobacterium
QMATGNSSKFDECDEISS

SEQ ID NO: 1103092 - protein, 6 aa, Mycobacterium
QNPTRD

SEQ ID NO: 1103093 - protein, 5 aa, Mycobacterium
QPAIT

SEQ ID NO: 1103094 - protein, 8 aa, Mycobacterium
QPDAEDPY

SEQ ID NO: 1103095 - protein, 6 aa, Mycobacterium
QPDTTV

SEQ ID NO: 1103096 - protein, 6 aa, Mycobacterium
QPEADA

SEQ ID NO: 1103097 - protein, 86 aa, Mycobacterium
QPEDAAVTASAASPESGPDTRERRTAPKGRPTPKRDAAKRRGPVAPAPLTAAEARRRRKELRGPKLSKEERKAEKLERRASMAERR

SEQ ID NO: 1103098 - protein, 14 aa, Mycobacterium
QPLKRTSDDGIASP

SEQ ID NO: 1103099 - protein, 6 aa, Mycobacterium
QPLPVS

SEQ ID NO: 1103100 - protein, 10 aa, Mycobacterium
QPPAEDSPTA

SEQ ID NO: 1103101 - protein, 15 aa, Mycobacterium
QPRPPGVSVSTSTPL

SEQ ID NO: 1103102 - protein, 8 aa, Mycobacterium
QPSAGAAV

SEQ ID NO: 1103103 - protein, 7 aa, Mycobacterium
QPSGAPL

SEQ ID NO: 1103104 - protein, 8 aa, Mycobacterium
QQAPPRLA

SEQ ID NO: 1103105 - protein, 5 aa, Mycobacterium
QQKAD

SEQ ID NO: 1103106 - protein, 6 aa, Mycobacterium
QQLANN

SEQ ID NO: 1103107 - protein, 6 aa, Mycobacterium
QQLNTE

SEQ ID NO: 1103108 - protein, 5 aa, Mycobacterium
QQPLV

SEQ ID NO: 1103109 - protein, 19 aa, Mycobacterium
QQQGGNSEMSTPEVNSERA

SEQ ID NO: 1103110 - protein, 19 aa, Mycobacterium
QQQNANTDEQAKIQAQSVE

SEQ ID NO: 1103111 - protein, 5 aa, Mycobacterium
QQTGV

SEQ ID NO: 1103112 - protein, 5 aa, Mycobacterium
QRADE

SEQ ID NO: 1103113 - protein, 9 aa, Mycobacterium
QRESKPEDF

SEQ ID NO: 1103114 - protein, 17 aa, Mycobacterium
QRFSSRASAGMAGARAT

SEQ ID NO: 1103115 - protein, 15 aa, Mycobacterium
QRLTPAEERFEKGRR

SEQ ID NO: 1103116 - protein, 4 aa, Mycobacterium
QRPK

SEQ ID NO: 1103117 - protein, 55 aa, Mycobacterium
QRPPQPEESDATTKIPTQQDAGTDSASTEKLNAPEEQKRRGGGMSAAELLRREGR

SEQ ID NO: 1103118 - protein, 15 aa, Mycobacterium
QRRPPTDLPSTANEH

SEQ ID NO: 1103119 - protein, 5 aa, Mycobacterium
QRRRS

SEQ ID NO: 1103120 - protein, 9 aa, Mycobacterium
QRWSDESDL

SEQ ID NO: 1103121 - protein, 5 aa, Mycobacterium
QSAGK

SEQ ID NO: 1103122 - protein, 4 aa, Mycobacterium
QSDA

SEQ ID NO: 1103123 - protein, 4 aa, Mycobacterium
QSDR

SEQ ID NO: 1103124 - protein, 4 aa, Mycobacterium
QSPP

SEQ ID NO: 1103125 - protein, 4 aa, Mycobacterium
QSPR

SEQ ID NO: 1103126 - protein, 6 aa, Mycobacterium
QSPVRA

SEQ ID NO: 1103127 - protein, 4 aa, Mycobacterium
QSSG

SEQ ID NO: 1103128 - protein, 24 aa, Mycobacterium
QTDSGPYLEDGSRISRDRATIPQE

SEQ ID NO: 1103129 - protein, 10 aa, Mycobacterium
QTGTESISTE

SEQ ID NO: 1103130 - protein, 6 aa, Mycobacterium
QTNSDL

SEQ ID NO: 1103131 - protein, 8 aa, Mycobacterium
QTPDVATG

SEQ ID NO: 1103132 - protein, 4 aa, Mycobacterium
QTTA

SEQ ID NO: 1103133 - protein, 8 aa, Mycobacterium
QTVSGDVG

SEQ ID NO: 1103134 - protein, 13 aa, Mycobacterium
QVPAGAPAMPGSG

SEQ ID NO: 1103135 - protein, 5 aa, Mycobacterium
QVPGV

SEQ ID NO: 1103136 - protein, 8 aa, Mycobacterium
RAAGEDVP

SEQ ID NO: 1103137 - protein, 6 aa, Mycobacterium
RAAGNP

SEQ ID NO: 1103138 - protein, 7 aa, Mycobacterium
RADGPAL

SEQ ID NO: 1103139 - protein, 5 aa, Mycobacterium
RAEVD

SEQ ID NO: 1103140 - protein, 4 aa, Mycobacterium
RAGA

SEQ ID NO: 1103141 - protein, 9 aa, Mycobacterium
RAGFGPRPD

SEQ ID NO: 1103142 - protein, 6 aa, Mycobacterium
RAGLAG

SEQ ID NO: 1103143 - protein, 33 aa, Mycobacterium; identical to SEQ ID NO: 279663

SEQ ID NO: 1103144 - protein, 14 aa, Mycobacterium
RAGTRRAKPADRRT

SEQ ID NO: 1103145 - protein, 9 aa, Mycobacterium
RAKTRSGAA

SEQ ID NO: 1103146 - protein, 9 aa, Mycobacterium
RAPTDQAAP

SEQ ID NO: 1103147 - protein, 7 aa, Mycobacterium
RARAGHM

SEQ ID NO: 1103148 - protein, 5 aa, Mycobacterium
RARAR

SEQ ID NO: 1103149 - protein, 7 aa, Mycobacterium
RARTEQT

SEQ ID NO: 1103150 - protein, 9 aa, Mycobacterium
RATTTSQRR

SEQ ID NO: 1103151 - protein, 4 aa, Mycobacterium
RDAG

SEQ ID NO: 1103152 - protein, 7 aa, Mycobacterium
RDAPSLQ

SEQ ID NO: 1103153 - protein, 10 aa, Mycobacterium
RDDEDVAEEK

SEQ ID NO: 1103154 - protein, 6 aa, Mycobacterium
RDDPAD

SEQ ID NO: 1103155 - protein, 20 aa, Mycobacterium
RDEESESKKREADVERDDAE

SEQ ID NO: 1103156 - protein, 13 aa, Mycobacterium
RDGGVGPIRGPPR

SEQ ID NO: 1103157 - protein, 6 aa, Mycobacterium
RDIAER

SEQ ID NO: 1103158 - protein, 9 aa, Mycobacterium
RDKHSTTVY

SEQ ID NO: 1103159 - protein, 8 aa, Mycobacterium
RDLDGEGE

SEQ ID NO: 1103160 - protein, 4 aa, Mycobacterium
RDPL

SEQ ID NO: 1103161 - protein, 13 aa, Mycobacterium
RDPLTGEYRGGPA

SEQ ID NO: 1103162 - protein, 6 aa, Mycobacterium
RDQDNA

SEQ ID NO: 1103163 - protein, 4 aa, Mycobacterium
RDQP

SEQ ID NO: 1103164 - protein, 21 aa, Mycobacterium
RDRTGDDRAGRPDGLTTDQAD

SEQ ID NO: 1103165 - protein, 14 aa, Mycobacterium
REAPATGARTSDPV

SEQ ID NO: 1103166 - protein, 8 aa, Mycobacterium
REATPQLR

SEQ ID NO: 1103167 - protein, 17 aa, Mycobacterium
REDRPPEQVPEATARTD

SEQ ID NO: 1103168 - protein, 13 aa, Mycobacterium
REEGRRSGGQPPP

SEQ ID NO: 1103169 - protein, 8 aa, Mycobacterium
REESGSNI

SEQ ID NO: 1103170 - protein, 8 aa, Mycobacterium
REESGTNI

SEQ ID NO: 1103171 - protein, 11 aa, Mycobacterium
REGNDREAGSV

SEQ ID NO: 1103172 - protein, 12 aa, Mycobacterium
REGSADSGRRRF

SEQ ID NO: 1103173 - protein, 6 aa, Mycobacterium
RELDGP

SEQ ID NO: 1103174 - protein, 6 aa, Mycobacterium
REQMRP

SEQ ID NO: 1103175 - protein, 4 aa, Mycobacterium
RERA

SEQ ID NO: 1103176 - protein, 34 aa, Mycobacterium
RERRRTRRRPRHRRNRATPADRSSSAASPDIAAT

SEQ ID NO: 1103177 - protein, 8 aa, Mycobacterium
RESDPDAA

SEQ ID NO: 1103178 - protein, 14 aa, Mycobacterium
REVGRRRGAGAASL

SEQ ID NO: 1103179 - protein, 12 aa, Mycobacterium
RFPDDAKVDEQL

SEQ ID NO: 1103180 - protein, 6 aa, Mycobacterium
RFTPTS

SEQ ID NO: 1103181 - protein, 4 aa, Mycobacterium
RGAG

SEQ ID NO: 1103182 - protein, 5 aa, Mycobacterium
RGAQR

SEQ ID NO: 1103183 - protein, 4 aa, Mycobacterium
RGAY

SEQ ID NO: 1103184 - protein, 7 aa, Mycobacterium
RGEDMES

SEQ ID NO: 1103185 - protein, 5 aa, Mycobacterium
RGFGD

SEQ ID NO: 1103186 - protein, 49 aa, Mycobacterium
RGGDPGEGFTPTVRDSTGAKAPAGDIPAAAAAAAAASAAERRKRRRRKI

SEQ ID NO: 1103187 - protein, 4 aa, Mycobacterium
RGGP

SEQ ID NO: 1103188 - protein, 27 aa, Mycobacterium
RGGPAGPGGGQPPRPPQPSAEPTTAMR

SEQ ID NO: 1103189 - protein, 7 aa, Mycobacterium
RGHQPAT

SEQ ID NO: 1103190 - protein, 10 aa, Mycobacterium
RGNDGTPSAR

SEQ ID NO: 1103191 - protein, 16 aa, Mycobacterium
RGNREDSDNPDEVTDD

SEQ ID NO: 1103192 - protein, 7 aa, Mycobacterium
RGPGGAL

SEQ ID NO: 1103193 - protein, 5 aa, Mycobacterium
RGQAA

SEQ ID NO: 1103194 - protein, 8 aa, Mycobacterium
RGRRKRRM

SEQ ID NO: 1103195 - protein, 20 aa, Mycobacterium
RGRTPGEGSAADTAEPPTEK

SEQ ID NO: 1103196 - protein, 13 aa, Mycobacterium
RGSGSTASQEDQV

SEQ ID NO: 1103197 - protein, 14 aa, Mycobacterium
RGSRLDREERTAAA

SEQ ID NO: 1103198 - protein, 5 aa, Mycobacterium
RGTDH

SEQ ID NO: 1103199 - protein, 12 aa, Mycobacterium
RGVEKTVAGQPV

SEQ ID NO: 1103200 - protein, 30 aa, Mycobacterium
RHATGTSAPAAKGTTRDVSKGASAAAAAGG

SEQ ID NO: 1103201 - protein, 23 aa, Mycobacterium
RHPVTRPGTAADPPRFRGGDGAR

SEQ ID NO: 1103202 - protein, 4 aa, Mycobacterium
RHRP

SEQ ID NO: 1103203 - protein, 7 aa, Mycobacterium
RHSESRA

SEQ ID NO: 1103204 - protein, 9 aa, Mycobacterium
RHTPSGGRV

SEQ ID NO: 1103205 - protein, 4 aa, Mycobacterium
RIPD

SEQ ID NO: 1103206 - protein, 19 aa, Mycobacterium
RIPGAEPAADEPTDSGPGS

SEQ ID NO: 1103207 - protein, 12 aa, Mycobacterium
RIRRDREAESLQ

SEQ ID NO: 1103208 - protein, 4 aa, Mycobacterium
RKED

SEQ ID NO: 1103209 - protein, 5 aa, Mycobacterium
RKEDK

SEQ ID NO: 1103210 - protein, 7 aa, Mycobacterium
RKNPRLP

SEQ ID NO: 1103211 - protein, 6 aa, Mycobacterium
RKSADE

SEQ ID NO: 1103212 - protein, 4 aa, Mycobacterium
RKTG

SEQ ID NO: 1103213 - protein, 10 aa, Mycobacterium
RLADRDDPRR

SEQ ID NO: 1103214 - protein, 6 aa, Mycobacterium
RLDEGR

SEQ ID NO: 1103215 - protein, 6 aa, Mycobacterium
RLKDPA

SEQ ID NO: 1103216 - protein, 7 aa, Mycobacterium
RLPATAS

SEQ ID NO: 1103217 - protein, 9 aa, Mycobacterium
RLPPSAKQT

SEQ ID NO: 1103218 - protein, 7 aa, Mycobacterium
RLSDGAT

SEQ ID NO: 1103219 - protein, 8 aa, Mycobacterium
RLSKPPRR

SEQ ID NO: 1103220 - protein, 13 aa, Mycobacterium
RLSPSTPATPPAR

SEQ ID NO: 1103221 - protein, 9 aa, Mycobacterium
RLTDPQSRV

SEQ ID NO: 1103222 - protein, 5 aa, Mycobacterium
RLTEA

SEQ ID NO: 1103223 - protein, 4 aa, Mycobacterium
RMPP

SEQ ID NO: 1103224 - protein, 11 aa, Mycobacterium
RMPQSSGGQGS

SEQ ID NO: 1103225 - protein, 9 aa, Mycobacterium
RNARRRPAT

SEQ ID NO: 1103226 - protein, 16 aa, Mycobacterium
RNDPARRAERRRAARR

SEQ ID NO: 1103227 - protein, 8 aa, Mycobacterium
RNNASYSY

SEQ ID NO: 1103228 - protein, 6 aa, Mycobacterium
RNQRPV

SEQ ID NO: 1103229 - protein, 17 aa, Mycobacterium
RNSVPAEVDSTEPAGQV

SEQ ID NO: 1103230 - protein, 7 aa, Mycobacterium
RNVSTEV

SEQ ID NO: 1103231 - protein, 9 aa, Mycobacterium
RPADAALAT

SEQ ID NO: 1103232 - protein, 5 aa, Mycobacterium
RPAGL

SEQ ID NO: 1103233 - protein, 15 aa, Mycobacterium
RPAPASGDDAHSGNA

SEQ ID NO: 1103234 - protein, 16 aa, Mycobacterium
RPDAYQPHSTTVVTGG

SEQ ID NO: 1103235 - protein, 6 aa, Mycobacterium
RPDLQG

SEQ ID NO: 1103236 - protein, 7 aa, Mycobacterium
RPEDKVS

SEQ ID NO: 1103237 - protein, 8 aa, Mycobacterium
RPESESHE

SEQ ID NO: 1103238 - protein, 12 aa, Mycobacterium
RPGIATQTATAG

SEQ ID NO: 1103239 - protein, 6 aa, Mycobacterium
RPLEDQ

SEQ ID NO: 1103240 - protein, 12 aa, Mycobacterium
RPMDDTDRSMDG

SEQ ID NO: 1103241 - protein, 6 aa, Mycobacterium
RPNPGI

SEQ ID NO: 1103242 - protein, 5 aa, Mycobacterium
RPPQV

SEQ ID NO: 1103243 - protein, 12 aa, Mycobacterium
RPPRAPDDNRTA

SEQ ID NO: 1103244 - protein, 6 aa, Mycobacterium
RPPRLG

SEQ ID NO: 1103245 - protein, 9 aa, Mycobacterium
RPPTDGEPY

SEQ ID NO: 1103246 - protein, 10 aa, Mycobacterium
RPQTAHAPST

SEQ ID NO: 1103247 - protein, 10 aa, Mycobacterium
RPRDAQPGDV

SEQ ID NO: 1103248 - protein, 14 aa, Mycobacterium
RPRLSRPRGRPPLG

SEQ ID NO: 1103249 - protein, 64 aa, Mycobacterium
RPRRSRSTPRTPESPEPRRRSRTQAPREAREPRETRDARKLPPRERRSSSYDRPERRPERSRRL

SEQ ID NO: 1103250 - protein, 10 aa, Mycobacterium
RQAQASRPDL

SEQ ID NO: 1103251 - protein, 4 aa, Mycobacterium
RQGA

SEQ ID NO: 1103252 - protein, 5 aa, Mycobacterium
RQGPR

SEQ ID NO: 1103253 - protein, 9 aa, Mycobacterium
RQHGTSPQA

SEQ ID NO: 1103254 - protein, 5 aa, Mycobacterium
RQIRN

SEQ ID NO: 1103255 - protein, 14 aa, Mycobacterium
RQNESGDSLETARP

SEQ ID NO: 1103256 - protein, 7 aa, Mycobacterium
RQPFSQA

SEQ ID NO: 1103257 - protein, 12 aa, Mycobacterium
RQPKDRQYAQPV

SEQ ID NO: 1103258 - protein, 8 aa, Mycobacterium
RQPPPGLG

SEQ ID NO: 1103259 - protein, 7 aa, Mycobacterium
RQPTAAD

SEQ ID NO: 1103260 - protein, 37 aa, Mycobacterium
RQRSLRARGPQPRRRRPSDQSAPGEQTDTAPADSSAL

SEQ ID NO: 1103261 - protein, 6 aa, Mycobacterium
RRAQAE

SEQ ID NO: 1103262 - protein, 62 aa, Mycobacterium
RRAQEPQPAPESRHGKHSAPGDGDEDGPLAPPPAPIQGPQETAEEAHARRRRSLEDTGGQSV

SEQ ID NO: 1103263 - protein, 5 aa, Mycobacterium
RRAQR

SEQ ID NO: 1103264 - protein, 6 aa, Mycobacterium
RRATGG

SEQ ID NO: 1103265 - protein, 4 aa, Mycobacterium
RREA

SEQ ID NO: 1103266 - protein, 8 aa, Mycobacterium
RRENRDDV

SEQ ID NO: 1103267 - protein, 10 aa, Mycobacterium
RRGGTGDTVE

SEQ ID NO: 1103268 - protein, 4 aa, Mycobacterium
RRGL

SEQ ID NO: 1103269 - protein, 15 aa, Mycobacterium
RRGPTPPAPTVPEGV

SEQ ID NO: 1103270 - protein, 4 aa, Mycobacterium
RRGS

SEQ ID NO: 1103271 - protein, 5 aa, Mycobacterium
RRHGQ

SEQ ID NO: 1103272 - protein, 12 aa, Mycobacterium
RRKTLPKARSGW

SEQ ID NO: 1103273 - protein, 27 aa, Mycobacterium
RRPPSRPNKTHHPHNTDTGHTVGEGSG

SEQ ID NO: 1103274 - protein, 17 aa, Mycobacterium
RRPRPDPDAPPAPTSEV

SEQ ID NO: 1103275 - protein, 35 aa, Mycobacterium
RRPTMDDDHPELDPAAAANSQPISPSPAGEKPVSF

SEQ ID NO: 1103276 - protein, 8 aa, Mycobacterium
RRPTTSAT

SEQ ID NO: 1103277 - protein, 29 aa, Mycobacterium
RRQSTDEITEVDPKAEDKIEDDGEKSFDS

SEQ ID NO: 1103278 - protein, 7 aa, Mycobacterium
RRRAEGS

SEQ ID NO: 1103279 - protein, 14 aa, Mycobacterium
RRRDARMSPELDPR

SEQ ID NO: 1103280 - protein, 11 aa, Mycobacterium
RRRDDEPGRPW

SEQ ID NO: 1103281 - protein, 6 aa, Mycobacterium
RRRDRA

SEQ ID NO: 1103282 - protein, 16 aa, Mycobacterium
RRRRAAGDPATGADPY

SEQ ID NO: 1103283 - protein, 11 aa, Mycobacterium
RRRSGTRALAP

SEQ ID NO: 1103284 - protein, 14 aa, Mycobacterium
RRSAAAPATAHALA

SEQ ID NO: 1103285 - protein, 7 aa, Mycobacterium
RRSVPPD

SEQ ID NO: 1103286 - protein, 31 aa, Mycobacterium
RRTTMGNPAGGASVEDPNAPARAALADTTGR

SEQ ID NO: 1103287 - protein, 11 aa, Mycobacterium
RRWSRQRGGIE

SEQ ID NO: 1103288 - protein, 5 aa, Mycobacterium
RSAAT

SEQ ID NO: 1103289 - protein, 6 aa, Mycobacterium
RSANRP

SEQ ID NO: 1103290 - protein, 4 aa, Mycobacterium
RSAV

SEQ ID NO: 1103291 - protein, 33 aa, Mycobacterium
RSDDSSADETTVATTTSSTPSPKPAPEADARPE

SEQ ID NO: 1103292 - protein, 13 aa, Mycobacterium
RSEERDAADQFGP

SEQ ID NO: 1103293 - protein, 8 aa, Mycobacterium
RSEGFTRP

SEQ ID NO: 1103294 - protein, 5 aa, Mycobacterium
RSEID

SEQ ID NO: 1103295 - protein, 7 aa, Mycobacterium
RSETGNF

SEQ ID NO: 1103296 - protein, 7 aa, Mycobacterium
RSGDDIR

SEQ ID NO: 1103297 - protein, 11 aa, Mycobacterium
RSGESPQAPAN

SEQ ID NO: 1103298 - protein, 7 aa, Mycobacterium
RSGGAAR

SEQ ID NO: 1103299 - protein, 38 aa, Mycobacterium
RSGPAAGHHSDPDWRPSADELDDEPLDDRDTRDAEPEG

SEQ ID NO: 1103300 - protein, 7 aa, Mycobacterium
RSGQTSL

SEQ ID NO: 1103301 - protein, 5 aa, Mycobacterium
RSHEH

SEQ ID NO: 1103302 - protein, 16 aa, Mycobacterium
RSKSSEPGPNAARSRP

SEQ ID NO: 1103303 - protein, 5 aa, Mycobacterium
RSLPG

SEQ ID NO: 1103304 - protein, 11 aa, Mycobacterium
RSQLQEQTSNV

SEQ ID NO: 1103305 - protein, 10 aa, Mycobacterium
RSQPQGDGQM

SEQ ID NO: 1103306 - protein, 8 aa, Mycobacterium
RSRAERME

SEQ ID NO: 1103307 - protein, 9 aa, Mycobacterium
RSRESARRE

SEQ ID NO: 1103308 - protein, 5 aa, Mycobacterium
RSSRF

SEQ ID NO: 1103309 - protein, 7 aa, Mycobacterium
RSSVEPE

SEQ ID NO: 1103310 - protein, 4 aa, Mycobacterium
RSYP

SEQ ID NO: 1103311 - protein, 13 aa, Mycobacterium
RTAGAPLGPHAGQ

SEQ ID NO: 1103312 - protein, 5 aa, Mycobacterium
RTAKA

SEQ ID NO: 1103313 - protein, 19 aa, Mycobacterium
RTDSGCPAPASTGTGTSGF

SEQ ID NO: 1103314 - protein, 17 aa, Mycobacterium
RTGDSGNRRTLSPRGSL

SEQ ID NO: 1103315 - protein, 7 aa, Mycobacterium
RTLTPQT

SEQ ID NO: 1103316 - protein, 16 aa, Mycobacterium
RTPPAGLGLTGEPVGD

SEQ ID NO: 1103317 - protein, 12 aa, Mycobacterium
RTQNEPNSEVAP

SEQ ID NO: 1103318 - protein, 9 aa, Mycobacterium
RTRETSAAR

SEQ ID NO: 1103319 - protein, 8 aa, Mycobacterium
RTRSPYQL

SEQ ID NO: 1103320 - protein, 12 aa, Mycobacterium
RTSGAPFGPHAG

SEQ ID NO: 1103321 - protein, 8 aa, Mycobacterium
RTSPGEYA

SEQ ID NO: 1103322 - protein, 10 aa, Mycobacterium
RTYQPRAGES

SEQ ID NO: 1103323 - protein, 8 aa, Mycobacterium
RVADSESE

SEQ ID NO: 1103324 - protein, 11 aa, Mycobacterium
RVGAGGTVGPG

SEQ ID NO: 1103325 - protein, 4 aa, Mycobacterium
RVGD

SEQ ID NO: 1103326 - protein, 7 aa, Mycobacterium
RVGGPRE

SEQ ID NO: 1103327 - protein, 6 aa, Mycobacterium
RVPGAQ

SEQ ID NO: 1103328 - protein, 5 aa, Mycobacterium
RWAPR

SEQ ID NO: 1103329 - protein, 6 aa, Mycobacterium
RYAPSD

SEQ ID NO: 1103330 - protein, 11 aa, Mycobacterium
RYGRSDATEDQ

SEQ ID NO: 1103331 - protein, 6 aa, Mycobacterium
RYSGDQ

SEQ ID NO: 1103332 - protein, 4 aa, Mycobacterium
RYTD

SEQ ID NO: 1103333 - protein, 105 aa, Mycobacterium
SAAEPGASGSEPPAGGYETPAYGEQPSYPPPPPGFEQPGYQPPQYQQPDYQQPQYQQPQYPPPPPGYQPYGSYGSPYDAPAGYPPPPPPGYPPYAGGYGAGPKTN

SEQ ID NO: 1103334 - protein, 9 aa, Mycobacterium
SAAQAGAES

SEQ ID NO: 1103335 - protein, 14 aa, Mycobacterium
SAEDRDLPSRTDRI

SEQ ID NO: 1103336 - protein, 10 aa, Mycobacterium
SAGPLFGGGT

SEQ ID NO: 1103337 - protein, 16 aa, Mycobacterium
SAGRVAQAPVRGTPRN

SEQ ID NO: 1103338 - protein, 13 aa, Mycobacterium
SAGTTAISGGGAA

SEQ ID NO: 1103339 - protein, 5 aa, Mycobacterium
SAHWG

SEQ ID NO: 1103340 - protein, 8 aa, Mycobacterium
SANPSSGG

SEQ ID NO: 1103341 - protein, 69 aa, Mycobacterium
SAPAATDDGQDEEPPRRRRSSERPRRAAKPAAERTRSSRDAARGAAARKPAKRAATPSRSRHNRPPETE

SEQ ID NO: 1103342 - protein, 7 aa, Mycobacterium
SAPGGQE

SEQ ID NO: 1103343 - protein, 4 aa, Mycobacterium
SAPP

SEQ ID NO: 1103344 - protein, 9 aa, Mycobacterium
SAPPQGDTR

SEQ ID NO: 1103345 - protein, 6 aa, Mycobacterium
SAPQCP

SEQ ID NO: 1103346 - protein, 7 aa, Mycobacterium
SAPSAVA

SEQ ID NO: 1103347 - protein, 27 aa, Mycobacterium
SAQAPRPAPAPEAQPAVAPPAPPAETI

SEQ ID NO: 1103348 - protein, 11 aa, Mycobacterium
SARPSALAPGR

SEQ ID NO: 1103349 - protein, 14 aa, Mycobacterium
SARSPLIANSSGNT

SEQ ID NO: 1103350 - protein, 37 aa, Mycobacterium
SARTPVDARRTPGDQGEQEVPDDGLPAPGVTPAEQAR

SEQ ID NO: 1103351 - protein, 10 aa, Mycobacterium
SASAPTEKSS

SEQ ID NO: 1103352 - protein, 8 aa, Mycobacterium
SASEGPNV

SEQ ID NO: 1103353 - protein, 6 aa, Mycobacterium
SATESR

SEQ ID NO: 1103354 - protein, 5 aa, Mycobacterium
SAVPE

SEQ ID NO: 1103355 - protein, 8 aa, Mycobacterium
SAVTGNDA

SEQ ID NO: 1103356 - protein, 7 aa, Mycobacterium
SDAVTDV

SEQ ID NO: 1103357 - protein, 101 aa, Mycobacterium
SDDDAGVPDDRIDDGGYGSDDGPSGRHSGEFPAQPEGADARQGDYTTDEYADGDYADSEYADEYADEYADDHPVTAGAQPPAEPSGPAHGGTWDGGEWTGS

SEQ ID NO: 1103358 - protein, 13 aa, Mycobacterium
SDDNTTSATVTTA

SEQ ID NO: 1103359 - protein, 9 aa, Mycobacterium
SDGNFRGGY

SEQ ID NO: 1103360 - protein, 8 aa, Mycobacterium
SDGSRVET

SEQ ID NO: 1103361 - protein, 7 aa, Mycobacterium
SDLSPGR

SEQ ID NO: 1103362 - protein, 8 aa, Mycobacterium
SDNGTPVE

SEQ ID NO: 1103363 - protein, 7 aa, Mycobacterium
SDPGVRD

SEQ ID NO: 1103364 - protein, 58 aa, Mycobacterium
SDPSAPPEEPAGAEAPDATGRHEPTGADSLGATGADSLGATGADSLGATGAMPPPTPG

SEQ ID NO: 1103365 - protein, 4 aa, Mycobacterium
SDRD

SEQ ID NO: 1103366 - protein, 12 aa, Mycobacterium
SDRVAPAGEPDN

SEQ ID NO: 1103367 - protein, 16 aa, Mycobacterium
SDSTTTAHVTGPPATF

SEQ ID NO: 1103368 - protein, 69 aa, Mycobacterium
SDTPAEPTPPAAATPPPVKKAPAKKAPAKKAPAKKAAAKKAPAKAVKKAPAKKNTAPPKKQPPPSPADL

SEQ ID NO: 1103369 - protein, 9 aa, Mycobacterium
SDVKTNAVT

SEQ ID NO: 1103370 - protein, 7 aa, Mycobacterium
SDVSRAA

SEQ ID NO: 1103371 - protein, 10 aa, Mycobacterium
SDVTNGPRGL

SEQ ID NO: 1103372 - protein, 13 aa, Mycobacterium
SDWRPSTEKEADP

SEQ ID NO: 1103373 - protein, 6 aa, Mycobacterium
SEADRA

SEQ ID NO: 1103374 - protein, 10 aa, Mycobacterium
SEFPGGDQAP

SEQ ID NO: 1103375 - protein, 4 aa, Mycobacterium
SEPA

SEQ ID NO: 1103376 - protein, 11 aa, Mycobacterium
SEPTSAGQARV

SEQ ID NO: 1103377 - protein, 61 aa, Mycobacterium
SEPVAPPAQQEQASADQGAINHDGHDHGEDGHAHGEYQPDPSQLPPPPDFSPEAARATAER

SEQ ID NO: 1103378 - protein, 4 aa, Mycobacterium
SESI

SEQ ID NO: 1103379 - protein, 10 aa, Mycobacterium
SGAGPLASDT

SEQ ID NO: 1103380 - protein, 10 aa, Mycobacterium
SGAPITPEQI

SEQ ID NO: 1103381 - protein, 22 aa, Mycobacterium
SGAPYPGTQYGPAQGQPPPRRR

SEQ ID NO: 1103382 - protein, 84 aa, Mycobacterium
SGDDSGESTTTTTTTTTTSEAPSVVPPQTVTESPTETTAPTETTAPPETTTTTPSETTTTTTAPTTTTTSPAATTTVETSTSTV

SEQ ID NO: 1103383 - protein, 9 aa, Mycobacterium
SGEIDETQY

SEQ ID NO: 1103384 - protein, 5 aa, Mycobacterium
SGEIG

SEQ ID NO: 1103385 - protein, 5 aa, Mycobacterium
SGELD

SEQ ID NO: 1103386 - protein, 12 aa, Mycobacterium
SGFSKSELEVPG

SEQ ID NO: 1103387 - protein, 18 aa, Mycobacterium
SGGAAPPAAPSAEGPGDE

SEQ ID NO: 1103388 - protein, 4 aa, Mycobacterium
SGGF

SEQ ID NO: 1103389 - protein, 7 aa, Mycobacterium
SGGYAGD

SEQ ID NO: 1103390 - protein, 12 aa, Mycobacterium
SGHGDADQSGAL

SEQ ID NO: 1103391 - protein, 12 aa, Mycobacterium
SGHGEARATPPT

SEQ ID NO: 1103392 - protein, 7 aa, Mycobacterium
SGNGQGL

SEQ ID NO: 1103393 - protein, 5 aa, Mycobacterium
SGPDA

SEQ ID NO: 1103394 - protein, 14 aa, Mycobacterium
SGPLLEGQAQTADQ

SEQ ID NO: 1103395 - protein, 8 aa, Mycobacterium
SGPSPLGP

SEQ ID NO: 1103396 - protein, 14 aa, Mycobacterium
SGQLAQAADREPID

SEQ ID NO: 1103397 - protein, 6 aa, Mycobacterium
SGQLGP

SEQ ID NO: 1103398 - protein, 5 aa, Mycobacterium
SGRSD

SEQ ID NO: 1103399 - protein, 19 aa, Mycobacterium
SGRSGPDAREVAASGARRG

SEQ ID NO: 1103400 - protein, 41 aa, Mycobacterium
SGSDDDSTPNPATTTTTTRSRTAPTTTRPTATSARPNRSAY

SEQ ID NO: 1103401 - protein, 8 aa, Mycobacterium
SGSGQRER

SEQ ID NO: 1103402 - protein, 35 aa, Mycobacterium
SGSRTAPSAPVADPETEEPATASARTATAAEPVVA

SEQ ID NO: 1103403 - protein, 9 aa, Mycobacterium
SGSSNPGTG

SEQ ID NO: 1103404 - protein, 8 aa, Mycobacterium
SGTNPTTA

SEQ ID NO: 1103405 - protein, 9 aa, Mycobacterium
SGTTGPPKR

SEQ ID NO: 1103406 - protein, 17 aa, Mycobacterium
SGTTGTPKGANRKPPMS

SEQ ID NO: 1103407 - protein, 5 aa, Mycobacterium
SIEGN

SEQ ID NO: 1103408 - protein, 8 aa, Mycobacterium
SINARDEA

SEQ ID NO: 1103409 - protein, 5 aa, Mycobacterium
SIPPT

SEQ ID NO: 1103410 - protein, 9 aa, Mycobacterium
SKADREKVG

SEQ ID NO: 1103411 - protein, 8 aa, Mycobacterium
SKKNATAT

SEQ ID NO: 1103412 - protein, 8 aa, Mycobacterium
SKPQRLDN

SEQ ID NO: 1103413 - protein, 7 aa, Mycobacterium
SKTATRT

SEQ ID NO: 1103414 - protein, 6 aa, Mycobacterium
SLGGTA

SEQ ID NO: 1103415 - protein, 7 aa, Mycobacterium
SLGPKAT

SEQ ID NO: 1103416 - protein, 11 aa, Mycobacterium
SLKTATAAARE

SEQ ID NO: 1103417 - protein, 11 aa, Mycobacterium
SLMNPKNPQMK

SEQ ID NO: 1103418 - protein, 4 aa, Mycobacterium
SLNR

SEQ ID NO: 1103419 - protein, 9 aa, Mycobacterium
SLPGDGAAP

SEQ ID NO: 1103420 - protein, 11 aa, Mycobacterium
SLPVADDATPV

SEQ ID NO: 1103421 - protein, 13 aa, Mycobacterium
SLPVTKDSGSEVI

SEQ ID NO: 1103422 - protein, 7 aa, Mycobacterium
SLSSTQA

SEQ ID NO: 1103423 - protein, 7 aa, Mycobacterium
SMAPDQV

SEQ ID NO: 1103424 - protein, 14 aa, Mycobacterium
SMPSGSAAARAGVD

SEQ ID NO: 1103425 - protein, 5 aa, Mycobacterium
SMSTY

SEQ ID NO: 1103426 - protein, 12 aa, Mycobacterium
SNAGAAEQSPRS

SEQ ID NO: 1103427 - protein, 13 aa, Mycobacterium
SNARQRKRNAPVP

SEQ ID NO: 1103428 - protein, 8 aa, Mycobacterium
SNLTGGGF

SEQ ID NO: 1103429 - protein, 9 aa, Mycobacterium
SNRFGSPQA

SEQ ID NO: 1103430 - protein, 5 aa, Mycobacterium
SNSIL

SEQ ID NO: 1103431 - protein, 6 aa, Mycobacterium
SNSNEQ

SEQ ID NO: 1103432 - protein, 19 aa, Mycobacterium
SPAADPSTSVRGNRVNGAQ

SEQ ID NO: 1103433 - protein, 7 aa, Mycobacterium
SPADAPT

SEQ ID NO: 1103434 - protein, 4 aa, Mycobacterium
SPDA

SEQ ID NO: 1103435 - protein, 24 aa, Mycobacterium
SPDATPPATLPPSSTDPSGAPTTF

SEQ ID NO: 1103436 - protein, 4 aa, Mycobacterium
SPDE

SEQ ID NO: 1103437 - protein, 6 aa, Mycobacterium
SPEPAR

SEQ ID NO: 1103438 - protein, 16 aa, Mycobacterium
SPEQVGTGNAGPRSDV

SEQ ID NO: 1103439 - protein, 23 aa, Mycobacterium
SPESVKSIDADADSALCFSVQYL

SEQ ID NO: 1103440 - protein, 16 aa, Mycobacterium
SPGPWRRNADPTAPAG

SEQ ID NO: 1103441 - protein, 29 aa, Mycobacterium
SPGRAAALNAGGIAAEANAAQAAGGSYAD

SEQ ID NO: 1103442 - protein, 8 aa, Mycobacterium
SPHNYEGE

SEQ ID NO: 1103443 - protein, 5 aa, Mycobacterium
SPHPG

SEQ ID NO: 1103444 - protein, 5 aa, Mycobacterium
SPLPG

SEQ ID NO: 1103445 - protein, 9 aa, Mycobacterium
SPNGAAKAA

SEQ ID NO: 1103446 - protein, 8 aa, Mycobacterium
SPNPPRKL

SEQ ID NO: 1103447 - protein, 5 aa, Mycobacterium
SPPIF

SEQ ID NO: 1103448 - protein, 13 aa, Mycobacterium
SPQAPGERQQAAG

SEQ ID NO: 1103449 - protein, 7 aa, Mycobacterium
SPQTAQT

SEQ ID NO: 1103450 - protein, 11 aa, Mycobacterium
SPTATSESEVT

SEQ ID NO: 1103451 - protein, 6 aa, Mycobacterium
SPYADR

SEQ ID NO: 1103452 - protein, 6 aa, Mycobacterium
SPYAER

SEQ ID NO: 1103453 - protein, 6 aa, Mycobacterium
SPYTGV

SEQ ID NO: 1103454 - protein, 8 aa, Mycobacterium
SQAESTEA

SEQ ID NO: 1103455 - protein, 12 aa, Mycobacterium
SQEDNSGEQRID

SEQ ID NO: 1103456 - protein, 6 aa, Mycobacterium
SQFPAP

SEQ ID NO: 1103457 - protein, 4 aa, Mycobacterium
SQGS

SEQ ID NO: 1103458 - protein, 5 aa, Mycobacterium
SQLRS

SEQ ID NO: 1103459 - protein, 9 aa, Mycobacterium
SQMGPYGQM

SEQ ID NO: 1103460 - protein, 11 aa, Mycobacterium
SQRGDPGYKAT

SEQ ID NO: 1103461 - protein, 14 aa, Mycobacterium
SRAKQLTKDMPKTT

SEQ ID NO: 1103462 - protein, 19 aa, Mycobacterium
SRFPSREEPLATPPPGSNL

SEQ ID NO: 1103463 - protein, 19 aa, Mycobacterium
SRGDFGAAGGGGRHAMSEA

SEQ ID NO: 1103464 - protein, 4 aa, Mycobacterium
SRGI

SEQ ID NO: 1103465 - protein, 11 aa, Mycobacterium
SRGPDAGPDQV

SEQ ID NO: 1103466 - protein, 22 aa, Mycobacterium
SRHAGDQSDATTPASRAPIRVA

SEQ ID NO: 1103467 - protein, 13 aa, Mycobacterium
SRKYGGAKTLDEI

SEQ ID NO: 1103468 - protein, 8 aa, Mycobacterium
SRPRSLAG

SEQ ID NO: 1103469 - protein, 4 aa, Mycobacterium
SRQR

SEQ ID NO: 1103470 - protein, 6 aa, Mycobacterium
SRRPLQ

SEQ ID NO: 1103471 - protein, 5 aa, Mycobacterium
SRRPR

SEQ ID NO: 1103472 - protein, 6 aa, Mycobacterium
SRRPTA

SEQ ID NO: 1103473 - protein, 38 aa, Mycobacterium
SRSVKPEPAEAGKAADREPLTTAGAADGGPDEEMPEPV

SEQ ID NO: 1103474 - protein, 6 aa, Mycobacterium
SRTIRE

SEQ ID NO: 1103475 - protein, 4 aa, Mycobacterium
SRTM

SEQ ID NO: 1103476 - protein, 5 aa, Mycobacterium
SRTPV

SEQ ID NO: 1103477 - protein, 23 aa, Mycobacterium
SRYAGDTDGTDYTCSGSPSAVAD

SEQ ID NO: 1103478 - protein, 25 aa, Mycobacterium
SSAQWSPKQPQGDGDPQQIKTAGDV

SEQ ID NO: 1103479 - protein, 10 aa, Mycobacterium
SSASPGQTED

SEQ ID NO: 1103480 - protein, 5 aa, Mycobacterium
SSDSM

SEQ ID NO: 1103481 - protein, 5 aa, Mycobacterium
SSLTD

SEQ ID NO: 1103482 - protein, 6 aa, Mycobacterium
SSPELA

SEQ ID NO: 1103483 - protein, 6 aa, Mycobacterium
SSPLEV

SEQ ID NO: 1103484 - protein, 7 aa, Mycobacterium
SSSADRA

SEQ ID NO: 1103485 - protein, 14 aa, Mycobacterium
SSSDEADTTPTTTL

SEQ ID NO: 1103486 - protein, 8 aa, Mycobacterium
SSTASNYL

SEQ ID NO: 1103487 - protein, 8 aa, Mycobacterium
SSTGTFRD

SEQ ID NO: 1103488 - protein, 9 aa, Mycobacterium
STAADPIGT

SEQ ID NO: 1103489 - protein, 14 aa, Mycobacterium
STEQRAASGEATER

SEQ ID NO: 1103490 - protein, 9 aa, Mycobacterium
STGRTPVAP

SEQ ID NO: 1103491 - protein, 7 aa, Mycobacterium
STLGESE

SEQ ID NO: 1103492 - protein, 4 aa, Mycobacterium
STNY

SEQ ID NO: 1103493 - protein, 10 aa, Mycobacterium
STPDPAPELP

SEQ ID NO: 1103494 - protein, 5 aa, Mycobacterium
STRRL

SEQ ID NO: 1103495 - protein, 9 aa, Mycobacterium
STTAEDNSL

SEQ ID NO: 1103496 - protein, 8 aa, Mycobacterium
STTMPGGP

SEQ ID NO: 1103497 - protein, 5 aa, Mycobacterium
STTTH

SEQ ID NO: 1103498 - protein, 6 aa, Mycobacterium
STVGTA

SEQ ID NO: 1103499 - protein, 8 aa, Mycobacterium
STVPDLTA

SEQ ID NO: 1103500 - protein, 14 aa, Mycobacterium
SVAPRTAKKTDSRL

SEQ ID NO: 1103501 - protein, 19 aa, Mycobacterium
SVEGEDAVAAEESAEEAHA

SEQ ID NO: 1103502 - protein, 15 aa, Mycobacterium
SVGRAREIEPGHRRD

SEQ ID NO: 1103503 - protein, 7 aa, Mycobacterium
SVRPTKA

SEQ ID NO: 1103504 - protein, 16 aa, Mycobacterium
SVSDGSMSQQGDGANI

SEQ ID NO: 1103505 - protein, 7 aa, Mycobacterium
SVSRKCR

SEQ ID NO: 1103506 - protein, 33 aa, Mycobacterium
SVSSSAADSTALPNVAPATGPTAAIDADTSTSW

SEQ ID NO: 1103507 - protein, 11 aa, Mycobacterium
SVTPGRPSTTR

SEQ ID NO: 1103508 - protein, 24 aa, Mycobacterium
TAAAEEVGTLPTPQDFANAEGKGV

SEQ ID NO: 1103509 - protein, 4 aa, Mycobacterium
TAAD

SEQ ID NO: 1103510 - protein, 15 aa, Mycobacterium
TAAERGRGGDQVKTA

SEQ ID NO: 1103511 - protein, 17 aa, Mycobacterium
TAANPPGATADVPPGPI

SEQ ID NO: 1103512 - protein, 8 aa, Mycobacterium
TADAGGVG

SEQ ID NO: 1103513 - protein, 5 aa, Mycobacterium
TADDR

SEQ ID NO: 1103514 - protein, 7 aa, Mycobacterium
TADNPAH

SEQ ID NO: 1103515 - protein, 28 aa, Mycobacterium
TADPATEANDAITAAYDGSGGPTGPLGV

SEQ ID NO: 1103516 - protein, 8 aa, Mycobacterium
TADSDDAE

SEQ ID NO: 1103517 - protein, 8 aa, Mycobacterium
TAEGESLT

SEQ ID NO: 1103518 - protein, 4 aa, Mycobacterium
TAEL

SEQ ID NO: 1103519 - protein, 6 aa, Mycobacterium
TAEPVP

SEQ ID NO: 1103520 - protein, 10 aa, Mycobacterium
TAGDRAPVAE

SEQ ID NO: 1103521 - protein, 13 aa, Mycobacterium
TAHGGPRSPSNVV

SEQ ID NO: 1103522 - protein, 5 aa, Mycobacterium
TAPAA

SEQ ID NO: 1103523 - protein, 9 aa, Mycobacterium
TAPAGPNEI

SEQ ID NO: 1103524 - protein, 12 aa, Mycobacterium
TARGGPAGVGEA

SEQ ID NO: 1103525 - protein, 17 aa, Mycobacterium
TARTNNRAGNPVGSSYL

SEQ ID NO: 1103526 - protein, 18 aa, Mycobacterium
TARTNNRAGNPVGSSYLS

SEQ ID NO: 1103527 - protein, 7 aa, Mycobacterium
TASGDMT

SEQ ID NO: 1103528 - protein, 10 aa, Mycobacterium
TASPAGRTAG

SEQ ID NO: 1103529 - protein, 33 aa, Mycobacterium
TASTDPEARREMTDPYTLSPDRSAEPELGAQPD

SEQ ID NO: 1103530 - protein, 14 aa, Mycobacterium
TASTSSPAPEGVSV

SEQ ID NO: 1103531 - protein, 12 aa, Mycobacterium
TATQQENINPGN

SEQ ID NO: 1103532 - protein, 24 aa, Mycobacterium
TAVATEQGRGELSPGSDRPNRLTQ

SEQ ID NO: 1103533 - protein, 7 aa, Mycobacterium
TAVGPPQ

SEQ ID NO: 1103534 - protein, 8 aa, Mycobacterium
TAYTSGAA

SEQ ID NO: 1103535 - protein, 4 aa, Mycobacterium
TDAE

SEQ ID NO: 1103536 - protein, 12 aa, Mycobacterium
TDAGGFESYVVK

SEQ ID NO: 1103537 - protein, 17 aa, Mycobacterium
TDGDNRLVSPPSSPEQV

SEQ ID NO: 1103538 - protein, 17 aa, Mycobacterium
TDGFGGNRGQCQGTPGM

SEQ ID NO: 1103539 - protein, 9 aa, Mycobacterium
TDPKTEPVF

SEQ ID NO: 1103540 - protein, 22 aa, Mycobacterium
TDTPPPAYPAAPAEERRRPGRV

SEQ ID NO: 1103541 - protein, 5 aa, Mycobacterium
TEDEV

SEQ ID NO: 1103542 - protein, 25 aa, Mycobacterium
TEDRPKAKAPLPALTPQRGRHRPAA

SEQ ID NO: 1103543 - protein, 5 aa, Mycobacterium
TEFGG

SEQ ID NO: 1103544 - protein, 10 aa, Mycobacterium
TEGADGEATV

SEQ ID NO: 1103545 - protein, 12 aa, Mycobacterium
TEGSSTNPTGAG

SEQ ID NO: 1103546 - protein, 9 aa, Mycobacterium
TELDPNERH

SEQ ID NO: 1103547 - protein, 6 aa, Mycobacterium
TEPSTV

SEQ ID NO: 1103548 - protein, 7 aa, Mycobacterium
TESPLGG

SEQ ID NO: 1103549 - protein, 15 aa, Mycobacterium
TESTAYSRFPTDQTA

SEQ ID NO: 1103550 - protein, 6 aa, Mycobacterium
TETDPF

SEQ ID NO: 1103551 - protein, 43 aa, Mycobacterium
TETSTPPPTTTAEPSTSTSVVTSTTTSTTVSTTTVTVTAPPPA

SEQ ID NO: 1103552 - protein, 6 aa, Mycobacterium
TFAPGA

SEQ ID NO: 1103553 - protein, 9 aa, Mycobacterium
TFSQPPPDW

SEQ ID NO: 1103554 - protein, 4 aa, Mycobacterium
TGAD

SEQ ID NO: 1103555 - protein, 4 aa, Mycobacterium
TGAG

SEQ ID NO: 1103556 - protein, 14 aa, Mycobacterium
TGAGLTGRRDGDTI

SEQ ID NO: 1103557 - protein, 9 aa, Mycobacterium
TGAGSTDEF

SEQ ID NO: 1103558 - protein, 9 aa, Mycobacterium
TGARPPRDL

SEQ ID NO: 1103559 - protein, 5 aa, Mycobacterium
TGATA

SEQ ID NO: 1103560 - protein, 5 aa, Mycobacterium
TGDRR

SEQ ID NO: 1103561 - protein, 8 aa, Mycobacterium
TGEDGTLR

SEQ ID NO: 1103562 - protein, 7 aa, Mycobacterium
TGEESAS

SEQ ID NO: 1103563 - protein, 15 aa, Mycobacterium
TGESLPVEAGPGSDV

SEQ ID NO: 1103564 - protein, 10 aa, Mycobacterium
TGESRPIARG

SEQ ID NO: 1103565 - protein, 16 aa, Mycobacterium
TGESVPVEAGPGSDVH

SEQ ID NO: 1103566 - protein, 5 aa, Mycobacterium
TGFGT

SEQ ID NO: 1103567 - protein, 8 aa, Mycobacterium
TGGDSARA

SEQ ID NO: 1103568 - protein, 7 aa, Mycobacterium
TGGPAGV

SEQ ID NO: 1103569 - protein, 17 aa, Mycobacterium
TGLASPPVGLGAGGLGS

SEQ ID NO: 1103570 - protein, 10 aa, Mycobacterium
TGQEARGDDA

SEQ ID NO: 1103571 - protein, 22 aa, Mycobacterium
TGRLDGDTVSAAGRAARPAPET

SEQ ID NO: 1103572 - protein, 14 aa, Mycobacterium
TGSDITAKKKSRKF

SEQ ID NO: 1103573 - protein, 7 aa, Mycobacterium
TGSFSQN

SEQ ID NO: 1103574 - protein, 7 aa, Mycobacterium
TGSGSYA

SEQ ID NO: 1103575 - protein, 6 aa, Mycobacterium
TGSSGL

SEQ ID NO: 1103576 - protein, 8 aa, Mycobacterium
TGSTEGLA

SEQ ID NO: 1103577 - protein, 23 aa, Mycobacterium
TGTAPQVETARRRGEAQADQSAA

SEQ ID NO: 1103578 - protein, 6 aa, Mycobacterium
TGTERH

SEQ ID NO: 1103579 - protein, 7 aa, Mycobacterium
TGTLSEN

SEQ ID NO: 1103580 - protein, 10 aa, Mycobacterium
TGTLTEGRPR

SEQ ID NO: 1103581 - protein, 12 aa, Mycobacterium
TGTLTKGEPTVT

SEQ ID NO: 1103582 - protein, 8 aa, Mycobacterium
TGTVTTGT

SEQ ID NO: 1103583 - protein, 32 aa, Mycobacterium
TGYRASLPAPPTPPATASGQPEPARQTDDPEL

SEQ ID NO: 1103584 - protein, 13 aa, Mycobacterium
THAPDAAAMTASQ

SEQ ID NO: 1103585 - protein, 7 aa, Mycobacterium
THGATRE

SEQ ID NO: 1103586 - protein, 17 aa, Mycobacterium
THGTVPTAVGSATEGVE

SEQ ID NO: 1103587 - protein, 4 aa, Mycobacterium
THPS

SEQ ID NO: 1103588 - protein, 8 aa, Mycobacterium
TIAPIPDA

SEQ ID NO: 1103589 - protein, 18 aa, Mycobacterium
TINGRTGKRGNARTGFAD

SEQ ID NO: 1103590 - protein, 7 aa, Mycobacterium
TIPRKEL

SEQ ID NO: 1103591 - protein, 5 aa, Mycobacterium
TKWSG

SEQ ID NO: 1103592 - protein, 15 aa, Mycobacterium
TLETSDSGDPPEGRI

SEQ ID NO: 1103593 - protein, 8 aa, Mycobacterium
TLGERDAE

SEQ ID NO: 1103594 - protein, 9 aa, Mycobacterium
TLGGRTLTP

SEQ ID NO: 1103595 - protein, 4 aa, Mycobacterium
TNHR

SEQ ID NO: 1103596 - protein, 4 aa, Mycobacterium
TNPD

SEQ ID NO: 1103597 - protein, 5 aa, Mycobacterium
TNRGA

SEQ ID NO: 1103598 - protein, 12 aa, Mycobacterium
TNSESADQEQGY

SEQ ID NO: 1103599 - protein, 9 aa, Mycobacterium
TNSPGKPPT

SEQ ID NO: 1103600 - protein, 4 aa, Mycobacterium
TPAP

SEQ ID NO: 1103601 - protein, 7 aa, Mycobacterium
TPAPATT

SEQ ID NO: 1103602 - protein, 12 aa, Mycobacterium
TPAPPPPGPTVS

SEQ ID NO: 1103603 - protein, 12 aa, Mycobacterium
TPATEAKAETPV

SEQ ID NO: 1103604 - protein, 19 aa, Mycobacterium
TPAVEAPAPVHGPAQTGKL

SEQ ID NO: 1103605 - protein, 4 aa, Mycobacterium
TPDT

SEQ ID NO: 1103606 - protein, 15 aa, Mycobacterium
TPEPVPTRRRWFRRR

SEQ ID NO: 1103607 - protein, 10 aa, Mycobacterium
TPETLRQGAE

SEQ ID NO: 1103608 - protein, 4 aa, Mycobacterium
TPGE

SEQ ID NO: 1103609 - protein, 5 aa, Mycobacterium
TPHRG

SEQ ID NO: 1103610 - protein, 24 aa, Mycobacterium
TPITPTATTATTAPGTTQTETETV

SEQ ID NO: 1103611 - protein, 16 aa, Mycobacterium
TPKPAEGVPPPPLNTP

SEQ ID NO: 1103612 - protein, 5 aa, Mycobacterium
TPLAG

SEQ ID NO: 1103613 - protein, 17 aa, Mycobacterium
TPLPGPQVATPVVQVAA

SEQ ID NO: 1103614 - protein, 8 aa, Mycobacterium
TPPDISSR

SEQ ID NO: 1103615 - protein, 21 aa, Mycobacterium
TPPPGVVPQGGAEAGAEAVES

SEQ ID NO: 1103616 - protein, 9 aa, Mycobacterium
TPRADNHPR

SEQ ID NO: 1103617 - protein, 5 aa, Mycobacterium
TPRDQ

SEQ ID NO: 1103618 - protein, 7 aa, Mycobacterium
TPSRTRA

SEQ ID NO: 1103619 - protein, 9 aa, Mycobacterium
TPTPEPLPE

SEQ ID NO: 1103620 - protein, 19 aa, Mycobacterium
TPTPGEADLTNTPAPRARR

SEQ ID NO: 1103621 - protein, 13 aa, Mycobacterium
TPTPTAEAPAEAG

SEQ ID NO: 1103622 - protein, 8 aa, Mycobacterium
TPTSTGTD

SEQ ID NO: 1103623 - protein, 4 aa, Mycobacterium
TPTY

SEQ ID NO: 1103624 - protein, 5 aa, Mycobacterium
TPTYK

SEQ ID NO: 1103625 - protein, 14 aa, Mycobacterium
TQRFTGEGDQPTTV

SEQ ID NO: 1103626 - protein, 44 aa, Mycobacterium
TQSSATATPPAAPPVRPKDRIDTSGLPAVGDDATIPRDAPKRPI

SEQ ID NO: 1103627 - protein, 4 aa, Mycobacterium
TRAV

SEQ ID NO: 1103628 - protein, 4 aa, Mycobacterium
TRDD

SEQ ID NO: 1103629 - protein, 6 aa, Mycobacterium
TRDFKG

SEQ ID NO: 1103630 - protein, 17 aa, Mycobacterium
TRDPNPARLENLTLQEN

SEQ ID NO: 1103631 - protein, 65 aa, Mycobacterium
TREPLEPGGIDGDPVEEPSDPDPPATAEPDDTATAEPDPPQQTQQNEPDENKPDDNPPGGTDENG

SEQ ID NO: 1103632 - protein, 7 aa, Mycobacterium
TRGFKPV

SEQ ID NO: 1103633 - protein, 6 aa, Mycobacterium
TRGRTL

SEQ ID NO: 1103634 - protein, 7 aa, Mycobacterium
TRKGRSQ

SEQ ID NO: 1103635 - protein, 7 aa, Mycobacterium
TRNDREW

SEQ ID NO: 1103636 - protein, 5 aa, Mycobacterium
TRRAG

SEQ ID NO: 1103637 - protein, 8 aa, Mycobacterium
TRRRGRSL

SEQ ID NO: 1103638 - protein, 4 aa, Mycobacterium
TRSA

SEQ ID NO: 1103639 - protein, 13 aa, Mycobacterium
TRTPAPSGLRTDS

SEQ ID NO: 1103640 - protein, 8 aa, Mycobacterium
TRTRGQVD

SEQ ID NO: 1103641 - protein, 5 aa, Mycobacterium
TRTRR

SEQ ID NO: 1103642 - protein, 8 aa, Mycobacterium
TSDDLGAA

SEQ ID NO: 1103643 - protein, 4 aa, Mycobacterium
TSGL

SEQ ID NO: 1103644 - protein, 14 aa, Mycobacterium
TSGTAPLSADDADA

SEQ ID NO: 1103645 - protein, 6 aa, Mycobacterium
TSIPQA

SEQ ID NO: 1103646 - protein, 12 aa, Mycobacterium
TSIRSPADTTLR

SEQ ID NO: 1103647 - protein, 8 aa, Mycobacterium
TSKARRTL

SEQ ID NO: 1103648 - protein, 6 aa, Mycobacterium
TSRAPW

SEQ ID NO: 1103649 - protein, 6 aa, Mycobacterium
TSRNGY

SEQ ID NO: 1103650 - protein, 19 aa, Mycobacterium
TSRRGVSAGGRSGAPSRTF

SEQ ID NO: 1103651 - protein, 7 aa, Mycobacterium
TSRTDDA

SEQ ID NO: 1103652 - protein, 9 aa, Mycobacterium
TSSAGPVLA

SEQ ID NO: 1103653 - protein, 6 aa, Mycobacterium
TSSLTD

SEQ ID NO: 1103654 - protein, 10 aa, Mycobacterium
TSTASLAPVP

SEQ ID NO: 1103655 - protein, 14 aa, Mycobacterium
TSTRTGDPGEYPPA

SEQ ID NO: 1103656 - protein, 10 aa, Mycobacterium
TSVSPLTRPH

SEQ ID NO: 1103657 - protein, 10 aa, Mycobacterium
TSVTDVEPSV

SEQ ID NO: 1103658 - protein, 22 aa, Mycobacterium
TTADSAANAPRRDEREPVGGDA

SEQ ID NO: 1103659 - protein, 5 aa, Mycobacterium
TTALP

SEQ ID NO: 1103660 - protein, 5 aa, Mycobacterium
TTDRA

SEQ ID NO: 1103661 - protein, 9 aa, Mycobacterium
TTEASAAPN

SEQ ID NO: 1103662 - protein, 4 aa, Mycobacterium
TTGA

SEQ ID NO: 1103663 - protein, 20 aa, Mycobacterium
TTGATGRGSRRSPEPSADPS

SEQ ID NO: 1103664 - protein, 9 aa, Mycobacterium
TTHDGARGY

SEQ ID NO: 1103665 - protein, 7 aa, Mycobacterium
TTIDTSP

SEQ ID NO: 1103666 - protein, 8 aa, Mycobacterium
TTKVGSDT

SEQ ID NO: 1103667 - protein, 7 aa, Mycobacterium
TTPFPGT

SEQ ID NO: 1103668 - protein, 8 aa, Mycobacterium
TTPGTERR

SEQ ID NO: 1103669 - protein, 17 aa, Mycobacterium
TTSGSTLADTYQGNRFS

SEQ ID NO: 1103670 - protein, 4 aa, Mycobacterium
TTTP

SEQ ID NO: 1103671 - protein, 17 aa, Mycobacterium
TTTQEGQQWKISQLIQV

SEQ ID NO: 1103672 - protein, 9 aa, Mycobacterium
TTTSEDNSL

SEQ ID NO: 1103673 - protein, 5 aa, Mycobacterium
TTTSS

SEQ ID NO: 1103674 - protein, 18 aa, Mycobacterium
TTTVGDDPPSATTSSARV

SEQ ID NO: 1103675 - protein, 11 aa, Mycobacterium
TTVNSRGAKTT

SEQ ID NO: 1103676 - protein, 5 aa, Mycobacterium
TVESA

SEQ ID NO: 1103677 - protein, 8 aa, Mycobacterium
TVGAASGL

SEQ ID NO: 1103678 - protein, 5 aa, Mycobacterium
TVGPQ

SEQ ID NO: 1103679 - protein, 13 aa, Mycobacterium
TVPGTTEAANTTF

SEQ ID NO: 1103680 - protein, 15 aa, Mycobacterium
TVPPGGDEYRRAHTA

SEQ ID NO: 1103681 - protein, 10 aa, Mycobacterium
TVRDAPKGID

SEQ ID NO: 1103682 - protein, 5 aa, Mycobacterium
TVRGG

SEQ ID NO: 1103683 - protein, 6 aa, Mycobacterium
TVSDAE

SEQ ID NO: 1103684 - protein, 9 aa, Mycobacterium
TWPGDLGER

SEQ ID NO: 1103685 - protein, 12 aa, Mycobacterium
TYRSRQAREESI

SEQ ID NO: 1103686 - protein, 6 aa, Mycobacterium
TYSDKY

SEQ ID NO: 1103687 - protein, 6 aa, Mycobacterium
VAAPGG

SEQ ID NO: 1103688 - protein, 8 aa, Mycobacterium
VAARGGPQ

SEQ ID NO: 1103689 - protein, 10 aa, Mycobacterium
VADNATSAMQ

SEQ ID NO: 1103690 - protein, 7 aa, Mycobacterium
VADQGVA

SEQ ID NO: 1103691 - protein, 10 aa, Mycobacterium
VAEAERTKAT

SEQ ID NO: 1103692 - protein, 6 aa, Mycobacterium
VAGDAD

SEQ ID NO: 1103693 - protein, 22 aa, Mycobacterium
VAGDDDAKDEDVQSDTAEPVAE

SEQ ID NO: 1103694 - protein, 14 aa, Mycobacterium
VAKRKDSENLGDRS

SEQ ID NO: 1103695 - protein, 33 aa, Mycobacterium
VANPESPETAEAPETSAADEADETGEAGRSPVR

SEQ ID NO: 1103696 - protein, 16 aa, Mycobacterium
VAPASTATDADERGAA

SEQ ID NO: 1103697 - protein, 6 aa, Mycobacterium
VAPNDH

SEQ ID NO: 1103698 - protein, 8 aa, Mycobacterium
VAPPQQKK

SEQ ID NO: 1103699 - protein, 26 aa, Mycobacterium
VAPPQQPSVRQPEVPVRSGDPAAVPA

SEQ ID NO: 1103700 - protein, 9 aa, Mycobacterium
VAPRPRNPR

SEQ ID NO: 1103701 - protein, 22 aa, Mycobacterium
VAQGEAPAETSGEATPVQAGRN

SEQ ID NO: 1103702 - protein, 6 aa, Mycobacterium
VARDSP

SEQ ID NO: 1103703 - protein, 10 aa, Mycobacterium
VARPNGGFGT

SEQ ID NO: 1103704 - protein, 11 aa, Mycobacterium
VDAGGPASATY

SEQ ID NO: 1103705 - protein, 4 aa, Mycobacterium
VDDP

SEQ ID NO: 1103706 - protein, 22 aa, Mycobacterium
VDEVRRNQVEPALRGGDWAGGA

SEQ ID NO: 1103707 - protein, 19 aa, Mycobacterium
VDGSDGSDGSDGSGGDTKA

SEQ ID NO: 1103708 - protein, 6 aa, Mycobacterium
VDKPPA

SEQ ID NO: 1103709 - protein, 7 aa, Mycobacterium
VDPDADT

SEQ ID NO: 1103710 - protein, 9 aa, Mycobacterium
VDPDPGPPV

SEQ ID NO: 1103711 - protein, 11 aa, Mycobacterium
VDPSGGARYEV

SEQ ID NO: 1103712 - protein, 5 aa, Mycobacterium
VDRND

SEQ ID NO: 1103713 - protein, 23 aa, Mycobacterium
VDTPAADTETDPEGAGNPPLDES

SEQ ID NO: 1103714 - protein, 11 aa, Mycobacterium
VEADPPPRDEL

SEQ ID NO: 1103715 - protein, 27 aa, Mycobacterium
VEAGEAGDREPLTTAGAVEGGAEAEAL

SEQ ID NO: 1103716 - protein, 17 aa, Mycobacterium
VEDGAPSELIGRDGGRY

SEQ ID NO: 1103717 - protein, 10 aa, Mycobacterium
VEGAAEAEAL

SEQ ID NO: 1103718 - protein, 11 aa, Mycobacterium
VEGAEEAEAVA

SEQ ID NO: 1103719 - protein, 18 aa, Mycobacterium
VEGEDAVAAEESAEEAHA

SEQ ID NO: 1103720 - protein, 21 aa, Mycobacterium
VELPPPSSAPVTTTQPTTSLA

SEQ ID NO: 1103721 - protein, 5 aa, Mycobacterium
VERGD

SEQ ID NO: 1103722 - protein, 14 aa, Mycobacterium
VERTEEAMDTASTI

SEQ ID NO: 1103723 - protein, 11 aa, Mycobacterium
VESAAAAGDNF

SEQ ID NO: 1103724 - protein, 17 aa, Mycobacterium
VESYDTRTGTWQPQPPL

SEQ ID NO: 1103725 - protein, 7 aa, Mycobacterium
VEVTDTG

SEQ ID NO: 1103726 - protein, 8 aa, Mycobacterium
VGAESRDA

SEQ ID NO: 1103727 - protein, 47 aa, Mycobacterium
VGAGEAADREALTTAGAVEGEDAVAAEESAEEAHEAAVEGAAEAEAL

SEQ ID NO: 1103728 - protein, 7 aa, Mycobacterium
VGAQAAR

SEQ ID NO: 1103729 - protein, 11 aa, Mycobacterium
VGDGPEVHPHE

SEQ ID NO: 1103730 - protein, 10 aa, Mycobacterium
VGDSPREKTS

SEQ ID NO: 1103731 - protein, 6 aa, Mycobacterium
VGDSRI

SEQ ID NO: 1103732 - protein, 9 aa, Mycobacterium
VGERSPGRL

SEQ ID NO: 1103733 - protein, 6 aa, Mycobacterium
VGGAEA

SEQ ID NO: 1103734 - protein, 8 aa, Mycobacterium
VGGQGRKE

SEQ ID NO: 1103735 - protein, 4 aa, Mycobacterium
VGGT

SEQ ID NO: 1103736 - protein, 5 aa, Mycobacterium
VGPDG

SEQ ID NO: 1103737 - protein, 8 aa, Mycobacterium
VGPLRPDQ

SEQ ID NO: 1103738 - protein, 6 aa, Mycobacterium
VGRPGT

SEQ ID NO: 1103739 - protein, 7 aa, Mycobacterium
VGRPPDV

SEQ ID NO: 1103740 - protein, 6 aa, Mycobacterium
VGSAYR

SEQ ID NO: 1103741 - protein, 5 aa, Mycobacterium
VGSDT

SEQ ID NO: 1103742 - protein, 4 aa, Mycobacterium
VGSE

SEQ ID NO: 1103743 - protein, 13 aa, Mycobacterium
VGSERGGLGGITR

SEQ ID NO: 1103744 - protein, 4 aa, Mycobacterium
VGSS

SEQ ID NO: 1103745 - protein, 29 aa, Mycobacterium
VHGPSTTATTTTTSPPIPRSSGPSTGRWL

SEQ ID NO: 1103746 - protein, 20 aa, Mycobacterium
VKDERTATGVNALTYCFVKS

SEQ ID NO: 1103747 - protein, 10 aa, Mycobacterium
VKETTADTTL

SEQ ID NO: 1103748 - protein, 4 aa, Mycobacterium
VKMP

SEQ ID NO: 1103749 - protein, 15 aa, Mycobacterium
VKPAGQPQPSDRLKG

SEQ ID NO: 1103750 - protein, 8 aa, Mycobacterium
VKPAGSEQ

SEQ ID NO: 1103751 - protein, 9 aa, Mycobacterium
VKPTSAQAI

SEQ ID NO: 1103752 - protein, 20 aa, Mycobacterium
VLPPSQLSDPQTGQPATPAL

SEQ ID NO: 1103753 - protein, 4 aa, Mycobacterium
VNAG

SEQ ID NO: 1103754 - protein, 8 aa, Mycobacterium
VNDAPALA

SEQ ID NO: 1103755 - protein, 6 aa, Mycobacterium
VNGDRQ

SEQ ID NO: 1103756 - protein, 7 aa, Mycobacterium
VNGPAGS

SEQ ID NO: 1103757 - protein, 14 aa, Mycobacterium
VNGPLTGDAAAPTF

SEQ ID NO: 1103758 - protein, 14 aa, Mycobacterium
VNPGWQARGPGGDL

SEQ ID NO: 1103759 - protein, 9 aa, Mycobacterium
VNPKTQTPI

SEQ ID NO: 1103760 - protein, 12 aa, Mycobacterium
VPAAASVSAEPD

SEQ ID NO: 1103761 - protein, 7 aa, Mycobacterium
VPADSDA

SEQ ID NO: 1103762 - protein, 5 aa, Mycobacterium
VPAGA

SEQ ID NO: 1103763 - protein, 9 aa, Mycobacterium
VPAGAQDVD

SEQ ID NO: 1103764 - protein, 29 aa, Mycobacterium
VPAPGDTGSDHDGPEGMPPKLDEPGPIAP

SEQ ID NO: 1103765 - protein, 14 aa, Mycobacterium
VPAPGEPTPPPKSL

SEQ ID NO: 1103766 - protein, 8 aa, Mycobacterium
VPATEEQA

SEQ ID NO: 1103767 - protein, 9 aa, Mycobacterium
VPDAGAAGQ

SEQ ID NO: 1103768 - protein, 8 aa, Mycobacterium
VPEDDKGL

SEQ ID NO: 1103769 - protein, 7 aa, Mycobacterium
VPENATA

SEQ ID NO: 1103770 - protein, 4 aa, Mycobacterium
VPGH

SEQ ID NO: 1103771 - protein, 20 aa, Mycobacterium
VPGKRAATPKECRSDDPYVP

SEQ ID NO: 1103772 - protein, 6 aa, Mycobacterium
VPGSVH

SEQ ID NO: 1103773 - protein, 11 aa, Mycobacterium
VPHEGKSTTAI

SEQ ID NO: 1103774 - protein, 14 aa, Mycobacterium
VPLSPPGAPLTLQA

SEQ ID NO: 1103775 - protein, 35 aa, Mycobacterium
VPPAPAPAPAPSGPLPAEAPVPPSDSDPTTQTAPS

SEQ ID NO: 1103776 - protein, 7 aa, Mycobacterium
VPPEGNR

SEQ ID NO: 1103777 - protein, 6 aa, Mycobacterium
VPPEQL

SEQ ID NO: 1103778 - protein, 12 aa, Mycobacterium
VPPNDPGVPPPL

SEQ ID NO: 1103779 - protein, 9 aa, Mycobacterium
VPPPARAPD

SEQ ID NO: 1103780 - protein, 9 aa, Mycobacterium
VPPPPQPIP

SEQ ID NO: 1103781 - protein, 60 aa, Mycobacterium
VPQAPSNPYYPPSSSGGGSGSSRGDYGSGSGSGSGSGSYDGGGSSGGEDSVWPFPSFGGG

SEQ ID NO: 1103782 - protein, 6 aa, Mycobacterium
VPQTPY

SEQ ID NO: 1103783 - protein, 17 aa, Mycobacterium
VPQTTVTSTVAPPVAEP

SEQ ID NO: 1103784 - protein, 12 aa, Mycobacterium
VPTPSESETNDV

SEQ ID NO: 1103785 - protein, 7 aa, Mycobacterium
VQGGAGG

SEQ ID NO: 1103786 - protein, 11 aa, Mycobacterium
VQPGDDLPPGG

SEQ ID NO: 1103787 - protein, 36 aa, Mycobacterium
VQPPNADPDQAEAGTEAPDTADSDRGLETKPEPEVK

SEQ ID NO: 1103788 - protein, 11 aa, Mycobacterium
VQTGDAASGFR

SEQ ID NO: 1103789 - protein, 11 aa, Mycobacterium
VRAESGAAAAR

SEQ ID NO: 1103790 - protein, 10 aa, Mycobacterium
VRDDDQRSAV

SEQ ID NO: 1103791 - protein, 10 aa, Mycobacterium
VRDPSEDQAL

SEQ ID NO: 1103792 - protein, 4 aa, Mycobacterium
VRET

SEQ ID NO: 1103793 - protein, 8 aa, Mycobacterium
VRETSADA

SEQ ID NO: 1103794 - protein, 8 aa, Mycobacterium
VRETSAEA

SEQ ID NO: 1103795 - protein, 8 aa, Mycobacterium
VRQSDSEA

SEQ ID NO: 1103796 - protein, 8 aa, Mycobacterium
VRRGGREY

SEQ ID NO: 1103797 - protein, 15 aa, Mycobacterium
VRRSDGDGPRRRRRP

SEQ ID NO: 1103798 - protein, 15 aa, Mycobacterium
VRTSGMTPYVVRIIE

SEQ ID NO: 1103799 - protein, 21 aa, Mycobacterium
VSARSGETPASEQESEEADES

SEQ ID NO: 1103800 - protein, 9 aa, Mycobacterium
VSDEETAKN

SEQ ID NO: 1103801 - protein, 5 aa, Mycobacterium
VSEGT

SEQ ID NO: 1103802 - protein, 9 aa, Mycobacterium
VSENPGEGT

SEQ ID NO: 1103803 - protein, 7 aa, Mycobacterium
VSKSTAG

SEQ ID NO: 1103804 - protein, 11 aa, Mycobacterium
VSNQDKPFGPN

SEQ ID NO: 1103805 - protein, 19 aa, Mycobacterium
VSNSSNPGDDGWKEMLAPA

SEQ ID NO: 1103806 - protein, 12 aa, Mycobacterium
VSPEKAAESAVK

SEQ ID NO: 1103807 - protein, 12 aa, Mycobacterium
VSSSEDAKVASR

SEQ ID NO: 1103808 - protein, 7 aa, Mycobacterium
VSTDGTT

SEQ ID NO: 1103809 - protein, 111 aa, Mycobacterium
VSTGSEESVEDPSESDIAGTPPIADEAATNDEQEQIEAPKDEEAQEVATKEEDLDETENLQEDLGEEELPQEDVESEQEDSAEETEEAEDTDDVENAEAEAETAAPEEKAA

SEQ ID NO: 1103810 - protein, 53 aa, Mycobacterium
VSTPADPAGPAPAAEPVAPAPPAAEPVAPAPPPVADPTTAPIPGTIPIGHPAT

SEQ ID NO: 1103811 - protein, 12 aa, Mycobacterium
VSTSTTGGDPQL

SEQ ID NO: 1103812 - protein, 7 aa, Mycobacterium
VSVPPQA

SEQ ID NO: 1103813 - protein, 9 aa, Mycobacterium
VTDGTVADP

SEQ ID NO: 1103814 - protein, 26 aa, Mycobacterium
VTEPEPEPEPEAAPEQDLDDAETGPI

SEQ ID NO: 1103815 - protein, 7 aa, Mycobacterium
VTEPGER

SEQ ID NO: 1103816 - protein, 6 aa, Mycobacterium
VTETGN

SEQ ID NO: 1103817 - protein, 26 aa, Mycobacterium
VTGESRPVTRGVGDPVTAGTVATDSG

SEQ ID NO: 1103818 - protein, 12 aa, Mycobacterium
VTGGDEAARNAE

SEQ ID NO: 1103819 - protein, 11 aa, Mycobacterium
VTGGGGGAQPR

SEQ ID NO: 1103820 - protein, 12 aa, Mycobacterium
VTPRGDGDLTST

SEQ ID NO: 1103821 - protein, 13 aa, Mycobacterium
VTSGIAATNGRLS

SEQ ID NO: 1103822 - protein, 13 aa, Mycobacterium
VTSREGVDEESPT

SEQ ID NO: 1103823 - protein, 11 aa, Mycobacterium
VVSPGPAPLDQ

SEQ ID NO: 1103824 - protein, 14 aa, Mycobacterium
WADPGTGSASDGGN

SEQ ID NO: 1103825 - protein, 8 aa, Mycobacterium
WAEDPAPH

SEQ ID NO: 1103826 - protein, 11 aa, Mycobacterium
WESSPQMDPFN

SEQ ID NO: 1103827 - protein, 15 aa, Mycobacterium
WGDPWGSPSTLDSDD

SEQ ID NO: 1103828 - protein, 4 aa, Mycobacterium
WGSG

SEQ ID NO: 1103829 - protein, 11 aa, Mycobacterium
WKDAGGRAGYS

SEQ ID NO: 1103830 - protein, 12 aa, Mycobacterium
WNDGRSDTTRDR

SEQ ID NO: 1103831 - protein, 4 aa, Mycobacterium
WNNS

SEQ ID NO: 1103832 - protein, 49 aa, Mycobacterium
WRPPRTSTTTTTPTTTSPTETPTTTTPTSPTTTPPSTTVIDPDGPGLLP

SEQ ID NO: 1103833 - protein, 8 aa, Mycobacterium
YAPDGPVR

SEQ ID NO: 1103834 - protein, 9 aa, Mycobacterium
YAPDGPVRV

SEQ ID NO: 1103835 - protein, 12 aa, Mycobacterium
YAPGADKLAPAE

SEQ ID NO: 1103836 - protein, 23 aa, Mycobacterium
YAPGSGPPVTEDWPTTGQTTSVY

SEQ ID NO: 1103837 - protein, 6 aa, Mycobacterium
YAPSQS

SEQ ID NO: 1103838 - protein, 5 aa, Mycobacterium
YASSV

SEQ ID NO: 1103839 - protein, 4 aa, Mycobacterium
YDRE

SEQ ID NO: 1103840 - protein, 9 aa, Mycobacterium
YDSESSLRR

SEQ ID NO: 1103841 - protein, 7 aa, Mycobacterium
YEPPTTI

SEQ ID NO: 1103842 - protein, 11 aa, Mycobacterium
YFPPPPPQPYA

SEQ ID NO: 1103843 - protein, 9 aa, Mycobacterium
YGAAAQQVE

SEQ ID NO: 1103844 - protein, 120 aa, Mycobacterium
YGAPATTANPWDPRADSADEAVAADRPSAPDLFGGQDDPDSIDTAPTRIEAPVSDEERAQSALEEPSLPAPTLGGSTAPEPADIEPADVGPADEKPADIEPADIEPADEEPTDEASSVPG

SEQ ID NO: 1103845 - protein, 10 aa, Mycobacterium
YGATDAQLQT

SEQ ID NO: 1103846 - protein, 7 aa, Mycobacterium
YGGDTPQ

SEQ ID NO: 1103847 - protein, 13 aa, Mycobacterium
YGGGYRDGRGMSY

SEQ ID NO: 1103848 - protein, 14 aa, Mycobacterium
YGPANLQSTQTEQT

SEQ ID NO: 1103849 - protein, 5 aa, Mycobacterium
YGPGV

SEQ ID NO: 1103850 - protein, 15 aa, Mycobacterium
YGTNKEKGEPPTSRD

SEQ ID NO: 1103851 - protein, 9 aa, Mycobacterium
YGYQGADAT

SEQ ID NO: 1103852 - protein, 7 aa, Mycobacterium
YNDPATL

SEQ ID NO: 1103853 - protein, 5 aa, Mycobacterium
YNGTK

SEQ ID NO: 1103854 - protein, 8 aa, Mycobacterium
YPANPPAL

SEQ ID NO: 1103855 - protein, 4 aa, Mycobacterium
YPGD

SEQ ID NO: 1103856 - protein, 12 aa, Mycobacterium
YPGNDPLANPDV

SEQ ID NO: 1103857 - protein, 37 aa, Mycobacterium
YPQPGHGPQGANPPRDPQQERGRDGDRPGDRPNPPAQ

SEQ ID NO: 1103858 - protein, 10 aa, Mycobacterium
YPQSEGAVDD

SEQ ID NO: 1103859 - protein, 7 aa, Mycobacterium
YPRAGGA

SEQ ID NO: 1103860 - protein, 4 aa, Mycobacterium
YPTG

SEQ ID NO: 1103861 - protein, 8 aa, Mycobacterium
YRAKATSL

SEQ ID NO: 1103862 - protein, 5 aa, Mycobacterium
YRGTT

SEQ ID NO: 1103863 - protein, 8 aa, Mycobacterium
YSDRRGRQ

SEQ ID NO: 1103864 - protein, 10 aa, Mycobacterium
YSYDSDGSPW

SEQ ID NO: 1103865 - protein, 9 aa, Mycobacterium
YTEPGRGTE

SEQ ID NO: 1103866 - protein, 8 aa, Mycobacterium
YTTTTTGA

SEQ ID NO: 1103867 - protein, 23 aa, Mycobacterium
YYSDPPDGYGGQRRPPGPPPEEP

SEQ ID NO: 1103868 - protein, 8 aa, Mycobacterium
AAAAADAA

SEQ ID NO: 1103869 - protein, 8 aa, Mycobacterium
AAAAAGSG

SEQ ID NO: 1103870 - protein, 12 aa, Mycobacterium
AAAAARNAGDTT

SEQ ID NO: 1103871 - protein, 5 aa, Mycobacterium
AAAAG

SEQ ID NO: 1103872 - protein, 25 aa, Mycobacterium
AAAAGGPAAGRGRPVGLPTPPKGWP

SEQ ID NO: 1103873 - protein, 9 aa, Mycobacterium
AAAAGPVGR

SEQ ID NO: 1103874 - protein, 8 aa, Mycobacterium
AAAAKEAG

SEQ ID NO: 1103875 - protein, 104 aa, Mycobacterium
AAAAPPEQAGPQGVPPGGVPGVPPGAVPGLPPGAVPPGAPPGAVPGLPPAAVPPEAPPASDTPAPQPRPFPQQPAPTPPPGPSPAPGPTPPPAPGTAPPADQDV

SEQ ID NO: 1103876 - protein, 15 aa, Mycobacterium
AAAAPSGAPASAGLG

SEQ ID NO: 1103877 - protein, 17 aa, Mycobacterium
AAAASAHAALAGDPHNE

SEQ ID NO: 1103878 - protein, 5 aa, Mycobacterium
AAAAW

SEQ ID NO: 1103879 - protein, 7 aa, Mycobacterium
AAADARP

SEQ ID NO: 1103880 - protein, 10 aa, Mycobacterium
AAADASGLPR

SEQ ID NO: 1103881 - protein, 25 aa, Mycobacterium
AAADERSREEKKAADERSREEQGGK

SEQ ID NO: 1103882 - protein, 8 aa, Mycobacterium
AAADPRAK

SEQ ID NO: 1103883 - protein, 8 aa, Mycobacterium
AAADPTDP

SEQ ID NO: 1103884 - protein, 9 aa, Mycobacterium
AAADQQPGV

SEQ ID NO: 1103885 - protein, 7 aa, Mycobacterium
AAADTLR

SEQ ID NO: 1103886 - protein, 11 aa, Mycobacterium
AAADVGNLPYG

SEQ ID NO: 1103887 - protein, 18 aa, Mycobacterium
AAADWDDDAALSRAEAQA

SEQ ID NO: 1103888 - protein, 4 aa, Mycobacterium
AAAE

SEQ ID NO: 1103889 - protein, 35 aa, Mycobacterium
AAAEETAAQAKSTVATASTAVSAPPPAPPAGLDSS

SEQ ID NO: 1103890 - protein, 14 aa, Mycobacterium
AAAETGPVAPVPTE

SEQ ID NO: 1103891 - protein, 6 aa, Mycobacterium
AAAGAA

SEQ ID NO: 1103892 - protein, 10 aa, Mycobacterium
AAAGAPAAVQ

SEQ ID NO: 1103893 - protein, 10 aa, Mycobacterium
AAAGDSEPAL

SEQ ID NO: 1103894 - protein, 8 aa, Mycobacterium
AAAGGGPA

SEQ ID NO: 1103895 - protein, 10 aa, Mycobacterium
AAAGGPPPSV

SEQ ID NO: 1103896 - protein, 14 aa, Mycobacterium
AAAGPAADKYTTAT

SEQ ID NO: 1103897 - protein, 6 aa, Mycobacterium
AAAGPV

SEQ ID NO: 1103898 - protein, 5 aa, Mycobacterium
AAAGT

SEQ ID NO: 1103899 - protein, 8 aa, Mycobacterium
AAAHGARD

SEQ ID NO: 1103900 - protein, 4 aa, Mycobacterium
AAAL

SEQ ID NO: 1103901 - protein, 6 aa, Mycobacterium
AAALAA

SEQ ID NO: 1103902 - protein, 4 aa, Mycobacterium
AAAN

SEQ ID NO: 1103903 - protein, 10 aa, Mycobacterium
AAANAAPTLP

SEQ ID NO: 1103904 - protein, 8 aa, Mycobacterium
AAANSARD

SEQ ID NO: 1103905 - protein, 38 aa, Mycobacterium
AAAPDDTAPDYTEPDYTEPEYTEPEFSEPEYTAPLPDD

SEQ ID NO: 1103906 - protein, 8 aa, Mycobacterium
AAAPGEKS

SEQ ID NO: 1103907 - protein, 7 aa, Mycobacterium
AAAPGEN

SEQ ID NO: 1103908 - protein, 35 aa, Mycobacterium
AAAPHTGAIPSVGPARGGFGGPPGLLSSPEPGEQL

SEQ ID NO: 1103909 - protein, 36 aa, Mycobacterium
AAAPLDPPAPGAPAVAPIPDKNPSKTVAAGGDPRQK

SEQ ID NO: 1103910 - protein, 4 aa, Mycobacterium
AAAQ

SEQ ID NO: 1103911 - protein, 8 aa, Mycobacterium
AAAQDAHD

SEQ ID NO: 1103912 - protein, 6 aa, Mycobacterium
AAAQPV

SEQ ID NO: 1103913 - protein, 5 aa, Mycobacterium
AAARQ

SEQ ID NO: 1103914 - protein, 5 aa, Mycobacterium
AAARS

SEQ ID NO: 1103915 - protein, 7 aa, Mycobacterium
AAARSEV

SEQ ID NO: 1103916 - protein, 12 aa, Mycobacterium
AAASGGRVPNPY

SEQ ID NO: 1103917 - protein, 14 aa, Mycobacterium
AAASPDGAPATDGI

SEQ ID NO: 1103918 - protein, 12 aa, Mycobacterium
AAASPGEAEVAP

SEQ ID NO: 1103919 - protein, 8 aa, Mycobacterium
AAASSATA

SEQ ID NO: 1103920 - protein, 4 aa, Mycobacterium
AAAT

SEQ ID NO: 1103921 - protein, 6 aa, Mycobacterium
AAATAR

SEQ ID NO: 1103922 - protein, 8 aa, Mycobacterium
AAATARAA

SEQ ID NO: 1103923 - protein, 12 aa, Mycobacterium
AAATQSQAPLPV

SEQ ID NO: 1103924 - protein, 6 aa, Mycobacterium
AAATSS

SEQ ID NO: 1103925 - protein, 9 aa, Mycobacterium
AAATTDNYK

SEQ ID NO: 1103926 - protein, 4 aa, Mycobacterium
AAAV

SEQ ID NO: 1103927 - protein, 18 aa, Mycobacterium
AADAGPRTPTHPGTGQQA

SEQ ID NO: 1103928 - protein, 13 aa, Mycobacterium
AADAQGSGYQARQ

SEQ ID NO: 1103929 - protein, 11 aa, Mycobacterium
AADEKTQGDKP

SEQ ID NO: 1103930 - protein, 18 aa, Mycobacterium
AADGALRPVDSSGADVTD

SEQ ID NO: 1103931 - protein, 7 aa, Mycobacterium
AADGGPK

SEQ ID NO: 1103932 - protein, 13 aa, Mycobacterium
AADGPGAPGGAQT

SEQ ID NO: 1103933 - protein, 12 aa, Mycobacterium
AADGPSRRRPAT

SEQ ID NO: 1103934 - protein, 13 aa, Mycobacterium
AADGQASENRYRA

SEQ ID NO: 1103935 - protein, 7 aa, Mycobacterium
AADGQTE

SEQ ID NO: 1103936 - protein, 9 aa, Mycobacterium
AADGTGATV

SEQ ID NO: 1103937 - protein, 6 aa, Mycobacterium
AADLGA

SEQ ID NO: 1103938 - protein, 5 aa, Mycobacterium
AADNA

SEQ ID NO: 1103939 - protein, 30 aa, Mycobacterium
AADNPNAPRVEGSGAAASEAPSGDVGWGTR

SEQ ID NO: 1103940 - protein, 7 aa, Mycobacterium
AADPAAP

SEQ ID NO: 1103941 - protein, 10 aa, Mycobacterium
AADPHGVPGP

SEQ ID NO: 1103942 - protein, 7 aa, Mycobacterium
AADQPRG

SEQ ID NO: 1103943 - protein, 4 aa, Mycobacterium
AADR

SEQ ID NO: 1103944 - protein, 6 aa, Mycobacterium
AADSGF

SEQ ID NO: 1103945 - protein, 6 aa, Mycobacterium
AADTTS

SEQ ID NO: 1103946 - protein, 8 aa, Mycobacterium
AAEAAEAA

SEQ ID NO: 1103947 - protein, 14 aa, Mycobacterium
AAEAEQRRREADLS

SEQ ID NO: 1103948 - protein, 10 aa, Mycobacterium
AAEALGPGAL

SEQ ID NO: 1103949 - protein, 8 aa, Mycobacterium
AAEDGADV

SEQ ID NO: 1103950 - protein, 20 aa, Mycobacterium
AAEDRAQETPAEASSVKPSR

SEQ ID NO: 1103951 - protein, 15 aa, Mycobacterium
AAEEPYAPKTDESPI

SEQ ID NO: 1103952 - protein, 14 aa, Mycobacterium
AAEGLAGSGGGSVS

SEQ ID NO: 1103953 - protein, 15 aa, Mycobacterium
AAEHRTTAEQYAASG

SEQ ID NO: 1103954 - protein, 18 aa, Mycobacterium
AAEKGTPGRGVNRAAGAA

SEQ ID NO: 1103955 - protein, 12 aa, Mycobacterium
AAELDSPERPAE

SEQ ID NO: 1103956 - protein, 5 aa, Mycobacterium
AAEMP

SEQ ID NO: 1103957 - protein, 9 aa, Mycobacterium
AAENPSEHP

SEQ ID NO: 1103958 - protein, 7 aa, Mycobacterium
AAEPELG

SEQ ID NO: 1103959 - protein, 7 aa, Mycobacterium
AAEPNQH

SEQ ID NO: 1103960 - protein, 9 aa, Mycobacterium
AAEPTDDHP

SEQ ID NO: 1103961 - protein, 7 aa, Mycobacterium
AAERVRR

SEQ ID NO: 1103962 - protein, 8 aa, Mycobacterium
AAESGARA

SEQ ID NO: 1103963 - protein, 18 aa, Mycobacterium
AAESRSDAADAARATAER

SEQ ID NO: 1103964 - protein, 9 aa, Mycobacterium
AAETGATQT

SEQ ID NO: 1103965 - protein, 10 aa, Mycobacterium
AAETPTPGGL

SEQ ID NO: 1103966 - protein, 16 aa, Mycobacterium
AAETSPSAKKRAARAP

SEQ ID NO: 1103967 - protein, 17 aa, Mycobacterium
AAFATAAAGGLATRSAV

SEQ ID NO: 1103968 - protein, 10 aa, Mycobacterium
AAGADRPDAI

SEQ ID NO: 1103969 - protein, 10 aa, Mycobacterium
AAGAGARSPV

SEQ ID NO: 1103970 - protein, 6 aa, Mycobacterium
AAGAGH

SEQ ID NO: 1103971 - protein, 8 aa, Mycobacterium
AAGAPEFD

SEQ ID NO: 1103972 - protein, 8 aa, Mycobacterium
AAGAPRDR

SEQ ID NO: 1103973 - protein, 9 aa, Mycobacterium
AAGASTVPI

SEQ ID NO: 1103974 - protein, 12 aa, Mycobacterium
AAGAVQAKREQL

SEQ ID NO: 1103975 - protein, 6 aa, Mycobacterium
AAGAYA

SEQ ID NO: 1103976 - protein, 12 aa, Mycobacterium
AAGAYGHRAGTP

SEQ ID NO: 1103977 - protein, 8 aa, Mycobacterium
AAGCGASQ

SEQ ID NO: 1103978 - protein, 4 aa, Mycobacterium
AAGD

SEQ ID NO: 1103979 - protein, 10 aa, Mycobacterium
AAGDATRQPH

SEQ ID NO: 1103980 - protein, 9 aa, Mycobacterium
AAGDATRRQ

SEQ ID NO: 1103981 - protein, 9 aa, Mycobacterium
AAGDEQRRW

SEQ ID NO: 1103982 - protein, 16 aa, Mycobacterium
AAGDPDQRQPPPGTGL

SEQ ID NO: 1103983 - protein, 7 aa, Mycobacterium
AAGEDVP

SEQ ID NO: 1103984 - protein, 9 aa, Mycobacterium
AAGEIDGQV

SEQ ID NO: 1103985 - protein, 4 aa, Mycobacterium
AAGG

SEQ ID NO: 1103986 - protein, 11 aa, Mycobacterium
AAGGADAEPDY

SEQ ID NO: 1103987 - protein, 6 aa, Mycobacterium
AAGGAL

SEQ ID NO: 1103988 - protein, 6 aa, Mycobacterium
AAGGDA

SEQ ID NO: 1103989 - protein, 7 aa, Mycobacterium
AAGGGLS

SEQ ID NO: 1103990 - protein, 8 aa, Mycobacterium
AAGGGWAA

SEQ ID NO: 1103991 - protein, 8 aa, Mycobacterium
AAGGNGKS

SEQ ID NO: 1103992 - protein, 6 aa, Mycobacterium
AAGGNI

SEQ ID NO: 1103993 - protein, 16 aa, Mycobacterium
AAGGPAGVGQAVGQSV

SEQ ID NO: 1103994 - protein, 7 aa, Mycobacterium
AAGGREQ

SEQ ID NO: 1103995 - protein, 9 aa, Mycobacterium
AAGIGGNAT

SEQ ID NO: 1103996 - protein, 5 aa, Mycobacterium
AAGLG

SEQ ID NO: 1103997 - protein, 5 aa, Mycobacterium
AAGPD

SEQ ID NO: 1103998 - protein, 10 aa, Mycobacterium
AAGPDSAGRE

SEQ ID NO: 1103999 - protein, 7 aa, Mycobacterium
AAGPDTI

SEQ ID NO: 1104000 - protein, 8 aa, Mycobacterium
AAGPEALR

SEQ ID NO: 1104001 - protein, 8 aa, Mycobacterium
AAGPPGHR

SEQ ID NO: 1104002 - protein, 11 aa, Mycobacterium
AAGPQVASGQI

SEQ ID NO: 1104003 - protein, 8 aa, Mycobacterium
AAGQPKDI

SEQ ID NO: 1104004 - protein, 20 aa, Mycobacterium
AAGQTAPGVVGAPTGARKRG

SEQ ID NO: 1104005 - protein, 4 aa, Mycobacterium
AAGR

SEQ ID NO: 1104006 - protein, 14 aa, Mycobacterium
AAGRRAPSARRYGR

SEQ ID NO: 1104007 - protein, 10 aa, Mycobacterium
AAGRTDDADG

SEQ ID NO: 1104008 - protein, 4 aa, Mycobacterium
AAGS

SEQ ID NO: 1104009 - protein, 24 aa, Mycobacterium
AAGSAQIGARDDDLDELTTGADTL

SEQ ID NO: 1104010 - protein, 8 aa, Mycobacterium
AAGSSLSD

SEQ ID NO: 1104011 - protein, 11 aa, Mycobacterium
AAGTPDEKTSV

SEQ ID NO: 1104012 - protein, 13 aa, Mycobacterium
AAGTTYGGGDTER

SEQ ID NO: 1104013 - protein, 4 aa, Mycobacterium
AAGV

SEQ ID NO: 1104014 - protein, 8 aa, Mycobacterium
AAHAAERR

SEQ ID NO: 1104015 - protein, 9 aa, Mycobacterium
AAHERNTDE

SEQ ID NO: 1104016 - protein, 28 aa, Mycobacterium
AAHRGEDMESHARGKGEAPAGADRSDPA

SEQ ID NO: 1104017 - protein, 11 aa, Mycobacterium
AAIAPRAISAP

SEQ ID NO: 1104018 - protein, 11 aa, Mycobacterium
AAINPGNSGGA

SEQ ID NO: 1104019 - protein, 12 aa, Mycobacterium
AAIREDSEGTVR

SEQ ID NO: 1104020 - protein, 18 aa, Mycobacterium
AAKEAAALDEDRPPEPDL

SEQ ID NO: 1104021 - protein, 14 aa, Mycobacterium
AAKEAIKGTPLEGS

SEQ ID NO: 1104022 - protein, 7 aa, Mycobacterium
AAKFPGG

SEQ ID NO: 1104023 - protein, 13 aa, Mycobacterium
AAKIASPPMSASG

SEQ ID NO: 1104024 - protein, 34 aa, Mycobacterium
AAKPEVGEDSATVGDADVDGDDDAVTGSADAEPE

SEQ ID NO: 1104025 - protein, 30 aa, Mycobacterium
AAKREREEKARKRKQQRIKTLGKDNTARLE

SEQ ID NO: 1104026 - protein, 7 aa, Mycobacterium
AALDGRA

SEQ ID NO: 1104027 - protein, 4 aa, Mycobacterium
AALE

SEQ ID NO: 1104028 - protein, 10 aa, Mycobacterium
AALERAKSAG

SEQ ID NO: 1104029 - protein, 4 aa, Mycobacterium
AALG

SEQ ID NO: 1104030 - protein, 14 aa, Mycobacterium
AALGAGRAVAGTAA

SEQ ID NO: 1104031 - protein, 6 aa, Mycobacterium
AALGQA

SEQ ID NO: 1104032 - protein, 4 aa, Mycobacterium
AANG

SEQ ID NO: 1104033 - protein, 7 aa, Mycobacterium
AANGETV

SEQ ID NO: 1104034 - protein, 9 aa, Mycobacterium
AANNNGSAF

SEQ ID NO: 1104035 - protein, 6 aa, Mycobacterium
AANPRV

SEQ ID NO: 1104036 - protein, 5 aa, Mycobacterium
AANPV

SEQ ID NO: 1104037 - protein, 6 aa, Mycobacterium
AANPVA

SEQ ID NO: 1104038 - protein, 6 aa, Mycobacterium
AANRAG

SEQ ID NO: 1104039 - protein, 16 aa, Mycobacterium
AANSGPMSRSPMTQRR

SEQ ID NO: 1104040 - protein, 4 aa, Mycobacterium
AAPA

SEQ ID NO: 1104041 - protein, 7 aa, Mycobacterium
AAPAARA

SEQ ID NO: 1104042 - protein, 9 aa, Mycobacterium
AAPAEGTVE

SEQ ID NO: 1104043 - protein, 10 aa, Mycobacterium
AAPAKSRLLQ

SEQ ID NO: 1104044 - protein, 6 aa, Mycobacterium
AAPALT

SEQ ID NO: 1104045 - protein, 43 aa, Mycobacterium
AAPANPADRPTPRPAGAGAPPPPPGVPANPAPPAFPPPPTITA

SEQ ID NO: 1104046 - protein, 15 aa, Mycobacterium
AAPAPGNPEPVTQKA

SEQ ID NO: 1104047 - protein, 15 aa, Mycobacterium
AAPAPQKVAAVEKAP

SEQ ID NO: 1104048 - protein, 14 aa, Mycobacterium
AAPDATPSGLGSLG

SEQ ID NO: 1104049 - protein, 5 aa, Mycobacterium
AAPDH

SEQ ID NO: 1104050 - protein, 9 aa, Mycobacterium
AAPDHNAAS

SEQ ID NO: 1104051 - protein, 15 aa, Mycobacterium
AAPDLGPLTDAPRRA

SEQ ID NO: 1104052 - protein, 13 aa, Mycobacterium
AAPDTTPTDSAAD

SEQ ID NO: 1104053 - protein, 6 aa, Mycobacterium
AAPFPN

SEQ ID NO: 1104054 - protein, 9 aa, Mycobacterium
AAPGADPTV

SEQ ID NO: 1104055 - protein, 5 aa, Mycobacterium
AAPGD

SEQ ID NO: 1104056 - protein, 6 aa, Mycobacterium
AAPGFN

SEQ ID NO: 1104057 - protein, 7 aa, Mycobacterium
AAPITGR

SEQ ID NO: 1104058 - protein, 7 aa, Mycobacterium
AAPKEDR

SEQ ID NO: 1104059 - protein, 8 aa, Mycobacterium
AAPKPVER

SEQ ID NO: 1104060 - protein, 6 aa, Mycobacterium
AAPLDA

SEQ ID NO: 1104061 - protein, 8 aa, Mycobacterium
AAPMPTPR

SEQ ID NO: 1104062 - protein, 6 aa, Mycobacterium
AAPPIA

SEQ ID NO: 1104063 - protein, 6 aa, Mycobacterium
AAPPPL

SEQ ID NO: 1104064 - protein, 10 aa, Mycobacterium
AAPPPPPPDL

SEQ ID NO: 1104065 - protein, 9 aa, Mycobacterium
AAPRLGEPR

SEQ ID NO: 1104066 - protein, 7 aa, Mycobacterium
AAPRLPG

SEQ ID NO: 1104067 - protein, 15 aa, Mycobacterium
AAPRVSDAGQPDIGR

SEQ ID NO: 1104068 - protein, 13 aa, Mycobacterium
AAPSGGGRRRRRE

SEQ ID NO: 1104069 - protein, 6 aa, Mycobacterium
AAPSKA

SEQ ID NO: 1104070 - protein, 7 aa, Mycobacterium
AAPSPAG

SEQ ID NO: 1104071 - protein, 5 aa, Mycobacterium
AAPTA

SEQ ID NO: 1104072 - protein, 54 aa, Mycobacterium
AAPTAIPQQTATSTAPTTSNGAPTPTADAPATTSAPSPTAPETPVTETTAPETI

SEQ ID NO: 1104073 - protein, 5 aa, Mycobacterium
AAPVS

SEQ ID NO: 1104074 - protein, 8 aa, Mycobacterium
AAQAGTQD

SEQ ID NO: 1104075 - protein, 44 aa, Mycobacterium
AAQAPAKAEESAIETEAEAKTAAEPAEAAKSTAAADTESKPVTG

SEQ ID NO: 1104076 - protein, 6 aa, Mycobacterium
AAQARR

SEQ ID NO: 1104077 - protein, 8 aa, Mycobacterium
AAQDERDR

SEQ ID NO: 1104078 - protein, 8 aa, Mycobacterium
AAQEAPPQ

SEQ ID NO: 1104079 - protein, 5 aa, Mycobacterium
AAQEL

SEQ ID NO: 1104080 - protein, 9 aa, Mycobacterium
AAQGANATA

SEQ ID NO: 1104081 - protein, 17 aa, Mycobacterium
AAQHDPKPKKVRGRTNW

SEQ ID NO: 1104082 - protein, 11 aa, Mycobacterium
AAQPPAEANTC

SEQ ID NO: 1104083 - protein, 9 aa, Mycobacterium
AAQPPPAEL

SEQ ID NO: 1104084 - protein, 8 aa, Mycobacterium
AAQPPPLE

SEQ ID NO: 1104085 - protein, 8 aa, Mycobacterium
AAQRDPDD

SEQ ID NO: 1104086 - protein, 6 aa, Mycobacterium
AAQYPN

SEQ ID NO: 1104087 - protein, 29 aa, Mycobacterium
AARAAGPASGQPGHHGDARGDTAGGARSV

SEQ ID NO: 1104088 - protein, 10 aa, Mycobacterium
AARAASAAET

SEQ ID NO: 1104089 - protein, 5 aa, Mycobacterium
AARAG

SEQ ID NO: 1104090 - protein, 10 aa, Mycobacterium
AARASEAAAL

SEQ ID NO: 1104091 - protein, 9 aa, Mycobacterium
AARDARAEH

SEQ ID NO: 1104092 - protein, 11 aa, Mycobacterium
AARDKRETNLN

SEQ ID NO: 1104093 - protein, 11 aa, Mycobacterium
AARDRADQDSE

SEQ ID NO: 1104094 - protein, 8 aa, Mycobacterium
AARDRDQA

SEQ ID NO: 1104095 - protein, 9 aa, Mycobacterium
AARETSAAA

SEQ ID NO: 1104096 - protein, 9 aa, Mycobacterium
AARGDGTRA

SEQ ID NO: 1104097 - protein, 5 aa, Mycobacterium
AARGE

SEQ ID NO: 1104098 - protein, 5 aa, Mycobacterium
AARGL

SEQ ID NO: 1104099 - protein, 13 aa, Mycobacterium
AARGLRSRPTTGH

SEQ ID NO: 1104100 - protein, 15 aa, Mycobacterium
AARGPHTADAAPSGP

SEQ ID NO: 1104101 - protein, 7 aa, Mycobacterium
AARHHGR

SEQ ID NO: 1104102 - protein, 8 aa, Mycobacterium
AARHHGRQ

SEQ ID NO: 1104103 - protein, 5 aa, Mycobacterium
AARHP

SEQ ID NO: 1104104 - protein, 5 aa, Mycobacterium
AARIG

SEQ ID NO: 1104105 - protein, 8 aa, Mycobacterium
AARPGRPL

SEQ ID NO: 1104106 - protein, 16 aa, Mycobacterium
AARQTNQALAQQKEAL

SEQ ID NO: 1104107 - protein, 17 aa, Mycobacterium
AARQTNQALAQQKEALE

SEQ ID NO: 1104108 - protein, 5 aa, Mycobacterium
AARRA

SEQ ID NO: 1104109 - protein, 11 aa, Mycobacterium
AARRDGEPAPI

SEQ ID NO: 1104110 - protein, 26 aa, Mycobacterium
AARREAKRRALGKHEPQTRTLGRGTV

SEQ ID NO: 1104111 - protein, 10 aa, Mycobacterium
AARSAPQSRA

SEQ ID NO: 1104112 - protein, 7 aa, Mycobacterium
AARSGPH

SEQ ID NO: 1104113 - protein, 6 aa, Mycobacterium
AARTGT

SEQ ID NO: 1104114 - protein, 10 aa, Mycobacterium
AARVDGDLGG

SEQ ID NO: 1104115 - protein, 11 aa, Mycobacterium
AASAARDGRLQ

SEQ ID NO: 1104116 - protein, 8 aa, Mycobacterium
AASAIGNA

SEQ ID NO: 1104117 - protein, 5 aa, Mycobacterium
AASAL

SEQ ID NO: 1104118 - protein, 5 aa, Mycobacterium
AASAN

SEQ ID NO: 1104119 - protein, 13 aa, Mycobacterium
AASAREGDDTSVT

SEQ ID NO: 1104120 - protein, 10 aa, Mycobacterium
AASARRDPDL

SEQ ID NO: 1104121 - protein, 32 aa, Mycobacterium
AASAVGDDRIQEAATGRVSPESWTHGSSTQRQ

SEQ ID NO: 1104122 - protein, 6 aa, Mycobacterium
AASDRR

SEQ ID NO: 1104123 - protein, 5 aa, Mycobacterium
AASER

SEQ ID NO: 1104124 - protein, 7 aa, Mycobacterium
AASEVED

SEQ ID NO: 1104125 - protein, 7 aa, Mycobacterium
AASGLDR

SEQ ID NO: 1104126 - protein, 13 aa, Mycobacterium
AASGQNDALQRAD

SEQ ID NO: 1104127 - protein, 6 aa, Mycobacterium
AASKPI

SEQ ID NO: 1104128 - protein, 22 aa, Mycobacterium
AASKSPSSSDIPGEDLLEGKVV

SEQ ID NO: 1104129 - protein, 7 aa, Mycobacterium
AASLAGP

SEQ ID NO: 1104130 - protein, 27 aa, Mycobacterium
AASPHSGALPSVGPSRHGGPPGGFPGG

SEQ ID NO: 1104131 - protein, 5 aa, Mycobacterium
AASPV

SEQ ID NO: 1104132 - protein, 13 aa, Mycobacterium
AASPVAAAQPGTV

SEQ ID NO: 1104133 - protein, 13 aa, Mycobacterium
AASRPPIRSLASG

SEQ ID NO: 1104134 - protein, 9 aa, Mycobacterium
AASSGSSPW

SEQ ID NO: 1104135 - protein, 9 aa, Mycobacterium
AASSNTASG

SEQ ID NO: 1104136 - protein, 11 aa, Mycobacterium
AASSRGAGPMG

SEQ ID NO: 1104137 - protein, 5 aa, Mycobacterium
AASTD

SEQ ID NO: 1104138 - protein, 6 aa, Mycobacterium
AASTIA

SEQ ID NO: 1104139 - protein, 5 aa, Mycobacterium
AASTR

SEQ ID NO: 1104140 - protein, 4 aa, Mycobacterium
AASV

SEQ ID NO: 1104141 - protein, 6 aa, Mycobacterium
AATAGA

SEQ ID NO: 1104142 - protein, 6 aa, Mycobacterium
AATDGD

SEQ ID NO: 1104143 - protein, 35 aa, Mycobacterium
AATDGGAGVPGPGSHQPFGPPPGGFGGPGAPPPPQ

SEQ ID NO: 1104144 - protein, 11 aa, Mycobacterium
AATDNSGAAAE

SEQ ID NO: 1104145 - protein, 10 aa, Mycobacterium
AATDPAAAAV

SEQ ID NO: 1104146 - protein, 7 aa, Mycobacterium
AATEADG

SEQ ID NO: 1104147 - protein, 9 aa, Mycobacterium
AATEDRRTE

SEQ ID NO: 1104148 - protein, 10 aa, Mycobacterium
AATFGSGGER

SEQ ID NO: 1104149 - protein, 8 aa, Mycobacterium
AATGDATV

SEQ ID NO: 1104150 - protein, 5 aa, Mycobacterium
AATGF

SEQ ID NO: 1104151 - protein, 8 aa, Mycobacterium
AATGGAAH

SEQ ID NO: 1104152 - protein, 17 aa, Mycobacterium
AATGGADGKPGCGSLPD

SEQ ID NO: 1104153 - protein, 70 aa, Mycobacterium
AATGGWTPSPPPPPPAPPMSRPQPRYPTGAQPHYPSGPQPHHPTGTHAPMRPPSTGAALSPPLSEQAGLE

SEQ ID NO: 1104154 - protein, 5 aa, Mycobacterium
AATGK

SEQ ID NO: 1104155 - protein, 22 aa, Mycobacterium
AATGRSKSRGTSDLEQSKKPPL

SEQ ID NO: 1104156 - protein, 7 aa, Mycobacterium
AATHGEA

SEQ ID NO: 1104157 - protein, 8 aa, Mycobacterium
AATHPDKI

SEQ ID NO: 1104158 - protein, 6 aa, Mycobacterium
AATLSE

SEQ ID NO: 1104159 - protein, 9 aa, Mycobacterium
AATPAAEPV

SEQ ID NO: 1104160 - protein, 20 aa, Mycobacterium
AATPGHNGTFDGVGSGGQVD

SEQ ID NO: 1104161 - protein, 12 aa, Mycobacterium
AATPPRRSRGRW

SEQ ID NO: 1104162 - protein, 6 aa, Mycobacterium
AATQVA

SEQ ID NO: 1104163 - protein, 8 aa, Mycobacterium
AATRDEAA

SEQ ID NO: 1104164 - protein, 8 aa, Mycobacterium
AATRVTGT

SEQ ID NO: 1104165 - protein, 4 aa, Mycobacterium
AATS

SEQ ID NO: 1104166 - protein, 11 aa, Mycobacterium
AATTAADAITE

SEQ ID NO: 1104167 - protein, 7 aa, Mycobacterium
AATTGNP

SEQ ID NO: 1104168 - protein, 5 aa, Mycobacterium
AATTS

SEQ ID NO: 1104169 - protein, 9 aa, Mycobacterium
AATTSPPVR

SEQ ID NO: 1104170 - protein, 8 aa, Mycobacterium
AATTTARE

SEQ ID NO: 1104171 - protein, 5 aa, Mycobacterium
AATWP

SEQ ID NO: 1104172 - protein, 6 aa, Mycobacterium
AAVDED

SEQ ID NO: 1104173 - protein, 8 aa, Mycobacterium
AAVDETKD

SEQ ID NO: 1104174 - protein, 48 aa, Mycobacterium
AAVGKNADVAAGSAVTGKVKNGQYWTGSPAAKSGKARHPWPGHRPPRA

SEQ ID NO: 1104175 - protein, 41 aa, Mycobacterium
AAVPATRHSAPAPSGSPSATFELPGEASGGFGGAATSLPAM

SEQ ID NO: 1104176 - protein, 5 aa, Mycobacterium
AAVPG

SEQ ID NO: 1104177 - protein, 11 aa, Mycobacterium
AAVPPDTTADF

SEQ ID NO: 1104178 - protein, 8 aa, Mycobacterium
AAVRPDSL

SEQ ID NO: 1104179 - protein, 6 aa, Mycobacterium
AAVTEP

SEQ ID NO: 1104180 - protein, 4 aa, Mycobacterium
AAYG

SEQ ID NO: 1104181 - protein, 8 aa, Mycobacterium
AAYSAAAQ

SEQ ID NO: 1104182 - protein, 6 aa, Mycobacterium
ACEKGA

SEQ ID NO: 1104183 - protein, 12 aa, Mycobacterium
ACGATQGYPWSN

SEQ ID NO: 1104184 - protein, 6 aa, Mycobacterium
ACPPEL

SEQ ID NO: 1104185 - protein, 6 aa, Mycobacterium
ADADAR

SEQ ID NO: 1104186 - protein, 9 aa, Mycobacterium
ADADGHAAG

SEQ ID NO: 1104187 - protein, 8 aa, Mycobacterium
ADADPQLR

SEQ ID NO: 1104188 - protein, 17 aa, Mycobacterium
ADADQAYTSAETQKAEQ

SEQ ID NO: 1104189 - protein, 8 aa, Mycobacterium
ADADQLAA

SEQ ID NO: 1104190 - protein, 13 aa, Mycobacterium
ADADSAADAERRR

SEQ ID NO: 1104191 - protein, 5 aa, Mycobacterium
ADAEF

SEQ ID NO: 1104192 - protein, 8 aa, Mycobacterium
ADAERING

SEQ ID NO: 1104193 - protein, 7 aa, Mycobacterium
ADAERTK

SEQ ID NO: 1104194 - protein, 29 aa, Mycobacterium
ADAGEPESEPEPEPEPEPEPEPEPEPEPV

SEQ ID NO: 1104195 - protein, 10 aa, Mycobacterium
ADAGNPVTQT

SEQ ID NO: 1104196 - protein, 20 aa, Mycobacterium
ADAGPDAGPDAEVPVSSAQL

SEQ ID NO: 1104197 - protein, 7 aa, Mycobacterium
ADAGPGY

SEQ ID NO: 1104198 - protein, 12 aa, Mycobacterium
ADAGSGAATIGQ

SEQ ID NO: 1104199 - protein, 13 aa, Mycobacterium
ADAKVTTKATANV

SEQ ID NO: 1104200 - protein, 4 aa, Mycobacterium
ADAQ

SEQ ID NO: 1104201 - protein, 10 aa, Mycobacterium
ADAQGIADNT

SEQ ID NO: 1104202 - protein, 15 aa, Mycobacterium
ADAQQAESVAAESNE

SEQ ID NO: 1104203 - protein, 9 aa, Mycobacterium
ADARGDLMP

SEQ ID NO: 1104204 - protein, 22 aa, Mycobacterium
ADARKISDGTVGGGPAADPEPL

SEQ ID NO: 1104205 - protein, 7 aa, Mycobacterium
ADATATV

SEQ ID NO: 1104206 - protein, 7 aa, Mycobacterium
ADATGAW

SEQ ID NO: 1104207 - protein, 6 aa, Mycobacterium
ADATGL

SEQ ID NO: 1104208 - protein, 5 aa, Mycobacterium
ADATL

SEQ ID NO: 1104209 - protein, 7 aa, Mycobacterium
ADAVPRR

SEQ ID NO: 1104210 - protein, 7 aa, Mycobacterium
ADDDQQV

SEQ ID NO: 1104211 - protein, 8 aa, Mycobacterium
ADDDSIAT

SEQ ID NO: 1104212 - protein, 8 aa, Mycobacterium
ADDDSITS

SEQ ID NO: 1104213 - protein, 7 aa, Mycobacterium
ADDEERM

SEQ ID NO: 1104214 - protein, 16 aa, Mycobacterium
ADDERVRSDADTLSRA

SEQ ID NO: 1104215 - protein, 16 aa, Mycobacterium
ADDGSDVTMTPSTLDG

SEQ ID NO: 1104216 - protein, 30 aa, Mycobacterium
ADDGSDVTMTPSTLDGADLATAADGTGATV

SEQ ID NO: 1104217 - protein, 18 aa, Mycobacterium
ADDHPHVSKGASPLAPDT

SEQ ID NO: 1104218 - protein, 9 aa, Mycobacterium
ADDPRPNAS

SEQ ID NO: 1104219 - protein, 4 aa, Mycobacterium
ADDR

SEQ ID NO: 1104220 - protein, 4 aa, Mycobacterium
ADDV

SEQ ID NO: 1104221 - protein, 5 aa, Mycobacterium
ADEDS

SEQ ID NO: 1104222 - protein, 9 aa, Mycobacterium
ADEDTARAA

SEQ ID NO: 1104223 - protein, 9 aa, Mycobacterium
ADEGRHVPG

SEQ ID NO: 1104224 - protein, 7 aa, Mycobacterium
ADESASA

SEQ ID NO: 1104225 - protein, 10 aa, Mycobacterium
ADESDNFDEA

SEQ ID NO: 1104226 - protein, 13 aa, Mycobacterium
ADFSGDTRADETF

SEQ ID NO: 1104227 - protein, 5 aa, Mycobacterium
ADFTG

SEQ ID NO: 1104228 - protein, 12 aa, Mycobacterium
ADGALAQADPAK

SEQ ID NO: 1104229 - protein, 7 aa, Mycobacterium
ADGDTET

SEQ ID NO: 1104230 - protein, 43 aa, Mycobacterium
ADGDVTAAAEEAAAQAKAAVATASNPVAGPSPVPVDGPDQSRL

SEQ ID NO: 1104231 - protein, 4 aa, Mycobacterium
ADGE

SEQ ID NO: 1104232 - protein, 26 aa, Mycobacterium
ADGERVEVSGAAAGQLAGVPADEVPR

SEQ ID NO: 1104233 - protein, 14 aa, Mycobacterium
ADGFAGKGEQLNKT

SEQ ID NO: 1104234 - protein, 8 aa, Mycobacterium
ADGGAPPG

SEQ ID NO: 1104235 - protein, 7 aa, Mycobacterium
ADGGAPR

SEQ ID NO: 1104236 - protein, 12 aa, Mycobacterium
ADGGVTAAGDPI

SEQ ID NO: 1104237 - protein, 18 aa, Mycobacterium
ADGHADTGDDEDPPDTTL

SEQ ID NO: 1104238 - protein, 9 aa, Mycobacterium
ADGIDAGRN

SEQ ID NO: 1104239 - protein, 7 aa, Mycobacterium
ADGNAAI

SEQ ID NO: 1104240 - protein, 4 aa, Mycobacterium
ADGR

SEQ ID NO: 1104241 - protein, 8 aa, Mycobacterium
ADGRATAA

SEQ ID NO: 1104242 - protein, 7 aa, Mycobacterium
ADGREDE

SEQ ID NO: 1104243 - protein, 6 aa, Mycobacterium
ADGRPV

SEQ ID NO: 1104244 - protein, 6 aa, Mycobacterium
ADGRRH

SEQ ID NO: 1104245 - protein, 6 aa, Mycobacterium
ADGRTA

SEQ ID NO: 1104246 - protein, 5 aa, Mycobacterium
ADGSI

SEQ ID NO: 1104247 - protein, 9 aa, Mycobacterium
ADGSTADFT

SEQ ID NO: 1104248 - protein, 12 aa, Mycobacterium
ADGTADDKLPGA

SEQ ID NO: 1104249 - protein, 15 aa, Mycobacterium
ADGTADIREAQASPL

SEQ ID NO: 1104250 - protein, 5 aa, Mycobacterium
ADGTR

SEQ ID NO: 1104251 - protein, 8 aa, Mycobacterium
ADGTVADP

SEQ ID NO: 1104252 - protein, 6 aa, Mycobacterium
ADIRGT

SEQ ID NO: 1104253 - protein, 9 aa, Mycobacterium
ADKADTLPH

SEQ ID NO: 1104254 - protein, 9 aa, Mycobacterium
ADKAPKGAR

SEQ ID NO: 1104255 - protein, 17 aa, Mycobacterium
ADLARRAGQVNAPAGAA

SEQ ID NO: 1104256 - protein, 13 aa, Mycobacterium
ADLESAAAGAPKH

SEQ ID NO: 1104257 - protein, 13 aa, Mycobacterium
ADLGSRTMREETD

SEQ ID NO: 1104258 - protein, 4 aa, Mycobacterium
ADLK

SEQ ID NO: 1104259 - protein, 9 aa, Mycobacterium
ADLPDEALP

SEQ ID NO: 1104260 - protein, 7 aa, Mycobacterium
ADLPGYR

SEQ ID NO: 1104261 - protein, 8 aa, Mycobacterium
ADLPPERL

SEQ ID NO: 1104262 - protein, 11 aa, Mycobacterium
ADLSDAQRTRL

SEQ ID NO: 1104263 - protein, 7 aa, Mycobacterium
ADMPTPR

SEQ ID NO: 1104264 - protein, 7 aa, Mycobacterium
ADNGQTV

SEQ ID NO: 1104265 - protein, 14 aa, Mycobacterium
ADNLRAEQKSASRL

SEQ ID NO: 1104266 - protein, 15 aa, Mycobacterium
ADNRVSGAHEGYDPA

SEQ ID NO: 1104267 - protein, 7 aa, Mycobacterium
ADNTDTA

SEQ ID NO: 1104268 - protein, 4 aa, Mycobacterium
ADNV

SEQ ID NO: 1104269 - protein, 5 aa, Mycobacterium
ADPAA

SEQ ID NO: 1104270 - protein, 6 aa, Mycobacterium
ADPADL

SEQ ID NO: 1104271 - protein, 6 aa, Mycobacterium
ADPAGG

SEQ ID NO: 1104272 - protein, 6 aa, Mycobacterium
ADPAPV

SEQ ID NO: 1104273 - protein, 6 aa, Mycobacterium
ADPDEP

SEQ ID NO: 1104274 - protein, 10 aa, Mycobacterium
ADPEAANDPI

SEQ ID NO: 1104275 - protein, 9 aa, Mycobacterium
ADPELDGMG

SEQ ID NO: 1104276 - protein, 5 aa, Mycobacterium
ADPGQ

SEQ ID NO: 1104277 - protein, 7 aa, Mycobacterium
ADPGQRV

SEQ ID NO: 1104278 - protein, 12 aa, Mycobacterium
ADPGSPPQEEGI

SEQ ID NO: 1104279 - protein, 9 aa, Mycobacterium
ADPKTEPVF

SEQ ID NO: 1104280 - protein, 9 aa, Mycobacterium
ADPPEIDES

SEQ ID NO: 1104281 - protein, 9 aa, Mycobacterium
ADPSPDRLA

SEQ ID NO: 1104282 - protein, 6 aa, Mycobacterium
ADPTGA

SEQ ID NO: 1104283 - protein, 4 aa, Mycobacterium
ADPW

SEQ ID NO: 1104284 - protein, 7 aa, Mycobacterium
ADQAAAP

SEQ ID NO: 1104285 - protein, 9 aa, Mycobacterium
ADQAERRAE

SEQ ID NO: 1104286 - protein, 7 aa, Mycobacterium
ADQATAY

SEQ ID NO: 1104287 - protein, 9 aa, Mycobacterium
ADQDGTLKA

SEQ ID NO: 1104288 - protein, 4 aa, Mycobacterium
ADQL

SEQ ID NO: 1104289 - protein, 9 aa, Mycobacterium
ADQNTRAGA

SEQ ID NO: 1104290 - protein, 6 aa, Mycobacterium
ADQVDP

SEQ ID NO: 1104291 - protein, 4 aa, Mycobacterium
ADRA

SEQ ID NO: 1104292 - protein, 10 aa, Mycobacterium
ADRAKEFDGR

SEQ ID NO: 1104293 - protein, 19 aa, Mycobacterium
ADRAREAELARQAATDPLT

SEQ ID NO: 1104294 - protein, 5 aa, Mycobacterium
ADRDT

SEQ ID NO: 1104295 - protein, 4 aa, Mycobacterium
ADRP

SEQ ID NO: 1104296 - protein, 7 aa, Mycobacterium
ADRPRDC

SEQ ID NO: 1104297 - protein, 76 aa, Mycobacterium
ADRPRRRRPRPEEQPPTPEPRRRPRTSSAREPRNARSRDPLPPRERRSPYDGDDRHDHRPQRDRGPREQPRRRSRF

SEQ ID NO: 1104298 - protein, 5 aa, Mycobacterium
ADRPW

SEQ ID NO: 1104299 - protein, 4 aa, Mycobacterium
ADRQ

SEQ ID NO: 1104300 - protein, 7 aa, Mycobacterium
ADRSAAA

SEQ ID NO: 1104301 - protein, 5 aa, Mycobacterium
ADRST

SEQ ID NO: 1104302 - protein, 9 aa, Mycobacterium
ADRVGPVGT

SEQ ID NO: 1104303 - protein, 7 aa, Mycobacterium
ADSDRVR

SEQ ID NO: 1104304 - protein, 7 aa, Mycobacterium
ADSEHRG

SEQ ID NO: 1104305 - protein, 4 aa, Mycobacterium
ADSG

SEQ ID NO: 1104306 - protein, 7 aa, Mycobacterium
ADSMSPG

SEQ ID NO: 1104307 - protein, 19 aa, Mycobacterium
ADSPATAGTAQSSGYDPSA

SEQ ID NO: 1104308 - protein, 7 aa, Mycobacterium
ADSPLAD

SEQ ID NO: 1104309 - protein, 8 aa, Mycobacterium
ADSPPGNW

SEQ ID NO: 1104310 - protein, 13 aa, Mycobacterium
ADSPRTSPKALPH

SEQ ID NO: 1104311 - protein, 97 aa, Mycobacterium
ADSPTVESTSSTTVDAAPAAPDTATEADTGEQAQPDVGAEEPAESEVDTEGPADPDDPEEPAAPEPEDTEDVEEPGAVPGEAEGGGDPRPVQPDETE

SEQ ID NO: 1104312 - protein, 9 aa, Mycobacterium
ADSTHPHEA

SEQ ID NO: 1104313 - protein, 6 aa, Mycobacterium
ADSWSA

SEQ ID NO: 1104314 - protein, 7 aa, Mycobacterium
ADTAELD

SEQ ID NO: 1104315 - protein, 40 aa, Mycobacterium
ADTASLDRPDPSDNRRKQNYDYRGGWGDPWGSPSTLDSDD

SEQ ID NO: 1104316 - protein, 6 aa, Mycobacterium
ADTDGT

SEQ ID NO: 1104317 - protein, 5 aa, Mycobacterium
ADTDN

SEQ ID NO: 1104318 - protein, 5 aa, Mycobacterium
ADTDR

SEQ ID NO: 1104319 - protein, 5 aa, Mycobacterium
ADTEH

SEQ ID NO: 1104320 - protein, 12 aa, Mycobacterium
ADTFDGNGDSFR

SEQ ID NO: 1104321 - protein, 11 aa, Mycobacterium
ADTFDGNGDTF

SEQ ID NO: 1104322 - protein, 11 aa, Mycobacterium
ADTGEPAPTGA

SEQ ID NO: 1104323 - protein, 7 aa, Mycobacterium
ADTGNDI

SEQ ID NO: 1104324 - protein, 8 aa, Mycobacterium
ADTMGAAD

SEQ ID NO: 1104325 - protein, 10 aa, Mycobacterium
ADTPDDLKNA

SEQ ID NO: 1104326 - protein, 7 aa, Mycobacterium
ADTPPHL

SEQ ID NO: 1104327 - protein, 6 aa, Mycobacterium
ADTPPQ

SEQ ID NO: 1104328 - protein, 7 aa, Mycobacterium
ADTRDDI

SEQ ID NO: 1104329 - protein, 10 aa, Mycobacterium
ADTSRTGRVG

SEQ ID NO: 1104330 - protein, 9 aa, Mycobacterium
ADTVPGGSD

SEQ ID NO: 1104331 - protein, 6 aa, Mycobacterium
ADVAGR

SEQ ID NO: 1104332 - protein, 13 aa, Mycobacterium
ADVGGQAEKQAES

SEQ ID NO: 1104333 - protein, 27 aa, Mycobacterium
ADVLGSSTTELGADESTSSTKGLTGLP

SEQ ID NO: 1104334 - protein, 13 aa, Mycobacterium
ADVPSAVPSSATV

SEQ ID NO: 1104335 - protein, 10 aa, Mycobacterium
ADVPTDTASS

SEQ ID NO: 1104336 - protein, 9 aa, Mycobacterium
ADVSGAGAA

SEQ ID NO: 1104337 - protein, 13 aa, Mycobacterium
ADWKPSAEKEVDP

SEQ ID NO: 1104338 - protein, 29 aa, Mycobacterium
ADYEPEPDDEPPVRQEPRIAATERGAGPM

SEQ ID NO: 1104339 - protein, 6 aa, Mycobacterium
ADYRIG

SEQ ID NO: 1104340 - protein, 7 aa, Mycobacterium
ADYRVGP

SEQ ID NO: 1104341 - protein, 9 aa, Mycobacterium
AEAAGTTVT

SEQ ID NO: 1104342 - protein, 4 aa, Mycobacterium
AEAD

SEQ ID NO: 1104343 - protein, 7 aa, Mycobacterium
AEAEQDT

SEQ ID NO: 1104344 - protein, 9 aa, Mycobacterium
AEAERTKAT

SEQ ID NO: 1104345 - protein, 13 aa, Mycobacterium
AEAGAGIGSPDEV

SEQ ID NO: 1104346 - protein, 4 aa, Mycobacterium
AEAL

SEQ ID NO: 1104347 - protein, 18 aa, Mycobacterium
AEAPAGPSQGLDTRKDSP

SEQ ID NO: 1104348 - protein, 9 aa, Mycobacterium
AEAPGSAGR

SEQ ID NO: 1104349 - protein, 6 aa, Mycobacterium
AEARGA

SEQ ID NO: 1104350 - protein, 6 aa, Mycobacterium
AEARRA

SEQ ID NO: 1104351 - protein, 10 aa, Mycobacterium
AEASGAENMA

SEQ ID NO: 1104352 - protein, 7 aa, Mycobacterium
AEASTIE

SEQ ID NO: 1104353 - protein, 47 aa, Mycobacterium
AEAYRNAQAAADRQRAVADAARNERDAAAAASKGQAEKDLADTEEQL

SEQ ID NO: 1104354 - protein, 15 aa, Mycobacterium
AEDDSTRPVDKRDSD

SEQ ID NO: 1104355 - protein, 9 aa, Mycobacterium
AEDETYDGS

SEQ ID NO: 1104356 - protein, 6 aa, Mycobacterium
AEDHPL

SEQ ID NO: 1104357 - protein, 10 aa, Mycobacterium
AEDNHPHESP

SEQ ID NO: 1104358 - protein, 6 aa, Mycobacterium
AEDRGV

SEQ ID NO: 1104359 - protein, 7 aa, Mycobacterium
AEDTPGA

SEQ ID NO: 1104360 - protein, 7 aa, Mycobacterium
AEDTVKD

SEQ ID NO: 1104361 - protein, 6 aa, Mycobacterium
AEEAAD

SEQ ID NO: 1104362 - protein, 10 aa, Mycobacterium
AEEAADADAA

SEQ ID NO: 1104363 - protein, 9 aa, Mycobacterium
AEEALEDPA

SEQ ID NO: 1104364 - protein, 7 aa, Mycobacterium
AEEASRR

SEQ ID NO: 1104365 - protein, 6 aa, Mycobacterium
AEEGNA

SEQ ID NO: 1104366 - protein, 12 aa, Mycobacterium
AEEPVPEPLPAA

SEQ ID NO: 1104367 - protein, 10 aa, Mycobacterium
AEERETAERL

SEQ ID NO: 1104368 - protein, 12 aa, Mycobacterium
AEETAEPERNVP

SEQ ID NO: 1104369 - protein, 8 aa, Mycobacterium
AEETARFG

SEQ ID NO: 1104370 - protein, 9 aa, Mycobacterium
AEEVPDPGR

SEQ ID NO: 1104371 - protein, 11 aa, Mycobacterium
AEGARPNTTLA

SEQ ID NO: 1104372 - protein, 9 aa, Mycobacterium
AEGAVSDPV

SEQ ID NO: 1104373 - protein, 8 aa, Mycobacterium
AEGEDKEL

SEQ ID NO: 1104374 - protein, 12 aa, Mycobacterium
AEGGGRANAIGG

SEQ ID NO: 1104375 - protein, 10 aa, Mycobacterium
AEGGPDPRGR

SEQ ID NO: 1104376 - protein, 12 aa, Mycobacterium
AEGLGPDALDGY

SEQ ID NO: 1104377 - protein, 8 aa, Mycobacterium
AEGLTPQD

SEQ ID NO: 1104378 - protein, 32 aa, Mycobacterium
AEGPEASTSHAGGPETGPAPAAPVAPGPAEAG

SEQ ID NO: 1104379 - protein, 5 aa, Mycobacterium
AEGQW

SEQ ID NO: 1104380 - protein, 5 aa, Mycobacterium
AEGRQ

SEQ ID NO: 1104381 - protein, 5 aa, Mycobacterium
AEGSH

SEQ ID NO: 1104382 - protein, 4 aa, Mycobacterium
AEGV

SEQ ID NO: 1104383 - protein, 7 aa, Mycobacterium
AEHGTGS

SEQ ID NO: 1104384 - protein, 43 aa, Mycobacterium
AEHHTAPHGDAPGEGTVTPLRRSRRRSGLDQLGDSSDPRVSKT

SEQ ID NO: 1104385 - protein, 5 aa, Mycobacterium
AEHTG

SEQ ID NO: 1104386 - protein, 4 aa, Mycobacterium
AEID

SEQ ID NO: 1104387 - protein, 8 aa, Mycobacterium
AEKEVQKQ

SEQ ID NO: 1104388 - protein, 16 aa, Mycobacterium
AEKLRQQNAEYAAAAR

SEQ ID NO: 1104389 - protein, 5 aa, Mycobacterium
AELAG

SEQ ID NO: 1104390 - protein, 8 aa, Mycobacterium
AELDAGPE

SEQ ID NO: 1104391 - protein, 9 aa, Mycobacterium
AELDAGPEK

SEQ ID NO: 1104392 - protein, 8 aa, Mycobacterium
AELDGPGT

SEQ ID NO: 1104393 - protein, 18 aa, Mycobacterium
AELSTGPGMGTEWELTVS

SEQ ID NO: 1104394 - protein, 17 aa, Mycobacterium
AEMPSAQGGAPRGEGAV

SEQ ID NO: 1104395 - protein, 18 aa, Mycobacterium
AENAARLNAEAGTISDPG

SEQ ID NO: 1104396 - protein, 10 aa, Mycobacterium
AENPDNETRI

SEQ ID NO: 1104397 - protein, 7 aa, Mycobacterium
AENPEPG

SEQ ID NO: 1104398 - protein, 6 aa, Mycobacterium
AENRAD

SEQ ID NO: 1104399 - protein, 11 aa, Mycobacterium
AEPALSPEDAA

SEQ ID NO: 1104400 - protein, 24 aa, Mycobacterium
AEPEDGGAAPVGAGTAADSPGDVD

SEQ ID NO: 1104401 - protein, 10 aa, Mycobacterium
AEPENATSQT

SEQ ID NO: 1104402 - protein, 5 aa, Mycobacterium
AEPGK

SEQ ID NO: 1104403 - protein, 9 aa, Mycobacterium
AEPGPVRAG

SEQ ID NO: 1104404 - protein, 6 aa, Mycobacterium
AEPGTS

SEQ ID NO: 1104405 - protein, 6 aa, Mycobacterium
AEPGTT

SEQ ID NO: 1104406 - protein, 17 aa, Mycobacterium
AEPGVRGGRSVRPVADT

SEQ ID NO: 1104407 - protein, 75 aa, Mycobacterium
AEPHPPEGEWAPRGEAGGAHRRSAEQPQWAPPPAPAPPPPPPPPPPPPPPPPAQQPPPPPQPTPPPAQQPSPEPQ

SEQ ID NO: 1104408 - protein, 7 aa, Mycobacterium
AEPKKRP

SEQ ID NO: 1104409 - protein, 16 aa, Mycobacterium
AEPPGAGTLGVPGDSV

SEQ ID NO: 1104410 - protein, 5 aa, Mycobacterium
AEPPL

SEQ ID NO: 1104411 - protein, 13 aa, Mycobacterium
AEPPQTRSRDFTG

SEQ ID NO: 1104412 - protein, 51 aa, Mycobacterium
AEPQPPEPDLVPPPGFGGAHRRPSEAEPHTEEPPRRRRRRAEEAPPVAEAP

SEQ ID NO: 1104413 - protein, 8 aa, Mycobacterium
AEPQRQGK

SEQ ID NO: 1104414 - protein, 9 aa, Mycobacterium
AEPRAGTPV

SEQ ID NO: 1104415 - protein, 11 aa, Mycobacterium
AEPRAKYTGET

SEQ ID NO: 1104416 - protein, 7 aa, Mycobacterium
AEPRAVR

SEQ ID NO: 1104417 - protein, 5 aa, Mycobacterium
AEPRM

SEQ ID NO: 1104418 - protein, 10 aa, Mycobacterium
AEPTGDSAAK

SEQ ID NO: 1104419 - protein, 7 aa, Mycobacterium
AEPVRPD

SEQ ID NO: 1104420 - protein, 14 aa, Mycobacterium
AEQAAEQRFGSAAR

SEQ ID NO: 1104421 - protein, 18 aa, Mycobacterium
AEQADAEAERIKAQGAQQ

SEQ ID NO: 1104422 - protein, 7 aa, Mycobacterium
AEQGGPV

SEQ ID NO: 1104423 - protein, 9 aa, Mycobacterium
AEQGKSSAV

SEQ ID NO: 1104424 - protein, 8 aa, Mycobacterium
AEQGYSSE

SEQ ID NO: 1104425 - protein, 5 aa, Mycobacterium
AEQPQ

SEQ ID NO: 1104426 - protein, 15 aa, Mycobacterium
AEQQAGTRAGVAAQP

SEQ ID NO: 1104427 - protein, 7 aa, Mycobacterium
AEQRATA

SEQ ID NO: 1104428 - protein, 9 aa, Mycobacterium
AERASSSAA

SEQ ID NO: 1104429 - protein, 10 aa, Mycobacterium
AERDDPDGGA

SEQ ID NO: 1104430 - protein, 9 aa, Mycobacterium
AERDPRNPA

SEQ ID NO: 1104431 - protein, 12 aa, Mycobacterium
AERESGGHDSSG

SEQ ID NO: 1104432 - protein, 5 aa, Mycobacterium
AERLD

SEQ ID NO: 1104433 - protein, 15 aa, Mycobacterium
AERTAARSGHSGKEY

SEQ ID NO: 1104434 - protein, 6 aa, Mycobacterium
AERTAS

SEQ ID NO: 1104435 - protein, 8 aa, Mycobacterium
AERVAAET

SEQ ID NO: 1104436 - protein, 11 aa, Mycobacterium
AESATQTSDTA

SEQ ID NO: 1104437 - protein, 7 aa, Mycobacterium
AESGTPI

SEQ ID NO: 1104438 - protein, 4 aa, Mycobacterium
AESI

SEQ ID NO: 1104439 - protein, 14 aa, Mycobacterium
AESIPASIGLSRRP

SEQ ID NO: 1104440 - protein, 32 aa, Mycobacterium
AESLNGTTSPTAAPGEPRAAAGGPVATSDAAT

SEQ ID NO: 1104441 - protein, 11 aa, Mycobacterium
AESLTGSSLAG

SEQ ID NO: 1104442 - protein, 8 aa, Mycobacterium
AESRRAPR

SEQ ID NO: 1104443 - protein, 14 aa, Mycobacterium
AETAPTTNPATTSA

SEQ ID NO: 1104444 - protein, 11 aa, Mycobacterium
AETARRRSRMN

SEQ ID NO: 1104445 - protein, 14 aa, Mycobacterium
AETDADGSTAGTRD

SEQ ID NO: 1104446 - protein, 7 aa, Mycobacterium
AETPWGP

SEQ ID NO: 1104447 - protein, 5 aa, Mycobacterium
AETRI

SEQ ID NO: 1104448 - protein, 8 aa, Mycobacterium
AETRLDDG

SEQ ID NO: 1104449 - protein, 11 aa, Mycobacterium
AETSVVSEDSS

SEQ ID NO: 1104450 - protein, 14 aa, Mycobacterium
AETVATRRRPPERP

SEQ ID NO: 1104451 - protein, 5 aa, Mycobacterium
AEVAT

SEQ ID NO: 1104452 - protein, 16 aa, Mycobacterium
AEVPRSAKSAALGRQL

SEQ ID NO: 1104453 - protein, 13 aa, Mycobacterium
AEYTREGARGGHD

SEQ ID NO: 1104454 - protein, 5 aa, Mycobacterium
AFANP

SEQ ID NO: 1104455 - protein, 4 aa, Mycobacterium
AFEG

SEQ ID NO: 1104456 - protein, 8 aa, Mycobacterium
AFEGAGAA

SEQ ID NO: 1104457 - protein, 10 aa, Mycobacterium
AFPQDNPAAV

SEQ ID NO: 1104458 - protein, 54 aa, Mycobacterium
AGAAGGGGGSGGGAAAAPRGPAPEAPARVAPPQQPSVRQPEVPVRSGDPAAVPA

SEQ ID NO: 1104459 - protein, 20 aa, Mycobacterium
AGAAGLAATESAGDGASSAT

SEQ ID NO: 1104460 - protein, 5 aa, Mycobacterium
AGAAL

SEQ ID NO: 1104461 - protein, 6 aa, Mycobacterium
AGAAPS

SEQ ID NO: 1104462 - protein, 17 aa, Mycobacterium
AGAATPVVAGTPSAGRD

SEQ ID NO: 1104463 - protein, 10 aa, Mycobacterium
AGADAASFSG

SEQ ID NO: 1104464 - protein, 7 aa, Mycobacterium
AGADGNI

SEQ ID NO: 1104465 - protein, 11 aa, Mycobacterium
AGADGSPAASG

SEQ ID NO: 1104466 - protein, 13 aa, Mycobacterium
AGADTQLAPVGAE

SEQ ID NO: 1104467 - protein, 5 aa, Mycobacterium
AGAEI

SEQ ID NO: 1104468 - protein, 9 aa, Mycobacterium
AGAEVGPAF

SEQ ID NO: 1104469 - protein, 8 aa, Mycobacterium
AGAGEASQ

SEQ ID NO: 1104470 - protein, 8 aa, Mycobacterium
AGAGQSVT

SEQ ID NO: 1104471 - protein, 9 aa, Mycobacterium
AGAGSGVVQ

SEQ ID NO: 1104472 - protein, 5 aa, Mycobacterium
AGAGT

SEQ ID NO: 1104473 - protein, 13 aa, Mycobacterium
AGAKGGNDRPGAF

SEQ ID NO: 1104474 - protein, 23 aa, Mycobacterium
AGAKRPGAKKTPAKASPNEGAAT

SEQ ID NO: 1104475 - protein, 10 aa, Mycobacterium
AGANDRAQAA

SEQ ID NO: 1104476 - protein, 10 aa, Mycobacterium
AGANGNAEVT

SEQ ID NO: 1104477 - protein, 8 aa, Mycobacterium
AGANGSGR

SEQ ID NO: 1104478 - protein, 4 aa, Mycobacterium
AGAP

SEQ ID NO: 1104479 - protein, 15 aa, Mycobacterium
AGAPGASTAQGGIDL

SEQ ID NO: 1104480 - protein, 28 aa, Mycobacterium
AGAPGDDPTQANRMNDAQAASTKITELC

SEQ ID NO: 1104481 - protein, 9 aa, Mycobacterium
AGAPLPDGA

SEQ ID NO: 1104482 - protein, 8 aa, Mycobacterium
AGAPSSGD

SEQ ID NO: 1104483 - protein, 7 aa, Mycobacterium
AGAQDVD

SEQ ID NO: 1104484 - protein, 8 aa, Mycobacterium
AGAQEKFG

SEQ ID NO: 1104485 - protein, 7 aa, Mycobacterium
AGAQSGS

SEQ ID NO: 1104486 - protein, 6 aa, Mycobacterium
AGARPV

SEQ ID NO: 1104487 - protein, 6 aa, Mycobacterium
AGASFT

SEQ ID NO: 1104488 - protein, 5 aa, Mycobacterium
AGASS

SEQ ID NO: 1104489 - protein, 5 aa, Mycobacterium
AGATA

SEQ ID NO: 1104490 - protein, 13 aa, Mycobacterium
AGATALQDSPRGR

SEQ ID NO: 1104491 - protein, 21 aa, Mycobacterium
AGATGEKSEQGFAARKNSGLL

SEQ ID NO: 1104492 - protein, 9 aa, Mycobacterium
AGATTLADT

SEQ ID NO: 1104493 - protein, 14 aa, Mycobacterium
AGATVGADSATPGI

SEQ ID NO: 1104494 - protein, 7 aa, Mycobacterium
AGAVQPT

SEQ ID NO: 1104495 - protein, 33 aa, Mycobacterium
AGAVTDTDDDAEGLGSVEGDEVAESAEDASEVH

SEQ ID NO: 1104496 - protein, 6 aa, Mycobacterium
AGAYGG

SEQ ID NO: 1104497 - protein, 4 aa, Mycobacterium
AGDA

SEQ ID NO: 1104498 - protein, 6 aa, Mycobacterium
AGDATE

SEQ ID NO: 1104499 - protein, 8 aa, Mycobacterium
AGDDAAAP

SEQ ID NO: 1104500 - protein, 8 aa, Mycobacterium
AGDDAVAG

SEQ ID NO: 1104501 - protein, 6 aa, Mycobacterium
AGDGGT

SEQ ID NO: 1104502 - protein, 8 aa, Mycobacterium
AGDGTPTA

SEQ ID NO: 1104503 - protein, 5 aa, Mycobacterium
AGDMT

SEQ ID NO: 1104504 - protein, 9 aa, Mycobacterium
AGDPAADDS

SEQ ID NO: 1104505 - protein, 5 aa, Mycobacterium
AGDPD

SEQ ID NO: 1104506 - protein, 9 aa, Mycobacterium
AGDPDAAAQ

SEQ ID NO: 1104507 - protein, 6 aa, Mycobacterium
AGDPEL

SEQ ID NO: 1104508 - protein, 8 aa, Mycobacterium
AGDPPIAS

SEQ ID NO: 1104509 - protein, 14 aa, Mycobacterium
AGDPPTASDVTAVP

SEQ ID NO: 1104510 - protein, 7 aa, Mycobacterium
AGDPTEA

SEQ ID NO: 1104511 - protein, 5 aa, Mycobacterium
AGDPV

SEQ ID NO: 1104512 - protein, 15 aa, Mycobacterium
AGDPVDNAELAQPPA

SEQ ID NO: 1104513 - protein, 10 aa, Mycobacterium
AGDRRRGRTG

SEQ ID NO: 1104514 - protein, 6 aa, Mycobacterium
AGDRVP

SEQ ID NO: 1104515 - protein, 12 aa, Mycobacterium
AGDRVQSADGMT

SEQ ID NO: 1104516 - protein, 11 aa, Mycobacterium
AGDSSGNAPEA

SEQ ID NO: 1104517 - protein, 5 aa, Mycobacterium
AGDSV

SEQ ID NO: 1104518 - protein, 4 aa, Mycobacterium
AGDT

SEQ ID NO: 1104519 - protein, 5 aa, Mycobacterium
AGDTR

SEQ ID NO: 1104520 - protein, 15 aa, Mycobacterium
AGDVGVDTAATPDGG

SEQ ID NO: 1104521 - protein, 10 aa, Mycobacterium
AGEAKTPRDE

SEQ ID NO: 1104522 - protein, 13 aa, Mycobacterium
AGEDLAKTGDPVL

SEQ ID NO: 1104523 - protein, 11 aa, Mycobacterium
AGEDPAGSAEA

SEQ ID NO: 1104524 - protein, 6 aa, Mycobacterium
AGEGGA

SEQ ID NO: 1104525 - protein, 28 aa, Mycobacterium
AGEGGAAGGCDSNPLSDPALPSDPRNWS

SEQ ID NO: 1104526 - protein, 15 aa, Mycobacterium
AGEHPPAREGLAAAG

SEQ ID NO: 1104527 - protein, 4 aa, Mycobacterium
AGEI

SEQ ID NO: 1104528 - protein, 5 aa, Mycobacterium
AGEIP

SEQ ID NO: 1104529 - protein, 10 aa, Mycobacterium
AGENGGPAVP

SEQ ID NO: 1104530 - protein, 5 aa, Mycobacterium
AGEPL

SEQ ID NO: 1104531 - protein, 6 aa, Mycobacterium
AGEQDR

SEQ ID NO: 1104532 - protein, 7 aa, Mycobacterium
AGEQERA

SEQ ID NO: 1104533 - protein, 7 aa, Mycobacterium
AGESGLA

SEQ ID NO: 1104534 - protein, 10 aa, Mycobacterium
AGETGAPQRP

SEQ ID NO: 1104535 - protein, 15 aa, Mycobacterium
AGETWTRGGRGAVAN

SEQ ID NO: 1104536 - protein, 8 aa, Mycobacterium
AGEVARSD

SEQ ID NO: 1104537 - protein, 6 aa, Mycobacterium
AGEVGG

SEQ ID NO: 1104538 - protein, 7 aa, Mycobacterium
AGFGGGN

SEQ ID NO: 1104539 - protein, 5 aa, Mycobacterium
AGFPA

SEQ ID NO: 1104540 - protein, 7 aa, Mycobacterium
AGGAAGL

SEQ ID NO: 1104541 - protein, 11 aa, Mycobacterium
AGGAATAAAGL

SEQ ID NO: 1104542 - protein, 6 aa, Mycobacterium
AGGAKG

SEQ ID NO: 1104543 - protein, 11 aa, Mycobacterium
AGGAKGVGTAV

SEQ ID NO: 1104544 - protein, 50 aa, Mycobacterium
AGGAKRPGAKKQAAPAAPAAAAPAATPAPEAPAQPEAAAAAPAKPEPEVK

SEQ ID NO: 1104545 - protein, 11 aa, Mycobacterium
AGGAVTTESGH

SEQ ID NO: 1104546 - protein, 4 aa, Mycobacterium
AGGE

SEQ ID NO: 1104547 - protein, 7 aa, Mycobacterium
AGGEYGS

SEQ ID NO: 1104548 - protein, 4 aa, Mycobacterium
AGGF

SEQ ID NO: 1104549 - protein, 15 aa, Mycobacterium
AGGFQDPTSESARAT

SEQ ID NO: 1104550 - protein, 14 aa, Mycobacterium
AGGGAPPEAAQSPQ

SEQ ID NO: 1104551 - protein, 32 aa, Mycobacterium
AGGGDTGPELGEREQQVGEQENPDTVDTAPTR

SEQ ID NO: 1104552 - protein, 6 aa, Mycobacterium
AGGGGY

SEQ ID NO: 1104553 - protein, 8 aa, Mycobacterium
AGGGPLGN

SEQ ID NO: 1104554 - protein, 17 aa, Mycobacterium
AGGGSGGKKVPEINADR

SEQ ID NO: 1104555 - protein, 12 aa, Mycobacterium
AGGISGSTTVGG

SEQ ID NO: 1104556 - protein, 4 aa, Mycobacterium
AGGL

SEQ ID NO: 1104557 - protein, 4 aa, Mycobacterium
AGGM

SEQ ID NO: 1104558 - protein, 7 aa, Mycobacterium
AGGPNEP

SEQ ID NO: 1104559 - protein, 4 aa, Mycobacterium
AGGQ

SEQ ID NO: 1104560 - protein, 6 aa, Mycobacterium
AGGREW

SEQ ID NO: 1104561 - protein, 9 aa, Mycobacterium
AGGRLDPDR

SEQ ID NO: 1104562 - protein, 9 aa, Mycobacterium
AGGRMPPER

SEQ ID NO: 1104563 - protein, 9 aa, Mycobacterium
AGGSATQDV

SEQ ID NO: 1104564 - protein, 10 aa, Mycobacterium
AGGSDEEKLQ

SEQ ID NO: 1104565 - protein, 9 aa, Mycobacterium
AGGSGTLSN

SEQ ID NO: 1104566 - protein, 4 aa, Mycobacterium
AGGT

SEQ ID NO: 1104567 - protein, 7 aa, Mycobacterium
AGGVNSA

SEQ ID NO: 1104568 - protein, 11 aa, Mycobacterium
AGGVPQDEGGK

SEQ ID NO: 1104569 - protein, 11 aa, Mycobacterium
AGGVPTDEGGK

SEQ ID NO: 1104570 - protein, 5 aa, Mycobacterium
AGHDG

SEQ ID NO: 1104571 - protein, 22 aa, Mycobacterium
AGHDPDDVRRTAAGAAGVPAGA

SEQ ID NO: 1104572 - protein, 15 aa, Mycobacterium
AGHGEAPPQSRSESR

SEQ ID NO: 1104573 - protein, 15 aa, Mycobacterium
AGHGHSHGADGGGFS

SEQ ID NO: 1104574 - protein, 9 aa, Mycobacterium
AGHGRPAAL

SEQ ID NO: 1104575 - protein, 7 aa, Mycobacterium
AGHPTVQ

SEQ ID NO: 1104576 - protein, 20 aa, Mycobacterium
AGHPVGAGRIEPGYDPRLTN

SEQ ID NO: 1104577 - protein, 6 aa, Mycobacterium
AGHTYG

SEQ ID NO: 1104578 - protein, 9 aa, Mycobacterium
AGIASGDAA

SEQ ID NO: 1104579 - protein, 7 aa, Mycobacterium
AGIDTAG

SEQ ID NO: 1104580 - protein, 11 aa, Mycobacterium
AGIEEGARTGL

SEQ ID NO: 1104581 - protein, 10 aa, Mycobacterium
AGKKPEDYGI

SEQ ID NO: 1104582 - protein, 29 aa, Mycobacterium
AGKRQADDEMAGADVSEKQLAESNEPDFQ

SEQ ID NO: 1104583 - protein, 13 aa, Mycobacterium
AGKVSASSGAGNT

SEQ ID NO: 1104584 - protein, 8 aa, Mycobacterium
AGLDRPGR

SEQ ID NO: 1104585 - protein, 29 aa, Mycobacterium
AGLDSPAPPAEDRRSLDTRDLPSRTDTIG

SEQ ID NO: 1104586 - protein, 11 aa, Mycobacterium
AGLESAGANEA

SEQ ID NO: 1104587 - protein, 10 aa, Mycobacterium
AGLGGAPKQR

SEQ ID NO: 1104588 - protein, 13 aa, Mycobacterium
AGLKGADPTEREP

SEQ ID NO: 1104589 - protein, 5 aa, Mycobacterium
AGLPP

SEQ ID NO: 1104590 - protein, 9 aa, Mycobacterium
AGMAGARAT

SEQ ID NO: 1104591 - protein, 4 aa, Mycobacterium
AGMG

SEQ ID NO: 1104592 - protein, 13 aa, Mycobacterium
AGNDAAAQQECQE

SEQ ID NO: 1104593 - protein, 8 aa, Mycobacterium
AGNDDPNL

SEQ ID NO: 1104594 - protein, 9 aa, Mycobacterium
AGNDQQAVQ

SEQ ID NO: 1104595 - protein, 6 aa, Mycobacterium
AGNDTA

SEQ ID NO: 1104596 - protein, 4 aa, Mycobacterium
AGNG

SEQ ID NO: 1104597 - protein, 32 aa, Mycobacterium
AGNGGDGATVARPTPPADRRPAATGAGAATAE

SEQ ID NO: 1104598 - protein, 9 aa, Mycobacterium
AGNGPEAPI

SEQ ID NO: 1104599 - protein, 16 aa, Mycobacterium
AGNQGESLANESVQAA

SEQ ID NO: 1104600 - protein, 18 aa, Mycobacterium
AGNQGGGDQGQDCGQNPA

SEQ ID NO: 1104601 - protein, 12 aa, Mycobacterium
AGNRTAAVEEGV

SEQ ID NO: 1104602 - protein, 9 aa, Mycobacterium
AGNTVDGTS

SEQ ID NO: 1104603 - protein, 6 aa, Mycobacterium
AGPAAN

SEQ ID NO: 1104604 - protein, 6 aa, Mycobacterium
AGPADV

SEQ ID NO: 1104605 - protein, 8 aa, Mycobacterium
AGPAERRH

SEQ ID NO: 1104606 - protein, 8 aa, Mycobacterium
AGPAESST

SEQ ID NO: 1104607 - protein, 8 aa, Mycobacterium
AGPAGELQ

SEQ ID NO: 1104608 - protein, 11 aa, Mycobacterium
AGPAGPDRSRG

SEQ ID NO: 1104609 - protein, 5 aa, Mycobacterium
AGPAR

SEQ ID NO: 1104610 - protein, 10 aa, Mycobacterium
AGPAWRDGSA

SEQ ID NO: 1104611 - protein, 7 aa, Mycobacterium
AGPDDLA

SEQ ID NO: 1104612 - protein, 6 aa, Mycobacterium
AGPDGN

SEQ ID NO: 1104613 - protein, 7 aa, Mycobacterium
AGPEDSV

SEQ ID NO: 1104614 - protein, 8 aa, Mycobacterium
AGPEGDRV

SEQ ID NO: 1104615 - protein, 11 aa, Mycobacterium
AGPEPAAAHST

SEQ ID NO: 1104616 - protein, 6 aa, Mycobacterium
AGPEST

SEQ ID NO: 1104617 - protein, 7 aa, Mycobacterium
AGPGDST

SEQ ID NO: 1104618 - protein, 6 aa, Mycobacterium
AGPGGR

SEQ ID NO: 1104619 - protein, 7 aa, Mycobacterium
AGPGPYP

SEQ ID NO: 1104620 - protein, 4 aa, Mycobacterium
AGPH

SEQ ID NO: 1104621 - protein, 6 aa, Mycobacterium
AGPLNT

SEQ ID NO: 1104622 - protein, 10 aa, Mycobacterium
AGPLPDQTDA

SEQ ID NO: 1104623 - protein, 8 aa, Mycobacterium
AGPPGQVD

SEQ ID NO: 1104624 - protein, 17 aa, Mycobacterium
AGPPRPGSGSATGALPG

SEQ ID NO: 1104625 - protein, 7 aa, Mycobacterium
AGPQGPK

SEQ ID NO: 1104626 - protein, 10 aa, Mycobacterium
AGPQVERQEI

SEQ ID NO: 1104627 - protein, 5 aa, Mycobacterium
AGPRR

SEQ ID NO: 1104628 - protein, 5 aa, Mycobacterium
AGPTA

SEQ ID NO: 1104629 - protein, 9 aa, Mycobacterium
AGPTETYPT

SEQ ID NO: 1104630 - protein, 30 aa, Mycobacterium
AGPTPPAASSATPPTTTAAAPAGDAPSDGL

SEQ ID NO: 1104631 - protein, 10 aa, Mycobacterium
AGQDDTYTDE

SEQ ID NO: 1104632 - protein, 12 aa, Mycobacterium
AGQIGNVDARPG

SEQ ID NO: 1104633 - protein, 4 aa, Mycobacterium
AGQL

SEQ ID NO: 1104634 - protein, 5 aa, Mycobacterium
AGQLP

SEQ ID NO: 1104635 - protein, 6 aa, Mycobacterium
AGQPAR

SEQ ID NO: 1104636 - protein, 6 aa, Mycobacterium
AGQPLV

SEQ ID NO: 1104637 - protein, 9 aa, Mycobacterium
AGQPNNPTF

SEQ ID NO: 1104638 - protein, 5 aa, Mycobacterium
AGQRG

SEQ ID NO: 1104639 - protein, 8 aa, Mycobacterium
AGQRGTTA

SEQ ID NO: 1104640 - protein, 6 aa, Mycobacterium
AGQRRS

SEQ ID NO: 1104641 - protein, 14 aa, Mycobacterium
AGQRTTAAARPRPA

SEQ ID NO: 1104642 - protein, 8 aa, Mycobacterium
AGQSQDSL

SEQ ID NO: 1104643 - protein, 6 aa, Mycobacterium
AGQVEE

SEQ ID NO: 1104644 - protein, 6 aa, Mycobacterium
AGQVGQ

SEQ ID NO: 1104645 - protein, 4 aa, Mycobacterium
AGRA

SEQ ID NO: 1104646 - protein, 4 aa, Mycobacterium
AGRD

SEQ ID NO: 1104647 - protein, 6 aa, Mycobacterium
AGRDAF

SEQ ID NO: 1104648 - protein, 5 aa, Mycobacterium
AGRDH

SEQ ID NO: 1104649 - protein, 16 aa, Mycobacterium
AGREPEDAADAAMATS

SEQ ID NO: 1104650 - protein, 6 aa, Mycobacterium
AGRESL

SEQ ID NO: 1104651 - protein, 5 aa, Mycobacterium
AGRFR

SEQ ID NO: 1104652 - protein, 10 aa, Mycobacterium
AGRGGKATVS

SEQ ID NO: 1104653 - protein, 5 aa, Mycobacterium
AGRGY

SEQ ID NO: 1104654 - protein, 7 aa, Mycobacterium
AGRMSGA

SEQ ID NO: 1104655 - protein, 10 aa, Mycobacterium
AGRPATPSDD

SEQ ID NO: 1104656 - protein, 10 aa, Mycobacterium
AGRPDNPAMV

SEQ ID NO: 1104657 - protein, 10 aa, Mycobacterium
AGRQTSHQEQ

SEQ ID NO: 1104658 - protein, 66 aa, Mycobacterium
AGRRPPRPNAAPSIGRAAPTAVPPAIASRPAADPTGRAPAPTSRTRATGSHHRSAPPPRGGFSSGQ

SEQ ID NO: 1104659 - protein, 6 aa, Mycobacterium
AGRSIR

SEQ ID NO: 1104660 - protein, 10 aa, Mycobacterium
AGRTPAEKIE

SEQ ID NO: 1104661 - protein, 5 aa, Mycobacterium
AGSAA

SEQ ID NO: 1104662 - protein, 7 aa, Mycobacterium
AGSAHGS

SEQ ID NO: 1104663 - protein, 7 aa, Mycobacterium
AGSANEY

SEQ ID NO: 1104664 - protein, 8 aa, Mycobacterium
AGSDAFDA

SEQ ID NO: 1104665 - protein, 4 aa, Mycobacterium
AGSG

SEQ ID NO: 1104666 - protein, 6 aa, Mycobacterium
AGSGAL

SEQ ID NO: 1104667 - protein, 9 aa, Mycobacterium
AGSGGGQLT

SEQ ID NO: 1104668 - protein, 9 aa, Mycobacterium
AGSGPGDAL

SEQ ID NO: 1104669 - protein, 22 aa, Mycobacterium
AGSIAGRTDNAALTGLAGAGSY

SEQ ID NO: 1104670 - protein, 6 aa, Mycobacterium
AGSKLA

SEQ ID NO: 1104671 - protein, 6 aa, Mycobacterium
AGSPLG

SEQ ID NO: 1104672 - protein, 26 aa, Mycobacterium
AGSPPNDSAPNDSAPNDSAPTDGEPR

SEQ ID NO: 1104673 - protein, 7 aa, Mycobacterium
AGSPPRP

SEQ ID NO: 1104674 - protein, 4 aa, Mycobacterium
AGSR

SEQ ID NO: 1104675 - protein, 7 aa, Mycobacterium
AGSSGSY

SEQ ID NO: 1104676 - protein, 47 aa, Mycobacterium
AGSSYCRGAGVSGPRKPAIEAESAANTDRRSRGAISRTDSRSTRSAC

SEQ ID NO: 1104677 - protein, 5 aa, Mycobacterium
AGSTA

SEQ ID NO: 1104678 - protein, 21 aa, Mycobacterium
AGSTARSVGRARELEPGHRRD

SEQ ID NO: 1104679 - protein, 5 aa, Mycobacterium
AGTAA

SEQ ID NO: 1104680 - protein, 7 aa, Mycobacterium
AGTAAAA

SEQ ID NO: 1104681 - protein, 6 aa, Mycobacterium
AGTGHA

SEQ ID NO: 1104682 - protein, 5 aa, Mycobacterium
AGTGT

SEQ ID NO: 1104683 - protein, 16 aa, Mycobacterium
AGTIPHTDGRVAGSRN

SEQ ID NO: 1104684 - protein, 9 aa, Mycobacterium
AGTPAPQVD

SEQ ID NO: 1104685 - protein, 6 aa, Mycobacterium
AGTQGL

SEQ ID NO: 1104686 - protein, 12 aa, Mycobacterium
AGTQPPTATQIA

SEQ ID NO: 1104687 - protein, 10 aa, Mycobacterium
AGTQRSGRLP

SEQ ID NO: 1104688 - protein, 7 aa, Mycobacterium
AGTSGTV

SEQ ID NO: 1104689 - protein, 8 aa, Mycobacterium
AGTTHTAE

SEQ ID NO: 1104690 - protein, 5 aa, Mycobacterium
AGTVD

SEQ ID NO: 1104691 - protein, 9 aa, Mycobacterium
AGTVPPEDI

SEQ ID NO: 1104692 - protein, 23 aa, Mycobacterium
AGVAGGGPDGAPQLATTVKSIQL

SEQ ID NO: 1104693 - protein, 6 aa, Mycobacterium
AGVPDI

SEQ ID NO: 1104694 - protein, 13 aa, Mycobacterium
AGVPDSLNGVSTG

SEQ ID NO: 1104695 - protein, 7 aa, Mycobacterium
AGVQPDA

SEQ ID NO: 1104696 - protein, 14 aa, Mycobacterium
AGWGRAENAAAARK

SEQ ID NO: 1104697 - protein, 13 aa, Mycobacterium
AGYANLTAGQPAA

SEQ ID NO: 1104698 - protein, 5 aa, Mycobacterium
AHAER

SEQ ID NO: 1104699 - protein, 14 aa, Mycobacterium
AHAGPSTRSAGTGS

SEQ ID NO: 1104700 - protein, 6 aa, Mycobacterium
AHAGPV

SEQ ID NO: 1104701 - protein, 24 aa, Mycobacterium
AHAGRKHGGPAGGDVTRLDDENVR

SEQ ID NO: 1104702 - protein, 7 aa, Mycobacterium
AHDDAKN

SEQ ID NO: 1104703 - protein, 11 aa, Mycobacterium
AHDPGQGQPVT

SEQ ID NO: 1104704 - protein, 28 aa, Mycobacterium
AHDPQTSYIEPPAVEDGAQTSYIPRPRP

SEQ ID NO: 1104705 - protein, 4 aa, Mycobacterium
AHES

SEQ ID NO: 1104706 - protein, 4 aa, Mycobacterium
AHGI

SEQ ID NO: 1104707 - protein, 4 aa, Mycobacterium
AHGT

SEQ ID NO: 1104708 - protein, 9 aa, Mycobacterium
AHKVSQEDS

SEQ ID NO: 1104709 - protein, 6 aa, Mycobacterium
AHLGGA

SEQ ID NO: 1104710 - protein, 17 aa, Mycobacterium
AHLSEETHKAADAAAKG

SEQ ID NO: 1104711 - protein, 8 aa, Mycobacterium
AHNESEGG

SEQ ID NO: 1104712 - protein, 9 aa, Mycobacterium
AHPAAGNEH

SEQ ID NO: 1104713 - protein, 6 aa, Mycobacterium
AHPAAT

SEQ ID NO: 1104714 - protein, 5 aa, Mycobacterium
AHPEL

SEQ ID NO: 1104715 - protein, 8 aa, Mycobacterium
AHPGTTTA

SEQ ID NO: 1104716 - protein, 9 aa, Mycobacterium
AHPKHASPY

SEQ ID NO: 1104717 - protein, 27 aa, Mycobacterium
AHQPTQGCAPPRRTRRSRNVRRPPRQG

SEQ ID NO: 1104718 - protein, 4 aa, Mycobacterium
AHRA

SEQ ID NO: 1104719 - protein, 12 aa, Mycobacterium
AHRAGGREEAIA

SEQ ID NO: 1104720 - protein, 4 aa, Mycobacterium
AHRQ

SEQ ID NO: 1104721 - protein, 6 aa, Mycobacterium
AHRRPD

SEQ ID NO: 1104722 - protein, 15 aa, Mycobacterium
AHRRQQDVDGPERGD

SEQ ID NO: 1104723 - protein, 14 aa, Mycobacterium
AHSEGGTGPVTVSV

SEQ ID NO: 1104724 - protein, 13 aa, Mycobacterium
AHSFDESDRVGRY

SEQ ID NO: 1104725 - protein, 6 aa, Mycobacterium
AHSPDR

SEQ ID NO: 1104726 - protein, 9 aa, Mycobacterium
AHTDAPAVG

SEQ ID NO: 1104727 - protein, 6 aa, Mycobacterium
AHTGES

SEQ ID NO: 1104728 - protein, 17 aa, Mycobacterium
AHTGHSHSHGDGGGFTR

SEQ ID NO: 1104729 - protein, 19 aa, Mycobacterium
AIADAARPQLADSEIPRRD

SEQ ID NO: 1104730 - protein, 6 aa, Mycobacterium
AIADRT

SEQ ID NO: 1104731 - protein, 4 aa, Mycobacterium
AIAE

SEQ ID NO: 1104732 - protein, 5 aa, Mycobacterium
AIAKG

SEQ ID NO: 1104733 - protein, 6 aa, Mycobacterium
AIDEGA

SEQ ID NO: 1104734 - protein, 8 aa, Mycobacterium
AIDGDGPA

SEQ ID NO: 1104735 - protein, 15 aa, Mycobacterium
AIEESARALGSSPAA

SEQ ID NO: 1104736 - protein, 5 aa, Mycobacterium
AIGPA

SEQ ID NO: 1104737 - protein, 7 aa, Mycobacterium
AIGPQAA

SEQ ID NO: 1104738 - protein, 5 aa, Mycobacterium
AIGPT

SEQ ID NO: 1104739 - protein, 10 aa, Mycobacterium
AIKGTPLEGS

SEQ ID NO: 1104740 - protein, 11 aa, Mycobacterium
AINAQSNPDEV

SEQ ID NO: 1104741 - protein, 15 aa, Mycobacterium
AIPATTAAGAPFPER

SEQ ID NO: 1104742 - protein, 6 aa, Mycobacterium
AIPEKG

SEQ ID NO: 1104743 - protein, 4 aa, Mycobacterium
AIPG

SEQ ID NO: 1104744 - protein, 17 aa, Mycobacterium
AIPGAGSPSAAPLPEPL

SEQ ID NO: 1104745 - protein, 14 aa, Mycobacterium
AIPPDETGPDQPME

SEQ ID NO: 1104746 - protein, 7 aa, Mycobacterium
AIPPGNL

SEQ ID NO: 1104747 - protein, 6 aa, Mycobacterium
AIRSPG

SEQ ID NO: 1104748 - protein, 6 aa, Mycobacterium
AISDRS

SEQ ID NO: 1104749 - protein, 11 aa, Mycobacterium
AITGNPGDQAC

SEQ ID NO: 1104750 - protein, 12 aa, Mycobacterium
AITPKGSGESTV

SEQ ID NO: 1104751 - protein, 5 aa, Mycobacterium
AITPL

SEQ ID NO: 1104752 - protein, 4 aa, Mycobacterium
AITT

SEQ ID NO: 1104753 - protein, 9 aa, Mycobacterium
AIVGTDPSG

SEQ ID NO: 1104754 - protein, 8 aa, Mycobacterium
AIYGQSTG

SEQ ID NO: 1104755 - protein, 8 aa, Mycobacterium
AKAEESAV

SEQ ID NO: 1104756 - protein, 9 aa, Mycobacterium
AKAEESSAS

SEQ ID NO: 1104757 - protein, 11 aa, Mycobacterium
AKAGLDGFSSG

SEQ ID NO: 1104758 - protein, 8 aa, Mycobacterium
AKARARAA

SEQ ID NO: 1104759 - protein, 15 aa, Mycobacterium
AKARGGDRVVVTAGV

SEQ ID NO: 1104760 - protein, 11 aa, Mycobacterium
AKDASGAKNAS

SEQ ID NO: 1104761 - protein, 9 aa, Mycobacterium
AKDATGAKW

SEQ ID NO: 1104762 - protein, 10 aa, Mycobacterium
AKDRPSRTAV

SEQ ID NO: 1104763 - protein, 6 aa, Mycobacterium
AKGECE

SEQ ID NO: 1104764 - protein, 13 aa, Mycobacterium
AKGGPGGKPGCGG

SEQ ID NO: 1104765 - protein, 23 aa, Mycobacterium
AKGGPGGKPGCGSLPDASKSYPV

SEQ ID NO: 1104766 - protein, 15 aa, Mycobacterium
AKGGPGGKPSCGSLP

SEQ ID NO: 1104767 - protein, 21 aa, Mycobacterium
AKGGPGGRPGCGSLPDATKNF

SEQ ID NO: 1104768 - protein, 12 aa, Mycobacterium
AKGGTEPETTTQ

SEQ ID NO: 1104769 - protein, 7 aa, Mycobacterium
AKGKGGV

SEQ ID NO: 1104770 - protein, 4 aa, Mycobacterium
AKGP

SEQ ID NO: 1104771 - protein, 7 aa, Mycobacterium
AKGQSHT

SEQ ID NO: 1104772 - protein, 9 aa, Mycobacterium
AKGRTGSDL

SEQ ID NO: 1104773 - protein, 15 aa, Mycobacterium
AKIGDMDETATPDPA

SEQ ID NO: 1104774 - protein, 4 aa, Mycobacterium
AKIP

SEQ ID NO: 1104775 - protein, 17 aa, Mycobacterium
AKIPGEAPVPVEGQAGQ

SEQ ID NO: 1104776 - protein, 9 aa, Mycobacterium
AKITGPADL

SEQ ID NO: 1104777 - protein, 6 aa, Mycobacterium
AKKSGL

SEQ ID NO: 1104778 - protein, 5 aa, Mycobacterium
AKLAD

SEQ ID NO: 1104779 - protein, 7 aa, Mycobacterium
AKLTPDY

SEQ ID NO: 1104780 - protein, 49 aa, Mycobacterium
AKNAPRPAGDDTAGPPAGADLGRTTDPTPKGRYTIPTPYGGPTLPIEPP

SEQ ID NO: 1104781 - protein, 13 aa, Mycobacterium
AKNPADRYPTAGD

SEQ ID NO: 1104782 - protein, 7 aa, Mycobacterium
AKNTKIN

SEQ ID NO: 1104783 - protein, 8 aa, Mycobacterium
AKPDYPNG

SEQ ID NO: 1104784 - protein, 8 aa, Mycobacterium
AKPDYPNS

SEQ ID NO: 1104785 - protein, 8 aa, Mycobacterium
AKPDYPSG

SEQ ID NO: 1104786 - protein, 10 aa, Mycobacterium
AKPEGAQDAS

SEQ ID NO: 1104787 - protein, 7 aa, Mycobacterium
AKPLTDS

SEQ ID NO: 1104788 - protein, 5 aa, Mycobacterium
AKPQS

SEQ ID NO: 1104789 - protein, 4 aa, Mycobacterium
AKPV

SEQ ID NO: 1104790 - protein, 12 aa, Mycobacterium
AKPVRNGSAGKD

SEQ ID NO: 1104791 - protein, 5 aa, Mycobacterium
AKQNS

SEQ ID NO: 1104792 - protein, 41 aa, Mycobacterium
AKQPHDRYPTAGELARAASAAAEGAPAAETVAPVTPPSTRQ

SEQ ID NO: 1104793 - protein, 9 aa, Mycobacterium
AKQPPAGEL

SEQ ID NO: 1104794 - protein, 16 aa, Mycobacterium
AKRPEDRYASAGEMAR

SEQ ID NO: 1104795 - protein, 8 aa, Mycobacterium
AKRRAGAA

SEQ ID NO: 1104796 - protein, 13 aa, Mycobacterium
AKRTEATPGAPLA

SEQ ID NO: 1104797 - protein, 5 aa, Mycobacterium
AKSAE

SEQ ID NO: 1104798 - protein, 10 aa, Mycobacterium
AKSGGAAHTM

SEQ ID NO: 1104799 - protein, 9 aa, Mycobacterium
AKSGRQTTY

SEQ ID NO: 1104800 - protein, 18 aa, Mycobacterium
AKSNLEAARSSAQQAKDA

SEQ ID NO: 1104801 - protein, 8 aa, Mycobacterium
AKSPADRF

SEQ ID NO: 1104802 - protein, 9 aa, Mycobacterium
AKSPDAARK

SEQ ID NO: 1104803 - protein, 8 aa, Mycobacterium
AKSPTSQV

SEQ ID NO: 1104804 - protein, 7 aa, Mycobacterium
AKTGKTT

SEQ ID NO: 1104805 - protein, 7 aa, Mycobacterium
AKTLKRA

SEQ ID NO: 1104806 - protein, 8 aa, Mycobacterium
AKTLPEGY

SEQ ID NO: 1104807 - protein, 6 aa, Mycobacterium
AKVAAG

SEQ ID NO: 1104808 - protein, 6 aa, Mycobacterium
AKVDEN

SEQ ID NO: 1104809 - protein, 10 aa, Mycobacterium
AKWSPPGGRV

SEQ ID NO: 1104810 - protein, 7 aa, Mycobacterium
ALAAAGS

SEQ ID NO: 1104811 - protein, 12 aa, Mycobacterium
ALAATPTATPAP

SEQ ID NO: 1104812 - protein, 5 aa, Mycobacterium
ALAGG

SEQ ID NO: 1104813 - protein, 6 aa, Mycobacterium
ALAGGA

SEQ ID NO: 1104814 - protein, 25 aa, Mycobacterium
ALAGGRPSAAKTGTNQLGDTDANRD

SEQ ID NO: 1104815 - protein, 15 aa, Mycobacterium
ALAGRASAAQPPNHL

SEQ ID NO: 1104816 - protein, 8 aa, Mycobacterium
ALAPPSAS

SEQ ID NO: 1104817 - protein, 9 aa, Mycobacterium
ALAPSGSDL

SEQ ID NO: 1104818 - protein, 12 aa, Mycobacterium
ALASAAAPAFEA

SEQ ID NO: 1104819 - protein, 6 aa, Mycobacterium
ALASAS

SEQ ID NO: 1104820 - protein, 50 aa, Mycobacterium
ALDGGARGERKNFGPPKQPPPSQPPPPPGRPPGGGGPPGGGGPAGPRRSL

SEQ ID NO: 1104821 - protein, 31 aa, Mycobacterium
ALDPATRTPNGRNTERGRNADNDQQRPTAGT

SEQ ID NO: 1104822 - protein, 9 aa, Mycobacterium
ALDPEGDEI

SEQ ID NO: 1104823 - protein, 12 aa, Mycobacterium
ALEGGEAPNEPG

SEQ ID NO: 1104824 - protein, 8 aa, Mycobacterium
ALEPGGTI

SEQ ID NO: 1104825 - protein, 9 aa, Mycobacterium
ALGAEKAGD

SEQ ID NO: 1104826 - protein, 9 aa, Mycobacterium
ALGDPADLA

SEQ ID NO: 1104827 - protein, 10 aa, Mycobacterium
ALGDPADLTT

SEQ ID NO: 1104828 - protein, 9 aa, Mycobacterium
ALGGNGYSL

SEQ ID NO: 1104829 - protein, 7 aa, Mycobacterium
ALGSAPI

SEQ ID NO: 1104830 - protein, 10 aa, Mycobacterium
ALGSDTTAHI

SEQ ID NO: 1104831 - protein, 11 aa, Mycobacterium
ALNDPTAREQL

SEQ ID NO: 1104832 - protein, 8 aa, Mycobacterium
ALNGSGYE

SEQ ID NO: 1104833 - protein, 21 aa, Mycobacterium
ALPATPPAALPAGSPMDNYPI

SEQ ID NO: 1104834 - protein, 22 aa, Mycobacterium
ALPGQTVAQSGEDVQPSPGTTL

SEQ ID NO: 1104835 - protein, 4 aa, Mycobacterium
ALPK

SEQ ID NO: 1104836 - protein, 11 aa, Mycobacterium
ALPPASPAGGQ

SEQ ID NO: 1104837 - protein, 9 aa, Mycobacterium
ALPPDQAAT

SEQ ID NO: 1104838 - protein, 17 aa, Mycobacterium
ALPPFPGDDYDAEDYDG

SEQ ID NO: 1104839 - protein, 7 aa, Mycobacterium
ALPPGTG

SEQ ID NO: 1104840 - protein, 10 aa, Mycobacterium
ALPQSRRTAE

SEQ ID NO: 1104841 - protein, 18 aa, Mycobacterium
ALRRPAESVPADQPGRGL

SEQ ID NO: 1104842 - protein, 10 aa, Mycobacterium
ALRSGPGLRP

SEQ ID NO: 1104843 - protein, 5 aa, Mycobacterium
ALSDN

SEQ ID NO: 1104844 - protein, 9 aa, Mycobacterium
ALSERQAEL

SEQ ID NO: 1104845 - protein, 11 aa, Mycobacterium
ALSGSASRFGE

SEQ ID NO: 1104846 - protein, 7 aa, Mycobacterium
ALSGYGA

SEQ ID NO: 1104847 - protein, 16 aa, Mycobacterium
ALSPPTTVSAATPEPD

SEQ ID NO: 1104848 - protein, 12 aa, Mycobacterium
ALSRGRADHGSG

SEQ ID NO: 1104849 - protein, 9 aa, Mycobacterium
ALTPGGPAF

SEQ ID NO: 1104850 - protein, 9 aa, Mycobacterium
ALTTDGYRP

SEQ ID NO: 1104851 - protein, 22 aa, Mycobacterium
ALTTERDESGAARADAGAKRTA

SEQ ID NO: 1104852 - protein, 4 aa, Mycobacterium
AMGD

SEQ ID NO: 1104853 - protein, 5 aa, Mycobacterium
AMRPE

SEQ ID NO: 1104854 - protein, 7 aa, Mycobacterium
AMRSPRN

SEQ ID NO: 1104855 - protein, 9 aa, Mycobacterium
AMSADSPVT

SEQ ID NO: 1104856 - protein, 13 aa, Mycobacterium
ANAATPNTSLAGT

SEQ ID NO: 1104857 - protein, 12 aa, Mycobacterium
ANAETRAELTAS

SEQ ID NO: 1104858 - protein, 6 aa, Mycobacterium
ANAVSE

SEQ ID NO: 1104859 - protein, 12 aa, Mycobacterium
ANDAEPRKGAMS

SEQ ID NO: 1104860 - protein, 11 aa, Mycobacterium
ANDPSGRIDAR

SEQ ID NO: 1104861 - protein, 5 aa, Mycobacterium
ANDTY

SEQ ID NO: 1104862 - protein, 7 aa, Mycobacterium
ANEAARS

SEQ ID NO: 1104863 - protein, 21 aa, Mycobacterium
ANEPEATTSSALRAALSMLGK

SEQ ID NO: 1104864 - protein, 15 aa, Mycobacterium
ANGEVVSPGPAPLDQ

SEQ ID NO: 1104865 - protein, 17 aa, Mycobacterium
ANGGGPVVPRDENGHVA

SEQ ID NO: 1104866 - protein, 15 aa, Mycobacterium
ANGNVVSPGPAPLDQ

SEQ ID NO: 1104867 - protein, 6 aa, Mycobacterium
ANGRRM

SEQ ID NO: 1104868 - protein, 4 aa, Mycobacterium
ANKR

SEQ ID NO: 1104869 - protein, 4 aa, Mycobacterium
ANLP

SEQ ID NO: 1104870 - protein, 8 aa, Mycobacterium
ANMPDSGV

SEQ ID NO: 1104871 - protein, 7 aa, Mycobacterium
ANNGDST

SEQ ID NO: 1104872 - protein, 15 aa, Mycobacterium
ANPIAAARFGRLNEL

SEQ ID NO: 1104873 - protein, 6 aa, Mycobacterium
ANPLAQ

SEQ ID NO: 1104874 - protein, 9 aa, Mycobacterium
ANPPDGLDP

SEQ ID NO: 1104875 - protein, 16 aa, Mycobacterium
ANPPGVGQEETAGQRT

SEQ ID NO: 1104876 - protein, 6 aa, Mycobacterium
ANPRRI

SEQ ID NO: 1104877 - protein, 5 aa, Mycobacterium
ANPSC

SEQ ID NO: 1104878 - protein, 8 aa, Mycobacterium
ANPSTPRG

SEQ ID NO: 1104879 - protein, 9 aa, Mycobacterium
ANPWSDQSV

SEQ ID NO: 1104880 - protein, 12 aa, Mycobacterium
ANREVGAGKEAY

SEQ ID NO: 1104881 - protein, 9 aa, Mycobacterium
ANRFGDGRP

SEQ ID NO: 1104882 - protein, 9 aa, Mycobacterium
ANRPQRRQD

SEQ ID NO: 1104883 - protein, 40 aa, Mycobacterium
ANRSGTELPGSAFDPDATRHAAAPTGPRHAKTAAAPRSRR

SEQ ID NO: 1104884 - protein, 6 aa, Mycobacterium
ANSATR

SEQ ID NO: 1104885 - protein, 11 aa, Mycobacterium
ANSPAAAAGIQ

SEQ ID NO: 1104886 - protein, 4 aa, Mycobacterium
ANSS

SEQ ID NO: 1104887 - protein, 13 aa, Mycobacterium
ANTALAGSALEAG

SEQ ID NO: 1104888 - protein, 11 aa, Mycobacterium
ANTGLQSIPAD

SEQ ID NO: 1104889 - protein, 7 aa, Mycobacterium
ANTPTVD

SEQ ID NO: 1104890 - protein, 8 aa, Mycobacterium
ANVETKLR

SEQ ID NO: 1104891 - protein, 24 aa, Mycobacterium
APAAPPAGPAPAAPSGPLLPAEAG

SEQ ID NO: 1104892 - protein, 25 aa, Mycobacterium
APAARDITPAPTTPADTGAWGPDRR

SEQ ID NO: 1104893 - protein, 5 aa, Mycobacterium
APAAY

SEQ ID NO: 1104894 - protein, 4 aa, Mycobacterium
APAD

SEQ ID NO: 1104895 - protein, 7 aa, Mycobacterium
APADEPR

SEQ ID NO: 1104896 - protein, 4 aa, Mycobacterium
APAG

SEQ ID NO: 1104897 - protein, 8 aa, Mycobacterium
APAGAQVD

SEQ ID NO: 1104898 - protein, 6 aa, Mycobacterium
APAGDG

SEQ ID NO: 1104899 - protein, 7 aa, Mycobacterium
APAGLKK

SEQ ID NO: 1104900 - protein, 17 aa, Mycobacterium
APAGPPDHTSPRDPALT

SEQ ID NO: 1104901 - protein, 12 aa, Mycobacterium
APAGQKNRRDLA

SEQ ID NO: 1104902 - protein, 11 aa, Mycobacterium
APAGQPTEMGS

SEQ ID NO: 1104903 - protein, 5 aa, Mycobacterium
APAGV

SEQ ID NO: 1104904 - protein, 13 aa, Mycobacterium
APAISPKKSWEGL

SEQ ID NO: 1104905 - protein, 4 aa, Mycobacterium
APAL

SEQ ID NO: 1104906 - protein, 5 aa, Mycobacterium
APALE

SEQ ID NO: 1104907 - protein, 9 aa, Mycobacterium
APANSRSRR

SEQ ID NO: 1104908 - protein, 4 aa, Mycobacterium
APAP

SEQ ID NO: 1104909 - protein, 11 aa, Mycobacterium
APAPAPAAPRT

SEQ ID NO: 1104910 - protein, 25 aa, Mycobacterium
APAPAVPAPAPAAPPPAPAPAAPPV

SEQ ID NO: 1104911 - protein, 9 aa, Mycobacterium
APAPDDRHT

SEQ ID NO: 1104912 - protein, 13 aa, Mycobacterium
APAPDSMTDTGRH

SEQ ID NO: 1104913 - protein, 11 aa, Mycobacterium
APAPGTRSPAV

SEQ ID NO: 1104914 - protein, 18 aa, Mycobacterium
APAPPAPPAALAPPAPPA

SEQ ID NO: 1104915 - protein, 5 aa, Mycobacterium
APARD

SEQ ID NO: 1104916 - protein, 18 aa, Mycobacterium
APARDKPIPVAPRPQAPA

SEQ ID NO: 1104917 - protein, 45 aa, Mycobacterium
APARPTGPESAARPTGPESAARPAGPESAARPPVSDYAGDPTREA

SEQ ID NO: 1104918 - protein, 7 aa, Mycobacterium
APASDAA

SEQ ID NO: 1104919 - protein, 9 aa, Mycobacterium
APATAERLR

SEQ ID NO: 1104920 - protein, 18 aa, Mycobacterium
APATGPTAAIDADTSTSW

SEQ ID NO: 1104921 - protein, 34 aa, Mycobacterium
APATPGKALAKAPNQERSARARRTRQAAPQNGLR

SEQ ID NO: 1104922 - protein, 9 aa, Mycobacterium
APATPPRFR

SEQ ID NO: 1104923 - protein, 10 aa, Mycobacterium
APATSGGRAR

SEQ ID NO: 1104924 - protein, 52 aa, Mycobacterium
APATTETAASSEVAEPTAGPTTSVSSPDPSATSEPEASGASTGADTADADTT

SEQ ID NO: 1104925 - protein, 7 aa, Mycobacterium
APAVPAP

SEQ ID NO: 1104926 - protein, 20 aa, Mycobacterium
APCAAGSTSAQSLTDTATDS

SEQ ID NO: 1104927 - protein, 8 aa, Mycobacterium
APDDDPYQ

SEQ ID NO: 1104928 - protein, 6 aa, Mycobacterium
APDDES

SEQ ID NO: 1104929 - protein, 16 aa, Mycobacterium
APDEGTYKVARLDQVT

SEQ ID NO: 1104930 - protein, 4 aa, Mycobacterium
APDG

SEQ ID NO: 1104931 - protein, 14 aa, Mycobacterium
APDGTRTEEPRPEG

SEQ ID NO: 1104932 - protein, 8 aa, Mycobacterium
APDHGDPM

SEQ ID NO: 1104933 - protein, 27 aa, Mycobacterium
APDKGLESGAPGSCKRRKPLSSNRTKA

SEQ ID NO: 1104934 - protein, 9 aa, Mycobacterium
APDKSREIG

SEQ ID NO: 1104935 - protein, 19 aa, Mycobacterium
APDLSEARSLDDTSAANVP

SEQ ID NO: 1104936 - protein, 4 aa, Mycobacterium
APEH

SEQ ID NO: 1104937 - protein, 5 aa, Mycobacterium
APENA

SEQ ID NO: 1104938 - protein, 15 aa, Mycobacterium
APEPEAPAAPSVPDL

SEQ ID NO: 1104939 - protein, 11 aa, Mycobacterium
APEPEAPPPVV

SEQ ID NO: 1104940 - protein, 8 aa, Mycobacterium
APEPGLET

SEQ ID NO: 1104941 - protein, 5 aa, Mycobacterium
APEPP

SEQ ID NO: 1104942 - protein, 7 aa, Mycobacterium
APEQRQE

SEQ ID NO: 1104943 - protein, 5 aa, Mycobacterium
APEQV

SEQ ID NO: 1104944 - protein, 4 aa, Mycobacterium
APER

SEQ ID NO: 1104945 - protein, 6 aa, Mycobacterium
APERRA

SEQ ID NO: 1104946 - protein, 5 aa, Mycobacterium
APERV

SEQ ID NO: 1104947 - protein, 5 aa, Mycobacterium
APESR

SEQ ID NO: 1104948 - protein, 5 aa, Mycobacterium
APETV

SEQ ID NO: 1104949 - protein, 13 aa, Mycobacterium
APEVGEPAGKTGA

SEQ ID NO: 1104950 - protein, 6 aa, Mycobacterium
APGAAG

SEQ ID NO: 1104951 - protein, 11 aa, Mycobacterium
APGADKLAPAE

SEQ ID NO: 1104952 - protein, 6 aa, Mycobacterium
APGAEL

SEQ ID NO: 1104953 - protein, 11 aa, Mycobacterium
APGAQYGGSLT

SEQ ID NO: 1104954 - protein, 5 aa, Mycobacterium
APGAT

SEQ ID NO: 1104955 - protein, 11 aa, Mycobacterium
APGDAGRDIDV

SEQ ID NO: 1104956 - protein, 6 aa, Mycobacterium
APGDKE

SEQ ID NO: 1104957 - protein, 7 aa, Mycobacterium
APGDRVP

SEQ ID NO: 1104958 - protein, 10 aa, Mycobacterium
APGEAPPPTV

SEQ ID NO: 1104959 - protein, 13 aa, Mycobacterium
APGEAPSVTAGAQ

SEQ ID NO: 1104960 - protein, 37 aa, Mycobacterium
APGEDITSVSNDEAGGLANGLPGDRDRIDPVRGTGYA

SEQ ID NO: 1104961 - protein, 5 aa, Mycobacterium
APGES

SEQ ID NO: 1104962 - protein, 14 aa, Mycobacterium
APGETPHLGSAEAG

SEQ ID NO: 1104963 - protein, 14 aa, Mycobacterium
APGGFARRRGTASL

SEQ ID NO: 1104964 - protein, 10 aa, Mycobacterium
APGMPGPSVD

SEQ ID NO: 1104965 - protein, 7 aa, Mycobacterium
APGPVDT

SEQ ID NO: 1104966 - protein, 5 aa, Mycobacterium
APGQR

SEQ ID NO: 1104967 - protein, 14 aa, Mycobacterium
APGSTKLQRPGSRI

SEQ ID NO: 1104968 - protein, 10 aa, Mycobacterium
APGTPGREEA

SEQ ID NO: 1104969 - protein, 11 aa, Mycobacterium
APGTPPVPADV

SEQ ID NO: 1104970 - protein, 15 aa, Mycobacterium
APGVTPPDPAKAQED

SEQ ID NO: 1104971 - protein, 14 aa, Mycobacterium
APGVTPPQIAPDAD

SEQ ID NO: 1104972 - protein, 12 aa, Mycobacterium
APGYSRTNPVSN

SEQ ID NO: 1104973 - protein, 8 aa, Mycobacterium
APHAGRGA

SEQ ID NO: 1104974 - protein, 31 aa, Mycobacterium
APHGVSPMAPPAPPGVPGAPEPVAPGAPPSG

SEQ ID NO: 1104975 - protein, 11 aa, Mycobacterium
APHRRRPITPA

SEQ ID NO: 1104976 - protein, 18 aa, Mycobacterium
APIDPAPSHTRAAPVGAP

SEQ ID NO: 1104977 - protein, 16 aa, Mycobacterium
APIRGPPRNARALRTG

SEQ ID NO: 1104978 - protein, 4 aa, Mycobacterium
APIT

SEQ ID NO: 1104979 - protein, 5 aa, Mycobacterium
APKPL

SEQ ID NO: 1104980 - protein, 11 aa, Mycobacterium
APKPPRGKEVT

SEQ ID NO: 1104981 - protein, 7 aa, Mycobacterium
APKRPSR

SEQ ID NO: 1104982 - protein, 5 aa, Mycobacterium
APKTG

SEQ ID NO: 1104983 - protein, 7 aa, Mycobacterium
APKTTGL

SEQ ID NO: 1104984 - protein, 6 aa, Mycobacterium
APLDGG

SEQ ID NO: 1104985 - protein, 5 aa, Mycobacterium
APLGL

SEQ ID NO: 1104986 - protein, 4 aa, Mycobacterium
APLP

SEQ ID NO: 1104987 - protein, 6 aa, Mycobacterium
APLPGL

SEQ ID NO: 1104988 - protein, 6 aa, Mycobacterium
APLSRD

SEQ ID NO: 1104989 - protein, 5 aa, Mycobacterium
APLSS

SEQ ID NO: 1104990 - protein, 16 aa, Mycobacterium
APMVPGAPPPAQPPIL

SEQ ID NO: 1104991 - protein, 5 aa, Mycobacterium
APNAG

SEQ ID NO: 1104992 - protein, 8 aa, Mycobacterium
APNAGGNG

SEQ ID NO: 1104993 - protein, 5 aa, Mycobacterium
APNAP

SEQ ID NO: 1104994 - protein, 5 aa, Mycobacterium
APNEF

SEQ ID NO: 1104995 - protein, 6 aa, Mycobacterium
APNHHG

SEQ ID NO: 1104996 - protein, 4 aa, Mycobacterium
APNL

SEQ ID NO: 1104997 - protein, 6 aa, Mycobacterium
APNPAA

SEQ ID NO: 1104998 - protein, 6 aa, Mycobacterium
APNRPN

SEQ ID NO: 1104999 - protein, 5 aa, Mycobacterium
APPAA

SEQ ID NO: 1105000 - protein, 7 aa, Mycobacterium
APPAAGQ

SEQ ID NO: 1105001 - protein, 5 aa, Mycobacterium
APPAG

SEQ ID NO: 1105002 - protein, 10 aa, Mycobacterium
APPAPPAETI

SEQ ID NO: 1105003 - protein, 10 aa, Mycobacterium
APPARAGPPP

SEQ ID NO: 1105004 - protein, 8 aa, Mycobacterium
APPARRFS

SEQ ID NO: 1105005 - protein, 10 aa, Mycobacterium
APPDAVSATA

SEQ ID NO: 1105006 - protein, 5 aa, Mycobacterium
APPEI

SEQ ID NO: 1105007 - protein, 16 aa, Mycobacterium
APPKAPATNGQGEPAV

SEQ ID NO: 1105008 - protein, 15 aa, Mycobacterium
APPPALAGLTGGADP

SEQ ID NO: 1105009 - protein, 7 aa, Mycobacterium
APPPAVE

SEQ ID NO: 1105010 - protein, 8 aa, Mycobacterium
APPPGLGP

SEQ ID NO: 1105011 - protein, 8 aa, Mycobacterium
APPPPGQG

SEQ ID NO: 1105012 - protein, 21 aa, Mycobacterium
APPPPPAPAQPAKPTARRRTG

SEQ ID NO: 1105013 - protein, 8 aa, Mycobacterium
APPPRGTG

SEQ ID NO: 1105014 - protein, 17 aa, Mycobacterium
APPPYPASVAPAKNRKK

SEQ ID NO: 1105015 - protein, 6 aa, Mycobacterium
APPSRR

SEQ ID NO: 1105016 - protein, 36 aa, Mycobacterium
APPVPGAPPAPGAPPPAGAPGAPVPPGAPPPGPLPP

SEQ ID NO: 1105017 - protein, 11 aa, Mycobacterium
APPVRREGADY

SEQ ID NO: 1105018 - protein, 10 aa, Mycobacterium
APPVTDGRPF

SEQ ID NO: 1105019 - protein, 11 aa, Mycobacterium
APQAKPYPQPH

SEQ ID NO: 1105020 - protein, 11 aa, Mycobacterium
APQDPTARQHA

SEQ ID NO: 1105021 - protein, 5 aa, Mycobacterium
APQHL

SEQ ID NO: 1105022 - protein, 11 aa, Mycobacterium
APQPVPTAEPV

SEQ ID NO: 1105023 - protein, 10 aa, Mycobacterium
APQRDAEPDY

SEQ ID NO: 1105024 - protein, 10 aa, Mycobacterium
APQRPPGTRS

SEQ ID NO: 1105025 - protein, 7 aa, Mycobacterium
APQSTLA

SEQ ID NO: 1105026 - protein, 8 aa, Mycobacterium
APQSWRSR

SEQ ID NO: 1105027 - protein, 12 aa, Mycobacterium
APRDGVTARQAL

SEQ ID NO: 1105028 - protein, 11 aa, Mycobacterium
APREAVDSGAC

SEQ ID NO: 1105029 - protein, 10 aa, Mycobacterium
APRGSGVGYP

SEQ ID NO: 1105030 - protein, 8 aa, Mycobacterium
APRGYARA

SEQ ID NO: 1105031 - protein, 11 aa, Mycobacterium
APRLSPNGIPP

SEQ ID NO: 1105032 - protein, 17 aa, Mycobacterium
APRPGGHLDPTSTSSDG

SEQ ID NO: 1105033 - protein, 12 aa, Mycobacterium
APRPQVERGTPV

SEQ ID NO: 1105034 - protein, 25 aa, Mycobacterium
APRPVERPPVDPAAQRAFGRPSGVR

SEQ ID NO: 1105035 - protein, 12 aa, Mycobacterium
APRSDASYDDMT

SEQ ID NO: 1105036 - protein, 10 aa, Mycobacterium
APRTPQPAAQ

SEQ ID NO: 1105037 - protein, 33 aa, Mycobacterium
APRTTTRPARRGAAAASSDVDVDADTAPAKPGL

SEQ ID NO: 1105038 - protein, 8 aa, Mycobacterium
APSARDSD

SEQ ID NO: 1105039 - protein, 12 aa, Mycobacterium
APSDDSAGGAEQ

SEQ ID NO: 1105040 - protein, 8 aa, Mycobacterium
APSDDTRE

SEQ ID NO: 1105041 - protein, 9 aa, Mycobacterium
APSDGAAHP

SEQ ID NO: 1105042 - protein, 40 aa, Mycobacterium
APSDPDNSSAERTLDDPESPEPLAAEGDGKTGKKKRGALR

SEQ ID NO: 1105043 - protein, 9 aa, Mycobacterium
APSGQTSDE

SEQ ID NO: 1105044 - protein, 6 aa, Mycobacterium
APSPLL

SEQ ID NO: 1105045 - protein, 8 aa, Mycobacterium
APSREYGP

SEQ ID NO: 1105046 - protein, 20 aa, Mycobacterium
APSVPPVDPTLSGATQIRWL

SEQ ID NO: 1105047 - protein, 6 aa, Mycobacterium
APSYRG

SEQ ID NO: 1105048 - protein, 5 aa, Mycobacterium
APTAT

SEQ ID NO: 1105049 - protein, 6 aa, Mycobacterium
APTEAE

SEQ ID NO: 1105050 - protein, 21 aa, Mycobacterium
APTGGSDVGSRAGHSSPTVSA

SEQ ID NO: 1105051 - protein, 20 aa, Mycobacterium
APTGLDGRGAFQDTSGVNGA

SEQ ID NO: 1105052 - protein, 23 aa, Mycobacterium
APTGTFADGRRVGPPAGGAGVQG

SEQ ID NO: 1105053 - protein, 5 aa, Mycobacterium
APTIS

SEQ ID NO: 1105054 - protein, 12 aa, Mycobacterium
APTSPGDPSGTV

SEQ ID NO: 1105055 - protein, 14 aa, Mycobacterium
APTVTHGRRRGRTA

SEQ ID NO: 1105056 - protein, 23 aa, Mycobacterium
APVAAAAAPVEQKPAKKPMTTGR

SEQ ID NO: 1105057 - protein, 5 aa, Mycobacterium
APVGP

SEQ ID NO: 1105058 - protein, 19 aa, Mycobacterium
APVGPVPPRPSESVSGRTA

SEQ ID NO: 1105059 - protein, 7 aa, Mycobacterium
APVNQDA

SEQ ID NO: 1105060 - protein, 10 aa, Mycobacterium
APVPAEGEGA

SEQ ID NO: 1105061 - protein, 4 aa, Mycobacterium
APVR

SEQ ID NO: 1105062 - protein, 18 aa, Mycobacterium
APVTEETPAKTTTARPDA

SEQ ID NO: 1105063 - protein, 4 aa, Mycobacterium
APYD

SEQ ID NO: 1105064 - protein, 4 aa, Mycobacterium
APYG

SEQ ID NO: 1105065 - protein, 13 aa, Mycobacterium
APYNNSVPQLGGV

SEQ ID NO: 1105066 - protein, 11 aa, Mycobacterium
APYRPGGRHRR

SEQ ID NO: 1105067 - protein, 4 aa, Mycobacterium
AQAA

SEQ ID NO: 1105068 - protein, 75 aa, Mycobacterium
AQAADARQVHGGPQPGFEPVPTGGSGASSGGEGGSASGAQQPPAGGIDPGGAAHPAPAGGGEPALSAPPAAGGGI

SEQ ID NO: 1105069 - protein, 7 aa, Mycobacterium
AQAANGA

SEQ ID NO: 1105070 - protein, 9 aa, Mycobacterium
AQAEESAAS

SEQ ID NO: 1105071 - protein, 8 aa, Mycobacterium
AQANGPAV

SEQ ID NO: 1105072 - protein, 20 aa, Mycobacterium
AQAPKSKTPTPPNPSPERST

SEQ ID NO: 1105073 - protein, 5 aa, Mycobacterium
AQARR

SEQ ID NO: 1105074 - protein, 39 aa, Mycobacterium
AQASRAAAEQAQKNGGNGSQASNGVPGGPTQPDYGAPAG

SEQ ID NO: 1105075 - protein, 10 aa, Mycobacterium
AQDGKTAAER

SEQ ID NO: 1105076 - protein, 13 aa, Mycobacterium
AQDGVGPEPTEGG

SEQ ID NO: 1105077 - protein, 8 aa, Mycobacterium
AQDPTTAT

SEQ ID NO: 1105078 - protein, 7 aa, Mycobacterium
AQDPVEG

SEQ ID NO: 1105079 - protein, 7 aa, Mycobacterium
AQDQAGH

SEQ ID NO: 1105080 - protein, 12 aa, Mycobacterium
AQDRSRPQPTQL

SEQ ID NO: 1105081 - protein, 9 aa, Mycobacterium
AQEAAPATA

SEQ ID NO: 1105082 - protein, 6 aa, Mycobacterium
AQEDVR

SEQ ID NO: 1105083 - protein, 7 aa, Mycobacterium
AQEEFPG

SEQ ID NO: 1105084 - protein, 10 aa, Mycobacterium
AQEGAGPTVG

SEQ ID NO: 1105085 - protein, 5 aa, Mycobacterium
AQEQR

SEQ ID NO: 1105086 - protein, 8 aa, Mycobacterium
AQERFDSK

SEQ ID NO: 1105087 - protein, 6 aa, Mycobacterium
AQGAVT

SEQ ID NO: 1105088 - protein, 5 aa, Mycobacterium
AQGGW

SEQ ID NO: 1105089 - protein, 7 aa, Mycobacterium
AQGMSTA

SEQ ID NO: 1105090 - protein, 6 aa, Mycobacterium
AQGNPW

SEQ ID NO: 1105091 - protein, 16 aa, Mycobacterium
AQGPNLEELHNWWLEF

SEQ ID NO: 1105092 - protein, 15 aa, Mycobacterium
AQGTEFRAPEGDYET

SEQ ID NO: 1105093 - protein, 6 aa, Mycobacterium
AQHSPA

SEQ ID NO: 1105094 - protein, 7 aa, Mycobacterium
AQIERKD

SEQ ID NO: 1105095 - protein, 5 aa, Mycobacterium
AQIPA

SEQ ID NO: 1105096 - protein, 7 aa, Mycobacterium
AQKHSAS

SEQ ID NO: 1105097 - protein, 8 aa, Mycobacterium
AQLGGNNP

SEQ ID NO: 1105098 - protein, 13 aa, Mycobacterium
AQLGPQQGSMQGP

SEQ ID NO: 1105099 - protein, 5 aa, Mycobacterium
AQLPQ

SEQ ID NO: 1105100 - protein, 10 aa, Mycobacterium
AQLTSRDGEW

SEQ ID NO: 1105101 - protein, 15 aa, Mycobacterium
AQNATAAGLDPPARQ

SEQ ID NO: 1105102 - protein, 9 aa, Mycobacterium
AQNGDGPLH

SEQ ID NO: 1105103 - protein, 12 aa, Mycobacterium
AQNNNSIITNCT

SEQ ID NO: 1105104 - protein, 8 aa, Mycobacterium
AQNQDGQT

SEQ ID NO: 1105105 - protein, 21 aa, Mycobacterium
AQNQSAQGPTAPVQPKSTLSQ

SEQ ID NO: 1105106 - protein, 4 aa, Mycobacterium
AQPA

SEQ ID NO: 1105107 - protein, 6 aa, Mycobacterium
AQPAEI

SEQ ID NO: 1105108 - protein, 10 aa, Mycobacterium
AQPAHGSIDG

SEQ ID NO: 1105109 - protein, 9 aa, Mycobacterium
AQPDAETGF

SEQ ID NO: 1105110 - protein, 26 aa, Mycobacterium
AQPDDGGPADESEPTEPLRGERGGYD

SEQ ID NO: 1105111 - protein, 7 aa, Mycobacterium
AQPFQGD

SEQ ID NO: 1105112 - protein, 8 aa, Mycobacterium
AQPGQPPA

SEQ ID NO: 1105113 - protein, 7 aa, Mycobacterium
AQPQQQF

SEQ ID NO: 1105114 - protein, 16 aa, Mycobacterium
AQPRATRAPRAEAGAP

SEQ ID NO: 1105115 - protein, 9 aa, Mycobacterium
AQQARADET

SEQ ID NO: 1105116 - protein, 14 aa, Mycobacterium
AQQSDADATQARQQ

SEQ ID NO: 1105117 - protein, 5 aa, Mycobacterium
AQQSE

SEQ ID NO: 1105118 - protein, 9 aa, Mycobacterium
AQQTPADKV

SEQ ID NO: 1105119 - protein, 14 aa, Mycobacterium
AQRATTNSLQAAQD

SEQ ID NO: 1105120 - protein, 6 aa, Mycobacterium
AQRDNA

SEQ ID NO: 1105121 - protein, 7 aa, Mycobacterium
AQRETLG

SEQ ID NO: 1105122 - protein, 5 aa, Mycobacterium
AQSAF

SEQ ID NO: 1105123 - protein, 15 aa, Mycobacterium
AQSAISGSTTTGVAG

SEQ ID NO: 1105124 - protein, 9 aa, Mycobacterium
AQSAPAGPP

SEQ ID NO: 1105125 - protein, 6 aa, Mycobacterium
AQSDRM

SEQ ID NO: 1105126 - protein, 7 aa, Mycobacterium
AQSGPSR

SEQ ID NO: 1105127 - protein, 12 aa, Mycobacterium
AQSLANSDVTAA

SEQ ID NO: 1105128 - protein, 11 aa, Mycobacterium
AQSRGQAERAR

SEQ ID NO: 1105129 - protein, 7 aa, Mycobacterium
AQSTAAG

SEQ ID NO: 1105130 - protein, 4 aa, Mycobacterium
AQSV

SEQ ID NO: 1105131 - protein, 12 aa, Mycobacterium
AQSVPAPLPEQA

SEQ ID NO: 1105132 - protein, 8 aa, Mycobacterium
AQTARRAH

SEQ ID NO: 1105133 - protein, 6 aa, Mycobacterium
AQTART

SEQ ID NO: 1105134 - protein, 18 aa, Mycobacterium
AQTPGERLGSARDRAVAE

SEQ ID NO: 1105135 - protein, 15 aa, Mycobacterium
AQTPGERRSGQQGTA

SEQ ID NO: 1105136 - protein, 8 aa, Mycobacterium
AQTPPPRV

SEQ ID NO: 1105137 - protein, 4 aa, Mycobacterium
AQTS

SEQ ID NO: 1105138 - protein, 5 aa, Mycobacterium
AQTSL

SEQ ID NO: 1105139 - protein, 8 aa, Mycobacterium
AQTTPFGT

SEQ ID NO: 1105140 - protein, 6 aa, Mycobacterium
AQVADE

SEQ ID NO: 1105141 - protein, 11 aa, Mycobacterium
AQVNRDSVDAI

SEQ ID NO: 1105142 - protein, 9 aa, Mycobacterium
AQYPTSGGT

SEQ ID NO: 1105143 - protein, 16 aa, Mycobacterium
ARAAEKQKIELGGEER

SEQ ID NO: 1105144 - protein, 9 aa, Mycobacterium
ARAAETAWN

SEQ ID NO: 1105145 - protein, 7 aa, Mycobacterium
ARAAETE

SEQ ID NO: 1105146 - protein, 16 aa, Mycobacterium
ARAAEVARSDDAALQA

SEQ ID NO: 1105147 - protein, 8 aa, Mycobacterium
ARAAGATT

SEQ ID NO: 1105148 - protein, 21 aa, Mycobacterium
ARAAGRALPALSGELSTAADT

SEQ ID NO: 1105149 - protein, 8 aa, Mycobacterium
ARAAPAAA

SEQ ID NO: 1105150 - protein, 8 aa, Mycobacterium
ARADGRHD

SEQ ID NO: 1105151 - protein, 8 aa, Mycobacterium
ARAEESAV

SEQ ID NO: 1105152 - protein, 6 aa, Mycobacterium
ARAEPE

SEQ ID NO: 1105153 - protein, 8 aa, Mycobacterium
ARAEPGLA

SEQ ID NO: 1105154 - protein, 6 aa, Mycobacterium
ARAETA

SEQ ID NO: 1105155 - protein, 4 aa, Mycobacterium
ARAG

SEQ ID NO: 1105156 - protein, 6 aa, Mycobacterium
ARAGAS

SEQ ID NO: 1105157 - protein, 7 aa, Mycobacterium
ARAGGSR

SEQ ID NO: 1105158 - protein, 15 aa, Mycobacterium
ARAGPPSAPAGEKDD

SEQ ID NO: 1105159 - protein, 9 aa, Mycobacterium
ARAKGLSER

SEQ ID NO: 1105160 - protein, 10 aa, Mycobacterium
ARARQRTGSA

SEQ ID NO: 1105161 - protein, 8 aa, Mycobacterium
ARATDSGL

SEQ ID NO: 1105162 - protein, 7 aa, Mycobacterium
ARDADDT

SEQ ID NO: 1105163 - protein, 7 aa, Mycobacterium
ARDAGAD

SEQ ID NO: 1105164 - protein, 10 aa, Mycobacterium
ARDAGAQIES

SEQ ID NO: 1105165 - protein, 9 aa, Mycobacterium
ARDGGSSHQ

SEQ ID NO: 1105166 - protein, 6 aa, Mycobacterium
ARDPEA

SEQ ID NO: 1105167 - protein, 5 aa, Mycobacterium
ARDRP

SEQ ID NO: 1105168 - protein, 12 aa, Mycobacterium
ARDTASGVRESQ

SEQ ID NO: 1105169 - protein, 18 aa, Mycobacterium
AREAVEGARKSGSAALGT

SEQ ID NO: 1105170 - protein, 6 aa, Mycobacterium
ARFDSA

SEQ ID NO: 1105171 - protein, 6 aa, Mycobacterium
ARFTES

SEQ ID NO: 1105172 - protein, 6 aa, Mycobacterium
ARGHIA

SEQ ID NO: 1105173 - protein, 4 aa, Mycobacterium
ARGL

SEQ ID NO: 1105174 - protein, 10 aa, Mycobacterium
ARGPIKTESR

SEQ ID NO: 1105175 - protein, 7 aa, Mycobacterium
ARHEPEA

SEQ ID NO: 1105176 - protein, 6 aa, Mycobacterium
ARHGRG

SEQ ID NO: 1105177 - protein, 29 aa, Mycobacterium
ARHSPRAATRPVETAATAGADGWAAPGVR

SEQ ID NO: 1105178 - protein, 8 aa, Mycobacterium
ARKGLDER

SEQ ID NO: 1105179 - protein, 20 aa, Mycobacterium
ARKTDIGESVSHSNAAAASI

SEQ ID NO: 1105180 - protein, 9 aa, Mycobacterium
ARLGSGAQR

SEQ ID NO: 1105181 - protein, 12 aa, Mycobacterium
ARLPDGSGSELS

SEQ ID NO: 1105182 - protein, 17 aa, Mycobacterium
ARLRGRSESTDLYTPSG

SEQ ID NO: 1105183 - protein, 7 aa, Mycobacterium
ARMGPKG

SEQ ID NO: 1105184 - protein, 4 aa, Mycobacterium
ARMP

SEQ ID NO: 1105185 - protein, 10 aa, Mycobacterium
ARNEGTTYRL

SEQ ID NO: 1105186 - protein, 16 aa, Mycobacterium
ARNPEKALESTLTGGG

SEQ ID NO: 1105187 - protein, 13 aa, Mycobacterium
ARNQRRAQEADRI

SEQ ID NO: 1105188 - protein, 4 aa, Mycobacterium
ARNR

SEQ ID NO: 1105189 - protein, 16 aa, Mycobacterium
ARNTPCVTRPGKRAPT

SEQ ID NO: 1105190 - protein, 5 aa, Mycobacterium
ARPAI

SEQ ID NO: 1105191 - protein, 6 aa, Mycobacterium
ARPALS

SEQ ID NO: 1105192 - protein, 16 aa, Mycobacterium
ARPDPQAPPPVADPDG

SEQ ID NO: 1105193 - protein, 4 aa, Mycobacterium
ARPG

SEQ ID NO: 1105194 - protein, 10 aa, Mycobacterium
ARPGEPSPWG

SEQ ID NO: 1105195 - protein, 20 aa, Mycobacterium
ARPGSGAAVEPGSGQPRQAG

SEQ ID NO: 1105196 - protein, 15 aa, Mycobacterium
ARPLGGKLSDRVGGA

SEQ ID NO: 1105197 - protein, 9 aa, Mycobacterium
ARPPEPAED

SEQ ID NO: 1105198 - protein, 8 aa, Mycobacterium
ARPPLAGS

SEQ ID NO: 1105199 - protein, 8 aa, Mycobacterium
ARPPLAGT

SEQ ID NO: 1105200 - protein, 6 aa, Mycobacterium
ARPPLQ

SEQ ID NO: 1105201 - protein, 8 aa, Mycobacterium
ARPPLQNT

SEQ ID NO: 1105202 - protein, 7 aa, Mycobacterium
ARPRDAD

SEQ ID NO: 1105203 - protein, 4 aa, Mycobacterium
ARQG

SEQ ID NO: 1105204 - protein, 14 aa, Mycobacterium
ARQGNAIDSRYHPS

SEQ ID NO: 1105205 - protein, 10 aa, Mycobacterium
ARQGQPPPDV

SEQ ID NO: 1105206 - protein, 6 aa, Mycobacterium
ARQGRA

SEQ ID NO: 1105207 - protein, 11 aa, Mycobacterium
ARQNAAEHAGE

SEQ ID NO: 1105208 - protein, 5 aa, Mycobacterium
ARQPT

SEQ ID NO: 1105209 - protein, 27 aa, Mycobacterium
ARQPVPPPVPAAAPYAAPPVEPTTAQR

SEQ ID NO: 1105210 - protein, 6 aa, Mycobacterium
ARQRST

SEQ ID NO: 1105211 - protein, 10 aa, Mycobacterium
ARQSGGGTRF

SEQ ID NO: 1105212 - protein, 10 aa, Mycobacterium
ARRADPGPDV

SEQ ID NO: 1105213 - protein, 7 aa, Mycobacterium
ARRAEAL

SEQ ID NO: 1105214 - protein, 15 aa, Mycobacterium
ARRATSEATGTPTRA

SEQ ID NO: 1105215 - protein, 10 aa, Mycobacterium
ARRDPGTPEV

SEQ ID NO: 1105216 - protein, 5 aa, Mycobacterium
ARRGE

SEQ ID NO: 1105217 - protein, 9 aa, Mycobacterium
ARRGGQTLT

SEQ ID NO: 1105218 - protein, 14 aa, Mycobacterium
ARRGLQEDRDVDEA

SEQ ID NO: 1105219 - protein, 5 aa, Mycobacterium
ARRGS

SEQ ID NO: 1105220 - protein, 5 aa, Mycobacterium
ARRPA

SEQ ID NO: 1105221 - protein, 10 aa, Mycobacterium
ARRPKTPSTS

SEQ ID NO: 1105222 - protein, 8 aa, Mycobacterium
ARRPQGPA

SEQ ID NO: 1105223 - protein, 8 aa, Mycobacterium
ARRPSQSG

SEQ ID NO: 1105224 - protein, 7 aa, Mycobacterium
ARRRSQE

SEQ ID NO: 1105225 - protein, 6 aa, Mycobacterium
ARRSNR

SEQ ID NO: 1105226 - protein, 30 aa, Mycobacterium
ARRTPGDQGEQEARDDGLPAPGVTPAEQAR

SEQ ID NO: 1105227 - protein, 8 aa, Mycobacterium
ARRTPGKK

SEQ ID NO: 1105228 - protein, 7 aa, Mycobacterium
ARRTRPR

SEQ ID NO: 1105229 - protein, 7 aa, Mycobacterium
ARSAAAL

SEQ ID NO: 1105230 - protein, 5 aa, Mycobacterium
ARSAG

SEQ ID NO: 1105231 - protein, 8 aa, Mycobacterium
ARSAGYPS

SEQ ID NO: 1105232 - protein, 8 aa, Mycobacterium
ARSAPGYV

SEQ ID NO: 1105233 - protein, 7 aa, Mycobacterium
ARSASTV

SEQ ID NO: 1105234 - protein, 7 aa, Mycobacterium
ARSATKL

SEQ ID NO: 1105235 - protein, 6 aa, Mycobacterium
ARSGGE

SEQ ID NO: 1105236 - protein, 11 aa, Mycobacterium
ARSGSLGPSRR

SEQ ID NO: 1105237 - protein, 8 aa, Mycobacterium
ARSKGLSP

SEQ ID NO: 1105238 - protein, 15 aa, Mycobacterium
ARSLTDSGLQSGSTV

SEQ ID NO: 1105239 - protein, 8 aa, Mycobacterium
ARSPGRTL

SEQ ID NO: 1105240 - protein, 11 aa, Mycobacterium
ARSQLQDQTSD

SEQ ID NO: 1105241 - protein, 11 aa, Mycobacterium
ARSRATGGTGL

SEQ ID NO: 1105242 - protein, 8 aa, Mycobacterium
ARSRGKAL

SEQ ID NO: 1105243 - protein, 9 aa, Mycobacterium
ARSRGRDGD

SEQ ID NO: 1105244 - protein, 8 aa, Mycobacterium
ARSRLQDP

SEQ ID NO: 1105245 - protein, 7 aa, Mycobacterium
ARSTDYT

SEQ ID NO: 1105246 - protein, 12 aa, Mycobacterium
ARSYDSAENGAE

SEQ ID NO: 1105247 - protein, 5 aa, Mycobacterium
ARTAV

SEQ ID NO: 1105248 - protein, 6 aa, Mycobacterium
ARTDLK

SEQ ID NO: 1105249 - protein, 18 aa, Mycobacterium
ARTDPNDPNSTQTAGSLR

SEQ ID NO: 1105250 - protein, 8 aa, Mycobacterium
ARTGDDGQ

SEQ ID NO: 1105251 - protein, 8 aa, Mycobacterium
ARTGPGRL

SEQ ID NO: 1105252 - protein, 16 aa, Mycobacterium
ARTPDGSPPSRESLDQ

SEQ ID NO: 1105253 - protein, 11 aa, Mycobacterium
ARTTAAATSSS

SEQ ID NO: 1105254 - protein, 27 aa, Mycobacterium
ARTTGGQYQNLTTSDSPELTAAITTLL

SEQ ID NO: 1105255 - protein, 7 aa, Mycobacterium
ARTTPDL

SEQ ID NO: 1105256 - protein, 10 aa, Mycobacterium
ARVRPANAPK

SEQ ID NO: 1105257 - protein, 9 aa, Mycobacterium
ARVRRGPKR

SEQ ID NO: 1105258 - protein, 22 aa, Mycobacterium
ARVVSDGGADPVVKDKQAAYDA

SEQ ID NO: 1105259 - protein, 5 aa, Mycobacterium
ARWDD

SEQ ID NO: 1105260 - protein, 20 aa, Mycobacterium
ARWPRTPAADRAATAGTGAL

SEQ ID NO: 1105261 - protein, 6 aa, Mycobacterium
ARYGAG

SEQ ID NO: 1105262 - protein, 12 aa, Mycobacterium
ARYTDPSARSFT

SEQ ID NO: 1105263 - protein, 10 aa, Mycobacterium
ASAAAGGTLP

SEQ ID NO: 1105264 - protein, 9 aa, Mycobacterium
ASAAGAQAF

SEQ ID NO: 1105265 - protein, 8 aa, Mycobacterium
ASAARAVA

SEQ ID NO: 1105266 - protein, 8 aa, Mycobacterium
ASADDAVN

SEQ ID NO: 1105267 - protein, 10 aa, Mycobacterium
ASADDRDPAG

SEQ ID NO: 1105268 - protein, 11 aa, Mycobacterium
ASADPADTGGF

SEQ ID NO: 1105269 - protein, 110 aa, Mycobacterium
ASAETPESSPPSVSTSASSESETTDPGPTVSDDENATEDEAAEAAEETEETEEAETADESAQVEESDQDTAADDDASRDRDTSSDSTQAVAAGPEEVEGAAEIEEAEEPS

SEQ ID NO: 1105270 - protein, 7 aa, Mycobacterium
ASAGAAR

SEQ ID NO: 1105271 - protein, 10 aa, Mycobacterium
ASAGPGAGAT

SEQ ID NO: 1105272 - protein, 10 aa, Mycobacterium
ASAGPGTGAT

SEQ ID NO: 1105273 - protein, 5 aa, Mycobacterium
ASAGQ

SEQ ID NO: 1105274 - protein, 7 aa, Mycobacterium
ASAIGNA

SEQ ID NO: 1105275 - protein, 9 aa, Mycobacterium
ASAPGGPSA

SEQ ID NO: 1105276 - protein, 28 aa, Mycobacterium
ASAPPAGAITPPEVDPAVPPPGGSVGPV

SEQ ID NO: 1105277 - protein, 8 aa, Mycobacterium
ASAPPVAR

SEQ ID NO: 1105278 - protein, 13 aa, Mycobacterium
ASAPYGNQPGAPH

SEQ ID NO: 1105279 - protein, 9 aa, Mycobacterium
ASASAGAHP

SEQ ID NO: 1105280 - protein, 10 aa, Mycobacterium
ASASAGGALP

SEQ ID NO: 1105281 - protein, 8 aa, Mycobacterium
ASASHAPR

SEQ ID NO: 1105282 - protein, 6 aa, Mycobacterium
ASASTV

SEQ ID NO: 1105283 - protein, 10 aa, Mycobacterium
ASATAPLSDA

SEQ ID NO: 1105284 - protein, 14 aa, Mycobacterium
ASATGVKSTPSVRI

SEQ ID NO: 1105285 - protein, 19 aa, Mycobacterium
ASATPVPSSSTEDFHPDPS

SEQ ID NO: 1105286 - protein, 7 aa, Mycobacterium
ASATTTA

SEQ ID NO: 1105287 - protein, 5 aa, Mycobacterium
ASAVG

SEQ ID NO: 1105288 - protein, 12 aa, Mycobacterium
ASAVPVNARSAP

SEQ ID NO: 1105289 - protein, 9 aa, Mycobacterium
ASAVTGGRA

SEQ ID NO: 1105290 - protein, 8 aa, Mycobacterium
ASDAHQTG

SEQ ID NO: 1105291 - protein, 8 aa, Mycobacterium
ASDESPLA

SEQ ID NO: 1105292 - protein, 4 aa, Mycobacterium
ASDG

SEQ ID NO: 1105293 - protein, 5 aa, Mycobacterium
ASDGE

SEQ ID NO: 1105294 - protein, 7 aa, Mycobacterium
ASDGLRG

SEQ ID NO: 1105295 - protein, 18 aa, Mycobacterium
ASDGVESVTRNGTLVQSG

SEQ ID NO: 1105296 - protein, 6 aa, Mycobacterium
ASDNAP

SEQ ID NO: 1105297 - protein, 8 aa, Mycobacterium
ASDPPPAL

SEQ ID NO: 1105298 - protein, 7 aa, Mycobacterium
ASDPRAA

SEQ ID NO: 1105299 - protein, 4 aa, Mycobacterium
ASEQ

SEQ ID NO: 1105300 - protein, 7 aa, Mycobacterium
ASERTPL

SEQ ID NO: 1105301 - protein, 5 aa, Mycobacterium
ASESA

SEQ ID NO: 1105302 - protein, 6 aa, Mycobacterium
ASETQL

SEQ ID NO: 1105303 - protein, 12 aa, Mycobacterium
ASGAASTARAAA

SEQ ID NO: 1105304 - protein, 8 aa, Mycobacterium
ASGADGTE

SEQ ID NO: 1105305 - protein, 19 aa, Mycobacterium
ASGAGQRRRTSGRLSERHT

SEQ ID NO: 1105306 - protein, 10 aa, Mycobacterium
ASGATAGEGI

SEQ ID NO: 1105307 - protein, 7 aa, Mycobacterium
ASGEESV

SEQ ID NO: 1105308 - protein, 8 aa, Mycobacterium
ASGESKSR

SEQ ID NO: 1105309 - protein, 8 aa, Mycobacterium
ASGEVELT

SEQ ID NO: 1105310 - protein, 8 aa, Mycobacterium
ASGGAATV

SEQ ID NO: 1105311 - protein, 11 aa, Mycobacterium
ASGGGGWGPVT

SEQ ID NO: 1105312 - protein, 12 aa, Mycobacterium
ASGGGTLTGHGA

SEQ ID NO: 1105313 - protein, 9 aa, Mycobacterium
ASGGPNCRG

SEQ ID NO: 1105314 - protein, 16 aa, Mycobacterium
ASGGVTTVTDSGHQQR

SEQ ID NO: 1105315 - protein, 16 aa, Mycobacterium
ASGHTRAPVVPSGELD

SEQ ID NO: 1105316 - protein, 7 aa, Mycobacterium
ASGLRPG

SEQ ID NO: 1105317 - protein, 13 aa, Mycobacterium
ASGQGGQAGEVAG

SEQ ID NO: 1105318 - protein, 15 aa, Mycobacterium
ASGQLAQAADREPID

SEQ ID NO: 1105319 - protein, 12 aa, Mycobacterium
ASGRGGEGSVGA

SEQ ID NO: 1105320 - protein, 7 aa, Mycobacterium
ASGRRMP

SEQ ID NO: 1105321 - protein, 9 aa, Mycobacterium
ASGRSRTQR

SEQ ID NO: 1105322 - protein, 11 aa, Mycobacterium
ASGSIGDPQSL

SEQ ID NO: 1105323 - protein, 8 aa, Mycobacterium
ASGTAATA

SEQ ID NO: 1105324 - protein, 8 aa, Mycobacterium
ASGTDATA

SEQ ID NO: 1105325 - protein, 5 aa, Mycobacterium
ASGWP

SEQ ID NO: 1105326 - protein, 4 aa, Mycobacterium
ASHT

SEQ ID NO: 1105327 - protein, 4 aa, Mycobacterium
ASIA

SEQ ID NO: 1105328 - protein, 4 aa, Mycobacterium
ASIG

SEQ ID NO: 1105329 - protein, 6 aa, Mycobacterium
ASIGQG

SEQ ID NO: 1105330 - protein, 6 aa, Mycobacterium
ASIPDQ

SEQ ID NO: 1105331 - protein, 5 aa, Mycobacterium
ASIPG

SEQ ID NO: 1105332 - protein, 7 aa, Mycobacterium
ASKASTV

SEQ ID NO: 1105333 - protein, 23 aa, Mycobacterium
ASKLVDPETGDEIPIPEEGLSKT

SEQ ID NO: 1105334 - protein, 7 aa, Mycobacterium
ASKPPVI

SEQ ID NO: 1105335 - protein, 7 aa, Mycobacterium
ASKSSTV

SEQ ID NO: 1105336 - protein, 16 aa, Mycobacterium
ASKVAGDANSVSDQTR

SEQ ID NO: 1105337 - protein, 9 aa, Mycobacterium
ASLEERERL

SEQ ID NO: 1105338 - protein, 4 aa, Mycobacterium
ASLS

SEQ ID NO: 1105339 - protein, 18 aa, Mycobacterium
ASLTGESEPVTKTAATLP

SEQ ID NO: 1105340 - protein, 4 aa, Mycobacterium
ASNG

SEQ ID NO: 1105341 - protein, 5 aa, Mycobacterium
ASNHA

SEQ ID NO: 1105342 - protein, 16 aa, Mycobacterium
ASNNPTALSKHKDPGV

SEQ ID NO: 1105343 - protein, 16 aa, Mycobacterium
ASNRDLDGAKASVELG

SEQ ID NO: 1105344 - protein, 15 aa, Mycobacterium
ASPAFEGRPDRGEVE

SEQ ID NO: 1105345 - protein, 9 aa, Mycobacterium
ASPANTVRG

SEQ ID NO: 1105346 - protein, 8 aa, Mycobacterium
ASPARQAT

SEQ ID NO: 1105347 - protein, 7 aa, Mycobacterium
ASPDSDV

SEQ ID NO: 1105348 - protein, 13 aa, Mycobacterium
ASPGASDAASSYP

SEQ ID NO: 1105349 - protein, 13 aa, Mycobacterium
ASPGDYEASLSTS

SEQ ID NO: 1105350 - protein, 5 aa, Mycobacterium
ASPHV

SEQ ID NO: 1105351 - protein, 7 aa, Mycobacterium
ASPLEPE

SEQ ID NO: 1105352 - protein, 5 aa, Mycobacterium
ASPSI

SEQ ID NO: 1105353 - protein, 7 aa, Mycobacterium
ASPVTAG

SEQ ID NO: 1105354 - protein, 9 aa, Mycobacterium
ASPWATPPP

SEQ ID NO: 1105355 - protein, 6 aa, Mycobacterium
ASQDPL

SEQ ID NO: 1105356 - protein, 7 aa, Mycobacterium
ASQPAAA

SEQ ID NO: 1105357 - protein, 10 aa, Mycobacterium
ASQVRTEADA

SEQ ID NO: 1105358 - protein, 22 aa, Mycobacterium
ASRAATEALDEQAEELRRSNAE

SEQ ID NO: 1105359 - protein, 6 aa, Mycobacterium
ASRADW

SEQ ID NO: 1105360 - protein, 5 aa, Mycobacterium
ASREA

SEQ ID NO: 1105361 - protein, 11 aa, Mycobacterium
ASRGSDPARTA

SEQ ID NO: 1105362 - protein, 10 aa, Mycobacterium
ASRGTGDAGA

SEQ ID NO: 1105363 - protein, 10 aa, Mycobacterium
ASRSPTAPSH

SEQ ID NO: 1105364 - protein, 10 aa, Mycobacterium
ASRSPTTPAH

SEQ ID NO: 1105365 - protein, 14 aa, Mycobacterium
ASRTPTNGNPDRVT

SEQ ID NO: 1105366 - protein, 6 aa, Mycobacterium
ASSAST

SEQ ID NO: 1105367 - protein, 16 aa, Mycobacterium
ASSEASAEQARTSEDR

SEQ ID NO: 1105368 - protein, 6 aa, Mycobacterium
ASSGAP

SEQ ID NO: 1105369 - protein, 7 aa, Mycobacterium
ASSGIGR

SEQ ID NO: 1105370 - protein, 11 aa, Mycobacterium
ASSLPSGDYTT

SEQ ID NO: 1105371 - protein, 7 aa, Mycobacterium
ASSPRLA

SEQ ID NO: 1105372 - protein, 13 aa, Mycobacterium
ASSRPPDAENPYG

SEQ ID NO: 1105373 - protein, 11 aa, Mycobacterium
ASSSPDGLDSA

SEQ ID NO: 1105374 - protein, 4 aa, Mycobacterium
ASST

SEQ ID NO: 1105375 - protein, 9 aa, Mycobacterium
ASSVDDPEV

SEQ ID NO: 1105376 - protein, 10 aa, Mycobacterium
ASSVKSGDSV

SEQ ID NO: 1105377 - protein, 11 aa, Mycobacterium
ASTAAASGPAI

SEQ ID NO: 1105378 - protein, 8 aa, Mycobacterium
ASTAQTLS

SEQ ID NO: 1105379 - protein, 12 aa, Mycobacterium
ASTDADGGAALT

SEQ ID NO: 1105380 - protein, 12 aa, Mycobacterium
ASTDATTAAAEA

SEQ ID NO: 1105381 - protein, 5 aa, Mycobacterium
ASTDR

SEQ ID NO: 1105382 - protein, 15 aa, Mycobacterium
ASTGDDPADPPADRT

SEQ ID NO: 1105383 - protein, 8 aa, Mycobacterium
ASTGGRRT

SEQ ID NO: 1105384 - protein, 19 aa, Mycobacterium
ASTIDTLNDRGETDRARAY

SEQ ID NO: 1105385 - protein, 11 aa, Mycobacterium
ASTKYREGQKN

SEQ ID NO: 1105386 - protein, 11 aa, Mycobacterium
ASTLDGDEAST

SEQ ID NO: 1105387 - protein, 11 aa, Mycobacterium
ASTLTAPAALG

SEQ ID NO: 1105388 - protein, 8 aa, Mycobacterium
ASTPGADL

SEQ ID NO: 1105389 - protein, 7 aa, Mycobacterium
ASTTSAT

SEQ ID NO: 1105390 - protein, 15 aa, Mycobacterium
ASTTSATIANNAPAL

SEQ ID NO: 1105391 - protein, 4 aa, Mycobacterium
ASTY

SEQ ID NO: 1105392 - protein, 13 aa, Mycobacterium
ASVPGGATARRRP

SEQ ID NO: 1105393 - protein, 8 aa, Mycobacterium
ASVPQPVG

SEQ ID NO: 1105394 - protein, 8 aa, Mycobacterium
ASVSGADD

SEQ ID NO: 1105395 - protein, 13 aa, Mycobacterium
ASVSGGATARRRP

SEQ ID NO: 1105396 - protein, 8 aa, Mycobacterium
ATAAAGGV

SEQ ID NO: 1105397 - protein, 6 aa, Mycobacterium
ATAAAT

SEQ ID NO: 1105398 - protein, 8 aa, Mycobacterium
ATAASTER

SEQ ID NO: 1105399 - protein, 6 aa, Mycobacterium
ATAATA

SEQ ID NO: 1105400 - protein, 8 aa, Mycobacterium
ATADPGEP

SEQ ID NO: 1105401 - protein, 7 aa, Mycobacterium
ATAERGP

SEQ ID NO: 1105402 - protein, 16 aa, Mycobacterium
ATAGGAEEETQGPESR

SEQ ID NO: 1105403 - protein, 19 aa, Mycobacterium
ATAGRDTGALSTATEATGG

SEQ ID NO: 1105404 - protein, 7 aa, Mycobacterium
ATAGTTL

SEQ ID NO: 1105405 - protein, 12 aa, Mycobacterium
ATALPSGTTPMP

SEQ ID NO: 1105406 - protein, 4 aa, Mycobacterium
ATAP

SEQ ID NO: 1105407 - protein, 8 aa, Mycobacterium
ATAPDIGS

SEQ ID NO: 1105408 - protein, 7 aa, Mycobacterium
ATAPEAF

SEQ ID NO: 1105409 - protein, 8 aa, Mycobacterium
ATAPLSAE

SEQ ID NO: 1105410 - protein, 10 aa, Mycobacterium
ATAPPPPGIP

SEQ ID NO: 1105411 - protein, 5 aa, Mycobacterium
ATAPT

SEQ ID NO: 1105412 - protein, 11 aa, Mycobacterium
ATAQPEVEAND

SEQ ID NO: 1105413 - protein, 10 aa, Mycobacterium
ATARAAAPPA

SEQ ID NO: 1105414 - protein, 8 aa, Mycobacterium
ATASAQEQ

SEQ ID NO: 1105415 - protein, 8 aa, Mycobacterium
ATASVTRA

SEQ ID NO: 1105416 - protein, 24 aa, Mycobacterium
ATATRNLPPQLAGAGSGVYNTTRQ

SEQ ID NO: 1105417 - protein, 6 aa, Mycobacterium
ATATSV

SEQ ID NO: 1105418 - protein, 6 aa, Mycobacterium
ATATTS

SEQ ID NO: 1105419 - protein, 4 aa, Mycobacterium
ATAV

SEQ ID NO: 1105420 - protein, 9 aa, Mycobacterium
ATAVEPPAR

SEQ ID NO: 1105421 - protein, 8 aa, Mycobacterium
ATAVPGGV

SEQ ID NO: 1105422 - protein, 17 aa, Mycobacterium
ATAVSDSRGVPQPYEKP

SEQ ID NO: 1105423 - protein, 7 aa, Mycobacterium
ATDAADT

SEQ ID NO: 1105424 - protein, 24 aa, Mycobacterium
ATDDEGDDDAPSTSRTQSLARAAE

SEQ ID NO: 1105425 - protein, 8 aa, Mycobacterium
ATDKSREL

SEQ ID NO: 1105426 - protein, 31 aa, Mycobacterium
ATDNDGYTQTPDRADPVPDGATGWHSITFAV

SEQ ID NO: 1105427 - protein, 7 aa, Mycobacterium
ATDPGQR

SEQ ID NO: 1105428 - protein, 5 aa, Mycobacterium
ATDPL

SEQ ID NO: 1105429 - protein, 4 aa, Mycobacterium
ATDR

SEQ ID NO: 1105430 - protein, 14 aa, Mycobacterium
ATDTARSARPELPP

SEQ ID NO: 1105431 - protein, 8 aa, Mycobacterium
ATDVAEGN

SEQ ID NO: 1105432 - protein, 9 aa, Mycobacterium
ATEGGDARQ

SEQ ID NO: 1105433 - protein, 8 aa, Mycobacterium
ATEKPGGW

SEQ ID NO: 1105434 - protein, 4 aa, Mycobacterium
ATES

SEQ ID NO: 1105435 - protein, 11 aa, Mycobacterium
ATESERERQDT

SEQ ID NO: 1105436 - protein, 6 aa, Mycobacterium
ATESIP

SEQ ID NO: 1105437 - protein, 8 aa, Mycobacterium
ATETDTIE

SEQ ID NO: 1105438 - protein, 5 aa, Mycobacterium
ATFGG

SEQ ID NO: 1105439 - protein, 9 aa, Mycobacterium
ATGAAAGSL

SEQ ID NO: 1105440 - protein, 8 aa, Mycobacterium
ATGAHRRS

SEQ ID NO: 1105441 - protein, 9 aa, Mycobacterium
ATGALKPKT

SEQ ID NO: 1105442 - protein, 9 aa, Mycobacterium
ATGDDTTLA

SEQ ID NO: 1105443 - protein, 9 aa, Mycobacterium
ATGDNPRVA

SEQ ID NO: 1105444 - protein, 7 aa, Mycobacterium
ATGDRFG

SEQ ID NO: 1105445 - protein, 6 aa, Mycobacterium
ATGEDY

SEQ ID NO: 1105446 - protein, 9 aa, Mycobacterium
ATGEESVTI

SEQ ID NO: 1105447 - protein, 8 aa, Mycobacterium
ATGGRSGI

SEQ ID NO: 1105448 - protein, 19 aa, Mycobacterium
ATGHDAPTQTVTSGPTRTV

SEQ ID NO: 1105449 - protein, 5 aa, Mycobacterium
ATGHS

SEQ ID NO: 1105450 - protein, 23 aa, Mycobacterium
ATGHSSPQFTAPPGHHAEGPPAT

SEQ ID NO: 1105451 - protein, 10 aa, Mycobacterium
ATGKPGESPY

SEQ ID NO: 1105452 - protein, 12 aa, Mycobacterium
ATGLPDPGPVTS

SEQ ID NO: 1105453 - protein, 7 aa, Mycobacterium
ATGQAVE

SEQ ID NO: 1105454 - protein, 5 aa, Mycobacterium
ATGQD

SEQ ID NO: 1105455 - protein, 5 aa, Mycobacterium
ATGQF

SEQ ID NO: 1105456 - protein, 7 aa, Mycobacterium
ATGQGTA

SEQ ID NO: 1105457 - protein, 5 aa, Mycobacterium
ATGRA

SEQ ID NO: 1105458 - protein, 10 aa, Mycobacterium
ATGRGREDDT

SEQ ID NO: 1105459 - protein, 6 aa, Mycobacterium
ATGRSP

SEQ ID NO: 1105460 - protein, 20 aa, Mycobacterium
ATGSITDDEYAAKRQQIIAD

SEQ ID NO: 1105461 - protein, 5 aa, Mycobacterium
ATGST

SEQ ID NO: 1105462 - protein, 7 aa, Mycobacterium
ATGSTAG

SEQ ID NO: 1105463 - protein, 5 aa, Mycobacterium
ATGTF

SEQ ID NO: 1105464 - protein, 7 aa, Mycobacterium
ATGTLDV

SEQ ID NO: 1105465 - protein, 5 aa, Mycobacterium
ATGTP

SEQ ID NO: 1105466 - protein, 6 aa, Mycobacterium
ATGTRD

SEQ ID NO: 1105467 - protein, 6 aa, Mycobacterium
ATGTTV

SEQ ID NO: 1105468 - protein, 5 aa, Mycobacterium
ATGTV

SEQ ID NO: 1105469 - protein, 8 aa, Mycobacterium
ATGWPGGA

SEQ ID NO: 1105470 - protein, 30 aa, Mycobacterium
ATGYTATAPAAPNDAAPTDSGPDAGEADSL

SEQ ID NO: 1105471 - protein, 30 aa, Mycobacterium
ATGYTATAPAAPNDAAPTDSGRDAGEADSL

SEQ ID NO: 1105472 - protein, 11 aa, Mycobacterium
ATHGGSAGGSH

SEQ ID NO: 1105473 - protein, 8 aa, Mycobacterium
ATIADTNN

SEQ ID NO: 1105474 - protein, 4 aa, Mycobacterium
ATKG

SEQ ID NO: 1105475 - protein, 5 aa, Mycobacterium
ATKGV

SEQ ID NO: 1105476 - protein, 9 aa, Mycobacterium
ATKRTEDSV

SEQ ID NO: 1105477 - protein, 4 aa, Mycobacterium
ATLG

SEQ ID NO: 1105478 - protein, 12 aa, Mycobacterium
ATLGAAGEQRVN

SEQ ID NO: 1105479 - protein, 11 aa, Mycobacterium
ATLSTSSDPGE

SEQ ID NO: 1105480 - protein, 12 aa, Mycobacterium
ATLTNDVNGVSD

SEQ ID NO: 1105481 - protein, 15 aa, Mycobacterium
ATMGGDSAQAQSGSI

SEQ ID NO: 1105482 - protein, 7 aa, Mycobacterium
ATNPAYG

SEQ ID NO: 1105483 - protein, 5 aa, Mycobacterium
ATNPK

SEQ ID NO: 1105484 - protein, 15 aa, Mycobacterium
ATNPLATTAPPPHHR

SEQ ID NO: 1105485 - protein, 16 aa, Mycobacterium
ATNPLATTAPPPHHRR

SEQ ID NO: 1105486 - protein, 6 aa, Mycobacterium
ATNRGL

SEQ ID NO: 1105487 - protein, 5 aa, Mycobacterium
ATNSV

SEQ ID NO: 1105488 - protein, 8 aa, Mycobacterium
ATNTAGDG

SEQ ID NO: 1105489 - protein, 9 aa, Mycobacterium
ATPAEDQGV

SEQ ID NO: 1105490 - protein, 17 aa, Mycobacterium
ATPAEVPNTSPAPRRRA

SEQ ID NO: 1105491 - protein, 12 aa, Mycobacterium
ATPDQAESPELP

SEQ ID NO: 1105492 - protein, 5 aa, Mycobacterium
ATPEE

SEQ ID NO: 1105493 - protein, 9 aa, Mycobacterium
ATPEPGPEV

SEQ ID NO: 1105494 - protein, 18 aa, Mycobacterium
ATPGNDARYTPKCRNMAN

SEQ ID NO: 1105495 - protein, 11 aa, Mycobacterium
ATPGPASGSVA

SEQ ID NO: 1105496 - protein, 14 aa, Mycobacterium
ATPGPDGAPVAAGR

SEQ ID NO: 1105497 - protein, 4 aa, Mycobacterium
ATPL

SEQ ID NO: 1105498 - protein, 11 aa, Mycobacterium
ATPNRTESTDI

SEQ ID NO: 1105499 - protein, 7 aa, Mycobacterium
ATPPALR

SEQ ID NO: 1105500 - protein, 4 aa, Mycobacterium
ATPQ

SEQ ID NO: 1105501 - protein, 5 aa, Mycobacterium
ATPQD

SEQ ID NO: 1105502 - protein, 23 aa, Mycobacterium
ATPRTGEVGSATTSPVSTGAWGS

SEQ ID NO: 1105503 - protein, 27 aa, Mycobacterium
ATPTGRTLDAPAPVAVSRPDSSPYGEI

SEQ ID NO: 1105504 - protein, 22 aa, Mycobacterium
ATPTHRAPPLDSSVSDVPEPIS

SEQ ID NO: 1105505 - protein, 17 aa, Mycobacterium
ATPVARSDKNARPGPLV

SEQ ID NO: 1105506 - protein, 8 aa, Mycobacterium
ATPVGSPT

SEQ ID NO: 1105507 - protein, 10 aa, Mycobacterium
ATPVPAPRNL

SEQ ID NO: 1105508 - protein, 13 aa, Mycobacterium
ATQAPDTAAMTAA

SEQ ID NO: 1105509 - protein, 6 aa, Mycobacterium
ATQAPE

SEQ ID NO: 1105510 - protein, 4 aa, Mycobacterium
ATRA

SEQ ID NO: 1105511 - protein, 6 aa, Mycobacterium
ATRDGR

SEQ ID NO: 1105512 - protein, 7 aa, Mycobacterium
ATRGKTL

SEQ ID NO: 1105513 - protein, 7 aa, Mycobacterium
ATRGRTL

SEQ ID NO: 1105514 - protein, 7 aa, Mycobacterium
ATRLGGG

SEQ ID NO: 1105515 - protein, 6 aa, Mycobacterium
ATRPAA

SEQ ID NO: 1105516 - protein, 5 aa, Mycobacterium
ATRPE

SEQ ID NO: 1105517 - protein, 8 aa, Mycobacterium
ATRPGSHN

SEQ ID NO: 1105518 - protein, 10 aa, Mycobacterium
ATRQTGGVAI

SEQ ID NO: 1105519 - protein, 22 aa, Mycobacterium
ATRSGRGANGSPDPADTREYSE

SEQ ID NO: 1105520 - protein, 12 aa, Mycobacterium
ATRSTRSEAPGT

SEQ ID NO: 1105521 - protein, 6 aa, Mycobacterium
ATRTGT

SEQ ID NO: 1105522 - protein, 10 aa, Mycobacterium
ATRTLSGRTE

SEQ ID NO: 1105523 - protein, 4 aa, Mycobacterium
ATRY

SEQ ID NO: 1105524 - protein, 22 aa, Mycobacterium
ATSAARDAPLPSGSLGNPRGRF

SEQ ID NO: 1105525 - protein, 16 aa, Mycobacterium
ATSAGADIAAAAADPG

SEQ ID NO: 1105526 - protein, 9 aa, Mycobacterium
ATSAQLTSQ

SEQ ID NO: 1105527 - protein, 7 aa, Mycobacterium
ATSGGGC

SEQ ID NO: 1105528 - protein, 6 aa, Mycobacterium
ATSGGQ

SEQ ID NO: 1105529 - protein, 8 aa, Mycobacterium
ATSGGRAR

SEQ ID NO: 1105530 - protein, 10 aa, Mycobacterium
ATSGGRARWE

SEQ ID NO: 1105531 - protein, 13 aa, Mycobacterium
ATSKTEGSQGSGV

SEQ ID NO: 1105532 - protein, 4 aa, Mycobacterium
ATSL

SEQ ID NO: 1105533 - protein, 14 aa, Mycobacterium
ATSNSNLDKMSQAR

SEQ ID NO: 1105534 - protein, 5 aa, Mycobacterium
ATSPD

SEQ ID NO: 1105535 - protein, 7 aa, Mycobacterium
ATSPDPL

SEQ ID NO: 1105536 - protein, 7 aa, Mycobacterium
ATSPGGV

SEQ ID NO: 1105537 - protein, 6 aa, Mycobacterium
ATSPGV

SEQ ID NO: 1105538 - protein, 13 aa, Mycobacterium
ATSPWVGATAWAR

SEQ ID NO: 1105539 - protein, 5 aa, Mycobacterium
ATSRR

SEQ ID NO: 1105540 - protein, 9 aa, Mycobacterium
ATSSVDTRT

SEQ ID NO: 1105541 - protein, 12 aa, Mycobacterium
ATSTTINDRQQA

SEQ ID NO: 1105542 - protein, 8 aa, Mycobacterium
ATTAEETR

SEQ ID NO: 1105543 - protein, 9 aa, Mycobacterium
ATTAGPAAV

SEQ ID NO: 1105544 - protein, 5 aa, Mycobacterium
ATTAL

SEQ ID NO: 1105545 - protein, 20 aa, Mycobacterium
ATTAVSARTPMTVKEVVHAG

SEQ ID NO: 1105546 - protein, 11 aa, Mycobacterium
ATTDGDRAQLT

SEQ ID NO: 1105547 - protein, 6 aa, Mycobacterium
ATTETA

SEQ ID NO: 1105548 - protein, 13 aa, Mycobacterium
ATTLSGAEFPGRP

SEQ ID NO: 1105549 - protein, 4 aa, Mycobacterium
ATTP

SEQ ID NO: 1105550 - protein, 7 aa, Mycobacterium
ATTPENM

SEQ ID NO: 1105551 - protein, 8 aa, Mycobacterium
ATTPFPGT

SEQ ID NO: 1105552 - protein, 6 aa, Mycobacterium
ATTPGR

SEQ ID NO: 1105553 - protein, 7 aa, Mycobacterium
ATTPGRP

SEQ ID NO: 1105554 - protein, 6 aa, Mycobacterium
ATTSAE

SEQ ID NO: 1105555 - protein, 20 aa, Mycobacterium
ATTSRTRKDKDAAGARTPPL

SEQ ID NO: 1105556 - protein, 7 aa, Mycobacterium
ATTYGSE

SEQ ID NO: 1105557 - protein, 8 aa, Mycobacterium
ATVDGSES

SEQ ID NO: 1105558 - protein, 9 aa, Mycobacterium
ATVEDAGSS

SEQ ID NO: 1105559 - protein, 7 aa, Mycobacterium
ATVGGGA

SEQ ID NO: 1105560 - protein, 6 aa, Mycobacterium
ATVGRQ

SEQ ID NO: 1105561 - protein, 6 aa, Mycobacterium
ATVGTL

SEQ ID NO: 1105562 - protein, 13 aa, Mycobacterium
ATVPDAKDVARSS

SEQ ID NO: 1105563 - protein, 5 aa, Mycobacterium
ATVPR

SEQ ID NO: 1105564 - protein, 18 aa, Mycobacterium
ATVPTRRVTAADEAVDVT

SEQ ID NO: 1105565 - protein, 18 aa, Mycobacterium
ATVSSNATGRGGRPASTR

SEQ ID NO: 1105566 - protein, 15 aa, Mycobacterium
ATYNEEQLDHGSQET

SEQ ID NO: 1105567 - protein, 7 aa, Mycobacterium
ATYSDKY

SEQ ID NO: 1105568 - protein, 7 aa, Mycobacterium
AVAAPTG

SEQ ID NO: 1105569 - protein, 15 aa, Mycobacterium
AVADADGVSIGDGRE

SEQ ID NO: 1105570 - protein, 23 aa, Mycobacterium
AVAEGNSRKDDLAKLTGGADQLA

SEQ ID NO: 1105571 - protein, 24 aa, Mycobacterium
AVAEGNSRKDDLTKLTDGADQLAD

SEQ ID NO: 1105572 - protein, 10 aa, Mycobacterium
AVAEGRAREH

SEQ ID NO: 1105573 - protein, 13 aa, Mycobacterium
AVAGTASRQYDDE

SEQ ID NO: 1105574 - protein, 8 aa, Mycobacterium
AVAGTQPG

SEQ ID NO: 1105575 - protein, 8 aa, Mycobacterium
AVAPSTTA

SEQ ID NO: 1105576 - protein, 9 aa, Mycobacterium
AVASSTALR

SEQ ID NO: 1105577 - protein, 12 aa, Mycobacterium
AVDDDEAAPIGP

SEQ ID NO: 1105578 - protein, 5 aa, Mycobacterium
AVEES

SEQ ID NO: 1105579 - protein, 9 aa, Mycobacterium
AVESSSEHP

SEQ ID NO: 1105580 - protein, 5 aa, Mycobacterium
AVGAP

SEQ ID NO: 1105581 - protein, 4 aa, Mycobacterium
AVGG

SEQ ID NO: 1105582 - protein, 6 aa, Mycobacterium
AVGGGA

SEQ ID NO: 1105583 - protein, 6 aa, Mycobacterium
AVGPPQ

SEQ ID NO: 1105584 - protein, 18 aa, Mycobacterium
AVGPPRAARADPKSAIAT

SEQ ID NO: 1105585 - protein, 7 aa, Mycobacterium
AVGQGKS

SEQ ID NO: 1105586 - protein, 12 aa, Mycobacterium
AVGRRADAAGLD

SEQ ID NO: 1105587 - protein, 6 aa, Mycobacterium
AVGSAT

SEQ ID NO: 1105588 - protein, 5 aa, Mycobacterium
AVGSS

SEQ ID NO: 1105589 - protein, 4 aa, Mycobacterium
AVGT

SEQ ID NO: 1105590 - protein, 11 aa, Mycobacterium
AVNQDGRSNGL

SEQ ID NO: 1105591 - protein, 27 aa, Mycobacterium
AVPAPAAPVAPAPPAPAGPLGALFRAL

SEQ ID NO: 1105592 - protein, 4 aa, Mycobacterium
AVPG

SEQ ID NO: 1105593 - protein, 5 aa, Mycobacterium
AVPGV

SEQ ID NO: 1105594 - protein, 5 aa, Mycobacterium
AVPKP

SEQ ID NO: 1105595 - protein, 6 aa, Mycobacterium
AVPKPS

SEQ ID NO: 1105596 - protein, 7 aa, Mycobacterium
AVPPDTH

SEQ ID NO: 1105597 - protein, 7 aa, Mycobacterium
AVPTGNN

SEQ ID NO: 1105598 - protein, 10 aa, Mycobacterium
AVRAEGPTPL

SEQ ID NO: 1105599 - protein, 7 aa, Mycobacterium
AVRQVPE

SEQ ID NO: 1105600 - protein, 6 aa, Mycobacterium
AVRRTS

SEQ ID NO: 1105601 - protein, 14 aa, Mycobacterium
AVRSPQIPAGSGNT

SEQ ID NO: 1105602 - protein, 8 aa, Mycobacterium
AVRSTTDR

SEQ ID NO: 1105603 - protein, 8 aa, Mycobacterium
AVRTEADA

SEQ ID NO: 1105604 - protein, 9 aa, Mycobacterium
AVRTEADAR

SEQ ID NO: 1105605 - protein, 9 aa, Mycobacterium
AVSAPTGTF

SEQ ID NO: 1105606 - protein, 10 aa, Mycobacterium
AVSGSKTAMI

SEQ ID NO: 1105607 - protein, 12 aa, Mycobacterium
AVSTTSTTITAH

SEQ ID NO: 1105608 - protein, 5 aa, Mycobacterium
AVTGG

SEQ ID NO: 1105609 - protein, 7 aa, Mycobacterium
AVTGRGR

SEQ ID NO: 1105610 - protein, 13 aa, Mycobacterium
AVTGTGLTGHRDG

SEQ ID NO: 1105611 - protein, 4 aa, Mycobacterium
AVTP

SEQ ID NO: 1105612 - protein, 6 aa, Mycobacterium
AVTPDQ

SEQ ID NO: 1105613 - protein, 8 aa, Mycobacterium
AVTPRASD

SEQ ID NO: 1105614 - protein, 45 aa, Mycobacterium
AWAAPTPEPPPEPTPEPEPETETEPEPLSEPESDADLDTDPGISR

SEQ ID NO: 1105615 - protein, 7 aa, Mycobacterium
AWRQSGE

SEQ ID NO: 1105616 - protein, 29 aa, Mycobacterium
AWTTDAAEPQIAARRSGPVPADEQASMTL

SEQ ID NO: 1105617 - protein, 13 aa, Mycobacterium
AYADELPRPPAQP

SEQ ID NO: 1105618 - protein, 8 aa, Mycobacterium
AYDPAADT

SEQ ID NO: 1105619 - protein, 13 aa, Mycobacterium
AYEPNREPDPPAG

SEQ ID NO: 1105620 - protein, 12 aa, Mycobacterium
AYESIGGNGRSV

SEQ ID NO: 1105621 - protein, 8 aa, Mycobacterium
AYKKDRYS

SEQ ID NO: 1105622 - protein, 12 aa, Mycobacterium
AYPPEGGFPDRG

SEQ ID NO: 1105623 - protein, 19 aa, Mycobacterium
AYPPPPDAPRGFGSEYNGP

SEQ ID NO: 1105624 - protein, 13 aa, Mycobacterium
AYPRPQEVDDEPS

SEQ ID NO: 1105625 - protein, 11 aa, Mycobacterium
AYPVTHPDGTC

SEQ ID NO: 1105626 - protein, 8 aa, Mycobacterium
AYSGESTH

SEQ ID NO: 1105627 - protein, 10 aa, Mycobacterium
AYSGPSMAPG

SEQ ID NO: 1105628 - protein, 10 aa, Mycobacterium
AYSPAGDPDG

SEQ ID NO: 1105629 - protein, 5 aa, Mycobacterium
AYSQQ

SEQ ID NO: 1105630 - protein, 20 aa, Mycobacterium
AYSRSSPSRSPRWRGAAVNG

SEQ ID NO: 1105631 - protein, 6 aa, Mycobacterium
AYSTSP

SEQ ID NO: 1105632 - protein, 8 aa, Mycobacterium
AYTGGPVM

SEQ ID NO: 1105633 - protein, 6 aa, Mycobacterium
AYTGGT

SEQ ID NO: 1105634 - protein, 25 aa, Mycobacterium
AYVPPPPPANYLPPAPAAPAYVPPA

SEQ ID NO: 1105635 - protein, 9 aa, Mycobacterium
CAAPATPRQ

SEQ ID NO: 1105636 - protein, 8 aa, Mycobacterium
CADGRGMR

SEQ ID NO: 1105637 - protein, 10 aa, Mycobacterium
CAQSPTGTRC

SEQ ID NO: 1105638 - protein, 4 aa, Mycobacterium
CDAA

SEQ ID NO: 1105639 - protein, 7 aa, Mycobacterium
CDGQTRM

SEQ ID NO: 1105640 - protein, 6 aa, Mycobacterium
CDPQDP

SEQ ID NO: 1105641 - protein, 7 aa, Mycobacterium
CDQPHAG

SEQ ID NO: 1105642 - protein, 8 aa, Mycobacterium
CEAGNKGM

SEQ ID NO: 1105643 - protein, 17 aa, Mycobacterium
CGPDTPRACPDGTLFDD

SEQ ID NO: 1105644 - protein, 5 aa, Mycobacterium
CGRTA

SEQ ID NO: 1105645 - protein, 12 aa, Mycobacterium
CGSPGGGWSYAP

SEQ ID NO: 1105646 - protein, 21 aa, Mycobacterium
CGTGGESPAPAEHPTSAGEDE

SEQ ID NO: 1105647 - protein, 18 aa, Mycobacterium
CHPGSVAPRTAKKTDSRL

SEQ ID NO: 1105648 - protein, 5 aa, Mycobacterium
CLESS

SEQ ID NO: 1105649 - protein, 23 aa, Mycobacterium
CNPPPAPTEPGAPVPDLGEQVSR

SEQ ID NO: 1105650 - protein, 8 aa, Mycobacterium
CNTETDPN

SEQ ID NO: 1105651 - protein, 14 aa, Mycobacterium
CPGGNTEASTSARI

SEQ ID NO: 1105652 - protein, 11 aa, Mycobacterium
CPNPSWASPTR

SEQ ID NO: 1105653 - protein, 7 aa, Mycobacterium
CPQGTNE

SEQ ID NO: 1105654 - protein, 9 aa, Mycobacterium
CQTGKDANE

SEQ ID NO: 1105655 - protein, 16 aa, Mycobacterium
CRAAKERLSGETATAV

SEQ ID NO: 1105656 - protein, 5 aa, Mycobacterium
CREGG

SEQ ID NO: 1105657 - protein, 7 aa, Mycobacterium
CRRRSAR

SEQ ID NO: 1105658 - protein, 6 aa, Mycobacterium
CSAASA

SEQ ID NO: 1105659 - protein, 7 aa, Mycobacterium
CSADTRM

SEQ ID NO: 1105660 - protein, 16 aa, Mycobacterium
CSPELQRYSPESMTDD

SEQ ID NO: 1105661 - protein, 30 aa, Mycobacterium
CSPGRAAALNAGGIAAEANAAQAAGGSYAD

SEQ ID NO: 1105662 - protein, 13 aa, Mycobacterium
CSSDDDQAARHEP

SEQ ID NO: 1105663 - protein, 8 aa, Mycobacterium
CSSGTHRV

SEQ ID NO: 1105664 - protein, 7 aa, Mycobacterium
CTGKTDP

SEQ ID NO: 1105665 - protein, 12 aa, Mycobacterium
CTGRPRQRPRGL

SEQ ID NO: 1105666 - protein, 24 aa, Mycobacterium
CTLTPTTAGLDAQASDSDPGSKYR

SEQ ID NO: 1105667 - protein, 14 aa, Mycobacterium
CTPTDVSGGPSDPG

SEQ ID NO: 1105668 - protein, 8 aa, Mycobacterium
DAAANGHE

SEQ ID NO: 1105669 - protein, 8 aa, Mycobacterium
DAAEPNQA

SEQ ID NO: 1105670 - protein, 8 aa, Mycobacterium
DAAERSYQ

SEQ ID NO: 1105671 - protein, 6 aa, Mycobacterium
DAAGAS

SEQ ID NO: 1105672 - protein, 9 aa, Mycobacterium
DAAGGALDG

SEQ ID NO: 1105673 - protein, 8 aa, Mycobacterium
DAAGIRPP

SEQ ID NO: 1105674 - protein, 8 aa, Mycobacterium
DAAKAGRA

SEQ ID NO: 1105675 - protein, 9 aa, Mycobacterium
DAAKNDDSF

SEQ ID NO: 1105676 - protein, 7 aa, Mycobacterium
DAANAVA

SEQ ID NO: 1105677 - protein, 9 aa, Mycobacterium
DAAPLTPAD

SEQ ID NO: 1105678 - protein, 6 aa, Mycobacterium
DAAPYA

SEQ ID NO: 1105679 - protein, 16 aa, Mycobacterium
DAAQLSSLADETPEGR

SEQ ID NO: 1105680 - protein, 11 aa, Mycobacterium
DAAQRKGPSVN

SEQ ID NO: 1105681 - protein, 9 aa, Mycobacterium
DAARSGRLT

SEQ ID NO: 1105682 - protein, 13 aa, Mycobacterium
DAARTRDHGGSGL

SEQ ID NO: 1105683 - protein, 9 aa, Mycobacterium
DAASREHGR

SEQ ID NO: 1105684 - protein, 5 aa, Mycobacterium
DAAVD

SEQ ID NO: 1105685 - protein, 9 aa, Mycobacterium
DADDPQERA

SEQ ID NO: 1105686 - protein, 9 aa, Mycobacterium
DADGEEDSA

SEQ ID NO: 1105687 - protein, 9 aa, Mycobacterium
DADGQEDTA

SEQ ID NO: 1105688 - protein, 10 aa, Mycobacterium
DADGRAHPGI

SEQ ID NO: 1105689 - protein, 9 aa, Mycobacterium
DADPESARK

SEQ ID NO: 1105690 - protein, 9 aa, Mycobacterium
DADQPGQYR

SEQ ID NO: 1105691 - protein, 13 aa, Mycobacterium
DADRIKMSKVDFL

SEQ ID NO: 1105692 - protein, 8 aa, Mycobacterium
DADRTRRL

SEQ ID NO: 1105693 - protein, 18 aa, Mycobacterium
DADTADPAGTAGTAAVGP

SEQ ID NO: 1105694 - protein, 9 aa, Mycobacterium
DADTARRAA

SEQ ID NO: 1105695 - protein, 9 aa, Mycobacterium
DAEEAAQAL

SEQ ID NO: 1105696 - protein, 7 aa, Mycobacterium
DAEEQLR

SEQ ID NO: 1105697 - protein, 4 aa, Mycobacterium
DAER

SEQ ID NO: 1105698 - protein, 6 aa, Mycobacterium
DAERRA

SEQ ID NO: 1105699 - protein, 13 aa, Mycobacterium
DAETADALGADAD

SEQ ID NO: 1105700 - protein, 5 aa, Mycobacterium
DAFGQ

SEQ ID NO: 1105701 - protein, 5 aa, Mycobacterium
DAGDV

SEQ ID NO: 1105702 - protein, 4 aa, Mycobacterium
DAGE

SEQ ID NO: 1105703 - protein, 9 aa, Mycobacterium
DAGEQAGEQ

SEQ ID NO: 1105704 - protein, 22 aa, Mycobacterium
DAGESDDAEPARAVESNGENPA

SEQ ID NO: 1105705 - protein, 4 aa, Mycobacterium
DAGF

SEQ ID NO: 1105706 - protein, 12 aa, Mycobacterium
DAGLPDTATVSE

SEQ ID NO: 1105707 - protein, 7 aa, Mycobacterium
DAGPRRV

SEQ ID NO: 1105708 - protein, 5 aa, Mycobacterium
DAGRY

SEQ ID NO: 1105709 - protein, 6 aa, Mycobacterium
DAGSYI

SEQ ID NO: 1105710 - protein, 12 aa, Mycobacterium
DAHAARSHGHRG

SEQ ID NO: 1105711 - protein, 10 aa, Mycobacterium
DAHGGTVHTQ

SEQ ID NO: 1105712 - protein, 4 aa, Mycobacterium
DAHH

SEQ ID NO: 1105713 - protein, 11 aa, Mycobacterium
DAIPETPAQRR

SEQ ID NO: 1105714 - protein, 9 aa, Mycobacterium
DAKPAGGGY

SEQ ID NO: 1105715 - protein, 19 aa, Mycobacterium
DAKSSLEQARDSAQQAKDA

SEQ ID NO: 1105716 - protein, 17 aa, Mycobacterium
DAKTPDDDRHGQSEKPD

SEQ ID NO: 1105717 - protein, 6 aa, Mycobacterium
DALDPK

SEQ ID NO: 1105718 - protein, 8 aa, Mycobacterium
DALGGDTR

SEQ ID NO: 1105719 - protein, 7 aa, Mycobacterium
DALGQQN

SEQ ID NO: 1105720 - protein, 8 aa, Mycobacterium
DALSGSLS

SEQ ID NO: 1105721 - protein, 4 aa, Mycobacterium
DALT

SEQ ID NO: 1105722 - protein, 5 aa, Mycobacterium
DANRR

SEQ ID NO: 1105723 - protein, 12 aa, Mycobacterium
DANYSGEEDVNG

SEQ ID NO: 1105724 - protein, 10 aa, Mycobacterium
DAPEKKRTRK

SEQ ID NO: 1105725 - protein, 4 aa, Mycobacterium
DAPG

SEQ ID NO: 1105726 - protein, 12 aa, Mycobacterium
DAPGAETISDEF

SEQ ID NO: 1105727 - protein, 16 aa, Mycobacterium
DAPGQTGAPGQPTDAE

SEQ ID NO: 1105728 - protein, 7 aa, Mycobacterium
DAPGYEG

SEQ ID NO: 1105729 - protein, 4 aa, Mycobacterium
DAPL

SEQ ID NO: 1105730 - protein, 10 aa, Mycobacterium
DAPPEFERPA

SEQ ID NO: 1105731 - protein, 10 aa, Mycobacterium
DAPPEPETSH

SEQ ID NO: 1105732 - protein, 7 aa, Mycobacterium
DAPPGMS

SEQ ID NO: 1105733 - protein, 8 aa, Mycobacterium
DAPPPAGV

SEQ ID NO: 1105734 - protein, 12 aa, Mycobacterium
DAQNGKAQAQRL

SEQ ID NO: 1105735 - protein, 10 aa, Mycobacterium
DAQNGKASVQ

SEQ ID NO: 1105736 - protein, 11 aa, Mycobacterium
DAQNGKASVQR

SEQ ID NO: 1105737 - protein, 9 aa, Mycobacterium
DAQNSPPQG

SEQ ID NO: 1105738 - protein, 7 aa, Mycobacterium
DAQQRRR

SEQ ID NO: 1105739 - protein, 9 aa, Mycobacterium
DAQSIAPKR

SEQ ID NO: 1105740 - protein, 8 aa, Mycobacterium
DARAAREP

SEQ ID NO: 1105741 - protein, 9 aa, Mycobacterium
DARAGGPTR

SEQ ID NO: 1105742 - protein, 7 aa, Mycobacterium
DARATTR

SEQ ID NO: 1105743 - protein, 9 aa, Mycobacterium
DARDELSWG

SEQ ID NO: 1105744 - protein, 9 aa, Mycobacterium
DARNTDNSG

SEQ ID NO: 1105745 - protein, 15 aa, Mycobacterium
DARPTGEERSDRGMG

SEQ ID NO: 1105746 - protein, 16 aa, Mycobacterium
DARQGAVTSAQTERHR

SEQ ID NO: 1105747 - protein, 8 aa, Mycobacterium
DARRQITR

SEQ ID NO: 1105748 - protein, 5 aa, Mycobacterium
DARRR

SEQ ID NO: 1105749 - protein, 4 aa, Mycobacterium
DARS

SEQ ID NO: 1105750 - protein, 12 aa, Mycobacterium
DARVERGPDPEV

SEQ ID NO: 1105751 - protein, 7 aa, Mycobacterium
DASEPRD

SEQ ID NO: 1105752 - protein, 7 aa, Mycobacterium
DASETQL

SEQ ID NO: 1105753 - protein, 6 aa, Mycobacterium
DASHDP

SEQ ID NO: 1105754 - protein, 7 aa, Mycobacterium
DASPGLT

SEQ ID NO: 1105755 - protein, 15 aa, Mycobacterium
DASRTDDDRSRRRLI

SEQ ID NO: 1105756 - protein, 5 aa, Mycobacterium
DASTG

SEQ ID NO: 1105757 - protein, 11 aa, Mycobacterium
DATAPDGTDQW

SEQ ID NO: 1105758 - protein, 6 aa, Mycobacterium
DATAQV

SEQ ID NO: 1105759 - protein, 8 aa, Mycobacterium
DATARAAP

SEQ ID NO: 1105760 - protein, 5 aa, Mycobacterium
DATAS

SEQ ID NO: 1105761 - protein, 16 aa, Mycobacterium
DATASGSGVSGHGADL

SEQ ID NO: 1105762 - protein, 7 aa, Mycobacterium
DATIGAR

SEQ ID NO: 1105763 - protein, 6 aa, Mycobacterium
DATISS

SEQ ID NO: 1105764 - protein, 7 aa, Mycobacterium
DATMPDR

SEQ ID NO: 1105765 - protein, 18 aa, Mycobacterium
DATQPADAELLTKAHTGT

SEQ ID NO: 1105766 - protein, 8 aa, Mycobacterium
DATRAGLP

SEQ ID NO: 1105767 - protein, 4 aa, Mycobacterium
DATT

SEQ ID NO: 1105768 - protein, 5 aa, Mycobacterium
DATTD

SEQ ID NO: 1105769 - protein, 12 aa, Mycobacterium
DAVDGAAGGLAA

SEQ ID NO: 1105770 - protein, 18 aa, Mycobacterium
DAVEEAGRGVTASLDGRR

SEQ ID NO: 1105771 - protein, 17 aa, Mycobacterium
DAVEPGGSDEDDAATTA

SEQ ID NO: 1105772 - protein, 11 aa, Mycobacterium
DAVGGATESER

SEQ ID NO: 1105773 - protein, 6 aa, Mycobacterium
DAVRAS

SEQ ID NO: 1105774 - protein, 8 aa, Mycobacterium
DCGSPPMN

SEQ ID NO: 1105775 - protein, 8 aa, Mycobacterium
DCPQYGEL

SEQ ID NO: 1105776 - protein, 8 aa, Mycobacterium
DDAAARQH

SEQ ID NO: 1105777 - protein, 12 aa, Mycobacterium
DDADDNVVAPQN

SEQ ID NO: 1105778 - protein, 7 aa, Mycobacterium
DDADTEA

SEQ ID NO: 1105779 - protein, 9 aa, Mycobacterium
DDAEVSSPY

SEQ ID NO: 1105780 - protein, 19 aa, Mycobacterium
DDALDDPDAFEKEPELAKA

SEQ ID NO: 1105781 - protein, 8 aa, Mycobacterium
DDAPDGGT

SEQ ID NO: 1105782 - protein, 31 aa, Mycobacterium
DDAPPPAPGADARAETDRGPAPQTPTGDGGG

SEQ ID NO: 1105783 - protein, 11 aa, Mycobacterium
DDDADSQATAT

SEQ ID NO: 1105784 - protein, 25 aa, Mycobacterium
DDDAGLDEDGVEGADRRRQQMDTGG

SEQ ID NO: 1105785 - protein, 13 aa, Mycobacterium
DDDAVAEDERPLR

SEQ ID NO: 1105786 - protein, 4 aa, Mycobacterium
DDDE

SEQ ID NO: 1105787 - protein, 56 aa, Mycobacterium
DDDEPERPSWPNPWQPKPQTPPKQDDDYWPQRPTVPTVPQAPKPVVPQAPQTPYVP

SEQ ID NO: 1105788 - protein, 7 aa, Mycobacterium
DDDEYYY

SEQ ID NO: 1105789 - protein, 13 aa, Mycobacterium
DDDLEAAGKTVRN

SEQ ID NO: 1105790 - protein, 6 aa, Mycobacterium
DDDLSP

SEQ ID NO: 1105791 - protein, 8 aa, Mycobacterium
DDDRETTL

SEQ ID NO: 1105792 - protein, 6 aa, Mycobacterium
DDEGTY

SEQ ID NO: 1105793 - protein, 11 aa, Mycobacterium
DDEHDTDAEAD

SEQ ID NO: 1105794 - protein, 7 aa, Mycobacterium
DDELTAR

SEQ ID NO: 1105795 - protein, 30 aa, Mycobacterium
DDERTTADPDERPAADPGKRRAGTPAGGDD

SEQ ID NO: 1105796 - protein, 8 aa, Mycobacterium
DDESAAAL

SEQ ID NO: 1105797 - protein, 6 aa, Mycobacterium
DDFDGT

SEQ ID NO: 1105798 - protein, 9 aa, Mycobacterium
DDGAEAAAP

SEQ ID NO: 1105799 - protein, 5 aa, Mycobacterium
DDGAG

SEQ ID NO: 1105800 - protein, 6 aa, Mycobacterium
DDGGVP

SEQ ID NO: 1105801 - protein, 4 aa, Mycobacterium
DDGI

SEQ ID NO: 1105802 - protein, 14 aa, Mycobacterium
DDGIDSPRARDVGT

SEQ ID NO: 1105803 - protein, 5 aa, Mycobacterium
DDGLR

SEQ ID NO: 1105804 - protein, 8 aa, Mycobacterium
DDGSRSEI

SEQ ID NO: 1105805 - protein, 20 aa, Mycobacterium
DDHAEEPSDEAQQRSSPGPI

SEQ ID NO: 1105806 - protein, 6 aa, Mycobacterium
DDIGET

SEQ ID NO: 1105807 - protein, 8 aa, Mycobacterium
DDIPVSTT

SEQ ID NO: 1105808 - protein, 11 aa, Mycobacterium
DDKPTAGESRA

SEQ ID NO: 1105809 - protein, 7 aa, Mycobacterium
DDKVGAA

SEQ ID NO: 1105810 - protein, 5 aa, Mycobacterium
DDLGA

SEQ ID NO: 1105811 - protein, 5 aa, Mycobacterium
DDLGG

SEQ ID NO: 1105812 - protein, 9 aa, Mycobacterium
DDMATSAWT

SEQ ID NO: 1105813 - protein, 12 aa, Mycobacterium
DDNGSGVPEEER

SEQ ID NO: 1105814 - protein, 8 aa, Mycobacterium
DDNNSGGR

SEQ ID NO: 1105815 - protein, 19 aa, Mycobacterium
DDNSADGANSPAARAVGTD

SEQ ID NO: 1105816 - protein, 8 aa, Mycobacterium
DDPAETMT

SEQ ID NO: 1105817 - protein, 9 aa, Mycobacterium
DDPASAALS

SEQ ID NO: 1105818 - protein, 7 aa, Mycobacterium
DDPEDPA

SEQ ID NO: 1105819 - protein, 11 aa, Mycobacterium
DDPELTAGPGR

SEQ ID NO: 1105820 - protein, 8 aa, Mycobacterium
DDPETEHV

SEQ ID NO: 1105821 - protein, 8 aa, Mycobacterium
DDPFNETV

SEQ ID NO: 1105822 - protein, 10 aa, Mycobacterium
DDPGGTGVGD

SEQ ID NO: 1105823 - protein, 9 aa, Mycobacterium
DDPSSSLRT

SEQ ID NO: 1105824 - protein, 9 aa, Mycobacterium
DDPTPCSPA

SEQ ID NO: 1105825 - protein, 9 aa, Mycobacterium
DDPTRPARN

SEQ ID NO: 1105826 - protein, 6 aa, Mycobacterium
DDPYHY

SEQ ID NO: 1105827 - protein, 10 aa, Mycobacterium
DDQARAQPLG

SEQ ID NO: 1105828 - protein, 8 aa, Mycobacterium
DDQGPGPA

SEQ ID NO: 1105829 - protein, 8 aa, Mycobacterium
DDQVKVGG

SEQ ID NO: 1105830 - protein, 9 aa, Mycobacterium
DDRDGTAAA

SEQ ID NO: 1105831 - protein, 13 aa, Mycobacterium
DDRDHDAGAGPRF

SEQ ID NO: 1105832 - protein, 15 aa, Mycobacterium
DDRKGQPATTASNQG

SEQ ID NO: 1105833 - protein, 13 aa, Mycobacterium
DDRKGQPDTTASN

SEQ ID NO: 1105834 - protein, 16 aa, Mycobacterium
DDRQGQPAATDSNQGY

SEQ ID NO: 1105835 - protein, 6 aa, Mycobacterium
DDRTEV

SEQ ID NO: 1105836 - protein, 5 aa, Mycobacterium
DDRVG

SEQ ID NO: 1105837 - protein, 21 aa, Mycobacterium
DDSGYETYPTGAEPEQQTSPV

SEQ ID NO: 1105838 - protein, 5 aa, Mycobacterium
DDSHH

SEQ ID NO: 1105839 - protein, 5 aa, Mycobacterium
DDSLA

SEQ ID NO: 1105840 - protein, 4 aa, Mycobacterium
DDST

SEQ ID NO: 1105841 - protein, 23 aa, Mycobacterium
DDTAAGPLSGEAKERWRGVEDGR

SEQ ID NO: 1105842 - protein, 8 aa, Mycobacterium
DDTAESDD

SEQ ID NO: 1105843 - protein, 6 aa, Mycobacterium
DDTAPP

SEQ ID NO: 1105844 - protein, 7 aa, Mycobacterium
DDTGVGI

SEQ ID NO: 1105845 - protein, 8 aa, Mycobacterium
DDTRAGRV

SEQ ID NO: 1105846 - protein, 8 aa, Mycobacterium
DDTVNATN

SEQ ID NO: 1105847 - protein, 8 aa, Mycobacterium
DDTWRRTP

SEQ ID NO: 1105848 - protein, 70 aa, Mycobacterium
DDVDDETDDVAAESDDAESVDDGTEDEYEYVPDSSGIETPADDERAEPAGDALGAARRRRYESKTAEAVS

SEQ ID NO: 1105849 - protein, 7 aa, Mycobacterium
DDVGSTT

SEQ ID NO: 1105850 - protein, 9 aa, Mycobacterium
DDVNAKQEA

SEQ ID NO: 1105851 - protein, 7 aa, Mycobacterium
DDVPPAV

SEQ ID NO: 1105852 - protein, 6 aa, Mycobacterium
DDVRDE

SEQ ID NO: 1105853 - protein, 9 aa, Mycobacterium
DDVSAAREI

SEQ ID NO: 1105854 - protein, 9 aa, Mycobacterium
DDYEPYEPL

SEQ ID NO: 1105855 - protein, 5 aa, Mycobacterium
DDYPD

SEQ ID NO: 1105856 - protein, 7 aa, Mycobacterium
DEAAPAL

SEQ ID NO: 1105857 - protein, 9 aa, Mycobacterium
DEAEAADRT

SEQ ID NO: 1105858 - protein, 17 aa, Mycobacterium
DEAEKIDGDRTVTVPPA

SEQ ID NO: 1105859 - protein, 12 aa, Mycobacterium
DEAGQRRIVGAV

SEQ ID NO: 1105860 - protein, 7 aa, Mycobacterium
DEARRGF

SEQ ID NO: 1105861 - protein, 6 aa, Mycobacterium
DEAYDD

SEQ ID NO: 1105862 - protein, 8 aa, Mycobacterium
DEDDPAAK

SEQ ID NO: 1105863 - protein, 8 aa, Mycobacterium
DEDGDPTV

SEQ ID NO: 1105864 - protein, 5 aa, Mycobacterium
DEDPA

SEQ ID NO: 1105865 - protein, 7 aa, Mycobacterium
DEDPDVE

SEQ ID NO: 1105866 - protein, 6 aa, Mycobacterium
DEDPVV

SEQ ID NO: 1105867 - protein, 8 aa, Mycobacterium
DEDTAGRV

SEQ ID NO: 1105868 - protein, 8 aa, Mycobacterium
DEEGEEVP

SEQ ID NO: 1105869 - protein, 6 aa, Mycobacterium
DEELQQ

SEQ ID NO: 1105870 - protein, 6 aa, Mycobacterium
DEENGL

SEQ ID NO: 1105871 - protein, 15 aa, Mycobacterium
DEENGPFVEDEENGH

SEQ ID NO: 1105872 - protein, 5 aa, Mycobacterium
DEEQD

SEQ ID NO: 1105873 - protein, 5 aa, Mycobacterium
DEFPD

SEQ ID NO: 1105874 - protein, 7 aa, Mycobacterium
DEGAVQT

SEQ ID NO: 1105875 - protein, 8 aa, Mycobacterium
DEGDEVRE

SEQ ID NO: 1105876 - protein, 19 aa, Mycobacterium
DEGPGRAPESRNSTFSAAD

SEQ ID NO: 1105877 - protein, 12 aa, Mycobacterium
DEGPGVARGAET

SEQ ID NO: 1105878 - protein, 11 aa, Mycobacterium
DEGQDRQTTEV

SEQ ID NO: 1105879 - protein, 4 aa, Mycobacterium
DEGR

SEQ ID NO: 1105880 - protein, 10 aa, Mycobacterium
DEGTCNPTNE

SEQ ID NO: 1105881 - protein, 10 aa, Mycobacterium
DEHDVEPPDV

SEQ ID NO: 1105882 - protein, 7 aa, Mycobacterium
DEHGAKT

SEQ ID NO: 1105883 - protein, 6 aa, Mycobacterium
DEHKQW

SEQ ID NO: 1105884 - protein, 4 aa, Mycobacterium
DEHQ

SEQ ID NO: 1105885 - protein, 5 aa, Mycobacterium
DEHTD

SEQ ID NO: 1105886 - protein, 6 aa, Mycobacterium
DEHTGV

SEQ ID NO: 1105887 - protein, 27 aa, Mycobacterium
DEIDRRDESLEDASAGESEGAVQSSRR

SEQ ID NO: 1105888 - protein, 11 aa, Mycobacterium
DEKRLRQSTEQ

SEQ ID NO: 1105889 - protein, 27 aa, Mycobacterium
DELDDAPEDRDEAVAEGAERDTAEDTG

SEQ ID NO: 1105890 - protein, 22 aa, Mycobacterium
DELDDGAERAADWTDDDARERI

SEQ ID NO: 1105891 - protein, 11 aa, Mycobacterium
DELDDGSEREC

SEQ ID NO: 1105892 - protein, 8 aa, Mycobacterium
DELGGGAS

SEQ ID NO: 1105893 - protein, 7 aa, Mycobacterium
DELGRSG

SEQ ID NO: 1105894 - protein, 11 aa, Mycobacterium
DELGSASEAGI

SEQ ID NO: 1105895 - protein, 11 aa, Mycobacterium
DELPGLRAGTG

SEQ ID NO: 1105896 - protein, 6 aa, Mycobacterium
DENKDA

SEQ ID NO: 1105897 - protein, 4 aa, Mycobacterium
DENN

SEQ ID NO: 1105898 - protein, 11 aa, Mycobacterium
DEPADLARGAT

SEQ ID NO: 1105899 - protein, 10 aa, Mycobacterium
DEPGPVSAGT

SEQ ID NO: 1105900 - protein, 5 aa, Mycobacterium
DEPLD

SEQ ID NO: 1105901 - protein, 23 aa, Mycobacterium
DEPSWPGPLPPPVASYQPTDQGV

SEQ ID NO: 1105902 - protein, 17 aa, Mycobacterium
DEPTSESESPQPPPLPA

SEQ ID NO: 1105903 - protein, 11 aa, Mycobacterium
DEPVTVQGDEA

SEQ ID NO: 1105904 - protein, 7 aa, Mycobacterium
DEQDKDV

SEQ ID NO: 1105905 - protein, 5 aa, Mycobacterium
DEQDN

SEQ ID NO: 1105906 - protein, 29 aa, Mycobacterium
DERESELGRRDPTVNRGKEVPNKPGHGLS

SEQ ID NO: 1105907 - protein, 4 aa, Mycobacterium
DERG

SEQ ID NO: 1105908 - protein, 7 aa, Mycobacterium
DERKGDV

SEQ ID NO: 1105909 - protein, 4 aa, Mycobacterium
DERR

SEQ ID NO: 1105910 - protein, 6 aa, Mycobacterium
DERTAR

SEQ ID NO: 1105911 - protein, 9 aa, Mycobacterium
DERVKERNR

SEQ ID NO: 1105912 - protein, 5 aa, Mycobacterium
DESGQ

SEQ ID NO: 1105913 - protein, 24 aa, Mycobacterium
DETPAAPPTPQVANPHPAAGTSVP

SEQ ID NO: 1105914 - protein, 7 aa, Mycobacterium
DETQARA

SEQ ID NO: 1105915 - protein, 7 aa, Mycobacterium
DEVAEAA

SEQ ID NO: 1105916 - protein, 12 aa, Mycobacterium
DEVGKRPQPRGP

SEQ ID NO: 1105917 - protein, 22 aa, Mycobacterium
DEVKDERTAEGLNAATYCLVKA

SEQ ID NO: 1105918 - protein, 11 aa, Mycobacterium
DEVPPSTRWQG

SEQ ID NO: 1105919 - protein, 6 aa, Mycobacterium
DEYDGG

SEQ ID NO: 1105920 - protein, 7 aa, Mycobacterium
DEYNTSS

SEQ ID NO: 1105921 - protein, 9 aa, Mycobacterium
DFAGTGAAI

SEQ ID NO: 1105922 - protein, 7 aa, Mycobacterium
DFGEARR

SEQ ID NO: 1105923 - protein, 8 aa, Mycobacterium
DFNSTPDM

SEQ ID NO: 1105924 - protein, 5 aa, Mycobacterium
DFPEP

SEQ ID NO: 1105925 - protein, 6 aa, Mycobacterium
DFPPER

SEQ ID NO: 1105926 - protein, 6 aa, Mycobacterium
DFPPGR

SEQ ID NO: 1105927 - protein, 7 aa, Mycobacterium
DFSADDR

SEQ ID NO: 1105928 - protein, 8 aa, Mycobacterium
DFSGAGAA

SEQ ID NO: 1105929 - protein, 10 aa, Mycobacterium
DFSGTGAAYG

SEQ ID NO: 1105930 - protein, 5 aa, Mycobacterium
DFSNP

SEQ ID NO: 1105931 - protein, 10 aa, Mycobacterium
DGAAAAEESR

SEQ ID NO: 1105932 - protein, 8 aa, Mycobacterium
DGAAGSTL

SEQ ID NO: 1105933 - protein, 9 aa, Mycobacterium
DGADKSGLT

SEQ ID NO: 1105934 - protein, 5 aa, Mycobacterium
DGADV

SEQ ID NO: 1105935 - protein, 6 aa, Mycobacterium
DGAEPE

SEQ ID NO: 1105936 - protein, 22 aa, Mycobacterium
DGAEPRRPAQEADTVDAAADTD

SEQ ID NO: 1105937 - protein, 7 aa, Mycobacterium
DGAGGVP

SEQ ID NO: 1105938 - protein, 10 aa, Mycobacterium
DGAGRTTTLR

SEQ ID NO: 1105939 - protein, 6 aa, Mycobacterium
DGANAS

SEQ ID NO: 1105940 - protein, 6 aa, Mycobacterium
DGANSG

SEQ ID NO: 1105941 - protein, 6 aa, Mycobacterium
DGAPAV

SEQ ID NO: 1105942 - protein, 9 aa, Mycobacterium
DGAPDAPPR

SEQ ID NO: 1105943 - protein, 5 aa, Mycobacterium
DGAQQ

SEQ ID NO: 1105944 - protein, 7 aa, Mycobacterium
DGARNHR

SEQ ID NO: 1105945 - protein, 5 aa, Mycobacterium
DGART

SEQ ID NO: 1105946 - protein, 7 aa, Mycobacterium
DGARTDL

SEQ ID NO: 1105947 - protein, 13 aa, Mycobacterium
DGAVRDDTPGEVV

SEQ ID NO: 1105948 - protein, 9 aa, Mycobacterium
DGDAQVAPA

SEQ ID NO: 1105949 - protein, 4 aa, Mycobacterium
DGDG

SEQ ID NO: 1105950 - protein, 8 aa, Mycobacterium
DGDGPAWL

SEQ ID NO: 1105951 - protein, 5 aa, Mycobacterium
DGDKQ

SEQ ID NO: 1105952 - protein, 9 aa, Mycobacterium
DGDKTAAEV

SEQ ID NO: 1105953 - protein, 10 aa, Mycobacterium
DGDSPVHRAP

SEQ ID NO: 1105954 - protein, 9 aa, Mycobacterium
DGDSTTAIG

SEQ ID NO: 1105955 - protein, 10 aa, Mycobacterium
DGDVAAHPSG

SEQ ID NO: 1105956 - protein, 8 aa, Mycobacterium
DGDVSGSA

SEQ ID NO: 1105957 - protein, 6 aa, Mycobacterium
DGDWRQ

SEQ ID NO: 1105958 - protein, 9 aa, Mycobacterium
DGEGPSASG

SEQ ID NO: 1105959 - protein, 9 aa, Mycobacterium
DGEKVGRER

SEQ ID NO: 1105960 - protein, 8 aa, Mycobacterium
DGEPETTS

SEQ ID NO: 1105961 - protein, 21 aa, Mycobacterium
DGETITVSSSTAAAGSDDSAQ

SEQ ID NO: 1105962 - protein, 6 aa, Mycobacterium
DGETVD

SEQ ID NO: 1105963 - protein, 4 aa, Mycobacterium
DGFD

SEQ ID NO: 1105964 - protein, 13 aa, Mycobacterium
DGFEVGGDGAAGA

SEQ ID NO: 1105965 - protein, 5 aa, Mycobacterium
DGFSG

SEQ ID NO: 1105966 - protein, 20 aa, Mycobacterium
DGGAAPVGAGTAADSPGDVD

SEQ ID NO: 1105967 - protein, 5 aa, Mycobacterium
DGGAP

SEQ ID NO: 1105968 - protein, 6 aa, Mycobacterium
DGGAPR

SEQ ID NO: 1105969 - protein, 5 aa, Mycobacterium
DGGFP

SEQ ID NO: 1105970 - protein, 4 aa, Mycobacterium
DGGG

SEQ ID NO: 1105971 - protein, 6 aa, Mycobacterium
DGGGII

SEQ ID NO: 1105972 - protein, 5 aa, Mycobacterium
DGGSL

SEQ ID NO: 1105973 - protein, 7 aa, Mycobacterium
DGGTRPY

SEQ ID NO: 1105974 - protein, 12 aa, Mycobacterium
DGHATSVGAASG

SEQ ID NO: 1105975 - protein, 13 aa, Mycobacterium
DGHGEGRATPPTM

SEQ ID NO: 1105976 - protein, 8 aa, Mycobacterium
DGHPVSGS

SEQ ID NO: 1105977 - protein, 31 aa, Mycobacterium
DGHSDYGQSWDSGRYAATDVEDPDYEDYEDY

SEQ ID NO: 1105978 - protein, 98 aa, Mycobacterium
DGIATTTVSQPPPPPPSSSTTTPTTASTTSPTTTTTTTTTTTTTTTTTTTRTTTTQPTTTAPPTTTQPPPPTTTAAPPPTTVDPPDPVTTTVIIPEDG

SEQ ID NO: 1105979 - protein, 16 aa, Mycobacterium
DGIGPARLDKLRALVR

SEQ ID NO: 1105980 - protein, 4 aa, Mycobacterium
DGLA

SEQ ID NO: 1105981 - protein, 6 aa, Mycobacterium
DGLPLG

SEQ ID NO: 1105982 - protein, 8 aa, Mycobacterium
DGLPQRSD

SEQ ID NO: 1105983 - protein, 12 aa, Mycobacterium
DGLSGVSGPQMG

SEQ ID NO: 1105984 - protein, 6 aa, Mycobacterium
DGLTDE

SEQ ID NO: 1105985 - protein, 11 aa, Mycobacterium
DGLTDGEVQRR

SEQ ID NO: 1105986 - protein, 10 aa, Mycobacterium
DGMTPRQAER

SEQ ID NO: 1105987 - protein, 15 aa, Mycobacterium
DGNAASAAAKEPTLE

SEQ ID NO: 1105988 - protein, 6 aa, Mycobacterium
DGNPAT

SEQ ID NO: 1105989 - protein, 20 aa, Mycobacterium
DGNPVNALQGEDGPIPISGT

SEQ ID NO: 1105990 - protein, 6 aa, Mycobacterium
DGNRVR

SEQ ID NO: 1105991 - protein, 7 aa, Mycobacterium
DGNTYPA

SEQ ID NO: 1105992 - protein, 8 aa, Mycobacterium
DGPAGATF

SEQ ID NO: 1105993 - protein, 13 aa, Mycobacterium
DGPAPALAAPEGW

SEQ ID NO: 1105994 - protein, 6 aa, Mycobacterium
DGPDAG

SEQ ID NO: 1105995 - protein, 8 aa, Mycobacterium
DGPDDEIK

SEQ ID NO: 1105996 - protein, 6 aa, Mycobacterium
DGPDVE

SEQ ID NO: 1105997 - protein, 6 aa, Mycobacterium
DGPGAA

SEQ ID NO: 1105998 - protein, 9 aa, Mycobacterium
DGPGIPDGL

SEQ ID NO: 1105999 - protein, 14 aa, Mycobacterium
DGPGTPEVLGDEPR

SEQ ID NO: 1106000 - protein, 7 aa, Mycobacterium
DGPMAPQ

SEQ ID NO: 1106001 - protein, 6 aa, Mycobacterium
DGPRYR

SEQ ID NO: 1106002 - protein, 7 aa, Mycobacterium
DGPSTTS

SEQ ID NO: 1106003 - protein, 5 aa, Mycobacterium
DGQAR

SEQ ID NO: 1106004 - protein, 5 aa, Mycobacterium
DGQNV

SEQ ID NO: 1106005 - protein, 9 aa, Mycobacterium
DGQQPITHP

SEQ ID NO: 1106006 - protein, 6 aa, Mycobacterium
DGQRDI

SEQ ID NO: 1106007 - protein, 7 aa, Mycobacterium
DGQRSGT

SEQ ID NO: 1106008 - protein, 6 aa, Mycobacterium
DGQTYD

SEQ ID NO: 1106009 - protein, 6 aa, Mycobacterium
DGRAAG

SEQ ID NO: 1106010 - protein, 10 aa, Mycobacterium
DGRDGPAVHQ

SEQ ID NO: 1106011 - protein, 5 aa, Mycobacterium
DGRDR

SEQ ID NO: 1106012 - protein, 6 aa, Mycobacterium
DGRERL

SEQ ID NO: 1106013 - protein, 8 aa, Mycobacterium
DGRGGARI

SEQ ID NO: 1106014 - protein, 10 aa, Mycobacterium
DGRGLPAEEH

SEQ ID NO: 1106015 - protein, 6 aa, Mycobacterium
DGRGNV

SEQ ID NO: 1106016 - protein, 5 aa, Mycobacterium
DGRIG

SEQ ID NO: 1106017 - protein, 5 aa, Mycobacterium
DGRLE

SEQ ID NO: 1106018 - protein, 5 aa, Mycobacterium
DGRPC

SEQ ID NO: 1106019 - protein, 11 aa, Mycobacterium
DGRQPMGPGGM

SEQ ID NO: 1106020 - protein, 6 aa, Mycobacterium
DGRQRL

SEQ ID NO: 1106021 - protein, 8 aa, Mycobacterium
DGRTDDTV

SEQ ID NO: 1106022 - protein, 6 aa, Mycobacterium
DGRTTS

SEQ ID NO: 1106023 - protein, 12 aa, Mycobacterium
DGRTVDASRNPA

SEQ ID NO: 1106024 - protein, 11 aa, Mycobacterium
DGSAHRGEQTL

SEQ ID NO: 1106025 - protein, 11 aa, Mycobacterium
DGSHSAGTMDA

SEQ ID NO: 1106026 - protein, 7 aa, Mycobacterium
DGSHTDI

SEQ ID NO: 1106027 - protein, 14 aa, Mycobacterium
DGSPAGQTVRENSH

SEQ ID NO: 1106028 - protein, 6 aa, Mycobacterium
DGSPSW

SEQ ID NO: 1106029 - protein, 10 aa, Mycobacterium
DGTGPIPELG

SEQ ID NO: 1106030 - protein, 6 aa, Mycobacterium
DGTKRQ

SEQ ID NO: 1106031 - protein, 6 aa, Mycobacterium
DGTPLR

SEQ ID NO: 1106032 - protein, 7 aa, Mycobacterium
DGTPTRT

SEQ ID NO: 1106033 - protein, 7 aa, Mycobacterium
DGTPVGS

SEQ ID NO: 1106034 - protein, 5 aa, Mycobacterium
DGTQM

SEQ ID NO: 1106035 - protein, 7 aa, Mycobacterium
DGTRSVT

SEQ ID NO: 1106036 - protein, 5 aa, Mycobacterium
DGTVG

SEQ ID NO: 1106037 - protein, 5 aa, Mycobacterium
DGVAE

SEQ ID NO: 1106038 - protein, 9 aa, Mycobacterium
DGVGVPEEE

SEQ ID NO: 1106039 - protein, 8 aa, Mycobacterium
DGVHPTPE

SEQ ID NO: 1106040 - protein, 11 aa, Mycobacterium
DGVNDAPALAT

SEQ ID NO: 1106041 - protein, 14 aa, Mycobacterium
DGVQAPRSHRPAPT

SEQ ID NO: 1106042 - protein, 14 aa, Mycobacterium
DGVRGKGERMGQAA

SEQ ID NO: 1106043 - protein, 18 aa, Mycobacterium
DGVRGQGERIGQATTDAN

SEQ ID NO: 1106044 - protein, 5 aa, Mycobacterium
DGVTA

SEQ ID NO: 1106045 - protein, 18 aa, Mycobacterium
DGYDTDVAKRGGRLSAGQ

SEQ ID NO: 1106046 - protein, 18 aa, Mycobacterium
DGYETRIDDGGTNISAGE

SEQ ID NO: 1106047 - protein, 4 aa, Mycobacterium
DGYI

SEQ ID NO: 1106048 - protein, 10 aa, Mycobacterium
DGYRDSQENQ

SEQ ID NO: 1106049 - protein, 6 aa, Mycobacterium
DHAAAD

SEQ ID NO: 1106050 - protein, 9 aa, Mycobacterium
DHAATAAEI

SEQ ID NO: 1106051 - protein, 7 aa, Mycobacterium
DHDAAAE

SEQ ID NO: 1106052 - protein, 7 aa, Mycobacterium
DHETEQM

SEQ ID NO: 1106053 - protein, 9 aa, Mycobacterium
DHGVRAGQL

SEQ ID NO: 1106054 - protein, 8 aa, Mycobacterium
DHHANPHR

SEQ ID NO: 1106055 - protein, 27 aa, Mycobacterium
DHHGRVASASSNSVDRQQNTSQTEREQ

SEQ ID NO: 1106056 - protein, 6 aa, Mycobacterium
DHNPTL

SEQ ID NO: 1106057 - protein, 15 aa, Mycobacterium
DHPAGSDVPVPPADA

SEQ ID NO: 1106058 - protein, 4 aa, Mycobacterium
DHPE

SEQ ID NO: 1106059 - protein, 7 aa, Mycobacterium
DHPRTAA

SEQ ID NO: 1106060 - protein, 8 aa, Mycobacterium
DHPTTAAR

SEQ ID NO: 1106061 - protein, 7 aa, Mycobacterium
DHRGGEE

SEQ ID NO: 1106062 - protein, 8 aa, Mycobacterium
DHRHRSGA

SEQ ID NO: 1106063 - protein, 8 aa, Mycobacterium
DHRPPGVG

SEQ ID NO: 1106064 - protein, 5 aa, Mycobacterium
DIAER

SEQ ID NO: 1106065 - protein, 13 aa, Mycobacterium
DIAPRDPTNAPHN

SEQ ID NO: 1106066 - protein, 14 aa, Mycobacterium
DIDPGKAIEGTAYS

SEQ ID NO: 1106067 - protein, 7 aa, Mycobacterium
DIDPGRI

SEQ ID NO: 1106068 - protein, 7 aa, Mycobacterium
DIEQTAG

SEQ ID NO: 1106069 - protein, 5 aa, Mycobacterium
DIPGR

SEQ ID NO: 1106070 - protein, 11 aa, Mycobacterium
DIPTDAQSGKI

SEQ ID NO: 1106071 - protein, 8 aa, Mycobacterium
DIRPTRDG

SEQ ID NO: 1106072 - protein, 6 aa, Mycobacterium
DISGNI

SEQ ID NO: 1106073 - protein, 12 aa, Mycobacterium
DISPNSPAERAG

SEQ ID NO: 1106074 - protein, 17 aa, Mycobacterium
DITDQKAAERALAESEE

SEQ ID NO: 1106075 - protein, 9 aa, Mycobacterium
DITNGPRGL

SEQ ID NO: 1106076 - protein, 9 aa, Mycobacterium
DITPADPVA

SEQ ID NO: 1106077 - protein, 4 aa, Mycobacterium
DITT

SEQ ID NO: 1106078 - protein, 7 aa, Mycobacterium
DKADGVT

SEQ ID NO: 1106079 - protein, 7 aa, Mycobacterium
DKDIADA

SEQ ID NO: 1106080 - protein, 9 aa, Mycobacterium
DKDSAPDIA

SEQ ID NO: 1106081 - protein, 8 aa, Mycobacterium
DKERRKQA

SEQ ID NO: 1106082 - protein, 4 aa, Mycobacterium
DKEW

SEQ ID NO: 1106083 - protein, 18 aa, Mycobacterium
DKGKTKSKDEAKRAEVTA

SEQ ID NO: 1106084 - protein, 8 aa, Mycobacterium
DKGTEMTS

SEQ ID NO: 1106085 - protein, 50 aa, Mycobacterium
DKKAAAAHADTAPGEFRKQEQDVIGQNKAEAAAVTKQGVAGMQGSKAAAL

SEQ ID NO: 1106086 - protein, 7 aa, Mycobacterium
DKKPAEL

SEQ ID NO: 1106087 - protein, 8 aa, Mycobacterium
DKKPDPKL

SEQ ID NO: 1106088 - protein, 14 aa, Mycobacterium
DKLGSASNAGTQVR

SEQ ID NO: 1106089 - protein, 7 aa, Mycobacterium
DKNAGIE

SEQ ID NO: 1106090 - protein, 12 aa, Mycobacterium
DKPDPAGPVNRD

SEQ ID NO: 1106091 - protein, 5 aa, Mycobacterium
DKPGF

SEQ ID NO: 1106092 - protein, 10 aa, Mycobacterium
DKPRQQRAAR

SEQ ID NO: 1106093 - protein, 5 aa, Mycobacterium
DKRHS

SEQ ID NO: 1106094 - protein, 9 aa, Mycobacterium
DKSGAAVPR

SEQ ID NO: 1106095 - protein, 15 aa, Mycobacterium
DKSHPSADMAQQSTA

SEQ ID NO: 1106096 - protein, 13 aa, Mycobacterium
DKSTAPYADAIPT

SEQ ID NO: 1106097 - protein, 9 aa, Mycobacterium
DKTGTLTTG

SEQ ID NO: 1106098 - protein, 10 aa, Mycobacterium
DKTSPKPDLS

SEQ ID NO: 1106099 - protein, 13 aa, Mycobacterium
DLADNGGRTNNNT

SEQ ID NO: 1106100 - protein, 14 aa, Mycobacterium
DLAETSGISSRRTD

SEQ ID NO: 1106101 - protein, 15 aa, Mycobacterium
DLAPPTARDPRGAAL

SEQ ID NO: 1106102 - protein, 13 aa, Mycobacterium
DLAQGSSIGVPST

SEQ ID NO: 1106103 - protein, 16 aa, Mycobacterium
DLASDEAPPQSEEWPK

SEQ ID NO: 1106104 - protein, 20 aa, Mycobacterium
DLDEPARERSETDDDELPSY

SEQ ID NO: 1106105 - protein, 8 aa, Mycobacterium
DLDPALRR

SEQ ID NO: 1106106 - protein, 8 aa, Mycobacterium
DLGAGPAR

SEQ ID NO: 1106107 - protein, 4 aa, Mycobacterium
DLGD

SEQ ID NO: 1106108 - protein, 18 aa, Mycobacterium
DLGERDGVRLSDDGTLAK

SEQ ID NO: 1106109 - protein, 16 aa, Mycobacterium
DLGGRNVSAQASTVSA

SEQ ID NO: 1106110 - protein, 5 aa, Mycobacterium
DLGSS

SEQ ID NO: 1106111 - protein, 9 aa, Mycobacterium
DLGTARRGA

SEQ ID NO: 1106112 - protein, 7 aa, Mycobacterium
DLPDPAA

SEQ ID NO: 1106113 - protein, 8 aa, Mycobacterium
DLPGTPAW

SEQ ID NO: 1106114 - protein, 8 aa, Mycobacterium
DLPSPDGL

SEQ ID NO: 1106115 - protein, 7 aa, Mycobacterium
DLRGTYR

SEQ ID NO: 1106116 - protein, 5 aa, Mycobacterium
DLRNP

SEQ ID NO: 1106117 - protein, 15 aa, Mycobacterium
DLRNTAAGADPAELG

SEQ ID NO: 1106118 - protein, 7 aa, Mycobacterium
DLSAPDG

SEQ ID NO: 1106119 - protein, 12 aa, Mycobacterium
DLSGGDAFTASS

SEQ ID NO: 1106120 - protein, 17 aa, Mycobacterium
DLSSTISNLNTTSLNDS

SEQ ID NO: 1106121 - protein, 8 aa, Mycobacterium
DLTDPRAQ

SEQ ID NO: 1106122 - protein, 12 aa, Mycobacterium
DLTPNAGTKEQT

SEQ ID NO: 1106123 - protein, 12 aa, Mycobacterium
DLTTALDQALER

SEQ ID NO: 1106124 - protein, 9 aa, Mycobacterium
DLYSSTPRA

SEQ ID NO: 1106125 - protein, 22 aa, Mycobacterium
DMANTDELTGLPNRRGLTRSAS

SEQ ID NO: 1106126 - protein, 11 aa, Mycobacterium
DMPTPRGSYGA

SEQ ID NO: 1106127 - protein, 13 aa, Mycobacterium
DMQEAAKVDGATA

SEQ ID NO: 1106128 - protein, 5 aa, Mycobacterium
DMRNP

SEQ ID NO: 1106129 - protein, 7 aa, Mycobacterium
DMSDGSR

SEQ ID NO: 1106130 - protein, 4 aa, Mycobacterium
DMTG

SEQ ID NO: 1106131 - protein, 6 aa, Mycobacterium
DNAAEY

SEQ ID NO: 1106132 - protein, 8 aa, Mycobacterium
DNAATAAA

SEQ ID NO: 1106133 - protein, 12 aa, Mycobacterium
DNATGANAQNLG

SEQ ID NO: 1106134 - protein, 6 aa, Mycobacterium
DNDDFK

SEQ ID NO: 1106135 - protein, 4 aa, Mycobacterium
DNDL

SEQ ID NO: 1106136 - protein, 9 aa, Mycobacterium
DNDSAEIEH

SEQ ID NO: 1106137 - protein, 7 aa, Mycobacterium
DNEAELA

SEQ ID NO: 1106138 - protein, 36 aa, Mycobacterium
DNEPTQYSNAYSDEPTQYGDYTGAYDQPPPEEPQPW

SEQ ID NO: 1106139 - protein, 36 aa, Mycobacterium
DNEPTQYSNAYSDEPTQYGDYTGAYDQPPPGEPQPW

SEQ ID NO: 1106140 - protein, 9 aa, Mycobacterium
DNEQELAPT

SEQ ID NO: 1106141 - protein, 6 aa, Mycobacterium
DNGAGI

SEQ ID NO: 1106142 - protein, 11 aa, Mycobacterium
DNGGPAAEEAR

SEQ ID NO: 1106143 - protein, 10 aa, Mycobacterium
DNGNDVPRGQ

SEQ ID NO: 1106144 - protein, 7 aa, Mycobacterium
DNHATAA

SEQ ID NO: 1106145 - protein, 7 aa, Mycobacterium
DNIDEAR

SEQ ID NO: 1106146 - protein, 12 aa, Mycobacterium
DNKLIRDTLGPI

SEQ ID NO: 1106147 - protein, 9 aa, Mycobacterium
DNLAHPKAV

SEQ ID NO: 1106148 - protein, 8 aa, Mycobacterium
DNNDPTKM

SEQ ID NO: 1106149 - protein, 8 aa, Mycobacterium
DNPAQPYL

SEQ ID NO: 1106150 - protein, 7 aa, Mycobacterium
DNPMTAK

SEQ ID NO: 1106151 - protein, 7 aa, Mycobacterium
DNRKADV

SEQ ID NO: 1106152 - protein, 6 aa, Mycobacterium
DNRPTE

SEQ ID NO: 1106153 - protein, 4 aa, Mycobacterium
DNSE

SEQ ID NO: 1106154 - protein, 4 aa, Mycobacterium
DNSG

SEQ ID NO: 1106155 - protein, 7 aa, Mycobacterium
DNSIPTA

SEQ ID NO: 1106156 - protein, 8 aa, Mycobacterium
DNSPATEK

SEQ ID NO: 1106157 - protein, 16 aa, Mycobacterium
DNSPSCDADPECVTSR

SEQ ID NO: 1106158 - protein, 17 aa, Mycobacterium
DNTETAAPLQEEKKADH

SEQ ID NO: 1106159 - protein, 18 aa, Mycobacterium
DNTFNPAQDLSRQENRQL

SEQ ID NO: 1106160 - protein, 10 aa, Mycobacterium
DNTPPPPGPV

SEQ ID NO: 1106161 - protein, 4 aa, Mycobacterium
DNVD

SEQ ID NO: 1106162 - protein, 11 aa, Mycobacterium
DNVDRARTDIQ

SEQ ID NO: 1106163 - protein, 28 aa, Mycobacterium
DPAAEEAAMEAEDGPVVRAEPDDVETPQ

SEQ ID NO: 1106164 - protein, 9 aa, Mycobacterium
DPAAPQAVS

SEQ ID NO: 1106165 - protein, 7 aa, Mycobacterium
DPAAQAA

SEQ ID NO: 1106166 - protein, 6 aa, Mycobacterium
DPAARG

SEQ ID NO: 1106167 - protein, 16 aa, Mycobacterium
DPADGTTLTEAPPRVS

SEQ ID NO: 1106168 - protein, 4 aa, Mycobacterium
DPAE

SEQ ID NO: 1106169 - protein, 8 aa, Mycobacterium
DPAFGSGP

SEQ ID NO: 1106170 - protein, 4 aa, Mycobacterium
DPAG

SEQ ID NO: 1106171 - protein, 5 aa, Mycobacterium
DPAGD

SEQ ID NO: 1106172 - protein, 13 aa, Mycobacterium
DPAGLTPQTRQRY

SEQ ID NO: 1106173 - protein, 14 aa, Mycobacterium
DPAGVDSASARAAG

SEQ ID NO: 1106174 - protein, 5 aa, Mycobacterium
DPAHE

SEQ ID NO: 1106175 - protein, 8 aa, Mycobacterium
DPAQEEVA

SEQ ID NO: 1106176 - protein, 6 aa, Mycobacterium
DPAQTT

SEQ ID NO: 1106177 - protein, 9 aa, Mycobacterium
DPARDERRA

SEQ ID NO: 1106178 - protein, 5 aa, Mycobacterium
DPARG

SEQ ID NO: 1106179 - protein, 11 aa, Mycobacterium
DPASRSVGELS

SEQ ID NO: 1106180 - protein, 33 aa, Mycobacterium
DPATGEYLTPGGRLERQTNSALRAPKSWQDLLP

SEQ ID NO: 1106181 - protein, 25 aa, Mycobacterium
DPATGLASAEAERRLQRDGPNELRA

SEQ ID NO: 1106182 - protein, 9 aa, Mycobacterium
DPATGQLTG

SEQ ID NO: 1106183 - protein, 11 aa, Mycobacterium
DPAVGGVSAND

SEQ ID NO: 1106184 - protein, 8 aa, Mycobacterium
DPAVGQEE

SEQ ID NO: 1106185 - protein, 12 aa, Mycobacterium
DPAVQPDAGGAG

SEQ ID NO: 1106186 - protein, 9 aa, Mycobacterium
DPDADPGQF

SEQ ID NO: 1106187 - protein, 7 aa, Mycobacterium
DPDDPTP

SEQ ID NO: 1106188 - protein, 18 aa, Mycobacterium
DPDEVPEGYPVKADTKTG

SEQ ID NO: 1106189 - protein, 4 aa, Mycobacterium
DPDG

SEQ ID NO: 1106190 - protein, 16 aa, Mycobacterium
DPDKTRKSALRRNEGV

SEQ ID NO: 1106191 - protein, 4 aa, Mycobacterium
DPDR

SEQ ID NO: 1106192 - protein, 14 aa, Mycobacterium
DPDRARRDDPAGPL

SEQ ID NO: 1106193 - protein, 13 aa, Mycobacterium
DPDRRDDRRGTQD

SEQ ID NO: 1106194 - protein, 5 aa, Mycobacterium
DPDSG

SEQ ID NO: 1106195 - protein, 6 aa, Mycobacterium
DPDTGC

SEQ ID NO: 1106196 - protein, 5 aa, Mycobacterium
DPEAR

SEQ ID NO: 1106197 - protein, 9 aa, Mycobacterium
DPEDMGARD

SEQ ID NO: 1106198 - protein, 15 aa, Mycobacterium
DPEKDAEKYAPLPYP

SEQ ID NO: 1106199 - protein, 13 aa, Mycobacterium
DPEKDAEKYAPMP

SEQ ID NO: 1106200 - protein, 5 aa, Mycobacterium
DPEPD

SEQ ID NO: 1106201 - protein, 4 aa, Mycobacterium
DPEQ

SEQ ID NO: 1106202 - protein, 7 aa, Mycobacterium
DPEQHQA

SEQ ID NO: 1106203 - protein, 7 aa, Mycobacterium
DPERDSG

SEQ ID NO: 1106204 - protein, 8 aa, Mycobacterium
DPERDSGR

SEQ ID NO: 1106205 - protein, 8 aa, Mycobacterium
DPESAIAR

SEQ ID NO: 1106206 - protein, 7 aa, Mycobacterium
DPESGNW

SEQ ID NO: 1106207 - protein, 7 aa, Mycobacterium
DPETENE

SEQ ID NO: 1106208 - protein, 7 aa, Mycobacterium
DPETREK

SEQ ID NO: 1106209 - protein, 12 aa, Mycobacterium
DPEVAESTRTLG

SEQ ID NO: 1106210 - protein, 4 aa, Mycobacterium
DPFA

SEQ ID NO: 1106211 - protein, 7 aa, Mycobacterium
DPGAGVP

SEQ ID NO: 1106212 - protein, 35 aa, Mycobacterium
DPGAPTEAFAPQKPAAPQMIPPRGDAPRPPKKKRN

SEQ ID NO: 1106213 - protein, 14 aa, Mycobacterium
DPGGILTPAPTERF

SEQ ID NO: 1106214 - protein, 23 aa, Mycobacterium
DPGGTGADRQFAGSTGGPDSSPS

SEQ ID NO: 1106215 - protein, 8 aa, Mycobacterium
DPGHPDAV

SEQ ID NO: 1106216 - protein, 13 aa, Mycobacterium
DPGIGAEEVPAEA

SEQ ID NO: 1106217 - protein, 5 aa, Mycobacterium
DPGRH

SEQ ID NO: 1106218 - protein, 13 aa, Mycobacterium
DPGTETEQPDGRV

SEQ ID NO: 1106219 - protein, 15 aa, Mycobacterium
DPGTPAVSERARGER

SEQ ID NO: 1106220 - protein, 105 aa, Mycobacterium
DPGTSSETTSTAPSSETTSPTSPSETTSPTSPSETTSPTSPSETTSPAPSSETTSAPTSSPSPTPSTAPTTTSVGAAPPSSSAPATTTPTSTTATRAPSATSTTV

SEQ ID NO: 1106221 - protein, 14 aa, Mycobacterium
DPGVGDALTPAATA

SEQ ID NO: 1106222 - protein, 17 aa, Mycobacterium
DPGYAAAAQAPRRRGRV

SEQ ID NO: 1106223 - protein, 6 aa, Mycobacterium
DPHRPG

SEQ ID NO: 1106224 - protein, 8 aa, Mycobacterium
DPHTRRGR

SEQ ID NO: 1106225 - protein, 6 aa, Mycobacterium
DPIADN

SEQ ID NO: 1106226 - protein, 13 aa, Mycobacterium
DPITEAQAVSADR

SEQ ID NO: 1106227 - protein, 8 aa, Mycobacterium
DPKAEQTW

SEQ ID NO: 1106228 - protein, 14 aa, Mycobacterium
DPKQRTTVEARRRE

SEQ ID NO: 1106229 - protein, 38 aa, Mycobacterium
DPLPEERNADNTPVPGTPESLTNPAPAQPDQGQSGGEI

SEQ ID NO: 1106230 - protein, 36 aa, Mycobacterium
DPLPGEKNPDNTPVPGTPESTTADPEVAATESGGAE

SEQ ID NO: 1106231 - protein, 11 aa, Mycobacterium
DPLTEAGTARI

SEQ ID NO: 1106232 - protein, 13 aa, Mycobacterium
DPNGLTPTARQRY

SEQ ID NO: 1106233 - protein, 53 aa, Mycobacterium
DPNGVGFENGAPPPAPTPIEGTPENPGPAVPPGSPCSYTPPADGLPRPGNPLP

SEQ ID NO: 1106234 - protein, 16 aa, Mycobacterium
DPNIPGNELDANQRAI

SEQ ID NO: 1106235 - protein, 4 aa, Mycobacterium
DPNN

SEQ ID NO: 1106236 - protein, 12 aa, Mycobacterium
DPNPTASSYQPP

SEQ ID NO: 1106237 - protein, 4 aa, Mycobacterium
DPNS

SEQ ID NO: 1106238 - protein, 12 aa, Mycobacterium
DPNVAQPDPGNT

SEQ ID NO: 1106239 - protein, 5 aa, Mycobacterium
DPPDA

SEQ ID NO: 1106240 - protein, 15 aa, Mycobacterium
DPPKPSDDPTGQGRN

SEQ ID NO: 1106241 - protein, 5 aa, Mycobacterium
DPPLR

SEQ ID NO: 1106242 - protein, 7 aa, Mycobacterium
DPPPCST

SEQ ID NO: 1106243 - protein, 21 aa, Mycobacterium
DPPRPARAEADDTDLANPYRG

SEQ ID NO: 1106244 - protein, 8 aa, Mycobacterium
DPPRPEAA

SEQ ID NO: 1106245 - protein, 8 aa, Mycobacterium
DPPRPEVA

SEQ ID NO: 1106246 - protein, 7 aa, Mycobacterium
DPPTGLA

SEQ ID NO: 1106247 - protein, 6 aa, Mycobacterium
DPPWPE

SEQ ID NO: 1106248 - protein, 6 aa, Mycobacterium
DPQALQ

SEQ ID NO: 1106249 - protein, 5 aa, Mycobacterium
DPQAR

SEQ ID NO: 1106250 - protein, 4 aa, Mycobacterium
DPQM

SEQ ID NO: 1106251 - protein, 6 aa, Mycobacterium
DPQQAT

SEQ ID NO: 1106252 - protein, 7 aa, Mycobacterium
DPRDSNV

SEQ ID NO: 1106253 - protein, 6 aa, Mycobacterium
DPRGWS

SEQ ID NO: 1106254 - protein, 5 aa, Mycobacterium
DPRSP

SEQ ID NO: 1106255 - protein, 6 aa, Mycobacterium
DPRSRQ

SEQ ID NO: 1106256 - protein, 7 aa, Mycobacterium
DPRTGGV

SEQ ID NO: 1106257 - protein, 4 aa, Mycobacterium
DPRV

SEQ ID NO: 1106258 - protein, 9 aa, Mycobacterium
DPSATPQDT

SEQ ID NO: 1106259 - protein, 13 aa, Mycobacterium
DPSAVQANSAAPI

SEQ ID NO: 1106260 - protein, 8 aa, Mycobacterium
DPSFSATL

SEQ ID NO: 1106261 - protein, 11 aa, Mycobacterium
DPSGERGGRPA

SEQ ID NO: 1106262 - protein, 17 aa, Mycobacterium
DPSGKPQSVQVTLGKMQ

SEQ ID NO: 1106263 - protein, 7 aa, Mycobacterium
DPSLNEI

SEQ ID NO: 1106264 - protein, 7 aa, Mycobacterium
DPSPVRA

SEQ ID NO: 1106265 - protein, 4 aa, Mycobacterium
DPSR

SEQ ID NO: 1106266 - protein, 29 aa, Mycobacterium
DPSRADLPDLTATRPPAHTLPKPRLRPSG

SEQ ID NO: 1106267 - protein, 4 aa, Mycobacterium
DPTA

SEQ ID NO: 1106268 - protein, 5 aa, Mycobacterium
DPTQV

SEQ ID NO: 1106269 - protein, 15 aa, Mycobacterium
DPTSTAAEEAERIGA

SEQ ID NO: 1106270 - protein, 10 aa, Mycobacterium
DPVGAESPIA

SEQ ID NO: 1106271 - protein, 11 aa, Mycobacterium
DPVPGRTATEL

SEQ ID NO: 1106272 - protein, 7 aa, Mycobacterium
DPWPEDV

SEQ ID NO: 1106273 - protein, 5 aa, Mycobacterium
DPYRY

SEQ ID NO: 1106274 - protein, 4 aa, Mycobacterium
DQAE

SEQ ID NO: 1106275 - protein, 16 aa, Mycobacterium
DQAGALSAAQRGEVQQ

SEQ ID NO: 1106276 - protein, 6 aa, Mycobacterium
DQASPP

SEQ ID NO: 1106277 - protein, 6 aa, Mycobacterium
DQCDSY

SEQ ID NO: 1106278 - protein, 7 aa, Mycobacterium
DQDPHVT

SEQ ID NO: 1106279 - protein, 10 aa, Mycobacterium
DQDSDARGRV

SEQ ID NO: 1106280 - protein, 4 aa, Mycobacterium
DQEG

SEQ ID NO: 1106281 - protein, 9 aa, Mycobacterium
DQGETLANE

SEQ ID NO: 1106282 - protein, 6 aa, Mycobacterium
DQGQAS

SEQ ID NO: 1106283 - protein, 5 aa, Mycobacterium
DQGQR

SEQ ID NO: 1106284 - protein, 10 aa, Mycobacterium
DQGYQAPATA

SEQ ID NO: 1106285 - protein, 6 aa, Mycobacterium
DQHPEG

SEQ ID NO: 1106286 - protein, 19 aa, Mycobacterium
DQHRDQGEYTPKDQAPDPV

SEQ ID NO: 1106287 - protein, 14 aa, Mycobacterium
DQIDDSALEQATRD

SEQ ID NO: 1106288 - protein, 6 aa, Mycobacterium
DQITGD

SEQ ID NO: 1106289 - protein, 7 aa, Mycobacterium
DQITNRP

SEQ ID NO: 1106290 - protein, 6 aa, Mycobacterium
DQLGDY

SEQ ID NO: 1106291 - protein, 6 aa, Mycobacterium
DQNGRD

SEQ ID NO: 1106292 - protein, 35 aa, Mycobacterium
DQPAAPSPEPDPGSSSAADSEPPPPPPGSEPPVSN

SEQ ID NO: 1106293 - protein, 9 aa, Mycobacterium
DQPDPDTQV

SEQ ID NO: 1106294 - protein, 7 aa, Mycobacterium
DQPLGDE

SEQ ID NO: 1106295 - protein, 6 aa, Mycobacterium
DQQDNL

SEQ ID NO: 1106296 - protein, 5 aa, Mycobacterium
DQRER

SEQ ID NO: 1106297 - protein, 16 aa, Mycobacterium
DQRGADRGVSATPARR

SEQ ID NO: 1106298 - protein, 7 aa, Mycobacterium
DQRPFAD

SEQ ID NO: 1106299 - protein, 8 aa, Mycobacterium
DQRQPVPV

SEQ ID NO: 1106300 - protein, 12 aa, Mycobacterium
DQRRRNAYTPDD

SEQ ID NO: 1106301 - protein, 14 aa, Mycobacterium
DQSAAGSAAPGAVA

SEQ ID NO: 1106302 - protein, 6 aa, Mycobacterium
DQSERT

SEQ ID NO: 1106303 - protein, 7 aa, Mycobacterium
DQSERTA

SEQ ID NO: 1106304 - protein, 14 aa, Mycobacterium
DQSRRISRQSRPDT

SEQ ID NO: 1106305 - protein, 38 aa, Mycobacterium
DQTQATNFADTDGDSETGGEAGTEGGTTARAGINGSRA

SEQ ID NO: 1106306 - protein, 7 aa, Mycobacterium
DQTREPT

SEQ ID NO: 1106307 - protein, 8 aa, Mycobacterium
DRAARDPR

SEQ ID NO: 1106308 - protein, 9 aa, Mycobacterium
DRAEADKAK

SEQ ID NO: 1106309 - protein, 5 aa, Mycobacterium
DRAER

SEQ ID NO: 1106310 - protein, 8 aa, Mycobacterium
DRAGAGTL

SEQ ID NO: 1106311 - protein, 5 aa, Mycobacterium
DRAGM

SEQ ID NO: 1106312 - protein, 6 aa, Mycobacterium
DRAGSA

SEQ ID NO: 1106313 - protein, 19 aa, Mycobacterium
DRAPAEIRGELEETQETVR

SEQ ID NO: 1106314 - protein, 13 aa, Mycobacterium
DRAPAGPQPELEY

SEQ ID NO: 1106315 - protein, 25 aa, Mycobacterium
DRAPGAGGSAARQKRAKGGGGSFTS

SEQ ID NO: 1106316 - protein, 23 aa, Mycobacterium
DRAPSSVTGVKTAERRQQRAQTI

SEQ ID NO: 1106317 - protein, 6 aa, Mycobacterium
DRAQEF

SEQ ID NO: 1106318 - protein, 6 aa, Mycobacterium
DRARSV

SEQ ID NO: 1106319 - protein, 6 aa, Mycobacterium
DRASAY

SEQ ID NO: 1106320 - protein, 28 aa, Mycobacterium
DRATDESDLAAATAEMESLKGKKSSVAG

SEQ ID NO: 1106321 - protein, 5 aa, Mycobacterium
DRAYV

SEQ ID NO: 1106322 - protein, 4 aa, Mycobacterium
DRDE

SEQ ID NO: 1106323 - protein, 5 aa, Mycobacterium
DRDID

SEQ ID NO: 1106324 - protein, 9 aa, Mycobacterium
DRDQPASIP

SEQ ID NO: 1106325 - protein, 5 aa, Mycobacterium
DRDTG

SEQ ID NO: 1106326 - protein, 9 aa, Mycobacterium
DRDVDGGRA

SEQ ID NO: 1106327 - protein, 20 aa, Mycobacterium
DREAEPALPEDNDVGSEPVT

SEQ ID NO: 1106328 - protein, 4 aa, Mycobacterium
DRFG

SEQ ID NO: 1106329 - protein, 8 aa, Mycobacterium
DRFGAGPS

SEQ ID NO: 1106330 - protein, 5 aa, Mycobacterium
DRFGS

SEQ ID NO: 1106331 - protein, 6 aa, Mycobacterium
DRGAAG

SEQ ID NO: 1106332 - protein, 5 aa, Mycobacterium
DRGGV

SEQ ID NO: 1106333 - protein, 10 aa, Mycobacterium
DRGPGIPPQE

SEQ ID NO: 1106334 - protein, 9 aa, Mycobacterium
DRHGHDAGD

SEQ ID NO: 1106335 - protein, 6 aa, Mycobacterium
DRHGTA

SEQ ID NO: 1106336 - protein, 13 aa, Mycobacterium
DRHPYPGIQGHAR

SEQ ID NO: 1106337 - protein, 7 aa, Mycobacterium
DRISADG

SEQ ID NO: 1106338 - protein, 12 aa, Mycobacterium
DRLEREKQRGID

SEQ ID NO: 1106339 - protein, 12 aa, Mycobacterium
DRLREERHDADT

SEQ ID NO: 1106340 - protein, 4 aa, Mycobacterium
DRLS

SEQ ID NO: 1106341 - protein, 10 aa, Mycobacterium
DRNDASQKIE

SEQ ID NO: 1106342 - protein, 7 aa, Mycobacterium
DRNEPAQ

SEQ ID NO: 1106343 - protein, 5 aa, Mycobacterium
DRNGD

SEQ ID NO: 1106344 - protein, 9 aa, Mycobacterium
DRNSSGSPT

SEQ ID NO: 1106345 - protein, 8 aa, Mycobacterium
DRPAAGQR

SEQ ID NO: 1106346 - protein, 6 aa, Mycobacterium
DRPGVA

SEQ ID NO: 1106347 - protein, 13 aa, Mycobacterium
DRPPRKAEEPRRY

SEQ ID NO: 1106348 - protein, 13 aa, Mycobacterium
DRPQSAPAPWPQP

SEQ ID NO: 1106349 - protein, 7 aa, Mycobacterium
DRPRQHR

SEQ ID NO: 1106350 - protein, 8 aa, Mycobacterium
DRPTGGGI

SEQ ID NO: 1106351 - protein, 8 aa, Mycobacterium
DRPVDPDT

SEQ ID NO: 1106352 - protein, 8 aa, Mycobacterium
DRPVDPGA

SEQ ID NO: 1106353 - protein, 10 aa, Mycobacterium
DRQLSPEEKR

SEQ ID NO: 1106354 - protein, 17 aa, Mycobacterium
DRQMSYNDSRAEGTRAT

SEQ ID NO: 1106355 - protein, 13 aa, Mycobacterium
DRQTGAAAEEAAV

SEQ ID NO: 1106356 - protein, 4 aa, Mycobacterium
DRRD

SEQ ID NO: 1106357 - protein, 20 aa, Mycobacterium
DRRGDPIGAADAGENRGRTV

SEQ ID NO: 1106358 - protein, 11 aa, Mycobacterium
DRRPGAEIPTV

SEQ ID NO: 1106359 - protein, 9 aa, Mycobacterium
DRRRSASGS

SEQ ID NO: 1106360 - protein, 18 aa, Mycobacterium
DRRSPTWKQRTSSAALGR

SEQ ID NO: 1106361 - protein, 20 aa, Mycobacterium
DRRTSMSQATIEDAPPRTGV

SEQ ID NO: 1106362 - protein, 20 aa, Mycobacterium
DRSGERARRERNEQPWVTRA

SEQ ID NO: 1106363 - protein, 21 aa, Mycobacterium
DRSKRNADENPSAATEPDEAV

SEQ ID NO: 1106364 - protein, 13 aa, Mycobacterium
DRSRAKGPSRWGA

SEQ ID NO: 1106365 - protein, 5 aa, Mycobacterium
DRSRI

SEQ ID NO: 1106366 - protein, 11 aa, Mycobacterium
DRSRSRQNGSF

SEQ ID NO: 1106367 - protein, 8 aa, Mycobacterium
DRSSAGRM

SEQ ID NO: 1106368 - protein, 9 aa, Mycobacterium
DRSTGGRAR

SEQ ID NO: 1106369 - protein, 6 aa, Mycobacterium
DRSTGN

SEQ ID NO: 1106370 - protein, 4 aa, Mycobacterium
DRSV

SEQ ID NO: 1106371 - protein, 4 aa, Mycobacterium
DRSW

SEQ ID NO: 1106372 - protein, 4 aa, Mycobacterium
DRTD

SEQ ID NO: 1106373 - protein, 8 aa, Mycobacterium
DRTEKPTF

SEQ ID NO: 1106374 - protein, 8 aa, Mycobacterium
DRTQKAAG

SEQ ID NO: 1106375 - protein, 6 aa, Mycobacterium
DRTRAA

SEQ ID NO: 1106376 - protein, 6 aa, Mycobacterium
DRTTVD

SEQ ID NO: 1106377 - protein, 14 aa, Mycobacterium
DRVAESPAPGRGAG

SEQ ID NO: 1106378 - protein, 8 aa, Mycobacterium
DRVDDEQM

SEQ ID NO: 1106379 - protein, 5 aa, Mycobacterium
DRVGR

SEQ ID NO: 1106380 - protein, 8 aa, Mycobacterium
DRVPRGVT

SEQ ID NO: 1106381 - protein, 12 aa, Mycobacterium
DRVPSSASSEQV

SEQ ID NO: 1106382 - protein, 20 aa, Mycobacterium
DRVPVSSHDHAGAAPPRPRT

SEQ ID NO: 1106383 - protein, 7 aa, Mycobacterium
DRVSQTQ

SEQ ID NO: 1106384 - protein, 31 aa, Mycobacterium
DSAAARGITQDRSRPRQAPVRRPKRPSRPMP

SEQ ID NO: 1106385 - protein, 6 aa, Mycobacterium
DSAAAS

SEQ ID NO: 1106386 - protein, 6 aa, Mycobacterium
DSAETR

SEQ ID NO: 1106387 - protein, 7 aa, Mycobacterium
DSAGTLD

SEQ ID NO: 1106388 - protein, 17 aa, Mycobacterium
DSAPAPAPAAAPAPVDP

SEQ ID NO: 1106389 - protein, 45 aa, Mycobacterium
DSAPAPAPAPAPAPAPAPAPAAAPAAAPAAAPAAAPAAAPAPVDP

SEQ ID NO: 1106390 - protein, 17 aa, Mycobacterium
DSAPPEYSVNRPPSAVN

SEQ ID NO: 1106391 - protein, 12 aa, Mycobacterium
DSARDRQHGGAG

SEQ ID NO: 1106392 - protein, 8 aa, Mycobacterium
DSASTDIN

SEQ ID NO: 1106393 - protein, 4 aa, Mycobacterium
DSAT

SEQ ID NO: 1106394 - protein, 9 aa, Mycobacterium
DSAVGQGVD

SEQ ID NO: 1106395 - protein, 4 aa, Mycobacterium
DSDA

SEQ ID NO: 1106396 - protein, 5 aa, Mycobacterium
DSDEF

SEQ ID NO: 1106397 - protein, 11 aa, Mycobacterium
DSDGSGTLDPQ

SEQ ID NO: 1106398 - protein, 8 aa, Mycobacterium
DSDRDPLT

SEQ ID NO: 1106399 - protein, 47 aa, Mycobacterium
DSEGQFADDEPVEDRDAEAVAGEVGAAEAEALEDSAVEQETAPDEIA

SEQ ID NO: 1106400 - protein, 15 aa, Mycobacterium
DSEGVARDKTPFEAD

SEQ ID NO: 1106401 - protein, 11 aa, Mycobacterium
DSEPGETGVAT

SEQ ID NO: 1106402 - protein, 4 aa, Mycobacterium
DSEY

SEQ ID NO: 1106403 - protein, 7 aa, Mycobacterium
DSFENRQ

SEQ ID NO: 1106404 - protein, 6 aa, Mycobacterium
DSFSGA

SEQ ID NO: 1106405 - protein, 7 aa, Mycobacterium
DSGAADT

SEQ ID NO: 1106406 - protein, 34 aa, Mycobacterium
DSGAGGGFGDDRRDREAATAGPKGGGADHGAPPE

SEQ ID NO: 1106407 - protein, 6 aa, Mycobacterium
DSGDGF

SEQ ID NO: 1106408 - protein, 8 aa, Mycobacterium
DSGDGPYL

SEQ ID NO: 1106409 - protein, 9 aa, Mycobacterium
DSGDLTDEQ

SEQ ID NO: 1106410 - protein, 10 aa, Mycobacterium
DSGEGMDAGT

SEQ ID NO: 1106411 - protein, 13 aa, Mycobacterium
DSGGAPAARPAVP

SEQ ID NO: 1106412 - protein, 9 aa, Mycobacterium
DSGGGVNPI

SEQ ID NO: 1106413 - protein, 15 aa, Mycobacterium
DSGPLIDSQAETADA

SEQ ID NO: 1106414 - protein, 15 aa, Mycobacterium
DSGPLLEGQAQTADQ

SEQ ID NO: 1106415 - protein, 9 aa, Mycobacterium
DSGPNQGAN

SEQ ID NO: 1106416 - protein, 5 aa, Mycobacterium
DSGSR

SEQ ID NO: 1106417 - protein, 5 aa, Mycobacterium
DSIEN

SEQ ID NO: 1106418 - protein, 4 aa, Mycobacterium
DSKV

SEQ ID NO: 1106419 - protein, 12 aa, Mycobacterium
DSLGGPADSDLG

SEQ ID NO: 1106420 - protein, 7 aa, Mycobacterium
DSLGRRR

SEQ ID NO: 1106421 - protein, 17 aa, Mycobacterium
DSLTDEETSRAAKATAP

SEQ ID NO: 1106422 - protein, 5 aa, Mycobacterium
DSMRD

SEQ ID NO: 1106423 - protein, 21 aa, Mycobacterium
DSNAQRNRADSASSSKSEDAL

SEQ ID NO: 1106424 - protein, 19 aa, Mycobacterium
DSNAQRNRADSGAQSWPEN

SEQ ID NO: 1106425 - protein, 16 aa, Mycobacterium
DSNTINRAVSDGEVAG

SEQ ID NO: 1106426 - protein, 16 aa, Mycobacterium
DSNVEADESTLTGESL

SEQ ID NO: 1106427 - protein, 13 aa, Mycobacterium
DSPGEPEDLPEAV

SEQ ID NO: 1106428 - protein, 7 aa, Mycobacterium
DSPPAVV

SEQ ID NO: 1106429 - protein, 8 aa, Mycobacterium
DSPPPPGV

SEQ ID NO: 1106430 - protein, 15 aa, Mycobacterium
DSPRQTGPDFGKASP

SEQ ID NO: 1106431 - protein, 9 aa, Mycobacterium
DSQAESTEA

SEQ ID NO: 1106432 - protein, 22 aa, Mycobacterium
DSQDYEVEESAEEAAAPADRPR

SEQ ID NO: 1106433 - protein, 5 aa, Mycobacterium
DSRAQ

SEQ ID NO: 1106434 - protein, 4 aa, Mycobacterium
DSRH

SEQ ID NO: 1106435 - protein, 13 aa, Mycobacterium
DSRPYIGGSTDNS

SEQ ID NO: 1106436 - protein, 12 aa, Mycobacterium
DSRRVRPRERED

SEQ ID NO: 1106437 - protein, 9 aa, Mycobacterium
DSRTGEMDK

SEQ ID NO: 1106438 - protein, 5 aa, Mycobacterium
DSRTS

SEQ ID NO: 1106439 - protein, 7 aa, Mycobacterium
DSRVPPT

SEQ ID NO: 1106440 - protein, 16 aa, Mycobacterium
DSSAQRHAQLSGQLTG

SEQ ID NO: 1106441 - protein, 9 aa, Mycobacterium
DSSDPTQNW

SEQ ID NO: 1106442 - protein, 6 aa, Mycobacterium
DSSLAR

SEQ ID NO: 1106443 - protein, 12 aa, Mycobacterium
DSSPMRRARPSA

SEQ ID NO: 1106444 - protein, 7 aa, Mycobacterium
DSSPVEV

SEQ ID NO: 1106445 - protein, 11 aa, Mycobacterium
DSSSLESGDSV

SEQ ID NO: 1106446 - protein, 7 aa, Mycobacterium
DSSSPGL

SEQ ID NO: 1106447 - protein, 7 aa, Mycobacterium
DSSTPAI

SEQ ID NO: 1106448 - protein, 9 aa, Mycobacterium
DSTAPEPIP

SEQ ID NO: 1106449 - protein, 4 aa, Mycobacterium
DSTI

SEQ ID NO: 1106450 - protein, 8 aa, Mycobacterium
DSTVEGPD

SEQ ID NO: 1106451 - protein, 14 aa, Mycobacterium
DSVPQTDGATQFEN

SEQ ID NO: 1106452 - protein, 6 aa, Mycobacterium
DSVSPL

SEQ ID NO: 1106453 - protein, 10 aa, Mycobacterium
DSVTTRSDDG

SEQ ID NO: 1106454 - protein, 10 aa, Mycobacterium
DSWKGGEALP

SEQ ID NO: 1106455 - protein, 9 aa, Mycobacterium
DSWSGTGGA

SEQ ID NO: 1106456 - protein, 9 aa, Mycobacterium
DSYDPTGEK

SEQ ID NO: 1106457 - protein, 6 aa, Mycobacterium
DSYSQL

SEQ ID NO: 1106458 - protein, 12 aa, Mycobacterium
DSYTRNSGFPGQ

SEQ ID NO: 1106459 - protein, 8 aa, Mycobacterium
DTAAESRE

SEQ ID NO: 1106460 - protein, 6 aa, Mycobacterium
DTAGYG

SEQ ID NO: 1106461 - protein, 13 aa, Mycobacterium
DTAIEVGSKDDPE

SEQ ID NO: 1106462 - protein, 8 aa, Mycobacterium
DTAPRKEF

SEQ ID NO: 1106463 - protein, 4 aa, Mycobacterium
DTAR

SEQ ID NO: 1106464 - protein, 7 aa, Mycobacterium
DTARNDD

SEQ ID NO: 1106465 - protein, 6 aa, Mycobacterium
DTASGP

SEQ ID NO: 1106466 - protein, 10 aa, Mycobacterium
DTATDVAKDA

SEQ ID NO: 1106467 - protein, 5 aa, Mycobacterium
DTATG

SEQ ID NO: 1106468 - protein, 5 aa, Mycobacterium
DTDAA

SEQ ID NO: 1106469 - protein, 40 aa, Mycobacterium
DTDAPAAPRQDSATAAAPVAQPQPVPTSAAPTVPQDQSIP

SEQ ID NO: 1106470 - protein, 10 aa, Mycobacterium
DTDDGRAAAG

SEQ ID NO: 1106471 - protein, 12 aa, Mycobacterium
DTDDPTIEPTPH

SEQ ID NO: 1106472 - protein, 6 aa, Mycobacterium
DTDEQV

SEQ ID NO: 1106473 - protein, 5 aa, Mycobacterium
DTDGN

SEQ ID NO: 1106474 - protein, 19 aa, Mycobacterium
DTDGYGQRADRRPPGAEQY

SEQ ID NO: 1106475 - protein, 7 aa, Mycobacterium
DTDMRTA

SEQ ID NO: 1106476 - protein, 15 aa, Mycobacterium
DTDPGANTEVGAGDE

SEQ ID NO: 1106477 - protein, 17 aa, Mycobacterium
DTDSGGQTDDGDRGQTA

SEQ ID NO: 1106478 - protein, 4 aa, Mycobacterium
DTEG

SEQ ID NO: 1106479 - protein, 7 aa, Mycobacterium
DTEGGDE

SEQ ID NO: 1106480 - protein, 6 aa, Mycobacterium
DTEVPT

SEQ ID NO: 1106481 - protein, 5 aa, Mycobacterium
DTFNG

SEQ ID NO: 1106482 - protein, 4 aa, Mycobacterium
DTGG

SEQ ID NO: 1106483 - protein, 10 aa, Mycobacterium
DTGGLTPADI

SEQ ID NO: 1106484 - protein, 5 aa, Mycobacterium
DTGRQ

SEQ ID NO: 1106485 - protein, 9 aa, Mycobacterium
DTGSDGVDT

SEQ ID NO: 1106486 - protein, 7 aa, Mycobacterium
DTGYGTG

SEQ ID NO: 1106487 - protein, 6 aa, Mycobacterium
DTIDES

SEQ ID NO: 1106488 - protein, 9 aa, Mycobacterium
DTIGKRDEQ

SEQ ID NO: 1106489 - protein, 4 aa, Mycobacterium
DTKV

SEQ ID NO: 1106490 - protein, 9 aa, Mycobacterium
DTLASTSSA

SEQ ID NO: 1106491 - protein, 47 aa, Mycobacterium
DTLDPRRTDDDKGGAVAPDPKNPVRDPENPRRDGTAETMRPDVRTRS

SEQ ID NO: 1106492 - protein, 4 aa, Mycobacterium
DTNA

SEQ ID NO: 1106493 - protein, 9 aa, Mycobacterium
DTNATLGNT

SEQ ID NO: 1106494 - protein, 5 aa, Mycobacterium
DTPEN

SEQ ID NO: 1106495 - protein, 39 aa, Mycobacterium
DTPGEERAGGVRPGEAPPDSAQTRATANRDPAAGRNLTP

SEQ ID NO: 1106496 - protein, 6 aa, Mycobacterium
DTPQFA

SEQ ID NO: 1106497 - protein, 9 aa, Mycobacterium
DTPRASAQD

SEQ ID NO: 1106498 - protein, 6 aa, Mycobacterium
DTPRDQ

SEQ ID NO: 1106499 - protein, 8 aa, Mycobacterium
DTPREKAR

SEQ ID NO: 1106500 - protein, 5 aa, Mycobacterium
DTPSA

SEQ ID NO: 1106501 - protein, 9 aa, Mycobacterium
DTRAGAQAM

SEQ ID NO: 1106502 - protein, 8 aa, Mycobacterium
DTRAGRVA

SEQ ID NO: 1106503 - protein, 6 aa, Mycobacterium
DTRDYY

SEQ ID NO: 1106504 - protein, 10 aa, Mycobacterium
DTRGYKPVDT

SEQ ID NO: 1106505 - protein, 17 aa, Mycobacterium
DTRPEDYEDAEIADGAG

SEQ ID NO: 1106506 - protein, 8 aa, Mycobacterium
DTRQATRL

SEQ ID NO: 1106507 - protein, 10 aa, Mycobacterium
DTSAQQLTDS

SEQ ID NO: 1106508 - protein, 11 aa, Mycobacterium
DTSAQQLTDSR

SEQ ID NO: 1106509 - protein, 6 aa, Mycobacterium
DTSGIA

SEQ ID NO: 1106510 - protein, 15 aa, Mycobacterium
DTSSMTGESVPERPA

SEQ ID NO: 1106511 - protein, 11 aa, Mycobacterium
DTTASDDGELA

SEQ ID NO: 1106512 - protein, 6 aa, Mycobacterium
DTTDRE

SEQ ID NO: 1106513 - protein, 9 aa, Mycobacterium
DTTGPGRTR

SEQ ID NO: 1106514 - protein, 4 aa, Mycobacterium
DTTP

SEQ ID NO: 1106515 - protein, 8 aa, Mycobacterium
DTTPPRVS

SEQ ID NO: 1106516 - protein, 8 aa, Mycobacterium
DTTPQVGD

SEQ ID NO: 1106517 - protein, 6 aa, Mycobacterium
DTTREI

SEQ ID NO: 1106518 - protein, 6 aa, Mycobacterium
DTTTTS

SEQ ID NO: 1106519 - protein, 7 aa, Mycobacterium
DTTVAPL

SEQ ID NO: 1106520 - protein, 5 aa, Mycobacterium
DTVAA

SEQ ID NO: 1106521 - protein, 4 aa, Mycobacterium
DTVD

SEQ ID NO: 1106522 - protein, 5 aa, Mycobacterium
DTVDA

SEQ ID NO: 1106523 - protein, 6 aa, Mycobacterium
DTVDAS

SEQ ID NO: 1106524 - protein, 6 aa, Mycobacterium
DTVDES

SEQ ID NO: 1106525 - protein, 4 aa, Mycobacterium
DTVG

SEQ ID NO: 1106526 - protein, 9 aa, Mycobacterium
DTVPAGESI

SEQ ID NO: 1106527 - protein, 10 aa, Mycobacterium
DTWPGDLGER

SEQ ID NO: 1106528 - protein, 4 aa, Mycobacterium
DTYA

SEQ ID NO: 1106529 - protein, 6 aa, Mycobacterium
DTYRGP

SEQ ID NO: 1106530 - protein, 4 aa, Mycobacterium
DTYS

SEQ ID NO: 1106531 - protein, 8 aa, Mycobacterium
DVAPPSTV

SEQ ID NO: 1106532 - protein, 6 aa, Mycobacterium
DVARGG

SEQ ID NO: 1106533 - protein, 7 aa, Mycobacterium
DVDGVTL

SEQ ID NO: 1106534 - protein, 7 aa, Mycobacterium
DVDPRSS

SEQ ID NO: 1106535 - protein, 48 aa, Mycobacterium
DVEAESPVDGAEDESEAEPEAVEGDVESVTESEGLGSVEGDEAAEAEE

SEQ ID NO: 1106536 - protein, 23 aa, Mycobacterium
DVEAESPVDGAEDESEAESEVVE

SEQ ID NO: 1106537 - protein, 16 aa, Mycobacterium
DVEAETGEAAADEVAE

SEQ ID NO: 1106538 - protein, 19 aa, Mycobacterium
DVEPDPAAAPTATPAEDVA

SEQ ID NO: 1106539 - protein, 5 aa, Mycobacterium
DVGGY

SEQ ID NO: 1106540 - protein, 18 aa, Mycobacterium
DVGLGSRPDPVPAGPPAA

SEQ ID NO: 1106541 - protein, 25 aa, Mycobacterium
DVGRGEARATASATASTAPTGSGSV

SEQ ID NO: 1106542 - protein, 13 aa, Mycobacterium
DVPAAASVSAEPD

SEQ ID NO: 1106543 - protein, 4 aa, Mycobacterium
DVPG

SEQ ID NO: 1106544 - protein, 12 aa, Mycobacterium
DVPGQNDGVGPA

SEQ ID NO: 1106545 - protein, 7 aa, Mycobacterium
DVPGSVH

SEQ ID NO: 1106546 - protein, 6 aa, Mycobacterium
DVPPRY

SEQ ID NO: 1106547 - protein, 4 aa, Mycobacterium
DVPQ

SEQ ID NO: 1106548 - protein, 11 aa, Mycobacterium
DVPRSGQDVPV

SEQ ID NO: 1106549 - protein, 6 aa, Mycobacterium
DVPSAE

SEQ ID NO: 1106550 - protein, 12 aa, Mycobacterium
DVPSSSVSRVRG

SEQ ID NO: 1106551 - protein, 7 aa, Mycobacterium
DVRSATA

SEQ ID NO: 1106552 - protein, 9 aa, Mycobacterium
DVSKQRVEG

SEQ ID NO: 1106553 - protein, 7 aa, Mycobacterium
DVTAGGG

SEQ ID NO: 1106554 - protein, 15 aa, Mycobacterium
DVTGNVAGADSQLRT

SEQ ID NO: 1106555 - protein, 7 aa, Mycobacterium
DWAGAQA

SEQ ID NO: 1106556 - protein, 10 aa, Mycobacterium
DWDASTNSVV

SEQ ID NO: 1106557 - protein, 6 aa, Mycobacterium
DYAPTV

SEQ ID NO: 1106558 - protein, 6 aa, Mycobacterium
DYASSV

SEQ ID NO: 1106559 - protein, 13 aa, Mycobacterium
DYDPATGTYVGPD

SEQ ID NO: 1106560 - protein, 6 aa, Mycobacterium
DYDQRQ

SEQ ID NO: 1106561 - protein, 8 aa, Mycobacterium
DYENEPIE

SEQ ID NO: 1106562 - protein, 20 aa, Mycobacterium
DYPDEAPLAEDYDETPADDT

SEQ ID NO: 1106563 - protein, 7 aa, Mycobacterium
DYRTGSE

SEQ ID NO: 1106564 - protein, 26 aa, Mycobacterium
DYTGSSGSAGVSGGGAVAGSTTGADD

SEQ ID NO: 1106565 - protein, 7 aa, Mycobacterium
DYYSPQA

SEQ ID NO: 1106566 - protein, 5 aa, Mycobacterium
EAADI

SEQ ID NO: 1106567 - protein, 6 aa, Mycobacterium
EAAGQI

SEQ ID NO: 1106568 - protein, 14 aa, Mycobacterium
EAAGVDNAAYPSDR

SEQ ID NO: 1106569 - protein, 5 aa, Mycobacterium
EAAKQ

SEQ ID NO: 1106570 - protein, 10 aa, Mycobacterium
EAAKSSRRRR

SEQ ID NO: 1106571 - protein, 9 aa, Mycobacterium
EAAPSTKPV

SEQ ID NO: 1106572 - protein, 7 aa, Mycobacterium
EAAPTGA

SEQ ID NO: 1106573 - protein, 13 aa, Mycobacterium
EAAPVTGPPRSLP

SEQ ID NO: 1106574 - protein, 14 aa, Mycobacterium
EAAPVTGPPRSLPA

SEQ ID NO: 1106575 - protein, 23 aa, Mycobacterium
EAARSAPQARAPFGGRLSDSKPV

SEQ ID NO: 1106576 - protein, 10 aa, Mycobacterium
EAARSVGESS

SEQ ID NO: 1106577 - protein, 16 aa, Mycobacterium
EAASPDAGLPTAPPVI

SEQ ID NO: 1106578 - protein, 8 aa, Mycobacterium
EAATNPSE

SEQ ID NO: 1106579 - protein, 7 aa, Mycobacterium
EAATPTN

SEQ ID NO: 1106580 - protein, 20 aa, Mycobacterium
EAATSHRDRRLPRPANGAIS

SEQ ID NO: 1106581 - protein, 10 aa, Mycobacterium
EAAVEGDEAL

SEQ ID NO: 1106582 - protein, 7 aa, Mycobacterium
EADTANV

SEQ ID NO: 1106583 - protein, 6 aa, Mycobacterium
EADTTH

SEQ ID NO: 1106584 - protein, 4 aa, Mycobacterium
EADV

SEQ ID NO: 1106585 - protein, 34 aa, Mycobacterium
EAEDSEADEAEASEADEAEASEADEAEAAPRSPM

SEQ ID NO: 1106586 - protein, 8 aa, Mycobacterium
EAEGGMGP

SEQ ID NO: 1106587 - protein, 13 aa, Mycobacterium
EAEHAAAEEERDL

SEQ ID NO: 1106588 - protein, 32 aa, Mycobacterium
EAGAGNDRVGEAGAGNDRVGEAGADDPAGERS

SEQ ID NO: 1106589 - protein, 16 aa, Mycobacterium
EAGDVGVDTAATPDGG

SEQ ID NO: 1106590 - protein, 13 aa, Mycobacterium
EAGEAADREPMTT

SEQ ID NO: 1106591 - protein, 6 aa, Mycobacterium
EAGGLY

SEQ ID NO: 1106592 - protein, 8 aa, Mycobacterium
EAGKYSEA

SEQ ID NO: 1106593 - protein, 9 aa, Mycobacterium
EAGPASVEE

SEQ ID NO: 1106594 - protein, 9 aa, Mycobacterium
EAGPDSGLR

SEQ ID NO: 1106595 - protein, 4 aa, Mycobacterium
EAGR

SEQ ID NO: 1106596 - protein, 6 aa, Mycobacterium
EAGRRS

SEQ ID NO: 1106597 - protein, 11 aa, Mycobacterium
EAGSYGKDTRG

SEQ ID NO: 1106598 - protein, 11 aa, Mycobacterium
EAGTPAVEPET

SEQ ID NO: 1106599 - protein, 9 aa, Mycobacterium
EAHDQTPLR

SEQ ID NO: 1106600 - protein, 6 aa, Mycobacterium
EAHGGG

SEQ ID NO: 1106601 - protein, 5 aa, Mycobacterium
EAHTY

SEQ ID NO: 1106602 - protein, 8 aa, Mycobacterium
EAIGPDAA

SEQ ID NO: 1106603 - protein, 8 aa, Mycobacterium
EAIPGDNL

SEQ ID NO: 1106604 - protein, 7 aa, Mycobacterium
EAKADVK

SEQ ID NO: 1106605 - protein, 6 aa, Mycobacterium
EALGPD

SEQ ID NO: 1106606 - protein, 24 aa, Mycobacterium
EALPRPDSAEASAEPGDPAATDGR

SEQ ID NO: 1106607 - protein, 7 aa, Mycobacterium
EANRAGT

SEQ ID NO: 1106608 - protein, 8 aa, Mycobacterium
EANRDEHR

SEQ ID NO: 1106609 - protein, 5 aa, Mycobacterium
EANRV

SEQ ID NO: 1106610 - protein, 5 aa, Mycobacterium
EAPAG

SEQ ID NO: 1106611 - protein, 9 aa, Mycobacterium
EAPAISPPH

SEQ ID NO: 1106612 - protein, 7 aa, Mycobacterium
EAPARET

SEQ ID NO: 1106613 - protein, 7 aa, Mycobacterium
EAPAVDG

SEQ ID NO: 1106614 - protein, 8 aa, Mycobacterium
EAPDGDGP

SEQ ID NO: 1106615 - protein, 12 aa, Mycobacterium
EAPLTGESEPVL

SEQ ID NO: 1106616 - protein, 9 aa, Mycobacterium
EAPPEPHPH

SEQ ID NO: 1106617 - protein, 36 aa, Mycobacterium
EAPPRDRPDPDPRIEPAGEPAPPVPDGPIDADLDPE

SEQ ID NO: 1106618 - protein, 8 aa, Mycobacterium
EAPQLPSG

SEQ ID NO: 1106619 - protein, 9 aa, Mycobacterium
EAPQQAPRT

SEQ ID NO: 1106620 - protein, 17 aa, Mycobacterium
EAPSVNPEVTPPERISS

SEQ ID NO: 1106621 - protein, 18 aa, Mycobacterium
EAPTAVPAPSRLVVDDDA

SEQ ID NO: 1106622 - protein, 10 aa, Mycobacterium
EAQAASDAAK

SEQ ID NO: 1106623 - protein, 18 aa, Mycobacterium
EAQDPVATVPPGSPLPTF

SEQ ID NO: 1106624 - protein, 8 aa, Mycobacterium
EAQPGTDG

SEQ ID NO: 1106625 - protein, 13 aa, Mycobacterium
EAQQNFGSQQAEL

SEQ ID NO: 1106626 - protein, 4 aa, Mycobacterium
EAQR

SEQ ID NO: 1106627 - protein, 9 aa, Mycobacterium
EAQRHNGLT

SEQ ID NO: 1106628 - protein, 7 aa, Mycobacterium
EAQTDAL

SEQ ID NO: 1106629 - protein, 8 aa, Mycobacterium
EARADEAE

SEQ ID NO: 1106630 - protein, 16 aa, Mycobacterium
EARAGRLSARRTSQRG

SEQ ID NO: 1106631 - protein, 12 aa, Mycobacterium
EARASGADPEAA

SEQ ID NO: 1106632 - protein, 24 aa, Mycobacterium
EARREAKRRATSGPVREATPIPRR

SEQ ID NO: 1106633 - protein, 8 aa, Mycobacterium
EARRTKPR

SEQ ID NO: 1106634 - protein, 12 aa, Mycobacterium
EARTNGEDKESA

SEQ ID NO: 1106635 - protein, 8 aa, Mycobacterium
EASASKAK

SEQ ID NO: 1106636 - protein, 7 aa, Mycobacterium
EASCDRE

SEQ ID NO: 1106637 - protein, 19 aa, Mycobacterium
EASEPETEGLGSVEGDEVA

SEQ ID NO: 1106638 - protein, 6 aa, Mycobacterium
EASGGT

SEQ ID NO: 1106639 - protein, 8 aa, Mycobacterium
EASNDVGS

SEQ ID NO: 1106640 - protein, 10 aa, Mycobacterium
EASQRAQRQA

SEQ ID NO: 1106641 - protein, 5 aa, Mycobacterium
EASRR

SEQ ID NO: 1106642 - protein, 28 aa, Mycobacterium
EASSGGGDEADATEEDIDGPRERAAAPK

SEQ ID NO: 1106643 - protein, 13 aa, Mycobacterium
EATAGEASTSVRS

SEQ ID NO: 1106644 - protein, 5 aa, Mycobacterium
EATDA

SEQ ID NO: 1106645 - protein, 10 aa, Mycobacterium
EATGSETPKW

SEQ ID NO: 1106646 - protein, 10 aa, Mycobacterium
EATQPPTTSF

SEQ ID NO: 1106647 - protein, 15 aa, Mycobacterium
EATRFGGKPAGDSVK

SEQ ID NO: 1106648 - protein, 16 aa, Mycobacterium
EATTTEEVKAILMAAD

SEQ ID NO: 1106649 - protein, 13 aa, Mycobacterium
EAVPTPVDDENRK

SEQ ID NO: 1106650 - protein, 10 aa, Mycobacterium
EAVSGDTGYT

SEQ ID NO: 1106651 - protein, 9 aa, Mycobacterium
EAVTEGRVG

SEQ ID NO: 1106652 - protein, 4 aa, Mycobacterium
EAYT

SEQ ID NO: 1106653 - protein, 14 aa, Mycobacterium
ECVDGSRGNSARHL

SEQ ID NO: 1106654 - protein, 12 aa, Mycobacterium
ECVNGTRGNSAD

SEQ ID NO: 1106655 - protein, 4 aa, Mycobacterium
EDAD

SEQ ID NO: 1106656 - protein, 7 aa, Mycobacterium
EDADTSV

SEQ ID NO: 1106657 - protein, 7 aa, Mycobacterium
EDAEPTS

SEQ ID NO: 1106658 - protein, 9 aa, Mycobacterium
EDANSAAGE

SEQ ID NO: 1106659 - protein, 24 aa, Mycobacterium
EDDAPTTPEPAGRSRKKPRKEPAL

SEQ ID NO: 1106660 - protein, 6 aa, Mycobacterium
EDDEAA

SEQ ID NO: 1106661 - protein, 10 aa, Mycobacterium
EDDPDEPPVV

SEQ ID NO: 1106662 - protein, 12 aa, Mycobacterium
EDDTATSRRRGG

SEQ ID NO: 1106663 - protein, 7 aa, Mycobacterium
EDETSGK

SEQ ID NO: 1106664 - protein, 4 aa, Mycobacterium
EDEY

SEQ ID NO: 1106665 - protein, 12 aa, Mycobacterium
EDGAPDELTARD

SEQ ID NO: 1106666 - protein, 13 aa, Mycobacterium
EDGEPFGAERNRP

SEQ ID NO: 1106667 - protein, 10 aa, Mycobacterium
EDGNDGARYG

SEQ ID NO: 1106668 - protein, 8 aa, Mycobacterium
EDLDAGGM

SEQ ID NO: 1106669 - protein, 5 aa, Mycobacterium
EDLDG

SEQ ID NO: 1106670 - protein, 18 aa, Mycobacterium
EDNGSGGVQVGNGSGLTG

SEQ ID NO: 1106671 - protein, 13 aa, Mycobacterium
EDNTTYDLTGQTE

SEQ ID NO: 1106672 - protein, 5 aa, Mycobacterium
EDPAV

SEQ ID NO: 1106673 - protein, 6 aa, Mycobacterium
EDPGRR

SEQ ID NO: 1106674 - protein, 23 aa, Mycobacterium
EDPKFASSVRGGTLRAPSTRRRL

SEQ ID NO: 1106675 - protein, 8 aa, Mycobacterium
EDPPRPSV

SEQ ID NO: 1106676 - protein, 13 aa, Mycobacterium
EDPRTADERRNDA

SEQ ID NO: 1106677 - protein, 16 aa, Mycobacterium
EDPSVHPSTDAGARDR

SEQ ID NO: 1106678 - protein, 16 aa, Mycobacterium
EDPVPPSQRHAGISPE

SEQ ID NO: 1106679 - protein, 11 aa, Mycobacterium
EDRAELTDGRA

SEQ ID NO: 1106680 - protein, 17 aa, Mycobacterium
EDRGASAQGQPLRAGDD

SEQ ID NO: 1106681 - protein, 5 aa, Mycobacterium
EDRGF

SEQ ID NO: 1106682 - protein, 14 aa, Mycobacterium
EDRRRAEQTKADTE

SEQ ID NO: 1106683 - protein, 9 aa, Mycobacterium
EDSGAQPVA

SEQ ID NO: 1106684 - protein, 11 aa, Mycobacterium
EDSPTSSGTIG

SEQ ID NO: 1106685 - protein, 8 aa, Mycobacterium
EDTGRTSL

SEQ ID NO: 1106686 - protein, 4 aa, Mycobacterium
EDTR

SEQ ID NO: 1106687 - protein, 12 aa, Mycobacterium
EDVETRPPGKPA

SEQ ID NO: 1106688 - protein, 6 aa, Mycobacterium
EDYEAA

SEQ ID NO: 1106689 - protein, 8 aa, Mycobacterium
EEAAETDN

SEQ ID NO: 1106690 - protein, 11 aa, Mycobacterium
EEAEAEAAEAL

SEQ ID NO: 1106691 - protein, 7 aa, Mycobacterium
EEAEAEH

SEQ ID NO: 1106692 - protein, 4 aa, Mycobacterium
EECG

SEQ ID NO: 1106693 - protein, 30 aa, Mycobacterium
EEEPSEPDRRLAPDSPTVLPARDGRPGGRV

SEQ ID NO: 1106694 - protein, 15 aa, Mycobacterium
EEERQLEADEAAERE

SEQ ID NO: 1106695 - protein, 7 aa, Mycobacterium
EEGGGTS

SEQ ID NO: 1106696 - protein, 7 aa, Mycobacterium
EEGKGGR

SEQ ID NO: 1106697 - protein, 4 aa, Mycobacterium
EEGR

SEQ ID NO: 1106698 - protein, 6 aa, Mycobacterium
EEGREL

SEQ ID NO: 1106699 - protein, 8 aa, Mycobacterium
EEGSADQV

SEQ ID NO: 1106700 - protein, 5 aa, Mycobacterium
EEGST

SEQ ID NO: 1106701 - protein, 12 aa, Mycobacterium
EEIDDDGRPAAE

SEQ ID NO: 1106702 - protein, 8 aa, Mycobacterium
EEIDPGPL

SEQ ID NO: 1106703 - protein, 5 aa, Mycobacterium
EEKEV

SEQ ID NO: 1106704 - protein, 13 aa, Mycobacterium
EELGRSESHRDAL

SEQ ID NO: 1106705 - protein, 6 aa, Mycobacterium
EELPGT

SEQ ID NO: 1106706 - protein, 11 aa, Mycobacterium
EENTDGFEHTT

SEQ ID NO: 1106707 - protein, 7 aa, Mycobacterium
EEPGGEP

SEQ ID NO: 1106708 - protein, 5 aa, Mycobacterium
EEPVN

SEQ ID NO: 1106709 - protein, 14 aa, Mycobacterium
EEQEERARLDRDEE

SEQ ID NO: 1106710 - protein, 15 aa, Mycobacterium
EEQRRRADSEGQNKS

SEQ ID NO: 1106711 - protein, 8 aa, Mycobacterium
EERAQHAA

SEQ ID NO: 1106712 - protein, 5 aa, Mycobacterium
EERNR

SEQ ID NO: 1106713 - protein, 10 aa, Mycobacterium
EESALPADTD

SEQ ID NO: 1106714 - protein, 9 aa, Mycobacterium
EESTANLRE

SEQ ID NO: 1106715 - protein, 98 aa, Mycobacterium
EETLDAARTQTETQPEPEAEPHAETEPQHEPEAEDEAQPEPEAEPQAEPEPEPEAEAGPTPEAEAEATPEPEATPEAEAAPLAEAAAQPPSAPQQSAC

SEQ ID NO: 1106716 - protein, 14 aa, Mycobacterium
EETTREPEAAAPVP

SEQ ID NO: 1106717 - protein, 8 aa, Mycobacterium
EEVAGTAR

SEQ ID NO: 1106718 - protein, 9 aa, Mycobacterium
EEVDRTPVT

SEQ ID NO: 1106719 - protein, 5 aa, Mycobacterium
EEVGA

SEQ ID NO: 1106720 - protein, 11 aa, Mycobacterium
EEVRDPARTIP

SEQ ID NO: 1106721 - protein, 28 aa, Mycobacterium
EEVSDAASQPMSPQVSAPESNAPGGQVD

SEQ ID NO: 1106722 - protein, 7 aa, Mycobacterium
EFDSDSS

SEQ ID NO: 1106723 - protein, 10 aa, Mycobacterium
EFPAARQPHR

SEQ ID NO: 1106724 - protein, 9 aa, Mycobacterium
EFPAPDTHA

SEQ ID NO: 1106725 - protein, 5 aa, Mycobacterium
EFPGK

SEQ ID NO: 1106726 - protein, 5 aa, Mycobacterium
EFPRS

SEQ ID NO: 1106727 - protein, 9 aa, Mycobacterium
EGADKPVGR

SEQ ID NO: 1106728 - protein, 8 aa, Mycobacterium
EGAEEGLS

SEQ ID NO: 1106729 - protein, 17 aa, Mycobacterium
EGAGAAARLESGQTIPL

SEQ ID NO: 1106730 - protein, 6 aa, Mycobacterium
EGAGAV

SEQ ID NO: 1106731 - protein, 15 aa, Mycobacterium
EGAGGTTKLRPGDAI

SEQ ID NO: 1106732 - protein, 12 aa, Mycobacterium
EGAGRPDPTAMS

SEQ ID NO: 1106733 - protein, 9 aa, Mycobacterium
EGARSVRPV

SEQ ID NO: 1106734 - protein, 8 aa, Mycobacterium
EGATGAPI

SEQ ID NO: 1106735 - protein, 4 aa, Mycobacterium
EGDD

SEQ ID NO: 1106736 - protein, 8 aa, Mycobacterium
EGDPEESI

SEQ ID NO: 1106737 - protein, 9 aa, Mycobacterium
EGDPGSAEA

SEQ ID NO: 1106738 - protein, 7 aa, Mycobacterium
EGDTVTI

SEQ ID NO: 1106739 - protein, 7 aa, Mycobacterium
EGEQPDE

SEQ ID NO: 1106740 - protein, 18 aa, Mycobacterium
EGERPSDELGEESNSTNG

SEQ ID NO: 1106741 - protein, 14 aa, Mycobacterium
EGETTAQGLGGTAN

SEQ ID NO: 1106742 - protein, 4 aa, Mycobacterium
EGGE

SEQ ID NO: 1106743 - protein, 12 aa, Mycobacterium
EGGGPAAQPLAA

SEQ ID NO: 1106744 - protein, 12 aa, Mycobacterium
EGGIEAPSGGAP

SEQ ID NO: 1106745 - protein, 7 aa, Mycobacterium
EGGSVRV

SEQ ID NO: 1106746 - protein, 12 aa, Mycobacterium
EGGTWKVCSTGP

SEQ ID NO: 1106747 - protein, 4 aa, Mycobacterium
EGGY

SEQ ID NO: 1106748 - protein, 12 aa, Mycobacterium
EGHDPTNPDNQG

SEQ ID NO: 1106749 - protein, 16 aa, Mycobacterium
EGKETRGNGTAAATVT

SEQ ID NO: 1106750 - protein, 13 aa, Mycobacterium
EGLDDTQSLNSTV

SEQ ID NO: 1106751 - protein, 10 aa, Mycobacterium
EGLRGNGDDV

SEQ ID NO: 1106752 - protein, 18 aa, Mycobacterium
EGLRGQGERIGEATTDAN

SEQ ID NO: 1106753 - protein, 6 aa, Mycobacterium
EGLSTR

SEQ ID NO: 1106754 - protein, 7 aa, Mycobacterium
EGMSASG

SEQ ID NO: 1106755 - protein, 9 aa, Mycobacterium
EGMSATGPQ

SEQ ID NO: 1106756 - protein, 11 aa, Mycobacterium
EGPGMRPEDAQ

SEQ ID NO: 1106757 - protein, 6 aa, Mycobacterium
EGPGRA

SEQ ID NO: 1106758 - protein, 10 aa, Mycobacterium
EGPKPPASAL

SEQ ID NO: 1106759 - protein, 11 aa, Mycobacterium
EGPNPARPPSD

SEQ ID NO: 1106760 - protein, 6 aa, Mycobacterium
EGPRHQ

SEQ ID NO: 1106761 - protein, 6 aa, Mycobacterium
EGQGAT

SEQ ID NO: 1106762 - protein, 5 aa, Mycobacterium
EGQHE

SEQ ID NO: 1106763 - protein, 7 aa, Mycobacterium
EGQMEAS

SEQ ID NO: 1106764 - protein, 5 aa, Mycobacterium
EGQSH

SEQ ID NO: 1106765 - protein, 8 aa, Mycobacterium
EGRDPENA

SEQ ID NO: 1106766 - protein, 7 aa, Mycobacterium
EGRDPIA

SEQ ID NO: 1106767 - protein, 5 aa, Mycobacterium
EGRIP

SEQ ID NO: 1106768 - protein, 17 aa, Mycobacterium
EGRPTVDPAAEVTGRRD

SEQ ID NO: 1106769 - protein, 12 aa, Mycobacterium
EGRVDTASYAPR

SEQ ID NO: 1106770 - protein, 7 aa, Mycobacterium
EGSDSLD

SEQ ID NO: 1106771 - protein, 6 aa, Mycobacterium
EGSGFS

SEQ ID NO: 1106772 - protein, 7 aa, Mycobacterium
EGSRVSS

SEQ ID NO: 1106773 - protein, 6 aa, Mycobacterium
EGSSRR

SEQ ID NO: 1106774 - protein, 9 aa, Mycobacterium
EGTAPPASD

SEQ ID NO: 1106775 - protein, 4 aa, Mycobacterium
EGTD

SEQ ID NO: 1106776 - protein, 27 aa, Mycobacterium
EGTDSPADPVPFRSTSPAQRRSKVSNE

SEQ ID NO: 1106777 - protein, 6 aa, Mycobacterium
EGTGPF

SEQ ID NO: 1106778 - protein, 13 aa, Mycobacterium
EGTRESETGGTFT

SEQ ID NO: 1106779 - protein, 8 aa, Mycobacterium
EGTSEAAG

SEQ ID NO: 1106780 - protein, 4 aa, Mycobacterium
EGVD

SEQ ID NO: 1106781 - protein, 5 aa, Mycobacterium
EGVGA

SEQ ID NO: 1106782 - protein, 7 aa, Mycobacterium
EGVGPAA

SEQ ID NO: 1106783 - protein, 8 aa, Mycobacterium
EGVRGKGE

SEQ ID NO: 1106784 - protein, 5 aa, Mycobacterium
EGVRR

SEQ ID NO: 1106785 - protein, 9 aa, Mycobacterium
EGYDTPTAV

SEQ ID NO: 1106786 - protein, 11 aa, Mycobacterium
EHAEEAGARHE

SEQ ID NO: 1106787 - protein, 5 aa, Mycobacterium
EHDDS

SEQ ID NO: 1106788 - protein, 4 aa, Mycobacterium
EHDG

SEQ ID NO: 1106789 - protein, 15 aa, Mycobacterium
EHGERVKAATTAATL

SEQ ID NO: 1106790 - protein, 18 aa, Mycobacterium
EHGRQVPNPLPRSAIGKT

SEQ ID NO: 1106791 - protein, 12 aa, Mycobacterium
EHHDESRLAQRR

SEQ ID NO: 1106792 - protein, 6 aa, Mycobacterium
EHHGGK

SEQ ID NO: 1106793 - protein, 12 aa, Mycobacterium
EHHPATAAQRVP

SEQ ID NO: 1106794 - protein, 19 aa, Mycobacterium
EHHRPAAHAADANRDVTPA

SEQ ID NO: 1106795 - protein, 6 aa, Mycobacterium
EHPAGS

SEQ ID NO: 1106796 - protein, 14 aa, Mycobacterium
EHPDASGAALAASR

SEQ ID NO: 1106797 - protein, 8 aa, Mycobacterium
EHPEASQD

SEQ ID NO: 1106798 - protein, 13 aa, Mycobacterium
EHPYPTDAGVGAT

SEQ ID NO: 1106799 - protein, 16 aa, Mycobacterium
EHRATAERHAASGDWA

SEQ ID NO: 1106800 - protein, 8 aa, Mycobacterium
EHSGDGPH

SEQ ID NO: 1106801 - protein, 4 aa, Mycobacterium
EHSQ

SEQ ID NO: 1106802 - protein, 14 aa, Mycobacterium
EHTAPDGGSPAVGA

SEQ ID NO: 1106803 - protein, 7 aa, Mycobacterium
EHTEPGT

SEQ ID NO: 1106804 - protein, 4 aa, Mycobacterium
EHTK

SEQ ID NO: 1106805 - protein, 15 aa, Mycobacterium
EIDEAEYRDRLAALR

SEQ ID NO: 1106806 - protein, 4 aa, Mycobacterium
EIDL

SEQ ID NO: 1106807 - protein, 7 aa, Mycobacterium
EIDPGPM

SEQ ID NO: 1106808 - protein, 21 aa, Mycobacterium
EIDPPDPSLATSPVVNTTRSS

SEQ ID NO: 1106809 - protein, 8 aa, Mycobacterium
EIHGGTAS

SEQ ID NO: 1106810 - protein, 5 aa, Mycobacterium
EIHPD

SEQ ID NO: 1106811 - protein, 10 aa, Mycobacterium
EIPKSPNGQD

SEQ ID NO: 1106812 - protein, 4 aa, Mycobacterium
EIPQ

SEQ ID NO: 1106813 - protein, 16 aa, Mycobacterium
EIPSAAADLARDSLPG

SEQ ID NO: 1106814 - protein, 22 aa, Mycobacterium
EIPSDKVKSTLGAAHPRHGSPY

SEQ ID NO: 1106815 - protein, 5 aa, Mycobacterium
EITED

SEQ ID NO: 1106816 - protein, 9 aa, Mycobacterium
EITGGNDPV

SEQ ID NO: 1106817 - protein, 44 aa, Mycobacterium
EKESDAEPEGEAQAAEPEVEAETADGAGESDAAGESEGEPEPEP

SEQ ID NO: 1106818 - protein, 4 aa, Mycobacterium
EKGD

SEQ ID NO: 1106819 - protein, 7 aa, Mycobacterium
EKGRGRA

SEQ ID NO: 1106820 - protein, 15 aa, Mycobacterium
EKHGAPAAASGADAE

SEQ ID NO: 1106821 - protein, 8 aa, Mycobacterium
EKHNADGS

SEQ ID NO: 1106822 - protein, 11 aa, Mycobacterium
EKHRERGADLA

SEQ ID NO: 1106823 - protein, 6 aa, Mycobacterium
EKIATD

SEQ ID NO: 1106824 - protein, 16 aa, Mycobacterium
EKIATDGVVTDGASAV

SEQ ID NO: 1106825 - protein, 17 aa, Mycobacterium
EKIATDGVVTDGSSAVD

SEQ ID NO: 1106826 - protein, 11 aa, Mycobacterium
EKLGKKAQARL

SEQ ID NO: 1106827 - protein, 10 aa, Mycobacterium
EKLGKRAAAR

SEQ ID NO: 1106828 - protein, 9 aa, Mycobacterium
EKLRQGTEV

SEQ ID NO: 1106829 - protein, 4 aa, Mycobacterium
EKMG

SEQ ID NO: 1106830 - protein, 8 aa, Mycobacterium
EKNLAGKA

SEQ ID NO: 1106831 - protein, 11 aa, Mycobacterium
EKPGISDPPHP

SEQ ID NO: 1106832 - protein, 6 aa, Mycobacterium
EKPSAW

SEQ ID NO: 1106833 - protein, 6 aa, Mycobacterium
EKPTTL

SEQ ID NO: 1106834 - protein, 7 aa, Mycobacterium
EKPTVTN

SEQ ID NO: 1106835 - protein, 6 aa, Mycobacterium
EKQPEL

SEQ ID NO: 1106836 - protein, 6 aa, Mycobacterium
EKRSDL

SEQ ID NO: 1106837 - protein, 7 aa, Mycobacterium
EKTGSDW

SEQ ID NO: 1106838 - protein, 35 aa, Mycobacterium
EKTGYTAALPTPRTPMPSDASGDTPHAVDTADPEL

SEQ ID NO: 1106839 - protein, 6 aa, Mycobacterium
EKTSLD

SEQ ID NO: 1106840 - protein, 7 aa, Mycobacterium
EKVPDDE

SEQ ID NO: 1106841 - protein, 7 aa, Mycobacterium
EKYPQGP

SEQ ID NO: 1106842 - protein, 13 aa, Mycobacterium
EKYRADNKITDTW

SEQ ID NO: 1106843 - protein, 5 aa, Mycobacterium
ELADK

SEQ ID NO: 1106844 - protein, 12 aa, Mycobacterium
ELAEEAGRAEAI

SEQ ID NO: 1106845 - protein, 6 aa, Mycobacterium
ELAGDA

SEQ ID NO: 1106846 - protein, 5 aa, Mycobacterium
ELAPN

SEQ ID NO: 1106847 - protein, 12 aa, Mycobacterium
ELAQQQPAAAPT

SEQ ID NO: 1106848 - protein, 8 aa, Mycobacterium
ELDDPATH

SEQ ID NO: 1106849 - protein, 5 aa, Mycobacterium
ELDER

SEQ ID NO: 1106850 - protein, 5 aa, Mycobacterium
ELDNG

SEQ ID NO: 1106851 - protein, 8 aa, Mycobacterium
ELDPNERH

SEQ ID NO: 1106852 - protein, 17 aa, Mycobacterium
ELDPRAAAIRTQLESEI

SEQ ID NO: 1106853 - protein, 7 aa, Mycobacterium
ELEADPD

SEQ ID NO: 1106854 - protein, 15 aa, Mycobacterium
ELEPVSARPETPPLR

SEQ ID NO: 1106855 - protein, 10 aa, Mycobacterium
ELEQQKAKLA

SEQ ID NO: 1106856 - protein, 14 aa, Mycobacterium
ELGADDEADPVTAG

SEQ ID NO: 1106857 - protein, 5 aa, Mycobacterium
ELGHK

SEQ ID NO: 1106858 - protein, 10 aa, Mycobacterium
ELGRNGDHKQ

SEQ ID NO: 1106859 - protein, 15 aa, Mycobacterium
ELHGGTASLEASPLG

SEQ ID NO: 1106860 - protein, 24 aa, Mycobacterium
ELHRSPPPRRRPWRQRGQDTARSA

SEQ ID NO: 1106861 - protein, 7 aa, Mycobacterium
ELNPEQR

SEQ ID NO: 1106862 - protein, 10 aa, Mycobacterium
ELPAPAAEPL

SEQ ID NO: 1106863 - protein, 4 aa, Mycobacterium
ELPE

SEQ ID NO: 1106864 - protein, 10 aa, Mycobacterium
ELPKPPPVDL

SEQ ID NO: 1106865 - protein, 5 aa, Mycobacterium
ELPNS

SEQ ID NO: 1106866 - protein, 36 aa, Mycobacterium
ELPPPKSDHSLKPPQSIAESGPDIVQQTSAKRRRAA

SEQ ID NO: 1106867 - protein, 10 aa, Mycobacterium
ELPQKPECDE

SEQ ID NO: 1106868 - protein, 11 aa, Mycobacterium
ELPSPARSSAR

SEQ ID NO: 1106869 - protein, 8 aa, Mycobacterium
ELQRTGGL

SEQ ID NO: 1106870 - protein, 8 aa, Mycobacterium
ELRTSESE

SEQ ID NO: 1106871 - protein, 6 aa, Mycobacterium
ELSNNA

SEQ ID NO: 1106872 - protein, 9 aa, Mycobacterium
ELSTARDAA

SEQ ID NO: 1106873 - protein, 17 aa, Mycobacterium
ELTANTRDTDTASLNQS

SEQ ID NO: 1106874 - protein, 13 aa, Mycobacterium
ELTDDGGSGRSSR

SEQ ID NO: 1106875 - protein, 8 aa, Mycobacterium
ELTEAQRV

SEQ ID NO: 1106876 - protein, 22 aa, Mycobacterium
ELTKGADGRVSAADTGEREEVP

SEQ ID NO: 1106877 - protein, 7 aa, Mycobacterium
EMEKSVD

SEQ ID NO: 1106878 - protein, 9 aa, Mycobacterium
EMGSVDRES

SEQ ID NO: 1106879 - protein, 21 aa, Mycobacterium
EMQADSQSAKPDQPAAPTQIA

SEQ ID NO: 1106880 - protein, 34 aa, Mycobacterium
EMQSEGKSDNPPATPITSERVDTNPTAEQPDKRS

SEQ ID NO: 1106881 - protein, 11 aa, Mycobacterium
EMRASPREAET

SEQ ID NO: 1106882 - protein, 6 aa, Mycobacterium
ENAHTS

SEQ ID NO: 1106883 - protein, 8 aa, Mycobacterium
ENASEHPI

SEQ ID NO: 1106884 - protein, 5 aa, Mycobacterium
ENDKR

SEQ ID NO: 1106885 - protein, 5 aa, Mycobacterium
ENGGR

SEQ ID NO: 1106886 - protein, 8 aa, Mycobacterium
ENGPNRLP

SEQ ID NO: 1106887 - protein, 8 aa, Mycobacterium
ENGTTSSQ

SEQ ID NO: 1106888 - protein, 8 aa, Mycobacterium
ENGWRDEQ

SEQ ID NO: 1106889 - protein, 22 aa, Mycobacterium
ENLETDEGPRIQAEPDDVEEKV

SEQ ID NO: 1106890 - protein, 7 aa, Mycobacterium
ENMRSAP

SEQ ID NO: 1106891 - protein, 18 aa, Mycobacterium
ENNVETRNYTYTGSGGVP

SEQ ID NO: 1106892 - protein, 23 aa, Mycobacterium
ENPPLPSDEAPAAGGPAVEESPV

SEQ ID NO: 1106893 - protein, 12 aa, Mycobacterium
ENPSESNEGEGL

SEQ ID NO: 1106894 - protein, 6 aa, Mycobacterium
ENPVTD

SEQ ID NO: 1106895 - protein, 13 aa, Mycobacterium
ENQDGDDGNLPID

SEQ ID NO: 1106896 - protein, 7 aa, Mycobacterium
ENSPKRL

SEQ ID NO: 1106897 - protein, 7 aa, Mycobacterium
ENSRPDQ

SEQ ID NO: 1106898 - protein, 13 aa, Mycobacterium
ENTDPGANDTQTP

SEQ ID NO: 1106899 - protein, 15 aa, Mycobacterium
ENTGEPVRDEQGRVR

SEQ ID NO: 1106900 - protein, 5 aa, Mycobacterium
ENVGA

SEQ ID NO: 1106901 - protein, 9 aa, Mycobacterium
ENVSGCGAQ

SEQ ID NO: 1106902 - protein, 11 aa, Mycobacterium
EPAAGQTVPQD

SEQ ID NO: 1106903 - protein, 10 aa, Mycobacterium
EPAATDRRRP

SEQ ID NO: 1106904 - protein, 11 aa, Mycobacterium
EPADAFGPEGP

SEQ ID NO: 1106905 - protein, 14 aa, Mycobacterium
EPAEELRSARSPQE

SEQ ID NO: 1106906 - protein, 10 aa, Mycobacterium
EPAELGDRRP

SEQ ID NO: 1106907 - protein, 5 aa, Mycobacterium
EPAEV

SEQ ID NO: 1106908 - protein, 4 aa, Mycobacterium
EPAF

SEQ ID NO: 1106909 - protein, 19 aa, Mycobacterium
EPAITNSPAAVSPSTVGGE

SEQ ID NO: 1106910 - protein, 6 aa, Mycobacterium
EPAKIG

SEQ ID NO: 1106911 - protein, 4 aa, Mycobacterium
EPAN

SEQ ID NO: 1106912 - protein, 9 aa, Mycobacterium
EPAPDGRAA

SEQ ID NO: 1106913 - protein, 7 aa, Mycobacterium
EPAPEPV

SEQ ID NO: 1106914 - protein, 8 aa, Mycobacterium
EPAPISPA

SEQ ID NO: 1106915 - protein, 10 aa, Mycobacterium
EPAPNGRDAL

SEQ ID NO: 1106916 - protein, 9 aa, Mycobacterium
EPAPPGTAA

SEQ ID NO: 1106917 - protein, 9 aa, Mycobacterium
EPASGVAPA

SEQ ID NO: 1106918 - protein, 9 aa, Mycobacterium
EPCASTDRP

SEQ ID NO: 1106919 - protein, 10 aa, Mycobacterium
EPCATTPTPF

SEQ ID NO: 1106920 - protein, 5 aa, Mycobacterium
EPDAN

SEQ ID NO: 1106921 - protein, 14 aa, Mycobacterium
EPDMPRPYRTPGGV

SEQ ID NO: 1106922 - protein, 8 aa, Mycobacterium
EPDPESRP

SEQ ID NO: 1106923 - protein, 11 aa, Mycobacterium
EPEGPGSLPDR

SEQ ID NO: 1106924 - protein, 9 aa, Mycobacterium
EPEGYSTPI

SEQ ID NO: 1106925 - protein, 6 aa, Mycobacterium
EPEKVN

SEQ ID NO: 1106926 - protein, 7 aa, Mycobacterium
EPETERA

SEQ ID NO: 1106927 - protein, 16 aa, Mycobacterium
EPFDPYSSAGTSSHHP

SEQ ID NO: 1106928 - protein, 55 aa, Mycobacterium
EPFSTAPSPQPSSTSTPAPTPSSTPSSAIEQPQDGSGDKEQKKEEKKREGRGNGN

SEQ ID NO: 1106929 - protein, 6 aa, Mycobacterium
EPGYAD

SEQ ID NO: 1106930 - protein, 7 aa, Mycobacterium
EPHAAED

SEQ ID NO: 1106931 - protein, 10 aa, Mycobacterium
EPKGNGRARG

SEQ ID NO: 1106932 - protein, 59 aa, Mycobacterium
EPKLSVTTDRDLDDEKTDGEEDTTSQEEPDGTEDSAAEDQQPEDSASGDPGPEAGNRSW

SEQ ID NO: 1106933 - protein, 4 aa, Mycobacterium
EPLD

SEQ ID NO: 1106934 - protein, 5 aa, Mycobacterium
EPLER

SEQ ID NO: 1106935 - protein, 18 aa, Mycobacterium
EPLPAATPLDDHQDHDHV

SEQ ID NO: 1106936 - protein, 18 aa, Mycobacterium
EPLPAGTPLDDHQDHDHV

SEQ ID NO: 1106937 - protein, 25 aa, Mycobacterium
EPLPPQRSRAARRLPPLGSAARQPM

SEQ ID NO: 1106938 - protein, 21 aa, Mycobacterium
EPLPSDGPDIAAAGADEETEW

SEQ ID NO: 1106939 - protein, 6 aa, Mycobacterium
EPMAGT

SEQ ID NO: 1106940 - protein, 30 aa, Mycobacterium
EPMHDGGGYPAPESAPRRDHADPTSHPDRE

SEQ ID NO: 1106941 - protein, 4 aa, Mycobacterium
EPMP

SEQ ID NO: 1106942 - protein, 5 aa, Mycobacterium
EPMTD

SEQ ID NO: 1106943 - protein, 13 aa, Mycobacterium
EPNKQAQVTNTTQ

SEQ ID NO: 1106944 - protein, 19 aa, Mycobacterium
EPPGGSTRPTTPVFAELPL

SEQ ID NO: 1106945 - protein, 8 aa, Mycobacterium
EPPGPYSR

SEQ ID NO: 1106946 - protein, 5 aa, Mycobacterium
EPPRV

SEQ ID NO: 1106947 - protein, 14 aa, Mycobacterium
EPRPLPDHGERMPR

SEQ ID NO: 1106948 - protein, 6 aa, Mycobacterium
EPRPTP

SEQ ID NO: 1106949 - protein, 11 aa, Mycobacterium
EPRSDSGPYLK

SEQ ID NO: 1106950 - protein, 18 aa, Mycobacterium
EPSGDDDADLSGTEDEQR

SEQ ID NO: 1106951 - protein, 14 aa, Mycobacterium
EPSTTNRRSPKTSS

SEQ ID NO: 1106952 - protein, 15 aa, Mycobacterium
EPTEGDDTEAWAPQP

SEQ ID NO: 1106953 - protein, 11 aa, Mycobacterium
EPTSAGAPRVP

SEQ ID NO: 1106954 - protein, 5 aa, Mycobacterium
EPTTA

SEQ ID NO: 1106955 - protein, 14 aa, Mycobacterium
EPTTGAVSDIEQAT

SEQ ID NO: 1106956 - protein, 16 aa, Mycobacterium
EPTVKSGTISAKQTWK

SEQ ID NO: 1106957 - protein, 5 aa, Mycobacterium
EPVEA

SEQ ID NO: 1106958 - protein, 14 aa, Mycobacterium
EPVNPPYTGLPPTG

SEQ ID NO: 1106959 - protein, 17 aa, Mycobacterium
EPVRATSGRHSSPMGRP

SEQ ID NO: 1106960 - protein, 6 aa, Mycobacterium
EPVSEQ

SEQ ID NO: 1106961 - protein, 17 aa, Mycobacterium
EPVTAPVGTPPPPVPPQ

SEQ ID NO: 1106962 - protein, 20 aa, Mycobacterium
EPYADGTAPIAARTSPPGAA

SEQ ID NO: 1106963 - protein, 24 aa, Mycobacterium
EPYNRRAEKPDGSLYPEDQPKRVE

SEQ ID NO: 1106964 - protein, 15 aa, Mycobacterium
EQAEASTAASSGSDR

SEQ ID NO: 1106965 - protein, 10 aa, Mycobacterium
EQAGAQPLNP

SEQ ID NO: 1106966 - protein, 7 aa, Mycobacterium
EQAGGES

SEQ ID NO: 1106967 - protein, 6 aa, Mycobacterium
EQAGRT

SEQ ID NO: 1106968 - protein, 7 aa, Mycobacterium
EQALRDP

SEQ ID NO: 1106969 - protein, 6 aa, Mycobacterium
EQAPAD

SEQ ID NO: 1106970 - protein, 8 aa, Mycobacterium
EQAPPRLA

SEQ ID NO: 1106971 - protein, 9 aa, Mycobacterium
EQEELERAA

SEQ ID NO: 1106972 - protein, 8 aa, Mycobacterium
EQEQSATL

SEQ ID NO: 1106973 - protein, 14 aa, Mycobacterium
EQGEFENNAPDEVR

SEQ ID NO: 1106974 - protein, 14 aa, Mycobacterium
EQGERDFVGVVDAE

SEQ ID NO: 1106975 - protein, 9 aa, Mycobacterium
EQGPMTPAR

SEQ ID NO: 1106976 - protein, 13 aa, Mycobacterium
EQGRTKAALASAR

SEQ ID NO: 1106977 - protein, 5 aa, Mycobacterium
EQISS

SEQ ID NO: 1106978 - protein, 7 aa, Mycobacterium
EQKTSHR

SEQ ID NO: 1106979 - protein, 5 aa, Mycobacterium
EQLGE

SEQ ID NO: 1106980 - protein, 12 aa, Mycobacterium
EQLGGAPADYQQ

SEQ ID NO: 1106981 - protein, 13 aa, Mycobacterium
EQLSGGDVSRENL

SEQ ID NO: 1106982 - protein, 7 aa, Mycobacterium
EQPLGDA

SEQ ID NO: 1106983 - protein, 8 aa, Mycobacterium
EQPLGDDA

SEQ ID NO: 1106984 - protein, 10 aa, Mycobacterium
EQPLGDDTRR

SEQ ID NO: 1106985 - protein, 5 aa, Mycobacterium
EQPLT

SEQ ID NO: 1106986 - protein, 33 aa, Mycobacterium
EQPQAPVVENKKPKGNGNGNGKGNGNGKGNGKG

SEQ ID NO: 1106987 - protein, 9 aa, Mycobacterium
EQQEKVPDE

SEQ ID NO: 1106988 - protein, 15 aa, Mycobacterium
EQRGTEPEETAEPAR

SEQ ID NO: 1106989 - protein, 6 aa, Mycobacterium
EQRHAN

SEQ ID NO: 1106990 - protein, 16 aa, Mycobacterium
EQRLTPAEERFEKGRR

SEQ ID NO: 1106991 - protein, 14 aa, Mycobacterium
EQRQPALSDEDAKL

SEQ ID NO: 1106992 - protein, 8 aa, Mycobacterium
EQRRQRRN

SEQ ID NO: 1106993 - protein, 6 aa, Mycobacterium
EQRSTV

SEQ ID NO: 1106994 - protein, 11 aa, Mycobacterium
EQSAGNGEPRI

SEQ ID NO: 1106995 - protein, 15 aa, Mycobacterium
EQSDAGPREAVRSTG

SEQ ID NO: 1106996 - protein, 17 aa, Mycobacterium
EQSDPGPREAVRSAGAG

SEQ ID NO: 1106997 - protein, 6 aa, Mycobacterium
EQSGLG

SEQ ID NO: 1106998 - protein, 4 aa, Mycobacterium
EQSR

SEQ ID NO: 1106999 - protein, 7 aa, Mycobacterium
EQSTKAV

SEQ ID NO: 1107000 - protein, 7 aa, Mycobacterium
EQTAATM

SEQ ID NO: 1107001 - protein, 11 aa, Mycobacterium
EQTGDPDTPPS

SEQ ID NO: 1107002 - protein, 5 aa, Mycobacterium
EQTGH

SEQ ID NO: 1107003 - protein, 6 aa, Mycobacterium
EQTPRG

SEQ ID NO: 1107004 - protein, 8 aa, Mycobacterium
EQVPAGSA

SEQ ID NO: 1107005 - protein, 6 aa, Mycobacterium
EQVTAA

SEQ ID NO: 1107006 - protein, 4 aa, Mycobacterium
EQWR

SEQ ID NO: 1107007 - protein, 18 aa, Mycobacterium
EQYTDGTPVSQHYLAVRD

SEQ ID NO: 1107008 - protein, 9 aa, Mycobacterium
ERAAEAEAL

SEQ ID NO: 1107009 - protein, 16 aa, Mycobacterium
ERAARAVEAAAQQGQL

SEQ ID NO: 1107010 - protein, 7 aa, Mycobacterium
ERAEEAQ

SEQ ID NO: 1107011 - protein, 4 aa, Mycobacterium
ERAG

SEQ ID NO: 1107012 - protein, 12 aa, Mycobacterium
ERAGEDRASGKV

SEQ ID NO: 1107013 - protein, 23 aa, Mycobacterium
ERAQSQTDLAAKAASYKVPTATV

SEQ ID NO: 1107014 - protein, 9 aa, Mycobacterium
ERATSRRSA

SEQ ID NO: 1107015 - protein, 6 aa, Mycobacterium
ERAVRS

SEQ ID NO: 1107016 - protein, 11 aa, Mycobacterium
ERDDDVKPGEV

SEQ ID NO: 1107017 - protein, 25 aa, Mycobacterium
ERDECSPDAAIGSGAGRSAAPSDGR

SEQ ID NO: 1107018 - protein, 10 aa, Mycobacterium
ERDEEDPDRL

SEQ ID NO: 1107019 - protein, 6 aa, Mycobacterium
EREAEP

SEQ ID NO: 1107020 - protein, 11 aa, Mycobacterium
EREDTAALRAS

SEQ ID NO: 1107021 - protein, 10 aa, Mycobacterium
EREGQSEEVE

SEQ ID NO: 1107022 - protein, 5 aa, Mycobacterium
ERGGP

SEQ ID NO: 1107023 - protein, 5 aa, Mycobacterium
ERGGR

SEQ ID NO: 1107024 - protein, 5 aa, Mycobacterium
ERGHR

SEQ ID NO: 1107025 - protein, 14 aa, Mycobacterium
ERGIGEPKSDRTRR

SEQ ID NO: 1107026 - protein, 8 aa, Mycobacterium
ERGVGPGD

SEQ ID NO: 1107027 - protein, 11 aa, Mycobacterium
ERHDGRSPELH

SEQ ID NO: 1107028 - protein, 36 aa, Mycobacterium
ERIGGDGTVVDGASEVDQATITGEPLPVDKATGDEV

SEQ ID NO: 1107029 - protein, 4 aa, Mycobacterium
ERKQ

SEQ ID NO: 1107030 - protein, 5 aa, Mycobacterium
ERLGT

SEQ ID NO: 1107031 - protein, 7 aa, Mycobacterium
ERLNGRG

SEQ ID NO: 1107032 - protein, 7 aa, Mycobacterium
ERNETIR

SEQ ID NO: 1107033 - protein, 6 aa, Mycobacterium
ERNPQL

SEQ ID NO: 1107034 - protein, 5 aa, Mycobacterium
ERPAL

SEQ ID NO: 1107035 - protein, 5 aa, Mycobacterium
ERPDL

SEQ ID NO: 1107036 - protein, 12 aa, Mycobacterium
ERPEGRRSPVSR

SEQ ID NO: 1107037 - protein, 13 aa, Mycobacterium
ERPGIKDPTDPVR

SEQ ID NO: 1107038 - protein, 5 aa, Mycobacterium
ERPHT

SEQ ID NO: 1107039 - protein, 80 aa, Mycobacterium
ERRAANAPAPGAKPKRTRKAQEGADAGAEAVDGSVTDAAGTDEAAGGPAAKASGNGAAKPSGGQAVSRTPKPGARPKKRK

SEQ ID NO: 1107040 - protein, 8 aa, Mycobacterium
ERRGGRSD

SEQ ID NO: 1107041 - protein, 6 aa, Mycobacterium
ERRGRA

SEQ ID NO: 1107042 - protein, 10 aa, Mycobacterium
ERRKQEAQEA

SEQ ID NO: 1107043 - protein, 9 aa, Mycobacterium
ERRKTQREL

SEQ ID NO: 1107044 - protein, 6 aa, Mycobacterium
ERRPVE

SEQ ID NO: 1107045 - protein, 9 aa, Mycobacterium
ERRSEISDG

SEQ ID NO: 1107046 - protein, 10 aa, Mycobacterium
ERRTQTGRRK

SEQ ID NO: 1107047 - protein, 16 aa, Mycobacterium
ERRTTGDPLAQGDPAA

SEQ ID NO: 1107048 - protein, 12 aa, Mycobacterium
ERRVRTGPCGDR

SEQ ID NO: 1107049 - protein, 13 aa, Mycobacterium
ERSAGAGSGRPRV

SEQ ID NO: 1107050 - protein, 5 aa, Mycobacterium
ERSAQ

SEQ ID NO: 1107051 - protein, 10 aa, Mycobacterium
ERSEQDPADP

SEQ ID NO: 1107052 - protein, 21 aa, Mycobacterium
ERSGTTVTAGPVAGSAMTPGA

SEQ ID NO: 1107053 - protein, 10 aa, Mycobacterium
ERSPTRTDQR

SEQ ID NO: 1107054 - protein, 6 aa, Mycobacterium
ERSQAF

SEQ ID NO: 1107055 - protein, 5 aa, Mycobacterium
ERSSQ

SEQ ID NO: 1107056 - protein, 5 aa, Mycobacterium
ERTGI

SEQ ID NO: 1107057 - protein, 9 aa, Mycobacterium
ERVEANTST

SEQ ID NO: 1107058 - protein, 5 aa, Mycobacterium
ERVHD

SEQ ID NO: 1107059 - protein, 12 aa, Mycobacterium
ERVTTGPGSARV

SEQ ID NO: 1107060 - protein, 10 aa, Mycobacterium
ERYKDAKGDF

SEQ ID NO: 1107061 - protein, 10 aa, Mycobacterium
ERYKDSKGDF

SEQ ID NO: 1107062 - protein, 9 aa, Mycobacterium
ESAAAGLGP

SEQ ID NO: 1107063 - protein, 9 aa, Mycobacterium
ESAAGAASG

SEQ ID NO: 1107064 - protein, 22 aa, Mycobacterium
ESAAPDVVAPERGSPQNWPDGA

SEQ ID NO: 1107065 - protein, 15 aa, Mycobacterium
ESADRSSELARKTPH

SEQ ID NO: 1107066 - protein, 11 aa, Mycobacterium
ESADTISASGF

SEQ ID NO: 1107067 - protein, 14 aa, Mycobacterium
ESAEAGKKLADADA

SEQ ID NO: 1107068 - protein, 7 aa, Mycobacterium
ESAGGAL

SEQ ID NO: 1107069 - protein, 6 aa, Mycobacterium
ESAGRA

SEQ ID NO: 1107070 - protein, 16 aa, Mycobacterium
ESAGRPLAATLAADVR

SEQ ID NO: 1107071 - protein, 9 aa, Mycobacterium
ESAGSIQPY

SEQ ID NO: 1107072 - protein, 27 aa, Mycobacterium
ESAGYQAELPERPDEPAEPTDDPTAAL

SEQ ID NO: 1107073 - protein, 10 aa, Mycobacterium
ESAITGESAP

SEQ ID NO: 1107074 - protein, 9 aa, Mycobacterium
ESAKTTDLR

SEQ ID NO: 1107075 - protein, 4 aa, Mycobacterium
ESAN

SEQ ID NO: 1107076 - protein, 7 aa, Mycobacterium
ESANPGW

SEQ ID NO: 1107077 - protein, 6 aa, Mycobacterium
ESARRT

SEQ ID NO: 1107078 - protein, 7 aa, Mycobacterium
ESARSSA

SEQ ID NO: 1107079 - protein, 10 aa, Mycobacterium
ESATEEQRAE

SEQ ID NO: 1107080 - protein, 7 aa, Mycobacterium
ESDPDAA

SEQ ID NO: 1107081 - protein, 9 aa, Mycobacterium
ESDVHTDRP

SEQ ID NO: 1107082 - protein, 14 aa, Mycobacterium
ESDWRPSTEKEADP

SEQ ID NO: 1107083 - protein, 7 aa, Mycobacterium
ESEGATV

SEQ ID NO: 1107084 - protein, 7 aa, Mycobacterium
ESETERM

SEQ ID NO: 1107085 - protein, 8 aa, Mycobacterium
ESGANDGL

SEQ ID NO: 1107086 - protein, 21 aa, Mycobacterium
ESGANGVAGNLDSAGQSAEDV

SEQ ID NO: 1107087 - protein, 11 aa, Mycobacterium
ESGEVSTTPLK

SEQ ID NO: 1107088 - protein, 7 aa, Mycobacterium
ESGFNDA

SEQ ID NO: 1107089 - protein, 11 aa, Mycobacterium
ESGGLAAGNNV

SEQ ID NO: 1107090 - protein, 11 aa, Mycobacterium
ESGSAASNTAL

SEQ ID NO: 1107091 - protein, 16 aa, Mycobacterium
ESGSQLGLESLPLVWD

SEQ ID NO: 1107092 - protein, 8 aa, Mycobacterium
ESHAARRA

SEQ ID NO: 1107093 - protein, 8 aa, Mycobacterium
ESKSQTMR

SEQ ID NO: 1107094 - protein, 8 aa, Mycobacterium
ESLPPRTP

SEQ ID NO: 1107095 - protein, 14 aa, Mycobacterium
ESLQSRDAVVEYRA

SEQ ID NO: 1107096 - protein, 8 aa, Mycobacterium
ESLRTATR

SEQ ID NO: 1107097 - protein, 4 aa, Mycobacterium
ESLS

SEQ ID NO: 1107098 - protein, 5 aa, Mycobacterium
ESMEP

SEQ ID NO: 1107099 - protein, 25 aa, Mycobacterium
ESPEAEVSATGYAKEMGDDYKAREA

SEQ ID NO: 1107100 - protein, 11 aa, Mycobacterium
ESPGEPSPLAA

SEQ ID NO: 1107101 - protein, 5 aa, Mycobacterium
ESPGF

SEQ ID NO: 1107102 - protein, 6 aa, Mycobacterium
ESPRGE

SEQ ID NO: 1107103 - protein, 6 aa, Mycobacterium
ESPVRA

SEQ ID NO: 1107104 - protein, 8 aa, Mycobacterium
ESQPPAGV

SEQ ID NO: 1107105 - protein, 15 aa, Mycobacterium
ESRPYIGGSQTNSIT

SEQ ID NO: 1107106 - protein, 6 aa, Mycobacterium
ESRRRV

SEQ ID NO: 1107107 - protein, 13 aa, Mycobacterium
ESRRSRTPALDAG

SEQ ID NO: 1107108 - protein, 7 aa, Mycobacterium
ESRSEHP

SEQ ID NO: 1107109 - protein, 26 aa, Mycobacterium
ESRSRAGRRPDSEARHERGNPSPTVE

SEQ ID NO: 1107110 - protein, 139 aa, Mycobacterium
ESSDSTASGSEPSSAGYEPPPIEQTQSAPPPAQDYLPPPAYDAPPAYPPSPGYEQQPGYPPSGGFAAPDYPPPPAGYPPPYPDAGPPPPHPGYGAPGYGAPSYPPPPPYGTMPGGYPPAGGYPDAGYGYGAPAPQGTNS

SEQ ID NO: 1107111 - protein, 12 aa, Mycobacterium
ESSGRHDRISGA

SEQ ID NO: 1107112 - protein, 6 aa, Mycobacterium
ESSPRH

SEQ ID NO: 1107113 - protein, 11 aa, Mycobacterium
ESTADLDNTLG

SEQ ID NO: 1107114 - protein, 8 aa, Mycobacterium
ESTEVTGG

SEQ ID NO: 1107115 - protein, 9 aa, Mycobacterium
ESTGPAAPL

SEQ ID NO: 1107116 - protein, 16 aa, Mycobacterium
ESTPPRQLSPAPAGRD

SEQ ID NO: 1107117 - protein, 5 aa, Mycobacterium
ESTQR

SEQ ID NO: 1107118 - protein, 4 aa, Mycobacterium
ESTR

SEQ ID NO: 1107119 - protein, 8 aa, Mycobacterium
ESTSGSFQ

SEQ ID NO: 1107120 - protein, 4 aa, Mycobacterium
ESTY

SEQ ID NO: 1107121 - protein, 6 aa, Mycobacterium
ESVASG

SEQ ID NO: 1107122 - protein, 7 aa, Mycobacterium
ESVETTR

SEQ ID NO: 1107123 - protein, 9 aa, Mycobacterium
ESVGTGQGG

SEQ ID NO: 1107124 - protein, 4 aa, Mycobacterium
ESVP

SEQ ID NO: 1107125 - protein, 5 aa, Mycobacterium
ESVPA

SEQ ID NO: 1107126 - protein, 9 aa, Mycobacterium
ESVPRRREA

SEQ ID NO: 1107127 - protein, 4 aa, Mycobacterium
ESVR

SEQ ID NO: 1107128 - protein, 19 aa, Mycobacterium
ESVSGTADLGKQGPSQSNA

SEQ ID NO: 1107129 - protein, 7 aa, Mycobacterium
ESVSSGP

SEQ ID NO: 1107130 - protein, 7 aa, Mycobacterium
ESWSTRS

SEQ ID NO: 1107131 - protein, 6 aa, Mycobacterium
ETAAQG

SEQ ID NO: 1107132 - protein, 4 aa, Mycobacterium
ETAE

SEQ ID NO: 1107133 - protein, 10 aa, Mycobacterium
ETAERRSQQA

SEQ ID NO: 1107134 - protein, 7 aa, Mycobacterium
ETAPTRP

SEQ ID NO: 1107135 - protein, 19 aa, Mycobacterium
ETARRTDSHATEPTQSDLQ

SEQ ID NO: 1107136 - protein, 4 aa, Mycobacterium
ETDA

SEQ ID NO: 1107137 - protein, 7 aa, Mycobacterium
ETDADAA

SEQ ID NO: 1107138 - protein, 17 aa, Mycobacterium
ETDAEGKPRAQYDGEPA

SEQ ID NO: 1107139 - protein, 6 aa, Mycobacterium
ETDPFG

SEQ ID NO: 1107140 - protein, 10 aa, Mycobacterium
ETDRRAEVRD

SEQ ID NO: 1107141 - protein, 10 aa, Mycobacterium
ETDTDAAGTT

SEQ ID NO: 1107142 - protein, 4 aa, Mycobacterium
ETEE

SEQ ID NO: 1107143 - protein, 14 aa, Mycobacterium
ETEPAPAPRNARTE

SEQ ID NO: 1107144 - protein, 6 aa, Mycobacterium
ETEPVP

SEQ ID NO: 1107145 - protein, 7 aa, Mycobacterium
ETESEHP

SEQ ID NO: 1107146 - protein, 7 aa, Mycobacterium
ETGEDKN

SEQ ID NO: 1107147 - protein, 16 aa, Mycobacterium
ETGEKTPVLGQGETAT

SEQ ID NO: 1107148 - protein, 5 aa, Mycobacterium
ETGLQ

SEQ ID NO: 1107149 - protein, 4 aa, Mycobacterium
ETGP

SEQ ID NO: 1107150 - protein, 6 aa, Mycobacterium
ETGTAV

SEQ ID NO: 1107151 - protein, 7 aa, Mycobacterium
ETHGPRR

SEQ ID NO: 1107152 - protein, 7 aa, Mycobacterium
ETINPER

SEQ ID NO: 1107153 - protein, 9 aa, Mycobacterium
ETKAESRGQ

SEQ ID NO: 1107154 - protein, 8 aa, Mycobacterium
ETKAETRG

SEQ ID NO: 1107155 - protein, 8 aa, Mycobacterium
ETKSTTMR

SEQ ID NO: 1107156 - protein, 5 aa, Mycobacterium
ETLDN

SEQ ID NO: 1107157 - protein, 12 aa, Mycobacterium
ETLPADHRRPLK

SEQ ID NO: 1107158 - protein, 6 aa, Mycobacterium
ETNDTA

SEQ ID NO: 1107159 - protein, 8 aa, Mycobacterium
ETNRAPFD

SEQ ID NO: 1107160 - protein, 6 aa, Mycobacterium
ETNTGL

SEQ ID NO: 1107161 - protein, 10 aa, Mycobacterium
ETPAETPVAP

SEQ ID NO: 1107162 - protein, 9 aa, Mycobacterium
ETPDPGTGQ

SEQ ID NO: 1107163 - protein, 6 aa, Mycobacterium
ETPDQV

SEQ ID NO: 1107164 - protein, 12 aa, Mycobacterium
ETPEDGSRPDSR

SEQ ID NO: 1107165 - protein, 6 aa, Mycobacterium
ETPEFD

SEQ ID NO: 1107166 - protein, 4 aa, Mycobacterium
ETPG

SEQ ID NO: 1107167 - protein, 24 aa, Mycobacterium
ETRPRASTEHTQARPLGPEAGGEV

SEQ ID NO: 1107168 - protein, 9 aa, Mycobacterium
ETRTGTREM

SEQ ID NO: 1107169 - protein, 9 aa, Mycobacterium
ETSPPGIRG

SEQ ID NO: 1107170 - protein, 10 aa, Mycobacterium
ETTPAVGAAS

SEQ ID NO: 1107171 - protein, 6 aa, Mycobacterium
ETTRNT

SEQ ID NO: 1107172 - protein, 9 aa, Mycobacterium
ETWEDGDRT

SEQ ID NO: 1107173 - protein, 17 aa, Mycobacterium
ETYDTRTQQWQSQPSLP

SEQ ID NO: 1107174 - protein, 11 aa, Mycobacterium
EVADSPKTLSA

SEQ ID NO: 1107175 - protein, 13 aa, Mycobacterium
EVDESESRTEESP

SEQ ID NO: 1107176 - protein, 5 aa, Mycobacterium
EVEGQ

SEQ ID NO: 1107177 - protein, 4 aa, Mycobacterium
EVER

SEQ ID NO: 1107178 - protein, 7 aa, Mycobacterium
EVERDAR

SEQ ID NO: 1107179 - protein, 10 aa, Mycobacterium
EVGEANPGAT

SEQ ID NO: 1107180 - protein, 17 aa, Mycobacterium
EVGKQRSVSMSPDDAPA

SEQ ID NO: 1107181 - protein, 26 aa, Mycobacterium
EVGNDPEDTRVSQLSGKEDDEQEDRL

SEQ ID NO: 1107182 - protein, 11 aa, Mycobacterium
EVGRPQSFDGA

SEQ ID NO: 1107183 - protein, 13 aa, Mycobacterium
EVGRRRGAGAASL

SEQ ID NO: 1107184 - protein, 9 aa, Mycobacterium
EVHEPRRDL

SEQ ID NO: 1107185 - protein, 9 aa, Mycobacterium
EVHNPGRDL

SEQ ID NO: 1107186 - protein, 8 aa, Mycobacterium
EVKGRGYA

SEQ ID NO: 1107187 - protein, 19 aa, Mycobacterium
EVPADATAAQIQATAKATG

SEQ ID NO: 1107188 - protein, 9 aa, Mycobacterium
EVPRGPDHR

SEQ ID NO: 1107189 - protein, 14 aa, Mycobacterium
EVPSGTPDETPRGA

SEQ ID NO: 1107190 - protein, 9 aa, Mycobacterium
EVRDPTRTI

SEQ ID NO: 1107191 - protein, 7 aa, Mycobacterium
EVREGKA

SEQ ID NO: 1107192 - protein, 13 aa, Mycobacterium
EVRTAAADGLPGD

SEQ ID NO: 1107193 - protein, 9 aa, Mycobacterium
EVSPEPEGR

SEQ ID NO: 1107194 - protein, 6 aa, Mycobacterium
EVSPGQ

SEQ ID NO: 1107195 - protein, 15 aa, Mycobacterium
EVSPKEAGSSPRHQT

SEQ ID NO: 1107196 - protein, 5 aa, Mycobacterium
EVSRT

SEQ ID NO: 1107197 - protein, 7 aa, Mycobacterium
EVTAGAA

SEQ ID NO: 1107198 - protein, 15 aa, Mycobacterium
EVTAKGVENVDEPRL

SEQ ID NO: 1107199 - protein, 8 aa, Mycobacterium
EVTPATDV

SEQ ID NO: 1107200 - protein, 5 aa, Mycobacterium
EYAAA

SEQ ID NO: 1107201 - protein, 9 aa, Mycobacterium
EYAASIPAG

SEQ ID NO: 1107202 - protein, 7 aa, Mycobacterium
EYAGDQA

SEQ ID NO: 1107203 - protein, 6 aa, Mycobacterium
EYERSE

SEQ ID NO: 1107204 - protein, 6 aa, Mycobacterium
EYGASD

SEQ ID NO: 1107205 - protein, 11 aa, Mycobacterium
EYGATDAQLQT

SEQ ID NO: 1107206 - protein, 6 aa, Mycobacterium
EYKYPE

SEQ ID NO: 1107207 - protein, 20 aa, Mycobacterium
EYPARPAPQPDIPGEEPDAA

SEQ ID NO: 1107208 - protein, 6 aa, Mycobacterium
EYPGDP

SEQ ID NO: 1107209 - protein, 6 aa, Mycobacterium
EYPQLG

SEQ ID NO: 1107210 - protein, 15 aa, Mycobacterium
EYPTDQYQPDDPALG

SEQ ID NO: 1107211 - protein, 6 aa, Mycobacterium
EYSTDA

SEQ ID NO: 1107212 - protein, 5 aa, Mycobacterium
FAAED

SEQ ID NO: 1107213 - protein, 9 aa, Mycobacterium
FAASGTGPV

SEQ ID NO: 1107214 - protein, 5 aa, Mycobacterium
FADAS

SEQ ID NO: 1107215 - protein, 9 aa, Mycobacterium
FADPDGAGY

SEQ ID NO: 1107216 - protein, 5 aa, Mycobacterium
FAENT

SEQ ID NO: 1107217 - protein, 6 aa, Mycobacterium
FAGGDP

SEQ ID NO: 1107218 - protein, 7 aa, Mycobacterium
FAGPDGG

SEQ ID NO: 1107219 - protein, 11 aa, Mycobacterium
FAGQGARTEVT

SEQ ID NO: 1107220 - protein, 6 aa, Mycobacterium
FAPGDS

SEQ ID NO: 1107221 - protein, 14 aa, Mycobacterium
FAPGGHPTTLPNPG

SEQ ID NO: 1107222 - protein, 6 aa, Mycobacterium
FASRTD

SEQ ID NO: 1107223 - protein, 9 aa, Mycobacterium
FATATAEQQ

SEQ ID NO: 1107224 - protein, 8 aa, Mycobacterium
FATTGEAS

SEQ ID NO: 1107225 - protein, 6 aa, Mycobacterium
FDDEGR

SEQ ID NO: 1107226 - protein, 8 aa, Mycobacterium
FDETAPRR

SEQ ID NO: 1107227 - protein, 8 aa, Mycobacterium
FDGRGDQL

SEQ ID NO: 1107228 - protein, 7 aa, Mycobacterium
FDPAAGT

SEQ ID NO: 1107229 - protein, 6 aa, Mycobacterium
FDPAAP

SEQ ID NO: 1107230 - protein, 10 aa, Mycobacterium
FDPAKPGRQL

SEQ ID NO: 1107231 - protein, 4 aa, Mycobacterium
FDPG

SEQ ID NO: 1107232 - protein, 6 aa, Mycobacterium
FDPPAR

SEQ ID NO: 1107233 - protein, 17 aa, Mycobacterium
FDPPGGTYSDERERRRN

SEQ ID NO: 1107234 - protein, 16 aa, Mycobacterium
FDPPREPATEAATTAE

SEQ ID NO: 1107235 - protein, 6 aa, Mycobacterium
FDQGDT

SEQ ID NO: 1107236 - protein, 45 aa, Mycobacterium
FDQNGKSEKPEQKPEKPQSAPGPAAAVPDQPAGGRSGSTPYDTDA

SEQ ID NO: 1107237 - protein, 6 aa, Mycobacterium
FDQSGL

SEQ ID NO: 1107238 - protein, 10 aa, Mycobacterium
FDSDNSGISE

SEQ ID NO: 1107239 - protein, 5 aa, Mycobacterium
FDTGR

SEQ ID NO: 1107240 - protein, 6 aa, Mycobacterium
FEATTG

SEQ ID NO: 1107241 - protein, 21 aa, Mycobacterium
FEDTDDEGYSDDEGGAQPRPS

SEQ ID NO: 1107242 - protein, 10 aa, Mycobacterium
FEGGEVDARS

SEQ ID NO: 1107243 - protein, 10 aa, Mycobacterium
FEPGRGERYA

SEQ ID NO: 1107244 - protein, 12 aa, Mycobacterium
FERTDPADVDER

SEQ ID NO: 1107245 - protein, 4 aa, Mycobacterium
FETH

SEQ ID NO: 1107246 - protein, 6 aa, Mycobacterium
FEVEGS

SEQ ID NO: 1107247 - protein, 13 aa, Mycobacterium
FGAPSGDSTADGA

SEQ ID NO: 1107248 - protein, 22 aa, Mycobacterium
FGDEDDAAGDAPVTVSTGGTTS

SEQ ID NO: 1107249 - protein, 56 aa, Mycobacterium
FGDGGRGGDGLPGQAGGNGGNAGLFGDGGAGGAGGDNARLSTEPVQAAAGGAGGNA

SEQ ID NO: 1107250 - protein, 6 aa, Mycobacterium
FGDNRA

SEQ ID NO: 1107251 - protein, 10 aa, Mycobacterium
FGDPVGPGTV

SEQ ID NO: 1107252 - protein, 12 aa, Mycobacterium
FGDRSAEELMTP

SEQ ID NO: 1107253 - protein, 7 aa, Mycobacterium
FGEEGSK

SEQ ID NO: 1107254 - protein, 10 aa, Mycobacterium
FGEQDTAPFS

SEQ ID NO: 1107255 - protein, 7 aa, Mycobacterium
FGESPSD

SEQ ID NO: 1107256 - protein, 33 aa, Mycobacterium
FGFGSASADEPPVPPPPAPADGPPPLGTPGRAY

SEQ ID NO: 1107257 - protein, 6 aa, Mycobacterium
FGGKGR

SEQ ID NO: 1107258 - protein, 9 aa, Mycobacterium
FGGTAAENE

SEQ ID NO: 1107259 - protein, 20 aa, Mycobacterium
FGKGQSRAITAESREPIRVA

SEQ ID NO: 1107260 - protein, 9 aa, Mycobacterium
FGNTGGDVF

SEQ ID NO: 1107261 - protein, 7 aa, Mycobacterium
FGPQADV

SEQ ID NO: 1107262 - protein, 4 aa, Mycobacterium
FGPT

SEQ ID NO: 1107263 - protein, 6 aa, Mycobacterium
FGPTPV

SEQ ID NO: 1107264 - protein, 4 aa, Mycobacterium
FGPV

SEQ ID NO: 1107265 - protein, 6 aa, Mycobacterium
FGRTDT

SEQ ID NO: 1107266 - protein, 8 aa, Mycobacterium
FGSNPRRN

SEQ ID NO: 1107267 - protein, 9 aa, Mycobacterium
FGSTPGHGV

SEQ ID NO: 1107268 - protein, 4 aa, Mycobacterium
FGTG

SEQ ID NO: 1107269 - protein, 9 aa, Mycobacterium
FKGKPGDLR

SEQ ID NO: 1107270 - protein, 14 aa, Mycobacterium
FKGPDSEARSSLDA

SEQ ID NO: 1107271 - protein, 4 aa, Mycobacterium
FKNG

SEQ ID NO: 1107272 - protein, 7 aa, Mycobacterium
FKSAVGP

SEQ ID NO: 1107273 - protein, 7 aa, Mycobacterium
FKTGQQI

SEQ ID NO: 1107274 - protein, 6 aa, Mycobacterium
FNESTV

SEQ ID NO: 1107275 - protein, 10 aa, Mycobacterium
FNGDPATEPI

SEQ ID NO: 1107276 - protein, 10 aa, Mycobacterium
FNGTDPSPTL

SEQ ID NO: 1107277 - protein, 8 aa, Mycobacterium
FNPETGRA

SEQ ID NO: 1107278 - protein, 9 aa, Mycobacterium
FPDRGGVTA

SEQ ID NO: 1107279 - protein, 16 aa, Mycobacterium
FPDSTTDSTRTKEVVD

SEQ ID NO: 1107280 - protein, 6 aa, Mycobacterium
FPELND

SEQ ID NO: 1107281 - protein, 16 aa, Mycobacterium
FPEPPQDGRVMVLLSY

SEQ ID NO: 1107282 - protein, 9 aa, Mycobacterium
FPGADPTRV

SEQ ID NO: 1107283 - protein, 5 aa, Mycobacterium
FPGEP

SEQ ID NO: 1107284 - protein, 5 aa, Mycobacterium
FPGLG

SEQ ID NO: 1107285 - protein, 6 aa, Mycobacterium
FPGSDS

SEQ ID NO: 1107286 - protein, 14 aa, Mycobacterium
FPNEKIDPARSGGD

SEQ ID NO: 1107287 - protein, 7 aa, Mycobacterium
FPPDDAG

SEQ ID NO: 1107288 - protein, 7 aa, Mycobacterium
FPPEIPG

SEQ ID NO: 1107289 - protein, 8 aa, Mycobacterium
FPPGADTL

SEQ ID NO: 1107290 - protein, 13 aa, Mycobacterium
FPPLSDERAPEIS

SEQ ID NO: 1107291 - protein, 5 aa, Mycobacterium
FPPQR

SEQ ID NO: 1107292 - protein, 7 aa, Mycobacterium
FPQDSPV

SEQ ID NO: 1107293 - protein, 6 aa, Mycobacterium
FPQESP

SEQ ID NO: 1107294 - protein, 8 aa, Mycobacterium
FPTDQTAR

SEQ ID NO: 1107295 - protein, 5 aa, Mycobacterium
FPTSG

SEQ ID NO: 1107296 - protein, 7 aa, Mycobacterium
FQETSND

SEQ ID NO: 1107297 - protein, 6 aa, Mycobacterium
FQGAGA

SEQ ID NO: 1107298 - protein, 6 aa, Mycobacterium
FRADDR

SEQ ID NO: 1107299 - protein, 10 aa, Mycobacterium
FRATTTTGDV

SEQ ID NO: 1107300 - protein, 6 aa, Mycobacterium
FRDRSA

SEQ ID NO: 1107301 - protein, 8 aa, Mycobacterium
FREPGDTR

SEQ ID NO: 1107302 - protein, 17 aa, Mycobacterium
FRGEADAGEDIDPDMPS

SEQ ID NO: 1107303 - protein, 11 aa, Mycobacterium
FRPRTSPPGVA

SEQ ID NO: 1107304 - protein, 7 aa, Mycobacterium
FRRHPSP

SEQ ID NO: 1107305 - protein, 6 aa, Mycobacterium
FSAGLS

SEQ ID NO: 1107306 - protein, 12 aa, Mycobacterium
FSATSPPGQRTL

SEQ ID NO: 1107307 - protein, 7 aa, Mycobacterium
FSDNSEA

SEQ ID NO: 1107308 - protein, 12 aa, Mycobacterium
FSGDDVDGDATV

SEQ ID NO: 1107309 - protein, 5 aa, Mycobacterium
FSGEA

SEQ ID NO: 1107310 - protein, 12 aa, Mycobacterium
FSGERGGPASDV

SEQ ID NO: 1107311 - protein, 5 aa, Mycobacterium
FSGGP

SEQ ID NO: 1107312 - protein, 23 aa, Mycobacterium
FSPDPDAFHPPDQKSGAPPEDPD

SEQ ID NO: 1107313 - protein, 10 aa, Mycobacterium
FSRGGPAVPQ

SEQ ID NO: 1107314 - protein, 8 aa, Mycobacterium
FSSGGSRI

SEQ ID NO: 1107315 - protein, 10 aa, Mycobacterium
FSSGSAALTG

SEQ ID NO: 1107316 - protein, 7 aa, Mycobacterium
FSSGTAV

SEQ ID NO: 1107317 - protein, 72 aa, Mycobacterium
FSSSAPRPEPVSTSTSAPSPTTPPPPPITTPPPSPAPAVTAATQQPEPQQGRDDKGPRGNGRGNGKGKGEKK

SEQ ID NO: 1107318 - protein, 8 aa, Mycobacterium
FTAPTSTV

SEQ ID NO: 1107319 - protein, 15 aa, Mycobacterium
FTDEGEEASTDQGRR

SEQ ID NO: 1107320 - protein, 9 aa, Mycobacterium
FTDGSDGFG

SEQ ID NO: 1107321 - protein, 11 aa, Mycobacterium
FTGGDNSPTLQ

SEQ ID NO: 1107322 - protein, 24 aa, Mycobacterium
FTGGELSYDSGAKTFTTVPPELAG

SEQ ID NO: 1107323 - protein, 11 aa, Mycobacterium
FTNPKTDFRNS

SEQ ID NO: 1107324 - protein, 11 aa, Mycobacterium
FTNRGTRSEEQ

SEQ ID NO: 1107325 - protein, 10 aa, Mycobacterium
FTPDPRPAPV

SEQ ID NO: 1107326 - protein, 25 aa, Mycobacterium
FTPGPDKRSVATTNGDQAPPKDPSG

SEQ ID NO: 1107327 - protein, 4 aa, Mycobacterium
FTPS

SEQ ID NO: 1107328 - protein, 7 aa, Mycobacterium
FTQTTAR

SEQ ID NO: 1107329 - protein, 14 aa, Mycobacterium
FTSEHTDEALRGTG

SEQ ID NO: 1107330 - protein, 13 aa, Mycobacterium
FTSNTEQTDTAAI

SEQ ID NO: 1107331 - protein, 5 aa, Mycobacterium
FTSTD

SEQ ID NO: 1107332 - protein, 6 aa, Mycobacterium
FTTGQE

SEQ ID NO: 1107333 - protein, 19 aa, Mycobacterium
FTTSPPAKVPSQDGRRIDY

SEQ ID NO: 1107334 - protein, 22 aa, Mycobacterium
FTTTEPPPPPTTEPPPPPPETV

SEQ ID NO: 1107335 - protein, 7 aa, Mycobacterium
FVDPAGG

SEQ ID NO: 1107336 - protein, 8 aa, Mycobacterium
FVPDSKPL

SEQ ID NO: 1107337 - protein, 9 aa, Mycobacterium
FYGSSAAPL

SEQ ID NO: 1107338 - protein, 18 aa, Mycobacterium
GAAAESSDPWNNAGTGHS

SEQ ID NO: 1107339 - protein, 6 aa, Mycobacterium
GAAAGI

SEQ ID NO: 1107340 - protein, 21 aa, Mycobacterium
GAAAGPQAPADSTDDLWLTGP

SEQ ID NO: 1107341 - protein, 19 aa, Mycobacterium
GAAANGLRYDTPQNATASV

SEQ ID NO: 1107342 - protein, 6 aa, Mycobacterium
GAAASA

SEQ ID NO: 1107343 - protein, 7 aa, Mycobacterium
GAAATLA

SEQ ID NO: 1107344 - protein, 9 aa, Mycobacterium
GAADGKPPL

SEQ ID NO: 1107345 - protein, 6 aa, Mycobacterium
GAAERR

SEQ ID NO: 1107346 - protein, 14 aa, Mycobacterium
GAAGTLEPEKRPQV

SEQ ID NO: 1107347 - protein, 7 aa, Mycobacterium
GAALAPG

SEQ ID NO: 1107348 - protein, 15 aa, Mycobacterium
GAANRTRESRRAARE

SEQ ID NO: 1107349 - protein, 15 aa, Mycobacterium
GAAPATAAPPRPATK

SEQ ID NO: 1107350 - protein, 28 aa, Mycobacterium
GAAPSGQASENGSAPAASVAAAPPAEDS

SEQ ID NO: 1107351 - protein, 7 aa, Mycobacterium
GAAQASA

SEQ ID NO: 1107352 - protein, 6 aa, Mycobacterium
GAAQKM

SEQ ID NO: 1107353 - protein, 16 aa, Mycobacterium
GAARSGARAAPVPLEV

SEQ ID NO: 1107354 - protein, 7 aa, Mycobacterium
GAASGLL

SEQ ID NO: 1107355 - protein, 15 aa, Mycobacterium
GAASPDNHDGEQARV

SEQ ID NO: 1107356 - protein, 8 aa, Mycobacterium
GAATKTGL

SEQ ID NO: 1107357 - protein, 13 aa, Mycobacterium
GAATPSGTRTVGA

SEQ ID NO: 1107358 - protein, 7 aa, Mycobacterium
GAATTLG

SEQ ID NO: 1107359 - protein, 9 aa, Mycobacterium
GAATTVGAT

SEQ ID NO: 1107360 - protein, 67 aa, Mycobacterium
GADATATGPAPANLPDGQPAAQPPNGQQPAAQTPGNQAGRASTPPPAAIPSGPSGPQQLSEAKAAAL

SEQ ID NO: 1107361 - protein, 63 aa, Mycobacterium
GADEADPAEQSVVAGGGSVVDDDETGLDEDRIQSPNGRSEQVHTRGDQGVRAGGAGKVSHDPG

SEQ ID NO: 1107362 - protein, 5 aa, Mycobacterium
GADEQ

SEQ ID NO: 1107363 - protein, 9 aa, Mycobacterium
GADETPTNR

SEQ ID NO: 1107364 - protein, 5 aa, Mycobacterium
GADFD

SEQ ID NO: 1107365 - protein, 15 aa, Mycobacterium
GADGAPGQNGGNAGL

SEQ ID NO: 1107366 - protein, 7 aa, Mycobacterium
GADGPGR

SEQ ID NO: 1107367 - protein, 8 aa, Mycobacterium
GADHGRIA

SEQ ID NO: 1107368 - protein, 9 aa, Mycobacterium
GADNGYSLN

SEQ ID NO: 1107369 - protein, 13 aa, Mycobacterium
GADPSPGWTPRDA

SEQ ID NO: 1107370 - protein, 11 aa, Mycobacterium
GADSAAGLGGE

SEQ ID NO: 1107371 - protein, 7 aa, Mycobacterium
GADSVTD

SEQ ID NO: 1107372 - protein, 7 aa, Mycobacterium
GADTSRL

SEQ ID NO: 1107373 - protein, 13 aa, Mycobacterium
GADVPNSGQRTNA

SEQ ID NO: 1107374 - protein, 18 aa, Mycobacterium
GAEAARRTRLPSSEAATM

SEQ ID NO: 1107375 - protein, 6 aa, Mycobacterium
GAEAAV

SEQ ID NO: 1107376 - protein, 11 aa, Mycobacterium
GAEDAAPAMSG

SEQ ID NO: 1107377 - protein, 8 aa, Mycobacterium
GAEDETGQ

SEQ ID NO: 1107378 - protein, 8 aa, Mycobacterium
GAEGPRSR

SEQ ID NO: 1107379 - protein, 7 aa, Mycobacterium
GAELPEP

SEQ ID NO: 1107380 - protein, 8 aa, Mycobacterium
GAEPAGAY

SEQ ID NO: 1107381 - protein, 15 aa, Mycobacterium
GAEPPDRRTLDGPPV

SEQ ID NO: 1107382 - protein, 10 aa, Mycobacterium
GAEPQLVPGR

SEQ ID NO: 1107383 - protein, 8 aa, Mycobacterium
GAEPTEIG

SEQ ID NO: 1107384 - protein, 14 aa, Mycobacterium
GAEPVSTPVTARTG

SEQ ID NO: 1107385 - protein, 4 aa, Mycobacterium
GAFA

SEQ ID NO: 1107386 - protein, 12 aa, Mycobacterium
GAGANTGALPYG

SEQ ID NO: 1107387 - protein, 7 aa, Mycobacterium
GAGGDGD

SEQ ID NO: 1107388 - protein, 7 aa, Mycobacterium
GAGGEAE

SEQ ID NO: 1107389 - protein, 15 aa, Mycobacterium
GAGGPGRTAELNDQR

SEQ ID NO: 1107390 - protein, 71 aa, Mycobacterium
GAGGPPVAAPPRPLPPHDPTHPAPGGRPPGATTRMTAPPRAGDPSAAGTTRLPSAPPRPPAAPEEEPQTTR

SEQ ID NO: 1107391 - protein, 7 aa, Mycobacterium
GAGGRRG

SEQ ID NO: 1107392 - protein, 5 aa, Mycobacterium
GAGKD

SEQ ID NO: 1107393 - protein, 8 aa, Mycobacterium
GAGPDAEY

SEQ ID NO: 1107394 - protein, 15 aa, Mycobacterium
GAGPHAGDKSLDRPV

SEQ ID NO: 1107395 - protein, 5 aa, Mycobacterium
GAGPL

SEQ ID NO: 1107396 - protein, 12 aa, Mycobacterium
GAGQREKVDPIP

SEQ ID NO: 1107397 - protein, 17 aa, Mycobacterium
GAGRDGSGEGAGHPNAA

SEQ ID NO: 1107398 - protein, 11 aa, Mycobacterium
GAGSPASPNPL

SEQ ID NO: 1107399 - protein, 5 aa, Mycobacterium
GAGTA

SEQ ID NO: 1107400 - protein, 6 aa, Mycobacterium
GAGTGG

SEQ ID NO: 1107401 - protein, 5 aa, Mycobacterium
GAGTL

SEQ ID NO: 1107402 - protein, 24 aa, Mycobacterium
GAGYRPEGTALAGGRELSDPALTR

SEQ ID NO: 1107403 - protein, 6 aa, Mycobacterium
GAHTEL

SEQ ID NO: 1107404 - protein, 13 aa, Mycobacterium
GAIQGGKYAAKAI

SEQ ID NO: 1107405 - protein, 13 aa, Mycobacterium
GAIRGSASEREGC

SEQ ID NO: 1107406 - protein, 15 aa, Mycobacterium
GAKAGPPSAATGIAE

SEQ ID NO: 1107407 - protein, 8 aa, Mycobacterium
GAKEKQIS

SEQ ID NO: 1107408 - protein, 6 aa, Mycobacterium
GAKINE

SEQ ID NO: 1107409 - protein, 9 aa, Mycobacterium
GAKPAKPRS

SEQ ID NO: 1107410 - protein, 24 aa, Mycobacterium
GAKQKQISATATVPAAGSVSADAD

SEQ ID NO: 1107411 - protein, 7 aa, Mycobacterium
GAKSSDH

SEQ ID NO: 1107412 - protein, 6 aa, Mycobacterium
GAKVSG

SEQ ID NO: 1107413 - protein, 19 aa, Mycobacterium
GALDGTDNESFPKPEEIGG

SEQ ID NO: 1107414 - protein, 4 aa, Mycobacterium
GALG

SEQ ID NO: 1107415 - protein, 5 aa, Mycobacterium
GALGG

SEQ ID NO: 1107416 - protein, 10 aa, Mycobacterium
GALGTTPTGT

SEQ ID NO: 1107417 - protein, 9 aa, Mycobacterium
GALKANASS

SEQ ID NO: 1107418 - protein, 6 aa, Mycobacterium
GALPAA

SEQ ID NO: 1107419 - protein, 7 aa, Mycobacterium
GALPPAR

SEQ ID NO: 1107420 - protein, 17 aa, Mycobacterium
GALPPDETPGPPQEMRQ

SEQ ID NO: 1107421 - protein, 20 aa, Mycobacterium
GALPPPDPPGRATATRPGPV

SEQ ID NO: 1107422 - protein, 6 aa, Mycobacterium
GALSGV

SEQ ID NO: 1107423 - protein, 6 aa, Mycobacterium
GALTPS

SEQ ID NO: 1107424 - protein, 7 aa, Mycobacterium
GAMSNST

SEQ ID NO: 1107425 - protein, 5 aa, Mycobacterium
GAMTA

SEQ ID NO: 1107426 - protein, 7 aa, Mycobacterium
GANNTET

SEQ ID NO: 1107427 - protein, 9 aa, Mycobacterium
GANVAPGEV

SEQ ID NO: 1107428 - protein, 5 aa, Mycobacterium
GANVT

SEQ ID NO: 1107429 - protein, 4 aa, Mycobacterium
GAPA

SEQ ID NO: 1107430 - protein, 8 aa, Mycobacterium
GAPAAREL

SEQ ID NO: 1107431 - protein, 24 aa, Mycobacterium
GAPAGIPITSEDEAEKPVVSEGVT

SEQ ID NO: 1107432 - protein, 9 aa, Mycobacterium
GAPARTGGW

SEQ ID NO: 1107433 - protein, 9 aa, Mycobacterium
GAPAVEPET

SEQ ID NO: 1107434 - protein, 8 aa, Mycobacterium
GAPAVTGA

SEQ ID NO: 1107435 - protein, 15 aa, Mycobacterium
GAPAYTAATGLTQEP

SEQ ID NO: 1107436 - protein, 5 aa, Mycobacterium
GAPDA

SEQ ID NO: 1107437 - protein, 8 aa, Mycobacterium
GAPDGPAD

SEQ ID NO: 1107438 - protein, 13 aa, Mycobacterium
GAPELADPNAGTA

SEQ ID NO: 1107439 - protein, 8 aa, Mycobacterium
GAPETPSV

SEQ ID NO: 1107440 - protein, 6 aa, Mycobacterium
GAPGAL

SEQ ID NO: 1107441 - protein, 6 aa, Mycobacterium
GAPGAV

SEQ ID NO: 1107442 - protein, 6 aa, Mycobacterium
GAPGLP

SEQ ID NO: 1107443 - protein, 5 aa, Mycobacterium
GAPGS

SEQ ID NO: 1107444 - protein, 5 aa, Mycobacterium
GAPKA

SEQ ID NO: 1107445 - protein, 11 aa, Mycobacterium
GAPNGQAAYRA

SEQ ID NO: 1107446 - protein, 7 aa, Mycobacterium
GAPPAAD

SEQ ID NO: 1107447 - protein, 13 aa, Mycobacterium
GAPPNSPAGARGV

SEQ ID NO: 1107448 - protein, 11 aa, Mycobacterium
GAPRRTQHDGD

SEQ ID NO: 1107449 - protein, 4 aa, Mycobacterium
GAPS

SEQ ID NO: 1107450 - protein, 6 aa, Mycobacterium
GAPTPI

SEQ ID NO: 1107451 - protein, 6 aa, Mycobacterium
GAPVST

SEQ ID NO: 1107452 - protein, 8 aa, Mycobacterium
GAQAPSDV

SEQ ID NO: 1107453 - protein, 18 aa, Mycobacterium
GAQGGTMANGDTKDGYRG

SEQ ID NO: 1107454 - protein, 13 aa, Mycobacterium
GAQPDGGSNTRAA

SEQ ID NO: 1107455 - protein, 6 aa, Mycobacterium
GAQPTE

SEQ ID NO: 1107456 - protein, 16 aa, Mycobacterium
GAQQTIPGGPVASQEA

SEQ ID NO: 1107457 - protein, 8 aa, Mycobacterium
GAREGASL

SEQ ID NO: 1107458 - protein, 10 aa, Mycobacterium
GARGGNRARV

SEQ ID NO: 1107459 - protein, 17 aa, Mycobacterium
GARNAPCATVPGKRAPT

SEQ ID NO: 1107460 - protein, 8 aa, Mycobacterium
GARPADAE

SEQ ID NO: 1107461 - protein, 6 aa, Mycobacterium
GARPHR

SEQ ID NO: 1107462 - protein, 5 aa, Mycobacterium
GARPL

SEQ ID NO: 1107463 - protein, 10 aa, Mycobacterium
GARPTAKTSI

SEQ ID NO: 1107464 - protein, 70 aa, Mycobacterium
GARRPGAKKAPAAPAAESTSAPAESAPAPAESAPAPAATPEPEPAPEAPSSGASDNGDTRVVGDEPPVKG

SEQ ID NO: 1107465 - protein, 68 aa, Mycobacterium
GARRPGAKKKTAAPAAAPAKPAEPEAEPQAQPEAQAEPEPEPEPEAPSQPASGNGDARVVGDEPPVKG

SEQ ID NO: 1107466 - protein, 11 aa, Mycobacterium
GARRSGMDRES

SEQ ID NO: 1107467 - protein, 13 aa, Mycobacterium
GARSAAKTQALEA

SEQ ID NO: 1107468 - protein, 5 aa, Mycobacterium
GARTR

SEQ ID NO: 1107469 - protein, 6 aa, Mycobacterium
GASAPV

SEQ ID NO: 1107470 - protein, 7 aa, Mycobacterium
GASGDLN

SEQ ID NO: 1107471 - protein, 4 aa, Mycobacterium
GASI

SEQ ID NO: 1107472 - protein, 13 aa, Mycobacterium
GASLGREGAPRQL

SEQ ID NO: 1107473 - protein, 8 aa, Mycobacterium
GASPATAT

SEQ ID NO: 1107474 - protein, 10 aa, Mycobacterium
GASPGASTAV

SEQ ID NO: 1107475 - protein, 8 aa, Mycobacterium
GASRSKNV

SEQ ID NO: 1107476 - protein, 4 aa, Mycobacterium
GASS

SEQ ID NO: 1107477 - protein, 6 aa, Mycobacterium
GASSSG

SEQ ID NO: 1107478 - protein, 7 aa, Mycobacterium
GASTQRL

SEQ ID NO: 1107479 - protein, 13 aa, Mycobacterium
GASTTSATITSHA

SEQ ID NO: 1107480 - protein, 6 aa, Mycobacterium
GATAAA

SEQ ID NO: 1107481 - protein, 11 aa, Mycobacterium
GATAERAFGRT

SEQ ID NO: 1107482 - protein, 6 aa, Mycobacterium
GATATT

SEQ ID NO: 1107483 - protein, 9 aa, Mycobacterium
GATDAPTFA

SEQ ID NO: 1107484 - protein, 10 aa, Mycobacterium
GATEVTQPWE

SEQ ID NO: 1107485 - protein, 6 aa, Mycobacterium
GATGEF

SEQ ID NO: 1107486 - protein, 9 aa, Mycobacterium
GATGSGKSV

SEQ ID NO: 1107487 - protein, 5 aa, Mycobacterium
GATLG

SEQ ID NO: 1107488 - protein, 12 aa, Mycobacterium
GATNPRNAANGY

SEQ ID NO: 1107489 - protein, 7 aa, Mycobacterium
GATPSER

SEQ ID NO: 1107490 - protein, 6 aa, Mycobacterium
GATSVF

SEQ ID NO: 1107491 - protein, 5 aa, Mycobacterium
GATVN

SEQ ID NO: 1107492 - protein, 7 aa, Mycobacterium
GATVPHG

SEQ ID NO: 1107493 - protein, 10 aa, Mycobacterium
GAVAGGQALT

SEQ ID NO: 1107494 - protein, 31 aa, Mycobacterium
GAVAPQPDWYGTSTSSSTSRGISGGGGADFD

SEQ ID NO: 1107495 - protein, 6 aa, Mycobacterium
GAVDPD

SEQ ID NO: 1107496 - protein, 6 aa, Mycobacterium
GAVPAD

SEQ ID NO: 1107497 - protein, 4 aa, Mycobacterium
GAVS

SEQ ID NO: 1107498 - protein, 13 aa, Mycobacterium
GAWAGGPGSPLQT

SEQ ID NO: 1107499 - protein, 11 aa, Mycobacterium
GAWEGPSSEQY

SEQ ID NO: 1107500 - protein, 4 aa, Mycobacterium
GAYD

SEQ ID NO: 1107501 - protein, 13 aa, Mycobacterium
GAYESIGGNGRSV

SEQ ID NO: 1107502 - protein, 8 aa, Mycobacterium
GCDTATDR

SEQ ID NO: 1107503 - protein, 4 aa, Mycobacterium
GCGG

SEQ ID NO: 1107504 - protein, 18 aa, Mycobacterium
GCTPETWDREAAGVSWDR

SEQ ID NO: 1107505 - protein, 9 aa, Mycobacterium
GDAAGSPHR

SEQ ID NO: 1107506 - protein, 13 aa, Mycobacterium
GDAAPNAGTQAET

SEQ ID NO: 1107507 - protein, 6 aa, Mycobacterium
GDAARS

SEQ ID NO: 1107508 - protein, 8 aa, Mycobacterium
GDADSARA

SEQ ID NO: 1107509 - protein, 7 aa, Mycobacterium
GDAGPDI

SEQ ID NO: 1107510 - protein, 10 aa, Mycobacterium
GDALDGSTIK

SEQ ID NO: 1107511 - protein, 8 aa, Mycobacterium
GDAPDVPG

SEQ ID NO: 1107512 - protein, 26 aa, Mycobacterium
GDAPKATTAPTTEAATAAAQPAAGDS

SEQ ID NO: 1107513 - protein, 9 aa, Mycobacterium
GDARSGVGG

SEQ ID NO: 1107514 - protein, 21 aa, Mycobacterium
GDASVGAGAGWHPDPTGRHEG

SEQ ID NO: 1107515 - protein, 7 aa, Mycobacterium
GDAVGAD

SEQ ID NO: 1107516 - protein, 7 aa, Mycobacterium
GDAYSGD

SEQ ID NO: 1107517 - protein, 10 aa, Mycobacterium
GDDATGTGGV

SEQ ID NO: 1107518 - protein, 8 aa, Mycobacterium
GDDCPDST

SEQ ID NO: 1107519 - protein, 11 aa, Mycobacterium
GDDGDMDATGL

SEQ ID NO: 1107520 - protein, 9 aa, Mycobacterium
GDDPLDDAE

SEQ ID NO: 1107521 - protein, 11 aa, Mycobacterium
GDDQDGTAGEA

SEQ ID NO: 1107522 - protein, 9 aa, Mycobacterium
GDDRSGSKA

SEQ ID NO: 1107523 - protein, 13 aa, Mycobacterium
GDDSDQPESRRGS

SEQ ID NO: 1107524 - protein, 9 aa, Mycobacterium
GDDSDRATW

SEQ ID NO: 1107525 - protein, 18 aa, Mycobacterium
GDDTRESWPSTYKVRERK

SEQ ID NO: 1107526 - protein, 9 aa, Mycobacterium
GDENLRKQS

SEQ ID NO: 1107527 - protein, 11 aa, Mycobacterium
GDEQQRTRAAL

SEQ ID NO: 1107528 - protein, 9 aa, Mycobacterium
GDERPAADP

SEQ ID NO: 1107529 - protein, 11 aa, Mycobacterium
GDESLDTARTA

SEQ ID NO: 1107530 - protein, 5 aa, Mycobacterium
GDEVA

SEQ ID NO: 1107531 - protein, 8 aa, Mycobacterium
GDEVKPAD

SEQ ID NO: 1107532 - protein, 4 aa, Mycobacterium
GDFG

SEQ ID NO: 1107533 - protein, 13 aa, Mycobacterium
GDFGTTVGGQPVT

SEQ ID NO: 1107534 - protein, 7 aa, Mycobacterium
GDFPGQA

SEQ ID NO: 1107535 - protein, 7 aa, Mycobacterium
GDFRGAR

SEQ ID NO: 1107536 - protein, 9 aa, Mycobacterium
GDFSGSGAA

SEQ ID NO: 1107537 - protein, 6 aa, Mycobacterium
GDGAPA

SEQ ID NO: 1107538 - protein, 6 aa, Mycobacterium
GDGASR

SEQ ID NO: 1107539 - protein, 5 aa, Mycobacterium
GDGDV

SEQ ID NO: 1107540 - protein, 20 aa, Mycobacterium
GDGEPVTDSMQREARAESRR

SEQ ID NO: 1107541 - protein, 8 aa, Mycobacterium
GDGLGGDE

SEQ ID NO: 1107542 - protein, 7 aa, Mycobacterium
GDGPARI

SEQ ID NO: 1107543 - protein, 8 aa, Mycobacterium
GDGPLTAP

SEQ ID NO: 1107544 - protein, 6 aa, Mycobacterium
GDGPQV

SEQ ID NO: 1107545 - protein, 16 aa, Mycobacterium
GDGPRAATAAGPVDQI

SEQ ID NO: 1107546 - protein, 7 aa, Mycobacterium
GDGQETS

SEQ ID NO: 1107547 - protein, 4 aa, Mycobacterium
GDGS

SEQ ID NO: 1107548 - protein, 12 aa, Mycobacterium
GDGTNDAPALAQ

SEQ ID NO: 1107549 - protein, 13 aa, Mycobacterium
GDGVARGLADRRR

SEQ ID NO: 1107550 - protein, 12 aa, Mycobacterium
GDGVNDAPALKA

SEQ ID NO: 1107551 - protein, 12 aa, Mycobacterium
GDGVNDAPALKK

SEQ ID NO: 1107552 - protein, 13 aa, Mycobacterium
GDGVNDAPALKSA

SEQ ID NO: 1107553 - protein, 11 aa, Mycobacterium
GDGVNDAPALQ

SEQ ID NO: 1107554 - protein, 7 aa, Mycobacterium
GDHPETA

SEQ ID NO: 1107555 - protein, 8 aa, Mycobacterium
GDHRGAPG

SEQ ID NO: 1107556 - protein, 8 aa, Mycobacterium
GDIARRDE

SEQ ID NO: 1107557 - protein, 7 aa, Mycobacterium
GDIDEDE

SEQ ID NO: 1107558 - protein, 9 aa, Mycobacterium
GDIDRRTAE

SEQ ID NO: 1107559 - protein, 6 aa, Mycobacterium
GDIGTA

SEQ ID NO: 1107560 - protein, 6 aa, Mycobacterium
GDIPDS

SEQ ID NO: 1107561 - protein, 15 aa, Mycobacterium
GDISVSSDGPGTGAA

SEQ ID NO: 1107562 - protein, 18 aa, Mycobacterium
GDKEAPQVQSIPAQPNTV

SEQ ID NO: 1107563 - protein, 4 aa, Mycobacterium
GDKL

SEQ ID NO: 1107564 - protein, 6 aa, Mycobacterium
GDLARR

SEQ ID NO: 1107565 - protein, 18 aa, Mycobacterium
GDLASDAEIPASAQEAER

SEQ ID NO: 1107566 - protein, 9 aa, Mycobacterium
GDLDEDSWE

SEQ ID NO: 1107567 - protein, 9 aa, Mycobacterium
GDLGARKAR

SEQ ID NO: 1107568 - protein, 10 aa, Mycobacterium
GDLGSSAARK

SEQ ID NO: 1107569 - protein, 5 aa, Mycobacterium
GDNAV

SEQ ID NO: 1107570 - protein, 4 aa, Mycobacterium
GDNP

SEQ ID NO: 1107571 - protein, 8 aa, Mycobacterium
GDNPRAAA

SEQ ID NO: 1107572 - protein, 9 aa, Mycobacterium
GDNQATAAA

SEQ ID NO: 1107573 - protein, 6 aa, Mycobacterium
GDNQPL

SEQ ID NO: 1107574 - protein, 9 aa, Mycobacterium
GDNRTTAAA

SEQ ID NO: 1107575 - protein, 9 aa, Mycobacterium
GDNRTTATA

SEQ ID NO: 1107576 - protein, 11 aa, Mycobacterium
GDPAAGTIPEE

SEQ ID NO: 1107577 - protein, 30 aa, Mycobacterium
GDPAESEMDRKRARQLADGTPGRGLTRDGH

SEQ ID NO: 1107578 - protein, 30 aa, Mycobacterium
GDPAESEMDRKRARQLTDGTPGRGLTRDGH

SEQ ID NO: 1107579 - protein, 7 aa, Mycobacterium
GDPATVE

SEQ ID NO: 1107580 - protein, 10 aa, Mycobacterium
GDPDEPPPTA

SEQ ID NO: 1107581 - protein, 8 aa, Mycobacterium
GDPDRYLS

SEQ ID NO: 1107582 - protein, 8 aa, Mycobacterium
GDPDSAEY

SEQ ID NO: 1107583 - protein, 9 aa, Mycobacterium
GDPDVGKGE

SEQ ID NO: 1107584 - protein, 9 aa, Mycobacterium
GDPKPVERL

SEQ ID NO: 1107585 - protein, 12 aa, Mycobacterium
GDPLADDGELGR

SEQ ID NO: 1107586 - protein, 9 aa, Mycobacterium
GDPLSEHEA

SEQ ID NO: 1107587 - protein, 10 aa, Mycobacterium
GDPLSPAGVE

SEQ ID NO: 1107588 - protein, 9 aa, Mycobacterium
GDPLSPEGV

SEQ ID NO: 1107589 - protein, 6 aa, Mycobacterium
GDPPAC

SEQ ID NO: 1107590 - protein, 16 aa, Mycobacterium
GDPPKRLTSANQQMTD

SEQ ID NO: 1107591 - protein, 9 aa, Mycobacterium
GDPRGRPEL

SEQ ID NO: 1107592 - protein, 14 aa, Mycobacterium
GDPTGEGTGGPGYE

SEQ ID NO: 1107593 - protein, 11 aa, Mycobacterium
GDPVGDPRSWP

SEQ ID NO: 1107594 - protein, 6 aa, Mycobacterium
GDQAPK

SEQ ID NO: 1107595 - protein, 10 aa, Mycobacterium
GDQDTSSGVG

SEQ ID NO: 1107596 - protein, 5 aa, Mycobacterium
GDQPA

SEQ ID NO: 1107597 - protein, 10 aa, Mycobacterium
GDQPAPSGPG

SEQ ID NO: 1107598 - protein, 5 aa, Mycobacterium
GDQQY

SEQ ID NO: 1107599 - protein, 5 aa, Mycobacterium
GDRAE

SEQ ID NO: 1107600 - protein, 7 aa, Mycobacterium
GDRASAD

SEQ ID NO: 1107601 - protein, 5 aa, Mycobacterium
GDRPA

SEQ ID NO: 1107602 - protein, 9 aa, Mycobacterium
GDRPRSADR

SEQ ID NO: 1107603 - protein, 10 aa, Mycobacterium
GDRSEAAIKT

SEQ ID NO: 1107604 - protein, 12 aa, Mycobacterium
GDRVENSAPPSV

SEQ ID NO: 1107605 - protein, 7 aa, Mycobacterium
GDRYGPK

SEQ ID NO: 1107606 - protein, 15 aa, Mycobacterium
GDRYPEAAVSSLADA

SEQ ID NO: 1107607 - protein, 6 aa, Mycobacterium
GDSDAA

SEQ ID NO: 1107608 - protein, 7 aa, Mycobacterium
GDSDESV

SEQ ID NO: 1107609 - protein, 5 aa, Mycobacterium
GDSGA

SEQ ID NO: 1107610 - protein, 8 aa, Mycobacterium
GDSGGTAV

SEQ ID NO: 1107611 - protein, 9 aa, Mycobacterium
GDSPENRDV

SEQ ID NO: 1107612 - protein, 4 aa, Mycobacterium
GDSR

SEQ ID NO: 1107613 - protein, 8 aa, Mycobacterium
GDSTTRAE

SEQ ID NO: 1107614 - protein, 7 aa, Mycobacterium
GDTAATR

SEQ ID NO: 1107615 - protein, 10 aa, Mycobacterium
GDTAAYTSFD

SEQ ID NO: 1107616 - protein, 12 aa, Mycobacterium
GDTGLDTGRPQS

SEQ ID NO: 1107617 - protein, 6 aa, Mycobacterium
GDTIGR

SEQ ID NO: 1107618 - protein, 6 aa, Mycobacterium
GDTKTR

SEQ ID NO: 1107619 - protein, 6 aa, Mycobacterium
GDTPAR

SEQ ID NO: 1107620 - protein, 8 aa, Mycobacterium
GDTSPTLG

SEQ ID NO: 1107621 - protein, 17 aa, Mycobacterium
GDTSSTDDQPARARAHG

SEQ ID NO: 1107622 - protein, 7 aa, Mycobacterium
GDTTLTG

SEQ ID NO: 1107623 - protein, 7 aa, Mycobacterium
GDTVRSG

SEQ ID NO: 1107624 - protein, 8 aa, Mycobacterium
GDVDSDQD

SEQ ID NO: 1107625 - protein, 7 aa, Mycobacterium
GDVKEQG

SEQ ID NO: 1107626 - protein, 7 aa, Mycobacterium
GDVPDDL

SEQ ID NO: 1107627 - protein, 7 aa, Mycobacterium
GDWAGGA

SEQ ID NO: 1107628 - protein, 14 aa, Mycobacterium
GDYPGAREKQRESV

SEQ ID NO: 1107629 - protein, 18 aa, Mycobacterium
GEAAPASTATDADERGAA

SEQ ID NO: 1107630 - protein, 23 aa, Mycobacterium
GEAEAEALAADADADADAEAEDL

SEQ ID NO: 1107631 - protein, 25 aa, Mycobacterium
GEAEAEALAADAEAEAEAEAEAEDL

SEQ ID NO: 1107632 - protein, 5 aa, Mycobacterium
GEAGM

SEQ ID NO: 1107633 - protein, 5 aa, Mycobacterium
GEAGR

SEQ ID NO: 1107634 - protein, 10 aa, Mycobacterium
GEAGSTPAAH

SEQ ID NO: 1107635 - protein, 55 aa, Mycobacterium
GEAPPSEPTRHRAEPELDYEPEPERHGQPEPAPYGQPEPGLYGQPELGRYGQPEL

SEQ ID NO: 1107636 - protein, 8 aa, Mycobacterium
GEDAGGDP

SEQ ID NO: 1107637 - protein, 46 aa, Mycobacterium
GEDAVAAEEAHEGAAEAEAVANGVAADDAAALEGEDGAAEEPLDED

SEQ ID NO: 1107638 - protein, 47 aa, Mycobacterium
GEDAVAAEESAEEAHEAAVEGAAEAEAVADEVAGADAGEPEPEPEPV

SEQ ID NO: 1107639 - protein, 7 aa, Mycobacterium
GEDDARA

SEQ ID NO: 1107640 - protein, 11 aa, Mycobacterium
GEDDGGDGDTV

SEQ ID NO: 1107641 - protein, 12 aa, Mycobacterium
GEDMKVSNVGFV

SEQ ID NO: 1107642 - protein, 9 aa, Mycobacterium
GEDTDPVST

SEQ ID NO: 1107643 - protein, 8 aa, Mycobacterium
GEEPGGAT

SEQ ID NO: 1107644 - protein, 7 aa, Mycobacterium
GEEPTRV

SEQ ID NO: 1107645 - protein, 12 aa, Mycobacterium
GEETKDPGRTPG

SEQ ID NO: 1107646 - protein, 6 aa, Mycobacterium
GEFGRD

SEQ ID NO: 1107647 - protein, 6 aa, Mycobacterium
GEGEGQ

SEQ ID NO: 1107648 - protein, 5 aa, Mycobacterium
GEGGA

SEQ ID NO: 1107649 - protein, 9 aa, Mycobacterium
GEGGAGPAA

SEQ ID NO: 1107650 - protein, 19 aa, Mycobacterium
GEGGGPLSETPQNPEPYPD

SEQ ID NO: 1107651 - protein, 5 aa, Mycobacterium
GEGSV

SEQ ID NO: 1107652 - protein, 4 aa, Mycobacterium
GEGT

SEQ ID NO: 1107653 - protein, 20 aa, Mycobacterium
GEGTDRPCPNPDLPLPTKHS

SEQ ID NO: 1107654 - protein, 18 aa, Mycobacterium
GEGTDRPCPNPELPLPTK

SEQ ID NO: 1107655 - protein, 6 aa, Mycobacterium
GEHGGL

SEQ ID NO: 1107656 - protein, 16 aa, Mycobacterium
GEIGSSRTVGYAEHGA

SEQ ID NO: 1107657 - protein, 13 aa, Mycobacterium
GEIPEERPNPYAL

SEQ ID NO: 1107658 - protein, 9 aa, Mycobacterium
GEIPGGGTA

SEQ ID NO: 1107659 - protein, 17 aa, Mycobacterium
GEKIAADGTVVEGASAV

SEQ ID NO: 1107660 - protein, 5 aa, Mycobacterium
GEKNV

SEQ ID NO: 1107661 - protein, 10 aa, Mycobacterium
GEKSPSGVSS

SEQ ID NO: 1107662 - protein, 6 aa, Mycobacterium
GELDRR

SEQ ID NO: 1107663 - protein, 9 aa, Mycobacterium
GELSTEDDH

SEQ ID NO: 1107664 - protein, 15 aa, Mycobacterium
GELTDARAARRLADP

SEQ ID NO: 1107665 - protein, 7 aa, Mycobacterium
GEMPEPN

SEQ ID NO: 1107666 - protein, 18 aa, Mycobacterium
GENDAEPPDPKDLSHSTA

SEQ ID NO: 1107667 - protein, 12 aa, Mycobacterium
GENDLDHPKRTS

SEQ ID NO: 1107668 - protein, 6 aa, Mycobacterium
GENKSV

SEQ ID NO: 1107669 - protein, 7 aa, Mycobacterium
GEPAERS

SEQ ID NO: 1107670 - protein, 7 aa, Mycobacterium
GEPAPIG

SEQ ID NO: 1107671 - protein, 7 aa, Mycobacterium
GEPDGGT

SEQ ID NO: 1107672 - protein, 6 aa, Mycobacterium
GEPDNG

SEQ ID NO: 1107673 - protein, 9 aa, Mycobacterium
GEPGESRSA

SEQ ID NO: 1107674 - protein, 5 aa, Mycobacterium
GEPGR

SEQ ID NO: 1107675 - protein, 19 aa, Mycobacterium
GEPGSQTQTDNLRAGQPDG

SEQ ID NO: 1107676 - protein, 7 aa, Mycobacterium
GEPIPSF

SEQ ID NO: 1107677 - protein, 8 aa, Mycobacterium
GEPPFVGD

SEQ ID NO: 1107678 - protein, 6 aa, Mycobacterium
GEPQDD

SEQ ID NO: 1107679 - protein, 5 aa, Mycobacterium
GEPRL

SEQ ID NO: 1107680 - protein, 11 aa, Mycobacterium
GEPTALTDPKD

SEQ ID NO: 1107681 - protein, 50 aa, Mycobacterium
GEPTVTVDDETAVDVENPENPESPETAEAPETSVADEADETGEAGRSPVR

SEQ ID NO: 1107682 - protein, 7 aa, Mycobacterium
GEPVEVP

SEQ ID NO: 1107683 - protein, 4 aa, Mycobacterium
GEPY

SEQ ID NO: 1107684 - protein, 5 aa, Mycobacterium
GEQAS

SEQ ID NO: 1107685 - protein, 7 aa, Mycobacterium
GEQEPDY

SEQ ID NO: 1107686 - protein, 5 aa, Mycobacterium
GEQLR

SEQ ID NO: 1107687 - protein, 8 aa, Mycobacterium
GEQPAATT

SEQ ID NO: 1107688 - protein, 9 aa, Mycobacterium
GEQTEATIR

SEQ ID NO: 1107689 - protein, 6 aa, Mycobacterium
GERDAT

SEQ ID NO: 1107690 - protein, 5 aa, Mycobacterium
GERIA

SEQ ID NO: 1107691 - protein, 7 aa, Mycobacterium
GERLDPT

SEQ ID NO: 1107692 - protein, 5 aa, Mycobacterium
GERPG

SEQ ID NO: 1107693 - protein, 5 aa, Mycobacterium
GERPS

SEQ ID NO: 1107694 - protein, 7 aa, Mycobacterium
GERQPET

SEQ ID NO: 1107695 - protein, 6 aa, Mycobacterium
GERRGV

SEQ ID NO: 1107696 - protein, 8 aa, Mycobacterium
GERTEAAI

SEQ ID NO: 1107697 - protein, 7 aa, Mycobacterium
GERTEPL

SEQ ID NO: 1107698 - protein, 9 aa, Mycobacterium
GESADGAVI

SEQ ID NO: 1107699 - protein, 14 aa, Mycobacterium
GESCSASSGAPGFT

SEQ ID NO: 1107700 - protein, 7 aa, Mycobacterium
GESDSDS

SEQ ID NO: 1107701 - protein, 29 aa, Mycobacterium
GESGTPREYDYETNTATRNYTYTGSGGVP

SEQ ID NO: 1107702 - protein, 5 aa, Mycobacterium
GESPE

SEQ ID NO: 1107703 - protein, 14 aa, Mycobacterium
GESVPEEVQPGDQV

SEQ ID NO: 1107704 - protein, 11 aa, Mycobacterium
GETDIDGEGRT

SEQ ID NO: 1107705 - protein, 6 aa, Mycobacterium
GETGEI

SEQ ID NO: 1107706 - protein, 5 aa, Mycobacterium
GETPV

SEQ ID NO: 1107707 - protein, 12 aa, Mycobacterium
GETRVAATPQTV

SEQ ID NO: 1107708 - protein, 7 aa, Mycobacterium
GETVDAN

SEQ ID NO: 1107709 - protein, 12 aa, Mycobacterium
GETYESGHGRTK

SEQ ID NO: 1107710 - protein, 11 aa, Mycobacterium
GEVDGKPTEPV

SEQ ID NO: 1107711 - protein, 6 aa, Mycobacterium
GEVPTT

SEQ ID NO: 1107712 - protein, 20 aa, Mycobacterium
GEVTSEGFNPNGIPSDLSAD

SEQ ID NO: 1107713 - protein, 13 aa, Mycobacterium
GEVTSTNGEQISS

SEQ ID NO: 1107714 - protein, 8 aa, Mycobacterium
GEWPGPAT

SEQ ID NO: 1107715 - protein, 5 aa, Mycobacterium
GFADS

SEQ ID NO: 1107716 - protein, 9 aa, Mycobacterium
GFADSPEWR

SEQ ID NO: 1107717 - protein, 7 aa, Mycobacterium
GFAPGGR

SEQ ID NO: 1107718 - protein, 51 aa, Mycobacterium
GFAREKKSHPQAAAKAKEAQGAALAPSDDVAGQAKAAKVDTMDAQPAGTFD

SEQ ID NO: 1107719 - protein, 4 aa, Mycobacterium
GFGD

SEQ ID NO: 1107720 - protein, 6 aa, Mycobacterium
GFGGGT

SEQ ID NO: 1107721 - protein, 5 aa, Mycobacterium
GFGGT

SEQ ID NO: 1107722 - protein, 5 aa, Mycobacterium
GFGPD

SEQ ID NO: 1107723 - protein, 7 aa, Mycobacterium
GFGPTSE

SEQ ID NO: 1107724 - protein, 10 aa, Mycobacterium
GFSGLGSADG

SEQ ID NO: 1107725 - protein, 11 aa, Mycobacterium
GFTPGAGLSGH

SEQ ID NO: 1107726 - protein, 11 aa, Mycobacterium
GFYDDGSQSVH

SEQ ID NO: 1107727 - protein, 28 aa, Mycobacterium
GGAAPVADRPIQPSAAPTPTPEQEPQQS

SEQ ID NO: 1107728 - protein, 6 aa, Mycobacterium
GGAART

SEQ ID NO: 1107729 - protein, 9 aa, Mycobacterium
GGAATTSLG

SEQ ID NO: 1107730 - protein, 8 aa, Mycobacterium
GGADASDL

SEQ ID NO: 1107731 - protein, 6 aa, Mycobacterium
GGADDR

SEQ ID NO: 1107732 - protein, 8 aa, Mycobacterium
GGADRSRA

SEQ ID NO: 1107733 - protein, 76 aa, Mycobacterium
GGADSDEESTVAPTPSSTVAPSPSPSRTSEPPPPPPPPPPPPPPPPPSAEAPVNTGPTWRPTQRPSQTKKPEIGVT

SEQ ID NO: 1107734 - protein, 26 aa, Mycobacterium
GGAGADSSTAHQRSDDLAPHVRSDES

SEQ ID NO: 1107735 - protein, 6 aa, Mycobacterium
GGAGAI

SEQ ID NO: 1107736 - protein, 8 aa, Mycobacterium
GGAGAPPT

SEQ ID NO: 1107737 - protein, 8 aa, Mycobacterium
GGAGGAEY

SEQ ID NO: 1107738 - protein, 10 aa, Mycobacterium
GGAGLGLRDG

SEQ ID NO: 1107739 - protein, 5 aa, Mycobacterium
GGAGQ

SEQ ID NO: 1107740 - protein, 6 aa, Mycobacterium
GGAGQP

SEQ ID NO: 1107741 - protein, 71 aa, Mycobacterium
GGAKRPGAKKPAAAEPAEDKPAPAPAKGLGIAGGAKRPGAKKAAPAAGTTPAPAAESAAAAEPAKAEPEVK

SEQ ID NO: 1107742 - protein, 9 aa, Mycobacterium
GGANPLGSG

SEQ ID NO: 1107743 - protein, 25 aa, Mycobacterium
GGAPAEPPVPADAVTASGSGLDPHI

SEQ ID NO: 1107744 - protein, 7 aa, Mycobacterium
GGAPNSR

SEQ ID NO: 1107745 - protein, 4 aa, Mycobacterium
GGAS

SEQ ID NO: 1107746 - protein, 6 aa, Mycobacterium
GGASLT

SEQ ID NO: 1107747 - protein, 4 aa, Mycobacterium
GGAT

SEQ ID NO: 1107748 - protein, 10 aa, Mycobacterium
GGATEPTGAR

SEQ ID NO: 1107749 - protein, 11 aa, Mycobacterium
GGATEQASTLR

SEQ ID NO: 1107750 - protein, 23 aa, Mycobacterium
GGATWAPAAGFTAPELSPAPPLN

SEQ ID NO: 1107751 - protein, 7 aa, Mycobacterium
GGAVNDG

SEQ ID NO: 1107752 - protein, 5 aa, Mycobacterium
GGAVS

SEQ ID NO: 1107753 - protein, 27 aa, Mycobacterium
GGCASEATTTPNGATQTSTPDPVSKNR

SEQ ID NO: 1107754 - protein, 6 aa, Mycobacterium
GGCEAP

SEQ ID NO: 1107755 - protein, 9 aa, Mycobacterium
GGDAPTAMG

SEQ ID NO: 1107756 - protein, 15 aa, Mycobacterium
GGDEGLTDADRHRRK

SEQ ID NO: 1107757 - protein, 5 aa, Mycobacterium
GGDFE

SEQ ID NO: 1107758 - protein, 6 aa, Mycobacterium
GGDGGF

SEQ ID NO: 1107759 - protein, 7 aa, Mycobacterium
GGDGLPA

SEQ ID NO: 1107760 - protein, 5 aa, Mycobacterium
GGDIA

SEQ ID NO: 1107761 - protein, 12 aa, Mycobacterium
GGDKTPAPKVTK

SEQ ID NO: 1107762 - protein, 6 aa, Mycobacterium
GGDMGS

SEQ ID NO: 1107763 - protein, 13 aa, Mycobacterium
GGDPTLSAAPRNV

SEQ ID NO: 1107764 - protein, 6 aa, Mycobacterium
GGDPVL

SEQ ID NO: 1107765 - protein, 9 aa, Mycobacterium
GGDSAGSAA

SEQ ID NO: 1107766 - protein, 9 aa, Mycobacterium
GGDSGSQSP

SEQ ID NO: 1107767 - protein, 33 aa, Mycobacterium
GGDSGSVSATVASPLPSSSAPEPSAAPAPRVAA

SEQ ID NO: 1107768 - protein, 7 aa, Mycobacterium
GGDSTAA

SEQ ID NO: 1107769 - protein, 41 aa, Mycobacterium
GGDTGSPSPRIAAPPSSSSEAPSTSSASAVEGVSGTDSQGF

SEQ ID NO: 1107770 - protein, 9 aa, Mycobacterium
GGDVPTGPT

SEQ ID NO: 1107771 - protein, 23 aa, Mycobacterium
GGDVRAEARPAGGLDVAVTLTAC

SEQ ID NO: 1107772 - protein, 10 aa, Mycobacterium
GGEETRSLDS

SEQ ID NO: 1107773 - protein, 24 aa, Mycobacterium
GGEGGPGGGAGAPPGGPGGPGGGA

SEQ ID NO: 1107774 - protein, 6 aa, Mycobacterium
GGEGVE

SEQ ID NO: 1107775 - protein, 6 aa, Mycobacterium
GGELGD

SEQ ID NO: 1107776 - protein, 11 aa, Mycobacterium
GGETVSGDAQV

SEQ ID NO: 1107777 - protein, 8 aa, Mycobacterium
GGEVEPAI

SEQ ID NO: 1107778 - protein, 9 aa, Mycobacterium
GGGATGADE

SEQ ID NO: 1107779 - protein, 10 aa, Mycobacterium
GGGDKATITT

SEQ ID NO: 1107780 - protein, 7 aa, Mycobacterium
GGGDPVR

SEQ ID NO: 1107781 - protein, 4 aa, Mycobacterium
GGGE

SEQ ID NO: 1107782 - protein, 4 aa, Mycobacterium
GGGF

SEQ ID NO: 1107783 - protein, 7 aa, Mycobacterium
GGGFDGD

SEQ ID NO: 1107784 - protein, 11 aa, Mycobacterium
GGGGLRGRHSG

SEQ ID NO: 1107785 - protein, 8 aa, Mycobacterium
GGGGRSVA

SEQ ID NO: 1107786 - protein, 7 aa, Mycobacterium
GGGGTSI

SEQ ID NO: 1107787 - protein, 24 aa, Mycobacterium
GGGHGNDTKHDRSDTPEHRDSAGR

SEQ ID NO: 1107788 - protein, 7 aa, Mycobacterium
GGGHGPL

SEQ ID NO: 1107789 - protein, 19 aa, Mycobacterium
GGGNAAGPSRGIDSGANTV

SEQ ID NO: 1107790 - protein, 10 aa, Mycobacterium
GGGPAGVGNA

SEQ ID NO: 1107791 - protein, 6 aa, Mycobacterium
GGGPDG

SEQ ID NO: 1107792 - protein, 9 aa, Mycobacterium
GGGQQPDAL

SEQ ID NO: 1107793 - protein, 4 aa, Mycobacterium
GGGR

SEQ ID NO: 1107794 - protein, 6 aa, Mycobacterium
GGGTAG

SEQ ID NO: 1107795 - protein, 5 aa, Mycobacterium
GGGTD

SEQ ID NO: 1107796 - protein, 5 aa, Mycobacterium
GGGWA

SEQ ID NO: 1107797 - protein, 8 aa, Mycobacterium
GGHAGHGE

SEQ ID NO: 1107798 - protein, 4 aa, Mycobacterium
GGHD

SEQ ID NO: 1107799 - protein, 17 aa, Mycobacterium
GGHDSSNCEPVDPPAPT

SEQ ID NO: 1107800 - protein, 7 aa, Mycobacterium
GGHPSLA

SEQ ID NO: 1107801 - protein, 5 aa, Mycobacterium
GGHPV

SEQ ID NO: 1107802 - protein, 11 aa, Mycobacterium
GGHPVKRSSRL

SEQ ID NO: 1107803 - protein, 5 aa, Mycobacterium
GGIET

SEQ ID NO: 1107804 - protein, 4 aa, Mycobacterium
GGIT

SEQ ID NO: 1107805 - protein, 9 aa, Mycobacterium
GGITPGNDV

SEQ ID NO: 1107806 - protein, 9 aa, Mycobacterium
GGITPGNSV

SEQ ID NO: 1107807 - protein, 13 aa, Mycobacterium
GGKGTEAAKESSD

SEQ ID NO: 1107808 - protein, 8 aa, Mycobacterium
GGKLPPPV

SEQ ID NO: 1107809 - protein, 19 aa, Mycobacterium
GGKPGESSGRRGDNPAWKR

SEQ ID NO: 1107810 - protein, 10 aa, Mycobacterium
GGLAGEPEEI

SEQ ID NO: 1107811 - protein, 9 aa, Mycobacterium
GGLAGSAPK

SEQ ID NO: 1107812 - protein, 12 aa, Mycobacterium
GGLGLPQSTATG

SEQ ID NO: 1107813 - protein, 6 aa, Mycobacterium
GGLGPE

SEQ ID NO: 1107814 - protein, 5 aa, Mycobacterium
GGLKP

SEQ ID NO: 1107815 - protein, 9 aa, Mycobacterium
GGLKTGEDV

SEQ ID NO: 1107816 - protein, 5 aa, Mycobacterium
GGLRS

SEQ ID NO: 1107817 - protein, 20 aa, Mycobacterium
GGLTTGAPVRVSGAPAGQVQ

SEQ ID NO: 1107818 - protein, 5 aa, Mycobacterium
GGMGE

SEQ ID NO: 1107819 - protein, 14 aa, Mycobacterium
GGMPKTSSGKIQRA

SEQ ID NO: 1107820 - protein, 8 aa, Mycobacterium
GGMPRPPR

SEQ ID NO: 1107821 - protein, 7 aa, Mycobacterium
GGNETDL

SEQ ID NO: 1107822 - protein, 4 aa, Mycobacterium
GGNG

SEQ ID NO: 1107823 - protein, 11 aa, Mycobacterium
GGNRDGTAAGR

SEQ ID NO: 1107824 - protein, 11 aa, Mycobacterium
GGNYGWPSSEG

SEQ ID NO: 1107825 - protein, 61 aa, Mycobacterium
GGPDPAAVPTAATMRPGAADLDAAQPEPEPEPEPEAEQYDDSAEAPTDPRLQSGAGIADEV

SEQ ID NO: 1107826 - protein, 8 aa, Mycobacterium
GGPEGQPQ

SEQ ID NO: 1107827 - protein, 8 aa, Mycobacterium
GGPFTEAG

SEQ ID NO: 1107828 - protein, 8 aa, Mycobacterium
GGPGAGLT

SEQ ID NO: 1107829 - protein, 4 aa, Mycobacterium
GGPI

SEQ ID NO: 1107830 - protein, 6 aa, Mycobacterium
GGPKAG

SEQ ID NO: 1107831 - protein, 11 aa, Mycobacterium
GGPKSGKSSAL

SEQ ID NO: 1107832 - protein, 7 aa, Mycobacterium
GGPLPDS

SEQ ID NO: 1107833 - protein, 22 aa, Mycobacterium
GGPLTAAGDAAREIAGAGQTLG

SEQ ID NO: 1107834 - protein, 13 aa, Mycobacterium
GGPPARRSSTHGR

SEQ ID NO: 1107835 - protein, 14 aa, Mycobacterium
GGPPDPSKGRCAEV

SEQ ID NO: 1107836 - protein, 8 aa, Mycobacterium
GGPRDQLQ

SEQ ID NO: 1107837 - protein, 24 aa, Mycobacterium
GGPSGNPPVRGRTSGTETTTADPL

SEQ ID NO: 1107838 - protein, 7 aa, Mycobacterium
GGPSVED

SEQ ID NO: 1107839 - protein, 9 aa, Mycobacterium
GGQAGDKDS

SEQ ID NO: 1107840 - protein, 4 aa, Mycobacterium
GGQE

SEQ ID NO: 1107841 - protein, 6 aa, Mycobacterium
GGQEYG

SEQ ID NO: 1107842 - protein, 10 aa, Mycobacterium
GGQNDKQVVP

SEQ ID NO: 1107843 - protein, 4 aa, Mycobacterium
GGQT

SEQ ID NO: 1107844 - protein, 8 aa, Mycobacterium
GGQVTSNS

SEQ ID NO: 1107845 - protein, 12 aa, Mycobacterium
GGRAGFPMDGRS

SEQ ID NO: 1107846 - protein, 11 aa, Mycobacterium
GGRDGNGSTVR

SEQ ID NO: 1107847 - protein, 6 aa, Mycobacterium
GGRDRR

SEQ ID NO: 1107848 - protein, 8 aa, Mycobacterium
GGRFSKDI

SEQ ID NO: 1107849 - protein, 4 aa, Mycobacterium
GGRG

SEQ ID NO: 1107850 - protein, 5 aa, Mycobacterium
GGRLA

SEQ ID NO: 1107851 - protein, 4 aa, Mycobacterium
GGRP

SEQ ID NO: 1107852 - protein, 9 aa, Mycobacterium
GGRSLGRTY

SEQ ID NO: 1107853 - protein, 6 aa, Mycobacterium
GGRTTV

SEQ ID NO: 1107854 - protein, 6 aa, Mycobacterium
GGRVPR

SEQ ID NO: 1107855 - protein, 8 aa, Mycobacterium
GGSAGGHL

SEQ ID NO: 1107856 - protein, 6 aa, Mycobacterium
GGSAGS

SEQ ID NO: 1107857 - protein, 7 aa, Mycobacterium
GGSAQTP

SEQ ID NO: 1107858 - protein, 59 aa, Mycobacterium
GGSATAVDGDAVADEPPRRRATDRRRAAPKPAARKSSRGDRPVKRSAPRARQAPAPETE

SEQ ID NO: 1107859 - protein, 17 aa, Mycobacterium
GGSDANGAEDPDGDEPD

SEQ ID NO: 1107860 - protein, 31 aa, Mycobacterium
GGSGAETKNADKQSVAEAPPTPLPGENPEVK

SEQ ID NO: 1107861 - protein, 9 aa, Mycobacterium
GGSGGARDS

SEQ ID NO: 1107862 - protein, 25 aa, Mycobacterium
GGSGGVGETQGGSGGVGETQGDTRV

SEQ ID NO: 1107863 - protein, 12 aa, Mycobacterium
GGSGNADQSGAL

SEQ ID NO: 1107864 - protein, 8 aa, Mycobacterium
GGSGSSIT

SEQ ID NO: 1107865 - protein, 4 aa, Mycobacterium
GGSI

SEQ ID NO: 1107866 - protein, 4 aa, Mycobacterium
GGSK

SEQ ID NO: 1107867 - protein, 10 aa, Mycobacterium
GGSKPYGYSG

SEQ ID NO: 1107868 - protein, 9 aa, Mycobacterium
GGSLDDPLT

SEQ ID NO: 1107869 - protein, 18 aa, Mycobacterium
GGSLTGPTRGVDQGADTV

SEQ ID NO: 1107870 - protein, 10 aa, Mycobacterium
GGSPIDNAAS

SEQ ID NO: 1107871 - protein, 5 aa, Mycobacterium
GGSPM

SEQ ID NO: 1107872 - protein, 4 aa, Mycobacterium
GGTA

SEQ ID NO: 1107873 - protein, 8 aa, Mycobacterium
GGTFNNDT

SEQ ID NO: 1107874 - protein, 5 aa, Mycobacterium
GGTGS

SEQ ID NO: 1107875 - protein, 4 aa, Mycobacterium
GGTI

SEQ ID NO: 1107876 - protein, 19 aa, Mycobacterium
GGTKVSLPRSDAQATTSQV

SEQ ID NO: 1107877 - protein, 9 aa, Mycobacterium
GGTPALEQD

SEQ ID NO: 1107878 - protein, 10 aa, Mycobacterium
GGTPNSPVCD

SEQ ID NO: 1107879 - protein, 6 aa, Mycobacterium
GGTQTV

SEQ ID NO: 1107880 - protein, 7 aa, Mycobacterium
GGTRDVQ

SEQ ID NO: 1107881 - protein, 5 aa, Mycobacterium
GGTRG

SEQ ID NO: 1107882 - protein, 8 aa, Mycobacterium
GGTTEGAS

SEQ ID NO: 1107883 - protein, 6 aa, Mycobacterium
GGTTEV

SEQ ID NO: 1107884 - protein, 10 aa, Mycobacterium
GGTTGSGKSE

SEQ ID NO: 1107885 - protein, 4 aa, Mycobacterium
GGTV

SEQ ID NO: 1107886 - protein, 5 aa, Mycobacterium
GGVAM

SEQ ID NO: 1107887 - protein, 10 aa, Mycobacterium
GGVDDPAGGV

SEQ ID NO: 1107888 - protein, 4 aa, Mycobacterium
GGVE

SEQ ID NO: 1107889 - protein, 5 aa, Mycobacterium
GGVGA

SEQ ID NO: 1107890 - protein, 4 aa, Mycobacterium
GGVN

SEQ ID NO: 1107891 - protein, 6 aa, Mycobacterium
GGVNPQ

SEQ ID NO: 1107892 - protein, 4 aa, Mycobacterium
GGVP

SEQ ID NO: 1107893 - protein, 7 aa, Mycobacterium
GGVPGLS

SEQ ID NO: 1107894 - protein, 10 aa, Mycobacterium
GGVSCSSGIS

SEQ ID NO: 1107895 - protein, 7 aa, Mycobacterium
GGVYSGD

SEQ ID NO: 1107896 - protein, 5 aa, Mycobacterium
GGYSV

SEQ ID NO: 1107897 - protein, 20 aa, Mycobacterium
GHANGEPVASAGRDPEAVRN

SEQ ID NO: 1107898 - protein, 10 aa, Mycobacterium
GHDATAASDV

SEQ ID NO: 1107899 - protein, 14 aa, Mycobacterium
GHDQPTRLATPAGE

SEQ ID NO: 1107900 - protein, 5 aa, Mycobacterium
GHEGS

SEQ ID NO: 1107901 - protein, 5 aa, Mycobacterium
GHEKP

SEQ ID NO: 1107902 - protein, 8 aa, Mycobacterium
GHELDGQS

SEQ ID NO: 1107903 - protein, 6 aa, Mycobacterium
GHELRT

SEQ ID NO: 1107904 - protein, 15 aa, Mycobacterium
GHGGPGRNSGSAGDI

SEQ ID NO: 1107905 - protein, 6 aa, Mycobacterium
GHGPTV

SEQ ID NO: 1107906 - protein, 9 aa, Mycobacterium
GHKEKRLPS

SEQ ID NO: 1107907 - protein, 8 aa, Mycobacterium
GHNPRTKI

SEQ ID NO: 1107908 - protein, 5 aa, Mycobacterium
GHRAD

SEQ ID NO: 1107909 - protein, 5 aa, Mycobacterium
GHRAG

SEQ ID NO: 1107910 - protein, 7 aa, Mycobacterium
GHSDDRD

SEQ ID NO: 1107911 - protein, 6 aa, Mycobacterium
GHSDQF

SEQ ID NO: 1107912 - protein, 9 aa, Mycobacterium
GHSGGTVSA

SEQ ID NO: 1107913 - protein, 10 aa, Mycobacterium
GHSGGTVSAD

SEQ ID NO: 1107914 - protein, 4 aa, Mycobacterium
GIAA

SEQ ID NO: 1107915 - protein, 13 aa, Mycobacterium
GIAGGQPSTTRVK

SEQ ID NO: 1107916 - protein, 10 aa, Mycobacterium
GIAKRVGESL

SEQ ID NO: 1107917 - protein, 5 aa, Mycobacterium
GIDGQ

SEQ ID NO: 1107918 - protein, 5 aa, Mycobacterium
GIDPD

SEQ ID NO: 1107919 - protein, 14 aa, Mycobacterium
GIEPPVAEPEDPGV

SEQ ID NO: 1107920 - protein, 5 aa, Mycobacterium
GIGGG

SEQ ID NO: 1107921 - protein, 11 aa, Mycobacterium
GIGIDKDDQER

SEQ ID NO: 1107922 - protein, 6 aa, Mycobacterium
GIGRGD

SEQ ID NO: 1107923 - protein, 5 aa, Mycobacterium
GIKDT

SEQ ID NO: 1107924 - protein, 10 aa, Mycobacterium
GINDAPALAT

SEQ ID NO: 1107925 - protein, 12 aa, Mycobacterium
GINQAGAQLAQG

SEQ ID NO: 1107926 - protein, 10 aa, Mycobacterium
GINRDESDLA

SEQ ID NO: 1107927 - protein, 5 aa, Mycobacterium
GIPAP

SEQ ID NO: 1107928 - protein, 7 aa, Mycobacterium
GIPDPSM

SEQ ID NO: 1107929 - protein, 5 aa, Mycobacterium
GIPEF

SEQ ID NO: 1107930 - protein, 10 aa, Mycobacterium
GIRDGDERQP

SEQ ID NO: 1107931 - protein, 6 aa, Mycobacterium
GIRSDS

SEQ ID NO: 1107932 - protein, 14 aa, Mycobacterium
GIRSSRSSQQEPGA

SEQ ID NO: 1107933 - protein, 10 aa, Mycobacterium
GISAATARTV

SEQ ID NO: 1107934 - protein, 16 aa, Mycobacterium
GISATAAGVDADGVAD

SEQ ID NO: 1107935 - protein, 7 aa, Mycobacterium
GITATER

SEQ ID NO: 1107936 - protein, 8 aa, Mycobacterium
GITPAGVD

SEQ ID NO: 1107937 - protein, 16 aa, Mycobacterium
GITPRVRKPKPVPEPA

SEQ ID NO: 1107938 - protein, 4 aa, Mycobacterium
GKAE

SEQ ID NO: 1107939 - protein, 6 aa, Mycobacterium
GKAEAA

SEQ ID NO: 1107940 - protein, 11 aa, Mycobacterium
GKAGAAAGAAT

SEQ ID NO: 1107941 - protein, 10 aa, Mycobacterium
GKASPEERPA

SEQ ID NO: 1107942 - protein, 9 aa, Mycobacterium
GKDADFSNL

SEQ ID NO: 1107943 - protein, 11 aa, Mycobacterium
GKDGEEADPEA

SEQ ID NO: 1107944 - protein, 8 aa, Mycobacterium
GKEDNPEV

SEQ ID NO: 1107945 - protein, 9 aa, Mycobacterium
GKENYQGSA

SEQ ID NO: 1107946 - protein, 15 aa, Mycobacterium
GKERQELRDDPAAEL

SEQ ID NO: 1107947 - protein, 29 aa, Mycobacterium
GKETVPSNPDNPKGAYTAARTAKDQGVPI

SEQ ID NO: 1107948 - protein, 9 aa, Mycobacterium
GKGAPTQGA

SEQ ID NO: 1107949 - protein, 8 aa, Mycobacterium
GKGPSASG

SEQ ID NO: 1107950 - protein, 25 aa, Mycobacterium
GKLGARDTRVATPSGLDGPGMSTSA

SEQ ID NO: 1107951 - protein, 8 aa, Mycobacterium
GKNPEDRS

SEQ ID NO: 1107952 - protein, 12 aa, Mycobacterium
GKNSTAATKTIT

SEQ ID NO: 1107953 - protein, 4 aa, Mycobacterium
GKPA

SEQ ID NO: 1107954 - protein, 12 aa, Mycobacterium
GKPDSGIGGGVS

SEQ ID NO: 1107955 - protein, 10 aa, Mycobacterium
GKPEATDDEV

SEQ ID NO: 1107956 - protein, 5 aa, Mycobacterium
GKPFD

SEQ ID NO: 1107957 - protein, 4 aa, Mycobacterium
GKPI

SEQ ID NO: 1107958 - protein, 14 aa, Mycobacterium
GKPKPAPEPAKSAA

SEQ ID NO: 1107959 - protein, 7 aa, Mycobacterium
GKPVTDE

SEQ ID NO: 1107960 - protein, 6 aa, Mycobacterium
GKRAPS

SEQ ID NO: 1107961 - protein, 6 aa, Mycobacterium
GKRAPT

SEQ ID NO: 1107962 - protein, 4 aa, Mycobacterium
GKRI

SEQ ID NO: 1107963 - protein, 6 aa, Mycobacterium
GKRPFI

SEQ ID NO: 1107964 - protein, 14 aa, Mycobacterium
GKRSSASEEAATSG

SEQ ID NO: 1107965 - protein, 7 aa, Mycobacterium
GKTAPAA

SEQ ID NO: 1107966 - protein, 8 aa, Mycobacterium
GKTPVAVK

SEQ ID NO: 1107967 - protein, 10 aa, Mycobacterium
GKTSDDDMAG

SEQ ID NO: 1107968 - protein, 5 aa, Mycobacterium
GKVRE

SEQ ID NO: 1107969 - protein, 9 aa, Mycobacterium
GKVTPEPGV

SEQ ID NO: 1107970 - protein, 5 aa, Mycobacterium
GKYTG

SEQ ID NO: 1107971 - protein, 5 aa, Mycobacterium
GLAQP

SEQ ID NO: 1107972 - protein, 14 aa, Mycobacterium
GLATQGGPTGVANS

SEQ ID NO: 1107973 - protein, 8 aa, Mycobacterium
GLDDTGGR

SEQ ID NO: 1107974 - protein, 14 aa, Mycobacterium
GLDDTGGSVSPGDE

SEQ ID NO: 1107975 - protein, 25 aa, Mycobacterium
GLDGPAEGDGPDGAHALPAEQTRGD

SEQ ID NO: 1107976 - protein, 4 aa, Mycobacterium
GLEG

SEQ ID NO: 1107977 - protein, 10 aa, Mycobacterium
GLEPADEATY

SEQ ID NO: 1107978 - protein, 5 aa, Mycobacterium
GLGAG

SEQ ID NO: 1107979 - protein, 9 aa, Mycobacterium
GLGAGSTRL

SEQ ID NO: 1107980 - protein, 5 aa, Mycobacterium
GLGAP

SEQ ID NO: 1107981 - protein, 5 aa, Mycobacterium
GLGMT

SEQ ID NO: 1107982 - protein, 4 aa, Mycobacterium
GLGN

SEQ ID NO: 1107983 - protein, 21 aa, Mycobacterium
GLGPRPRAGSLPRGAGSRFRE

SEQ ID NO: 1107984 - protein, 15 aa, Mycobacterium
GLGQPKTADLSGATW

SEQ ID NO: 1107985 - protein, 12 aa, Mycobacterium
GLGRPGPPVPET

SEQ ID NO: 1107986 - protein, 5 aa, Mycobacterium
GLGSA

SEQ ID NO: 1107987 - protein, 11 aa, Mycobacterium
GLGSESVQKAE

SEQ ID NO: 1107988 - protein, 21 aa, Mycobacterium
GLNEPADTAHGDDVHDAAQEP

SEQ ID NO: 1107989 - protein, 22 aa, Mycobacterium
GLNSPSSSTTAQPGQSGSALKP

SEQ ID NO: 1107990 - protein, 4 aa, Mycobacterium
GLPA

SEQ ID NO: 1107991 - protein, 15 aa, Mycobacterium
GLPAPQTVYAVKIPR

SEQ ID NO: 1107992 - protein, 8 aa, Mycobacterium
GLPDGEVD

SEQ ID NO: 1107993 - protein, 5 aa, Mycobacterium
GLPGV

SEQ ID NO: 1107994 - protein, 7 aa, Mycobacterium
GLPGYEG

SEQ ID NO: 1107995 - protein, 14 aa, Mycobacterium
GLPHRSATRSFAEG

SEQ ID NO: 1107996 - protein, 7 aa, Mycobacterium
GLPNERG

SEQ ID NO: 1107997 - protein, 22 aa, Mycobacterium
GLPPAPPPGAPRDPGPPPPGAE

SEQ ID NO: 1107998 - protein, 12 aa, Mycobacterium
GLPPDGDEIRNP

SEQ ID NO: 1107999 - protein, 11 aa, Mycobacterium
GLPQNSPTGLP

SEQ ID NO: 1108000 - protein, 14 aa, Mycobacterium
GLPRRPSGRIERDA

SEQ ID NO: 1108001 - protein, 12 aa, Mycobacterium
GLPSEVRRGHDE

SEQ ID NO: 1108002 - protein, 8 aa, Mycobacterium
GLPTPGLP

SEQ ID NO: 1108003 - protein, 9 aa, Mycobacterium
GLPTVKGDP

SEQ ID NO: 1108004 - protein, 7 aa, Mycobacterium
GLPVRRP

SEQ ID NO: 1108005 - protein, 14 aa, Mycobacterium
GLQDAQRSGNFAEY

SEQ ID NO: 1108006 - protein, 9 aa, Mycobacterium
GLQDDRDAL

SEQ ID NO: 1108007 - protein, 8 aa, Mycobacterium
GLRAQGRR

SEQ ID NO: 1108008 - protein, 21 aa, Mycobacterium
GLRDNADGSLLEKDGKPLGSS

SEQ ID NO: 1108009 - protein, 14 aa, Mycobacterium
GLRDPASRPSAAEW

SEQ ID NO: 1108010 - protein, 7 aa, Mycobacterium
GLRDPRH

SEQ ID NO: 1108011 - protein, 5 aa, Mycobacterium
GLRPL

SEQ ID NO: 1108012 - protein, 9 aa, Mycobacterium
GLSDAPQNY

SEQ ID NO: 1108013 - protein, 5 aa, Mycobacterium
GLSDG

SEQ ID NO: 1108014 - protein, 5 aa, Mycobacterium
GLSDT

SEQ ID NO: 1108015 - protein, 12 aa, Mycobacterium
GLSMDPGAKVTY

SEQ ID NO: 1108016 - protein, 6 aa, Mycobacterium
GLSNSG

SEQ ID NO: 1108017 - protein, 8 aa, Mycobacterium
GLSPAGEQ

SEQ ID NO: 1108018 - protein, 8 aa, Mycobacterium
GLSPSQAE

SEQ ID NO: 1108019 - protein, 8 aa, Mycobacterium
GLSTSAAG

SEQ ID NO: 1108020 - protein, 11 aa, Mycobacterium
GLTAAGTADAR

SEQ ID NO: 1108021 - protein, 9 aa, Mycobacterium
GLTGSAGYA

SEQ ID NO: 1108022 - protein, 4 aa, Mycobacterium
GLTN

SEQ ID NO: 1108023 - protein, 8 aa, Mycobacterium
GLTPGSAE

SEQ ID NO: 1108024 - protein, 6 aa, Mycobacterium
GLTPGT

SEQ ID NO: 1108025 - protein, 5 aa, Mycobacterium
GLTSG

SEQ ID NO: 1108026 - protein, 5 aa, Mycobacterium
GLTSR

SEQ ID NO: 1108027 - protein, 5 aa, Mycobacterium
GLTTP

SEQ ID NO: 1108028 - protein, 5 aa, Mycobacterium
GMAGA

SEQ ID NO: 1108029 - protein, 12 aa, Mycobacterium
GMGPTPESPSYL

SEQ ID NO: 1108030 - protein, 7 aa, Mycobacterium
GMPDGTG

SEQ ID NO: 1108031 - protein, 5 aa, Mycobacterium
GMRSQ

SEQ ID NO: 1108032 - protein, 8 aa, Mycobacterium
GMSAGAAV

SEQ ID NO: 1108033 - protein, 5 aa, Mycobacterium
GMSPA

SEQ ID NO: 1108034 - protein, 16 aa, Mycobacterium
GMSPAPLSSTPGQVAE

SEQ ID NO: 1108035 - protein, 11 aa, Mycobacterium
GMSPDGSTAGI

SEQ ID NO: 1108036 - protein, 5 aa, Mycobacterium
GMSSG

SEQ ID NO: 1108037 - protein, 18 aa, Mycobacterium
GNAAGGPPTQVSEDGQAA

SEQ ID NO: 1108038 - protein, 7 aa, Mycobacterium
GNAAGPL

SEQ ID NO: 1108039 - protein, 14 aa, Mycobacterium
GNADGLGVSPGQRI

SEQ ID NO: 1108040 - protein, 10 aa, Mycobacterium
GNAEAARRAG

SEQ ID NO: 1108041 - protein, 5 aa, Mycobacterium
GNAGA

SEQ ID NO: 1108042 - protein, 4 aa, Mycobacterium
GNAI

SEQ ID NO: 1108043 - protein, 5 aa, Mycobacterium
GNATG

SEQ ID NO: 1108044 - protein, 17 aa, Mycobacterium
GNATPADPGPDLIPGGT

SEQ ID NO: 1108045 - protein, 9 aa, Mycobacterium
GNDATVGAR

SEQ ID NO: 1108046 - protein, 6 aa, Mycobacterium
GNDPVR

SEQ ID NO: 1108047 - protein, 8 aa, Mycobacterium
GNEIPRTE

SEQ ID NO: 1108048 - protein, 4 aa, Mycobacterium
GNGI

SEQ ID NO: 1108049 - protein, 9 aa, Mycobacterium
GNGPASPGV

SEQ ID NO: 1108050 - protein, 6 aa, Mycobacterium
GNGPSD

SEQ ID NO: 1108051 - protein, 8 aa, Mycobacterium
GNGTEPEF

SEQ ID NO: 1108052 - protein, 6 aa, Mycobacterium
GNLGGP

SEQ ID NO: 1108053 - protein, 7 aa, Mycobacterium
GNNVGKG

SEQ ID NO: 1108054 - protein, 10 aa, Mycobacterium
GNPADSGKIR

SEQ ID NO: 1108055 - protein, 9 aa, Mycobacterium
GNPASLEPF

SEQ ID NO: 1108056 - protein, 8 aa, Mycobacterium
GNPFGGSI

SEQ ID NO: 1108057 - protein, 7 aa, Mycobacterium
GNPLAGK

SEQ ID NO: 1108058 - protein, 10 aa, Mycobacterium
GNPRGVTNPT

SEQ ID NO: 1108059 - protein, 6 aa, Mycobacterium
GNPSTA

SEQ ID NO: 1108060 - protein, 11 aa, Mycobacterium
GNPTAGQARAS

SEQ ID NO: 1108061 - protein, 12 aa, Mycobacterium
GNPTEGASRASL

SEQ ID NO: 1108062 - protein, 23 aa, Mycobacterium
GNPYVPTVGNAGDDEAPKAHADK

SEQ ID NO: 1108063 - protein, 11 aa, Mycobacterium
GNQGEPRANEA

SEQ ID NO: 1108064 - protein, 9 aa, Mycobacterium
GNRDGGTNP

SEQ ID NO: 1108065 - protein, 5 aa, Mycobacterium
GNRQA

SEQ ID NO: 1108066 - protein, 6 aa, Mycobacterium
GNRSEQ

SEQ ID NO: 1108067 - protein, 4 aa, Mycobacterium
GNRT

SEQ ID NO: 1108068 - protein, 8 aa, Mycobacterium
GNSDGSMT

SEQ ID NO: 1108069 - protein, 4 aa, Mycobacterium
GNSR

SEQ ID NO: 1108070 - protein, 7 aa, Mycobacterium
GNSVGKE

SEQ ID NO: 1108071 - protein, 5 aa, Mycobacterium
GNTAA

SEQ ID NO: 1108072 - protein, 4 aa, Mycobacterium
GNTF

SEQ ID NO: 1108073 - protein, 12 aa, Mycobacterium
GNTGDPRPLPAG

SEQ ID NO: 1108074 - protein, 24 aa, Mycobacterium
GNTGENCTQNPPPDPAVPADPRGW

SEQ ID NO: 1108075 - protein, 22 aa, Mycobacterium
GNTPSPLNFTSDPGAKADGIPA

SEQ ID NO: 1108076 - protein, 8 aa, Mycobacterium
GNVGAKER

SEQ ID NO: 1108077 - protein, 7 aa, Mycobacterium
GNVGAKQ

SEQ ID NO: 1108078 - protein, 21 aa, Mycobacterium
GNVGGAGQCTQHNPRRPADAG

SEQ ID NO: 1108079 - protein, 4 aa, Mycobacterium
GNVP

SEQ ID NO: 1108080 - protein, 6 aa, Mycobacterium
GNVRPG

SEQ ID NO: 1108081 - protein, 15 aa, Mycobacterium
GPAAAPRSGGDGNIA

SEQ ID NO: 1108082 - protein, 12 aa, Mycobacterium
GPAAASSVPGRA

SEQ ID NO: 1108083 - protein, 9 aa, Mycobacterium
GPAALTTDQ

SEQ ID NO: 1108084 - protein, 5 aa, Mycobacterium
GPAAT

SEQ ID NO: 1108085 - protein, 13 aa, Mycobacterium
GPAATSAGNLPDG

SEQ ID NO: 1108086 - protein, 13 aa, Mycobacterium
GPAEARPTGARAG

SEQ ID NO: 1108087 - protein, 12 aa, Mycobacterium
GPAFRASRRPPG

SEQ ID NO: 1108088 - protein, 29 aa, Mycobacterium
GPAGPPPPGYPAPGYPGYPPAGYGAPPQY

SEQ ID NO: 1108089 - protein, 5 aa, Mycobacterium
GPAGW

SEQ ID NO: 1108090 - protein, 5 aa, Mycobacterium
GPAIG

SEQ ID NO: 1108091 - protein, 4 aa, Mycobacterium
GPAL

SEQ ID NO: 1108092 - protein, 4 aa, Mycobacterium
GPAP

SEQ ID NO: 1108093 - protein, 5 aa, Mycobacterium
GPAPT

SEQ ID NO: 1108094 - protein, 9 aa, Mycobacterium
GPAQRPQRT

SEQ ID NO: 1108095 - protein, 5 aa, Mycobacterium
GPARR

SEQ ID NO: 1108096 - protein, 6 aa, Mycobacterium
GPARVP

SEQ ID NO: 1108097 - protein, 6 aa, Mycobacterium
GPATGR

SEQ ID NO: 1108098 - protein, 9 aa, Mycobacterium
GPDADAATN

SEQ ID NO: 1108099 - protein, 6 aa, Mycobacterium
GPDAGI

SEQ ID NO: 1108100 - protein, 8 aa, Mycobacterium
GPDENGRN

SEQ ID NO: 1108101 - protein, 15 aa, Mycobacterium
GPDGEPAGSTGFDDV

SEQ ID NO: 1108102 - protein, 11 aa, Mycobacterium
GPDGSDSALPG

SEQ ID NO: 1108103 - protein, 8 aa, Mycobacterium
GPDGSYEY

SEQ ID NO: 1108104 - protein, 16 aa, Mycobacterium
GPDGTVRASSDPSRIG

SEQ ID NO: 1108105 - protein, 4 aa, Mycobacterium
GPDI

SEQ ID NO: 1108106 - protein, 7 aa, Mycobacterium
GPDRGDM

SEQ ID NO: 1108107 - protein, 7 aa, Mycobacterium
GPDRGDV

SEQ ID NO: 1108108 - protein, 4 aa, Mycobacterium
GPEA

SEQ ID NO: 1108109 - protein, 7 aa, Mycobacterium
GPEDSMT

SEQ ID NO: 1108110 - protein, 8 aa, Mycobacterium
GPEGSLAS

SEQ ID NO: 1108111 - protein, 4 aa, Mycobacterium
GPER

SEQ ID NO: 1108112 - protein, 18 aa, Mycobacterium
GPERKARERRKATNPYLT

SEQ ID NO: 1108113 - protein, 5 aa, Mycobacterium
GPETK

SEQ ID NO: 1108114 - protein, 8 aa, Mycobacterium
GPFPKEAV

SEQ ID NO: 1108115 - protein, 50 aa, Mycobacterium
GPGADATATGPAATEPPAGQAPQPQGNNQPPAAAPPNRPGQAPTPQQPEV

SEQ ID NO: 1108116 - protein, 22 aa, Mycobacterium
GPGATQIQPAGSRIPKDRTEPA

SEQ ID NO: 1108117 - protein, 10 aa, Mycobacterium
GPGDDFAGAG

SEQ ID NO: 1108118 - protein, 10 aa, Mycobacterium
GPGGARQPGW

SEQ ID NO: 1108119 - protein, 11 aa, Mycobacterium
GPGGPSERTRT

SEQ ID NO: 1108120 - protein, 4 aa, Mycobacterium
GPGL

SEQ ID NO: 1108121 - protein, 10 aa, Mycobacterium
GPGLTAGSTG

SEQ ID NO: 1108122 - protein, 5 aa, Mycobacterium
GPGNP

SEQ ID NO: 1108123 - protein, 59 aa, Mycobacterium
GPGQMGPGQMGPGQMGPGQMGPGQMGPGQMGPGQMGPGQMTPGQQQSPTTTTAVPSSPR

SEQ ID NO: 1108124 - protein, 5 aa, Mycobacterium
GPGSL

SEQ ID NO: 1108125 - protein, 9 aa, Mycobacterium
GPGTPEVVG

SEQ ID NO: 1108126 - protein, 5 aa, Mycobacterium
GPIRP

SEQ ID NO: 1108127 - protein, 24 aa, Mycobacterium
GPISDSTAAPAATADGANPTRLPG

SEQ ID NO: 1108128 - protein, 8 aa, Mycobacterium
GPLAPDQV

SEQ ID NO: 1108129 - protein, 18 aa, Mycobacterium
GPLDQRRNERVSASRLRP

SEQ ID NO: 1108130 - protein, 18 aa, Mycobacterium
GPLGGTDPRGFSPNGVPD

SEQ ID NO: 1108131 - protein, 18 aa, Mycobacterium
GPLGLGGAGQPVADSETK

SEQ ID NO: 1108132 - protein, 7 aa, Mycobacterium
GPLTPQD

SEQ ID NO: 1108133 - protein, 6 aa, Mycobacterium
GPMAPA

SEQ ID NO: 1108134 - protein, 5 aa, Mycobacterium
GPMPG

SEQ ID NO: 1108135 - protein, 8 aa, Mycobacterium
GPNGIGKS

SEQ ID NO: 1108136 - protein, 6 aa, Mycobacterium
GPNKEN

SEQ ID NO: 1108137 - protein, 12 aa, Mycobacterium
GPNRATNSSGCG

SEQ ID NO: 1108138 - protein, 4 aa, Mycobacterium
GPNS

SEQ ID NO: 1108139 - protein, 13 aa, Mycobacterium
GPNTDPGGPRSAT

SEQ ID NO: 1108140 - protein, 8 aa, Mycobacterium
GPPDQLTN

SEQ ID NO: 1108141 - protein, 16 aa, Mycobacterium
GPPEGAEGKDTAQDEW

SEQ ID NO: 1108142 - protein, 9 aa, Mycobacterium
GPPGSGRST

SEQ ID NO: 1108143 - protein, 8 aa, Mycobacterium
GPPHGGHD

SEQ ID NO: 1108144 - protein, 17 aa, Mycobacterium
GPPPPPGMRPPPMPPPG

SEQ ID NO: 1108145 - protein, 6 aa, Mycobacterium
GPPTTV

SEQ ID NO: 1108146 - protein, 10 aa, Mycobacterium
GPQDSGNALP

SEQ ID NO: 1108147 - protein, 6 aa, Mycobacterium
GPQDTV

SEQ ID NO: 1108148 - protein, 26 aa, Mycobacterium
GPQEHDSEPAPPTPPSKDDVAPLSFA

SEQ ID NO: 1108149 - protein, 8 aa, Mycobacterium
GPQGSATA

SEQ ID NO: 1108150 - protein, 33 aa, Mycobacterium; identical to SEQ ID NO: 262240

SEQ ID NO: 1108151 - protein, 7 aa, Mycobacterium
GPQNMPK

SEQ ID NO: 1108152 - protein, 10 aa, Mycobacterium
GPRDAGGNVV

SEQ ID NO: 1108153 - protein, 15 aa, Mycobacterium
GPRPDDAQAHSNSSP

SEQ ID NO: 1108154 - protein, 13 aa, Mycobacterium
GPRPELASSQPGF

SEQ ID NO: 1108155 - protein, 8 aa, Mycobacterium
GPRPERPE

SEQ ID NO: 1108156 - protein, 7 aa, Mycobacterium
GPRPPLA

SEQ ID NO: 1108157 - protein, 11 aa, Mycobacterium
GPRVAGSGSIT

SEQ ID NO: 1108158 - protein, 9 aa, Mycobacterium
GPSERYAER

SEQ ID NO: 1108159 - protein, 4 aa, Mycobacterium
GPSF

SEQ ID NO: 1108160 - protein, 4 aa, Mycobacterium
GPSG

SEQ ID NO: 1108161 - protein, 11 aa, Mycobacterium
GPSGAGKSTIA

SEQ ID NO: 1108162 - protein, 7 aa, Mycobacterium
GPSGCGK

SEQ ID NO: 1108163 - protein, 6 aa, Mycobacterium
GPSGIG

SEQ ID NO: 1108164 - protein, 9 aa, Mycobacterium
GPSGSGKST

SEQ ID NO: 1108165 - protein, 8 aa, Mycobacterium
GPSPETRR

SEQ ID NO: 1108166 - protein, 6 aa, Mycobacterium
GPSRGW

SEQ ID NO: 1108167 - protein, 5 aa, Mycobacterium
GPSRL

SEQ ID NO: 1108168 - protein, 14 aa, Mycobacterium
GPSTQSTSGTARAR

SEQ ID NO: 1108169 - protein, 4 aa, Mycobacterium
GPTG

SEQ ID NO: 1108170 - protein, 17 aa, Mycobacterium
GPTGVIGSNKKDSADTV

SEQ ID NO: 1108171 - protein, 13 aa, Mycobacterium
GPTPDNPDFAASK

SEQ ID NO: 1108172 - protein, 14 aa, Mycobacterium
GPTPENPDFSGSKD

SEQ ID NO: 1108173 - protein, 11 aa, Mycobacterium
GPTPEQPKGPF

SEQ ID NO: 1108174 - protein, 10 aa, Mycobacterium
GPVAAPADRV

SEQ ID NO: 1108175 - protein, 11 aa, Mycobacterium
GPVDDTPIPPE

SEQ ID NO: 1108176 - protein, 5 aa, Mycobacterium
GPVGP

SEQ ID NO: 1108177 - protein, 9 aa, Mycobacterium
GPWPPTPAR

SEQ ID NO: 1108178 - protein, 5 aa, Mycobacterium
GPYPF

SEQ ID NO: 1108179 - protein, 4 aa, Mycobacterium
GPYR

SEQ ID NO: 1108180 - protein, 4 aa, Mycobacterium
GQAP

SEQ ID NO: 1108181 - protein, 4 aa, Mycobacterium
GQAS

SEQ ID NO: 1108182 - protein, 8 aa, Mycobacterium
GQATSDAN

SEQ ID NO: 1108183 - protein, 6 aa, Mycobacterium
GQDQNE

SEQ ID NO: 1108184 - protein, 15 aa, Mycobacterium
GQEAAAAVGDSMAQG

SEQ ID NO: 1108185 - protein, 4 aa, Mycobacterium
GQEK

SEQ ID NO: 1108186 - protein, 6 aa, Mycobacterium
GQGATI

SEQ ID NO: 1108187 - protein, 10 aa, Mycobacterium
GQGAYAAGNA

SEQ ID NO: 1108188 - protein, 6 aa, Mycobacterium
GQGGAL

SEQ ID NO: 1108189 - protein, 6 aa, Mycobacterium
GQGGNL

SEQ ID NO: 1108190 - protein, 9 aa, Mycobacterium
GQGGWEKTE

SEQ ID NO: 1108191 - protein, 4 aa, Mycobacterium
GQGM

SEQ ID NO: 1108192 - protein, 17 aa, Mycobacterium
GQHDPTKRRARIRRPAT

SEQ ID NO: 1108193 - protein, 6 aa, Mycobacterium
GQLGTS

SEQ ID NO: 1108194 - protein, 40 aa, Mycobacterium
GQLPAPGPVPVPVPGPAPVPAAPLDAGTSQLPPAPAPGAP

SEQ ID NO: 1108195 - protein, 13 aa, Mycobacterium
GQLSSHKSVTDTL

SEQ ID NO: 1108196 - protein, 7 aa, Mycobacterium
GQNSLPQ

SEQ ID NO: 1108197 - protein, 22 aa, Mycobacterium
GQPAPDDATRGVDNPDTGQTDF

SEQ ID NO: 1108198 - protein, 6 aa, Mycobacterium
GQPATV

SEQ ID NO: 1108199 - protein, 18 aa, Mycobacterium
GQPDPADLEADPTRPDPI

SEQ ID NO: 1108200 - protein, 6 aa, Mycobacterium
GQPDST

SEQ ID NO: 1108201 - protein, 12 aa, Mycobacterium
GQPGADGFSGVA

SEQ ID NO: 1108202 - protein, 9 aa, Mycobacterium
GQPPDTDAD

SEQ ID NO: 1108203 - protein, 6 aa, Mycobacterium
GQPTDL

SEQ ID NO: 1108204 - protein, 4 aa, Mycobacterium
GQPV

SEQ ID NO: 1108205 - protein, 5 aa, Mycobacterium
GQQAT

SEQ ID NO: 1108206 - protein, 9 aa, Mycobacterium
GQQPEMSPE

SEQ ID NO: 1108207 - protein, 4 aa, Mycobacterium
GQQV

SEQ ID NO: 1108208 - protein, 9 aa, Mycobacterium
GQRGTDPND

SEQ ID NO: 1108209 - protein, 6 aa, Mycobacterium
GQRRGV

SEQ ID NO: 1108210 - protein, 5 aa, Mycobacterium
GQRSA

SEQ ID NO: 1108211 - protein, 8 aa, Mycobacterium
GQRSAPLQ

SEQ ID NO: 1108212 - protein, 5 aa, Mycobacterium
GQSAA

SEQ ID NO: 1108213 - protein, 5 aa, Mycobacterium
GQSEG

SEQ ID NO: 1108214 - protein, 6 aa, Mycobacterium
GQSGDI

SEQ ID NO: 1108215 - protein, 6 aa, Mycobacterium
GQSKRD

SEQ ID NO: 1108216 - protein, 6 aa, Mycobacterium
GQSMPA

SEQ ID NO: 1108217 - protein, 5 aa, Mycobacterium
GQSRG

SEQ ID NO: 1108218 - protein, 7 aa, Mycobacterium
GQSRRTA

SEQ ID NO: 1108219 - protein, 7 aa, Mycobacterium
GQTTTPY

SEQ ID NO: 1108220 - protein, 5 aa, Mycobacterium
GQWEA

SEQ ID NO: 1108221 - protein, 10 aa, Mycobacterium
GQWPGDLGER

SEQ ID NO: 1108222 - protein, 6 aa, Mycobacterium
GQYTGF

SEQ ID NO: 1108223 - protein, 15 aa, Mycobacterium
GRAATEAEQTQASTA

SEQ ID NO: 1108224 - protein, 15 aa, Mycobacterium
GRADARDNPDPDRRQ

SEQ ID NO: 1108225 - protein, 10 aa, Mycobacterium
GRADPDHSWE

SEQ ID NO: 1108226 - protein, 5 aa, Mycobacterium
GRAEV

SEQ ID NO: 1108227 - protein, 6 aa, Mycobacterium
GRAGLR

SEQ ID NO: 1108228 - protein, 10 aa, Mycobacterium
GRAGYSPHPA

SEQ ID NO: 1108229 - protein, 5 aa, Mycobacterium
GRAMT

SEQ ID NO: 1108230 - protein, 6 aa, Mycobacterium
GRAPFE

SEQ ID NO: 1108231 - protein, 8 aa, Mycobacterium
GRAPLDTP

SEQ ID NO: 1108232 - protein, 20 aa, Mycobacterium
GRARGPEDGDVTRLDDAQVR

SEQ ID NO: 1108233 - protein, 14 aa, Mycobacterium
GRDAHRADAPTRIP

SEQ ID NO: 1108234 - protein, 10 aa, Mycobacterium
GRDEGAYEEQ

SEQ ID NO: 1108235 - protein, 6 aa, Mycobacterium
GRDGQT

SEQ ID NO: 1108236 - protein, 54 aa, Mycobacterium
GRDPGTGFSPTVRDSTSAKAPASGIPAAASGVAASAAERRKRRRRQKDEIAGRA

SEQ ID NO: 1108237 - protein, 5 aa, Mycobacterium
GRDST

SEQ ID NO: 1108238 - protein, 7 aa, Mycobacterium
GRDTSSG

SEQ ID NO: 1108239 - protein, 13 aa, Mycobacterium
GREHSAEDDEHGN

SEQ ID NO: 1108240 - protein, 10 aa, Mycobacterium
GREIGGDTAQ

SEQ ID NO: 1108241 - protein, 6 aa, Mycobacterium
GREPGF

SEQ ID NO: 1108242 - protein, 15 aa, Mycobacterium
GRERSFAGGSWPKSR

SEQ ID NO: 1108243 - protein, 10 aa, Mycobacterium
GRETAERADL

SEQ ID NO: 1108244 - protein, 5 aa, Mycobacterium
GRGFD

SEQ ID NO: 1108245 - protein, 31 aa, Mycobacterium
GRGGDGGAGGQGINLGTGTGRGGDGGAGGHS

SEQ ID NO: 1108246 - protein, 10 aa, Mycobacterium
GRGGTDVARE

SEQ ID NO: 1108247 - protein, 30 aa, Mycobacterium
GRGPTTGPPTATEPECGSSGESFSPTTPEE

SEQ ID NO: 1108248 - protein, 65 aa, Mycobacterium
GRGYPPPGYQQGYPPPGYQQGYPPPGYQQGYPPPGYQHGYPPPGYQHGYPPPGYPPQQGYAPPGV

SEQ ID NO: 1108249 - protein, 14 aa, Mycobacterium
GRHALGEGDGRTGI

SEQ ID NO: 1108250 - protein, 6 aa, Mycobacterium
GRHPEP

SEQ ID NO: 1108251 - protein, 5 aa, Mycobacterium
GRHRG

SEQ ID NO: 1108252 - protein, 4 aa, Mycobacterium
GRID

SEQ ID NO: 1108253 - protein, 10 aa, Mycobacterium
GRIGKRTRGI

SEQ ID NO: 1108254 - protein, 6 aa, Mycobacterium
GRIPGQ

SEQ ID NO: 1108255 - protein, 6 aa, Mycobacterium
GRIPGT

SEQ ID NO: 1108256 - protein, 5 aa, Mycobacterium
GRIPN

SEQ ID NO: 1108257 - protein, 8 aa, Mycobacterium
GRKQDNPA

SEQ ID NO: 1108258 - protein, 10 aa, Mycobacterium
GRLPTQASQL

SEQ ID NO: 1108259 - protein, 16 aa, Mycobacterium
GRLQPEQLTSSGAQTP

SEQ ID NO: 1108260 - protein, 10 aa, Mycobacterium
GRNARRRPTT

SEQ ID NO: 1108261 - protein, 7 aa, Mycobacterium
GRNEGDG

SEQ ID NO: 1108262 - protein, 7 aa, Mycobacterium
GRNGRSI

SEQ ID NO: 1108263 - protein, 15 aa, Mycobacterium
GRPADGGERAAALPA

SEQ ID NO: 1108264 - protein, 7 aa, Mycobacterium
GRPAPHD

SEQ ID NO: 1108265 - protein, 15 aa, Mycobacterium
GRPDATDDEVRAAAR

SEQ ID NO: 1108266 - protein, 9 aa, Mycobacterium
GRPDATEAE

SEQ ID NO: 1108267 - protein, 10 aa, Mycobacterium
GRPEAGRDEV

SEQ ID NO: 1108268 - protein, 10 aa, Mycobacterium
GRPEATDDDL

SEQ ID NO: 1108269 - protein, 11 aa, Mycobacterium
GRPEPTPKSVE

SEQ ID NO: 1108270 - protein, 12 aa, Mycobacterium
GRPIDNPDQRIQ

SEQ ID NO: 1108271 - protein, 9 aa, Mycobacterium
GRPKETELT

SEQ ID NO: 1108272 - protein, 7 aa, Mycobacterium
GRPPVTR

SEQ ID NO: 1108273 - protein, 40 aa, Mycobacterium
GRPPYSGGDSLQRHPADAGALDAERAGDPGDTEPDPWRDP

SEQ ID NO: 1108274 - protein, 12 aa, Mycobacterium
GRPRPPAGQSAG

SEQ ID NO: 1108275 - protein, 44 aa, Mycobacterium
GRPRQSATVSPASRVSDARRDADPSSPTPPPPPARPHNPPPPTP

SEQ ID NO: 1108276 - protein, 9 aa, Mycobacterium
GRPRTDRTR

SEQ ID NO: 1108277 - protein, 12 aa, Mycobacterium
GRPRYRTSGVPK

SEQ ID NO: 1108278 - protein, 13 aa, Mycobacterium
GRPRYRTSGVPKV

SEQ ID NO: 1108279 - protein, 24 aa, Mycobacterium
GRPSAAGDGYDPLATSASNLGPES

SEQ ID NO: 1108280 - protein, 24 aa, Mycobacterium
GRPSAAGNGYDPLSSGATNLGPED

SEQ ID NO: 1108281 - protein, 12 aa, Mycobacterium
GRPSPAGSDEAE

SEQ ID NO: 1108282 - protein, 5 aa, Mycobacterium
GRPTD

SEQ ID NO: 1108283 - protein, 7 aa, Mycobacterium
GRPTDHP

SEQ ID NO: 1108284 - protein, 5 aa, Mycobacterium
GRPTV

SEQ ID NO: 1108285 - protein, 11 aa, Mycobacterium
GRQGDAPDAAL

SEQ ID NO: 1108286 - protein, 12 aa, Mycobacterium
GRQIGAATGWWS

SEQ ID NO: 1108287 - protein, 11 aa, Mycobacterium
GRQKGSGAPMG

SEQ ID NO: 1108288 - protein, 15 aa, Mycobacterium
GRQPGLYGATGQMSP

SEQ ID NO: 1108289 - protein, 24 aa, Mycobacterium
GRQRYRTSGVPTAADLRSALQPLL

SEQ ID NO: 1108290 - protein, 12 aa, Mycobacterium
GRRAGRDSARGL

SEQ ID NO: 1108291 - protein, 9 aa, Mycobacterium
GRRDNDESV

SEQ ID NO: 1108292 - protein, 24 aa, Mycobacterium
GRRDPASGAGQRRRVSGGLSERHT

SEQ ID NO: 1108293 - protein, 21 aa, Mycobacterium
GRRETGVGQEVGPNAPGQGAE

SEQ ID NO: 1108294 - protein, 7 aa, Mycobacterium
GRRGTAV

SEQ ID NO: 1108295 - protein, 5 aa, Mycobacterium
GRRGV

SEQ ID NO: 1108296 - protein, 17 aa, Mycobacterium
GRRHDQRGIGAARTRPQ

SEQ ID NO: 1108297 - protein, 12 aa, Mycobacterium
GRRPTTDDDEGA

SEQ ID NO: 1108298 - protein, 49 aa, Mycobacterium
GRRQPDGGEDSVGRRQPDGGEDSVGRRQPDGGEDSVGRRRPDGGEDSEN

SEQ ID NO: 1108299 - protein, 39 aa, Mycobacterium
GRRQPGDESGPVGRRQPGDESDPVGRRGAEPVARPEADP

SEQ ID NO: 1108300 - protein, 5 aa, Mycobacterium
GRRRE

SEQ ID NO: 1108301 - protein, 27 aa, Mycobacterium
GRRRPAARLDPGRHRADPARARRGRVR

SEQ ID NO: 1108302 - protein, 9 aa, Mycobacterium
GRRRRRGVS

SEQ ID NO: 1108303 - protein, 16 aa, Mycobacterium
GRRSSGSRLAGSSAAW

SEQ ID NO: 1108304 - protein, 7 aa, Mycobacterium
GRRTEIS

SEQ ID NO: 1108305 - protein, 134 aa, Mycobacterium
GRSAPAPAASISRPDQPRPAGAFPYSDGRSARPVRRSRGPATGRYDPPVRGTPVHGAGAERWRGPAVSDDSAGDSAAAPDSASTTRISRPAADDFQPDVPETPSAPADRSATAEMPTSGRPPADYGGDPTRESL

SEQ ID NO: 1108306 - protein, 8 aa, Mycobacterium
GRSGALSR

SEQ ID NO: 1108307 - protein, 10 aa, Mycobacterium
GRSGTEVAKE

SEQ ID NO: 1108308 - protein, 4 aa, Mycobacterium
GRSI

SEQ ID NO: 1108309 - protein, 16 aa, Mycobacterium
GRSPAPQPAPQPAPQP

SEQ ID NO: 1108310 - protein, 20 aa, Mycobacterium
GRSPAPQPAPQPAPQPAPQP

SEQ ID NO: 1108311 - protein, 10 aa, Mycobacterium
GRSPQSRGDA

SEQ ID NO: 1108312 - protein, 11 aa, Mycobacterium
GRSPTEDPQKV

SEQ ID NO: 1108313 - protein, 4 aa, Mycobacterium
GRSR

SEQ ID NO: 1108314 - protein, 11 aa, Mycobacterium
GRSSRLSSDTS

SEQ ID NO: 1108315 - protein, 9 aa, Mycobacterium
GRTAPTQLA

SEQ ID NO: 1108316 - protein, 14 aa, Mycobacterium
GRTGAATQTATSGW

SEQ ID NO: 1108317 - protein, 9 aa, Mycobacterium
GRTGGAAAR

SEQ ID NO: 1108318 - protein, 6 aa, Mycobacterium
GRTGRI

SEQ ID NO: 1108319 - protein, 12 aa, Mycobacterium
GRTGTEEDSREA

SEQ ID NO: 1108320 - protein, 15 aa, Mycobacterium
GRTPPPPATREPLPA

SEQ ID NO: 1108321 - protein, 16 aa, Mycobacterium
GRTPPPPATREPLPAE

SEQ ID NO: 1108322 - protein, 12 aa, Mycobacterium
GRTPPPPPTNTN

SEQ ID NO: 1108323 - protein, 8 aa, Mycobacterium
GRTQPVTV

SEQ ID NO: 1108324 - protein, 5 aa, Mycobacterium
GRTRI

SEQ ID NO: 1108325 - protein, 11 aa, Mycobacterium
GRTRQDNDESV

SEQ ID NO: 1108326 - protein, 15 aa, Mycobacterium
GRTSSTTRDQTTPRN

SEQ ID NO: 1108327 - protein, 13 aa, Mycobacterium
GRTVPGEGTRARE

SEQ ID NO: 1108328 - protein, 7 aa, Mycobacterium
GRVAEPH

SEQ ID NO: 1108329 - protein, 17 aa, Mycobacterium
GRVDSRSEDAGSGTGRA

SEQ ID NO: 1108330 - protein, 4 aa, Mycobacterium
GRVG

SEQ ID NO: 1108331 - protein, 8 aa, Mycobacterium
GRVSAPSV

SEQ ID NO: 1108332 - protein, 7 aa, Mycobacterium
GRVTGGP

SEQ ID NO: 1108333 - protein, 12 aa, Mycobacterium
GRWGGVSSVNPQ

SEQ ID NO: 1108334 - protein, 24 aa, Mycobacterium
GRYGPLGPLGGTDPAGFSPNGVPD

SEQ ID NO: 1108335 - protein, 7 aa, Mycobacterium
GRYPTGN

SEQ ID NO: 1108336 - protein, 5 aa, Mycobacterium
GRYQP

SEQ ID NO: 1108337 - protein, 7 aa, Mycobacterium
GSAAGLS

SEQ ID NO: 1108338 - protein, 6 aa, Mycobacterium
GSADLP

SEQ ID NO: 1108339 - protein, 39 aa, Mycobacterium
GSAERPSGAPGSGGAPTDAVTGPAPEFGPPQAPPPVEKR

SEQ ID NO: 1108340 - protein, 9 aa, Mycobacterium
GSAGLDSPT

SEQ ID NO: 1108341 - protein, 5 aa, Mycobacterium
GSAIT

SEQ ID NO: 1108342 - protein, 10 aa, Mycobacterium
GSAMATGGAD

SEQ ID NO: 1108343 - protein, 4 aa, Mycobacterium
GSAP

SEQ ID NO: 1108344 - protein, 9 aa, Mycobacterium
GSAPGPTLH

SEQ ID NO: 1108345 - protein, 5 aa, Mycobacterium
GSAPP

SEQ ID NO: 1108346 - protein, 7 aa, Mycobacterium
GSAPTTT

SEQ ID NO: 1108347 - protein, 7 aa, Mycobacterium
GSARSAD

SEQ ID NO: 1108348 - protein, 26 aa, Mycobacterium
GSASAVPAVPADAVTASGSGLDPHIS

SEQ ID NO: 1108349 - protein, 5 aa, Mycobacterium
GSASL

SEQ ID NO: 1108350 - protein, 9 aa, Mycobacterium
GSASVEGPR

SEQ ID NO: 1108351 - protein, 8 aa, Mycobacterium
GSASVTAK

SEQ ID NO: 1108352 - protein, 6 aa, Mycobacterium
GSAVEG

SEQ ID NO: 1108353 - protein, 7 aa, Mycobacterium
GSAVPVA

SEQ ID NO: 1108354 - protein, 6 aa, Mycobacterium
GSCATA

SEQ ID NO: 1108355 - protein, 9 aa, Mycobacterium
GSDAERGLS

SEQ ID NO: 1108356 - protein, 20 aa, Mycobacterium
GSDAQRNRTDSGTWSRPEDA

SEQ ID NO: 1108357 - protein, 10 aa, Mycobacterium
GSDGARYDVQ

SEQ ID NO: 1108358 - protein, 5 aa, Mycobacterium
GSDGT

SEQ ID NO: 1108359 - protein, 4 aa, Mycobacterium
GSDP

SEQ ID NO: 1108360 - protein, 24 aa, Mycobacterium
GSDPPDTAPTAAPQTTSTAPPAAL

SEQ ID NO: 1108361 - protein, 5 aa, Mycobacterium
GSDRT

SEQ ID NO: 1108362 - protein, 7 aa, Mycobacterium
GSDSVTV

SEQ ID NO: 1108363 - protein, 19 aa, Mycobacterium
GSDTERNRADSAASFRSED

SEQ ID NO: 1108364 - protein, 4 aa, Mycobacterium
GSEE

SEQ ID NO: 1108365 - protein, 7 aa, Mycobacterium
GSEGAAD

SEQ ID NO: 1108366 - protein, 4 aa, Mycobacterium
GSEP

SEQ ID NO: 1108367 - protein, 7 aa, Mycobacterium
GSEPVNI

SEQ ID NO: 1108368 - protein, 5 aa, Mycobacterium
GSERD

SEQ ID NO: 1108369 - protein, 7 aa, Mycobacterium
GSGAAAT

SEQ ID NO: 1108370 - protein, 9 aa, Mycobacterium
GSGAAVDNG

SEQ ID NO: 1108371 - protein, 6 aa, Mycobacterium
GSGGAQ

SEQ ID NO: 1108372 - protein, 7 aa, Mycobacterium
GSGPDVP

SEQ ID NO: 1108373 - protein, 11 aa, Mycobacterium
GSGPSQDRSKA

SEQ ID NO: 1108374 - protein, 4 aa, Mycobacterium
GSGR

SEQ ID NO: 1108375 - protein, 22 aa, Mycobacterium
GSGRGSAGVNGAVNKATNSDAF

SEQ ID NO: 1108376 - protein, 10 aa, Mycobacterium
GSGRPAAGTE

SEQ ID NO: 1108377 - protein, 6 aa, Mycobacterium
GSGRPY

SEQ ID NO: 1108378 - protein, 11 aa, Mycobacterium
GSGSAASNTAL

SEQ ID NO: 1108379 - protein, 9 aa, Mycobacterium
GSGSSASRA

SEQ ID NO: 1108380 - protein, 6 aa, Mycobacterium
GSGTDV

SEQ ID NO: 1108381 - protein, 4 aa, Mycobacterium
GSGV

SEQ ID NO: 1108382 - protein, 10 aa, Mycobacterium
GSGVGKPGAE

SEQ ID NO: 1108383 - protein, 7 aa, Mycobacterium
GSIGAGG

SEQ ID NO: 1108384 - protein, 7 aa, Mycobacterium
GSIGSQL

SEQ ID NO: 1108385 - protein, 16 aa, Mycobacterium
GSISAQRQRIPGTGTG

SEQ ID NO: 1108386 - protein, 5 aa, Mycobacterium
GSISG

SEQ ID NO: 1108387 - protein, 7 aa, Mycobacterium
GSKETAE

SEQ ID NO: 1108388 - protein, 9 aa, Mycobacterium
GSKVPPIDA

SEQ ID NO: 1108389 - protein, 9 aa, Mycobacterium
GSLADQVRR

SEQ ID NO: 1108390 - protein, 9 aa, Mycobacterium
GSLAPGGRL

SEQ ID NO: 1108391 - protein, 6 aa, Mycobacterium
GSLQRR

SEQ ID NO: 1108392 - protein, 6 aa, Mycobacterium
GSMAGQ

SEQ ID NO: 1108393 - protein, 4 aa, Mycobacterium
GSNT

SEQ ID NO: 1108394 - protein, 7 aa, Mycobacterium
GSPDNGR

SEQ ID NO: 1108395 - protein, 5 aa, Mycobacterium
GSPEL

SEQ ID NO: 1108396 - protein, 5 aa, Mycobacterium
GSPLR

SEQ ID NO: 1108397 - protein, 7 aa, Mycobacterium
GSPPPQC

SEQ ID NO: 1108398 - protein, 14 aa, Mycobacterium
GSPQAPGERQQAAG

SEQ ID NO: 1108399 - protein, 4 aa, Mycobacterium
GSPR

SEQ ID NO: 1108400 - protein, 10 aa, Mycobacterium
GSPSHEVPDN

SEQ ID NO: 1108401 - protein, 6 aa, Mycobacterium
GSPTRV

SEQ ID NO: 1108402 - protein, 9 aa, Mycobacterium
GSPTSSEVT

SEQ ID NO: 1108403 - protein, 11 aa, Mycobacterium
GSPVYGSGLPS

SEQ ID NO: 1108404 - protein, 5 aa, Mycobacterium
GSQDT

SEQ ID NO: 1108405 - protein, 12 aa, Mycobacterium
GSRAQELAGEVS

SEQ ID NO: 1108406 - protein, 8 aa, Mycobacterium
GSRDEALE

SEQ ID NO: 1108407 - protein, 7 aa, Mycobacterium
GSRDSYS

SEQ ID NO: 1108408 - protein, 5 aa, Mycobacterium
GSREA

SEQ ID NO: 1108409 - protein, 6 aa, Mycobacterium
GSRGDG

SEQ ID NO: 1108410 - protein, 9 aa, Mycobacterium
GSRLGYQES

SEQ ID NO: 1108411 - protein, 6 aa, Mycobacterium
GSRPVV

SEQ ID NO: 1108412 - protein, 10 aa, Mycobacterium
GSRPYPADSL

SEQ ID NO: 1108413 - protein, 5 aa, Mycobacterium
GSRRG

SEQ ID NO: 1108414 - protein, 14 aa, Mycobacterium
GSRSWNPLEGVFGR

SEQ ID NO: 1108415 - protein, 9 aa, Mycobacterium
GSSASEIDD

SEQ ID NO: 1108416 - protein, 28 aa, Mycobacterium
GSSCVGAGGYSDVNPGTPVTVKNGKGEI

SEQ ID NO: 1108417 - protein, 5 aa, Mycobacterium
GSSDP

SEQ ID NO: 1108418 - protein, 9 aa, Mycobacterium
GSSEGQPRQ

SEQ ID NO: 1108419 - protein, 11 aa, Mycobacterium
GSSEVKGELGG

SEQ ID NO: 1108420 - protein, 8 aa, Mycobacterium
GSSGPDVA

SEQ ID NO: 1108421 - protein, 7 aa, Mycobacterium
GSSGPFA

SEQ ID NO: 1108422 - protein, 12 aa, Mycobacterium
GSSGSGNPVESS

SEQ ID NO: 1108423 - protein, 7 aa, Mycobacterium
GSSPDDI

SEQ ID NO: 1108424 - protein, 7 aa, Mycobacterium
GSSRRQR

SEQ ID NO: 1108425 - protein, 17 aa, Mycobacterium
GSTEHPSITGSRPDAPE

SEQ ID NO: 1108426 - protein, 16 aa, Mycobacterium
GSTGAGDGQATSSAEA

SEQ ID NO: 1108427 - protein, 6 aa, Mycobacterium
GSTGAQ

SEQ ID NO: 1108428 - protein, 11 aa, Mycobacterium
GSTGRSSELGA

SEQ ID NO: 1108429 - protein, 9 aa, Mycobacterium
GSTGTPKGV

SEQ ID NO: 1108430 - protein, 7 aa, Mycobacterium
GSTGTVA

SEQ ID NO: 1108431 - protein, 5 aa, Mycobacterium
GSTQT

SEQ ID NO: 1108432 - protein, 10 aa, Mycobacterium
GSTSKSLSQT

SEQ ID NO: 1108433 - protein, 5 aa, Mycobacterium
GSTTL

SEQ ID NO: 1108434 - protein, 13 aa, Mycobacterium
GSVAPPSQAMNDQ

SEQ ID NO: 1108435 - protein, 7 aa, Mycobacterium
GSVDTAE

SEQ ID NO: 1108436 - protein, 6 aa, Mycobacterium
GSVGAA

SEQ ID NO: 1108437 - protein, 4 aa, Mycobacterium
GSVN

SEQ ID NO: 1108438 - protein, 4 aa, Mycobacterium
GSVP

SEQ ID NO: 1108439 - protein, 8 aa, Mycobacterium
GSVSPVQE

SEQ ID NO: 1108440 - protein, 15 aa, Mycobacterium
GSVTPRTAKKTDSRL

SEQ ID NO: 1108441 - protein, 7 aa, Mycobacterium
GSWSETA

SEQ ID NO: 1108442 - protein, 8 aa, Mycobacterium
GSWSETNR

SEQ ID NO: 1108443 - protein, 6 aa, Mycobacterium
GSYDMD

SEQ ID NO: 1108444 - protein, 4 aa, Mycobacterium
GTAA

SEQ ID NO: 1108445 - protein, 5 aa, Mycobacterium
GTAAA

SEQ ID NO: 1108446 - protein, 13 aa, Mycobacterium
GTAAASKEGNVAN

SEQ ID NO: 1108447 - protein, 9 aa, Mycobacterium
GTAAGRPLK

SEQ ID NO: 1108448 - protein, 18 aa, Mycobacterium
GTAAQTAAVTDPGAFAQT

SEQ ID NO: 1108449 - protein, 9 aa, Mycobacterium
GTADGTPEL

SEQ ID NO: 1108450 - protein, 5 aa, Mycobacterium
GTADI

SEQ ID NO: 1108451 - protein, 16 aa, Mycobacterium
GTAERSGLWSPAPLRL

SEQ ID NO: 1108452 - protein, 6 aa, Mycobacterium
GTAGEP

SEQ ID NO: 1108453 - protein, 8 aa, Mycobacterium
GTAGGATI

SEQ ID NO: 1108454 - protein, 7 aa, Mycobacterium
GTAGPFG

SEQ ID NO: 1108455 - protein, 4 aa, Mycobacterium
GTAL

SEQ ID NO: 1108456 - protein, 9 aa, Mycobacterium
GTALGVQGT

SEQ ID NO: 1108457 - protein, 6 aa, Mycobacterium
GTANLG

SEQ ID NO: 1108458 - protein, 14 aa, Mycobacterium
GTANMRSDETDRLN

SEQ ID NO: 1108459 - protein, 6 aa, Mycobacterium
GTAPEV

SEQ ID NO: 1108460 - protein, 6 aa, Mycobacterium
GTATNL

SEQ ID NO: 1108461 - protein, 7 aa, Mycobacterium
GTATTGR

SEQ ID NO: 1108462 - protein, 10 aa, Mycobacterium
GTCGTGRAGV

SEQ ID NO: 1108463 - protein, 13 aa, Mycobacterium
GTDARNAPEVPAE

SEQ ID NO: 1108464 - protein, 4 aa, Mycobacterium
GTDF

SEQ ID NO: 1108465 - protein, 6 aa, Mycobacterium
GTDPEA

SEQ ID NO: 1108466 - protein, 8 aa, Mycobacterium
GTDPSSDI

SEQ ID NO: 1108467 - protein, 11 aa, Mycobacterium
GTDQEEASATL

SEQ ID NO: 1108468 - protein, 5 aa, Mycobacterium
GTEGL

SEQ ID NO: 1108469 - protein, 8 aa, Mycobacterium
GTEIGTES

SEQ ID NO: 1108470 - protein, 11 aa, Mycobacterium
GTEKLAGSGIT

SEQ ID NO: 1108471 - protein, 7 aa, Mycobacterium
GTEPATV

SEQ ID NO: 1108472 - protein, 11 aa, Mycobacterium
GTEQISNVSPP

SEQ ID NO: 1108473 - protein, 8 aa, Mycobacterium
GTERGHPT

SEQ ID NO: 1108474 - protein, 5 aa, Mycobacterium
GTEVP

SEQ ID NO: 1108475 - protein, 19 aa, Mycobacterium
GTGDDAGTDGVDDTRGQTA

SEQ ID NO: 1108476 - protein, 10 aa, Mycobacterium
GTGDERAAEV

SEQ ID NO: 1108477 - protein, 5 aa, Mycobacterium
GTGGG

SEQ ID NO: 1108478 - protein, 4 aa, Mycobacterium
GTGI

SEQ ID NO: 1108479 - protein, 7 aa, Mycobacterium
GTGPKQA

SEQ ID NO: 1108480 - protein, 5 aa, Mycobacterium
GTGSV

SEQ ID NO: 1108481 - protein, 6 aa, Mycobacterium
GTGSVV

SEQ ID NO: 1108482 - protein, 12 aa, Mycobacterium
GTGTESPPTAQM

SEQ ID NO: 1108483 - protein, 13 aa, Mycobacterium
GTHSTASLPRSGV

SEQ ID NO: 1108484 - protein, 7 aa, Mycobacterium
GTIGAGG

SEQ ID NO: 1108485 - protein, 10 aa, Mycobacterium
GTIKGSYNTD

SEQ ID NO: 1108486 - protein, 9 aa, Mycobacterium
GTIPPNPSE

SEQ ID NO: 1108487 - protein, 18 aa, Mycobacterium
GTISGTSVAEADTSGQTV

SEQ ID NO: 1108488 - protein, 11 aa, Mycobacterium
GTITLGNRQAS

SEQ ID NO: 1108489 - protein, 6 aa, Mycobacterium
GTKNRA

SEQ ID NO: 1108490 - protein, 11 aa, Mycobacterium
GTKTPATTLPE

SEQ ID NO: 1108491 - protein, 18 aa, Mycobacterium
GTKVGPAAMPKGPLPAQA

SEQ ID NO: 1108492 - protein, 4 aa, Mycobacterium
GTLS

SEQ ID NO: 1108493 - protein, 8 aa, Mycobacterium
GTLTANRP

SEQ ID NO: 1108494 - protein, 6 aa, Mycobacterium
GTLTMG

SEQ ID NO: 1108495 - protein, 10 aa, Mycobacterium
GTMAQPGETV

SEQ ID NO: 1108496 - protein, 4 aa, Mycobacterium
GTMG

SEQ ID NO: 1108497 - protein, 16 aa, Mycobacterium
GTNAETALRDGQMTPE

SEQ ID NO: 1108498 - protein, 8 aa, Mycobacterium
GTNGTADL

SEQ ID NO: 1108499 - protein, 7 aa, Mycobacterium
GTNQDIP

SEQ ID NO: 1108500 - protein, 6 aa, Mycobacterium
GTPAAI

SEQ ID NO: 1108501 - protein, 9 aa, Mycobacterium
GTPALEQDS

SEQ ID NO: 1108502 - protein, 7 aa, Mycobacterium
GTPGVAT

SEQ ID NO: 1108503 - protein, 15 aa, Mycobacterium
GTPGVPQIDLPRTVS

SEQ ID NO: 1108504 - protein, 93 aa, Mycobacterium
GTPLPPGAVPAGTPPVAPPPGAPAPATTPVPAAPPAPTAAPAAVAPPPPPGNSINGTPLPPVPPAAAEVPPSGGAVPAAPSAFGGNGTGGPSL

SEQ ID NO: 1108505 - protein, 5 aa, Mycobacterium
GTPPT

SEQ ID NO: 1108506 - protein, 7 aa, Mycobacterium
GTPSVTG

SEQ ID NO: 1108507 - protein, 23 aa, Mycobacterium
GTPVGSVRPGTGSPSDYRALPGG

SEQ ID NO: 1108508 - protein, 13 aa, Mycobacterium
GTPVSHRDHTGVR

SEQ ID NO: 1108509 - protein, 7 aa, Mycobacterium
GTQADYS

SEQ ID NO: 1108510 - protein, 5 aa, Mycobacterium
GTQDG

SEQ ID NO: 1108511 - protein, 4 aa, Mycobacterium
GTQI

SEQ ID NO: 1108512 - protein, 5 aa, Mycobacterium
GTQPR

SEQ ID NO: 1108513 - protein, 7 aa, Mycobacterium
GTQVTKE

SEQ ID NO: 1108514 - protein, 6 aa, Mycobacterium
GTRASL

SEQ ID NO: 1108515 - protein, 7 aa, Mycobacterium
GTRGCES

SEQ ID NO: 1108516 - protein, 13 aa, Mycobacterium
GTRKSTAVGAGTA

SEQ ID NO: 1108517 - protein, 10 aa, Mycobacterium
GTSKPSPTSL

SEQ ID NO: 1108518 - protein, 9 aa, Mycobacterium
GTSMPEKPA

SEQ ID NO: 1108519 - protein, 6 aa, Mycobacterium
GTSTRS

SEQ ID NO: 1108520 - protein, 8 aa, Mycobacterium
GTSTRSYE

SEQ ID NO: 1108521 - protein, 4 aa, Mycobacterium
GTTA

SEQ ID NO: 1108522 - protein, 10 aa, Mycobacterium
GTTAEAYNNI

SEQ ID NO: 1108523 - protein, 11 aa, Mycobacterium
GTTASRSGSGL

SEQ ID NO: 1108524 - protein, 11 aa, Mycobacterium
GTTEPALRGET

SEQ ID NO: 1108525 - protein, 4 aa, Mycobacterium
GTTG

SEQ ID NO: 1108526 - protein, 5 aa, Mycobacterium
GTTGA

SEQ ID NO: 1108527 - protein, 6 aa, Mycobacterium
GTTGGS

SEQ ID NO: 1108528 - protein, 7 aa, Mycobacterium
GTTGMPK

SEQ ID NO: 1108529 - protein, 7 aa, Mycobacterium
GTTGPVA

SEQ ID NO: 1108530 - protein, 8 aa, Mycobacterium
GTTGPVGV

SEQ ID NO: 1108531 - protein, 8 aa, Mycobacterium
GTTGPVKD

SEQ ID NO: 1108532 - protein, 19 aa, Mycobacterium
GTTGTPKGANRSAPPSLAP

SEQ ID NO: 1108533 - protein, 8 aa, Mycobacterium
GTTIPGSA

SEQ ID NO: 1108534 - protein, 6 aa, Mycobacterium
GTTQRL

SEQ ID NO: 1108535 - protein, 9 aa, Mycobacterium
GTVDAGYQT

SEQ ID NO: 1108536 - protein, 11 aa, Mycobacterium
GTVNAGPDGDG

SEQ ID NO: 1108537 - protein, 17 aa, Mycobacterium
GTVPPNPSELLGSQAAK

SEQ ID NO: 1108538 - protein, 6 aa, Mycobacterium
GTVPTA

SEQ ID NO: 1108539 - protein, 20 aa, Mycobacterium
GTVTPGTEEAADPVPFEKQN

SEQ ID NO: 1108540 - protein, 13 aa, Mycobacterium
GTYSTGPQQESRL

SEQ ID NO: 1108541 - protein, 11 aa, Mycobacterium
GVADDSNPAPH

SEQ ID NO: 1108542 - protein, 6 aa, Mycobacterium
GVAGGV

SEQ ID NO: 1108543 - protein, 7 aa, Mycobacterium
GVDASYS

SEQ ID NO: 1108544 - protein, 33 aa, Mycobacterium
GVDEERSAAVASRPSEEGAGAVGEPEAAHTEHG

SEQ ID NO: 1108545 - protein, 13 aa, Mycobacterium
GVDGEEPGEMENG

SEQ ID NO: 1108546 - protein, 13 aa, Mycobacterium
GVDGTRPYCTGDG

SEQ ID NO: 1108547 - protein, 5 aa, Mycobacterium
GVDSP

SEQ ID NO: 1108548 - protein, 8 aa, Mycobacterium
GVEDNPGY

SEQ ID NO: 1108549 - protein, 7 aa, Mycobacterium
GVEEPAT

SEQ ID NO: 1108550 - protein, 5 aa, Mycobacterium
GVERQ

SEQ ID NO: 1108551 - protein, 8 aa, Mycobacterium
GVESQGEL

SEQ ID NO: 1108552 - protein, 14 aa, Mycobacterium
GVFSPGRAQIPQRT

SEQ ID NO: 1108553 - protein, 16 aa, Mycobacterium
GVGAGDDAVKQSGGDG

SEQ ID NO: 1108554 - protein, 7 aa, Mycobacterium
GVGAGQT

SEQ ID NO: 1108555 - protein, 8 aa, Mycobacterium
GVGDGGSA

SEQ ID NO: 1108556 - protein, 27 aa, Mycobacterium
GVGGAAAAGAKGLGSRLRSRGDTTPWD

SEQ ID NO: 1108557 - protein, 5 aa, Mycobacterium
GVGGG

SEQ ID NO: 1108558 - protein, 5 aa, Mycobacterium
GVGHG

SEQ ID NO: 1108559 - protein, 8 aa, Mycobacterium
GVGIPEGR

SEQ ID NO: 1108560 - protein, 4 aa, Mycobacterium
GVGL

SEQ ID NO: 1108561 - protein, 24 aa, Mycobacterium
GVHRDPGRDARVDAPGGAELGDRN

SEQ ID NO: 1108562 - protein, 7 aa, Mycobacterium
GVKGGDG

SEQ ID NO: 1108563 - protein, 32 aa, Mycobacterium
GVKPGPRLPDVEAGGDYVASGDGLTDCDGQGT

SEQ ID NO: 1108564 - protein, 7 aa, Mycobacterium
GVKPRNS

SEQ ID NO: 1108565 - protein, 4 aa, Mycobacterium
GVLP

SEQ ID NO: 1108566 - protein, 17 aa, Mycobacterium
GVNPDKEEPSGSTDETL

SEQ ID NO: 1108567 - protein, 10 aa, Mycobacterium
GVPAAAGSTL

SEQ ID NO: 1108568 - protein, 40 aa, Mycobacterium
GVPEPPSIRYPGGPAPGPIPYPGAPPYGAPQYAPDGTPLY

SEQ ID NO: 1108569 - protein, 5 aa, Mycobacterium
GVPGM

SEQ ID NO: 1108570 - protein, 9 aa, Mycobacterium
GVPGTGESM

SEQ ID NO: 1108571 - protein, 5 aa, Mycobacterium
GVPPI

SEQ ID NO: 1108572 - protein, 24 aa, Mycobacterium
GVPQAPPPPPSPSVTVPPPPSETV

SEQ ID NO: 1108573 - protein, 10 aa, Mycobacterium
GVPQEPQSPE

SEQ ID NO: 1108574 - protein, 16 aa, Mycobacterium
GVPREAPAAAAGPATD

SEQ ID NO: 1108575 - protein, 7 aa, Mycobacterium
GVRGNAR

SEQ ID NO: 1108576 - protein, 5 aa, Mycobacterium
GVRNR

SEQ ID NO: 1108577 - protein, 7 aa, Mycobacterium
GVRPLGR

SEQ ID NO: 1108578 - protein, 16 aa, Mycobacterium
GVRRGPPGSPESPIPV

SEQ ID NO: 1108579 - protein, 7 aa, Mycobacterium
GVRTSPE

SEQ ID NO: 1108580 - protein, 16 aa, Mycobacterium
GVSATTYAEPQHDSDA

SEQ ID NO: 1108581 - protein, 6 aa, Mycobacterium
GVSDPQ

SEQ ID NO: 1108582 - protein, 8 aa, Mycobacterium
GVSEPTAG

SEQ ID NO: 1108583 - protein, 17 aa, Mycobacterium
GVSGGAAAVRRTAGGTP

SEQ ID NO: 1108584 - protein, 9 aa, Mycobacterium
GVSGTGKTT

SEQ ID NO: 1108585 - protein, 7 aa, Mycobacterium
GVSKSAA

SEQ ID NO: 1108586 - protein, 7 aa, Mycobacterium
GVSNHAA

SEQ ID NO: 1108587 - protein, 7 aa, Mycobacterium
GVSTGQV

SEQ ID NO: 1108588 - protein, 9 aa, Mycobacterium
GVTATKSRL

SEQ ID NO: 1108589 - protein, 10 aa, Mycobacterium
GVTEAGDPAY

SEQ ID NO: 1108590 - protein, 12 aa, Mycobacterium
GVTGGGGGAQPR

SEQ ID NO: 1108591 - protein, 8 aa, Mycobacterium
GVTPRTPN

SEQ ID NO: 1108592 - protein, 6 aa, Mycobacterium
GVTQGD

SEQ ID NO: 1108593 - protein, 11 aa, Mycobacterium
GVTRPTGDRLE

SEQ ID NO: 1108594 - protein, 10 aa, Mycobacterium
GWPEGSTADA

SEQ ID NO: 1108595 - protein, 16 aa, Mycobacterium
GWPPQAGGPHPPQPQG

SEQ ID NO: 1108596 - protein, 7 aa, Mycobacterium
GWSAPAV

SEQ ID NO: 1108597 - protein, 6 aa, Mycobacterium
GWTDPS

SEQ ID NO: 1108598 - protein, 6 aa, Mycobacterium
GYAENG

SEQ ID NO: 1108599 - protein, 6 aa, Mycobacterium
GYDDYT

SEQ ID NO: 1108600 - protein, 9 aa, Mycobacterium
GYEKPNPHI

SEQ ID NO: 1108601 - protein, 4 aa, Mycobacterium
GYEY

SEQ ID NO: 1108602 - protein, 12 aa, Mycobacterium
GYGDAGPDAGAG

SEQ ID NO: 1108603 - protein, 9 aa, Mycobacterium
GYGGPNAQQ

SEQ ID NO: 1108604 - protein, 6 aa, Mycobacterium
GYGSPA

SEQ ID NO: 1108605 - protein, 6 aa, Mycobacterium
GYGTAV

SEQ ID NO: 1108606 - protein, 17 aa, Mycobacterium
GYKTNYDSRDYLPEDVP

SEQ ID NO: 1108607 - protein, 10 aa, Mycobacterium
GYKTNYNDRT

SEQ ID NO: 1108608 - protein, 5 aa, Mycobacterium
GYLPS

SEQ ID NO: 1108609 - protein, 7 aa, Mycobacterium
GYQPTAE

SEQ ID NO: 1108610 - protein, 18 aa, Mycobacterium
GYQTGDPARCDTFATNNL

SEQ ID NO: 1108611 - protein, 12 aa, Mycobacterium
GYQTSYNDRNYL

SEQ ID NO: 1108612 - protein, 8 aa, Mycobacterium
GYTPERAG

SEQ ID NO: 1108613 - protein, 4 aa, Mycobacterium
GYVN

SEQ ID NO: 1108614 - protein, 12 aa, Mycobacterium
HAAAGAGLPSGG

SEQ ID NO: 1108615 - protein, 6 aa, Mycobacterium
HAARET

SEQ ID NO: 1108616 - protein, 5 aa, Mycobacterium
HADGV

SEQ ID NO: 1108617 - protein, 5 aa, Mycobacterium
HADTD

SEQ ID NO: 1108618 - protein, 10 aa, Mycobacterium
HADTTQPTVP

SEQ ID NO: 1108619 - protein, 17 aa, Mycobacterium
HAGGNQTVIVGDAVAAG

SEQ ID NO: 1108620 - protein, 21 aa, Mycobacterium
HAGNRIERSGRPRLRRPSGTR

SEQ ID NO: 1108621 - protein, 5 aa, Mycobacterium
HAGPS

SEQ ID NO: 1108622 - protein, 9 aa, Mycobacterium
HAHAAPPAA

SEQ ID NO: 1108623 - protein, 8 aa, Mycobacterium
HAHGPHPL

SEQ ID NO: 1108624 - protein, 4 aa, Mycobacterium
HAHP

SEQ ID NO: 1108625 - protein, 26 aa, Mycobacterium
HALAGGRPSAAKTGTNQLGDTDANRD

SEQ ID NO: 1108626 - protein, 26 aa, Mycobacterium
HALAGGRPSAAKTGTNQLGDTGANRD

SEQ ID NO: 1108627 - protein, 61 aa, Mycobacterium
HANGDQGEYVGRRRAPDQVEPEPPRGKHSAAGEEPTEAPAAPEAPAEPDADGGAHTGGQSV

SEQ ID NO: 1108628 - protein, 49 aa, Mycobacterium
HAPAGAEAGAHHHGPGAEQTDDHHSHPEPSPAAPAGEPASDNHGTSAEH

SEQ ID NO: 1108629 - protein, 49 aa, Mycobacterium
HAPAGAEAGAHHHGPGAEQTEDHHSHPEPSPAAPAGEPASEDHATSAEH

SEQ ID NO: 1108630 - protein, 4 aa, Mycobacterium
HAPG

SEQ ID NO: 1108631 - protein, 6 aa, Mycobacterium
HAPGGP

SEQ ID NO: 1108632 - protein, 7 aa, Mycobacterium
HAQADSV

SEQ ID NO: 1108633 - protein, 4 aa, Mycobacterium
HARD

SEQ ID NO: 1108634 - protein, 4 aa, Mycobacterium
HARP

SEQ ID NO: 1108635 - protein, 7 aa, Mycobacterium
HARSGDL

SEQ ID NO: 1108636 - protein, 24 aa, Mycobacterium
HARTGGEWNRPAGSEDFAIPVKAN

SEQ ID NO: 1108637 - protein, 6 aa, Mycobacterium
HASPSQ

SEQ ID NO: 1108638 - protein, 13 aa, Mycobacterium
HAVQEGGGIRSAP

SEQ ID NO: 1108639 - protein, 16 aa, Mycobacterium
HAVTTDRQQPASPVTS

SEQ ID NO: 1108640 - protein, 7 aa, Mycobacterium
HDAPAGV

SEQ ID NO: 1108641 - protein, 8 aa, Mycobacterium
HDAPPRVT

SEQ ID NO: 1108642 - protein, 6 aa, Mycobacterium
HDASGW

SEQ ID NO: 1108643 - protein, 4 aa, Mycobacterium
HDEL

SEQ ID NO: 1108644 - protein, 5 aa, Mycobacterium
HDEPG

SEQ ID NO: 1108645 - protein, 5 aa, Mycobacterium
HDLPP

SEQ ID NO: 1108646 - protein, 9 aa, Mycobacterium
HDQADSRRD

SEQ ID NO: 1108647 - protein, 7 aa, Mycobacterium
HDQTPLR

SEQ ID NO: 1108648 - protein, 4 aa, Mycobacterium
HDRS

SEQ ID NO: 1108649 - protein, 22 aa, Mycobacterium
HDSTGTPAPPVPVQSPPPAAEP

SEQ ID NO: 1108650 - protein, 4 aa, Mycobacterium
HDTA

SEQ ID NO: 1108651 - protein, 4 aa, Mycobacterium
HDVP

SEQ ID NO: 1108652 - protein, 13 aa, Mycobacterium
HEAAQEAVADPAL

SEQ ID NO: 1108653 - protein, 8 aa, Mycobacterium
HEAQHAGR

SEQ ID NO: 1108654 - protein, 4 aa, Mycobacterium
HEEA

SEQ ID NO: 1108655 - protein, 14 aa, Mycobacterium
HEESTQLAENEAAA

SEQ ID NO: 1108656 - protein, 41 aa, Mycobacterium
HEGNSHADNDGHDQGSHDHGEGHSHDHDHGHGHSHDGWGGK

SEQ ID NO: 1108657 - protein, 10 aa, Mycobacterium
HEHSTGGSRW

SEQ ID NO: 1108658 - protein, 9 aa, Mycobacterium
HEPGKRDPL

SEQ ID NO: 1108659 - protein, 7 aa, Mycobacterium
HEPRRDL

SEQ ID NO: 1108660 - protein, 6 aa, Mycobacterium
HEQPHT

SEQ ID NO: 1108661 - protein, 8 aa, Mycobacterium
HESAPGEL

SEQ ID NO: 1108662 - protein, 5 aa, Mycobacterium
HESEL

SEQ ID NO: 1108663 - protein, 4 aa, Mycobacterium
HEST

SEQ ID NO: 1108664 - protein, 8 aa, Mycobacterium
HETDRTAT

SEQ ID NO: 1108665 - protein, 6 aa, Mycobacterium
HETTAT

SEQ ID NO: 1108666 - protein, 11 aa, Mycobacterium
HEYGSGTPWAK

SEQ ID NO: 1108667 - protein, 8 aa, Mycobacterium
HGAPSRIR

SEQ ID NO: 1108668 - protein, 6 aa, Mycobacterium
HGAQAA

SEQ ID NO: 1108669 - protein, 6 aa, Mycobacterium
HGATSF

SEQ ID NO: 1108670 - protein, 6 aa, Mycobacterium
HGATTP

SEQ ID NO: 1108671 - protein, 13 aa, Mycobacterium
HGDEDAADTTEIE

SEQ ID NO: 1108672 - protein, 15 aa, Mycobacterium
HGDEEDTAAAAPVQR

SEQ ID NO: 1108673 - protein, 9 aa, Mycobacterium
HGDITTREP

SEQ ID NO: 1108674 - protein, 13 aa, Mycobacterium
HGENGAHGVIAVA

SEQ ID NO: 1108675 - protein, 11 aa, Mycobacterium
HGEPVPGEAAP

SEQ ID NO: 1108676 - protein, 6 aa, Mycobacterium
HGGEGL

SEQ ID NO: 1108677 - protein, 11 aa, Mycobacterium
HGGGEASVTST

SEQ ID NO: 1108678 - protein, 6 aa, Mycobacterium
HGGGTE

SEQ ID NO: 1108679 - protein, 4 aa, Mycobacterium
HGGH

SEQ ID NO: 1108680 - protein, 8 aa, Mycobacterium
HGGSGSEA

SEQ ID NO: 1108681 - protein, 6 aa, Mycobacterium
HGGTIE

SEQ ID NO: 1108682 - protein, 4 aa, Mycobacterium
HGGY

SEQ ID NO: 1108683 - protein, 104 aa, Mycobacterium
HGHAPASADGGHHGTTPEDGHGEHDATTPDDAHSDHHGAGAEPAEGNDHGTSSEHVQSPDSNHEPAAPPPVNEPAGESAAPATAEVPAPPAVPAQDDHGDHDHR

SEQ ID NO: 1108684 - protein, 5 aa, Mycobacterium
HGHAV

SEQ ID NO: 1108685 - protein, 8 aa, Mycobacterium
HGNPQTEV

SEQ ID NO: 1108686 - protein, 6 aa, Mycobacterium
HGPVAT

SEQ ID NO: 1108687 - protein, 24 aa, Mycobacterium
HGQTEGLRREPHGAVSAKTRQPLG

SEQ ID NO: 1108688 - protein, 9 aa, Mycobacterium
HGSDPARTA

SEQ ID NO: 1108689 - protein, 10 aa, Mycobacterium
HGTDPKTRGA

SEQ ID NO: 1108690 - protein, 8 aa, Mycobacterium
HGTGADIT

SEQ ID NO: 1108691 - protein, 5 aa, Mycobacterium
HGTRA

SEQ ID NO: 1108692 - protein, 16 aa, Mycobacterium
HGTVPTAVGSATEGVE

SEQ ID NO: 1108693 - protein, 6 aa, Mycobacterium
HHGHQA

SEQ ID NO: 1108694 - protein, 12 aa, Mycobacterium
HHHGGSAPTVPT

SEQ ID NO: 1108695 - protein, 25 aa, Mycobacterium
HHNDSRRHGEATEAPVGRPQAESGL

SEQ ID NO: 1108696 - protein, 19 aa, Mycobacterium
HHTPARRDEDSPREDAPQR

SEQ ID NO: 1108697 - protein, 36 aa, Mycobacterium
HHVGGQRSATRRTGQDQQGRRGQQGRRARPREGQRY

SEQ ID NO: 1108698 - protein, 6 aa, Mycobacterium
HIRDTG

SEQ ID NO: 1108699 - protein, 14 aa, Mycobacterium
HISASSQGAGTGTT

SEQ ID NO: 1108700 - protein, 10 aa, Mycobacterium
HKDGRPSTVP

SEQ ID NO: 1108701 - protein, 7 aa, Mycobacterium
HKMTQDD

SEQ ID NO: 1108702 - protein, 7 aa, Mycobacterium
HLDDPNV

SEQ ID NO: 1108703 - protein, 8 aa, Mycobacterium
HLDGPTEA

SEQ ID NO: 1108704 - protein, 11 aa, Mycobacterium
HLGPDTTLSGT

SEQ ID NO: 1108705 - protein, 11 aa, Mycobacterium
HLGSGAPPGRI

SEQ ID NO: 1108706 - protein, 13 aa, Mycobacterium
HLSPDTQRALNPA

SEQ ID NO: 1108707 - protein, 13 aa, Mycobacterium
HLSQPDAECTPDT

SEQ ID NO: 1108708 - protein, 13 aa, Mycobacterium
HLTPEPLLATPAR

SEQ ID NO: 1108709 - protein, 5 aa, Mycobacterium
HNDPT

SEQ ID NO: 1108710 - protein, 4 aa, Mycobacterium
HNDS

SEQ ID NO: 1108711 - protein, 14 aa, Mycobacterium
HNGTSYIDTGDPDG

SEQ ID NO: 1108712 - protein, 9 aa, Mycobacterium
HNRPAGAQG

SEQ ID NO: 1108713 - protein, 13 aa, Mycobacterium
HNSAAAGPARPVR

SEQ ID NO: 1108714 - protein, 40 aa, Mycobacterium
HNWKGDPNATTSGQDIPQPPAGSLPNTPAPTLAPAPPIAA

SEQ ID NO: 1108715 - protein, 9 aa, Mycobacterium
HPDAAGTAA

SEQ ID NO: 1108716 - protein, 5 aa, Mycobacterium
HPDDL

SEQ ID NO: 1108717 - protein, 11 aa, Mycobacterium
HPDDPDSSRLT

SEQ ID NO: 1108718 - protein, 7 aa, Mycobacterium
HPDKAEA

SEQ ID NO: 1108719 - protein, 10 aa, Mycobacterium
HPDSDPDALA

SEQ ID NO: 1108720 - protein, 7 aa, Mycobacterium
HPENDKR

SEQ ID NO: 1108721 - protein, 11 aa, Mycobacterium
HPEPAATTPYV

SEQ ID NO: 1108722 - protein, 7 aa, Mycobacterium
HPFENPT

SEQ ID NO: 1108723 - protein, 8 aa, Mycobacterium
HPGPRSAA

SEQ ID NO: 1108724 - protein, 11 aa, Mycobacterium
HPLTPPSYGGR

SEQ ID NO: 1108725 - protein, 10 aa, Mycobacterium
HPPAPRPARR

SEQ ID NO: 1108726 - protein, 5 aa, Mycobacterium
HPPDE

SEQ ID NO: 1108727 - protein, 11 aa, Mycobacterium
HPRPMSGPSHR

SEQ ID NO: 1108728 - protein, 21 aa, Mycobacterium
HPRSAKSAEARLESQAMNHEW

SEQ ID NO: 1108729 - protein, 6 aa, Mycobacterium
HPSLPH

SEQ ID NO: 1108730 - protein, 20 aa, Mycobacterium
HPSRKKRSDSADPKPKKSTA

SEQ ID NO: 1108731 - protein, 6 aa, Mycobacterium
HPTGEL

SEQ ID NO: 1108732 - protein, 15 aa, Mycobacterium
HQERTSASNGSSNGH

SEQ ID NO: 1108733 - protein, 19 aa, Mycobacterium
HQFGAQARGKGAPAGAGLS

SEQ ID NO: 1108734 - protein, 14 aa, Mycobacterium
HQGSAGRPPQTTAV

SEQ ID NO: 1108735 - protein, 13 aa, Mycobacterium
HQGSAGSPPPTAA

SEQ ID NO: 1108736 - protein, 9 aa, Mycobacterium
HQQPDGSVR

SEQ ID NO: 1108737 - protein, 9 aa, Mycobacterium
HQRARSERR

SEQ ID NO: 1108738 - protein, 8 aa, Mycobacterium
HQRPKLER

SEQ ID NO: 1108739 - protein, 4 aa, Mycobacterium
HQSR

SEQ ID NO: 1108740 - protein, 5 aa, Mycobacterium
HRDAG

SEQ ID NO: 1108741 - protein, 4 aa, Mycobacterium
HRDE

SEQ ID NO: 1108742 - protein, 8 aa, Mycobacterium
HRDEADEL

SEQ ID NO: 1108743 - protein, 11 aa, Mycobacterium
HRDRATRTLEG

SEQ ID NO: 1108744 - protein, 6 aa, Mycobacterium
HRDSGA

SEQ ID NO: 1108745 - protein, 6 aa, Mycobacterium
HRETTA

SEQ ID NO: 1108746 - protein, 4 aa, Mycobacterium
HRGN

SEQ ID NO: 1108747 - protein, 10 aa, Mycobacterium
HRNPDPGPWD

SEQ ID NO: 1108748 - protein, 24 aa, Mycobacterium
HRPAIETERTAGRVSSSRIDTQED

SEQ ID NO: 1108749 - protein, 9 aa, Mycobacterium
HRPGDGRSI

SEQ ID NO: 1108750 - protein, 7 aa, Mycobacterium
HRPPVAE

SEQ ID NO: 1108751 - protein, 8 aa, Mycobacterium
HRPPVTEG

SEQ ID NO: 1108752 - protein, 18 aa, Mycobacterium
HRRGLSGARNSGLRAASG

SEQ ID NO: 1108753 - protein, 12 aa, Mycobacterium
HRSRQARRADRP

SEQ ID NO: 1108754 - protein, 10 aa, Mycobacterium
HRTAGKGARA

SEQ ID NO: 1108755 - protein, 10 aa, Mycobacterium
HRVGQPKSRC

SEQ ID NO: 1108756 - protein, 10 aa, Mycobacterium
HSAEVSGTDV

SEQ ID NO: 1108757 - protein, 11 aa, Mycobacterium
HSASAPTEKSS

SEQ ID NO: 1108758 - protein, 8 aa, Mycobacterium
HSDAEAKV

SEQ ID NO: 1108759 - protein, 7 aa, Mycobacterium
HSDDAAG

SEQ ID NO: 1108760 - protein, 7 aa, Mycobacterium
HSDPEAG

SEQ ID NO: 1108761 - protein, 9 aa, Mycobacterium
HSDRDERCG

SEQ ID NO: 1108762 - protein, 16 aa, Mycobacterium
HSDSYWPQSRERAAQA

SEQ ID NO: 1108763 - protein, 9 aa, Mycobacterium
HSGEGGADL

SEQ ID NO: 1108764 - protein, 6 aa, Mycobacterium
HSGLDA

SEQ ID NO: 1108765 - protein, 13 aa, Mycobacterium
HSGRQVDASTPWH

SEQ ID NO: 1108766 - protein, 4 aa, Mycobacterium
HSLP

SEQ ID NO: 1108767 - protein, 4 aa, Mycobacterium
HSPE

SEQ ID NO: 1108768 - protein, 6 aa, Mycobacterium
HSPEPR

SEQ ID NO: 1108769 - protein, 18 aa, Mycobacterium
HSPLSGNHLTDSANGGQA

SEQ ID NO: 1108770 - protein, 7 aa, Mycobacterium
HSPNKER

SEQ ID NO: 1108771 - protein, 16 aa, Mycobacterium
HSQDADEMPDPEAPTL

SEQ ID NO: 1108772 - protein, 7 aa, Mycobacterium
HSQSAIG

SEQ ID NO: 1108773 - protein, 11 aa, Mycobacterium
HSSSGSASGPL

SEQ ID NO: 1108774 - protein, 21 aa, Mycobacterium
HSTEGHERAPVTRQVGDPRPI

SEQ ID NO: 1108775 - protein, 40 aa, Mycobacterium
HSVKPEPAEAGKAGQAADHETLTTARAADGGPDEGMPEPV

SEQ ID NO: 1108776 - protein, 6 aa, Mycobacterium
HTAAAG

SEQ ID NO: 1108777 - protein, 7 aa, Mycobacterium
HTDPAGP

SEQ ID NO: 1108778 - protein, 13 aa, Mycobacterium
HTDPAQTDTTNVS

SEQ ID NO: 1108779 - protein, 7 aa, Mycobacterium
HTEATAL

SEQ ID NO: 1108780 - protein, 12 aa, Mycobacterium
HTEDNTGLTSSN

SEQ ID NO: 1108781 - protein, 9 aa, Mycobacterium
HTESSTPLR

SEQ ID NO: 1108782 - protein, 15 aa, Mycobacterium
HTEVADTGRNRALAS

SEQ ID NO: 1108783 - protein, 9 aa, Mycobacterium
HTGPNDNHI

SEQ ID NO: 1108784 - protein, 7 aa, Mycobacterium
HTHGPRN

SEQ ID NO: 1108785 - protein, 6 aa, Mycobacterium
HTKREQ

SEQ ID NO: 1108786 - protein, 13 aa, Mycobacterium
HTNTPGSKNTKRW

SEQ ID NO: 1108787 - protein, 5 aa, Mycobacterium
HTPAG

SEQ ID NO: 1108788 - protein, 8 aa, Mycobacterium
HTPAGGSV

SEQ ID NO: 1108789 - protein, 7 aa, Mycobacterium
HTPPGGS

SEQ ID NO: 1108790 - protein, 6 aa, Mycobacterium
HTPPHG

SEQ ID NO: 1108791 - protein, 4 aa, Mycobacterium
HTRG

SEQ ID NO: 1108792 - protein, 23 aa, Mycobacterium
HTSTTSQVEPARRRGEAQSNQGA

SEQ ID NO: 1108793 - protein, 5 aa, Mycobacterium
HTTSG

SEQ ID NO: 1108794 - protein, 6 aa, Mycobacterium
HVAGPD

SEQ ID NO: 1108795 - protein, 11 aa, Mycobacterium
HVESAADSGTP

SEQ ID NO: 1108796 - protein, 4 aa, Mycobacterium
HVGT

SEQ ID NO: 1108797 - protein, 10 aa, Mycobacterium
HYSAHQSPKR

SEQ ID NO: 1108798 - protein, 19 aa, Mycobacterium
IAAESARAAAARDGDTRRR

SEQ ID NO: 1108799 - protein, 5 aa, Mycobacterium
IAAGD

SEQ ID NO: 1108800 - protein, 6 aa, Mycobacterium
IAAGQR

SEQ ID NO: 1108801 - protein, 14 aa, Mycobacterium
IAAPQDQDDRALVD

SEQ ID NO: 1108802 - protein, 8 aa, Mycobacterium
IADAARGA

SEQ ID NO: 1108803 - protein, 4 aa, Mycobacterium
IADN

SEQ ID NO: 1108804 - protein, 8 aa, Mycobacterium
IADTGMSQ

SEQ ID NO: 1108805 - protein, 12 aa, Mycobacterium
IAGEPTTSPAEL

SEQ ID NO: 1108806 - protein, 5 aa, Mycobacterium
IAGES

SEQ ID NO: 1108807 - protein, 5 aa, Mycobacterium
IAHPT

SEQ ID NO: 1108808 - protein, 11 aa, Mycobacterium
IAPNGQPSGFS

SEQ ID NO: 1108809 - protein, 7 aa, Mycobacterium
IAPPTGL

SEQ ID NO: 1108810 - protein, 5 aa, Mycobacterium
IAPRT

SEQ ID NO: 1108811 - protein, 8 aa, Mycobacterium
IAPTEGRL

SEQ ID NO: 1108812 - protein, 12 aa, Mycobacterium
IAQAQDRGDLTD

SEQ ID NO: 1108813 - protein, 5 aa, Mycobacterium
IASDR

SEQ ID NO: 1108814 - protein, 18 aa, Mycobacterium
IASPKGRHSVSTEESNHR

SEQ ID NO: 1108815 - protein, 8 aa, Mycobacterium
IATTPEDT

SEQ ID NO: 1108816 - protein, 4 aa, Mycobacterium
IDAA

SEQ ID NO: 1108817 - protein, 5 aa, Mycobacterium
IDAGT

SEQ ID NO: 1108818 - protein, 8 aa, Mycobacterium
IDDSGRLT

SEQ ID NO: 1108819 - protein, 9 aa, Mycobacterium
IDEKGAEGT

SEQ ID NO: 1108820 - protein, 14 aa, Mycobacterium
IDGPPRNTPQIGQP

SEQ ID NO: 1108821 - protein, 6 aa, Mycobacterium
IDGTDH

SEQ ID NO: 1108822 - protein, 5 aa, Mycobacterium
IDGTH

SEQ ID NO: 1108823 - protein, 8 aa, Mycobacterium
IDKNTSYR

SEQ ID NO: 1108824 - protein, 8 aa, Mycobacterium
IDNPDQRI

SEQ ID NO: 1108825 - protein, 9 aa, Mycobacterium
IDPATSLSE

SEQ ID NO: 1108826 - protein, 38 aa, Mycobacterium
IDPDGPGPLSPQTFTQAPPVPPTTVTAPAPTPTAPPPL

SEQ ID NO: 1108827 - protein, 5 aa, Mycobacterium
IDPKV

SEQ ID NO: 1108828 - protein, 11 aa, Mycobacterium
IDPPGDRGEWR

SEQ ID NO: 1108829 - protein, 11 aa, Mycobacterium
IDPRGSEPLRA

SEQ ID NO: 1108830 - protein, 9 aa, Mycobacterium
IDPSAQPQD

SEQ ID NO: 1108831 - protein, 10 aa, Mycobacterium
IDPSATPQDT

SEQ ID NO: 1108832 - protein, 5 aa, Mycobacterium
IDQAR

SEQ ID NO: 1108833 - protein, 4 aa, Mycobacterium
IDRD

SEQ ID NO: 1108834 - protein, 9 aa, Mycobacterium
IDSPAGGPT

SEQ ID NO: 1108835 - protein, 6 aa, Mycobacterium
IDSRGT

SEQ ID NO: 1108836 - protein, 23 aa, Mycobacterium
IDTLEADDTVADLSDAATRTGHS

SEQ ID NO: 1108837 - protein, 17 aa, Mycobacterium
IDTTAAVAASGAIAGED

SEQ ID NO: 1108838 - protein, 29 aa, Mycobacterium
IEAKSPKTLEEADSQAKAGGGKAGEVKGE

SEQ ID NO: 1108839 - protein, 13 aa, Mycobacterium
IEAPPSAPKPLSP

SEQ ID NO: 1108840 - protein, 10 aa, Mycobacterium
IEASPSGRLS

SEQ ID NO: 1108841 - protein, 13 aa, Mycobacterium
IEDEDEDEDVDEL

SEQ ID NO: 1108842 - protein, 6 aa, Mycobacterium
IEGDSS

SEQ ID NO: 1108843 - protein, 8 aa, Mycobacterium
IEGSNPVR

SEQ ID NO: 1108844 - protein, 4 aa, Mycobacterium
IEIP

SEQ ID NO: 1108845 - protein, 23 aa, Mycobacterium
IEPDPSLGVTRADPAAATTTTAN

SEQ ID NO: 1108846 - protein, 7 aa, Mycobacterium
IEPRAGD

SEQ ID NO: 1108847 - protein, 8 aa, Mycobacterium
IEQAANAQ

SEQ ID NO: 1108848 - protein, 12 aa, Mycobacterium
IEQASGSWRTNY

SEQ ID NO: 1108849 - protein, 15 aa, Mycobacterium
IEQPDPAPRMAEGPV

SEQ ID NO: 1108850 - protein, 10 aa, Mycobacterium
IEQTRGELGA

SEQ ID NO: 1108851 - protein, 6 aa, Mycobacterium
IERSPR

SEQ ID NO: 1108852 - protein, 12 aa, Mycobacterium
IETSGQGGSGLA

SEQ ID NO: 1108853 - protein, 8 aa, Mycobacterium
IGAAATAQ

SEQ ID NO: 1108854 - protein, 9 aa, Mycobacterium
IGAGATAQL

SEQ ID NO: 1108855 - protein, 9 aa, Mycobacterium
IGAGATVGP

SEQ ID NO: 1108856 - protein, 9 aa, Mycobacterium
IGAGSTAQL

SEQ ID NO: 1108857 - protein, 5 aa, Mycobacterium
IGASG

SEQ ID NO: 1108858 - protein, 5 aa, Mycobacterium
IGATG

SEQ ID NO: 1108859 - protein, 13 aa, Mycobacterium
IGDDAKVSNVEFV

SEQ ID NO: 1108860 - protein, 7 aa, Mycobacterium
IGDGPRN

SEQ ID NO: 1108861 - protein, 4 aa, Mycobacterium
IGEA

SEQ ID NO: 1108862 - protein, 10 aa, Mycobacterium
IGEKSKGRDW

SEQ ID NO: 1108863 - protein, 10 aa, Mycobacterium
IGEKTKGRAW

SEQ ID NO: 1108864 - protein, 16 aa, Mycobacterium
IGEPTPAAAPPEGTQA

SEQ ID NO: 1108865 - protein, 10 aa, Mycobacterium
IGGPAPDQYN

SEQ ID NO: 1108866 - protein, 10 aa, Mycobacterium
IGGSPETDVD

SEQ ID NO: 1108867 - protein, 7 aa, Mycobacterium
IGGTERY

SEQ ID NO: 1108868 - protein, 5 aa, Mycobacterium
IGGTS

SEQ ID NO: 1108869 - protein, 7 aa, Mycobacterium
IGNGSTY

SEQ ID NO: 1108870 - protein, 6 aa, Mycobacterium
IGNPDG

SEQ ID NO: 1108871 - protein, 6 aa, Mycobacterium
IGPPGE

SEQ ID NO: 1108872 - protein, 4 aa, Mycobacterium
IGPS

SEQ ID NO: 1108873 - protein, 7 aa, Mycobacterium
IGPTPSW

SEQ ID NO: 1108874 - protein, 14 aa, Mycobacterium
IGPYGSLSVGFSRG

SEQ ID NO: 1108875 - protein, 14 aa, Mycobacterium
IGQPPDNAGPRAQL

SEQ ID NO: 1108876 - protein, 5 aa, Mycobacterium
IGQSA

SEQ ID NO: 1108877 - protein, 4 aa, Mycobacterium
IGRD

SEQ ID NO: 1108878 - protein, 11 aa, Mycobacterium
IGRDGDAVTGA

SEQ ID NO: 1108879 - protein, 7 aa, Mycobacterium
IGRSTDN

SEQ ID NO: 1108880 - protein, 4 aa, Mycobacterium
IGSA

SEQ ID NO: 1108881 - protein, 14 aa, Mycobacterium
IGSATDDVERTQPA

SEQ ID NO: 1108882 - protein, 7 aa, Mycobacterium
IGSDGIA

SEQ ID NO: 1108883 - protein, 6 aa, Mycobacterium
IGSDGT

SEQ ID NO: 1108884 - protein, 10 aa, Mycobacterium
IGSDTHTAAR

SEQ ID NO: 1108885 - protein, 17 aa, Mycobacterium
IGSEDTAPPPAQDSADS

SEQ ID NO: 1108886 - protein, 5 aa, Mycobacterium
IGSEP

SEQ ID NO: 1108887 - protein, 7 aa, Mycobacterium
IGSTTSR

SEQ ID NO: 1108888 - protein, 6 aa, Mycobacterium
IGTPPE

SEQ ID NO: 1108889 - protein, 8 aa, Mycobacterium
IGTQPPSW

SEQ ID NO: 1108890 - protein, 12 aa, Mycobacterium
IHGEQRADGRNG

SEQ ID NO: 1108891 - protein, 13 aa, Mycobacterium
IHGEQRADGRNGY

SEQ ID NO: 1108892 - protein, 4 aa, Mycobacterium
IHGG

SEQ ID NO: 1108893 - protein, 6 aa, Mycobacterium
IHPPGS

SEQ ID NO: 1108894 - protein, 10 aa, Mycobacterium
IKEAKGFGGF

SEQ ID NO: 1108895 - protein, 7 aa, Mycobacterium
IKEPRES

SEQ ID NO: 1108896 - protein, 7 aa, Mycobacterium
IKGGDRV

SEQ ID NO: 1108897 - protein, 4 aa, Mycobacterium
IKQT

SEQ ID NO: 1108898 - protein, 7 aa, Mycobacterium
IKSRETL

SEQ ID NO: 1108899 - protein, 7 aa, Mycobacterium
INAEGAA

SEQ ID NO: 1108900 - protein, 18 aa, Mycobacterium
INGRTGKRGNARTGFADP

SEQ ID NO: 1108901 - protein, 20 aa, Mycobacterium
INRPQDPATARFVNAMQLAA

SEQ ID NO: 1108902 - protein, 7 aa, Mycobacterium
IPAAPRA

SEQ ID NO: 1108903 - protein, 8 aa, Mycobacterium
IPADGAQP

SEQ ID NO: 1108904 - protein, 12 aa, Mycobacterium
IPADRTSVPPDI

SEQ ID NO: 1108905 - protein, 6 aa, Mycobacterium
IPAEAT

SEQ ID NO: 1108906 - protein, 13 aa, Mycobacterium
IPAGGSPNSVGLP

SEQ ID NO: 1108907 - protein, 11 aa, Mycobacterium
IPAGSGPGGVS

SEQ ID NO: 1108908 - protein, 8 aa, Mycobacterium
IPAGTDTA

SEQ ID NO: 1108909 - protein, 14 aa, Mycobacterium
IPAGTETEDGTAGL

SEQ ID NO: 1108910 - protein, 8 aa, Mycobacterium
IPANAGLQ

SEQ ID NO: 1108911 - protein, 11 aa, Mycobacterium
IPAPRAESPQC

SEQ ID NO: 1108912 - protein, 46 aa, Mycobacterium
IPAPSINNGMNPLPADQLPQPPSPVSDPLSPPGQGRVECSGQQPNP

SEQ ID NO: 1108913 - protein, 9 aa, Mycobacterium
IPATVAGSA

SEQ ID NO: 1108914 - protein, 5 aa, Mycobacterium
IPDDP

SEQ ID NO: 1108915 - protein, 10 aa, Mycobacterium
IPDGGGGSVE

SEQ ID NO: 1108916 - protein, 7 aa, Mycobacterium
IPEEGES

SEQ ID NO: 1108917 - protein, 10 aa, Mycobacterium
IPEGGGRGAL

SEQ ID NO: 1108918 - protein, 6 aa, Mycobacterium
IPEGQG

SEQ ID NO: 1108919 - protein, 4 aa, Mycobacterium
IPER

SEQ ID NO: 1108920 - protein, 4 aa, Mycobacterium
IPFT

SEQ ID NO: 1108921 - protein, 10 aa, Mycobacterium
IPGAGRAGKA

SEQ ID NO: 1108922 - protein, 18 aa, Mycobacterium
IPGAPGQISPPLQAAESG

SEQ ID NO: 1108923 - protein, 7 aa, Mycobacterium
IPGGERV

SEQ ID NO: 1108924 - protein, 9 aa, Mycobacterium
IPGGRTQIT

SEQ ID NO: 1108925 - protein, 5 aa, Mycobacterium
IPGPG

SEQ ID NO: 1108926 - protein, 20 aa, Mycobacterium
IPHPTGTSAPEGESQGPDTP

SEQ ID NO: 1108927 - protein, 9 aa, Mycobacterium
IPKDPAPEL

SEQ ID NO: 1108928 - protein, 8 aa, Mycobacterium
IPKEPLDA

SEQ ID NO: 1108929 - protein, 8 aa, Mycobacterium
IPKRRQKR

SEQ ID NO: 1108930 - protein, 23 aa, Mycobacterium
IPNGNRSMSTAAPASPTRGPRWR

SEQ ID NO: 1108931 - protein, 8 aa, Mycobacterium
IPPGGSTA

SEQ ID NO: 1108932 - protein, 8 aa, Mycobacterium
IPPGQSGE

SEQ ID NO: 1108933 - protein, 143 aa, Mycobacterium
IPPIPTGTREAAQDTRSDALVSDDGRNRPERSASEGPGPGASVGDPAESVDGTAGEIDEAEDSDNDAADTTPVATDVEAPEQDDDEDRNVVPAEEEDADVDPDTASTPEDPSAVGNDGNGDERQTDDNDGTSDASQTEHTDES

SEQ ID NO: 1108934 - protein, 6 aa, Mycobacterium
IPPSGM

SEQ ID NO: 1108935 - protein, 5 aa, Mycobacterium
IPRAT

SEQ ID NO: 1108936 - protein, 12 aa, Mycobacterium
IPRDDNDKGPQL

SEQ ID NO: 1108937 - protein, 12 aa, Mycobacterium
IPRDRASVPPDV

SEQ ID NO: 1108938 - protein, 11 aa, Mycobacterium
IPRPSDTDPRL

SEQ ID NO: 1108939 - protein, 8 aa, Mycobacterium
IPSGPGDH

SEQ ID NO: 1108940 - protein, 8 aa, Mycobacterium
IPTETDRR

SEQ ID NO: 1108941 - protein, 6 aa, Mycobacterium
IPTGSL

SEQ ID NO: 1108942 - protein, 11 aa, Mycobacterium
IPTPPPLGTYP

SEQ ID NO: 1108943 - protein, 17 aa, Mycobacterium
IPVDGTVEQGHSEVDES

SEQ ID NO: 1108944 - protein, 8 aa, Mycobacterium
IQGDPTEA

SEQ ID NO: 1108945 - protein, 8 aa, Mycobacterium
IQGGSQPV

SEQ ID NO: 1108946 - protein, 5 aa, Mycobacterium
IQPES

SEQ ID NO: 1108947 - protein, 7 aa, Mycobacterium
IQPGPTL

SEQ ID NO: 1108948 - protein, 6 aa, Mycobacterium
IQPPRG

SEQ ID NO: 1108949 - protein, 7 aa, Mycobacterium
IQPRSYD

SEQ ID NO: 1108950 - protein, 12 aa, Mycobacterium
IQREEADDFNKR

SEQ ID NO: 1108951 - protein, 7 aa, Mycobacterium
IQSESKD

SEQ ID NO: 1108952 - protein, 17 aa, Mycobacterium
IQSPGPWRRNDTPAVTR

SEQ ID NO: 1108953 - protein, 13 aa, Mycobacterium
IRAQSASLGHGDE

SEQ ID NO: 1108954 - protein, 16 aa, Mycobacterium
IRESGGDRSAVTGGTT

SEQ ID NO: 1108955 - protein, 6 aa, Mycobacterium
IRESGT

SEQ ID NO: 1108956 - protein, 5 aa, Mycobacterium
IRGAY

SEQ ID NO: 1108957 - protein, 14 aa, Mycobacterium
IRGPPRRSSTTLTG

SEQ ID NO: 1108958 - protein, 8 aa, Mycobacterium
IRGPQKTI

SEQ ID NO: 1108959 - protein, 7 aa, Mycobacterium
IRPNPGI

SEQ ID NO: 1108960 - protein, 11 aa, Mycobacterium
IRPPAGATEST

SEQ ID NO: 1108961 - protein, 5 aa, Mycobacterium
IRQAR

SEQ ID NO: 1108962 - protein, 18 aa, Mycobacterium
IRQGTDRLASGSRQVAGG

SEQ ID NO: 1108963 - protein, 11 aa, Mycobacterium
IRRNRESESLQ

SEQ ID NO: 1108964 - protein, 6 aa, Mycobacterium
IRRSGV

SEQ ID NO: 1108965 - protein, 7 aa, Mycobacterium
IRSAAAG

SEQ ID NO: 1108966 - protein, 10 aa, Mycobacterium
IRSHAGTTFG

SEQ ID NO: 1108967 - protein, 10 aa, Mycobacterium
IRSPADTTLR

SEQ ID NO: 1108968 - protein, 4 aa, Mycobacterium
IRTA

SEQ ID NO: 1108969 - protein, 9 aa, Mycobacterium
IRTASSSDW

SEQ ID NO: 1108970 - protein, 5 aa, Mycobacterium
IRTGA

SEQ ID NO: 1108971 - protein, 11 aa, Mycobacterium
IRTPADTTLRD

SEQ ID NO: 1108972 - protein, 5 aa, Mycobacterium
ISAAT

SEQ ID NO: 1108973 - protein, 10 aa, Mycobacterium
ISAGSPEEMH

SEQ ID NO: 1108974 - protein, 12 aa, Mycobacterium
ISAPGPDTEGRG

SEQ ID NO: 1108975 - protein, 8 aa, Mycobacterium
ISDAAGTI

SEQ ID NO: 1108976 - protein, 18 aa, Mycobacterium
ISDARRRRRESTTAAAVS

SEQ ID NO: 1108977 - protein, 63 aa, Mycobacterium
ISDEERAQSALEEPSLPAPTLGGSTAPEPADIEPADVGTADEKPADIEPADEEPTDEASSVPG

SEQ ID NO: 1108978 - protein, 8 aa, Mycobacterium
ISDPTLPG

SEQ ID NO: 1108979 - protein, 7 aa, Mycobacterium
ISDRPTH

SEQ ID NO: 1108980 - protein, 11 aa, Mycobacterium
ISGDHRYGSPG

SEQ ID NO: 1108981 - protein, 13 aa, Mycobacterium
ISGGGAKAVGNAV

SEQ ID NO: 1108982 - protein, 6 aa, Mycobacterium
ISGGGG

SEQ ID NO: 1108983 - protein, 9 aa, Mycobacterium
ISGTTPSVE

SEQ ID NO: 1108984 - protein, 4 aa, Mycobacterium
ISHP

SEQ ID NO: 1108985 - protein, 10 aa, Mycobacterium
ISPDDEEKGI

SEQ ID NO: 1108986 - protein, 12 aa, Mycobacterium
ISPPPPPGTPPA

SEQ ID NO: 1108987 - protein, 4 aa, Mycobacterium
ISPQ

SEQ ID NO: 1108988 - protein, 11 aa, Mycobacterium
ISQERTTVPPD

SEQ ID NO: 1108989 - protein, 9 aa, Mycobacterium
ISQSGNGQI

SEQ ID NO: 1108990 - protein, 10 aa, Mycobacterium
ISRERAESVP

SEQ ID NO: 1108991 - protein, 10 aa, Mycobacterium
ISSDPLANTS

SEQ ID NO: 1108992 - protein, 19 aa, Mycobacterium
ISSNGSVDSAEPALEYGSA

SEQ ID NO: 1108993 - protein, 16 aa, Mycobacterium
ISSPAGGPTEVSMRCP

SEQ ID NO: 1108994 - protein, 7 aa, Mycobacterium
ISSSATP

SEQ ID NO: 1108995 - protein, 5 aa, Mycobacterium
ISTGA

SEQ ID NO: 1108996 - protein, 5 aa, Mycobacterium
ISTQA

SEQ ID NO: 1108997 - protein, 6 aa, Mycobacterium
ITAEGA

SEQ ID NO: 1108998 - protein, 5 aa, Mycobacterium
ITAGA

SEQ ID NO: 1108999 - protein, 10 aa, Mycobacterium
ITAKKKSRKF

SEQ ID NO: 1109000 - protein, 4 aa, Mycobacterium
ITAR

SEQ ID NO: 1109001 - protein, 20 aa, Mycobacterium
ITARGGAGQISAAPSGPRRR

SEQ ID NO: 1109002 - protein, 10 aa, Mycobacterium
ITARPEVADG

SEQ ID NO: 1109003 - protein, 12 aa, Mycobacterium
ITDETGWSAPAV

SEQ ID NO: 1109004 - protein, 16 aa, Mycobacterium
ITDTHSDKSREAVGQG

SEQ ID NO: 1109005 - protein, 7 aa, Mycobacterium
ITGAGSA

SEQ ID NO: 1109006 - protein, 98 aa, Mycobacterium
ITGDSTSDTTTTTPLTPVTTTSAPAVVPPATVTETATATTTTEPVTTTTTTEPTTTTTTTTTTTTTPSTSVSTSTSTSTVTQTETQTETVTETPAPPA

SEQ ID NO: 1109007 - protein, 13 aa, Mycobacterium
ITGGGAKAVGNAV

SEQ ID NO: 1109008 - protein, 25 aa, Mycobacterium
ITGGNYQNLGTSASPELAAAISSML

SEQ ID NO: 1109009 - protein, 13 aa, Mycobacterium
ITGNPGDPRYPYR

SEQ ID NO: 1109010 - protein, 56 aa, Mycobacterium
ITGNPGDQRYPYREPRPAPSPGGPPPGPPAGTTPAGSAPAPPQSPEPGSPIETGGP

SEQ ID NO: 1109011 - protein, 9 aa, Mycobacterium
ITGPVDSPR

SEQ ID NO: 1109012 - protein, 4 aa, Mycobacterium
ITLT

SEQ ID NO: 1109013 - protein, 6 aa, Mycobacterium
ITNGAS

SEQ ID NO: 1109014 - protein, 6 aa, Mycobacterium
ITNQPQ

SEQ ID NO: 1109015 - protein, 16 aa, Mycobacterium
ITPERQQKYDLSEPYS

SEQ ID NO: 1109016 - protein, 16 aa, Mycobacterium
ITPRVPAGDTDPSTEV

SEQ ID NO: 1109017 - protein, 9 aa, Mycobacterium
ITPSATAVG

SEQ ID NO: 1109018 - protein, 7 aa, Mycobacterium
ITRESGV

SEQ ID NO: 1109019 - protein, 10 aa, Mycobacterium
ITRPDGKPIK

SEQ ID NO: 1109020 - protein, 11 aa, Mycobacterium
ITRPDGKPIKH

SEQ ID NO: 1109021 - protein, 12 aa, Mycobacterium
ITRPDGTPIEST

SEQ ID NO: 1109022 - protein, 4 aa, Mycobacterium
ITTA

SEQ ID NO: 1109023 - protein, 5 aa, Mycobacterium
ITTEA

SEQ ID NO: 1109024 - protein, 7 aa, Mycobacterium
ITTGTAS

SEQ ID NO: 1109025 - protein, 20 aa, Mycobacterium
ITTSDGTVLSSNTSNAAQTS

SEQ ID NO: 1109026 - protein, 11 aa, Mycobacterium
IVGNDGTKTPI

SEQ ID NO: 1109027 - protein, 55 aa, Mycobacterium
IVPPPAPPAFGTTRNGNLPGPPNAFDQNNPLPPPWYPQPGPPPAPAPGVVQGNPL

SEQ ID NO: 1109028 - protein, 25 aa, Mycobacterium
IVPPPQQAPPPTPTPTAAVAPPPVL

SEQ ID NO: 1109029 - protein, 9 aa, Mycobacterium
IYGEDGAAA

SEQ ID NO: 1109030 - protein, 14 aa, Mycobacterium
KAAAPIPDGVQPKG

SEQ ID NO: 1109031 - protein, 5 aa, Mycobacterium
KAAGE

SEQ ID NO: 1109032 - protein, 15 aa, Mycobacterium
KAAKQAGGATEAEPT

SEQ ID NO: 1109033 - protein, 5 aa, Mycobacterium
KAALP

SEQ ID NO: 1109034 - protein, 11 aa, Mycobacterium
KAAVSSLRSED

SEQ ID NO: 1109035 - protein, 9 aa, Mycobacterium
KADACEETA

SEQ ID NO: 1109036 - protein, 13 aa, Mycobacterium
KADAEDQKMTGTG

SEQ ID NO: 1109037 - protein, 5 aa, Mycobacterium
KADGS

SEQ ID NO: 1109038 - protein, 8 aa, Mycobacterium
KADGTLAE

SEQ ID NO: 1109039 - protein, 39 aa, Mycobacterium
KADKLGAPDDDTAAGDEFGGTRPAPDPAPAPVAGGAPTA

SEQ ID NO: 1109040 - protein, 9 aa, Mycobacterium
KADRELEAQ

SEQ ID NO: 1109041 - protein, 6 aa, Mycobacterium
KAEEDV

SEQ ID NO: 1109042 - protein, 12 aa, Mycobacterium
KAEKTADSPLRE

SEQ ID NO: 1109043 - protein, 13 aa, Mycobacterium
KAFEEGEADARKT

SEQ ID NO: 1109044 - protein, 13 aa, Mycobacterium
KAGAESTGDQGPL

SEQ ID NO: 1109045 - protein, 12 aa, Mycobacterium
KAGAKTEPELVT

SEQ ID NO: 1109046 - protein, 11 aa, Mycobacterium
KAGPTAETRPA

SEQ ID NO: 1109047 - protein, 10 aa, Mycobacterium
KAGQDTRLED

SEQ ID NO: 1109048 - protein, 7 aa, Mycobacterium
KAIDDSQ

SEQ ID NO: 1109049 - protein, 5 aa, Mycobacterium
KAKML

SEQ ID NO: 1109050 - protein, 33 aa, Mycobacterium
KALADAASSESSGDEPAAPLSTEQKLADRYGKR

SEQ ID NO: 1109051 - protein, 7 aa, Mycobacterium
KANRAAA

SEQ ID NO: 1109052 - protein, 6 aa, Mycobacterium
KAPGNY

SEQ ID NO: 1109053 - protein, 9 aa, Mycobacterium
KAPGTPVPG

SEQ ID NO: 1109054 - protein, 5 aa, Mycobacterium
KAPRF

SEQ ID NO: 1109055 - protein, 21 aa, Mycobacterium
KARARQAVADAKQNAKSRPAV

SEQ ID NO: 1109056 - protein, 13 aa, Mycobacterium
KARIAAGKAEISS

SEQ ID NO: 1109057 - protein, 7 aa, Mycobacterium
KARKPAL

SEQ ID NO: 1109058 - protein, 10 aa, Mycobacterium
KARRSRRRKR

SEQ ID NO: 1109059 - protein, 6 aa, Mycobacterium
KASAHG

SEQ ID NO: 1109060 - protein, 43 aa, Mycobacterium
KASASVAPAAPAAPAAAPQAAASGPASNWDRAPGAPAPAAGNW

SEQ ID NO: 1109061 - protein, 8 aa, Mycobacterium
KASTELAG

SEQ ID NO: 1109062 - protein, 8 aa, Mycobacterium
KATEEQLR

SEQ ID NO: 1109063 - protein, 8 aa, Mycobacterium
KATGVTGN

SEQ ID NO: 1109064 - protein, 9 aa, Mycobacterium
KATSRMGEE

SEQ ID NO: 1109065 - protein, 13 aa, Mycobacterium
KAVAASAPSSVGY

SEQ ID NO: 1109066 - protein, 10 aa, Mycobacterium
KAVRSPAKDT

SEQ ID NO: 1109067 - protein, 5 aa, Mycobacterium
KCPET

SEQ ID NO: 1109068 - protein, 8 aa, Mycobacterium
KDAENDRG

SEQ ID NO: 1109069 - protein, 9 aa, Mycobacterium
KDAPTDTAS

SEQ ID NO: 1109070 - protein, 5 aa, Mycobacterium
KDDAA

SEQ ID NO: 1109071 - protein, 12 aa, Mycobacterium
KDDGRLDEGIDP

SEQ ID NO: 1109072 - protein, 8 aa, Mycobacterium
KDEAPDAV

SEQ ID NO: 1109073 - protein, 6 aa, Mycobacterium
KDGARV

SEQ ID NO: 1109074 - protein, 6 aa, Mycobacterium
KDIADA

SEQ ID NO: 1109075 - protein, 10 aa, Mycobacterium
KDLGTNGGGF

SEQ ID NO: 1109076 - protein, 8 aa, Mycobacterium
KDPDAKET

SEQ ID NO: 1109077 - protein, 11 aa, Mycobacterium
KDTDHDDDADN

SEQ ID NO: 1109078 - protein, 10 aa, Mycobacterium
KDTSPPAPRR

SEQ ID NO: 1109079 - protein, 20 aa, Mycobacterium
KEDEDTGIDETEHAETAYEL

SEQ ID NO: 1109080 - protein, 6 aa, Mycobacterium
KEDNPE

SEQ ID NO: 1109081 - protein, 9 aa, Mycobacterium
KEEAAERAD

SEQ ID NO: 1109082 - protein, 8 aa, Mycobacterium
KEEEQKKL

SEQ ID NO: 1109083 - protein, 6 aa, Mycobacterium
KEGLER

SEQ ID NO: 1109084 - protein, 11 aa, Mycobacterium
KEGQAGQTKLT

SEQ ID NO: 1109085 - protein, 14 aa, Mycobacterium
KEGQQWKISNLIQV

SEQ ID NO: 1109086 - protein, 11 aa, Mycobacterium
KEGRPVAPGEV

SEQ ID NO: 1109087 - protein, 8 aa, Mycobacterium
KEGSQQGM

SEQ ID NO: 1109088 - protein, 9 aa, Mycobacterium
KELNEESNF

SEQ ID NO: 1109089 - protein, 13 aa, Mycobacterium
KEMQESAKHAGLG

SEQ ID NO: 1109090 - protein, 10 aa, Mycobacterium
KENAHGSPAT

SEQ ID NO: 1109091 - protein, 7 aa, Mycobacterium
KEPPPSV

SEQ ID NO: 1109092 - protein, 7 aa, Mycobacterium
KEQAGGR

SEQ ID NO: 1109093 - protein, 13 aa, Mycobacterium
KERDKKVESTETE

SEQ ID NO: 1109094 - protein, 6 aa, Mycobacterium
KERGAG

SEQ ID NO: 1109095 - protein, 5 aa, Mycobacterium
KERLQ

SEQ ID NO: 1109096 - protein, 8 aa, Mycobacterium
KERRTQPA

SEQ ID NO: 1109097 - protein, 8 aa, Mycobacterium
KESAQPAI

SEQ ID NO: 1109098 - protein, 34 aa, Mycobacterium
KETPLENTPEGGLGEELRGEKQSEEHSHEHVPES

SEQ ID NO: 1109099 - protein, 13 aa, Mycobacterium
KFGPNPTDIGVSG

SEQ ID NO: 1109100 - protein, 6 aa, Mycobacterium
KFGQGD

SEQ ID NO: 1109101 - protein, 9 aa, Mycobacterium
KFPGNTETG

SEQ ID NO: 1109102 - protein, 9 aa, Mycobacterium
KGAAGVTGA

SEQ ID NO: 1109103 - protein, 6 aa, Mycobacterium
KGAPEV

SEQ ID NO: 1109104 - protein, 6 aa, Mycobacterium
KGARGE

SEQ ID NO: 1109105 - protein, 8 aa, Mycobacterium
KGATDRAA

SEQ ID NO: 1109106 - protein, 9 aa, Mycobacterium
KGDARADGG

SEQ ID NO: 1109107 - protein, 8 aa, Mycobacterium
KGDDDDEI

SEQ ID NO: 1109108 - protein, 34 aa, Mycobacterium
KGDPNATLSGQPIPDLGPVPAAAPAQPAAQPPPL

SEQ ID NO: 1109109 - protein, 8 aa, Mycobacterium
KGEPMTEE

SEQ ID NO: 1109110 - protein, 9 aa, Mycobacterium
KGGGGGGGI

SEQ ID NO: 1109111 - protein, 7 aa, Mycobacterium
KGGGGWT

SEQ ID NO: 1109112 - protein, 8 aa, Mycobacterium
KGGGPDGF

SEQ ID NO: 1109113 - protein, 9 aa, Mycobacterium
KGGLKGTAG

SEQ ID NO: 1109114 - protein, 10 aa, Mycobacterium
KGKADAAKKW

SEQ ID NO: 1109115 - protein, 6 aa, Mycobacterium
KGKAEA

SEQ ID NO: 1109116 - protein, 6 aa, Mycobacterium
KGKGPM

SEQ ID NO: 1109117 - protein, 13 aa, Mycobacterium
KGLDDRQSLNSTV

SEQ ID NO: 1109118 - protein, 9 aa, Mycobacterium
KGLPHPSTR

SEQ ID NO: 1109119 - protein, 8 aa, Mycobacterium
KGLSPFSP

SEQ ID NO: 1109120 - protein, 6 aa, Mycobacterium
KGPATA

SEQ ID NO: 1109121 - protein, 5 aa, Mycobacterium
KGPWD

SEQ ID NO: 1109122 - protein, 47 aa, Mycobacterium
KGREDLGSNAAGEAEATRDAAVSRDDSAVRADSGADSGRSASADDVG

SEQ ID NO: 1109123 - protein, 6 aa, Mycobacterium
KGRNAE

SEQ ID NO: 1109124 - protein, 4 aa, Mycobacterium
KGRS

SEQ ID NO: 1109125 - protein, 15 aa, Mycobacterium
KGRTRPGEPGIRRSG

SEQ ID NO: 1109126 - protein, 7 aa, Mycobacterium
KGSGLTE

SEQ ID NO: 1109127 - protein, 30 aa, Mycobacterium
KGTGGTSRYAAPSARRATATEQEDKGEPMS

SEQ ID NO: 1109128 - protein, 7 aa, Mycobacterium
KGTPLEN

SEQ ID NO: 1109129 - protein, 7 aa, Mycobacterium
KGTRVQK

SEQ ID NO: 1109130 - protein, 11 aa, Mycobacterium
KGVDPGQSLAG

SEQ ID NO: 1109131 - protein, 11 aa, Mycobacterium
KGVRDPESVEA

SEQ ID NO: 1109132 - protein, 9 aa, Mycobacterium
KGWGPGAVE

SEQ ID NO: 1109133 - protein, 14 aa, Mycobacterium
KHAEPKSSNKIQGG

SEQ ID NO: 1109134 - protein, 7 aa, Mycobacterium
KHAPDAV

SEQ ID NO: 1109135 - protein, 7 aa, Mycobacterium
KHGGASR

SEQ ID NO: 1109136 - protein, 7 aa, Mycobacterium
KHGGATQ

SEQ ID NO: 1109137 - protein, 6 aa, Mycobacterium
KHGRPF

SEQ ID NO: 1109138 - protein, 27 aa, Mycobacterium
KHQAHQQKTATSVTAEQNGRPVPVGAP

SEQ ID NO: 1109139 - protein, 7 aa, Mycobacterium
KHQRDHE

SEQ ID NO: 1109140 - protein, 14 aa, Mycobacterium
KHRPARDPQPGGVG

SEQ ID NO: 1109141 - protein, 7 aa, Mycobacterium
KHSRAAA

SEQ ID NO: 1109142 - protein, 8 aa, Mycobacterium
KIEPAGDK

SEQ ID NO: 1109143 - protein, 6 aa, Mycobacterium
KIGERT

SEQ ID NO: 1109144 - protein, 5 aa, Mycobacterium
KITGD

SEQ ID NO: 1109145 - protein, 8 aa, Mycobacterium
KKAPTPTI

SEQ ID NO: 1109146 - protein, 10 aa, Mycobacterium
KKDGTDEPKA

SEQ ID NO: 1109147 - protein, 13 aa, Mycobacterium
KKFSTEPAGLAPQ

SEQ ID NO: 1109148 - protein, 9 aa, Mycobacterium
KKKGDTELP

SEQ ID NO: 1109149 - protein, 9 aa, Mycobacterium
KKMKRTERR

SEQ ID NO: 1109150 - protein, 22 aa, Mycobacterium
KKQAEQVPPPAAQSVDSVKSDI

SEQ ID NO: 1109151 - protein, 5 aa, Mycobacterium
KKSQY

SEQ ID NO: 1109152 - protein, 9 aa, Mycobacterium
KKYGKDRQR

SEQ ID NO: 1109153 - protein, 7 aa, Mycobacterium
KKYNAEF

SEQ ID NO: 1109154 - protein, 8 aa, Mycobacterium
KLGGSSGV

SEQ ID NO: 1109155 - protein, 12 aa, Mycobacterium
KLGTPAAAPVAA

SEQ ID NO: 1109156 - protein, 6 aa, Mycobacterium
KLNDNY

SEQ ID NO: 1109157 - protein, 15 aa, Mycobacterium
KLPAQRPSDLPPDKP

SEQ ID NO: 1109158 - protein, 12 aa, Mycobacterium
KLPDRNAVSGWQ

SEQ ID NO: 1109159 - protein, 6 aa, Mycobacterium
KLPGGL

SEQ ID NO: 1109160 - protein, 7 aa, Mycobacterium
KLPPEEA

SEQ ID NO: 1109161 - protein, 7 aa, Mycobacterium
KLPPGAV

SEQ ID NO: 1109162 - protein, 4 aa, Mycobacterium
KLPT

SEQ ID NO: 1109163 - protein, 8 aa, Mycobacterium
KLSPNGYY

SEQ ID NO: 1109164 - protein, 11 aa, Mycobacterium
KMGQAPNTVSV

SEQ ID NO: 1109165 - protein, 6 aa, Mycobacterium
KMTRSQ

SEQ ID NO: 1109166 - protein, 12 aa, Mycobacterium
KNGNGDTENSDK

SEQ ID NO: 1109167 - protein, 10 aa, Mycobacterium
KNGTEGAEFA

SEQ ID NO: 1109168 - protein, 5 aa, Mycobacterium
KNLDD

SEQ ID NO: 1109169 - protein, 5 aa, Mycobacterium
KNLPP

SEQ ID NO: 1109170 - protein, 6 aa, Mycobacterium
KNMSPP

SEQ ID NO: 1109171 - protein, 5 aa, Mycobacterium
KNPDG

SEQ ID NO: 1109172 - protein, 7 aa, Mycobacterium
KNPQEAI

SEQ ID NO: 1109173 - protein, 19 aa, Mycobacterium
KNSEVESSESLAAPDPDAR

SEQ ID NO: 1109174 - protein, 7 aa, Mycobacterium
KNSVDAD

SEQ ID NO: 1109175 - protein, 11 aa, Mycobacterium
KNTIAADETRH

SEQ ID NO: 1109176 - protein, 21 aa, Mycobacterium
KNTKTSRENDQISRSLDADPI

SEQ ID NO: 1109177 - protein, 14 aa, Mycobacterium
KNVSDTLAQRSGQV

SEQ ID NO: 1109178 - protein, 7 aa, Mycobacterium
KNVSTEV

SEQ ID NO: 1109179 - protein, 6 aa, Mycobacterium
KPAEAS

SEQ ID NO: 1109180 - protein, 6 aa, Mycobacterium
KPAGKF

SEQ ID NO: 1109181 - protein, 6 aa, Mycobacterium
KPANAS

SEQ ID NO: 1109182 - protein, 7 aa, Mycobacterium
KPAPPEV

SEQ ID NO: 1109183 - protein, 8 aa, Mycobacterium
KPARIDTP

SEQ ID NO: 1109184 - protein, 26 aa, Mycobacterium
KPASSIPATTADESTAGTEHSPAAAT

SEQ ID NO: 1109185 - protein, 20 aa, Mycobacterium
KPDTAERELTAARDRLTGSF

SEQ ID NO: 1109186 - protein, 9 aa, Mycobacterium
KPDTVEQQL

SEQ ID NO: 1109187 - protein, 9 aa, Mycobacterium
KPEESQARR

SEQ ID NO: 1109188 - protein, 18 aa, Mycobacterium
KPFDTRRGELAPQMPQAS

SEQ ID NO: 1109189 - protein, 10 aa, Mycobacterium
KPGAPRIPEE

SEQ ID NO: 1109190 - protein, 9 aa, Mycobacterium
KPGKRAPTA

SEQ ID NO: 1109191 - protein, 7 aa, Mycobacterium
KPGNHDV

SEQ ID NO: 1109192 - protein, 18 aa, Mycobacterium
KPGQNTADVRSSLSTERR

SEQ ID NO: 1109193 - protein, 7 aa, Mycobacterium
KPHPARP

SEQ ID NO: 1109194 - protein, 10 aa, Mycobacterium
KPLIPRTQRQ

SEQ ID NO: 1109195 - protein, 7 aa, Mycobacterium
KPLPKAD

SEQ ID NO: 1109196 - protein, 5 aa, Mycobacterium
KPLPS

SEQ ID NO: 1109197 - protein, 5 aa, Mycobacterium
KPPGL

SEQ ID NO: 1109198 - protein, 14 aa, Mycobacterium
KPPSDIVSGKPSFL

SEQ ID NO: 1109199 - protein, 4 aa, Mycobacterium
KPPV

SEQ ID NO: 1109200 - protein, 6 aa, Mycobacterium
KPPVRG

SEQ ID NO: 1109201 - protein, 12 aa, Mycobacterium
KPRDGEDFGTTE

SEQ ID NO: 1109202 - protein, 7 aa, Mycobacterium
KPRPYDG

SEQ ID NO: 1109203 - protein, 9 aa, Mycobacterium
KPSAATAAK

SEQ ID NO: 1109204 - protein, 8 aa, Mycobacterium
KPSQATGV

SEQ ID NO: 1109205 - protein, 4 aa, Mycobacterium
KPVN

SEQ ID NO: 1109206 - protein, 6 aa, Mycobacterium
KPVTNA

SEQ ID NO: 1109207 - protein, 8 aa, Mycobacterium
KQAEEATD

SEQ ID NO: 1109208 - protein, 11 aa, Mycobacterium
KQDSDVARRQD

SEQ ID NO: 1109209 - protein, 6 aa, Mycobacterium
KQDSRV

SEQ ID NO: 1109210 - protein, 8 aa, Mycobacterium
KQFGDDTA

SEQ ID NO: 1109211 - protein, 8 aa, Mycobacterium
KQGNVADD

SEQ ID NO: 1109212 - protein, 8 aa, Mycobacterium
KQKKQGLD

SEQ ID NO: 1109213 - protein, 9 aa, Mycobacterium
KQLQSNDAA

SEQ ID NO: 1109214 - protein, 7 aa, Mycobacterium
KQLTDSK

SEQ ID NO: 1109215 - protein, 7 aa, Mycobacterium
KQSSNPI

SEQ ID NO: 1109216 - protein, 25 aa, Mycobacterium
KQTNTGGGDGAPAAVEEPAEAPADD

SEQ ID NO: 1109217 - protein, 10 aa, Mycobacterium
KQTRAEGQGL

SEQ ID NO: 1109218 - protein, 10 aa, Mycobacterium
KRAADREVAT

SEQ ID NO: 1109219 - protein, 9 aa, Mycobacterium
KRAGGNGVR

SEQ ID NO: 1109220 - protein, 9 aa, Mycobacterium
KRAPTTPRK

SEQ ID NO: 1109221 - protein, 6 aa, Mycobacterium
KRASVA

SEQ ID NO: 1109222 - protein, 40 aa, Mycobacterium
KRAVASGEVAETVKSADQQLSQQGSAAQSELQSSVDGLSA

SEQ ID NO: 1109223 - protein, 6 aa, Mycobacterium
KRDAQM

SEQ ID NO: 1109224 - protein, 10 aa, Mycobacterium
KRDGDGAPPI

SEQ ID NO: 1109225 - protein, 15 aa, Mycobacterium
KREDGQIKMAKVEFV

SEQ ID NO: 1109226 - protein, 7 aa, Mycobacterium
KREFKPA

SEQ ID NO: 1109227 - protein, 4 aa, Mycobacterium
KREL

SEQ ID NO: 1109228 - protein, 8 aa, Mycobacterium
KRENRSDV

SEQ ID NO: 1109229 - protein, 13 aa, Mycobacterium
KRERERAEEAARV

SEQ ID NO: 1109230 - protein, 6 aa, Mycobacterium
KRGELS

SEQ ID NO: 1109231 - protein, 14 aa, Mycobacterium
KRGIGEPKPDRTRR

SEQ ID NO: 1109232 - protein, 7 aa, Mycobacterium
KRGINPE

SEQ ID NO: 1109233 - protein, 18 aa, Mycobacterium
KRKLERQLENRAERERKR

SEQ ID NO: 1109234 - protein, 86 aa, Mycobacterium
KRKSRRGRSDAAEDTETADAETADAEVEETETADAETESVTPDADADADADAEEPVPTAEDDPASDTPESGDGKLQNRRPTGKGAV

SEQ ID NO: 1109235 - protein, 7 aa, Mycobacterium
KRNGGNQ

SEQ ID NO: 1109236 - protein, 6 aa, Mycobacterium
KRPNAT

SEQ ID NO: 1109237 - protein, 8 aa, Mycobacterium
KRPPDRRP

SEQ ID NO: 1109238 - protein, 5 aa, Mycobacterium
KRPRK

SEQ ID NO: 1109239 - protein, 55 aa, Mycobacterium
KRPRTPAPKAAERPQRRSGRAAAGHPVRSGRSSGGYGDTRRNQGRRARTLEGQRY

SEQ ID NO: 1109240 - protein, 5 aa, Mycobacterium
KRPSA

SEQ ID NO: 1109241 - protein, 13 aa, Mycobacterium
KRRPPAGLSPQEL

SEQ ID NO: 1109242 - protein, 5 aa, Mycobacterium
KRSHT

SEQ ID NO: 1109243 - protein, 7 aa, Mycobacterium
KRSRSSR

SEQ ID NO: 1109244 - protein, 5 aa, Mycobacterium
KRVPA

SEQ ID NO: 1109245 - protein, 7 aa, Mycobacterium
KRVPPEN

SEQ ID NO: 1109246 - protein, 7 aa, Mycobacterium
KSADGQW

SEQ ID NO: 1109247 - protein, 8 aa, Mycobacterium
KSADSDQV

SEQ ID NO: 1109248 - protein, 9 aa, Mycobacterium
KSADTPQTL

SEQ ID NO: 1109249 - protein, 9 aa, Mycobacterium
KSAEGRQRR

SEQ ID NO: 1109250 - protein, 5 aa, Mycobacterium
KSAGV

SEQ ID NO: 1109251 - protein, 8 aa, Mycobacterium
KSATKWSG

SEQ ID NO: 1109252 - protein, 9 aa, Mycobacterium
KSDGPTSVA

SEQ ID NO: 1109253 - protein, 5 aa, Mycobacterium
KSEHM

SEQ ID NO: 1109254 - protein, 13 aa, Mycobacterium
KSGLGAGDEPPVT

SEQ ID NO: 1109255 - protein, 7 aa, Mycobacterium
KSGNYTV

SEQ ID NO: 1109256 - protein, 4 aa, Mycobacterium
KSGP

SEQ ID NO: 1109257 - protein, 4 aa, Mycobacterium
KSGR

SEQ ID NO: 1109258 - protein, 7 aa, Mycobacterium
KSGTHRP

SEQ ID NO: 1109259 - protein, 103 aa, Mycobacterium
KSGVTLPEKGTAAKESEERAAVRAEEAAAAAPAPEKAPEKEPEAPAEAPAAKASTTTESKPAGATPAAAPAKGLGIAGGAKRPGAKKTATEKTAAAPAEAKGL

SEQ ID NO: 1109260 - protein, 15 aa, Mycobacterium
KSKAKQLSKDMPKTT

SEQ ID NO: 1109261 - protein, 7 aa, Mycobacterium
KSLESYT

SEQ ID NO: 1109262 - protein, 10 aa, Mycobacterium
KSLNSRNESL

SEQ ID NO: 1109263 - protein, 8 aa, Mycobacterium
KSLPSNGK

SEQ ID NO: 1109264 - protein, 17 aa, Mycobacterium
KSPAGNGSTSRRRIPNP

SEQ ID NO: 1109265 - protein, 6 aa, Mycobacterium
KSQGDG

SEQ ID NO: 1109266 - protein, 5 aa, Mycobacterium
KSSTL

SEQ ID NO: 1109267 - protein, 7 aa, Mycobacterium
KSTAGKP

SEQ ID NO: 1109268 - protein, 15 aa, Mycobacterium
KSTVRPAANVATAGV

SEQ ID NO: 1109269 - protein, 15 aa, Mycobacterium
KTAAKEAIKGTPLEG

SEQ ID NO: 1109270 - protein, 15 aa, Mycobacterium
KTAAKEAVKGTPLEG

SEQ ID NO: 1109271 - protein, 14 aa, Mycobacterium
KTAGDVTRRYRDGD

SEQ ID NO: 1109272 - protein, 8 aa, Mycobacterium
KTAGQATS

SEQ ID NO: 1109273 - protein, 6 aa, Mycobacterium
KTARRY

SEQ ID NO: 1109274 - protein, 6 aa, Mycobacterium
KTAVDE

SEQ ID NO: 1109275 - protein, 7 aa, Mycobacterium
KTDPPTF

SEQ ID NO: 1109276 - protein, 7 aa, Mycobacterium
KTDRGYQ

SEQ ID NO: 1109277 - protein, 8 aa, Mycobacterium
KTEGFTRP

SEQ ID NO: 1109278 - protein, 6 aa, Mycobacterium
KTGDRR

SEQ ID NO: 1109279 - protein, 8 aa, Mycobacterium
KTGEHGTP

SEQ ID NO: 1109280 - protein, 5 aa, Mycobacterium
KTGNS

SEQ ID NO: 1109281 - protein, 10 aa, Mycobacterium
KTGSLTGTNS

SEQ ID NO: 1109282 - protein, 9 aa, Mycobacterium
KTGTLTANR

SEQ ID NO: 1109283 - protein, 8 aa, Mycobacterium
KTGTLTDG

SEQ ID NO: 1109284 - protein, 9 aa, Mycobacterium
KTGTLTENG

SEQ ID NO: 1109285 - protein, 8 aa, Mycobacterium
KTGTLTQN

SEQ ID NO: 1109286 - protein, 9 aa, Mycobacterium
KTGTLTSNE

SEQ ID NO: 1109287 - protein, 7 aa, Mycobacterium
KTKKTAV

SEQ ID NO: 1109288 - protein, 5 aa, Mycobacterium
KTLAP

SEQ ID NO: 1109289 - protein, 17 aa, Mycobacterium
KTNASGGQDAPQTQPRS

SEQ ID NO: 1109290 - protein, 7 aa, Mycobacterium
KTPEQLN

SEQ ID NO: 1109291 - protein, 19 aa, Mycobacterium
KTPEQPRRREGDDDRADTD

SEQ ID NO: 1109292 - protein, 7 aa, Mycobacterium
KTPGGQD

SEQ ID NO: 1109293 - protein, 6 aa, Mycobacterium
KTPQNY

SEQ ID NO: 1109294 - protein, 8 aa, Mycobacterium
KTREELAP

SEQ ID NO: 1109295 - protein, 13 aa, Mycobacterium
KTSNAGAPEQEPR

SEQ ID NO: 1109296 - protein, 8 aa, Mycobacterium
KTTAANLE

SEQ ID NO: 1109297 - protein, 7 aa, Mycobacterium
KTVAPAD

SEQ ID NO: 1109298 - protein, 4 aa, Mycobacterium
KTVR

SEQ ID NO: 1109299 - protein, 13 aa, Mycobacterium
KVAHPGRSGLSVR

SEQ ID NO: 1109300 - protein, 8 aa, Mycobacterium
KVDAGKKW

SEQ ID NO: 1109301 - protein, 6 aa, Mycobacterium
KVDTDR

SEQ ID NO: 1109302 - protein, 6 aa, Mycobacterium
KVDTTR

SEQ ID NO: 1109303 - protein, 15 aa, Mycobacterium
KVEENPRRRITPGSV

SEQ ID NO: 1109304 - protein, 24 aa, Mycobacterium
KVEPTTGAAEPPDVPVDPAPRPRR

SEQ ID NO: 1109305 - protein, 4 aa, Mycobacterium
KVGD

SEQ ID NO: 1109306 - protein, 11 aa, Mycobacterium
KVGDTAAKEIN

SEQ ID NO: 1109307 - protein, 7 aa, Mycobacterium
KVGKKTA

SEQ ID NO: 1109308 - protein, 17 aa, Mycobacterium
KVGPQQAAPRAVESAGS

SEQ ID NO: 1109309 - protein, 12 aa, Mycobacterium
KVGSGYRQDGRF

SEQ ID NO: 1109310 - protein, 19 aa, Mycobacterium
KVGTSTSAGVASAGGHGIR

SEQ ID NO: 1109311 - protein, 9 aa, Mycobacterium
KVNTTTAAA

SEQ ID NO: 1109312 - protein, 6 aa, Mycobacterium
KVPAEA

SEQ ID NO: 1109313 - protein, 13 aa, Mycobacterium
KVPAGQSDSSRSF

SEQ ID NO: 1109314 - protein, 8 aa, Mycobacterium
KVPQDATA

SEQ ID NO: 1109315 - protein, 7 aa, Mycobacterium
KVSGPER

SEQ ID NO: 1109316 - protein, 7 aa, Mycobacterium
KVTEAEQ

SEQ ID NO: 1109317 - protein, 4 aa, Mycobacterium
KVTG

SEQ ID NO: 1109318 - protein, 4 aa, Mycobacterium
KWDG

SEQ ID NO: 1109319 - protein, 6 aa, Mycobacterium
KWSPGD

SEQ ID NO: 1109320 - protein, 7 aa, Mycobacterium
KYADRYA

SEQ ID NO: 1109321 - protein, 5 aa, Mycobacterium
KYPQG

SEQ ID NO: 1109322 - protein, 7 aa, Mycobacterium
KYRRSKM

SEQ ID NO: 1109323 - protein, 10 aa, Mycobacterium
LAAEPGVTGV

SEQ ID NO: 1109324 - protein, 11 aa, Mycobacterium
LAAEQEEAGHT

SEQ ID NO: 1109325 - protein, 7 aa, Mycobacterium
LAAETTA

SEQ ID NO: 1109326 - protein, 17 aa, Mycobacterium
LAAGGFQDPGSESARAT

SEQ ID NO: 1109327 - protein, 5 aa, Mycobacterium
LAAQT

SEQ ID NO: 1109328 - protein, 9 aa, Mycobacterium
LAARPEPTL

SEQ ID NO: 1109329 - protein, 11 aa, Mycobacterium
LADDDQPRLPE

SEQ ID NO: 1109330 - protein, 8 aa, Mycobacterium
LADPGNRV

SEQ ID NO: 1109331 - protein, 16 aa, Mycobacterium
LADRPVRDDSPDIDDI

SEQ ID NO: 1109332 - protein, 17 aa, Mycobacterium
LADSPSTAQAIESGRAT

SEQ ID NO: 1109333 - protein, 10 aa, Mycobacterium
LADTQDPDTL

SEQ ID NO: 1109334 - protein, 10 aa, Mycobacterium
LAEAGDTAQA

SEQ ID NO: 1109335 - protein, 9 aa, Mycobacterium
LAEGHDRDS

SEQ ID NO: 1109336 - protein, 18 aa, Mycobacterium
LAEHGGAQTWQSMLTPPG

SEQ ID NO: 1109337 - protein, 11 aa, Mycobacterium
LAENNNSSSFQ

SEQ ID NO: 1109338 - protein, 14 aa, Mycobacterium
LAERDTGGLSGGEL

SEQ ID NO: 1109339 - protein, 7 aa, Mycobacterium
LAGAGYS

SEQ ID NO: 1109340 - protein, 7 aa, Mycobacterium
LAGARAT

SEQ ID NO: 1109341 - protein, 6 aa, Mycobacterium
LAGDGA

SEQ ID NO: 1109342 - protein, 9 aa, Mycobacterium
LAGDPTGSA

SEQ ID NO: 1109343 - protein, 13 aa, Mycobacterium
LAGENHSDAPDFD

SEQ ID NO: 1109344 - protein, 8 aa, Mycobacterium
LAGGDDPQ

SEQ ID NO: 1109345 - protein, 7 aa, Mycobacterium
LAGKPTV

SEQ ID NO: 1109346 - protein, 6 aa, Mycobacterium
LAGLGP

SEQ ID NO: 1109347 - protein, 11 aa, Mycobacterium
LAGQSDQFGKA

SEQ ID NO: 1109348 - protein, 8 aa, Mycobacterium
LAGRAANA

SEQ ID NO: 1109349 - protein, 7 aa, Mycobacterium
LAGSPEA

SEQ ID NO: 1109350 - protein, 6 aa, Mycobacterium
LAGSPL

SEQ ID NO: 1109351 - protein, 9 aa, Mycobacterium
LAGTGISPL

SEQ ID NO: 1109352 - protein, 13 aa, Mycobacterium
LAGTRRPGNSVAG

SEQ ID NO: 1109353 - protein, 4 aa, Mycobacterium
LAKT

SEQ ID NO: 1109354 - protein, 8 aa, Mycobacterium
LANTKDTL

SEQ ID NO: 1109355 - protein, 11 aa, Mycobacterium
LAPATDREPVA

SEQ ID NO: 1109356 - protein, 18 aa, Mycobacterium
LAPDADGESPVEEPTEPV

SEQ ID NO: 1109357 - protein, 11 aa, Mycobacterium
LAPDGPVSGSS

SEQ ID NO: 1109358 - protein, 10 aa, Mycobacterium
LAPDGTPSSF

SEQ ID NO: 1109359 - protein, 5 aa, Mycobacterium
LAPEA

SEQ ID NO: 1109360 - protein, 10 aa, Mycobacterium
LAPEPGDTQA

SEQ ID NO: 1109361 - protein, 28 aa, Mycobacterium
LAPETGGDDEVADDSGGSLLDSLFDSVE

SEQ ID NO: 1109362 - protein, 24 aa, Mycobacterium
LAPGAASEPLTEDTDAGITAAPSS

SEQ ID NO: 1109363 - protein, 18 aa, Mycobacterium
LAPNPAPARLETTSALEK

SEQ ID NO: 1109364 - protein, 6 aa, Mycobacterium
LAPNQD

SEQ ID NO: 1109365 - protein, 7 aa, Mycobacterium
LAPPPVV

SEQ ID NO: 1109366 - protein, 15 aa, Mycobacterium
LAPQSAPGDARRGFL

SEQ ID NO: 1109367 - protein, 9 aa, Mycobacterium
LAPQSDGPA

SEQ ID NO: 1109368 - protein, 12 aa, Mycobacterium
LAPSDLAAAPTV

SEQ ID NO: 1109369 - protein, 6 aa, Mycobacterium
LAPTGK

SEQ ID NO: 1109370 - protein, 16 aa, Mycobacterium
LAPVGGAEALPTRSPG

SEQ ID NO: 1109371 - protein, 10 aa, Mycobacterium
LAQDRDPIGE

SEQ ID NO: 1109372 - protein, 84 aa, Mycobacterium
LAQPTDTDGSGQTSDDPAGGGSEDAGGGGDTTDDPVDSGDPSEEPDEPEPSRESAPDQGGSGDYGGTDDPATESPAPTLRESPF

SEQ ID NO: 1109373 - protein, 10 aa, Mycobacterium
LAQTQRQTDE

SEQ ID NO: 1109374 - protein, 9 aa, Mycobacterium
LAREPRSEY

SEQ ID NO: 1109375 - protein, 12 aa, Mycobacterium
LARGEATVKEPS

SEQ ID NO: 1109376 - protein, 13 aa, Mycobacterium
LARRGAPTGPRPV

SEQ ID NO: 1109377 - protein, 30 aa, Mycobacterium
LARRGRRPTEEHDEDEDEDLTDEAYGEPRR

SEQ ID NO: 1109378 - protein, 20 aa, Mycobacterium
LARSANEEQTWQQMLIPPTG

SEQ ID NO: 1109379 - protein, 10 aa, Mycobacterium
LARSNYDAST

SEQ ID NO: 1109380 - protein, 11 aa, Mycobacterium
LARTDNSGWGD

SEQ ID NO: 1109381 - protein, 6 aa, Mycobacterium
LASDDA

SEQ ID NO: 1109382 - protein, 5 aa, Mycobacterium
LASGP

SEQ ID NO: 1109383 - protein, 8 aa, Mycobacterium
LASGPLGD

SEQ ID NO: 1109384 - protein, 7 aa, Mycobacterium
LASPKSV

SEQ ID NO: 1109385 - protein, 7 aa, Mycobacterium
LASQTGG

SEQ ID NO: 1109386 - protein, 4 aa, Mycobacterium
LASS

SEQ ID NO: 1109387 - protein, 18 aa, Mycobacterium
LATAATKLNEDARAISDP

SEQ ID NO: 1109388 - protein, 7 aa, Mycobacterium
LATAEND

SEQ ID NO: 1109389 - protein, 8 aa, Mycobacterium
LATAENDL

SEQ ID NO: 1109390 - protein, 8 aa, Mycobacterium
LATGSRRL

SEQ ID NO: 1109391 - protein, 7 aa, Mycobacterium
LATQASA

SEQ ID NO: 1109392 - protein, 11 aa, Mycobacterium
LATSPKAITKA

SEQ ID NO: 1109393 - protein, 9 aa, Mycobacterium
LDADPATGR

SEQ ID NO: 1109394 - protein, 7 aa, Mycobacterium
LDAGRGW

SEQ ID NO: 1109395 - protein, 5 aa, Mycobacterium
LDARD

SEQ ID NO: 1109396 - protein, 6 aa, Mycobacterium
LDDAGV

SEQ ID NO: 1109397 - protein, 12 aa, Mycobacterium
LDDAQPDPPLRP

SEQ ID NO: 1109398 - protein, 8 aa, Mycobacterium
LDDPGRIG

SEQ ID NO: 1109399 - protein, 12 aa, Mycobacterium
LDDQPVREPAVV

SEQ ID NO: 1109400 - protein, 4 aa, Mycobacterium
LDDR

SEQ ID NO: 1109401 - protein, 5 aa, Mycobacterium
LDDRA

SEQ ID NO: 1109402 - protein, 26 aa, Mycobacterium
LDDRQVDGAKIGPAGDHTLGAGSTLT

SEQ ID NO: 1109403 - protein, 4 aa, Mycobacterium
LDDS

SEQ ID NO: 1109404 - protein, 7 aa, Mycobacterium
LDEEDHQ

SEQ ID NO: 1109405 - protein, 90 aa, Mycobacterium
LDETEDASTQSESPLQEEVPSDAVHSADDLTESGLTDLDSTEIDISDDQADAQAAQQESEVTAGDDGSSEAGRAAEDSTPSPEPSGDVAD

SEQ ID NO: 1109406 - protein, 7 aa, Mycobacterium
LDGGGVD

SEQ ID NO: 1109407 - protein, 9 aa, Mycobacterium
LDGGSISEQ

SEQ ID NO: 1109408 - protein, 11 aa, Mycobacterium
LDGKPQRTGEV

SEQ ID NO: 1109409 - protein, 6 aa, Mycobacterium
LDGRSA

SEQ ID NO: 1109410 - protein, 11 aa, Mycobacterium
LDGSATPADVQ

SEQ ID NO: 1109411 - protein, 8 aa, Mycobacterium
LDKGTASL

SEQ ID NO: 1109412 - protein, 10 aa, Mycobacterium
LDKPNQDDRK

SEQ ID NO: 1109413 - protein, 7 aa, Mycobacterium
LDNGRYE

SEQ ID NO: 1109414 - protein, 8 aa, Mycobacterium
LDNGTASL

SEQ ID NO: 1109415 - protein, 10 aa, Mycobacterium
LDNSNQPPFT

SEQ ID NO: 1109416 - protein, 9 aa, Mycobacterium
LDPDASRSV

SEQ ID NO: 1109417 - protein, 9 aa, Mycobacterium
LDPDSRDIV

SEQ ID NO: 1109418 - protein, 10 aa, Mycobacterium
LDPEAAARRR

SEQ ID NO: 1109419 - protein, 8 aa, Mycobacterium
LDPEDRPY

SEQ ID NO: 1109420 - protein, 6 aa, Mycobacterium
LDPGLA

SEQ ID NO: 1109421 - protein, 15 aa, Mycobacterium
LDPGVRPARRKRDSH

SEQ ID NO: 1109422 - protein, 6 aa, Mycobacterium
LDPMGK

SEQ ID NO: 1109423 - protein, 9 aa, Mycobacterium
LDPNDPRDW

SEQ ID NO: 1109424 - protein, 7 aa, Mycobacterium
LDPPGGR

SEQ ID NO: 1109425 - protein, 7 aa, Mycobacterium
LDPPPQV

SEQ ID NO: 1109426 - protein, 4 aa, Mycobacterium
LDPQ

SEQ ID NO: 1109427 - protein, 13 aa, Mycobacterium
LDQDPVKSVPGQP

SEQ ID NO: 1109428 - protein, 5 aa, Mycobacterium
LDQFP

SEQ ID NO: 1109429 - protein, 26 aa, Mycobacterium
LDQGGGEDAVGPDQARGHDAAAPRRG

SEQ ID NO: 1109430 - protein, 4 aa, Mycobacterium
LDRG

SEQ ID NO: 1109431 - protein, 10 aa, Mycobacterium
LDRGRRRPAP

SEQ ID NO: 1109432 - protein, 8 aa, Mycobacterium
LDRTTGNI

SEQ ID NO: 1109433 - protein, 10 aa, Mycobacterium
LDSAETEALS

SEQ ID NO: 1109434 - protein, 11 aa, Mycobacterium
LDSPGGAQTSL

SEQ ID NO: 1109435 - protein, 12 aa, Mycobacterium
LDSQSPSGGGAV

SEQ ID NO: 1109436 - protein, 10 aa, Mycobacterium
LDSQTDTAAE

SEQ ID NO: 1109437 - protein, 4 aa, Mycobacterium
LDSR

SEQ ID NO: 1109438 - protein, 14 aa, Mycobacterium
LDTGGYDAPGGNGR

SEQ ID NO: 1109439 - protein, 9 aa, Mycobacterium
LDTSPKVPA

SEQ ID NO: 1109440 - protein, 22 aa, Mycobacterium
LDVGTDKGAGGAGADSEDPEVV

SEQ ID NO: 1109441 - protein, 6 aa, Mycobacterium
LEAAER

SEQ ID NO: 1109442 - protein, 15 aa, Mycobacterium
LEAAPPAPAPQPAPA

SEQ ID NO: 1109443 - protein, 6 aa, Mycobacterium
LEADGR

SEQ ID NO: 1109444 - protein, 9 aa, Mycobacterium
LEAGRPPRR

SEQ ID NO: 1109445 - protein, 13 aa, Mycobacterium
LEAPDVPPAEQAR

SEQ ID NO: 1109446 - protein, 8 aa, Mycobacterium
LEASPANL

SEQ ID NO: 1109447 - protein, 13 aa, Mycobacterium
LEDGGPQQGMPAD

SEQ ID NO: 1109448 - protein, 9 aa, Mycobacterium
LEETERNAR

SEQ ID NO: 1109449 - protein, 28 aa, Mycobacterium
LEGDTEGAANSADEALSRAQQARDATHS

SEQ ID NO: 1109450 - protein, 28 aa, Mycobacterium
LEGDTGGASRFADEAQHHAEAARDATHS

SEQ ID NO: 1109451 - protein, 8 aa, Mycobacterium
LEGTSTDI

SEQ ID NO: 1109452 - protein, 18 aa, Mycobacterium
LEKSPGTIPQESDTPSEV

SEQ ID NO: 1109453 - protein, 4 aa, Mycobacterium
LEPA

SEQ ID NO: 1109454 - protein, 4 aa, Mycobacterium
LEPD

SEQ ID NO: 1109455 - protein, 7 aa, Mycobacterium
LEPNPPV

SEQ ID NO: 1109456 - protein, 6 aa, Mycobacterium
LEPPQD

SEQ ID NO: 1109457 - protein, 12 aa, Mycobacterium
LEPQPSPPDFTP

SEQ ID NO: 1109458 - protein, 26 aa, Mycobacterium
LEPRPVSRPPVDPAAQRAFGRPTGVN

SEQ ID NO: 1109459 - protein, 7 aa, Mycobacterium
LEQAGRT

SEQ ID NO: 1109460 - protein, 8 aa, Mycobacterium
LEQDRPDL

SEQ ID NO: 1109461 - protein, 7 aa, Mycobacterium
LERRTGK

SEQ ID NO: 1109462 - protein, 11 aa, Mycobacterium
LERTTSPYQLP

SEQ ID NO: 1109463 - protein, 9 aa, Mycobacterium
LESESGDEA

SEQ ID NO: 1109464 - protein, 11 aa, Mycobacterium
LESGDQPPAGA

SEQ ID NO: 1109465 - protein, 8 aa, Mycobacterium
LESRSEHP

SEQ ID NO: 1109466 - protein, 9 aa, Mycobacterium
LESSHGDQA

SEQ ID NO: 1109467 - protein, 11 aa, Mycobacterium
LETPDDRSVPN

SEQ ID NO: 1109468 - protein, 8 aa, Mycobacterium
LETPEDVS

SEQ ID NO: 1109469 - protein, 15 aa, Mycobacterium
LETSDTGGAESEGQF

SEQ ID NO: 1109470 - protein, 10 aa, Mycobacterium
LETSPKIPAD

SEQ ID NO: 1109471 - protein, 9 aa, Mycobacterium
LEVSPQGGT

SEQ ID NO: 1109472 - protein, 4 aa, Mycobacterium
LGAD

SEQ ID NO: 1109473 - protein, 8 aa, Mycobacterium
LGAEKAGD

SEQ ID NO: 1109474 - protein, 18 aa, Mycobacterium
LGAGHRAASNRPDAGVYS

SEQ ID NO: 1109475 - protein, 7 aa, Mycobacterium
LGAGRLP

SEQ ID NO: 1109476 - protein, 8 aa, Mycobacterium
LGAKPTTV

SEQ ID NO: 1109477 - protein, 6 aa, Mycobacterium
LGAPGA

SEQ ID NO: 1109478 - protein, 6 aa, Mycobacterium
LGAPPM

SEQ ID NO: 1109479 - protein, 6 aa, Mycobacterium
LGATGT

SEQ ID NO: 1109480 - protein, 12 aa, Mycobacterium
LGATHKTHGSPH

SEQ ID NO: 1109481 - protein, 5 aa, Mycobacterium
LGATR

SEQ ID NO: 1109482 - protein, 9 aa, Mycobacterium
LGDDSDASY

SEQ ID NO: 1109483 - protein, 7 aa, Mycobacterium
LGDGTGW

SEQ ID NO: 1109484 - protein, 4 aa, Mycobacterium
LGDP

SEQ ID NO: 1109485 - protein, 7 aa, Mycobacterium
LGDPADG

SEQ ID NO: 1109486 - protein, 10 aa, Mycobacterium
LGDPGRTDAI

SEQ ID NO: 1109487 - protein, 10 aa, Mycobacterium
LGDPQAAASV

SEQ ID NO: 1109488 - protein, 7 aa, Mycobacterium
LGDRHGR

SEQ ID NO: 1109489 - protein, 8 aa, Mycobacterium
LGDRYGRR

SEQ ID NO: 1109490 - protein, 18 aa, Mycobacterium
LGDTTHSGLWSPGPMRFQ

SEQ ID NO: 1109491 - protein, 6 aa, Mycobacterium
LGEAPA

SEQ ID NO: 1109492 - protein, 6 aa, Mycobacterium
LGEDSR

SEQ ID NO: 1109493 - protein, 6 aa, Mycobacterium
LGEEGV

SEQ ID NO: 1109494 - protein, 14 aa, Mycobacterium
LGEEPEPYPDGDDL

SEQ ID NO: 1109495 - protein, 5 aa, Mycobacterium
LGEGQ

SEQ ID NO: 1109496 - protein, 9 aa, Mycobacterium
LGENGSEVR

SEQ ID NO: 1109497 - protein, 4 aa, Mycobacterium
LGEP

SEQ ID NO: 1109498 - protein, 10 aa, Mycobacterium
LGEQIGPDTD

SEQ ID NO: 1109499 - protein, 24 aa, Mycobacterium
LGETELPDERKRPTVRENPAPAEA

SEQ ID NO: 1109500 - protein, 5 aa, Mycobacterium
LGGAA

SEQ ID NO: 1109501 - protein, 21 aa, Mycobacterium
LGGATGELGAPVADQTQNGDV

SEQ ID NO: 1109502 - protein, 5 aa, Mycobacterium
LGGDD

SEQ ID NO: 1109503 - protein, 9 aa, Mycobacterium
LGGDPGAVR

SEQ ID NO: 1109504 - protein, 6 aa, Mycobacterium
LGGPHA

SEQ ID NO: 1109505 - protein, 19 aa, Mycobacterium
LGGPPGPGGPGASVADNTE

SEQ ID NO: 1109506 - protein, 10 aa, Mycobacterium
LGGRDGTGGL

SEQ ID NO: 1109507 - protein, 6 aa, Mycobacterium
LGGTAA

SEQ ID NO: 1109508 - protein, 9 aa, Mycobacterium
LGHKKDSLE

SEQ ID NO: 1109509 - protein, 9 aa, Mycobacterium
LGHSAGDDA

SEQ ID NO: 1109510 - protein, 8 aa, Mycobacterium
LGKRGGDT

SEQ ID NO: 1109511 - protein, 8 aa, Mycobacterium
LGLGGETM

SEQ ID NO: 1109512 - protein, 6 aa, Mycobacterium
LGLPGS

SEQ ID NO: 1109513 - protein, 5 aa, Mycobacterium
LGNGE

SEQ ID NO: 1109514 - protein, 14 aa, Mycobacterium
LGNGQKNLLPLRAA

SEQ ID NO: 1109515 - protein, 10 aa, Mycobacterium
LGPALEDAGR

SEQ ID NO: 1109516 - protein, 4 aa, Mycobacterium
LGPE

SEQ ID NO: 1109517 - protein, 5 aa, Mycobacterium
LGPRT

SEQ ID NO: 1109518 - protein, 5 aa, Mycobacterium
LGPTD

SEQ ID NO: 1109519 - protein, 9 aa, Mycobacterium
LGPTGRERR

SEQ ID NO: 1109520 - protein, 6 aa, Mycobacterium
LGPTGV

SEQ ID NO: 1109521 - protein, 20 aa, Mycobacterium
LGPYGRDDSYTTTEYRYEPG

SEQ ID NO: 1109522 - protein, 8 aa, Mycobacterium
LGQAEAAR

SEQ ID NO: 1109523 - protein, 6 aa, Mycobacterium
LGQHGA

SEQ ID NO: 1109524 - protein, 6 aa, Mycobacterium
LGQPEL

SEQ ID NO: 1109525 - protein, 8 aa, Mycobacterium
LGQPNAAE

SEQ ID NO: 1109526 - protein, 17 aa, Mycobacterium
LGQPTPTPLLPEAVTPS

SEQ ID NO: 1109527 - protein, 6 aa, Mycobacterium
LGQQIT

SEQ ID NO: 1109528 - protein, 11 aa, Mycobacterium
LGRDDESPEFN

SEQ ID NO: 1109529 - protein, 6 aa, Mycobacterium
LGREGT

SEQ ID NO: 1109530 - protein, 4 aa, Mycobacterium
LGRP

SEQ ID NO: 1109531 - protein, 9 aa, Mycobacterium
LGRPDPDAA

SEQ ID NO: 1109532 - protein, 14 aa, Mycobacterium
LGRRKRTRGGVAVE

SEQ ID NO: 1109533 - protein, 11 aa, Mycobacterium
LGRVGSKNTLG

SEQ ID NO: 1109534 - protein, 4 aa, Mycobacterium
LGSA

SEQ ID NO: 1109535 - protein, 5 aa, Mycobacterium
LGSAD

SEQ ID NO: 1109536 - protein, 12 aa, Mycobacterium
LGSAGAPGSGSF

SEQ ID NO: 1109537 - protein, 31 aa, Mycobacterium
LGSDCQYPKSAEAASKSNNPPRSGKVPTEPA

SEQ ID NO: 1109538 - protein, 7 aa, Mycobacterium
LGSGGNA

SEQ ID NO: 1109539 - protein, 8 aa, Mycobacterium
LGSPGGPH

SEQ ID NO: 1109540 - protein, 10 aa, Mycobacterium
LGSPGPSTLR

SEQ ID NO: 1109541 - protein, 13 aa, Mycobacterium
LGSQLQDTEGYQT

SEQ ID NO: 1109542 - protein, 9 aa, Mycobacterium
LGSRTPSSV

SEQ ID NO: 1109543 - protein, 9 aa, Mycobacterium
LGSSSDLRV

SEQ ID NO: 1109544 - protein, 8 aa, Mycobacterium
LGSTSADC

SEQ ID NO: 1109545 - protein, 4 aa, Mycobacterium
LGTG

SEQ ID NO: 1109546 - protein, 12 aa, Mycobacterium
LGTGEDDSTPAF

SEQ ID NO: 1109547 - protein, 7 aa, Mycobacterium
LGTQNTS

SEQ ID NO: 1109548 - protein, 33 aa, Mycobacterium
LGTRGPAAEPSVRPRPSDTLTYPDHKNRSSLRR

SEQ ID NO: 1109549 - protein, 12 aa, Mycobacterium
LGTSPTAGENVP

SEQ ID NO: 1109550 - protein, 7 aa, Mycobacterium
LGTSPYA

SEQ ID NO: 1109551 - protein, 10 aa, Mycobacterium
LGTTQALETG

SEQ ID NO: 1109552 - protein, 4 aa, Mycobacterium
LGVS

SEQ ID NO: 1109553 - protein, 13 aa, Mycobacterium
LGYDESGMPLPEG

SEQ ID NO: 1109554 - protein, 6 aa, Mycobacterium
LHDGTQ

SEQ ID NO: 1109555 - protein, 13 aa, Mycobacterium
LHDTARKSSLASQ

SEQ ID NO: 1109556 - protein, 6 aa, Mycobacterium
LKAAKK

SEQ ID NO: 1109557 - protein, 7 aa, Mycobacterium
LKADGAT

SEQ ID NO: 1109558 - protein, 9 aa, Mycobacterium
LKAPSAQPF

SEQ ID NO: 1109559 - protein, 15 aa, Mycobacterium
LKARAEAGDGASARA

SEQ ID NO: 1109560 - protein, 9 aa, Mycobacterium
LKDEGESTY

SEQ ID NO: 1109561 - protein, 8 aa, Mycobacterium
LKDPQGHD

SEQ ID NO: 1109562 - protein, 10 aa, Mycobacterium
LKEGSGAAIT

SEQ ID NO: 1109563 - protein, 7 aa, Mycobacterium
LKEPTRT

SEQ ID NO: 1109564 - protein, 7 aa, Mycobacterium
LKESGRY

SEQ ID NO: 1109565 - protein, 7 aa, Mycobacterium
LKETGYS

SEQ ID NO: 1109566 - protein, 4 aa, Mycobacterium
LKGR

SEQ ID NO: 1109567 - protein, 6 aa, Mycobacterium
LKKGSA

SEQ ID NO: 1109568 - protein, 13 aa, Mycobacterium
LKPGKDDLKGLPQ

SEQ ID NO: 1109569 - protein, 7 aa, Mycobacterium
LKPSTDV

SEQ ID NO: 1109570 - protein, 7 aa, Mycobacterium
LKPSTPL

SEQ ID NO: 1109571 - protein, 7 aa, Mycobacterium
LKQGKSQ

SEQ ID NO: 1109572 - protein, 7 aa, Mycobacterium
LKRQQSN

SEQ ID NO: 1109573 - protein, 8 aa, Mycobacterium
LKRRDDGV

SEQ ID NO: 1109574 - protein, 10 aa, Mycobacterium
LLPGQGPLLP

SEQ ID NO: 1109575 - protein, 10 aa, Mycobacterium
LLPPDGDGEW

SEQ ID NO: 1109576 - protein, 9 aa, Mycobacterium
LNAQTGNLS

SEQ ID NO: 1109577 - protein, 10 aa, Mycobacterium
LNAQTGSLSP

SEQ ID NO: 1109578 - protein, 7 aa, Mycobacterium
LNDTNGW

SEQ ID NO: 1109579 - protein, 6 aa, Mycobacterium
LNEDNT

SEQ ID NO: 1109580 - protein, 17 aa, Mycobacterium
LNEGRTPNITPKKKRKK

SEQ ID NO: 1109581 - protein, 8 aa, Mycobacterium
LNPDDVNA

SEQ ID NO: 1109582 - protein, 5 aa, Mycobacterium
LNPDE

SEQ ID NO: 1109583 - protein, 6 aa, Mycobacterium
LNPDNT

SEQ ID NO: 1109584 - protein, 8 aa, Mycobacterium
LNPHDGPA

SEQ ID NO: 1109585 - protein, 6 aa, Mycobacterium
LNPRRS

SEQ ID NO: 1109586 - protein, 4 aa, Mycobacterium
LNQD

SEQ ID NO: 1109587 - protein, 7 aa, Mycobacterium
LNSRDQQ

SEQ ID NO: 1109588 - protein, 6 aa, Mycobacterium
LNSSSA

SEQ ID NO: 1109589 - protein, 15 aa, Mycobacterium
LNTGAAPSAPTSEPV

SEQ ID NO: 1109590 - protein, 4 aa, Mycobacterium
LPAD

SEQ ID NO: 1109591 - protein, 7 aa, Mycobacterium
LPAGAEL

SEQ ID NO: 1109592 - protein, 7 aa, Mycobacterium
LPANEGY

SEQ ID NO: 1109593 - protein, 12 aa, Mycobacterium
LPANGRTATSPA

SEQ ID NO: 1109594 - protein, 21 aa, Mycobacterium
LPAPPRRPQETAEPVPAFDPD

SEQ ID NO: 1109595 - protein, 18 aa, Mycobacterium
LPAPQAAPPPASAAPGTV

SEQ ID NO: 1109596 - protein, 5 aa, Mycobacterium
LPAPS

SEQ ID NO: 1109597 - protein, 14 aa, Mycobacterium
LPAPSGAAVATTAA

SEQ ID NO: 1109598 - protein, 10 aa, Mycobacterium
LPAPYQPGDE

SEQ ID NO: 1109599 - protein, 4 aa, Mycobacterium
LPAR

SEQ ID NO: 1109600 - protein, 6 aa, Mycobacterium
LPARSD

SEQ ID NO: 1109601 - protein, 11 aa, Mycobacterium
LPASTAGGSLA

SEQ ID NO: 1109602 - protein, 7 aa, Mycobacterium
LPDAPTA

SEQ ID NO: 1109603 - protein, 12 aa, Mycobacterium
LPDASPDDDIRG

SEQ ID NO: 1109604 - protein, 6 aa, Mycobacterium
LPDATS

SEQ ID NO: 1109605 - protein, 19 aa, Mycobacterium
LPDEETAAKLGLSSPRTAP

SEQ ID NO: 1109606 - protein, 12 aa, Mycobacterium
LPDGGLTDCESH

SEQ ID NO: 1109607 - protein, 10 aa, Mycobacterium
LPDPHDDTSL

SEQ ID NO: 1109608 - protein, 11 aa, Mycobacterium
LPDPRPSENVR

SEQ ID NO: 1109609 - protein, 11 aa, Mycobacterium
LPDVPNKQYGG

SEQ ID NO: 1109610 - protein, 4 aa, Mycobacterium
LPED

SEQ ID NO: 1109611 - protein, 5 aa, Mycobacterium
LPEDL

SEQ ID NO: 1109612 - protein, 5 aa, Mycobacterium
LPEGK

SEQ ID NO: 1109613 - protein, 4 aa, Mycobacterium
LPEP

SEQ ID NO: 1109614 - protein, 7 aa, Mycobacterium
LPEPRSD

SEQ ID NO: 1109615 - protein, 6 aa, Mycobacterium
LPEQDH

SEQ ID NO: 1109616 - protein, 5 aa, Mycobacterium
LPERS

SEQ ID NO: 1109617 - protein, 11 aa, Mycobacterium
LPESRQKTRHS

SEQ ID NO: 1109618 - protein, 27 aa, Mycobacterium
LPETGEPSGLAPADLDAAGQPVEPRSV

SEQ ID NO: 1109619 - protein, 9 aa, Mycobacterium
LPETGPGSI

SEQ ID NO: 1109620 - protein, 5 aa, Mycobacterium
LPETS

SEQ ID NO: 1109621 - protein, 19 aa, Mycobacterium
LPGALSSGLQEQGVSADVA

SEQ ID NO: 1109622 - protein, 38 aa, Mycobacterium
LPGDGPPSGSTPPVNIPGAGPSPDGPVTRLNPGGIAPE

SEQ ID NO: 1109623 - protein, 4 aa, Mycobacterium
LPGH

SEQ ID NO: 1109624 - protein, 7 aa, Mycobacterium
LPGKPPT

SEQ ID NO: 1109625 - protein, 6 aa, Mycobacterium
LPGKQP

SEQ ID NO: 1109626 - protein, 11 aa, Mycobacterium
LPGLTPQHGRH

SEQ ID NO: 1109627 - protein, 4 aa, Mycobacterium
LPGP

SEQ ID NO: 1109628 - protein, 9 aa, Mycobacterium
LPGPGGRPV

SEQ ID NO: 1109629 - protein, 6 aa, Mycobacterium
LPGQNG

SEQ ID NO: 1109630 - protein, 5 aa, Mycobacterium
LPGRP

SEQ ID NO: 1109631 - protein, 7 aa, Mycobacterium
LPGRRDL

SEQ ID NO: 1109632 - protein, 7 aa, Mycobacterium
LPGSSQT

SEQ ID NO: 1109633 - protein, 15 aa, Mycobacterium
LPGTDPGAATPDRTA

SEQ ID NO: 1109634 - protein, 12 aa, Mycobacterium
LPGTPAGDERPG

SEQ ID NO: 1109635 - protein, 26 aa, Mycobacterium
LPPALTGPPPPAGPGPAPAPAGQPLL

SEQ ID NO: 1109636 - protein, 20 aa, Mycobacterium
LPPAPPPMAPRDPGPTPGSE

SEQ ID NO: 1109637 - protein, 10 aa, Mycobacterium
LPPARRGVQR

SEQ ID NO: 1109638 - protein, 5 aa, Mycobacterium
LPPDT

SEQ ID NO: 1109639 - protein, 12 aa, Mycobacterium
LPPDTTKADREQ

SEQ ID NO: 1109640 - protein, 4 aa, Mycobacterium
LPPE

SEQ ID NO: 1109641 - protein, 4 aa, Mycobacterium
LPPM

SEQ ID NO: 1109642 - protein, 15 aa, Mycobacterium
LPPPPPEPGTNCREV

SEQ ID NO: 1109643 - protein, 10 aa, Mycobacterium
LPPPPPKPLK

SEQ ID NO: 1109644 - protein, 112 aa, Mycobacterium
LPPPPPKPLKPKAQTRRGRRKAQEADPEDTADSEDTTEETTEEAERSESDDAVTESVDTGSADTDATDETEETEAADEEPVASSGGLRNRRPSGKGDSSRRRRRLRGGIAVE

SEQ ID NO: 1109645 - protein, 70 aa, Mycobacterium
LPPPPPPPPPSTPGGPLPYGGSPVPPPPPPPGQPTQASGFHTPPPPGGPPPGWPPQPPQSSGGGGGSKGP

SEQ ID NO: 1109646 - protein, 6 aa, Mycobacterium
LPPRQG

SEQ ID NO: 1109647 - protein, 4 aa, Mycobacterium
LPPS

SEQ ID NO: 1109648 - protein, 12 aa, Mycobacterium
LPPSASSHQVGD

SEQ ID NO: 1109649 - protein, 7 aa, Mycobacterium
LPPSPDP

SEQ ID NO: 1109650 - protein, 8 aa, Mycobacterium
LPPTGASD

SEQ ID NO: 1109651 - protein, 4 aa, Mycobacterium
LPPV

SEQ ID NO: 1109652 - protein, 8 aa, Mycobacterium
LPPYDPAD

SEQ ID NO: 1109653 - protein, 7 aa, Mycobacterium
LPQGDAY

SEQ ID NO: 1109654 - protein, 13 aa, Mycobacterium
LPQGNSSVGTGLT

SEQ ID NO: 1109655 - protein, 12 aa, Mycobacterium
LPQPGDLPNDGN

SEQ ID NO: 1109656 - protein, 13 aa, Mycobacterium
LPQSASARQVGDE

SEQ ID NO: 1109657 - protein, 7 aa, Mycobacterium
LPRDGKA

SEQ ID NO: 1109658 - protein, 7 aa, Mycobacterium
LPRDGRA

SEQ ID NO: 1109659 - protein, 5 aa, Mycobacterium
LPRED

SEQ ID NO: 1109660 - protein, 22 aa, Mycobacterium
LPRPGRDAPGLGAAQPATNGVK

SEQ ID NO: 1109661 - protein, 17 aa, Mycobacterium
LPRPGRRPGRPRPGGGA

SEQ ID NO: 1109662 - protein, 17 aa, Mycobacterium
LPRSEWTPPASGLHGAG

SEQ ID NO: 1109663 - protein, 57 aa, Mycobacterium
LPSAATGQPVARRSGSPSRPLTPAPARPEAGRPDPVRRTPPPAGPPQRNGRQSPNYQ

SEQ ID NO: 1109664 - protein, 11 aa, Mycobacterium
LPSAGAPGDPV

SEQ ID NO: 1109665 - protein, 6 aa, Mycobacterium
LPSGRI

SEQ ID NO: 1109666 - protein, 8 aa, Mycobacterium
LPSGSLDE

SEQ ID NO: 1109667 - protein, 4 aa, Mycobacterium
LPSM

SEQ ID NO: 1109668 - protein, 7 aa, Mycobacterium
LPSPPYY

SEQ ID NO: 1109669 - protein, 16 aa, Mycobacterium
LPSRPGDGRVALPDPD

SEQ ID NO: 1109670 - protein, 5 aa, Mycobacterium
LPSRR

SEQ ID NO: 1109671 - protein, 8 aa, Mycobacterium
LPSRSARS

SEQ ID NO: 1109672 - protein, 9 aa, Mycobacterium
LPSSATAHR

SEQ ID NO: 1109673 - protein, 7 aa, Mycobacterium
LPSSTAT

SEQ ID NO: 1109674 - protein, 10 aa, Mycobacterium
LPSTAGPNVS

SEQ ID NO: 1109675 - protein, 6 aa, Mycobacterium
LPTGDV

SEQ ID NO: 1109676 - protein, 6 aa, Mycobacterium
LPTPYH

SEQ ID NO: 1109677 - protein, 6 aa, Mycobacterium
LPTSPL

SEQ ID NO: 1109678 - protein, 8 aa, Mycobacterium
LPTTADAH

SEQ ID NO: 1109679 - protein, 5 aa, Mycobacterium
LPTTP

SEQ ID NO: 1109680 - protein, 5 aa, Mycobacterium
LPYGP

SEQ ID NO: 1109681 - protein, 5 aa, Mycobacterium
LQAQG

SEQ ID NO: 1109682 - protein, 9 aa, Mycobacterium
LQAQGAGGW

SEQ ID NO: 1109683 - protein, 16 aa, Mycobacterium
LQEERDDARTAEQRAE

SEQ ID NO: 1109684 - protein, 6 aa, Mycobacterium
LQGDEA

SEQ ID NO: 1109685 - protein, 9 aa, Mycobacterium
LQGGSTITQ

SEQ ID NO: 1109686 - protein, 5 aa, Mycobacterium
LQGVG

SEQ ID NO: 1109687 - protein, 13 aa, Mycobacterium
LQNDDATIERAEN

SEQ ID NO: 1109688 - protein, 15 aa, Mycobacterium
LQNDEATIRKAENVK

SEQ ID NO: 1109689 - protein, 6 aa, Mycobacterium
LQPDKQ

SEQ ID NO: 1109690 - protein, 7 aa, Mycobacterium
LQPGNPV

SEQ ID NO: 1109691 - protein, 12 aa, Mycobacterium
LQPPPASGSGVR

SEQ ID NO: 1109692 - protein, 15 aa, Mycobacterium
LQQAAEQKFGPGNYR

SEQ ID NO: 1109693 - protein, 15 aa, Mycobacterium
LQQNGTDLAGEGGVE

SEQ ID NO: 1109694 - protein, 4 aa, Mycobacterium
LQQT

SEQ ID NO: 1109695 - protein, 5 aa, Mycobacterium
LQRDG

SEQ ID NO: 1109696 - protein, 9 aa, Mycobacterium
LQRKDRKSE

SEQ ID NO: 1109697 - protein, 5 aa, Mycobacterium
LQSEG

SEQ ID NO: 1109698 - protein, 5 aa, Mycobacterium
LQTGT

SEQ ID NO: 1109699 - protein, 9 aa, Mycobacterium
LRAQSADEV

SEQ ID NO: 1109700 - protein, 5 aa, Mycobacterium
LRASR

SEQ ID NO: 1109701 - protein, 4 aa, Mycobacterium
LRAT

SEQ ID NO: 1109702 - protein, 10 aa, Mycobacterium
LRDDSAEVAG

SEQ ID NO: 1109703 - protein, 6 aa, Mycobacterium
LRDEQA

SEQ ID NO: 1109704 - protein, 18 aa, Mycobacterium
LRDGANREIQGAQRSGDG

SEQ ID NO: 1109705 - protein, 8 aa, Mycobacterium
LRDPSRAA

SEQ ID NO: 1109706 - protein, 12 aa, Mycobacterium
LREARGKVAAGP

SEQ ID NO: 1109707 - protein, 9 aa, Mycobacterium
LREATPALR

SEQ ID NO: 1109708 - protein, 6 aa, Mycobacterium
LREGQA

SEQ ID NO: 1109709 - protein, 10 aa, Mycobacterium
LRESPEQRRR

SEQ ID NO: 1109710 - protein, 4 aa, Mycobacterium
LRGA

SEQ ID NO: 1109711 - protein, 9 aa, Mycobacterium
LRGRPTSRS

SEQ ID NO: 1109712 - protein, 4 aa, Mycobacterium
LRKP

SEQ ID NO: 1109713 - protein, 4 aa, Mycobacterium
LRNG

SEQ ID NO: 1109714 - protein, 5 aa, Mycobacterium
LRPAT

SEQ ID NO: 1109715 - protein, 4 aa, Mycobacterium
LRPD

SEQ ID NO: 1109716 - protein, 7 aa, Mycobacterium
LRPDPTV

SEQ ID NO: 1109717 - protein, 7 aa, Mycobacterium
LRPGAAG

SEQ ID NO: 1109718 - protein, 6 aa, Mycobacterium
LRPGRA

SEQ ID NO: 1109719 - protein, 4 aa, Mycobacterium
LRPP

SEQ ID NO: 1109720 - protein, 7 aa, Mycobacterium
LRPPDAI

SEQ ID NO: 1109721 - protein, 7 aa, Mycobacterium
LRPTAGA

SEQ ID NO: 1109722 - protein, 19 aa, Mycobacterium
LRQGTAEVPSWTPQQRTEM

SEQ ID NO: 1109723 - protein, 10 aa, Mycobacterium
LRSAGSGYEN

SEQ ID NO: 1109724 - protein, 8 aa, Mycobacterium
LRSGDSNM

SEQ ID NO: 1109725 - protein, 4 aa, Mycobacterium
LRST

SEQ ID NO: 1109726 - protein, 4 aa, Mycobacterium
LRTG

SEQ ID NO: 1109727 - protein, 8 aa, Mycobacterium
LRTGESAA

SEQ ID NO: 1109728 - protein, 9 aa, Mycobacterium
LRTPGSTTT

SEQ ID NO: 1109729 - protein, 14 aa, Mycobacterium
LRTTARRAGPGADA

SEQ ID NO: 1109730 - protein, 12 aa, Mycobacterium
LRYGKSDASDEQ

SEQ ID NO: 1109731 - protein, 12 aa, Mycobacterium
LRYGRSDATEDQ

SEQ ID NO: 1109732 - protein, 10 aa, Mycobacterium
LSADSLSSDP

SEQ ID NO: 1109733 - protein, 9 aa, Mycobacterium
LSAEERSEA

SEQ ID NO: 1109734 - protein, 6 aa, Mycobacterium
LSAEQQ

SEQ ID NO: 1109735 - protein, 10 aa, Mycobacterium
LSAPKSVASP

SEQ ID NO: 1109736 - protein, 7 aa, Mycobacterium
LSAPTVA

SEQ ID NO: 1109737 - protein, 6 aa, Mycobacterium
LSAQQQ

SEQ ID NO: 1109738 - protein, 14 aa, Mycobacterium
LSARRGSTDSRWPA

SEQ ID NO: 1109739 - protein, 7 aa, Mycobacterium
LSASPSQ

SEQ ID NO: 1109740 - protein, 11 aa, Mycobacterium
LSATAADQPMR

SEQ ID NO: 1109741 - protein, 7 aa, Mycobacterium
LSATPAQ

SEQ ID NO: 1109742 - protein, 6 aa, Mycobacterium
LSDAGK

SEQ ID NO: 1109743 - protein, 6 aa, Mycobacterium
LSDAGR

SEQ ID NO: 1109744 - protein, 4 aa, Mycobacterium
LSDN

SEQ ID NO: 1109745 - protein, 5 aa, Mycobacterium
LSDPI

SEQ ID NO: 1109746 - protein, 15 aa, Mycobacterium
LSDPQTGQPATPALP

SEQ ID NO: 1109747 - protein, 7 aa, Mycobacterium
LSDPRRG

SEQ ID NO: 1109748 - protein, 24 aa, Mycobacterium
LSEAPTSWDRPTPTPEPEPEPVGG

SEQ ID NO: 1109749 - protein, 10 aa, Mycobacterium
LSEARREEPA

SEQ ID NO: 1109750 - protein, 9 aa, Mycobacterium
LSEDQNNTV

SEQ ID NO: 1109751 - protein, 8 aa, Mycobacterium
LSEEGRKE

SEQ ID NO: 1109752 - protein, 12 aa, Mycobacterium
LSENAGTDEPRT

SEQ ID NO: 1109753 - protein, 5 aa, Mycobacterium
LSESA

SEQ ID NO: 1109754 - protein, 12 aa, Mycobacterium
LSETGRGASTPV

SEQ ID NO: 1109755 - protein, 5 aa, Mycobacterium
LSGAG

SEQ ID NO: 1109756 - protein, 15 aa, Mycobacterium
LSGALGSAAGMDPST

SEQ ID NO: 1109757 - protein, 6 aa, Mycobacterium
LSGDAY

SEQ ID NO: 1109758 - protein, 7 aa, Mycobacterium
LSGDDAH

SEQ ID NO: 1109759 - protein, 7 aa, Mycobacterium
LSGEDHN

SEQ ID NO: 1109760 - protein, 9 aa, Mycobacterium
LSGGQQQRV

SEQ ID NO: 1109761 - protein, 9 aa, Mycobacterium
LSGLASAPE

SEQ ID NO: 1109762 - protein, 10 aa, Mycobacterium
LSGLSSAPEM

SEQ ID NO: 1109763 - protein, 10 aa, Mycobacterium
LSGPETPALQ

SEQ ID NO: 1109764 - protein, 9 aa, Mycobacterium
LSGPGDPTW

SEQ ID NO: 1109765 - protein, 6 aa, Mycobacterium
LSGPVA

SEQ ID NO: 1109766 - protein, 7 aa, Mycobacterium
LSGRSDV

SEQ ID NO: 1109767 - protein, 4 aa, Mycobacterium
LSGT

SEQ ID NO: 1109768 - protein, 4 aa, Mycobacterium
LSGV

SEQ ID NO: 1109769 - protein, 8 aa, Mycobacterium
LSIGGGPP

SEQ ID NO: 1109770 - protein, 7 aa, Mycobacterium
LSKAETE

SEQ ID NO: 1109771 - protein, 9 aa, Mycobacterium
LSKDRRKQA

SEQ ID NO: 1109772 - protein, 9 aa, Mycobacterium
LSKHPEEFG

SEQ ID NO: 1109773 - protein, 6 aa, Mycobacterium
LSNQPV

SEQ ID NO: 1109774 - protein, 9 aa, Mycobacterium
LSPAAPADE

SEQ ID NO: 1109775 - protein, 12 aa, Mycobacterium
LSPDAFGTGPVS

SEQ ID NO: 1109776 - protein, 5 aa, Mycobacterium
LSPDQ

SEQ ID NO: 1109777 - protein, 5 aa, Mycobacterium
LSPDS

SEQ ID NO: 1109778 - protein, 9 aa, Mycobacterium
LSPEDRAGQ

SEQ ID NO: 1109779 - protein, 9 aa, Mycobacterium
LSPEQARGV

SEQ ID NO: 1109780 - protein, 17 aa, Mycobacterium
LSPEQVATGETDSRGDV

SEQ ID NO: 1109781 - protein, 17 aa, Mycobacterium
LSPEQVGTGNAGPRSDV

SEQ ID NO: 1109782 - protein, 15 aa, Mycobacterium
LSPGGSRPRLIPDSE

SEQ ID NO: 1109783 - protein, 14 aa, Mycobacterium
LSPHSRGAGDGPMS

SEQ ID NO: 1109784 - protein, 6 aa, Mycobacterium
LSPSAF

SEQ ID NO: 1109785 - protein, 12 aa, Mycobacterium
LSQARDADSGNL

SEQ ID NO: 1109786 - protein, 10 aa, Mycobacterium
LSQDTPDCGT

SEQ ID NO: 1109787 - protein, 6 aa, Mycobacterium
LSQNPW

SEQ ID NO: 1109788 - protein, 4 aa, Mycobacterium
LSQR

SEQ ID NO: 1109789 - protein, 13 aa, Mycobacterium
LSQTAGRLGDSRT

SEQ ID NO: 1109790 - protein, 7 aa, Mycobacterium
LSRDPRQ

SEQ ID NO: 1109791 - protein, 7 aa, Mycobacterium
LSRENPQ

SEQ ID NO: 1109792 - protein, 15 aa, Mycobacterium
LSRGSQATRTTDNTA

SEQ ID NO: 1109793 - protein, 22 aa, Mycobacterium
LSRGTAETDDALTRSDRRDAQR

SEQ ID NO: 1109794 - protein, 11 aa, Mycobacterium
LSRQTGTALRT

SEQ ID NO: 1109795 - protein, 14 aa, Mycobacterium
LSRSQAQERREQFG

SEQ ID NO: 1109796 - protein, 6 aa, Mycobacterium
LSRTGP

SEQ ID NO: 1109797 - protein, 5 aa, Mycobacterium
LSSAG

SEQ ID NO: 1109798 - protein, 9 aa, Mycobacterium
LSSASQGGL

SEQ ID NO: 1109799 - protein, 40 aa, Mycobacterium
LSSSIGAYTASQSSSSSSSGGGSSSSGGGGGGGGGGGGGS

SEQ ID NO: 1109800 - protein, 7 aa, Mycobacterium
LSSTQTT

SEQ ID NO: 1109801 - protein, 4 aa, Mycobacterium
LSTE

SEQ ID NO: 1109802 - protein, 6 aa, Mycobacterium
LSTEHA

SEQ ID NO: 1109803 - protein, 8 aa, Mycobacterium
LSTQLSGA

SEQ ID NO: 1109804 - protein, 7 aa, Mycobacterium
LSTTGYG

SEQ ID NO: 1109805 - protein, 15 aa, Mycobacterium
LSTTGYGDITPVTEG

SEQ ID NO: 1109806 - protein, 10 aa, Mycobacterium
LSTTLPGGPV

SEQ ID NO: 1109807 - protein, 9 aa, Mycobacterium
LSTTMPGGP

SEQ ID NO: 1109808 - protein, 13 aa, Mycobacterium
LSTTSTTITNRAT

SEQ ID NO: 1109809 - protein, 9 aa, Mycobacterium
LSVDPGSRG

SEQ ID NO: 1109810 - protein, 13 aa, Mycobacterium
LSVTPQGAGSSTV

SEQ ID NO: 1109811 - protein, 8 aa, Mycobacterium
LSVTQDDR

SEQ ID NO: 1109812 - protein, 14 aa, Mycobacterium
LTAAGAQSADGKST

SEQ ID NO: 1109813 - protein, 11 aa, Mycobacterium
LTAEAGRAEAI

SEQ ID NO: 1109814 - protein, 9 aa, Mycobacterium
LTAGDSRTP

SEQ ID NO: 1109815 - protein, 12 aa, Mycobacterium
LTAGNERTATQD

SEQ ID NO: 1109816 - protein, 6 aa, Mycobacterium
LTANPQ

SEQ ID NO: 1109817 - protein, 20 aa, Mycobacterium
LTAPDDLASAAEHAESQGHT

SEQ ID NO: 1109818 - protein, 15 aa, Mycobacterium
LTARDDATGLGSTAD

SEQ ID NO: 1109819 - protein, 14 aa, Mycobacterium
LTASGAQSTDGKAA

SEQ ID NO: 1109820 - protein, 14 aa, Mycobacterium
LTASGSQSNDGKAA

SEQ ID NO: 1109821 - protein, 14 aa, Mycobacterium
LTATAQALDGLGDR

SEQ ID NO: 1109822 - protein, 13 aa, Mycobacterium
LTATQQENINPGN

SEQ ID NO: 1109823 - protein, 12 aa, Mycobacterium
LTATTAQGAVTD

SEQ ID NO: 1109824 - protein, 8 aa, Mycobacterium
LTDGADQL

SEQ ID NO: 1109825 - protein, 4 aa, Mycobacterium
LTDN

SEQ ID NO: 1109826 - protein, 29 aa, Mycobacterium
LTDPPVGQPGTPAMPGQYPRTGQGGEPRL

SEQ ID NO: 1109827 - protein, 8 aa, Mycobacterium
LTDPSLPP

SEQ ID NO: 1109828 - protein, 5 aa, Mycobacterium
LTDRG

SEQ ID NO: 1109829 - protein, 10 aa, Mycobacterium
LTDRGAPNLV

SEQ ID NO: 1109830 - protein, 6 aa, Mycobacterium
LTEDEV

SEQ ID NO: 1109831 - protein, 16 aa, Mycobacterium
LTEGRQEKVPAARLRP

SEQ ID NO: 1109832 - protein, 9 aa, Mycobacterium
LTESGDVEA

SEQ ID NO: 1109833 - protein, 10 aa, Mycobacterium
LTESNGAMTS

SEQ ID NO: 1109834 - protein, 13 aa, Mycobacterium
LTGDADTAQTLSG

SEQ ID NO: 1109835 - protein, 8 aa, Mycobacterium
LTGGSTGR

SEQ ID NO: 1109836 - protein, 11 aa, Mycobacterium
LTGNEPGGLGN

SEQ ID NO: 1109837 - protein, 8 aa, Mycobacterium
LTGQPRAT

SEQ ID NO: 1109838 - protein, 15 aa, Mycobacterium
LTGRENSGDVAAGRR

SEQ ID NO: 1109839 - protein, 14 aa, Mycobacterium
LTGSIGEDQKRAEV

SEQ ID NO: 1109840 - protein, 7 aa, Mycobacterium
LTGTERH

SEQ ID NO: 1109841 - protein, 13 aa, Mycobacterium
LTGTIGEDQKRAE

SEQ ID NO: 1109842 - protein, 4 aa, Mycobacterium
LTHS

SEQ ID NO: 1109843 - protein, 8 aa, Mycobacterium
LTKTAVPK

SEQ ID NO: 1109844 - protein, 11 aa, Mycobacterium
LTNADGNHHPW

SEQ ID NO: 1109845 - protein, 4 aa, Mycobacterium
LTPA

SEQ ID NO: 1109846 - protein, 8 aa, Mycobacterium
LTPAEQTL

SEQ ID NO: 1109847 - protein, 5 aa, Mycobacterium
LTPAT

SEQ ID NO: 1109848 - protein, 6 aa, Mycobacterium
LTPATR

SEQ ID NO: 1109849 - protein, 18 aa, Mycobacterium
LTPDPNPARLENLTLQEN

SEQ ID NO: 1109850 - protein, 5 aa, Mycobacterium
LTPDT

SEQ ID NO: 1109851 - protein, 6 aa, Mycobacterium
LTPESV

SEQ ID NO: 1109852 - protein, 7 aa, Mycobacterium
LTPGGTA

SEQ ID NO: 1109853 - protein, 8 aa, Mycobacterium
LTPPAADR

SEQ ID NO: 1109854 - protein, 7 aa, Mycobacterium
LTPPGAF

SEQ ID NO: 1109855 - protein, 11 aa, Mycobacterium
LTPPGESTLPT

SEQ ID NO: 1109856 - protein, 8 aa, Mycobacterium
LTPSGALT

SEQ ID NO: 1109857 - protein, 9 aa, Mycobacterium
LTPTARQRY

SEQ ID NO: 1109858 - protein, 21 aa, Mycobacterium
LTQEAEDSGIRNPVRVDSVWD

SEQ ID NO: 1109859 - protein, 6 aa, Mycobacterium
LTQITK

SEQ ID NO: 1109860 - protein, 10 aa, Mycobacterium
LTRDSTEMGK

SEQ ID NO: 1109861 - protein, 14 aa, Mycobacterium
LTRGGRGRAGGVDP

SEQ ID NO: 1109862 - protein, 14 aa, Mycobacterium
LTRQDSSVLPQTTE

SEQ ID NO: 1109863 - protein, 6 aa, Mycobacterium
LTSERS

SEQ ID NO: 1109864 - protein, 11 aa, Mycobacterium
LTSLSDPEADV

SEQ ID NO: 1109865 - protein, 12 aa, Mycobacterium
LTSPDDEDPKVA

SEQ ID NO: 1109866 - protein, 8 aa, Mycobacterium
LTSRKATR

SEQ ID NO: 1109867 - protein, 5 aa, Mycobacterium
LTSTS

SEQ ID NO: 1109868 - protein, 6 aa, Mycobacterium
LTTADR

SEQ ID NO: 1109869 - protein, 23 aa, Mycobacterium
LTTAKTADGNAPIPPSGQGSTYR

SEQ ID NO: 1109870 - protein, 23 aa, Mycobacterium
LTTATTADGNAPIPPSGQGSTYR

SEQ ID NO: 1109871 - protein, 11 aa, Mycobacterium
LTTDPDKRSMR

SEQ ID NO: 1109872 - protein, 14 aa, Mycobacterium
LTVSPSAAAAETAS

SEQ ID NO: 1109873 - protein, 13 aa, Mycobacterium
LTYDGEDNARKEA

SEQ ID NO: 1109874 - protein, 17 aa, Mycobacterium
LVNPNPDLRDPNPPLPP

SEQ ID NO: 1109875 - protein, 6 aa, Mycobacterium
LYGPGG

SEQ ID NO: 1109876 - protein, 11 aa, Mycobacterium
LYTAKSQGRNA

SEQ ID NO: 1109877 - protein, 12 aa, Mycobacterium
MAAQTGSAPTIE

SEQ ID NO: 1109878 - protein, 9 aa, Mycobacterium
MADGSEDDY

SEQ ID NO: 1109879 - protein, 11 aa, Mycobacterium
MAEETKDPVNT

SEQ ID NO: 1109880 - protein, 9 aa, Mycobacterium
MAGSAAPGP

SEQ ID NO: 1109881 - protein, 49 aa, Mycobacterium
MAKKPDKRYQSAGELAQAAKRALNAPVRRPGRTSRHAAARPDRKKPHKG

SEQ ID NO: 1109882 - protein, 44 aa, Mycobacterium
MAKQPGDRFPTAGDLAKAASAAAMQPAAPAAGAAAAAPPNSTRQ

SEQ ID NO: 1109883 - protein, 22 aa, Mycobacterium
MAPGSDQRLPGPTGLMPPVLSR

SEQ ID NO: 1109884 - protein, 24 aa, Mycobacterium
MAPSDAALDDAVGSRMRSTSRESL

SEQ ID NO: 1109885 - protein, 5 aa, Mycobacterium
MAPSS

SEQ ID NO: 1109886 - protein, 12 aa, Mycobacterium
MAPTGPYDPDRE

SEQ ID NO: 1109887 - protein, 20 aa, Mycobacterium
MASEGATARAPGAGPGDPTV

SEQ ID NO: 1109888 - protein, 7 aa, Mycobacterium
MATDQGN

SEQ ID NO: 1109889 - protein, 9 aa, Mycobacterium
MATGSAAEF

SEQ ID NO: 1109890 - protein, 6 aa, Mycobacterium
MDGPAL

SEQ ID NO: 1109891 - protein, 13 aa, Mycobacterium
MEAKGGPRGVADA

SEQ ID NO: 1109892 - protein, 7 aa, Mycobacterium
MERGHPS

SEQ ID NO: 1109893 - protein, 8 aa, Mycobacterium
MGDSEKIR

SEQ ID NO: 1109894 - protein, 14 aa, Mycobacterium
MGEETDDPKRNIPR

SEQ ID NO: 1109895 - protein, 8 aa, Mycobacterium
MGGSGSVV

SEQ ID NO: 1109896 - protein, 8 aa, Mycobacterium
MGHKKDSL

SEQ ID NO: 1109897 - protein, 41 aa, Mycobacterium
MGPQGGFQRGPGSAGPFGPGGPVMESPRQPAGPAAPTAPPR

SEQ ID NO: 1109898 - protein, 6 aa, Mycobacterium
MGQADP

SEQ ID NO: 1109899 - protein, 4 aa, Mycobacterium
MGRG

SEQ ID NO: 1109900 - protein, 14 aa, Mycobacterium
MGSGQSSAQQNAGL

SEQ ID NO: 1109901 - protein, 6 aa, Mycobacterium
MGSSAM

SEQ ID NO: 1109902 - protein, 4 aa, Mycobacterium
MGVG

SEQ ID NO: 1109903 - protein, 9 aa, Mycobacterium
MKDTSANLN

SEQ ID NO: 1109904 - protein, 8 aa, Mycobacterium
MKPGETAR

SEQ ID NO: 1109905 - protein, 9 aa, Mycobacterium
MKTADGSKT

SEQ ID NO: 1109906 - protein, 9 aa, Mycobacterium
MNFSGGQRQ

SEQ ID NO: 1109907 - protein, 13 aa, Mycobacterium
MNSGTSAAKEAGN

SEQ ID NO: 1109908 - protein, 5 aa, Mycobacterium
MPADG

SEQ ID NO: 1109909 - protein, 8 aa, Mycobacterium
MPAPAGAI

SEQ ID NO: 1109910 - protein, 9 aa, Mycobacterium
MPDAPTSMA

SEQ ID NO: 1109911 - protein, 11 aa, Mycobacterium
MPHEGKSTTAI

SEQ ID NO: 1109912 - protein, 5 aa, Mycobacterium
MPKTT

SEQ ID NO: 1109913 - protein, 11 aa, Mycobacterium
MPNPEENNSDN

SEQ ID NO: 1109914 - protein, 27 aa, Mycobacterium
MPPGWTATATAPFKSATKWSGTSYGDH

SEQ ID NO: 1109915 - protein, 12 aa, Mycobacterium
MPPQARGPFSDS

SEQ ID NO: 1109916 - protein, 10 aa, Mycobacterium
MPSTDTPEKM

SEQ ID NO: 1109917 - protein, 7 aa, Mycobacterium
MPTPATP

SEQ ID NO: 1109918 - protein, 10 aa, Mycobacterium
MPTPTQQSPQ

SEQ ID NO: 1109919 - protein, 14 aa, Mycobacterium
MQAGPGDFTGPAVP

SEQ ID NO: 1109920 - protein, 6 aa, Mycobacterium
MQDGNN

SEQ ID NO: 1109921 - protein, 4 aa, Mycobacterium
MQGW

SEQ ID NO: 1109922 - protein, 7 aa, Mycobacterium
MQPEADA

SEQ ID NO: 1109923 - protein, 18 aa, Mycobacterium
MQPTPLPPVPLPREAAPS

SEQ ID NO: 1109924 - protein, 5 aa, Mycobacterium
MRGSY

SEQ ID NO: 1109925 - protein, 31 aa, Mycobacterium
MRPPTESDAAFTPDPDSAPGGVEGEDRRTPI

SEQ ID NO: 1109926 - protein, 6 aa, Mycobacterium
MRPSER

SEQ ID NO: 1109927 - protein, 9 aa, Mycobacterium
MRTPPEGAL

SEQ ID NO: 1109928 - protein, 8 aa, Mycobacterium
MSEAGPQK

SEQ ID NO: 1109929 - protein, 7 aa, Mycobacterium
MSEQNGA

SEQ ID NO: 1109930 - protein, 5 aa, Mycobacterium
MSERR

SEQ ID NO: 1109931 - protein, 7 aa, Mycobacterium
MSGEWSK

SEQ ID NO: 1109932 - protein, 10 aa, Mycobacterium
MSGPARTDVD

SEQ ID NO: 1109933 - protein, 7 aa, Mycobacterium
MSGPSPV

SEQ ID NO: 1109934 - protein, 8 aa, Mycobacterium
MSPELDPR

SEQ ID NO: 1109935 - protein, 8 aa, Mycobacterium
MSPNDAPA

SEQ ID NO: 1109936 - protein, 6 aa, Mycobacterium
MSPRAA

SEQ ID NO: 1109937 - protein, 11 aa, Mycobacterium
MSRDGDKFSGA

SEQ ID NO: 1109938 - protein, 10 aa, Mycobacterium
MSRDPRRRFG

SEQ ID NO: 1109939 - protein, 12 aa, Mycobacterium
MSSLSGESPRKP

SEQ ID NO: 1109940 - protein, 8 aa, Mycobacterium
MSTGTTAL

SEQ ID NO: 1109941 - protein, 6 aa, Mycobacterium
MTAATS

SEQ ID NO: 1109942 - protein, 15 aa, Mycobacterium
MTKGMSGGPTVDQEG

SEQ ID NO: 1109943 - protein, 17 aa, Mycobacterium
MTNASSVPAGHGHNYGE

SEQ ID NO: 1109944 - protein, 13 aa, Mycobacterium
MTPDPPQRFGSAT

SEQ ID NO: 1109945 - protein, 34 aa, Mycobacterium
MTQGEEAFPNGSIGQNPYSPPSDTGEALGLPPSQ

SEQ ID NO: 1109946 - protein, 19 aa, Mycobacterium
MTRAGGSASVRSAPGEGTS

SEQ ID NO: 1109947 - protein, 11 aa, Mycobacterium
MTRDPAQRFGD

SEQ ID NO: 1109948 - protein, 5 aa, Mycobacterium
MTSPA

SEQ ID NO: 1109949 - protein, 7 aa, Mycobacterium
MTTGPYR

SEQ ID NO: 1109950 - protein, 20 aa, Mycobacterium
NAADAATGRHGGTGPQSHAD

SEQ ID NO: 1109951 - protein, 8 aa, Mycobacterium
NAANQTAT

SEQ ID NO: 1109952 - protein, 10 aa, Mycobacterium
NAAPTHGPHT

SEQ ID NO: 1109953 - protein, 7 aa, Mycobacterium
NAAQNGV

SEQ ID NO: 1109954 - protein, 6 aa, Mycobacterium
NAATRE

SEQ ID NO: 1109955 - protein, 9 aa, Mycobacterium
NADATALRS

SEQ ID NO: 1109956 - protein, 14 aa, Mycobacterium
NADESTAPRTRRSN

SEQ ID NO: 1109957 - protein, 15 aa, Mycobacterium
NADESTAPRTRRSNH

SEQ ID NO: 1109958 - protein, 4 aa, Mycobacterium
NADK

SEQ ID NO: 1109959 - protein, 8 aa, Mycobacterium
NADKATTV

SEQ ID NO: 1109960 - protein, 6 aa, Mycobacterium
NADSGI

SEQ ID NO: 1109961 - protein, 9 aa, Mycobacterium
NADVAPGSA

SEQ ID NO: 1109962 - protein, 10 aa, Mycobacterium
NAEARGTGGL

SEQ ID NO: 1109963 - protein, 6 aa, Mycobacterium
NAEPAR

SEQ ID NO: 1109964 - protein, 7 aa, Mycobacterium
NAETGTQ

SEQ ID NO: 1109965 - protein, 13 aa, Mycobacterium
NAGALDTAGTAEV

SEQ ID NO: 1109966 - protein, 4 aa, Mycobacterium
NAGP

SEQ ID NO: 1109967 - protein, 9 aa, Mycobacterium
NAGPGTNGS

SEQ ID NO: 1109968 - protein, 4 aa, Mycobacterium
NAGR

SEQ ID NO: 1109969 - protein, 8 aa, Mycobacterium
NAKGGPVG

SEQ ID NO: 1109970 - protein, 8 aa, Mycobacterium
NANPGLDR

SEQ ID NO: 1109971 - protein, 8 aa, Mycobacterium
NANQKLQD

SEQ ID NO: 1109972 - protein, 6 aa, Mycobacterium
NANYPE

SEQ ID NO: 1109973 - protein, 7 aa, Mycobacterium
NAPPGMT

SEQ ID NO: 1109974 - protein, 6 aa, Mycobacterium
NARAGV

SEQ ID NO: 1109975 - protein, 22 aa, Mycobacterium
NARDAAATAQRELEASQRGIED

SEQ ID NO: 1109976 - protein, 19 aa, Mycobacterium
NARDAGQTSFGAAKDAGAL

SEQ ID NO: 1109977 - protein, 6 aa, Mycobacterium
NARGAA

SEQ ID NO: 1109978 - protein, 12 aa, Mycobacterium
NARQRKRNAPVP

SEQ ID NO: 1109979 - protein, 9 aa, Mycobacterium
NARSETGTA

SEQ ID NO: 1109980 - protein, 5 aa, Mycobacterium
NARTT

SEQ ID NO: 1109981 - protein, 5 aa, Mycobacterium
NASRE

SEQ ID NO: 1109982 - protein, 8 aa, Mycobacterium
NASSAGEL

SEQ ID NO: 1109983 - protein, 10 aa, Mycobacterium
NASVDATPRI

SEQ ID NO: 1109984 - protein, 10 aa, Mycobacterium
NASVDDTPRI

SEQ ID NO: 1109985 - protein, 7 aa, Mycobacterium
NATETEV

SEQ ID NO: 1109986 - protein, 18 aa, Mycobacterium
NATGGPAGVGVATGDAVR

SEQ ID NO: 1109987 - protein, 9 aa, Mycobacterium
NATGSGNAV

SEQ ID NO: 1109988 - protein, 4 aa, Mycobacterium
NATY

SEQ ID NO: 1109989 - protein, 5 aa, Mycobacterium
NCGKS

SEQ ID NO: 1109990 - protein, 7 aa, Mycobacterium
NCGTPED

SEQ ID NO: 1109991 - protein, 4 aa, Mycobacterium
NDAA

SEQ ID NO: 1109992 - protein, 7 aa, Mycobacterium
NDAAREV

SEQ ID NO: 1109993 - protein, 10 aa, Mycobacterium
NDAASDNSQM

SEQ ID NO: 1109994 - protein, 10 aa, Mycobacterium
NDAGPTGRTA

SEQ ID NO: 1109995 - protein, 4 aa, Mycobacterium
NDAN

SEQ ID NO: 1109996 - protein, 8 aa, Mycobacterium
NDAPPGVA

SEQ ID NO: 1109997 - protein, 13 aa, Mycobacterium
NDATVQEQDGEWT

SEQ ID NO: 1109998 - protein, 7 aa, Mycobacterium
NDDVTAE

SEQ ID NO: 1109999 - protein, 7 aa, Mycobacterium
NDEAQLD

SEQ ID NO: 1110000 - protein, 11 aa, Mycobacterium
NDEATRSTIDE

SEQ ID NO: 1110001 - protein, 8 aa, Mycobacterium
NDEDPNPY

SEQ ID NO: 1110002 - protein, 5 aa, Mycobacterium
NDETI

SEQ ID NO: 1110003 - protein, 7 aa, Mycobacterium
NDGDREQ

SEQ ID NO: 1110004 - protein, 4 aa, Mycobacterium
NDGG

SEQ ID NO: 1110005 - protein, 10 aa, Mycobacterium
NDGQPVTDEQ

SEQ ID NO: 1110006 - protein, 6 aa, Mycobacterium
NDGQTV

SEQ ID NO: 1110007 - protein, 17 aa, Mycobacterium
NDPAPRPSQSRPGIPAG

SEQ ID NO: 1110008 - protein, 6 aa, Mycobacterium
NDPQAG

SEQ ID NO: 1110009 - protein, 6 aa, Mycobacterium
NDQYDQ

SEQ ID NO: 1110010 - protein, 9 aa, Mycobacterium
NDRKERLDR

SEQ ID NO: 1110011 - protein, 7 aa, Mycobacterium
NDRKRSD

SEQ ID NO: 1110012 - protein, 8 aa, Mycobacterium
NDRQERLD

SEQ ID NO: 1110013 - protein, 13 aa, Mycobacterium
NDRSKGPAAARNA

SEQ ID NO: 1110014 - protein, 7 aa, Mycobacterium
NDRTAQA

SEQ ID NO: 1110015 - protein, 15 aa, Mycobacterium
NDSPEVQQQAAAQAQ

SEQ ID NO: 1110016 - protein, 14 aa, Mycobacterium
NDTGQPEKARAYTT

SEQ ID NO: 1110017 - protein, 6 aa, Mycobacterium
NDTIAS

SEQ ID NO: 1110018 - protein, 8 aa, Mycobacterium
NEDGTASV

SEQ ID NO: 1110019 - protein, 7 aa, Mycobacterium
NEDRPQL

SEQ ID NO: 1110020 - protein, 5 aa, Mycobacterium
NEDST

SEQ ID NO: 1110021 - protein, 9 aa, Mycobacterium
NEEPELSSL

SEQ ID NO: 1110022 - protein, 8 aa, Mycobacterium
NEGNAAEQ

SEQ ID NO: 1110023 - protein, 10 aa, Mycobacterium
NEGPDGEAAV

SEQ ID NO: 1110024 - protein, 5 aa, Mycobacterium
NEHQD

SEQ ID NO: 1110025 - protein, 11 aa, Mycobacterium
NENLAQARDAD

SEQ ID NO: 1110026 - protein, 8 aa, Mycobacterium
NERELAPT

SEQ ID NO: 1110027 - protein, 6 aa, Mycobacterium
NERRSD

SEQ ID NO: 1110028 - protein, 6 aa, Mycobacterium
NESDGG

SEQ ID NO: 1110029 - protein, 7 aa, Mycobacterium
NEYTPNI

SEQ ID NO: 1110030 - protein, 8 aa, Mycobacterium
NGAGPDFG

SEQ ID NO: 1110031 - protein, 14 aa, Mycobacterium
NGAKASVEASISAS

SEQ ID NO: 1110032 - protein, 6 aa, Mycobacterium
NGAPAP

SEQ ID NO: 1110033 - protein, 5 aa, Mycobacterium
NGDPV

SEQ ID NO: 1110034 - protein, 11 aa, Mycobacterium
NGEDYQYSTPE

SEQ ID NO: 1110035 - protein, 5 aa, Mycobacterium
NGEGI

SEQ ID NO: 1110036 - protein, 4 aa, Mycobacterium
NGEL

SEQ ID NO: 1110037 - protein, 7 aa, Mycobacterium
NGFGPDG

SEQ ID NO: 1110038 - protein, 4 aa, Mycobacterium
NGFN

SEQ ID NO: 1110039 - protein, 6 aa, Mycobacterium
NGGAQR

SEQ ID NO: 1110040 - protein, 4 aa, Mycobacterium
NGGE

SEQ ID NO: 1110041 - protein, 5 aa, Mycobacterium
NGGEP

SEQ ID NO: 1110042 - protein, 10 aa, Mycobacterium
NGGPAPAGAQ

SEQ ID NO: 1110043 - protein, 24 aa, Mycobacterium
NGGRDTDTGETSGAATTTTATRTA

SEQ ID NO: 1110044 - protein, 7 aa, Mycobacterium
NGGREFG

SEQ ID NO: 1110045 - protein, 27 aa, Mycobacterium
NGGRELSSGASQLADGTEKLRAGGQEL

SEQ ID NO: 1110046 - protein, 9 aa, Mycobacterium
NGIRPLETD

SEQ ID NO: 1110047 - protein, 4 aa, Mycobacterium
NGKE

SEQ ID NO: 1110048 - protein, 8 aa, Mycobacterium
NGKGGQPV

SEQ ID NO: 1110049 - protein, 4 aa, Mycobacterium
NGLG

SEQ ID NO: 1110050 - protein, 8 aa, Mycobacterium
NGLGTPAG

SEQ ID NO: 1110051 - protein, 8 aa, Mycobacterium
NGLTDGHS

SEQ ID NO: 1110052 - protein, 11 aa, Mycobacterium
NGNADEDTKRV

SEQ ID NO: 1110053 - protein, 4 aa, Mycobacterium
NGNG

SEQ ID NO: 1110054 - protein, 10 aa, Mycobacterium
NGPGAADEAR

SEQ ID NO: 1110055 - protein, 37 aa, Mycobacterium
NGPPPAPPAPPAGPLPPAPPGAPLPPAPPAEVVPPPA

SEQ ID NO: 1110056 - protein, 53 aa, Mycobacterium
NGPPPPPGAPAPPPPAPEAAPPPPPAPALPPPPPPAPAPPVEPVPPPPPPPPG

SEQ ID NO: 1110057 - protein, 13 aa, Mycobacterium
NGPQDVADAAHRA

SEQ ID NO: 1110058 - protein, 8 aa, Mycobacterium
NGPSPLGP

SEQ ID NO: 1110059 - protein, 15 aa, Mycobacterium
NGPTKAVELSSGPTP

SEQ ID NO: 1110060 - protein, 7 aa, Mycobacterium
NGQIGDK

SEQ ID NO: 1110061 - protein, 28 aa, Mycobacterium
NGQYWKGSPAVKSGKAKHPWPDHRPPRA

SEQ ID NO: 1110062 - protein, 5 aa, Mycobacterium
NGRFS

SEQ ID NO: 1110063 - protein, 10 aa, Mycobacterium
NGRGLPADEH

SEQ ID NO: 1110064 - protein, 15 aa, Mycobacterium
NGRGLSGAGATLTTR

SEQ ID NO: 1110065 - protein, 4 aa, Mycobacterium
NGRP

SEQ ID NO: 1110066 - protein, 8 aa, Mycobacterium
NGRPAKEP

SEQ ID NO: 1110067 - protein, 7 aa, Mycobacterium
NGSATPF

SEQ ID NO: 1110068 - protein, 7 aa, Mycobacterium
NGSGPEL

SEQ ID NO: 1110069 - protein, 8 aa, Mycobacterium
NGSRSAGV

SEQ ID NO: 1110070 - protein, 7 aa, Mycobacterium
NGSSTPY

SEQ ID NO: 1110071 - protein, 22 aa, Mycobacterium
NGTIGSPPVGGRRRRRRGNADA

SEQ ID NO: 1110072 - protein, 5 aa, Mycobacterium
NGTYY

SEQ ID NO: 1110073 - protein, 5 aa, Mycobacterium
NGVAA

SEQ ID NO: 1110074 - protein, 6 aa, Mycobacterium
NGVPRA

SEQ ID NO: 1110075 - protein, 19 aa, Mycobacterium
NGWNDRDPTIPASDWPPAL

SEQ ID NO: 1110076 - protein, 4 aa, Mycobacterium
NGYQ

SEQ ID NO: 1110077 - protein, 4 aa, Mycobacterium
NHEP

SEQ ID NO: 1110078 - protein, 19 aa, Mycobacterium
NHPTPLDSSVSDEIEPARA

SEQ ID NO: 1110079 - protein, 4 aa, Mycobacterium
NHTG

SEQ ID NO: 1110080 - protein, 6 aa, Mycobacterium
NHYPQD

SEQ ID NO: 1110081 - protein, 8 aa, Mycobacterium
NIDPTTDE

SEQ ID NO: 1110082 - protein, 7 aa, Mycobacterium
NIGGNPS

SEQ ID NO: 1110083 - protein, 12 aa, Mycobacterium
NIPKNKPKALNT

SEQ ID NO: 1110084 - protein, 5 aa, Mycobacterium
NIPPT

SEQ ID NO: 1110085 - protein, 10 aa, Mycobacterium
NISGGDGPAR

SEQ ID NO: 1110086 - protein, 5 aa, Mycobacterium
NITPN

SEQ ID NO: 1110087 - protein, 6 aa, Mycobacterium
NKAVPA

SEQ ID NO: 1110088 - protein, 8 aa, Mycobacterium
NKEYSAPR

SEQ ID NO: 1110089 - protein, 6 aa, Mycobacterium
NKKQGY

SEQ ID NO: 1110090 - protein, 8 aa, Mycobacterium
NKLGQTEY

SEQ ID NO: 1110091 - protein, 78 aa, Mycobacterium
NKRNQSRHDEAETIRSEARDENRHVAQREARAEETAAKARAVQAEADVKTAQAKGLQQEAAGHRHEATNSRDDLNEQF

SEQ ID NO: 1110092 - protein, 5 aa, Mycobacterium
NKSVE

SEQ ID NO: 1110093 - protein, 7 aa, Mycobacterium
NKTAKTV

SEQ ID NO: 1110094 - protein, 14 aa, Mycobacterium
NKTPTLDHRPAENT

SEQ ID NO: 1110095 - protein, 4 aa, Mycobacterium
NKVQ

SEQ ID NO: 1110096 - protein, 7 aa, Mycobacterium
NLAPDGW

SEQ ID NO: 1110097 - protein, 10 aa, Mycobacterium
NLDPGTKVTY

SEQ ID NO: 1110098 - protein, 19 aa, Mycobacterium
NLGEPGETADGTAETADTV

SEQ ID NO: 1110099 - protein, 9 aa, Mycobacterium
NLGNESPYA

SEQ ID NO: 1110100 - protein, 11 aa, Mycobacterium
NLGRASEEGSG

SEQ ID NO: 1110101 - protein, 4 aa, Mycobacterium
NLPG

SEQ ID NO: 1110102 - protein, 8 aa, Mycobacterium
NLPGTSQT

SEQ ID NO: 1110103 - protein, 15 aa, Mycobacterium
NLPTGARFEVRLPLA

SEQ ID NO: 1110104 - protein, 14 aa, Mycobacterium
NLQDPALGESSGGL

SEQ ID NO: 1110105 - protein, 5 aa, Mycobacterium
NLRGR

SEQ ID NO: 1110106 - protein, 7 aa, Mycobacterium
NLRPPDV

SEQ ID NO: 1110107 - protein, 12 aa, Mycobacterium
NLSPRPPADPAT

SEQ ID NO: 1110108 - protein, 9 aa, Mycobacterium
NLTANAGSI

SEQ ID NO: 1110109 - protein, 7 aa, Mycobacterium
NLTTPDE

SEQ ID NO: 1110110 - protein, 14 aa, Mycobacterium
NMAANGYGAHSPGG

SEQ ID NO: 1110111 - protein, 12 aa, Mycobacterium
NMGETKSNESVA

SEQ ID NO: 1110112 - protein, 11 aa, Mycobacterium
NMGPNTADAAS

SEQ ID NO: 1110113 - protein, 6 aa, Mycobacterium
NNDESR

SEQ ID NO: 1110114 - protein, 7 aa, Mycobacterium
NNGGPAS

SEQ ID NO: 1110115 - protein, 6 aa, Mycobacterium
NNGQTV

SEQ ID NO: 1110116 - protein, 14 aa, Mycobacterium
NNGVSPTVKKGDTF

SEQ ID NO: 1110117 - protein, 4 aa, Mycobacterium
NNPF

SEQ ID NO: 1110118 - protein, 9 aa, Mycobacterium
NNPGETSGT

SEQ ID NO: 1110119 - protein, 7 aa, Mycobacterium
NNPGVPD

SEQ ID NO: 1110120 - protein, 8 aa, Mycobacterium
NNPNNTDD

SEQ ID NO: 1110121 - protein, 9 aa, Mycobacterium
NNPQPGTDY

SEQ ID NO: 1110122 - protein, 18 aa, Mycobacterium
NNPWRGPPVPVGTPIQDG

SEQ ID NO: 1110123 - protein, 8 aa, Mycobacterium
NNQAGSTL

SEQ ID NO: 1110124 - protein, 8 aa, Mycobacterium
NNRSVGGA

SEQ ID NO: 1110125 - protein, 9 aa, Mycobacterium
NNSRSTRVI

SEQ ID NO: 1110126 - protein, 13 aa, Mycobacterium
NNTAGWDTKTVRD

SEQ ID NO: 1110127 - protein, 13 aa, Mycobacterium
NPAAPRVERAEET

SEQ ID NO: 1110128 - protein, 6 aa, Mycobacterium
NPADAE

SEQ ID NO: 1110129 - protein, 6 aa, Mycobacterium
NPADAS

SEQ ID NO: 1110130 - protein, 6 aa, Mycobacterium
NPADTD

SEQ ID NO: 1110131 - protein, 15 aa, Mycobacterium
NPAGTKPPDPEDLQS

SEQ ID NO: 1110132 - protein, 9 aa, Mycobacterium
NPANYLTNP

SEQ ID NO: 1110133 - protein, 17 aa, Mycobacterium
NPAPAAPPAPVEKPAAK

SEQ ID NO: 1110134 - protein, 5 aa, Mycobacterium
NPASD

SEQ ID NO: 1110135 - protein, 13 aa, Mycobacterium
NPATALSTNGVAG

SEQ ID NO: 1110136 - protein, 5 aa, Mycobacterium
NPDAD

SEQ ID NO: 1110137 - protein, 10 aa, Mycobacterium
NPDERADEMK

SEQ ID NO: 1110138 - protein, 9 aa, Mycobacterium
NPDFQEEAA

SEQ ID NO: 1110139 - protein, 10 aa, Mycobacterium
NPDGRAARRT

SEQ ID NO: 1110140 - protein, 8 aa, Mycobacterium
NPDGSRTF

SEQ ID NO: 1110141 - protein, 7 aa, Mycobacterium
NPDKAAA

SEQ ID NO: 1110142 - protein, 8 aa, Mycobacterium
NPDPAVRD

SEQ ID NO: 1110143 - protein, 15 aa, Mycobacterium
NPDRTLRKEAAARGW

SEQ ID NO: 1110144 - protein, 5 aa, Mycobacterium
NPEDV

SEQ ID NO: 1110145 - protein, 7 aa, Mycobacterium
NPGARDE

SEQ ID NO: 1110146 - protein, 9 aa, Mycobacterium
NPGGSYTLA

SEQ ID NO: 1110147 - protein, 5 aa, Mycobacterium
NPGLI

SEQ ID NO: 1110148 - protein, 6 aa, Mycobacterium
NPGPGL

SEQ ID NO: 1110149 - protein, 27 aa, Mycobacterium
NPGSEFDAKKTVKSGEKLNKAKADMAK

SEQ ID NO: 1110150 - protein, 17 aa, Mycobacterium
NPHATGTSGVTTQPHGG

SEQ ID NO: 1110151 - protein, 5 aa, Mycobacterium
NPHSP

SEQ ID NO: 1110152 - protein, 4 aa, Mycobacterium
NPIP

SEQ ID NO: 1110153 - protein, 10 aa, Mycobacterium
NPKAAARDSL

SEQ ID NO: 1110154 - protein, 9 aa, Mycobacterium
NPKPDGKTV

SEQ ID NO: 1110155 - protein, 12 aa, Mycobacterium
NPLAPPAALAAP

SEQ ID NO: 1110156 - protein, 7 aa, Mycobacterium
NPLGPGD

SEQ ID NO: 1110157 - protein, 4 aa, Mycobacterium
NPLT

SEQ ID NO: 1110158 - protein, 13 aa, Mycobacterium
NPNSPYVRQKPEV

SEQ ID NO: 1110159 - protein, 10 aa, Mycobacterium
NPPDPRNPRT

SEQ ID NO: 1110160 - protein, 7 aa, Mycobacterium
NPPIDTP

SEQ ID NO: 1110161 - protein, 18 aa, Mycobacterium
NPPPPAPAAEPPPPALGK

SEQ ID NO: 1110162 - protein, 7 aa, Mycobacterium
NPPWTSP

SEQ ID NO: 1110163 - protein, 9 aa, Mycobacterium
NPQDDPEAR

SEQ ID NO: 1110164 - protein, 20 aa, Mycobacterium
NPQPAAPPPPAAEPEPARQR

SEQ ID NO: 1110165 - protein, 8 aa, Mycobacterium
NPSGEPTL

SEQ ID NO: 1110166 - protein, 6 aa, Mycobacterium
NPTRSP

SEQ ID NO: 1110167 - protein, 4 aa, Mycobacterium
NPVA

SEQ ID NO: 1110168 - protein, 9 aa, Mycobacterium
NQAAGLARQ

SEQ ID NO: 1110169 - protein, 7 aa, Mycobacterium
NQDRQFG

SEQ ID NO: 1110170 - protein, 5 aa, Mycobacterium
NQEQG

SEQ ID NO: 1110171 - protein, 10 aa, Mycobacterium
NQGEALANES

SEQ ID NO: 1110172 - protein, 13 aa, Mycobacterium
NQGGAAAAAGLPS

SEQ ID NO: 1110173 - protein, 6 aa, Mycobacterium
NQHDDQ

SEQ ID NO: 1110174 - protein, 4 aa, Mycobacterium
NQKW

SEQ ID NO: 1110175 - protein, 5 aa, Mycobacterium
NQNSE

SEQ ID NO: 1110176 - protein, 6 aa, Mycobacterium
NQPALG

SEQ ID NO: 1110177 - protein, 4 aa, Mycobacterium
NQRY

SEQ ID NO: 1110178 - protein, 10 aa, Mycobacterium
NQTTRSLNES

SEQ ID NO: 1110179 - protein, 8 aa, Mycobacterium
NRADPIAT

SEQ ID NO: 1110180 - protein, 6 aa, Mycobacterium
NRADTV

SEQ ID NO: 1110181 - protein, 7 aa, Mycobacterium
NRAHGKT

SEQ ID NO: 1110182 - protein, 10 aa, Mycobacterium
NRAPDGADRD

SEQ ID NO: 1110183 - protein, 6 aa, Mycobacterium
NRDAAG

SEQ ID NO: 1110184 - protein, 9 aa, Mycobacterium
NRDDSDAIS

SEQ ID NO: 1110185 - protein, 10 aa, Mycobacterium
NRDRADSTRD

SEQ ID NO: 1110186 - protein, 15 aa, Mycobacterium
NRDRSPRPGETQEPT

SEQ ID NO: 1110187 - protein, 11 aa, Mycobacterium
NRDSADAITSR

SEQ ID NO: 1110188 - protein, 5 aa, Mycobacterium
NREAG

SEQ ID NO: 1110189 - protein, 24 aa, Mycobacterium
NRLPDAGAHTTRHDPRIRGDESLR

SEQ ID NO: 1110190 - protein, 14 aa, Mycobacterium
NRNLEAERSEQSVP

SEQ ID NO: 1110191 - protein, 12 aa, Mycobacterium
NRPAQPDTVAAP

SEQ ID NO: 1110192 - protein, 6 aa, Mycobacterium
NRPGDM

SEQ ID NO: 1110193 - protein, 4 aa, Mycobacterium
NRPL

SEQ ID NO: 1110194 - protein, 10 aa, Mycobacterium
NRPTDPATEQ

SEQ ID NO: 1110195 - protein, 6 aa, Mycobacterium
NRPYPK

SEQ ID NO: 1110196 - protein, 8 aa, Mycobacterium
NRQENRDR

SEQ ID NO: 1110197 - protein, 15 aa, Mycobacterium
NRQKRQGGRSAQDGA

SEQ ID NO: 1110198 - protein, 11 aa, Mycobacterium
NRQSPGGAGWK

SEQ ID NO: 1110199 - protein, 4 aa, Mycobacterium
NRQT

SEQ ID NO: 1110200 - protein, 6 aa, Mycobacterium
NRREQG

SEQ ID NO: 1110201 - protein, 10 aa, Mycobacterium
NRRTGQKRTI

SEQ ID NO: 1110202 - protein, 5 aa, Mycobacterium
NRSAG

SEQ ID NO: 1110203 - protein, 7 aa, Mycobacterium
NRSTGEL

SEQ ID NO: 1110204 - protein, 6 aa, Mycobacterium
NRSTRC

SEQ ID NO: 1110205 - protein, 12 aa, Mycobacterium
NRTHSADSRTHC

SEQ ID NO: 1110206 - protein, 6 aa, Mycobacterium
NRTRKQ

SEQ ID NO: 1110207 - protein, 5 aa, Mycobacterium
NRVGP

SEQ ID NO: 1110208 - protein, 10 aa, Mycobacterium
NSADGIKETA

SEQ ID NO: 1110209 - protein, 9 aa, Mycobacterium
NSAISNLSD

SEQ ID NO: 1110210 - protein, 5 aa, Mycobacterium
NSAQA

SEQ ID NO: 1110211 - protein, 9 aa, Mycobacterium
NSDGKHDRA

SEQ ID NO: 1110212 - protein, 6 aa, Mycobacterium
NSFSGA

SEQ ID NO: 1110213 - protein, 4 aa, Mycobacterium
NSGA

SEQ ID NO: 1110214 - protein, 45 aa, Mycobacterium
NSGAGARLRRRGGPAAGHRSDPDWRPSASDLDEDLDDVEEKAPSR

SEQ ID NO: 1110215 - protein, 5 aa, Mycobacterium
NSGPV

SEQ ID NO: 1110216 - protein, 11 aa, Mycobacterium
NSGTPVPENVT

SEQ ID NO: 1110217 - protein, 6 aa, Mycobacterium
NSHDEP

SEQ ID NO: 1110218 - protein, 9 aa, Mycobacterium
NSLGSGTAA

SEQ ID NO: 1110219 - protein, 8 aa, Mycobacterium
NSLGVDGG

SEQ ID NO: 1110220 - protein, 12 aa, Mycobacterium
NSPGMGADATRV

SEQ ID NO: 1110221 - protein, 10 aa, Mycobacterium
NSRDRETTVL

SEQ ID NO: 1110222 - protein, 6 aa, Mycobacterium
NSRRTH

SEQ ID NO: 1110223 - protein, 7 aa, Mycobacterium
NSSDIDP

SEQ ID NO: 1110224 - protein, 23 aa, Mycobacterium
NSSDIDPLANADASREISTAADA

SEQ ID NO: 1110225 - protein, 6 aa, Mycobacterium
NSSGPV

SEQ ID NO: 1110226 - protein, 14 aa, Mycobacterium
NSTGQFKTDFESQA

SEQ ID NO: 1110227 - protein, 40 aa, Mycobacterium
NSTGTSVQIRSSETATPSSLEDTTALTDPTPVKPGSNTIE

SEQ ID NO: 1110228 - protein, 10 aa, Mycobacterium
NSTTVAGGAG

SEQ ID NO: 1110229 - protein, 16 aa, Mycobacterium
NSVPAEVDSTEPAGQV

SEQ ID NO: 1110230 - protein, 6 aa, Mycobacterium
NSVPDS

SEQ ID NO: 1110231 - protein, 9 aa, Mycobacterium
NTAEESQTI

SEQ ID NO: 1110232 - protein, 12 aa, Mycobacterium
NTAGPEQTAAAS

SEQ ID NO: 1110233 - protein, 10 aa, Mycobacterium
NTAPADAPLP

SEQ ID NO: 1110234 - protein, 6 aa, Mycobacterium
NTATFD

SEQ ID NO: 1110235 - protein, 6 aa, Mycobacterium
NTDETM

SEQ ID NO: 1110236 - protein, 6 aa, Mycobacterium
NTDQLS

SEQ ID NO: 1110237 - protein, 15 aa, Mycobacterium
NTDRIGTATLNTNQN

SEQ ID NO: 1110238 - protein, 4 aa, Mycobacterium
NTGA

SEQ ID NO: 1110239 - protein, 5 aa, Mycobacterium
NTGEP

SEQ ID NO: 1110240 - protein, 5 aa, Mycobacterium
NTGSV

SEQ ID NO: 1110241 - protein, 7 aa, Mycobacterium
NTGTPAV

SEQ ID NO: 1110242 - protein, 10 aa, Mycobacterium
NTLAAKATSA

SEQ ID NO: 1110243 - protein, 6 aa, Mycobacterium
NTLSEA

SEQ ID NO: 1110244 - protein, 17 aa, Mycobacterium
NTNGAAVNARPDEPGLG

SEQ ID NO: 1110245 - protein, 5 aa, Mycobacterium
NTPAD

SEQ ID NO: 1110246 - protein, 13 aa, Mycobacterium
NTPDGSAATSETM

SEQ ID NO: 1110247 - protein, 13 aa, Mycobacterium
NTPEAAAALAGTT

SEQ ID NO: 1110248 - protein, 4 aa, Mycobacterium
NTPV

SEQ ID NO: 1110249 - protein, 6 aa, Mycobacterium
NTQSEK

SEQ ID NO: 1110250 - protein, 7 aa, Mycobacterium
NTSIPQA

SEQ ID NO: 1110251 - protein, 5 aa, Mycobacterium
NTSPH

SEQ ID NO: 1110252 - protein, 5 aa, Mycobacterium
NTSPI

SEQ ID NO: 1110253 - protein, 6 aa, Mycobacterium
NTTPHP

SEQ ID NO: 1110254 - protein, 5 aa, Mycobacterium
NTTRD

SEQ ID NO: 1110255 - protein, 7 aa, Mycobacterium
NTVGTTH

SEQ ID NO: 1110256 - protein, 5 aa, Mycobacterium
NTVTV

SEQ ID NO: 1110257 - protein, 8 aa, Mycobacterium
NVADDQSE

SEQ ID NO: 1110258 - protein, 46 aa, Mycobacterium
NVAPRQPEVTTTTPTTTTTTTTTPPETTTATTTAEPTPSTTPGPLG

SEQ ID NO: 1110259 - protein, 7 aa, Mycobacterium
NVATTEV

SEQ ID NO: 1110260 - protein, 5 aa, Mycobacterium
NVDQY

SEQ ID NO: 1110261 - protein, 13 aa, Mycobacterium
NVEETSVDGEPRA

SEQ ID NO: 1110262 - protein, 6 aa, Mycobacterium
NVERGD

SEQ ID NO: 1110263 - protein, 5 aa, Mycobacterium
NVGTQ

SEQ ID NO: 1110264 - protein, 9 aa, Mycobacterium
NVKASAKAD

SEQ ID NO: 1110265 - protein, 14 aa, Mycobacterium
NVPGQGATAEVDGR

SEQ ID NO: 1110266 - protein, 4 aa, Mycobacterium
NVSA

SEQ ID NO: 1110267 - protein, 10 aa, Mycobacterium
NVSASAKPDT

SEQ ID NO: 1110268 - protein, 20 aa, Mycobacterium
NVSNSSNPGDDGWKEMLAPA

SEQ ID NO: 1110269 - protein, 11 aa, Mycobacterium
NVTPGRPTTTR

SEQ ID NO: 1110270 - protein, 15 aa, Mycobacterium
NWKGDPNATMSGQDV

SEQ ID NO: 1110271 - protein, 13 aa, Mycobacterium
NYDPEDEEQKDEM

SEQ ID NO: 1110272 - protein, 18 aa, Mycobacterium
NYQPFDGYTDKKESEKKL

SEQ ID NO: 1110273 - protein, 21 aa, Mycobacterium
NYQPPADLKPPPGTEVGPNGN

SEQ ID NO: 1110274 - protein, 7 aa, Mycobacterium
PAAADGE

SEQ ID NO: 1110275 - protein, 5 aa, Mycobacterium
PAAAE

SEQ ID NO: 1110276 - protein, 19 aa, Mycobacterium
PAAAPPASPPAPPPPPPPD

SEQ ID NO: 1110277 - protein, 14 aa, Mycobacterium
PAADQQSSRSPHQR

SEQ ID NO: 1110278 - protein, 10 aa, Mycobacterium
PAAEHTEVGQ

SEQ ID NO: 1110279 - protein, 9 aa, Mycobacterium
PAAEITDGT

SEQ ID NO: 1110280 - protein, 13 aa, Mycobacterium
PAAETAVATSPEA

SEQ ID NO: 1110281 - protein, 4 aa, Mycobacterium
PAAG

SEQ ID NO: 1110282 - protein, 5 aa, Mycobacterium
PAAGA

SEQ ID NO: 1110283 - protein, 12 aa, Mycobacterium
PAAGRDGPPGPR

SEQ ID NO: 1110284 - protein, 10 aa, Mycobacterium
PAAKNNFEQG

SEQ ID NO: 1110285 - protein, 12 aa, Mycobacterium
PAALPTPPKGWP

SEQ ID NO: 1110286 - protein, 9 aa, Mycobacterium
PAAQAAGTG

SEQ ID NO: 1110287 - protein, 10 aa, Mycobacterium
PAARTGISGP

SEQ ID NO: 1110288 - protein, 4 aa, Mycobacterium
PAAT

SEQ ID NO: 1110289 - protein, 6 aa, Mycobacterium
PAATPV

SEQ ID NO: 1110290 - protein, 5 aa, Mycobacterium
PAATV

SEQ ID NO: 1110291 - protein, 7 aa, Mycobacterium
PACGTPL

SEQ ID NO: 1110292 - protein, 12 aa, Mycobacterium
PADAAPPGSPGV

SEQ ID NO: 1110293 - protein, 14 aa, Mycobacterium
PADATTVGGPAQPL

SEQ ID NO: 1110294 - protein, 5 aa, Mycobacterium
PADGA

SEQ ID NO: 1110295 - protein, 15 aa, Mycobacterium
PADGTYDIETGGNVR

SEQ ID NO: 1110296 - protein, 5 aa, Mycobacterium
PADGW

SEQ ID NO: 1110297 - protein, 7 aa, Mycobacterium
PADRSEA

SEQ ID NO: 1110298 - protein, 10 aa, Mycobacterium
PADSGPTPIQ

SEQ ID NO: 1110299 - protein, 10 aa, Mycobacterium
PADTDMPETA

SEQ ID NO: 1110300 - protein, 5 aa, Mycobacterium
PAEGF

SEQ ID NO: 1110301 - protein, 18 aa, Mycobacterium
PAEGPPAPPAVPADRPAL

SEQ ID NO: 1110302 - protein, 29 aa, Mycobacterium
PAEQQDEDPDQPGERRFTAPSGFDAGSTQ

SEQ ID NO: 1110303 - protein, 8 aa, Mycobacterium
PAESQARG

SEQ ID NO: 1110304 - protein, 16 aa, Mycobacterium
PAETASHADYEEPGRR

SEQ ID NO: 1110305 - protein, 11 aa, Mycobacterium
PAETSRAENTR

SEQ ID NO: 1110306 - protein, 5 aa, Mycobacterium
PAEYH

SEQ ID NO: 1110307 - protein, 4 aa, Mycobacterium
PAFA

SEQ ID NO: 1110308 - protein, 6 aa, Mycobacterium
PAFGTN

SEQ ID NO: 1110309 - protein, 7 aa, Mycobacterium
PAFPTNT

SEQ ID NO: 1110310 - protein, 4 aa, Mycobacterium
PAGA

SEQ ID NO: 1110311 - protein, 9 aa, Mycobacterium
PAGAPSPAV

SEQ ID NO: 1110312 - protein, 8 aa, Mycobacterium
PAGDEATS

SEQ ID NO: 1110313 - protein, 8 aa, Mycobacterium
PAGEPGSH

SEQ ID NO: 1110314 - protein, 9 aa, Mycobacterium
PAGEQQRRD

SEQ ID NO: 1110315 - protein, 4 aa, Mycobacterium
PAGF

SEQ ID NO: 1110316 - protein, 7 aa, Mycobacterium
PAGGDHR

SEQ ID NO: 1110317 - protein, 8 aa, Mycobacterium
PAGGHSAE

SEQ ID NO: 1110318 - protein, 17 aa, Mycobacterium
PAGGSSRNQPQQADEQA

SEQ ID NO: 1110319 - protein, 22 aa, Mycobacterium
PAGGSTEPEDHRHDVEPSHPHQ

SEQ ID NO: 1110320 - protein, 20 aa, Mycobacterium
PAGLTKEQAVEAARARGDGT

SEQ ID NO: 1110321 - protein, 18 aa, Mycobacterium
PAGPPLADDPTASIRANH

SEQ ID NO: 1110322 - protein, 18 aa, Mycobacterium
PAGPPLADDPTASIRDNH

SEQ ID NO: 1110323 - protein, 11 aa, Mycobacterium
PAGPPQRTRGH

SEQ ID NO: 1110324 - protein, 6 aa, Mycobacterium
PAGREA

SEQ ID NO: 1110325 - protein, 10 aa, Mycobacterium
PAGRGTGLAA

SEQ ID NO: 1110326 - protein, 5 aa, Mycobacterium
PAGRS

SEQ ID NO: 1110327 - protein, 9 aa, Mycobacterium
PAGSAEPTR

SEQ ID NO: 1110328 - protein, 8 aa, Mycobacterium
PAGSGGDY

SEQ ID NO: 1110329 - protein, 15 aa, Mycobacterium
PAGSLTSAVPRAVAD

SEQ ID NO: 1110330 - protein, 10 aa, Mycobacterium
PAGSSLADNA

SEQ ID NO: 1110331 - protein, 14 aa, Mycobacterium
PAGTEIRDNRSING

SEQ ID NO: 1110332 - protein, 6 aa, Mycobacterium
PAGTPV

SEQ ID NO: 1110333 - protein, 13 aa, Mycobacterium
PAGVDRRASAGSG

SEQ ID NO: 1110334 - protein, 6 aa, Mycobacterium
PAGVPL

SEQ ID NO: 1110335 - protein, 28 aa, Mycobacterium
PAHHRTEPVEPAGRRQPRYAEPERGGSL

SEQ ID NO: 1110336 - protein, 9 aa, Mycobacterium
PAHQQSESP

SEQ ID NO: 1110337 - protein, 6 aa, Mycobacterium
PAIGGP

SEQ ID NO: 1110338 - protein, 23 aa, Mycobacterium
PAINSAPDRTPQHGAGEPHGDVP

SEQ ID NO: 1110339 - protein, 12 aa, Mycobacterium
PAIPGAGEPSRW

SEQ ID NO: 1110340 - protein, 7 aa, Mycobacterium
PAISSKG

SEQ ID NO: 1110341 - protein, 4 aa, Mycobacterium
PAKL

SEQ ID NO: 1110342 - protein, 19 aa, Mycobacterium
PALAGEGGGGVRDDGPEDA

SEQ ID NO: 1110343 - protein, 4 aa, Mycobacterium
PALD

SEQ ID NO: 1110344 - protein, 4 aa, Mycobacterium
PALE

SEQ ID NO: 1110345 - protein, 14 aa, Mycobacterium
PALPEKSGSPDSFA

SEQ ID NO: 1110346 - protein, 4 aa, Mycobacterium
PALR

SEQ ID NO: 1110347 - protein, 8 aa, Mycobacterium
PALRPGQV

SEQ ID NO: 1110348 - protein, 5 aa, Mycobacterium
PANQR

SEQ ID NO: 1110349 - protein, 4 aa, Mycobacterium
PAPA

SEQ ID NO: 1110350 - protein, 17 aa, Mycobacterium
PAPAAPAAPPPPGNSLN

SEQ ID NO: 1110351 - protein, 16 aa, Mycobacterium
PAPAAPALPEAPPPVY

SEQ ID NO: 1110352 - protein, 29 aa, Mycobacterium
PAPAEDAPAEEPAASSPAPTRADQPSPAI

SEQ ID NO: 1110353 - protein, 8 aa, Mycobacterium
PAPAETAA

SEQ ID NO: 1110354 - protein, 16 aa, Mycobacterium
PAPATPPPPLSPGGRT

SEQ ID NO: 1110355 - protein, 15 aa, Mycobacterium
PAPEEGGSGGTGTEQ

SEQ ID NO: 1110356 - protein, 13 aa, Mycobacterium
PAPGDPTPSAPPL

SEQ ID NO: 1110357 - protein, 12 aa, Mycobacterium
PAPGPVAPAHPT

SEQ ID NO: 1110358 - protein, 30 aa, Mycobacterium
PAPPAAVPAAPVPAPVPAAAQAAPLPEPVP

SEQ ID NO: 1110359 - protein, 12 aa, Mycobacterium
PAPPERRAGTDY

SEQ ID NO: 1110360 - protein, 28 aa, Mycobacterium
PAPPPRPQPRTPEPAPTASGWKPVPAEG

SEQ ID NO: 1110361 - protein, 33 aa, Mycobacterium
PAPPQPPAATPPSWPPAPPSAPPPQHPGGFAPP

SEQ ID NO: 1110362 - protein, 4 aa, Mycobacterium
PAPR

SEQ ID NO: 1110363 - protein, 25 aa, Mycobacterium
PAPRNSALHNSANTSTVSQDAHDTT

SEQ ID NO: 1110364 - protein, 5 aa, Mycobacterium
PAPTF

SEQ ID NO: 1110365 - protein, 16 aa, Mycobacterium
PAPVDGRAETVAAVST

SEQ ID NO: 1110366 - protein, 9 aa, Mycobacterium
PAPVGSEGG

SEQ ID NO: 1110367 - protein, 22 aa, Mycobacterium
PAQAPPPAPADGAPHLPVPGPV

SEQ ID NO: 1110368 - protein, 4 aa, Mycobacterium
PAQG

SEQ ID NO: 1110369 - protein, 10 aa, Mycobacterium
PAQPERSGLS

SEQ ID NO: 1110370 - protein, 10 aa, Mycobacterium
PAQQAGKVAE

SEQ ID NO: 1110371 - protein, 16 aa, Mycobacterium
PAQYGGRDDEPVPADA

SEQ ID NO: 1110372 - protein, 16 aa, Mycobacterium
PARPAASPRCADRTST

SEQ ID NO: 1110373 - protein, 5 aa, Mycobacterium
PARPP

SEQ ID NO: 1110374 - protein, 7 aa, Mycobacterium
PARRATA

SEQ ID NO: 1110375 - protein, 5 aa, Mycobacterium
PARRR

SEQ ID NO: 1110376 - protein, 16 aa, Mycobacterium
PARRVTPAVTAPPRPV

SEQ ID NO: 1110377 - protein, 12 aa, Mycobacterium
PASRESAYPLGG

SEQ ID NO: 1110378 - protein, 8 aa, Mycobacterium
PASRGGKL

SEQ ID NO: 1110379 - protein, 12 aa, Mycobacterium
PATAAGARATAA

SEQ ID NO: 1110380 - protein, 19 aa, Mycobacterium
PATEATAASPAAAAPPVPR

SEQ ID NO: 1110381 - protein, 6 aa, Mycobacterium
PATFTT

SEQ ID NO: 1110382 - protein, 4 aa, Mycobacterium
PATG

SEQ ID NO: 1110383 - protein, 8 aa, Mycobacterium
PATGATSV

SEQ ID NO: 1110384 - protein, 8 aa, Mycobacterium
PATPTGSW

SEQ ID NO: 1110385 - protein, 21 aa, Mycobacterium
PATPTVRQEVSRQSRCSRPAS

SEQ ID NO: 1110386 - protein, 8 aa, Mycobacterium
PATRPSLR

SEQ ID NO: 1110387 - protein, 6 aa, Mycobacterium
PATTPV

SEQ ID NO: 1110388 - protein, 5 aa, Mycobacterium
PATVG

SEQ ID NO: 1110389 - protein, 21 aa, Mycobacterium
PAVDAPGTPPMGTPPPPPKSA

SEQ ID NO: 1110390 - protein, 9 aa, Mycobacterium
PAVDPDASA

SEQ ID NO: 1110391 - protein, 4 aa, Mycobacterium
PAVH

SEQ ID NO: 1110392 - protein, 11 aa, Mycobacterium
PAVPSLPAETV

SEQ ID NO: 1110393 - protein, 9 aa, Mycobacterium
PAVRPASTF

SEQ ID NO: 1110394 - protein, 7 aa, Mycobacterium
PAVSGSR

SEQ ID NO: 1110395 - protein, 9 aa, Mycobacterium
PAYEEQHRQ

SEQ ID NO: 1110396 - protein, 8 aa, Mycobacterium
PAYESARR

SEQ ID NO: 1110397 - protein, 8 aa, Mycobacterium
PCAQPGKA

SEQ ID NO: 1110398 - protein, 7 aa, Mycobacterium
PCPRGTA

SEQ ID NO: 1110399 - protein, 9 aa, Mycobacterium
PDAAPSPHD

SEQ ID NO: 1110400 - protein, 22 aa, Mycobacterium
PDAARDTDLPDELDALPGYEGS

SEQ ID NO: 1110401 - protein, 10 aa, Mycobacterium
PDAASETVQQ

SEQ ID NO: 1110402 - protein, 10 aa, Mycobacterium
PDADNPPDSA

SEQ ID NO: 1110403 - protein, 7 aa, Mycobacterium
PDAERGQ

SEQ ID NO: 1110404 - protein, 7 aa, Mycobacterium
PDAGPAS

SEQ ID NO: 1110405 - protein, 8 aa, Mycobacterium
PDAGTAGQ

SEQ ID NO: 1110406 - protein, 33 aa, Mycobacterium
PDAPPTAVPPTAAPPTGTSGVPPTSKPRPEFQD

SEQ ID NO: 1110407 - protein, 8 aa, Mycobacterium
PDARLGEH

SEQ ID NO: 1110408 - protein, 11 aa, Mycobacterium
PDATGVPVDTP

SEQ ID NO: 1110409 - protein, 14 aa, Mycobacterium
PDAVPTRRRWFRRR

SEQ ID NO: 1110410 - protein, 10 aa, Mycobacterium
PDAVTGPLTA

SEQ ID NO: 1110411 - protein, 7 aa, Mycobacterium
PDCGPNR

SEQ ID NO: 1110412 - protein, 14 aa, Mycobacterium
PDCPGNRDTQPTKD

SEQ ID NO: 1110413 - protein, 7 aa, Mycobacterium
PDDADGL

SEQ ID NO: 1110414 - protein, 7 aa, Mycobacterium
PDDEREE

SEQ ID NO: 1110415 - protein, 4 aa, Mycobacterium
PDDP

SEQ ID NO: 1110416 - protein, 24 aa, Mycobacterium
PDDPDDRPKPDDGYGEGRPEGVPS

SEQ ID NO: 1110417 - protein, 5 aa, Mycobacterium
PDDPY

SEQ ID NO: 1110418 - protein, 9 aa, Mycobacterium
PDDRGLGPS

SEQ ID NO: 1110419 - protein, 10 aa, Mycobacterium
PDEPRRPANR

SEQ ID NO: 1110420 - protein, 77 aa, Mycobacterium
PDEPTPVEEQPGEPEPEPEQATPTNGAVDEAASVEPDGELVEPAEDTVTAEDENGETEPEAESAIEAEPELEDDEYA

SEQ ID NO: 1110421 - protein, 4 aa, Mycobacterium
PDEV

SEQ ID NO: 1110422 - protein, 12 aa, Mycobacterium
PDFGSGKPSAAS

SEQ ID NO: 1110423 - protein, 5 aa, Mycobacterium
PDGAA

SEQ ID NO: 1110424 - protein, 6 aa, Mycobacterium
PDGATA

SEQ ID NO: 1110425 - protein, 19 aa, Mycobacterium
PDGDRAAPPDERPESGTGS

SEQ ID NO: 1110426 - protein, 7 aa, Mycobacterium
PDGEEFE

SEQ ID NO: 1110427 - protein, 5 aa, Mycobacterium
PDGGF

SEQ ID NO: 1110428 - protein, 16 aa, Mycobacterium
PDGGSYNEGTPQRESY

SEQ ID NO: 1110429 - protein, 4 aa, Mycobacterium
PDGL

SEQ ID NO: 1110430 - protein, 7 aa, Mycobacterium
PDGPIQD

SEQ ID NO: 1110431 - protein, 6 aa, Mycobacterium
PDGREI

SEQ ID NO: 1110432 - protein, 13 aa, Mycobacterium
PDGSQPATRKRNP

SEQ ID NO: 1110433 - protein, 13 aa, Mycobacterium
PDGTGRGGNNYAG

SEQ ID NO: 1110434 - protein, 7 aa, Mycobacterium
PDGTGRI

SEQ ID NO: 1110435 - protein, 27 aa, Mycobacterium
PDGWQANSGSRKGIEGGRTDPVTGQPV

SEQ ID NO: 1110436 - protein, 17 aa, Mycobacterium
PDHDDHPSTRNTDGSGV

SEQ ID NO: 1110437 - protein, 6 aa, Mycobacterium
PDIGPR

SEQ ID NO: 1110438 - protein, 12 aa, Mycobacterium
PDIGTPEEGAPD

SEQ ID NO: 1110439 - protein, 8 aa, Mycobacterium
PDISSQLP

SEQ ID NO: 1110440 - protein, 9 aa, Mycobacterium
PDKATGLDS

SEQ ID NO: 1110441 - protein, 6 aa, Mycobacterium
PDKIST

SEQ ID NO: 1110442 - protein, 6 aa, Mycobacterium
PDLGQH

SEQ ID NO: 1110443 - protein, 4 aa, Mycobacterium
PDLP

SEQ ID NO: 1110444 - protein, 4 aa, Mycobacterium
PDLS

SEQ ID NO: 1110445 - protein, 10 aa, Mycobacterium
PDLSANQDAD

SEQ ID NO: 1110446 - protein, 6 aa, Mycobacterium
PDLSGG

SEQ ID NO: 1110447 - protein, 5 aa, Mycobacterium
PDNND

SEQ ID NO: 1110448 - protein, 4 aa, Mycobacterium
PDPA

SEQ ID NO: 1110449 - protein, 42 aa, Mycobacterium
PDPETDTADGAQDAPDEASLGAPDTPPQEQPPAEPRRPSRLG

SEQ ID NO: 1110450 - protein, 4 aa, Mycobacterium
PDPI

SEQ ID NO: 1110451 - protein, 10 aa, Mycobacterium
PDPPTPAPVN

SEQ ID NO: 1110452 - protein, 11 aa, Mycobacterium
PDQDLRSPRSL

SEQ ID NO: 1110453 - protein, 4 aa, Mycobacterium
PDQP

SEQ ID NO: 1110454 - protein, 8 aa, Mycobacterium
PDRDAEGD

SEQ ID NO: 1110455 - protein, 11 aa, Mycobacterium
PDRDDGTGSGV

SEQ ID NO: 1110456 - protein, 4 aa, Mycobacterium
PDRF

SEQ ID NO: 1110457 - protein, 9 aa, Mycobacterium
PDRGHADLN

SEQ ID NO: 1110458 - protein, 4 aa, Mycobacterium
PDRH

SEQ ID NO: 1110459 - protein, 8 aa, Mycobacterium
PDRTPDAA

SEQ ID NO: 1110460 - protein, 13 aa, Mycobacterium
PDSARASITPDGG

SEQ ID NO: 1110461 - protein, 7 aa, Mycobacterium
PDSASGD

SEQ ID NO: 1110462 - protein, 5 aa, Mycobacterium
PDSDG

SEQ ID NO: 1110463 - protein, 7 aa, Mycobacterium
PDSGGQE

SEQ ID NO: 1110464 - protein, 8 aa, Mycobacterium
PDSRGCGQ

SEQ ID NO: 1110465 - protein, 9 aa, Mycobacterium
PDSTAETVQ

SEQ ID NO: 1110466 - protein, 43 aa, Mycobacterium
PDSTSDPVASRTSTSAAPTTTSRGSTTRTRTSTSTPPPTESYD

SEQ ID NO: 1110467 - protein, 8 aa, Mycobacterium
PDSVAPAV

SEQ ID NO: 1110468 - protein, 7 aa, Mycobacterium
PDTASGF

SEQ ID NO: 1110469 - protein, 71 aa, Mycobacterium
PDTATPATPPPVPPVKKAAARKAAPSKKATPAKKVPAKKVPAKKAPVKKAAAKKAAPTKAAPTKEAPPVQA

SEQ ID NO: 1110470 - protein, 15 aa, Mycobacterium
PDTATRLTDSGAEEV

SEQ ID NO: 1110471 - protein, 6 aa, Mycobacterium
PDTCGP

SEQ ID NO: 1110472 - protein, 7 aa, Mycobacterium
PDTEAPA

SEQ ID NO: 1110473 - protein, 7 aa, Mycobacterium
PDTGGRA

SEQ ID NO: 1110474 - protein, 69 aa, Mycobacterium
PDTRERRTAPKGRPTPKRDAAKRRGPVAPAPLTAAEARRRRKELRGPKLSKEERKAEKLERRASMAERR

SEQ ID NO: 1110475 - protein, 11 aa, Mycobacterium
PDTSADQTTAA

SEQ ID NO: 1110476 - protein, 7 aa, Mycobacterium
PDVASQV

SEQ ID NO: 1110477 - protein, 6 aa, Mycobacterium
PDVDPA

SEQ ID NO: 1110478 - protein, 7 aa, Mycobacterium
PDYGPPT

SEQ ID NO: 1110479 - protein, 8 aa, Mycobacterium
PDYPSTGA

SEQ ID NO: 1110480 - protein, 7 aa, Mycobacterium
PDYPTAY

SEQ ID NO: 1110481 - protein, 14 aa, Mycobacterium
PEAGRTDDVDPVTA

SEQ ID NO: 1110482 - protein, 14 aa, Mycobacterium
PEAGRTDEVDPVTA

SEQ ID NO: 1110483 - protein, 5 aa, Mycobacterium
PEAGS

SEQ ID NO: 1110484 - protein, 11 aa, Mycobacterium
PEAGSSLISPQ

SEQ ID NO: 1110485 - protein, 6 aa, Mycobacterium
PEATDD

SEQ ID NO: 1110486 - protein, 7 aa, Mycobacterium
PEATDDE

SEQ ID NO: 1110487 - protein, 7 aa, Mycobacterium
PEDATGP

SEQ ID NO: 1110488 - protein, 5 aa, Mycobacterium
PEDEA

SEQ ID NO: 1110489 - protein, 6 aa, Mycobacterium
PEDERA

SEQ ID NO: 1110490 - protein, 10 aa, Mycobacterium
PEDLGERARE

SEQ ID NO: 1110491 - protein, 10 aa, Mycobacterium
PEDPKGQLQA

SEQ ID NO: 1110492 - protein, 6 aa, Mycobacterium
PEEHTR

SEQ ID NO: 1110493 - protein, 7 aa, Mycobacterium
PEFASAT

SEQ ID NO: 1110494 - protein, 4 aa, Mycobacterium
PEFT

SEQ ID NO: 1110495 - protein, 12 aa, Mycobacterium
PEGDGMPQTSDD

SEQ ID NO: 1110496 - protein, 6 aa, Mycobacterium
PEGPPL

SEQ ID NO: 1110497 - protein, 13 aa, Mycobacterium
PEGQDFPRTASGK

SEQ ID NO: 1110498 - protein, 32 aa, Mycobacterium
PEGTAEAVSTPSPARDEPPHEPDASATHRPGG

SEQ ID NO: 1110499 - protein, 6 aa, Mycobacterium
PEGTPV

SEQ ID NO: 1110500 - protein, 8 aa, Mycobacterium
PEHANGDH

SEQ ID NO: 1110501 - protein, 9 aa, Mycobacterium
PEHSSAHPN

SEQ ID NO: 1110502 - protein, 5 aa, Mycobacterium
PEIGA

SEQ ID NO: 1110503 - protein, 9 aa, Mycobacterium
PEKTGTQAD

SEQ ID NO: 1110504 - protein, 6 aa, Mycobacterium
PEKVNN

SEQ ID NO: 1110505 - protein, 9 aa, Mycobacterium
PELAGGSAW

SEQ ID NO: 1110506 - protein, 6 aa, Mycobacterium
PELARG

SEQ ID NO: 1110507 - protein, 13 aa, Mycobacterium
PELATEEGYRPTL

SEQ ID NO: 1110508 - protein, 13 aa, Mycobacterium
PEMTDPANLFTAL

SEQ ID NO: 1110509 - protein, 6 aa, Mycobacterium
PENHQP

SEQ ID NO: 1110510 - protein, 14 aa, Mycobacterium
PENSAWPEASPGRL

SEQ ID NO: 1110511 - protein, 10 aa, Mycobacterium
PENVADGEDI

SEQ ID NO: 1110512 - protein, 5 aa, Mycobacterium
PEPAR

SEQ ID NO: 1110513 - protein, 18 aa, Mycobacterium
PEPEGVPVNETPPPTQKA

SEQ ID NO: 1110514 - protein, 11 aa, Mycobacterium
PEPPARPAAEP

SEQ ID NO: 1110515 - protein, 8 aa, Mycobacterium
PEPPVLPP

SEQ ID NO: 1110516 - protein, 7 aa, Mycobacterium
PEPPYPL

SEQ ID NO: 1110517 - protein, 6 aa, Mycobacterium
PEPSRR

SEQ ID NO: 1110518 - protein, 12 aa, Mycobacterium
PEQDSAAPDEQW

SEQ ID NO: 1110519 - protein, 10 aa, Mycobacterium
PEQPSGQRLA

SEQ ID NO: 1110520 - protein, 5 aa, Mycobacterium
PERAR

SEQ ID NO: 1110521 - protein, 4 aa, Mycobacterium
PERL

SEQ ID NO: 1110522 - protein, 8 aa, Mycobacterium
PERLGPKG

SEQ ID NO: 1110523 - protein, 9 aa, Mycobacterium
PERNPDGAQ

SEQ ID NO: 1110524 - protein, 30 aa, Mycobacterium
PERPQPARRGNANRDADPDNDDPDDDTTLR

SEQ ID NO: 1110525 - protein, 6 aa, Mycobacterium
PERQGA

SEQ ID NO: 1110526 - protein, 4 aa, Mycobacterium
PERV

SEQ ID NO: 1110527 - protein, 8 aa, Mycobacterium
PESDDYHE

SEQ ID NO: 1110528 - protein, 5 aa, Mycobacterium
PESGG

SEQ ID NO: 1110529 - protein, 8 aa, Mycobacterium
PESGWASP

SEQ ID NO: 1110530 - protein, 5 aa, Mycobacterium
PESLH

SEQ ID NO: 1110531 - protein, 4 aa, Mycobacterium
PESV

SEQ ID NO: 1110532 - protein, 5 aa, Mycobacterium
PETAS

SEQ ID NO: 1110533 - protein, 11 aa, Mycobacterium
PETGPGDRHDK

SEQ ID NO: 1110534 - protein, 13 aa, Mycobacterium
PETIGTDLSTAQS

SEQ ID NO: 1110535 - protein, 13 aa, Mycobacterium
PETPTQAESDTAV

SEQ ID NO: 1110536 - protein, 4 aa, Mycobacterium
PETT

SEQ ID NO: 1110537 - protein, 4 aa, Mycobacterium
PEVG

SEQ ID NO: 1110538 - protein, 15 aa, Mycobacterium
PEVGAERQDLRQYPG

SEQ ID NO: 1110539 - protein, 39 aa, Mycobacterium
PEVGESLPGTKGTRPVIDPGTVSEGLVPGSGVDLPEKGI

SEQ ID NO: 1110540 - protein, 13 aa, Mycobacterium
PEVQASIGTPSEI

SEQ ID NO: 1110541 - protein, 12 aa, Mycobacterium
PEWSPSTPVSSN

SEQ ID NO: 1110542 - protein, 13 aa, Mycobacterium
PFEDRKEPGSVGC

SEQ ID NO: 1110543 - protein, 5 aa, Mycobacterium
PFGDE

SEQ ID NO: 1110544 - protein, 27 aa, Mycobacterium
PFGPGQPGMQTPQQTQPGSPATTAPAR

SEQ ID NO: 1110545 - protein, 11 aa, Mycobacterium
PFPARLGPKGN

SEQ ID NO: 1110546 - protein, 8 aa, Mycobacterium
PFPDEPPR

SEQ ID NO: 1110547 - protein, 5 aa, Mycobacterium
PFPSP

SEQ ID NO: 1110548 - protein, 14 aa, Mycobacterium
PFSDDSDAEPDAEF

SEQ ID NO: 1110549 - protein, 5 aa, Mycobacterium
PFSPE

SEQ ID NO: 1110550 - protein, 4 aa, Mycobacterium
PGAA

SEQ ID NO: 1110551 - protein, 7 aa, Mycobacterium
PGAAGTV

SEQ ID NO: 1110552 - protein, 9 aa, Mycobacterium
PGAESPEQM

SEQ ID NO: 1110553 - protein, 6 aa, Mycobacterium
PGAGAI

SEQ ID NO: 1110554 - protein, 18 aa, Mycobacterium
PGALGGKTGFTDDAGQTF

SEQ ID NO: 1110555 - protein, 8 aa, Mycobacterium
PGAMDGDR

SEQ ID NO: 1110556 - protein, 5 aa, Mycobacterium
PGAPE

SEQ ID NO: 1110557 - protein, 8 aa, Mycobacterium
PGAPQRRA

SEQ ID NO: 1110558 - protein, 9 aa, Mycobacterium
PGARGTKDA

SEQ ID NO: 1110559 - protein, 4 aa, Mycobacterium
PGAS

SEQ ID NO: 1110560 - protein, 5 aa, Mycobacterium
PGASI

SEQ ID NO: 1110561 - protein, 4 aa, Mycobacterium
PGAT

SEQ ID NO: 1110562 - protein, 7 aa, Mycobacterium
PGDAANA

SEQ ID NO: 1110563 - protein, 6 aa, Mycobacterium
PGDDPR

SEQ ID NO: 1110564 - protein, 14 aa, Mycobacterium
PGDDTSEARSLGQT

SEQ ID NO: 1110565 - protein, 8 aa, Mycobacterium
PGDGDGVV

SEQ ID NO: 1110566 - protein, 8 aa, Mycobacterium
PGDGTGVV

SEQ ID NO: 1110567 - protein, 7 aa, Mycobacterium
PGDKAAN

SEQ ID NO: 1110568 - protein, 4 aa, Mycobacterium
PGDQ

SEQ ID NO: 1110569 - protein, 7 aa, Mycobacterium
PGDREEL

SEQ ID NO: 1110570 - protein, 7 aa, Mycobacterium
PGDSAVG

SEQ ID NO: 1110571 - protein, 14 aa, Mycobacterium
PGDSQPGHSSGQSD

SEQ ID NO: 1110572 - protein, 7 aa, Mycobacterium
PGDTGVH

SEQ ID NO: 1110573 - protein, 5 aa, Mycobacterium
PGDYE

SEQ ID NO: 1110574 - protein, 7 aa, Mycobacterium
PGELTNP

SEQ ID NO: 1110575 - protein, 4 aa, Mycobacterium
PGEP

SEQ ID NO: 1110576 - protein, 25 aa, Mycobacterium
PGEPPDEAAPPPAPPHAKPDAYAES

SEQ ID NO: 1110577 - protein, 10 aa, Mycobacterium
PGESYSGQDS

SEQ ID NO: 1110578 - protein, 9 aa, Mycobacterium
PGETGHDYA

SEQ ID NO: 1110579 - protein, 10 aa, Mycobacterium
PGFGGNAVTA

SEQ ID NO: 1110580 - protein, 7 aa, Mycobacterium
PGFGGNR

SEQ ID NO: 1110581 - protein, 7 aa, Mycobacterium
PGFQPPR

SEQ ID NO: 1110582 - protein, 14 aa, Mycobacterium
PGGDGLDGNITGPD

SEQ ID NO: 1110583 - protein, 7 aa, Mycobacterium
PGGELAA

SEQ ID NO: 1110584 - protein, 12 aa, Mycobacterium
PGGGEFTATPAR

SEQ ID NO: 1110585 - protein, 4 aa, Mycobacterium
PGGK

SEQ ID NO: 1110586 - protein, 21 aa, Mycobacterium
PGGKTAFYGPPSQIGPSMGTT

SEQ ID NO: 1110587 - protein, 5 aa, Mycobacterium
PGGLA

SEQ ID NO: 1110588 - protein, 8 aa, Mycobacterium
PGGRAPSW

SEQ ID NO: 1110589 - protein, 6 aa, Mycobacterium
PGGTTD

SEQ ID NO: 1110590 - protein, 4 aa, Mycobacterium
PGGV

SEQ ID NO: 1110591 - protein, 5 aa, Mycobacterium
PGGYS

SEQ ID NO: 1110592 - protein, 5 aa, Mycobacterium
PGHTD

SEQ ID NO: 1110593 - protein, 5 aa, Mycobacterium
PGIDA

SEQ ID NO: 1110594 - protein, 17 aa, Mycobacterium
PGIPEGDKSTFWGSTLF

SEQ ID NO: 1110595 - protein, 5 aa, Mycobacterium
PGKQY

SEQ ID NO: 1110596 - protein, 5 aa, Mycobacterium
PGLAG

SEQ ID NO: 1110597 - protein, 6 aa, Mycobacterium
PGLAPV

SEQ ID NO: 1110598 - protein, 7 aa, Mycobacterium
PGLGTSD

SEQ ID NO: 1110599 - protein, 6 aa, Mycobacterium
PGLPSQ

SEQ ID NO: 1110600 - protein, 11 aa, Mycobacterium
PGLQTNPTALD

SEQ ID NO: 1110601 - protein, 12 aa, Mycobacterium
PGMRYKSGGPFA

SEQ ID NO: 1110602 - protein, 11 aa, Mycobacterium
PGNEEAAATVA

SEQ ID NO: 1110603 - protein, 5 aa, Mycobacterium
PGNGR

SEQ ID NO: 1110604 - protein, 12 aa, Mycobacterium
PGNPPFLPPGSQ

SEQ ID NO: 1110605 - protein, 8 aa, Mycobacterium
PGNRQNRA

SEQ ID NO: 1110606 - protein, 4 aa, Mycobacterium
PGPA

SEQ ID NO: 1110607 - protein, 27 aa, Mycobacterium
PGPALDEAKGAVDAAAREAGRDPSEIG

SEQ ID NO: 1110608 - protein, 7 aa, Mycobacterium
PGPALTR

SEQ ID NO: 1110609 - protein, 18 aa, Mycobacterium
PGPAPGPIPYPGAPPYGA

SEQ ID NO: 1110610 - protein, 17 aa, Mycobacterium
PGPASERQTRPATTRFA

SEQ ID NO: 1110611 - protein, 7 aa, Mycobacterium
PGPDDGT

SEQ ID NO: 1110612 - protein, 10 aa, Mycobacterium
PGPDGRPTAT

SEQ ID NO: 1110613 - protein, 12 aa, Mycobacterium
PGPHRGAVGHRG

SEQ ID NO: 1110614 - protein, 6 aa, Mycobacterium
PGPLAG

SEQ ID NO: 1110615 - protein, 9 aa, Mycobacterium
PGPNPGQTW

SEQ ID NO: 1110616 - protein, 4 aa, Mycobacterium
PGPT

SEQ ID NO: 1110617 - protein, 5 aa, Mycobacterium
PGPVA

SEQ ID NO: 1110618 - protein, 15 aa, Mycobacterium
PGPVKRAARLLPGLH

SEQ ID NO: 1110619 - protein, 11 aa, Mycobacterium
PGQGVTPDGPG

SEQ ID NO: 1110620 - protein, 9 aa, Mycobacterium
PGQISPDTK

SEQ ID NO: 1110621 - protein, 4 aa, Mycobacterium
PGQS

SEQ ID NO: 1110622 - protein, 4 aa, Mycobacterium
PGRG

SEQ ID NO: 1110623 - protein, 12 aa, Mycobacterium
PGRGGHEDDKQT

SEQ ID NO: 1110624 - protein, 4 aa, Mycobacterium
PGRH

SEQ ID NO: 1110625 - protein, 12 aa, Mycobacterium
PGRPAEAPPGSI

SEQ ID NO: 1110626 - protein, 6 aa, Mycobacterium
PGRPYR

SEQ ID NO: 1110627 - protein, 4 aa, Mycobacterium
PGRS

SEQ ID NO: 1110628 - protein, 15 aa, Mycobacterium
PGSAERGRDLLARLT

SEQ ID NO: 1110629 - protein, 8 aa, Mycobacterium
PGSDERCA

SEQ ID NO: 1110630 - protein, 5 aa, Mycobacterium
PGSDH

SEQ ID NO: 1110631 - protein, 16 aa, Mycobacterium
PGSEYGPDAAPPSAAR

SEQ ID NO: 1110632 - protein, 7 aa, Mycobacterium
PGSGATA

SEQ ID NO: 1110633 - protein, 8 aa, Mycobacterium
PGSGATAV

SEQ ID NO: 1110634 - protein, 5 aa, Mycobacterium
PGSGL

SEQ ID NO: 1110635 - protein, 7 aa, Mycobacterium
PGSGSQW

SEQ ID NO: 1110636 - protein, 10 aa, Mycobacterium
PGSGVDSPTT

SEQ ID NO: 1110637 - protein, 7 aa, Mycobacterium
PGSGYRV

SEQ ID NO: 1110638 - protein, 9 aa, Mycobacterium
PGSLSPGSR

SEQ ID NO: 1110639 - protein, 9 aa, Mycobacterium
PGSPAYTYP

SEQ ID NO: 1110640 - protein, 9 aa, Mycobacterium
PGSPDVAEF

SEQ ID NO: 1110641 - protein, 8 aa, Mycobacterium
PGSPGAAE

SEQ ID NO: 1110642 - protein, 6 aa, Mycobacterium
PGSVPR

SEQ ID NO: 1110643 - protein, 20 aa, Mycobacterium
PGTEEDAAQEGTKVGVGPGG

SEQ ID NO: 1110644 - protein, 6 aa, Mycobacterium
PGTPGV

SEQ ID NO: 1110645 - protein, 14 aa, Mycobacterium
PGTRRQWERDPHDP

SEQ ID NO: 1110646 - protein, 4 aa, Mycobacterium
PGTV

SEQ ID NO: 1110647 - protein, 11 aa, Mycobacterium
PGVGGHGQPHL

SEQ ID NO: 1110648 - protein, 13 aa, Mycobacterium
PGVLTPADAAPAR

SEQ ID NO: 1110649 - protein, 4 aa, Mycobacterium
PGWD

SEQ ID NO: 1110650 - protein, 18 aa, Mycobacterium
PGWEPSTAPGARAAAHAT

SEQ ID NO: 1110651 - protein, 7 aa, Mycobacterium
PGWPPPW

SEQ ID NO: 1110652 - protein, 7 aa, Mycobacterium
PGWRPQR

SEQ ID NO: 1110653 - protein, 11 aa, Mycobacterium
PGYKTSYDDTR

SEQ ID NO: 1110654 - protein, 6 aa, Mycobacterium
PHADKP

SEQ ID NO: 1110655 - protein, 27 aa, Mycobacterium
PHANPESASAEAGGGDTPVMPSTGRQT

SEQ ID NO: 1110656 - protein, 5 aa, Mycobacterium
PHAPG

SEQ ID NO: 1110657 - protein, 13 aa, Mycobacterium
PHGTNEAKDTIRR

SEQ ID NO: 1110658 - protein, 4 aa, Mycobacterium
PHPD

SEQ ID NO: 1110659 - protein, 6 aa, Mycobacterium
PHQRGG

SEQ ID NO: 1110660 - protein, 4 aa, Mycobacterium
PHRP

SEQ ID NO: 1110661 - protein, 9 aa, Mycobacterium
PHTARTRGP

SEQ ID NO: 1110662 - protein, 5 aa, Mycobacterium
PIATR

SEQ ID NO: 1110663 - protein, 7 aa, Mycobacterium
PICSPSQ

SEQ ID NO: 1110664 - protein, 10 aa, Mycobacterium
PIEPPAAKPP

SEQ ID NO: 1110665 - protein, 8 aa, Mycobacterium
PIERTQPA

SEQ ID NO: 1110666 - protein, 12 aa, Mycobacterium
PIGASDSESGAD

SEQ ID NO: 1110667 - protein, 13 aa, Mycobacterium
PILDTQSDTSDAI

SEQ ID NO: 1110668 - protein, 19 aa, Mycobacterium
PIPGRAGAARTPESRETTD

SEQ ID NO: 1110669 - protein, 12 aa, Mycobacterium
PIPPAGPVSELS

SEQ ID NO: 1110670 - protein, 5 aa, Mycobacterium
PIPSD

SEQ ID NO: 1110671 - protein, 11 aa, Mycobacterium
PIPYPGAPAYG

SEQ ID NO: 1110672 - protein, 4 aa, Mycobacterium
PIRL

SEQ ID NO: 1110673 - protein, 8 aa, Mycobacterium
PIRSTGRV

SEQ ID NO: 1110674 - protein, 6 aa, Mycobacterium
PISGNR

SEQ ID NO: 1110675 - protein, 38 aa, Mycobacterium
PISTRPEVGADDSVTAPLATRGRRAEAAAEPSGADDPW

SEQ ID NO: 1110676 - protein, 5 aa, Mycobacterium
PITEA

SEQ ID NO: 1110677 - protein, 11 aa, Mycobacterium
PKADPTGGLTA

SEQ ID NO: 1110678 - protein, 4 aa, Mycobacterium
PKAR

SEQ ID NO: 1110679 - protein, 10 aa, Mycobacterium
PKDAEASIAS

SEQ ID NO: 1110680 - protein, 9 aa, Mycobacterium
PKDQAPDPV

SEQ ID NO: 1110681 - protein, 5 aa, Mycobacterium
PKDRI

SEQ ID NO: 1110682 - protein, 4 aa, Mycobacterium
PKEV

SEQ ID NO: 1110683 - protein, 6 aa, Mycobacterium
PKGGAV

SEQ ID NO: 1110684 - protein, 11 aa, Mycobacterium
PKGGTITHTEP

SEQ ID NO: 1110685 - protein, 21 aa, Mycobacterium
PKGQQGGYAQFGTGAAGYGAQ

SEQ ID NO: 1110686 - protein, 21 aa, Mycobacterium
PKGREDPSSLKGNQDAEARVE

SEQ ID NO: 1110687 - protein, 8 aa, Mycobacterium
PKHGTPHH

SEQ ID NO: 1110688 - protein, 14 aa, Mycobacterium
PKIPEASQIEPATG

SEQ ID NO: 1110689 - protein, 8 aa, Mycobacterium
PKLSPAEA

SEQ ID NO: 1110690 - protein, 7 aa, Mycobacterium
PKPAPAI

SEQ ID NO: 1110691 - protein, 15 aa, Mycobacterium
PKPGDDGLPLANTGR

SEQ ID NO: 1110692 - protein, 8 aa, Mycobacterium
PKPGDIRT

SEQ ID NO: 1110693 - protein, 10 aa, Mycobacterium
PKPGQTIPGV

SEQ ID NO: 1110694 - protein, 9 aa, Mycobacterium
PKPSPKIPE

SEQ ID NO: 1110695 - protein, 8 aa, Mycobacterium
PKQAPNAV

SEQ ID NO: 1110696 - protein, 4 aa, Mycobacterium
PKQL

SEQ ID NO: 1110697 - protein, 20 aa, Mycobacterium
PKRRRTRAQNRARRIQEERR

SEQ ID NO: 1110698 - protein, 16 aa, Mycobacterium
PKSASGKILRKDLRNG

SEQ ID NO: 1110699 - protein, 8 aa, Mycobacterium
PKSSRGAR

SEQ ID NO: 1110700 - protein, 4 aa, Mycobacterium
PKTG

SEQ ID NO: 1110701 - protein, 24 aa, Mycobacterium
PKVKNSADDDDEASAGPSDGENAE

SEQ ID NO: 1110702 - protein, 7 aa, Mycobacterium
PKVTEVE

SEQ ID NO: 1110703 - protein, 13 aa, Mycobacterium
PLADQAAANELGT

SEQ ID NO: 1110704 - protein, 6 aa, Mycobacterium
PLADRT

SEQ ID NO: 1110705 - protein, 8 aa, Mycobacterium
PLADTQAR

SEQ ID NO: 1110706 - protein, 14 aa, Mycobacterium
PLAGREGLHPGSVG

SEQ ID NO: 1110707 - protein, 7 aa, Mycobacterium
PLAPPPT

SEQ ID NO: 1110708 - protein, 4 aa, Mycobacterium
PLAT

SEQ ID NO: 1110709 - protein, 26 aa, Mycobacterium
PLAVGPPRRRLTRRERAREERYRRRR

SEQ ID NO: 1110710 - protein, 11 aa, Mycobacterium
PLDEGERRTRQ

SEQ ID NO: 1110711 - protein, 9 aa, Mycobacterium
PLDVSPQQI

SEQ ID NO: 1110712 - protein, 13 aa, Mycobacterium
PLPAAPPPRRQPH

SEQ ID NO: 1110713 - protein, 6 aa, Mycobacterium
PLPAGQ

SEQ ID NO: 1110714 - protein, 5 aa, Mycobacterium
PLPAM

SEQ ID NO: 1110715 - protein, 32 aa, Mycobacterium
PLPAPAPGGPPPGPPAIAPPGIASTPDPDPSA

SEQ ID NO: 1110716 - protein, 32 aa, Mycobacterium
PLPAPPPGGPPPGPPAEAQPGQQSIPGPTPAP

SEQ ID NO: 1110717 - protein, 41 aa, Mycobacterium
PLPDGDPPAMPGLPPPSRESAESDPRPPQPRSAAPGAYADS

SEQ ID NO: 1110718 - protein, 6 aa, Mycobacterium
PLPDTV

SEQ ID NO: 1110719 - protein, 5 aa, Mycobacterium
PLPGA

SEQ ID NO: 1110720 - protein, 7 aa, Mycobacterium
PLPGPGC

SEQ ID NO: 1110721 - protein, 5 aa, Mycobacterium
PLPIP

SEQ ID NO: 1110722 - protein, 12 aa, Mycobacterium
PLPNMPNNTSGS

SEQ ID NO: 1110723 - protein, 4 aa, Mycobacterium
PLPP

SEQ ID NO: 1110724 - protein, 14 aa, Mycobacterium
PLPPARSRASRRLP

SEQ ID NO: 1110725 - protein, 7 aa, Mycobacterium
PLPPGTD

SEQ ID NO: 1110726 - protein, 5 aa, Mycobacterium
PLPPP

SEQ ID NO: 1110727 - protein, 20 aa, Mycobacterium
PLPPSAAYPAPAPRRPATRA

SEQ ID NO: 1110728 - protein, 10 aa, Mycobacterium
PLPPSALSTG

SEQ ID NO: 1110729 - protein, 7 aa, Mycobacterium
PLPQATT

SEQ ID NO: 1110730 - protein, 4 aa, Mycobacterium
PLPR

SEQ ID NO: 1110731 - protein, 16 aa, Mycobacterium
PLPRPQVAAPVVQVAA

SEQ ID NO: 1110732 - protein, 18 aa, Mycobacterium
PLPYQGGPGQPYYPPPRR

SEQ ID NO: 1110733 - protein, 4 aa, Mycobacterium
PLQA

SEQ ID NO: 1110734 - protein, 4 aa, Mycobacterium
PLQQ

SEQ ID NO: 1110735 - protein, 5 aa, Mycobacterium
PLQSR

SEQ ID NO: 1110736 - protein, 13 aa, Mycobacterium
PLQSSEATATMSR

SEQ ID NO: 1110737 - protein, 5 aa, Mycobacterium
PLRGQ

SEQ ID NO: 1110738 - protein, 6 aa, Mycobacterium
PLRGQS

SEQ ID NO: 1110739 - protein, 54 aa, Mycobacterium
PLRPTGKRSRRAGEAGDADKAPEADSSGSKDDDGSGPKAKKKTAKKPKDGPSRN

SEQ ID NO: 1110740 - protein, 50 aa, Mycobacterium
PLRPTGKRTRRAAVETDAESDATELTESSGTENGSGTKKKTAKKEPGRYP

SEQ ID NO: 1110741 - protein, 15 aa, Mycobacterium
PLRSRGTVAATAPVS

SEQ ID NO: 1110742 - protein, 6 aa, Mycobacterium
PLSDGV

SEQ ID NO: 1110743 - protein, 22 aa, Mycobacterium
PLSNRSSRHRADMAPGPTPLTP

SEQ ID NO: 1110744 - protein, 10 aa, Mycobacterium
PLSPAMPPEE

SEQ ID NO: 1110745 - protein, 14 aa, Mycobacterium
PLSPDPGAPLTLQA

SEQ ID NO: 1110746 - protein, 5 aa, Mycobacterium
PLSPT

SEQ ID NO: 1110747 - protein, 6 aa, Mycobacterium
PLSQQA

SEQ ID NO: 1110748 - protein, 10 aa, Mycobacterium
PLTARTSVTA

SEQ ID NO: 1110749 - protein, 18 aa, Mycobacterium
PMESITGTGGDPADDDAV

SEQ ID NO: 1110750 - protein, 4 aa, Mycobacterium
PMGP

SEQ ID NO: 1110751 - protein, 5 aa, Mycobacterium
PMPRR

SEQ ID NO: 1110752 - protein, 7 aa, Mycobacterium
PMRSPAN

SEQ ID NO: 1110753 - protein, 14 aa, Mycobacterium
PMTAPPKRPSRWSP

SEQ ID NO: 1110754 - protein, 15 aa, Mycobacterium
PMTAPPKRPSRWSPA

SEQ ID NO: 1110755 - protein, 10 aa, Mycobacterium
PMTPSRKVPP

SEQ ID NO: 1110756 - protein, 10 aa, Mycobacterium
PNAGQDALGP

SEQ ID NO: 1110757 - protein, 6 aa, Mycobacterium
PNAQFG

SEQ ID NO: 1110758 - protein, 8 aa, Mycobacterium
PNAQTDKR

SEQ ID NO: 1110759 - protein, 10 aa, Mycobacterium
PNEITAEPAV

SEQ ID NO: 1110760 - protein, 6 aa, Mycobacterium
PNEVGQ

SEQ ID NO: 1110761 - protein, 5 aa, Mycobacterium
PNFGD

SEQ ID NO: 1110762 - protein, 6 aa, Mycobacterium
PNFTPN

SEQ ID NO: 1110763 - protein, 6 aa, Mycobacterium
PNGAVK

SEQ ID NO: 1110764 - protein, 12 aa, Mycobacterium
PNGLSPDDEQTY

SEQ ID NO: 1110765 - protein, 8 aa, Mycobacterium
PNGYADAT

SEQ ID NO: 1110766 - protein, 8 aa, Mycobacterium
PNNERAHP

SEQ ID NO: 1110767 - protein, 7 aa, Mycobacterium
PNPEPAQ

SEQ ID NO: 1110768 - protein, 9 aa, Mycobacterium
PNPRTVPES

SEQ ID NO: 1110769 - protein, 24 aa, Mycobacterium
PNRARPAQPTETAAGRLKPVAARA

SEQ ID NO: 1110770 - protein, 5 aa, Mycobacterium
PNRDR

SEQ ID NO: 1110771 - protein, 7 aa, Mycobacterium
PNRSRRH

SEQ ID NO: 1110772 - protein, 18 aa, Mycobacterium
PNSDPAARIAGKNADPDL

SEQ ID NO: 1110773 - protein, 4 aa, Mycobacterium
PNSL

SEQ ID NO: 1110774 - protein, 8 aa, Mycobacterium
PNSPRIRQ

SEQ ID NO: 1110775 - protein, 15 aa, Mycobacterium
PPAAAQPDADPGPES

SEQ ID NO: 1110776 - protein, 12 aa, Mycobacterium
PPAAGADPRTGA

SEQ ID NO: 1110777 - protein, 24 aa, Mycobacterium
PPAASPHPDPAPTDTEDDRTTGRG

SEQ ID NO: 1110778 - protein, 6 aa, Mycobacterium
PPADAA

SEQ ID NO: 1110779 - protein, 7 aa, Mycobacterium
PPADAPT

SEQ ID NO: 1110780 - protein, 14 aa, Mycobacterium
PPADPSAQPLQPGQ

SEQ ID NO: 1110781 - protein, 8 aa, Mycobacterium
PPAKAHDH

SEQ ID NO: 1110782 - protein, 12 aa, Mycobacterium
PPANPSPDPLRA

SEQ ID NO: 1110783 - protein, 8 aa, Mycobacterium
PPAPDEFA

SEQ ID NO: 1110784 - protein, 77 aa, Mycobacterium
PPAPPSTTRPPAPSPRPAPAPTSTAPQTTGPSTTPRASGPAPAPETPRTVTTTAPSPASPAPVPPASPTPPPPPPTV

SEQ ID NO: 1110785 - protein, 13 aa, Mycobacterium
PPARHAAPSRPKL

SEQ ID NO: 1110786 - protein, 9 aa, Mycobacterium
PPASAIEPP

SEQ ID NO: 1110787 - protein, 5 aa, Mycobacterium
PPATV

SEQ ID NO: 1110788 - protein, 4 aa, Mycobacterium
PPAV

SEQ ID NO: 1110789 - protein, 6 aa, Mycobacterium
PPAVGQ

SEQ ID NO: 1110790 - protein, 22 aa, Mycobacterium
PPDAESARADAARAALPDGDQV

SEQ ID NO: 1110791 - protein, 6 aa, Mycobacterium
PPDGRS

SEQ ID NO: 1110792 - protein, 7 aa, Mycobacterium
PPDTGAK

SEQ ID NO: 1110793 - protein, 29 aa, Mycobacterium
PPEGTPLPPGAVRAGTPPVSEPGTPPFPV

SEQ ID NO: 1110794 - protein, 5 aa, Mycobacterium
PPEHA

SEQ ID NO: 1110795 - protein, 5 aa, Mycobacterium
PPEHT

SEQ ID NO: 1110796 - protein, 19 aa, Mycobacterium
PPEKAQQTSLRPGAEVQAS

SEQ ID NO: 1110797 - protein, 4 aa, Mycobacterium
PPEL

SEQ ID NO: 1110798 - protein, 8 aa, Mycobacterium
PPESLEEA

SEQ ID NO: 1110799 - protein, 8 aa, Mycobacterium
PPFQNSRP

SEQ ID NO: 1110800 - protein, 23 aa, Mycobacterium
PPGAAQPAAPPDELAEAKTNDPW

SEQ ID NO: 1110801 - protein, 6 aa, Mycobacterium
PPGADD

SEQ ID NO: 1110802 - protein, 7 aa, Mycobacterium
PPGDETA

SEQ ID NO: 1110803 - protein, 10 aa, Mycobacterium
PPGPTATADF

SEQ ID NO: 1110804 - protein, 6 aa, Mycobacterium
PPGQSG

SEQ ID NO: 1110805 - protein, 11 aa, Mycobacterium
PPGSFISPGGP

SEQ ID NO: 1110806 - protein, 8 aa, Mycobacterium
PPGSLEEA

SEQ ID NO: 1110807 - protein, 19 aa, Mycobacterium
PPGWTPEKTERLRPVLTAT

SEQ ID NO: 1110808 - protein, 21 aa, Mycobacterium
PPLGATYPGTLPPPVQYPKRR

SEQ ID NO: 1110809 - protein, 6 aa, Mycobacterium
PPLNPD

SEQ ID NO: 1110810 - protein, 13 aa, Mycobacterium
PPLPDAPDDYNGP

SEQ ID NO: 1110811 - protein, 6 aa, Mycobacterium
PPNAMQ

SEQ ID NO: 1110812 - protein, 21 aa, Mycobacterium
PPNIANAARTPAQWDERRDNR

SEQ ID NO: 1110813 - protein, 4 aa, Mycobacterium
PPNW

SEQ ID NO: 1110814 - protein, 33 aa, Mycobacterium
PPPGMPPPPVPGVPNPPPPYGTGIPPQSHPAPN

SEQ ID NO: 1110815 - protein, 6 aa, Mycobacterium
PPPGPY

SEQ ID NO: 1110816 - protein, 4 aa, Mycobacterium
PPPP

SEQ ID NO: 1110817 - protein, 84 aa, Mycobacterium
PPPPGGYPPPPPPGGYQPPPPPPSGGGYPPPPSGGFPPPQEGGYPPPQGPGGYPPPAGYGPPQGGFPPPAQGYPPVGGPPAYSV

SEQ ID NO: 1110818 - protein, 14 aa, Mycobacterium
PPPPPGPDHRPRNS

SEQ ID NO: 1110819 - protein, 63 aa, Mycobacterium
PPPPPSGWQGAPQAPAYPGYPPYQPHSQPGQPAPHGGAAAASPKEDPGHEGGGENGRSAPPSN

SEQ ID NO: 1110820 - protein, 6 aa, Mycobacterium
PPPQAA

SEQ ID NO: 1110821 - protein, 7 aa, Mycobacterium
PPPRPSI

SEQ ID NO: 1110822 - protein, 4 aa, Mycobacterium
PPPV

SEQ ID NO: 1110823 - protein, 18 aa, Mycobacterium
PPQEASDATLRDGSDIGV

SEQ ID NO: 1110824 - protein, 7 aa, Mycobacterium
PPQPSGV

SEQ ID NO: 1110825 - protein, 9 aa, Mycobacterium
PPQQRRNPT

SEQ ID NO: 1110826 - protein, 7 aa, Mycobacterium
PPRAGVS

SEQ ID NO: 1110827 - protein, 5 aa, Mycobacterium
PPRIP

SEQ ID NO: 1110828 - protein, 8 aa, Mycobacterium
PPRPGAAD

SEQ ID NO: 1110829 - protein, 7 aa, Mycobacterium
PPRRRTG

SEQ ID NO: 1110830 - protein, 27 aa, Mycobacterium
PPRSEASAVDDVEPGPASYSSGASGVL

SEQ ID NO: 1110831 - protein, 8 aa, Mycobacterium
PPSAFGRG

SEQ ID NO: 1110832 - protein, 8 aa, Mycobacterium
PPSEQATV

SEQ ID NO: 1110833 - protein, 6 aa, Mycobacterium
PPSEWQ

SEQ ID NO: 1110834 - protein, 8 aa, Mycobacterium
PPSGPKVS

SEQ ID NO: 1110835 - protein, 6 aa, Mycobacterium
PPSGVD

SEQ ID NO: 1110836 - protein, 7 aa, Mycobacterium
PPSITTG

SEQ ID NO: 1110837 - protein, 8 aa, Mycobacterium
PPSLESSA

SEQ ID NO: 1110838 - protein, 6 aa, Mycobacterium
PPSPDP

SEQ ID NO: 1110839 - protein, 8 aa, Mycobacterium
PPSPSGRL

SEQ ID NO: 1110840 - protein, 8 aa, Mycobacterium
PPSTDATV

SEQ ID NO: 1110841 - protein, 11 aa, Mycobacterium
PPSVNRAGYGD

SEQ ID NO: 1110842 - protein, 5 aa, Mycobacterium
PPSYS

SEQ ID NO: 1110843 - protein, 7 aa, Mycobacterium
PPTAVHT

SEQ ID NO: 1110844 - protein, 6 aa, Mycobacterium
PPTQQR

SEQ ID NO: 1110845 - protein, 5 aa, Mycobacterium
PPTRA

SEQ ID NO: 1110846 - protein, 13 aa, Mycobacterium
PPTSQRPSTELVD

SEQ ID NO: 1110847 - protein, 7 aa, Mycobacterium
PPVAGDA

SEQ ID NO: 1110848 - protein, 14 aa, Mycobacterium
PPVEPAVSQAPPTI

SEQ ID NO: 1110849 - protein, 5 aa, Mycobacterium
PPVER

SEQ ID NO: 1110850 - protein, 11 aa, Mycobacterium
PPVFGSDGRSA

SEQ ID NO: 1110851 - protein, 12 aa, Mycobacterium
PPVIGGNGTKHG

SEQ ID NO: 1110852 - protein, 13 aa, Mycobacterium
PPVIGGNGTKHGA

SEQ ID NO: 1110853 - protein, 8 aa, Mycobacterium
PPVTPTPT

SEQ ID NO: 1110854 - protein, 8 aa, Mycobacterium
PPWGPDAA

SEQ ID NO: 1110855 - protein, 14 aa, Mycobacterium
PPWPASTEQTIATA

SEQ ID NO: 1110856 - protein, 13 aa, Mycobacterium
PQAPAERTRDFKG

SEQ ID NO: 1110857 - protein, 5 aa, Mycobacterium
PQASG

SEQ ID NO: 1110858 - protein, 4 aa, Mycobacterium
PQAT

SEQ ID NO: 1110859 - protein, 6 aa, Mycobacterium
PQGATA

SEQ ID NO: 1110860 - protein, 10 aa, Mycobacterium
PQGDGGPVLK

SEQ ID NO: 1110861 - protein, 4 aa, Mycobacterium
PQGI

SEQ ID NO: 1110862 - protein, 5 aa, Mycobacterium
PQGPR

SEQ ID NO: 1110863 - protein, 5 aa, Mycobacterium
PQGPT

SEQ ID NO: 1110864 - protein, 5 aa, Mycobacterium
PQGSG

SEQ ID NO: 1110865 - protein, 7 aa, Mycobacterium
PQHPSTH

SEQ ID NO: 1110866 - protein, 6 aa, Mycobacterium
PQLGEG

SEQ ID NO: 1110867 - protein, 7 aa, Mycobacterium
PQLPGAP

SEQ ID NO: 1110868 - protein, 53 aa, Mycobacterium
PQMRSDDAATRQVASASDQAKAAVDAPAPEALPKAAPKPAAPPPPPEAPPAEA

SEQ ID NO: 1110869 - protein, 6 aa, Mycobacterium
PQNRAK

SEQ ID NO: 1110870 - protein, 5 aa, Mycobacterium
PQPAA

SEQ ID NO: 1110871 - protein, 24 aa, Mycobacterium
PQPAPEPGPVQPSPDDNRAQPPQV

SEQ ID NO: 1110872 - protein, 5 aa, Mycobacterium
PQPLS

SEQ ID NO: 1110873 - protein, 4 aa, Mycobacterium
PQPP

SEQ ID NO: 1110874 - protein, 7 aa, Mycobacterium
PQPPLGS

SEQ ID NO: 1110875 - protein, 8 aa, Mycobacterium
PQPPPLPA

SEQ ID NO: 1110876 - protein, 15 aa, Mycobacterium
PQPRPTQKRSRAGAL

SEQ ID NO: 1110877 - protein, 5 aa, Mycobacterium
PQPVS

SEQ ID NO: 1110878 - protein, 4 aa, Mycobacterium
PQRG

SEQ ID NO: 1110879 - protein, 10 aa, Mycobacterium
PQRPGAPSPF

SEQ ID NO: 1110880 - protein, 10 aa, Mycobacterium
PQRRPGASGI

SEQ ID NO: 1110881 - protein, 11 aa, Mycobacterium
PQRSRQSASAT

SEQ ID NO: 1110882 - protein, 8 aa, Mycobacterium
PQSDPSVV

SEQ ID NO: 1110883 - protein, 19 aa, Mycobacterium
PQSVEQQLGAAKEQLTGTF

SEQ ID NO: 1110884 - protein, 8 aa, Mycobacterium
PQSVSVPR

SEQ ID NO: 1110885 - protein, 8 aa, Mycobacterium
PQSVTVPR

SEQ ID NO: 1110886 - protein, 5 aa, Mycobacterium
PQTKG

SEQ ID NO: 1110887 - protein, 9 aa, Mycobacterium
PQTRGKTLK

SEQ ID NO: 1110888 - protein, 57 aa, Mycobacterium
PQVPQQPQWPGSGSGAGSGSGSSSGSYGGSGSYGGGRGDSGSSRGGSGSGVPGDVNG

SEQ ID NO: 1110889 - protein, 6 aa, Mycobacterium
PQWGPP

SEQ ID NO: 1110890 - protein, 6 aa, Mycobacterium
PQYHGA

SEQ ID NO: 1110891 - protein, 5 aa, Mycobacterium
PRAAA

SEQ ID NO: 1110892 - protein, 10 aa, Mycobacterium
PRAAAPPLRD

SEQ ID NO: 1110893 - protein, 6 aa, Mycobacterium
PRAHYT

SEQ ID NO: 1110894 - protein, 4 aa, Mycobacterium
PRAR

SEQ ID NO: 1110895 - protein, 5 aa, Mycobacterium
PRATA

SEQ ID NO: 1110896 - protein, 8 aa, Mycobacterium
PRATLGTA

SEQ ID NO: 1110897 - protein, 9 aa, Mycobacterium
PRDADNLTQ

SEQ ID NO: 1110898 - protein, 13 aa, Mycobacterium
PRDANAAKRRRQA

SEQ ID NO: 1110899 - protein, 5 aa, Mycobacterium
PRDGA

SEQ ID NO: 1110900 - protein, 9 aa, Mycobacterium
PRDLRSPQA

SEQ ID NO: 1110901 - protein, 16 aa, Mycobacterium
PRDPNYSEANRAFDGD

SEQ ID NO: 1110902 - protein, 5 aa, Mycobacterium
PRDQP

SEQ ID NO: 1110903 - protein, 6 aa, Mycobacterium
PRDRRP

SEQ ID NO: 1110904 - protein, 8 aa, Mycobacterium
PRDTPPWK

SEQ ID NO: 1110905 - protein, 5 aa, Mycobacterium
PREAA

SEQ ID NO: 1110906 - protein, 4 aa, Mycobacterium
PREN

SEQ ID NO: 1110907 - protein, 12 aa, Mycobacterium
PREVPENGRNGD

SEQ ID NO: 1110908 - protein, 12 aa, Mycobacterium
PRGAEEQEREPE

SEQ ID NO: 1110909 - protein, 14 aa, Mycobacterium
PRGDDDDHDGEPEK

SEQ ID NO: 1110910 - protein, 20 aa, Mycobacterium
PRGPELGRDDASVLRDGTGA

SEQ ID NO: 1110911 - protein, 10 aa, Mycobacterium
PRGQTEAASA

SEQ ID NO: 1110912 - protein, 8 aa, Mycobacterium
PRGSGAAI

SEQ ID NO: 1110913 - protein, 8 aa, Mycobacterium
PRHGSTSL

SEQ ID NO: 1110914 - protein, 10 aa, Mycobacterium
PRIDDGPGVK

SEQ ID NO: 1110915 - protein, 6 aa, Mycobacterium
PRKAAT

SEQ ID NO: 1110916 - protein, 13 aa, Mycobacterium
PRLAAGAPGGTTP

SEQ ID NO: 1110917 - protein, 4 aa, Mycobacterium
PRLP

SEQ ID NO: 1110918 - protein, 13 aa, Mycobacterium
PRLPTGKPDYRSL

SEQ ID NO: 1110919 - protein, 12 aa, Mycobacterium
PRNADDDEREPE

SEQ ID NO: 1110920 - protein, 20 aa, Mycobacterium
PRNERGKVDRPALPEPQRGP

SEQ ID NO: 1110921 - protein, 7 aa, Mycobacterium
PRNETIA

SEQ ID NO: 1110922 - protein, 13 aa, Mycobacterium
PRNGTNNAVSSSA

SEQ ID NO: 1110923 - protein, 7 aa, Mycobacterium
PRNRDDE

SEQ ID NO: 1110924 - protein, 4 aa, Mycobacterium
PRPD

SEQ ID NO: 1110925 - protein, 8 aa, Mycobacterium
PRPEPRRD

SEQ ID NO: 1110926 - protein, 10 aa, Mycobacterium
PRPGGDMTPL

SEQ ID NO: 1110927 - protein, 14 aa, Mycobacterium
PRPPDEEPDVSTGL

SEQ ID NO: 1110928 - protein, 25 aa, Mycobacterium
PRPQPTETNGHARHAAADSDPDDAI

SEQ ID NO: 1110929 - protein, 7 aa, Mycobacterium
PRPRPTG

SEQ ID NO: 1110930 - protein, 12 aa, Mycobacterium
PRPVTDDGKPLI

SEQ ID NO: 1110931 - protein, 13 aa, Mycobacterium
PRQRRSRVNPDGT

SEQ ID NO: 1110932 - protein, 5 aa, Mycobacterium
PRQSF

SEQ ID NO: 1110933 - protein, 12 aa, Mycobacterium
PRRDGTSSPRRR

SEQ ID NO: 1110934 - protein, 6 aa, Mycobacterium
PRRPFD

SEQ ID NO: 1110935 - protein, 7 aa, Mycobacterium
PRRSGAD

SEQ ID NO: 1110936 - protein, 8 aa, Mycobacterium
PRRSQGPE

SEQ ID NO: 1110937 - protein, 5 aa, Mycobacterium
PRSLP

SEQ ID NO: 1110938 - protein, 7 aa, Mycobacterium
PRTDPRS

SEQ ID NO: 1110939 - protein, 12 aa, Mycobacterium
PRTGEGPQGVPV

SEQ ID NO: 1110940 - protein, 10 aa, Mycobacterium
PRTGQGGPPM

SEQ ID NO: 1110941 - protein, 8 aa, Mycobacterium
PRTLGRQN

SEQ ID NO: 1110942 - protein, 6 aa, Mycobacterium
PRTPPS

SEQ ID NO: 1110943 - protein, 7 aa, Mycobacterium
PRTRESG

SEQ ID NO: 1110944 - protein, 8 aa, Mycobacterium
PRTRRRAR

SEQ ID NO: 1110945 - protein, 10 aa, Mycobacterium
PRTTASDVEA

SEQ ID NO: 1110946 - protein, 6 aa, Mycobacterium
PRTTDS

SEQ ID NO: 1110947 - protein, 10 aa, Mycobacterium
PRTTSGKLAR

SEQ ID NO: 1110948 - protein, 13 aa, Mycobacterium
PRYDSAKPAGQQP

SEQ ID NO: 1110949 - protein, 7 aa, Mycobacterium
PRYSGDQ

SEQ ID NO: 1110950 - protein, 13 aa, Mycobacterium
PSAADAAKVPRDD

SEQ ID NO: 1110951 - protein, 11 aa, Mycobacterium
PSADAVGPPAV

SEQ ID NO: 1110952 - protein, 6 aa, Mycobacterium
PSAHWG

SEQ ID NO: 1110953 - protein, 12 aa, Mycobacterium
PSALTDPGTPMT

SEQ ID NO: 1110954 - protein, 6 aa, Mycobacterium
PSDDAR

SEQ ID NO: 1110955 - protein, 10 aa, Mycobacterium
PSDPSPKRIS

SEQ ID NO: 1110956 - protein, 6 aa, Mycobacterium
PSDTGD

SEQ ID NO: 1110957 - protein, 10 aa, Mycobacterium
PSEAPPAAAT

SEQ ID NO: 1110958 - protein, 17 aa, Mycobacterium
PSELTDPQLGQPGTPAL

SEQ ID NO: 1110959 - protein, 9 aa, Mycobacterium
PSGAAGTDA

SEQ ID NO: 1110960 - protein, 7 aa, Mycobacterium
PSGDNAH

SEQ ID NO: 1110961 - protein, 6 aa, Mycobacterium
PSGKYS

SEQ ID NO: 1110962 - protein, 10 aa, Mycobacterium
PSGLPISGTS

SEQ ID NO: 1110963 - protein, 9 aa, Mycobacterium
PSGNAYSKG

SEQ ID NO: 1110964 - protein, 7 aa, Mycobacterium
PSGPVHT

SEQ ID NO: 1110965 - protein, 5 aa, Mycobacterium
PSGRA

SEQ ID NO: 1110966 - protein, 7 aa, Mycobacterium
PSHHAGR

SEQ ID NO: 1110967 - protein, 5 aa, Mycobacterium
PSIPE

SEQ ID NO: 1110968 - protein, 8 aa, Mycobacterium
PSKPKYDE

SEQ ID NO: 1110969 - protein, 6 aa, Mycobacterium
PSLNGL

SEQ ID NO: 1110970 - protein, 4 aa, Mycobacterium
PSLS

SEQ ID NO: 1110971 - protein, 7 aa, Mycobacterium
PSNEDQP

SEQ ID NO: 1110972 - protein, 4 aa, Mycobacterium
PSNH

SEQ ID NO: 1110973 - protein, 22 aa, Mycobacterium
PSPAPFRQAPRDADSWATAASG

SEQ ID NO: 1110974 - protein, 36 aa, Mycobacterium
PSPAPPPGPAIRTQEEAPVADATTGATGGGGGGSVA

SEQ ID NO: 1110975 - protein, 7 aa, Mycobacterium
PSPPQRR

SEQ ID NO: 1110976 - protein, 12 aa, Mycobacterium
PSPPVPGTANPA

SEQ ID NO: 1110977 - protein, 5 aa, Mycobacterium
PSPSV

SEQ ID NO: 1110978 - protein, 4 aa, Mycobacterium
PSQG

SEQ ID NO: 1110979 - protein, 16 aa, Mycobacterium
PSQQAQGTVQPGDPAD

SEQ ID NO: 1110980 - protein, 17 aa, Mycobacterium
PSQSDDPRQRSTYPGER

SEQ ID NO: 1110981 - protein, 4 aa, Mycobacterium
PSQV

SEQ ID NO: 1110982 - protein, 8 aa, Mycobacterium
PSRLRRPG

SEQ ID NO: 1110983 - protein, 8 aa, Mycobacterium
PSRRSAPL

SEQ ID NO: 1110984 - protein, 5 aa, Mycobacterium
PSRSA

SEQ ID NO: 1110985 - protein, 10 aa, Mycobacterium
PSRSLRSAPA

SEQ ID NO: 1110986 - protein, 7 aa, Mycobacterium
PSRYSAS

SEQ ID NO: 1110987 - protein, 12 aa, Mycobacterium
PSSQPLPGVGAG

SEQ ID NO: 1110988 - protein, 7 aa, Mycobacterium
PSSRTLA

SEQ ID NO: 1110989 - protein, 7 aa, Mycobacterium
PSSTAEL

SEQ ID NO: 1110990 - protein, 10 aa, Mycobacterium
PSSWRSPADL

SEQ ID NO: 1110991 - protein, 8 aa, Mycobacterium
PSTDDPRG

SEQ ID NO: 1110992 - protein, 5 aa, Mycobacterium
PSTDR

SEQ ID NO: 1110993 - protein, 5 aa, Mycobacterium
PSTDY

SEQ ID NO: 1110994 - protein, 5 aa, Mycobacterium
PSTFS

SEQ ID NO: 1110995 - protein, 7 aa, Mycobacterium
PSTGAAI

SEQ ID NO: 1110996 - protein, 6 aa, Mycobacterium
PSTPDA

SEQ ID NO: 1110997 - protein, 4 aa, Mycobacterium
PSTT

SEQ ID NO: 1110998 - protein, 4 aa, Mycobacterium
PSWE

SEQ ID NO: 1110999 - protein, 6 aa, Mycobacterium
PSYDPW

SEQ ID NO: 1111000 - protein, 5 aa, Mycobacterium
PSYGM

SEQ ID NO: 1111001 - protein, 18 aa, Mycobacterium
PTAEAPIQPTETTTTDRG

SEQ ID NO: 1111002 - protein, 8 aa, Mycobacterium
PTAGPGEI

SEQ ID NO: 1111003 - protein, 9 aa, Mycobacterium
PTAPTAAVA

SEQ ID NO: 1111004 - protein, 5 aa, Mycobacterium
PTAQL

SEQ ID NO: 1111005 - protein, 5 aa, Mycobacterium
PTARA

SEQ ID NO: 1111006 - protein, 15 aa, Mycobacterium
PTASTGTTAQSAADY

SEQ ID NO: 1111007 - protein, 10 aa, Mycobacterium
PTATAGAPLV

SEQ ID NO: 1111008 - protein, 10 aa, Mycobacterium
PTATAGSTLV

SEQ ID NO: 1111009 - protein, 6 aa, Mycobacterium
PTATSG

SEQ ID NO: 1111010 - protein, 7 aa, Mycobacterium
PTAVGSR

SEQ ID NO: 1111011 - protein, 6 aa, Mycobacterium
PTCSTA

SEQ ID NO: 1111012 - protein, 30 aa, Mycobacterium
PTDAEETPDKSVAVSGDNPDDTESPAEDGI

SEQ ID NO: 1111013 - protein, 6 aa, Mycobacterium
PTDSVQ

SEQ ID NO: 1111014 - protein, 12 aa, Mycobacterium
PTEHLDASDADQ

SEQ ID NO: 1111015 - protein, 5 aa, Mycobacterium
PTERQ

SEQ ID NO: 1111016 - protein, 10 aa, Mycobacterium
PTETVSPARR

SEQ ID NO: 1111017 - protein, 25 aa, Mycobacterium
PTGGGASAGPSVAGSGGASASPRQI

SEQ ID NO: 1111018 - protein, 4 aa, Mycobacterium
PTGP

SEQ ID NO: 1111019 - protein, 21 aa, Mycobacterium
PTGPGPGPAPDYDAPAALQAD

SEQ ID NO: 1111020 - protein, 6 aa, Mycobacterium
PTGTNT

SEQ ID NO: 1111021 - protein, 5 aa, Mycobacterium
PTGTV

SEQ ID NO: 1111022 - protein, 5 aa, Mycobacterium
PTHPP

SEQ ID NO: 1111023 - protein, 20 aa, Mycobacterium
PTIPPDQAFTQNQTTGPNGL

SEQ ID NO: 1111024 - protein, 6 aa, Mycobacterium
PTKSLP

SEQ ID NO: 1111025 - protein, 13 aa, Mycobacterium
PTLDPASRVPTVA

SEQ ID NO: 1111026 - protein, 5 aa, Mycobacterium
PTLEG

SEQ ID NO: 1111027 - protein, 7 aa, Mycobacterium
PTLGESE

SEQ ID NO: 1111028 - protein, 4 aa, Mycobacterium
PTLK

SEQ ID NO: 1111029 - protein, 6 aa, Mycobacterium
PTLSRT

SEQ ID NO: 1111030 - protein, 6 aa, Mycobacterium
PTPPLG

SEQ ID NO: 1111031 - protein, 44 aa, Mycobacterium
PTPPPAAPPAEDPTAPAPSADDEEDREGPRRRARREREQRRAVK

SEQ ID NO: 1111032 - protein, 8 aa, Mycobacterium
PTPPPMPP

SEQ ID NO: 1111033 - protein, 13 aa, Mycobacterium
PTPQQPPPRPDRP

SEQ ID NO: 1111034 - protein, 5 aa, Mycobacterium
PTPRM

SEQ ID NO: 1111035 - protein, 7 aa, Mycobacterium
PTPRPIP

SEQ ID NO: 1111036 - protein, 4 aa, Mycobacterium
PTPT

SEQ ID NO: 1111037 - protein, 8 aa, Mycobacterium
PTPTGYTN

SEQ ID NO: 1111038 - protein, 7 aa, Mycobacterium
PTPTRAT

SEQ ID NO: 1111039 - protein, 9 aa, Mycobacterium
PTQRARPSR

SEQ ID NO: 1111040 - protein, 6 aa, Mycobacterium
PTQVNT

SEQ ID NO: 1111041 - protein, 6 aa, Mycobacterium
PTRAAA

SEQ ID NO: 1111042 - protein, 15 aa, Mycobacterium
PTRGAGPVGDPPERG

SEQ ID NO: 1111043 - protein, 4 aa, Mycobacterium
PTRI

SEQ ID NO: 1111044 - protein, 6 aa, Mycobacterium
PTRNQS

SEQ ID NO: 1111045 - protein, 6 aa, Mycobacterium
PTRPEL

SEQ ID NO: 1111046 - protein, 10 aa, Mycobacterium
PTRPSTDEWS

SEQ ID NO: 1111047 - protein, 5 aa, Mycobacterium
PTRRS

SEQ ID NO: 1111048 - protein, 5 aa, Mycobacterium
PTRYN

SEQ ID NO: 1111049 - protein, 7 aa, Mycobacterium
PTSALDP

SEQ ID NO: 1111050 - protein, 14 aa, Mycobacterium
PTSGKWADTGNPAR

SEQ ID NO: 1111051 - protein, 4 aa, Mycobacterium
PTSN

SEQ ID NO: 1111052 - protein, 102 aa, Mycobacterium
PTTAASPQPGYSPGGGQQGAGQYGYTEGAPRYSNEPQYQSDPRYPSAPQYPNDPGGRTSPTGPPTGPYPTGQPTGYDDPSGGRHTGMPGGQQYPYGGDRGGR

SEQ ID NO: 1111053 - protein, 7 aa, Mycobacterium
PTTGGLY

SEQ ID NO: 1111054 - protein, 6 aa, Mycobacterium
PTTGTG

SEQ ID NO: 1111055 - protein, 11 aa, Mycobacterium
PTTNREATKAA

SEQ ID NO: 1111056 - protein, 12 aa, Mycobacterium
PTTRTSSPYSLT

SEQ ID NO: 1111057 - protein, 19 aa, Mycobacterium
PTVPPDVAQTQNQTTGPNG

SEQ ID NO: 1111058 - protein, 20 aa, Mycobacterium
PTVPPDVAQTQNQTTGPNGL

SEQ ID NO: 1111059 - protein, 4 aa, Mycobacterium
PTVT

SEQ ID NO: 1111060 - protein, 4 aa, Mycobacterium
PTYS

SEQ ID NO: 1111061 - protein, 13 aa, Mycobacterium
PVAAGGDTRNQNT

SEQ ID NO: 1111062 - protein, 27 aa, Mycobacterium
PVADSGPDELSEPVEQPVEPPTARPVD

SEQ ID NO: 1111063 - protein, 31 aa, Mycobacterium
PVADSGPDELSEPVEQPVEQPVEPPTARPVD

SEQ ID NO: 1111064 - protein, 10 aa, Mycobacterium
PVAKDPGSTV

SEQ ID NO: 1111065 - protein, 10 aa, Mycobacterium
PVANPPSHTV

SEQ ID NO: 1111066 - protein, 46 aa, Mycobacterium
PVAPASGAVPVAPSAFGSNDSGVPTVGTAQYNPQTGEYIAPDGSMN

SEQ ID NO: 1111067 - protein, 11 aa, Mycobacterium
PVAPPSPAQIN

SEQ ID NO: 1111068 - protein, 4 aa, Mycobacterium
PVAR

SEQ ID NO: 1111069 - protein, 12 aa, Mycobacterium
PVASGGERARPL

SEQ ID NO: 1111070 - protein, 16 aa, Mycobacterium
PVDDGYDDEYRSTAGR

SEQ ID NO: 1111071 - protein, 6 aa, Mycobacterium
PVDEGR

SEQ ID NO: 1111072 - protein, 4 aa, Mycobacterium
PVDP

SEQ ID NO: 1111073 - protein, 8 aa, Mycobacterium
PVEEGGVS

SEQ ID NO: 1111074 - protein, 4 aa, Mycobacterium
PVGA

SEQ ID NO: 1111075 - protein, 4 aa, Mycobacterium
PVGD

SEQ ID NO: 1111076 - protein, 17 aa, Mycobacterium
PVGGDDSDEGADLGGGT

SEQ ID NO: 1111077 - protein, 11 aa, Mycobacterium
PVIGGNGTKHG

SEQ ID NO: 1111078 - protein, 12 aa, Mycobacterium
PVKSTDNGQDIT

SEQ ID NO: 1111079 - protein, 41 aa, Mycobacterium
PVMEQPGSDNFADTDNNGDTGSEAGTEGGTTVAAGVNGSRA

SEQ ID NO: 1111080 - protein, 4 aa, Mycobacterium
PVND

SEQ ID NO: 1111081 - protein, 6 aa, Mycobacterium
PVNEAA

SEQ ID NO: 1111082 - protein, 16 aa, Mycobacterium
PVNEPPKKASRAGRNL

SEQ ID NO: 1111083 - protein, 10 aa, Mycobacterium
PVPAQLTRPE

SEQ ID NO: 1111084 - protein, 60 aa, Mycobacterium
PVPDSSSDSSSDSSGSSSSSGSTYDESESPQQTVHGPQPTTAPTQTEEPAGQAPPGQGNT

SEQ ID NO: 1111085 - protein, 5 aa, Mycobacterium
PVPHP

SEQ ID NO: 1111086 - protein, 29 aa, Mycobacterium
PVPNPPPVPNPPPVPNPPPAPPPPPEKRR

SEQ ID NO: 1111087 - protein, 7 aa, Mycobacterium
PVPPPAF

SEQ ID NO: 1111088 - protein, 7 aa, Mycobacterium
PVPQERP

SEQ ID NO: 1111089 - protein, 8 aa, Mycobacterium
PVPQPDST

SEQ ID NO: 1111090 - protein, 17 aa, Mycobacterium
PVPRSDAKDTSTAKAGA

SEQ ID NO: 1111091 - protein, 14 aa, Mycobacterium
PVPSDSDSESAGER

SEQ ID NO: 1111092 - protein, 7 aa, Mycobacterium
PVPSGAA

SEQ ID NO: 1111093 - protein, 8 aa, Mycobacterium
PVPSTADI

SEQ ID NO: 1111094 - protein, 7 aa, Mycobacterium
PVQRPSR

SEQ ID NO: 1111095 - protein, 8 aa, Mycobacterium
PVRDSSGR

SEQ ID NO: 1111096 - protein, 4 aa, Mycobacterium
PVRP

SEQ ID NO: 1111097 - protein, 20 aa, Mycobacterium
PVRRRASRAAGPANGTVSET

SEQ ID NO: 1111098 - protein, 16 aa, Mycobacterium
PVRSSGMTPYATRLIE

SEQ ID NO: 1111099 - protein, 15 aa, Mycobacterium
PVSTTDTEPEPEPEV

SEQ ID NO: 1111100 - protein, 14 aa, Mycobacterium
PVTANPAPPEEHPR

SEQ ID NO: 1111101 - protein, 15 aa, Mycobacterium
PVTANPAPPEEHPRP

SEQ ID NO: 1111102 - protein, 11 aa, Mycobacterium
PVTEAPEPAVA

SEQ ID NO: 1111103 - protein, 7 aa, Mycobacterium
PVTEEAA

SEQ ID NO: 1111104 - protein, 11 aa, Mycobacterium
PVTGGDRGAAY

SEQ ID NO: 1111105 - protein, 13 aa, Mycobacterium
PVTTTDASEESET

SEQ ID NO: 1111106 - protein, 12 aa, Mycobacterium
PWGAPPGTADEL

SEQ ID NO: 1111107 - protein, 144 aa, Mycobacterium
PWPGQQPEQGTDQPAGDSAANQGWQPPTPGAGQQPEQPSWQPPAYTPQQYPQYQQPAQPPTYSPQQYPADQYGQQPAEYSPAGYPPPGQYGQPGGYGQQYGQPYGQPGQYGQQPGQAGQYGQYPGAPGAPGYPAPGSEEGSKRS

SEQ ID NO: 1111108 - protein, 4 aa, Mycobacterium
PYAP

SEQ ID NO: 1111109 - protein, 13 aa, Mycobacterium
PYDPYRGAAQPTA

SEQ ID NO: 1111110 - protein, 5 aa, Mycobacterium
PYDRY

SEQ ID NO: 1111111 - protein, 12 aa, Mycobacterium
PYFPPPPPQPYA

SEQ ID NO: 1111112 - protein, 63 aa, Mycobacterium
PYGRPPPAPPPPPPSLAPPPPADAPPVPAPEPPPGPGPLPGPLPAEAPLASGPMTASYDSRTG

SEQ ID NO: 1111113 - protein, 6 aa, Mycobacterium
PYKYPE

SEQ ID NO: 1111114 - protein, 9 aa, Mycobacterium
PYNRGTATC

SEQ ID NO: 1111115 - protein, 8 aa, Mycobacterium
PYPAPASR

SEQ ID NO: 1111116 - protein, 10 aa, Mycobacterium
PYPERLGPKG

SEQ ID NO: 1111117 - protein, 13 aa, Mycobacterium
PYPGGRMQVAAAS

SEQ ID NO: 1111118 - protein, 13 aa, Mycobacterium
PYPRTGQAGDPHL

SEQ ID NO: 1111119 - protein, 4 aa, Mycobacterium
PYRG

SEQ ID NO: 1111120 - protein, 26 aa, Mycobacterium
PYRPAYPAYPAYPPASARVRKERSDG

SEQ ID NO: 1111121 - protein, 4 aa, Mycobacterium
PYTG

SEQ ID NO: 1111122 - protein, 5 aa, Mycobacterium
PYVPA

SEQ ID NO: 1111123 - protein, 10 aa, Mycobacterium
PYVPTRTEAL

SEQ ID NO: 1111124 - protein, 4 aa, Mycobacterium
QAAA

SEQ ID NO: 1111125 - protein, 6 aa, Mycobacterium
QAADAT

SEQ ID NO: 1111126 - protein, 8 aa, Mycobacterium
QAAENEVQ

SEQ ID NO: 1111127 - protein, 18 aa, Mycobacterium
QAAEPGAASPQTPAASTG

SEQ ID NO: 1111128 - protein, 13 aa, Mycobacterium
QAAEPHRAHASSS

SEQ ID NO: 1111129 - protein, 7 aa, Mycobacterium
QAALGRN

SEQ ID NO: 1111130 - protein, 14 aa, Mycobacterium
QAAPARRRLSPTAT

SEQ ID NO: 1111131 - protein, 8 aa, Mycobacterium
QAAPRALP

SEQ ID NO: 1111132 - protein, 6 aa, Mycobacterium
QAAREM

SEQ ID NO: 1111133 - protein, 7 aa, Mycobacterium
QAATGQT

SEQ ID NO: 1111134 - protein, 6 aa, Mycobacterium
QAATPV

SEQ ID NO: 1111135 - protein, 16 aa, Mycobacterium
QAAVGPDGPPMDYVAA

SEQ ID NO: 1111136 - protein, 5 aa, Mycobacterium
QADAD

SEQ ID NO: 1111137 - protein, 5 aa, Mycobacterium
QADNR

SEQ ID NO: 1111138 - protein, 11 aa, Mycobacterium
QADPSKATGLD

SEQ ID NO: 1111139 - protein, 16 aa, Mycobacterium
QADRELGIPGEDLPGS

SEQ ID NO: 1111140 - protein, 5 aa, Mycobacterium
QADRH

SEQ ID NO: 1111141 - protein, 5 aa, Mycobacterium
QADTR

SEQ ID NO: 1111142 - protein, 6 aa, Mycobacterium
QAEIPG

SEQ ID NO: 1111143 - protein, 7 aa, Mycobacterium
QAENKGL

SEQ ID NO: 1111144 - protein, 12 aa, Mycobacterium
QAEQAAAATPVI

SEQ ID NO: 1111145 - protein, 80 aa, Mycobacterium
QAEQTLRAEQANTGESSVPNGDTVTDDQTSDSTGTDDSSDTDTTQDTGTEETEDTGTVTESPAGETGDAPAVDESDTPVV

SEQ ID NO: 1111146 - protein, 7 aa, Mycobacterium
QAERLGR

SEQ ID NO: 1111147 - protein, 12 aa, Mycobacterium
QAERSSDPARRE

SEQ ID NO: 1111148 - protein, 8 aa, Mycobacterium
QAGASTLE

SEQ ID NO: 1111149 - protein, 4 aa, Mycobacterium
QAGF

SEQ ID NO: 1111150 - protein, 11 aa, Mycobacterium
QAGGPGPNRYD

SEQ ID NO: 1111151 - protein, 8 aa, Mycobacterium
QAGNGMSD

SEQ ID NO: 1111152 - protein, 6 aa, Mycobacterium
QAGPAV

SEQ ID NO: 1111153 - protein, 12 aa, Mycobacterium
QAHGDWPPEPTE

SEQ ID NO: 1111154 - protein, 12 aa, Mycobacterium
QAIQSSPGLRPL

SEQ ID NO: 1111155 - protein, 13 aa, Mycobacterium
QAKAGAAAAGLSD

SEQ ID NO: 1111156 - protein, 17 aa, Mycobacterium
QAKAGQGVRASGIARFM

SEQ ID NO: 1111157 - protein, 4 aa, Mycobacterium
QALT

SEQ ID NO: 1111158 - protein, 9 aa, Mycobacterium
QANEDGNVE

SEQ ID NO: 1111159 - protein, 6 aa, Mycobacterium
QANQAA

SEQ ID NO: 1111160 - protein, 5 aa, Mycobacterium
QANST

SEQ ID NO: 1111161 - protein, 5 aa, Mycobacterium
QAPNE

SEQ ID NO: 1111162 - protein, 8 aa, Mycobacterium
QAPRSGSA

SEQ ID NO: 1111163 - protein, 12 aa, Mycobacterium
QAPSRPDGAPIA

SEQ ID NO: 1111164 - protein, 6 aa, Mycobacterium
QAPVSR

SEQ ID NO: 1111165 - protein, 11 aa, Mycobacterium
QAQAAEAGSAL

SEQ ID NO: 1111166 - protein, 17 aa, Mycobacterium
QAQEQGIDTVPDAPASM

SEQ ID NO: 1111167 - protein, 5 aa, Mycobacterium
QAQGR

SEQ ID NO: 1111168 - protein, 11 aa, Mycobacterium
QAQSKSVGTIT

SEQ ID NO: 1111169 - protein, 11 aa, Mycobacterium
QAQSKSVGTVA

SEQ ID NO: 1111170 - protein, 7 aa, Mycobacterium
QAQTRDD

SEQ ID NO: 1111171 - protein, 11 aa, Mycobacterium
QAQWGEKQIPA

SEQ ID NO: 1111172 - protein, 11 aa, Mycobacterium
QARAEKDPAHA

SEQ ID NO: 1111173 - protein, 5 aa, Mycobacterium
QARED

SEQ ID NO: 1111174 - protein, 10 aa, Mycobacterium
QARRRPPPPL

SEQ ID NO: 1111175 - protein, 13 aa, Mycobacterium
QARRRQENEAKRF

SEQ ID NO: 1111176 - protein, 8 aa, Mycobacterium
QASAGGLD

SEQ ID NO: 1111177 - protein, 5 aa, Mycobacterium
QASAR

SEQ ID NO: 1111178 - protein, 8 aa, Mycobacterium
QASEAQLR

SEQ ID NO: 1111179 - protein, 17 aa, Mycobacterium
QASKSRTAGQPNPPIPD

SEQ ID NO: 1111180 - protein, 15 aa, Mycobacterium
QATAQNDASTGDERD

SEQ ID NO: 1111181 - protein, 17 aa, Mycobacterium
QATEELPAKSDQCTAAG

SEQ ID NO: 1111182 - protein, 9 aa, Mycobacterium
QATGAAPPR

SEQ ID NO: 1111183 - protein, 6 aa, Mycobacterium
QATTDI

SEQ ID NO: 1111184 - protein, 12 aa, Mycobacterium
QAVQQAGATTNE

SEQ ID NO: 1111185 - protein, 6 aa, Mycobacterium
QAVTSL

SEQ ID NO: 1111186 - protein, 16 aa, Mycobacterium
QCTPPGIESASALPTN

SEQ ID NO: 1111187 - protein, 12 aa, Mycobacterium
QDAQRSGDFAQY

SEQ ID NO: 1111188 - protein, 16 aa, Mycobacterium
QDDDAAGDPLPYTGED

SEQ ID NO: 1111189 - protein, 12 aa, Mycobacterium
QDDNGTYEVGRP

SEQ ID NO: 1111190 - protein, 7 aa, Mycobacterium
QDDSPVD

SEQ ID NO: 1111191 - protein, 5 aa, Mycobacterium
QDDSV

SEQ ID NO: 1111192 - protein, 7 aa, Mycobacterium
QDEQDPV

SEQ ID NO: 1111193 - protein, 4 aa, Mycobacterium
QDET

SEQ ID NO: 1111194 - protein, 5 aa, Mycobacterium
QDEVT

SEQ ID NO: 1111195 - protein, 7 aa, Mycobacterium
QDFDPVE

SEQ ID NO: 1111196 - protein, 6 aa, Mycobacterium
QDGAHI

SEQ ID NO: 1111197 - protein, 5 aa, Mycobacterium
QDGPA

SEQ ID NO: 1111198 - protein, 5 aa, Mycobacterium
QDGPV

SEQ ID NO: 1111199 - protein, 9 aa, Mycobacterium
QDGQPVTDQ

SEQ ID NO: 1111200 - protein, 23 aa, Mycobacterium
QDGVPRGATGKVDVTRLRALLEQ

SEQ ID NO: 1111201 - protein, 6 aa, Mycobacterium
QDHPPS

SEQ ID NO: 1111202 - protein, 5 aa, Mycobacterium
QDKVD

SEQ ID NO: 1111203 - protein, 4 aa, Mycobacterium
QDLG

SEQ ID NO: 1111204 - protein, 9 aa, Mycobacterium
QDNRGNPNG

SEQ ID NO: 1111205 - protein, 9 aa, Mycobacterium
QDPAKDTLP

SEQ ID NO: 1111206 - protein, 5 aa, Mycobacterium
QDPSG

SEQ ID NO: 1111207 - protein, 12 aa, Mycobacterium
QDPSSAEPETEV

SEQ ID NO: 1111208 - protein, 7 aa, Mycobacterium
QDQDVRD

SEQ ID NO: 1111209 - protein, 8 aa, Mycobacterium
QDQDVRDG

SEQ ID NO: 1111210 - protein, 7 aa, Mycobacterium
QDRDPIG

SEQ ID NO: 1111211 - protein, 6 aa, Mycobacterium
QDRETP

SEQ ID NO: 1111212 - protein, 38 aa, Mycobacterium
QDRKDQPPPTTVTETPTSQGAPPETPGAAAPAFGDHEP

SEQ ID NO: 1111213 - protein, 28 aa, Mycobacterium
QDRPSFGSSITGAAPSVPAAALPAGSVE

SEQ ID NO: 1111214 - protein, 8 aa, Mycobacterium
QDRRAAVN

SEQ ID NO: 1111215 - protein, 12 aa, Mycobacterium
QDSATSKGAIGS

SEQ ID NO: 1111216 - protein, 9 aa, Mycobacterium
QDSKTGQLI

SEQ ID NO: 1111217 - protein, 9 aa, Mycobacterium
QDSPIGVRG

SEQ ID NO: 1111218 - protein, 7 aa, Mycobacterium
QDSPMNV

SEQ ID NO: 1111219 - protein, 11 aa, Mycobacterium
QDTGNAHGPVT

SEQ ID NO: 1111220 - protein, 6 aa, Mycobacterium
QDTNAG

SEQ ID NO: 1111221 - protein, 6 aa, Mycobacterium
QDVGVG

SEQ ID NO: 1111222 - protein, 6 aa, Mycobacterium
QDYGGE

SEQ ID NO: 1111223 - protein, 7 aa, Mycobacterium
QEAAQNE

SEQ ID NO: 1111224 - protein, 12 aa, Mycobacterium
QEAKGKGATAEE

SEQ ID NO: 1111225 - protein, 18 aa, Mycobacterium
QEAKSELSKDYHNTNTEV

SEQ ID NO: 1111226 - protein, 13 aa, Mycobacterium
QEARGAGEDRETA

SEQ ID NO: 1111227 - protein, 9 aa, Mycobacterium
QEDSTAMGE

SEQ ID NO: 1111228 - protein, 4 aa, Mycobacterium
QEFD

SEQ ID NO: 1111229 - protein, 10 aa, Mycobacterium
QEFSSGKTAV

SEQ ID NO: 1111230 - protein, 11 aa, Mycobacterium
QEGCSGGRGGS

SEQ ID NO: 1111231 - protein, 8 aa, Mycobacterium
QEGPPPEL

SEQ ID NO: 1111232 - protein, 10 aa, Mycobacterium
QEKSMKSGRS

SEQ ID NO: 1111233 - protein, 12 aa, Mycobacterium
QEPDHPVPEPAC

SEQ ID NO: 1111234 - protein, 17 aa, Mycobacterium
QEPDHPVPESACRSAPT

SEQ ID NO: 1111235 - protein, 5 aa, Mycobacterium
QEQCS

SEQ ID NO: 1111236 - protein, 4 aa, Mycobacterium
QEQS

SEQ ID NO: 1111237 - protein, 17 aa, Mycobacterium
QERPANVGSGIHEGEMR

SEQ ID NO: 1111238 - protein, 6 aa, Mycobacterium
QERQRF

SEQ ID NO: 1111239 - protein, 6 aa, Mycobacterium
QERRRI

SEQ ID NO: 1111240 - protein, 7 aa, Mycobacterium
QERYDAK

SEQ ID NO: 1111241 - protein, 8 aa, Mycobacterium
QESERQRI

SEQ ID NO: 1111242 - protein, 4 aa, Mycobacterium
QEST

SEQ ID NO: 1111243 - protein, 24 aa, Mycobacterium
QFDRSSTVDVGGLGDRTAELIRSW

SEQ ID NO: 1111244 - protein, 7 aa, Mycobacterium
QFGPTQY

SEQ ID NO: 1111245 - protein, 5 aa, Mycobacterium
QFGQS

SEQ ID NO: 1111246 - protein, 11 aa, Mycobacterium
QFGSSGGPLAE

SEQ ID NO: 1111247 - protein, 9 aa, Mycobacterium
QFPDQGASP

SEQ ID NO: 1111248 - protein, 11 aa, Mycobacterium
QFPGPGRTETN

SEQ ID NO: 1111249 - protein, 8 aa, Mycobacterium
QFPTPQDI

SEQ ID NO: 1111250 - protein, 6 aa, Mycobacterium
QGALQT

SEQ ID NO: 1111251 - protein, 14 aa, Mycobacterium
QGDGHSDVGPHQGL

SEQ ID NO: 1111252 - protein, 7 aa, Mycobacterium
QGDGQSI

SEQ ID NO: 1111253 - protein, 5 aa, Mycobacterium
QGDID

SEQ ID NO: 1111254 - protein, 4 aa, Mycobacterium
QGEG

SEQ ID NO: 1111255 - protein, 6 aa, Mycobacterium
QGEPIP

SEQ ID NO: 1111256 - protein, 15 aa, Mycobacterium
QGETGGERSDPGSGT

SEQ ID NO: 1111257 - protein, 9 aa, Mycobacterium
QGGAPGTGI

SEQ ID NO: 1111258 - protein, 7 aa, Mycobacterium
QGGERLP

SEQ ID NO: 1111259 - protein, 5 aa, Mycobacterium
QGGFG

SEQ ID NO: 1111260 - protein, 19 aa, Mycobacterium
QGGGALGSAVTPGLEEPLG

SEQ ID NO: 1111261 - protein, 5 aa, Mycobacterium
QGGTP

SEQ ID NO: 1111262 - protein, 8 aa, Mycobacterium
QGHRDPRS

SEQ ID NO: 1111263 - protein, 7 aa, Mycobacterium
QGHTGTA

SEQ ID NO: 1111264 - protein, 14 aa, Mycobacterium
QGKPIADDADLDGL

SEQ ID NO: 1111265 - protein, 6 aa, Mycobacterium
QGLSAG

SEQ ID NO: 1111266 - protein, 17 aa, Mycobacterium
QGNGFKTVTPKEQGSNY

SEQ ID NO: 1111267 - protein, 18 aa, Mycobacterium
QGPAAPSTPSTTPPAPAR

SEQ ID NO: 1111268 - protein, 4 aa, Mycobacterium
QGPR

SEQ ID NO: 1111269 - protein, 6 aa, Mycobacterium
QGPTTL

SEQ ID NO: 1111270 - protein, 6 aa, Mycobacterium
QGQGTT

SEQ ID NO: 1111271 - protein, 7 aa, Mycobacterium
QGQSGST

SEQ ID NO: 1111272 - protein, 7 aa, Mycobacterium
QGRPAFT

SEQ ID NO: 1111273 - protein, 5 aa, Mycobacterium
QGRRG

SEQ ID NO: 1111274 - protein, 6 aa, Mycobacterium
QGRSAV

SEQ ID NO: 1111275 - protein, 4 aa, Mycobacterium
QGRT

SEQ ID NO: 1111276 - protein, 5 aa, Mycobacterium
QGRTA

SEQ ID NO: 1111277 - protein, 7 aa, Mycobacterium
QGRTDPK

SEQ ID NO: 1111278 - protein, 10 aa, Mycobacterium
QGSAKTTTTR

SEQ ID NO: 1111279 - protein, 7 aa, Mycobacterium
QGSQWPG

SEQ ID NO: 1111280 - protein, 6 aa, Mycobacterium
QGTASG

SEQ ID NO: 1111281 - protein, 12 aa, Mycobacterium
QGTKESAETGGH

SEQ ID NO: 1111282 - protein, 10 aa, Mycobacterium
QGVPDGTEAH

SEQ ID NO: 1111283 - protein, 5 aa, Mycobacterium
QGVPV

SEQ ID NO: 1111284 - protein, 14 aa, Mycobacterium
QHAGETMKAGVNAP

SEQ ID NO: 1111285 - protein, 25 aa, Mycobacterium
QHDDNSGTETVEQAADTQSESTNSL

SEQ ID NO: 1111286 - protein, 6 aa, Mycobacterium
QHGQPA

SEQ ID NO: 1111287 - protein, 8 aa, Mycobacterium
QHGTSPQA

SEQ ID NO: 1111288 - protein, 8 aa, Mycobacterium
QHNAGDKS

SEQ ID NO: 1111289 - protein, 5 aa, Mycobacterium
QHPAA

SEQ ID NO: 1111290 - protein, 6 aa, Mycobacterium
QHPETA

SEQ ID NO: 1111291 - protein, 16 aa, Mycobacterium
QHPGNAAPEPHYRPSA

SEQ ID NO: 1111292 - protein, 9 aa, Mycobacterium
QHPSSDELD

SEQ ID NO: 1111293 - protein, 18 aa, Mycobacterium
QHRGQGEYAPKDQAPDPV

SEQ ID NO: 1111294 - protein, 7 aa, Mycobacterium
QHTPETA

SEQ ID NO: 1111295 - protein, 30 aa, Mycobacterium
QIGGNANATGNFQKAPEAGTTAGDGVTAEA

SEQ ID NO: 1111296 - protein, 5 aa, Mycobacterium
QIGVG

SEQ ID NO: 1111297 - protein, 17 aa, Mycobacterium
QIPDGPAISGPFAGQRP

SEQ ID NO: 1111298 - protein, 9 aa, Mycobacterium
QIPSPGVNY

SEQ ID NO: 1111299 - protein, 8 aa, Mycobacterium
QIRAQDPA

SEQ ID NO: 1111300 - protein, 6 aa, Mycobacterium
QIRDSA

SEQ ID NO: 1111301 - protein, 9 aa, Mycobacterium
QISDPTTQA

SEQ ID NO: 1111302 - protein, 20 aa, Mycobacterium
QKGLQDQMASQSEDADAMGE

SEQ ID NO: 1111303 - protein, 6 aa, Mycobacterium
QKLGGG

SEQ ID NO: 1111304 - protein, 7 aa, Mycobacterium
QKMQQDQ

SEQ ID NO: 1111305 - protein, 10 aa, Mycobacterium
QKNGETTSHT

SEQ ID NO: 1111306 - protein, 6 aa, Mycobacterium
QKPGES

SEQ ID NO: 1111307 - protein, 7 aa, Mycobacterium
QKVDHRN

SEQ ID NO: 1111308 - protein, 9 aa, Mycobacterium
QKVDHSNVN

SEQ ID NO: 1111309 - protein, 10 aa, Mycobacterium
QLARGEDPGL

SEQ ID NO: 1111310 - protein, 6 aa, Mycobacterium
QLDPQV

SEQ ID NO: 1111311 - protein, 13 aa, Mycobacterium
QLGNSRAAAPPRS

SEQ ID NO: 1111312 - protein, 13 aa, Mycobacterium
QLGPHEGSVQGPL

SEQ ID NO: 1111313 - protein, 30 aa, Mycobacterium
QLPAPAPAPARQEAADVPANPPSAETIKPP

SEQ ID NO: 1111314 - protein, 10 aa, Mycobacterium
QLPAQPAVTA

SEQ ID NO: 1111315 - protein, 10 aa, Mycobacterium
QLPGDDRREL

SEQ ID NO: 1111316 - protein, 12 aa, Mycobacterium
QLPGDDRRELAG

SEQ ID NO: 1111317 - protein, 4 aa, Mycobacterium
QLQT

SEQ ID NO: 1111318 - protein, 6 aa, Mycobacterium
QLRGDE

SEQ ID NO: 1111319 - protein, 4 aa, Mycobacterium
QLRS

SEQ ID NO: 1111320 - protein, 6 aa, Mycobacterium
QLSPAD

SEQ ID NO: 1111321 - protein, 15 aa, Mycobacterium
QLTPEQAAAAAADAA

SEQ ID NO: 1111322 - protein, 5 aa, Mycobacterium
QLTPG

SEQ ID NO: 1111323 - protein, 17 aa, Mycobacterium
QLTSKNVSAQASTVSAG

SEQ ID NO: 1111324 - protein, 5 aa, Mycobacterium
QNDPQ

SEQ ID NO: 1111325 - protein, 25 aa, Mycobacterium
QNGPPPPQPPALTPSELGNPTRTSL

SEQ ID NO: 1111326 - protein, 9 aa, Mycobacterium
QNGSASHAS

SEQ ID NO: 1111327 - protein, 11 aa, Mycobacterium
QNLPANTRAQI

SEQ ID NO: 1111328 - protein, 13 aa, Mycobacterium
QNLPPNAAPPPPL

SEQ ID NO: 1111329 - protein, 7 aa, Mycobacterium
QNRGSAA

SEQ ID NO: 1111330 - protein, 33 aa, Mycobacterium
QNRQPETAGTSPEAPGSPASSTADRAAPPPGMD

SEQ ID NO: 1111331 - protein, 14 aa, Mycobacterium
QNSARDTAGSDAAA

SEQ ID NO: 1111332 - protein, 5 aa, Mycobacterium
QNSPY

SEQ ID NO: 1111333 - protein, 9 aa, Mycobacterium
QNTSTAGVG

SEQ ID NO: 1111334 - protein, 11 aa, Mycobacterium
QNVGELDKPRF

SEQ ID NO: 1111335 - protein, 6 aa, Mycobacterium
QPAGVA

SEQ ID NO: 1111336 - protein, 12 aa, Mycobacterium
QPAKSTPDRAVA

SEQ ID NO: 1111337 - protein, 4 aa, Mycobacterium
QPAP

SEQ ID NO: 1111338 - protein, 7 aa, Mycobacterium
QPAPVPP

SEQ ID NO: 1111339 - protein, 5 aa, Mycobacterium
QPAYE

SEQ ID NO: 1111340 - protein, 9 aa, Mycobacterium
QPDAEDPHQ

SEQ ID NO: 1111341 - protein, 5 aa, Mycobacterium
QPDPT

SEQ ID NO: 1111342 - protein, 4 aa, Mycobacterium
QPDQ

SEQ ID NO: 1111343 - protein, 11 aa, Mycobacterium
QPDSVDTDLTA

SEQ ID NO: 1111344 - protein, 12 aa, Mycobacterium
QPDTTVVAGDAD

SEQ ID NO: 1111345 - protein, 5 aa, Mycobacterium
QPEAA

SEQ ID NO: 1111346 - protein, 4 aa, Mycobacterium
QPEF

SEQ ID NO: 1111347 - protein, 9 aa, Mycobacterium
QPEKPTDRR

SEQ ID NO: 1111348 - protein, 14 aa, Mycobacterium
QPELSEPPTRRSTT

SEQ ID NO: 1111349 - protein, 8 aa, Mycobacterium
QPEPRDGL

SEQ ID NO: 1111350 - protein, 7 aa, Mycobacterium
QPFQPGP

SEQ ID NO: 1111351 - protein, 9 aa, Mycobacterium
QPGDETPYQ

SEQ ID NO: 1111352 - protein, 8 aa, Mycobacterium
QPGEQVTT

SEQ ID NO: 1111353 - protein, 5 aa, Mycobacterium
QPGGI

SEQ ID NO: 1111354 - protein, 17 aa, Mycobacterium
QPGKAGADGRDLSERQA

SEQ ID NO: 1111355 - protein, 4 aa, Mycobacterium
QPGL

SEQ ID NO: 1111356 - protein, 4 aa, Mycobacterium
QPGQ

SEQ ID NO: 1111357 - protein, 11 aa, Mycobacterium
QPGRTRAVGDS

SEQ ID NO: 1111358 - protein, 20 aa, Mycobacterium
QPGTGLAPGSYGSTAAPTEV

SEQ ID NO: 1111359 - protein, 8 aa, Mycobacterium
QPGTGSTF

SEQ ID NO: 1111360 - protein, 9 aa, Mycobacterium
QPGTYRRGG

SEQ ID NO: 1111361 - protein, 4 aa, Mycobacterium
QPGV

SEQ ID NO: 1111362 - protein, 4 aa, Mycobacterium
QPHV

SEQ ID NO: 1111363 - protein, 7 aa, Mycobacterium
QPIGPGT

SEQ ID NO: 1111364 - protein, 27 aa, Mycobacterium
QPKGADGQPSEQAVSDSAVSETWGGQI

SEQ ID NO: 1111365 - protein, 4 aa, Mycobacterium
QPLN

SEQ ID NO: 1111366 - protein, 7 aa, Mycobacterium
QPLPVSG

SEQ ID NO: 1111367 - protein, 6 aa, Mycobacterium
QPPATS

SEQ ID NO: 1111368 - protein, 8 aa, Mycobacterium
QPPAVQPE

SEQ ID NO: 1111369 - protein, 4 aa, Mycobacterium
QPPD

SEQ ID NO: 1111370 - protein, 6 aa, Mycobacterium
QPPDVS

SEQ ID NO: 1111371 - protein, 17 aa, Mycobacterium
QPPGYAPGYGAPGYPPQ

SEQ ID NO: 1111372 - protein, 4 aa, Mycobacterium
QPPV

SEQ ID NO: 1111373 - protein, 16 aa, Mycobacterium
QPPVPPKSVSPHADPA

SEQ ID NO: 1111374 - protein, 12 aa, Mycobacterium
QPPVPPPDIPEE

SEQ ID NO: 1111375 - protein, 21 aa, Mycobacterium
QPPYGQQPYGQPAYGQPAYGQ

SEQ ID NO: 1111376 - protein, 10 aa, Mycobacterium
QPQNATTAEG

SEQ ID NO: 1111377 - protein, 37 aa, Mycobacterium
QPQYGQQPQYGQPQYGQQPQYGQPGGYPPPFGGQVPG

SEQ ID NO: 1111378 - protein, 9 aa, Mycobacterium
QPSAGAAVG

SEQ ID NO: 1111379 - protein, 7 aa, Mycobacterium
QPSGRLN

SEQ ID NO: 1111380 - protein, 5 aa, Mycobacterium
QPSRR

SEQ ID NO: 1111381 - protein, 5 aa, Mycobacterium
QPTAL

SEQ ID NO: 1111382 - protein, 30 aa, Mycobacterium
QPVPPPPPFPQGAPPSAPGPGAEPPKERGS

SEQ ID NO: 1111383 - protein, 69 aa, Mycobacterium
QPVRKTARRGVEAAPRPRRTPTGRPTRDSRSAPQTAPIARPAELPARPKNATQAKARAKARKAKAPKVV

SEQ ID NO: 1111384 - protein, 70 aa, Mycobacterium
QPVRKTARRGVEAAPRPRRTPTGRPTRDSRSAPQTAPIARPAELPARPKNATQAKARAKARKAKAPKVVR

SEQ ID NO: 1111385 - protein, 6 aa, Mycobacterium
QPVSSP

SEQ ID NO: 1111386 - protein, 14 aa, Mycobacterium
QPWDDTVPVHVTWR

SEQ ID NO: 1111387 - protein, 11 aa, Mycobacterium
QPYGGSTTGWT

SEQ ID NO: 1111388 - protein, 5 aa, Mycobacterium
QQAGA

SEQ ID NO: 1111389 - protein, 9 aa, Mycobacterium
QQDPDARQP

SEQ ID NO: 1111390 - protein, 4 aa, Mycobacterium
QQEA

SEQ ID NO: 1111391 - protein, 7 aa, Mycobacterium
QQEPTPL

SEQ ID NO: 1111392 - protein, 5 aa, Mycobacterium
QQGAD

SEQ ID NO: 1111393 - protein, 16 aa, Mycobacterium
QQHGAAAADGQYRDGY

SEQ ID NO: 1111394 - protein, 6 aa, Mycobacterium
QQKADI

SEQ ID NO: 1111395 - protein, 9 aa, Mycobacterium
QQLANNDVQ

SEQ ID NO: 1111396 - protein, 4 aa, Mycobacterium
QQNR

SEQ ID NO: 1111397 - protein, 6 aa, Mycobacterium
QQPDTL

SEQ ID NO: 1111398 - protein, 7 aa, Mycobacterium
QQPGFAP

SEQ ID NO: 1111399 - protein, 10 aa, Mycobacterium
QQPLVEQKGQ

SEQ ID NO: 1111400 - protein, 7 aa, Mycobacterium
QQPPSTT

SEQ ID NO: 1111401 - protein, 13 aa, Mycobacterium
QQPSEAGSAYPDN

SEQ ID NO: 1111402 - protein, 27 aa, Mycobacterium
QQQPGHRPVGPDTGYQGADPYSQQQPY

SEQ ID NO: 1111403 - protein, 7 aa, Mycobacterium
QQRAQTI

SEQ ID NO: 1111404 - protein, 13 aa, Mycobacterium
QQRDADATQAREQ

SEQ ID NO: 1111405 - protein, 18 aa, Mycobacterium
QQRDQGQYTPKDKAPDPV

SEQ ID NO: 1111406 - protein, 11 aa, Mycobacterium
QQREAALNTEV

SEQ ID NO: 1111407 - protein, 11 aa, Mycobacterium
QQSNSQRGRAS

SEQ ID NO: 1111408 - protein, 16 aa, Mycobacterium
QQTRQIEAGGEAPDID

SEQ ID NO: 1111409 - protein, 9 aa, Mycobacterium
QQTYRDGGG

SEQ ID NO: 1111410 - protein, 6 aa, Mycobacterium
QQYPHA

SEQ ID NO: 1111411 - protein, 6 aa, Mycobacterium
QRAGAH

SEQ ID NO: 1111412 - protein, 7 aa, Mycobacterium
QRALRSA

SEQ ID NO: 1111413 - protein, 12 aa, Mycobacterium
QRDENGEPREFT

SEQ ID NO: 1111414 - protein, 6 aa, Mycobacterium
QRDGGD

SEQ ID NO: 1111415 - protein, 5 aa, Mycobacterium
QRDGR

SEQ ID NO: 1111416 - protein, 7 aa, Mycobacterium
QRDIAER

SEQ ID NO: 1111417 - protein, 4 aa, Mycobacterium
QRDQ

SEQ ID NO: 1111418 - protein, 10 aa, Mycobacterium
QREAALNTEV

SEQ ID NO: 1111419 - protein, 5 aa, Mycobacterium
QREED

SEQ ID NO: 1111420 - protein, 8 aa, Mycobacterium
QREEPGSE

SEQ ID NO: 1111421 - protein, 5 aa, Mycobacterium
QREGL

SEQ ID NO: 1111422 - protein, 9 aa, Mycobacterium
QRESSISTY

SEQ ID NO: 1111423 - protein, 4 aa, Mycobacterium
QRFG

SEQ ID NO: 1111424 - protein, 4 aa, Mycobacterium
QRGR

SEQ ID NO: 1111425 - protein, 5 aa, Mycobacterium
QRGRS

SEQ ID NO: 1111426 - protein, 8 aa, Mycobacterium
QRGSLPQT

SEQ ID NO: 1111427 - protein, 10 aa, Mycobacterium
QRKQAQLPED

SEQ ID NO: 1111428 - protein, 6 aa, Mycobacterium
QRLSRR

SEQ ID NO: 1111429 - protein, 6 aa, Mycobacterium
QRNGRA

SEQ ID NO: 1111430 - protein, 7 aa, Mycobacterium
QRNNARS

SEQ ID NO: 1111431 - protein, 5 aa, Mycobacterium
QRNTA

SEQ ID NO: 1111432 - protein, 15 aa, Mycobacterium
QRNVSAPHAGTVERA

SEQ ID NO: 1111433 - protein, 5 aa, Mycobacterium
QRPAG

SEQ ID NO: 1111434 - protein, 5 aa, Mycobacterium
QRPHH

SEQ ID NO: 1111435 - protein, 5 aa, Mycobacterium
QRPLD

SEQ ID NO: 1111436 - protein, 51 aa, Mycobacterium
QRPPQPEESDATTKIPTQQDPKSTEKLNAPEEQKRRGGGMSAAELLRREGR

SEQ ID NO: 1111437 - protein, 5 aa, Mycobacterium
QRPVI

SEQ ID NO: 1111438 - protein, 6 aa, Mycobacterium
QRQYPS

SEQ ID NO: 1111439 - protein, 19 aa, Mycobacterium
QRRADGTYEQVRPSHSWNS

SEQ ID NO: 1111440 - protein, 8 aa, Mycobacterium
QRRDGTEL

SEQ ID NO: 1111441 - protein, 14 aa, Mycobacterium
QRRQGQWRGHGESV

SEQ ID NO: 1111442 - protein, 4 aa, Mycobacterium
QRRS

SEQ ID NO: 1111443 - protein, 5 aa, Mycobacterium
QRRST

SEQ ID NO: 1111444 - protein, 17 aa, Mycobacterium
QRRVPTEVDSPERPPGD

SEQ ID NO: 1111445 - protein, 5 aa, Mycobacterium
QRSAD

SEQ ID NO: 1111446 - protein, 10 aa, Mycobacterium
QRSAGKTNAE

SEQ ID NO: 1111447 - protein, 14 aa, Mycobacterium
QRSEGGESGGAASL

SEQ ID NO: 1111448 - protein, 5 aa, Mycobacterium
QRSGK

SEQ ID NO: 1111449 - protein, 6 aa, Mycobacterium
QRSSPF

SEQ ID NO: 1111450 - protein, 6 aa, Mycobacterium
QRSSRF

SEQ ID NO: 1111451 - protein, 4 aa, Mycobacterium
QRTS

SEQ ID NO: 1111452 - protein, 10 aa, Mycobacterium
QRVDPSDANA

SEQ ID NO: 1111453 - protein, 7 aa, Mycobacterium
QRVSRRT

SEQ ID NO: 1111454 - protein, 4 aa, Mycobacterium
QSAA

SEQ ID NO: 1111455 - protein, 21 aa, Mycobacterium
QSAAGAAAAAQHEAAAAAYST

SEQ ID NO: 1111456 - protein, 8 aa, Mycobacterium
QSAALDQI

SEQ ID NO: 1111457 - protein, 7 aa, Mycobacterium
QSADTSS

SEQ ID NO: 1111458 - protein, 20 aa, Mycobacterium
QSAEDAAAVTADTHRAPTRD

SEQ ID NO: 1111459 - protein, 8 aa, Mycobacterium
QSANEIPG

SEQ ID NO: 1111460 - protein, 10 aa, Mycobacterium
QSAPAPASAL

SEQ ID NO: 1111461 - protein, 8 aa, Mycobacterium
QSAPGGQE

SEQ ID NO: 1111462 - protein, 9 aa, Mycobacterium
QSAPPGQAG

SEQ ID NO: 1111463 - protein, 5 aa, Mycobacterium
QSAPV

SEQ ID NO: 1111464 - protein, 7 aa, Mycobacterium
QSATADS

SEQ ID NO: 1111465 - protein, 53 aa, Mycobacterium
QSATTTSAPLSTSSSVAAPPTPTPSPSPTPTPAPTVDEESVPSPTAPALPTTT

SEQ ID NO: 1111466 - protein, 6 aa, Mycobacterium
QSAVGE

SEQ ID NO: 1111467 - protein, 9 aa, Mycobacterium
QSDADQAKV

SEQ ID NO: 1111468 - protein, 5 aa, Mycobacterium
QSDAP

SEQ ID NO: 1111469 - protein, 5 aa, Mycobacterium
QSDDI

SEQ ID NO: 1111470 - protein, 20 aa, Mycobacterium
QSDGPNDPRLDQLYAWWGTH

SEQ ID NO: 1111471 - protein, 9 aa, Mycobacterium
QSGDDDAQN

SEQ ID NO: 1111472 - protein, 6 aa, Mycobacterium
QSGESL

SEQ ID NO: 1111473 - protein, 7 aa, Mycobacterium
QSGQGIG

SEQ ID NO: 1111474 - protein, 8 aa, Mycobacterium
QSGQPVAT

SEQ ID NO: 1111475 - protein, 10 aa, Mycobacterium
QSGSSNPGTG

SEQ ID NO: 1111476 - protein, 5 aa, Mycobacterium
QSGYL

SEQ ID NO: 1111477 - protein, 10 aa, Mycobacterium
QSHEADKQRR

SEQ ID NO: 1111478 - protein, 20 aa, Mycobacterium
QSISSRNVSYDSNAAAKSRF

SEQ ID NO: 1111479 - protein, 6 aa, Mycobacterium
QSITTA

SEQ ID NO: 1111480 - protein, 18 aa, Mycobacterium
QSKRAGGNRVVHDRLDIP

SEQ ID NO: 1111481 - protein, 9 aa, Mycobacterium
QSLNSRNES

SEQ ID NO: 1111482 - protein, 8 aa, Mycobacterium
QSNADEDK

SEQ ID NO: 1111483 - protein, 7 aa, Mycobacterium
QSPGAAG

SEQ ID NO: 1111484 - protein, 17 aa, Mycobacterium
QSPNSQYARAASRSLRE

SEQ ID NO: 1111485 - protein, 10 aa, Mycobacterium
QSPPPGRVQP

SEQ ID NO: 1111486 - protein, 21 aa, Mycobacterium
QSPQTSGPPVTSTPPRTTASQ

SEQ ID NO: 1111487 - protein, 5 aa, Mycobacterium
QSPRW

SEQ ID NO: 1111488 - protein, 10 aa, Mycobacterium
QSPTTPRSRV

SEQ ID NO: 1111489 - protein, 7 aa, Mycobacterium
QSRSLPD

SEQ ID NO: 1111490 - protein, 10 aa, Mycobacterium
QSSGNTLGDL

SEQ ID NO: 1111491 - protein, 6 aa, Mycobacterium
QSSNRF

SEQ ID NO: 1111492 - protein, 6 aa, Mycobacterium
QSSRLG

SEQ ID NO: 1111493 - protein, 10 aa, Mycobacterium
QSSSSDFAKL

SEQ ID NO: 1111494 - protein, 12 aa, Mycobacterium
QSSVPQPPPSQL

SEQ ID NO: 1111495 - protein, 4 aa, Mycobacterium
QSTG

SEQ ID NO: 1111496 - protein, 21 aa, Mycobacterium
QSTGANANAIDSTNASFASLG

SEQ ID NO: 1111497 - protein, 7 aa, Mycobacterium
QSTPGLD

SEQ ID NO: 1111498 - protein, 8 aa, Mycobacterium
QSTTQQLN

SEQ ID NO: 1111499 - protein, 11 aa, Mycobacterium
QSVDKGQMEAA

SEQ ID NO: 1111500 - protein, 5 aa, Mycobacterium
QSWPT

SEQ ID NO: 1111501 - protein, 8 aa, Mycobacterium
QSWRPGAS

SEQ ID NO: 1111502 - protein, 4 aa, Mycobacterium
QSWT

SEQ ID NO: 1111503 - protein, 11 aa, Mycobacterium
QSWTDPQPRTV

SEQ ID NO: 1111504 - protein, 7 aa, Mycobacterium
QSYDQLS

SEQ ID NO: 1111505 - protein, 6 aa, Mycobacterium
QTAADI

SEQ ID NO: 1111506 - protein, 11 aa, Mycobacterium
QTAPEPYPGPG

SEQ ID NO: 1111507 - protein, 6 aa, Mycobacterium
QTASGS

SEQ ID NO: 1111508 - protein, 12 aa, Mycobacterium
QTASTSLPEQKD

SEQ ID NO: 1111509 - protein, 6 aa, Mycobacterium
QTDDGS

SEQ ID NO: 1111510 - protein, 8 aa, Mycobacterium
QTDPAALD

SEQ ID NO: 1111511 - protein, 24 aa, Mycobacterium
QTDSGPYLEDGSRISRDKTTIPQE

SEQ ID NO: 1111512 - protein, 4 aa, Mycobacterium
QTEG

SEQ ID NO: 1111513 - protein, 10 aa, Mycobacterium
QTEQDGVPHT

SEQ ID NO: 1111514 - protein, 5 aa, Mycobacterium
QTESP

SEQ ID NO: 1111515 - protein, 4 aa, Mycobacterium
QTGG

SEQ ID NO: 1111516 - protein, 6 aa, Mycobacterium
QTLNTE

SEQ ID NO: 1111517 - protein, 11 aa, Mycobacterium
QTNANLGEDPV

SEQ ID NO: 1111518 - protein, 4 aa, Mycobacterium
QTNV

SEQ ID NO: 1111519 - protein, 12 aa, Mycobacterium
QTPAGTKTTAPR

SEQ ID NO: 1111520 - protein, 9 aa, Mycobacterium
QTPAPPGLK

SEQ ID NO: 1111521 - protein, 4 aa, Mycobacterium
QTPD

SEQ ID NO: 1111522 - protein, 17 aa, Mycobacterium
QTPDEQSPAESAGRINH

SEQ ID NO: 1111523 - protein, 26 aa, Mycobacterium
QTPDLESGGGVTPGATPPDSDQMSGI

SEQ ID NO: 1111524 - protein, 15 aa, Mycobacterium
QTQRFTGEGDQPTTV

SEQ ID NO: 1111525 - protein, 9 aa, Mycobacterium
QTRDRGSAA

SEQ ID NO: 1111526 - protein, 10 aa, Mycobacterium
QTRTKGQVDS

SEQ ID NO: 1111527 - protein, 7 aa, Mycobacterium
QTRYDTK

SEQ ID NO: 1111528 - protein, 4 aa, Mycobacterium
QTSA

SEQ ID NO: 1111529 - protein, 8 aa, Mycobacterium
QTSPARGA

SEQ ID NO: 1111530 - protein, 13 aa, Mycobacterium
QTSPFVEDEENGH

SEQ ID NO: 1111531 - protein, 8 aa, Mycobacterium
QTSTSPDW

SEQ ID NO: 1111532 - protein, 15 aa, Mycobacterium
QTTGTGAADQRVGNW

SEQ ID NO: 1111533 - protein, 6 aa, Mycobacterium
QTVESA

SEQ ID NO: 1111534 - protein, 12 aa, Mycobacterium
QTVQPPPQTTIA

SEQ ID NO: 1111535 - protein, 5 aa, Mycobacterium
QVADA

SEQ ID NO: 1111536 - protein, 5 aa, Mycobacterium
QVAEA

SEQ ID NO: 1111537 - protein, 12 aa, Mycobacterium
QVAGEAAATLHP

SEQ ID NO: 1111538 - protein, 11 aa, Mycobacterium
QVARDDARPHL

SEQ ID NO: 1111539 - protein, 12 aa, Mycobacterium
QVDASGERLEGV

SEQ ID NO: 1111540 - protein, 12 aa, Mycobacterium
QVDDQEKPAREL

SEQ ID NO: 1111541 - protein, 7 aa, Mycobacterium
QVDGATQ

SEQ ID NO: 1111542 - protein, 18 aa, Mycobacterium
QVDGESRSDIAEVTLNAA

SEQ ID NO: 1111543 - protein, 7 aa, Mycobacterium
QVDTSAA

SEQ ID NO: 1111544 - protein, 17 aa, Mycobacterium
QVEPPDTAADCECESRK

SEQ ID NO: 1111545 - protein, 5 aa, Mycobacterium
QVNTP

SEQ ID NO: 1111546 - protein, 5 aa, Mycobacterium
QVPAD

SEQ ID NO: 1111547 - protein, 5 aa, Mycobacterium
QVPPA

SEQ ID NO: 1111548 - protein, 19 aa, Mycobacterium
QVPPTLEEASRSLGVSPTR

SEQ ID NO: 1111549 - protein, 6 aa, Mycobacterium
QVRADD

SEQ ID NO: 1111550 - protein, 21 aa, Mycobacterium
QVSDTAAGKGAELADKAHEAG

SEQ ID NO: 1111551 - protein, 8 aa, Mycobacterium
QVSGPTGA

SEQ ID NO: 1111552 - protein, 8 aa, Mycobacterium
QVSTGGPM

SEQ ID NO: 1111553 - protein, 5 aa, Mycobacterium
QVTGG

SEQ ID NO: 1111554 - protein, 9 aa, Mycobacterium
QVTGGPAFG

SEQ ID NO: 1111555 - protein, 4 aa, Mycobacterium
QVTR

SEQ ID NO: 1111556 - protein, 6 aa, Mycobacterium
QVTSST

SEQ ID NO: 1111557 - protein, 12 aa, Mycobacterium
QVTTETNGDYGR

SEQ ID NO: 1111558 - protein, 9 aa, Mycobacterium
QWQAAQDGG

SEQ ID NO: 1111559 - protein, 15 aa, Mycobacterium
QWRSPEDETTIDTPD

SEQ ID NO: 1111560 - protein, 8 aa, Mycobacterium
QWTPPKPA

SEQ ID NO: 1111561 - protein, 9 aa, Mycobacterium
QYADDVADK

SEQ ID NO: 1111562 - protein, 5 aa, Mycobacterium
QYDPV

SEQ ID NO: 1111563 - protein, 7 aa, Mycobacterium
QYGPRAP

SEQ ID NO: 1111564 - protein, 10 aa, Mycobacterium
QYPEQQQAGV

SEQ ID NO: 1111565 - protein, 7 aa, Mycobacterium
QYQSGRG

SEQ ID NO: 1111566 - protein, 8 aa, Mycobacterium
RAAAPAAV

SEQ ID NO: 1111567 - protein, 8 aa, Mycobacterium
RAAAQQKF

SEQ ID NO: 1111568 - protein, 6 aa, Mycobacterium
RAAARR

SEQ ID NO: 1111569 - protein, 10 aa, Mycobacterium
RAAASADVEE

SEQ ID NO: 1111570 - protein, 11 aa, Mycobacterium
RAAERTTDDAR

SEQ ID NO: 1111571 - protein, 6 aa, Mycobacterium
RAAGEV

SEQ ID NO: 1111572 - protein, 7 aa, Mycobacterium
RAAGGSR

SEQ ID NO: 1111573 - protein, 5 aa, Mycobacterium
RAAGN

SEQ ID NO: 1111574 - protein, 7 aa, Mycobacterium
RAAGSAH

SEQ ID NO: 1111575 - protein, 77 aa, Mycobacterium
RAANAPAPGAKPSRKKKAGTDSAVAGPSDGAAGAESAGIDEAPSETPPAAESPTTSAAQGGASNRTPRPGARPKKRK

SEQ ID NO: 1111576 - protein, 9 aa, Mycobacterium
RAAPPPGSH

SEQ ID NO: 1111577 - protein, 13 aa, Mycobacterium
RAAQDSGTKDPSV

SEQ ID NO: 1111578 - protein, 13 aa, Mycobacterium
RAARAGRAAAEQG

SEQ ID NO: 1111579 - protein, 11 aa, Mycobacterium
RAARETLSGDD

SEQ ID NO: 1111580 - protein, 5 aa, Mycobacterium
RAARG

SEQ ID NO: 1111581 - protein, 15 aa, Mycobacterium
RAARPSEGSGPLPRA

SEQ ID NO: 1111582 - protein, 6 aa, Mycobacterium
RAASPA

SEQ ID NO: 1111583 - protein, 7 aa, Mycobacterium
RAATGAA

SEQ ID NO: 1111584 - protein, 4 aa, Mycobacterium
RADA

SEQ ID NO: 1111585 - protein, 6 aa, Mycobacterium
RADGRL

SEQ ID NO: 1111586 - protein, 9 aa, Mycobacterium
RADGRVPSL

SEQ ID NO: 1111587 - protein, 19 aa, Mycobacterium
RADHRDDSVDDSHGYDDDD

SEQ ID NO: 1111588 - protein, 14 aa, Mycobacterium
RADNALTGEDESAI

SEQ ID NO: 1111589 - protein, 11 aa, Mycobacterium
RADVEDTGGAG

SEQ ID NO: 1111590 - protein, 16 aa, Mycobacterium
RAEASGLSGDGGLIER

SEQ ID NO: 1111591 - protein, 12 aa, Mycobacterium
RAEGLRAEAAGQ

SEQ ID NO: 1111592 - protein, 7 aa, Mycobacterium
RAEIGPQ

SEQ ID NO: 1111593 - protein, 4 aa, Mycobacterium
RAEQ

SEQ ID NO: 1111594 - protein, 6 aa, Mycobacterium
RAEQLG

SEQ ID NO: 1111595 - protein, 7 aa, Mycobacterium
RAERASA

SEQ ID NO: 1111596 - protein, 13 aa, Mycobacterium
RAERGDASSGPPT

SEQ ID NO: 1111597 - protein, 6 aa, Mycobacterium
RAERQK

SEQ ID NO: 1111598 - protein, 5 aa, Mycobacterium
RAESA

SEQ ID NO: 1111599 - protein, 7 aa, Mycobacterium
RAESAEL

SEQ ID NO: 1111600 - protein, 8 aa, Mycobacterium
RAESDGRT

SEQ ID NO: 1111601 - protein, 8 aa, Mycobacterium
RAETTEFG

SEQ ID NO: 1111602 - protein, 6 aa, Mycobacterium
RAEVDT

SEQ ID NO: 1111603 - protein, 15 aa, Mycobacterium
RAGAASAVTSTSRQV

SEQ ID NO: 1111604 - protein, 12 aa, Mycobacterium
RAGDVSSVEADK

SEQ ID NO: 1111605 - protein, 7 aa, Mycobacterium
RAGEGTV

SEQ ID NO: 1111606 - protein, 5 aa, Mycobacterium
RAGET

SEQ ID NO: 1111607 - protein, 17 aa, Mycobacterium
RAGETGDVEDAPDVVPT

SEQ ID NO: 1111608 - protein, 14 aa, Mycobacterium
RAGGTAEVPPGMGP

SEQ ID NO: 1111609 - protein, 4 aa, Mycobacterium
RAGL

SEQ ID NO: 1111610 - protein, 7 aa, Mycobacterium
RAGLAGV

SEQ ID NO: 1111611 - protein, 44 aa, Mycobacterium
RAGPRGETRGAAQGRGSSTRRTRGDDRGASRPRRVSGSCEPGGG

SEQ ID NO: 1111612 - protein, 11 aa, Mycobacterium
RAGRRPQPLRG

SEQ ID NO: 1111613 - protein, 8 aa, Mycobacterium
RAGRTTPL

SEQ ID NO: 1111614 - protein, 9 aa, Mycobacterium
RAGRTTPLA

SEQ ID NO: 1111615 - protein, 28 aa, Mycobacterium
RAGRTTPLAATPVDPAASHSGVAPVGAP

SEQ ID NO: 1111616 - protein, 7 aa, Mycobacterium
RAGSETR

SEQ ID NO: 1111617 - protein, 18 aa, Mycobacterium
RAGSGTTPAPREGNSLAA

SEQ ID NO: 1111618 - protein, 9 aa, Mycobacterium
RAGTDSRQL

SEQ ID NO: 1111619 - protein, 14 aa, Mycobacterium
RAGTRRAKPADRHT

SEQ ID NO: 1111620 - protein, 31 aa, Mycobacterium
RAGTVAGKPPRTLPGKPGAAAPNGVTAPGVA

SEQ ID NO: 1111621 - protein, 10 aa, Mycobacterium
RAHASSDAPM

SEQ ID NO: 1111622 - protein, 11 aa, Mycobacterium
RAHDERQAAEI

SEQ ID NO: 1111623 - protein, 19 aa, Mycobacterium
RAHGPDDGDVTRLDDAQVR

SEQ ID NO: 1111624 - protein, 19 aa, Mycobacterium
RAHGPEDGDVTRLDDENVR

SEQ ID NO: 1111625 - protein, 15 aa, Mycobacterium
RAHRAEDEAEGDPAD

SEQ ID NO: 1111626 - protein, 7 aa, Mycobacterium
RAHTGPV

SEQ ID NO: 1111627 - protein, 6 aa, Mycobacterium
RAINEP

SEQ ID NO: 1111628 - protein, 6 aa, Mycobacterium
RAISSR

SEQ ID NO: 1111629 - protein, 9 aa, Mycobacterium
RAKDSDRND

SEQ ID NO: 1111630 - protein, 14 aa, Mycobacterium
RALDAAATRRASRD

SEQ ID NO: 1111631 - protein, 7 aa, Mycobacterium
RALGASR

SEQ ID NO: 1111632 - protein, 10 aa, Mycobacterium
RALGGAPTEA

SEQ ID NO: 1111633 - protein, 5 aa, Mycobacterium
RALTA

SEQ ID NO: 1111634 - protein, 5 aa, Mycobacterium
RAMGT

SEQ ID NO: 1111635 - protein, 18 aa, Mycobacterium
RANGEELAGLSPRDYPGA

SEQ ID NO: 1111636 - protein, 18 aa, Mycobacterium
RANGEELTGLSPRDYPGA

SEQ ID NO: 1111637 - protein, 21 aa, Mycobacterium
RANPAADPQAVTGGKAASDGL

SEQ ID NO: 1111638 - protein, 9 aa, Mycobacterium
RANPEPPSI

SEQ ID NO: 1111639 - protein, 15 aa, Mycobacterium
RANSRSAGSTGPASV

SEQ ID NO: 1111640 - protein, 10 aa, Mycobacterium
RANTSVPPDI

SEQ ID NO: 1111641 - protein, 4 aa, Mycobacterium
RAPA

SEQ ID NO: 1111642 - protein, 8 aa, Mycobacterium
RAPAAPGS

SEQ ID NO: 1111643 - protein, 10 aa, Mycobacterium
RAPAKSVGSV

SEQ ID NO: 1111644 - protein, 4 aa, Mycobacterium
RAPD

SEQ ID NO: 1111645 - protein, 15 aa, Mycobacterium
RAPEVGAPSEIPGFS

SEQ ID NO: 1111646 - protein, 12 aa, Mycobacterium
RAPFTGDGPTDA

SEQ ID NO: 1111647 - protein, 15 aa, Mycobacterium
RAPGAGRAEAAPIQE

SEQ ID NO: 1111648 - protein, 16 aa, Mycobacterium
RAPGQPEDTLTPVESA

SEQ ID NO: 1111649 - protein, 4 aa, Mycobacterium
RAPR

SEQ ID NO: 1111650 - protein, 10 aa, Mycobacterium
RAPRPSAPGD

SEQ ID NO: 1111651 - protein, 11 aa, Mycobacterium
RAPRQSPPPVM

SEQ ID NO: 1111652 - protein, 7 aa, Mycobacterium
RAPRSSA

SEQ ID NO: 1111653 - protein, 12 aa, Mycobacterium
RAPSSPEQARAN

SEQ ID NO: 1111654 - protein, 7 aa, Mycobacterium
RAPTAGV

SEQ ID NO: 1111655 - protein, 6 aa, Mycobacterium
RAQAPQ

SEQ ID NO: 1111656 - protein, 10 aa, Mycobacterium
RAQPGGQQPD

SEQ ID NO: 1111657 - protein, 6 aa, Mycobacterium
RAQPHR

SEQ ID NO: 1111658 - protein, 17 aa, Mycobacterium
RAQQDPTGPTGGGVRTE

SEQ ID NO: 1111659 - protein, 4 aa, Mycobacterium
RAQR

SEQ ID NO: 1111660 - protein, 10 aa, Mycobacterium
RAQSDTAGTV

SEQ ID NO: 1111661 - protein, 7 aa, Mycobacterium
RAQSGRS

SEQ ID NO: 1111662 - protein, 5 aa, Mycobacterium
RAQSL

SEQ ID NO: 1111663 - protein, 10 aa, Mycobacterium
RAQTLTTEAY

SEQ ID NO: 1111664 - protein, 12 aa, Mycobacterium
RAQTTRQPSPGT

SEQ ID NO: 1111665 - protein, 7 aa, Mycobacterium
RARAEEE

SEQ ID NO: 1111666 - protein, 9 aa, Mycobacterium
RARGDGEIH

SEQ ID NO: 1111667 - protein, 21 aa, Mycobacterium
RARGRAAASRIGGGSPRPAPL

SEQ ID NO: 1111668 - protein, 38 aa, Mycobacterium
RARQPAAPRQSTAPPAKKTAARPAKTARKTTASRRATA

SEQ ID NO: 1111669 - protein, 7 aa, Mycobacterium
RARRGDA

SEQ ID NO: 1111670 - protein, 15 aa, Mycobacterium
RARSSAVPGPTGMPA

SEQ ID NO: 1111671 - protein, 34 aa, Mycobacterium
RARTEQVNKESAARLAKQKADQAAADAEASQRAA

SEQ ID NO: 1111672 - protein, 6 aa, Mycobacterium
RARTTV

SEQ ID NO: 1111673 - protein, 7 aa, Mycobacterium
RASAPGA

SEQ ID NO: 1111674 - protein, 7 aa, Mycobacterium
RASGGDS

SEQ ID NO: 1111675 - protein, 9 aa, Mycobacterium
RASGPGAGL

SEQ ID NO: 1111676 - protein, 13 aa, Mycobacterium
RASGRAAAAGGRA

SEQ ID NO: 1111677 - protein, 5 aa, Mycobacterium
RASLD

SEQ ID NO: 1111678 - protein, 5 aa, Mycobacterium
RASRA

SEQ ID NO: 1111679 - protein, 4 aa, Mycobacterium
RAST

SEQ ID NO: 1111680 - protein, 9 aa, Mycobacterium
RATAPPDVA

SEQ ID NO: 1111681 - protein, 9 aa, Mycobacterium
RATATSQRR

SEQ ID NO: 1111682 - protein, 5 aa, Mycobacterium
RATGG

SEQ ID NO: 1111683 - protein, 16 aa, Mycobacterium
RATGGISPQERQRLPG

SEQ ID NO: 1111684 - protein, 5 aa, Mycobacterium
RATGS

SEQ ID NO: 1111685 - protein, 4 aa, Mycobacterium
RATT

SEQ ID NO: 1111686 - protein, 5 aa, Mycobacterium
RAVPG

SEQ ID NO: 1111687 - protein, 5 aa, Mycobacterium
RAVPT

SEQ ID NO: 1111688 - protein, 6 aa, Mycobacterium
RAWDGQ

SEQ ID NO: 1111689 - protein, 10 aa, Mycobacterium
RCDSGSTPAA

SEQ ID NO: 1111690 - protein, 5 aa, Mycobacterium
RCGQE

SEQ ID NO: 1111691 - protein, 22 aa, Mycobacterium
RCSSGRIEASENGWQPRGDPME

SEQ ID NO: 1111692 - protein, 4 aa, Mycobacterium
RDAA

SEQ ID NO: 1111693 - protein, 10 aa, Mycobacterium
RDAAPSGEYA

SEQ ID NO: 1111694 - protein, 8 aa, Mycobacterium
RDAATTRQ

SEQ ID NO: 1111695 - protein, 8 aa, Mycobacterium
RDAETQNL

SEQ ID NO: 1111696 - protein, 9 aa, Mycobacterium
RDAGRIDEE

SEQ ID NO: 1111697 - protein, 6 aa, Mycobacterium
RDAGSG

SEQ ID NO: 1111698 - protein, 8 aa, Mycobacterium
RDAPSLQT

SEQ ID NO: 1111699 - protein, 10 aa, Mycobacterium
RDATGSGSAE

SEQ ID NO: 1111700 - protein, 6 aa, Mycobacterium
RDAVET

SEQ ID NO: 1111701 - protein, 8 aa, Mycobacterium
RDAYSGTG

SEQ ID NO: 1111702 - protein, 6 aa, Mycobacterium
RDCTPA

SEQ ID NO: 1111703 - protein, 16 aa, Mycobacterium
RDDDDDDDDAKVAGKN

SEQ ID NO: 1111704 - protein, 9 aa, Mycobacterium
RDDDQRSAV

SEQ ID NO: 1111705 - protein, 4 aa, Mycobacterium
RDDE

SEQ ID NO: 1111706 - protein, 7 aa, Mycobacterium
RDDPADV

SEQ ID NO: 1111707 - protein, 12 aa, Mycobacterium
RDDRRADPPVQR

SEQ ID NO: 1111708 - protein, 13 aa, Mycobacterium
RDDSIDKTDLTDA

SEQ ID NO: 1111709 - protein, 6 aa, Mycobacterium
RDDVGR

SEQ ID NO: 1111710 - protein, 8 aa, Mycobacterium
RDEDLPPT

SEQ ID NO: 1111711 - protein, 14 aa, Mycobacterium
RDEGGLTASFTIPV

SEQ ID NO: 1111712 - protein, 8 aa, Mycobacterium
RDEIATPA

SEQ ID NO: 1111713 - protein, 9 aa, Mycobacterium
RDENAAVRA

SEQ ID NO: 1111714 - protein, 16 aa, Mycobacterium
RDENGKPQTAATLNGT

SEQ ID NO: 1111715 - protein, 11 aa, Mycobacterium
RDGAEKTVAPA

SEQ ID NO: 1111716 - protein, 11 aa, Mycobacterium
RDGAPPPLRDP

SEQ ID NO: 1111717 - protein, 10 aa, Mycobacterium
RDGEDVAEEK

SEQ ID NO: 1111718 - protein, 9 aa, Mycobacterium
RDGENRSVQ

SEQ ID NO: 1111719 - protein, 5 aa, Mycobacterium
RDGRN

SEQ ID NO: 1111720 - protein, 4 aa, Mycobacterium
RDGT

SEQ ID NO: 1111721 - protein, 12 aa, Mycobacterium
RDGTEKTVAPTD

SEQ ID NO: 1111722 - protein, 14 aa, Mycobacterium
RDGVDELNSGAQRL

SEQ ID NO: 1111723 - protein, 7 aa, Mycobacterium
RDGVTVR

SEQ ID NO: 1111724 - protein, 14 aa, Mycobacterium
RDHHADEPKPIDAS

SEQ ID NO: 1111725 - protein, 8 aa, Mycobacterium
RDKARAAI

SEQ ID NO: 1111726 - protein, 13 aa, Mycobacterium
RDKLTGEYRGGPA

SEQ ID NO: 1111727 - protein, 6 aa, Mycobacterium
RDKVQE

SEQ ID NO: 1111728 - protein, 8 aa, Mycobacterium
RDLDGDGE

SEQ ID NO: 1111729 - protein, 8 aa, Mycobacterium
RDLPPSAV

SEQ ID NO: 1111730 - protein, 11 aa, Mycobacterium
RDLQRPHDPWE

SEQ ID NO: 1111731 - protein, 6 aa, Mycobacterium
RDLRNS

SEQ ID NO: 1111732 - protein, 8 aa, Mycobacterium
RDNDRAGA

SEQ ID NO: 1111733 - protein, 7 aa, Mycobacterium
RDNITAS

SEQ ID NO: 1111734 - protein, 38 aa, Mycobacterium
RDNPGLHRPSVPPDRRPRHSAEHRQRTPDQTPPNGRSP

SEQ ID NO: 1111735 - protein, 26 aa, Mycobacterium
RDNRSGEAGGVTTAARPTAEAQPGWR

SEQ ID NO: 1111736 - protein, 9 aa, Mycobacterium
RDNTDTFNA

SEQ ID NO: 1111737 - protein, 8 aa, Mycobacterium
RDPAETEV

SEQ ID NO: 1111738 - protein, 28 aa, Mycobacterium
RDPAPVFPAGPTASQITVTDPAQPFPLS

SEQ ID NO: 1111739 - protein, 5 aa, Mycobacterium
RDPAT

SEQ ID NO: 1111740 - protein, 9 aa, Mycobacterium
RDPHGRHRP

SEQ ID NO: 1111741 - protein, 28 aa, Mycobacterium
RDPLRAQRDPLAADSGRARSNRDDRRQW

SEQ ID NO: 1111742 - protein, 9 aa, Mycobacterium
RDPPPEPES

SEQ ID NO: 1111743 - protein, 4 aa, Mycobacterium
RDPR

SEQ ID NO: 1111744 - protein, 16 aa, Mycobacterium
RDPRGIQQGTGPQAAV

SEQ ID NO: 1111745 - protein, 7 aa, Mycobacterium
RDPTARR

SEQ ID NO: 1111746 - protein, 8 aa, Mycobacterium
RDPTSRRP

SEQ ID NO: 1111747 - protein, 6 aa, Mycobacterium
RDQETA

SEQ ID NO: 1111748 - protein, 22 aa, Mycobacterium
RDRAETGGASKRDAGERKSKKS

SEQ ID NO: 1111749 - protein, 7 aa, Mycobacterium
RDRDEEL

SEQ ID NO: 1111750 - protein, 6 aa, Mycobacterium
RDRGPV

SEQ ID NO: 1111751 - protein, 6 aa, Mycobacterium
RDRGVK

SEQ ID NO: 1111752 - protein, 4 aa, Mycobacterium
RDRP

SEQ ID NO: 1111753 - protein, 23 aa, Mycobacterium
RDRTRTEAVAPPAVDTAAPTSEV

SEQ ID NO: 1111754 - protein, 12 aa, Mycobacterium
RDSEAAAEQSRR

SEQ ID NO: 1111755 - protein, 10 aa, Mycobacterium
RDSETAPIQT

SEQ ID NO: 1111756 - protein, 6 aa, Mycobacterium
RDSGAL

SEQ ID NO: 1111757 - protein, 31 aa, Mycobacterium
RDSGTQTASTATSTTQTSSPFDVPPPTEAGA

SEQ ID NO: 1111758 - protein, 4 aa, Mycobacterium
RDSL

SEQ ID NO: 1111759 - protein, 15 aa, Mycobacterium
RDSRADVRVPGDRLR

SEQ ID NO: 1111760 - protein, 14 aa, Mycobacterium
RDTRRRNETATERL

SEQ ID NO: 1111761 - protein, 7 aa, Mycobacterium
RDTTNQF

SEQ ID NO: 1111762 - protein, 12 aa, Mycobacterium
RDVPPPDGTPPR

SEQ ID NO: 1111763 - protein, 12 aa, Mycobacterium
RDVTERRREQDR

SEQ ID NO: 1111764 - protein, 4 aa, Mycobacterium
RDWG

SEQ ID NO: 1111765 - protein, 23 aa, Mycobacterium
RDYPGNATATAQQVAADRATTSN

SEQ ID NO: 1111766 - protein, 10 aa, Mycobacterium
REAAAHNATM

SEQ ID NO: 1111767 - protein, 18 aa, Mycobacterium
REAAGKGELVGSAPRRRG

SEQ ID NO: 1111768 - protein, 11 aa, Mycobacterium
READSQRAQGV

SEQ ID NO: 1111769 - protein, 8 aa, Mycobacterium
REAEDLSE

SEQ ID NO: 1111770 - protein, 11 aa, Mycobacterium
REAGGHFKTPT

SEQ ID NO: 1111771 - protein, 13 aa, Mycobacterium
REAGLSDANGTFP

SEQ ID NO: 1111772 - protein, 10 aa, Mycobacterium
REAHAAGRLQ

SEQ ID NO: 1111773 - protein, 18 aa, Mycobacterium
REAIEGARHSGSATLGTF

SEQ ID NO: 1111774 - protein, 8 aa, Mycobacterium
REANDTVN

SEQ ID NO: 1111775 - protein, 14 aa, Mycobacterium
REAPATGARTGDPV

SEQ ID NO: 1111776 - protein, 7 aa, Mycobacterium
REAQQKL

SEQ ID NO: 1111777 - protein, 14 aa, Mycobacterium
REARVAREAAQQES

SEQ ID NO: 1111778 - protein, 6 aa, Mycobacterium
REASAD

SEQ ID NO: 1111779 - protein, 14 aa, Mycobacterium
REATAGTVERPGAV

SEQ ID NO: 1111780 - protein, 8 aa, Mycobacterium
REATPEDF

SEQ ID NO: 1111781 - protein, 24 aa, Mycobacterium
REATTNGTPPTDTKPPAGSKPAAA

SEQ ID NO: 1111782 - protein, 11 aa, Mycobacterium
REDGPALGVTG

SEQ ID NO: 1111783 - protein, 18 aa, Mycobacterium
REDGPPSHHKKRGTPSMG

SEQ ID NO: 1111784 - protein, 4 aa, Mycobacterium
REDI

SEQ ID NO: 1111785 - protein, 4 aa, Mycobacterium
REEG

SEQ ID NO: 1111786 - protein, 13 aa, Mycobacterium
REEGRRSSGQPPP

SEQ ID NO: 1111787 - protein, 12 aa, Mycobacterium
REEQSATGLPGG

SEQ ID NO: 1111788 - protein, 8 aa, Mycobacterium
REESGRSV

SEQ ID NO: 1111789 - protein, 20 aa, Mycobacterium
REETADDDHDGVPDVYQTRQ

SEQ ID NO: 1111790 - protein, 11 aa, Mycobacterium
REETPEHGTRD

SEQ ID NO: 1111791 - protein, 4 aa, Mycobacterium
REGA

SEQ ID NO: 1111792 - protein, 8 aa, Mycobacterium
REGDSDSS

SEQ ID NO: 1111793 - protein, 6 aa, Mycobacterium
REGELP

SEQ ID NO: 1111794 - protein, 6 aa, Mycobacterium
REGETL

SEQ ID NO: 1111795 - protein, 11 aa, Mycobacterium
REGGERSPGRL

SEQ ID NO: 1111796 - protein, 5 aa, Mycobacterium
REGIG

SEQ ID NO: 1111797 - protein, 11 aa, Mycobacterium
REGKDREAGSV

SEQ ID NO: 1111798 - protein, 7 aa, Mycobacterium
REGRGAP

SEQ ID NO: 1111799 - protein, 4 aa, Mycobacterium
REGV

SEQ ID NO: 1111800 - protein, 4 aa, Mycobacterium
REGY

SEQ ID NO: 1111801 - protein, 5 aa, Mycobacterium
REIGP

SEQ ID NO: 1111802 - protein, 16 aa, Mycobacterium
REITDGPRDQAPRGGR

SEQ ID NO: 1111803 - protein, 5 aa, Mycobacterium
REKHG

SEQ ID NO: 1111804 - protein, 4 aa, Mycobacterium
REKI

SEQ ID NO: 1111805 - protein, 5 aa, Mycobacterium
REKPW

SEQ ID NO: 1111806 - protein, 5 aa, Mycobacterium
RELDG

SEQ ID NO: 1111807 - protein, 6 aa, Mycobacterium
RENGTI

SEQ ID NO: 1111808 - protein, 7 aa, Mycobacterium
RENSPIA

SEQ ID NO: 1111809 - protein, 50 aa, Mycobacterium
REPALAGVGPSPHQQSASGGGGPAGRPPAPTSPAGSAPSAPSLDSSQTAC

SEQ ID NO: 1111810 - protein, 8 aa, Mycobacterium
REPAPYGR

SEQ ID NO: 1111811 - protein, 10 aa, Mycobacterium
REPKPDLTDE

SEQ ID NO: 1111812 - protein, 13 aa, Mycobacterium
REPVGVNPQAGRR

SEQ ID NO: 1111813 - protein, 6 aa, Mycobacterium
REQNSG

SEQ ID NO: 1111814 - protein, 5 aa, Mycobacterium
RERAG

SEQ ID NO: 1111815 - protein, 7 aa, Mycobacterium
RERESDL

SEQ ID NO: 1111816 - protein, 8 aa, Mycobacterium
RERGMSTA

SEQ ID NO: 1111817 - protein, 4 aa, Mycobacterium
RERR

SEQ ID NO: 1111818 - protein, 12 aa, Mycobacterium
RERRAAASAAGR

SEQ ID NO: 1111819 - protein, 34 aa, Mycobacterium
RERRRTRRRPRHRRNRVTPADRSSSAASPDIAAT

SEQ ID NO: 1111820 - protein, 11 aa, Mycobacterium
RESQAAAGIND

SEQ ID NO: 1111821 - protein, 6 aa, Mycobacterium
RESTRP

SEQ ID NO: 1111822 - protein, 6 aa, Mycobacterium
RETEDV

SEQ ID NO: 1111823 - protein, 7 aa, Mycobacterium
RETLKPA

SEQ ID NO: 1111824 - protein, 19 aa, Mycobacterium
RETNRWPAGTRGRSRSKSY

SEQ ID NO: 1111825 - protein, 8 aa, Mycobacterium
RETPGPLV

SEQ ID NO: 1111826 - protein, 5 aa, Mycobacterium
REVAD

SEQ ID NO: 1111827 - protein, 14 aa, Mycobacterium
REVTNNVDRHADAK

SEQ ID NO: 1111828 - protein, 18 aa, Mycobacterium
REVTQGANTLADSSRQLA

SEQ ID NO: 1111829 - protein, 4 aa, Mycobacterium
REYD

SEQ ID NO: 1111830 - protein, 4 aa, Mycobacterium
RFDQ

SEQ ID NO: 1111831 - protein, 5 aa, Mycobacterium
RFDSA

SEQ ID NO: 1111832 - protein, 12 aa, Mycobacterium
RFPDDGKVDEQL

SEQ ID NO: 1111833 - protein, 12 aa, Mycobacterium
RFTHTDPSQIGG

SEQ ID NO: 1111834 - protein, 5 aa, Mycobacterium
RFTPR

SEQ ID NO: 1111835 - protein, 7 aa, Mycobacterium
RFTSADG

SEQ ID NO: 1111836 - protein, 5 aa, Mycobacterium
RGAAG

SEQ ID NO: 1111837 - protein, 30 aa, Mycobacterium
RGADDVDDRAEHRSRRHSPRDADADRWEFD

SEQ ID NO: 1111838 - protein, 4 aa, Mycobacterium
RGAE

SEQ ID NO: 1111839 - protein, 22 aa, Mycobacterium
RGAGKLDGPIPIERTSSPYQLP

SEQ ID NO: 1111840 - protein, 9 aa, Mycobacterium
RGAGRSGKA

SEQ ID NO: 1111841 - protein, 19 aa, Mycobacterium
RGAGSDGTDGTAAATPNAA

SEQ ID NO: 1111842 - protein, 11 aa, Mycobacterium
RGAIGPEARTR

SEQ ID NO: 1111843 - protein, 6 aa, Mycobacterium
RGAKPA

SEQ ID NO: 1111844 - protein, 17 aa, Mycobacterium
RGAPIGAADATANRART

SEQ ID NO: 1111845 - protein, 8 aa, Mycobacterium
RGAPWSTR

SEQ ID NO: 1111846 - protein, 11 aa, Mycobacterium
RGAQPNTSLAD

SEQ ID NO: 1111847 - protein, 10 aa, Mycobacterium
RGAREAEELS

SEQ ID NO: 1111848 - protein, 16 aa, Mycobacterium
RGASEARTDEVATRSH

SEQ ID NO: 1111849 - protein, 11 aa, Mycobacterium
RGASRKLTSKQ

SEQ ID NO: 1111850 - protein, 12 aa, Mycobacterium
RGATDEDSRPHR

SEQ ID NO: 1111851 - protein, 8 aa, Mycobacterium
RGDDDDTI

SEQ ID NO: 1111852 - protein, 9 aa, Mycobacterium
RGDDGGTPL

SEQ ID NO: 1111853 - protein, 10 aa, Mycobacterium
RGDPPTAASP

SEQ ID NO: 1111854 - protein, 8 aa, Mycobacterium
RGDTGPPW

SEQ ID NO: 1111855 - protein, 23 aa, Mycobacterium
RGDTSRSRRGDTSRSRGGGSTGL

SEQ ID NO: 1111856 - protein, 5 aa, Mycobacterium
RGEDD

SEQ ID NO: 1111857 - protein, 4 aa, Mycobacterium
RGEL

SEQ ID NO: 1111858 - protein, 11 aa, Mycobacterium
RGENISSQELE

SEQ ID NO: 1111859 - protein, 8 aa, Mycobacterium
RGEPVTSE

SEQ ID NO: 1111860 - protein, 13 aa, Mycobacterium
RGEPWPKPLPEPA

SEQ ID NO: 1111861 - protein, 7 aa, Mycobacterium
RGERPGF

SEQ ID NO: 1111862 - protein, 10 aa, Mycobacterium
RGESNTRMAA

SEQ ID NO: 1111863 - protein, 7 aa, Mycobacterium
RGETDTG

SEQ ID NO: 1111864 - protein, 5 aa, Mycobacterium
RGEYE

SEQ ID NO: 1111865 - protein, 6 aa, Mycobacterium
RGFGDP

SEQ ID NO: 1111866 - protein, 9 aa, Mycobacterium
RGFSGPQNG

SEQ ID NO: 1111867 - protein, 12 aa, Mycobacterium
RGGAAGDGRAKF

SEQ ID NO: 1111868 - protein, 28 aa, Mycobacterium
RGGCASEATTTPNGATQTSTPDPASKNR

SEQ ID NO: 1111869 - protein, 4 aa, Mycobacterium
RGGD

SEQ ID NO: 1111870 - protein, 50 aa, Mycobacterium
RGGDPGEGFTPTVRDSTGAKAPAGDIPAAAAAAAAASAAERRKRRRRKIT

SEQ ID NO: 1111871 - protein, 13 aa, Mycobacterium
RGGELGGPLPPTV

SEQ ID NO: 1111872 - protein, 7 aa, Mycobacterium
RGGEPGV

SEQ ID NO: 1111873 - protein, 6 aa, Mycobacterium
RGGESG

SEQ ID NO: 1111874 - protein, 31 aa, Mycobacterium
RGGFGGGGFGGGFGGGGFGGGGGGFSGGGGR

SEQ ID NO: 1111875 - protein, 19 aa, Mycobacterium
RGGGPQLSRGDGAGAQLAE

SEQ ID NO: 1111876 - protein, 7 aa, Mycobacterium
RGGHTDV

SEQ ID NO: 1111877 - protein, 4 aa, Mycobacterium
RGGL

SEQ ID NO: 1111878 - protein, 5 aa, Mycobacterium
RGGPR

SEQ ID NO: 1111879 - protein, 8 aa, Mycobacterium
RGGPRRRA

SEQ ID NO: 1111880 - protein, 46 aa, Mycobacterium
RGGPSNPGGGQPPRPPQPSAEPTTAMRAGAPKPEPEPEGNEPTTAI

SEQ ID NO: 1111881 - protein, 6 aa, Mycobacterium
RGGPYE

SEQ ID NO: 1111882 - protein, 8 aa, Mycobacterium
RGGQIAPR

SEQ ID NO: 1111883 - protein, 5 aa, Mycobacterium
RGGRP

SEQ ID NO: 1111884 - protein, 8 aa, Mycobacterium
RGGRSERK

SEQ ID NO: 1111885 - protein, 7 aa, Mycobacterium
RGGTETK

SEQ ID NO: 1111886 - protein, 6 aa, Mycobacterium
RGGTHT

SEQ ID NO: 1111887 - protein, 8 aa, Mycobacterium
RGGTQQPA

SEQ ID NO: 1111888 - protein, 4 aa, Mycobacterium
RGGV

SEQ ID NO: 1111889 - protein, 9 aa, Mycobacterium
RGIAEPRAD

SEQ ID NO: 1111890 - protein, 9 aa, Mycobacterium
RGISGRMAS

SEQ ID NO: 1111891 - protein, 14 aa, Mycobacterium
RGKARPYNEPPSVV

SEQ ID NO: 1111892 - protein, 8 aa, Mycobacterium
RGKPTRAG

SEQ ID NO: 1111893 - protein, 13 aa, Mycobacterium
RGKRAAQSTTSNW

SEQ ID NO: 1111894 - protein, 4 aa, Mycobacterium
RGLP

SEQ ID NO: 1111895 - protein, 13 aa, Mycobacterium
RGLPEPAKALEGK

SEQ ID NO: 1111896 - protein, 10 aa, Mycobacterium
RGLPPAGDTL

SEQ ID NO: 1111897 - protein, 9 aa, Mycobacterium
RGLQQTAPE

SEQ ID NO: 1111898 - protein, 6 aa, Mycobacterium
RGLRPE

SEQ ID NO: 1111899 - protein, 7 aa, Mycobacterium
RGMNPDE

SEQ ID NO: 1111900 - protein, 13 aa, Mycobacterium
RGNAAASDLTRPG

SEQ ID NO: 1111901 - protein, 19 aa, Mycobacterium
RGNDDDDDDDDDGKVAGKN

SEQ ID NO: 1111902 - protein, 16 aa, Mycobacterium
RGNDDDDDDNKVAGKN

SEQ ID NO: 1111903 - protein, 10 aa, Mycobacterium
RGNDETPSAR

SEQ ID NO: 1111904 - protein, 7 aa, Mycobacterium
RGNDGEH

SEQ ID NO: 1111905 - protein, 4 aa, Mycobacterium
RGNE

SEQ ID NO: 1111906 - protein, 9 aa, Mycobacterium
RGNPTTDEA

SEQ ID NO: 1111907 - protein, 20 aa, Mycobacterium
RGNREDSDDADEVTDDPVEV

SEQ ID NO: 1111908 - protein, 6 aa, Mycobacterium
RGPAEH

SEQ ID NO: 1111909 - protein, 7 aa, Mycobacterium
RGPESIN

SEQ ID NO: 1111910 - protein, 40 aa, Mycobacterium
RGPGQGDEPTEPSAAGGPGDQTGPDDATRPSPTADHEPAT

SEQ ID NO: 1111911 - protein, 4 aa, Mycobacterium
RGPL

SEQ ID NO: 1111912 - protein, 7 aa, Mycobacterium
RGPMPPH

SEQ ID NO: 1111913 - protein, 7 aa, Mycobacterium
RGPSGAL

SEQ ID NO: 1111914 - protein, 9 aa, Mycobacterium
RGPTGPAQL

SEQ ID NO: 1111915 - protein, 14 aa, Mycobacterium
RGPTPPAPTVPEGV

SEQ ID NO: 1111916 - protein, 6 aa, Mycobacterium
RGQAAD

SEQ ID NO: 1111917 - protein, 5 aa, Mycobacterium
RGQDT

SEQ ID NO: 1111918 - protein, 7 aa, Mycobacterium
RGRAADA

SEQ ID NO: 1111919 - protein, 5 aa, Mycobacterium
RGRDD

SEQ ID NO: 1111920 - protein, 10 aa, Mycobacterium
RGRGERIGEA

SEQ ID NO: 1111921 - protein, 6 aa, Mycobacterium
RGRGQG

SEQ ID NO: 1111922 - protein, 15 aa, Mycobacterium
RGRGRATPTEVLTLP

SEQ ID NO: 1111923 - protein, 5 aa, Mycobacterium
RGRPP

SEQ ID NO: 1111924 - protein, 4 aa, Mycobacterium
RGRQ

SEQ ID NO: 1111925 - protein, 11 aa, Mycobacterium
RGRRDSGAARA

SEQ ID NO: 1111926 - protein, 9 aa, Mycobacterium
RGRRGGGDE

SEQ ID NO: 1111927 - protein, 7 aa, Mycobacterium
RGRSGSV

SEQ ID NO: 1111928 - protein, 21 aa, Mycobacterium
RGRTPGEGSAADTAEPPTEKL

SEQ ID NO: 1111929 - protein, 23 aa, Mycobacterium
RGSAESKPIDGEAPQDKDPRLEK

SEQ ID NO: 1111930 - protein, 17 aa, Mycobacterium
RGSAESKPVAEPHRETS

SEQ ID NO: 1111931 - protein, 17 aa, Mycobacterium
RGSGSSVSQEDRVRSTI

SEQ ID NO: 1111932 - protein, 14 aa, Mycobacterium
RGSGSTASQEDQVR

SEQ ID NO: 1111933 - protein, 20 aa, Mycobacterium
RGSNSRVPRADSSLPSGSGL

SEQ ID NO: 1111934 - protein, 111 aa, Mycobacterium
RGSRASGTAAANPPQPLRPSAEPTRAMPDTGAAGNEPTTAIPAQRESERHRESARHDDSDDSAASTRAIPTARQSDADAATEKLNTRPDDEATRRGGKGLSAQDLLRREGR

SEQ ID NO: 1111935 - protein, 14 aa, Mycobacterium
RGSRRYRAPSAHPC

SEQ ID NO: 1111936 - protein, 8 aa, Mycobacterium
RGSTGLRA

SEQ ID NO: 1111937 - protein, 10 aa, Mycobacterium
RGSTSPSRTY

SEQ ID NO: 1111938 - protein, 6 aa, Mycobacterium
RGSVPV

SEQ ID NO: 1111939 - protein, 8 aa, Mycobacterium
RGSWSETA

SEQ ID NO: 1111940 - protein, 15 aa, Mycobacterium
RGTAPPTTEDEEVPS

SEQ ID NO: 1111941 - protein, 9 aa, Mycobacterium
RGTEAAPPE

SEQ ID NO: 1111942 - protein, 11 aa, Mycobacterium
RGTGQATAGQA

SEQ ID NO: 1111943 - protein, 15 aa, Mycobacterium
RGTGRPLAEDNPIPS

SEQ ID NO: 1111944 - protein, 11 aa, Mycobacterium
RGTPADTGTAQ

SEQ ID NO: 1111945 - protein, 10 aa, Mycobacterium
RGTPAETGTA

SEQ ID NO: 1111946 - protein, 9 aa, Mycobacterium
RGTPARTQV

SEQ ID NO: 1111947 - protein, 7 aa, Mycobacterium
RGTPLRE

SEQ ID NO: 1111948 - protein, 11 aa, Mycobacterium
RGVEAHRESDA

SEQ ID NO: 1111949 - protein, 11 aa, Mycobacterium
RGVEKTVAGQT

SEQ ID NO: 1111950 - protein, 5 aa, Mycobacterium
RGVGN

SEQ ID NO: 1111951 - protein, 8 aa, Mycobacterium
RGVRPADP

SEQ ID NO: 1111952 - protein, 5 aa, Mycobacterium
RGVTP

SEQ ID NO: 1111953 - protein, 4 aa, Mycobacterium
RGYA

SEQ ID NO: 1111954 - protein, 10 aa, Mycobacterium
RGYDTAEVGR

SEQ ID NO: 1111955 - protein, 15 aa, Mycobacterium
RGYSTKSGAEADQHG

SEQ ID NO: 1111956 - protein, 15 aa, Mycobacterium
RHAAPAARSPWTGTG

SEQ ID NO: 1111957 - protein, 6 aa, Mycobacterium
RHARAT

SEQ ID NO: 1111958 - protein, 33 aa, Mycobacterium
RHATGTSAPAAKGAKGTTRDVSKGASAAAAAGG

SEQ ID NO: 1111959 - protein, 5 aa, Mycobacterium
RHGDA

SEQ ID NO: 1111960 - protein, 94 aa, Mycobacterium
RHGDHGPASADGGHHGTGPEDAHGEPHGTAPEDAHSNHHGAGAEPREADDHGTTGGDVYRPDSSHEPIAPPPVSEPADESAAPAPAEVPAPPTV

SEQ ID NO: 1111961 - protein, 9 aa, Mycobacterium
RHGPEEGPA

SEQ ID NO: 1111962 - protein, 4 aa, Mycobacterium
RHIT

SEQ ID NO: 1111963 - protein, 8 aa, Mycobacterium
RHKPPQPV

SEQ ID NO: 1111964 - protein, 16 aa, Mycobacterium
RHPSGPDNVTPMRPSR

SEQ ID NO: 1111965 - protein, 23 aa, Mycobacterium
RHPVTRPATAADPPRFRGGEGAP

SEQ ID NO: 1111966 - protein, 13 aa, Mycobacterium
RHQKEAGREITAA

SEQ ID NO: 1111967 - protein, 13 aa, Mycobacterium
RHRPATFRPGPAR

SEQ ID NO: 1111968 - protein, 31 aa, Mycobacterium
RHRRKNAAEHPGSEPGSSLRGQDTSPPSDRR

SEQ ID NO: 1111969 - protein, 8 aa, Mycobacterium
RHTPAGGR

SEQ ID NO: 1111970 - protein, 10 aa, Mycobacterium
RHTPSGGRVE

SEQ ID NO: 1111971 - protein, 8 aa, Mycobacterium
RHTPTGGT

SEQ ID NO: 1111972 - protein, 6 aa, Mycobacterium
RHYGGA

SEQ ID NO: 1111973 - protein, 7 aa, Mycobacterium
RIAEPQT

SEQ ID NO: 1111974 - protein, 9 aa, Mycobacterium
RIAGPGAAA

SEQ ID NO: 1111975 - protein, 5 aa, Mycobacterium
RIGAG

SEQ ID NO: 1111976 - protein, 7 aa, Mycobacterium
RIGGETV

SEQ ID NO: 1111977 - protein, 13 aa, Mycobacterium
RIGSGTQRAATPV

SEQ ID NO: 1111978 - protein, 4 aa, Mycobacterium
RIGT

SEQ ID NO: 1111979 - protein, 19 aa, Mycobacterium
RINNSEPSGSEAEFAPSAQ

SEQ ID NO: 1111980 - protein, 19 aa, Mycobacterium
RIPGAEPAADKPTDAGPGS

SEQ ID NO: 1111981 - protein, 9 aa, Mycobacterium
RIPPSPTQL

SEQ ID NO: 1111982 - protein, 5 aa, Mycobacterium
RIQNS

SEQ ID NO: 1111983 - protein, 11 aa, Mycobacterium
RKADAGAGLAG

SEQ ID NO: 1111984 - protein, 25 aa, Mycobacterium
RKAGTEPPPEKAPDTDPDTEKVGAG

SEQ ID NO: 1111985 - protein, 16 aa, Mycobacterium
RKDAPEGHLSGPAPAA

SEQ ID NO: 1111986 - protein, 6 aa, Mycobacterium
RKDRLQ

SEQ ID NO: 1111987 - protein, 10 aa, Mycobacterium
RKEAAGNAPR

SEQ ID NO: 1111988 - protein, 7 aa, Mycobacterium
RKGATSA

SEQ ID NO: 1111989 - protein, 7 aa, Mycobacterium
RKGEPWG

SEQ ID NO: 1111990 - protein, 13 aa, Mycobacterium
RKGPDTSGRSYPQ

SEQ ID NO: 1111991 - protein, 5 aa, Mycobacterium
RKGRG

SEQ ID NO: 1111992 - protein, 22 aa, Mycobacterium
RKKRGEASAKKKKAARDPEDSA

SEQ ID NO: 1111993 - protein, 82 aa, Mycobacterium
RKNDDAGEPEDSVPAADDSADAAAAGERTTTPPKGKPTPKRSEATRRRGPVAPAPLTSAEARKRRKEMRGPKLSREERKAER

SEQ ID NO: 1111994 - protein, 19 aa, Mycobacterium
RKNGASTEKTEADPHPDPS

SEQ ID NO: 1111995 - protein, 6 aa, Mycobacterium
RKPENN

SEQ ID NO: 1111996 - protein, 7 aa, Mycobacterium
RKPTAAD

SEQ ID NO: 1111997 - protein, 8 aa, Mycobacterium
RKQDISNG

SEQ ID NO: 1111998 - protein, 5 aa, Mycobacterium
RKRDR

SEQ ID NO: 1111999 - protein, 6 aa, Mycobacterium
RKRNAR

SEQ ID NO: 1112000 - protein, 7 aa, Mycobacterium
RKRTGEL

SEQ ID NO: 1112001 - protein, 24 aa, Mycobacterium
RKSSTVDAEQWTPDPVDEDTLDSD

SEQ ID NO: 1112002 - protein, 66 aa, Mycobacterium
RKTAAARAGGVEISDDDTAVDGDAEPATVAATPPAPLPDKPVPGARPVRPTSSRTGRPSGKRTPRN

SEQ ID NO: 1112003 - protein, 34 aa, Mycobacterium
RKTPAAVPVATDTADATATDATDDAPQRLTPPGA

SEQ ID NO: 1112004 - protein, 13 aa, Mycobacterium
RLAADAESNGGQL

SEQ ID NO: 1112005 - protein, 8 aa, Mycobacterium
RLAGEAPL

SEQ ID NO: 1112006 - protein, 7 aa, Mycobacterium
RLDDPGR

SEQ ID NO: 1112007 - protein, 5 aa, Mycobacterium
RLDGA

SEQ ID NO: 1112008 - protein, 15 aa, Mycobacterium
RLEESADLSELTPEQ

SEQ ID NO: 1112009 - protein, 6 aa, Mycobacterium
RLERGT

SEQ ID NO: 1112010 - protein, 12 aa, Mycobacterium
RLESGGEVNPYT

SEQ ID NO: 1112011 - protein, 13 aa, Mycobacterium
RLGDASPAGDGPH

SEQ ID NO: 1112012 - protein, 9 aa, Mycobacterium
RLGNPGFEQ

SEQ ID NO: 1112013 - protein, 4 aa, Mycobacterium
RLGT

SEQ ID NO: 1112014 - protein, 10 aa, Mycobacterium
RLGTQEVEGE

SEQ ID NO: 1112015 - protein, 5 aa, Mycobacterium
RLKDP

SEQ ID NO: 1112016 - protein, 8 aa, Mycobacterium
RLPAEDLT

SEQ ID NO: 1112017 - protein, 12 aa, Mycobacterium
RLPAGSHAANCP

SEQ ID NO: 1112018 - protein, 5 aa, Mycobacterium
RLPAP

SEQ ID NO: 1112019 - protein, 12 aa, Mycobacterium
RLPAPDQGGPVR

SEQ ID NO: 1112020 - protein, 8 aa, Mycobacterium
RLPATASQ

SEQ ID NO: 1112021 - protein, 10 aa, Mycobacterium
RLPDQPDALA

SEQ ID NO: 1112022 - protein, 8 aa, Mycobacterium
RLPEGRDE

SEQ ID NO: 1112023 - protein, 6 aa, Mycobacterium
RLPGKY

SEQ ID NO: 1112024 - protein, 5 aa, Mycobacterium
RLPGR

SEQ ID NO: 1112025 - protein, 4 aa, Mycobacterium
RLPR

SEQ ID NO: 1112026 - protein, 12 aa, Mycobacterium
RLPRRRASWLSR

SEQ ID NO: 1112027 - protein, 11 aa, Mycobacterium
RLREAGKTAAA

SEQ ID NO: 1112028 - protein, 12 aa, Mycobacterium
RLRGGADRRALG

SEQ ID NO: 1112029 - protein, 14 aa, Mycobacterium
RLRPPPGYKDTTVP

SEQ ID NO: 1112030 - protein, 6 aa, Mycobacterium
RLSAAD

SEQ ID NO: 1112031 - protein, 8 aa, Mycobacterium
RLSDGATI

SEQ ID NO: 1112032 - protein, 6 aa, Mycobacterium
RLSESL

SEQ ID NO: 1112033 - protein, 10 aa, Mycobacterium
RLSKSQSTLG

SEQ ID NO: 1112034 - protein, 6 aa, Mycobacterium
RLSPAA

SEQ ID NO: 1112035 - protein, 8 aa, Mycobacterium
RLSPRGPE

SEQ ID NO: 1112036 - protein, 13 aa, Mycobacterium
RLSPSTPATPPVR

SEQ ID NO: 1112037 - protein, 5 aa, Mycobacterium
RLTES

SEQ ID NO: 1112038 - protein, 4 aa, Mycobacterium
RLTG

SEQ ID NO: 1112039 - protein, 6 aa, Mycobacterium
RLTGPP

SEQ ID NO: 1112040 - protein, 7 aa, Mycobacterium
RMAPDDA

SEQ ID NO: 1112041 - protein, 4 aa, Mycobacterium
RMAR

SEQ ID NO: 1112042 - protein, 7 aa, Mycobacterium
RMASDPA

SEQ ID NO: 1112043 - protein, 8 aa, Mycobacterium
RMETTDVE

SEQ ID NO: 1112044 - protein, 5 aa, Mycobacterium
RMGKD

SEQ ID NO: 1112045 - protein, 6 aa, Mycobacterium
RMPART

SEQ ID NO: 1112046 - protein, 7 aa, Mycobacterium
RMPARTR

SEQ ID NO: 1112047 - protein, 5 aa, Mycobacterium
RMPKS

SEQ ID NO: 1112048 - protein, 12 aa, Mycobacterium
RMPQSSGGQGSI

SEQ ID NO: 1112049 - protein, 6 aa, Mycobacterium
RMPRSE

SEQ ID NO: 1112050 - protein, 10 aa, Mycobacterium
RNAAADDAPA

SEQ ID NO: 1112051 - protein, 8 aa, Mycobacterium
RNAGSADE

SEQ ID NO: 1112052 - protein, 13 aa, Mycobacterium
RNAPEGDAAGPDR

SEQ ID NO: 1112053 - protein, 7 aa, Mycobacterium
RNAPPIT

SEQ ID NO: 1112054 - protein, 38 aa, Mycobacterium
RNAVSTAAAAAQRATERPASGPPAPPAPSAPPAREDRE

SEQ ID NO: 1112055 - protein, 9 aa, Mycobacterium
RNDGPTPVQ

SEQ ID NO: 1112056 - protein, 9 aa, Mycobacterium
RNDNDGTAE

SEQ ID NO: 1112057 - protein, 7 aa, Mycobacterium
RNDPRRM

SEQ ID NO: 1112058 - protein, 5 aa, Mycobacterium
RNFDE

SEQ ID NO: 1112059 - protein, 5 aa, Mycobacterium
RNGAT

SEQ ID NO: 1112060 - protein, 11 aa, Mycobacterium
RNGATPPTETT

SEQ ID NO: 1112061 - protein, 8 aa, Mycobacterium
RNGEPGAG

SEQ ID NO: 1112062 - protein, 14 aa, Mycobacterium
RNGITVKDPDGTIR

SEQ ID NO: 1112063 - protein, 7 aa, Mycobacterium
RNGQQGF

SEQ ID NO: 1112064 - protein, 13 aa, Mycobacterium
RNPDTYPQPDEFR

SEQ ID NO: 1112065 - protein, 9 aa, Mycobacterium
RNPGRRDAD

SEQ ID NO: 1112066 - protein, 8 aa, Mycobacterium
RNPRPPQA

SEQ ID NO: 1112067 - protein, 6 aa, Mycobacterium
RNPTIA

SEQ ID NO: 1112068 - protein, 9 aa, Mycobacterium
RNRDAGSPE

SEQ ID NO: 1112069 - protein, 11 aa, Mycobacterium
RNRHDAVDGST

SEQ ID NO: 1112070 - protein, 5 aa, Mycobacterium
RNRRA

SEQ ID NO: 1112071 - protein, 4 aa, Mycobacterium
RNRS

SEQ ID NO: 1112072 - protein, 16 aa, Mycobacterium
RNRTMTDTRDLPPSAV

SEQ ID NO: 1112073 - protein, 8 aa, Mycobacterium
RNSAAGRI

SEQ ID NO: 1112074 - protein, 16 aa, Mycobacterium
RNTAPAAVPGEAVAEP

SEQ ID NO: 1112075 - protein, 8 aa, Mycobacterium
RNTSPHPA

SEQ ID NO: 1112076 - protein, 5 aa, Mycobacterium
RNVEH

SEQ ID NO: 1112077 - protein, 10 aa, Mycobacterium
RNVPTSTADT

SEQ ID NO: 1112078 - protein, 14 aa, Mycobacterium
RNYDPEDEEQKDEM

SEQ ID NO: 1112079 - protein, 5 aa, Mycobacterium
RPAAD

SEQ ID NO: 1112080 - protein, 12 aa, Mycobacterium
RPAAIPSSLAST

SEQ ID NO: 1112081 - protein, 10 aa, Mycobacterium
RPADAALATA

SEQ ID NO: 1112082 - protein, 12 aa, Mycobacterium
RPADHRAAKAAV

SEQ ID NO: 1112083 - protein, 12 aa, Mycobacterium
RPADRDAARADL

SEQ ID NO: 1112084 - protein, 6 aa, Mycobacterium
RPAEEP

SEQ ID NO: 1112085 - protein, 7 aa, Mycobacterium
RPAEVRR

SEQ ID NO: 1112086 - protein, 10 aa, Mycobacterium
RPAGDARDKA

SEQ ID NO: 1112087 - protein, 6 aa, Mycobacterium
RPAGLE

SEQ ID NO: 1112088 - protein, 7 aa, Mycobacterium
RPAGQGP

SEQ ID NO: 1112089 - protein, 15 aa, Mycobacterium
RPAPASGEDAHSGNA

SEQ ID NO: 1112090 - protein, 10 aa, Mycobacterium
RPAPTARPGH

SEQ ID NO: 1112091 - protein, 10 aa, Mycobacterium
RPAPTPSTAE

SEQ ID NO: 1112092 - protein, 13 aa, Mycobacterium
RPARQRPHTLPAD

SEQ ID NO: 1112093 - protein, 26 aa, Mycobacterium
RPARRPNNNHQPRSTDTGHTAGEGSG

SEQ ID NO: 1112094 - protein, 14 aa, Mycobacterium
RPASHARAAAVGAP

SEQ ID NO: 1112095 - protein, 9 aa, Mycobacterium
RPASTVRGS

SEQ ID NO: 1112096 - protein, 6 aa, Mycobacterium
RPAVRG

SEQ ID NO: 1112097 - protein, 6 aa, Mycobacterium
RPDAAA

SEQ ID NO: 1112098 - protein, 6 aa, Mycobacterium
RPDARD

SEQ ID NO: 1112099 - protein, 16 aa, Mycobacterium
RPDAYQPHSSTQLTGG

SEQ ID NO: 1112100 - protein, 11 aa, Mycobacterium
RPDAYTAADKL

SEQ ID NO: 1112101 - protein, 7 aa, Mycobacterium
RPDDAPT

SEQ ID NO: 1112102 - protein, 8 aa, Mycobacterium
RPDELQGE

SEQ ID NO: 1112103 - protein, 4 aa, Mycobacterium
RPDF

SEQ ID NO: 1112104 - protein, 9 aa, Mycobacterium
RPDGSYQEL

SEQ ID NO: 1112105 - protein, 4 aa, Mycobacterium
RPDL

SEQ ID NO: 1112106 - protein, 8 aa, Mycobacterium
RPDMPPAV

SEQ ID NO: 1112107 - protein, 10 aa, Mycobacterium
RPDPPPGTDR

SEQ ID NO: 1112108 - protein, 10 aa, Mycobacterium
RPDPQDNRRS

SEQ ID NO: 1112109 - protein, 12 aa, Mycobacterium
RPDQQTDPAAAQ

SEQ ID NO: 1112110 - protein, 8 aa, Mycobacterium
RPDSESHE

SEQ ID NO: 1112111 - protein, 6 aa, Mycobacterium
RPDSGA

SEQ ID NO: 1112112 - protein, 6 aa, Mycobacterium
RPDTGQ

SEQ ID NO: 1112113 - protein, 8 aa, Mycobacterium
RPDTLGAG

SEQ ID NO: 1112114 - protein, 4 aa, Mycobacterium
RPEH

SEQ ID NO: 1112115 - protein, 13 aa, Mycobacterium
RPEPIRPAGDGAF

SEQ ID NO: 1112116 - protein, 9 aa, Mycobacterium
RPEPTPTPV

SEQ ID NO: 1112117 - protein, 7 aa, Mycobacterium
RPEPVAK

SEQ ID NO: 1112118 - protein, 10 aa, Mycobacterium
RPERAGEAAG

SEQ ID NO: 1112119 - protein, 6 aa, Mycobacterium
RPERDP

SEQ ID NO: 1112120 - protein, 18 aa, Mycobacterium
RPGADPASVRTGVTEAVD

SEQ ID NO: 1112121 - protein, 8 aa, Mycobacterium
RPGAPPIK

SEQ ID NO: 1112122 - protein, 5 aa, Mycobacterium
RPGAV

SEQ ID NO: 1112123 - protein, 8 aa, Mycobacterium
RPGEPFPG

SEQ ID NO: 1112124 - protein, 4 aa, Mycobacterium
RPGG

SEQ ID NO: 1112125 - protein, 6 aa, Mycobacterium
RPGGRV

SEQ ID NO: 1112126 - protein, 8 aa, Mycobacterium
RPGIAPGF

SEQ ID NO: 1112127 - protein, 6 aa, Mycobacterium
RPGIGT

SEQ ID NO: 1112128 - protein, 7 aa, Mycobacterium
RPGPDAR

SEQ ID NO: 1112129 - protein, 30 aa, Mycobacterium
RPGRERSGRRPTTRGLPGPCRQTGVAGRQS

SEQ ID NO: 1112130 - protein, 7 aa, Mycobacterium
RPGRPTA

SEQ ID NO: 1112131 - protein, 6 aa, Mycobacterium
RPGSLQ

SEQ ID NO: 1112132 - protein, 5 aa, Mycobacterium
RPGST

SEQ ID NO: 1112133 - protein, 9 aa, Mycobacterium
RPGTTQTDS

SEQ ID NO: 1112134 - protein, 12 aa, Mycobacterium
RPHEPSRRETAT

SEQ ID NO: 1112135 - protein, 13 aa, Mycobacterium
RPHETGDADQSAV

SEQ ID NO: 1112136 - protein, 8 aa, Mycobacterium
RPIPARPC

SEQ ID NO: 1112137 - protein, 39 aa, Mycobacterium
RPKAIGDAPLSSTAGSGGVTATATATPASTRRSRQQEYD

SEQ ID NO: 1112138 - protein, 8 aa, Mycobacterium
RPKPHAHG

SEQ ID NO: 1112139 - protein, 10 aa, Mycobacterium
RPKPVQKPHP

SEQ ID NO: 1112140 - protein, 7 aa, Mycobacterium
RPLGEPS

SEQ ID NO: 1112141 - protein, 14 aa, Mycobacterium
RPLLDGQAESTDAI

SEQ ID NO: 1112142 - protein, 5 aa, Mycobacterium
RPLPG

SEQ ID NO: 1112143 - protein, 6 aa, Mycobacterium
RPLPSD

SEQ ID NO: 1112144 - protein, 12 aa, Mycobacterium
RPLPSDAVPRPL

SEQ ID NO: 1112145 - protein, 12 aa, Mycobacterium
RPNAAQKESEYI

SEQ ID NO: 1112146 - protein, 8 aa, Mycobacterium
RPNPPLAS

SEQ ID NO: 1112147 - protein, 4 aa, Mycobacterium
RPNR

SEQ ID NO: 1112148 - protein, 11 aa, Mycobacterium
RPNTDEGPYLE

SEQ ID NO: 1112149 - protein, 12 aa, Mycobacterium
RPPDNPVPYGRE

SEQ ID NO: 1112150 - protein, 6 aa, Mycobacterium
RPPEVQ

SEQ ID NO: 1112151 - protein, 5 aa, Mycobacterium
RPPPT

SEQ ID NO: 1112152 - protein, 14 aa, Mycobacterium
RPPQEHLEEGRRSV

SEQ ID NO: 1112153 - protein, 7 aa, Mycobacterium
RPPVRGG

SEQ ID NO: 1112154 - protein, 5 aa, Mycobacterium
RPPVS

SEQ ID NO: 1112155 - protein, 19 aa, Mycobacterium
RPQIKARSDGSNAASALPR

SEQ ID NO: 1112156 - protein, 7 aa, Mycobacterium
RPQLGPP

SEQ ID NO: 1112157 - protein, 6 aa, Mycobacterium
RPQRDM

SEQ ID NO: 1112158 - protein, 17 aa, Mycobacterium
RPQTVPETAHSGDSRTA

SEQ ID NO: 1112159 - protein, 11 aa, Mycobacterium
RPRDAPTRTAV

SEQ ID NO: 1112160 - protein, 12 aa, Mycobacterium
RPRDTWRSRAGE

SEQ ID NO: 1112161 - protein, 12 aa, Mycobacterium
RPREVDGNRRTK

SEQ ID NO: 1112162 - protein, 4 aa, Mycobacterium
RPRG

SEQ ID NO: 1112163 - protein, 6 aa, Mycobacterium
RPRGVS

SEQ ID NO: 1112164 - protein, 4 aa, Mycobacterium
RPRI

SEQ ID NO: 1112165 - protein, 4 aa, Mycobacterium
RPRL

SEQ ID NO: 1112166 - protein, 5 aa, Mycobacterium
RPRNY

SEQ ID NO: 1112167 - protein, 7 aa, Mycobacterium
RPRPDTA

SEQ ID NO: 1112168 - protein, 64 aa, Mycobacterium
RPRRSRSTPRTPESPEPRRRSRTQAPREAREPRETRDARKLPPRERRSSSYDRPERRTERSRRL

SEQ ID NO: 1112169 - protein, 6 aa, Mycobacterium
RPRSNL

SEQ ID NO: 1112170 - protein, 8 aa, Mycobacterium
RPSAPSAV

SEQ ID NO: 1112171 - protein, 8 aa, Mycobacterium
RPSEPLAQ

SEQ ID NO: 1112172 - protein, 7 aa, Mycobacterium
RPSGRSA

SEQ ID NO: 1112173 - protein, 10 aa, Mycobacterium
RPSLEGADLT

SEQ ID NO: 1112174 - protein, 8 aa, Mycobacterium
RPSQRRKQ

SEQ ID NO: 1112175 - protein, 15 aa, Mycobacterium
RPSRTGDSAGSAPRV

SEQ ID NO: 1112176 - protein, 14 aa, Mycobacterium
RPTADQRPSPAQSA

SEQ ID NO: 1112177 - protein, 6 aa, Mycobacterium
RPTEHP

SEQ ID NO: 1112178 - protein, 6 aa, Mycobacterium
RPTFSN

SEQ ID NO: 1112179 - protein, 26 aa, Mycobacterium
RPTGTDGSEDRPHDGGGGTTGGGGPA

SEQ ID NO: 1112180 - protein, 25 aa, Mycobacterium
RPTPPPLPTGASPPPSTDGSHAGGR

SEQ ID NO: 1112181 - protein, 25 aa, Mycobacterium
RPTPPPLPTGASPPPSTDGSHGGGR

SEQ ID NO: 1112182 - protein, 7 aa, Mycobacterium
RPTRGSD

SEQ ID NO: 1112183 - protein, 8 aa, Mycobacterium
RPTSTRAA

SEQ ID NO: 1112184 - protein, 4 aa, Mycobacterium
RPTT

SEQ ID NO: 1112185 - protein, 4 aa, Mycobacterium
RPVD

SEQ ID NO: 1112186 - protein, 7 aa, Mycobacterium
RPVPTAR

SEQ ID NO: 1112187 - protein, 6 aa, Mycobacterium
RPYNEN

SEQ ID NO: 1112188 - protein, 62 aa, Mycobacterium
RPYQGGDSLQRHPTDAGALDAERDGDADELDDPWRNPGAAAALGTPALAPAGPTQAAAPLGK

SEQ ID NO: 1112189 - protein, 10 aa, Mycobacterium
RQADDARTAA

SEQ ID NO: 1112190 - protein, 13 aa, Mycobacterium
RQAELAEPGGTGA

SEQ ID NO: 1112191 - protein, 4 aa, Mycobacterium
RQAG

SEQ ID NO: 1112192 - protein, 9 aa, Mycobacterium
RQARRRRFG

SEQ ID NO: 1112193 - protein, 6 aa, Mycobacterium
RQDPLR

SEQ ID NO: 1112194 - protein, 13 aa, Mycobacterium
RQDRPPLTGTADA

SEQ ID NO: 1112195 - protein, 11 aa, Mycobacterium
RQDRSAREDPA

SEQ ID NO: 1112196 - protein, 7 aa, Mycobacterium
RQELKPA

SEQ ID NO: 1112197 - protein, 5 aa, Mycobacterium
RQFER

SEQ ID NO: 1112198 - protein, 6 aa, Mycobacterium
RQGAGT

SEQ ID NO: 1112199 - protein, 21 aa, Mycobacterium
RQGDRSELDEAGTVTWPDAPA

SEQ ID NO: 1112200 - protein, 15 aa, Mycobacterium
RQGNGGLVGDHTPAG

SEQ ID NO: 1112201 - protein, 6 aa, Mycobacterium
RQGPNL

SEQ ID NO: 1112202 - protein, 12 aa, Mycobacterium
RQGQGGSSGDRD

SEQ ID NO: 1112203 - protein, 11 aa, Mycobacterium
RQGVSGSSVGK

SEQ ID NO: 1112204 - protein, 4 aa, Mycobacterium
RQGY

SEQ ID NO: 1112205 - protein, 28 aa, Mycobacterium
RQIAPAVESGARGGRTTRGDDRGTARRH

SEQ ID NO: 1112206 - protein, 7 aa, Mycobacterium
RQKKAMQ

SEQ ID NO: 1112207 - protein, 24 aa, Mycobacterium
RQLPRSAARGPSAEAADDGRRKGF

SEQ ID NO: 1112208 - protein, 13 aa, Mycobacterium
RQLSVGPESTTSL

SEQ ID NO: 1112209 - protein, 6 aa, Mycobacterium
RQMSAG

SEQ ID NO: 1112210 - protein, 16 aa, Mycobacterium
RQMSYNDSRAEGTQAA

SEQ ID NO: 1112211 - protein, 9 aa, Mycobacterium
RQNGPTTLT

SEQ ID NO: 1112212 - protein, 9 aa, Mycobacterium
RQPAFSSGR

SEQ ID NO: 1112213 - protein, 13 aa, Mycobacterium
RQPPPTPSEPAVG

SEQ ID NO: 1112214 - protein, 6 aa, Mycobacterium
RQPPYK

SEQ ID NO: 1112215 - protein, 4 aa, Mycobacterium
RQPR

SEQ ID NO: 1112216 - protein, 5 aa, Mycobacterium
RQPVG

SEQ ID NO: 1112217 - protein, 4 aa, Mycobacterium
RQQR

SEQ ID NO: 1112218 - protein, 12 aa, Mycobacterium
RQRDSVEKRGNR

SEQ ID NO: 1112219 - protein, 5 aa, Mycobacterium
RQRGG

SEQ ID NO: 1112220 - protein, 9 aa, Mycobacterium
RQRPDRITA

SEQ ID NO: 1112221 - protein, 5 aa, Mycobacterium
RQRSA

SEQ ID NO: 1112222 - protein, 4 aa, Mycobacterium
RQSA

SEQ ID NO: 1112223 - protein, 9 aa, Mycobacterium
RQSAGDDGF

SEQ ID NO: 1112224 - protein, 9 aa, Mycobacterium
RQSGAAGAV

SEQ ID NO: 1112225 - protein, 4 aa, Mycobacterium
RQSV

SEQ ID NO: 1112226 - protein, 5 aa, Mycobacterium
RQSVR

SEQ ID NO: 1112227 - protein, 9 aa, Mycobacterium
RQTETGARR

SEQ ID NO: 1112228 - protein, 11 aa, Mycobacterium
RQTGTESISTE

SEQ ID NO: 1112229 - protein, 6 aa, Mycobacterium
RQTLAD

SEQ ID NO: 1112230 - protein, 6 aa, Mycobacterium
RQTRGR

SEQ ID NO: 1112231 - protein, 7 aa, Mycobacterium
RRAADGA

SEQ ID NO: 1112232 - protein, 5 aa, Mycobacterium
RRAAG

SEQ ID NO: 1112233 - protein, 29 aa, Mycobacterium
RRAAGGARGPLGAAEGDPYEIGSDGMGQD

SEQ ID NO: 1112234 - protein, 8 aa, Mycobacterium
RRAAKRSS

SEQ ID NO: 1112235 - protein, 13 aa, Mycobacterium
RRADMTDTATDLS

SEQ ID NO: 1112236 - protein, 15 aa, Mycobacterium
RRAEAAGRSADHVST

SEQ ID NO: 1112237 - protein, 5 aa, Mycobacterium
RRAGL

SEQ ID NO: 1112238 - protein, 18 aa, Mycobacterium
RRAGRELGSRSAVADSKQ

SEQ ID NO: 1112239 - protein, 5 aa, Mycobacterium
RRANE

SEQ ID NO: 1112240 - protein, 25 aa, Mycobacterium
RRAPAPPPPVDPATVGTTPAEPDLA

SEQ ID NO: 1112241 - protein, 8 aa, Mycobacterium
RRAPGSGR

SEQ ID NO: 1112242 - protein, 10 aa, Mycobacterium
RRAPQAGGRE

SEQ ID NO: 1112243 - protein, 58 aa, Mycobacterium
RRAQEPRPAPEPRHGKHSAPGDGNEDEPPAPIQGPQETAEEAHARRRRSLEDTGGQSV

SEQ ID NO: 1112244 - protein, 9 aa, Mycobacterium
RRARAESRR

SEQ ID NO: 1112245 - protein, 8 aa, Mycobacterium
RRARDVAA

SEQ ID NO: 1112246 - protein, 14 aa, Mycobacterium
RRARTGSRRRSRWQ

SEQ ID NO: 1112247 - protein, 25 aa, Mycobacterium
RRASGEKPVATPRQAPAKRSSHLTR

SEQ ID NO: 1112248 - protein, 11 aa, Mycobacterium
RRASSALVDDG

SEQ ID NO: 1112249 - protein, 19 aa, Mycobacterium
RRATGGGSPGDSDSDSDRQ

SEQ ID NO: 1112250 - protein, 12 aa, Mycobacterium
RRATTSGGRRIG

SEQ ID NO: 1112251 - protein, 4 aa, Mycobacterium
RRAV

SEQ ID NO: 1112252 - protein, 8 aa, Mycobacterium
RRAYPQEN

SEQ ID NO: 1112253 - protein, 7 aa, Mycobacterium
RRDDADA

SEQ ID NO: 1112254 - protein, 4 aa, Mycobacterium
RRDG

SEQ ID NO: 1112255 - protein, 10 aa, Mycobacterium
RRDGDAAAEA

SEQ ID NO: 1112256 - protein, 6 aa, Mycobacterium
RRDGGA

SEQ ID NO: 1112257 - protein, 12 aa, Mycobacterium
RRDGVTTTFGSA

SEQ ID NO: 1112258 - protein, 5 aa, Mycobacterium
RRDPK

SEQ ID NO: 1112259 - protein, 6 aa, Mycobacterium
RRDPQA

SEQ ID NO: 1112260 - protein, 5 aa, Mycobacterium
RRDYA

SEQ ID NO: 1112261 - protein, 8 aa, Mycobacterium
RREEPRDD

SEQ ID NO: 1112262 - protein, 7 aa, Mycobacterium
RREESRM

SEQ ID NO: 1112263 - protein, 5 aa, Mycobacterium
RREFR

SEQ ID NO: 1112264 - protein, 7 aa, Mycobacterium
RRENGPI

SEQ ID NO: 1112265 - protein, 6 aa, Mycobacterium
RREQSA

SEQ ID NO: 1112266 - protein, 15 aa, Mycobacterium
RREVPVGPASLARDG

SEQ ID NO: 1112267 - protein, 12 aa, Mycobacterium
RRGADYSEPGVR

SEQ ID NO: 1112268 - protein, 6 aa, Mycobacterium
RRGATT

SEQ ID NO: 1112269 - protein, 22 aa, Mycobacterium
RRGDAGSPGKHSDGSTHGAPPG

SEQ ID NO: 1112270 - protein, 14 aa, Mycobacterium
RRGDEGEPVPGAEA

SEQ ID NO: 1112271 - protein, 5 aa, Mycobacterium
RRGEA

SEQ ID NO: 1112272 - protein, 6 aa, Mycobacterium
RRGEPV

SEQ ID NO: 1112273 - protein, 18 aa, Mycobacterium
RRGGDVAGAAPAATSGIE

SEQ ID NO: 1112274 - protein, 8 aa, Mycobacterium
RRGGEEVE

SEQ ID NO: 1112275 - protein, 16 aa, Mycobacterium
RRGGHTEATHGGHEHR

SEQ ID NO: 1112276 - protein, 14 aa, Mycobacterium
RRGLGRRRKSWAKS

SEQ ID NO: 1112277 - protein, 7 aa, Mycobacterium
RRGQESF

SEQ ID NO: 1112278 - protein, 8 aa, Mycobacterium
RRGRAGAQ

SEQ ID NO: 1112279 - protein, 20 aa, Mycobacterium
RRGRKPDEKDPLVLATSQEM

SEQ ID NO: 1112280 - protein, 6 aa, Mycobacterium
RRGRSL

SEQ ID NO: 1112281 - protein, 9 aa, Mycobacterium
RRGSPWSTR

SEQ ID NO: 1112282 - protein, 6 aa, Mycobacterium
RRGTDA

SEQ ID NO: 1112283 - protein, 9 aa, Mycobacterium
RRGTPDETL

SEQ ID NO: 1112284 - protein, 17 aa, Mycobacterium
RRGVSAGGRSGAPSRTF

SEQ ID NO: 1112285 - protein, 7 aa, Mycobacterium
RRHPGRT

SEQ ID NO: 1112286 - protein, 20 aa, Mycobacterium
RRIADGDDREPTVRSETVKH

SEQ ID NO: 1112287 - protein, 10 aa, Mycobacterium
RRKSGTGSVS

SEQ ID NO: 1112288 - protein, 9 aa, Mycobacterium
RRLGTDPEE

SEQ ID NO: 1112289 - protein, 5 aa, Mycobacterium
RRLTG

SEQ ID NO: 1112290 - protein, 7 aa, Mycobacterium
RRLTGAE

SEQ ID NO: 1112291 - protein, 17 aa, Mycobacterium
RRNDPARRAERRRAARR

SEQ ID NO: 1112292 - protein, 9 aa, Mycobacterium
RRNEMNSPT

SEQ ID NO: 1112293 - protein, 26 aa, Mycobacterium
RRNIASQAEQFGGTATVSTADSGTGA

SEQ ID NO: 1112294 - protein, 4 aa, Mycobacterium
RRPA

SEQ ID NO: 1112295 - protein, 10 aa, Mycobacterium
RRPGPAAQPV

SEQ ID NO: 1112296 - protein, 5 aa, Mycobacterium
RRPGT

SEQ ID NO: 1112297 - protein, 16 aa, Mycobacterium
RRPKPKPWPRVAEEVT

SEQ ID NO: 1112298 - protein, 7 aa, Mycobacterium
RRPQTGQ

SEQ ID NO: 1112299 - protein, 12 aa, Mycobacterium
RRPRRQPTPSAN

SEQ ID NO: 1112300 - protein, 5 aa, Mycobacterium
RRPRV

SEQ ID NO: 1112301 - protein, 7 aa, Mycobacterium
RRPTAAD

SEQ ID NO: 1112302 - protein, 9 aa, Mycobacterium
RRPTTSATQ

SEQ ID NO: 1112303 - protein, 11 aa, Mycobacterium
RRPVDQRVGTA

SEQ ID NO: 1112304 - protein, 4 aa, Mycobacterium
RRQA

SEQ ID NO: 1112305 - protein, 7 aa, Mycobacterium
RRQAPRT

SEQ ID NO: 1112306 - protein, 6 aa, Mycobacterium
RRQHPS

SEQ ID NO: 1112307 - protein, 8 aa, Mycobacterium
RRQSASRA

SEQ ID NO: 1112308 - protein, 10 aa, Mycobacterium
RRQSQPPAKW

SEQ ID NO: 1112309 - protein, 29 aa, Mycobacterium
RRQSTDEITEVEPKAEDKIEDDGEKSFDS

SEQ ID NO: 1112310 - protein, 7 aa, Mycobacterium
RRRAEGT

SEQ ID NO: 1112311 - protein, 8 aa, Mycobacterium
RRRAERAN

SEQ ID NO: 1112312 - protein, 9 aa, Mycobacterium
RRRAERANR

SEQ ID NO: 1112313 - protein, 6 aa, Mycobacterium
RRRAQR

SEQ ID NO: 1112314 - protein, 9 aa, Mycobacterium
RRRAQRVRR

SEQ ID NO: 1112315 - protein, 10 aa, Mycobacterium
RRRDDEPAHP

SEQ ID NO: 1112316 - protein, 10 aa, Mycobacterium
RRRDLGPTPR

SEQ ID NO: 1112317 - protein, 10 aa, Mycobacterium
RRRDRTNGTY

SEQ ID NO: 1112318 - protein, 11 aa, Mycobacterium
RRREASERATA

SEQ ID NO: 1112319 - protein, 7 aa, Mycobacterium
RRRENRT

SEQ ID NO: 1112320 - protein, 9 aa, Mycobacterium
RRRKRREAE

SEQ ID NO: 1112321 - protein, 4 aa, Mycobacterium
RRRP

SEQ ID NO: 1112322 - protein, 7 aa, Mycobacterium
RRRPIGS

SEQ ID NO: 1112323 - protein, 6 aa, Mycobacterium
RRRPTT

SEQ ID NO: 1112324 - protein, 21 aa, Mycobacterium
RRRRDKEQLQARLRGDEDSAD

SEQ ID NO: 1112325 - protein, 8 aa, Mycobacterium
RRRRGPAA

SEQ ID NO: 1112326 - protein, 5 aa, Mycobacterium
RRRSA

SEQ ID NO: 1112327 - protein, 10 aa, Mycobacterium
RRRSAGRPKG

SEQ ID NO: 1112328 - protein, 21 aa, Mycobacterium
RRRSARGRPADGARSPGRRSR

SEQ ID NO: 1112329 - protein, 12 aa, Mycobacterium
RRRSGTRALAPS

SEQ ID NO: 1112330 - protein, 17 aa, Mycobacterium
RRRSQPPKPVAPSPQSE

SEQ ID NO: 1112331 - protein, 5 aa, Mycobacterium
RRRSY

SEQ ID NO: 1112332 - protein, 21 aa, Mycobacterium
RRRTKSVEQSIADTDEPSTRL

SEQ ID NO: 1112333 - protein, 17 aa, Mycobacterium
RRRTPTGPTRRQAAPAR

SEQ ID NO: 1112334 - protein, 11 aa, Mycobacterium
RRSAQDARPTV

SEQ ID NO: 1112335 - protein, 19 aa, Mycobacterium
RRSAQPPVVDETAQKMDDD

SEQ ID NO: 1112336 - protein, 6 aa, Mycobacterium
RRSATR

SEQ ID NO: 1112337 - protein, 10 aa, Mycobacterium
RRSDPLSAER

SEQ ID NO: 1112338 - protein, 5 aa, Mycobacterium
RRSDR

SEQ ID NO: 1112339 - protein, 14 aa, Mycobacterium
RRSGVSGPSSLPGL

SEQ ID NO: 1112340 - protein, 4 aa, Mycobacterium
RRSP

SEQ ID NO: 1112341 - protein, 13 aa, Mycobacterium
RRSRKGPAPMEAE

SEQ ID NO: 1112342 - protein, 13 aa, Mycobacterium
RRSSDVMAPSEQA

SEQ ID NO: 1112343 - protein, 5 aa, Mycobacterium
RRSSR

SEQ ID NO: 1112344 - protein, 5 aa, Mycobacterium
RRSTA

SEQ ID NO: 1112345 - protein, 16 aa, Mycobacterium
RRSTAIEQMTTTASLG

SEQ ID NO: 1112346 - protein, 15 aa, Mycobacterium
RRTAAGSWKATAGKP

SEQ ID NO: 1112347 - protein, 10 aa, Mycobacterium
RRTELSPTRT

SEQ ID NO: 1112348 - protein, 14 aa, Mycobacterium
RRTETAAATATGGL

SEQ ID NO: 1112349 - protein, 5 aa, Mycobacterium
RRTGR

SEQ ID NO: 1112350 - protein, 17 aa, Mycobacterium
RRTGSTGFKGVSGRPGS

SEQ ID NO: 1112351 - protein, 5 aa, Mycobacterium
RRTRS

SEQ ID NO: 1112352 - protein, 9 aa, Mycobacterium
RRTRSSRRT

SEQ ID NO: 1112353 - protein, 6 aa, Mycobacterium
RRTTRL

SEQ ID NO: 1112354 - protein, 6 aa, Mycobacterium
RRVAGQ

SEQ ID NO: 1112355 - protein, 4 aa, Mycobacterium
RRVP

SEQ ID NO: 1112356 - protein, 6 aa, Mycobacterium
RRVPDR

SEQ ID NO: 1112357 - protein, 12 aa, Mycobacterium
RRVPERDPRTEV

SEQ ID NO: 1112358 - protein, 12 aa, Mycobacterium
RRVPERTGEFSP

SEQ ID NO: 1112359 - protein, 13 aa, Mycobacterium
RRVRTDETPPDGI

SEQ ID NO: 1112360 - protein, 5 aa, Mycobacterium
RRWRE

SEQ ID NO: 1112361 - protein, 12 aa, Mycobacterium
RRWSRQRGGVEY

SEQ ID NO: 1112362 - protein, 13 aa, Mycobacterium
RRYPDAPAIDDGT

SEQ ID NO: 1112363 - protein, 6 aa, Mycobacterium
RSAATL

SEQ ID NO: 1112364 - protein, 12 aa, Mycobacterium
RSADHMAPSEQA

SEQ ID NO: 1112365 - protein, 37 aa, Mycobacterium
RSAEAAADTAAERRDSLTAEVDAERRSRLEGDATGRQ

SEQ ID NO: 1112366 - protein, 5 aa, Mycobacterium
RSAEG

SEQ ID NO: 1112367 - protein, 10 aa, Mycobacterium
RSAESGTALA

SEQ ID NO: 1112368 - protein, 15 aa, Mycobacterium
RSAHGAADRATDSDA

SEQ ID NO: 1112369 - protein, 5 aa, Mycobacterium
RSAIG

SEQ ID NO: 1112370 - protein, 5 aa, Mycobacterium
RSAKR

SEQ ID NO: 1112371 - protein, 10 aa, Mycobacterium
RSANSGVPTT

SEQ ID NO: 1112372 - protein, 7 aa, Mycobacterium
RSAPISE

SEQ ID NO: 1112373 - protein, 7 aa, Mycobacterium
RSAPPIT

SEQ ID NO: 1112374 - protein, 5 aa, Mycobacterium
RSAPT

SEQ ID NO: 1112375 - protein, 8 aa, Mycobacterium
RSARPDSA

SEQ ID NO: 1112376 - protein, 12 aa, Mycobacterium
RSASVDAANLLK

SEQ ID NO: 1112377 - protein, 10 aa, Mycobacterium
RSATDSVQGI

SEQ ID NO: 1112378 - protein, 6 aa, Mycobacterium
RSDGQQ

SEQ ID NO: 1112379 - protein, 9 aa, Mycobacterium
RSDGVAAES

SEQ ID NO: 1112380 - protein, 7 aa, Mycobacterium
RSDLGNQ

SEQ ID NO: 1112381 - protein, 9 aa, Mycobacterium
RSDRSTGPA

SEQ ID NO: 1112382 - protein, 22 aa, Mycobacterium
RSDTDNLATPQTTTRPAPPVQD

SEQ ID NO: 1112383 - protein, 11 aa, Mycobacterium
RSEGADTKVAT

SEQ ID NO: 1112384 - protein, 9 aa, Mycobacterium
RSENPPQSN

SEQ ID NO: 1112385 - protein, 8 aa, Mycobacterium
RSEPSTGE

SEQ ID NO: 1112386 - protein, 15 aa, Mycobacterium
RSESDESVTVSGGGG

SEQ ID NO: 1112387 - protein, 32 aa, Mycobacterium
RSGAAGARSPLVPDAPPPSGSMAKADPDNPQR

SEQ ID NO: 1112388 - protein, 7 aa, Mycobacterium
RSGAPGS

SEQ ID NO: 1112389 - protein, 10 aa, Mycobacterium
RSGARTPLGA

SEQ ID NO: 1112390 - protein, 5 aa, Mycobacterium
RSGAT

SEQ ID NO: 1112391 - protein, 6 aa, Mycobacterium
RSGDDI

SEQ ID NO: 1112392 - protein, 7 aa, Mycobacterium
RSGDNDL

SEQ ID NO: 1112393 - protein, 9 aa, Mycobacterium
RSGDNDLTA

SEQ ID NO: 1112394 - protein, 6 aa, Mycobacterium
RSGEDI

SEQ ID NO: 1112395 - protein, 6 aa, Mycobacterium
RSGELD

SEQ ID NO: 1112396 - protein, 18 aa, Mycobacterium
RSGGPPIQSGARIPEDTE

SEQ ID NO: 1112397 - protein, 38 aa, Mycobacterium
RSGPAAGHHSDPDWRPSADELDDEPVDDRDTRDAEPEG

SEQ ID NO: 1112398 - protein, 4 aa, Mycobacterium
RSGR

SEQ ID NO: 1112399 - protein, 8 aa, Mycobacterium
RSGSTHGY

SEQ ID NO: 1112400 - protein, 12 aa, Mycobacterium
RSGTPATERTSR

SEQ ID NO: 1112401 - protein, 6 aa, Mycobacterium
RSHAEG

SEQ ID NO: 1112402 - protein, 13 aa, Mycobacterium
RSHASQRRLAALN

SEQ ID NO: 1112403 - protein, 6 aa, Mycobacterium
RSHPRP

SEQ ID NO: 1112404 - protein, 7 aa, Mycobacterium
RSIGPDS

SEQ ID NO: 1112405 - protein, 9 aa, Mycobacterium
RSINERDEA

SEQ ID NO: 1112406 - protein, 5 aa, Mycobacterium
RSITG

SEQ ID NO: 1112407 - protein, 11 aa, Mycobacterium
RSKDGSETGRR

SEQ ID NO: 1112408 - protein, 7 aa, Mycobacterium
RSKGAGD

SEQ ID NO: 1112409 - protein, 9 aa, Mycobacterium
RSLNARDEA

SEQ ID NO: 1112410 - protein, 8 aa, Mycobacterium
RSLNESKV

SEQ ID NO: 1112411 - protein, 6 aa, Mycobacterium
RSLRTP

SEQ ID NO: 1112412 - protein, 8 aa, Mycobacterium
RSLTPDTT

SEQ ID NO: 1112413 - protein, 7 aa, Mycobacterium
RSLTPQT

SEQ ID NO: 1112414 - protein, 4 aa, Mycobacterium
RSNE

SEQ ID NO: 1112415 - protein, 18 aa, Mycobacterium
RSNQEKLTSGALSTAGTV

SEQ ID NO: 1112416 - protein, 16 aa, Mycobacterium
RSPDLRADRATLRGTE

SEQ ID NO: 1112417 - protein, 7 aa, Mycobacterium
RSPFGAE

SEQ ID NO: 1112418 - protein, 5 aa, Mycobacterium
RSPGF

SEQ ID NO: 1112419 - protein, 7 aa, Mycobacterium
RSPGLTA

SEQ ID NO: 1112420 - protein, 5 aa, Mycobacterium
RSPGT

SEQ ID NO: 1112421 - protein, 7 aa, Mycobacterium
RSPHPIR

SEQ ID NO: 1112422 - protein, 5 aa, Mycobacterium
RSPID

SEQ ID NO: 1112423 - protein, 15 aa, Mycobacterium
RSPRPAAPPPRRQPH

SEQ ID NO: 1112424 - protein, 6 aa, Mycobacterium
RSPRSG

SEQ ID NO: 1112425 - protein, 11 aa, Mycobacterium
RSPSNSPPITP

SEQ ID NO: 1112426 - protein, 15 aa, Mycobacterium
RSPSRRPGGAPVRYR

SEQ ID NO: 1112427 - protein, 9 aa, Mycobacterium
RSPSSDEFG

SEQ ID NO: 1112428 - protein, 6 aa, Mycobacterium
RSPSTG

SEQ ID NO: 1112429 - protein, 26 aa, Mycobacterium
RSQDAAVSDPGTGAREAGVTPRLADA

SEQ ID NO: 1112430 - protein, 6 aa, Mycobacterium
RSQPGQ

SEQ ID NO: 1112431 - protein, 15 aa, Mycobacterium
RSRAAPEAMENSTAP

SEQ ID NO: 1112432 - protein, 43 aa, Mycobacterium
RSRESARREVDAGTYPTAETQAAPSEPSMSVDRDAATNRSSAT

SEQ ID NO: 1112433 - protein, 7 aa, Mycobacterium
RSRPGAR

SEQ ID NO: 1112434 - protein, 9 aa, Mycobacterium
RSRQRTGAS

SEQ ID NO: 1112435 - protein, 11 aa, Mycobacterium
RSRRGKYPAAA

SEQ ID NO: 1112436 - protein, 6 aa, Mycobacterium
RSRRRR

SEQ ID NO: 1112437 - protein, 11 aa, Mycobacterium
RSRSAAGRTTV

SEQ ID NO: 1112438 - protein, 8 aa, Mycobacterium
RSRYGSEQ

SEQ ID NO: 1112439 - protein, 72 aa, Mycobacterium
RSSAGDARSRKAPASRPGKPGKSGDAARGKPRGAARRETRSADPRSPKELTGAAADPGFVDDTGDEPGADSI

SEQ ID NO: 1112440 - protein, 6 aa, Mycobacterium
RSSGYS

SEQ ID NO: 1112441 - protein, 10 aa, Mycobacterium
RSSLESERAY

SEQ ID NO: 1112442 - protein, 18 aa, Mycobacterium
RSSNFPGRDGAGYPIEND

SEQ ID NO: 1112443 - protein, 9 aa, Mycobacterium
RSSSPERRC

SEQ ID NO: 1112444 - protein, 8 aa, Mycobacterium
RSSSRRRA

SEQ ID NO: 1112445 - protein, 7 aa, Mycobacterium
RSSSSDA

SEQ ID NO: 1112446 - protein, 9 aa, Mycobacterium
RSSTTGQID

SEQ ID NO: 1112447 - protein, 8 aa, Mycobacterium
RSSVEPEV

SEQ ID NO: 1112448 - protein, 6 aa, Mycobacterium
RSSVSP

SEQ ID NO: 1112449 - protein, 5 aa, Mycobacterium
RSTEC

SEQ ID NO: 1112450 - protein, 9 aa, Mycobacterium
RSTEPMPVS

SEQ ID NO: 1112451 - protein, 4 aa, Mycobacterium
RSTF

SEQ ID NO: 1112452 - protein, 10 aa, Mycobacterium
RSTGAGAEAH

SEQ ID NO: 1112453 - protein, 6 aa, Mycobacterium
RSTGDA

SEQ ID NO: 1112454 - protein, 5 aa, Mycobacterium
RSTGQ

SEQ ID NO: 1112455 - protein, 5 aa, Mycobacterium
RSTRD

SEQ ID NO: 1112456 - protein, 4 aa, Mycobacterium
RSTV

SEQ ID NO: 1112457 - protein, 14 aa, Mycobacterium
RSTVEANVRSGDRR

SEQ ID NO: 1112458 - protein, 6 aa, Mycobacterium
RSVPPD

SEQ ID NO: 1112459 - protein, 6 aa, Mycobacterium
RSVPPS

SEQ ID NO: 1112460 - protein, 13 aa, Mycobacterium
RSVSNDVAKGAQI

SEQ ID NO: 1112461 - protein, 24 aa, Mycobacterium
RSVSTQYETGRSSARSDSEQPVAP

SEQ ID NO: 1112462 - protein, 5 aa, Mycobacterium
RSYPG

SEQ ID NO: 1112463 - protein, 9 aa, Mycobacterium
RTAADTAQL

SEQ ID NO: 1112464 - protein, 11 aa, Mycobacterium
RTAAPAEAKTS

SEQ ID NO: 1112465 - protein, 34 aa, Mycobacterium
RTAEADAPAAPQRPVTETAPPPPARGIDAPTEKL

SEQ ID NO: 1112466 - protein, 8 aa, Mycobacterium
RTAERIAS

SEQ ID NO: 1112467 - protein, 15 aa, Mycobacterium
RTAGEKGLTTAGSTL

SEQ ID NO: 1112468 - protein, 4 aa, Mycobacterium
RTAN

SEQ ID NO: 1112469 - protein, 5 aa, Mycobacterium
RTAPA

SEQ ID NO: 1112470 - protein, 14 aa, Mycobacterium
RTAPAERPDTEGAT

SEQ ID NO: 1112471 - protein, 4 aa, Mycobacterium
RTAR

SEQ ID NO: 1112472 - protein, 4 aa, Mycobacterium
RTAT

SEQ ID NO: 1112473 - protein, 6 aa, Mycobacterium
RTATDA

SEQ ID NO: 1112474 - protein, 23 aa, Mycobacterium
RTCAAAPAAVSGPQAPTEVGSRR

SEQ ID NO: 1112475 - protein, 10 aa, Mycobacterium
RTDDRHGLPA

SEQ ID NO: 1112476 - protein, 7 aa, Mycobacterium
RTDGTSN

SEQ ID NO: 1112477 - protein, 7 aa, Mycobacterium
RTDPAAG

SEQ ID NO: 1112478 - protein, 5 aa, Mycobacterium
RTDPR

SEQ ID NO: 1112479 - protein, 9 aa, Mycobacterium
RTDRAATTL

SEQ ID NO: 1112480 - protein, 13 aa, Mycobacterium
RTDRRAATSKGDK

SEQ ID NO: 1112481 - protein, 6 aa, Mycobacterium
RTEERA

SEQ ID NO: 1112482 - protein, 61 aa, Mycobacterium
RTEGNRPEPGPRPDQGAAYASEIPDLSGPRPPQQRKPVDRPVPEQQPKPTPKPAPPAGNRA

SEQ ID NO: 1112483 - protein, 4 aa, Mycobacterium
RTEP

SEQ ID NO: 1112484 - protein, 8 aa, Mycobacterium
RTGAEGAD

SEQ ID NO: 1112485 - protein, 5 aa, Mycobacterium
RTGAF

SEQ ID NO: 1112486 - protein, 22 aa, Mycobacterium
RTGGHDTTTVRHTDREADGRQH

SEQ ID NO: 1112487 - protein, 7 aa, Mycobacterium
RTGIDNP

SEQ ID NO: 1112488 - protein, 7 aa, Mycobacterium
RTGNELA

SEQ ID NO: 1112489 - protein, 5 aa, Mycobacterium
RTGPL

SEQ ID NO: 1112490 - protein, 6 aa, Mycobacterium
RTGRPI

SEQ ID NO: 1112491 - protein, 8 aa, Mycobacterium
RTGSPYSL

SEQ ID NO: 1112492 - protein, 8 aa, Mycobacterium
RTGTAAAG

SEQ ID NO: 1112493 - protein, 28 aa, Mycobacterium
RTGTAEQNANPTKSGAAIASNGRRRPRH

SEQ ID NO: 1112494 - protein, 14 aa, Mycobacterium
RTGVGLPGESSGLV

SEQ ID NO: 1112495 - protein, 5 aa, Mycobacterium
RTGVP

SEQ ID NO: 1112496 - protein, 12 aa, Mycobacterium
RTGVTGRGSGLT

SEQ ID NO: 1112497 - protein, 6 aa, Mycobacterium
RTGWTA

SEQ ID NO: 1112498 - protein, 6 aa, Mycobacterium
RTHYRG

SEQ ID NO: 1112499 - protein, 4 aa, Mycobacterium
RTKE

SEQ ID NO: 1112500 - protein, 6 aa, Mycobacterium
RTLEEH

SEQ ID NO: 1112501 - protein, 13 aa, Mycobacterium
RTNDPQPPQQPPT

SEQ ID NO: 1112502 - protein, 5 aa, Mycobacterium
RTNEE

SEQ ID NO: 1112503 - protein, 4 aa, Mycobacterium
RTPA

SEQ ID NO: 1112504 - protein, 6 aa, Mycobacterium
RTPDAP

SEQ ID NO: 1112505 - protein, 6 aa, Mycobacterium
RTPDEI

SEQ ID NO: 1112506 - protein, 8 aa, Mycobacterium
RTPEPQPV

SEQ ID NO: 1112507 - protein, 7 aa, Mycobacterium
RTPFTGD

SEQ ID NO: 1112508 - protein, 5 aa, Mycobacterium
RTPGR

SEQ ID NO: 1112509 - protein, 20 aa, Mycobacterium
RTPLPPRRDWDDESIDADTR

SEQ ID NO: 1112510 - protein, 16 aa, Mycobacterium
RTPPADLGLTGEPVGD

SEQ ID NO: 1112511 - protein, 11 aa, Mycobacterium
RTPPPGTSPTE

SEQ ID NO: 1112512 - protein, 6 aa, Mycobacterium
RTPRPV

SEQ ID NO: 1112513 - protein, 9 aa, Mycobacterium
RTPTHLEGR

SEQ ID NO: 1112514 - protein, 7 aa, Mycobacterium
RTPTNAT

SEQ ID NO: 1112515 - protein, 8 aa, Mycobacterium
RTQAATSG

SEQ ID NO: 1112516 - protein, 8 aa, Mycobacterium
RTQAPTSG

SEQ ID NO: 1112517 - protein, 5 aa, Mycobacterium
RTQPA

SEQ ID NO: 1112518 - protein, 4 aa, Mycobacterium
RTQQ

SEQ ID NO: 1112519 - protein, 8 aa, Mycobacterium
RTREESTL

SEQ ID NO: 1112520 - protein, 21 aa, Mycobacterium
RTRPAPSPWPAPPARVADDTG

SEQ ID NO: 1112521 - protein, 7 aa, Mycobacterium
RTRRAGA

SEQ ID NO: 1112522 - protein, 7 aa, Mycobacterium
RTSEGEV

SEQ ID NO: 1112523 - protein, 6 aa, Mycobacterium
RTSGRS

SEQ ID NO: 1112524 - protein, 6 aa, Mycobacterium
RTSPEH

SEQ ID NO: 1112525 - protein, 10 aa, Mycobacterium
RTSQSSRAAL

SEQ ID NO: 1112526 - protein, 9 aa, Mycobacterium
RTTATGEEV

SEQ ID NO: 1112527 - protein, 7 aa, Mycobacterium
RTTATST

SEQ ID NO: 1112528 - protein, 10 aa, Mycobacterium
RTTGWRATAD

SEQ ID NO: 1112529 - protein, 7 aa, Mycobacterium
RTTPAYQ

SEQ ID NO: 1112530 - protein, 8 aa, Mycobacterium
RTTTPTPV

SEQ ID NO: 1112531 - protein, 25 aa, Mycobacterium
RTTVAETPFRGGSGGGAAAAAPDQV

SEQ ID NO: 1112532 - protein, 4 aa, Mycobacterium
RTVP

SEQ ID NO: 1112533 - protein, 5 aa, Mycobacterium
RTYSN

SEQ ID NO: 1112534 - protein, 17 aa, Mycobacterium
RVAEGKTNDVPTRAARS

SEQ ID NO: 1112535 - protein, 8 aa, Mycobacterium
RVAGSESE

SEQ ID NO: 1112536 - protein, 13 aa, Mycobacterium
RVAPAGRRSSSVE

SEQ ID NO: 1112537 - protein, 7 aa, Mycobacterium
RVDGGPE

SEQ ID NO: 1112538 - protein, 8 aa, Mycobacterium
RVDVGGPT

SEQ ID NO: 1112539 - protein, 35 aa, Mycobacterium
RVEESTVEPESVTEADQARALAEEAEAEAAEAEAM

SEQ ID NO: 1112540 - protein, 11 aa, Mycobacterium
RVGAGATVGPG

SEQ ID NO: 1112541 - protein, 5 aa, Mycobacterium
RVGAP

SEQ ID NO: 1112542 - protein, 12 aa, Mycobacterium
RVGEAKRDAVTR

SEQ ID NO: 1112543 - protein, 8 aa, Mycobacterium
RVGGPREY

SEQ ID NO: 1112544 - protein, 18 aa, Mycobacterium
RVKSSDDVPTESGRLRTR

SEQ ID NO: 1112545 - protein, 13 aa, Mycobacterium
RVNAKGGPGGRPG

SEQ ID NO: 1112546 - protein, 18 aa, Mycobacterium
RVNTERTEEAIDTGASAI

SEQ ID NO: 1112547 - protein, 4 aa, Mycobacterium
RVPA

SEQ ID NO: 1112548 - protein, 7 aa, Mycobacterium
RVPGESG

SEQ ID NO: 1112549 - protein, 7 aa, Mycobacterium
RVPPPRL

SEQ ID NO: 1112550 - protein, 10 aa, Mycobacterium
RVSGAPASVA

SEQ ID NO: 1112551 - protein, 7 aa, Mycobacterium
RVSRGEG

SEQ ID NO: 1112552 - protein, 10 aa, Mycobacterium
RVTGGDGDLA

SEQ ID NO: 1112553 - protein, 6 aa, Mycobacterium
RVTNHG

SEQ ID NO: 1112554 - protein, 9 aa, Mycobacterium
RVTSSASAQ

SEQ ID NO: 1112555 - protein, 8 aa, Mycobacterium
RWSDESDL

SEQ ID NO: 1112556 - protein, 7 aa, Mycobacterium
RWSTEGN

SEQ ID NO: 1112557 - protein, 15 aa, Mycobacterium
RYADPHTRGRIPAPN

SEQ ID NO: 1112558 - protein, 6 aa, Mycobacterium
RYAGDQ

SEQ ID NO: 1112559 - protein, 16 aa, Mycobacterium
RYAGTDLADPSRRGTA

SEQ ID NO: 1112560 - protein, 4 aa, Mycobacterium
RYAP

SEQ ID NO: 1112561 - protein, 8 aa, Mycobacterium
RYATPNGA

SEQ ID NO: 1112562 - protein, 8 aa, Mycobacterium
RYGATGAA

SEQ ID NO: 1112563 - protein, 10 aa, Mycobacterium
RYNETAAPVG

SEQ ID NO: 1112564 - protein, 9 aa, Mycobacterium
RYPGRSAPP

SEQ ID NO: 1112565 - protein, 9 aa, Mycobacterium
RYPQSGGTY

SEQ ID NO: 1112566 - protein, 8 aa, Mycobacterium
SAAAAEAA

SEQ ID NO: 1112567 - protein, 18 aa, Mycobacterium
SAAAERLSVSDGDRVTIG

SEQ ID NO: 1112568 - protein, 9 aa, Mycobacterium
SAAAGTASE

SEQ ID NO: 1112569 - protein, 5 aa, Mycobacterium
SAAAM

SEQ ID NO: 1112570 - protein, 4 aa, Mycobacterium
SAAD

SEQ ID NO: 1112571 - protein, 5 aa, Mycobacterium
SAADP

SEQ ID NO: 1112572 - protein, 9 aa, Mycobacterium
SAAEGGSGL

SEQ ID NO: 1112573 - protein, 6 aa, Mycobacterium
SAAEKI

SEQ ID NO: 1112574 - protein, 99 aa, Mycobacterium
SAAEPGASGSEPPAGGYETPAYGEQPSYPPPPPGFEQPGYQPPQYQQPDYQQPQYPPPPPGYQPYGSYGSPYDAPAGYPPPPPGYPPYSGGYGAGPKTN

SEQ ID NO: 1112575 - protein, 8 aa, Mycobacterium
SAAGGSPA

SEQ ID NO: 1112576 - protein, 8 aa, Mycobacterium
SAAGGTPL

SEQ ID NO: 1112577 - protein, 14 aa, Mycobacterium
SAAGSPLTVDGGTR

SEQ ID NO: 1112578 - protein, 17 aa, Mycobacterium
SAAGTSAAEVTADALNG

SEQ ID NO: 1112579 - protein, 9 aa, Mycobacterium
SAAGVEPRD

SEQ ID NO: 1112580 - protein, 9 aa, Mycobacterium
SAAHTTSNT

SEQ ID NO: 1112581 - protein, 9 aa, Mycobacterium
SAAPAASSR

SEQ ID NO: 1112582 - protein, 7 aa, Mycobacterium
SAAPGQR

SEQ ID NO: 1112583 - protein, 7 aa, Mycobacterium
SAAPQPI

SEQ ID NO: 1112584 - protein, 9 aa, Mycobacterium
SAARGTEIA

SEQ ID NO: 1112585 - protein, 9 aa, Mycobacterium
SAARRNYDR

SEQ ID NO: 1112586 - protein, 10 aa, Mycobacterium
SAATAVAEGR

SEQ ID NO: 1112587 - protein, 5 aa, Mycobacterium
SAAVE

SEQ ID NO: 1112588 - protein, 15 aa, Mycobacterium
SADCPQDAAPNPGVR

SEQ ID NO: 1112589 - protein, 10 aa, Mycobacterium
SADDDAAMRQ

SEQ ID NO: 1112590 - protein, 9 aa, Mycobacterium
SADDPETVR

SEQ ID NO: 1112591 - protein, 9 aa, Mycobacterium
SADDPTTPM

SEQ ID NO: 1112592 - protein, 7 aa, Mycobacterium
SADGRSG

SEQ ID NO: 1112593 - protein, 8 aa, Mycobacterium
SADGSANV

SEQ ID NO: 1112594 - protein, 10 aa, Mycobacterium
SADPDTAAGV

SEQ ID NO: 1112595 - protein, 16 aa, Mycobacterium
SADPGRESDAAGHRPA

SEQ ID NO: 1112596 - protein, 6 aa, Mycobacterium
SADPRI

SEQ ID NO: 1112597 - protein, 8 aa, Mycobacterium
SADVDGNK

SEQ ID NO: 1112598 - protein, 4 aa, Mycobacterium
SAEA

SEQ ID NO: 1112599 - protein, 10 aa, Mycobacterium
SAEERAEAVQ

SEQ ID NO: 1112600 - protein, 21 aa, Mycobacterium
SAEGLSSAEARARTARTGPNV

SEQ ID NO: 1112601 - protein, 8 aa, Mycobacterium
SAEHGDPS

SEQ ID NO: 1112602 - protein, 7 aa, Mycobacterium
SAEHRGE

SEQ ID NO: 1112603 - protein, 24 aa, Mycobacterium
SAEPGRSDIGSHAQAVSAGPLLTD

SEQ ID NO: 1112604 - protein, 10 aa, Mycobacterium
SAERAAAQAR

SEQ ID NO: 1112605 - protein, 5 aa, Mycobacterium
SAERF

SEQ ID NO: 1112606 - protein, 9 aa, Mycobacterium
SAERPGPGL

SEQ ID NO: 1112607 - protein, 10 aa, Mycobacterium
SAFTQPAAQR

SEQ ID NO: 1112608 - protein, 11 aa, Mycobacterium
SAGEEKQPAIG

SEQ ID NO: 1112609 - protein, 10 aa, Mycobacterium
SAGEEKQPVI

SEQ ID NO: 1112610 - protein, 5 aa, Mycobacterium
SAGFS

SEQ ID NO: 1112611 - protein, 9 aa, Mycobacterium
SAGGPRPDQ

SEQ ID NO: 1112612 - protein, 6 aa, Mycobacterium
SAGGRY

SEQ ID NO: 1112613 - protein, 10 aa, Mycobacterium
SAGGTATGTV

SEQ ID NO: 1112614 - protein, 9 aa, Mycobacterium
SAGLSPADL

SEQ ID NO: 1112615 - protein, 4 aa, Mycobacterium
SAGM

SEQ ID NO: 1112616 - protein, 6 aa, Mycobacterium
SAGNAA

SEQ ID NO: 1112617 - protein, 16 aa, Mycobacterium
SAGPILTTSTGASAVA

SEQ ID NO: 1112618 - protein, 9 aa, Mycobacterium
SAGPLDGMD

SEQ ID NO: 1112619 - protein, 8 aa, Mycobacterium
SAGPLFGG

SEQ ID NO: 1112620 - protein, 13 aa, Mycobacterium
SAGRADSRMRGTV

SEQ ID NO: 1112621 - protein, 11 aa, Mycobacterium
SAGSAGAAEAA

SEQ ID NO: 1112622 - protein, 10 aa, Mycobacterium
SAGSRTGRRR

SEQ ID NO: 1112623 - protein, 33 aa, Mycobacterium
SAGTLGTTDEHRHDPHTDPVRASKSAETEQRPM

SEQ ID NO: 1112624 - protein, 8 aa, Mycobacterium
SAGTPGMK

SEQ ID NO: 1112625 - protein, 21 aa, Mycobacterium
SAGTPPNARPIGGTTSNAEHQ

SEQ ID NO: 1112626 - protein, 12 aa, Mycobacterium
SAGVQANNPRYS

SEQ ID NO: 1112627 - protein, 9 aa, Mycobacterium
SAHATSTTA

SEQ ID NO: 1112628 - protein, 7 aa, Mycobacterium
SAHPDTR

SEQ ID NO: 1112629 - protein, 7 aa, Mycobacterium
SAHQPGF

SEQ ID NO: 1112630 - protein, 14 aa, Mycobacterium
SAIGTVSEACRTVG

SEQ ID NO: 1112631 - protein, 6 aa, Mycobacterium
SAIPEG

SEQ ID NO: 1112632 - protein, 6 aa, Mycobacterium
SAIQHA

SEQ ID NO: 1112633 - protein, 8 aa, Mycobacterium
SALEPGTY

SEQ ID NO: 1112634 - protein, 5 aa, Mycobacterium
SALGP

SEQ ID NO: 1112635 - protein, 12 aa, Mycobacterium
SALSAQTTAEFR

SEQ ID NO: 1112636 - protein, 7 aa, Mycobacterium
SALSSRR

SEQ ID NO: 1112637 - protein, 17 aa, Mycobacterium
SALTASPTSAAAEAATR

SEQ ID NO: 1112638 - protein, 7 aa, Mycobacterium
SALTGES

SEQ ID NO: 1112639 - protein, 11 aa, Mycobacterium
SALTSTLADRD

SEQ ID NO: 1112640 - protein, 7 aa, Mycobacterium
SANDAPS

SEQ ID NO: 1112641 - protein, 9 aa, Mycobacterium
SANRNQASC

SEQ ID NO: 1112642 - protein, 71 aa, Mycobacterium
SAPAATDDGHGQDEEPPRRRRSSERPRRAAKPAAERTRSSRDAARGAAARKPAKRAATPSRSRHNRPPETE

SEQ ID NO: 1112643 - protein, 9 aa, Mycobacterium
SAPAQPPVT

SEQ ID NO: 1112644 - protein, 8 aa, Mycobacterium
SAPASATV

SEQ ID NO: 1112645 - protein, 9 aa, Mycobacterium
SAPDDAQAV

SEQ ID NO: 1112646 - protein, 20 aa, Mycobacterium
SAPDTATPVDRSGGYTATSG

SEQ ID NO: 1112647 - protein, 8 aa, Mycobacterium
SAPDVGQA

SEQ ID NO: 1112648 - protein, 8 aa, Mycobacterium
SAPEQLTA

SEQ ID NO: 1112649 - protein, 7 aa, Mycobacterium
SAPERRT

SEQ ID NO: 1112650 - protein, 7 aa, Mycobacterium
SAPGAAE

SEQ ID NO: 1112651 - protein, 4 aa, Mycobacterium
SAPH

SEQ ID NO: 1112652 - protein, 7 aa, Mycobacterium
SAPNCPL

SEQ ID NO: 1112653 - protein, 15 aa, Mycobacterium
SAPPAVAPDTDQEHA

SEQ ID NO: 1112654 - protein, 32 aa, Mycobacterium
SAPPPPSSAAATVGTVATGTAPAPGAPAAATA

SEQ ID NO: 1112655 - protein, 8 aa, Mycobacterium
SAPQAIAG

SEQ ID NO: 1112656 - protein, 7 aa, Mycobacterium
SAPQCPL

SEQ ID NO: 1112657 - protein, 4 aa, Mycobacterium
SAPR

SEQ ID NO: 1112658 - protein, 8 aa, Mycobacterium
SAPRRTRP

SEQ ID NO: 1112659 - protein, 15 aa, Mycobacterium
SAQAPRPAPAPEAQP

SEQ ID NO: 1112660 - protein, 9 aa, Mycobacterium
SAQDGKTAL

SEQ ID NO: 1112661 - protein, 7 aa, Mycobacterium
SAQGVAD

SEQ ID NO: 1112662 - protein, 12 aa, Mycobacterium
SAQQAADGVARG

SEQ ID NO: 1112663 - protein, 25 aa, Mycobacterium
SAQRAYGGGGEDEKDEQPRGVGVAG

SEQ ID NO: 1112664 - protein, 8 aa, Mycobacterium
SAQSGGAV

SEQ ID NO: 1112665 - protein, 4 aa, Mycobacterium
SAQY

SEQ ID NO: 1112666 - protein, 5 aa, Mycobacterium
SARAR

SEQ ID NO: 1112667 - protein, 9 aa, Mycobacterium
SARGVTDEP

SEQ ID NO: 1112668 - protein, 7 aa, Mycobacterium
SARPGTL

SEQ ID NO: 1112669 - protein, 25 aa, Mycobacterium
SARQATARVASRARSAGDFADQGTS

SEQ ID NO: 1112670 - protein, 12 aa, Mycobacterium
SARQRRTGDPVP

SEQ ID NO: 1112671 - protein, 4 aa, Mycobacterium
SARR

SEQ ID NO: 1112672 - protein, 9 aa, Mycobacterium
SARRATAAP

SEQ ID NO: 1112673 - protein, 5 aa, Mycobacterium
SARRR

SEQ ID NO: 1112674 - protein, 8 aa, Mycobacterium
SARSPAIP

SEQ ID NO: 1112675 - protein, 6 aa, Mycobacterium
SASAAG

SEQ ID NO: 1112676 - protein, 8 aa, Mycobacterium
SASAIGNA

SEQ ID NO: 1112677 - protein, 9 aa, Mycobacterium
SASDTPSTG

SEQ ID NO: 1112678 - protein, 18 aa, Mycobacterium
SASKKLSEAPQTVGTSAP

SEQ ID NO: 1112679 - protein, 8 aa, Mycobacterium
SASMSGEL

SEQ ID NO: 1112680 - protein, 20 aa, Mycobacterium
SASPLGRDLAEGSGVELDRA

SEQ ID NO: 1112681 - protein, 15 aa, Mycobacterium
SASRLEGELGDPNSK

SEQ ID NO: 1112682 - protein, 12 aa, Mycobacterium
SATAQPNDQAVA

SEQ ID NO: 1112683 - protein, 12 aa, Mycobacterium
SATDPRRDRAAR

SEQ ID NO: 1112684 - protein, 7 aa, Mycobacterium
SATEAAE

SEQ ID NO: 1112685 - protein, 9 aa, Mycobacterium
SATEGSNVA

SEQ ID NO: 1112686 - protein, 6 aa, Mycobacterium
SATGSF

SEQ ID NO: 1112687 - protein, 4 aa, Mycobacterium
SATL

SEQ ID NO: 1112688 - protein, 5 aa, Mycobacterium
SATPQ

SEQ ID NO: 1112689 - protein, 5 aa, Mycobacterium
SATQL

SEQ ID NO: 1112690 - protein, 10 aa, Mycobacterium
SATRRGQQVD

SEQ ID NO: 1112691 - protein, 9 aa, Mycobacterium
SATSPQGRA

SEQ ID NO: 1112692 - protein, 27 aa, Mycobacterium
SAVAGELRPEPAPPGDSATLAQLGTTN

SEQ ID NO: 1112693 - protein, 7 aa, Mycobacterium
SAVESAQ

SEQ ID NO: 1112694 - protein, 6 aa, Mycobacterium
SAVGEP

SEQ ID NO: 1112695 - protein, 7 aa, Mycobacterium
SAVGPAL

SEQ ID NO: 1112696 - protein, 9 aa, Mycobacterium
SAVREGNSA

SEQ ID NO: 1112697 - protein, 5 aa, Mycobacterium
SAVSG

SEQ ID NO: 1112698 - protein, 10 aa, Mycobacterium
SAWSARRNRQ

SEQ ID NO: 1112699 - protein, 7 aa, Mycobacterium
SDAANAI

SEQ ID NO: 1112700 - protein, 14 aa, Mycobacterium
SDAFRKQYESAEVT

SEQ ID NO: 1112701 - protein, 6 aa, Mycobacterium
SDAMNV

SEQ ID NO: 1112702 - protein, 9 aa, Mycobacterium
SDAPSSVTA

SEQ ID NO: 1112703 - protein, 8 aa, Mycobacterium
SDAQRDGD

SEQ ID NO: 1112704 - protein, 6 aa, Mycobacterium
SDARRG

SEQ ID NO: 1112705 - protein, 8 aa, Mycobacterium
SDAVTDVA

SEQ ID NO: 1112706 - protein, 7 aa, Mycobacterium
SDAVTEV

SEQ ID NO: 1112707 - protein, 105 aa, Mycobacterium
SDDDAGVPDDRIDDGGYGSDDGPSGRHSGEFPAQPEGADARQGDYTDEYADGDYADSEYADEYADEYADEYADDHPVTAGAQPPAEPSGPAHGGTWDGGDWTGSH

SEQ ID NO: 1112708 - protein, 5 aa, Mycobacterium
SDEEY

SEQ ID NO: 1112709 - protein, 6 aa, Mycobacterium
SDERCA

SEQ ID NO: 1112710 - protein, 10 aa, Mycobacterium
SDFPGGDQAP

SEQ ID NO: 1112711 - protein, 10 aa, Mycobacterium
SDFSGTGAAI

SEQ ID NO: 1112712 - protein, 10 aa, Mycobacterium
SDFSGTGAAL

SEQ ID NO: 1112713 - protein, 6 aa, Mycobacterium
SDGDYY

SEQ ID NO: 1112714 - protein, 6 aa, Mycobacterium
SDGGAV

SEQ ID NO: 1112715 - protein, 7 aa, Mycobacterium
SDGPLGG

SEQ ID NO: 1112716 - protein, 9 aa, Mycobacterium
SDGTAPDGM

SEQ ID NO: 1112717 - protein, 18 aa, Mycobacterium
SDHGSRAQEPAQEKIPAP

SEQ ID NO: 1112718 - protein, 6 aa, Mycobacterium
SDHPRT

SEQ ID NO: 1112719 - protein, 11 aa, Mycobacterium
SDIGNGRGPVD

SEQ ID NO: 1112720 - protein, 9 aa, Mycobacterium
SDKADGSVV

SEQ ID NO: 1112721 - protein, 5 aa, Mycobacterium
SDKFA

SEQ ID NO: 1112722 - protein, 10 aa, Mycobacterium
SDKTGTLTKN

SEQ ID NO: 1112723 - protein, 5 aa, Mycobacterium
SDLGP

SEQ ID NO: 1112724 - protein, 6 aa, Mycobacterium
SDLSPG

SEQ ID NO: 1112725 - protein, 10 aa, Mycobacterium
SDPAAQASTV

SEQ ID NO: 1112726 - protein, 7 aa, Mycobacterium
SDPAQGA

SEQ ID NO: 1112727 - protein, 6 aa, Mycobacterium
SDPNPC

SEQ ID NO: 1112728 - protein, 66 aa, Mycobacterium
SDPSAPPDEPAGAEAPDATGRHEPTGADSLGATGADSLGATGADSLGATGADSLGATGAMPPPTPG

SEQ ID NO: 1112729 - protein, 14 aa, Mycobacterium
SDPTTRSQVVSEDG

SEQ ID NO: 1112730 - protein, 7 aa, Mycobacterium
SDQQLRH

SEQ ID NO: 1112731 - protein, 9 aa, Mycobacterium
SDQTAAKAA

SEQ ID NO: 1112732 - protein, 5 aa, Mycobacterium
SDRDP

SEQ ID NO: 1112733 - protein, 5 aa, Mycobacterium
SDRGA

SEQ ID NO: 1112734 - protein, 9 aa, Mycobacterium
SDRGGPAPV

SEQ ID NO: 1112735 - protein, 14 aa, Mycobacterium
SDRGPGVPQEDLGQ

SEQ ID NO: 1112736 - protein, 10 aa, Mycobacterium
SDRRKARRAA

SEQ ID NO: 1112737 - protein, 16 aa, Mycobacterium
SDRSVDAPDAPGTVTP

SEQ ID NO: 1112738 - protein, 4 aa, Mycobacterium
SDSL

SEQ ID NO: 1112739 - protein, 10 aa, Mycobacterium
SDSSRQDQAR

SEQ ID NO: 1112740 - protein, 7 aa, Mycobacterium
SDTEVDV

SEQ ID NO: 1112741 - protein, 11 aa, Mycobacterium
SDTGGINSGDK

SEQ ID NO: 1112742 - protein, 14 aa, Mycobacterium
SDTKPFDPENPYGE

SEQ ID NO: 1112743 - protein, 69 aa, Mycobacterium
SDTPAEPTPPSAATPPPVKKTPAKKAPAKKAPGKKAAAKKAPAKAVKKAPAKKNTAPPKKQPPPSPADL

SEQ ID NO: 1112744 - protein, 6 aa, Mycobacterium
SDTSQA

SEQ ID NO: 1112745 - protein, 11 aa, Mycobacterium
SDTVPDPLGYT

SEQ ID NO: 1112746 - protein, 6 aa, Mycobacterium
SDVAPG

SEQ ID NO: 1112747 - protein, 10 aa, Mycobacterium
SDVESNPKNY

SEQ ID NO: 1112748 - protein, 4 aa, Mycobacterium
SDVT

SEQ ID NO: 1112749 - protein, 11 aa, Mycobacterium
SDVTNGPRGLN

SEQ ID NO: 1112750 - protein, 6 aa, Mycobacterium
SDWADG

SEQ ID NO: 1112751 - protein, 9 aa, Mycobacterium
SDYAAAAPY

SEQ ID NO: 1112752 - protein, 10 aa, Mycobacterium
SDYSRDDYVG

SEQ ID NO: 1112753 - protein, 13 aa, Mycobacterium
SEAAETSGASPLS

SEQ ID NO: 1112754 - protein, 6 aa, Mycobacterium
SEAAHP

SEQ ID NO: 1112755 - protein, 7 aa, Mycobacterium
SEAARSL

SEQ ID NO: 1112756 - protein, 4 aa, Mycobacterium
SEAG

SEQ ID NO: 1112757 - protein, 6 aa, Mycobacterium
SEAKAN

SEQ ID NO: 1112758 - protein, 14 aa, Mycobacterium
SEAPKTVDAETEHG

SEQ ID NO: 1112759 - protein, 9 aa, Mycobacterium
SEARGDDLG

SEQ ID NO: 1112760 - protein, 4 aa, Mycobacterium
SEAS

SEQ ID NO: 1112761 - protein, 9 aa, Mycobacterium
SEDADAMGE

SEQ ID NO: 1112762 - protein, 4 aa, Mycobacterium
SEDG

SEQ ID NO: 1112763 - protein, 9 aa, Mycobacterium
SEDGSPERF

SEQ ID NO: 1112764 - protein, 15 aa, Mycobacterium
SEDSALTDLDGTQRM

SEQ ID NO: 1112765 - protein, 18 aa, Mycobacterium
SEDVSGDRDGVSVRTGGT

SEQ ID NO: 1112766 - protein, 6 aa, Mycobacterium
SEERDS

SEQ ID NO: 1112767 - protein, 5 aa, Mycobacterium
SEETP

SEQ ID NO: 1112768 - protein, 6 aa, Mycobacterium
SEETPV

SEQ ID NO: 1112769 - protein, 6 aa, Mycobacterium
SEGDEV

SEQ ID NO: 1112770 - protein, 9 aa, Mycobacterium
SEGGTVPTE

SEQ ID NO: 1112771 - protein, 6 aa, Mycobacterium
SEGNTA

SEQ ID NO: 1112772 - protein, 8 aa, Mycobacterium
SEGPKRYA

SEQ ID NO: 1112773 - protein, 5 aa, Mycobacterium
SEGPY

SEQ ID NO: 1112774 - protein, 6 aa, Mycobacterium
SEGYPS

SEQ ID NO: 1112775 - protein, 4 aa, Mycobacterium
SEKG

SEQ ID NO: 1112776 - protein, 9 aa, Mycobacterium
SELAGAGSA

SEQ ID NO: 1112777 - protein, 13 aa, Mycobacterium
SELTDPVEQRRRL

SEQ ID NO: 1112778 - protein, 7 aa, Mycobacterium
SELTEDD

SEQ ID NO: 1112779 - protein, 5 aa, Mycobacterium
SENAG

SEQ ID NO: 1112780 - protein, 35 aa, Mycobacterium
SENKQEEAEAPVTSSGAATASAPPPGSQNAVPTEP

SEQ ID NO: 1112781 - protein, 6 aa, Mycobacterium
SEPDSA

SEQ ID NO: 1112782 - protein, 8 aa, Mycobacterium
SEPGGHKK

SEQ ID NO: 1112783 - protein, 10 aa, Mycobacterium
SEPPGPDRTA

SEQ ID NO: 1112784 - protein, 11 aa, Mycobacterium
SEPTSAGEARV

SEQ ID NO: 1112785 - protein, 7 aa, Mycobacterium
SEQPHPY

SEQ ID NO: 1112786 - protein, 14 aa, Mycobacterium
SEQSRPQTGRMARQ

SEQ ID NO: 1112787 - protein, 10 aa, Mycobacterium
SERGQPGGQI

SEQ ID NO: 1112788 - protein, 5 aa, Mycobacterium
SERIA

SEQ ID NO: 1112789 - protein, 16 aa, Mycobacterium
SERVPEAEPSSPDKRP

SEQ ID NO: 1112790 - protein, 4 aa, Mycobacterium
SERY

SEQ ID NO: 1112791 - protein, 7 aa, Mycobacterium
SERYRNY

SEQ ID NO: 1112792 - protein, 6 aa, Mycobacterium
SESHMR

SEQ ID NO: 1112793 - protein, 4 aa, Mycobacterium
SESP

SEQ ID NO: 1112794 - protein, 9 aa, Mycobacterium
SESSGETDF

SEQ ID NO: 1112795 - protein, 6 aa, Mycobacterium
SESSRT

SEQ ID NO: 1112796 - protein, 16 aa, Mycobacterium
SESTPPPSAEVTKSVT

SEQ ID NO: 1112797 - protein, 9 aa, Mycobacterium
SETAEGRGR

SEQ ID NO: 1112798 - protein, 6 aa, Mycobacterium
SETPIN

SEQ ID NO: 1112799 - protein, 8 aa, Mycobacterium
SEVEQTAA

SEQ ID NO: 1112800 - protein, 4 aa, Mycobacterium
SEVH

SEQ ID NO: 1112801 - protein, 6 aa, Mycobacterium
SEVPGR

SEQ ID NO: 1112802 - protein, 6 aa, Mycobacterium
SEVSGW

SEQ ID NO: 1112803 - protein, 8 aa, Mycobacterium
SEVSQGEL

SEQ ID NO: 1112804 - protein, 5 aa, Mycobacterium
SEWTE

SEQ ID NO: 1112805 - protein, 37 aa, Mycobacterium
SFDEDETAAAAPADGGSVAAEPDPTNDNRTDGTERES

SEQ ID NO: 1112806 - protein, 5 aa, Mycobacterium
SFGGG

SEQ ID NO: 1112807 - protein, 9 aa, Mycobacterium
SFKSAVGPS

SEQ ID NO: 1112808 - protein, 7 aa, Mycobacterium
SFPSEKA

SEQ ID NO: 1112809 - protein, 7 aa, Mycobacterium
SFPSKKA

SEQ ID NO: 1112810 - protein, 19 aa, Mycobacterium
SFTLPEKGTAAKEAEERAA

SEQ ID NO: 1112811 - protein, 8 aa, Mycobacterium
SGAAAAEA

SEQ ID NO: 1112812 - protein, 11 aa, Mycobacterium
SGADSEHEPAT

SEQ ID NO: 1112813 - protein, 15 aa, Mycobacterium
SGADVAEETKDARRV

SEQ ID NO: 1112814 - protein, 6 aa, Mycobacterium
SGAELT

SEQ ID NO: 1112815 - protein, 4 aa, Mycobacterium
SGAG

SEQ ID NO: 1112816 - protein, 10 aa, Mycobacterium
SGAGAAASFS

SEQ ID NO: 1112817 - protein, 10 aa, Mycobacterium
SGAGPVAGPV

SEQ ID NO: 1112818 - protein, 6 aa, Mycobacterium
SGAGYA

SEQ ID NO: 1112819 - protein, 12 aa, Mycobacterium
SGAPEPVGGAHV

SEQ ID NO: 1112820 - protein, 21 aa, Mycobacterium
SGAPESSVPQGTFDTGPVDGG

SEQ ID NO: 1112821 - protein, 21 aa, Mycobacterium
SGAPISAQEITDAAESVGEES

SEQ ID NO: 1112822 - protein, 11 aa, Mycobacterium
SGAPITPEQID

SEQ ID NO: 1112823 - protein, 22 aa, Mycobacterium
SGAPYPGAQYGPAQGQPPPRRR

SEQ ID NO: 1112824 - protein, 12 aa, Mycobacterium
SGAQQVDAASSA

SEQ ID NO: 1112825 - protein, 5 aa, Mycobacterium
SGARV

SEQ ID NO: 1112826 - protein, 7 aa, Mycobacterium
SGATLTE

SEQ ID NO: 1112827 - protein, 6 aa, Mycobacterium
SGDAAA

SEQ ID NO: 1112828 - protein, 5 aa, Mycobacterium
SGDEE

SEQ ID NO: 1112829 - protein, 15 aa, Mycobacterium
SGDNVKSAQIDDREQ

SEQ ID NO: 1112830 - protein, 8 aa, Mycobacterium
SGDPEAVR

SEQ ID NO: 1112831 - protein, 9 aa, Mycobacterium
SGDREAVER

SEQ ID NO: 1112832 - protein, 7 aa, Mycobacterium
SGDSATF

SEQ ID NO: 1112833 - protein, 6 aa, Mycobacterium
SGEAGY

SEQ ID NO: 1112834 - protein, 10 aa, Mycobacterium
SGEAPDAPKV

SEQ ID NO: 1112835 - protein, 6 aa, Mycobacterium
SGEIGR

SEQ ID NO: 1112836 - protein, 5 aa, Mycobacterium
SGELE

SEQ ID NO: 1112837 - protein, 18 aa, Mycobacterium
SGEQIANASSGLNQQAGE

SEQ ID NO: 1112838 - protein, 5 aa, Mycobacterium
SGERI

SEQ ID NO: 1112839 - protein, 6 aa, Mycobacterium
SGETSA

SEQ ID NO: 1112840 - protein, 6 aa, Mycobacterium
SGEWSK

SEQ ID NO: 1112841 - protein, 7 aa, Mycobacterium
SGFNPSR

SEQ ID NO: 1112842 - protein, 9 aa, Mycobacterium
SGFSESELE

SEQ ID NO: 1112843 - protein, 16 aa, Mycobacterium
SGFSGDFNSDANAVAH

SEQ ID NO: 1112844 - protein, 8 aa, Mycobacterium
SGGDAGTA

SEQ ID NO: 1112845 - protein, 13 aa, Mycobacterium
SGGDFGRDHRGDE

SEQ ID NO: 1112846 - protein, 71 aa, Mycobacterium
SGGDQSGAPPSVPADASVAAEAAAPAPAPPDSAVGSSGGALPQADGVQSATGAPAQASPAPPPRPDDAAGW

SEQ ID NO: 1112847 - protein, 5 aa, Mycobacterium
SGGER

SEQ ID NO: 1112848 - protein, 23 aa, Mycobacterium
SGGESSSQSPVSVPTDAESAKVN

SEQ ID NO: 1112849 - protein, 12 aa, Mycobacterium
SGGFPPPIAPDA

SEQ ID NO: 1112850 - protein, 6 aa, Mycobacterium
SGGGAL

SEQ ID NO: 1112851 - protein, 5 aa, Mycobacterium
SGGGR

SEQ ID NO: 1112852 - protein, 8 aa, Mycobacterium
SGGKADIP

SEQ ID NO: 1112853 - protein, 10 aa, Mycobacterium
SGGPGQPSLA

SEQ ID NO: 1112854 - protein, 6 aa, Mycobacterium
SGGPIR

SEQ ID NO: 1112855 - protein, 10 aa, Mycobacterium
SGGPSGVGAA

SEQ ID NO: 1112856 - protein, 7 aa, Mycobacterium
SGGPVGV

SEQ ID NO: 1112857 - protein, 16 aa, Mycobacterium
SGGQRSQGGIAPSQRA

SEQ ID NO: 1112858 - protein, 12 aa, Mycobacterium
SGGVTAPRDSPL

SEQ ID NO: 1112859 - protein, 8 aa, Mycobacterium
SGGYAGDR

SEQ ID NO: 1112860 - protein, 12 aa, Mycobacterium
SGHNDADQSGAL

SEQ ID NO: 1112861 - protein, 5 aa, Mycobacterium
SGIPV

SEQ ID NO: 1112862 - protein, 13 aa, Mycobacterium
SGITQPGRRVPDD

SEQ ID NO: 1112863 - protein, 7 aa, Mycobacterium
SGKAAPR

SEQ ID NO: 1112864 - protein, 8 aa, Mycobacterium
SGKAAQFG

SEQ ID NO: 1112865 - protein, 10 aa, Mycobacterium
SGLGTTPTGT

SEQ ID NO: 1112866 - protein, 6 aa, Mycobacterium
SGLPAF

SEQ ID NO: 1112867 - protein, 8 aa, Mycobacterium
SGLPAKDF

SEQ ID NO: 1112868 - protein, 8 aa, Mycobacterium
SGLQPGAD

SEQ ID NO: 1112869 - protein, 8 aa, Mycobacterium
SGLSDASC

SEQ ID NO: 1112870 - protein, 5 aa, Mycobacterium
SGLSV

SEQ ID NO: 1112871 - protein, 6 aa, Mycobacterium
SGLTAP

SEQ ID NO: 1112872 - protein, 5 aa, Mycobacterium
SGLTE

SEQ ID NO: 1112873 - protein, 5 aa, Mycobacterium
SGNAI

SEQ ID NO: 1112874 - protein, 11 aa, Mycobacterium
SGNRPERLKPG

SEQ ID NO: 1112875 - protein, 10 aa, Mycobacterium
SGNRVGRDER

SEQ ID NO: 1112876 - protein, 5 aa, Mycobacterium
SGNSM

SEQ ID NO: 1112877 - protein, 8 aa, Mycobacterium
SGPDADAI

SEQ ID NO: 1112878 - protein, 10 aa, Mycobacterium
SGPGITPFST

SEQ ID NO: 1112879 - protein, 7 aa, Mycobacterium
SGPGVYP

SEQ ID NO: 1112880 - protein, 6 aa, Mycobacterium
SGPQLA

SEQ ID NO: 1112881 - protein, 7 aa, Mycobacterium
SGPRRHP

SEQ ID NO: 1112882 - protein, 6 aa, Mycobacterium
SGPSGF

SEQ ID NO: 1112883 - protein, 12 aa, Mycobacterium
SGPYGGGGGGQM

SEQ ID NO: 1112884 - protein, 10 aa, Mycobacterium
SGQDAQTWTQ

SEQ ID NO: 1112885 - protein, 18 aa, Mycobacterium
SGQGGTATFADPAEATAA

SEQ ID NO: 1112886 - protein, 26 aa, Mycobacterium
SGQGGTATFADPAEATAALGQRTPED

SEQ ID NO: 1112887 - protein, 10 aa, Mycobacterium
SGQLAQAEDR

SEQ ID NO: 1112888 - protein, 7 aa, Mycobacterium
SGQLGPA

SEQ ID NO: 1112889 - protein, 5 aa, Mycobacterium
SGQLR

SEQ ID NO: 1112890 - protein, 14 aa, Mycobacterium
SGQPMSEGNNRKDH

SEQ ID NO: 1112891 - protein, 6 aa, Mycobacterium
SGQVDG

SEQ ID NO: 1112892 - protein, 19 aa, Mycobacterium
SGRAGPDAREVAASGARRG

SEQ ID NO: 1112893 - protein, 16 aa, Mycobacterium
SGRAPRGALAAGGPTT

SEQ ID NO: 1112894 - protein, 12 aa, Mycobacterium
SGRDPHEQGRVA

SEQ ID NO: 1112895 - protein, 4 aa, Mycobacterium
SGRF

SEQ ID NO: 1112896 - protein, 4 aa, Mycobacterium
SGRG

SEQ ID NO: 1112897 - protein, 8 aa, Mycobacterium
SGRGSGRR

SEQ ID NO: 1112898 - protein, 12 aa, Mycobacterium
SGRLNPAPAISA

SEQ ID NO: 1112899 - protein, 6 aa, Mycobacterium
SGRPAQ

SEQ ID NO: 1112900 - protein, 8 aa, Mycobacterium
SGRPLDRE

SEQ ID NO: 1112901 - protein, 19 aa, Mycobacterium
SGRPPTPAEIRTTAKTMRR

SEQ ID NO: 1112902 - protein, 10 aa, Mycobacterium
SGRRSDPDLD

SEQ ID NO: 1112903 - protein, 6 aa, Mycobacterium
SGRSDA

SEQ ID NO: 1112904 - protein, 7 aa, Mycobacterium
SGRTAAS

SEQ ID NO: 1112905 - protein, 4 aa, Mycobacterium
SGSA

SEQ ID NO: 1112906 - protein, 16 aa, Mycobacterium
SGSAAAERRGRAMSGA

SEQ ID NO: 1112907 - protein, 6 aa, Mycobacterium
SGSAAV

SEQ ID NO: 1112908 - protein, 40 aa, Mycobacterium
SGSDDDSTPNPATTTTTTRSRTAPTTTRPTATSARPNRSA

SEQ ID NO: 1112909 - protein, 13 aa, Mycobacterium
SGSDGSKPATELT

SEQ ID NO: 1112910 - protein, 4 aa, Mycobacterium
SGSE

SEQ ID NO: 1112911 - protein, 4 aa, Mycobacterium
SGSG

SEQ ID NO: 1112912 - protein, 12 aa, Mycobacterium
SGSPLAPPDNDT

SEQ ID NO: 1112913 - protein, 6 aa, Mycobacterium
SGSRDG

SEQ ID NO: 1112914 - protein, 35 aa, Mycobacterium
SGSRTAPSAPVADPETEEPATASARTATAAESVVA

SEQ ID NO: 1112915 - protein, 7 aa, Mycobacterium
SGSSAVD

SEQ ID NO: 1112916 - protein, 17 aa, Mycobacterium
SGSSGAPKGVRHSHGNA

SEQ ID NO: 1112917 - protein, 7 aa, Mycobacterium
SGSTATI

SEQ ID NO: 1112918 - protein, 9 aa, Mycobacterium
SGSTRSPRG

SEQ ID NO: 1112919 - protein, 8 aa, Mycobacterium
SGTEIDTG

SEQ ID NO: 1112920 - protein, 10 aa, Mycobacterium
SGTETTESAA

SEQ ID NO: 1112921 - protein, 12 aa, Mycobacterium
SGTPGSADTENV

SEQ ID NO: 1112922 - protein, 6 aa, Mycobacterium
SGTSYA

SEQ ID NO: 1112923 - protein, 17 aa, Mycobacterium
SGTTGTPKGANRKPPLS

SEQ ID NO: 1112924 - protein, 11 aa, Mycobacterium
SGVAAGASWGN

SEQ ID NO: 1112925 - protein, 6 aa, Mycobacterium
SGVDAD

SEQ ID NO: 1112926 - protein, 5 aa, Mycobacterium
SGVHD

SEQ ID NO: 1112927 - protein, 14 aa, Mycobacterium
SGVKSAVNQTGYSL

SEQ ID NO: 1112928 - protein, 6 aa, Mycobacterium
SGVPSS

SEQ ID NO: 1112929 - protein, 15 aa, Mycobacterium
SGVSAKTDGPVPTPP

SEQ ID NO: 1112930 - protein, 5 aa, Mycobacterium
SGVTT

SEQ ID NO: 1112931 - protein, 18 aa, Mycobacterium
SGYPADACTPAPSPDSAT

SEQ ID NO: 1112932 - protein, 5 aa, Mycobacterium
SGYPV

SEQ ID NO: 1112933 - protein, 11 aa, Mycobacterium
SGYRPLTEDPA

SEQ ID NO: 1112934 - protein, 19 aa, Mycobacterium
SHDASDSIDGALESSAAGI

SEQ ID NO: 1112935 - protein, 7 aa, Mycobacterium
SHDPFSA

SEQ ID NO: 1112936 - protein, 6 aa, Mycobacterium
SHEHAR

SEQ ID NO: 1112937 - protein, 6 aa, Mycobacterium
SHEIPS

SEQ ID NO: 1112938 - protein, 5 aa, Mycobacterium
SHGDL

SEQ ID NO: 1112939 - protein, 5 aa, Mycobacterium
SHGEG

SEQ ID NO: 1112940 - protein, 16 aa, Mycobacterium
SHGGTIDATSGSGTTA

SEQ ID NO: 1112941 - protein, 10 aa, Mycobacterium
SHPALQPDAG

SEQ ID NO: 1112942 - protein, 6 aa, Mycobacterium
SHPPDE

SEQ ID NO: 1112943 - protein, 6 aa, Mycobacterium
SHRTTA

SEQ ID NO: 1112944 - protein, 15 aa, Mycobacterium
SHTDDGETLSDNEIR

SEQ ID NO: 1112945 - protein, 9 aa, Mycobacterium
SIPGEGKNI

SEQ ID NO: 1112946 - protein, 9 aa, Mycobacterium
SIPKGQWEA

SEQ ID NO: 1112947 - protein, 5 aa, Mycobacterium
SIQAN

SEQ ID NO: 1112948 - protein, 14 aa, Mycobacterium
SIRPGDTAARLGGD

SEQ ID NO: 1112949 - protein, 21 aa, Mycobacterium
SIRRSSLQPRQPSRTHSSPAV

SEQ ID NO: 1112950 - protein, 7 aa, Mycobacterium
SIRSDNT

SEQ ID NO: 1112951 - protein, 9 aa, Mycobacterium
SITGSSDRL

SEQ ID NO: 1112952 - protein, 8 aa, Mycobacterium
SKAPGDKV

SEQ ID NO: 1112953 - protein, 8 aa, Mycobacterium
SKDRRKQA

SEQ ID NO: 1112954 - protein, 6 aa, Mycobacterium
SKERVR

SEQ ID NO: 1112955 - protein, 9 aa, Mycobacterium
SKGEDELPV

SEQ ID NO: 1112956 - protein, 4 aa, Mycobacterium
SKGP

SEQ ID NO: 1112957 - protein, 8 aa, Mycobacterium
SKGTLTGA

SEQ ID NO: 1112958 - protein, 8 aa, Mycobacterium
SKGTRAER

SEQ ID NO: 1112959 - protein, 12 aa, Mycobacterium
SKGVDARPARSF

SEQ ID NO: 1112960 - protein, 9 aa, Mycobacterium
SKHSGAGAA

SEQ ID NO: 1112961 - protein, 6 aa, Mycobacterium
SKIQGA

SEQ ID NO: 1112962 - protein, 9 aa, Mycobacterium
SKKNATATE

SEQ ID NO: 1112963 - protein, 15 aa, Mycobacterium
SKNKDPQASAPGIGT

SEQ ID NO: 1112964 - protein, 5 aa, Mycobacterium
SKNLG

SEQ ID NO: 1112965 - protein, 6 aa, Mycobacterium
SKNWGQ

SEQ ID NO: 1112966 - protein, 8 aa, Mycobacterium
SKRDGCGE

SEQ ID NO: 1112967 - protein, 8 aa, Mycobacterium
SKRNATAD

SEQ ID NO: 1112968 - protein, 12 aa, Mycobacterium
SKRSSDGSGAIG

SEQ ID NO: 1112969 - protein, 7 aa, Mycobacterium
SKSEYAD

SEQ ID NO: 1112970 - protein, 11 aa, Mycobacterium
SKVAEAKGVPV

SEQ ID NO: 1112971 - protein, 21 aa, Mycobacterium
SKYTANQQGQTLPVGQPEQDV

SEQ ID NO: 1112972 - protein, 4 aa, Mycobacterium
SLAA

SEQ ID NO: 1112973 - protein, 7 aa, Mycobacterium
SLAAESG

SEQ ID NO: 1112974 - protein, 9 aa, Mycobacterium
SLAAKGDVT

SEQ ID NO: 1112975 - protein, 10 aa, Mycobacterium
SLAGTAAPPR

SEQ ID NO: 1112976 - protein, 19 aa, Mycobacterium
SLAQDARKLAGDPGTPLDP

SEQ ID NO: 1112977 - protein, 15 aa, Mycobacterium
SLAQQGKTPPSIGTL

SEQ ID NO: 1112978 - protein, 20 aa, Mycobacterium
SLATDAPTGMAPAADAPTAM

SEQ ID NO: 1112979 - protein, 8 aa, Mycobacterium
SLDEDDRE

SEQ ID NO: 1112980 - protein, 4 aa, Mycobacterium
SLDG

SEQ ID NO: 1112981 - protein, 6 aa, Mycobacterium
SLEEAG

SEQ ID NO: 1112982 - protein, 8 aa, Mycobacterium
SLEEQAQV

SEQ ID NO: 1112983 - protein, 10 aa, Mycobacterium
SLGAPQVAGA

SEQ ID NO: 1112984 - protein, 13 aa, Mycobacterium
SLGGTLAGPDPAW

SEQ ID NO: 1112985 - protein, 17 aa, Mycobacterium
SLGGTTELYTEPGRGTE

SEQ ID NO: 1112986 - protein, 17 aa, Mycobacterium
SLGPRGNDTFDHAKSGD

SEQ ID NO: 1112987 - protein, 7 aa, Mycobacterium
SLGRPPV

SEQ ID NO: 1112988 - protein, 10 aa, Mycobacterium
SLKDATPQLR

SEQ ID NO: 1112989 - protein, 9 aa, Mycobacterium
SLKERDESV

SEQ ID NO: 1112990 - protein, 20 aa, Mycobacterium
SLKSTTATKDPTAKKPTLEQ

SEQ ID NO: 1112991 - protein, 12 aa, Mycobacterium
SLKTATSAAREL

SEQ ID NO: 1112992 - protein, 5 aa, Mycobacterium
SLNRS

SEQ ID NO: 1112993 - protein, 9 aa, Mycobacterium
SLNTGGTRI

SEQ ID NO: 1112994 - protein, 9 aa, Mycobacterium
SLPADQQST

SEQ ID NO: 1112995 - protein, 7 aa, Mycobacterium
SLPAGRR

SEQ ID NO: 1112996 - protein, 15 aa, Mycobacterium
SLPEGAFGTAAAAGS

SEQ ID NO: 1112997 - protein, 7 aa, Mycobacterium
SLPGAVN

SEQ ID NO: 1112998 - protein, 17 aa, Mycobacterium
SLPPGNIAGASTEVIQK

SEQ ID NO: 1112999 - protein, 7 aa, Mycobacterium
SLPQRRA

SEQ ID NO: 1113000 - protein, 5 aa, Mycobacterium
SLPRD

SEQ ID NO: 1113001 - protein, 16 aa, Mycobacterium
SLQGSDPYKVGPATGL

SEQ ID NO: 1113002 - protein, 6 aa, Mycobacterium
SLQPDN

SEQ ID NO: 1113003 - protein, 5 aa, Mycobacterium
SLQTT

SEQ ID NO: 1113004 - protein, 12 aa, Mycobacterium
SLRDDADLRDKA

SEQ ID NO: 1113005 - protein, 6 aa, Mycobacterium
SLRRDG

SEQ ID NO: 1113006 - protein, 7 aa, Mycobacterium
SLSARGR

SEQ ID NO: 1113007 - protein, 18 aa, Mycobacterium
SLSGGGFRDPESDSARAS

SEQ ID NO: 1113008 - protein, 9 aa, Mycobacterium
SLSNTGAAR

SEQ ID NO: 1113009 - protein, 17 aa, Mycobacterium
SLSPSGFSDPGSESAHA

SEQ ID NO: 1113010 - protein, 7 aa, Mycobacterium
SLSSSEA

SEQ ID NO: 1113011 - protein, 4 aa, Mycobacterium
SLTA

SEQ ID NO: 1113012 - protein, 12 aa, Mycobacterium
SLTENGAEATLS

SEQ ID NO: 1113013 - protein, 29 aa, Mycobacterium
SLTPTERIRSPRGRYGSYDDDPDRYGDLD

SEQ ID NO: 1113014 - protein, 7 aa, Mycobacterium
SMGASAT

SEQ ID NO: 1113015 - protein, 12 aa, Mycobacterium
SMNAPEPDPATV

SEQ ID NO: 1113016 - protein, 12 aa, Mycobacterium
SMPGEGKSTTAI

SEQ ID NO: 1113017 - protein, 15 aa, Mycobacterium
SMPSGSAAARAGVDS

SEQ ID NO: 1113018 - protein, 9 aa, Mycobacterium
SMRATDVAP

SEQ ID NO: 1113019 - protein, 23 aa, Mycobacterium
SMRATDVSPSRLAAAQEASKQFA

SEQ ID NO: 1113020 - protein, 9 aa, Mycobacterium
SMRQSEAEM

SEQ ID NO: 1113021 - protein, 9 aa, Mycobacterium
SMSPNEAPS

SEQ ID NO: 1113022 - protein, 9 aa, Mycobacterium
SMSRPRRDR

SEQ ID NO: 1113023 - protein, 4 aa, Mycobacterium
SMST

SEQ ID NO: 1113024 - protein, 4 aa, Mycobacterium
SMTA

SEQ ID NO: 1113025 - protein, 12 aa, Mycobacterium
SNAIGRPVPGGS

SEQ ID NO: 1113026 - protein, 6 aa, Mycobacterium
SNAPSV

SEQ ID NO: 1113027 - protein, 10 aa, Mycobacterium
SNDAATDGAK

SEQ ID NO: 1113028 - protein, 8 aa, Mycobacterium
SNIGDRPV

SEQ ID NO: 1113029 - protein, 6 aa, Mycobacterium
SNLGDE

SEQ ID NO: 1113030 - protein, 14 aa, Mycobacterium
SNLTGGGFEVEGSQ

SEQ ID NO: 1113031 - protein, 7 aa, Mycobacterium
SNNATFD

SEQ ID NO: 1113032 - protein, 9 aa, Mycobacterium
SNNATFNEQ

SEQ ID NO: 1113033 - protein, 15 aa, Mycobacterium
SNPHHGRSASAGGAA

SEQ ID NO: 1113034 - protein, 9 aa, Mycobacterium
SNPSEAADE

SEQ ID NO: 1113035 - protein, 16 aa, Mycobacterium
SNPSNREDPLPGGPQW

SEQ ID NO: 1113036 - protein, 10 aa, Mycobacterium
SNQDKPFGPN

SEQ ID NO: 1113037 - protein, 7 aa, Mycobacterium
SNRTRRG

SEQ ID NO: 1113038 - protein, 10 aa, Mycobacterium
SNSEAADQRV

SEQ ID NO: 1113039 - protein, 9 aa, Mycobacterium
SNSGGDANY

SEQ ID NO: 1113040 - protein, 8 aa, Mycobacterium
SNSPTWRN

SEQ ID NO: 1113041 - protein, 4 aa, Mycobacterium
SNSR

SEQ ID NO: 1113042 - protein, 16 aa, Mycobacterium
SNSTGSTGLGSTTADA

SEQ ID NO: 1113043 - protein, 13 aa, Mycobacterium
SNSYGLAQPPRLD

SEQ ID NO: 1113044 - protein, 5 aa, Mycobacterium
SNTAL

SEQ ID NO: 1113045 - protein, 4 aa, Mycobacterium
SNTG

SEQ ID NO: 1113046 - protein, 7 aa, Mycobacterium
SNTTPFG

SEQ ID NO: 1113047 - protein, 4 aa, Mycobacterium
SNVG

SEQ ID NO: 1113048 - protein, 23 aa, Mycobacterium
SNVGPDDPQQAAVPPPPAPAPPL

SEQ ID NO: 1113049 - protein, 9 aa, Mycobacterium
SNVPADAQR

SEQ ID NO: 1113050 - protein, 20 aa, Mycobacterium
SPAADPSTSVRGNRVNGPQA

SEQ ID NO: 1113051 - protein, 17 aa, Mycobacterium
SPAARAARERAGLAPQT

SEQ ID NO: 1113052 - protein, 9 aa, Mycobacterium
SPAGPGGPL

SEQ ID NO: 1113053 - protein, 14 aa, Mycobacterium
SPAPGADPTADQRK

SEQ ID NO: 1113054 - protein, 16 aa, Mycobacterium
SPAPGAGPAAPGPAGP

SEQ ID NO: 1113055 - protein, 6 aa, Mycobacterium
SPAREA

SEQ ID NO: 1113056 - protein, 6 aa, Mycobacterium
SPARPL

SEQ ID NO: 1113057 - protein, 7 aa, Mycobacterium
SPASVSS

SEQ ID NO: 1113058 - protein, 8 aa, Mycobacterium
SPATTAAL

SEQ ID NO: 1113059 - protein, 5 aa, Mycobacterium
SPAVS

SEQ ID NO: 1113060 - protein, 28 aa, Mycobacterium
SPDAKRPEDAAQLDGTPFETMPDRPRRV

SEQ ID NO: 1113061 - protein, 76 aa, Mycobacterium
SPDATPPSDGTSPATPPSSTDPSGAPTTSVPSTTVPSTTVPPTSVPPPPSSAPSTAPTSAPSSSAAAEPGTTTRAP

SEQ ID NO: 1113062 - protein, 13 aa, Mycobacterium
SPDDVSQEVASDR

SEQ ID NO: 1113063 - protein, 4 aa, Mycobacterium
SPDG

SEQ ID NO: 1113064 - protein, 6 aa, Mycobacterium
SPDGKT

SEQ ID NO: 1113065 - protein, 5 aa, Mycobacterium
SPDLD

SEQ ID NO: 1113066 - protein, 7 aa, Mycobacterium
SPDPGSL

SEQ ID NO: 1113067 - protein, 8 aa, Mycobacterium
SPDPGSLG

SEQ ID NO: 1113068 - protein, 7 aa, Mycobacterium
SPDPRFG

SEQ ID NO: 1113069 - protein, 13 aa, Mycobacterium
SPEDQSENADAAT

SEQ ID NO: 1113070 - protein, 11 aa, Mycobacterium
SPEGEADAPKL

SEQ ID NO: 1113071 - protein, 8 aa, Mycobacterium
SPELQPGK

SEQ ID NO: 1113072 - protein, 18 aa, Mycobacterium
SPESLDQDFANAKAKLTG

SEQ ID NO: 1113073 - protein, 8 aa, Mycobacterium
SPESPWNK

SEQ ID NO: 1113074 - protein, 21 aa, Mycobacterium
SPESSPETNCTTSQTITATSR

SEQ ID NO: 1113075 - protein, 8 aa, Mycobacterium
SPETGANV

SEQ ID NO: 1113076 - protein, 5 aa, Mycobacterium
SPGAF

SEQ ID NO: 1113077 - protein, 7 aa, Mycobacterium
SPGASRA

SEQ ID NO: 1113078 - protein, 9 aa, Mycobacterium
SPGDRPRGQ

SEQ ID NO: 1113079 - protein, 10 aa, Mycobacterium
SPGDTSYIAD

SEQ ID NO: 1113080 - protein, 4 aa, Mycobacterium
SPGP

SEQ ID NO: 1113081 - protein, 24 aa, Mycobacterium
SPGPAPAAPEAPQATSSAPVTQNG

SEQ ID NO: 1113082 - protein, 5 aa, Mycobacterium
SPGSR

SEQ ID NO: 1113083 - protein, 6 aa, Mycobacterium
SPGSSP

SEQ ID NO: 1113084 - protein, 6 aa, Mycobacterium
SPHPGV

SEQ ID NO: 1113085 - protein, 9 aa, Mycobacterium
SPKSKAPTY

SEQ ID NO: 1113086 - protein, 9 aa, Mycobacterium
SPLGRPSRI

SEQ ID NO: 1113087 - protein, 5 aa, Mycobacterium
SPLPL

SEQ ID NO: 1113088 - protein, 11 aa, Mycobacterium
SPLRRNSDGRI

SEQ ID NO: 1113089 - protein, 4 aa, Mycobacterium
SPLT

SEQ ID NO: 1113090 - protein, 11 aa, Mycobacterium
SPLTAASTHSQ

SEQ ID NO: 1113091 - protein, 7 aa, Mycobacterium
SPPFQHS

SEQ ID NO: 1113092 - protein, 7 aa, Mycobacterium
SPPRLGD

SEQ ID NO: 1113093 - protein, 8 aa, Mycobacterium
SPPRLGDD

SEQ ID NO: 1113094 - protein, 5 aa, Mycobacterium
SPPTL

SEQ ID NO: 1113095 - protein, 9 aa, Mycobacterium
SPPYTGGPV

SEQ ID NO: 1113096 - protein, 5 aa, Mycobacterium
SPQAQ

SEQ ID NO: 1113097 - protein, 7 aa, Mycobacterium
SPQARPA

SEQ ID NO: 1113098 - protein, 9 aa, Mycobacterium
SPQPPPLPA

SEQ ID NO: 1113099 - protein, 4 aa, Mycobacterium
SPQR

SEQ ID NO: 1113100 - protein, 6 aa, Mycobacterium
SPQSID

SEQ ID NO: 1113101 - protein, 6 aa, Mycobacterium
SPQVNS

SEQ ID NO: 1113102 - protein, 10 aa, Mycobacterium
SPRADTRSAL

SEQ ID NO: 1113103 - protein, 7 aa, Mycobacterium
SPRAGMG

SEQ ID NO: 1113104 - protein, 12 aa, Mycobacterium
SPRKERRLLRRY

SEQ ID NO: 1113105 - protein, 12 aa, Mycobacterium
SPRNGSSRPLRE

SEQ ID NO: 1113106 - protein, 6 aa, Mycobacterium
SPRNTW

SEQ ID NO: 1113107 - protein, 5 aa, Mycobacterium
SPRQR

SEQ ID NO: 1113108 - protein, 7 aa, Mycobacterium
SPRRPRR

SEQ ID NO: 1113109 - protein, 6 aa, Mycobacterium
SPRRRR

SEQ ID NO: 1113110 - protein, 9 aa, Mycobacterium
SPRRSEPRG

SEQ ID NO: 1113111 - protein, 9 aa, Mycobacterium
SPRSDARGE

SEQ ID NO: 1113112 - protein, 8 aa, Mycobacterium
SPRSKASG

SEQ ID NO: 1113113 - protein, 6 aa, Mycobacterium
SPRTEV

SEQ ID NO: 1113114 - protein, 15 aa, Mycobacterium
SPRYAPRDAGEDPAV

SEQ ID NO: 1113115 - protein, 11 aa, Mycobacterium
SPSAGGPDPVV

SEQ ID NO: 1113116 - protein, 8 aa, Mycobacterium
SPSAVRDL

SEQ ID NO: 1113117 - protein, 11 aa, Mycobacterium
SPSEADKMDPQ

SEQ ID NO: 1113118 - protein, 10 aa, Mycobacterium
SPSEDPATPD

SEQ ID NO: 1113119 - protein, 13 aa, Mycobacterium
SPSGQTYTTRPGS

SEQ ID NO: 1113120 - protein, 20 aa, Mycobacterium
SPSLTGKSVRSDLEDGKATS

SEQ ID NO: 1113121 - protein, 24 aa, Mycobacterium
SPSPLAQDLRSAEDRDLPSRTDRI

SEQ ID NO: 1113122 - protein, 21 aa, Mycobacterium
SPSSSETSSATADQSTDPKTR

SEQ ID NO: 1113123 - protein, 6 aa, Mycobacterium
SPSTSM

SEQ ID NO: 1113124 - protein, 7 aa, Mycobacterium
SPTQKER

SEQ ID NO: 1113125 - protein, 6 aa, Mycobacterium
SPTQSN

SEQ ID NO: 1113126 - protein, 6 aa, Mycobacterium
SPTRHV

SEQ ID NO: 1113127 - protein, 8 aa, Mycobacterium
SPTSSPVT

SEQ ID NO: 1113128 - protein, 14 aa, Mycobacterium
SPVRDGSDAGGSEV

SEQ ID NO: 1113129 - protein, 11 aa, Mycobacterium
SPVTRKHADEV

SEQ ID NO: 1113130 - protein, 11 aa, Mycobacterium
SPWTAPPAAAA

SEQ ID NO: 1113131 - protein, 5 aa, Mycobacterium
SQAAR

SEQ ID NO: 1113132 - protein, 7 aa, Mycobacterium
SQADGPL

SEQ ID NO: 1113133 - protein, 13 aa, Mycobacterium
SQAQSTGNSDPLG

SEQ ID NO: 1113134 - protein, 8 aa, Mycobacterium
SQASGAEQ

SEQ ID NO: 1113135 - protein, 6 aa, Mycobacterium
SQDGNE

SEQ ID NO: 1113136 - protein, 14 aa, Mycobacterium
SQDQRVNASEPVAR

SEQ ID NO: 1113137 - protein, 11 aa, Mycobacterium
SQEDNTGEQRI

SEQ ID NO: 1113138 - protein, 31 aa, Mycobacterium
SQELDKMPKGQPVGIPGAPYATPVASSAESQ

SEQ ID NO: 1113139 - protein, 10 aa, Mycobacterium
SQGAPPSPLQ

SEQ ID NO: 1113140 - protein, 10 aa, Mycobacterium
SQGKTAPRTV

SEQ ID NO: 1113141 - protein, 19 aa, Mycobacterium
SQGNNAAQIAADTAAPWDG

SEQ ID NO: 1113142 - protein, 9 aa, Mycobacterium
SQKGQQDQM

SEQ ID NO: 1113143 - protein, 11 aa, Mycobacterium
SQLASGGRALA

SEQ ID NO: 1113144 - protein, 6 aa, Mycobacterium
SQLPPQ

SEQ ID NO: 1113145 - protein, 9 aa, Mycobacterium
SQLQQQTAN

SEQ ID NO: 1113146 - protein, 10 aa, Mycobacterium
SQLSGSGVSN

SEQ ID NO: 1113147 - protein, 6 aa, Mycobacterium
SQMTKT

SEQ ID NO: 1113148 - protein, 13 aa, Mycobacterium
SQNQNYPSRAGGA

SEQ ID NO: 1113149 - protein, 4 aa, Mycobacterium
SQPG

SEQ ID NO: 1113150 - protein, 7 aa, Mycobacterium
SQPGNHD

SEQ ID NO: 1113151 - protein, 5 aa, Mycobacterium
SQPNR

SEQ ID NO: 1113152 - protein, 5 aa, Mycobacterium
SQPVP

SEQ ID NO: 1113153 - protein, 10 aa, Mycobacterium
SQQGTIKPSR

SEQ ID NO: 1113154 - protein, 14 aa, Mycobacterium
SQQPVYATDRGEAE

SEQ ID NO: 1113155 - protein, 12 aa, Mycobacterium
SQRAARRADVGR

SEQ ID NO: 1113156 - protein, 8 aa, Mycobacterium
SQRAQRQA

SEQ ID NO: 1113157 - protein, 7 aa, Mycobacterium
SQRGRVR

SEQ ID NO: 1113158 - protein, 4 aa, Mycobacterium
SQRL

SEQ ID NO: 1113159 - protein, 7 aa, Mycobacterium
SQSRVES

SEQ ID NO: 1113160 - protein, 5 aa, Mycobacterium
SQTAG

SEQ ID NO: 1113161 - protein, 13 aa, Mycobacterium
SQTAGRLGDSRTD

SEQ ID NO: 1113162 - protein, 4 aa, Mycobacterium
SQTE

SEQ ID NO: 1113163 - protein, 8 aa, Mycobacterium
SQTGTDLL

SEQ ID NO: 1113164 - protein, 16 aa, Mycobacterium
SQTPPAPPPQIPQKPK

SEQ ID NO: 1113165 - protein, 16 aa, Mycobacterium
SQTPSAPPPQIPQKPK

SEQ ID NO: 1113166 - protein, 6 aa, Mycobacterium
SQVEHS

SEQ ID NO: 1113167 - protein, 5 aa, Mycobacterium
SQVGP

SEQ ID NO: 1113168 - protein, 5 aa, Mycobacterium
SQYTP

SEQ ID NO: 1113169 - protein, 13 aa, Mycobacterium
SRAARRRRNRVTE

SEQ ID NO: 1113170 - protein, 13 aa, Mycobacterium
SRAARTDTGGVDR

SEQ ID NO: 1113171 - protein, 8 aa, Mycobacterium
SRADEGRA

SEQ ID NO: 1113172 - protein, 15 aa, Mycobacterium
SRADTGIAGAAARGA

SEQ ID NO: 1113173 - protein, 8 aa, Mycobacterium
SRAGDGDE

SEQ ID NO: 1113174 - protein, 10 aa, Mycobacterium
SRAGSADVDD

SEQ ID NO: 1113175 - protein, 10 aa, Mycobacterium
SRAPQGSRPV

SEQ ID NO: 1113176 - protein, 6 aa, Mycobacterium
SRASRA

SEQ ID NO: 1113177 - protein, 7 aa, Mycobacterium
SRATAAG

SEQ ID NO: 1113178 - protein, 6 aa, Mycobacterium
SRDERV

SEQ ID NO: 1113179 - protein, 4 aa, Mycobacterium
SRDL

SEQ ID NO: 1113180 - protein, 8 aa, Mycobacterium
SRDPADRF

SEQ ID NO: 1113181 - protein, 18 aa, Mycobacterium
SRDRDIADKAARLPRSRR

SEQ ID NO: 1113182 - protein, 6 aa, Mycobacterium
SRDRTA

SEQ ID NO: 1113183 - protein, 7 aa, Mycobacterium
SRDTEPD

SEQ ID NO: 1113184 - protein, 13 aa, Mycobacterium
SRDVEADRQHPTK

SEQ ID NO: 1113185 - protein, 9 aa, Mycobacterium
SREAGEIPA

SEQ ID NO: 1113186 - protein, 13 aa, Mycobacterium
SREGSAGSGRRRF

SEQ ID NO: 1113187 - protein, 25 aa, Mycobacterium
SRFPSREEPLATPPPGSNLKPVTGN

SEQ ID NO: 1113188 - protein, 11 aa, Mycobacterium
SRGAASGGAAP

SEQ ID NO: 1113189 - protein, 7 aa, Mycobacterium
SRGDSPR

SEQ ID NO: 1113190 - protein, 12 aa, Mycobacterium
SRGGESPQAPAN

SEQ ID NO: 1113191 - protein, 8 aa, Mycobacterium
SRGKTTEV

SEQ ID NO: 1113192 - protein, 21 aa, Mycobacterium
SRGPKFAPEPAAAESASEPVA

SEQ ID NO: 1113193 - protein, 6 aa, Mycobacterium
SRGQLT

SEQ ID NO: 1113194 - protein, 13 aa, Mycobacterium
SRGSNAAPGGSGL

SEQ ID NO: 1113195 - protein, 9 aa, Mycobacterium
SRGSNSYSY

SEQ ID NO: 1113196 - protein, 11 aa, Mycobacterium
SRHETSRAGNT

SEQ ID NO: 1113197 - protein, 9 aa, Mycobacterium
SRHGKSPWT

SEQ ID NO: 1113198 - protein, 9 aa, Mycobacterium
SRHHRGDNT

SEQ ID NO: 1113199 - protein, 22 aa, Mycobacterium
SRHPADQSDATTPASRAPIRVA

SEQ ID NO: 1113200 - protein, 5 aa, Mycobacterium
SRIGG

SEQ ID NO: 1113201 - protein, 14 aa, Mycobacterium
SRKYGGAKTLDEID

SEQ ID NO: 1113202 - protein, 11 aa, Mycobacterium
SRLDGATQQPD

SEQ ID NO: 1113203 - protein, 11 aa, Mycobacterium
SRLDNKPDTAT

SEQ ID NO: 1113204 - protein, 5 aa, Mycobacterium
SRLDT

SEQ ID NO: 1113205 - protein, 21 aa, Mycobacterium
SRLEDAAATSAAARAALRSAG

SEQ ID NO: 1113206 - protein, 4 aa, Mycobacterium
SRLG

SEQ ID NO: 1113207 - protein, 23 aa, Mycobacterium
SRLGENAGIGAGTTEDAAGARSD

SEQ ID NO: 1113208 - protein, 4 aa, Mycobacterium
SRLQ

SEQ ID NO: 1113209 - protein, 17 aa, Mycobacterium
SRLSRGDAGADYAKTHG

SEQ ID NO: 1113210 - protein, 5 aa, Mycobacterium
SRNDA

SEQ ID NO: 1113211 - protein, 6 aa, Mycobacterium
SRNGGV

SEQ ID NO: 1113212 - protein, 7 aa, Mycobacterium
SRNLSKD

SEQ ID NO: 1113213 - protein, 8 aa, Mycobacterium
SRNPTVAG

SEQ ID NO: 1113214 - protein, 9 aa, Mycobacterium
SRPADRQGG

SEQ ID NO: 1113215 - protein, 7 aa, Mycobacterium
SRPAGDE

SEQ ID NO: 1113216 - protein, 5 aa, Mycobacterium
SRPAP

SEQ ID NO: 1113217 - protein, 14 aa, Mycobacterium
SRPEGVDSHGNDRV

SEQ ID NO: 1113218 - protein, 9 aa, Mycobacterium
SRPELAGQS

SEQ ID NO: 1113219 - protein, 6 aa, Mycobacterium
SRPGEY

SEQ ID NO: 1113220 - protein, 6 aa, Mycobacterium
SRPGPA

SEQ ID NO: 1113221 - protein, 5 aa, Mycobacterium
SRPGV

SEQ ID NO: 1113222 - protein, 10 aa, Mycobacterium
SRPGVNGSTV

SEQ ID NO: 1113223 - protein, 4 aa, Mycobacterium
SRPH

SEQ ID NO: 1113224 - protein, 9 aa, Mycobacterium
SRPPRRPTD

SEQ ID NO: 1113225 - protein, 8 aa, Mycobacterium
SRPPRSLS

SEQ ID NO: 1113226 - protein, 18 aa, Mycobacterium
SRPQTVPETAHSGDSRTA

SEQ ID NO: 1113227 - protein, 8 aa, Mycobacterium
SRQITDSP

SEQ ID NO: 1113228 - protein, 11 aa, Mycobacterium
SRQTDTTGQVD

SEQ ID NO: 1113229 - protein, 10 aa, Mycobacterium
SRRGAGTAVS

SEQ ID NO: 1113230 - protein, 13 aa, Mycobacterium
SRRGAPDQPLERA

SEQ ID NO: 1113231 - protein, 5 aa, Mycobacterium
SRRLR

SEQ ID NO: 1113232 - protein, 10 aa, Mycobacterium
SRRPRPPSES

SEQ ID NO: 1113233 - protein, 6 aa, Mycobacterium
SRRPVQ

SEQ ID NO: 1113234 - protein, 5 aa, Mycobacterium
SRRQH

SEQ ID NO: 1113235 - protein, 7 aa, Mycobacterium
SRRREQR

SEQ ID NO: 1113236 - protein, 8 aa, Mycobacterium
SRRRRGDN

SEQ ID NO: 1113237 - protein, 13 aa, Mycobacterium
SRRRTGAPALPAR

SEQ ID NO: 1113238 - protein, 6 aa, Mycobacterium
SRRTAA

SEQ ID NO: 1113239 - protein, 7 aa, Mycobacterium
SRRVQRQ

SEQ ID NO: 1113240 - protein, 9 aa, Mycobacterium
SRSDSRRGE

SEQ ID NO: 1113241 - protein, 8 aa, Mycobacterium
SRSETTSA

SEQ ID NO: 1113242 - protein, 9 aa, Mycobacterium
SRSKRPKRA

SEQ ID NO: 1113243 - protein, 4 aa, Mycobacterium
SRSQ

SEQ ID NO: 1113244 - protein, 11 aa, Mycobacterium
SRSRKADNREL

SEQ ID NO: 1113245 - protein, 8 aa, Mycobacterium
SRSRSDDK

SEQ ID NO: 1113246 - protein, 14 aa, Mycobacterium
SRSTAASATTAKEG

SEQ ID NO: 1113247 - protein, 7 aa, Mycobacterium
SRTAHSD

SEQ ID NO: 1113248 - protein, 8 aa, Mycobacterium
SRTATSSS

SEQ ID NO: 1113249 - protein, 8 aa, Mycobacterium
SRTDTVQR

SEQ ID NO: 1113250 - protein, 4 aa, Mycobacterium
SRTG

SEQ ID NO: 1113251 - protein, 8 aa, Mycobacterium
SRTGGAPT

SEQ ID NO: 1113252 - protein, 6 aa, Mycobacterium
SRTGNK

SEQ ID NO: 1113253 - protein, 6 aa, Mycobacterium
SRTGQS

SEQ ID NO: 1113254 - protein, 9 aa, Mycobacterium
SRTGRQRRR

SEQ ID NO: 1113255 - protein, 4 aa, Mycobacterium
SRTP

SEQ ID NO: 1113256 - protein, 6 aa, Mycobacterium
SRTPVK

SEQ ID NO: 1113257 - protein, 13 aa, Mycobacterium
SRTPVKVKTGQSS

SEQ ID NO: 1113258 - protein, 5 aa, Mycobacterium
SRTRA

SEQ ID NO: 1113259 - protein, 13 aa, Mycobacterium
SRTREPLVGQSGG

SEQ ID NO: 1113260 - protein, 7 aa, Mycobacterium
SRVTAAP

SEQ ID NO: 1113261 - protein, 15 aa, Mycobacterium
SRVTNTAGANQEPRT

SEQ ID NO: 1113262 - protein, 23 aa, Mycobacterium
SRYAGDADGTDYTCSGSPSAVAD

SEQ ID NO: 1113263 - protein, 8 aa, Mycobacterium
SSAAPVSA

SEQ ID NO: 1113264 - protein, 6 aa, Mycobacterium
SSAATG

SEQ ID NO: 1113265 - protein, 7 aa, Mycobacterium
SSAAVPV

SEQ ID NO: 1113266 - protein, 9 aa, Mycobacterium
SSAAVTARQ

SEQ ID NO: 1113267 - protein, 10 aa, Mycobacterium
SSAERGSLDP

SEQ ID NO: 1113268 - protein, 4 aa, Mycobacterium
SSAP

SEQ ID NO: 1113269 - protein, 5 aa, Mycobacterium
SSARA

SEQ ID NO: 1113270 - protein, 6 aa, Mycobacterium
SSARSS

SEQ ID NO: 1113271 - protein, 12 aa, Mycobacterium
SSASTPRSPLSL

SEQ ID NO: 1113272 - protein, 9 aa, Mycobacterium
SSATTDSNE

SEQ ID NO: 1113273 - protein, 18 aa, Mycobacterium
SSAYDRVQQNQDNGDADV

SEQ ID NO: 1113274 - protein, 6 aa, Mycobacterium
SSCTTL

SEQ ID NO: 1113275 - protein, 9 aa, Mycobacterium
SSDDGYNTT

SEQ ID NO: 1113276 - protein, 5 aa, Mycobacterium
SSESL

SEQ ID NO: 1113277 - protein, 25 aa, Mycobacterium
SSETNPGGSVQKPRAIEDENPPTSI

SEQ ID NO: 1113278 - protein, 6 aa, Mycobacterium
SSEWSK

SEQ ID NO: 1113279 - protein, 11 aa, Mycobacterium
SSFETSKNNVG

SEQ ID NO: 1113280 - protein, 7 aa, Mycobacterium
SSFTNSI

SEQ ID NO: 1113281 - protein, 8 aa, Mycobacterium
SSGAQLRG

SEQ ID NO: 1113282 - protein, 5 aa, Mycobacterium
SSGDL

SEQ ID NO: 1113283 - protein, 7 aa, Mycobacterium
SSGGDYR

SEQ ID NO: 1113284 - protein, 9 aa, Mycobacterium
SSGGGLGGR

SEQ ID NO: 1113285 - protein, 5 aa, Mycobacterium
SSGGQ

SEQ ID NO: 1113286 - protein, 8 aa, Mycobacterium
SSGHRSTQ

SEQ ID NO: 1113287 - protein, 10 aa, Mycobacterium
SSGITSRPGL

SEQ ID NO: 1113288 - protein, 9 aa, Mycobacterium
SSGPGPGSM

SEQ ID NO: 1113289 - protein, 11 aa, Mycobacterium
SSGTPGGPADR

SEQ ID NO: 1113290 - protein, 10 aa, Mycobacterium
SSGTTGNPKG

SEQ ID NO: 1113291 - protein, 11 aa, Mycobacterium
SSHDETNPLDP

SEQ ID NO: 1113292 - protein, 8 aa, Mycobacterium
SSHLTGGG

SEQ ID NO: 1113293 - protein, 6 aa, Mycobacterium
SSIEGN

SEQ ID NO: 1113294 - protein, 10 aa, Mycobacterium
SSKQSLTDPL

SEQ ID NO: 1113295 - protein, 7 aa, Mycobacterium
SSKTYRE

SEQ ID NO: 1113296 - protein, 9 aa, Mycobacterium
SSLPDSKDK

SEQ ID NO: 1113297 - protein, 11 aa, Mycobacterium
SSLSGDDGAGT

SEQ ID NO: 1113298 - protein, 4 aa, Mycobacterium
SSMR

SEQ ID NO: 1113299 - protein, 6 aa, Mycobacterium
SSPAAV

SEQ ID NO: 1113300 - protein, 12 aa, Mycobacterium
SSPDGKVLLEKN

SEQ ID NO: 1113301 - protein, 7 aa, Mycobacterium
SSPEPGD

SEQ ID NO: 1113302 - protein, 4 aa, Mycobacterium
SSPI

SEQ ID NO: 1113303 - protein, 7 aa, Mycobacterium
SSPNAGG

SEQ ID NO: 1113304 - protein, 7 aa, Mycobacterium
SSPNPHP

SEQ ID NO: 1113305 - protein, 38 aa, Mycobacterium
SSPPPDQWPAPPPPPTGPPQGATQWGPRTTGPTRGGAA

SEQ ID NO: 1113306 - protein, 7 aa, Mycobacterium
SSPPRLA

SEQ ID NO: 1113307 - protein, 15 aa, Mycobacterium
SSPPWEDGDAGARRA

SEQ ID NO: 1113308 - protein, 8 aa, Mycobacterium
SSPQLGDD

SEQ ID NO: 1113309 - protein, 7 aa, Mycobacterium
SSPQPNL

SEQ ID NO: 1113310 - protein, 8 aa, Mycobacterium
SSPQSRAS

SEQ ID NO: 1113311 - protein, 6 aa, Mycobacterium
SSPSQA

SEQ ID NO: 1113312 - protein, 9 aa, Mycobacterium
SSPSTRSLG

SEQ ID NO: 1113313 - protein, 17 aa, Mycobacterium
SSPVTGPTIVTAVLPCG

SEQ ID NO: 1113314 - protein, 7 aa, Mycobacterium
SSQKTGE

SEQ ID NO: 1113315 - protein, 6 aa, Mycobacterium
SSQSGV

SEQ ID NO: 1113316 - protein, 7 aa, Mycobacterium
SSREGHS

SEQ ID NO: 1113317 - protein, 7 aa, Mycobacterium
SSRLTEA

SEQ ID NO: 1113318 - protein, 5 aa, Mycobacterium
SSSDS

SEQ ID NO: 1113319 - protein, 6 aa, Mycobacterium
SSSERL

SEQ ID NO: 1113320 - protein, 24 aa, Mycobacterium
SSSIDQAPVTGESVPVDKNPVPDV

SEQ ID NO: 1113321 - protein, 24 aa, Mycobacterium
SSSIDQAPVTGESVPVDKSPVPDV

SEQ ID NO: 1113322 - protein, 10 aa, Mycobacterium
SSSRAPATAR

SEQ ID NO: 1113323 - protein, 10 aa, Mycobacterium
SSSTDDPATS

SEQ ID NO: 1113324 - protein, 25 aa, Mycobacterium
SSTAFTPARPAPGDIEGQRKAGDIA

SEQ ID NO: 1113325 - protein, 12 aa, Mycobacterium
SSTAVSAGPSRR

SEQ ID NO: 1113326 - protein, 5 aa, Mycobacterium
SSTDA

SEQ ID NO: 1113327 - protein, 23 aa, Mycobacterium
SSTGDDEAAPQAGGFTPGTVNPA

SEQ ID NO: 1113328 - protein, 4 aa, Mycobacterium
SSTL

SEQ ID NO: 1113329 - protein, 5 aa, Mycobacterium
SSTLT

SEQ ID NO: 1113330 - protein, 5 aa, Mycobacterium
SSTQA

SEQ ID NO: 1113331 - protein, 7 aa, Mycobacterium
SSTRAGA

SEQ ID NO: 1113332 - protein, 8 aa, Mycobacterium
SSTRDSFP

SEQ ID NO: 1113333 - protein, 6 aa, Mycobacterium
SSTRSA

SEQ ID NO: 1113334 - protein, 19 aa, Mycobacterium
SSVAEASATFTPQNPTASI

SEQ ID NO: 1113335 - protein, 7 aa, Mycobacterium
SSVATEI

SEQ ID NO: 1113336 - protein, 8 aa, Mycobacterium
SSVDDPEV

SEQ ID NO: 1113337 - protein, 6 aa, Mycobacterium
SSVDDV

SEQ ID NO: 1113338 - protein, 11 aa, Mycobacterium
SSVEPRKPSVA

SEQ ID NO: 1113339 - protein, 10 aa, Mycobacterium
SSVSAPGGTF

SEQ ID NO: 1113340 - protein, 8 aa, Mycobacterium
SSVSGDRE

SEQ ID NO: 1113341 - protein, 10 aa, Mycobacterium
SSVTDVEPSV

SEQ ID NO: 1113342 - protein, 7 aa, Mycobacterium
SSWNGPA

SEQ ID NO: 1113343 - protein, 24 aa, Mycobacterium
STAAEIAEEEATEDAERQGGSEPL

SEQ ID NO: 1113344 - protein, 9 aa, Mycobacterium
STAAEPRPL

SEQ ID NO: 1113345 - protein, 15 aa, Mycobacterium
STAAPTASATPAWGE

SEQ ID NO: 1113346 - protein, 5 aa, Mycobacterium
STAAQ

SEQ ID NO: 1113347 - protein, 13 aa, Mycobacterium
STADANARTEGAA

SEQ ID NO: 1113348 - protein, 10 aa, Mycobacterium
STAGPPKNLA

SEQ ID NO: 1113349 - protein, 6 aa, Mycobacterium
STARDT

SEQ ID NO: 1113350 - protein, 5 aa, Mycobacterium
STARV

SEQ ID NO: 1113351 - protein, 9 aa, Mycobacterium
STARVTGTA

SEQ ID NO: 1113352 - protein, 6 aa, Mycobacterium
STATDA

SEQ ID NO: 1113353 - protein, 8 aa, Mycobacterium
STATGQDP

SEQ ID NO: 1113354 - protein, 5 aa, Mycobacterium
STATI

SEQ ID NO: 1113355 - protein, 12 aa, Mycobacterium
STAVESMSDDSA

SEQ ID NO: 1113356 - protein, 4 aa, Mycobacterium
STDA

SEQ ID NO: 1113357 - protein, 10 aa, Mycobacterium
STDDRAPKGF

SEQ ID NO: 1113358 - protein, 6 aa, Mycobacterium
STDPVG

SEQ ID NO: 1113359 - protein, 8 aa, Mycobacterium
STDRAAEV

SEQ ID NO: 1113360 - protein, 7 aa, Mycobacterium
STDSPRN

SEQ ID NO: 1113361 - protein, 14 aa, Mycobacterium
STDTAALTGVGGTG

SEQ ID NO: 1113362 - protein, 9 aa, Mycobacterium
STDTWQDGI

SEQ ID NO: 1113363 - protein, 6 aa, Mycobacterium
STEEPL

SEQ ID NO: 1113364 - protein, 4 aa, Mycobacterium
STEG

SEQ ID NO: 1113365 - protein, 28 aa, Mycobacterium
STFKSQKGDLRKEGYGGSSGEGGDDDVK

SEQ ID NO: 1113366 - protein, 5 aa, Mycobacterium
STGAG

SEQ ID NO: 1113367 - protein, 4 aa, Mycobacterium
STGF

SEQ ID NO: 1113368 - protein, 8 aa, Mycobacterium
STGKDADF

SEQ ID NO: 1113369 - protein, 19 aa, Mycobacterium
STGLASPPVGLGAGGLGSI

SEQ ID NO: 1113370 - protein, 11 aa, Mycobacterium
STGPEQREVPD

SEQ ID NO: 1113371 - protein, 11 aa, Mycobacterium
STGQEARGDDA

SEQ ID NO: 1113372 - protein, 11 aa, Mycobacterium
STGQEATGDTS

SEQ ID NO: 1113373 - protein, 9 aa, Mycobacterium
STGSTIATG

SEQ ID NO: 1113374 - protein, 6 aa, Mycobacterium
STGSVI

SEQ ID NO: 1113375 - protein, 21 aa, Mycobacterium
STGVPSPPVGLGGGGQGSIST

SEQ ID NO: 1113376 - protein, 9 aa, Mycobacterium
STIAPIPDA

SEQ ID NO: 1113377 - protein, 7 aa, Mycobacterium
STIAPQA

SEQ ID NO: 1113378 - protein, 4 aa, Mycobacterium
STLG

SEQ ID NO: 1113379 - protein, 4 aa, Mycobacterium
STLT

SEQ ID NO: 1113380 - protein, 8 aa, Mycobacterium
STLTGTSM

SEQ ID NO: 1113381 - protein, 4 aa, Mycobacterium
STPA

SEQ ID NO: 1113382 - protein, 5 aa, Mycobacterium
STPDL

SEQ ID NO: 1113383 - protein, 6 aa, Mycobacterium
STPDYG

SEQ ID NO: 1113384 - protein, 6 aa, Mycobacterium
STPEPM

SEQ ID NO: 1113385 - protein, 5 aa, Mycobacterium
STPGV

SEQ ID NO: 1113386 - protein, 21 aa, Mycobacterium
STPPPTGTASAAPPPQPTGPV

SEQ ID NO: 1113387 - protein, 10 aa, Mycobacterium
STPQTSGRVS

SEQ ID NO: 1113388 - protein, 37 aa, Mycobacterium
STPVQAPPRAPERIDTTGLPAVGDDATIPRDAPKRPI

SEQ ID NO: 1113389 - protein, 4 aa, Mycobacterium
STPY

SEQ ID NO: 1113390 - protein, 8 aa, Mycobacterium
STQAPPGV

SEQ ID NO: 1113391 - protein, 18 aa, Mycobacterium
STQPEPSPLPPSVEISPK

SEQ ID NO: 1113392 - protein, 9 aa, Mycobacterium
STQRDTEKA

SEQ ID NO: 1113393 - protein, 5 aa, Mycobacterium
STRAG

SEQ ID NO: 1113394 - protein, 19 aa, Mycobacterium
STRAGSDPLAVTEDGTTAR

SEQ ID NO: 1113395 - protein, 12 aa, Mycobacterium
STRAKDSDRNET

SEQ ID NO: 1113396 - protein, 7 aa, Mycobacterium
STRAQWD

SEQ ID NO: 1113397 - protein, 7 aa, Mycobacterium
STRDGAE

SEQ ID NO: 1113398 - protein, 9 aa, Mycobacterium
STREEITSR

SEQ ID NO: 1113399 - protein, 22 aa, Mycobacterium
STRKPTERGPSEDHDAKTDPHP

SEQ ID NO: 1113400 - protein, 18 aa, Mycobacterium
STRNASIPKQTDDPCFAG

SEQ ID NO: 1113401 - protein, 4 aa, Mycobacterium
STSA

SEQ ID NO: 1113402 - protein, 7 aa, Mycobacterium
STSADNA

SEQ ID NO: 1113403 - protein, 8 aa, Mycobacterium
STSAMDEG

SEQ ID NO: 1113404 - protein, 10 aa, Mycobacterium
STSKMSGERR

SEQ ID NO: 1113405 - protein, 51 aa, Mycobacterium
STSNEQPTANESAAPAAEAVPPPLPGENPEVKSPIQPPAQQAPPPTPTPTA

SEQ ID NO: 1113406 - protein, 8 aa, Mycobacterium
STSPTIGQ

SEQ ID NO: 1113407 - protein, 11 aa, Mycobacterium
STSSMSRRASP

SEQ ID NO: 1113408 - protein, 14 aa, Mycobacterium
STTASFSPESERQL

SEQ ID NO: 1113409 - protein, 7 aa, Mycobacterium
STTSRLN

SEQ ID NO: 1113410 - protein, 17 aa, Mycobacterium
STTSTSSGGGRGPGRGI

SEQ ID NO: 1113411 - protein, 4 aa, Mycobacterium
STTV

SEQ ID NO: 1113412 - protein, 7 aa, Mycobacterium
STTVGRQ

SEQ ID NO: 1113413 - protein, 5 aa, Mycobacterium
STTYA

SEQ ID NO: 1113414 - protein, 6 aa, Mycobacterium
STTYAG

SEQ ID NO: 1113415 - protein, 8 aa, Mycobacterium
STVAGTGQ

SEQ ID NO: 1113416 - protein, 4 aa, Mycobacterium
STVG

SEQ ID NO: 1113417 - protein, 24 aa, Mycobacterium
STVPDLTAGKVDEVRRNQVEPALR

SEQ ID NO: 1113418 - protein, 15 aa, Mycobacterium
STVTNADGVAEPPRS

SEQ ID NO: 1113419 - protein, 11 aa, Mycobacterium
SVAESADTAAL

SEQ ID NO: 1113420 - protein, 13 aa, Mycobacterium
SVAGEGTAVTLHF

SEQ ID NO: 1113421 - protein, 12 aa, Mycobacterium
SVAGNSGAFPDL

SEQ ID NO: 1113422 - protein, 5 aa, Mycobacterium
SVAQG

SEQ ID NO: 1113423 - protein, 16 aa, Mycobacterium
SVARQSPEAAANPQTA

SEQ ID NO: 1113424 - protein, 7 aa, Mycobacterium
SVDGANP

SEQ ID NO: 1113425 - protein, 10 aa, Mycobacterium
SVDPGQLEAS

SEQ ID NO: 1113426 - protein, 6 aa, Mycobacterium
SVEEVT

SEQ ID NO: 1113427 - protein, 5 aa, Mycobacterium
SVEPG

SEQ ID NO: 1113428 - protein, 6 aa, Mycobacterium
SVETAR

SEQ ID NO: 1113429 - protein, 6 aa, Mycobacterium
SVETLG

SEQ ID NO: 1113430 - protein, 6 aa, Mycobacterium
SVETTR

SEQ ID NO: 1113431 - protein, 8 aa, Mycobacterium
SVEVTDTG

SEQ ID NO: 1113432 - protein, 7 aa, Mycobacterium
SVGGAEA

SEQ ID NO: 1113433 - protein, 12 aa, Mycobacterium
SVGGGPAAVGNA

SEQ ID NO: 1113434 - protein, 9 aa, Mycobacterium
SVGGGPAGV

SEQ ID NO: 1113435 - protein, 16 aa, Mycobacterium
SVGGGVSRDYGADDEP

SEQ ID NO: 1113436 - protein, 9 aa, Mycobacterium
SVGGPEGDL

SEQ ID NO: 1113437 - protein, 7 aa, Mycobacterium
SVGHPEA

SEQ ID NO: 1113438 - protein, 10 aa, Mycobacterium
SVPEDDKGLM

SEQ ID NO: 1113439 - protein, 7 aa, Mycobacterium
SVPGPQA

SEQ ID NO: 1113440 - protein, 7 aa, Mycobacterium
SVPGSEH

SEQ ID NO: 1113441 - protein, 6 aa, Mycobacterium
SVPLPD

SEQ ID NO: 1113442 - protein, 8 aa, Mycobacterium
SVPPGHGH

SEQ ID NO: 1113443 - protein, 11 aa, Mycobacterium
SVPPPSPHDAF

SEQ ID NO: 1113444 - protein, 9 aa, Mycobacterium
SVPSTPGVT

SEQ ID NO: 1113445 - protein, 6 aa, Mycobacterium
SVQTEP

SEQ ID NO: 1113446 - protein, 5 aa, Mycobacterium
SVRQP

SEQ ID NO: 1113447 - protein, 5 aa, Mycobacterium
SVSAG

SEQ ID NO: 1113448 - protein, 32 aa, Mycobacterium
SVSDEPARQPDQEQHPQTDTTDTTDTLFDGCE

SEQ ID NO: 1113449 - protein, 23 aa, Mycobacterium
SVSGARLEAATGAETVSDSRSLV

SEQ ID NO: 1113450 - protein, 11 aa, Mycobacterium
SVSPPTTPTEA

SEQ ID NO: 1113451 - protein, 12 aa, Mycobacterium
SVSSSAADSTAL

SEQ ID NO: 1113452 - protein, 8 aa, Mycobacterium
SVTAGTER

SEQ ID NO: 1113453 - protein, 9 aa, Mycobacterium
SVTDTRERE

SEQ ID NO: 1113454 - protein, 9 aa, Mycobacterium
SWAAGSRQV

SEQ ID NO: 1113455 - protein, 11 aa, Mycobacterium
SWGPQSEKKTF

SEQ ID NO: 1113456 - protein, 8 aa, Mycobacterium
SWNSAENP

SEQ ID NO: 1113457 - protein, 9 aa, Mycobacterium
SWVTPGPLA

SEQ ID NO: 1113458 - protein, 10 aa, Mycobacterium
SWVTPGPLAG

SEQ ID NO: 1113459 - protein, 6 aa, Mycobacterium
SYASNR

SEQ ID NO: 1113460 - protein, 6 aa, Mycobacterium
SYDDYA

SEQ ID NO: 1113461 - protein, 10 aa, Mycobacterium
SYDGDETGRR

SEQ ID NO: 1113462 - protein, 6 aa, Mycobacterium
SYDPNA

SEQ ID NO: 1113463 - protein, 10 aa, Mycobacterium
SYGEADERSA

SEQ ID NO: 1113464 - protein, 11 aa, Mycobacterium
SYPQPPGTYDD

SEQ ID NO: 1113465 - protein, 4 aa, Mycobacterium
SYRT

SEQ ID NO: 1113466 - protein, 6 aa, Mycobacterium
SYTEGT

SEQ ID NO: 1113467 - protein, 7 aa, Mycobacterium
SYTPEAN

SEQ ID NO: 1113468 - protein, 5 aa, Mycobacterium
SYTSL

SEQ ID NO: 1113469 - protein, 6 aa, Mycobacterium
TAAAST

SEQ ID NO: 1113470 - protein, 6 aa, Mycobacterium
TAAASV

SEQ ID NO: 1113471 - protein, 11 aa, Mycobacterium
TAADGDVGHAD

SEQ ID NO: 1113472 - protein, 39 aa, Mycobacterium
TAADNRKSAEQVAAAQADYDKTMADARGEASSIRDEARV

SEQ ID NO: 1113473 - protein, 5 aa, Mycobacterium
TAADP

SEQ ID NO: 1113474 - protein, 17 aa, Mycobacterium
TAAERGRGGDKVKTAVT

SEQ ID NO: 1113475 - protein, 6 aa, Mycobacterium
TAAGAP

SEQ ID NO: 1113476 - protein, 12 aa, Mycobacterium
TAAGAQSIDGKA

SEQ ID NO: 1113477 - protein, 8 aa, Mycobacterium
TAAGTGAY

SEQ ID NO: 1113478 - protein, 14 aa, Mycobacterium
TAALTGAQQDQADS

SEQ ID NO: 1113479 - protein, 9 aa, Mycobacterium
TAANITGPA

SEQ ID NO: 1113480 - protein, 4 aa, Mycobacterium
TAAP

SEQ ID NO: 1113481 - protein, 16 aa, Mycobacterium
TAAPNAFATGRNPRNA

SEQ ID NO: 1113482 - protein, 8 aa, Mycobacterium
TAAPTATT

SEQ ID NO: 1113483 - protein, 6 aa, Mycobacterium
TAAPTT

SEQ ID NO: 1113484 - protein, 10 aa, Mycobacterium
TAAQESDARI

SEQ ID NO: 1113485 - protein, 12 aa, Mycobacterium
TAASANVNAGAA

SEQ ID NO: 1113486 - protein, 7 aa, Mycobacterium
TAATQAE

SEQ ID NO: 1113487 - protein, 21 aa, Mycobacterium
TAATTDRRESSAVQRDRPNRL

SEQ ID NO: 1113488 - protein, 13 aa, Mycobacterium
TAATYKDMRDGAN

SEQ ID NO: 1113489 - protein, 4 aa, Mycobacterium
TAAV

SEQ ID NO: 1113490 - protein, 11 aa, Mycobacterium
TAAVAESGGEP

SEQ ID NO: 1113491 - protein, 8 aa, Mycobacterium
TADADGVG

SEQ ID NO: 1113492 - protein, 9 aa, Mycobacterium
TADAEPHTE

SEQ ID NO: 1113493 - protein, 11 aa, Mycobacterium
TADAEPVATER

SEQ ID NO: 1113494 - protein, 6 aa, Mycobacterium
TADDAA

SEQ ID NO: 1113495 - protein, 11 aa, Mycobacterium
TADDPQFQPGF

SEQ ID NO: 1113496 - protein, 8 aa, Mycobacterium
TADGEELR

SEQ ID NO: 1113497 - protein, 16 aa, Mycobacterium
TADGSRAQVSATAAGQ

SEQ ID NO: 1113498 - protein, 27 aa, Mycobacterium
TADPATEANDAITAAYDGSGGPTGPLG

SEQ ID NO: 1113499 - protein, 4 aa, Mycobacterium
TADR

SEQ ID NO: 1113500 - protein, 27 aa, Mycobacterium
TADRSTGTTVAPKDTAPEPESAPTTTI

SEQ ID NO: 1113501 - protein, 9 aa, Mycobacterium
TADRTPRGR

SEQ ID NO: 1113502 - protein, 8 aa, Mycobacterium
TADTDEGR

SEQ ID NO: 1113503 - protein, 13 aa, Mycobacterium
TAEETRNPQRDVP

SEQ ID NO: 1113504 - protein, 9 aa, Mycobacterium
TAEGESLTG

SEQ ID NO: 1113505 - protein, 5 aa, Mycobacterium
TAEHA

SEQ ID NO: 1113506 - protein, 9 aa, Mycobacterium
TAEPEPTAQ

SEQ ID NO: 1113507 - protein, 5 aa, Mycobacterium
TAEPV

SEQ ID NO: 1113508 - protein, 32 aa, Mycobacterium
TAETDETAETDDSAPADGGAAPSRRRRIPRPG

SEQ ID NO: 1113509 - protein, 11 aa, Mycobacterium
TAEVAGDPQQV

SEQ ID NO: 1113510 - protein, 4 aa, Mycobacterium
TAGA

SEQ ID NO: 1113511 - protein, 14 aa, Mycobacterium
TAGAPFGPHAGEAE

SEQ ID NO: 1113512 - protein, 9 aa, Mycobacterium
TAGAQAISP

SEQ ID NO: 1113513 - protein, 6 aa, Mycobacterium
TAGASG

SEQ ID NO: 1113514 - protein, 17 aa, Mycobacterium
TAGGGAGVAHDSAAPGV

SEQ ID NO: 1113515 - protein, 6 aa, Mycobacterium
TAGGTR

SEQ ID NO: 1113516 - protein, 11 aa, Mycobacterium
TAGNAHDGPVA

SEQ ID NO: 1113517 - protein, 7 aa, Mycobacterium
TAGNDED

SEQ ID NO: 1113518 - protein, 8 aa, Mycobacterium
TAGNPADA

SEQ ID NO: 1113519 - protein, 11 aa, Mycobacterium
TAGNQVRDAKG

SEQ ID NO: 1113520 - protein, 10 aa, Mycobacterium
TAGQGEMPTP

SEQ ID NO: 1113521 - protein, 5 aa, Mycobacterium
TAGRY

SEQ ID NO: 1113522 - protein, 25 aa, Mycobacterium
TAGSAPATTAGAPQPARNGASTNRY

SEQ ID NO: 1113523 - protein, 20 aa, Mycobacterium
TAHGGPRSPSNVVGAGSVDP

SEQ ID NO: 1113524 - protein, 12 aa, Mycobacterium
TAHNPARGVDNQ

SEQ ID NO: 1113525 - protein, 10 aa, Mycobacterium
TAHPPPSGWD

SEQ ID NO: 1113526 - protein, 4 aa, Mycobacterium
TAHT

SEQ ID NO: 1113527 - protein, 7 aa, Mycobacterium
TAIGGPP

SEQ ID NO: 1113528 - protein, 7 aa, Mycobacterium
TAIGPSQ

SEQ ID NO: 1113529 - protein, 9 aa, Mycobacterium
TAKDSRAEN

SEQ ID NO: 1113530 - protein, 28 aa, Mycobacterium
TAKEIGSMTDTPESTSERIAGAGERRGV

SEQ ID NO: 1113531 - protein, 7 aa, Mycobacterium
TALSDEP

SEQ ID NO: 1113532 - protein, 9 aa, Mycobacterium
TALSSTGRV

SEQ ID NO: 1113533 - protein, 9 aa, Mycobacterium
TAPAEGRDA

SEQ ID NO: 1113534 - protein, 7 aa, Mycobacterium
TAPATRR

SEQ ID NO: 1113535 - protein, 11 aa, Mycobacterium
TAPDARPEATY

SEQ ID NO: 1113536 - protein, 19 aa, Mycobacterium
TAPDDLTSAAEHAQSQGHT

SEQ ID NO: 1113537 - protein, 4 aa, Mycobacterium
TAPE

SEQ ID NO: 1113538 - protein, 10 aa, Mycobacterium
TAPEDAGPRT

SEQ ID NO: 1113539 - protein, 16 aa, Mycobacterium
TAPEDRQRAANVDGTG

SEQ ID NO: 1113540 - protein, 14 aa, Mycobacterium
TAPETRTRHDSGRP

SEQ ID NO: 1113541 - protein, 8 aa, Mycobacterium
TAPGIRPD

SEQ ID NO: 1113542 - protein, 6 aa, Mycobacterium
TAPGRA

SEQ ID NO: 1113543 - protein, 7 aa, Mycobacterium
TAPGTKV

SEQ ID NO: 1113544 - protein, 6 aa, Mycobacterium
TAPIDR

SEQ ID NO: 1113545 - protein, 12 aa, Mycobacterium
TAPKPSRAARDA

SEQ ID NO: 1113546 - protein, 12 aa, Mycobacterium
TAPKPSRAGREA

SEQ ID NO: 1113547 - protein, 4 aa, Mycobacterium
TAPL

SEQ ID NO: 1113548 - protein, 8 aa, Mycobacterium
TAPLNSPS

SEQ ID NO: 1113549 - protein, 6 aa, Mycobacterium
TAPLPV

SEQ ID NO: 1113550 - protein, 6 aa, Mycobacterium
TAPLSA

SEQ ID NO: 1113551 - protein, 12 aa, Mycobacterium
TAPRPPQPPEPA

SEQ ID NO: 1113552 - protein, 10 aa, Mycobacterium
TAPTASASTN

SEQ ID NO: 1113553 - protein, 16 aa, Mycobacterium
TAPTPTSTTSAASEPV

SEQ ID NO: 1113554 - protein, 15 aa, Mycobacterium
TAPTSPVDVPGRPHG

SEQ ID NO: 1113555 - protein, 6 aa, Mycobacterium
TAPTTA

SEQ ID NO: 1113556 - protein, 6 aa, Mycobacterium
TAQAQR

SEQ ID NO: 1113557 - protein, 6 aa, Mycobacterium
TAQPLG

SEQ ID NO: 1113558 - protein, 7 aa, Mycobacterium
TAQPPSI

SEQ ID NO: 1113559 - protein, 8 aa, Mycobacterium
TAQRPGVR

SEQ ID NO: 1113560 - protein, 4 aa, Mycobacterium
TARA

SEQ ID NO: 1113561 - protein, 5 aa, Mycobacterium
TARDY

SEQ ID NO: 1113562 - protein, 4 aa, Mycobacterium
TARG

SEQ ID NO: 1113563 - protein, 7 aa, Mycobacterium
TARGDRD

SEQ ID NO: 1113564 - protein, 9 aa, Mycobacterium
TARHPGGGV

SEQ ID NO: 1113565 - protein, 9 aa, Mycobacterium
TARPGTTTA

SEQ ID NO: 1113566 - protein, 8 aa, Mycobacterium
TARPSGTF

SEQ ID NO: 1113567 - protein, 8 aa, Mycobacterium
TARSSPDA

SEQ ID NO: 1113568 - protein, 8 aa, Mycobacterium
TARSSPEA

SEQ ID NO: 1113569 - protein, 4 aa, Mycobacterium
TART

SEQ ID NO: 1113570 - protein, 14 aa, Mycobacterium
TARTETGDVVVEEQ

SEQ ID NO: 1113571 - protein, 8 aa, Mycobacterium
TASGAAAQ

SEQ ID NO: 1113572 - protein, 13 aa, Mycobacterium
TASGATAPRPGTV

SEQ ID NO: 1113573 - protein, 13 aa, Mycobacterium
TASHERPEPAVTA

SEQ ID NO: 1113574 - protein, 4 aa, Mycobacterium
TASL

SEQ ID NO: 1113575 - protein, 12 aa, Mycobacterium
TASLDSESEAAV

SEQ ID NO: 1113576 - protein, 4 aa, Mycobacterium
TASP

SEQ ID NO: 1113577 - protein, 14 aa, Mycobacterium
TASTSSPAPDGVSV

SEQ ID NO: 1113578 - protein, 7 aa, Mycobacterium
TATAEQL

SEQ ID NO: 1113579 - protein, 7 aa, Mycobacterium
TATARRV

SEQ ID NO: 1113580 - protein, 5 aa, Mycobacterium
TATAS

SEQ ID NO: 1113581 - protein, 111 aa, Mycobacterium
TATASADTDTGTAANADATGGGADDRARPDTAAAAGGGTDRDPDVEPADGGAVAESDDAGDITGRDTDPEPLPDPADGEPQPSEDAPVADKEPEEPRPPCCKDGDKDCEPG

SEQ ID NO: 1113582 - protein, 11 aa, Mycobacterium
TATDDGSPGVQ

SEQ ID NO: 1113583 - protein, 11 aa, Mycobacterium
TATDGDESDSA

SEQ ID NO: 1113584 - protein, 5 aa, Mycobacterium
TATEN

SEQ ID NO: 1113585 - protein, 6 aa, Mycobacterium
TATEVT

SEQ ID NO: 1113586 - protein, 5 aa, Mycobacterium
TATGE

SEQ ID NO: 1113587 - protein, 6 aa, Mycobacterium
TATGEP

SEQ ID NO: 1113588 - protein, 10 aa, Mycobacterium
TATGGAANRG

SEQ ID NO: 1113589 - protein, 13 aa, Mycobacterium
TATGSADPVSAGV

SEQ ID NO: 1113590 - protein, 6 aa, Mycobacterium
TATNSH

SEQ ID NO: 1113591 - protein, 7 aa, Mycobacterium
TATPEVS

SEQ ID NO: 1113592 - protein, 5 aa, Mycobacterium
TATPG

SEQ ID NO: 1113593 - protein, 4 aa, Mycobacterium
TATR

SEQ ID NO: 1113594 - protein, 9 aa, Mycobacterium
TATRQAYGL

SEQ ID NO: 1113595 - protein, 7 aa, Mycobacterium
TATSMSG

SEQ ID NO: 1113596 - protein, 8 aa, Mycobacterium
TATTPGHG

SEQ ID NO: 1113597 - protein, 4 aa, Mycobacterium
TAVA

SEQ ID NO: 1113598 - protein, 6 aa, Mycobacterium
TAVGRG

SEQ ID NO: 1113599 - protein, 9 aa, Mycobacterium
TCPSPIGGA

SEQ ID NO: 1113600 - protein, 5 aa, Mycobacterium
TDADI

SEQ ID NO: 1113601 - protein, 69 aa, Mycobacterium
TDAGQGLEQAADGAQQLATGLDTADDGAQRLATGAGTLSSGLDSARAGSAQLAAGTRQLAGTVDTATGP

SEQ ID NO: 1113602 - protein, 8 aa, Mycobacterium
TDARSGDQ

SEQ ID NO: 1113603 - protein, 6 aa, Mycobacterium
TDASPL

SEQ ID NO: 1113604 - protein, 5 aa, Mycobacterium
TDAVR

SEQ ID NO: 1113605 - protein, 9 aa, Mycobacterium
TDDAEDAEA

SEQ ID NO: 1113606 - protein, 4 aa, Mycobacterium
TDDG

SEQ ID NO: 1113607 - protein, 9 aa, Mycobacterium
TDDGHGIPA

SEQ ID NO: 1113608 - protein, 9 aa, Mycobacterium
TDDGPGIDP

SEQ ID NO: 1113609 - protein, 16 aa, Mycobacterium
TDDGTGGASADGGSGL

SEQ ID NO: 1113610 - protein, 21 aa, Mycobacterium
TDDPEIDAEAAPAQDDSPFAQ

SEQ ID NO: 1113611 - protein, 8 aa, Mycobacterium
TDDPTQAW

SEQ ID NO: 1113612 - protein, 21 aa, Mycobacterium
TDDRTAKRLDRAADRDDDADL

SEQ ID NO: 1113613 - protein, 4 aa, Mycobacterium
TDEA

SEQ ID NO: 1113614 - protein, 8 aa, Mycobacterium
TDEKAVAE

SEQ ID NO: 1113615 - protein, 5 aa, Mycobacterium
TDESG

SEQ ID NO: 1113616 - protein, 12 aa, Mycobacterium
TDETNGYGATNV

SEQ ID NO: 1113617 - protein, 12 aa, Mycobacterium
TDGADPNDPGQY

SEQ ID NO: 1113618 - protein, 5 aa, Mycobacterium
TDGAI

SEQ ID NO: 1113619 - protein, 5 aa, Mycobacterium
TDGAN

SEQ ID NO: 1113620 - protein, 9 aa, Mycobacterium
TDGDGPAVD

SEQ ID NO: 1113621 - protein, 19 aa, Mycobacterium
TDGGETASTHDTHSPGDMG

SEQ ID NO: 1113622 - protein, 5 aa, Mycobacterium
TDGSM

SEQ ID NO: 1113623 - protein, 8 aa, Mycobacterium
TDGSVPVD

SEQ ID NO: 1113624 - protein, 7 aa, Mycobacterium
TDGTPTT

SEQ ID NO: 1113625 - protein, 4 aa, Mycobacterium
TDHA

SEQ ID NO: 1113626 - protein, 5 aa, Mycobacterium
TDIDP

SEQ ID NO: 1113627 - protein, 6 aa, Mycobacterium
TDIPAT

SEQ ID NO: 1113628 - protein, 5 aa, Mycobacterium
TDIPE

SEQ ID NO: 1113629 - protein, 5 aa, Mycobacterium
TDNGD

SEQ ID NO: 1113630 - protein, 16 aa, Mycobacterium
TDPAALPAEDAPGAEV

SEQ ID NO: 1113631 - protein, 17 aa, Mycobacterium
TDPADGTTLTEAPPRVS

SEQ ID NO: 1113632 - protein, 18 aa, Mycobacterium
TDPADGTTLTEAPPRVSA

SEQ ID NO: 1113633 - protein, 7 aa, Mycobacterium
TDPEGRS

SEQ ID NO: 1113634 - protein, 10 aa, Mycobacterium
TDPGMSPNLT

SEQ ID NO: 1113635 - protein, 8 aa, Mycobacterium
TDPGPTTV

SEQ ID NO: 1113636 - protein, 5 aa, Mycobacterium
TDPLG

SEQ ID NO: 1113637 - protein, 5 aa, Mycobacterium
TDPPG

SEQ ID NO: 1113638 - protein, 8 aa, Mycobacterium
TDPPVTPD

SEQ ID NO: 1113639 - protein, 4 aa, Mycobacterium
TDPQ

SEQ ID NO: 1113640 - protein, 4 aa, Mycobacterium
TDPR

SEQ ID NO: 1113641 - protein, 10 aa, Mycobacterium
TDPSAPEPAS

SEQ ID NO: 1113642 - protein, 6 aa, Mycobacterium
TDQVSG

SEQ ID NO: 1113643 - protein, 7 aa, Mycobacterium
TDRAPSL

SEQ ID NO: 1113644 - protein, 5 aa, Mycobacterium
TDRDR

SEQ ID NO: 1113645 - protein, 8 aa, Mycobacterium
TDREAGQR

SEQ ID NO: 1113646 - protein, 16 aa, Mycobacterium
TDREPDRDQYPDPERP

SEQ ID NO: 1113647 - protein, 5 aa, Mycobacterium
TDRIE

SEQ ID NO: 1113648 - protein, 4 aa, Mycobacterium
TDRQ

SEQ ID NO: 1113649 - protein, 4 aa, Mycobacterium
TDRY

SEQ ID NO: 1113650 - protein, 8 aa, Mycobacterium
TDSAGGRI

SEQ ID NO: 1113651 - protein, 11 aa, Mycobacterium
TDSGLGATAVR

SEQ ID NO: 1113652 - protein, 6 aa, Mycobacterium
TDSIRT

SEQ ID NO: 1113653 - protein, 6 aa, Mycobacterium
TDSRWA

SEQ ID NO: 1113654 - protein, 5 aa, Mycobacterium
TDSTL

SEQ ID NO: 1113655 - protein, 8 aa, Mycobacterium
TDTDREVA

SEQ ID NO: 1113656 - protein, 8 aa, Mycobacterium
TDTITQAS

SEQ ID NO: 1113657 - protein, 22 aa, Mycobacterium
TDTPPPAYPAAPTEERRRPGRV

SEQ ID NO: 1113658 - protein, 31 aa, Mycobacterium; identical to SEQ ID NO: 289314

SEQ ID NO: 1113659 - protein, 14 aa, Mycobacterium
TDTSRARASGGTGL

SEQ ID NO: 1113660 - protein, 7 aa, Mycobacterium
TDVDTPD

SEQ ID NO: 1113661 - protein, 21 aa, Mycobacterium
TDVQTDGAAASAAVRAASEGT

SEQ ID NO: 1113662 - protein, 6 aa, Mycobacterium
TDYMPT

SEQ ID NO: 1113663 - protein, 12 aa, Mycobacterium
TEAAAQSTDGHA

SEQ ID NO: 1113664 - protein, 5 aa, Mycobacterium
TEAGL

SEQ ID NO: 1113665 - protein, 19 aa, Mycobacterium
TEAHGGRITAASRGPGMGS

SEQ ID NO: 1113666 - protein, 19 aa, Mycobacterium
TEAHSGRITAASRGPGLGS

SEQ ID NO: 1113667 - protein, 12 aa, Mycobacterium
TEASVSPDTAGA

SEQ ID NO: 1113668 - protein, 8 aa, Mycobacterium
TEDDTSGW

SEQ ID NO: 1113669 - protein, 5 aa, Mycobacterium
TEDKA

SEQ ID NO: 1113670 - protein, 25 aa, Mycobacterium
TEDRPKAKEPLPALTPQRGRHRPAA

SEQ ID NO: 1113671 - protein, 5 aa, Mycobacterium
TEDSV

SEQ ID NO: 1113672 - protein, 90 aa, Mycobacterium
TEDTTAAADEPATDTEQPAKGTDDAESAADKTGAEETDTVDEDAEVTEDADEDAEVTEDDDEDAEVTEDAGEDAEATDDAAVTPKRDGKW

SEQ ID NO: 1113673 - protein, 26 aa, Mycobacterium
TEEIGTTAARPVAAPAPPPPKDPVPR

SEQ ID NO: 1113674 - protein, 5 aa, Mycobacterium
TEEQA

SEQ ID NO: 1113675 - protein, 11 aa, Mycobacterium
TEERRNARELR

SEQ ID NO: 1113676 - protein, 4 aa, Mycobacterium
TEEV

SEQ ID NO: 1113677 - protein, 12 aa, Mycobacterium
TEEVAAGKSSTV

SEQ ID NO: 1113678 - protein, 12 aa, Mycobacterium
TEGPRHRPAPEL

SEQ ID NO: 1113679 - protein, 5 aa, Mycobacterium
TEGQD

SEQ ID NO: 1113680 - protein, 4 aa, Mycobacterium
TEHH

SEQ ID NO: 1113681 - protein, 12 aa, Mycobacterium
TEIDGAPLGDTM

SEQ ID NO: 1113682 - protein, 11 aa, Mycobacterium
TEITPPRGVDP

SEQ ID NO: 1113683 - protein, 6 aa, Mycobacterium
TEKKTY

SEQ ID NO: 1113684 - protein, 6 aa, Mycobacterium
TEKPLG

SEQ ID NO: 1113685 - protein, 13 aa, Mycobacterium
TENPGPSDPATQA

SEQ ID NO: 1113686 - protein, 10 aa, Mycobacterium
TEPDGEPALD

SEQ ID NO: 1113687 - protein, 9 aa, Mycobacterium
TEPEGPAEN

SEQ ID NO: 1113688 - protein, 5 aa, Mycobacterium
TEPGA

SEQ ID NO: 1113689 - protein, 26 aa, Mycobacterium
TEPITAAARTSVQPLAKSSANGVPTS

SEQ ID NO: 1113690 - protein, 4 aa, Mycobacterium
TEPM

SEQ ID NO: 1113691 - protein, 10 aa, Mycobacterium
TEPTPEPVEK

SEQ ID NO: 1113692 - protein, 5 aa, Mycobacterium
TEPYV

SEQ ID NO: 1113693 - protein, 4 aa, Mycobacterium
TEQD

SEQ ID NO: 1113694 - protein, 7 aa, Mycobacterium
TEQDLAS

SEQ ID NO: 1113695 - protein, 8 aa, Mycobacterium
TEQTPETL

SEQ ID NO: 1113696 - protein, 5 aa, Mycobacterium
TERAV

SEQ ID NO: 1113697 - protein, 5 aa, Mycobacterium
TERQV

SEQ ID NO: 1113698 - protein, 7 aa, Mycobacterium
TERTDAD

SEQ ID NO: 1113699 - protein, 13 aa, Mycobacterium
TERTSDDAEPGTA

SEQ ID NO: 1113700 - protein, 8 aa, Mycobacterium
TESERGIE

SEQ ID NO: 1113701 - protein, 9 aa, Mycobacterium
TESGADTDG

SEQ ID NO: 1113702 - protein, 9 aa, Mycobacterium
TETDPAARR

SEQ ID NO: 1113703 - protein, 6 aa, Mycobacterium
TEVPRR

SEQ ID NO: 1113704 - protein, 7 aa, Mycobacterium
TFARPGH

SEQ ID NO: 1113705 - protein, 5 aa, Mycobacterium
TFGAS

SEQ ID NO: 1113706 - protein, 48 aa, Mycobacterium
TFGGAGKTEKKESTDEKESTASTPAKDDKDSAPAKSESNSGTDSKPAA

SEQ ID NO: 1113707 - protein, 48 aa, Mycobacterium
TFGGAGKTQEKESTDEKESTASTPAKDDKDSAPAKSESNSGTDSKPAA

SEQ ID NO: 1113708 - protein, 12 aa, Mycobacterium
TFPDEGDNDPPK

SEQ ID NO: 1113709 - protein, 9 aa, Mycobacterium
TFPDTRTAY

SEQ ID NO: 1113710 - protein, 20 aa, Mycobacterium
TFSSQDASIPREDTNACFAR

SEQ ID NO: 1113711 - protein, 8 aa, Mycobacterium
TGADSVTD

SEQ ID NO: 1113712 - protein, 11 aa, Mycobacterium
TGAEATPPRSG

SEQ ID NO: 1113713 - protein, 11 aa, Mycobacterium
TGAGFTPTFPS

SEQ ID NO: 1113714 - protein, 16 aa, Mycobacterium
TGAGGAAAMSESGNPL

SEQ ID NO: 1113715 - protein, 8 aa, Mycobacterium
TGAGHGTG

SEQ ID NO: 1113716 - protein, 10 aa, Mycobacterium
TGAGSTDEYR

SEQ ID NO: 1113717 - protein, 10 aa, Mycobacterium
TGAGYRPDGR

SEQ ID NO: 1113718 - protein, 7 aa, Mycobacterium
TGALPGA

SEQ ID NO: 1113719 - protein, 7 aa, Mycobacterium
TGALSDR

SEQ ID NO: 1113720 - protein, 4 aa, Mycobacterium
TGAM

SEQ ID NO: 1113721 - protein, 13 aa, Mycobacterium
TGAMTAPHSDGDV

SEQ ID NO: 1113722 - protein, 9 aa, Mycobacterium
TGANGSGKT

SEQ ID NO: 1113723 - protein, 22 aa, Mycobacterium
TGANPLGQPRQRTLRRTPNRGL

SEQ ID NO: 1113724 - protein, 5 aa, Mycobacterium
TGANT

SEQ ID NO: 1113725 - protein, 6 aa, Mycobacterium
TGAPAE

SEQ ID NO: 1113726 - protein, 6 aa, Mycobacterium
TGAPAQ

SEQ ID NO: 1113727 - protein, 5 aa, Mycobacterium
TGDAV

SEQ ID NO: 1113728 - protein, 10 aa, Mycobacterium
TGDENTAPRI

SEQ ID NO: 1113729 - protein, 6 aa, Mycobacterium
TGDGAL

SEQ ID NO: 1113730 - protein, 6 aa, Mycobacterium
TGDPTN

SEQ ID NO: 1113731 - protein, 9 aa, Mycobacterium
TGDRLPEGA

SEQ ID NO: 1113732 - protein, 5 aa, Mycobacterium
TGDRM

SEQ ID NO: 1113733 - protein, 9 aa, Mycobacterium
TGDRTQPEF

SEQ ID NO: 1113734 - protein, 13 aa, Mycobacterium
TGDRYDPAAAADA

SEQ ID NO: 1113735 - protein, 22 aa, Mycobacterium
TGDTRTESHTVSYDPIPKVVCG

SEQ ID NO: 1113736 - protein, 4 aa, Mycobacterium
TGDV

SEQ ID NO: 1113737 - protein, 5 aa, Mycobacterium
TGEAD

SEQ ID NO: 1113738 - protein, 11 aa, Mycobacterium
TGEAETPTGPL

SEQ ID NO: 1113739 - protein, 9 aa, Mycobacterium
TGEDGTLRD

SEQ ID NO: 1113740 - protein, 7 aa, Mycobacterium
TGEGAYA

SEQ ID NO: 1113741 - protein, 8 aa, Mycobacterium
TGEGPYLR

SEQ ID NO: 1113742 - protein, 6 aa, Mycobacterium
TGEHSH

SEQ ID NO: 1113743 - protein, 11 aa, Mycobacterium
TGEPDTTGSAA

SEQ ID NO: 1113744 - protein, 88 aa, Mycobacterium
TGEPGRARTSAKKSPRAAKRRPVRETKRTPVDAPPRGRQQTRDARPQRSAPRTTPIARPKDVPARPKSTSQAKARAKARKAKAPKVVR

SEQ ID NO: 1113745 - protein, 13 aa, Mycobacterium
TGERYNAAAAADA

SEQ ID NO: 1113746 - protein, 8 aa, Mycobacterium
TGESPDYG

SEQ ID NO: 1113747 - protein, 8 aa, Mycobacterium
TGESTVSE

SEQ ID NO: 1113748 - protein, 12 aa, Mycobacterium
TGETSSDAVGGG

SEQ ID NO: 1113749 - protein, 4 aa, Mycobacterium
TGFG

SEQ ID NO: 1113750 - protein, 10 aa, Mycobacterium
TGFGKTPYRP

SEQ ID NO: 1113751 - protein, 64 aa, Mycobacterium
TGFGPGSVPAKKQVPPPKRTPAVSPLGKAAAKRVGPAAPKGSTRGAPAGAGGAGSPAGPSALSA

SEQ ID NO: 1113752 - protein, 4 aa, Mycobacterium
TGGA

SEQ ID NO: 1113753 - protein, 10 aa, Mycobacterium
TGGAGKSTAL

SEQ ID NO: 1113754 - protein, 5 aa, Mycobacterium
TGGAR

SEQ ID NO: 1113755 - protein, 5 aa, Mycobacterium
TGGAT

SEQ ID NO: 1113756 - protein, 9 aa, Mycobacterium
TGGDGDQVE

SEQ ID NO: 1113757 - protein, 8 aa, Mycobacterium
TGGDQPLT

SEQ ID NO: 1113758 - protein, 11 aa, Mycobacterium
TGGERDPETPI

SEQ ID NO: 1113759 - protein, 15 aa, Mycobacterium
TGGESEAQKHAKTLT

SEQ ID NO: 1113760 - protein, 9 aa, Mycobacterium
TGGLYSTGN

SEQ ID NO: 1113761 - protein, 10 aa, Mycobacterium
TGGNTGTQIT

SEQ ID NO: 1113762 - protein, 8 aa, Mycobacterium
TGGPAGVG

SEQ ID NO: 1113763 - protein, 5 aa, Mycobacterium
TGGPP

SEQ ID NO: 1113764 - protein, 8 aa, Mycobacterium
TGGPSGVG

SEQ ID NO: 1113765 - protein, 10 aa, Mycobacterium
TGGRRGGASL

SEQ ID NO: 1113766 - protein, 5 aa, Mycobacterium
TGGTL

SEQ ID NO: 1113767 - protein, 8 aa, Mycobacterium
TGGTNRFE

SEQ ID NO: 1113768 - protein, 7 aa, Mycobacterium
TGGTRVP

SEQ ID NO: 1113769 - protein, 15 aa, Mycobacterium
TGGTTAPAQPPATAE

SEQ ID NO: 1113770 - protein, 10 aa, Mycobacterium
TGGTTGPSKG

SEQ ID NO: 1113771 - protein, 11 aa, Mycobacterium
TGGVDARRRRE

SEQ ID NO: 1113772 - protein, 11 aa, Mycobacterium
TGHPPVTPHHG

SEQ ID NO: 1113773 - protein, 4 aa, Mycobacterium
TGIC

SEQ ID NO: 1113774 - protein, 16 aa, Mycobacterium
TGKGGALSSGKYAPDL

SEQ ID NO: 1113775 - protein, 8 aa, Mycobacterium
TGKPPTVE

SEQ ID NO: 1113776 - protein, 9 aa, Mycobacterium
TGKQPEAVR

SEQ ID NO: 1113777 - protein, 7 aa, Mycobacterium
TGMDTEV

SEQ ID NO: 1113778 - protein, 6 aa, Mycobacterium
TGMEHG

SEQ ID NO: 1113779 - protein, 9 aa, Mycobacterium
TGNAEQQQE

SEQ ID NO: 1113780 - protein, 5 aa, Mycobacterium
TGNDI

SEQ ID NO: 1113781 - protein, 14 aa, Mycobacterium
TGNLDLTPSSHWPE

SEQ ID NO: 1113782 - protein, 5 aa, Mycobacterium
TGNPD

SEQ ID NO: 1113783 - protein, 9 aa, Mycobacterium
TGNQDLTAR

SEQ ID NO: 1113784 - protein, 5 aa, Mycobacterium
TGNSL

SEQ ID NO: 1113785 - protein, 10 aa, Mycobacterium
TGNVTYRGQE

SEQ ID NO: 1113786 - protein, 9 aa, Mycobacterium
TGPAPPGLS

SEQ ID NO: 1113787 - protein, 5 aa, Mycobacterium
TGPED

SEQ ID NO: 1113788 - protein, 6 aa, Mycobacterium
TGPERA

SEQ ID NO: 1113789 - protein, 10 aa, Mycobacterium
TGPETANEAS

SEQ ID NO: 1113790 - protein, 12 aa, Mycobacterium
TGPEVDPGGNVT

SEQ ID NO: 1113791 - protein, 7 aa, Mycobacterium
TGPGVPE

SEQ ID NO: 1113792 - protein, 13 aa, Mycobacterium
TGPHTDQSLGAAG

SEQ ID NO: 1113793 - protein, 7 aa, Mycobacterium
TGPPATF

SEQ ID NO: 1113794 - protein, 6 aa, Mycobacterium
TGPPVV

SEQ ID NO: 1113795 - protein, 10 aa, Mycobacterium
TGPRPGGFGQ

SEQ ID NO: 1113796 - protein, 7 aa, Mycobacterium
TGPTRGH

SEQ ID NO: 1113797 - protein, 5 aa, Mycobacterium
TGPVD

SEQ ID NO: 1113798 - protein, 7 aa, Mycobacterium
TGQAEAT

SEQ ID NO: 1113799 - protein, 6 aa, Mycobacterium
TGQPWT

SEQ ID NO: 1113800 - protein, 7 aa, Mycobacterium
TGQSGGV

SEQ ID NO: 1113801 - protein, 6 aa, Mycobacterium
TGQSQV

SEQ ID NO: 1113802 - protein, 6 aa, Mycobacterium
TGQSTT

SEQ ID NO: 1113803 - protein, 6 aa, Mycobacterium
TGRGEP

SEQ ID NO: 1113804 - protein, 22 aa, Mycobacterium
TGRLDGDTVSAAGRAGRPAPET

SEQ ID NO: 1113805 - protein, 4 aa, Mycobacterium
TGRM

SEQ ID NO: 1113806 - protein, 6 aa, Mycobacterium
TGRMGS

SEQ ID NO: 1113807 - protein, 7 aa, Mycobacterium
TGRRQHR

SEQ ID NO: 1113808 - protein, 9 aa, Mycobacterium
TGRSRSSGD

SEQ ID NO: 1113809 - protein, 4 aa, Mycobacterium
TGRY

SEQ ID NO: 1113810 - protein, 5 aa, Mycobacterium
TGSAL

SEQ ID NO: 1113811 - protein, 4 aa, Mycobacterium
TGSI

SEQ ID NO: 1113812 - protein, 35 aa, Mycobacterium
TGSPDSATPIPVPPISGGGGPLDPPPSVQTRIEST

SEQ ID NO: 1113813 - protein, 16 aa, Mycobacterium
TGSPQAPRGDAPTAEQ

SEQ ID NO: 1113814 - protein, 9 aa, Mycobacterium
TGSPSAAAH

SEQ ID NO: 1113815 - protein, 30 aa, Mycobacterium
TGSQGDSGTVTETASVPTETPPAELPPPVT

SEQ ID NO: 1113816 - protein, 22 aa, Mycobacterium
TGSRDEAAPSGALTEASAQTAI

SEQ ID NO: 1113817 - protein, 5 aa, Mycobacterium
TGSTG

SEQ ID NO: 1113818 - protein, 5 aa, Mycobacterium
TGSTT

SEQ ID NO: 1113819 - protein, 16 aa, Mycobacterium
TGSTTTVQVTGPPATF

SEQ ID NO: 1113820 - protein, 6 aa, Mycobacterium
TGSVRE

SEQ ID NO: 1113821 - protein, 14 aa, Mycobacterium
TGTAQSAARSPSNL

SEQ ID NO: 1113822 - protein, 6 aa, Mycobacterium
TGTDTL

SEQ ID NO: 1113823 - protein, 13 aa, Mycobacterium
TGTEAEQQTYARQ

SEQ ID NO: 1113824 - protein, 5 aa, Mycobacterium
TGTGG

SEQ ID NO: 1113825 - protein, 9 aa, Mycobacterium
TGTLTEGSP

SEQ ID NO: 1113826 - protein, 13 aa, Mycobacterium
TGTMGYSKNGTRS

SEQ ID NO: 1113827 - protein, 8 aa, Mycobacterium
TGTPQRAS

SEQ ID NO: 1113828 - protein, 8 aa, Mycobacterium
TGTPRRAS

SEQ ID NO: 1113829 - protein, 4 aa, Mycobacterium
TGTV

SEQ ID NO: 1113830 - protein, 8 aa, Mycobacterium
TGTVTTGS

SEQ ID NO: 1113831 - protein, 4 aa, Mycobacterium
TGVA

SEQ ID NO: 1113832 - protein, 5 aa, Mycobacterium
TGVGG

SEQ ID NO: 1113833 - protein, 39 aa, Mycobacterium
TGVNPFTDSTAAGTGTSTTITTSAPTTTAATPTSSFEGQ

SEQ ID NO: 1113834 - protein, 9 aa, Mycobacterium
TGVPRGRTG

SEQ ID NO: 1113835 - protein, 4 aa, Mycobacterium
TGWG

SEQ ID NO: 1113836 - protein, 15 aa, Mycobacterium
TGWGTGGGFRPNPGI

SEQ ID NO: 1113837 - protein, 5 aa, Mycobacterium
TGYDP

SEQ ID NO: 1113838 - protein, 13 aa, Mycobacterium
THAPDAAAMTESQ

SEQ ID NO: 1113839 - protein, 8 aa, Mycobacterium
THARGGDL

SEQ ID NO: 1113840 - protein, 7 aa, Mycobacterium
THDPGAL

SEQ ID NO: 1113841 - protein, 13 aa, Mycobacterium
THGDRTQLYTSRG

SEQ ID NO: 1113842 - protein, 9 aa, Mycobacterium
THGRKKTAE

SEQ ID NO: 1113843 - protein, 6 aa, Mycobacterium
THGTGT

SEQ ID NO: 1113844 - protein, 7 aa, Mycobacterium
THPTTGQ

SEQ ID NO: 1113845 - protein, 24 aa, Mycobacterium
THRRAEAARYTRRTPAESDTRAAA

SEQ ID NO: 1113846 - protein, 13 aa, Mycobacterium
THRSTAAVSRTRA

SEQ ID NO: 1113847 - protein, 14 aa, Mycobacterium
THTPADGVPDPKQA

SEQ ID NO: 1113848 - protein, 8 aa, Mycobacterium
TIDPRAED

SEQ ID NO: 1113849 - protein, 9 aa, Mycobacterium
TIDQTSPHL

SEQ ID NO: 1113850 - protein, 8 aa, Mycobacterium
TIEERDDV

SEQ ID NO: 1113851 - protein, 8 aa, Mycobacterium
TIEPPPEL

SEQ ID NO: 1113852 - protein, 9 aa, Mycobacterium
TIGAGATAQ

SEQ ID NO: 1113853 - protein, 17 aa, Mycobacterium
TIGGLASRTAADDYGRL

SEQ ID NO: 1113854 - protein, 12 aa, Mycobacterium
TIGPGDPDDRRR

SEQ ID NO: 1113855 - protein, 6 aa, Mycobacterium
TIGPRT

SEQ ID NO: 1113856 - protein, 7 aa, Mycobacterium
TIGQKAG

SEQ ID NO: 1113857 - protein, 10 aa, Mycobacterium
TIPAAEPGTF

SEQ ID NO: 1113858 - protein, 12 aa, Mycobacterium
TIPRKELSPPIF

SEQ ID NO: 1113859 - protein, 21 aa, Mycobacterium
TISATDTPGGGMTVEIDLAAP

SEQ ID NO: 1113860 - protein, 5 aa, Mycobacterium
TITSD

SEQ ID NO: 1113861 - protein, 8 aa, Mycobacterium
TKAATRRY

SEQ ID NO: 1113862 - protein, 26 aa, Mycobacterium
TKATNPRPGQTNPGGIKDAPHVLVQE

SEQ ID NO: 1113863 - protein, 14 aa, Mycobacterium
TKATNPRRGDPKQK

SEQ ID NO: 1113864 - protein, 9 aa, Mycobacterium
TKDDGPTYN

SEQ ID NO: 1113865 - protein, 11 aa, Mycobacterium
TKGIDQSRTQL

SEQ ID NO: 1113866 - protein, 8 aa, Mycobacterium
TKGRTAAA

SEQ ID NO: 1113867 - protein, 6 aa, Mycobacterium
TKHPGQ

SEQ ID NO: 1113868 - protein, 4 aa, Mycobacterium
TKHV

SEQ ID NO: 1113869 - protein, 7 aa, Mycobacterium
TKPPRRR

SEQ ID NO: 1113870 - protein, 7 aa, Mycobacterium
TKPRDES

SEQ ID NO: 1113871 - protein, 5 aa, Mycobacterium
TKQAI

SEQ ID NO: 1113872 - protein, 8 aa, Mycobacterium
TKQEGTDV

SEQ ID NO: 1113873 - protein, 5 aa, Mycobacterium
TKTAG

SEQ ID NO: 1113874 - protein, 7 aa, Mycobacterium
TKTGLGA

SEQ ID NO: 1113875 - protein, 8 aa, Mycobacterium
TKVGSDTA

SEQ ID NO: 1113876 - protein, 9 aa, Mycobacterium
TKYAAKGKT

SEQ ID NO: 1113877 - protein, 17 aa, Mycobacterium
TLAGHGDHGGHGVPGPA

SEQ ID NO: 1113878 - protein, 5 aa, Mycobacterium
TLAQR

SEQ ID NO: 1113879 - protein, 22 aa, Mycobacterium
TLDDSSDSPPRSRQHVATGNEH

SEQ ID NO: 1113880 - protein, 5 aa, Mycobacterium
TLEKQ

SEQ ID NO: 1113881 - protein, 15 aa, Mycobacterium
TLETGDSGDPPEGRI

SEQ ID NO: 1113882 - protein, 5 aa, Mycobacterium
TLGEP

SEQ ID NO: 1113883 - protein, 5 aa, Mycobacterium
TLGPS

SEQ ID NO: 1113884 - protein, 6 aa, Mycobacterium
TLGPTG

SEQ ID NO: 1113885 - protein, 7 aa, Mycobacterium
TLGSSTE

SEQ ID NO: 1113886 - protein, 11 aa, Mycobacterium
TLKRSDQQKDE

SEQ ID NO: 1113887 - protein, 8 aa, Mycobacterium
TLNERDAE

SEQ ID NO: 1113888 - protein, 7 aa, Mycobacterium
TLPAGAD

SEQ ID NO: 1113889 - protein, 5 aa, Mycobacterium
TLPGD

SEQ ID NO: 1113890 - protein, 6 aa, Mycobacterium
TLPGDD

SEQ ID NO: 1113891 - protein, 11 aa, Mycobacterium
TLPGSAPGYPD

SEQ ID NO: 1113892 - protein, 26 aa, Mycobacterium
TLPPNPNPRSVGADAAAPVGANNGGG

SEQ ID NO: 1113893 - protein, 4 aa, Mycobacterium
TLPR

SEQ ID NO: 1113894 - protein, 5 aa, Mycobacterium
TLPRN

SEQ ID NO: 1113895 - protein, 9 aa, Mycobacterium
TLPSGHTTA

SEQ ID NO: 1113896 - protein, 12 aa, Mycobacterium
TLPSGKPDYPTA

SEQ ID NO: 1113897 - protein, 9 aa, Mycobacterium
TLPTPTGQR

SEQ ID NO: 1113898 - protein, 9 aa, Mycobacterium
TLRETNKER

SEQ ID NO: 1113899 - protein, 11 aa, Mycobacterium
TLRTPGDDRRS

SEQ ID NO: 1113900 - protein, 4 aa, Mycobacterium
TLSG

SEQ ID NO: 1113901 - protein, 9 aa, Mycobacterium
TLSGRTLTP

SEQ ID NO: 1113902 - protein, 9 aa, Mycobacterium
TLSGSPFSL

SEQ ID NO: 1113903 - protein, 8 aa, Mycobacterium
TLSPGQLQ

SEQ ID NO: 1113904 - protein, 6 aa, Mycobacterium
TLSSAS

SEQ ID NO: 1113905 - protein, 8 aa, Mycobacterium
TLSTGEDV

SEQ ID NO: 1113906 - protein, 5 aa, Mycobacterium
TLSTI

SEQ ID NO: 1113907 - protein, 4 aa, Mycobacterium
TLTP

SEQ ID NO: 1113908 - protein, 5 aa, Mycobacterium
TLTPA

SEQ ID NO: 1113909 - protein, 10 aa, Mycobacterium
TLTPEQAEAF

SEQ ID NO: 1113910 - protein, 8 aa, Mycobacterium
TLTPSPQV

SEQ ID NO: 1113911 - protein, 4 aa, Mycobacterium
TLTS

SEQ ID NO: 1113912 - protein, 7 aa, Mycobacterium
TLTTQSR

SEQ ID NO: 1113913 - protein, 9 aa, Mycobacterium
TMGRSRSGK

SEQ ID NO: 1113914 - protein, 10 aa, Mycobacterium
TMGSTTSVNN

SEQ ID NO: 1113915 - protein, 6 aa, Mycobacterium
TMPNAT

SEQ ID NO: 1113916 - protein, 9 aa, Mycobacterium
TNDKDEPLI

SEQ ID NO: 1113917 - protein, 6 aa, Mycobacterium
TNGELT

SEQ ID NO: 1113918 - protein, 6 aa, Mycobacterium
TNGEVT

SEQ ID NO: 1113919 - protein, 9 aa, Mycobacterium
TNGGSSDGE

SEQ ID NO: 1113920 - protein, 4 aa, Mycobacterium
TNLP

SEQ ID NO: 1113921 - protein, 6 aa, Mycobacterium
TNLPEY

SEQ ID NO: 1113922 - protein, 6 aa, Mycobacterium
TNLPPG

SEQ ID NO: 1113923 - protein, 8 aa, Mycobacterium
TNLTSSKM

SEQ ID NO: 1113924 - protein, 5 aa, Mycobacterium
TNNPD

SEQ ID NO: 1113925 - protein, 8 aa, Mycobacterium
TNPAATFG

SEQ ID NO: 1113926 - protein, 7 aa, Mycobacterium
TNPKATL

SEQ ID NO: 1113927 - protein, 7 aa, Mycobacterium
TNPTAPT

SEQ ID NO: 1113928 - protein, 12 aa, Mycobacterium
TNSEAADQEQGY

SEQ ID NO: 1113929 - protein, 8 aa, Mycobacterium
TNSRKAPT

SEQ ID NO: 1113930 - protein, 7 aa, Mycobacterium
TNTRIND

SEQ ID NO: 1113931 - protein, 6 aa, Mycobacterium
TNVSTE

SEQ ID NO: 1113932 - protein, 12 aa, Mycobacterium
TPAADAGPDTGS

SEQ ID NO: 1113933 - protein, 9 aa, Mycobacterium
TPAAEPRGE

SEQ ID NO: 1113934 - protein, 13 aa, Mycobacterium
TPAAKEKSVKTAA

SEQ ID NO: 1113935 - protein, 13 aa, Mycobacterium
TPAAPRVERAEET

SEQ ID NO: 1113936 - protein, 19 aa, Mycobacterium
TPAATGATRSPAGAQGTGL

SEQ ID NO: 1113937 - protein, 8 aa, Mycobacterium
TPACSSGW

SEQ ID NO: 1113938 - protein, 7 aa, Mycobacterium
TPAGPVG

SEQ ID NO: 1113939 - protein, 10 aa, Mycobacterium
TPAKAGATAA

SEQ ID NO: 1113940 - protein, 13 aa, Mycobacterium
TPAPATVSAAPAD

SEQ ID NO: 1113941 - protein, 20 aa, Mycobacterium
TPAPFPADAPAERPRQMEHR

SEQ ID NO: 1113942 - protein, 9 aa, Mycobacterium
TPARPDGSI

SEQ ID NO: 1113943 - protein, 6 aa, Mycobacterium
TPDAAE

SEQ ID NO: 1113944 - protein, 5 aa, Mycobacterium
TPDEM

SEQ ID NO: 1113945 - protein, 14 aa, Mycobacterium
TPDGVTADRVDPAA

SEQ ID NO: 1113946 - protein, 9 aa, Mycobacterium
TPDSPAPQM

SEQ ID NO: 1113947 - protein, 5 aa, Mycobacterium
TPDTP

SEQ ID NO: 1113948 - protein, 5 aa, Mycobacterium
TPEAL

SEQ ID NO: 1113949 - protein, 21 aa, Mycobacterium
TPEEPTVDDGEVEDVTQATEA

SEQ ID NO: 1113950 - protein, 11 aa, Mycobacterium
TPEGLPLPDSI

SEQ ID NO: 1113951 - protein, 8 aa, Mycobacterium
TPEKDGQL

SEQ ID NO: 1113952 - protein, 5 aa, Mycobacterium
TPERL

SEQ ID NO: 1113953 - protein, 11 aa, Mycobacterium
TPETLRQGAEI

SEQ ID NO: 1113954 - protein, 10 aa, Mycobacterium
TPFPAGSGEL

SEQ ID NO: 1113955 - protein, 10 aa, Mycobacterium
TPGADRDQVA

SEQ ID NO: 1113956 - protein, 10 aa, Mycobacterium
TPGAPPEAVS

SEQ ID NO: 1113957 - protein, 34 aa, Mycobacterium
TPGQPAPQPRPAAESAAAPPAAAPPRSQVPPPPV

SEQ ID NO: 1113958 - protein, 4 aa, Mycobacterium
TPGS

SEQ ID NO: 1113959 - protein, 7 aa, Mycobacterium
TPGSDPF

SEQ ID NO: 1113960 - protein, 6 aa, Mycobacterium
TPGTGA

SEQ ID NO: 1113961 - protein, 6 aa, Mycobacterium
TPGTVS

SEQ ID NO: 1113962 - protein, 6 aa, Mycobacterium
TPITPT

SEQ ID NO: 1113963 - protein, 8 aa, Mycobacterium
TPKNDEKL

SEQ ID NO: 1113964 - protein, 29 aa, Mycobacterium
TPKPAEGVPPPPLNAPLPEPAPPAPPAPR

SEQ ID NO: 1113965 - protein, 4 aa, Mycobacterium
TPLR

SEQ ID NO: 1113966 - protein, 8 aa, Mycobacterium
TPLSARAS

SEQ ID NO: 1113967 - protein, 7 aa, Mycobacterium
TPLSRQS

SEQ ID NO: 1113968 - protein, 6 aa, Mycobacterium
TPNNYD

SEQ ID NO: 1113969 - protein, 12 aa, Mycobacterium
TPPDGEKVDNPE

SEQ ID NO: 1113970 - protein, 8 aa, Mycobacterium
TPPGTATV

SEQ ID NO: 1113971 - protein, 21 aa, Mycobacterium
TPPPGVVPQGGAETGAEAVES

SEQ ID NO: 1113972 - protein, 12 aa, Mycobacterium
TPPPNGSNHRNS

SEQ ID NO: 1113973 - protein, 110 aa, Mycobacterium
TPPVPRPKYEQPQSYGQYPGYYGQPPTQGGSGQHQQGPQQQQRPGYPTPYGGYPGSGPGTGGFPAGAQSGPPTPPTGFPTYGQPPASNTPTSQAPAPHQSPSSSQPGQSS

SEQ ID NO: 1113974 - protein, 6 aa, Mycobacterium
TPPWGQ

SEQ ID NO: 1113975 - protein, 11 aa, Mycobacterium
TPQASAVPGSV

SEQ ID NO: 1113976 - protein, 9 aa, Mycobacterium
TPQDSPFNV

SEQ ID NO: 1113977 - protein, 8 aa, Mycobacterium
TPQDSQFN

SEQ ID NO: 1113978 - protein, 7 aa, Mycobacterium
TPQPALD

SEQ ID NO: 1113979 - protein, 4 aa, Mycobacterium
TPRA

SEQ ID NO: 1113980 - protein, 11 aa, Mycobacterium
TPRGADSLAQP

SEQ ID NO: 1113981 - protein, 8 aa, Mycobacterium
TPRGGSAA

SEQ ID NO: 1113982 - protein, 7 aa, Mycobacterium
TPRRGDY

SEQ ID NO: 1113983 - protein, 6 aa, Mycobacterium
TPRVSR

SEQ ID NO: 1113984 - protein, 10 aa, Mycobacterium
TPRYRATRPL

SEQ ID NO: 1113985 - protein, 4 aa, Mycobacterium
TPSA

SEQ ID NO: 1113986 - protein, 16 aa, Mycobacterium
TPSEDGRGASRGRHSL

SEQ ID NO: 1113987 - protein, 7 aa, Mycobacterium
TPSGALT

SEQ ID NO: 1113988 - protein, 18 aa, Mycobacterium
TPSPQTALPQTALPQGEV

SEQ ID NO: 1113989 - protein, 23 aa, Mycobacterium
TPSPQTALPQTALPQTALPQGEV

SEQ ID NO: 1113990 - protein, 4 aa, Mycobacterium
TPST

SEQ ID NO: 1113991 - protein, 5 aa, Mycobacterium
TPTAA

SEQ ID NO: 1113992 - protein, 56 aa, Mycobacterium
TPTPAPAPRASSPISPSREAPAPPAQQPFATRTRPPAQPTPPAQYPRPVTPPSIWR

SEQ ID NO: 1113993 - protein, 4 aa, Mycobacterium
TPVD

SEQ ID NO: 1113994 - protein, 12 aa, Mycobacterium
TPVDADTAENFN

SEQ ID NO: 1113995 - protein, 11 aa, Mycobacterium
TPVGAEHDYRQ

SEQ ID NO: 1113996 - protein, 11 aa, Mycobacterium
TPVGAEHNYRE

SEQ ID NO: 1113997 - protein, 15 aa, Mycobacterium
TPVPGRTATELANDA

SEQ ID NO: 1113998 - protein, 8 aa, Mycobacterium
TPVPPEVG

SEQ ID NO: 1113999 - protein, 41 aa, Mycobacterium
TPVTETPAAETQAPEEDFEGPRRRARREREERRAAQARATA

SEQ ID NO: 1114000 - protein, 7 aa, Mycobacterium
TPVTSTG

SEQ ID NO: 1114001 - protein, 4 aa, Mycobacterium
TPWT

SEQ ID NO: 1114002 - protein, 16 aa, Mycobacterium
TPYKAKAGSSWLGSPP

SEQ ID NO: 1114003 - protein, 9 aa, Mycobacterium
TQAGPDIGW

SEQ ID NO: 1114004 - protein, 8 aa, Mycobacterium
TQDGTDVD

SEQ ID NO: 1114005 - protein, 10 aa, Mycobacterium
TQEAADGLAA

SEQ ID NO: 1114006 - protein, 58 aa, Mycobacterium
TQGKEGQTKDVESATDAPPDTSKAVPKPVTPMSPETQSPPVTIPATGAAPKPAPPEQL

SEQ ID NO: 1114007 - protein, 63 aa, Mycobacterium
TQGPYGPVPGGFPPPNVATSAPNAHGPQPSPGVPAAAIPGQLSPAVPGARPPLPPAPPGARTV

SEQ ID NO: 1114008 - protein, 8 aa, Mycobacterium
TQGSDGTW

SEQ ID NO: 1114009 - protein, 17 aa, Mycobacterium
TQGSSGSTPLPSDTIAG

SEQ ID NO: 1114010 - protein, 4 aa, Mycobacterium
TQHR

SEQ ID NO: 1114011 - protein, 8 aa, Mycobacterium
TQKGQLEA

SEQ ID NO: 1114012 - protein, 11 aa, Mycobacterium
TQLANEREPHE

SEQ ID NO: 1114013 - protein, 10 aa, Mycobacterium
TQLDRGARQY

SEQ ID NO: 1114014 - protein, 11 aa, Mycobacterium
TQNEPNSEVAP

SEQ ID NO: 1114015 - protein, 8 aa, Mycobacterium
TQNPEATA

SEQ ID NO: 1114016 - protein, 13 aa, Mycobacterium
TQPAEPAPVSPNR

SEQ ID NO: 1114017 - protein, 6 aa, Mycobacterium
TQPGTL

SEQ ID NO: 1114018 - protein, 6 aa, Mycobacterium
TQPMPG

SEQ ID NO: 1114019 - protein, 12 aa, Mycobacterium
TQQKPDSEVPPD

SEQ ID NO: 1114020 - protein, 4 aa, Mycobacterium
TQQP

SEQ ID NO: 1114021 - protein, 4 aa, Mycobacterium
TQQR

SEQ ID NO: 1114022 - protein, 19 aa, Mycobacterium
TQQTTPTQQTITKTVAGKT

SEQ ID NO: 1114023 - protein, 16 aa, Mycobacterium
TQQTYRELTSTSNCTT

SEQ ID NO: 1114024 - protein, 5 aa, Mycobacterium
TQRSD

SEQ ID NO: 1114025 - protein, 11 aa, Mycobacterium
TQRTKTRREVE

SEQ ID NO: 1114026 - protein, 5 aa, Mycobacterium
TQSEA

SEQ ID NO: 1114027 - protein, 4 aa, Mycobacterium
TQSG

SEQ ID NO: 1114028 - protein, 21 aa, Mycobacterium
TQSPSPGSGVNYGSRITLNFA

SEQ ID NO: 1114029 - protein, 11 aa, Mycobacterium
TQSTPGQRPDT

SEQ ID NO: 1114030 - protein, 14 aa, Mycobacterium
TQSYGSSLNNPTGM

SEQ ID NO: 1114031 - protein, 9 aa, Mycobacterium
TQTDTSDSI

SEQ ID NO: 1114032 - protein, 4 aa, Mycobacterium
TQVG

SEQ ID NO: 1114033 - protein, 14 aa, Mycobacterium
TRAIGGAGSAAPND

SEQ ID NO: 1114034 - protein, 9 aa, Mycobacterium
TRARRAGAT

SEQ ID NO: 1114035 - protein, 9 aa, Mycobacterium
TRAVPEPPS

SEQ ID NO: 1114036 - protein, 9 aa, Mycobacterium
TRDDAGNAV

SEQ ID NO: 1114037 - protein, 7 aa, Mycobacterium
TRDDPSR

SEQ ID NO: 1114038 - protein, 5 aa, Mycobacterium
TRDEA

SEQ ID NO: 1114039 - protein, 14 aa, Mycobacterium
TRDPLTGEYRGGPA

SEQ ID NO: 1114040 - protein, 9 aa, Mycobacterium
TRDRDAVER

SEQ ID NO: 1114041 - protein, 10 aa, Mycobacterium
TREDPSPLQK

SEQ ID NO: 1114042 - protein, 8 aa, Mycobacterium
TREDPSRP

SEQ ID NO: 1114043 - protein, 9 aa, Mycobacterium
TREETPGSL

SEQ ID NO: 1114044 - protein, 4 aa, Mycobacterium
TREP

SEQ ID NO: 1114045 - protein, 5 aa, Mycobacterium
TRERS

SEQ ID NO: 1114046 - protein, 4 aa, Mycobacterium
TRGA

SEQ ID NO: 1114047 - protein, 7 aa, Mycobacterium
TRGAEYG

SEQ ID NO: 1114048 - protein, 8 aa, Mycobacterium
TRGFKPVD

SEQ ID NO: 1114049 - protein, 11 aa, Mycobacterium
TRGGPGTETET

SEQ ID NO: 1114050 - protein, 5 aa, Mycobacterium
TRGLT

SEQ ID NO: 1114051 - protein, 4 aa, Mycobacterium
TRGR

SEQ ID NO: 1114052 - protein, 9 aa, Mycobacterium
TRGTDTDMA

SEQ ID NO: 1114053 - protein, 9 aa, Mycobacterium
TRGTGSYGY

SEQ ID NO: 1114054 - protein, 6 aa, Mycobacterium
TRHDAE

SEQ ID NO: 1114055 - protein, 4 aa, Mycobacterium
TRIE

SEQ ID NO: 1114056 - protein, 10 aa, Mycobacterium
TRKPDVDGGV

SEQ ID NO: 1114057 - protein, 5 aa, Mycobacterium
TRLES

SEQ ID NO: 1114058 - protein, 5 aa, Mycobacterium
TRLPG

SEQ ID NO: 1114059 - protein, 4 aa, Mycobacterium
TRMS

SEQ ID NO: 1114060 - protein, 7 aa, Mycobacterium
TRNSSTL

SEQ ID NO: 1114061 - protein, 4 aa, Mycobacterium
TRPA

SEQ ID NO: 1114062 - protein, 6 aa, Mycobacterium
TRPAAA

SEQ ID NO: 1114063 - protein, 7 aa, Mycobacterium
TRPADGM

SEQ ID NO: 1114064 - protein, 8 aa, Mycobacterium
TRPAVPGL

SEQ ID NO: 1114065 - protein, 10 aa, Mycobacterium
TRPDGKPIKH

SEQ ID NO: 1114066 - protein, 6 aa, Mycobacterium
TRPDLK

SEQ ID NO: 1114067 - protein, 6 aa, Mycobacterium
TRPDPQ

SEQ ID NO: 1114068 - protein, 12 aa, Mycobacterium
TRPDVDSPEAGD

SEQ ID NO: 1114069 - protein, 7 aa, Mycobacterium
TRPGTRN

SEQ ID NO: 1114070 - protein, 6 aa, Mycobacterium
TRPLGE

SEQ ID NO: 1114071 - protein, 17 aa, Mycobacterium
TRPPKAKDTGAQHEPRP

SEQ ID NO: 1114072 - protein, 23 aa, Mycobacterium
TRPVPAPWPRPGGLQSDPSEGVK

SEQ ID NO: 1114073 - protein, 6 aa, Mycobacterium
TRQIRN

SEQ ID NO: 1114074 - protein, 23 aa, Mycobacterium
TRQPAEQPAVEAAPAPATAAPGV

SEQ ID NO: 1114075 - protein, 12 aa, Mycobacterium
TRQSGRLETPDY

SEQ ID NO: 1114076 - protein, 27 aa, Mycobacterium
TRRDPSAKAHPGSLRATRRDEERPDAA

SEQ ID NO: 1114077 - protein, 9 aa, Mycobacterium
TRRRGRSLG

SEQ ID NO: 1114078 - protein, 24 aa, Mycobacterium
TRRRTGAVDDRPTTREATSVPAAS

SEQ ID NO: 1114079 - protein, 15 aa, Mycobacterium
TRSGTELLGSSKDSL

SEQ ID NO: 1114080 - protein, 5 aa, Mycobacterium
TRSQS

SEQ ID NO: 1114081 - protein, 8 aa, Mycobacterium
TRTQQRHG

SEQ ID NO: 1114082 - protein, 14 aa, Mycobacterium
TRTQSPAAEKDTVA

SEQ ID NO: 1114083 - protein, 8 aa, Mycobacterium
TRVPGNGA

SEQ ID NO: 1114084 - protein, 7 aa, Mycobacterium
TRVTSEP

SEQ ID NO: 1114085 - protein, 5 aa, Mycobacterium
TRYDR

SEQ ID NO: 1114086 - protein, 8 aa, Mycobacterium
TRYSTSPT

SEQ ID NO: 1114087 - protein, 8 aa, Mycobacterium
TRYTTHPT

SEQ ID NO: 1114088 - protein, 10 aa, Mycobacterium
TSAARSGKVA

SEQ ID NO: 1114089 - protein, 7 aa, Mycobacterium
TSAASFT

SEQ ID NO: 1114090 - protein, 9 aa, Mycobacterium
TSAATASRA

SEQ ID NO: 1114091 - protein, 9 aa, Mycobacterium
TSADGRNWV

SEQ ID NO: 1114092 - protein, 4 aa, Mycobacterium
TSAF

SEQ ID NO: 1114093 - protein, 7 aa, Mycobacterium
TSALRSA

SEQ ID NO: 1114094 - protein, 6 aa, Mycobacterium
TSAPEL

SEQ ID NO: 1114095 - protein, 10 aa, Mycobacterium
TSARSMPGSG

SEQ ID NO: 1114096 - protein, 35 aa, Mycobacterium
TSARTERLDRPRADQPGYDDRPSYAPYSGADHPGY

SEQ ID NO: 1114097 - protein, 23 aa, Mycobacterium
TSDAPQPATPATETAAPGADEVT

SEQ ID NO: 1114098 - protein, 9 aa, Mycobacterium
TSDDLGATG

SEQ ID NO: 1114099 - protein, 6 aa, Mycobacterium
TSDPDN

SEQ ID NO: 1114100 - protein, 8 aa, Mycobacterium
TSDPGVRD

SEQ ID NO: 1114101 - protein, 9 aa, Mycobacterium
TSDRDSAQI

SEQ ID NO: 1114102 - protein, 16 aa, Mycobacterium
TSDSRSAKETAAESLK

SEQ ID NO: 1114103 - protein, 14 aa, Mycobacterium
TSDTTAGPPEPNRL

SEQ ID NO: 1114104 - protein, 13 aa, Mycobacterium
TSEADGGLAPASR

SEQ ID NO: 1114105 - protein, 14 aa, Mycobacterium
TSEQATAAVRRSEA

SEQ ID NO: 1114106 - protein, 10 aa, Mycobacterium
TSEQPAQAPI

SEQ ID NO: 1114107 - protein, 5 aa, Mycobacterium
TSERS

SEQ ID NO: 1114108 - protein, 13 aa, Mycobacterium
TSESDDSGAGRGI

SEQ ID NO: 1114109 - protein, 5 aa, Mycobacterium
TSEVS

SEQ ID NO: 1114110 - protein, 10 aa, Mycobacterium
TSFNTSPAAG

SEQ ID NO: 1114111 - protein, 6 aa, Mycobacterium
TSFPSG

SEQ ID NO: 1114112 - protein, 4 aa, Mycobacterium
TSGD

SEQ ID NO: 1114113 - protein, 8 aa, Mycobacterium
TSGDLGAA

SEQ ID NO: 1114114 - protein, 12 aa, Mycobacterium
TSGFSGDSGVNI

SEQ ID NO: 1114115 - protein, 6 aa, Mycobacterium
TSGGAL

SEQ ID NO: 1114116 - protein, 12 aa, Mycobacterium
TSGIAATNGRLS

SEQ ID NO: 1114117 - protein, 5 aa, Mycobacterium
TSGLP

SEQ ID NO: 1114118 - protein, 6 aa, Mycobacterium
TSGPGD

SEQ ID NO: 1114119 - protein, 7 aa, Mycobacterium
TSGPGEL

SEQ ID NO: 1114120 - protein, 7 aa, Mycobacterium
TSGPLPD

SEQ ID NO: 1114121 - protein, 9 aa, Mycobacterium
TSGSSGVPK

SEQ ID NO: 1114122 - protein, 11 aa, Mycobacterium
TSGSTRAPAGV

SEQ ID NO: 1114123 - protein, 6 aa, Mycobacterium
TSGTDA

SEQ ID NO: 1114124 - protein, 4 aa, Mycobacterium
TSIE

SEQ ID NO: 1114125 - protein, 15 aa, Mycobacterium
TSKAPDGKSTIESGS

SEQ ID NO: 1114126 - protein, 11 aa, Mycobacterium
TSKPEVPGGRG

SEQ ID NO: 1114127 - protein, 4 aa, Mycobacterium
TSLA

SEQ ID NO: 1114128 - protein, 4 aa, Mycobacterium
TSLG

SEQ ID NO: 1114129 - protein, 9 aa, Mycobacterium
TSLGGSNGL

SEQ ID NO: 1114130 - protein, 7 aa, Mycobacterium
TSLPDSA

SEQ ID NO: 1114131 - protein, 7 aa, Mycobacterium
TSLPPRQ

SEQ ID NO: 1114132 - protein, 5 aa, Mycobacterium
TSLRP

SEQ ID NO: 1114133 - protein, 8 aa, Mycobacterium
TSLSETAG

SEQ ID NO: 1114134 - protein, 9 aa, Mycobacterium
TSNEETVEA

SEQ ID NO: 1114135 - protein, 12 aa, Mycobacterium
TSNVGAAEQEPR

SEQ ID NO: 1114136 - protein, 9 aa, Mycobacterium
TSPKIPADL

SEQ ID NO: 1114137 - protein, 4 aa, Mycobacterium
TSPL

SEQ ID NO: 1114138 - protein, 5 aa, Mycobacterium
TSPRT

SEQ ID NO: 1114139 - protein, 6 aa, Mycobacterium
TSPSTV

SEQ ID NO: 1114140 - protein, 15 aa, Mycobacterium
TSQLTESLAGRDEEL

SEQ ID NO: 1114141 - protein, 6 aa, Mycobacterium
TSQPPI

SEQ ID NO: 1114142 - protein, 6 aa, Mycobacterium
TSQTTL

SEQ ID NO: 1114143 - protein, 7 aa, Mycobacterium
TSRAPHG

SEQ ID NO: 1114144 - protein, 12 aa, Mycobacterium
TSRGEGQLDGPI

SEQ ID NO: 1114145 - protein, 7 aa, Mycobacterium
TSRIKED

SEQ ID NO: 1114146 - protein, 8 aa, Mycobacterium
TSRKRAEA

SEQ ID NO: 1114147 - protein, 23 aa, Mycobacterium
TSRPPASPLPATDPAALPEAQPG

SEQ ID NO: 1114148 - protein, 5 aa, Mycobacterium
TSRRS

SEQ ID NO: 1114149 - protein, 8 aa, Mycobacterium
TSSAGPVL

SEQ ID NO: 1114150 - protein, 19 aa, Mycobacterium
TSSGGSLTETYQGNRVSQE

SEQ ID NO: 1114151 - protein, 6 aa, Mycobacterium
TSSSPK

SEQ ID NO: 1114152 - protein, 12 aa, Mycobacterium
TSSSRSAESDVD

SEQ ID NO: 1114153 - protein, 10 aa, Mycobacterium
TSTDSARTVP

SEQ ID NO: 1114154 - protein, 6 aa, Mycobacterium
TSTGPI

SEQ ID NO: 1114155 - protein, 9 aa, Mycobacterium
TSTIGTDQK

SEQ ID NO: 1114156 - protein, 6 aa, Mycobacterium
TSTPAT

SEQ ID NO: 1114157 - protein, 7 aa, Mycobacterium
TSTQQAA

SEQ ID NO: 1114158 - protein, 8 aa, Mycobacterium
TSTRGASL

SEQ ID NO: 1114159 - protein, 6 aa, Mycobacterium
TSTRSD

SEQ ID NO: 1114160 - protein, 13 aa, Mycobacterium
TSVGPGAGTAQAH

SEQ ID NO: 1114161 - protein, 6 aa, Mycobacterium
TSVGTA

SEQ ID NO: 1114162 - protein, 11 aa, Mycobacterium
TSVSPLTRPHR

SEQ ID NO: 1114163 - protein, 14 aa, Mycobacterium
TSVSPLTRPHRSIP

SEQ ID NO: 1114164 - protein, 11 aa, Mycobacterium
TSYRKSTGQTL

SEQ ID NO: 1114165 - protein, 9 aa, Mycobacterium
TTAAAPAVL

SEQ ID NO: 1114166 - protein, 11 aa, Mycobacterium
TTAAGAPSESS

SEQ ID NO: 1114167 - protein, 9 aa, Mycobacterium
TTADASPWW

SEQ ID NO: 1114168 - protein, 21 aa, Mycobacterium
TTADSAANESRVDSPEEPVGD

SEQ ID NO: 1114169 - protein, 6 aa, Mycobacterium
TTALPA

SEQ ID NO: 1114170 - protein, 4 aa, Mycobacterium
TTAN

SEQ ID NO: 1114171 - protein, 7 aa, Mycobacterium
TTAPTVD

SEQ ID NO: 1114172 - protein, 7 aa, Mycobacterium
TTAPYGP

SEQ ID NO: 1114173 - protein, 7 aa, Mycobacterium
TTARQPM

SEQ ID NO: 1114174 - protein, 8 aa, Mycobacterium
TTDAPTGF

SEQ ID NO: 1114175 - protein, 17 aa, Mycobacterium
TTDERTGLTGNQYTAPL

SEQ ID NO: 1114176 - protein, 11 aa, Mycobacterium
TTDGTKPLENK

SEQ ID NO: 1114177 - protein, 7 aa, Mycobacterium
TTDPQSV

SEQ ID NO: 1114178 - protein, 9 aa, Mycobacterium
TTDRTEEKA

SEQ ID NO: 1114179 - protein, 6 aa, Mycobacterium
TTEDIP

SEQ ID NO: 1114180 - protein, 4 aa, Mycobacterium
TTEE

SEQ ID NO: 1114181 - protein, 10 aa, Mycobacterium
TTEQEAQATR

SEQ ID NO: 1114182 - protein, 34 aa, Mycobacterium
TTEVDAPAGSPDATPAPVADPAEMESDTAEDSEV

SEQ ID NO: 1114183 - protein, 72 aa, Mycobacterium
TTEVEDPKVPVGKSRRTPKAQPQTQAPEADAEADAEPETDAEPDAEPETEGSADAEDTDDTDLPDPAPEPEP

SEQ ID NO: 1114184 - protein, 12 aa, Mycobacterium
TTEVYDGSGWTQ

SEQ ID NO: 1114185 - protein, 9 aa, Mycobacterium
TTFDGQRQE

SEQ ID NO: 1114186 - protein, 10 aa, Mycobacterium
TTGAGKSEGI

SEQ ID NO: 1114187 - protein, 20 aa, Mycobacterium
TTGATGRGSRRSPEPSADLS

SEQ ID NO: 1114188 - protein, 6 aa, Mycobacterium
TTGEPV

SEQ ID NO: 1114189 - protein, 4 aa, Mycobacterium
TTGI

SEQ ID NO: 1114190 - protein, 10 aa, Mycobacterium
TTGPAERTGA

SEQ ID NO: 1114191 - protein, 4 aa, Mycobacterium
TTGR

SEQ ID NO: 1114192 - protein, 8 aa, Mycobacterium
TTGSFSQN

SEQ ID NO: 1114193 - protein, 17 aa, Mycobacterium
TTGSSQAPRGDAPTAEQ

SEQ ID NO: 1114194 - protein, 5 aa, Mycobacterium
TTGTG

SEQ ID NO: 1114195 - protein, 9 aa, Mycobacterium
TTHDGTRGY

SEQ ID NO: 1114196 - protein, 8 aa, Mycobacterium
TTHDGVRG

SEQ ID NO: 1114197 - protein, 7 aa, Mycobacterium
TTKSRDD

SEQ ID NO: 1114198 - protein, 4 aa, Mycobacterium
TTLG

SEQ ID NO: 1114199 - protein, 9 aa, Mycobacterium
TTLSGGDLD

SEQ ID NO: 1114200 - protein, 11 aa, Mycobacterium
TTLTSTGSVDS

SEQ ID NO: 1114201 - protein, 9 aa, Mycobacterium
TTNDTTREQ

SEQ ID NO: 1114202 - protein, 9 aa, Mycobacterium
TTNGATPEQ

SEQ ID NO: 1114203 - protein, 9 aa, Mycobacterium
TTNGATREQ

SEQ ID NO: 1114204 - protein, 12 aa, Mycobacterium
TTPAHTPPRPHG

SEQ ID NO: 1114205 - protein, 12 aa, Mycobacterium
TTPDDYPGPLPR

SEQ ID NO: 1114206 - protein, 12 aa, Mycobacterium
TTPEDPRPERIS

SEQ ID NO: 1114207 - protein, 5 aa, Mycobacterium
TTPGE

SEQ ID NO: 1114208 - protein, 5 aa, Mycobacterium
TTPGG

SEQ ID NO: 1114209 - protein, 5 aa, Mycobacterium
TTPGR

SEQ ID NO: 1114210 - protein, 5 aa, Mycobacterium
TTPIE

SEQ ID NO: 1114211 - protein, 10 aa, Mycobacterium
TTPLAASPLA

SEQ ID NO: 1114212 - protein, 4 aa, Mycobacterium
TTPM

SEQ ID NO: 1114213 - protein, 34 aa, Mycobacterium; identical to SEQ ID NO: 292053

SEQ ID NO: 1114214 - protein, 17 aa, Mycobacterium
TTPPPGTGAEGNPDAVQ

SEQ ID NO: 1114215 - protein, 7 aa, Mycobacterium
TTPRSAA

SEQ ID NO: 1114216 - protein, 6 aa, Mycobacterium
TTQQET

SEQ ID NO: 1114217 - protein, 18 aa, Mycobacterium
TTREVRAPSWNPDGTYTR

SEQ ID NO: 1114218 - protein, 5 aa, Mycobacterium
TTRMS

SEQ ID NO: 1114219 - protein, 13 aa, Mycobacterium
TTRPHAGESMKDN

SEQ ID NO: 1114220 - protein, 7 aa, Mycobacterium
TTRSPSY

SEQ ID NO: 1114221 - protein, 5 aa, Mycobacterium
TTSDS

SEQ ID NO: 1114222 - protein, 5 aa, Mycobacterium
TTSGE

SEQ ID NO: 1114223 - protein, 12 aa, Mycobacterium
TTSNPPPKATKH

SEQ ID NO: 1114224 - protein, 9 aa, Mycobacterium
TTTAEDNSL

SEQ ID NO: 1114225 - protein, 17 aa, Mycobacterium
TTTQEGQRWKISQLIQV

SEQ ID NO: 1114226 - protein, 14 aa, Mycobacterium
TTTSKENPDGAFAA

SEQ ID NO: 1114227 - protein, 16 aa, Mycobacterium
TTTSRERPDASQTASS

SEQ ID NO: 1114228 - protein, 6 aa, Mycobacterium
TTTSSA

SEQ ID NO: 1114229 - protein, 14 aa, Mycobacterium
TTTTPTPSGGSLYS

SEQ ID NO: 1114230 - protein, 11 aa, Mycobacterium
TTVNSRGAQTT

SEQ ID NO: 1114231 - protein, 7 aa, Mycobacterium
TTVPQQV

SEQ ID NO: 1114232 - protein, 16 aa, Mycobacterium
TTVPSEDDGRRPPRLG

SEQ ID NO: 1114233 - protein, 7 aa, Mycobacterium
TTVQPRH

SEQ ID NO: 1114234 - protein, 20 aa, Mycobacterium
TTVTPTAEIPTPAPTTPAPL

SEQ ID NO: 1114235 - protein, 9 aa, Mycobacterium
TTVTSSRPA

SEQ ID NO: 1114236 - protein, 12 aa, Mycobacterium
TVAADGEKFSGA

SEQ ID NO: 1114237 - protein, 7 aa, Mycobacterium
TVADTTA

SEQ ID NO: 1114238 - protein, 5 aa, Mycobacterium
TVAGA

SEQ ID NO: 1114239 - protein, 4 aa, Mycobacterium
TVAQ

SEQ ID NO: 1114240 - protein, 5 aa, Mycobacterium
TVDGE

SEQ ID NO: 1114241 - protein, 9 aa, Mycobacterium
TVDRTPRGR

SEQ ID NO: 1114242 - protein, 7 aa, Mycobacterium
TVDTQKL

SEQ ID NO: 1114243 - protein, 10 aa, Mycobacterium
TVEGNTAGLY

SEQ ID NO: 1114244 - protein, 29 aa, Mycobacterium
TVEPDEPDEPWQPPWEDDDDDKPTPTLPT

SEQ ID NO: 1114245 - protein, 6 aa, Mycobacterium
TVESTR

SEQ ID NO: 1114246 - protein, 18 aa, Mycobacterium
TVESYDTRTGTWQPQPPL

SEQ ID NO: 1114247 - protein, 15 aa, Mycobacterium
TVETATTTAEDVTAQ

SEQ ID NO: 1114248 - protein, 46 aa, Mycobacterium
TVGAASGLRHGDHGPAGAEAGHHGPSGGHEGGHHAPAGVEAEHERP

SEQ ID NO: 1114249 - protein, 8 aa, Mycobacterium
TVGDKDYR

SEQ ID NO: 1114250 - protein, 6 aa, Mycobacterium
TVGPQW

SEQ ID NO: 1114251 - protein, 12 aa, Mycobacterium
TVGSSPSRDDLS

SEQ ID NO: 1114252 - protein, 8 aa, Mycobacterium
TVGSSTAA

SEQ ID NO: 1114253 - protein, 11 aa, Mycobacterium
TVKDRKTLEEI

SEQ ID NO: 1114254 - protein, 11 aa, Mycobacterium
TVKPKADITPE

SEQ ID NO: 1114255 - protein, 18 aa, Mycobacterium
TVLPQQPPMDTQGVEAPG

SEQ ID NO: 1114256 - protein, 10 aa, Mycobacterium
TVNEPGDGAV

SEQ ID NO: 1114257 - protein, 10 aa, Mycobacterium
TVNPKTQTPI

SEQ ID NO: 1114258 - protein, 10 aa, Mycobacterium
TVPGGTPPGT

SEQ ID NO: 1114259 - protein, 9 aa, Mycobacterium
TVPGPTPVT

SEQ ID NO: 1114260 - protein, 6 aa, Mycobacterium
TVPGTA

SEQ ID NO: 1114261 - protein, 13 aa, Mycobacterium
TVPGTTRAANTTF

SEQ ID NO: 1114262 - protein, 12 aa, Mycobacterium
TVPPANQTSAIT

SEQ ID NO: 1114263 - protein, 8 aa, Mycobacterium
TVPRRREA

SEQ ID NO: 1114264 - protein, 4 aa, Mycobacterium
TVPT

SEQ ID NO: 1114265 - protein, 7 aa, Mycobacterium
TVQGAAG

SEQ ID NO: 1114266 - protein, 6 aa, Mycobacterium
TVRGGQ

SEQ ID NO: 1114267 - protein, 16 aa, Mycobacterium
TVSEEAAREGRNRTAR

SEQ ID NO: 1114268 - protein, 7 aa, Mycobacterium
TVSEGQR

SEQ ID NO: 1114269 - protein, 4 aa, Mycobacterium
TVSR

SEQ ID NO: 1114270 - protein, 6 aa, Mycobacterium
TVSTAG

SEQ ID NO: 1114271 - protein, 60 aa, Mycobacterium
TVTAPAPPPEPPPPPAEPPPGGPPPGGPPPAGPPPAQGPGDTGAAQPLVPGPPPAGPDGV

SEQ ID NO: 1114272 - protein, 10 aa, Mycobacterium
TVTATGARTR

SEQ ID NO: 1114273 - protein, 24 aa, Mycobacterium
TVTGTPPVPDEHPSPQTLPEVGAR

SEQ ID NO: 1114274 - protein, 8 aa, Mycobacterium
TVTPEAAT

SEQ ID NO: 1114275 - protein, 10 aa, Mycobacterium
TVTPGAGMGT

SEQ ID NO: 1114276 - protein, 8 aa, Mycobacterium
TVTRPSTS

SEQ ID NO: 1114277 - protein, 6 aa, Mycobacterium
TVTTAG

SEQ ID NO: 1114278 - protein, 7 aa, Mycobacterium
TWRTPSP

SEQ ID NO: 1114279 - protein, 5 aa, Mycobacterium
TYAQA

SEQ ID NO: 1114280 - protein, 6 aa, Mycobacterium
TYDGNP

SEQ ID NO: 1114281 - protein, 9 aa, Mycobacterium
TYGGEAGNR

SEQ ID NO: 1114282 - protein, 10 aa, Mycobacterium
TYGGEAGNRF

SEQ ID NO: 1114283 - protein, 4 aa, Mycobacterium
TYGV

SEQ ID NO: 1114284 - protein, 7 aa, Mycobacterium
TYNDPAT

SEQ ID NO: 1114285 - protein, 20 aa, Mycobacterium
TYPDPATVPTSPTAKNLHGQ

SEQ ID NO: 1114286 - protein, 8 aa, Mycobacterium
TYQPADND

SEQ ID NO: 1114287 - protein, 7 aa, Mycobacterium
TYRGTTI

SEQ ID NO: 1114288 - protein, 16 aa, Mycobacterium
TYSDKYDSWDELPDGA

SEQ ID NO: 1114289 - protein, 7 aa, Mycobacterium
VAAGGDD

SEQ ID NO: 1114290 - protein, 10 aa, Mycobacterium
VAAGSAEELH

SEQ ID NO: 1114291 - protein, 8 aa, Mycobacterium
VAAGTGRT

SEQ ID NO: 1114292 - protein, 11 aa, Mycobacterium
VAAKGGPQCTD

SEQ ID NO: 1114293 - protein, 9 aa, Mycobacterium
VAAQATGEF

SEQ ID NO: 1114294 - protein, 7 aa, Mycobacterium
VAASTDR

SEQ ID NO: 1114295 - protein, 19 aa, Mycobacterium
VADEDEAMEPADDDDAAEV

SEQ ID NO: 1114296 - protein, 8 aa, Mycobacterium
VADGDYDR

SEQ ID NO: 1114297 - protein, 8 aa, Mycobacterium
VADPTRSR

SEQ ID NO: 1114298 - protein, 7 aa, Mycobacterium
VADRGPS

SEQ ID NO: 1114299 - protein, 11 aa, Mycobacterium
VAEAASSVAEG

SEQ ID NO: 1114300 - protein, 8 aa, Mycobacterium
VAEDNRRR

SEQ ID NO: 1114301 - protein, 4 aa, Mycobacterium
VAEG

SEQ ID NO: 1114302 - protein, 24 aa, Mycobacterium
VAEGRGKAQAESLRKTKTATPARR

SEQ ID NO: 1114303 - protein, 15 aa, Mycobacterium
VAERRRRRAAETAGI

SEQ ID NO: 1114304 - protein, 15 aa, Mycobacterium
VAESGVSARGLDPAA

SEQ ID NO: 1114305 - protein, 4 aa, Mycobacterium
VAGA

SEQ ID NO: 1114306 - protein, 22 aa, Mycobacterium
VAGEEDAKDEEVQSDTAEPVAE

SEQ ID NO: 1114307 - protein, 12 aa, Mycobacterium
VAGEPDSGTTAG

SEQ ID NO: 1114308 - protein, 17 aa, Mycobacterium
VAGGYADPGTAARPSVD

SEQ ID NO: 1114309 - protein, 64 aa, Mycobacterium
VAGRPSATWPSQPPPSQPPPTGRPPAQRPYPSAPRPSAPPTYPTPQPSRPAPVQPPLSSPAMES

SEQ ID NO: 1114310 - protein, 8 aa, Mycobacterium
VAGSTAPY

SEQ ID NO: 1114311 - protein, 12 aa, Mycobacterium
VAGTASRQYDDE

SEQ ID NO: 1114312 - protein, 9 aa, Mycobacterium
VAGTTSAGL

SEQ ID NO: 1114313 - protein, 15 aa, Mycobacterium
VAKRKDSENLGDRSS

SEQ ID NO: 1114314 - protein, 5 aa, Mycobacterium
VANPK

SEQ ID NO: 1114315 - protein, 8 aa, Mycobacterium
VAPDAGSR

SEQ ID NO: 1114316 - protein, 12 aa, Mycobacterium
VAPDGTPLGPGL

SEQ ID NO: 1114317 - protein, 8 aa, Mycobacterium
VAPDHPKI

SEQ ID NO: 1114318 - protein, 7 aa, Mycobacterium
VAPGGVG

SEQ ID NO: 1114319 - protein, 6 aa, Mycobacterium
VAPGTP

SEQ ID NO: 1114320 - protein, 6 aa, Mycobacterium
VAPGVA

SEQ ID NO: 1114321 - protein, 7 aa, Mycobacterium
VAPPEGR

SEQ ID NO: 1114322 - protein, 8 aa, Mycobacterium
VAPPGADP

SEQ ID NO: 1114323 - protein, 13 aa, Mycobacterium
VAPPRGWTQEDTE

SEQ ID NO: 1114324 - protein, 28 aa, Mycobacterium
VAPPTTPVPPYPYPPYAQYGSPYYAPPQ

SEQ ID NO: 1114325 - protein, 8 aa, Mycobacterium
VAPPVAEP

SEQ ID NO: 1114326 - protein, 13 aa, Mycobacterium
VAPPVETPPARSE

SEQ ID NO: 1114327 - protein, 25 aa, Mycobacterium
VAPRDDRDEPPPRTELGGAESHGAA

SEQ ID NO: 1114328 - protein, 8 aa, Mycobacterium
VAPRPRNP

SEQ ID NO: 1114329 - protein, 8 aa, Mycobacterium
VAPRSGPA

SEQ ID NO: 1114330 - protein, 12 aa, Mycobacterium
VAPRVEYGGGGT

SEQ ID NO: 1114331 - protein, 10 aa, Mycobacterium
VAPSRSAAAV

SEQ ID NO: 1114332 - protein, 11 aa, Mycobacterium
VAPSRSATPVE

SEQ ID NO: 1114333 - protein, 13 aa, Mycobacterium
VAPTSAADPSGTV

SEQ ID NO: 1114334 - protein, 9 aa, Mycobacterium
VAQSEGEFR

SEQ ID NO: 1114335 - protein, 7 aa, Mycobacterium
VAQTDRA

SEQ ID NO: 1114336 - protein, 10 aa, Mycobacterium
VAQTSYPADV

SEQ ID NO: 1114337 - protein, 9 aa, Mycobacterium
VARESANDV

SEQ ID NO: 1114338 - protein, 6 aa, Mycobacterium
VARSGG

SEQ ID NO: 1114339 - protein, 24 aa, Mycobacterium
VARSPGTATSPAATAGSADREVQA

SEQ ID NO: 1114340 - protein, 15 aa, Mycobacterium
VASGANPKSWKDLLP

SEQ ID NO: 1114341 - protein, 15 aa, Mycobacterium
VASGARRAPAKAAAI

SEQ ID NO: 1114342 - protein, 6 aa, Mycobacterium
VASGPR

SEQ ID NO: 1114343 - protein, 12 aa, Mycobacterium
VASPSGDDPQQA

SEQ ID NO: 1114344 - protein, 13 aa, Mycobacterium
VASTGQQVDVGAD

SEQ ID NO: 1114345 - protein, 10 aa, Mycobacterium
VASYQEKDAV

SEQ ID NO: 1114346 - protein, 13 aa, Mycobacterium
VATADDIDAMEVF

SEQ ID NO: 1114347 - protein, 19 aa, Mycobacterium
VATEANGEDPAPERDATGE

SEQ ID NO: 1114348 - protein, 13 aa, Mycobacterium
VATPEDPASSRLG

SEQ ID NO: 1114349 - protein, 6 aa, Mycobacterium
VATQKW

SEQ ID NO: 1114350 - protein, 8 aa, Mycobacterium
VATQSVSD

SEQ ID NO: 1114351 - protein, 9 aa, Mycobacterium
VATSPVTKN

SEQ ID NO: 1114352 - protein, 4 aa, Mycobacterium
VATT

SEQ ID NO: 1114353 - protein, 7 aa, Mycobacterium
VCGSPSV

SEQ ID NO: 1114354 - protein, 5 aa, Mycobacterium
VDAAG

SEQ ID NO: 1114355 - protein, 8 aa, Mycobacterium
VDAATGAD

SEQ ID NO: 1114356 - protein, 10 aa, Mycobacterium
VDADPPPRDE

SEQ ID NO: 1114357 - protein, 15 aa, Mycobacterium
VDAGQPPDNAGPRAE

SEQ ID NO: 1114358 - protein, 8 aa, Mycobacterium
VDAPVTDT

SEQ ID NO: 1114359 - protein, 6 aa, Mycobacterium
VDARSD

SEQ ID NO: 1114360 - protein, 7 aa, Mycobacterium
VDDAEDF

SEQ ID NO: 1114361 - protein, 13 aa, Mycobacterium
VDDDSGGKREQGD

SEQ ID NO: 1114362 - protein, 16 aa, Mycobacterium
VDDIGAAAGKATAKAA

SEQ ID NO: 1114363 - protein, 5 aa, Mycobacterium
VDDNT

SEQ ID NO: 1114364 - protein, 13 aa, Mycobacterium
VDDPAEGPAAAAA

SEQ ID NO: 1114365 - protein, 13 aa, Mycobacterium
VDDPAPPPSGAGF

SEQ ID NO: 1114366 - protein, 7 aa, Mycobacterium
VDDPHLK

SEQ ID NO: 1114367 - protein, 9 aa, Mycobacterium
VDEKGAEFN

SEQ ID NO: 1114368 - protein, 26 aa, Mycobacterium
VDESSLTGESLPVPKQTDPTPGAPLA

SEQ ID NO: 1114369 - protein, 9 aa, Mycobacterium
VDGAGAGEL

SEQ ID NO: 1114370 - protein, 11 aa, Mycobacterium
VDGAGARTSLT

SEQ ID NO: 1114371 - protein, 4 aa, Mycobacterium
VDGC

SEQ ID NO: 1114372 - protein, 5 aa, Mycobacterium
VDGDG

SEQ ID NO: 1114373 - protein, 22 aa, Mycobacterium
VDGGAAQQSPALAAGGPDRRKT

SEQ ID NO: 1114374 - protein, 10 aa, Mycobacterium
VDGKPLNEPY

SEQ ID NO: 1114375 - protein, 5 aa, Mycobacterium
VDGPS

SEQ ID NO: 1114376 - protein, 4 aa, Mycobacterium
VDGR

SEQ ID NO: 1114377 - protein, 17 aa, Mycobacterium
VDGRAPKRLAEGKFDLS

SEQ ID NO: 1114378 - protein, 16 aa, Mycobacterium
VDGSDGSDGSGGDAKA

SEQ ID NO: 1114379 - protein, 6 aa, Mycobacterium
VDGWTG

SEQ ID NO: 1114380 - protein, 23 aa, Mycobacterium
VDHAGSDTHSHDTHGHDGHGGDH

SEQ ID NO: 1114381 - protein, 10 aa, Mycobacterium
VDINRKPNNH

SEQ ID NO: 1114382 - protein, 5 aa, Mycobacterium
VDLPP

SEQ ID NO: 1114383 - protein, 12 aa, Mycobacterium
VDNARRAREAAQ

SEQ ID NO: 1114384 - protein, 4 aa, Mycobacterium
VDNI

SEQ ID NO: 1114385 - protein, 8 aa, Mycobacterium
VDPAATGM

SEQ ID NO: 1114386 - protein, 26 aa, Mycobacterium
VDPDPGPPAVQLPPGVAPGPGPAPHA

SEQ ID NO: 1114387 - protein, 27 aa, Mycobacterium
VDPDPGPPSVQLPPGVAPGPGPAPHAP

SEQ ID NO: 1114388 - protein, 7 aa, Mycobacterium
VDPEENR

SEQ ID NO: 1114389 - protein, 10 aa, Mycobacterium
VDPNGVPGPR

SEQ ID NO: 1114390 - protein, 18 aa, Mycobacterium
VDPPQRSDRLDDQGNGDL

SEQ ID NO: 1114391 - protein, 16 aa, Mycobacterium
VDPQQQHQLNDGAPFQ

SEQ ID NO: 1114392 - protein, 12 aa, Mycobacterium
VDPSGGARYEVR

SEQ ID NO: 1114393 - protein, 5 aa, Mycobacterium
VDPTQ

SEQ ID NO: 1114394 - protein, 7 aa, Mycobacterium
VDQDGRE

SEQ ID NO: 1114395 - protein, 8 aa, Mycobacterium
VDQPDKPS

SEQ ID NO: 1114396 - protein, 4 aa, Mycobacterium
VDQV

SEQ ID NO: 1114397 - protein, 8 aa, Mycobacterium
VDRAEQVA

SEQ ID NO: 1114398 - protein, 6 aa, Mycobacterium
VDSPTA

SEQ ID NO: 1114399 - protein, 15 aa, Mycobacterium
VDSSDPTTPTPGNVP

SEQ ID NO: 1114400 - protein, 42 aa, Mycobacterium
VDSTDEADDVDEAAAGREPGDDDKAEADSGAATTKPPTRRPV

SEQ ID NO: 1114401 - protein, 7 aa, Mycobacterium
VDSTGSM

SEQ ID NO: 1114402 - protein, 7 aa, Mycobacterium
VDSTRQQ

SEQ ID NO: 1114403 - protein, 29 aa, Mycobacterium
VDTAEPHPVTDGTAGWNQPDAAGEPTRRR

SEQ ID NO: 1114404 - protein, 14 aa, Mycobacterium
VDTAREQVAAQGPR

SEQ ID NO: 1114405 - protein, 13 aa, Mycobacterium
VDTGSDLPPLDDA

SEQ ID NO: 1114406 - protein, 5 aa, Mycobacterium
VDTGT

SEQ ID NO: 1114407 - protein, 4 aa, Mycobacterium
VDTP

SEQ ID NO: 1114408 - protein, 6 aa, Mycobacterium
VDTSRR

SEQ ID NO: 1114409 - protein, 6 aa, Mycobacterium
VDTTRQ

SEQ ID NO: 1114410 - protein, 11 aa, Mycobacterium
VEAATPPDRDR

SEQ ID NO: 1114411 - protein, 6 aa, Mycobacterium
VEATQS

SEQ ID NO: 1114412 - protein, 22 aa, Mycobacterium
VEDAKAAGAKVTEEAQQDSQRI

SEQ ID NO: 1114413 - protein, 10 aa, Mycobacterium
VEDATDLPRS

SEQ ID NO: 1114414 - protein, 17 aa, Mycobacterium
VEDDDDGTLDEAESSAV

SEQ ID NO: 1114415 - protein, 16 aa, Mycobacterium
VEDGAPSELIGRGGGR

SEQ ID NO: 1114416 - protein, 5 aa, Mycobacterium
VEDGD

SEQ ID NO: 1114417 - protein, 6 aa, Mycobacterium
VEDPPR

SEQ ID NO: 1114418 - protein, 4 aa, Mycobacterium
VEEF

SEQ ID NO: 1114419 - protein, 5 aa, Mycobacterium
VEEQG

SEQ ID NO: 1114420 - protein, 43 aa, Mycobacterium
VEETEAKARAAQAEAEAKAAEAARLAETASSRRDALNSSQQHL

SEQ ID NO: 1114421 - protein, 47 aa, Mycobacterium
VEGEAEAEELASDVEGAPEPEGVEAAEAEAESPVDGAEAEAESEVVE

SEQ ID NO: 1114422 - protein, 44 aa, Mycobacterium
VEGEAEAEELASDVEGAPEPEGVEAAEAEAESPVDGAEAESEVV

SEQ ID NO: 1114423 - protein, 19 aa, Mycobacterium
VEGEDAVAAEESAAEAHEA

SEQ ID NO: 1114424 - protein, 28 aa, Mycobacterium
VEGEDAVAAEESAEEAHEAAVEGAEEAE

SEQ ID NO: 1114425 - protein, 5 aa, Mycobacterium
VEGKG

SEQ ID NO: 1114426 - protein, 15 aa, Mycobacterium
VEIDTDEDLTETEIE

SEQ ID NO: 1114427 - protein, 8 aa, Mycobacterium
VEKGKLDR

SEQ ID NO: 1114428 - protein, 13 aa, Mycobacterium
VEKGPAAEGEPTP

SEQ ID NO: 1114429 - protein, 33 aa, Mycobacterium
VELPPPSSAPVTTTQPTTSPAPAVTVPPTTITS

SEQ ID NO: 1114430 - protein, 7 aa, Mycobacterium
VENPNSL

SEQ ID NO: 1114431 - protein, 12 aa, Mycobacterium
VENTSDRDFDVT

SEQ ID NO: 1114432 - protein, 6 aa, Mycobacterium
VEPAEL

SEQ ID NO: 1114433 - protein, 12 aa, Mycobacterium
VEPDRDHVRGRY

SEQ ID NO: 1114434 - protein, 13 aa, Mycobacterium
VEPIPDAERSARP

SEQ ID NO: 1114435 - protein, 5 aa, Mycobacterium
VEPRR

SEQ ID NO: 1114436 - protein, 10 aa, Mycobacterium
VEPSSGNTVE

SEQ ID NO: 1114437 - protein, 4 aa, Mycobacterium
VEQG

SEQ ID NO: 1114438 - protein, 13 aa, Mycobacterium
VERAPLPPEPQLA

SEQ ID NO: 1114439 - protein, 13 aa, Mycobacterium
VERDAAPTPVPEA

SEQ ID NO: 1114440 - protein, 7 aa, Mycobacterium
VERDTTR

SEQ ID NO: 1114441 - protein, 8 aa, Mycobacterium
VEREARED

SEQ ID NO: 1114442 - protein, 54 aa, Mycobacterium
VEREEAAEERAAEAEADDASEPQPEEAADTEPAADGAVTRVESRSVATESQSGG

SEQ ID NO: 1114443 - protein, 9 aa, Mycobacterium
VERRNEDGT

SEQ ID NO: 1114444 - protein, 15 aa, Mycobacterium
VERTEEAMDTASTIA

SEQ ID NO: 1114445 - protein, 7 aa, Mycobacterium
VERTEPA

SEQ ID NO: 1114446 - protein, 11 aa, Mycobacterium
VESAAAAGDNY

SEQ ID NO: 1114447 - protein, 5 aa, Mycobacterium
VESAE

SEQ ID NO: 1114448 - protein, 9 aa, Mycobacterium
VESDTRHGG

SEQ ID NO: 1114449 - protein, 5 aa, Mycobacterium
VESGR

SEQ ID NO: 1114450 - protein, 7 aa, Mycobacterium
VESPANA

SEQ ID NO: 1114451 - protein, 7 aa, Mycobacterium
VETEGCG

SEQ ID NO: 1114452 - protein, 11 aa, Mycobacterium
VETGDAASGFR

SEQ ID NO: 1114453 - protein, 4 aa, Mycobacterium
VETR

SEQ ID NO: 1114454 - protein, 18 aa, Mycobacterium
VETSIGSYGPVDGISGDG

SEQ ID NO: 1114455 - protein, 11 aa, Mycobacterium
VEVDPDATPGL

SEQ ID NO: 1114456 - protein, 7 aa, Mycobacterium
VEVTDSG

SEQ ID NO: 1114457 - protein, 10 aa, Mycobacterium
VGAAAAAATE

SEQ ID NO: 1114458 - protein, 5 aa, Mycobacterium
VGAAD

SEQ ID NO: 1114459 - protein, 8 aa, Mycobacterium
VGAAPSGD

SEQ ID NO: 1114460 - protein, 13 aa, Mycobacterium
VGADGNPSLPGAS

SEQ ID NO: 1114461 - protein, 5 aa, Mycobacterium
VGADT

SEQ ID NO: 1114462 - protein, 13 aa, Mycobacterium
VGAGDPDSDRGTE

SEQ ID NO: 1114463 - protein, 5 aa, Mycobacterium
VGARG

SEQ ID NO: 1114464 - protein, 12 aa, Mycobacterium
VGARPARSTTPV

SEQ ID NO: 1114465 - protein, 9 aa, Mycobacterium
VGARPTHGP

SEQ ID NO: 1114466 - protein, 10 aa, Mycobacterium
VGASEAARAG

SEQ ID NO: 1114467 - protein, 11 aa, Mycobacterium
VGATSLAGAAS

SEQ ID NO: 1114468 - protein, 9 aa, Mycobacterium
VGDAAAARA

SEQ ID NO: 1114469 - protein, 8 aa, Mycobacterium
VGDDESTV

SEQ ID NO: 1114470 - protein, 14 aa, Mycobacterium
VGDDLPGETSPASW

SEQ ID NO: 1114471 - protein, 13 aa, Mycobacterium
VGDEAAADRTGRI

SEQ ID NO: 1114472 - protein, 11 aa, Mycobacterium
VGDEGQLPSSL

SEQ ID NO: 1114473 - protein, 7 aa, Mycobacterium
VGDGDTL

SEQ ID NO: 1114474 - protein, 10 aa, Mycobacterium
VGEAGRAAAD

SEQ ID NO: 1114475 - protein, 12 aa, Mycobacterium
VGEAPEPPGPQI

SEQ ID NO: 1114476 - protein, 6 aa, Mycobacterium
VGEEHT

SEQ ID NO: 1114477 - protein, 7 aa, Mycobacterium
VGEPPCA

SEQ ID NO: 1114478 - protein, 6 aa, Mycobacterium
VGETGN

SEQ ID NO: 1114479 - protein, 9 aa, Mycobacterium
VGFSPEDTA

SEQ ID NO: 1114480 - protein, 5 aa, Mycobacterium
VGGAA

SEQ ID NO: 1114481 - protein, 11 aa, Mycobacterium
VGGATSSSSNT

SEQ ID NO: 1114482 - protein, 9 aa, Mycobacterium
VGGDGSASP

SEQ ID NO: 1114483 - protein, 17 aa, Mycobacterium
VGGDTTATLTSDADTAA

SEQ ID NO: 1114484 - protein, 8 aa, Mycobacterium
VGGEPARD

SEQ ID NO: 1114485 - protein, 12 aa, Mycobacterium
VGGGPQGVGNAV

SEQ ID NO: 1114486 - protein, 9 aa, Mycobacterium
VGGGPVGVG

SEQ ID NO: 1114487 - protein, 13 aa, Mycobacterium
VGGGVDPAQTAAV

SEQ ID NO: 1114488 - protein, 12 aa, Mycobacterium
VGGNTNNPIYNS

SEQ ID NO: 1114489 - protein, 18 aa, Mycobacterium
VGGSDATARDAASAAAHD

SEQ ID NO: 1114490 - protein, 8 aa, Mycobacterium
VGGSGPLT

SEQ ID NO: 1114491 - protein, 16 aa, Mycobacterium
VGGSGSIRSAPAQGTV

SEQ ID NO: 1114492 - protein, 5 aa, Mycobacterium
VGGTA

SEQ ID NO: 1114493 - protein, 8 aa, Mycobacterium
VGKDSPRT

SEQ ID NO: 1114494 - protein, 7 aa, Mycobacterium
VGKGTEI

SEQ ID NO: 1114495 - protein, 17 aa, Mycobacterium
VGLPKPEVGLPKPAVEL

SEQ ID NO: 1114496 - protein, 4 aa, Mycobacterium
VGPD

SEQ ID NO: 1114497 - protein, 12 aa, Mycobacterium
VGPDGLGNSPEH

SEQ ID NO: 1114498 - protein, 6 aa, Mycobacterium
VGPDGR

SEQ ID NO: 1114499 - protein, 12 aa, Mycobacterium
VGPDGVNNSTDV

SEQ ID NO: 1114500 - protein, 11 aa, Mycobacterium
VGPGSVPDASG

SEQ ID NO: 1114501 - protein, 7 aa, Mycobacterium
VGPLRPD

SEQ ID NO: 1114502 - protein, 17 aa, Mycobacterium
VGPLSEPVDGAPRKEAL

SEQ ID NO: 1114503 - protein, 14 aa, Mycobacterium
VGPPPPPQDTSGPQ

SEQ ID NO: 1114504 - protein, 4 aa, Mycobacterium
VGQG

SEQ ID NO: 1114505 - protein, 12 aa, Mycobacterium
VGQQDEDPEEPV

SEQ ID NO: 1114506 - protein, 5 aa, Mycobacterium
VGQQQ

SEQ ID NO: 1114507 - protein, 13 aa, Mycobacterium
VGQSTKVSDVEFL

SEQ ID NO: 1114508 - protein, 7 aa, Mycobacterium
VGRGGGG

SEQ ID NO: 1114509 - protein, 7 aa, Mycobacterium
VGRNTGV

SEQ ID NO: 1114510 - protein, 14 aa, Mycobacterium
VGRPPGGGHLNRSC

SEQ ID NO: 1114511 - protein, 19 aa, Mycobacterium
VGRQRGAGMGGGHDEREQT

SEQ ID NO: 1114512 - protein, 32 aa, Mycobacterium
VGRRNAQQSATAGGCGGSGGGSGCGTCTLSCD

SEQ ID NO: 1114513 - protein, 4 aa, Mycobacterium
VGRS

SEQ ID NO: 1114514 - protein, 8 aa, Mycobacterium
VGRSAGAG

SEQ ID NO: 1114515 - protein, 14 aa, Mycobacterium
VGRSAGEEKQPAIG

SEQ ID NO: 1114516 - protein, 12 aa, Mycobacterium
VGSAAGRARRRD

SEQ ID NO: 1114517 - protein, 7 aa, Mycobacterium
VGSDITA

SEQ ID NO: 1114518 - protein, 14 aa, Mycobacterium
VGSDPAKDASVASP

SEQ ID NO: 1114519 - protein, 16 aa, Mycobacterium
VGSELAGPAGAPQPHL

SEQ ID NO: 1114520 - protein, 5 aa, Mycobacterium
VGSEQ

SEQ ID NO: 1114521 - protein, 7 aa, Mycobacterium
VGSGPGF

SEQ ID NO: 1114522 - protein, 5 aa, Mycobacterium
VGSNT

SEQ ID NO: 1114523 - protein, 9 aa, Mycobacterium
VGSTADVAE

SEQ ID NO: 1114524 - protein, 6 aa, Mycobacterium
VGTAEY

SEQ ID NO: 1114525 - protein, 8 aa, Mycobacterium
VGTDGNDA

SEQ ID NO: 1114526 - protein, 7 aa, Mycobacterium
VGTDSPP

SEQ ID NO: 1114527 - protein, 10 aa, Mycobacterium
VGTEKSGAAQ

SEQ ID NO: 1114528 - protein, 6 aa, Mycobacterium
VGVPGA

SEQ ID NO: 1114529 - protein, 4 aa, Mycobacterium
VGYD

SEQ ID NO: 1114530 - protein, 7 aa, Mycobacterium
VGYDAEG

SEQ ID NO: 1114531 - protein, 4 aa, Mycobacterium
VGYR

SEQ ID NO: 1114532 - protein, 13 aa, Mycobacterium
VHAPAPSHAPAQV

SEQ ID NO: 1114533 - protein, 8 aa, Mycobacterium
VHEPRRDL

SEQ ID NO: 1114534 - protein, 11 aa, Mycobacterium
VHGDNDAGRLA

SEQ ID NO: 1114535 - protein, 7 aa, Mycobacterium
VHGGTGR

SEQ ID NO: 1114536 - protein, 24 aa, Mycobacterium
VHTPAGTTVTTTVSKGTAADGTGY

SEQ ID NO: 1114537 - protein, 7 aa, Mycobacterium
VIPGDGD

SEQ ID NO: 1114538 - protein, 15 aa, Mycobacterium
VKAGERKDVDPDIGD

SEQ ID NO: 1114539 - protein, 9 aa, Mycobacterium
VKDRGRFAG

SEQ ID NO: 1114540 - protein, 9 aa, Mycobacterium
VKDSHPDMR

SEQ ID NO: 1114541 - protein, 12 aa, Mycobacterium
VKGGPKGVGNAV

SEQ ID NO: 1114542 - protein, 7 aa, Mycobacterium
VKGSGSG

SEQ ID NO: 1114543 - protein, 9 aa, Mycobacterium
VKGTSADAI

SEQ ID NO: 1114544 - protein, 8 aa, Mycobacterium
VKKGEPGL

SEQ ID NO: 1114545 - protein, 12 aa, Mycobacterium
VKKPPTKLREVR

SEQ ID NO: 1114546 - protein, 16 aa, Mycobacterium
VKPAGQPQASDRLKGG

SEQ ID NO: 1114547 - protein, 9 aa, Mycobacterium
VKPAGSEQV

SEQ ID NO: 1114548 - protein, 27 aa, Mycobacterium
VKPAPVKAAPPEPEAAPPPPAAPPVAE

SEQ ID NO: 1114549 - protein, 9 aa, Mycobacterium
VKPASAQAI

SEQ ID NO: 1114550 - protein, 6 aa, Mycobacterium
VKPGLE

SEQ ID NO: 1114551 - protein, 8 aa, Mycobacterium
VKPTSAEA

SEQ ID NO: 1114552 - protein, 6 aa, Mycobacterium
VKPVDS

SEQ ID NO: 1114553 - protein, 7 aa, Mycobacterium
VKPVDSE

SEQ ID NO: 1114554 - protein, 11 aa, Mycobacterium
VKQGNSGGPMI

SEQ ID NO: 1114555 - protein, 11 aa, Mycobacterium
VKRGEATNGGV

SEQ ID NO: 1114556 - protein, 13 aa, Mycobacterium
VKRQTGADQIKTT

SEQ ID NO: 1114557 - protein, 9 aa, Mycobacterium
VKRTSADAI

SEQ ID NO: 1114558 - protein, 9 aa, Mycobacterium
VKSASAQAI

SEQ ID NO: 1114559 - protein, 7 aa, Mycobacterium
VKTNAVT

SEQ ID NO: 1114560 - protein, 15 aa, Mycobacterium
VLPPPPAPLPPPPPG

SEQ ID NO: 1114561 - protein, 5 aa, Mycobacterium
VNAGG

SEQ ID NO: 1114562 - protein, 24 aa, Mycobacterium
VNAPATPTTATAAPPPLPSQAPLR

SEQ ID NO: 1114563 - protein, 8 aa, Mycobacterium
VNATEPVA

SEQ ID NO: 1114564 - protein, 6 aa, Mycobacterium
VNDAPA

SEQ ID NO: 1114565 - protein, 23 aa, Mycobacterium
VNDETDPDFAAPDSDLRSGGPQS

SEQ ID NO: 1114566 - protein, 11 aa, Mycobacterium
VNDQRGHAAGD

SEQ ID NO: 1114567 - protein, 7 aa, Mycobacterium
VNEAARL

SEQ ID NO: 1114568 - protein, 10 aa, Mycobacterium
VNEDGTATVT

SEQ ID NO: 1114569 - protein, 5 aa, Mycobacterium
VNGDR

SEQ ID NO: 1114570 - protein, 5 aa, Mycobacterium
VNGPW

SEQ ID NO: 1114571 - protein, 6 aa, Mycobacterium
VNGTGT

SEQ ID NO: 1114572 - protein, 5 aa, Mycobacterium
VNGTS

SEQ ID NO: 1114573 - protein, 14 aa, Mycobacterium
VNPGWQARGSGGDL

SEQ ID NO: 1114574 - protein, 8 aa, Mycobacterium
VNQLPDGA

SEQ ID NO: 1114575 - protein, 11 aa, Mycobacterium
VNRGAPDGPIR

SEQ ID NO: 1114576 - protein, 5 aa, Mycobacterium
VNRGV

SEQ ID NO: 1114577 - protein, 5 aa, Mycobacterium
VPAAA

SEQ ID NO: 1114578 - protein, 13 aa, Mycobacterium
VPAAASVSATPTE

SEQ ID NO: 1114579 - protein, 11 aa, Mycobacterium
VPAEAPAGSAL

SEQ ID NO: 1114580 - protein, 7 aa, Mycobacterium
VPAGGED

SEQ ID NO: 1114581 - protein, 9 aa, Mycobacterium
VPAGPPAPR

SEQ ID NO: 1114582 - protein, 5 aa, Mycobacterium
VPAGR

SEQ ID NO: 1114583 - protein, 10 aa, Mycobacterium
VPAGSTATLG

SEQ ID NO: 1114584 - protein, 10 aa, Mycobacterium
VPANRPRVQG

SEQ ID NO: 1114585 - protein, 6 aa, Mycobacterium
VPANVG

SEQ ID NO: 1114586 - protein, 9 aa, Mycobacterium
VPAPDRDLT

SEQ ID NO: 1114587 - protein, 12 aa, Mycobacterium
VPAPDTTVPAPE

SEQ ID NO: 1114588 - protein, 6 aa, Mycobacterium
VPAPVV

SEQ ID NO: 1114589 - protein, 5 aa, Mycobacterium
VPASR

SEQ ID NO: 1114590 - protein, 10 aa, Mycobacterium
VPATDTAGAH

SEQ ID NO: 1114591 - protein, 10 aa, Mycobacterium
VPATPYPEGI

SEQ ID NO: 1114592 - protein, 6 aa, Mycobacterium
VPDAGV

SEQ ID NO: 1114593 - protein, 8 aa, Mycobacterium
VPDDPAPY

SEQ ID NO: 1114594 - protein, 11 aa, Mycobacterium
VPDNGSDPVDN

SEQ ID NO: 1114595 - protein, 16 aa, Mycobacterium
VPDSVGTDFTPAPLQT

SEQ ID NO: 1114596 - protein, 12 aa, Mycobacterium
VPEAGEKPETTE

SEQ ID NO: 1114597 - protein, 6 aa, Mycobacterium
VPEAQA

SEQ ID NO: 1114598 - protein, 9 aa, Mycobacterium
VPEDDKGLM

SEQ ID NO: 1114599 - protein, 5 aa, Mycobacterium
VPEED

SEQ ID NO: 1114600 - protein, 5 aa, Mycobacterium
VPEGT

SEQ ID NO: 1114601 - protein, 6 aa, Mycobacterium
VPENAA

SEQ ID NO: 1114602 - protein, 25 aa, Mycobacterium
VPEPPSIRGEGPPAPGPAPAPGPLP

SEQ ID NO: 1114603 - protein, 35 aa, Mycobacterium
VPEPPSLRGMGPPAIGPVPYPGSPPYGGSLYGPDG

SEQ ID NO: 1114604 - protein, 37 aa, Mycobacterium
VPEQPSPTTAPARAAPSTAEPSPPAPAAKAGSDTKAS

SEQ ID NO: 1114605 - protein, 7 aa, Mycobacterium
VPETPMQ

SEQ ID NO: 1114606 - protein, 25 aa, Mycobacterium
VPGAEPPQAPPQSQSQASENSESSG

SEQ ID NO: 1114607 - protein, 9 aa, Mycobacterium
VPGAGPDQE

SEQ ID NO: 1114608 - protein, 8 aa, Mycobacterium
VPGDGREE

SEQ ID NO: 1114609 - protein, 5 aa, Mycobacterium
VPGDQ

SEQ ID NO: 1114610 - protein, 6 aa, Mycobacterium
VPGGGF

SEQ ID NO: 1114611 - protein, 11 aa, Mycobacterium
VPGGGSKPHYG

SEQ ID NO: 1114612 - protein, 9 aa, Mycobacterium
VPGHGDATA

SEQ ID NO: 1114613 - protein, 20 aa, Mycobacterium
VPGKRAATPKECRSDEPYVP

SEQ ID NO: 1114614 - protein, 11 aa, Mycobacterium
VPGPDGSIGCG

SEQ ID NO: 1114615 - protein, 10 aa, Mycobacterium
VPGPPPGSAV

SEQ ID NO: 1114616 - protein, 10 aa, Mycobacterium
VPGQRPDSAL

SEQ ID NO: 1114617 - protein, 4 aa, Mycobacterium
VPGR

SEQ ID NO: 1114618 - protein, 9 aa, Mycobacterium
VPGSDSGIA

SEQ ID NO: 1114619 - protein, 10 aa, Mycobacterium
VPGSGPESVS

SEQ ID NO: 1114620 - protein, 17 aa, Mycobacterium
VPGSGRLHRSGSMPQPL

SEQ ID NO: 1114621 - protein, 8 aa, Mycobacterium
VPGSKGYG

SEQ ID NO: 1114622 - protein, 7 aa, Mycobacterium
VPGVARG

SEQ ID NO: 1114623 - protein, 10 aa, Mycobacterium
VPKAPDSPEV

SEQ ID NO: 1114624 - protein, 6 aa, Mycobacterium
VPKTTR

SEQ ID NO: 1114625 - protein, 11 aa, Mycobacterium
VPLGGDTTASI

SEQ ID NO: 1114626 - protein, 10 aa, Mycobacterium
VPMQPASTNK

SEQ ID NO: 1114627 - protein, 7 aa, Mycobacterium
VPNPRAD

SEQ ID NO: 1114628 - protein, 4 aa, Mycobacterium
VPPA

SEQ ID NO: 1114629 - protein, 6 aa, Mycobacterium
VPPALS

SEQ ID NO: 1114630 - protein, 13 aa, Mycobacterium
VPPANPSPDPLRA

SEQ ID NO: 1114631 - protein, 19 aa, Mycobacterium
VPPAQQPAYVPPAPQQPRL

SEQ ID NO: 1114632 - protein, 10 aa, Mycobacterium
VPPDARNGLA

SEQ ID NO: 1114633 - protein, 25 aa, Mycobacterium
VPPEGDSDSASEALDSAVPPDTTRP

SEQ ID NO: 1114634 - protein, 8 aa, Mycobacterium
VPPEGNRV

SEQ ID NO: 1114635 - protein, 6 aa, Mycobacterium
VPPERL

SEQ ID NO: 1114636 - protein, 9 aa, Mycobacterium
VPPGPADIP

SEQ ID NO: 1114637 - protein, 18 aa, Mycobacterium
VPPGWKPGSKAAPAPELP

SEQ ID NO: 1114638 - protein, 12 aa, Mycobacterium
VPPLKGGDAAGI

SEQ ID NO: 1114639 - protein, 13 aa, Mycobacterium
VPPNEQGPPPPPW

SEQ ID NO: 1114640 - protein, 29 aa, Mycobacterium
VPPPAPASEPPPPDGGWSAAGYGAPPPVV

SEQ ID NO: 1114641 - protein, 29 aa, Mycobacterium
VPPPAPVSEPPPPDGGWSAAGYGGPPPVV

SEQ ID NO: 1114642 - protein, 9 aa, Mycobacterium
VPPPDRSPI

SEQ ID NO: 1114643 - protein, 12 aa, Mycobacterium
VPPPGVEPEART

SEQ ID NO: 1114644 - protein, 36 aa, Mycobacterium
VPPPPEPPHDDEEFPPPDDESGPSSGPPTTVNPITN

SEQ ID NO: 1114645 - protein, 8 aa, Mycobacterium
VPPPQPGT

SEQ ID NO: 1114646 - protein, 7 aa, Mycobacterium
VPPRPHA

SEQ ID NO: 1114647 - protein, 9 aa, Mycobacterium
VPPSDPGVP

SEQ ID NO: 1114648 - protein, 12 aa, Mycobacterium
VPPSERGAASGV

SEQ ID NO: 1114649 - protein, 18 aa, Mycobacterium
VPPTGPTQLSAGKAAALQ

SEQ ID NO: 1114650 - protein, 48 aa, Mycobacterium
VPPYGRPPLAPPPAPPAPAPAPAEGSPALPAEAPLASGTSVATYDQNG

SEQ ID NO: 1114651 - protein, 56 aa, Mycobacterium
VPQAPSNPYYPPSSSGGGSGPSRGDYGSGSGSGSYDGGGSSGGEDSVWPFPSFGGG

SEQ ID NO: 1114652 - protein, 56 aa, Mycobacterium
VPQPPVPLSPPAPVAPKPGDPPPPPAAPPVSGPAPLPAEAAPAGYGGNVGPVGSRH

SEQ ID NO: 1114653 - protein, 13 aa, Mycobacterium
VPQTGPDDSRPLE

SEQ ID NO: 1114654 - protein, 6 aa, Mycobacterium
VPSGDL

SEQ ID NO: 1114655 - protein, 8 aa, Mycobacterium
VPSGNSTD

SEQ ID NO: 1114656 - protein, 9 aa, Mycobacterium
VPSPPQPIP

SEQ ID NO: 1114657 - protein, 12 aa, Mycobacterium
VPSPVPVPSPVP

SEQ ID NO: 1114658 - protein, 13 aa, Mycobacterium
VPSSAARLTERSR

SEQ ID NO: 1114659 - protein, 13 aa, Mycobacterium
VPSSKPHKPETQP

SEQ ID NO: 1114660 - protein, 7 aa, Mycobacterium
VPSTLDG

SEQ ID NO: 1114661 - protein, 8 aa, Mycobacterium
VPTAEGPK

SEQ ID NO: 1114662 - protein, 5 aa, Mycobacterium
VPTEQ

SEQ ID NO: 1114663 - protein, 18 aa, Mycobacterium
VPTEQTQTVETFSPDDAG

SEQ ID NO: 1114664 - protein, 13 aa, Mycobacterium
VPTGGPGEGTPAP

SEQ ID NO: 1114665 - protein, 11 aa, Mycobacterium
VPTGSTATLGR

SEQ ID NO: 1114666 - protein, 9 aa, Mycobacterium
VPTGTQDVD

SEQ ID NO: 1114667 - protein, 7 aa, Mycobacterium
VPTPPRA

SEQ ID NO: 1114668 - protein, 9 aa, Mycobacterium
VPTRPQVPT

SEQ ID NO: 1114669 - protein, 5 aa, Mycobacterium
VPTSA

SEQ ID NO: 1114670 - protein, 31 aa, Mycobacterium
VPVAPPAPAPLPAAPPAPVPAPIPAAPVPAP

SEQ ID NO: 1114671 - protein, 7 aa, Mycobacterium
VPVPGSG

SEQ ID NO: 1114672 - protein, 14 aa, Mycobacterium
VPVPSPAPVPQPVA

SEQ ID NO: 1114673 - protein, 8 aa, Mycobacterium
VPVSGESV

SEQ ID NO: 1114674 - protein, 7 aa, Mycobacterium
VQAGSQN

SEQ ID NO: 1114675 - protein, 11 aa, Mycobacterium
VQDTGRQLQNA

SEQ ID NO: 1114676 - protein, 6 aa, Mycobacterium
VQGAAG

SEQ ID NO: 1114677 - protein, 22 aa, Mycobacterium
VQGAAGGIRSGLSSGSRSTAAA

SEQ ID NO: 1114678 - protein, 8 aa, Mycobacterium
VQGDPTEA

SEQ ID NO: 1114679 - protein, 4 aa, Mycobacterium
VQGS

SEQ ID NO: 1114680 - protein, 6 aa, Mycobacterium
VQGVNA

SEQ ID NO: 1114681 - protein, 9 aa, Mycobacterium
VQKKQQDWH

SEQ ID NO: 1114682 - protein, 6 aa, Mycobacterium
VQPGAN

SEQ ID NO: 1114683 - protein, 36 aa, Mycobacterium
VQPPNADPDKAEAGTEAPDTADSDRGLETKPEPEVK

SEQ ID NO: 1114684 - protein, 10 aa, Mycobacterium
VQPSEDPSTN

SEQ ID NO: 1114685 - protein, 6 aa, Mycobacterium
VQSPPL

SEQ ID NO: 1114686 - protein, 8 aa, Mycobacterium
VQSTQEGV

SEQ ID NO: 1114687 - protein, 16 aa, Mycobacterium
VRAAESAQAEAEKAYS

SEQ ID NO: 1114688 - protein, 11 aa, Mycobacterium
VRADPATRTPL

SEQ ID NO: 1114689 - protein, 5 aa, Mycobacterium
VRAGR

SEQ ID NO: 1114690 - protein, 26 aa, Mycobacterium
VRAGRAKPLPLAPADQPATAHTAAAP

SEQ ID NO: 1114691 - protein, 26 aa, Mycobacterium
VRAGRAKPLPLAPTGQPATAHVAAAP

SEQ ID NO: 1114692 - protein, 23 aa, Mycobacterium
VRASADSAFAGSSSTVHVTGPAA

SEQ ID NO: 1114693 - protein, 28 aa, Mycobacterium
VRATEPEPEPEPEAAPEQDLDDAETGPI

SEQ ID NO: 1114694 - protein, 8 aa, Mycobacterium
VRDAGRAG

SEQ ID NO: 1114695 - protein, 9 aa, Mycobacterium
VRDAPKGID

SEQ ID NO: 1114696 - protein, 9 aa, Mycobacterium
VRDPAEDQA

SEQ ID NO: 1114697 - protein, 12 aa, Mycobacterium
VRDPEGRPLRDG

SEQ ID NO: 1114698 - protein, 6 aa, Mycobacterium
VRDPRN

SEQ ID NO: 1114699 - protein, 15 aa, Mycobacterium
VRDQQNRAEFAAAGK

SEQ ID NO: 1114700 - protein, 5 aa, Mycobacterium
VREPR

SEQ ID NO: 1114701 - protein, 6 aa, Mycobacterium
VREQPE

SEQ ID NO: 1114702 - protein, 5 aa, Mycobacterium
VRETP

SEQ ID NO: 1114703 - protein, 31 aa, Mycobacterium
VRGDAGSSARRAISGCGGAGFAARGGNHTLV

SEQ ID NO: 1114704 - protein, 12 aa, Mycobacterium
VRGGPAGVGNAV

SEQ ID NO: 1114705 - protein, 11 aa, Mycobacterium
VRGPGSSRGWR

SEQ ID NO: 1114706 - protein, 9 aa, Mycobacterium
VRGQASADA

SEQ ID NO: 1114707 - protein, 6 aa, Mycobacterium
VRGQPG

SEQ ID NO: 1114708 - protein, 6 aa, Mycobacterium
VRGSYP

SEQ ID NO: 1114709 - protein, 10 aa, Mycobacterium
VRKGERAAES

SEQ ID NO: 1114710 - protein, 9 aa, Mycobacterium
VRKPDGTQL

SEQ ID NO: 1114711 - protein, 7 aa, Mycobacterium
VRPDQKR

SEQ ID NO: 1114712 - protein, 12 aa, Mycobacterium
VRPGDPGSVDPE

SEQ ID NO: 1114713 - protein, 10 aa, Mycobacterium
VRPGGPAGDY

SEQ ID NO: 1114714 - protein, 7 aa, Mycobacterium
VRPPNAS

SEQ ID NO: 1114715 - protein, 8 aa, Mycobacterium
VRPQPVPI

SEQ ID NO: 1114716 - protein, 6 aa, Mycobacterium
VRPSDI

SEQ ID NO: 1114717 - protein, 5 aa, Mycobacterium
VRPTS

SEQ ID NO: 1114718 - protein, 9 aa, Mycobacterium
VRQSDSEAE

SEQ ID NO: 1114719 - protein, 6 aa, Mycobacterium
VRRAGP

SEQ ID NO: 1114720 - protein, 11 aa, Mycobacterium
VRRDPDHELRR

SEQ ID NO: 1114721 - protein, 10 aa, Mycobacterium
VRRGGAEQRI

SEQ ID NO: 1114722 - protein, 10 aa, Mycobacterium
VRRGNEYPPL

SEQ ID NO: 1114723 - protein, 8 aa, Mycobacterium
VRRPDGTP

SEQ ID NO: 1114724 - protein, 15 aa, Mycobacterium
VRRSDGDGPRRHRRP

SEQ ID NO: 1114725 - protein, 12 aa, Mycobacterium
VRRSGRPGSVAQ

SEQ ID NO: 1114726 - protein, 8 aa, Mycobacterium
VRRTTDEQ

SEQ ID NO: 1114727 - protein, 10 aa, Mycobacterium
VRRYTSRANH

SEQ ID NO: 1114728 - protein, 9 aa, Mycobacterium
VRSDGKEFP

SEQ ID NO: 1114729 - protein, 5 aa, Mycobacterium
VRSEG

SEQ ID NO: 1114730 - protein, 13 aa, Mycobacterium
VRSGEITAPLGSN

SEQ ID NO: 1114731 - protein, 7 aa, Mycobacterium
VRSGGAR

SEQ ID NO: 1114732 - protein, 5 aa, Mycobacterium
VRSPS

SEQ ID NO: 1114733 - protein, 7 aa, Mycobacterium
VRTEQER

SEQ ID NO: 1114734 - protein, 5 aa, Mycobacterium
VRTPE

SEQ ID NO: 1114735 - protein, 8 aa, Mycobacterium
VRTTSVES

SEQ ID NO: 1114736 - protein, 7 aa, Mycobacterium
VSADGVA

SEQ ID NO: 1114737 - protein, 10 aa, Mycobacterium
VSAEPDGDRV

SEQ ID NO: 1114738 - protein, 13 aa, Mycobacterium
VSANDPSCDADPC

SEQ ID NO: 1114739 - protein, 5 aa, Mycobacterium
VSANT

SEQ ID NO: 1114740 - protein, 8 aa, Mycobacterium
VSAPDDAE

SEQ ID NO: 1114741 - protein, 21 aa, Mycobacterium
VSARSGETPASEQESEEAEES

SEQ ID NO: 1114742 - protein, 9 aa, Mycobacterium
VSDGPGGGA

SEQ ID NO: 1114743 - protein, 39 aa, Mycobacterium
VSDKPTSGSPGGPDSAATTRITRPSPDDFQPDVPEDAGT

SEQ ID NO: 1114744 - protein, 14 aa, Mycobacterium
VSDSADKPTPQGLT

SEQ ID NO: 1114745 - protein, 7 aa, Mycobacterium
VSEGRTV

SEQ ID NO: 1114746 - protein, 6 aa, Mycobacterium
VSEGTR

SEQ ID NO: 1114747 - protein, 13 aa, Mycobacterium
VSESTGRSVSEAN

SEQ ID NO: 1114748 - protein, 16 aa, Mycobacterium
VSGAPSRRVRETAGES

SEQ ID NO: 1114749 - protein, 30 aa, Mycobacterium
VSGDDDQSDPPNTAAGRASAFNPKRNAAKR

SEQ ID NO: 1114750 - protein, 6 aa, Mycobacterium
VSGDFG

SEQ ID NO: 1114751 - protein, 19 aa, Mycobacterium
VSGDNAGQPQRTGYPDPNL

SEQ ID NO: 1114752 - protein, 5 aa, Mycobacterium
VSGEL

SEQ ID NO: 1114753 - protein, 4 aa, Mycobacterium
VSGF

SEQ ID NO: 1114754 - protein, 24 aa, Mycobacterium
VSGGGGGGSGTETDGREGSGGGFA

SEQ ID NO: 1114755 - protein, 25 aa, Mycobacterium
VSGGNGPTGGGRAEVHRRGRARTRA

SEQ ID NO: 1114756 - protein, 7 aa, Mycobacterium
VSGGTAV

SEQ ID NO: 1114757 - protein, 11 aa, Mycobacterium
VSGIDTNQLSD

SEQ ID NO: 1114758 - protein, 5 aa, Mycobacterium
VSGPD

SEQ ID NO: 1114759 - protein, 8 aa, Mycobacterium
VSGPGAGL

SEQ ID NO: 1114760 - protein, 9 aa, Mycobacterium
VSGPGQRHD

SEQ ID NO: 1114761 - protein, 21 aa, Mycobacterium
VSGPGQSVTVPTPVAQATVGD

SEQ ID NO: 1114762 - protein, 15 aa, Mycobacterium
VSGPPDAGLPTSPRR

SEQ ID NO: 1114763 - protein, 10 aa, Mycobacterium
VSGQPLATRL

SEQ ID NO: 1114764 - protein, 10 aa, Mycobacterium
VSGSGTATAV

SEQ ID NO: 1114765 - protein, 10 aa, Mycobacterium
VSGSPMTGTT

SEQ ID NO: 1114766 - protein, 8 aa, Mycobacterium
VSGTSPQA

SEQ ID NO: 1114767 - protein, 5 aa, Mycobacterium
VSKHG

SEQ ID NO: 1114768 - protein, 10 aa, Mycobacterium
VSLEDQSVSP

SEQ ID NO: 1114769 - protein, 11 aa, Mycobacterium
VSMSPSDAPAM

SEQ ID NO: 1114770 - protein, 9 aa, Mycobacterium
VSNPDLAGR

SEQ ID NO: 1114771 - protein, 13 aa, Mycobacterium
VSNTSVPDPRIDR

SEQ ID NO: 1114772 - protein, 8 aa, Mycobacterium
VSPADKQR

SEQ ID NO: 1114773 - protein, 9 aa, Mycobacterium
VSPDDRVSG

SEQ ID NO: 1114774 - protein, 10 aa, Mycobacterium
VSPDRSQQAP

SEQ ID NO: 1114775 - protein, 10 aa, Mycobacterium
VSPEAGSWGT

SEQ ID NO: 1114776 - protein, 18 aa, Mycobacterium
VSPRDEARFGGADPEAAV

SEQ ID NO: 1114777 - protein, 11 aa, Mycobacterium
VSPRPRAARSL

SEQ ID NO: 1114778 - protein, 5 aa, Mycobacterium
VSPSE

SEQ ID NO: 1114779 - protein, 5 aa, Mycobacterium
VSQDN

SEQ ID NO: 1114780 - protein, 6 aa, Mycobacterium
VSQPPR

SEQ ID NO: 1114781 - protein, 4 aa, Mycobacterium
VSQR

SEQ ID NO: 1114782 - protein, 5 aa, Mycobacterium
VSQRA

SEQ ID NO: 1114783 - protein, 11 aa, Mycobacterium
VSRAGEQAQAA

SEQ ID NO: 1114784 - protein, 29 aa, Mycobacterium
VSRDAAQAGGLTTLPGDPFGGGPKAPMLP

SEQ ID NO: 1114785 - protein, 9 aa, Mycobacterium
VSRHSGASH

SEQ ID NO: 1114786 - protein, 8 aa, Mycobacterium
VSRPKRRD

SEQ ID NO: 1114787 - protein, 4 aa, Mycobacterium
VSRR

SEQ ID NO: 1114788 - protein, 32 aa, Mycobacterium
VSSAASDSTALPNVSPSSGPASAIDGDSSTSW

SEQ ID NO: 1114789 - protein, 9 aa, Mycobacterium
VSSERPGSW

SEQ ID NO: 1114790 - protein, 12 aa, Mycobacterium
VSSGESPNARPI

SEQ ID NO: 1114791 - protein, 6 aa, Mycobacterium
VSSREG

SEQ ID NO: 1114792 - protein, 20 aa, Mycobacterium
VSSSGSRTALAAAAGARTQR

SEQ ID NO: 1114793 - protein, 12 aa, Mycobacterium
VSSSTDAKVASR

SEQ ID NO: 1114794 - protein, 6 aa, Mycobacterium
VSSTLS

SEQ ID NO: 1114795 - protein, 6 aa, Mycobacterium
VSTANS

SEQ ID NO: 1114796 - protein, 7 aa, Mycobacterium
VSTDSTT

SEQ ID NO: 1114797 - protein, 4 aa, Mycobacterium
VSTP

SEQ ID NO: 1114798 - protein, 10 aa, Mycobacterium
VSTPNGTSTV

SEQ ID NO: 1114799 - protein, 7 aa, Mycobacterium
VSTPTGA

SEQ ID NO: 1114800 - protein, 4 aa, Mycobacterium
VSTS

SEQ ID NO: 1114801 - protein, 12 aa, Mycobacterium
VSTSTEGGDPQL

SEQ ID NO: 1114802 - protein, 5 aa, Mycobacterium
VSTTS

SEQ ID NO: 1114803 - protein, 9 aa, Mycobacterium
VSYRGTNVG

SEQ ID NO: 1114804 - protein, 18 aa, Mycobacterium
VSYTPPSNEDWVLVADAN

SEQ ID NO: 1114805 - protein, 8 aa, Mycobacterium
VTAEPDTL

SEQ ID NO: 1114806 - protein, 7 aa, Mycobacterium
VTAEPVP

SEQ ID NO: 1114807 - protein, 5 aa, Mycobacterium
VTAGG

SEQ ID NO: 1114808 - protein, 13 aa, Mycobacterium
VTAPQAIPGTAPA

SEQ ID NO: 1114809 - protein, 11 aa, Mycobacterium
VTAPSPSGSPV

SEQ ID NO: 1114810 - protein, 8 aa, Mycobacterium
VTARTGGE

SEQ ID NO: 1114811 - protein, 6 aa, Mycobacterium
VTATTS

SEQ ID NO: 1114812 - protein, 9 aa, Mycobacterium
VTDEETAKN

SEQ ID NO: 1114813 - protein, 7 aa, Mycobacterium
VTDQRPQ

SEQ ID NO: 1114814 - protein, 8 aa, Mycobacterium
VTDRGSNA

SEQ ID NO: 1114815 - protein, 13 aa, Mycobacterium
VTDTGFPESVRPD

SEQ ID NO: 1114816 - protein, 7 aa, Mycobacterium
VTEDTAV

SEQ ID NO: 1114817 - protein, 25 aa, Mycobacterium
VTEDTAVSPVTEETPAKTTTARPNA

SEQ ID NO: 1114818 - protein, 41 aa, Mycobacterium
VTEPPPPPPETTAAPPPPPPATTEPPPPPPTTTTRAGPRQV

SEQ ID NO: 1114819 - protein, 11 aa, Mycobacterium
VTGAGGTDEYR

SEQ ID NO: 1114820 - protein, 11 aa, Mycobacterium
VTGATSQLREE

SEQ ID NO: 1114821 - protein, 10 aa, Mycobacterium
VTGDPADLAG

SEQ ID NO: 1114822 - protein, 10 aa, Mycobacterium
VTGDTGTTDL

SEQ ID NO: 1114823 - protein, 14 aa, Mycobacterium
VTGEDAERDLPARD

SEQ ID NO: 1114824 - protein, 20 aa, Mycobacterium
VTGEGKAAGDEPAQPSPPRR

SEQ ID NO: 1114825 - protein, 11 aa, Mycobacterium
VTGESRPIARG

SEQ ID NO: 1114826 - protein, 13 aa, Mycobacterium
VTGGDEAARNAED

SEQ ID NO: 1114827 - protein, 10 aa, Mycobacterium
VTGGTGGGFP

SEQ ID NO: 1114828 - protein, 4 aa, Mycobacterium
VTGR

SEQ ID NO: 1114829 - protein, 8 aa, Mycobacterium
VTGRPRNE

SEQ ID NO: 1114830 - protein, 4 aa, Mycobacterium
VTNA

SEQ ID NO: 1114831 - protein, 13 aa, Mycobacterium
VTNPATHEPDPTN

SEQ ID NO: 1114832 - protein, 5 aa, Mycobacterium
VTNPT

SEQ ID NO: 1114833 - protein, 9 aa, Mycobacterium
VTPAQYGDP

SEQ ID NO: 1114834 - protein, 7 aa, Mycobacterium
VTPATDV

SEQ ID NO: 1114835 - protein, 14 aa, Mycobacterium
VTPELSPADEAYRE

SEQ ID NO: 1114836 - protein, 6 aa, Mycobacterium
VTPNPR

SEQ ID NO: 1114837 - protein, 7 aa, Mycobacterium
VTPPEDL

SEQ ID NO: 1114838 - protein, 6 aa, Mycobacterium
VTPPTA

SEQ ID NO: 1114839 - protein, 26 aa, Mycobacterium
VTPRTTGPIPVTAGPERSEIDPTSAG

SEQ ID NO: 1114840 - protein, 10 aa, Mycobacterium
VTPSETPRVL

SEQ ID NO: 1114841 - protein, 6 aa, Mycobacterium
VTPSQR

SEQ ID NO: 1114842 - protein, 12 aa, Mycobacterium
VTPSSSPLPARP

SEQ ID NO: 1114843 - protein, 5 aa, Mycobacterium
VTPST

SEQ ID NO: 1114844 - protein, 4 aa, Mycobacterium
VTQN

SEQ ID NO: 1114845 - protein, 6 aa, Mycobacterium
VTQRGD

SEQ ID NO: 1114846 - protein, 11 aa, Mycobacterium
VTRASSGLTEE

SEQ ID NO: 1114847 - protein, 4 aa, Mycobacterium
VTRG

SEQ ID NO: 1114848 - protein, 5 aa, Mycobacterium
VTRPE

SEQ ID NO: 1114849 - protein, 17 aa, Mycobacterium
VTSAQSPRSAPTSPRTI

SEQ ID NO: 1114850 - protein, 34 aa, Mycobacterium
VTSGASAIAKASLDASLQDDLPEESRASAFGRSE

SEQ ID NO: 1114851 - protein, 14 aa, Mycobacterium
VTSREGVDEESPTW

SEQ ID NO: 1114852 - protein, 17 aa, Mycobacterium
VTSRPGDGTSISATIPV

SEQ ID NO: 1114853 - protein, 8 aa, Mycobacterium
VTSSPLPV

SEQ ID NO: 1114854 - protein, 8 aa, Mycobacterium
VTSTGVPG

SEQ ID NO: 1114855 - protein, 10 aa, Mycobacterium
VTTAPGQGSR

SEQ ID NO: 1114856 - protein, 15 aa, Mycobacterium
VTTARTLNEQQGDVD

SEQ ID NO: 1114857 - protein, 7 aa, Mycobacterium
VTTASGE

SEQ ID NO: 1114858 - protein, 7 aa, Mycobacterium
VTTDNYK

SEQ ID NO: 1114859 - protein, 6 aa, Mycobacterium
VTTGRG

SEQ ID NO: 1114860 - protein, 11 aa, Mycobacterium
VTTNPNDGTVE

SEQ ID NO: 1114861 - protein, 8 aa, Mycobacterium
VTTPEPAL

SEQ ID NO: 1114862 - protein, 6 aa, Mycobacterium
VTTPGR

SEQ ID NO: 1114863 - protein, 73 aa, Mycobacterium
VTTPPTTVPTTTTTTTTSPTTTTTTTTTTTTTTTTTTTTTTTTTTTPPTTTTTQPPTTTEPPTTTQQPRTTAM

SEQ ID NO: 1114864 - protein, 12 aa, Mycobacterium
VTTSAAADPQRV

SEQ ID NO: 1114865 - protein, 4 aa, Mycobacterium
VTTT

SEQ ID NO: 1114866 - protein, 7 aa, Mycobacterium
VTTTSNP

SEQ ID NO: 1114867 - protein, 9 aa, Mycobacterium
VTYRGTEVG

SEQ ID NO: 1114868 - protein, 10 aa, Mycobacterium
VTYRGTEVGQ

SEQ ID NO: 1114869 - protein, 6 aa, Mycobacterium
VVDPTD

SEQ ID NO: 1114870 - protein, 12 aa, Mycobacterium
VVESTPAAPPLS

SEQ ID NO: 1114871 - protein, 22 aa, Mycobacterium
VVGTGRATVGAATNAVTGAATR

SEQ ID NO: 1114872 - protein, 6 aa, Mycobacterium
VVPDDE

SEQ ID NO: 1114873 - protein, 15 aa, Mycobacterium
VVPQPEEPPPRPHSR

SEQ ID NO: 1114874 - protein, 7 aa, Mycobacterium
VYGRDRT

SEQ ID NO: 1114875 - protein, 6 aa, Mycobacterium
VYNGTK

SEQ ID NO: 1114876 - protein, 6 aa, Mycobacterium
VYPSEV

SEQ ID NO: 1114877 - protein, 11 aa, Mycobacterium
VYSYDSDGSPW

SEQ ID NO: 1114878 - protein, 8 aa, Mycobacterium
WAEDPAPR

SEQ ID NO: 1114879 - protein, 21 aa, Mycobacterium
WAPAGASEATGNEGTSGDARG

SEQ ID NO: 1114880 - protein, 25 aa, Mycobacterium
WAPGMGQGYGPGMCGPGGPGMYGPG

SEQ ID NO: 1114881 - protein, 14 aa, Mycobacterium
WARRPGTALGPASA

SEQ ID NO: 1114882 - protein, 19 aa, Mycobacterium
WDPDTEPDERHNHHDGKDS

SEQ ID NO: 1114883 - protein, 8 aa, Mycobacterium
WDSGTDTW

SEQ ID NO: 1114884 - protein, 4 aa, Mycobacterium
WDTA

SEQ ID NO: 1114885 - protein, 10 aa, Mycobacterium
WDTPARPARA

SEQ ID NO: 1114886 - protein, 10 aa, Mycobacterium
WESSPQMDPF

SEQ ID NO: 1114887 - protein, 7 aa, Mycobacterium
WGEPGKG

SEQ ID NO: 1114888 - protein, 14 aa, Mycobacterium
WGEPTGSPSTVDAD

SEQ ID NO: 1114889 - protein, 7 aa, Mycobacterium
WGGPAGL

SEQ ID NO: 1114890 - protein, 8 aa, Mycobacterium
WGGSTYPW

SEQ ID NO: 1114891 - protein, 12 aa, Mycobacterium
WGPRTGTGQLPN

SEQ ID NO: 1114892 - protein, 10 aa, Mycobacterium
WGRRDAPPQN

SEQ ID NO: 1114893 - protein, 11 aa, Mycobacterium
WGSPDPEPRPW

SEQ ID NO: 1114894 - protein, 13 aa, Mycobacterium
WGSPRTVGSAGGG

SEQ ID NO: 1114895 - protein, 10 aa, Mycobacterium
WGSTEAGMGP

SEQ ID NO: 1114896 - protein, 19 aa, Mycobacterium
WHNPTAAKGAVRPSGPTDI

SEQ ID NO: 1114897 - protein, 12 aa, Mycobacterium
WKDAGGRAGYSL

SEQ ID NO: 1114898 - protein, 44 aa, Mycobacterium
WKGDPNATLSGQDVPQLPPGTEPVQSEPGAAPPAPPAPPAAAPL

SEQ ID NO: 1114899 - protein, 9 aa, Mycobacterium
WKGTTSAER

SEQ ID NO: 1114900 - protein, 16 aa, Mycobacterium
WKQRPSDPSEPRVSKT

SEQ ID NO: 1114901 - protein, 7 aa, Mycobacterium
WNDDGSA

SEQ ID NO: 1114902 - protein, 18 aa, Mycobacterium
WNPETREYGPISDPESPM

SEQ ID NO: 1114903 - protein, 12 aa, Mycobacterium
WNRDRADSSRDR

SEQ ID NO: 1114904 - protein, 8 aa, Mycobacterium
WPAGPTCA

SEQ ID NO: 1114905 - protein, 10 aa, Mycobacterium
WPALDDSDVD

SEQ ID NO: 1114906 - protein, 13 aa, Mycobacterium
WPAPAGRPRRAGV

SEQ ID NO: 1114907 - protein, 10 aa, Mycobacterium
WPDMGTGNAA

SEQ ID NO: 1114908 - protein, 4 aa, Mycobacterium
WPEK

SEQ ID NO: 1114909 - protein, 7 aa, Mycobacterium
WPPPPVQ

SEQ ID NO: 1114910 - protein, 4 aa, Mycobacterium
WPQP

SEQ ID NO: 1114911 - protein, 14 aa, Mycobacterium
WPSTRGTKATAKTG

SEQ ID NO: 1114912 - protein, 14 aa, Mycobacterium
WPVPGTKAEKRAER

SEQ ID NO: 1114913 - protein, 6 aa, Mycobacterium
WQASAD

SEQ ID NO: 1114914 - protein, 11 aa, Mycobacterium
WQPPAEDSPTA

SEQ ID NO: 1114915 - protein, 19 aa, Mycobacterium
WQSSGGDTGPLGPRSGDVY

SEQ ID NO: 1114916 - protein, 4 aa, Mycobacterium
WRDG

SEQ ID NO: 1114917 - protein, 14 aa, Mycobacterium
WRDGVGTRRTAAGR

SEQ ID NO: 1114918 - protein, 9 aa, Mycobacterium
WRDTDDERG

SEQ ID NO: 1114919 - protein, 49 aa, Mycobacterium
WRPPRTSTTTTTPTTTSPTETTTTTTPTSPTTTPPSTTVIDPDGPGLLP

SEQ ID NO: 1114920 - protein, 15 aa, Mycobacterium
WRRPRDWPKNGRDVS

SEQ ID NO: 1114921 - protein, 13 aa, Mycobacterium
WSAGTPVEALTDG

SEQ ID NO: 1114922 - protein, 10 aa, Mycobacterium
WSDPGTPLDD

SEQ ID NO: 1114923 - protein, 16 aa, Mycobacterium
WSEPERAALRYLRQSC

SEQ ID NO: 1114924 - protein, 4 aa, Mycobacterium
WSGE

SEQ ID NO: 1114925 - protein, 6 aa, Mycobacterium
WSGPYD

SEQ ID NO: 1114926 - protein, 5 aa, Mycobacterium
WSPES

SEQ ID NO: 1114927 - protein, 7 aa, Mycobacterium
WSQAGKT

SEQ ID NO: 1114928 - protein, 5 aa, Mycobacterium
WSRPA

SEQ ID NO: 1114929 - protein, 8 aa, Mycobacterium
WSRTETEW

SEQ ID NO: 1114930 - protein, 22 aa, Mycobacterium
WSTGSRRERMPENQDRTVTSPR

SEQ ID NO: 1114931 - protein, 12 aa, Mycobacterium
WSTQAPVNTPVH

SEQ ID NO: 1114932 - protein, 18 aa, Mycobacterium
WTAPPSAAPALVSEDGRT

SEQ ID NO: 1114933 - protein, 5 aa, Mycobacterium
WTATQ

SEQ ID NO: 1114934 - protein, 18 aa, Mycobacterium
WTQDKTEKLRGLLRSDEN

SEQ ID NO: 1114935 - protein, 13 aa, Mycobacterium
YAAADGDPGTAWT

SEQ ID NO: 1114936 - protein, 10 aa, Mycobacterium
YAAGDDDTLR

SEQ ID NO: 1114937 - protein, 11 aa, Mycobacterium
YAAGTAEVVGP

SEQ ID NO: 1114938 - protein, 6 aa, Mycobacterium
YADQQR

SEQ ID NO: 1114939 - protein, 6 aa, Mycobacterium
YAEAAP

SEQ ID NO: 1114940 - protein, 8 aa, Mycobacterium
YAGADRPV

SEQ ID NO: 1114941 - protein, 11 aa, Mycobacterium
YAGDRGRARET

SEQ ID NO: 1114942 - protein, 10 aa, Mycobacterium
YAGGLGSPFA

SEQ ID NO: 1114943 - protein, 12 aa, Mycobacterium
YAPAGAARKDWE

SEQ ID NO: 1114944 - protein, 8 aa, Mycobacterium
YAPDGTPL

SEQ ID NO: 1114945 - protein, 4 aa, Mycobacterium
YAPG

SEQ ID NO: 1114946 - protein, 12 aa, Mycobacterium
YAPGSDKLAPAE

SEQ ID NO: 1114947 - protein, 24 aa, Mycobacterium
YASARQWSRPRHEEDAMKTAGQEI

SEQ ID NO: 1114948 - protein, 15 aa, Mycobacterium
YATEKATVTVPDGYD

SEQ ID NO: 1114949 - protein, 17 aa, Mycobacterium
YDAARSAIPPTVSDEQV

SEQ ID NO: 1114950 - protein, 14 aa, Mycobacterium
YDADADAELAPPPR

SEQ ID NO: 1114951 - protein, 5 aa, Mycobacterium
YDDAG

SEQ ID NO: 1114952 - protein, 62 aa, Mycobacterium
YDDEYDDYADEYDGDPDADDDFSDGYYDDADPGRDDAAWPTANQPTEPLEKPAAKASPAALP

SEQ ID NO: 1114953 - protein, 15 aa, Mycobacterium
YDEGRAAEQQASADI

SEQ ID NO: 1114954 - protein, 5 aa, Mycobacterium
YDGEF

SEQ ID NO: 1114955 - protein, 11 aa, Mycobacterium
YDGPTTATTPT

SEQ ID NO: 1114956 - protein, 11 aa, Mycobacterium
YDGSTRSFAAG

SEQ ID NO: 1114957 - protein, 6 aa, Mycobacterium
YDNGRT

SEQ ID NO: 1114958 - protein, 15 aa, Mycobacterium
YDPATGKDKQPTTTP

SEQ ID NO: 1114959 - protein, 38 aa, Mycobacterium
YDPATGSYIGPDGKQYRQADLGQSAPGGQTWQTMLLPP

SEQ ID NO: 1114960 - protein, 39 aa, Mycobacterium
YDPATGTYLAPDGREYTQSNLAETGPAEKSWQSMLTPPG

SEQ ID NO: 1114961 - protein, 18 aa, Mycobacterium
YDPATGTYVGPDGRVYTQ

SEQ ID NO: 1114962 - protein, 4 aa, Mycobacterium
YDPE

SEQ ID NO: 1114963 - protein, 8 aa, Mycobacterium
YDPEQRRS

SEQ ID NO: 1114964 - protein, 21 aa, Mycobacterium
YDRPAGLDNPRSPRRAGGMPN

SEQ ID NO: 1114965 - protein, 4 aa, Mycobacterium
YDSA

SEQ ID NO: 1114966 - protein, 6 aa, Mycobacterium
YDTDDW

SEQ ID NO: 1114967 - protein, 13 aa, Mycobacterium
YDTIAGPASPTAN

SEQ ID NO: 1114968 - protein, 5 aa, Mycobacterium
YDVSP

SEQ ID NO: 1114969 - protein, 9 aa, Mycobacterium
YEAQGSTAV

SEQ ID NO: 1114970 - protein, 7 aa, Mycobacterium
YEEERSH

SEQ ID NO: 1114971 - protein, 19 aa, Mycobacterium
YEETSARVDAETTASARIP

SEQ ID NO: 1114972 - protein, 32 aa, Mycobacterium
YENVEDEYEDAEGEYEDVDDASEQGDSSEADL

SEQ ID NO: 1114973 - protein, 15 aa, Mycobacterium
YEPPSPPVQQPSLPS

SEQ ID NO: 1114974 - protein, 12 aa, Mycobacterium
YESATAAALPQS

SEQ ID NO: 1114975 - protein, 5 aa, Mycobacterium
YESNS

SEQ ID NO: 1114976 - protein, 4 aa, Mycobacterium
YGAN

SEQ ID NO: 1114977 - protein, 56 aa, Mycobacterium
YGAPATTANPWDPRADSADEAVAADRPSAPDRPSAPDLFGGQDDPDSIDTAPTRIE

SEQ ID NO: 1114978 - protein, 15 aa, Mycobacterium
YGDDSTSSSSSRRMS

SEQ ID NO: 1114979 - protein, 8 aa, Mycobacterium
YGDPQLSD

SEQ ID NO: 1114980 - protein, 9 aa, Mycobacterium
YGDQLDERG

SEQ ID NO: 1114981 - protein, 12 aa, Mycobacterium
YGEESKNPKKIV

SEQ ID NO: 1114982 - protein, 11 aa, Mycobacterium
YGEESRNPKKI

SEQ ID NO: 1114983 - protein, 10 aa, Mycobacterium
YGEQPATEPQ

SEQ ID NO: 1114984 - protein, 4 aa, Mycobacterium
YGGD

SEQ ID NO: 1114985 - protein, 4 aa, Mycobacterium
YGGE

SEQ ID NO: 1114986 - protein, 6 aa, Mycobacterium
YGGGAA

SEQ ID NO: 1114987 - protein, 18 aa, Mycobacterium
YGGSDGAAGELYKPPASD

SEQ ID NO: 1114988 - protein, 6 aa, Mycobacterium
YGGTAG

SEQ ID NO: 1114989 - protein, 11 aa, Mycobacterium
YGGTHQGAPNF

SEQ ID NO: 1114990 - protein, 6 aa, Mycobacterium
YGGTST

SEQ ID NO: 1114991 - protein, 9 aa, Mycobacterium
YGNLGSSVR

SEQ ID NO: 1114992 - protein, 7 aa, Mycobacterium
YGPGAGV

SEQ ID NO: 1114993 - protein, 4 aa, Mycobacterium
YGPP

SEQ ID NO: 1114994 - protein, 6 aa, Mycobacterium
YGPPER

SEQ ID NO: 1114995 - protein, 19 aa, Mycobacterium
YGPPTATSTDDQEQGGEGV

SEQ ID NO: 1114996 - protein, 6 aa, Mycobacterium
YGPTEA

SEQ ID NO: 1114997 - protein, 6 aa, Mycobacterium
YGQNPG

SEQ ID NO: 1114998 - protein, 6 aa, Mycobacterium
YGQTQP

SEQ ID NO: 1114999 - protein, 7 aa, Mycobacterium
YGRADPA

SEQ ID NO: 1115000 - protein, 18 aa, Mycobacterium
YGRGAETATVAAPEADST

SEQ ID NO: 1115001 - protein, 9 aa, Mycobacterium
YGRPSANET

SEQ ID NO: 1115002 - protein, 5 aa, Mycobacterium
YGRQA

SEQ ID NO: 1115003 - protein, 8 aa, Mycobacterium
YGSAAPYM

SEQ ID NO: 1115004 - protein, 4 aa, Mycobacterium
YGSG

SEQ ID NO: 1115005 - protein, 6 aa, Mycobacterium
YGSPTT

SEQ ID NO: 1115006 - protein, 20 aa, Mycobacterium
YGTDRKQRAGLPAPSADSHQ

SEQ ID NO: 1115007 - protein, 14 aa, Mycobacterium
YGTPRLPPSSADYP

SEQ ID NO: 1115008 - protein, 9 aa, Mycobacterium
YGTSGTARV

SEQ ID NO: 1115009 - protein, 7 aa, Mycobacterium
YHPVRSR

SEQ ID NO: 1115010 - protein, 7 aa, Mycobacterium
YKPKTAA

SEQ ID NO: 1115011 - protein, 4 aa, Mycobacterium
YKTS

SEQ ID NO: 1115012 - protein, 13 aa, Mycobacterium
YKWGGGQNGKSAI

SEQ ID NO: 1115013 - protein, 7 aa, Mycobacterium
YLPPDNS

SEQ ID NO: 1115014 - protein, 15 aa, Mycobacterium
YLPPTNSVRQAQEQF

SEQ ID NO: 1115015 - protein, 12 aa, Mycobacterium
YLTTSDGRSRTL

SEQ ID NO: 1115016 - protein, 8 aa, Mycobacterium
YNKGSLPH

SEQ ID NO: 1115017 - protein, 6 aa, Mycobacterium
YNPAAV

SEQ ID NO: 1115018 - protein, 9 aa, Mycobacterium
YNPTRRFDS

SEQ ID NO: 1115019 - protein, 10 aa, Mycobacterium
YNRGTATCDA

SEQ ID NO: 1115020 - protein, 8 aa, Mycobacterium
YPASPPAL

SEQ ID NO: 1115021 - protein, 4 aa, Mycobacterium
YPDP

SEQ ID NO: 1115022 - protein, 12 aa, Mycobacterium
YPDRATGESTDS

SEQ ID NO: 1115023 - protein, 8 aa, Mycobacterium
YPDRPEGD

SEQ ID NO: 1115024 - protein, 9 aa, Mycobacterium
YPEEAQRQA

SEQ ID NO: 1115025 - protein, 7 aa, Mycobacterium
YPERPAG

SEQ ID NO: 1115026 - protein, 9 aa, Mycobacterium
YPESTQGVT

SEQ ID NO: 1115027 - protein, 10 aa, Mycobacterium
YPGDTDRKSD

SEQ ID NO: 1115028 - protein, 39 aa, Mycobacterium
YPGGYPPQPYGAYPPAYPTQPYGGYPPSPPTAPKNGLGT

SEQ ID NO: 1115029 - protein, 4 aa, Mycobacterium
YPGI

SEQ ID NO: 1115030 - protein, 6 aa, Mycobacterium
YPGLSE

SEQ ID NO: 1115031 - protein, 7 aa, Mycobacterium
YPGRGMR

SEQ ID NO: 1115032 - protein, 4 aa, Mycobacterium
YPGT

SEQ ID NO: 1115033 - protein, 5 aa, Mycobacterium
YPHRR

SEQ ID NO: 1115034 - protein, 7 aa, Mycobacterium
YPKAGGA

SEQ ID NO: 1115035 - protein, 6 aa, Mycobacterium
YPKPSP

SEQ ID NO: 1115036 - protein, 7 aa, Mycobacterium
YPNQPNV

SEQ ID NO: 1115037 - protein, 62 aa, Mycobacterium
YPPPGYQQGYPPPGYQQGYPPPGYQQGYPPPGYQHGYPPPGYQHGYPPPGYPPQQGYAPPDV

SEQ ID NO: 1115038 - protein, 38 aa, Mycobacterium
YPQPGHGPQGGANPPRDPQQERGRDGDRPGDRPNPPAQ

SEQ ID NO: 1115039 - protein, 11 aa, Mycobacterium
YPQSEGAVDDA

SEQ ID NO: 1115040 - protein, 8 aa, Mycobacterium
YPREKPSD

SEQ ID NO: 1115041 - protein, 5 aa, Mycobacterium
YPTGY

SEQ ID NO: 1115042 - protein, 8 aa, Mycobacterium
YPTYAEAQ

SEQ ID NO: 1115043 - protein, 10 aa, Mycobacterium
YQAGDDLTAG

SEQ ID NO: 1115044 - protein, 8 aa, Mycobacterium
YQANKSDQ

SEQ ID NO: 1115045 - protein, 16 aa, Mycobacterium
YQPELPAPTPDPAQQV

SEQ ID NO: 1115046 - protein, 18 aa, Mycobacterium
YRAPTTQTRRRRRQPPLH

SEQ ID NO: 1115047 - protein, 8 aa, Mycobacterium
YRDEDGNL

SEQ ID NO: 1115048 - protein, 6 aa, Mycobacterium
YRDGTV

SEQ ID NO: 1115049 - protein, 9 aa, Mycobacterium
YRGNYDQAT

SEQ ID NO: 1115050 - protein, 11 aa, Mycobacterium
YRLGRGGRLRT

SEQ ID NO: 1115051 - protein, 12 aa, Mycobacterium
YRNRHDAVDGST

SEQ ID NO: 1115052 - protein, 12 aa, Mycobacterium
YRNRHDAVNGST

SEQ ID NO: 1115053 - protein, 12 aa, Mycobacterium
YRPEQRSAELTQ

SEQ ID NO: 1115054 - protein, 14 aa, Mycobacterium
YRPGAGARRPGGPD

SEQ ID NO: 1115055 - protein, 17 aa, Mycobacterium
YRSTPGPGGQMPAPGAM

SEQ ID NO: 1115056 - protein, 19 aa, Mycobacterium
YRTGTPEISKSGRGNVVEP

SEQ ID NO: 1115057 - protein, 8 aa, Mycobacterium
YSAPESEQ

SEQ ID NO: 1115058 - protein, 9 aa, Mycobacterium
YSDPANEAQ

SEQ ID NO: 1115059 - protein, 9 aa, Mycobacterium
YSGGLGSPV

SEQ ID NO: 1115060 - protein, 18 aa, Mycobacterium
YSGSQYNAGRKVPSSQMR

SEQ ID NO: 1115061 - protein, 7 aa, Mycobacterium
YSPAEPY

SEQ ID NO: 1115062 - protein, 7 aa, Mycobacterium
YSPGAGG

SEQ ID NO: 1115063 - protein, 4 aa, Mycobacterium
YSPP

SEQ ID NO: 1115064 - protein, 8 aa, Mycobacterium
YSPPTTEV

SEQ ID NO: 1115065 - protein, 9 aa, Mycobacterium
YSPRGTPVS

SEQ ID NO: 1115066 - protein, 13 aa, Mycobacterium
YSQDPDGTTAGSV

SEQ ID NO: 1115067 - protein, 7 aa, Mycobacterium
YSRKDST

SEQ ID NO: 1115068 - protein, 12 aa, Mycobacterium
YSSNQGRDTSVS

SEQ ID NO: 1115069 - protein, 18 aa, Mycobacterium
YSSPRPTGRHQPEPRSAG

SEQ ID NO: 1115070 - protein, 8 aa, Mycobacterium
YTAGSIGA

SEQ ID NO: 1115071 - protein, 8 aa, Mycobacterium
YTAPAAAG

SEQ ID NO: 1115072 - protein, 7 aa, Mycobacterium
YTDDGRT

SEQ ID NO: 1115073 - protein, 8 aa, Mycobacterium
YTGGGGKQ

SEQ ID NO: 1115074 - protein, 11 aa, Mycobacterium
YTGTVSPPSTV

SEQ ID NO: 1115075 - protein, 12 aa, Mycobacterium
YTKRASETPPSE

SEQ ID NO: 1115076 - protein, 7 aa, Mycobacterium
YTPGGRA

SEQ ID NO: 1115077 - protein, 9 aa, Mycobacterium
YTPSSASKL

SEQ ID NO: 1115078 - protein, 4 aa, Mycobacterium
YTQG

SEQ ID NO: 1115079 - protein, 10 aa, Mycobacterium
YTRKQSKRSL

SEQ ID NO: 1115080 - protein, 10 aa, Mycobacterium
YTSGKSTALT

SEQ ID NO: 1115081 - protein, 17 aa, Mycobacterium
YVSGPSSSYVTAADPAD

SEQ ID NO: 1115082 - protein, 15 aa, Mycobacterium
YVSGQDGTSDCDGHG

SEQ ID NO: 1115083 - protein, 10 aa, Mycobacterium
YYGGSDANGF

SEQ ID NO: 1115084 - protein, 14 aa, Mycobacterium
YYPPRPPAGHDHPG

SEQ ID NO: 1115085 - protein, 15 aa, Mycobacterium
YYPPRPPAGHDHPGM

SEQ ID NO: 1115086 - protein, 33 aa, Mycobacterium
YYSDDEPTQLSNYGTGYGEYDQSPTEADSATPW

SEQ ID NO: 1115087 - protein, 18 aa, Mycobacterium
RRYADYLPSDGFTTLNIV

SEQ ID NO: 1115088 - protein, 24 aa, Mycobacterium
PFVELRFFRSIPFASATAIAVCAF

SEQ ID NO: 1115089 - protein, 24 aa, Mycobacterium
TAIAVCAFAAWGAFLFMMSIYLQG

SEQ ID NO: 1115090 - protein, 18 aa, Mycobacterium
VSAQPLWLVFAGVGVLIF

SEQ ID NO: 1115091 - protein, 24 aa, Mycobacterium
EKLGKLHFWLTFIGFHTTFLVQHW

SEQ ID NO: 1115092 - protein, 26 aa, Mycobacterium
GVLLWQHLFWFFGHPEVYIIALPFFG

SEQ ID NO: 1115093 - protein, 21 aa, Mycobacterium
ADYLPSDGFTTLNIVSTIGAF

SEQ ID NO: 1115094 - protein, 25 aa, Mycobacterium
FPTAGHLCSWAKFSPGIQSSAGKTK

SEQ ID NO: 1115095 - protein, 18 aa, Mycobacterium
GIVSEIFPVFSRKPIFGY

SEQ ID NO: 1115096 - protein, 23 aa, Mycobacterium
LEDACIKLSVVASDIFGVSGRAM

SEQ ID NO: 1115097 - protein, 27 aa, Mycobacterium
LLHHELEFWWELALLIVIMLLGHWVEM

SEQ ID NO: 1115098 - protein, 18 aa, Mycobacterium
LNLALAVPVTLVLIASSF

SEQ ID NO: 1115099 - protein, 24 aa, Mycobacterium
RDLTRYRIDLVATRTAERNRVEKL

SEQ ID NO: 1115100 - protein, 18 aa, Mycobacterium
SGRAMMAALIAGERDPKV

SEQ ID NO: 1115101 - protein, 27 aa, Mycobacterium
SPLSGRLVGRFGARPSLMIAGALIVAA

SEQ ID NO: 1115102 - protein, 24 aa, Mycobacterium
VPTGIKFFNWIGTMWKGQLTFETP

SEQ ID NO: 1115103 - protein, 17 aa, Mycobacterium
AAFFFPAYSAILPRILP

SEQ ID NO: 1115104 - protein, 19 aa, Mycobacterium
AAGCMPVMIGWSAVTGTIQ

SEQ ID NO: 1115105 - protein, 20 aa, Mycobacterium
AASPCALAISVPVTVVAAIG

SEQ ID NO: 1115106 - protein, 20 aa, Mycobacterium
AESLPAVLIASAATGFAGAL

SEQ ID NO: 1115107 - protein, 32 aa, Mycobacterium; identical to SEQ ID NO: 299029

SEQ ID NO: 1115108 - protein, 17 aa, Mycobacterium
AGVPVGITTCWEVIFDR

SEQ ID NO: 1115109 - protein, 19 aa, Mycobacterium
AHLRARHDLVLEMFTAVHA

SEQ ID NO: 1115110 - protein, 18 aa, Mycobacterium
AISGEYLSAASFLGVAGL

SEQ ID NO: 1115111 - protein, 21 aa, Mycobacterium
ALHECGHMWVARATGMKVRRY

SEQ ID NO: 1115112 - protein, 19 aa, Mycobacterium
ALLGHFCDPAVALVAPRIV

SEQ ID NO: 1115113 - protein, 20 aa, Mycobacterium
ALLLLFGFGMIWFGILIGSL

SEQ ID NO: 1115114 - protein, 18 aa, Mycobacterium
ALLSAIGIAGMDRLVQRN

SEQ ID NO: 1115115 - protein, 17 aa, Mycobacterium
AMFEGFFGYSLPDDLLS

SEQ ID NO: 1115116 - protein, 25 aa, Mycobacterium
ANLFVVAFGMSWGPVVWVLLGEMFP

SEQ ID NO: 1115117 - protein, 17 aa, Mycobacterium
ANWLITVTFPGLREHLG

SEQ ID NO: 1115118 - protein, 24 aa, Mycobacterium
AQSDIKRLLSFTLVSHIGYMVFGI

SEQ ID NO: 1115119 - protein, 22 aa, Mycobacterium
ARAGRVQWRTGLIFGAAGMAGA

SEQ ID NO: 1115120 - protein, 19 aa, Mycobacterium
ARTPWPVFTLGMLQADIIG

SEQ ID NO: 1115121 - protein, 23 aa, Mycobacterium
ATERSPLPLALRNDLPVPIRVRL

SEQ ID NO: 1115122 - protein, 19 aa, Mycobacterium
ATESVRMLAPIPGKSAVGI

SEQ ID NO: 1115123 - protein, 20 aa, Mycobacterium
AVTGCTRGPTVTRYEVELGP

SEQ ID NO: 1115124 - protein, 19 aa, Mycobacterium
CALAVLLTAIFVPESKSVT

SEQ ID NO: 1115125 - protein, 19 aa, Mycobacterium
CLPMLAQIPVFLGLYHVLM

SEQ ID NO: 1115126 - protein, 19 aa, Mycobacterium
CLVYAGLVGAGFAWLEDIL

SEQ ID NO: 1115127 - protein, 18 aa, Mycobacterium
CTTCGACVEQCPVDIEHI

SEQ ID NO: 1115128 - protein, 21 aa, Mycobacterium
DATVSVAGFPAVNSDIQRLLW

SEQ ID NO: 1115129 - protein, 25 aa, Mycobacterium
DDLLACLYGLYALLRLHFVQEEENY

SEQ ID NO: 1115130 - protein, 20 aa, Mycobacterium
DFFNFYACDVTLKLNGLQPG

SEQ ID NO: 1115131 - protein, 21 aa, Mycobacterium
DGEVKIADFGLVRAVAEAKIT

SEQ ID NO: 1115132 - protein, 20 aa, Mycobacterium
DLYLRIAPELYLKRLCVGGV

SEQ ID NO: 1115133 - protein, 20 aa, Mycobacterium
EAEGGMGPHGLMIGMTGSGK

SEQ ID NO: 1115134 - protein, 17 aa, Mycobacterium
ECGRCQSQCPAWNTGKP

SEQ ID NO: 1115135 - protein, 20 aa, Mycobacterium
ENGRAAWLLGASFISEGAIP

SEQ ID NO: 1115136 - protein, 18 aa, Mycobacterium
EQMLQWAPECFGTPGDLK

SEQ ID NO: 1115137 - protein, 23 aa, Mycobacterium
ERDLRARLLRSYEAQQEGLQVLL

SEQ ID NO: 1115138 - protein, 20 aa, Mycobacterium
ERHLPRIFTHLNPRTRNPVT

SEQ ID NO: 1115139 - protein, 17 aa, Mycobacterium
FALSGFLLWRGHAAAAR

SEQ ID NO: 1115140 - protein, 20 aa, Mycobacterium
FARTEFQAVQFMPLVIAPQL

SEQ ID NO: 1115141 - protein, 17 aa, Mycobacterium
FATGWASFGLRIALVPL

SEQ ID NO: 1115142 - protein, 18 aa, Mycobacterium
FFVTFLIRTIAWKTILAD

SEQ ID NO: 1115143 - protein, 25 aa, Mycobacterium
FGLPVLPLIIGVILGPRIERQLRQS

SEQ ID NO: 1115144 - protein, 24 aa, Mycobacterium
FKAGRFKNLILGLVILPFFVTFLI

SEQ ID NO: 1115145 - protein, 17 aa, Mycobacterium
FLRTLILSLAATHHPDQ

SEQ ID NO: 1115146 - protein, 18 aa, Mycobacterium
GAAMAFSSVFVVGNSLRL

SEQ ID NO: 1115147 - protein, 19 aa, Mycobacterium
GAIAVYGYDGFLYSIGFLV

SEQ ID NO: 1115148 - protein, 17 aa, Mycobacterium
GAVCIAGAWLYTGGSKP

SEQ ID NO: 1115149 - protein, 20 aa, Mycobacterium
GAYLSYIMCKAMNRSFISVI

SEQ ID NO: 1115150 - protein, 17 aa, Mycobacterium
GDPKLTLPDAITGNPGD

SEQ ID NO: 1115151 - protein, 19 aa, Mycobacterium
GETWGFIGGYLSWVPVILN

SEQ ID NO: 1115152 - protein, 30 aa, Mycobacterium; identical to SEQ ID NO: 10389

SEQ ID NO: 1115153 - protein, 26 aa, Mycobacterium
GHNLWNWPPAFFSWFAAGMVLAELTV

SEQ ID NO: 1115154 - protein, 18 aa, Mycobacterium
GLFFAFWSWVGFESTAMY

SEQ ID NO: 1115155 - protein, 17 aa, Mycobacterium
GQPHLSATLGLLPDADA

SEQ ID NO: 1115156 - protein, 24 aa, Mycobacterium
GRISAFVRWVARTPWPVFTLGMLQ

SEQ ID NO: 1115157 - protein, 19 aa, Mycobacterium
HATDLLFNGVIGRQLPAGL

SEQ ID NO: 1115158 - protein, 23 aa, Mycobacterium
HDAFERPGLLILVFVVTIVSAGF

SEQ ID NO: 1115159 - protein, 21 aa, Mycobacterium
HELRTPLTTIRGFAELYRQGA

SEQ ID NO: 1115160 - protein, 25 aa, Mycobacterium
HIVDVKRALAWIKEHIAEYGGDPDF

SEQ ID NO: 1115161 - protein, 25 aa, Mycobacterium
HTGGAWLILFMIFNVIWTYALVRGA

SEQ ID NO: 1115162 - protein, 26 aa, Mycobacterium
IACGLAALCYAEFASTVPVAGSAYTF

SEQ ID NO: 1115163 - protein, 20 aa, Mycobacterium
IAPELYLKRLCVGGVERVFE

SEQ ID NO: 1115164 - protein, 20 aa, Mycobacterium
IEALTGFLAAFINVRISAPV

SEQ ID NO: 1115165 - protein, 27 aa, Mycobacterium
IGRFGEKRAPFALGVAALLFGFPIFFD

SEQ ID NO: 1115166 - protein, 24 aa, Mycobacterium
IQESIKGLAAYAMQFGETIAAGPF

SEQ ID NO: 1115167 - protein, 28 aa, Mycobacterium
ISVLPIIALMVIAVWLLGVGTLMDLALV

SEQ ID NO: 1115168 - protein, 17 aa, Mycobacterium
IVSEIFPVFSRKPIFGY

SEQ ID NO: 1115169 - protein, 22 aa, Mycobacterium
IWAEEAWGRYWGWDPKETVSFI

SEQ ID NO: 1115170 - protein, 23 aa, Mycobacterium
KKRPRLTMFDDFGGRVPSDKPPI

SEQ ID NO: 1115171 - protein, 18 aa, Mycobacterium
KLAARLAALASLGAAVIH

SEQ ID NO: 1115172 - protein, 19 aa, Mycobacterium
KPFVRQIRTTRQMQELQPQ

SEQ ID NO: 1115173 - protein, 26 aa, Mycobacterium
KRIIPRATMIAVLGVGLFYVFVSWMA

SEQ ID NO: 1115174 - protein, 17 aa, Mycobacterium
LASAATVALAFLAMVFA

SEQ ID NO: 1115175 - protein, 22 aa, Mycobacterium
LGDRIGRQRVLALVILLMSAST

SEQ ID NO: 1115176 - protein, 24 aa, Mycobacterium
LGDRLGRKRVLAITIVLMAGATFC

SEQ ID NO: 1115177 - protein, 24 aa, Mycobacterium
LGSTMGILTWMFVDGHGSGLMNYT

SEQ ID NO: 1115178 - protein, 17 aa, Mycobacterium
LGVFPLIVMFLITSITM

SEQ ID NO: 1115179 - protein, 19 aa, Mycobacterium
LHRDVAIKVLRADLARDPS

SEQ ID NO: 1115180 - protein, 26 aa, Mycobacterium
LIMREARAGDRYLLCSDGLSDPVSHD

SEQ ID NO: 1115181 - protein, 18 aa, Mycobacterium
LLFGFPIFFDAGLVVFLP

SEQ ID NO: 1115182 - protein, 18 aa, Mycobacterium
LLFIGVLFGLLLVTGTTI

SEQ ID NO: 1115183 - protein, 24 aa, Mycobacterium
LLTDFKGGSTFLGMEKLPHTAAVV

SEQ ID NO: 1115184 - protein, 18 aa, Mycobacterium
LMLLGGRLGDTIGRKRTF

SEQ ID NO: 1115185 - protein, 24 aa, Mycobacterium
LNERELRAVLGHELSHVYNRDILI

SEQ ID NO: 1115186 - protein, 17 aa, Mycobacterium
LQLWNFLALVLDSLAIA

SEQ ID NO: 1115187 - protein, 23 aa, Mycobacterium
LREFGNIVFHFSLLGLLVAIAAG

SEQ ID NO: 1115188 - protein, 19 aa, Mycobacterium
LRGDYLAIVTLGFGEIIRL

SEQ ID NO: 1115189 - protein, 22 aa, Mycobacterium
LRQLRWALGEVQRGNYNAHMQI

SEQ ID NO: 1115190 - protein, 18 aa, Mycobacterium
LRTPLTAMRADLDTLRIH

SEQ ID NO: 1115191 - protein, 25 aa, Mycobacterium
LRVIQGVAIGGEWGGATLMVTEHAE

SEQ ID NO: 1115192 - protein, 18 aa, Mycobacterium
LSAIPMGVPLEWNVFMMF

SEQ ID NO: 1115193 - protein, 17 aa, Mycobacterium
LSSLRIVFVSGSQLGAE

SEQ ID NO: 1115194 - protein, 19 aa, Mycobacterium
LTFGGLMLLGGRLGDTIGR

SEQ ID NO: 1115195 - protein, 22 aa, Mycobacterium
LTHGFFKAGLFLGAGSVMHAMD

SEQ ID NO: 1115196 - protein, 18 aa, Mycobacterium
LVAIALVRQRWRGQRAVD

SEQ ID NO: 1115197 - protein, 24 aa, Mycobacterium
LVAQLGVACAVAIAVDATIVRLVL

SEQ ID NO: 1115198 - protein, 20 aa, Mycobacterium
LVRYLAREYLLIVSTSSSES

SEQ ID NO: 1115199 - protein, 19 aa, Mycobacterium
MFADVRFAGVIFPVVGWWL

SEQ ID NO: 1115200 - protein, 36 aa, Mycobacterium; identical to SEQ ID NO: 320446

SEQ ID NO: 1115201 - protein, 25 aa, Mycobacterium
MMESEFPGELGVLFKNLETKGNPWG

SEQ ID NO: 1115202 - protein, 26 aa, Mycobacterium
MTVARRFGGSLLLYAFPAAGAFAAMH

SEQ ID NO: 1115203 - protein, 26 aa, Mycobacterium
MVHLARIFFTGAFRRPREANWVIGSL

SEQ ID NO: 1115204 - protein, 18 aa, Mycobacterium
NAAHELRTPLTAMRADLD

SEQ ID NO: 1115205 - protein, 25 aa, Mycobacterium
NDSGFWLVSRFFGMDVKTTLKTWTV

SEQ ID NO: 1115206 - protein, 27 aa, Mycobacterium
NNGLRPEPIIALGILLTWCSVERGVAT

SEQ ID NO: 1115207 - protein, 26 aa, Mycobacterium
PDDLRFAVAGIARFSETLNQRDAQLR

SEQ ID NO: 1115208 - protein, 20 aa, Mycobacterium
PDLLDGVGLIVGIDRFMSEA

SEQ ID NO: 1115209 - protein, 18 aa, Mycobacterium
PFNNGLRPEGQIATGALI

SEQ ID NO: 1115210 - protein, 17 aa, Mycobacterium
PRTLPNAVAPVIAGTGA

SEQ ID NO: 1115211 - protein, 24 aa, Mycobacterium
PVFGFGVIFGAIWAEEAWGRYWGW

SEQ ID NO: 1115212 - protein, 18 aa, Mycobacterium
PVLIRLFTRQGFGHEIRE

SEQ ID NO: 1115213 - protein, 18 aa, Mycobacterium
PVLMDWAVGLAFPCQQPM

SEQ ID NO: 1115214 - protein, 22 aa, Mycobacterium
PVSHMWVTKFLRTHGLIHDCPK

SEQ ID NO: 1115215 - protein, 20 aa, Mycobacterium
QRQALRAGLSVRPMIVTLIG

SEQ ID NO: 1115216 - protein, 24 aa, Mycobacterium
QSYFGNDHFAEWAPGMKSIDDALE

SEQ ID NO: 1115217 - protein, 19 aa, Mycobacterium
RAILYKPFVRQIRTTRQMQ

SEQ ID NO: 1115218 - protein, 19 aa, Mycobacterium
RGGYDFRPQIVGVFTDLSG

SEQ ID NO: 1115219 - protein, 24 aa, Mycobacterium
RGSYGGVLMFGMLTSFAGLGMFNP

SEQ ID NO: 1115220 - protein, 18 aa, Mycobacterium
RITVLAMDAVPRISRAQS

SEQ ID NO: 1115221 - protein, 23 aa, Mycobacterium
RRTGKFASFAVAFAFVSIATGIF

SEQ ID NO: 1115222 - protein, 25 aa, Mycobacterium
RSLVRSGMDLGPWLVSRDITVVSTV

SEQ ID NO: 1115223 - protein, 25 aa, Mycobacterium
RVSSLDFFVSLAFMPVSFAIVGPLS

SEQ ID NO: 1115224 - protein, 17 aa, Mycobacterium
RVYLTWITSTGYTYGAL

SEQ ID NO: 1115225 - protein, 20 aa, Mycobacterium
SITLDGQWVLVTFTVADGIR

SEQ ID NO: 1115226 - protein, 22 aa, Mycobacterium
SQFDALHFAKPIFGPAARALAQ

SEQ ID NO: 1115227 - protein, 22 aa, Mycobacterium
SVHVYRLVWRQMILFAHNIIIF

SEQ ID NO: 1115228 - protein, 20 aa, Mycobacterium
TATFLVWWAVGAGVQTALLF

SEQ ID NO: 1115229 - protein, 24 aa, Mycobacterium
TFPAMFPTQVRYAGFAIAYNVSTS

SEQ ID NO: 1115230 - protein, 19 aa, Mycobacterium
TFTGIRLAVGMAYSSVVAA

SEQ ID NO: 1115231 - protein, 26 aa, Mycobacterium
TLLVAIPFTVLVAFTLNILLREIGAA

SEQ ID NO: 1115232 - protein, 18 aa, Mycobacterium
TPALPIPYPRTGQGGDPK

SEQ ID NO: 1115233 - protein, 17 aa, Mycobacterium
TPGRGFRNGPFASEIEL

SEQ ID NO: 1115234 - protein, 23 aa, Mycobacterium
TPTKWTHHFGVFAGLAGSLGALA

SEQ ID NO: 1115235 - protein, 19 aa, Mycobacterium
TVADGIRLGDRTEASIKTT

SEQ ID NO: 1115236 - protein, 17 aa, Mycobacterium
VAGAFVFSDLVMMKYLA

SEQ ID NO: 1115237 - protein, 25 aa, Mycobacterium
VALLVGFGVMIGRLLEITGGAQVLA

SEQ ID NO: 1115238 - protein, 20 aa, Mycobacterium
VATPCPLLLAAPVAIVSGLS

SEQ ID NO: 1115239 - protein, 18 aa, Mycobacterium
VEFLWGRLPLYIVAIYPM

SEQ ID NO: 1115240 - protein, 18 aa, Mycobacterium
VGEAAMLAFLFSISEGLE

SEQ ID NO: 1115241 - protein, 19 aa, Mycobacterium
VGFLLLLWLFIWSVLRILR

SEQ ID NO: 1115242 - protein, 22 aa, Mycobacterium
VVALPLALAFGISSGVGAAAGL

SEQ ID NO: 1115243 - protein, 24 aa, Mycobacterium
VVGLGCGFGPLNNRFFPPMGSILY

SEQ ID NO: 1115244 - protein, 25 aa, Mycobacterium
WAAGVLGALAIVIAILIVLNAQDRK

SEQ ID NO: 1115245 - protein, 17 aa, Mycobacterium
WAVGLAFPCQQPMLHAN

SEQ ID NO: 1115246 - protein, 18 aa, Mycobacterium
WGPVVWVLLGEMFPNRIR

SEQ ID NO: 1115247 - protein, 17 aa, Mycobacterium
WIGTMWKGQLTFETPML

SEQ ID NO: 1115248 - protein, 17 aa, Mycobacterium
WLLLAPRDYLSTFMKVG

SEQ ID NO: 1115249 - protein, 18 aa, Mycobacterium
WMGVLIWCVYVFNMTMFA

SEQ ID NO: 1115250 - protein, 17 aa, Mycobacterium
WPAGTCLGIDPATNQPT

SEQ ID NO: 1115251 - protein, 17 aa, Mycobacterium
WQFGITTVYHFIFVPLT

SEQ ID NO: 1115252 - protein, 19 aa, Mycobacterium
WYTQLPFLLEAMLAALIGV

SEQ ID NO: 1115253 - protein, 20 aa, Mycobacterium
YLRFRREAQNAAALNHPAIV

SEQ ID NO: 1115254 - protein, 18 aa, Mycobacterium
YSFLPSWLSFLVDKENAR

SEQ ID NO: 1115255 - protein, 20 aa, Mycobacterium
YSIDELPQFINVLKRDMSVV

SEQ ID NO: 1115256 - protein, 17 aa, Mycobacterium
YVFPLGVVVGGPFLPLA

SEQ ID NO: 1115257 - protein, 23 aa, Mycobacterium
AAAAAVGCVLSWAAAGRPATAAP

SEQ ID NO: 1115258 - protein, 20 aa, Mycobacterium
AAAAAVWLVAPCTELFEDER

SEQ ID NO: 1115259 - protein, 36 aa, Mycobacterium
AAADPRAKLLRKRRWALRLGLFFTVTSVFWILVTAV

SEQ ID NO: 1115260 - protein, 18 aa, Mycobacterium
AAAFLQLRIDRVTPDVVT

SEQ ID NO: 1115261 - protein, 18 aa, Mycobacterium
AAAGMAWEVLGARAERTG

SEQ ID NO: 1115262 - protein, 17 aa, Mycobacterium
AAAKLGVTWEMSFLYAV

SEQ ID NO: 1115263 - protein, 18 aa, Mycobacterium
AAALLFPAAVCAAAAVLC

SEQ ID NO: 1115264 - protein, 25 aa, Mycobacterium
AAALVLAVLCFLNLSESIDLLAIWI

SEQ ID NO: 1115265 - protein, 25 aa, Mycobacterium
AAAPGQRPLAVGVTWTESVTEQAAG

SEQ ID NO: 1115266 - protein, 18 aa, Mycobacterium
AAAPGVAVFSVFAVLSSA

SEQ ID NO: 1115267 - protein, 25 aa, Mycobacterium
AAAPRQIAWGGLLFALGVIVLAVFV

SEQ ID NO: 1115268 - protein, 17 aa, Mycobacterium
AAARGLRTAPPTAHYLR

SEQ ID NO: 1115269 - protein, 21 aa, Mycobacterium
AAARPLWFVLVGFGLIITALA

SEQ ID NO: 1115270 - protein, 27 aa, Mycobacterium
AAAVAVLAVRGWPLRILAVLVAAASAG

SEQ ID NO: 1115271 - protein, 19 aa, Mycobacterium
AADLCALLLQIYVVMGAGW

SEQ ID NO: 1115272 - protein, 18 aa, Mycobacterium
AAELRLPPDTTREDREQV

SEQ ID NO: 1115273 - protein, 18 aa, Mycobacterium
AAGEIPLVLVLLALLIQW

SEQ ID NO: 1115274 - protein, 24 aa, Mycobacterium
AAGFRFVDTLAMCLGVTAVSALFG

SEQ ID NO: 1115275 - protein, 18 aa, Mycobacterium
AAGGIAWLAGWRSAADLC

SEQ ID NO: 1115276 - protein, 21 aa, Mycobacterium
AAGITVWLGLVANLGGVAGQQ

SEQ ID NO: 1115277 - protein, 26 aa, Mycobacterium
AAGLGAAALICFAVLVPPVGSRTSER

SEQ ID NO: 1115278 - protein, 19 aa, Mycobacterium
AAGLVGALAFWVSHSVAGM

SEQ ID NO: 1115279 - protein, 25 aa, Mycobacterium
AAGMAVGVLVGWGLLELFPGDLERD

SEQ ID NO: 1115280 - protein, 24 aa, Mycobacterium
AAGPSFWWGFLLVFAGQFLVALVF

SEQ ID NO: 1115281 - protein, 22 aa, Mycobacterium
AAGRFAAGGLRVLACAVRTPYE

SEQ ID NO: 1115282 - protein, 17 aa, Mycobacterium
AAGWYLLLAELWPADSR

SEQ ID NO: 1115283 - protein, 25 aa, Mycobacterium
AAHLRRRPAEVIPVGRPWMGRDDFR

SEQ ID NO: 1115284 - protein, 22 aa, Mycobacterium
AAHVAVGFLLKIGSSGVIFQTA

SEQ ID NO: 1115285 - protein, 26 aa, Mycobacterium
AAIAFLLFAAWTWREGRNAGGDDDVR

SEQ ID NO: 1115286 - protein, 23 aa, Mycobacterium
AAIALLGIFAFYLAFVAELPPPP

SEQ ID NO: 1115287 - protein, 18 aa, Mycobacterium
AAIGYGIGVFISKMLVRF

SEQ ID NO: 1115288 - protein, 19 aa, Mycobacterium
AAIRARSGLHLLMLGALAA

SEQ ID NO: 1115289 - protein, 17 aa, Mycobacterium
AAIRLTFAMARDNALPF

SEQ ID NO: 1115290 - protein, 20 aa, Mycobacterium
AAISEIWLDLDSAGPWLFGI

SEQ ID NO: 1115291 - protein, 17 aa, Mycobacterium
AAKRSSYLHFSRRPDTT

SEQ ID NO: 1115292 - protein, 22 aa, Mycobacterium
AALAYVCVLAYLGITQSLHAAL

SEQ ID NO: 1115293 - protein, 23 aa, Mycobacterium
AALCAAGICLIAYQGSRLGEDAL

SEQ ID NO: 1115294 - protein, 23 aa, Mycobacterium
AALCASIAGALFAPIVGFMAPSQ

SEQ ID NO: 1115295 - protein, 23 aa, Mycobacterium
AALDAGYTYGLLWVAAVAVLVGG

SEQ ID NO: 1115296 - protein, 26 aa, Mycobacterium
AALGRRIVARFGWRRPQTLLAAGLLV

SEQ ID NO: 1115297 - protein, 26 aa, Mycobacterium
AALGSDWPFVVGIAVATLLLSVAAGA

SEQ ID NO: 1115298 - protein, 28 aa, Mycobacterium
AALLIKYLWPMRRMRAADVRTMSLVAGG

SEQ ID NO: 1115299 - protein, 22 aa, Mycobacterium
AALLSWGGWLVVTAVVFSFANG

SEQ ID NO: 1115300 - protein, 21 aa, Mycobacterium
AALRALLDMGAKDVAVLRDSR

SEQ ID NO: 1115301 - protein, 23 aa, Mycobacterium
AALREVLNRVALPHLADRLDEEK

SEQ ID NO: 1115302 - protein, 19 aa, Mycobacterium
AALSHIMWLLVRRRRELTC

SEQ ID NO: 1115303 - protein, 30 aa, Mycobacterium
AALVAVTVSVWWRPAAVVAVVLTVSAVVLA

SEQ ID NO: 1115304 - protein, 26 aa, Mycobacterium
AALVAWWMWEKRRIHPLVSTRMLAKP

SEQ ID NO: 1115305 - protein, 24 aa, Mycobacterium
AALVGCFAFGWGFTAATSSLILWT

SEQ ID NO: 1115306 - protein, 23 aa, Mycobacterium
AALWPAEALEAVRLLIFGGEACP

SEQ ID NO: 1115307 - protein, 30 aa, Mycobacterium
AAMGVGITEAVLWFIRRWLVSRATMGVEAD

SEQ ID NO: 1115308 - protein, 19 aa, Mycobacterium
AAMPLLLGVCTVAVTMGLV

SEQ ID NO: 1115309 - protein, 24 aa, Mycobacterium
AAMWPQLGAPLGFLLANGLFLGLI

SEQ ID NO: 1115310 - protein, 24 aa, Mycobacterium
AANGLCFAGSFFFTSAAWVQLVRS

SEQ ID NO: 1115311 - protein, 24 aa, Mycobacterium
AANLKFIGDMFIRLIQMSIVPLVM

SEQ ID NO: 1115312 - protein, 20 aa, Mycobacterium
AAPICLLMFAILAVVLLLLN

SEQ ID NO: 1115313 - protein, 17 aa, Mycobacterium
AARAWRRPLSLTPTGVL

SEQ ID NO: 1115314 - protein, 25 aa, Mycobacterium
AAREKRWGPTHIRRAAAAAVVGLIL

SEQ ID NO: 1115315 - protein, 23 aa, Mycobacterium
AARRALTSPVRWSSRSGRHSARS

SEQ ID NO: 1115316 - protein, 19 aa, Mycobacterium
AARSWRRRLLIVVAGGLLP

SEQ ID NO: 1115317 - protein, 17 aa, Mycobacterium
AASDDWVVIAARLLGMQ

SEQ ID NO: 1115318 - protein, 18 aa, Mycobacterium
AASGARRGVGLALLAAVT

SEQ ID NO: 1115319 - protein, 35 aa, Mycobacterium
AASVWKRIAAVLLRIEPWLPKALFVLVVAGALLSF

SEQ ID NO: 1115320 - protein, 19 aa, Mycobacterium
AASYSWYYAWTPGTGYLAN

SEQ ID NO: 1115321 - protein, 19 aa, Mycobacterium
AATAYRLFTGSPPFPHSNP

SEQ ID NO: 1115322 - protein, 21 aa, Mycobacterium
AATPRRRGFLSSFQYVTLVGG

SEQ ID NO: 1115323 - protein, 23 aa, Mycobacterium
AATRRYTYGFGRAEDIAGLFVVA

SEQ ID NO: 1115324 - protein, 25 aa, Mycobacterium
AATTWELVVVFPWFAVAVATACVGA

SEQ ID NO: 1115325 - protein, 21 aa, Mycobacterium
AATVMRFVLLRGWVFHPRRTR

SEQ ID NO: 1115326 - protein, 20 aa, Mycobacterium
AAVCFVIRMLGVRYQLNAPR

SEQ ID NO: 1115327 - protein, 24 aa, Mycobacterium
AAVFCVLGVLPLIVLTQLGIIVGL

SEQ ID NO: 1115328 - protein, 25 aa, Mycobacterium
AAVLAVCGFFGWGFATTMAGLPFAM

SEQ ID NO: 1115329 - protein, 24 aa, Mycobacterium
AAVLSRMPLVLGIIGLTSLVLLFL

SEQ ID NO: 1115330 - protein, 23 aa, Mycobacterium
AAVLSVLALLLVIAELINKPSEA

SEQ ID NO: 1115331 - protein, 20 aa, Mycobacterium
AAVLVGWVARDWWMRRRGWT

SEQ ID NO: 1115332 - protein, 17 aa, Mycobacterium
AAVPAVWAQQNLVSEQG

SEQ ID NO: 1115333 - protein, 19 aa, Mycobacterium
AAVRRTVMTSGRTIMFSAV

SEQ ID NO: 1115334 - protein, 19 aa, Mycobacterium
AAVVLVHWFVIARREVDPE

SEQ ID NO: 1115335 - protein, 27 aa, Mycobacterium
AAVYYWVICLVLSFGQGRIERRLERYV

SEQ ID NO: 1115336 - protein, 22 aa, Mycobacterium
AAWASRWHPVDVVLGPGTTITV

SEQ ID NO: 1115337 - protein, 23 aa, Mycobacterium
AAYSSRWWLSGLLVGAGAGVKLT

SEQ ID NO: 1115338 - protein, 21 aa, Mycobacterium
AAYTRRTEVGIMRLVGASRWY

SEQ ID NO: 1115339 - protein, 18 aa, Mycobacterium
ACGLICAGAALPAYLAGS

SEQ ID NO: 1115340 - protein, 18 aa, Mycobacterium
ACGLLFLSATGLTWSHYA

SEQ ID NO: 1115341 - protein, 30 aa, Mycobacterium
ACLIATAALILSVWTWWQARPPSYDAAAQA

SEQ ID NO: 1115342 - protein, 24 aa, Mycobacterium
ACPKEPDLRLTLLRPSDEEDVPDI

SEQ ID NO: 1115343 - protein, 20 aa, Mycobacterium
ADALAGLVWVNTTAATAAAM

SEQ ID NO: 1115344 - protein, 23 aa, Mycobacterium
ADATFLDLMWPMLLAASGIGLCT

SEQ ID NO: 1115345 - protein, 31 aa, Mycobacterium
ADDRPAVVPWYRRTPVALAIGAAAVLAALAA

SEQ ID NO: 1115346 - protein, 17 aa, Mycobacterium
ADEAVPDVLERMARGHT

SEQ ID NO: 1115347 - protein, 20 aa, Mycobacterium
ADEQRPALFDAQRVADLADA

SEQ ID NO: 1115348 - protein, 26 aa, Mycobacterium
ADGPKAVLWTSGWTPRFTGETIFLAR

SEQ ID NO: 1115349 - protein, 23 aa, Mycobacterium
ADGYRPVAPTVRHLDLSGDLIDQ

SEQ ID NO: 1115350 - protein, 23 aa, Mycobacterium
ADHLRFAVAHVHPLALAWLDGGG

SEQ ID NO: 1115351 - protein, 22 aa, Mycobacterium
ADHTITRMRIRPGIAPTTTVLL

SEQ ID NO: 1115352 - protein, 22 aa, Mycobacterium
ADKPLLPSFAVKVVEQVATALD

SEQ ID NO: 1115353 - protein, 18 aa, Mycobacterium
ADKPWPNDYLQLAEAQKF

SEQ ID NO: 1115354 - protein, 19 aa, Mycobacterium
ADLALARGAALASAQGSVG

SEQ ID NO: 1115355 - protein, 17 aa, Mycobacterium
ADLLLRTEARVVARPDR

SEQ ID NO: 1115356 - protein, 24 aa, Mycobacterium
ADNLVIRLARRFLRTTDDYDGDKL

SEQ ID NO: 1115357 - protein, 21 aa, Mycobacterium
ADPATTWRGWVDHTLVIALIA

SEQ ID NO: 1115358 - protein, 22 aa, Mycobacterium
ADQKLGGSIAWAAGEIPLVLVL

SEQ ID NO: 1115359 - protein, 36 aa, Mycobacterium
ADQLPGLRPGTGLTIVTWLLRIGFLASPPLVGLIAD

SEQ ID NO: 1115360 - protein, 22 aa, Mycobacterium
ADSPVWRPMIIILGLATMLLAG

SEQ ID NO: 1115361 - protein, 18 aa, Mycobacterium
ADSRVWVAVGVGCAALAA

SEQ ID NO: 1115362 - protein, 17 aa, Mycobacterium
ADTMARRLIGWAPGHPG

SEQ ID NO: 1115363 - protein, 20 aa, Mycobacterium
ADVEALVGYVTRLSDDIDGA

SEQ ID NO: 1115364 - protein, 21 aa, Mycobacterium
ADVLIALGITAFGAHSAARTA

SEQ ID NO: 1115365 - protein, 22 aa, Mycobacterium
ADVRESGRLVIGVNVPYAPNEF

SEQ ID NO: 1115366 - protein, 25 aa, Mycobacterium
ADVRIAHPLISRAHLVLRFDQGRWV

SEQ ID NO: 1115367 - protein, 19 aa, Mycobacterium
ADVSLSVAFPGEVTSTNGD

SEQ ID NO: 1115368 - protein, 24 aa, Mycobacterium
ADYPTVLLSGDWLSREQVTAASQF

SEQ ID NO: 1115369 - protein, 27 aa, Mycobacterium
ADYRVRAALKYVWRDKPLFLALLAVTT

SEQ ID NO: 1115370 - protein, 27 aa, Mycobacterium
AEAAEPLFGSWGVRLTVAVAVVATMSG

SEQ ID NO: 1115371 - protein, 24 aa, Mycobacterium
AEADLRGLLPRGYAADACEMRTPP

SEQ ID NO: 1115372 - protein, 18 aa, Mycobacterium
AEADLRIANARLQSGGEV

SEQ ID NO: 1115373 - protein, 24 aa, Mycobacterium
AEADRYRAAYVLQYGDIFIVTTII

SEQ ID NO: 1115374 - protein, 23 aa, Mycobacterium
AEAEAKAAEAARLRDVASTHREA

SEQ ID NO: 1115375 - protein, 22 aa, Mycobacterium
AEAGVSLLTRWLSSNIGEGLIF

SEQ ID NO: 1115376 - protein, 23 aa, Mycobacterium
AEAPVNTGPTWRPTQRPSQTKKP

SEQ ID NO: 1115377 - protein, 18 aa, Mycobacterium
AEARTVAMLNHPGIASVY

SEQ ID NO: 1115378 - protein, 18 aa, Mycobacterium
AEDIAGLFVVAMIALSAI

SEQ ID NO: 1115379 - protein, 23 aa, Mycobacterium
AEENELYPALARPLGSGEATATM

SEQ ID NO: 1115380 - protein, 23 aa, Mycobacterium
AEFAPDRHRGFVVSFLVWSVVVG

SEQ ID NO: 1115381 - protein, 17 aa, Mycobacterium
AEFPGRPQLVFLTFVVV

SEQ ID NO: 1115382 - protein, 21 aa, Mycobacterium
AEGPFSVGIWSTWMSGQPDGR

SEQ ID NO: 1115383 - protein, 22 aa, Mycobacterium
AEGRTPVWFAVDGEICGVAVVS

SEQ ID NO: 1115384 - protein, 18 aa, Mycobacterium
AEGYRSARVQSWLDPSAD

SEQ ID NO: 1115385 - protein, 24 aa, Mycobacterium
AEHDELRETLPLLRDAADRLAEAP

SEQ ID NO: 1115386 - protein, 24 aa, Mycobacterium
AEHIGFSVWSIWSVMVLFMPEAVY

SEQ ID NO: 1115387 - protein, 23 aa, Mycobacterium
AEITRLAPVVGFLAAVLVLAQLC

SEQ ID NO: 1115388 - protein, 23 aa, Mycobacterium
AELEARGVLALAQITGIHETNTR

SEQ ID NO: 1115389 - protein, 20 aa, Mycobacterium
AELLAAFFWTAYLFGAFLIY

SEQ ID NO: 1115390 - protein, 21 aa, Mycobacterium
AELPAAVTATVFGVLAGFAVR

SEQ ID NO: 1115391 - protein, 24 aa, Mycobacterium
AELPEYRILPNFKQVVTSSNQWQS

SEQ ID NO: 1115392 - protein, 25 aa, Mycobacterium
AELRRDRTSFIIAHRLSTIRDADLI

SEQ ID NO: 1115393 - protein, 20 aa, Mycobacterium
AEMFPTRMRYSGVSLGYQVT

SEQ ID NO: 1115394 - protein, 23 aa, Mycobacterium
AEPAREVATVLGLDEVYAEQSPA

SEQ ID NO: 1115395 - protein, 33 aa, Mycobacterium
AEPGARRRLLLKATRIDVGLAMLIAGAVNMSML

SEQ ID NO: 1115396 - protein, 22 aa, Mycobacterium
AEPYPGPGIGLIIGWLAVIVLT

SEQ ID NO: 1115397 - protein, 21 aa, Mycobacterium
AERSVGLSIWLMRTPEGKAVL

SEQ ID NO: 1115398 - protein, 24 aa, Mycobacterium
AESGTFGALAWSDADDIPDVAPAA

SEQ ID NO: 1115399 - protein, 19 aa, Mycobacterium
AESRASIVHGDYRIDNTIL

SEQ ID NO: 1115400 - protein, 27 aa, Mycobacterium
AETAWPFLAGTAVGWLAARAWRRPLSL

SEQ ID NO: 1115401 - protein, 19 aa, Mycobacterium
AETGGPRRATWLVVGVALV

SEQ ID NO: 1115402 - protein, 20 aa, Mycobacterium
AEVAFLAYVVHFGRKAVRAG

SEQ ID NO: 1115403 - protein, 19 aa, Mycobacterium
AEVFSKLYRDVLCAQRNAL

SEQ ID NO: 1115404 - protein, 28 aa, Mycobacterium
AEVGGAAWLPFLVAFLIATITAFSYLEL

SEQ ID NO: 1115405 - protein, 19 aa, Mycobacterium
AEVGYLLSMHPSVLATLKV

SEQ ID NO: 1115406 - protein, 20 aa, Mycobacterium
AEVLRQIAAIGLGAGSLAVV

SEQ ID NO: 1115407 - protein, 30 aa, Mycobacterium
AEVSMWLVLTFPAWVLVVSALIYSREVTPR

SEQ ID NO: 1115408 - protein, 23 aa, Mycobacterium
AEVTSIDTIVPWSSHQAQVLFTM

SEQ ID NO: 1115409 - protein, 17 aa, Mycobacterium
AFAAMVFYPLHLLPFGL

SEQ ID NO: 1115410 - protein, 24 aa, Mycobacterium
AFASPENAVRCAIALQHSLRRRPN

SEQ ID NO: 1115411 - protein, 18 aa, Mycobacterium
AFATWLLVNLPIMVLFPR

SEQ ID NO: 1115412 - protein, 18 aa, Mycobacterium
AFAVIAYFHFHKEHPSSA

SEQ ID NO: 1115413 - protein, 17 aa, Mycobacterium
AFEQRYLDWSVWIGVAV

SEQ ID NO: 1115414 - protein, 17 aa, Mycobacterium
AFFCFTTLVAYYYMAET

SEQ ID NO: 1115415 - protein, 18 aa, Mycobacterium
AFGADVWLLAALAAPLLT

SEQ ID NO: 1115416 - protein, 26 aa, Mycobacterium
AFGGPGALFWMWAVAFLGASTSFVEC

SEQ ID NO: 1115417 - protein, 27 aa, Mycobacterium
AFLLGPDNFFAWALSVMFLVFTLRAIL

SEQ ID NO: 1115418 - protein, 27 aa, Mycobacterium
AFLLLARPLFWARVRRGALFKAAGVLA

SEQ ID NO: 1115419 - protein, 19 aa, Mycobacterium
AFLSWAGFEACASMGEETD

SEQ ID NO: 1115420 - protein, 23 aa, Mycobacterium
AFPEGTTWCGLGYGRFRPAMFQA

SEQ ID NO: 1115421 - protein, 19 aa, Mycobacterium
AFSLLGLRQLYFLIDGLLD

SEQ ID NO: 1115422 - protein, 19 aa, Mycobacterium
AFVGIPVGRWLDRVGPRWI

SEQ ID NO: 1115423 - protein, 21 aa, Mycobacterium
AFVRRRARVPVTAVGVVAFVA

SEQ ID NO: 1115424 - protein, 17 aa, Mycobacterium
AGAALRHRGNGVLVSRA

SEQ ID NO: 1115425 - protein, 19 aa, Mycobacterium
AGAAMAFSSVFVVTNSLRL

SEQ ID NO: 1115426 - protein, 26 aa, Mycobacterium
AGAAQYSWFIGCGVAFALYYVLATRG

SEQ ID NO: 1115427 - protein, 18 aa, Mycobacterium
AGAEPLLVIITAAMFGAT

SEQ ID NO: 1115428 - protein, 18 aa, Mycobacterium
AGALLPVRAQRWWLALNV

SEQ ID NO: 1115429 - protein, 20 aa, Mycobacterium
AGAVAVLGNRHWVRNIAIGL

SEQ ID NO: 1115430 - protein, 17 aa, Mycobacterium
AGAVCRFLLDRTVTSAV

SEQ ID NO: 1115431 - protein, 21 aa, Mycobacterium
AGAVLVLLAGRRLWHRFRGQP

SEQ ID NO: 1115432 - protein, 32 aa, Mycobacterium
AGAYGGGLLARFIPGTVLLIGFAVMMVATAVA

SEQ ID NO: 1115433 - protein, 26 aa, Mycobacterium
AGCGTWLIYRITRRVGRKQRESGFRW

SEQ ID NO: 1115434 - protein, 18 aa, Mycobacterium
AGENLSLMLAGSQLGITI

SEQ ID NO: 1115435 - protein, 18 aa, Mycobacterium
AGGALAWMAADTVAPLAY

SEQ ID NO: 1115436 - protein, 23 aa, Mycobacterium
AGGLAVLIMVLWVGTALTISTTD

SEQ ID NO: 1115437 - protein, 24 aa, Mycobacterium
AGGMVARAGLRPVGRLTQAAERVA

SEQ ID NO: 1115438 - protein, 25 aa, Mycobacterium
AGGPTRELWMVLALAVGAAVAVKVG

SEQ ID NO: 1115439 - protein, 25 aa, Mycobacterium
AGGRYELGETLPLDAGKILGVGLAL

SEQ ID NO: 1115440 - protein, 21 aa, Mycobacterium
AGILRPEIRVGAGALLAAALV

SEQ ID NO: 1115441 - protein, 27 aa, Mycobacterium
AGISRSRLLRWPARVYTDIFRGLPEVV

SEQ ID NO: 1115442 - protein, 23 aa, Mycobacterium
AGKDAFPASFVVKLVDPEQHQEF

SEQ ID NO: 1115443 - protein, 26 aa, Mycobacterium
AGLALKTLLGMPVWIGPVVVGGIVIT

SEQ ID NO: 1115444 - protein, 20 aa, Mycobacterium
AGLHARCIDADTRLYLPMPF

SEQ ID NO: 1115445 - protein, 21 aa, Mycobacterium
AGLLGPWLLRAGFGEQYQADG

SEQ ID NO: 1115446 - protein, 17 aa, Mycobacterium
AGLLRLTSDAGWPVIAV

SEQ ID NO: 1115447 - protein, 19 aa, Mycobacterium
AGLRTGIIRAMGGSGSVVT

SEQ ID NO: 1115448 - protein, 18 aa, Mycobacterium
AGLSGFLVGQLVNAWVVV

SEQ ID NO: 1115449 - protein, 18 aa, Mycobacterium
AGLYRCAVGTFAALVSGH

SEQ ID NO: 1115450 - protein, 27 aa, Mycobacterium
AGMGFGRDLRSAIFDRVTRFSAEDTAR

SEQ ID NO: 1115451 - protein, 19 aa, Mycobacterium
AGMQWALGANAGFVAAAAA

SEQ ID NO: 1115452 - protein, 18 aa, Mycobacterium
AGNKYIARRNLIWSVAAE

SEQ ID NO: 1115453 - protein, 17 aa, Mycobacterium
AGPDHVWSLELPEEPVV

SEQ ID NO: 1115454 - protein, 26 aa, Mycobacterium
AGPLKFAQLVGFVFAAVGTIGFAAEW

SEQ ID NO: 1115455 - protein, 21 aa, Mycobacterium
AGPLLRLLVIAVISGAIALIG

SEQ ID NO: 1115456 - protein, 23 aa, Mycobacterium
AGPLPYIVMEYVDGVTLRDIVHS

SEQ ID NO: 1115457 - protein, 20 aa, Mycobacterium
AGPSSVWFVALFVGLMLIGL

SEQ ID NO: 1115458 - protein, 31 aa, Mycobacterium
AGRSDLRWWHPWAWLAYPGCYVVIALAVLNQ

SEQ ID NO: 1115459 - protein, 24 aa, Mycobacterium
AGSALPLLLLFSVANRSLVDVLTS

SEQ ID NO: 1115460 - protein, 19 aa, Mycobacterium
AGSLTFIAVLVMRETKDAP

SEQ ID NO: 1115461 - protein, 22 aa, Mycobacterium
AGSSWATLYLRDSVGAPGAIAA

SEQ ID NO: 1115462 - protein, 25 aa, Mycobacterium
AGSWFDAARPVGQWIDTVLRTLVGD

SEQ ID NO: 1115463 - protein, 22 aa, Mycobacterium
AGTQNWTAWLFGSLDPGNSITV

SEQ ID NO: 1115464 - protein, 21 aa, Mycobacterium
AGVAVGFGFLAKMLQAFLVLP

SEQ ID NO: 1115465 - protein, 17 aa, Mycobacterium
AGVKELDEVRGWRDRVL

SEQ ID NO: 1115466 - protein, 26 aa, Mycobacterium
AGVLVAACAVNFTMLLIGFIVTGIAV

SEQ ID NO: 1115467 - protein, 23 aa, Mycobacterium
AGVPRPAGVVAQGVLGVYIGTMV

SEQ ID NO: 1115468 - protein, 18 aa, Mycobacterium
AGVTLVFGELAPKRLAMQ

SEQ ID NO: 1115469 - protein, 27 aa, Mycobacterium
AGYLPRRLSVVNSRKAPTLALVVPGII

SEQ ID NO: 1115470 - protein, 42 aa, Mycobacterium
AHAPLWREFLRFWTVSFPVVAYRSWRWWLGSAAAFFLVAALI

SEQ ID NO: 1115471 - protein, 18 aa, Mycobacterium
AHHYLRMIYDILATALAL

SEQ ID NO: 1115472 - protein, 19 aa, Mycobacterium
AHIARSCGVPVIMTPLTGD

SEQ ID NO: 1115473 - protein, 23 aa, Mycobacterium
AHIPTLREAAVWSAFYVGIAILF

SEQ ID NO: 1115474 - protein, 24 aa, Mycobacterium
AHRGQWARVLPRFSALALGCVGVL

SEQ ID NO: 1115475 - protein, 18 aa, Mycobacterium
AHRLKRAATAVVVAAALA

SEQ ID NO: 1115476 - protein, 20 aa, Mycobacterium
AHYFILIGLFGIFVAGCTAV

SEQ ID NO: 1115477 - protein, 18 aa, Mycobacterium
AIADRPGIAPGFVAGYIA

SEQ ID NO: 1115478 - protein, 26 aa, Mycobacterium
AIEHPLWSSFVWRNEVSDTFVETVAA

SEQ ID NO: 1115479 - protein, 26 aa, Mycobacterium
AIELTWWPARRRELLLNSALAAALAQ

SEQ ID NO: 1115480 - protein, 22 aa, Mycobacterium
AIGLKYKFGYDDSLDVVGVHLV

SEQ ID NO: 1115481 - protein, 24 aa, Mycobacterium
AIGVASRVGRRTVLTSPLPNWLPD

SEQ ID NO: 1115482 - protein, 23 aa, Mycobacterium
AIINFLLIAAVVYFVILMPYKKL

SEQ ID NO: 1115483 - protein, 18 aa, Mycobacterium
AIIRRTRAGLSPFSPDKM

SEQ ID NO: 1115484 - protein, 24 aa, Mycobacterium
AILHKRLPEGFLHAMASVLFLLFG

SEQ ID NO: 1115485 - protein, 18 aa, Mycobacterium
AILMAIGLFALRFPVLID

SEQ ID NO: 1115486 - protein, 28 aa, Mycobacterium
AILVCIGAYVLLRFSLRTPPVIGGNGTK

SEQ ID NO: 1115487 - protein, 20 aa, Mycobacterium
AINAAWDRLGGSAGVLGVPA

SEQ ID NO: 1115488 - protein, 20 aa, Mycobacterium
AIRDAVLILLVFVAALVLVL

SEQ ID NO: 1115489 - protein, 25 aa, Mycobacterium
AIRVTPKFTRMIVAGLFGVLVLMLG

SEQ ID NO: 1115490 - protein, 34 aa, Mycobacterium
AISAMLIYRLVSWIFLAAIGWVVFFFVFRTEKDI

SEQ ID NO: 1115491 - protein, 18 aa, Mycobacterium
AISGDYLSAASFLGIAGA

SEQ ID NO: 1115492 - protein, 21 aa, Mycobacterium
AISPKKSWEGLVGSLLFGGTA

SEQ ID NO: 1115493 - protein, 27 aa, Mycobacterium
AIVLRDLRIPAIGVVLLLLSSLVVGAG

SEQ ID NO: 1115494 - protein, 27 aa, Mycobacterium
AIYNYTWLVLMLPFGMIGVTVLTVVMP

SEQ ID NO: 1115495 - protein, 23 aa, Mycobacterium
AKAPCTVNSFASLAQQGYFNDTP

SEQ ID NO: 1115496 - protein, 25 aa, Mycobacterium
AKGRREVWIPRSLGAAVVVMRLMPR

SEQ ID NO: 1115497 - protein, 21 aa, Mycobacterium
AKPGRRGWAAMWPQLGAPLGF

SEQ ID NO: 1115498 - protein, 17 aa, Mycobacterium
AKWEPFLTPNLWTTYVL

SEQ ID NO: 1115499 - protein, 20 aa, Mycobacterium
AKYPVAGSVYNWSKKLASRL

SEQ ID NO: 1115500 - protein, 24 aa, Mycobacterium
ALAAILCADLSMLSKAETERIWLP

SEQ ID NO: 1115501 - protein, 18 aa, Mycobacterium
ALAALGGYVWTRSAVERP

SEQ ID NO: 1115502 - protein, 18 aa, Mycobacterium
ALAEALPAALVPRLVLVD

SEQ ID NO: 1115503 - protein, 17 aa, Mycobacterium
ALAFAREGAELVVSDID

SEQ ID NO: 1115504 - protein, 20 aa, Mycobacterium
ALAGAIAWAVIAFFRGETVN

SEQ ID NO: 1115505 - protein, 18 aa, Mycobacterium
ALAGRTSLVIAHRLSTVR

SEQ ID NO: 1115506 - protein, 20 aa, Mycobacterium
ALAICLFSVGLLRDHGGDVL

SEQ ID NO: 1115507 - protein, 24 aa, Mycobacterium
ALALGARDRPDFALWDSPWQVVVG

SEQ ID NO: 1115508 - protein, 25 aa, Mycobacterium
ALALTVLAALAWRSGATRPRKDEAS

SEQ ID NO: 1115509 - protein, 27 aa, Mycobacterium
ALALVLAVAGGYLFWRNYTADAAEQAR

SEQ ID NO: 1115510 - protein, 18 aa, Mycobacterium
ALAPLGLLGSRLIFAHLF

SEQ ID NO: 1115511 - protein, 23 aa, Mycobacterium
ALAPLTLGLWWALYMVFIAVLSG

SEQ ID NO: 1115512 - protein, 18 aa, Mycobacterium
ALCAVVLVQAASRMFFLR

SEQ ID NO: 1115513 - protein, 19 aa, Mycobacterium
ALDAGRWQALMLPVTTLVI

SEQ ID NO: 1115514 - protein, 18 aa, Mycobacterium
ALDIARFGGAAFLIGYGL

SEQ ID NO: 1115515 - protein, 25 aa, Mycobacterium
ALEYARPGPDGAPVPAGRVDPYDIG

SEQ ID NO: 1115516 - protein, 23 aa, Mycobacterium
ALFLNFTAVIALAVCLASVGMSD

SEQ ID NO: 1115517 - protein, 23 aa, Mycobacterium
ALFVARSRVRSVSDFIDTRRGSI

SEQ ID NO: 1115518 - protein, 19 aa, Mycobacterium
ALGIDRWSKVKAVSAAVAF

SEQ ID NO: 1115519 - protein, 21 aa, Mycobacterium
ALGLACLRSGTAQLLARAAAV

SEQ ID NO: 1115520 - protein, 18 aa, Mycobacterium
ALGLAVVYAAVAAMAVQF

SEQ ID NO: 1115521 - protein, 24 aa, Mycobacterium
ALGLVASWLLSRRIKRHTRGLEVA

SEQ ID NO: 1115522 - protein, 18 aa, Mycobacterium
ALGVALIVLHRWRVPLGW

SEQ ID NO: 1115523 - protein, 17 aa, Mycobacterium
ALHCTWMSCAFVVVAGR

SEQ ID NO: 1115524 - protein, 25 aa, Mycobacterium
ALIDPTWFGGLTVAWLWLTVVFANL

SEQ ID NO: 1115525 - protein, 18 aa, Mycobacterium
ALIPLGIAGLVLIIDALK

SEQ ID NO: 1115526 - protein, 19 aa, Mycobacterium
ALIRRARDAGFERLDEIRA

SEQ ID NO: 1115527 - protein, 19 aa, Mycobacterium
ALLAALAWRALGSADGRDR

SEQ ID NO: 1115528 - protein, 18 aa, Mycobacterium
ALLALLGYLKVRRIRGPQ

SEQ ID NO: 1115529 - protein, 19 aa, Mycobacterium
ALLFLGGIYLFWNTVAGQA

SEQ ID NO: 1115530 - protein, 21 aa, Mycobacterium
ALLGARFINWVARRVTRRIDA

SEQ ID NO: 1115531 - protein, 19 aa, Mycobacterium
ALLIGFPIAMAVTAFGVMA

SEQ ID NO: 1115532 - protein, 25 aa, Mycobacterium
ALLLEYTAPLLVVAWLWLTTRRRPS

SEQ ID NO: 1115533 - protein, 24 aa, Mycobacterium
ALLPVLWILSLSLKPTSSVKDGKL

SEQ ID NO: 1115534 - protein, 26 aa, Mycobacterium
ALLRADVPGGVWARGLRARKRLERYF

SEQ ID NO: 1115535 - protein, 17 aa, Mycobacterium
ALLRLDGAMFFGAAERI

SEQ ID NO: 1115536 - protein, 31 aa, Mycobacterium
ALLRTLHVILGWRPVLLLPLTFALFTPLAVP

SEQ ID NO: 1115537 - protein, 17 aa, Mycobacterium
ALLTLAFIDVWQWTPFM

SEQ ID NO: 1115538 - protein, 24 aa, Mycobacterium
ALMACFMGSIGFVYANATALALGE

SEQ ID NO: 1115539 - protein, 17 aa, Mycobacterium
ALMAVKAVYCGTLGFWV

SEQ ID NO: 1115540 - protein, 17 aa, Mycobacterium
ALMFRFNNPDALLVLLL

SEQ ID NO: 1115541 - protein, 18 aa, Mycobacterium
ALMGRILLVSGLLVAGSW

SEQ ID NO: 1115542 - protein, 22 aa, Mycobacterium
ALNLSGAWRHSRGEGQTVAVID

SEQ ID NO: 1115543 - protein, 26 aa, Mycobacterium
ALPELRDDWRPVLWAVAILTMVVGTV

SEQ ID NO: 1115544 - protein, 23 aa, Mycobacterium
ALPPTTALGLWTFDAAAGNSQIT

SEQ ID NO: 1115545 - protein, 21 aa, Mycobacterium
ALPRHAKPVAPRRWPRALPIA

SEQ ID NO: 1115546 - protein, 24 aa, Mycobacterium
ALPVLRWAWTPPLFAGSLLTLMPL

SEQ ID NO: 1115547 - protein, 19 aa, Mycobacterium
ALRHRGNGVLVSRASHRRR

SEQ ID NO: 1115548 - protein, 31 aa, Mycobacterium
ALRRALRPALGWSIGIATYFLLLGAMLTSIL

SEQ ID NO: 1115549 - protein, 29 aa, Mycobacterium
ALRYYRKEVLRLIAEIGMGTGAMAVIGGT

SEQ ID NO: 1115550 - protein, 18 aa, Mycobacterium
ALSLCPKIGAAISATPAG

SEQ ID NO: 1115551 - protein, 20 aa, Mycobacterium
ALSVIACLIATAALILSVWT

SEQ ID NO: 1115552 - protein, 18 aa, Mycobacterium
ALTGFALPAEISGRGVAL

SEQ ID NO: 1115553 - protein, 23 aa, Mycobacterium
ALTLLRIRLPQALRVITPALASE

SEQ ID NO: 1115554 - protein, 18 aa, Mycobacterium
ALVIRQIYRPELDLVRYG

SEQ ID NO: 1115555 - protein, 18 aa, Mycobacterium
ALVLFDFFFHVRKAHIPT

SEQ ID NO: 1115556 - protein, 17 aa, Mycobacterium
ALVLLGFALVTFVAALA

SEQ ID NO: 1115557 - protein, 18 aa, Mycobacterium
ALVLLQLRVFYAREQPWT

SEQ ID NO: 1115558 - protein, 18 aa, Mycobacterium
ALVRLRDAGTAVGMYRGE

SEQ ID NO: 1115559 - protein, 25 aa, Mycobacterium
ALVWLRPPQRWRAQQRALTRAHRSL

SEQ ID NO: 1115560 - protein, 24 aa, Mycobacterium
ALWACADGLVTFRHLALMQIANTF

SEQ ID NO: 1115561 - protein, 18 aa, Mycobacterium
ALWICVLNPLVIIHLMGG

SEQ ID NO: 1115562 - protein, 23 aa, Mycobacterium
AMAAGLLLGRWVPGLNTVVESIA

SEQ ID NO: 1115563 - protein, 21 aa, Mycobacterium
AMATLRVAFLSALVLELLATL

SEQ ID NO: 1115564 - protein, 26 aa, Mycobacterium
AMDSYGWRIPFLIAGVLGGVGLYIRL

SEQ ID NO: 1115565 - protein, 24 aa, Mycobacterium
AMGLCVLAGLVSFASPCVVPLVPG

SEQ ID NO: 1115566 - protein, 26 aa, Mycobacterium
AMIASRLALLMSCVVYLAVWVRGRRP

SEQ ID NO: 1115567 - protein, 26 aa, Mycobacterium
AMITLPALGLWHLWSGSPQAPGERQQ

SEQ ID NO: 1115568 - protein, 18 aa, Mycobacterium
AMLGWLAVERIRDGHATS

SEQ ID NO: 1115569 - protein, 27 aa, Mycobacterium
AMMMPRYRISWGIAINVVGGMAVIYAF

SEQ ID NO: 1115570 - protein, 17 aa, Mycobacterium
AMNAGLVNPVFWLGMMI

SEQ ID NO: 1115571 - protein, 17 aa, Mycobacterium
AMSAVFYAPAFAALTRF

SEQ ID NO: 1115572 - protein, 20 aa, Mycobacterium
AMTRAGEVFEEFESDSSVMI

SEQ ID NO: 1115573 - protein, 19 aa, Mycobacterium
AMVLLPFTVMRHARLPRPA

SEQ ID NO: 1115574 - protein, 21 aa, Mycobacterium
ANLRSAWYRLPPREDAGPLLV

SEQ ID NO: 1115575 - protein, 27 aa, Mycobacterium
ANSAWILCAAIAYNLLRAVGVLAGGVH

SEQ ID NO: 1115576 - protein, 25 aa, Mycobacterium
ANVFTRINAILGVLFAIVLSTGSLI

SEQ ID NO: 1115577 - protein, 25 aa, Mycobacterium
APAAVAWAAMLGWIVLDGTWAQWLA

SEQ ID NO: 1115578 - protein, 18 aa, Mycobacterium
APAPELPDFQAIAAQQQE

SEQ ID NO: 1115579 - protein, 26 aa, Mycobacterium
APARLDDARFLLPVLGVPSEPGAESA

SEQ ID NO: 1115580 - protein, 18 aa, Mycobacterium
APASALWGLLAVIAANQL

SEQ ID NO: 1115581 - protein, 30 aa, Mycobacterium
APAVATRRSIPWERVFAYGVVPALALVLAV

SEQ ID NO: 1115582 - protein, 21 aa, Mycobacterium
APAWLTWGVVPAYMLVALLFG

SEQ ID NO: 1115583 - protein, 24 aa, Mycobacterium
APCPVPGCRDAAMVDFRDTIWLPT

SEQ ID NO: 1115584 - protein, 18 aa, Mycobacterium
APEKAAWGVALGLTVTLV

SEQ ID NO: 1115585 - protein, 19 aa, Mycobacterium
APFGYLDWLRWFGYTLVGN

SEQ ID NO: 1115586 - protein, 19 aa, Mycobacterium
APGRRVHVVAHDWGSTGMW

SEQ ID NO: 1115587 - protein, 25 aa, Mycobacterium
APIGVFCLLAALAGDVGFAVVTSAL

SEQ ID NO: 1115588 - protein, 17 aa, Mycobacterium
APKRLARPFGMLVDLLA

SEQ ID NO: 1115589 - protein, 19 aa, Mycobacterium
APLAFEGLVAFFFESTFIG

SEQ ID NO: 1115590 - protein, 20 aa, Mycobacterium
APLFIGWWIAGARYLMKNDP

SEQ ID NO: 1115591 - protein, 34 aa, Mycobacterium
APLVRLADRYAAWFLPLTLVLAGAAWLVSGSAVR

SEQ ID NO: 1115592 - protein, 20 aa, Mycobacterium
APMFLLGILGLIVFYQQLGW

SEQ ID NO: 1115593 - protein, 26 aa, Mycobacterium
APNLPIDTLFPFISMFAVSNTALINM

SEQ ID NO: 1115594 - protein, 20 aa, Mycobacterium
APPRLPAGYRWIAVRPGAPP

SEQ ID NO: 1115595 - protein, 32 aa, Mycobacterium
APRPPQQGRRSWGWVVAVVLVIAALVAIAILG

SEQ ID NO: 1115596 - protein, 18 aa, Mycobacterium
APRSLLRQAVRFGAVGVV

SEQ ID NO: 1115597 - protein, 19 aa, Mycobacterium
APSHLGAGLNAMFPGMPSV

SEQ ID NO: 1115598 - protein, 18 aa, Mycobacterium
APVELPPPSSAPVTTTQP

SEQ ID NO: 1115599 - protein, 22 aa, Mycobacterium
APVLVGVAWKLLLAPVGGGLAG

SEQ ID NO: 1115600 - protein, 19 aa, Mycobacterium
APVPAPWSVLAQFAAGPTL

SEQ ID NO: 1115601 - protein, 20 aa, Mycobacterium
APWLSRRFGLSRAISAALTI

SEQ ID NO: 1115602 - protein, 24 aa, Mycobacterium
AQADYPAPAGQYWVPRRLGGGAPT

SEQ ID NO: 1115603 - protein, 18 aa, Mycobacterium
AQFGFLLVWVIVLANVMA

SEQ ID NO: 1115604 - protein, 18 aa, Mycobacterium
AQHPRLPRQDALKVLTAA

SEQ ID NO: 1115605 - protein, 19 aa, Mycobacterium
AQIFEAFWTTIQLTVYSAV

SEQ ID NO: 1115606 - protein, 28 aa, Mycobacterium
AQPTIWEIGRPWYLAWAGLIYIVATLVT

SEQ ID NO: 1115607 - protein, 26 aa, Mycobacterium
AQRTRLAEVLGRIYGRPASLQLHIDP

SEQ ID NO: 1115608 - protein, 28 aa, Mycobacterium
AQRWSSPFWQTWDLLLLWLAQLHGGNGL

SEQ ID NO: 1115609 - protein, 23 aa, Mycobacterium
AQVVLIAAIIVMFGVAAVLAAIL

SEQ ID NO: 1115610 - protein, 26 aa, Mycobacterium
AQYGPKAPRLWLPPLDEPIRLVEVLQ

SEQ ID NO: 1115611 - protein, 17 aa, Mycobacterium
ARAALWGVEGDPEEPIT

SEQ ID NO: 1115612 - protein, 18 aa, Mycobacterium
ARAFARLIAFMDEHGYTH

SEQ ID NO: 1115613 - protein, 21 aa, Mycobacterium
ARARRLLPAAALVLVATAVGA

SEQ ID NO: 1115614 - protein, 21 aa, Mycobacterium
ARASWETWMVVLAVLVPALVV

SEQ ID NO: 1115615 - protein, 33 aa, Mycobacterium
ARAWRDLREGFGKRELWLHLGWQDIKQRYRRSV

SEQ ID NO: 1115616 - protein, 19 aa, Mycobacterium
ARDARAFHATGQMLFGPEL

SEQ ID NO: 1115617 - protein, 24 aa, Mycobacterium
AREAELLALFAGAVLRGADLTVLL

SEQ ID NO: 1115618 - protein, 19 aa, Mycobacterium
ARELLRVAFGPSVVALVVI

SEQ ID NO: 1115619 - protein, 19 aa, Mycobacterium
ARETLPVYLVQAAACAAVG

SEQ ID NO: 1115620 - protein, 18 aa, Mycobacterium
ARETVDWMRANLPSTAGP

SEQ ID NO: 1115621 - protein, 17 aa, Mycobacterium
ARGPAWRLMGIIFATIF

SEQ ID NO: 1115622 - protein, 19 aa, Mycobacterium
ARHYPVMVVLHTGLLAGCL

SEQ ID NO: 1115623 - protein, 27 aa, Mycobacterium
ARIPLPGSAPRPVWLHAFAHPEKDRRV

SEQ ID NO: 1115624 - protein, 18 aa, Mycobacterium
ARKQRIGPVWAVAVGYAV

SEQ ID NO: 1115625 - protein, 24 aa, Mycobacterium
ARKYFTYGDVLGFVYAQAKFQLTG

SEQ ID NO: 1115626 - protein, 20 aa, Mycobacterium
ARLAPDVELVCYRIAQESLT

SEQ ID NO: 1115627 - protein, 21 aa, Mycobacterium
ARLAVFAALVFGLFYLVAVER

SEQ ID NO: 1115628 - protein, 17 aa, Mycobacterium
ARLDGRSPVSIGLPLPG

SEQ ID NO: 1115629 - protein, 17 aa, Mycobacterium
ARLIPRVGVASVIAEGF

SEQ ID NO: 1115630 - protein, 26 aa, Mycobacterium
ARLPRPARLRPAGRMRWHAWVRLAVP

SEQ ID NO: 1115631 - protein, 19 aa, Mycobacterium
ARLSVPLLVQRGIDHGIPP

SEQ ID NO: 1115632 - protein, 20 aa, Mycobacterium
ARLTEAFNMMLRALTESRER

SEQ ID NO: 1115633 - protein, 28 aa, Mycobacterium
ARLTGRRVTRWEWLWAALLAGAVAVIVT

SEQ ID NO: 1115634 - protein, 18 aa, Mycobacterium
ARMGPRIVVTQLRPVLWV

SEQ ID NO: 1115635 - protein, 22 aa, Mycobacterium
ARPLIAFYNWCANATLRAFGVE

SEQ ID NO: 1115636 - protein, 18 aa, Mycobacterium
ARPPSDFYVRGTGPDGRM

SEQ ID NO: 1115637 - protein, 20 aa, Mycobacterium
ARPVWARVLGRRLPRTGAAD

SEQ ID NO: 1115638 - protein, 23 aa, Mycobacterium
ARRFSAVALWCFVAMALSGVINA

SEQ ID NO: 1115639 - protein, 17 aa, Mycobacterium
ARRGVRWHLAGYLAMVV

SEQ ID NO: 1115640 - protein, 18 aa, Mycobacterium
ARRLAAGLRRRGVGPGDV

SEQ ID NO: 1115641 - protein, 17 aa, Mycobacterium
ARRVERPETAYLQYTSG

SEQ ID NO: 1115642 - protein, 23 aa, Mycobacterium
ARSGRLRSAFDVAESVGAGSVDA

SEQ ID NO: 1115643 - protein, 17 aa, Mycobacterium
ARSRASRRLPPFHSAAR

SEQ ID NO: 1115644 - protein, 17 aa, Mycobacterium
ARSYARMAAAYPVAGSA

SEQ ID NO: 1115645 - protein, 30 aa, Mycobacterium
ARSYHLTVWQRIRWIQLPSMLPYLATAIRL

SEQ ID NO: 1115646 - protein, 21 aa, Mycobacterium
ARTGARIILLNSEFSGPQIKE

SEQ ID NO: 1115647 - protein, 33 aa, Mycobacterium
ARTGPAKWIRRFAIPIILGWILLVAVLSLTVPQ

SEQ ID NO: 1115648 - protein, 25 aa, Mycobacterium
ARTPGELADAHWVEFSATTRMSGVD

SEQ ID NO: 1115649 - protein, 24 aa, Mycobacterium
ARTVLSITGTGDWALVDDTFNHIR

SEQ ID NO: 1115650 - protein, 20 aa, Mycobacterium
ARTYGWHRAEVFTAVANAVL

SEQ ID NO: 1115651 - protein, 20 aa, Mycobacterium
ARVALMGGGQYLLDILDPAT

SEQ ID NO: 1115652 - protein, 22 aa, Mycobacterium
ARVSLIPTLLVAIPFTVLVAFT

SEQ ID NO: 1115653 - protein, 28 aa, Mycobacterium
ARVWDSAPCKAWLLAHPLLLGVVLLVLF

SEQ ID NO: 1115654 - protein, 30 aa, Mycobacterium
ARYRTTVMARLRLFGFGVPAFIGILSGIVA

SEQ ID NO: 1115655 - protein, 18 aa, Mycobacterium
ASAGLHLIFAIFLLVVRF

SEQ ID NO: 1115656 - protein, 18 aa, Mycobacterium
ASDINFVLALALFVFIAY

SEQ ID NO: 1115657 - protein, 23 aa, Mycobacterium
ASDKPFEPLAMRQHVLGPYPFDP

SEQ ID NO: 1115658 - protein, 17 aa, Mycobacterium
ASEAVAFYRGEIAERTG

SEQ ID NO: 1115659 - protein, 18 aa, Mycobacterium
ASEIVELLNRFFAVIVDE

SEQ ID NO: 1115660 - protein, 22 aa, Mycobacterium
ASELRTALFDRFQPIGEDGQPS

SEQ ID NO: 1115661 - protein, 18 aa, Mycobacterium
ASFVFLRRLLLLAWMGTH

SEQ ID NO: 1115662 - protein, 18 aa, Mycobacterium
ASGQWALAIRHRLRAIAR

SEQ ID NO: 1115663 - protein, 17 aa, Mycobacterium
ASIMLMFTVVSLLDRNL

SEQ ID NO: 1115664 - protein, 17 aa, Mycobacterium
ASIPVVAEVVMFFNIAA

SEQ ID NO: 1115665 - protein, 21 aa, Mycobacterium
ASLAASGYVTWHHREAMHRQQ

SEQ ID NO: 1115666 - protein, 17 aa, Mycobacterium
ASLKDVLQAGGPLDAKR

SEQ ID NO: 1115667 - protein, 23 aa, Mycobacterium
ASLLLLLLFWQWRTMPQTVWDVS

SEQ ID NO: 1115668 - protein, 19 aa, Mycobacterium
ASLLTPWWLRVLGAQVGSG

SEQ ID NO: 1115669 - protein, 21 aa, Mycobacterium
ASLPLHAFFGVVLMGMNSVLA

SEQ ID NO: 1115670 - protein, 26 aa, Mycobacterium
ASLVGRLGDHILFYGRALAGTPHAAM

SEQ ID NO: 1115671 - protein, 23 aa, Mycobacterium
ASPKRILFVAALVMAAAGLLGLP

SEQ ID NO: 1115672 - protein, 35 aa, Mycobacterium
ASPPILAVAMPWVFLRVRFVRRKWTAITLAATPAG

SEQ ID NO: 1115673 - protein, 23 aa, Mycobacterium
ASPTRTFFKVTLPLIVPGIVAAA

SEQ ID NO: 1115674 - protein, 19 aa, Mycobacterium
ASQFARFMREPDRMNELAK

SEQ ID NO: 1115675 - protein, 20 aa, Mycobacterium
ASRIGDRLVAFAGLMIAAGG

SEQ ID NO: 1115676 - protein, 18 aa, Mycobacterium
ASSLPWAVPPSAPPPAPG

SEQ ID NO: 1115677 - protein, 24 aa, Mycobacterium
ASTLCPLLVLGIWWRGLTAVGASC

SEQ ID NO: 1115678 - protein, 25 aa, Mycobacterium
ASTRWMVLVGCALGFAFLTKMLQAF

SEQ ID NO: 1115679 - protein, 20 aa, Mycobacterium
ASWLRIVIGAALIVFGLVRF

SEQ ID NO: 1115680 - protein, 24 aa, Mycobacterium
ATAATRWLQIRGKRAAAAEAGPTP

SEQ ID NO: 1115681 - protein, 18 aa, Mycobacterium
ATAGFLLTVLATFGATTA

SEQ ID NO: 1115682 - protein, 23 aa, Mycobacterium
ATAKRIAAQLGIDTVIAEVLPGD

SEQ ID NO: 1115683 - protein, 18 aa, Mycobacterium
ATALPVWGIIAGKSLAVV

SEQ ID NO: 1115684 - protein, 17 aa, Mycobacterium
ATDRVWRVVNSRWAELP

SEQ ID NO: 1115685 - protein, 20 aa, Mycobacterium
ATEVSFERETWSAIKGRSTF

SEQ ID NO: 1115686 - protein, 24 aa, Mycobacterium
ATGAGKGSVLWSLIAGIAPAVKTG

SEQ ID NO: 1115687 - protein, 25 aa, Mycobacterium
ATGDRFGRRRVFQIGLTVFAFGSLL

SEQ ID NO: 1115688 - protein, 28 aa, Mycobacterium
ATGPDPMLEWMFWTGLLVTAADVLIALG

SEQ ID NO: 1115689 - protein, 21 aa, Mycobacterium
ATHRGRIYLAVGLLTGVVFLG

SEQ ID NO: 1115690 - protein, 25 aa, Mycobacterium
ATIVCLLLAYPLAYVIAFKAGRFKN

SEQ ID NO: 1115691 - protein, 19 aa, Mycobacterium
ATLCAALGLFVAMAADPLS

SEQ ID NO: 1115692 - protein, 27 aa, Mycobacterium
ATLGARPSTVWWRVSLPLLAPGLVSGS

SEQ ID NO: 1115693 - protein, 24 aa, Mycobacterium
ATLHGWGAGDHVVLVKGAVERVLE

SEQ ID NO: 1115694 - protein, 37 aa, Mycobacterium
ATLIRMLLVPAFMHLMGRWNWWAPKPLARLHERFGIS

SEQ ID NO: 1115695 - protein, 19 aa, Mycobacterium
ATLLGWLLAAFAVRPLKRL

SEQ ID NO: 1115696 - protein, 18 aa, Mycobacterium
ATLPIALIAVVWAALQFL

SEQ ID NO: 1115697 - protein, 24 aa, Mycobacterium
ATLTALQWVVWLALLNNVAAEFSL

SEQ ID NO: 1115698 - protein, 25 aa, Mycobacterium
ATMVLFPMYFLKSFAYAGLAVVGFA

SEQ ID NO: 1115699 - protein, 29 aa, Mycobacterium
ATNLFSVKSYGEFEFWFAGIKVAAIVAFI

SEQ ID NO: 1115700 - protein, 22 aa, Mycobacterium
ATPDRKGLYGAFPQMGAPAGTA

SEQ ID NO: 1115701 - protein, 25 aa, Mycobacterium
ATPPHGSWFVTRWVVASALGGPLLI

SEQ ID NO: 1115702 - protein, 22 aa, Mycobacterium
ATPQLSGLVLLDLPDHDSVEVA

SEQ ID NO: 1115703 - protein, 18 aa, Mycobacterium
ATSVAAWALGRPDNALSL

SEQ ID NO: 1115704 - protein, 21 aa, Mycobacterium
ATSVACPWPYPEAKVYDPQGY

SEQ ID NO: 1115705 - protein, 17 aa, Mycobacterium
ATVHHWPDVGAALTEIR

SEQ ID NO: 1115706 - protein, 18 aa, Mycobacterium
ATVIGLLTILGFSLYDTV

SEQ ID NO: 1115707 - protein, 24 aa, Mycobacterium
ATVMSRLMLVLGVAPVLAPSLGAA

SEQ ID NO: 1115708 - protein, 21 aa, Mycobacterium
ATVNRGCVVQTHLFHDRIMRM

SEQ ID NO: 1115709 - protein, 17 aa, Mycobacterium
AVAAGLHARCIDADTRL

SEQ ID NO: 1115710 - protein, 21 aa, Mycobacterium
AVAAVLAWLLGELIRPGAGMV

SEQ ID NO: 1115711 - protein, 22 aa, Mycobacterium
AVACAITLVAVFFTRETKGIDL

SEQ ID NO: 1115712 - protein, 19 aa, Mycobacterium
AVAELLAIAGVKYLVLGEG

SEQ ID NO: 1115713 - protein, 18 aa, Mycobacterium
AVAERMKFATWLVFGGIW

SEQ ID NO: 1115714 - protein, 19 aa, Mycobacterium
AVAGILCFVLIITIPFGFA

SEQ ID NO: 1115715 - protein, 21 aa, Mycobacterium
AVAGLASWLVPSLTFGTALIL

SEQ ID NO: 1115716 - protein, 24 aa, Mycobacterium
AVAPFKSATKWSGVSYGAHGNWLI

SEQ ID NO: 1115717 - protein, 25 aa, Mycobacterium
AVASGRWVAETSWGASWFDLSPVAL

SEQ ID NO: 1115718 - protein, 28 aa, Mycobacterium
AVAWFLRFLVRHGMYWFVGYRVVLGVVV

SEQ ID NO: 1115719 - protein, 21 aa, Mycobacterium
AVFAWWQLRAPAPIVDLRTTV

SEQ ID NO: 1115720 - protein, 17 aa, Mycobacterium
AVFLACPEVPRFRRMLA

SEQ ID NO: 1115721 - protein, 18 aa, Mycobacterium
AVFLAGILTPAAVVAIAV

SEQ ID NO: 1115722 - protein, 17 aa, Mycobacterium
AVGALLFLGGMAAAGSN

SEQ ID NO: 1115723 - protein, 22 aa, Mycobacterium
AVGFPLCYAAYLSVTDYRLTDR

SEQ ID NO: 1115724 - protein, 27 aa, Mycobacterium
AVGLAGCLLLAFALPWTSVLAGVAVLA

SEQ ID NO: 1115725 - protein, 24 aa, Mycobacterium
AVGLCAAVAWITGRSKDFYLPGIW

SEQ ID NO: 1115726 - protein, 20 aa, Mycobacterium
AVGLVALPLAVRAARPVRGG

SEQ ID NO: 1115727 - protein, 22 aa, Mycobacterium
AVGMAVAMAFVRGLARRDTGEL

SEQ ID NO: 1115728 - protein, 23 aa, Mycobacterium
AVGSRRAWAIPVAVVGALIAVGA

SEQ ID NO: 1115729 - protein, 22 aa, Mycobacterium
AVGVGLLLYFTPIMSVRDIVVV

SEQ ID NO: 1115730 - protein, 19 aa, Mycobacterium
AVIFASFGLFAPRNASVVA

SEQ ID NO: 1115731 - protein, 27 aa, Mycobacterium
AVIGLLGLLVCFALAVLLPLSPDRRRL

SEQ ID NO: 1115732 - protein, 17 aa, Mycobacterium
AVLDVAHIARWAGCVGN

SEQ ID NO: 1115733 - protein, 18 aa, Mycobacterium
AVLGRWAVDRPAHPLLIC

SEQ ID NO: 1115734 - protein, 20 aa, Mycobacterium
AVLMALTWRRLPWQPLPDGD

SEQ ID NO: 1115735 - protein, 18 aa, Mycobacterium
AVLMLYTILVIRGLRTAI

SEQ ID NO: 1115736 - protein, 24 aa, Mycobacterium
AVLMPFAGIAFLWFIGVIRDGFGR

SEQ ID NO: 1115737 - protein, 17 aa, Mycobacterium
AVLTGLVGVAAVPLADT

SEQ ID NO: 1115738 - protein, 27 aa, Mycobacterium
AVLTSRPSLLFAHGSFRDDAMRKQRVS

SEQ ID NO: 1115739 - protein, 27 aa, Mycobacterium
AVLYAVCSRRWWLSGLLVGLAAGVKLT

SEQ ID NO: 1115740 - protein, 23 aa, Mycobacterium
AVMGDFALNCAWDDFGADPTMVD

SEQ ID NO: 1115741 - protein, 19 aa, Mycobacterium
AVMLYSFVVAYVIAFALKK

SEQ ID NO: 1115742 - protein, 26 aa, Mycobacterium
AVMPTREVIGYWAAVILIAARLLQGF

SEQ ID NO: 1115743 - protein, 20 aa, Mycobacterium
AVMRNRLAAVLLIGVTGYGC

SEQ ID NO: 1115744 - protein, 18 aa, Mycobacterium
AVNNGFYYNAFIGNLIPG

SEQ ID NO: 1115745 - protein, 32 aa, Mycobacterium
AVPRLRRWVLTTVRPRLVEVLNDFRDLAAEPQ

SEQ ID NO: 1115746 - protein, 18 aa, Mycobacterium
AVPTALAGIYGMNFDHMP

SEQ ID NO: 1115747 - protein, 24 aa, Mycobacterium
AVQALRAGELVGVYPEATISRSFE

SEQ ID NO: 1115748 - protein, 20 aa, Mycobacterium
AVRASLLLWGGWLLVTGVVF

SEQ ID NO: 1115749 - protein, 24 aa, Mycobacterium
AVSAVLCPLLVYGWLGAPRMGLEG

SEQ ID NO: 1115750 - protein, 18 aa, Mycobacterium
AVSLELVIGFSLALALHQ

SEQ ID NO: 1115751 - protein, 18 aa, Mycobacterium
AVSRLTRRSVPPDVAQIF

SEQ ID NO: 1115752 - protein, 18 aa, Mycobacterium
AVSRSVVAYAEIPHAQHA

SEQ ID NO: 1115753 - protein, 23 aa, Mycobacterium
AVSTFCLLFLLTASVVLPLKALL

SEQ ID NO: 1115754 - protein, 25 aa, Mycobacterium
AVTGPRLTLVIGCAIISVSYLAGLQ

SEQ ID NO: 1115755 - protein, 22 aa, Mycobacterium
AVTGTACWYALFFAISQIPLAN

SEQ ID NO: 1115756 - protein, 24 aa, Mycobacterium
AVTPGRRGLSIGVIAALVTVVVVV

SEQ ID NO: 1115757 - protein, 24 aa, Mycobacterium
AVTRRRPSVTWVRGGAEALPVPDA

SEQ ID NO: 1115758 - protein, 21 aa, Mycobacterium
AVVALAWRKPRFDETRPGRAL

SEQ ID NO: 1115759 - protein, 18 aa, Mycobacterium
AVVDRMWQLVAAIGGGML

SEQ ID NO: 1115760 - protein, 22 aa, Mycobacterium
AVVLLLGWSFFYFSDDTRGFKP

SEQ ID NO: 1115761 - protein, 24 aa, Mycobacterium
AVVPARSLLGLSVGFFVGALVVLV

SEQ ID NO: 1115762 - protein, 19 aa, Mycobacterium
AVVPFDVDIAAGRVNASKL

SEQ ID NO: 1115763 - protein, 18 aa, Mycobacterium
AVVSVWRRGIRLWVPALA

SEQ ID NO: 1115764 - protein, 26 aa, Mycobacterium
AVVTGNAVIAWVCIAASAVGVILLIV

SEQ ID NO: 1115765 - protein, 19 aa, Mycobacterium
AVVVPIVHFYGRKELAHIM

SEQ ID NO: 1115766 - protein, 18 aa, Mycobacterium
AVVVVFAVALVLYIVMSA

SEQ ID NO: 1115767 - protein, 21 aa, Mycobacterium
AVVWTFTLVWLMSERGWSAAS

SEQ ID NO: 1115768 - protein, 23 aa, Mycobacterium
AVWLSVPGTGRWRRAARMPQPLL

SEQ ID NO: 1115769 - protein, 22 aa, Mycobacterium
AVYGRWSQRIGWHAEDAPAISY

SEQ ID NO: 1115770 - protein, 24 aa, Mycobacterium
AWALGRPDNALSLTAVRAAADCAA

SEQ ID NO: 1115771 - protein, 22 aa, Mycobacterium
AWAPMLVLLAGLWTVRFLAQWL

SEQ ID NO: 1115772 - protein, 29 aa, Mycobacterium
AWLDGAVWWKALLAFVVAVALIIGVNYAN

SEQ ID NO: 1115773 - protein, 27 aa, Mycobacterium
AWLIARRFGPGAARSVLPFAAVLSAAA

SEQ ID NO: 1115774 - protein, 26 aa, Mycobacterium
AWLLGELIRPGAGMVFDGELDSELAG

SEQ ID NO: 1115775 - protein, 26 aa, Mycobacterium
AWQRVKGRLLALLGFTALEAVAVLLL

SEQ ID NO: 1115776 - protein, 21 aa, Mycobacterium
AWRHGACLVPAPRSLVRSGMD

SEQ ID NO: 1115777 - protein, 18 aa, Mycobacterium
AWTSLAMGLVSVGTMAVW

SEQ ID NO: 1115778 - protein, 17 aa, Mycobacterium
AWVPVKYPGAVRDPDTG

SEQ ID NO: 1115779 - protein, 26 aa, Mycobacterium
AWVQTKRLLMRFLRDPMTFFFGVVFP

SEQ ID NO: 1115780 - protein, 18 aa, Mycobacterium
AYALPILAVLTVVVIYQT

SEQ ID NO: 1115781 - protein, 19 aa, Mycobacterium
AYFVIGWQAGLAFTTESLR

SEQ ID NO: 1115782 - protein, 26 aa, Mycobacterium
AYGWHAGTPWGAWLFTRAQRLCRPVF

SEQ ID NO: 1115783 - protein, 19 aa, Mycobacterium
AYHAAGFWRRGLLGHPKKL

SEQ ID NO: 1115784 - protein, 31 aa, Mycobacterium; identical to SEQ ID NO: 10665

SEQ ID NO: 1115785 - protein, 19 aa, Mycobacterium
AYLASTRLLAGVIVVVPLY

SEQ ID NO: 1115786 - protein, 18 aa, Mycobacterium
AYLWSWPIVFVGQMSVAL

SEQ ID NO: 1115787 - protein, 17 aa, Mycobacterium
AYSRLIFVSGLERHLPR

SEQ ID NO: 1115788 - protein, 21 aa, Mycobacterium
AYTGYRGLDWVVFGVTAVIAV

SEQ ID NO: 1115789 - protein, 17 aa, Mycobacterium
AYTRRGLAATGWPPVRW

SEQ ID NO: 1115790 - protein, 19 aa, Mycobacterium
AYVPEIASFIAGQAAFTMM

SEQ ID NO: 1115791 - protein, 25 aa, Mycobacterium
AYVYSLDNTRLWSNLDCAPSNETLV

SEQ ID NO: 1115792 - protein, 24 aa, Mycobacterium
CAFAETYWQLLLFRSLGGVGSAMF

SEQ ID NO: 1115793 - protein, 26 aa, Mycobacterium
CALGFAFLTKMLQAFLVMPGLALAFL

SEQ ID NO: 1115794 - protein, 32 aa, Mycobacterium
CAVAPSIALLIGLRFAQGFCGAAGVVISRAVI

SEQ ID NO: 1115795 - protein, 18 aa, Mycobacterium
CAVREGLVDWIRRTHGTA

SEQ ID NO: 1115796 - protein, 18 aa, Mycobacterium
CERARVAIGQTLRETTRH

SEQ ID NO: 1115797 - protein, 17 aa, Mycobacterium
CGALDWPDMGTGNDAID

SEQ ID NO: 1115798 - protein, 24 aa, Mycobacterium
CGDRLDSLDVRRFVRRILRRPPPT

SEQ ID NO: 1115799 - protein, 31 aa, Mycobacterium
CGFRSRLYAERWCAWALLAVTVIVPTGVMVR

SEQ ID NO: 1115800 - protein, 18 aa, Mycobacterium
CGIIVPRNALPEWLQWVS

SEQ ID NO: 1115801 - protein, 19 aa, Mycobacterium
CGTYHAMMNFEVRVVPPND

SEQ ID NO: 1115802 - protein, 19 aa, Mycobacterium
CGVSVAWWPLHPATGTLDV

SEQ ID NO: 1115803 - protein, 26 aa, Mycobacterium
CGVVIAGSLVVHWSTMHELFAITDSV

SEQ ID NO: 1115804 - protein, 41 aa, Mycobacterium
CLAAVLWWACHRPNRLWWRFTAWWFGCAALAVLWWVVPLLL

SEQ ID NO: 1115805 - protein, 34 aa, Mycobacterium
CLAGLFAAGWIHRRGRRLLAHAASMVFLAAFAVV

SEQ ID NO: 1115806 - protein, 19 aa, Mycobacterium
CLVVFAAFMAYFGLYSRHH

SEQ ID NO: 1115807 - protein, 27 aa, Mycobacterium
CMRLHALGWRSAYHHEVLARGLAPDDV

SEQ ID NO: 1115808 - protein, 23 aa, Mycobacterium
CNDPKGYQPLAIREHSLGPYPFD

SEQ ID NO: 1115809 - protein, 20 aa, Mycobacterium
CPDPALPMPLTNSGYINHDG

SEQ ID NO: 1115810 - protein, 19 aa, Mycobacterium
CPDVQLLAIPGTWESSPQM

SEQ ID NO: 1115811 - protein, 23 aa, Mycobacterium
CPEVPRFRRMLAASACLVVATAF

SEQ ID NO: 1115812 - protein, 24 aa, Mycobacterium
CQNALLTRRLWTIPLIAAGVVAMV

SEQ ID NO: 1115813 - protein, 20 aa, Mycobacterium
CRVVATGNSLDAVWSQLKPD

SEQ ID NO: 1115814 - protein, 19 aa, Mycobacterium
CSQPPSLSLTQLGNSFTGP

SEQ ID NO: 1115815 - protein, 25 aa, Mycobacterium
CTAVTCLKPHIGVFVVIILIAQRRW

SEQ ID NO: 1115816 - protein, 22 aa, Mycobacterium
CTDGPLAWNGVFAFYIPGLVLV

SEQ ID NO: 1115817 - protein, 18 aa, Mycobacterium
CTHMSGVHCDVRVIRHDR

SEQ ID NO: 1115818 - protein, 20 aa, Mycobacterium
CTVLFTVVWWHVSHSRSNWL

SEQ ID NO: 1115819 - protein, 20 aa, Mycobacterium
CVLLGVPMAMVLARSPSRAV

SEQ ID NO: 1115820 - protein, 19 aa, Mycobacterium
CVQLGIALIGARREVGRRR

SEQ ID NO: 1115821 - protein, 18 aa, Mycobacterium
CVVQTHLFHDRIMRMDTV

SEQ ID NO: 1115822 - protein, 17 aa, Mycobacterium
CVYAVGLKTRFGYDDSL

SEQ ID NO: 1115823 - protein, 17 aa, Mycobacterium
CYGLWAFGRDDQGGTSW

SEQ ID NO: 1115824 - protein, 24 aa, Mycobacterium
DADEASSRIELHVGRDLQFIRING

SEQ ID NO: 1115825 - protein, 27 aa, Mycobacterium
DADTRLYLPMPFFWVGGFGSGVLSALV

SEQ ID NO: 1115826 - protein, 22 aa, Mycobacterium
DADYRLGWYVIIGTIPIGVIGL

SEQ ID NO: 1115827 - protein, 20 aa, Mycobacterium
DAELAWLYRNSRALVFPSKY

SEQ ID NO: 1115828 - protein, 25 aa, Mycobacterium
DAGAPPRFPLPVAAPVGAVVAAFEA

SEQ ID NO: 1115829 - protein, 17 aa, Mycobacterium
DAHAAGPDHVWSLELPE

SEQ ID NO: 1115830 - protein, 19 aa, Mycobacterium
DAIIDRWLLTPSPTATLKY

SEQ ID NO: 1115831 - protein, 19 aa, Mycobacterium
DAKPGNFAFVGDEVSAVFD

SEQ ID NO: 1115832 - protein, 17 aa, Mycobacterium
DALEELSKSIVVEVDNA

SEQ ID NO: 1115833 - protein, 25 aa, Mycobacterium
DALTAIPLWVAFVVGTKAATRRYTY

SEQ ID NO: 1115834 - protein, 25 aa, Mycobacterium
DAMDVARWSRRIAVQSAVVGMSLSL

SEQ ID NO: 1115835 - protein, 18 aa, Mycobacterium
DAPAIRGVLGLHLTLQRG

SEQ ID NO: 1115836 - protein, 25 aa, Mycobacterium
DAQLWRVALAGGRSMSARFLITATG

SEQ ID NO: 1115837 - protein, 20 aa, Mycobacterium
DAQVTARAALWGVEGDPEEP

SEQ ID NO: 1115838 - protein, 20 aa, Mycobacterium
DARAVLAARGLDHATVQVEP

SEQ ID NO: 1115839 - protein, 18 aa, Mycobacterium
DARKLPPRERRSSSYDRP

SEQ ID NO: 1115840 - protein, 23 aa, Mycobacterium
DASALDVASLWAPRSREEELRVP

SEQ ID NO: 1115841 - protein, 25 aa, Mycobacterium
DATIIRMFLVPAIMKMLGDDCWWAP

SEQ ID NO: 1115842 - protein, 27 aa, Mycobacterium
DAVASRAGDLITWWTGDSVMVFDGSGL

SEQ ID NO: 1115843 - protein, 31 aa, Mycobacterium
DAVIADGTWARLYSDWVPRALPPGWKPGSKA

SEQ ID NO: 1115844 - protein, 28 aa, Mycobacterium
DAVPLRHPWRWVAAVVIVVLVGLFLYGA

SEQ ID NO: 1115845 - protein, 23 aa, Mycobacterium
DAVPRISRAQSLDVLSSMANIAG

SEQ ID NO: 1115846 - protein, 22 aa, Mycobacterium
DAWLALCGTYGWAPGVMGASVG

SEQ ID NO: 1115847 - protein, 17 aa, Mycobacterium
DAYADSLGLVFLCAAPI

SEQ ID NO: 1115848 - protein, 23 aa, Mycobacterium
DAYEPYNPFGPAPTGARPEVQYL

SEQ ID NO: 1115849 - protein, 24 aa, Mycobacterium
DDAGPRAELPFPINAIPQPGDLPD

SEQ ID NO: 1115850 - protein, 17 aa, Mycobacterium
DDALRSQLVLSLLSWGV

SEQ ID NO: 1115851 - protein, 24 aa, Mycobacterium
DDDGRPAAELALALRPEYVDLIPA

SEQ ID NO: 1115852 - protein, 18 aa, Mycobacterium
DDFVHLLLGFASIGRTIE

SEQ ID NO: 1115853 - protein, 24 aa, Mycobacterium
DDGKSVGCGNALISDTSGAEAANN

SEQ ID NO: 1115854 - protein, 26 aa, Mycobacterium
DDKGLMTRSEMISRLVFAMGGRAAEE

SEQ ID NO: 1115855 - protein, 24 aa, Mycobacterium
DDLLCAVGERLRRCVGPSDTLARI

SEQ ID NO: 1115856 - protein, 31 aa, Mycobacterium
DDLWALTVIHLRLSLIPIVLGLLIAVPLGAL

SEQ ID NO: 1115857 - protein, 17 aa, Mycobacterium
DDMHAVVLVAGYSDPDK

SEQ ID NO: 1115858 - protein, 17 aa, Mycobacterium
DDMKLVLAAAGTHLLTQ

SEQ ID NO: 1115859 - protein, 24 aa, Mycobacterium
DDPPRWLPDWLRPTGQRVRVDAPP

SEQ ID NO: 1115860 - protein, 23 aa, Mycobacterium
DDPTLCWSWQRVAGDQAPRTTVI

SEQ ID NO: 1115861 - protein, 30 aa, Mycobacterium
DDRLFCNSPFCWIGGIAFSVLATLVAGATL

SEQ ID NO: 1115862 - protein, 17 aa, Mycobacterium
DDVPDFMQIAGVRELPG

SEQ ID NO: 1115863 - protein, 17 aa, Mycobacterium
DEALGWQETLLNFVSTN

SEQ ID NO: 1115864 - protein, 25 aa, Mycobacterium
DEAVRELAELAVARRGEVVAHVNAA

SEQ ID NO: 1115865 - protein, 23 aa, Mycobacterium
DELPWSHRWDRILGGSVDGLTWM

SEQ ID NO: 1115866 - protein, 22 aa, Mycobacterium
DELRADGTLAEISQRYLKANAS

SEQ ID NO: 1115867 - protein, 19 aa, Mycobacterium
DEMSPGWAALWAVGLLVTG

SEQ ID NO: 1115868 - protein, 26 aa, Mycobacterium
DEPEDGRRGWHVPQLAFGAAAVVAAI

SEQ ID NO: 1115869 - protein, 21 aa, Mycobacterium
DEPHRRRRIILAGRAAAALLA

SEQ ID NO: 1115870 - protein, 21 aa, Mycobacterium
DEQRIAVLLSELERTRAFDRE

SEQ ID NO: 1115871 - protein, 27 aa, Mycobacterium
DFELAPGFVPEITWPSATCSLPRLPLR

SEQ ID NO: 1115872 - protein, 24 aa, Mycobacterium
DFFLYATAASLVFNQAFFPDQSSF

SEQ ID NO: 1115873 - protein, 37 aa, Mycobacterium
DFFRPIRNYFYWEPHCYNIPVCFAIRSVFDTLDGINV

SEQ ID NO: 1115874 - protein, 27 aa, Mycobacterium
DFIALFDRICRVGRSLRVHLLLATQSL

SEQ ID NO: 1115875 - protein, 26 aa, Mycobacterium
DFKRTCAVLQELRRRGVRVAIDDFGS

SEQ ID NO: 1115876 - protein, 18 aa, Mycobacterium
DFLPFGWVAVLYALPFAM

SEQ ID NO: 1115877 - protein, 22 aa, Mycobacterium
DFLSIGWWPVFNVADPSVVGGA

SEQ ID NO: 1115878 - protein, 19 aa, Mycobacterium
DFLVMAGYWLMFTAILIGG

SEQ ID NO: 1115879 - protein, 21 aa, Mycobacterium
DFVEPYLPIAVVAALDAVFGG

SEQ ID NO: 1115880 - protein, 24 aa, Mycobacterium
DFVPQLSVTIAYVLAVVSVGALVM

SEQ ID NO: 1115881 - protein, 18 aa, Mycobacterium
DGADWLITGMNAVTKLDL

SEQ ID NO: 1115882 - protein, 25 aa, Mycobacterium
DGAFLTWGWRVPFLLSAVMVALGLY

SEQ ID NO: 1115883 - protein, 27 aa, Mycobacterium
DGAGPWKRLVKVILPLIKPAILVALLF

SEQ ID NO: 1115884 - protein, 23 aa, Mycobacterium
DGARLWLPTYLVWFVGGMLLAVL

SEQ ID NO: 1115885 - protein, 20 aa, Mycobacterium
DGASLWRSVREVILPLVSPG

SEQ ID NO: 1115886 - protein, 23 aa, Mycobacterium
DGDPRLVSAPTFVKGQQGVIQAV

SEQ ID NO: 1115887 - protein, 19 aa, Mycobacterium
DGEVTWPPPPVQVSAAPAA

SEQ ID NO: 1115888 - protein, 25 aa, Mycobacterium
DGFVRRIPIEIDEAAVIDGLTVAAA

SEQ ID NO: 1115889 - protein, 21 aa, Mycobacterium
DGGFIERPERLVIVLTGAGLS

SEQ ID NO: 1115890 - protein, 23 aa, Mycobacterium
DGHVVTGSWAFELTVSGTGTPGP

SEQ ID NO: 1115891 - protein, 25 aa, Mycobacterium
DGNAALRWTLLTGAACNDAAVTCRE

SEQ ID NO: 1115892 - protein, 20 aa, Mycobacterium
DGRAGWLIAGLILIVAGVLA

SEQ ID NO: 1115893 - protein, 22 aa, Mycobacterium
DGRSPVSIGLPLPGWDLAVVDK

SEQ ID NO: 1115894 - protein, 25 aa, Mycobacterium
DGSTRGKYWWVRWAIITVAVVVLTV

SEQ ID NO: 1115895 - protein, 22 aa, Mycobacterium
DGTATLRFVLRDRGPVADSCSQ

SEQ ID NO: 1115896 - protein, 17 aa, Mycobacterium
DGVELWLTGLGFVAQTA

SEQ ID NO: 1115897 - protein, 25 aa, Mycobacterium
DGVKEFPGPWALVPVGATIAFILSA

SEQ ID NO: 1115898 - protein, 18 aa, Mycobacterium
DGYSRSGAGLGVVMATSG

SEQ ID NO: 1115899 - protein, 21 aa, Mycobacterium
DGYTRKRAFLMVALPIVRPGI

SEQ ID NO: 1115900 - protein, 25 aa, Mycobacterium
DHDELPGRSLVALCPITVRGREHGT

SEQ ID NO: 1115901 - protein, 20 aa, Mycobacterium
DHPDQVVSWVGWLRAPDAAS

SEQ ID NO: 1115902 - protein, 18 aa, Mycobacterium
DHTPRTVALIGTAALALT

SEQ ID NO: 1115903 - protein, 18 aa, Mycobacterium
DIGIEALTGFLAAFINVR

SEQ ID NO: 1115904 - protein, 18 aa, Mycobacterium
DIVIAVWVLIWLFVGMAV

SEQ ID NO: 1115905 - protein, 20 aa, Mycobacterium
DIYCTVLGPTVLRLAGVVVI

SEQ ID NO: 1115906 - protein, 21 aa, Mycobacterium
DKEWGHRLRAFVVKAEGASVD

SEQ ID NO: 1115907 - protein, 18 aa, Mycobacterium
DKGPQLLNNLPFATKVAV

SEQ ID NO: 1115908 - protein, 18 aa, Mycobacterium
DKLGWFFLFSEGNVSLAG

SEQ ID NO: 1115909 - protein, 19 aa, Mycobacterium
DKPVIFWTPATGARVVRGA

SEQ ID NO: 1115910 - protein, 18 aa, Mycobacterium
DKRLLPYMIGAFVLIVGA

SEQ ID NO: 1115911 - protein, 20 aa, Mycobacterium
DKVGRKPLLISFAVGGILYT

SEQ ID NO: 1115912 - protein, 21 aa, Mycobacterium
DLAAFLGLSGTVWLSAIVFEP

SEQ ID NO: 1115913 - protein, 20 aa, Mycobacterium
DLARLGGFLRGAATARSSSV

SEQ ID NO: 1115914 - protein, 21 aa, Mycobacterium
DLASEFGFWAGACLPLGLALC

SEQ ID NO: 1115915 - protein, 22 aa, Mycobacterium
DLATPYALHAVSIDERFEIDRW

SEQ ID NO: 1115916 - protein, 25 aa, Mycobacterium
DLDAGAWWLIGWRVVQGVGGAMLIA

SEQ ID NO: 1115917 - protein, 20 aa, Mycobacterium
DLDLRIGVFNTIALLLSSWA

SEQ ID NO: 1115918 - protein, 19 aa, Mycobacterium
DLFDRLQLVLVLSALAVDL

SEQ ID NO: 1115919 - protein, 21 aa, Mycobacterium
DLFRYPGIRSDSDIFTLSFPF

SEQ ID NO: 1115920 - protein, 28 aa, Mycobacterium
DLGRDAWFTMLTFWFFAAGWAAAKATAP

SEQ ID NO: 1115921 - protein, 27 aa, Mycobacterium
DLIRGSLRILLPLSIIGAIILVSGGVI

SEQ ID NO: 1115922 - protein, 21 aa, Mycobacterium
DLLGRARPPLNNTIDQLNRLA

SEQ ID NO: 1115923 - protein, 20 aa, Mycobacterium
DLLHGLLMYSGNDAAHALAR

SEQ ID NO: 1115924 - protein, 24 aa, Mycobacterium
DLPFYRLVLSYLFVATFLAFIANL

SEQ ID NO: 1115925 - protein, 20 aa, Mycobacterium
DLRNPVGWLRLVGLLEAASW

SEQ ID NO: 1115926 - protein, 18 aa, Mycobacterium
DLSFYIMRFLLGAAEAGL

SEQ ID NO: 1115927 - protein, 30 aa, Mycobacterium
DLSQCKTGADANEFVQCRVVATGNSLDAVW

SEQ ID NO: 1115928 - protein, 24 aa, Mycobacterium
DLSSLRPGSLEALLPPDQRGRPGA

SEQ ID NO: 1115929 - protein, 19 aa, Mycobacterium
DLVPRELAVVTPLIALLLV

SEQ ID NO: 1115930 - protein, 50 aa, Mycobacterium
DLYSRIKPTLLGALPWRWGDPHARLLKPWARIVVTVWVVVVVPLLLATLA

SEQ ID NO: 1115931 - protein, 30 aa, Mycobacterium
DMIGRPLGPATMFTGLAIQVFCPGAVAALA

SEQ ID NO: 1115932 - protein, 29 aa, Mycobacterium
DMPTPRGSYGAAFIDGRIVAVGGEEPTRV

SEQ ID NO: 1115933 - protein, 18 aa, Mycobacterium
DNIAQWSRNLNILAAQSA

SEQ ID NO: 1115934 - protein, 19 aa, Mycobacterium
DPARTIPRAIPIALGLTLA

SEQ ID NO: 1115935 - protein, 26 aa, Mycobacterium
DPEARPRLILGAAMITLPALGLWHLW

SEQ ID NO: 1115936 - protein, 23 aa, Mycobacterium
DPELRTVLQQGPGFAQEVSQLLT

SEQ ID NO: 1115937 - protein, 22 aa, Mycobacterium
DPKETVSFIAWVVYAAYLHARS

SEQ ID NO: 1115938 - protein, 21 aa, Mycobacterium
DPMIKQMGFALAFGVLIDAFV

SEQ ID NO: 1115939 - protein, 20 aa, Mycobacterium
DPNWSWLKWLPHVQHQSDVD

SEQ ID NO: 1115940 - protein, 30 aa, Mycobacterium
DPPRFLPARLHRWWLYRRLADVAALEHFTA

SEQ ID NO: 1115941 - protein, 20 aa, Mycobacterium
DPRFEVSEIGPFVLAIRQPV

SEQ ID NO: 1115942 - protein, 23 aa, Mycobacterium
DPRTLWRNPVMLIVEIGALWSTA

SEQ ID NO: 1115943 - protein, 24 aa, Mycobacterium
DPSARSFTTAAIWLTVATLVVAAI

SEQ ID NO: 1115944 - protein, 24 aa, Mycobacterium
DPSSPWYIGIYFALIIFFTYFYVS

SEQ ID NO: 1115945 - protein, 22 aa, Mycobacterium
DPSTRWAYWMGLFITFADILIA

SEQ ID NO: 1115946 - protein, 24 aa, Mycobacterium
DPYDIGPTPSWRNLRYPRDQIPTD

SEQ ID NO: 1115947 - protein, 25 aa, Mycobacterium
DQLPHRRLPFWVALAMSVALVGPTL

SEQ ID NO: 1115948 - protein, 17 aa, Mycobacterium
DQTAYFDTDFFDVLRDQ

SEQ ID NO: 1115949 - protein, 18 aa, Mycobacterium
DQVGWIVLQLSLAVALLA

SEQ ID NO: 1115950 - protein, 29 aa, Mycobacterium
DRDRLKIPFGHELRTGDIMYLDIKEGAEF

SEQ ID NO: 1115951 - protein, 17 aa, Mycobacterium
DRGLCCGAGGARMWMEE

SEQ ID NO: 1115952 - protein, 27 aa, Mycobacterium
DRHGRPFRRRNYVPGLLTIGALAVVAL

SEQ ID NO: 1115953 - protein, 27 aa, Mycobacterium
DRIGHRRLLLCGATLFAAVSVVTAYAP

SEQ ID NO: 1115954 - protein, 19 aa, Mycobacterium
DRILLGAGGAVWLTALGTG

SEQ ID NO: 1115955 - protein, 19 aa, Mycobacterium
DRLGRRKLLIFGLALAAVS

SEQ ID NO: 1115956 - protein, 25 aa, Mycobacterium
DRLPLLCCLVAFILTFFVTRTIVRY

SEQ ID NO: 1115957 - protein, 20 aa, Mycobacterium
DRLVAFAGLMIAAGGYLLIS

SEQ ID NO: 1115958 - protein, 20 aa, Mycobacterium
DRMVVIPTILAVVLVVLYVL

SEQ ID NO: 1115959 - protein, 17 aa, Mycobacterium
DRRDMPPFYAASGAAAG

SEQ ID NO: 1115960 - protein, 23 aa, Mycobacterium
DRRFIGPIIWDPRAGEVVRAVVS

SEQ ID NO: 1115961 - protein, 20 aa, Mycobacterium
DRVGRRAVIVTGAIGIVCYA

SEQ ID NO: 1115962 - protein, 24 aa, Mycobacterium
DRYELGEILGFGGMSEVHLARDNR

SEQ ID NO: 1115963 - protein, 17 aa, Mycobacterium
DSFRLSGPDMRAVRQAV

SEQ ID NO: 1115964 - protein, 26 aa, Mycobacterium
DSGLWHRIAAGVSRRPAVVAVASIGA

SEQ ID NO: 1115965 - protein, 19 aa, Mycobacterium
DSILLSRGRIPEYVLVGLV

SEQ ID NO: 1115966 - protein, 18 aa, Mycobacterium
DSMPRGGLQRTTFQLRKD

SEQ ID NO: 1115967 - protein, 18 aa, Mycobacterium
DSNRLRVGQEVIAAGAPL

SEQ ID NO: 1115968 - protein, 19 aa, Mycobacterium
DSSGQWLIGVFLGGLLGGS

SEQ ID NO: 1115969 - protein, 25 aa, Mycobacterium
DSYSDDTWRLWSYSWEAKEPGRYTM

SEQ ID NO: 1115970 - protein, 21 aa, Mycobacterium
DTKNMPALVLLGFALVTFVAA

SEQ ID NO: 1115971 - protein, 28 aa, Mycobacterium
DTKRVWLELTYFYGLGALIVFLGALALG

SEQ ID NO: 1115972 - protein, 25 aa, Mycobacterium
DTLVFCAIAAPIIGFGNMGSFAVYA

SEQ ID NO: 1115973 - protein, 21 aa, Mycobacterium
DTPGRRLPIVVIASAEVGAAA

SEQ ID NO: 1115974 - protein, 23 aa, Mycobacterium
DTPKDVLAGFDFTAQGVWAFARP

SEQ ID NO: 1115975 - protein, 22 aa, Mycobacterium
DTTRLQRWFAYLVFAVAAYVIV

SEQ ID NO: 1115976 - protein, 25 aa, Mycobacterium
DTVDAGLWVAFWFFLAQLNFVLGAV

SEQ ID NO: 1115977 - protein, 17 aa, Mycobacterium
DTVRLFVLFPTDETWSD

SEQ ID NO: 1115978 - protein, 17 aa, Mycobacterium
DVAEDGLPFWIIASCAL

SEQ ID NO: 1115979 - protein, 32 aa, Mycobacterium
DVDAPDFWALLALRAVVFAVVMALLFKLLAPL

SEQ ID NO: 1115980 - protein, 18 aa, Mycobacterium
DVDIKLIARTTHHLFQPL

SEQ ID NO: 1115981 - protein, 17 aa, Mycobacterium
DVDLCGVTSVYHYAVAV

SEQ ID NO: 1115982 - protein, 20 aa, Mycobacterium
DVDTGFWLWVAALPLLVIGY

SEQ ID NO: 1115983 - protein, 20 aa, Mycobacterium
DVGASPAWRNLRVPLAAIPD

SEQ ID NO: 1115984 - protein, 23 aa, Mycobacterium
DVGFLLTVGMWFAFGVAAVAIFE

SEQ ID NO: 1115985 - protein, 20 aa, Mycobacterium
DVGIGVRPHGPLVFRVAERM

SEQ ID NO: 1115986 - protein, 24 aa, Mycobacterium
DVHLDWREVMAADRELLGAHRRRY

SEQ ID NO: 1115987 - protein, 17 aa, Mycobacterium
DVIPDFIPVLGYADDAI

SEQ ID NO: 1115988 - protein, 18 aa, Mycobacterium
DVLQAGGPLDAKRAASII

SEQ ID NO: 1115989 - protein, 34 aa, Mycobacterium
DVRLRRRGWPSVIALRLIPAVPFAVLNYAAGASA

SEQ ID NO: 1115990 - protein, 19 aa, Mycobacterium
DVSAEAWLVADMDTGEVIA

SEQ ID NO: 1115991 - protein, 26 aa, Mycobacterium
DVSWAPGRFALWVAFWAGWATVLAST

SEQ ID NO: 1115992 - protein, 25 aa, Mycobacterium
DWGCVSRLNLAMALWGALCAAETDL

SEQ ID NO: 1115993 - protein, 19 aa, Mycobacterium
DWQSVESVASPAWYDDLVL

SEQ ID NO: 1115994 - protein, 19 aa, Mycobacterium
DWSWLKWLPHTDIPGEADG

SEQ ID NO: 1115995 - protein, 18 aa, Mycobacterium
DWTSLRIGLLTVPVAGLV

SEQ ID NO: 1115996 - protein, 35 aa, Mycobacterium
DYIFGFSFYTAHYFGAWVFIAGFLVHIAIKIPRMR

SEQ ID NO: 1115997 - protein, 20 aa, Mycobacterium
DYLPSDGFTTLNIVSTIGAF

SEQ ID NO: 1115998 - protein, 26 aa, Mycobacterium
DYNLEWKPVGGFPVTAGWIHAVRRGH

SEQ ID NO: 1115999 - protein, 19 aa, Mycobacterium
EAAHTFGRFFTGQVTAAGK

SEQ ID NO: 1116000 - protein, 19 aa, Mycobacterium
EACPPDLAERLAVEGREVW

SEQ ID NO: 1116001 - protein, 21 aa, Mycobacterium
EAKPLKIGHKIVTGMRGSYGG

SEQ ID NO: 1116002 - protein, 25 aa, Mycobacterium
EALIQLLADRAFEWSLNAGEVIERV

SEQ ID NO: 1116003 - protein, 19 aa, Mycobacterium
EALKVMFVITAIALAGLIV

SEQ ID NO: 1116004 - protein, 17 aa, Mycobacterium
EALLRLDERRRLLDRPP

SEQ ID NO: 1116005 - protein, 27 aa, Mycobacterium
EALLRPVIEFLRPVPSVALIPLVVLTI

SEQ ID NO: 1116006 - protein, 23 aa, Mycobacterium
EALPDWVPFAVLLPVAAVVLAWF

SEQ ID NO: 1116007 - protein, 24 aa, Mycobacterium
EANYGTWWFWLGLLLIVGILLLVG

SEQ ID NO: 1116008 - protein, 18 aa, Mycobacterium
EAPFDWYQSVLAHLASIS

SEQ ID NO: 1116009 - protein, 18 aa, Mycobacterium
EAPPSLVRVTRRGVPAQA

SEQ ID NO: 1116010 - protein, 23 aa, Mycobacterium
EAPSDWRTVGLLVGLFVAVILLV

SEQ ID NO: 1116011 - protein, 19 aa, Mycobacterium
EAPSFSLAVLPMFLPAVVA

SEQ ID NO: 1116012 - protein, 20 aa, Mycobacterium
EARVGVLIASVLAFTLSWAL

SEQ ID NO: 1116013 - protein, 25 aa, Mycobacterium
EATARGWPVLTFTRPVSLRDRIPAP

SEQ ID NO: 1116014 - protein, 21 aa, Mycobacterium
EAVLTRLGRHSALGTYADGTS

SEQ ID NO: 1116015 - protein, 17 aa, Mycobacterium
EAVPDVLERMARGHTRY

SEQ ID NO: 1116016 - protein, 17 aa, Mycobacterium
EAVQRASVFARVSPEQK

SEQ ID NO: 1116017 - protein, 21 aa, Mycobacterium
ECPFCGRATGAIDEVRTHFGD

SEQ ID NO: 1116018 - protein, 32 aa, Mycobacterium
EDDGEWLSWRWNWWWLLALIPVLLVVGLIVGA

SEQ ID NO: 1116019 - protein, 26 aa, Mycobacterium
EDFLCPACGNFERQFGPTINKLIDTG

SEQ ID NO: 1116020 - protein, 20 aa, Mycobacterium
EDGLPFWIIASCALAIGLGT

SEQ ID NO: 1116021 - protein, 24 aa, Mycobacterium
EDILKRSYFLMGICGEDTDRPCPD

SEQ ID NO: 1116022 - protein, 26 aa, Mycobacterium
EDPVLLDWLVGLAFPCQRPFDHRNGV

SEQ ID NO: 1116023 - protein, 18 aa, Mycobacterium
EDSLHHWLNLTLAAGGAL

SEQ ID NO: 1116024 - protein, 20 aa, Mycobacterium
EDTDRPCPDPALPMPLTNSG

SEQ ID NO: 1116025 - protein, 29 aa, Mycobacterium
EDVPNLAWCVGYINASWTLRADLTARAFA

SEQ ID NO: 1116026 - protein, 20 aa, Mycobacterium
EEEAGRWDLLLAGPLRTVDA

SEQ ID NO: 1116027 - protein, 22 aa, Mycobacterium
EEHRRPGGLKALGVSARTVLGN

SEQ ID NO: 1116028 - protein, 25 aa, Mycobacterium
EEIDALAVMGIRPIAYLASTRLLAG

SEQ ID NO: 1116029 - protein, 25 aa, Mycobacterium
EEIRDLTAFFAWSAWASAAERPGHN

SEQ ID NO: 1116030 - protein, 21 aa, Mycobacterium
EELRVPIGVTATGEPLYFDLK

SEQ ID NO: 1116031 - protein, 21 aa, Mycobacterium
EEQRVAWSRAMSGALIGFAGA

SEQ ID NO: 1116032 - protein, 21 aa, Mycobacterium
EERGPFAIVIARFVPIVRTLA

SEQ ID NO: 1116033 - protein, 23 aa, Mycobacterium
EESNFPAIVKFLSEQVLARNTDR

SEQ ID NO: 1116034 - protein, 20 aa, Mycobacterium
EEYRRVWLATLAVFGGVAIV

SEQ ID NO: 1116035 - protein, 19 aa, Mycobacterium
EFAEQCIRPVALEYDQRQE

SEQ ID NO: 1116036 - protein, 19 aa, Mycobacterium
EFDHVHFAYTAGTPVIEDL

SEQ ID NO: 1116037 - protein, 26 aa, Mycobacterium
EFFAYTKICSHLGCPSSLYEQQTHRI

SEQ ID NO: 1116038 - protein, 24 aa, Mycobacterium
EFKSDAAKIWADFTAANVGTQTAF

SEQ ID NO: 1116039 - protein, 18 aa, Mycobacterium
EFLTAFFALSAVVYATLT

SEQ ID NO: 1116040 - protein, 19 aa, Mycobacterium
EFTARFVINCSGVLSRPKW

SEQ ID NO: 1116041 - protein, 26 aa, Mycobacterium
EFTLRWRDAAAIDWGTIVLFGTGIIF

SEQ ID NO: 1116042 - protein, 27 aa, Mycobacterium
EFYTPWSWLPRIVMQFTAGAFACAAVR

SEQ ID NO: 1116043 - protein, 26 aa, Mycobacterium
EGDGRAWKCTLCYDRLHDGLEPACAK

SEQ ID NO: 1116044 - protein, 19 aa, Mycobacterium
EGFAALLSMSIGLFTLAVL

SEQ ID NO: 1116045 - protein, 19 aa, Mycobacterium
EGFALPLVHGAWITALVFT

SEQ ID NO: 1116046 - protein, 20 aa, Mycobacterium
EGFGLLVAPPKAGKSWMVAG

SEQ ID NO: 1116047 - protein, 25 aa, Mycobacterium
EGGPDHRGRVRIGTVLVSPTEPEHD

SEQ ID NO: 1116048 - protein, 24 aa, Mycobacterium
EGLFLGAISWLFGNVIVAGGNAGA

SEQ ID NO: 1116049 - protein, 22 aa, Mycobacterium
EGLRAVAVLAVVLYHAGMPGLG

SEQ ID NO: 1116050 - protein, 20 aa, Mycobacterium
EGPAVTYLLHAGRRSAVDLR

SEQ ID NO: 1116051 - protein, 24 aa, Mycobacterium
EGQSHGWQPWIWVVIVAGVAVMAG

SEQ ID NO: 1116052 - protein, 24 aa, Mycobacterium
EGRGWGAIVGVGLFLGVAALFYTL

SEQ ID NO: 1116053 - protein, 28 aa, Mycobacterium
EGTMLLRLCMLPGLILLIWAAPRVARHI

SEQ ID NO: 1116054 - protein, 24 aa, Mycobacterium
EGTSEPKAVLSLYEDFLCPACGNF

SEQ ID NO: 1116055 - protein, 23 aa, Mycobacterium
EHAGIDWNVIFLLLGMMVIVGVV

SEQ ID NO: 1116056 - protein, 25 aa, Mycobacterium
EHRPSAKAPLLWAASAALPWLVLVV

SEQ ID NO: 1116057 - protein, 21 aa, Mycobacterium
EHRRGSFGLPAPGFDTRIVDP

SEQ ID NO: 1116058 - protein, 25 aa, Mycobacterium
EHVKSLRAVPVPAPRNLGRLPKHHT

SEQ ID NO: 1116059 - protein, 24 aa, Mycobacterium
EHYVIDILLGWAFAAVAVVALNRY

SEQ ID NO: 1116060 - protein, 18 aa, Mycobacterium
EIAEAVEGMLARIGEEQQ

SEQ ID NO: 1116061 - protein, 24 aa, Mycobacterium
EIAEAVKGMLERIWSEQDRTKAAL

SEQ ID NO: 1116062 - protein, 19 aa, Mycobacterium
EIGDPWSADVVLKVNAPTD

SEQ ID NO: 1116063 - protein, 24 aa, Mycobacterium
EIIEELRLPPFRVPAPRHSAQHAS

SEQ ID NO: 1116064 - protein, 21 aa, Mycobacterium
EIILIRGLTNYAFWVPNGSPE

SEQ ID NO: 1116065 - protein, 24 aa, Mycobacterium
EINERTFRLLAIFMPGVKLVGNIT

SEQ ID NO: 1116066 - protein, 23 aa, Mycobacterium
EIPHAQHAFDFFGSPRAHYTANA

SEQ ID NO: 1116067 - protein, 24 aa, Mycobacterium
EKPGPRPGALIGNVIWVLLFGIWL

SEQ ID NO: 1116068 - protein, 17 aa, Mycobacterium
EKRNWGGWIGFLALVAF

SEQ ID NO: 1116069 - protein, 20 aa, Mycobacterium
EKSMVFGMIVTVFAMRCAAA

SEQ ID NO: 1116070 - protein, 22 aa, Mycobacterium
ELAEEGFRVGGALSVSLGLAAG

SEQ ID NO: 1116071 - protein, 18 aa, Mycobacterium
ELAPKAKIIAAVREAENQ

SEQ ID NO: 1116072 - protein, 20 aa, Mycobacterium
ELDDAIGVVHLRDLLGDDGT

SEQ ID NO: 1116073 - protein, 19 aa, Mycobacterium
ELDKPRFEQALATLTDSLR

SEQ ID NO: 1116074 - protein, 25 aa, Mycobacterium
ELDLPAWWRQIAWLPHRPVLVPGTV

SEQ ID NO: 1116075 - protein, 20 aa, Mycobacterium
ELFEEAFAMAGGWHAGLGLL

SEQ ID NO: 1116076 - protein, 17 aa, Mycobacterium
ELMLSDAGRSWVITAYV

SEQ ID NO: 1116077 - protein, 21 aa, Mycobacterium
ELPAALSRLRVPAVMTSVLVL

SEQ ID NO: 1116078 - protein, 23 aa, Mycobacterium
ELPHGRLAGAMAVMSGTLGFGGG

SEQ ID NO: 1116079 - protein, 20 aa, Mycobacterium
ELPSHLPAPVLPTVDVDSLR

SEQ ID NO: 1116080 - protein, 21 aa, Mycobacterium
ELQARLTVLAVDDAGMSTVEY

SEQ ID NO: 1116081 - protein, 18 aa, Mycobacterium
ELQLPPRDTRVIEKKEAA

SEQ ID NO: 1116082 - protein, 19 aa, Mycobacterium
ELRAKRTLDKLAIVGQAKP

SEQ ID NO: 1116083 - protein, 23 aa, Mycobacterium
ELSAYKIPRRITALTRDDLPVMA

SEQ ID NO: 1116084 - protein, 17 aa, Mycobacterium
ELTRLYRPMPVRIDLDT

SEQ ID NO: 1116085 - protein, 39 aa, Mycobacterium
ELTSRFWRRSGIRIVRRPVPHLIASVLVLLLLGGAAGFA

SEQ ID NO: 1116086 - protein, 45 aa, Mycobacterium
ELVVPIAVLVCFRAAQSPRWARLLQFLPVLAIPAVVLFFSVFEYF

SEQ ID NO: 1116087 - protein, 19 aa, Mycobacterium
EMDERLTAMIAQIVESYGR

SEQ ID NO: 1116088 - protein, 24 aa, Mycobacterium
EMKAPTGVPLKLAVLAGVLDTGAN

SEQ ID NO: 1116089 - protein, 23 aa, Mycobacterium
ENIVWAVLFHRLVVLAGVGLIVW

SEQ ID NO: 1116090 - protein, 20 aa, Mycobacterium
ENNLGFKIIFGLPGIVLASI

SEQ ID NO: 1116091 - protein, 20 aa, Mycobacterium
ENVGWVAVAGLVGFVGNELV

SEQ ID NO: 1116092 - protein, 24 aa, Mycobacterium
EPAGVHFRPFLAALGASLCAGAAL

SEQ ID NO: 1116093 - protein, 19 aa, Mycobacterium
EPAPEPFTLAGTLRLPDEV

SEQ ID NO: 1116094 - protein, 17 aa, Mycobacterium
EPEPEPPAPETEIIEAI

SEQ ID NO: 1116095 - protein, 20 aa, Mycobacterium
EPGQILVLLNVGAIFMGTAL

SEQ ID NO: 1116096 - protein, 24 aa, Mycobacterium
EPGTRLRKDLSWWDLTVFGVSVVI

SEQ ID NO: 1116097 - protein, 20 aa, Mycobacterium
EPGVQLLALVSVAALAASAV

SEQ ID NO: 1116098 - protein, 17 aa, Mycobacterium
EPLAVRRAVRGAAIGNT

SEQ ID NO: 1116099 - protein, 18 aa, Mycobacterium
EPLIGRGLETLLGGAGIP

SEQ ID NO: 1116100 - protein, 24 aa, Mycobacterium
EPQTVRWTLRLDVSDVDGKLMISR

SEQ ID NO: 1116101 - protein, 28 aa, Mycobacterium
EPSLWEISRPWYLAWAGLAYVVAAVATL

SEQ ID NO: 1116102 - protein, 23 aa, Mycobacterium
EPTTGALLRHFARQAGAFENERI

SEQ ID NO: 1116103 - protein, 20 aa, Mycobacterium
EPTVLCAHWAMNGPDVTTTL

SEQ ID NO: 1116104 - protein, 17 aa, Mycobacterium
EQAAEVFVGTHLGPESD

SEQ ID NO: 1116105 - protein, 24 aa, Mycobacterium
EQIGSRFPWAFFMVVVAWLAVIFA

SEQ ID NO: 1116106 - protein, 20 aa, Mycobacterium
EQIMPLLVVAVMSQLVFSGG

SEQ ID NO: 1116107 - protein, 25 aa, Mycobacterium
EQLWLRCALVIAIAMGAAMIAIGVA

SEQ ID NO: 1116108 - protein, 22 aa, Mycobacterium
EQVIPLMPGAAMTGRDGDDVMG

SEQ ID NO: 1116109 - protein, 23 aa, Mycobacterium
ERDYRLAYAANRVFAFAGVDPDA

SEQ ID NO: 1116110 - protein, 21 aa, Mycobacterium
ERFDTCTEFARALVTPESPAP

SEQ ID NO: 1116111 - protein, 17 aa, Mycobacterium
ERIGQIWPEEGGPVSLT

SEQ ID NO: 1116112 - protein, 19 aa, Mycobacterium
ERLKAWRRGLIFALFVFAA

SEQ ID NO: 1116113 - protein, 17 aa, Mycobacterium
ERLKRDFATALDYWPLV

SEQ ID NO: 1116114 - protein, 19 aa, Mycobacterium
ERLSWPRTIGLGAQHVVAM

SEQ ID NO: 1116115 - protein, 18 aa, Mycobacterium
ERPDFRWLMSSDVCKHCT

SEQ ID NO: 1116116 - protein, 19 aa, Mycobacterium
ERPGMPFGPGQPGMQTPQQ

SEQ ID NO: 1116117 - protein, 21 aa, Mycobacterium
ERPRRHPLLIRVWGLIRLDYT

SEQ ID NO: 1116118 - protein, 24 aa, Mycobacterium
ERQVKRWGSQWGHVRLEDDPRDAD

SEQ ID NO: 1116119 - protein, 24 aa, Mycobacterium
ERRTEWPLAGVALLFLAAYAVDVL

SEQ ID NO: 1116120 - protein, 18 aa, Mycobacterium
ERVFEVLDLEPIIREEPD

SEQ ID NO: 1116121 - protein, 32 aa, Mycobacterium
ERVLEWPDIVGVSFPRGARWARVDLPDDEYIP

SEQ ID NO: 1116122 - protein, 19 aa, Mycobacterium
ERVPLRLQPSVLRAQVVMG

SEQ ID NO: 1116123 - protein, 21 aa, Mycobacterium
ERVSNLFLTKTVYSVLLAVLV

SEQ ID NO: 1116124 - protein, 22 aa, Mycobacterium
ERYTTTYLRFVWTMSATAVVLC

SEQ ID NO: 1116125 - protein, 21 aa, Mycobacterium
ESALPRLIAKMEHLGVERSTV

SEQ ID NO: 1116126 - protein, 27 aa, Mycobacterium
ESATGRPSPRWRALLLAAVAACAACGL

SEQ ID NO: 1116127 - protein, 19 aa, Mycobacterium
ESGVTLWLDPDSHLGALDP

SEQ ID NO: 1116128 - protein, 26 aa, Mycobacterium
ESITSRLPLVLGIIAGISFVLLFLLT

SEQ ID NO: 1116129 - protein, 25 aa, Mycobacterium
ESPAAAFRRLRLEMLAAERATLIAE

SEQ ID NO: 1116130 - protein, 18 aa, Mycobacterium
ETALPWVRIASLAVPAIL

SEQ ID NO: 1116131 - protein, 22 aa, Mycobacterium
ETARRSVGLFAFGPPPPPLMLP

SEQ ID NO: 1116132 - protein, 22 aa, Mycobacterium
ETERGFSMALGRLGDPADSDCL

SEQ ID NO: 1116133 - protein, 28 aa, Mycobacterium
ETIKGDASVGWLRLGALVLALSALAALL

SEQ ID NO: 1116134 - protein, 22 aa, Mycobacterium
ETWPTRWAQRIGHDRPDVVLLM

SEQ ID NO: 1116135 - protein, 24 aa, Mycobacterium
ETYSLPMRRLVGFAATAVDASLIP

SEQ ID NO: 1116136 - protein, 20 aa, Mycobacterium
EVAAPLLRQGDVVVVEAGEV

SEQ ID NO: 1116137 - protein, 20 aa, Mycobacterium
EVDRLIRLVDAFVWVLDPQK

SEQ ID NO: 1116138 - protein, 18 aa, Mycobacterium
EVGIMRLVGASRWYTQLP

SEQ ID NO: 1116139 - protein, 20 aa, Mycobacterium
EVHDLHVWTLVPGKDVVTAH

SEQ ID NO: 1116140 - protein, 18 aa, Mycobacterium
EVLDSVLDKVKWRRRRSR

SEQ ID NO: 1116141 - protein, 19 aa, Mycobacterium
EVLFVIGFLASFLALQTSA

SEQ ID NO: 1116142 - protein, 18 aa, Mycobacterium
EVMVPRTEMVWIESDKTA

SEQ ID NO: 1116143 - protein, 22 aa, Mycobacterium
EVPGILQMIFASAFGLDSAFGA

SEQ ID NO: 1116144 - protein, 18 aa, Mycobacterium
EVPLNMRDGLGLRLELKL

SEQ ID NO: 1116145 - protein, 17 aa, Mycobacterium
EVVFAWPGLGRLVYNAV

SEQ ID NO: 1116146 - protein, 25 aa, Mycobacterium
EVVGRRKMWYAISGVIVLIALASIL

SEQ ID NO: 1116147 - protein, 21 aa, Mycobacterium
EVVVAPAWMFQRGVFAWNGAI

SEQ ID NO: 1116148 - protein, 19 aa, Mycobacterium
EWALMGGVGPGIFLVQQLF

SEQ ID NO: 1116149 - protein, 21 aa, Mycobacterium
EWDPLTGLLTRRAFYQRLSTL

SEQ ID NO: 1116150 - protein, 29 aa, Mycobacterium
EWLDAQVFPPLEWAVEGIVPEGFGLLVAP

SEQ ID NO: 1116151 - protein, 19 aa, Mycobacterium
EWSGAALLATETAKPGRRG

SEQ ID NO: 1116152 - protein, 31 aa, Mycobacterium
EWYNTALGLAMVFGRFLPIILVLALAGSFAR

SEQ ID NO: 1116153 - protein, 18 aa, Mycobacterium
FAAARRTSWREFLDNRRP

SEQ ID NO: 1116154 - protein, 18 aa, Mycobacterium
FAALTVWFVIDPQLWLLV

SEQ ID NO: 1116155 - protein, 25 aa, Mycobacterium
FAATVVVCMIWRLVGQGLKHTPQNY

SEQ ID NO: 1116156 - protein, 22 aa, Mycobacterium
FAAVCAGALIIIIGVVFVEQGQ

SEQ ID NO: 1116157 - protein, 22 aa, Mycobacterium
FADGARAYGFILAFFGVGSALG

SEQ ID NO: 1116158 - protein, 28 aa, Mycobacterium
FAERAFKRPVVSFLVGFSMLAAGVTSAA

SEQ ID NO: 1116159 - protein, 21 aa, Mycobacterium
FAFFIGFVVSATWGQINSADG

SEQ ID NO: 1116160 - protein, 30 aa, Mycobacterium
FAGALLDRWDRRLVLIGANSARLVLVLGVA

SEQ ID NO: 1116161 - protein, 19 aa, Mycobacterium
FAGLVTLGVLLLVARRRLA

SEQ ID NO: 1116162 - protein, 17 aa, Mycobacterium
FALMGLRQLFFLLGGLL

SEQ ID NO: 1116163 - protein, 24 aa, Mycobacterium
FALNLCMAMGLALAIDYTLLMVSR

SEQ ID NO: 1116164 - protein, 23 aa, Mycobacterium
FAMGGRAAEELVFREPTTGAVSD

SEQ ID NO: 1116165 - protein, 19 aa, Mycobacterium
FAMRCAAAIGFLQMKRWGH

SEQ ID NO: 1116166 - protein, 18 aa, Mycobacterium
FAPYFPSVWILRKLQAKK

SEQ ID NO: 1116167 - protein, 25 aa, Mycobacterium
FAQANRIAHRWMFSDGVPQANADDQ

SEQ ID NO: 1116168 - protein, 25 aa, Mycobacterium
FARAIPSTALIPFAMMLFGVSPEMK

SEQ ID NO: 1116169 - protein, 17 aa, Mycobacterium
FARYPREASAVGILAAA

SEQ ID NO: 1116170 - protein, 19 aa, Mycobacterium
FAVGWGLGGFLWATVGGAI

SEQ ID NO: 1116171 - protein, 25 aa, Mycobacterium
FAVLSWVAGVGLGWLTALAAGNVKI

SEQ ID NO: 1116172 - protein, 23 aa, Mycobacterium
FAYLPRLVSPALRYREPSPRPAQ

SEQ ID NO: 1116173 - protein, 26 aa, Mycobacterium
FCLSLTPSLLPRDWLFQGLIGGANAA

SEQ ID NO: 1116174 - protein, 24 aa, Mycobacterium
FDETRPGRALPQWVTSVVDASVTR

SEQ ID NO: 1116175 - protein, 20 aa, Mycobacterium
FDHDFHIPIIGTWDALGFLQ

SEQ ID NO: 1116176 - protein, 22 aa, Mycobacterium
FDHVRFSYPTADKVSLASLEEV

SEQ ID NO: 1116177 - protein, 25 aa, Mycobacterium
FDPLRLRVGAALMLMLAYSASVGGL

SEQ ID NO: 1116178 - protein, 26 aa, Mycobacterium
FDPNSRFTISMMWSGDKAWRQAGERR

SEQ ID NO: 1116179 - protein, 21 aa, Mycobacterium
FDRVELVKLLLVVGAALPRAY

SEQ ID NO: 1116180 - protein, 17 aa, Mycobacterium
FDSKVFVVSFVFNVLVA

SEQ ID NO: 1116181 - protein, 20 aa, Mycobacterium
FDSMPIPAFTPLAARMSAGL

SEQ ID NO: 1116182 - protein, 23 aa, Mycobacterium
FEAEARSAAALTHPNIVAVHDYG

SEQ ID NO: 1116183 - protein, 20 aa, Mycobacterium
FEATPLWAAIYMLPLTFGFL

SEQ ID NO: 1116184 - protein, 23 aa, Mycobacterium
FEAVGLLIAVDWFAGIFRTFLNV

SEQ ID NO: 1116185 - protein, 19 aa, Mycobacterium
FEGAEKVWGRIRGHEDHES

SEQ ID NO: 1116186 - protein, 22 aa, Mycobacterium
FEGRPALGVAASIAVGVLLTQA

SEQ ID NO: 1116187 - protein, 17 aa, Mycobacterium
FEKEPLLIWTLIASLFI

SEQ ID NO: 1116188 - protein, 23 aa, Mycobacterium
FELKEFKTGAGRMAIEADVPILP

SEQ ID NO: 1116189 - protein, 17 aa, Mycobacterium
FEMRYRIPGVLDPGDTG

SEQ ID NO: 1116190 - protein, 17 aa, Mycobacterium
FEPNPYWSRLHAPGAEL

SEQ ID NO: 1116191 - protein, 26 aa, Mycobacterium
FEQMRKRFGSTMGYELDIRADTASLD

SEQ ID NO: 1116192 - protein, 27 aa, Mycobacterium
FERFAWDWEHCLGSEPRWGRWYDAEGV

SEQ ID NO: 1116193 - protein, 21 aa, Mycobacterium
FERFDPRSGTWESLPDMPTPR

SEQ ID NO: 1116194 - protein, 18 aa, Mycobacterium
FERGGPYLVRGAEDLIPT

SEQ ID NO: 1116195 - protein, 20 aa, Mycobacterium
FEVYFVPAGYVFSIWSVIYL

SEQ ID NO: 1116196 - protein, 18 aa, Mycobacterium
FFALYGTAAVYYWVICLV

SEQ ID NO: 1116197 - protein, 24 aa, Mycobacterium
FFAPHSWWPIMIALSFSTAAVGAA

SEQ ID NO: 1116198 - protein, 34 aa, Mycobacterium
FFFAAELLDTWLWRWASFLIVFGVMVLVTALLAL

SEQ ID NO: 1116199 - protein, 25 aa, Mycobacterium
FFFVLPRWFELMGSTSPTLGTVLRI

SEQ ID NO: 1116200 - protein, 24 aa, Mycobacterium
FFGANLIEGFGLEWGTAGVAAVAL

SEQ ID NO: 1116201 - protein, 36 aa, Mycobacterium
FFRPIRNYFYWEPHCFNIPVCASMRSVFDALDGVNT

SEQ ID NO: 1116202 - protein, 25 aa, Mycobacterium
FFRSPRWVPVVGWLLVLSAISGLFF

SEQ ID NO: 1116203 - protein, 37 aa, Mycobacterium
FGAGLFIAFDQLWKWNNIVALVLSVLVILGLVVGVRV

SEQ ID NO: 1116204 - protein, 19 aa, Mycobacterium
FGALAGVRWSPPKRVTGVL

SEQ ID NO: 1116205 - protein, 20 aa, Mycobacterium
FGALFFCLSLTPSLLPRDWL

SEQ ID NO: 1116206 - protein, 20 aa, Mycobacterium
FGALPWQAAVALAIMVNVAV

SEQ ID NO: 1116207 - protein, 18 aa, Mycobacterium
FGALVAFSAVNLTVIKHY

SEQ ID NO: 1116208 - protein, 24 aa, Mycobacterium
FGAPDGPADLVFLIAAPDSGGAEH

SEQ ID NO: 1116209 - protein, 20 aa, Mycobacterium
FGAWMGFATLWAVLVYFPVA

SEQ ID NO: 1116210 - protein, 28 aa, Mycobacterium
FGGDALKAFWYHFAIMFEALFILTTVDA

SEQ ID NO: 1116211 - protein, 19 aa, Mycobacterium
FGGDFPGTIIIPRLYALHI

SEQ ID NO: 1116212 - protein, 21 aa, Mycobacterium
FGGRNWTVFSAFVLLIPTLGT

SEQ ID NO: 1116213 - protein, 20 aa, Mycobacterium
FGHDPWWLILAKAVGVFVFL

SEQ ID NO: 1116214 - protein, 18 aa, Mycobacterium
FGHVSVKFGTPTWAVLVI

SEQ ID NO: 1116215 - protein, 22 aa, Mycobacterium
FGIRIDPFPAAVIAFSLNVGGY

SEQ ID NO: 1116216 - protein, 25 aa, Mycobacterium
FGLIARLPFAFAAGLGINSFLATTV

SEQ ID NO: 1116217 - protein, 17 aa, Mycobacterium
FGLIGVVIAWTFFFDFV

SEQ ID NO: 1116218 - protein, 17 aa, Mycobacterium
FGLPVLEAQILGCPVIC

SEQ ID NO: 1116219 - protein, 17 aa, Mycobacterium
FGLWWRAQQQKVDHRNV

SEQ ID NO: 1116220 - protein, 19 aa, Mycobacterium
FGMGLDIAWLLPAALICLG

SEQ ID NO: 1116221 - protein, 22 aa, Mycobacterium
FGNTGGEVFERGGPYLVRGAED

SEQ ID NO: 1116222 - protein, 19 aa, Mycobacterium
FGQMRFDRTTGYSAIFTNV

SEQ ID NO: 1116223 - protein, 36 aa, Mycobacterium
FGQTRLLRWSIPGIAHFFTMWGFFILASVYLEAYGL

SEQ ID NO: 1116224 - protein, 19 aa, Mycobacterium
FGSAARRAAILAAVVCVLT

SEQ ID NO: 1116225 - protein, 32 aa, Mycobacterium
FGSARAVQGLGWLRRHTRTIQIFGGVLLLIVG

SEQ ID NO: 1116226 - protein, 29 aa, Mycobacterium
FGTGFAHEVWAVVLFRIVGGIGVGVASVI

SEQ ID NO: 1116227 - protein, 21 aa, Mycobacterium
FGTLPLFWSIAMARMSGLMAA

SEQ ID NO: 1116228 - protein, 17 aa, Mycobacterium
FGTRALVLVRLLVPSAH

SEQ ID NO: 1116229 - protein, 18 aa, Mycobacterium
FGVAPAFIVYGTLLSQSR

SEQ ID NO: 1116230 - protein, 22 aa, Mycobacterium
FGVMAGEGLGWIELASTRDLEE

SEQ ID NO: 1116231 - protein, 30 aa, Mycobacterium
FGVRHVVRMWPLWIFAASFVSPLPWILVTA

SEQ ID NO: 1116232 - protein, 28 aa, Mycobacterium
FGWWYCAFISAALLAWVLRQDSTTRAGG

SEQ ID NO: 1116233 - protein, 23 aa, Mycobacterium
FHTPFKAAVLYFVVANLILAIFS

SEQ ID NO: 1116234 - protein, 23 aa, Mycobacterium
FILCPIFSCLALVQWPGGVAGRY

SEQ ID NO: 1116235 - protein, 25 aa, Mycobacterium
FIMGRLKDLLIVRGRNHYPDDIEGT

SEQ ID NO: 1116236 - protein, 20 aa, Mycobacterium
FINEARWVRGAVPFQGDIGS

SEQ ID NO: 1116237 - protein, 29 aa, Mycobacterium
FIRDAFDPARPVAVNVIDFGDDPDRGTWE

SEQ ID NO: 1116238 - protein, 17 aa, Mycobacterium
FISRCYNLILKSTLAAG

SEQ ID NO: 1116239 - protein, 25 aa, Mycobacterium
FITPIAVGLIFRFLLNDQIGAIPAL

SEQ ID NO: 1116240 - protein, 18 aa, Mycobacterium
FIVALAFAELVSRWPYEG

SEQ ID NO: 1116241 - protein, 18 aa, Mycobacterium
FIVAVVFFSGFVLGKNSG

SEQ ID NO: 1116242 - protein, 20 aa, Mycobacterium
FIVCSGLLQGIYWIRQGGDF

SEQ ID NO: 1116243 - protein, 25 aa, Mycobacterium
FIVRHPVLIIVAWVAAAAVLFLLIP

SEQ ID NO: 1116244 - protein, 25 aa, Mycobacterium
FKDRNRLATFAAVFLAGGVMFTLSV

SEQ ID NO: 1116245 - protein, 20 aa, Mycobacterium
FKLNIARGYLMIALPIGLVA

SEQ ID NO: 1116246 - protein, 17 aa, Mycobacterium
FLAYTLYVLIRWVSGPY

SEQ ID NO: 1116247 - protein, 22 aa, Mycobacterium
FLCVAIIAFIYIKLFGASAPGS

SEQ ID NO: 1116248 - protein, 18 aa, Mycobacterium
FLDFRLTPDTLRDGVVTV

SEQ ID NO: 1116249 - protein, 24 aa, Mycobacterium
FLDHAHIIAAVAFFLGIVLVAVYH

SEQ ID NO: 1116250 - protein, 28 aa, Mycobacterium
FLDQRINLEFDLTFSPRQLCSPTIAPLT

SEQ ID NO: 1116251 - protein, 18 aa, Mycobacterium
FLFWLGMGSLTVMSLLYL

SEQ ID NO: 1116252 - protein, 23 aa, Mycobacterium
FLGALCFLAAALLVLPPKRSENP

SEQ ID NO: 1116253 - protein, 23 aa, Mycobacterium
FLHIPWLLPVAMWILAVASVVTV

SEQ ID NO: 1116254 - protein, 18 aa, Mycobacterium
FLIRPWRRERRITLDGML

SEQ ID NO: 1116255 - protein, 23 aa, Mycobacterium
FLIVLGVIAKWVVPPISKVLQER

SEQ ID NO: 1116256 - protein, 26 aa, Mycobacterium
FLIYGTAAALVFPRLFFPDVSPATGL

SEQ ID NO: 1116257 - protein, 25 aa, Mycobacterium
FLLCVIPGLIASIMLMFTVVSLLDR

SEQ ID NO: 1116258 - protein, 23 aa, Mycobacterium
FLLKSSLRPPGGRMFDVQVIRTI

SEQ ID NO: 1116259 - protein, 25 aa, Mycobacterium
FLLLGRPLAWLTTSLTDWLNGLSGS

SEQ ID NO: 1116260 - protein, 19 aa, Mycobacterium
FLLTYVFAFGVTKAATNYF

SEQ ID NO: 1116261 - protein, 24 aa, Mycobacterium
FLLVPVFLAALFVGDGHETYWRVV

SEQ ID NO: 1116262 - protein, 21 aa, Mycobacterium
FLPSRWWSMTPLDGVVTAVLV

SEQ ID NO: 1116263 - protein, 19 aa, Mycobacterium
FLSSLLRSLISKEVFFSLS

SEQ ID NO: 1116264 - protein, 22 aa, Mycobacterium
FLSVRRGRLHPLLLVSISAISF

SEQ ID NO: 1116265 - protein, 17 aa, Mycobacterium
FLTFFVVAAFGALMVDR

SEQ ID NO: 1116266 - protein, 21 aa, Mycobacterium
FLVAKVIEWVKEIGIGNTFTS

SEQ ID NO: 1116267 - protein, 18 aa, Mycobacterium
FLVEFTRANETVWLDLTR

SEQ ID NO: 1116268 - protein, 18 aa, Mycobacterium
FLVLVWVFGGLFAAMLPM

SEQ ID NO: 1116269 - protein, 20 aa, Mycobacterium
FLVPALAGYIAFAIADRPGI

SEQ ID NO: 1116270 - protein, 20 aa, Mycobacterium
FLVPNGTFFFVLLIFLIVLG

SEQ ID NO: 1116271 - protein, 18 aa, Mycobacterium
FLVSRRIAGDSANFLVGG

SEQ ID NO: 1116272 - protein, 18 aa, Mycobacterium
FLVWSVVVGFLLGSLTVT

SEQ ID NO: 1116273 - protein, 18 aa, Mycobacterium
FLYEIAFQLAAFVILLWL

SEQ ID NO: 1116274 - protein, 21 aa, Mycobacterium
FMGVYLRFLRPGRVSEVSVIG

SEQ ID NO: 1116275 - protein, 24 aa, Mycobacterium
FMLRLKVALMAGIVLACPVWLHQV

SEQ ID NO: 1116276 - protein, 18 aa, Mycobacterium
FMLSDGLSNLGGPLRKLK

SEQ ID NO: 1116277 - protein, 18 aa, Mycobacterium
FMMICSGLPAIALGVVCW

SEQ ID NO: 1116278 - protein, 23 aa, Mycobacterium
FMTMDRWLMWRWPTTGRFLEYMK

SEQ ID NO: 1116279 - protein, 32 aa, Mycobacterium
FNALVAVAITGLWLWIGYDALLLIVATQILQM

SEQ ID NO: 1116280 - protein, 30 aa, Mycobacterium
FNNGLRPEPLIAFAVIAVWMLVENTIGTRR

SEQ ID NO: 1116281 - protein, 37 aa, Mycobacterium
FNPDRAATPWAIAGSFAVLFLPYSLLGPFAGALLDRW

SEQ ID NO: 1116282 - protein, 17 aa, Mycobacterium
FNPSGPDAQAWGVVIST

SEQ ID NO: 1116283 - protein, 17 aa, Mycobacterium
FNTWGVFAISYATATLH

SEQ ID NO: 1116284 - protein, 17 aa, Mycobacterium
FPAIAGVTLMLGALYVF

SEQ ID NO: 1116285 - protein, 21 aa, Mycobacterium
FPDYYRLRFGRGVEVAASVML

SEQ ID NO: 1116286 - protein, 24 aa, Mycobacterium
FPGLHPERLLAVFLGLPLLVALGV

SEQ ID NO: 1116287 - protein, 25 aa, Mycobacterium
FPGLREHLGLAYGFYGMCAILSGLF

SEQ ID NO: 1116288 - protein, 21 aa, Mycobacterium
FPGTIIIPRLYALHILLIPGI

SEQ ID NO: 1116289 - protein, 20 aa, Mycobacterium
FPHSNPAVIISHHLNTPPPR

SEQ ID NO: 1116290 - protein, 19 aa, Mycobacterium
FPIAAHFHTVIPFADVMES

SEQ ID NO: 1116291 - protein, 19 aa, Mycobacterium
FPIDVGWVAGTVFFGAAAL

SEQ ID NO: 1116292 - protein, 19 aa, Mycobacterium
FPLLAGPFAPWVFTGNLTA

SEQ ID NO: 1116293 - protein, 25 aa, Mycobacterium
FPLNRADNWLHFALGVVMLVLALTL

SEQ ID NO: 1116294 - protein, 25 aa, Mycobacterium
FPLRRALRSPRVWALAVVYFGVAYG

SEQ ID NO: 1116295 - protein, 18 aa, Mycobacterium
FPLTMVMVELIWQWTPFM

SEQ ID NO: 1116296 - protein, 24 aa, Mycobacterium
FPNFLNLASPYAFTGASFFTMMEI

SEQ ID NO: 1116297 - protein, 26 aa, Mycobacterium
FPPALPRMPSWWPLNMTWGGGLPSAV

SEQ ID NO: 1116298 - protein, 18 aa, Mycobacterium
FPPMGSILYWLRPGTIRL

SEQ ID NO: 1116299 - protein, 23 aa, Mycobacterium
FPRKISFLPGMRYYAGNWDTTWW

SEQ ID NO: 1116300 - protein, 26 aa, Mycobacterium
FPTFLRNIRPILGLGVGLVVITTFAV

SEQ ID NO: 1116301 - protein, 21 aa, Mycobacterium
FPVLIDGYDQWGWQVECGSGF

SEQ ID NO: 1116302 - protein, 18 aa, Mycobacterium
FPVLPMAFTPDFDVAVDS

SEQ ID NO: 1116303 - protein, 17 aa, Mycobacterium
FPYVDFLQMQLIAVLFF

SEQ ID NO: 1116304 - protein, 17 aa, Mycobacterium
FQPIHVTIAAWFTIGIP

SEQ ID NO: 1116305 - protein, 26 aa, Mycobacterium
FQPPSQAFGIVWPMLYADIAAVSAAT

SEQ ID NO: 1116306 - protein, 29 aa, Mycobacterium
FQREADIAATLWHPHIVSVHDRGDFDGLL

SEQ ID NO: 1116307 - protein, 18 aa, Mycobacterium
FRAVPVLIMMIFAYFLYA

SEQ ID NO: 1116308 - protein, 21 aa, Mycobacterium
FRGLPEVVIILLIGLGVGPIV

SEQ ID NO: 1116309 - protein, 26 aa, Mycobacterium
FRGMIGRLAIFLAVLIGYLLALAMGD

SEQ ID NO: 1116310 - protein, 22 aa, Mycobacterium
FRKEIIRLIAEISMGAGTLAMI

SEQ ID NO: 1116311 - protein, 24 aa, Mycobacterium
FRLNCASCHNFTGRGGALSSGKYA

SEQ ID NO: 1116312 - protein, 21 aa, Mycobacterium
FRRRLSAAVLLLVGLGVAGGV

SEQ ID NO: 1116313 - protein, 18 aa, Mycobacterium
FRSWEFFRTTGESFWQFS

SEQ ID NO: 1116314 - protein, 19 aa, Mycobacterium
FRTLDAFRIFDNIYILTGG

SEQ ID NO: 1116315 - protein, 17 aa, Mycobacterium
FSGICAVIMVLASALAV

SEQ ID NO: 1116316 - protein, 17 aa, Mycobacterium
FSLFMYVSMVLAESLLA

SEQ ID NO: 1116317 - protein, 18 aa, Mycobacterium
FSNVTYRGVQIGKVMGVN

SEQ ID NO: 1116318 - protein, 25 aa, Mycobacterium
FSREADLAAALWHPHIVGVHDRGEY

SEQ ID NO: 1116319 - protein, 25 aa, Mycobacterium
FSRVGLCTVPLTLVASVFGLWAGLA

SEQ ID NO: 1116320 - protein, 21 aa, Mycobacterium
FSRYSDQIMRSFGYALTATIV

SEQ ID NO: 1116321 - protein, 17 aa, Mycobacterium
FSSGPYVPADPALYDYD

SEQ ID NO: 1116322 - protein, 25 aa, Mycobacterium
FSTTLKWRGSAVLRAVLFTGSSAPM

SEQ ID NO: 1116323 - protein, 27 aa, Mycobacterium
FSVADFWRFWVVHLWVEDFLELFTTVM

SEQ ID NO: 1116324 - protein, 19 aa, Mycobacterium
FSVALPVVLTVAAMPFTYS

SEQ ID NO: 1116325 - protein, 20 aa, Mycobacterium
FSYEMRPSWSRTYAHGNELK

SEQ ID NO: 1116326 - protein, 17 aa, Mycobacterium
FTANVFALMGLRQLFFL

SEQ ID NO: 1116327 - protein, 37 aa, Mycobacterium
FTFIGAFILAQAMLKHGLARRFAFRILALPRAGQSTT

SEQ ID NO: 1116328 - protein, 17 aa, Mycobacterium
FTGLQAMLDPPRAAATP

SEQ ID NO: 1116329 - protein, 18 aa, Mycobacterium
FTGWGGFDTGLGFWQPPT

SEQ ID NO: 1116330 - protein, 25 aa, Mycobacterium
FTLPELIDGGLLALRIALLSLIIAW

SEQ ID NO: 1116331 - protein, 18 aa, Mycobacterium
FTLSFPFERWTRPENVAD

SEQ ID NO: 1116332 - protein, 18 aa, Mycobacterium
FTLSWALFRITDWISPPE

SEQ ID NO: 1116333 - protein, 24 aa, Mycobacterium
FTPTKWIHHFGLFAAVGAAVAALA

SEQ ID NO: 1116334 - protein, 18 aa, Mycobacterium
FTQRTLRPLMAVLTTEVD

SEQ ID NO: 1116335 - protein, 24 aa, Mycobacterium
FTTIYSLRFLWGAFSRKGLHEPSL

SEQ ID NO: 1116336 - protein, 27 aa, Mycobacterium
FTVCCILSFIVGFAMLGALTFLPTFMQ

SEQ ID NO: 1116337 - protein, 25 aa, Mycobacterium
FVAALSFATVNGWWYVSNFGVPWSN

SEQ ID NO: 1116338 - protein, 22 aa, Mycobacterium
FVAFNAGSTWLFGIAGKCGILH

SEQ ID NO: 1116339 - protein, 22 aa, Mycobacterium
FVEARWLSVLLLSAGLAGFCVH

SEQ ID NO: 1116340 - protein, 17 aa, Mycobacterium
FVGGWQLSSERLIPAFY

SEQ ID NO: 1116341 - protein, 19 aa, Mycobacterium
FVILVGLIIVRQWRLLGAF

SEQ ID NO: 1116342 - protein, 17 aa, Mycobacterium
FVLALALFVFIAYHAAG

SEQ ID NO: 1116343 - protein, 19 aa, Mycobacterium
FVLGMALALVMHRTIFGKG

SEQ ID NO: 1116344 - protein, 19 aa, Mycobacterium
FVLRDRGPVADSCSQPPSL

SEQ ID NO: 1116345 - protein, 24 aa, Mycobacterium
FVPAALPWYYTWPLAVVSALAQSR

SEQ ID NO: 1116346 - protein, 22 aa, Mycobacterium
FVPALDMLLAIIRRTRAGLSPF

SEQ ID NO: 1116347 - protein, 23 aa, Mycobacterium
FVQRLGERRVYVSGLIIVALSTA

SEQ ID NO: 1116348 - protein, 18 aa, Mycobacterium
FVRRQLRLPSPLIDVRLF

SEQ ID NO: 1116349 - protein, 18 aa, Mycobacterium
FVTGIGFPGVPIEELLFF

SEQ ID NO: 1116350 - protein, 25 aa, Mycobacterium
FVTQRFMLRWRTWLTDRLTGDWLDG

SEQ ID NO: 1116351 - protein, 24 aa, Mycobacterium
FVVGAALGYLGWRRFQRKEHVWSS

SEQ ID NO: 1116352 - protein, 20 aa, Mycobacterium
FVVGVVALVISLAVNIRPTA

SEQ ID NO: 1116353 - protein, 22 aa, Mycobacterium
FVVTIPAWFGGLGTRRTPEGRQ

SEQ ID NO: 1116354 - protein, 41 aa, Mycobacterium
FVVVEAFYLFSCRSLTRSAWRIGLFTNRWLIAGVAVQAVAQ

SEQ ID NO: 1116355 - protein, 19 aa, Mycobacterium
FVVVLAFAYLCFTVLAPWQ

SEQ ID NO: 1116356 - protein, 27 aa, Mycobacterium
FWAGACLPLGLALCLLFTGLFFAKPMN

SEQ ID NO: 1116357 - protein, 18 aa, Mycobacterium
FWALPSRFLTGAAAAGGI

SEQ ID NO: 1116358 - protein, 18 aa, Mycobacterium
FWLLLAGRKLAARDRRVL

SEQ ID NO: 1116359 - protein, 18 aa, Mycobacterium
FWRFTRYGIVVTLLSTTL

SEQ ID NO: 1116360 - protein, 25 aa, Mycobacterium
FWTLLEIIPNLTLIVVLGFGAYAAG

SEQ ID NO: 1116361 - protein, 18 aa, Mycobacterium
FWTPDYGAVIVRGAMNAG

SEQ ID NO: 1116362 - protein, 29 aa, Mycobacterium
FYGMCAILSGLFVWRWVRETKGVSLEDMH

SEQ ID NO: 1116363 - protein, 19 aa, Mycobacterium
FYLVWPLLIVGTAWLIARR

SEQ ID NO: 1116364 - protein, 18 aa, Mycobacterium
FYLVWPLLLIAVVGVLAI

SEQ ID NO: 1116365 - protein, 17 aa, Mycobacterium
FYPSIKHLLLEQAAEVF

SEQ ID NO: 1116366 - protein, 23 aa, Mycobacterium
GAAAGLAVAVWVVGIRGLLHDRG

SEQ ID NO: 1116367 - protein, 24 aa, Mycobacterium
GAAGYAIGVFAVWLTRYMLSRDTS

SEQ ID NO: 1116368 - protein, 22 aa, Mycobacterium
GAALWLPWLLVAGIVFVLVSAA

SEQ ID NO: 1116369 - protein, 18 aa, Mycobacterium
GAARGWQLIVMYGATEAT

SEQ ID NO: 1116370 - protein, 19 aa, Mycobacterium
GACFWHLVDLLWIVLFALL

SEQ ID NO: 1116371 - protein, 21 aa, Mycobacterium
GADEHGRYLGGYGAPATTANP

SEQ ID NO: 1116372 - protein, 25 aa, Mycobacterium
GADKSGLTALTWPVVANFAVDAAMA

SEQ ID NO: 1116373 - protein, 25 aa, Mycobacterium
GAELSFTEFAVWRTAGAIGLYAVLG

SEQ ID NO: 1116374 - protein, 27 aa, Mycobacterium
GAERDGRRLVAVLLRGTRQPIAPWEQA

SEQ ID NO: 1116375 - protein, 25 aa, Mycobacterium
GAESGDLWAGVGFTLGPLIIAFAVL

SEQ ID NO: 1116376 - protein, 25 aa, Mycobacterium
GAETLRLKSYLIMCRNSSRDYAEFA

SEQ ID NO: 1116377 - protein, 30 aa, Mycobacterium
GAFDALGMDVEWVIESWVLPFGVAGAVVVS

SEQ ID NO: 1116378 - protein, 20 aa, Mycobacterium
GAGAERWRGPAVSDDSAGDS

SEQ ID NO: 1116379 - protein, 21 aa, Mycobacterium
GAGGVKGWILGGAAILGAGIT

SEQ ID NO: 1116380 - protein, 24 aa, Mycobacterium
GAGHRVKGIVLGWTAIALLCAAAT

SEQ ID NO: 1116381 - protein, 22 aa, Mycobacterium
GAGKSTFARLVAGYTHPTAGSV

SEQ ID NO: 1116382 - protein, 21 aa, Mycobacterium
GAIFAGLLWWAAFGMDSPALV

SEQ ID NO: 1116383 - protein, 17 aa, Mycobacterium
GALAMALGALVVGALRP

SEQ ID NO: 1116384 - protein, 17 aa, Mycobacterium
GALARRAVIAAIGLGVV

SEQ ID NO: 1116385 - protein, 17 aa, Mycobacterium
GALETAHRTGTLHRDIK

SEQ ID NO: 1116386 - protein, 18 aa, Mycobacterium
GALLGGLILGVMENYGQA

SEQ ID NO: 1116387 - protein, 26 aa, Mycobacterium
GALMRAVAGVSIFKLVRYLAREYLLI

SEQ ID NO: 1116388 - protein, 31 aa, Mycobacterium
GALPKIRAGQVQWRLAGIFAAAGIPATVAGS

SEQ ID NO: 1116389 - protein, 23 aa, Mycobacterium
GALPSIPAFLWGLLFIGGLTATF

SEQ ID NO: 1116390 - protein, 23 aa, Mycobacterium
GALSEWHWQAIFWVGVPIGVLGT

SEQ ID NO: 1116391 - protein, 27 aa, Mycobacterium
GALSKSAIVPLHFWLPGAMAAPTPVSA

SEQ ID NO: 1116392 - protein, 17 aa, Mycobacterium
GALTFLPTFMQFVDGVS

SEQ ID NO: 1116393 - protein, 20 aa, Mycobacterium
GALVAVLWLVARLEIIVVPV

SEQ ID NO: 1116394 - protein, 26 aa, Mycobacterium
GALVPYIRWPMWLRSIVATVALAAIL

SEQ ID NO: 1116395 - protein, 23 aa, Mycobacterium
GAMPLMPALMMVWGTARTTAAAT

SEQ ID NO: 1116396 - protein, 20 aa, Mycobacterium
GANSARLVLVLGVAALLAGR

SEQ ID NO: 1116397 - protein, 24 aa, Mycobacterium
GANSGWWPLLWFTAKVWVFLFVYI

SEQ ID NO: 1116398 - protein, 18 aa, Mycobacterium
GASLVMWMGELVTERGIG

SEQ ID NO: 1116399 - protein, 23 aa, Mycobacterium
GASTLPVQVAWMLTAVVLNALAT

SEQ ID NO: 1116400 - protein, 24 aa, Mycobacterium
GASTRIPAPVILVVLATLLFGLFA

SEQ ID NO: 1116401 - protein, 27 aa, Mycobacterium
GATFCLSFTRLPYFQSLGVPLAVGMTI

SEQ ID NO: 1116402 - protein, 28 aa, Mycobacterium
GATFCLSFTRLPYFQTLGVPLAIGMVVV

SEQ ID NO: 1116403 - protein, 18 aa, Mycobacterium
GATVNWATLIALGIGDIV

SEQ ID NO: 1116404 - protein, 27 aa, Mycobacterium
GAVAAFVAFFVWERFARTRLIEPAGVH

SEQ ID NO: 1116405 - protein, 18 aa, Mycobacterium
GAVHLRVWLAERLAAASG

SEQ ID NO: 1116406 - protein, 25 aa, Mycobacterium
GAVICAGVAYAWWPDEAAYRPIQPW

SEQ ID NO: 1116407 - protein, 17 aa, Mycobacterium
GAVIGLWRAKVVEMTGM

SEQ ID NO: 1116408 - protein, 21 aa, Mycobacterium
GAVPSEFGPEFLVALDGGNPN

SEQ ID NO: 1116409 - protein, 18 aa, Mycobacterium
GAVVVPFSTFATARELAE

SEQ ID NO: 1116410 - protein, 20 aa, Mycobacterium
GAVYLRTSWMTARQKTLVSL

SEQ ID NO: 1116411 - protein, 26 aa, Mycobacterium
GAWEIPVVAVAVVWLAFELALFRDSS

SEQ ID NO: 1116412 - protein, 29 aa, Mycobacterium
GAYLSLRLLIPVIRWQRRDTLLADGDTST

SEQ ID NO: 1116413 - protein, 19 aa, Mycobacterium
GCAVVAWYSLAKVRERAPT

SEQ ID NO: 1116414 - protein, 19 aa, Mycobacterium
GCLTPRLVEHVKSLRAVPV

SEQ ID NO: 1116415 - protein, 17 aa, Mycobacterium
GCVDSPDGVKCAAAMAL

SEQ ID NO: 1116416 - protein, 20 aa, Mycobacterium
GDAGAWLLWDGRRSPVDLAN

SEQ ID NO: 1116417 - protein, 23 aa, Mycobacterium
GDAQLGLAPSYRAAEPGLALTRC

SEQ ID NO: 1116418 - protein, 20 aa, Mycobacterium
GDENFLIVGVDSRIGENSGM

SEQ ID NO: 1116419 - protein, 20 aa, Mycobacterium
GDFDGLLWISMDFVQGTDAA

SEQ ID NO: 1116420 - protein, 17 aa, Mycobacterium
GDIPFQVQLPPGAVAPG

SEQ ID NO: 1116421 - protein, 17 aa, Mycobacterium
GDKVFKSIAVAAGATII

SEQ ID NO: 1116422 - protein, 32 aa, Mycobacterium
GDLLGLPGWVTQRLWWALLLTVGFWGVVRVAE

SEQ ID NO: 1116423 - protein, 19 aa, Mycobacterium
GDPAYEVLVPFAVDGGPTV

SEQ ID NO: 1116424 - protein, 24 aa, Mycobacterium
GDRDVEIRGYLTLNPLKYSHPMLS

SEQ ID NO: 1116425 - protein, 24 aa, Mycobacterium
GDSARRSGNEFLFQQLAAQNVETL

SEQ ID NO: 1116426 - protein, 19 aa, Mycobacterium
GDSRGYLMRDGELTQITKD

SEQ ID NO: 1116427 - protein, 18 aa, Mycobacterium
GDTFLWWLAAASLLGAGT

SEQ ID NO: 1116428 - protein, 20 aa, Mycobacterium
GDVFGLRRWYVLTFLMGLFF

SEQ ID NO: 1116429 - protein, 25 aa, Mycobacterium
GDVTWPEAMGLVVINGLIIVLLAVT

SEQ ID NO: 1116430 - protein, 29 aa, Mycobacterium
GEAAVTAWSIGRWPVILLLVVVAVAVLYY

SEQ ID NO: 1116431 - protein, 28 aa, Mycobacterium
GEAGADIFRDFPQVVAVISNMAEKRSLA

SEQ ID NO: 1116432 - protein, 22 aa, Mycobacterium
GEAVLAFALLLLFGFGMIWFGI

SEQ ID NO: 1116433 - protein, 20 aa, Mycobacterium
GEAVLYPRGTIAMANAGPNT

SEQ ID NO: 1116434 - protein, 20 aa, Mycobacterium
GEDLLDWTMQILKAVPNFAL

SEQ ID NO: 1116435 - protein, 23 aa, Mycobacterium
GEDPNWVAVLGWQGGLENQRGQF

SEQ ID NO: 1116436 - protein, 31 aa, Mycobacterium
GEEQAPPRWPWVVGVTAIIAAISLVVSVALL

SEQ ID NO: 1116437 - protein, 20 aa, Mycobacterium
GEEWPQPKPEPAFKAAIAAA

SEQ ID NO: 1116438 - protein, 21 aa, Mycobacterium
GEGHLVLPLALVTGAIVTAGG

SEQ ID NO: 1116439 - protein, 28 aa, Mycobacterium
GEGPNKLPAYLLMVVAALGLLVYLCNFG

SEQ ID NO: 1116440 - protein, 23 aa, Mycobacterium
GEIPRELSALLDRILDFPTSTAE

SEQ ID NO: 1116441 - protein, 24 aa, Mycobacterium
GEISLPPGYLPLRVPIEVHFTQRV

SEQ ID NO: 1116442 - protein, 24 aa, Mycobacterium
GELLGSPLRYRAGRIGDFLRVEGP

SEQ ID NO: 1116443 - protein, 23 aa, Mycobacterium
GELRAELIAGGRSNLTFLVFDDA

SEQ ID NO: 1116444 - protein, 24 aa, Mycobacterium
GELRLAAERAELIPDINGYMAAME

SEQ ID NO: 1116445 - protein, 24 aa, Mycobacterium
GEQSRLQLQISDMFETLSRRSRSL

SEQ ID NO: 1116446 - protein, 26 aa, Mycobacterium
GERDRLPIEIAIAVLVLGVLLLVYRS

SEQ ID NO: 1116447 - protein, 26 aa, Mycobacterium
GESPEVKKGATFDCEVSIDGTKREVT

SEQ ID NO: 1116448 - protein, 21 aa, Mycobacterium
GETFLTNAFRAFGALTEDNRV

SEQ ID NO: 1116449 - protein, 26 aa, Mycobacterium
GEVAGWLAGWVYMWALVIIMATVAYG

SEQ ID NO: 1116450 - protein, 20 aa, Mycobacterium
GEVAVFVFFGLVAVLGTQYT

SEQ ID NO: 1116451 - protein, 25 aa, Mycobacterium
GEVPPEFRATFQAGIVGDRLAAGSA

SEQ ID NO: 1116452 - protein, 19 aa, Mycobacterium
GFAAIDWRSVAYGCLGVVV

SEQ ID NO: 1116453 - protein, 18 aa, Mycobacterium
GFAFYALDLHKCGRSHRD

SEQ ID NO: 1116454 - protein, 19 aa, Mycobacterium
GFAVFGGWVQEWLQTQFGI

SEQ ID NO: 1116455 - protein, 19 aa, Mycobacterium
GFEEYKRVLVATGKLLGLV

SEQ ID NO: 1116456 - protein, 23 aa, Mycobacterium
GFFTRKAWEIVVGVIVLFVYGGI

SEQ ID NO: 1116457 - protein, 19 aa, Mycobacterium
GFLVPAPGAVPIKFRSTYV

SEQ ID NO: 1116458 - protein, 22 aa, Mycobacterium
GFPADGRAGVTVLTLGNHNGSA

SEQ ID NO: 1116459 - protein, 19 aa, Mycobacterium
GFVERRLLVKPGMTGLWQV

SEQ ID NO: 1116460 - protein, 20 aa, Mycobacterium
GFVVFVLWLALGRYGNIPLG

SEQ ID NO: 1116461 - protein, 26 aa, Mycobacterium
GFYLTCAVFVFGVLGALMRAVAGVSI

SEQ ID NO: 1116462 - protein, 18 aa, Mycobacterium
GFYSPLFYRDLIGDPTGL

SEQ ID NO: 1116463 - protein, 20 aa, Mycobacterium
GGAEAFRAAGLSAIQLGDEA

SEQ ID NO: 1116464 - protein, 19 aa, Mycobacterium
GGAFRWCLQAADRLRVDFV

SEQ ID NO: 1116465 - protein, 27 aa, Mycobacterium
GGALMELDSAFGLHGWQWMFLIEGLVT

SEQ ID NO: 1116466 - protein, 24 aa, Mycobacterium
GGALQPFLDYALGYRRGVNAGQPP

SEQ ID NO: 1116467 - protein, 24 aa, Mycobacterium
GGALTEVSWRLAFLVNAPIGLLIV

SEQ ID NO: 1116468 - protein, 22 aa, Mycobacterium
GGDALSGCGIITAPGAPPAPAD

SEQ ID NO: 1116469 - protein, 24 aa, Mycobacterium
GGDYGLEFFAGWLTEYSLSVDNLF

SEQ ID NO: 1116470 - protein, 22 aa, Mycobacterium
GGFEIIPFLVGIIVAIVLIAIY

SEQ ID NO: 1116471 - protein, 32 aa, Mycobacterium
GGFFTDHLSWRWAFWINVPVGIVVFFVAAAAI

SEQ ID NO: 1116472 - protein, 25 aa, Mycobacterium
GGGVLQCGLMDWGCVSRLNLAMALW

SEQ ID NO: 1116473 - protein, 23 aa, Mycobacterium
GGHWPFGAVFGGLLGGVVALAAL

SEQ ID NO: 1116474 - protein, 23 aa, Mycobacterium
GGILPLLWIAWVAIKSFWQGRNT

SEQ ID NO: 1116475 - protein, 20 aa, Mycobacterium
GGLGPRGTTTIVFGLLAFNV

SEQ ID NO: 1116476 - protein, 26 aa, Mycobacterium
GGLLRRTYPLLVRRLVTLVPALAILA

SEQ ID NO: 1116477 - protein, 19 aa, Mycobacterium
GGLPMPIAVGTSLIVIAMK

SEQ ID NO: 1116478 - protein, 20 aa, Mycobacterium
GGLRVLACAVRTPYEADRFG

SEQ ID NO: 1116479 - protein, 23 aa, Mycobacterium
GGMTCASCAARVEKKLNRIDGVS

SEQ ID NO: 1116480 - protein, 17 aa, Mycobacterium
GGPGYKFANEYPTNQYQ

SEQ ID NO: 1116481 - protein, 22 aa, Mycobacterium
GGPLCDRFGRKAIYTYDLLVYM

SEQ ID NO: 1116482 - protein, 29 aa, Mycobacterium
GGPPPSVRRYAWHRVRRIMPAYAVTVVAA

SEQ ID NO: 1116483 - protein, 19 aa, Mycobacterium
GGRLLRMLLTQGAPLRPYP

SEQ ID NO: 1116484 - protein, 32 aa, Mycobacterium
GGTLPLYLPKVGLRFAVTVGLLLLATGLFLMR

SEQ ID NO: 1116485 - protein, 18 aa, Mycobacterium
GGTVKAFLIAGGSLTAVA

SEQ ID NO: 1116486 - protein, 26 aa, Mycobacterium
GGVAVYLWRMWVSRGRPGGVAAAAGS

SEQ ID NO: 1116487 - protein, 23 aa, Mycobacterium
GGVKRIAAFASIVVPFMAVVYIV

SEQ ID NO: 1116488 - protein, 26 aa, Mycobacterium
GGVLLEHFWWGSVFLINAPVMAVLVI

SEQ ID NO: 1116489 - protein, 18 aa, Mycobacterium
GGVSGTWGYRRELRGQWH

SEQ ID NO: 1116490 - protein, 19 aa, Mycobacterium
GGWIACGLLFLSATGLTWS

SEQ ID NO: 1116491 - protein, 22 aa, Mycobacterium
GHAWWAYPLLLAFCTFDAVVPV

SEQ ID NO: 1116492 - protein, 18 aa, Mycobacterium
GHDKNLFPDWAIAEGPFL

SEQ ID NO: 1116493 - protein, 25 aa, Mycobacterium
GHLAARFGLRPAPFLLGLSYALIAV

SEQ ID NO: 1116494 - protein, 23 aa, Mycobacterium
GHRGELKAFVAVFAVGMAAVLIA

SEQ ID NO: 1116495 - protein, 19 aa, Mycobacterium
GHTLERLFPGIGRLDDSFP

SEQ ID NO: 1116496 - protein, 26 aa, Mycobacterium
GHTPLQIACSLVFPAAVGALVYAMCA

SEQ ID NO: 1116497 - protein, 18 aa, Mycobacterium
GIAAVLGFGVFKRRVKGA

SEQ ID NO: 1116498 - protein, 24 aa, Mycobacterium
GIAEEFSQKVFVIFQRLHGREAYS

SEQ ID NO: 1116499 - protein, 19 aa, Mycobacterium
GIATPIAWLQAAGMVAAFI

SEQ ID NO: 1116500 - protein, 18 aa, Mycobacterium
GICAVIMVLASALAVRLV

SEQ ID NO: 1116501 - protein, 25 aa, Mycobacterium
GIFLSFVVNWLLQWAADGPNKPLWF

SEQ ID NO: 1116502 - protein, 27 aa, Mycobacterium
GIGAYVWWGLCPGFFLLLLPAGSLEIL

SEQ ID NO: 1116503 - protein, 25 aa, Mycobacterium
GIGLACAIGGYAFGKIPVKQRPVLY

SEQ ID NO: 1116504 - protein, 23 aa, Mycobacterium
GIGRVDWIGQFPLTMVMVELIWQ

SEQ ID NO: 1116505 - protein, 18 aa, Mycobacterium
GIIAEYLALHHGKQPLII

SEQ ID NO: 1116506 - protein, 19 aa, Mycobacterium
GIILACLIPMVIGYRKASM

SEQ ID NO: 1116507 - protein, 25 aa, Mycobacterium
GILGFLAGVTLCILAYKGFTTITNQ

SEQ ID NO: 1116508 - protein, 19 aa, Mycobacterium
GINGSRARLPFNLDPARTP

SEQ ID NO: 1116509 - protein, 19 aa, Mycobacterium
GIPGHLVEFVEALRKQGIS

SEQ ID NO: 1116510 - protein, 28 aa, Mycobacterium
GIRVNSFTSMFVFIGAVVYLMAAPRGRE

SEQ ID NO: 1116511 - protein, 20 aa, Mycobacterium
GISLPSRVFAILAIVFSVGF

SEQ ID NO: 1116512 - protein, 18 aa, Mycobacterium
GITMGIPVVGTWMHWALF

SEQ ID NO: 1116513 - protein, 18 aa, Mycobacterium
GIVLGTACLVVFRRPALA

SEQ ID NO: 1116514 - protein, 27 aa, Mycobacterium
GKARFIAWPPGRWGGVGSVNPQTAADP

SEQ ID NO: 1116515 - protein, 18 aa, Mycobacterium
GKELYDMSCVSCHGSNLQ

SEQ ID NO: 1116516 - protein, 26 aa, Mycobacterium
GKEVPRGEVGRIFVGTTFPFEGYTGG

SEQ ID NO: 1116517 - protein, 26 aa, Mycobacterium
GKIPVKQRPVLYLALEDGHRRLQDRF

SEQ ID NO: 1116518 - protein, 19 aa, Mycobacterium
GKSTLAWIMAGLTVPTTGS

SEQ ID NO: 1116519 - protein, 26 aa, Mycobacterium
GKVRETIMRRLLAFGSALTIIGAAGG

SEQ ID NO: 1116520 - protein, 22 aa, Mycobacterium
GLALTRCYDGALVRYTEAGRTN

SEQ ID NO: 1116521 - protein, 23 aa, Mycobacterium
GLASLRMPIGLGLVVVVAAGVLL

SEQ ID NO: 1116522 - protein, 18 aa, Mycobacterium
GLASRPGQSLWYVKLKKP

SEQ ID NO: 1116523 - protein, 23 aa, Mycobacterium
GLDDGRFAWFVKVHHTVMDGVAG

SEQ ID NO: 1116524 - protein, 25 aa, Mycobacterium
GLDGLRPFFTGYLPAVFLAGILTPA

SEQ ID NO: 1116525 - protein, 25 aa, Mycobacterium
GLDRELAARFGFLLAIPAVFASGLF

SEQ ID NO: 1116526 - protein, 18 aa, Mycobacterium
GLEAMLYTLLRGELPSAT

SEQ ID NO: 1116527 - protein, 18 aa, Mycobacterium
GLFGIVWVGLGLSIFQQF

SEQ ID NO: 1116528 - protein, 18 aa, Mycobacterium
GLFLPMGAGKPIRLQGAF

SEQ ID NO: 1116529 - protein, 18 aa, Mycobacterium
GLFYGGGIDQLWKQAVAA

SEQ ID NO: 1116530 - protein, 25 aa, Mycobacterium
GLGGWASVHLFGFPALDDTTPLFAF

SEQ ID NO: 1116531 - protein, 28 aa, Mycobacterium
GLGLPGWGALKLALPRSGNADASYLAAE

SEQ ID NO: 1116532 - protein, 21 aa, Mycobacterium
GLGVARLMRFVPRSVMVGFVN

SEQ ID NO: 1116533 - protein, 17 aa, Mycobacterium
GLIFLILVGTSFGLWWR

SEQ ID NO: 1116534 - protein, 20 aa, Mycobacterium
GLIGVFGYPAAFAVLAVLPL

SEQ ID NO: 1116535 - protein, 20 aa, Mycobacterium
GLIVSEWIRGGSLAEVAETA

SEQ ID NO: 1116536 - protein, 35 aa, Mycobacterium
GLKDLAINCGYPLIERFPLMFFTSAAVLLIGMGRW

SEQ ID NO: 1116537 - protein, 25 aa, Mycobacterium
GLLAFEIIVLLALAAWIFITGPQSG

SEQ ID NO: 1116538 - protein, 21 aa, Mycobacterium
GLLARKPRALILDEPLAGLDA

SEQ ID NO: 1116539 - protein, 39 aa, Mycobacterium
GLLEPKRAMRIRGWRRLGAAVVRWPGPILLLTIALSLIG

SEQ ID NO: 1116540 - protein, 31 aa, Mycobacterium
GLLFALGVIVLAVFVLWVWAQRRRRKRRAAE

SEQ ID NO: 1116541 - protein, 26 aa, Mycobacterium
GLLVFGVGVAIYFAKAGPRDGAVTAG

SEQ ID NO: 1116542 - protein, 19 aa, Mycobacterium
GLMGLGAALLIAALLLSTY

SEQ ID NO: 1116543 - protein, 25 aa, Mycobacterium
GLPAPWPRIMREAARSRADAVPDAL

SEQ ID NO: 1116544 - protein, 21 aa, Mycobacterium
GLPEEIRPLIPVVKAASAVGL

SEQ ID NO: 1116545 - protein, 29 aa, Mycobacterium
GLPHLDAGPFLSYGIQWIAFGIIAPIGLG

SEQ ID NO: 1116546 - protein, 22 aa, Mycobacterium
GLPTDGVVALLDFGGSGTSITL

SEQ ID NO: 1116547 - protein, 24 aa, Mycobacterium
GLQRLRATYHYRIQAGYLGLYMLP

SEQ ID NO: 1116548 - protein, 23 aa, Mycobacterium
GLRPGEEKLVFSRFWRSDPSRVR

SEQ ID NO: 1116549 - protein, 25 aa, Mycobacterium
GLRRGAINWRQVAVLSVAGCGPASV

SEQ ID NO: 1116550 - protein, 18 aa, Mycobacterium
GLRRRGVGPGDVVAFQLP

SEQ ID NO: 1116551 - protein, 23 aa, Mycobacterium
GLTNFRTFFGFALNDPVNKQMLY

SEQ ID NO: 1116552 - protein, 24 aa, Mycobacterium
GLVCAIGLAGGYVFSVFLQGVNPG

SEQ ID NO: 1116553 - protein, 19 aa, Mycobacterium
GLVEFRNPFGLENWTLPVL

SEQ ID NO: 1116554 - protein, 19 aa, Mycobacterium
GLYIDDFWWTAVWAGIVLS

SEQ ID NO: 1116555 - protein, 21 aa, Mycobacterium
GLYWCAIGLIIALAASGIAKR

SEQ ID NO: 1116556 - protein, 19 aa, Mycobacterium
GMAGLTWAALAAIGLASAA

SEQ ID NO: 1116557 - protein, 22 aa, Mycobacterium
GMATPRWLRRLPRRGWSAGLAL

SEQ ID NO: 1116558 - protein, 24 aa, Mycobacterium
GMGLRSGGTIAIIFSLVCIGLAAF

SEQ ID NO: 1116559 - protein, 25 aa, Mycobacterium
GMLIATRAATGWKVLRANDSAVAII

SEQ ID NO: 1116560 - protein, 24 aa, Mycobacterium
GMLLCVSFPPFGWWYCAFISAALL

SEQ ID NO: 1116561 - protein, 17 aa, Mycobacterium
GMRTLDLVGGGNGVTAN

SEQ ID NO: 1116562 - protein, 23 aa, Mycobacterium
GMRVAGFVLPLAVTLFAFILIAN

SEQ ID NO: 1116563 - protein, 28 aa, Mycobacterium
GMSRSPRWWRFFGALQWLLIAVAVAGGV

SEQ ID NO: 1116564 - protein, 17 aa, Mycobacterium
GNDEFALALVMTVGTVV

SEQ ID NO: 1116565 - protein, 18 aa, Mycobacterium
GNFGSVFLAWLVMVVTVF

SEQ ID NO: 1116566 - protein, 18 aa, Mycobacterium
GNFRRIADEMVRHAEDSL

SEQ ID NO: 1116567 - protein, 23 aa, Mycobacterium
GNGAFFSQFMGWVLSPLGHDVNE

SEQ ID NO: 1116568 - protein, 18 aa, Mycobacterium
GNLAFFFLVPALAGYIAF

SEQ ID NO: 1116569 - protein, 23 aa, Mycobacterium
GNLWPGQGGVYIWAYRTMGETWG

SEQ ID NO: 1116570 - protein, 23 aa, Mycobacterium
GNMYEFINLTSFCGLVAAAVVLR

SEQ ID NO: 1116571 - protein, 18 aa, Mycobacterium
GNVLLEWMRMPGDIVFIG

SEQ ID NO: 1116572 - protein, 24 aa, Mycobacterium
GPAAEMADRLLVPVTDGYDVFEPG

SEQ ID NO: 1116573 - protein, 25 aa, Mycobacterium
GPAFARAVVEIGVLGGVVLVLALAA

SEQ ID NO: 1116574 - protein, 18 aa, Mycobacterium
GPAYAVLGFALWIALYLA

SEQ ID NO: 1116575 - protein, 19 aa, Mycobacterium
GPDAPRDGLGLKFVLYLAF

SEQ ID NO: 1116576 - protein, 25 aa, Mycobacterium
GPDQSRLPLAAAVATAVLVLLAVLV

SEQ ID NO: 1116577 - protein, 25 aa, Mycobacterium
GPERFRQALFRALAGFIELWMLAGG

SEQ ID NO: 1116578 - protein, 29 aa, Mycobacterium
GPFLKIPPYLPVYIDRDWVAQAEVALKCP

SEQ ID NO: 1116579 - protein, 17 aa, Mycobacterium
GPFNVWGYFGFLISIAF

SEQ ID NO: 1116580 - protein, 19 aa, Mycobacterium
GPGIGWSWWVLTAVAAVAL

SEQ ID NO: 1116581 - protein, 18 aa, Mycobacterium
GPGQPSWGRLGPLGGTDP

SEQ ID NO: 1116582 - protein, 20 aa, Mycobacterium
GPGRVEFDHVHFAYTAGTPV

SEQ ID NO: 1116583 - protein, 20 aa, Mycobacterium
GPGTAARLAARRGARVTGVD

SEQ ID NO: 1116584 - protein, 19 aa, Mycobacterium
GPGTGRLWLDTLIADVLAT

SEQ ID NO: 1116585 - protein, 21 aa, Mycobacterium
GPLLEILQILKAHGIGMNNMV

SEQ ID NO: 1116586 - protein, 17 aa, Mycobacterium
GPLPIPFFFGVLAGEEP

SEQ ID NO: 1116587 - protein, 38 aa, Mycobacterium
GPLRKLKDPSWRVGAWACSVIVVAAWGSILLMGVTDPL

SEQ ID NO: 1116588 - protein, 27 aa, Mycobacterium
GPNKPLWFGVDAWRWMFLAMAVPAVVY

SEQ ID NO: 1116589 - protein, 19 aa, Mycobacterium
GPRAPSWAYSAMVFDGLPA

SEQ ID NO: 1116590 - protein, 19 aa, Mycobacterium
GPRFIPWLRRTVGNPAAPH

SEQ ID NO: 1116591 - protein, 27 aa, Mycobacterium
GPSTWKFGALCAVLSAVILGIAMGRGG

SEQ ID NO: 1116592 - protein, 17 aa, Mycobacterium
GPTVTRYEVELGPGVKV

SEQ ID NO: 1116593 - protein, 24 aa, Mycobacterium
GPVSWAGGVGFRVVALMGPDALET

SEQ ID NO: 1116594 - protein, 19 aa, Mycobacterium
GPVTSEFNGKVHFVEQNRA

SEQ ID NO: 1116595 - protein, 29 aa, Mycobacterium
GPWVPASWRRWWWALLLAFVPIHLVVSAV

SEQ ID NO: 1116596 - protein, 20 aa, Mycobacterium
GQAAFAWLPDIADMGFSSVL

SEQ ID NO: 1116597 - protein, 17 aa, Mycobacterium
GQATLWLTWPFGPAGAL

SEQ ID NO: 1116598 - protein, 37 aa, Mycobacterium
GQELAHWDFYMGLAYFKLAIIAAGIAFRARMGGTEDN

SEQ ID NO: 1116599 - protein, 19 aa, Mycobacterium
GQGAVNWARSTMRISDLGG

SEQ ID NO: 1116600 - protein, 18 aa, Mycobacterium
GQGGRLIVVIGASAKSGS

SEQ ID NO: 1116601 - protein, 17 aa, Mycobacterium
GQLEASRALGFSYSSSM

SEQ ID NO: 1116602 - protein, 31 aa, Mycobacterium
GQLRAGTALIARGEFSLVIIGLVGASVEALE

SEQ ID NO: 1116603 - protein, 23 aa, Mycobacterium
GQPPPRRRGLIVAGAILAVILLV

SEQ ID NO: 1116604 - protein, 24 aa, Mycobacterium
GQQDVSRWAWYVVVAVAAGAVLRA

SEQ ID NO: 1116605 - protein, 17 aa, Mycobacterium
GQRKARDARAFHATGQM

SEQ ID NO: 1116606 - protein, 23 aa, Mycobacterium
GQRRIPVQYAKRMVGRRMYGGTS

SEQ ID NO: 1116607 - protein, 23 aa, Mycobacterium
GQTLDHVLGLIVKFTESAGGSTF

SEQ ID NO: 1116608 - protein, 24 aa, Mycobacterium
GQVDVASAWRWTALLAAVVTLAAL

SEQ ID NO: 1116609 - protein, 18 aa, Mycobacterium
GQVLGSVVALDFVARTWS

SEQ ID NO: 1116610 - protein, 23 aa, Mycobacterium
GQVVFQRGFQLPKLPPGTETVEV

SEQ ID NO: 1116611 - protein, 18 aa, Mycobacterium
GRDAVSLADTRFGPLATR

SEQ ID NO: 1116612 - protein, 19 aa, Mycobacterium
GRDSILGSFPVPREAESKP

SEQ ID NO: 1116613 - protein, 28 aa, Mycobacterium
GRFAFHRPWHVIAGWIVLIAVVAGVLTV

SEQ ID NO: 1116614 - protein, 20 aa, Mycobacterium
GRGSREWLAGVAIGLALVVK

SEQ ID NO: 1116615 - protein, 18 aa, Mycobacterium
GRHHRRLAAFVAVSVVSA

SEQ ID NO: 1116616 - protein, 29 aa, Mycobacterium
GRHRYGVALAERLDLRAGRLVVAEDENAH

SEQ ID NO: 1116617 - protein, 21 aa, Mycobacterium
GRIAIAVLFVGGWQLSSERLI

SEQ ID NO: 1116618 - protein, 18 aa, Mycobacterium
GRIALGVLGAVGALTAWF

SEQ ID NO: 1116619 - protein, 17 aa, Mycobacterium
GRIGQKVLLELRRRVFR

SEQ ID NO: 1116620 - protein, 19 aa, Mycobacterium
GRIMALWLVGFLGSRPIAA

SEQ ID NO: 1116621 - protein, 21 aa, Mycobacterium
GRLAALPLWAWLATLAVLTVG

SEQ ID NO: 1116622 - protein, 18 aa, Mycobacterium
GRLFTPFFITVGLVEAAY

SEQ ID NO: 1116623 - protein, 19 aa, Mycobacterium
GRLGTVLLIVGGVGVAVAA

SEQ ID NO: 1116624 - protein, 18 aa, Mycobacterium
GRMQMRFGPNRVGPKGLL

SEQ ID NO: 1116625 - protein, 30 aa, Mycobacterium
GRNTDWVAIAWEWQAGNVFQRVTIVADQSP

SEQ ID NO: 1116626 - protein, 20 aa, Mycobacterium
GRPALLGFLGATLITAGGLG

SEQ ID NO: 1116627 - protein, 27 aa, Mycobacterium
GRPGCWQKVTRDLWPAPYLVLDTGASL

SEQ ID NO: 1116628 - protein, 20 aa, Mycobacterium
GRPRPVEFIFGWDDWIYLHE

SEQ ID NO: 1116629 - protein, 31 aa, Mycobacterium
GRPWTLNAVEWLDGLTFQWWMYPVGVMAILV

SEQ ID NO: 1116630 - protein, 17 aa, Mycobacterium
GRQPVSIFLPTYLVLSA

SEQ ID NO: 1116631 - protein, 23 aa, Mycobacterium
GRRDLSMAFGWSLFNWIADVACL

SEQ ID NO: 1116632 - protein, 18 aa, Mycobacterium
GRRLPRTGAADWVMPETT

SEQ ID NO: 1116633 - protein, 25 aa, Mycobacterium
GRRLTGWVAALFSWRRRHLSTPPAP

SEQ ID NO: 1116634 - protein, 27 aa, Mycobacterium
GRRRTQRNVYIPWSLTVTPISQSEVGS

SEQ ID NO: 1116635 - protein, 20 aa, Mycobacterium
GRRWVYLCATAVVAGVAIGF

SEQ ID NO: 1116636 - protein, 20 aa, Mycobacterium
GRSIMALAVLFAVGMNVYVY

SEQ ID NO: 1116637 - protein, 18 aa, Mycobacterium
GRTAYLVMELVNGEPLNS

SEQ ID NO: 1116638 - protein, 19 aa, Mycobacterium
GRTGIGLKLSGSRTAQAWA

SEQ ID NO: 1116639 - protein, 17 aa, Mycobacterium
GRVARRTALAVIALLGL

SEQ ID NO: 1116640 - protein, 30 aa, Mycobacterium
GRVIEIVHPTFLYELVWNLLVFAVLIWADR

SEQ ID NO: 1116641 - protein, 24 aa, Mycobacterium
GRVNWRRCAPRSIGAGLLVGLLTG

SEQ ID NO: 1116642 - protein, 23 aa, Mycobacterium
GRVYSELAASWLWVITLAGVCLW

SEQ ID NO: 1116643 - protein, 25 aa, Mycobacterium
GRYELREVLGLGGMAEVRDGWDTRL

SEQ ID NO: 1116644 - protein, 19 aa, Mycobacterium
GRYRLLVFHGGPPNLQFWQ

SEQ ID NO: 1116645 - protein, 19 aa, Mycobacterium
GRYRLQRLIATGGMGQVWE

SEQ ID NO: 1116646 - protein, 21 aa, Mycobacterium
GRYTGEIAFYCYGEGKVEAIR

SEQ ID NO: 1116647 - protein, 17 aa, Mycobacterium
GSAPPFVPCTHIHSDDL

SEQ ID NO: 1116648 - protein, 21 aa, Mycobacterium
GSEAARAGWLGDVDFTADIRG

SEQ ID NO: 1116649 - protein, 17 aa, Mycobacterium
GSFAVYAALGWVYKTVI

SEQ ID NO: 1116650 - protein, 21 aa, Mycobacterium
GSFPTRVGLMTGVYTAALQGG

SEQ ID NO: 1116651 - protein, 20 aa, Mycobacterium
GSGRSALWHLVGRLHAERLD

SEQ ID NO: 1116652 - protein, 25 aa, Mycobacterium
GSGYRVPPSLVRRADGQTVQLTPLL

SEQ ID NO: 1116653 - protein, 18 aa, Mycobacterium
GSHGLRVLLVGSSDVPVD

SEQ ID NO: 1116654 - protein, 28 aa, Mycobacterium
GSIAPTVMKLIWRLLGLLPPQRRIASLT

SEQ ID NO: 1116655 - protein, 26 aa, Mycobacterium
GSKRSLGVIGGILGALVLLIVIVVLV

SEQ ID NO: 1116656 - protein, 17 aa, Mycobacterium
GSLFPFLFITIACGALS

SEQ ID NO: 1116657 - protein, 17 aa, Mycobacterium
GSLLPNRQRSVARQLVV

SEQ ID NO: 1116658 - protein, 19 aa, Mycobacterium
GSMLWLFVGTMVVTVPLAW

SEQ ID NO: 1116659 - protein, 20 aa, Mycobacterium
GSSRGWRAVAPLSRDDAWII

SEQ ID NO: 1116660 - protein, 19 aa, Mycobacterium
GSVPAELDAIVTRISVAGG

SEQ ID NO: 1116661 - protein, 20 aa, Mycobacterium
GTACLVVFRRPALALHVLLD

SEQ ID NO: 1116662 - protein, 24 aa, Mycobacterium
GTAIRAGLALPRPLREVIAEGDAV

SEQ ID NO: 1116663 - protein, 26 aa, Mycobacterium
GTAVKALLTFQPWWTAMRSGSRTAPS

SEQ ID NO: 1116664 - protein, 19 aa, Mycobacterium
GTAYGFPFGALPAGGAELP

SEQ ID NO: 1116665 - protein, 18 aa, Mycobacterium
GTDRPCPNPELPLPTKHS

SEQ ID NO: 1116666 - protein, 18 aa, Mycobacterium
GTEHGDPFLGRTMGTSSD

SEQ ID NO: 1116667 - protein, 18 aa, Mycobacterium
GTIARRFALSPIPLYLLA

SEQ ID NO: 1116668 - protein, 18 aa, Mycobacterium
GTKGLSMFFVPKHLFDPA

SEQ ID NO: 1116669 - protein, 25 aa, Mycobacterium
GTLAANLIGGWVLMLLIMTAFPQLH

SEQ ID NO: 1116670 - protein, 25 aa, Mycobacterium
GTLLFKLTPWIVVAIFVFGAAMATY

SEQ ID NO: 1116671 - protein, 18 aa, Mycobacterium
GTLLVFGAIAVWAVVEQN

SEQ ID NO: 1116672 - protein, 27 aa, Mycobacterium
GTLPRLRYDQFMAIGWKMLIPVSLAWI

SEQ ID NO: 1116673 - protein, 29 aa, Mycobacterium
GTLRILTELARDWPKLRVVDQANSGKSSA

SEQ ID NO: 1116674 - protein, 26 aa, Mycobacterium
GTMAVWKFGALIGYAALYAYVAPWQL

SEQ ID NO: 1116675 - protein, 18 aa, Mycobacterium
GTNPFALLLVSFLGPIAA

SEQ ID NO: 1116676 - protein, 19 aa, Mycobacterium
GTPVEILREGKPMTLTVEP

SEQ ID NO: 1116677 - protein, 17 aa, Mycobacterium
GTQDLGLMLLRVGLGVL

SEQ ID NO: 1116678 - protein, 24 aa, Mycobacterium
GTQWRDVVAFVLLVLVLLFRPTGI

SEQ ID NO: 1116679 - protein, 20 aa, Mycobacterium
GTRFRMTLPVAVHEQPEVVL

SEQ ID NO: 1116680 - protein, 23 aa, Mycobacterium
GTRRLWPAAVAVVIAMFSVTLAP

SEQ ID NO: 1116681 - protein, 27 aa, Mycobacterium
GTVMEIVGWRALWGLGNALFIATALAT

SEQ ID NO: 1116682 - protein, 25 aa, Mycobacterium
GTVYARLDIGVAIFFVLSGFLLFRP

SEQ ID NO: 1116683 - protein, 23 aa, Mycobacterium
GTWRVNTYPGLACDVKSHLYSYS

SEQ ID NO: 1116684 - protein, 31 aa, Mycobacterium
GVALKMLWPSAPRWVGVPLYLMLGYVALLFA

SEQ ID NO: 1116685 - protein, 22 aa, Mycobacterium
GVAQCLALLPGVSRSGATISAG

SEQ ID NO: 1116686 - protein, 25 aa, Mycobacterium
GVAVIVLGWVAYRIFEAVEKSRAEA

SEQ ID NO: 1116687 - protein, 20 aa, Mycobacterium
GVAVLLAWIPLRNRPGVGTV

SEQ ID NO: 1116688 - protein, 18 aa, Mycobacterium
GVAYRPVPMVAGVVLGTL

SEQ ID NO: 1116689 - protein, 26 aa, Mycobacterium
GVELPKAMFWIGIVYILFATVVAFWI

SEQ ID NO: 1116690 - protein, 18 aa, Mycobacterium
GVFWAGLAFLGFLQVTAF

SEQ ID NO: 1116691 - protein, 23 aa, Mycobacterium
GVGLGLSVARGFVEAMGGTVTAN

SEQ ID NO: 1116692 - protein, 24 aa, Mycobacterium
GVGLMAWLNIIGIIILQQPAYKAL

SEQ ID NO: 1116693 - protein, 23 aa, Mycobacterium
GVGPLRLARRHLLPGAVPNAVVA

SEQ ID NO: 1116694 - protein, 18 aa, Mycobacterium
GVIAVGGYHVYKGATKKF

SEQ ID NO: 1116695 - protein, 18 aa, Mycobacterium
GVIYRPLLFTSVNAQVAD

SEQ ID NO: 1116696 - protein, 20 aa, Mycobacterium
GVKFLIPVVDRLIRVDQRVV

SEQ ID NO: 1116697 - protein, 17 aa, Mycobacterium
GVLHLLVGYIILQIALG

SEQ ID NO: 1116698 - protein, 26 aa, Mycobacterium
GVLLWQHLFWFFGHPEVYVIALPFFG

SEQ ID NO: 1116699 - protein, 18 aa, Mycobacterium
GVLMARRGAGDPRRLLTV

SEQ ID NO: 1116700 - protein, 21 aa, Mycobacterium
GVLPLWQIWTILGLLAVLGLR

SEQ ID NO: 1116701 - protein, 21 aa, Mycobacterium
GVLVIPRLFARYPREASAVGI

SEQ ID NO: 1116702 - protein, 18 aa, Mycobacterium
GVMAAVYLVEYGRGKFAK

SEQ ID NO: 1116703 - protein, 24 aa, Mycobacterium
GVNGSRVFLPFGLDPDRTPVMGSY

SEQ ID NO: 1116704 - protein, 27 aa, Mycobacterium
GVPHWARGLMPVVIIPLFASLVVGLLM

SEQ ID NO: 1116705 - protein, 17 aa, Mycobacterium
GVPHWRIIVRHIVPNVA

SEQ ID NO: 1116706 - protein, 19 aa, Mycobacterium
GVPPWMVFAGFSISLIYQF

SEQ ID NO: 1116707 - protein, 17 aa, Mycobacterium
GVPRGRTGIGLKLSGSR

SEQ ID NO: 1116708 - protein, 25 aa, Mycobacterium
GVQCSVGYGVGRACDLTTTGRTVRI

SEQ ID NO: 1116709 - protein, 18 aa, Mycobacterium
GVRGLRGLFSRRVNITAL

SEQ ID NO: 1116710 - protein, 19 aa, Mycobacterium
GVRVMPVFAVKSGAFFALT

SEQ ID NO: 1116711 - protein, 20 aa, Mycobacterium
GVRWPNPWPNTFAHHEFFHA

SEQ ID NO: 1116712 - protein, 27 aa, Mycobacterium
GVTAAYLWSLWALFFTHAGMPGMTMSF

SEQ ID NO: 1116713 - protein, 29 aa, Mycobacterium
GVVAAVLLWQWRAHRGPVLVAALAAGGAA

SEQ ID NO: 1116714 - protein, 23 aa, Mycobacterium
GVVALAALIGYRARSGRLRSAFD

SEQ ID NO: 1116715 - protein, 23 aa, Mycobacterium
GVVLCALSPLLPVRQTTATILWP

SEQ ID NO: 1116716 - protein, 24 aa, Mycobacterium
GVVPVWRYRVHRWAVDARAVYTRT

SEQ ID NO: 1116717 - protein, 20 aa, Mycobacterium
GVVVEHPWLLVVLAPMVGAG

SEQ ID NO: 1116718 - protein, 19 aa, Mycobacterium
GVVYRCNQKSLGRSVAIKV

SEQ ID NO: 1116719 - protein, 19 aa, Mycobacterium
GVYRKGRLQLISAAFEPLI

SEQ ID NO: 1116720 - protein, 18 aa, Mycobacterium
GWAGVVVVGGVLGVRYLL

SEQ ID NO: 1116721 - protein, 21 aa, Mycobacterium
GWKMLIPVSLAWIMIVATAHS

SEQ ID NO: 1116722 - protein, 19 aa, Mycobacterium
GWLNRLKVLARRMCVTATP

SEQ ID NO: 1116723 - protein, 25 aa, Mycobacterium
GWLSDRFGRRPVYVVGAVLGATWGF

SEQ ID NO: 1116724 - protein, 19 aa, Mycobacterium
GWNAAYFCGSNAVLRREAL

SEQ ID NO: 1116725 - protein, 19 aa, Mycobacterium
GWSDAGPRAPSWAYSAMVF

SEQ ID NO: 1116726 - protein, 19 aa, Mycobacterium
GWTAIPMWVLGILTFLIPA

SEQ ID NO: 1116727 - protein, 18 aa, Mycobacterium
GWWTSEIAVVIWMVGVSL

SEQ ID NO: 1116728 - protein, 31 aa, Mycobacterium
GYALQWPMFAGFCVYAYYKFVRYEEAPPEQN

SEQ ID NO: 1116729 - protein, 26 aa, Mycobacterium
GYDGFLYSIGFLVAWLVALLLVAELL

SEQ ID NO: 1116730 - protein, 26 aa, Mycobacterium
GYDQWGWQVECGSGFVANLTQAENAA

SEQ ID NO: 1116731 - protein, 22 aa, Mycobacterium
GYEPKAAMRILFVSLPLGVATA

SEQ ID NO: 1116732 - protein, 19 aa, Mycobacterium
GYHSLPFGLMRGFGHVGLG

SEQ ID NO: 1116733 - protein, 22 aa, Mycobacterium
GYLDEIVIRVGPSPTPAEQQAA

SEQ ID NO: 1116734 - protein, 22 aa, Mycobacterium
GYPARLVVPGLYGYVSATKWVV

SEQ ID NO: 1116735 - protein, 21 aa, Mycobacterium
GYPLVCLIGLYLAAKAMFVRH

SEQ ID NO: 1116736 - protein, 17 aa, Mycobacterium
GYPSQYGGGYPGAGGPS

SEQ ID NO: 1116737 - protein, 25 aa, Mycobacterium
GYQTRLQERYVWNSVDVMLEAFVFA

SEQ ID NO: 1116738 - protein, 24 aa, Mycobacterium
HAAEQRAALEWSHPSPDVLATIPG

SEQ ID NO: 1116739 - protein, 18 aa, Mycobacterium
HAAFGARRRGLLAVYARE

SEQ ID NO: 1116740 - protein, 19 aa, Mycobacterium
HAASMVFLAAFAVVTLAMP

SEQ ID NO: 1116741 - protein, 21 aa, Mycobacterium
HADEINRAVVLIAVSVLLVGV

SEQ ID NO: 1116742 - protein, 18 aa, Mycobacterium
HAEIKRLADRIGTHVRLA

SEQ ID NO: 1116743 - protein, 18 aa, Mycobacterium
HAFGESFLTQNFPVGSVV

SEQ ID NO: 1116744 - protein, 18 aa, Mycobacterium
HAGEVFAVLQMPDGDFPG

SEQ ID NO: 1116745 - protein, 17 aa, Mycobacterium
HAVLLVHGFTDYFFHTE

SEQ ID NO: 1116746 - protein, 23 aa, Mycobacterium
HETSRAGNTFGIAGMAVALIATI

SEQ ID NO: 1116747 - protein, 17 aa, Mycobacterium
HETYWRVVAFVVFAVAV

SEQ ID NO: 1116748 - protein, 21 aa, Mycobacterium
HFFGLRRPWPAVVTAHAVESP

SEQ ID NO: 1116749 - protein, 19 aa, Mycobacterium
HGFAVFFALLAAIFMAIGI

SEQ ID NO: 1116750 - protein, 19 aa, Mycobacterium
HGNSLEWATSCPPPRHNFT

SEQ ID NO: 1116751 - protein, 20 aa, Mycobacterium
HGRPLNAFATAGGFFLSFML

SEQ ID NO: 1116752 - protein, 23 aa, Mycobacterium
HHAVGGIGGVLAWLVNTAASAVI

SEQ ID NO: 1116753 - protein, 27 aa, Mycobacterium
HHPKKELWFAWWVMVVFYQLYGVLFFL

SEQ ID NO: 1116754 - protein, 23 aa, Mycobacterium
HIDPDMLGGLTIAVGDEVIDGSL

SEQ ID NO: 1116755 - protein, 23 aa, Mycobacterium
HISRGRMAALVIGTFLVGVYGGY

SEQ ID NO: 1116756 - protein, 21 aa, Mycobacterium
HLLLVRPGFVIGRMTAGMDPA

SEQ ID NO: 1116757 - protein, 19 aa, Mycobacterium
HLPETEFLIADSFPTTDSS

SEQ ID NO: 1116758 - protein, 25 aa, Mycobacterium
HLQHTKWGVGIALLFVTLPFVVRSV

SEQ ID NO: 1116759 - protein, 20 aa, Mycobacterium
HLQPWQVVYAIGYPLVCLIG

SEQ ID NO: 1116760 - protein, 21 aa, Mycobacterium
HLVALPVLIVLIATGYRTPPR

SEQ ID NO: 1116761 - protein, 22 aa, Mycobacterium
HNCASRYLYALGREGLSSGLQK

SEQ ID NO: 1116762 - protein, 23 aa, Mycobacterium
HNYGESVLDGWAAVAPPPDWTAA

SEQ ID NO: 1116763 - protein, 18 aa, Mycobacterium
HPHTFRRLFVAFYFVMYM

SEQ ID NO: 1116764 - protein, 20 aa, Mycobacterium
HPPGALLTFVWLDRIGLGGG

SEQ ID NO: 1116765 - protein, 20 aa, Mycobacterium
HQMAEPFSVFGYHVTGSTGT

SEQ ID NO: 1116766 - protein, 17 aa, Mycobacterium
HRALMAIAISEAGLANT

SEQ ID NO: 1116767 - protein, 21 aa, Mycobacterium
HRDIAYALVLVWALIGIAVRL

SEQ ID NO: 1116768 - protein, 23 aa, Mycobacterium
HRFHHLKWAGVGDVNFGLFTLVW

SEQ ID NO: 1116769 - protein, 18 aa, Mycobacterium
HRLVVPRVVASTFVALLL

SEQ ID NO: 1116770 - protein, 21 aa, Mycobacterium
HRPASVIKVLIAIQSLKELNL

SEQ ID NO: 1116771 - protein, 21 aa, Mycobacterium
HRRVPPPATRKGTITIEPPPE

SEQ ID NO: 1116772 - protein, 20 aa, Mycobacterium
HSRSNWLVMFIVLIVLTVVA

SEQ ID NO: 1116773 - protein, 24 aa, Mycobacterium
HSRSWTRPAGFERFAWDWEHCLGS

SEQ ID NO: 1116774 - protein, 17 aa, Mycobacterium
HTALNYVRARQVTTEIN

SEQ ID NO: 1116775 - protein, 17 aa, Mycobacterium
HTPYLAWLAQASANSAA

SEQ ID NO: 1116776 - protein, 19 aa, Mycobacterium
HTVAALAMWLGSAVTGGPL

SEQ ID NO: 1116777 - protein, 22 aa, Mycobacterium
HVAEIILAILLFVDATDVRGGL

SEQ ID NO: 1116778 - protein, 17 aa, Mycobacterium
HVFEMRYRIPGVLDPGD

SEQ ID NO: 1116779 - protein, 19 aa, Mycobacterium
HVLGPYPFDPSLVAQGIPP

SEQ ID NO: 1116780 - protein, 20 aa, Mycobacterium
HVLLGIAGYNFGRFCLTPAP

SEQ ID NO: 1116781 - protein, 27 aa, Mycobacterium
HVQKMPVAFFMRTRTGALVSRLGNDVL

SEQ ID NO: 1116782 - protein, 22 aa, Mycobacterium
HWNPRLIVIPGAPLVRRGPYRW

SEQ ID NO: 1116783 - protein, 18 aa, Mycobacterium
HWPSGGAQWARWYPMAML

SEQ ID NO: 1116784 - protein, 19 aa, Mycobacterium
IAAAVFLATWVPLFASFGA

SEQ ID NO: 1116785 - protein, 24 aa, Mycobacterium
IAAFLWHRVHRGWRPVLVAYVLVM

SEQ ID NO: 1116786 - protein, 19 aa, Mycobacterium
IAAFVLALTYRSYRLTTAE

SEQ ID NO: 1116787 - protein, 29 aa, Mycobacterium
IAALLGKWFWWPQRVRNQPVPSPWPSPGP

SEQ ID NO: 1116788 - protein, 19 aa, Mycobacterium
IAAMFAILVALTGVMFVLA

SEQ ID NO: 1116789 - protein, 19 aa, Mycobacterium
IAAMLDERAPGAFAVTYYP

SEQ ID NO: 1116790 - protein, 19 aa, Mycobacterium
IAAPKLKWVAGAIGGGLTF

SEQ ID NO: 1116791 - protein, 27 aa, Mycobacterium
IAARRPEAHLSLIWFTVCSSVVHAVIM

SEQ ID NO: 1116792 - protein, 24 aa, Mycobacterium
IAGGILAGWLHFRIDYAGHTEVAD

SEQ ID NO: 1116793 - protein, 32 aa, Mycobacterium
IAGLPCLPWFIDSAWNLAFGVLPPYWAAKAFW

SEQ ID NO: 1116794 - protein, 26 aa, Mycobacterium
IAGVDPRVGLFASFTMAVTVAILGGR

SEQ ID NO: 1116795 - protein, 19 aa, Mycobacterium
IAIPFSFLVLVWVFGGLLA

SEQ ID NO: 1116796 - protein, 17 aa, Mycobacterium
IAIPVVAFSTMFAMLIG

SEQ ID NO: 1116797 - protein, 18 aa, Mycobacterium
IAISLASIIPVLAVGAAG

SEQ ID NO: 1116798 - protein, 17 aa, Mycobacterium
IAIVLAVTFGLSAYTAL

SEQ ID NO: 1116799 - protein, 25 aa, Mycobacterium
IALEVLATLCLRASDGFRKKVWMAP

SEQ ID NO: 1116800 - protein, 17 aa, Mycobacterium
IALFAGMFGGNREGTNP

SEQ ID NO: 1116801 - protein, 17 aa, Mycobacterium
IALFMGVYLRFLRPGRV

SEQ ID NO: 1116802 - protein, 20 aa, Mycobacterium
IALNQSWRGAISRFLGHDAG

SEQ ID NO: 1116803 - protein, 17 aa, Mycobacterium
IALPAARLAPDVELVCY

SEQ ID NO: 1116804 - protein, 19 aa, Mycobacterium
IALPLLAYFAIMWGGGYLL

SEQ ID NO: 1116805 - protein, 20 aa, Mycobacterium
IALRTFKWMLGFSAVAAVLA

SEQ ID NO: 1116806 - protein, 18 aa, Mycobacterium
IALVEVWPASSRPYIGGS

SEQ ID NO: 1116807 - protein, 25 aa, Mycobacterium
IALVLFCLWPFTRLVHVFSAPIGYL

SEQ ID NO: 1116808 - protein, 17 aa, Mycobacterium
IAMAVTAFGVMAGEGLG

SEQ ID NO: 1116809 - protein, 17 aa, Mycobacterium
IAMFGFWGIVLGPVLMI

SEQ ID NO: 1116810 - protein, 19 aa, Mycobacterium
IANASAWTLGARVVPAVGL

SEQ ID NO: 1116811 - protein, 24 aa, Mycobacterium
IAPVIAGVIWKLMFNPQFGILNHV

SEQ ID NO: 1116812 - protein, 23 aa, Mycobacterium
IARPEPLARWLALSTTIYLKLFG

SEQ ID NO: 1116813 - protein, 19 aa, Mycobacterium
IASLGAMLYLSMDIAIHWG

SEQ ID NO: 1116814 - protein, 22 aa, Mycobacterium
IATACVAAICLVQSDPTIALVG

SEQ ID NO: 1116815 - protein, 24 aa, Mycobacterium
IATMPADGGLVFSTIPPGGIAAGR

SEQ ID NO: 1116816 - protein, 17 aa, Mycobacterium
IATWLIISRCVLPRLGR

SEQ ID NO: 1116817 - protein, 24 aa, Mycobacterium
IAVICAVAVFSAIVLRDLRIPAIG

SEQ ID NO: 1116818 - protein, 21 aa, Mycobacterium
IAVLICLGAALMAYFKPLGKR

SEQ ID NO: 1116819 - protein, 28 aa, Mycobacterium
IAWLAGWRSAADLCWIAGTVLAVVPAVV

SEQ ID NO: 1116820 - protein, 26 aa, Mycobacterium
ICGGVIAGTVVVGWVMWLIMINPFRL

SEQ ID NO: 1116821 - protein, 26 aa, Mycobacterium
ICLRIRRVEGGWGMLSVTQLFAATIF

SEQ ID NO: 1116822 - protein, 27 aa, Mycobacterium
IDAARLLTWRASWMAATGVPFERGEGS

SEQ ID NO: 1116823 - protein, 26 aa, Mycobacterium
IDDALELRGRILGAFEQAERSSDPKR

SEQ ID NO: 1116824 - protein, 23 aa, Mycobacterium
IDDRLKKFGTMAAAMVLYVLISQ

SEQ ID NO: 1116825 - protein, 24 aa, Mycobacterium
IDEVTEYFLVGSFASWIVALGGLA

SEQ ID NO: 1116826 - protein, 27 aa, Mycobacterium
IDFDDCGFGWFFYDFGTAVSFIEDDPA

SEQ ID NO: 1116827 - protein, 19 aa, Mycobacterium
IDGCRELIQNAAMAANGEH

SEQ ID NO: 1116828 - protein, 17 aa, Mycobacterium
IDGMRRWLVEGPLDLSR

SEQ ID NO: 1116829 - protein, 17 aa, Mycobacterium
IDLPFAVSPVVVGVALI

SEQ ID NO: 1116830 - protein, 22 aa, Mycobacterium
IDPDGPGLLPPRTITETPAPGA

SEQ ID NO: 1116831 - protein, 25 aa, Mycobacterium
IDTAWCAGVVWGAARARELLSRAHI

SEQ ID NO: 1116832 - protein, 18 aa, Mycobacterium
IEALWWGQGRLLGERRRL

SEQ ID NO: 1116833 - protein, 18 aa, Mycobacterium
IEDLAGWARVERPDLARI

SEQ ID NO: 1116834 - protein, 24 aa, Mycobacterium
IEHPGKRAPTVELCNDPKGYQPLA

SEQ ID NO: 1116835 - protein, 20 aa, Mycobacterium
IELALAWRSGEDDPLVEAVV

SEQ ID NO: 1116836 - protein, 24 aa, Mycobacterium
IERDSPTWSPRWVDHLVGDRIHRE

SEQ ID NO: 1116837 - protein, 17 aa, Mycobacterium
IETPVPFRAVIRHRAYQ

SEQ ID NO: 1116838 - protein, 25 aa, Mycobacterium
IEVCTRLPIRAILMVVAATVAVQRT

SEQ ID NO: 1116839 - protein, 19 aa, Mycobacterium
IFACGLVIMITGVRLTWAM

SEQ ID NO: 1116840 - protein, 18 aa, Mycobacterium
IFDHLGPQLRWWEWTLDN

SEQ ID NO: 1116841 - protein, 19 aa, Mycobacterium
IFFVLSGFLLFRPWVQAAA

SEQ ID NO: 1116842 - protein, 24 aa, Mycobacterium
IFSHLGAITVDWTVIAVFVAAAMA

SEQ ID NO: 1116843 - protein, 22 aa, Mycobacterium
IFSIPWAQELFILDPTNPAITS

SEQ ID NO: 1116844 - protein, 20 aa, Mycobacterium
IFVGTTFPFEGYTGGGHKQI

SEQ ID NO: 1116845 - protein, 24 aa, Mycobacterium
IFYMFAGGALLMFVATCTIGSSRD

SEQ ID NO: 1116846 - protein, 17 aa, Mycobacterium
IGALFVLGFLRFGLPPE

SEQ ID NO: 1116847 - protein, 19 aa, Mycobacterium
IGALGRRAADREVATGTVL

SEQ ID NO: 1116848 - protein, 19 aa, Mycobacterium
IGALLFRLVFIFVGAELLA

SEQ ID NO: 1116849 - protein, 19 aa, Mycobacterium
IGAVIWGIVDAVLIFTDKV

SEQ ID NO: 1116850 - protein, 19 aa, Mycobacterium
IGDPQIRVVIAGQLKQGKS

SEQ ID NO: 1116851 - protein, 24 aa, Mycobacterium
IGDRAWARLIGRHARSVQRHVREH

SEQ ID NO: 1116852 - protein, 17 aa, Mycobacterium
IGDRLVDRFGETAVARA

SEQ ID NO: 1116853 - protein, 24 aa, Mycobacterium
IGFAEGWHDFWHGDIGVWVMTRGL

SEQ ID NO: 1116854 - protein, 20 aa, Mycobacterium
IGFAVIVFLLVRFVVPPVRR

SEQ ID NO: 1116855 - protein, 20 aa, Mycobacterium
IGFSVVEVILAYVGYNVVYA

SEQ ID NO: 1116856 - protein, 18 aa, Mycobacterium
IGFVCCLGSVAGIALGLV

SEQ ID NO: 1116857 - protein, 17 aa, Mycobacterium
IGFVFAFFIGFVVSATW

SEQ ID NO: 1116858 - protein, 20 aa, Mycobacterium
IGGALVIGALGRRAADREVA

SEQ ID NO: 1116859 - protein, 18 aa, Mycobacterium
IGGLLIVVVALFLGVDPG

SEQ ID NO: 1116860 - protein, 19 aa, Mycobacterium
IGGLVAFLFLLARTKMSKF

SEQ ID NO: 1116861 - protein, 21 aa, Mycobacterium
IGGVLYIDMRLVEGASLKDVL

SEQ ID NO: 1116862 - protein, 18 aa, Mycobacterium
IGGVVTIIMGLVFIGLIP

SEQ ID NO: 1116863 - protein, 17 aa, Mycobacterium
IGGWWRITVPALQRAGW

SEQ ID NO: 1116864 - protein, 27 aa, Mycobacterium
IGIAARAGHPISFWRFTRYGIVVTLLS

SEQ ID NO: 1116865 - protein, 23 aa, Mycobacterium
IGIAWPHLSAWAMSRVDDPAEGP

SEQ ID NO: 1116866 - protein, 19 aa, Mycobacterium
IGIMYCIACFAFFLVGGLM

SEQ ID NO: 1116867 - protein, 23 aa, Mycobacterium
IGLAVALAFLFGYALSTLPLLKA

SEQ ID NO: 1116868 - protein, 24 aa, Mycobacterium
IGLFDTWPGLIIPYITFALPLAIY

SEQ ID NO: 1116869 - protein, 17 aa, Mycobacterium
IGLSLAVGRGVLSALGE

SEQ ID NO: 1116870 - protein, 17 aa, Mycobacterium
IGLSMLGDLPWWVTGVI

SEQ ID NO: 1116871 - protein, 18 aa, Mycobacterium
IGNLRGALLGGLILGVME

SEQ ID NO: 1116872 - protein, 18 aa, Mycobacterium
IGNTVEWFDFAIYGFLAT

SEQ ID NO: 1116873 - protein, 17 aa, Mycobacterium
IGQEAKLSWPNATTYLS

SEQ ID NO: 1116874 - protein, 30 aa, Mycobacterium
IGQKVLLELRRRVFRHFQRLDLAFHDRYTS

SEQ ID NO: 1116875 - protein, 24 aa, Mycobacterium
IGRDMPKLVIAVAVVMIALVTARQ

SEQ ID NO: 1116876 - protein, 25 aa, Mycobacterium
IGRSSRFVKMYGLRIDLQRLETALR

SEQ ID NO: 1116877 - protein, 19 aa, Mycobacterium
IGSAIPFVAQHKVLFAVIA

SEQ ID NO: 1116878 - protein, 17 aa, Mycobacterium
IGSRSPLGFGRGAEQSG

SEQ ID NO: 1116879 - protein, 22 aa, Mycobacterium
IGTLCAAMGFVLEYSIGGAAPA

SEQ ID NO: 1116880 - protein, 17 aa, Mycobacterium
IGTLFAFVLVSAGVIVL

SEQ ID NO: 1116881 - protein, 17 aa, Mycobacterium
IGTMWRPIEFVFNTPSH

SEQ ID NO: 1116882 - protein, 22 aa, Mycobacterium
IGVEAFTGFFAALVNVRIAAPV

SEQ ID NO: 1116883 - protein, 17 aa, Mycobacterium
IGVPWWFLVGQLPVAGV

SEQ ID NO: 1116884 - protein, 24 aa, Mycobacterium
IGVTRISLNFAMFRSAFEQGAQLG

SEQ ID NO: 1116885 - protein, 18 aa, Mycobacterium
IIGTWDALGFLQDFFAVA

SEQ ID NO: 1116886 - protein, 23 aa, Mycobacterium
IILAQAIGRLGNYFNQELYGRAT

SEQ ID NO: 1116887 - protein, 17 aa, Mycobacterium
IIPRAAVCAERIDEVLQ

SEQ ID NO: 1116888 - protein, 18 aa, Mycobacterium
IIPVTRFIVGTTIGIQAA

SEQ ID NO: 1116889 - protein, 21 aa, Mycobacterium
IIRHPEVRRSLLTQKSYAEGL

SEQ ID NO: 1116890 - protein, 21 aa, Mycobacterium
IISCVKAALFGLIAGLVACYR

SEQ ID NO: 1116891 - protein, 21 aa, Mycobacterium
IIVAVVVALLIIAALAMMARK

SEQ ID NO: 1116892 - protein, 19 aa, Mycobacterium
IKPTLPILLANLTSVTQVL

SEQ ID NO: 1116893 - protein, 17 aa, Mycobacterium
IKRRKMIGVSLGVGLGA

SEQ ID NO: 1116894 - protein, 17 aa, Mycobacterium
IKTDLALSNAVYGLTIA

SEQ ID NO: 1116895 - protein, 17 aa, Mycobacterium
ILAAGLWAGLLWGADGT

SEQ ID NO: 1116896 - protein, 21 aa, Mycobacterium
ILAICIYGGYFGAAAGVLLLA

SEQ ID NO: 1116897 - protein, 17 aa, Mycobacterium
ILAIRWRLPSGTEIDTG

SEQ ID NO: 1116898 - protein, 34 aa, Mycobacterium
ILALVYLAGWWRLRRRGDAWPAGRTVAWLLGCAT

SEQ ID NO: 1116899 - protein, 18 aa, Mycobacterium
ILCVTVLLLPLGIPVLRL

SEQ ID NO: 1116900 - protein, 19 aa, Mycobacterium
ILHSANLSAAFFNLGPEMA

SEQ ID NO: 1116901 - protein, 18 aa, Mycobacterium
ILIRGFTFGIDFEGGTKV

SEQ ID NO: 1116902 - protein, 18 aa, Mycobacterium
ILLIPGIMLALIAAHLAL

SEQ ID NO: 1116903 - protein, 21 aa, Mycobacterium
ILLLAAFSWMISSRIVRGLTM

SEQ ID NO: 1116904 - protein, 20 aa, Mycobacterium
ILLWGSAGVFGFVENNLGFK

SEQ ID NO: 1116905 - protein, 19 aa, Mycobacterium
ILRETELRVDESALTGESA

SEQ ID NO: 1116906 - protein, 25 aa, Mycobacterium
ILRKAGYRPALIVGDPDRMSAEVLR

SEQ ID NO: 1116907 - protein, 17 aa, Mycobacterium
ILSEAALSFLGLGIQPP

SEQ ID NO: 1116908 - protein, 32 aa, Mycobacterium
ILSITMVTLIGWWALSRVLGRLVNIPDVHKLE

SEQ ID NO: 1116909 - protein, 17 aa, Mycobacterium
ILSVIGFIVMFGGVVFA

SEQ ID NO: 1116910 - protein, 20 aa, Mycobacterium
ILVGLWSLYSALRPRRRTGL

SEQ ID NO: 1116911 - protein, 17 aa, Mycobacterium
ILVHGWPDSHVVWDSVA

SEQ ID NO: 1116912 - protein, 19 aa, Mycobacterium
ILVTSILVLLAFPLLTAAL

SEQ ID NO: 1116913 - protein, 21 aa, Mycobacterium
ILVWRLVRRDTVQPAISGFIG

SEQ ID NO: 1116914 - protein, 24 aa, Mycobacterium
ILWNLSGPVTLPFVGVELPKAMFW

SEQ ID NO: 1116915 - protein, 23 aa, Mycobacterium
ILWQLSGPLTLFGLTLPRALFWI

SEQ ID NO: 1116916 - protein, 18 aa, Mycobacterium
IMLAAWLWLGRRVVGDDP

SEQ ID NO: 1116917 - protein, 29 aa, Mycobacterium
IMSLRRRRFRWCVAAAYLSGVSTVAGVGA

SEQ ID NO: 1116918 - protein, 18 aa, Mycobacterium
IMVFVGSDFVVTVRHGDH

SEQ ID NO: 1116919 - protein, 26 aa, Mycobacterium
INKPSEASIGWALYALIVLSLLQAGS

SEQ ID NO: 1116920 - protein, 30 aa, Mycobacterium
INYIVWRWFGSINWAAWWIAVPLVIAETYS

SEQ ID NO: 1116921 - protein, 17 aa, Mycobacterium
IPAAAQRMFARFPVAQR

SEQ ID NO: 1116922 - protein, 26 aa, Mycobacterium
IPAAVAWVCVPVLFGVAFAILVLTVA

SEQ ID NO: 1116923 - protein, 27 aa, Mycobacterium
IPAGERLYCAAVPHLRHVFVDRHPDGG

SEQ ID NO: 1116924 - protein, 20 aa, Mycobacterium
IPAIIRGLIAVAWYGIQTYL

SEQ ID NO: 1116925 - protein, 19 aa, Mycobacterium
IPDVLRPDIAVAYTDTDGY

SEQ ID NO: 1116926 - protein, 25 aa, Mycobacterium
IPEEHLPLVLPFKYLGVPKDTLMEL

SEQ ID NO: 1116927 - protein, 25 aa, Mycobacterium
IPFGFAAFRIASYALWPFGRTIVEK

SEQ ID NO: 1116928 - protein, 18 aa, Mycobacterium
IPLSFAVLVWVFGGLLAA

SEQ ID NO: 1116929 - protein, 20 aa, Mycobacterium
IPLVLVLLALLIQWRRSDDR

SEQ ID NO: 1116930 - protein, 21 aa, Mycobacterium
IPMGVPLEWNVFMMFCVITLF

SEQ ID NO: 1116931 - protein, 23 aa, Mycobacterium
IPVADVPSALAFGFSNTLGSVAL

SEQ ID NO: 1116932 - protein, 24 aa, Mycobacterium
IPVDCAAPHAMEVTGAVNLKEKFP

SEQ ID NO: 1116933 - protein, 17 aa, Mycobacterium
IPVLVVGLAVILSANAL

SEQ ID NO: 1116934 - protein, 32 aa, Mycobacterium
IPVVAFSTMFAMLIGYRLPDFPGARWIAPLLG

SEQ ID NO: 1116935 - protein, 25 aa, Mycobacterium
IQDPRMILPQNKFPFIPPQVDPDPG

SEQ ID NO: 1116936 - protein, 18 aa, Mycobacterium
IQWLSNINMVLALLLALF

SEQ ID NO: 1116937 - protein, 17 aa, Mycobacterium
IRAAMLLAAAWFLLFAL

SEQ ID NO: 1116938 - protein, 18 aa, Mycobacterium
IRDYRAEFVVADDGELTA

SEQ ID NO: 1116939 - protein, 24 aa, Mycobacterium
IRGLPNRWASLTGDVVATGAAHQT

SEQ ID NO: 1116940 - protein, 17 aa, Mycobacterium
IRHQPPRGYGRLARMVQ

SEQ ID NO: 1116941 - protein, 19 aa, Mycobacterium
IRIEIAIVLAVTFGLSAYT

SEQ ID NO: 1116942 - protein, 19 aa, Mycobacterium
IRLAGRHARHLTDMLDALS

SEQ ID NO: 1116943 - protein, 21 aa, Mycobacterium
IRLGVLIGIAAAQGMVGAVQF

SEQ ID NO: 1116944 - protein, 22 aa, Mycobacterium
IRPDPLRRLGLDAPDTQGEILR

SEQ ID NO: 1116945 - protein, 21 aa, Mycobacterium
IRPVMPEAYFVYGVSRVLPQA

SEQ ID NO: 1116946 - protein, 17 aa, Mycobacterium
IRRVRIGIILAACLVTL

SEQ ID NO: 1116947 - protein, 19 aa, Mycobacterium
IRTDLSWWAALSTNGIYVP

SEQ ID NO: 1116948 - protein, 24 aa, Mycobacterium
ISFEVRGGLFVRQIHHWAALLFAA

SEQ ID NO: 1116949 - protein, 17 aa, Mycobacterium
ISGIGWASGYLGSVFLL

SEQ ID NO: 1116950 - protein, 23 aa, Mycobacterium
ISGRGVALLLLWYCATVMVSMVG

SEQ ID NO: 1116951 - protein, 23 aa, Mycobacterium
ISHPGELFVLYIAGYATFRFLVE

SEQ ID NO: 1116952 - protein, 17 aa, Mycobacterium
ISLPSWAAGSHQVSCSI

SEQ ID NO: 1116953 - protein, 20 aa, Mycobacterium
ISPPDARGRVAGLFSSGFMI

SEQ ID NO: 1116954 - protein, 28 aa, Mycobacterium
ISRCVLPRLGRRLAANRVAVWTTAAVFL

SEQ ID NO: 1116955 - protein, 20 aa, Mycobacterium
ISSVALIWFGGLRIDAGQMQ

SEQ ID NO: 1116956 - protein, 20 aa, Mycobacterium
ISTEIAEAFGTPGGPAAAGI

SEQ ID NO: 1116957 - protein, 27 aa, Mycobacterium
ISTLPFLWNIFRSWRYGEPVTVDDPWG

SEQ ID NO: 1116958 - protein, 27 aa, Mycobacterium
ISTLPFLWNIFRSWRYGEPVVVDDPWG

SEQ ID NO: 1116959 - protein, 19 aa, Mycobacterium
ISVLLSYYANDLFTSLQVA

SEQ ID NO: 1116960 - protein, 24 aa, Mycobacterium
ISWTHHWVWVLPLMIWLWHGPLRR

SEQ ID NO: 1116961 - protein, 17 aa, Mycobacterium
ITDGWWVYLAVYLLFIG

SEQ ID NO: 1116962 - protein, 25 aa, Mycobacterium
ITEPKKAAAALAWLVEEMEQRYQDM

SEQ ID NO: 1116963 - protein, 18 aa, Mycobacterium
ITFADILIALALTDASRT

SEQ ID NO: 1116964 - protein, 22 aa, Mycobacterium
ITLAIGVTRMAKRRAVIRRLPA

SEQ ID NO: 1116965 - protein, 21 aa, Mycobacterium
ITLGPRGNDTFNHAKAGDCLN

SEQ ID NO: 1116966 - protein, 17 aa, Mycobacterium
ITPATRWGPLVQALLVI

SEQ ID NO: 1116967 - protein, 18 aa, Mycobacterium
ITRWGRYRTANGALVAAT

SEQ ID NO: 1116968 - protein, 18 aa, Mycobacterium
ITSWGVLYYAFTVLSDQI

SEQ ID NO: 1116969 - protein, 17 aa, Mycobacterium
ITTRHRIVFGLIALAGA

SEQ ID NO: 1116970 - protein, 18 aa, Mycobacterium
ITTTLGWVVAGLISLLNV

SEQ ID NO: 1116971 - protein, 30 aa, Mycobacterium
ITVPAIAALVGRANWWPSRVTASPGAERIG

SEQ ID NO: 1116972 - protein, 17 aa, Mycobacterium
IVALALFVAGFYGLYFG

SEQ ID NO: 1116973 - protein, 29 aa, Mycobacterium
IVAYTVVALIARYVLHRMIDRAATGRSKS

SEQ ID NO: 1116974 - protein, 25 aa, Mycobacterium
IVFDIEIVFLYPWAVAFDSLGVFAL

SEQ ID NO: 1116975 - protein, 17 aa, Mycobacterium
IVFVLIFQRRIVAGLTS

SEQ ID NO: 1116976 - protein, 22 aa, Mycobacterium
IVGFAVTFGAWVAEAVARRFRT

SEQ ID NO: 1116977 - protein, 21 aa, Mycobacterium
IVGLLSVYGGILLGVVAVILG

SEQ ID NO: 1116978 - protein, 17 aa, Mycobacterium
IVIGAALIVFGLVRFAR

SEQ ID NO: 1116979 - protein, 25 aa, Mycobacterium
IVISLVVCAVVYLLLTIAVTGSLSV

SEQ ID NO: 1116980 - protein, 17 aa, Mycobacterium
IVLLIWVVLAVLNVVGV

SEQ ID NO: 1116981 - protein, 32 aa, Mycobacterium
IVPTGVMVRLCQWYPDDAWLVLAIYTALGAVA

SEQ ID NO: 1116982 - protein, 17 aa, Mycobacterium
IVVPVALATMLAALLMP

SEQ ID NO: 1116983 - protein, 24 aa, Mycobacterium
IWLPALRCPPGLTVIAGVVAEASL

SEQ ID NO: 1116984 - protein, 19 aa, Mycobacterium
IWQGRRLGPLVAEQLPVVI

SEQ ID NO: 1116985 - protein, 21 aa, Mycobacterium
IWVSAFFLFPGFVHPMSPTMS

SEQ ID NO: 1116986 - protein, 19 aa, Mycobacterium
IYGALPFVYLAWIVLGIGL

SEQ ID NO: 1116987 - protein, 21 aa, Mycobacterium
IYPALHRRRVLALQLSTLRRA

SEQ ID NO: 1116988 - protein, 22 aa, Mycobacterium
IYVVMGAGWVLYRGHFGQQIPA

SEQ ID NO: 1116989 - protein, 26 aa, Mycobacterium
IYYPVSAIMWVWYKAFAFLLGPDNFF

SEQ ID NO: 1116990 - protein, 18 aa, Mycobacterium
KAAAFGIVVVPQFLPSSG

SEQ ID NO: 1116991 - protein, 23 aa, Mycobacterium
KACGARTRISTFLAGALLLALVV

SEQ ID NO: 1116992 - protein, 22 aa, Mycobacterium
KALKLAALLTQPGRTYDVSSPD

SEQ ID NO: 1116993 - protein, 19 aa, Mycobacterium
KALVTFSLDGKVRLGSDST

SEQ ID NO: 1116994 - protein, 23 aa, Mycobacterium
KAPGAVLGFLFWLGMGSLTVMSL

SEQ ID NO: 1116995 - protein, 18 aa, Mycobacterium
KAPTLALVVPGIIGFILS

SEQ ID NO: 1116996 - protein, 19 aa, Mycobacterium
KAQRRLWLAQLAMWPTLIV

SEQ ID NO: 1116997 - protein, 19 aa, Mycobacterium
KAVYCGTLGFWVARLVILR

SEQ ID NO: 1116998 - protein, 24 aa, Mycobacterium
KDFYLPGIWMYLGLAVVFTLSVVI

SEQ ID NO: 1116999 - protein, 18 aa, Mycobacterium
KDKISGLLDESAKALNGS

SEQ ID NO: 1117000 - protein, 20 aa, Mycobacterium
KDLYARLQILPMSFHGRWQS

SEQ ID NO: 1117001 - protein, 20 aa, Mycobacterium
KEPLLIWTLIASLFIGNLLL

SEQ ID NO: 1117002 - protein, 22 aa, Mycobacterium
KESELRSAGVQFIMLDRTMAEY

SEQ ID NO: 1117003 - protein, 17 aa, Mycobacterium
KGRGRALHAVWSQSDAP

SEQ ID NO: 1117004 - protein, 18 aa, Mycobacterium
KGSEGGLVVSDRHLDDPN

SEQ ID NO: 1117005 - protein, 18 aa, Mycobacterium
KGVELCTAVDVDLPPLWG

SEQ ID NO: 1117006 - protein, 19 aa, Mycobacterium
KGYFLLGIWMSLFWASVFA

SEQ ID NO: 1117007 - protein, 27 aa, Mycobacterium
KHRAMLFRPRYGALGLVALPYAALSLI

SEQ ID NO: 1117008 - protein, 23 aa, Mycobacterium
KHWFIEVPIRIVAYTVVALIARY

SEQ ID NO: 1117009 - protein, 17 aa, Mycobacterium
KIFGWHGMGEWVVQGIA

SEQ ID NO: 1117010 - protein, 22 aa, Mycobacterium
KILLYILGGWLFALATHGVDGF

SEQ ID NO: 1117011 - protein, 25 aa, Mycobacterium
KKEPGRYPNPFLFVVNYIKQVVAEL

SEQ ID NO: 1117012 - protein, 19 aa, Mycobacterium
KKVATEWHQLVGAQTVEEV

SEQ ID NO: 1117013 - protein, 21 aa, Mycobacterium
KKYVNRMAGFLGWNLSITQAQ

SEQ ID NO: 1117014 - protein, 25 aa, Mycobacterium
KLAARRPQPVAQWRTLPDAPTARLM

SEQ ID NO: 1117015 - protein, 17 aa, Mycobacterium
KLAGWSITGAIIDKNVR

SEQ ID NO: 1117016 - protein, 32 aa, Mycobacterium
KLDPVLRLPLALGVIHLLARIPLPGSAPRPVW

SEQ ID NO: 1117017 - protein, 25 aa, Mycobacterium
KLGLLPRYRKLFGANTLMYFRPGFS

SEQ ID NO: 1117018 - protein, 21 aa, Mycobacterium
KLGLVDVLFSGKVSRPALALL

SEQ ID NO: 1117019 - protein, 26 aa, Mycobacterium
KLLRTPRPYLYAGILFFATLGALAVN

SEQ ID NO: 1117020 - protein, 18 aa, Mycobacterium
KLLVSSLLLNWVLGPALM

SEQ ID NO: 1117021 - protein, 17 aa, Mycobacterium
KLNIARTATEAITTLWS

SEQ ID NO: 1117022 - protein, 17 aa, Mycobacterium
KLSARIKSAPMMLPGKN

SEQ ID NO: 1117023 - protein, 18 aa, Mycobacterium
KLSLQMFGGSGYLQDYPM

SEQ ID NO: 1117024 - protein, 18 aa, Mycobacterium
KLSRLDMPGVARVLDVAN

SEQ ID NO: 1117025 - protein, 24 aa, Mycobacterium
KLVFKILVMILWLAPIGAFGAIAN

SEQ ID NO: 1117026 - protein, 22 aa, Mycobacterium
KMEELREHFGLEPEDLNIDLGP

SEQ ID NO: 1117027 - protein, 20 aa, Mycobacterium
KMMIAPVIFCTIVLGIGSVA

SEQ ID NO: 1117028 - protein, 20 aa, Mycobacterium
KMRQNLGWAVGYNVIALPIA

SEQ ID NO: 1117029 - protein, 19 aa, Mycobacterium
KNTLIAFGVTVFLWILPGI

SEQ ID NO: 1117030 - protein, 28 aa, Mycobacterium
KNVPSLRYLSYRLTMERDGADWLITGMN

SEQ ID NO: 1117031 - protein, 24 aa, Mycobacterium
KPDVPAAPLCRLTSAAASSSAVSV

SEQ ID NO: 1117032 - protein, 32 aa, Mycobacterium
KPFPHRWSVMFLVAVGFWNFLGAGVFGFLINL

SEQ ID NO: 1117033 - protein, 19 aa, Mycobacterium
KPGEVDWVLDRLGQEIDAL

SEQ ID NO: 1117034 - protein, 17 aa, Mycobacterium
KPGRRSAAVTAPVDDDT

SEQ ID NO: 1117035 - protein, 18 aa, Mycobacterium
KPIAFAAAIAFLLFAAWT

SEQ ID NO: 1117036 - protein, 23 aa, Mycobacterium
KPKFPARLRIFLLTLAVVDDVGA

SEQ ID NO: 1117037 - protein, 20 aa, Mycobacterium
KPLARLHERFGISESAEPEY

SEQ ID NO: 1117038 - protein, 24 aa, Mycobacterium
KPLARLTPVAAWILTCSVMTGAIA

SEQ ID NO: 1117039 - protein, 18 aa, Mycobacterium
KPLLISFAVGGILYTYVL

SEQ ID NO: 1117040 - protein, 19 aa, Mycobacterium
KPQGLGVVFGMALFQVILV

SEQ ID NO: 1117041 - protein, 19 aa, Mycobacterium
KPTGGLFGIVWVGLGLSIF

SEQ ID NO: 1117042 - protein, 20 aa, Mycobacterium
KQLLAERIGQIWPEEGGPVS

SEQ ID NO: 1117043 - protein, 23 aa, Mycobacterium
KQNPLLGLRFRYAVTDPDRTRRV

SEQ ID NO: 1117044 - protein, 25 aa, Mycobacterium
KQPMSMGRRLGITFAAAAALFVLIA

SEQ ID NO: 1117045 - protein, 21 aa, Mycobacterium
KRASVAQLFKLWGGTLAANLI

SEQ ID NO: 1117046 - protein, 19 aa, Mycobacterium
KRFPNINTFGLIGVVIAWT

SEQ ID NO: 1117047 - protein, 28 aa, Mycobacterium
KRIVIAFAVLCAVVLIVYIDRDGYRDTQ

SEQ ID NO: 1117048 - protein, 28 aa, Mycobacterium
KRLPHLPRRQRFFLSLYVPVVMRVLCQA

SEQ ID NO: 1117049 - protein, 18 aa, Mycobacterium
KRLPTSGGLYTWNSKAWG

SEQ ID NO: 1117050 - protein, 28 aa, Mycobacterium
KRQLKRTAGFWGLWGIGVAAVISGDFSG

SEQ ID NO: 1117051 - protein, 24 aa, Mycobacterium
KRTGFGRTPFRPHNIPFVMLGAAL

SEQ ID NO: 1117052 - protein, 19 aa, Mycobacterium
KRTTFNNDYYRIFNQSHVR

SEQ ID NO: 1117053 - protein, 23 aa, Mycobacterium
KSELASWLPPGPVATADYPTVLL

SEQ ID NO: 1117054 - protein, 18 aa, Mycobacterium
KSLVSANWWWVVAAVVAS

SEQ ID NO: 1117055 - protein, 25 aa, Mycobacterium
KSPDKRFERCVDFARALEHRIGSDD

SEQ ID NO: 1117056 - protein, 20 aa, Mycobacterium
KSVAWVYLWIFRGTPVYVQL

SEQ ID NO: 1117057 - protein, 23 aa, Mycobacterium
KTDSRLAARLAALASLGASVIHF

SEQ ID NO: 1117058 - protein, 24 aa, Mycobacterium
KTDVPRLLSEVGLSGMEERDTGGL

SEQ ID NO: 1117059 - protein, 30 aa, Mycobacterium
KTLARWLIRRWRLSDEMALLIGTAAIVVLL

SEQ ID NO: 1117060 - protein, 25 aa, Mycobacterium
KTNVRRFVDDVAFVVGKESRDRLKG

SEQ ID NO: 1117061 - protein, 18 aa, Mycobacterium
KVDFKVDRSLPLFDESTA

SEQ ID NO: 1117062 - protein, 20 aa, Mycobacterium
KVKLHAFVALVLVSLLTALA

SEQ ID NO: 1117063 - protein, 18 aa, Mycobacterium
KVLDLTVRLAEVMLSSGS

SEQ ID NO: 1117064 - protein, 20 aa, Mycobacterium
KVLFICVAAGLAIGSAGLGN

SEQ ID NO: 1117065 - protein, 20 aa, Mycobacterium
KWKPVEARADADFVVAPDER

SEQ ID NO: 1117066 - protein, 21 aa, Mycobacterium
KWMLGFSAVAAVLAWLLGELI

SEQ ID NO: 1117067 - protein, 25 aa, Mycobacterium
KYLFRKRMVTSMAVALLASAVAAYL

SEQ ID NO: 1117068 - protein, 19 aa, Mycobacterium
KYNRIGFRELVRIHEEREA

SEQ ID NO: 1117069 - protein, 21 aa, Mycobacterium
KYRATAMVVVPVMLSRLLDHI

SEQ ID NO: 1117070 - protein, 20 aa, Mycobacterium
KYSHPMLSLGLPVLFIALGG

SEQ ID NO: 1117071 - protein, 26 aa, Mycobacterium
LAACAALAPKAWRARGAVPLAGLAGA

SEQ ID NO: 1117072 - protein, 18 aa, Mycobacterium
LAAEELLRTGGLNRAVVA

SEQ ID NO: 1117073 - protein, 24 aa, Mycobacterium
LAAEHPGCIGVPIPGGSFTIEPLD

SEQ ID NO: 1117074 - protein, 33 aa, Mycobacterium
LAAEIVFACFLYRAWNLPVAVLAGAAAGLAMAI

SEQ ID NO: 1117075 - protein, 17 aa, Mycobacterium
LAAELDVTVIFKEINQG

SEQ ID NO: 1117076 - protein, 18 aa, Mycobacterium
LAAFDEVIERGMAKKPER

SEQ ID NO: 1117077 - protein, 17 aa, Mycobacterium
LAAFFIVYGLVVFGLST

SEQ ID NO: 1117078 - protein, 24 aa, Mycobacterium
LAAGAWYFWPIWPILGAGIGVLGH

SEQ ID NO: 1117079 - protein, 23 aa, Mycobacterium
LAAGVLAPIGFVLPMSVGAILMS

SEQ ID NO: 1117080 - protein, 17 aa, Mycobacterium
LAAIARVEWPAYNSSNQ

SEQ ID NO: 1117081 - protein, 18 aa, Mycobacterium
LAAIAVVLMRSEPDPEAR

SEQ ID NO: 1117082 - protein, 18 aa, Mycobacterium
LAALAVSWYLSRRLQRSI

SEQ ID NO: 1117083 - protein, 30 aa, Mycobacterium
LAALTGTPAWEMFKPWSIISIAVAVVLAFV

SEQ ID NO: 1117084 - protein, 30 aa, Mycobacterium
LAASLFWLDGKRWWPYVPPFAAVLAPAERR

SEQ ID NO: 1117085 - protein, 22 aa, Mycobacterium
LAASVLPVWLLLAPRDYLSTFM

SEQ ID NO: 1117086 - protein, 25 aa, Mycobacterium
LAATFAASFGFMLPVSTPQNAIVYG

SEQ ID NO: 1117087 - protein, 18 aa, Mycobacterium
LAATIARKLGLTGALGTV

SEQ ID NO: 1117088 - protein, 17 aa, Mycobacterium
LAAVLLIGVTGYGCGAI

SEQ ID NO: 1117089 - protein, 19 aa, Mycobacterium
LAAVVPRLRGVPRAVVDRM

SEQ ID NO: 1117090 - protein, 19 aa, Mycobacterium
LACATKWSGLYFVAFFGVL

SEQ ID NO: 1117091 - protein, 18 aa, Mycobacterium
LADAEVGYLLSMHPSVLA

SEQ ID NO: 1117092 - protein, 21 aa, Mycobacterium
LADGLTAWIAAPLLFIGVLFG

SEQ ID NO: 1117093 - protein, 19 aa, Mycobacterium
LADIGVVGALLVWHVVGAQ

SEQ ID NO: 1117094 - protein, 17 aa, Mycobacterium
LADPVFIAAQARERLGF

SEQ ID NO: 1117095 - protein, 20 aa, Mycobacterium
LADTRFGPLATRTRRLLDGR

SEQ ID NO: 1117096 - protein, 22 aa, Mycobacterium
LAEPLAPLLGFLGAGAQTAVSI

SEQ ID NO: 1117097 - protein, 18 aa, Mycobacterium
LAERLAVEGREVWNTYGP

SEQ ID NO: 1117098 - protein, 20 aa, Mycobacterium
LAEVLFFRWLLDGRGSREWL

SEQ ID NO: 1117099 - protein, 24 aa, Mycobacterium
LAFALARPRGWPEAVAAVPAAGLL

SEQ ID NO: 1117100 - protein, 31 aa, Mycobacterium
LAGASLRPGRTFRLFSRVIGGFGLASLGALG

SEQ ID NO: 1117101 - protein, 22 aa, Mycobacterium
LAGAVSRWRWLLSAVAAAMLGA

SEQ ID NO: 1117102 - protein, 20 aa, Mycobacterium
LAGRDIRLLAKILLGIEGIG

SEQ ID NO: 1117103 - protein, 18 aa, Mycobacterium
LAGWRAVREYDLKLILAF

SEQ ID NO: 1117104 - protein, 17 aa, Mycobacterium
LAGYIAFAIADRPGIAP

SEQ ID NO: 1117105 - protein, 21 aa, Mycobacterium
LAIAVATRWLINKLPAHPAGS

SEQ ID NO: 1117106 - protein, 24 aa, Mycobacterium
LAIFEPRLARWLDRPRGPGPSRMT

SEQ ID NO: 1117107 - protein, 17 aa, Mycobacterium
LALAVGLAGGWMGSKTA

SEQ ID NO: 1117108 - protein, 19 aa, Mycobacterium
LALGGEWSGAALLATETAK

SEQ ID NO: 1117109 - protein, 17 aa, Mycobacterium
LALLLAYLAMPFDVIPD

SEQ ID NO: 1117110 - protein, 19 aa, Mycobacterium
LALLLVWLALYAGVCLPIN

SEQ ID NO: 1117111 - protein, 23 aa, Mycobacterium
LALLPLLALLVWLPARRRRDDEP

SEQ ID NO: 1117112 - protein, 25 aa, Mycobacterium
LALNRRTASSGGEWIGTVTTMRDST

SEQ ID NO: 1117113 - protein, 17 aa, Mycobacterium
LALSLASFYAFYSGLGI

SEQ ID NO: 1117114 - protein, 21 aa, Mycobacterium
LALWRLDRLDGRRMHRLIPTR

SEQ ID NO: 1117115 - protein, 21 aa, Mycobacterium
LAMPVAPWWYLRELRALLESR

SEQ ID NO: 1117116 - protein, 21 aa, Mycobacterium
LAPAARRWAIALGVVLIVTIG

SEQ ID NO: 1117117 - protein, 26 aa, Mycobacterium
LAPKRLAMQYARRWALVVASPLSAMS

SEQ ID NO: 1117118 - protein, 17 aa, Mycobacterium
LAPLWAKLLRTPRPYLY

SEQ ID NO: 1117119 - protein, 17 aa, Mycobacterium
LAPTVLVAIPFTVLVSF

SEQ ID NO: 1117120 - protein, 28 aa, Mycobacterium
LAPTVWGWRNRPVWRWFAFGAAVGVAAG

SEQ ID NO: 1117121 - protein, 28 aa, Mycobacterium
LARNRWRWFYRHLFDLAIVVLPLLRPLQ

SEQ ID NO: 1117122 - protein, 17 aa, Mycobacterium
LARRTRRRVNIGFVAGG

SEQ ID NO: 1117123 - protein, 18 aa, Mycobacterium
LASLKAGLIAGAVGLAAV

SEQ ID NO: 1117124 - protein, 29 aa, Mycobacterium
LASLYIGIRYERWMAIAAMATLLFDLVVT

SEQ ID NO: 1117125 - protein, 17 aa, Mycobacterium
LASPPLVGLIADWTSLR

SEQ ID NO: 1117126 - protein, 18 aa, Mycobacterium
LASRARRGDPKFRRATIG

SEQ ID NO: 1117127 - protein, 26 aa, Mycobacterium
LATLLFGLFANRWLARRTRRRVNIGF

SEQ ID NO: 1117128 - protein, 25 aa, Mycobacterium
LATPLRRADLLAAYGTAFSLAAAAQ

SEQ ID NO: 1117129 - protein, 24 aa, Mycobacterium
LATTFAVGVVAYWAVPELTIAAAL

SEQ ID NO: 1117130 - protein, 20 aa, Mycobacterium
LAVEGMVFMSLVALDVLLFY

SEQ ID NO: 1117131 - protein, 20 aa, Mycobacterium
LAVGLAGGWMGSKTASIIEA

SEQ ID NO: 1117132 - protein, 21 aa, Mycobacterium
LAVGLGALWLPWGAATYLLLR

SEQ ID NO: 1117133 - protein, 17 aa, Mycobacterium
LAVGMAYSSVVAAELFN

SEQ ID NO: 1117134 - protein, 22 aa, Mycobacterium
LAVLRGRLHPVGGLGVALGATV

SEQ ID NO: 1117135 - protein, 18 aa, Mycobacterium
LAVLVLWTTVRLPGAPDY

SEQ ID NO: 1117136 - protein, 17 aa, Mycobacterium
LAVSFALYGLVKKVVTA

SEQ ID NO: 1117137 - protein, 23 aa, Mycobacterium
LAVSWYLSRRLQRSITEVASAAT

SEQ ID NO: 1117138 - protein, 21 aa, Mycobacterium
LAVTTIYEWIAAPVGLVLAAA

SEQ ID NO: 1117139 - protein, 18 aa, Mycobacterium
LAVVTPLIALLLVLGVYP

SEQ ID NO: 1117140 - protein, 24 aa, Mycobacterium
LAYPRYFPPISLWTGLSLLGVAVA

SEQ ID NO: 1117141 - protein, 21 aa, Mycobacterium
LCAAVAVAGLGLWLLTRPRSA

SEQ ID NO: 1117142 - protein, 19 aa, Mycobacterium
LCGVTSVYHYAVAVYPDSR

SEQ ID NO: 1117143 - protein, 19 aa, Mycobacterium
LCLAVDPDLLVTVNAMTAG

SEQ ID NO: 1117144 - protein, 19 aa, Mycobacterium
LCLVGTVWLVVRARNSTRA

SEQ ID NO: 1117145 - protein, 19 aa, Mycobacterium
LDAACDRIADGAIFAGLLW

SEQ ID NO: 1117146 - protein, 17 aa, Mycobacterium
LDALRVFEYVYATTRGG

SEQ ID NO: 1117147 - protein, 18 aa, Mycobacterium
LDDPRWIAMLAAVLTVSG

SEQ ID NO: 1117148 - protein, 25 aa, Mycobacterium
LDDVYLPLWVRRVAWVATIVLLMTG

SEQ ID NO: 1117149 - protein, 17 aa, Mycobacterium
LDFTKTDAFLSITVASV

SEQ ID NO: 1117150 - protein, 21 aa, Mycobacterium
LDHVFTLSVPSLWRETPAPYG

SEQ ID NO: 1117151 - protein, 18 aa, Mycobacterium
LDKVKWRRRRSRWMTSAA

SEQ ID NO: 1117152 - protein, 20 aa, Mycobacterium
LDNIPARGGAVVAINHTGYI

SEQ ID NO: 1117153 - protein, 19 aa, Mycobacterium
LDPLPRWVRAEVLSTGDLV

SEQ ID NO: 1117154 - protein, 20 aa, Mycobacterium
LDPVARRAWQWFVTEVPQRS

SEQ ID NO: 1117155 - protein, 18 aa, Mycobacterium
LDPWDVFHQGLARRTGMT

SEQ ID NO: 1117156 - protein, 20 aa, Mycobacterium
LDRAVAIKLLHPAMRAQPDV

SEQ ID NO: 1117157 - protein, 17 aa, Mycobacterium
LDRIAYRTTIFAFPVFG

SEQ ID NO: 1117158 - protein, 21 aa, Mycobacterium
LDRLLPLWIGIAMAAGLLLGR

SEQ ID NO: 1117159 - protein, 23 aa, Mycobacterium
LDRNSPSLFCMIRNWHDAEPAFT

SEQ ID NO: 1117160 - protein, 18 aa, Mycobacterium
LDRPVAIKILHPAMNAQP

SEQ ID NO: 1117161 - protein, 28 aa, Mycobacterium
LDRWEPEPPRLLVFAFIWGTSAAVVISA

SEQ ID NO: 1117162 - protein, 24 aa, Mycobacterium
LDSESRLSGVLSDYTTPVDGRIGL

SEQ ID NO: 1117163 - protein, 31 aa, Mycobacterium
LDTTEIFDGTGWRLGAAMPTPRQMSAAASDD

SEQ ID NO: 1117164 - protein, 23 aa, Mycobacterium
LDVDVVLCATGYAAADYLGQIEV

SEQ ID NO: 1117165 - protein, 33 aa, Mycobacterium
LDVKLGLMCLAAFPILVALVWWFRNESAKTYRK

SEQ ID NO: 1117166 - protein, 24 aa, Mycobacterium
LDVKQPLAYCLPGVRSRVVLSDGA

SEQ ID NO: 1117167 - protein, 24 aa, Mycobacterium
LDVSLRPALWVARQQPDAAGDVDD

SEQ ID NO: 1117168 - protein, 25 aa, Mycobacterium
LDVVPARLRRPGAAVLEIDDEDPIF

SEQ ID NO: 1117169 - protein, 22 aa, Mycobacterium
LEAFKRWTAEAPRDPARRNQVA

SEQ ID NO: 1117170 - protein, 20 aa, Mycobacterium
LEGRLLAGLLAPYGDEPTPT

SEQ ID NO: 1117171 - protein, 31 aa, Mycobacterium
LEIGGRAMLFGGIFPPFWLAGTAMLGLSKII

SEQ ID NO: 1117172 - protein, 20 aa, Mycobacterium
LEMTAPIYIWALLMALALNK

SEQ ID NO: 1117173 - protein, 24 aa, Mycobacterium
LEPEGFSVFGVFWGAFGLASGAAF

SEQ ID NO: 1117174 - protein, 21 aa, Mycobacterium
LEPILAYGRYRLLAHGHRGEL

SEQ ID NO: 1117175 - protein, 24 aa, Mycobacterium
LEPKRAMRVRGWRKVGAATVRWPG

SEQ ID NO: 1117176 - protein, 25 aa, Mycobacterium
LERRGRIGGTWDLFRYPGIRSDSDI

SEQ ID NO: 1117177 - protein, 18 aa, Mycobacterium
LESFRVTLTISVGVTIVN

SEQ ID NO: 1117178 - protein, 24 aa, Mycobacterium
LESLFRLDHLAARMRRNGANLLVL

SEQ ID NO: 1117179 - protein, 27 aa, Mycobacterium
LEWNVFMMFCVITLFVGHADLGLAELS

SEQ ID NO: 1117180 - protein, 17 aa, Mycobacterium
LFAAQAIVLTVGAATTS

SEQ ID NO: 1117181 - protein, 17 aa, Mycobacterium
LFASLFIMLRRKRIPGV

SEQ ID NO: 1117182 - protein, 23 aa, Mycobacterium
LFASLVVGLLMFLLLGRPLAWLT

SEQ ID NO: 1117183 - protein, 18 aa, Mycobacterium
LFASPVFTVCCILSFIVG

SEQ ID NO: 1117184 - protein, 20 aa, Mycobacterium
LFATVVAFWIGRPIITLSFN

SEQ ID NO: 1117185 - protein, 19 aa, Mycobacterium
LFDRARATLHIGIGLADTL

SEQ ID NO: 1117186 - protein, 26 aa, Mycobacterium
LFGLSMPGWVWWLILYAIFVGLNSWG

SEQ ID NO: 1117187 - protein, 24 aa, Mycobacterium
LFIMLRRKRIPGVARGPAWRLMGI

SEQ ID NO: 1117188 - protein, 27 aa, Mycobacterium
LFLGIPLLYRLGELIAPLTFFVLAYLS

SEQ ID NO: 1117189 - protein, 25 aa, Mycobacterium
LFLLTARTGFWIGVLPIALYSLLPV

SEQ ID NO: 1117190 - protein, 24 aa, Mycobacterium
LFLQLLRDRQWWLGSTVAALGFGL

SEQ ID NO: 1117191 - protein, 17 aa, Mycobacterium
LFLSLLVAVNILYRVSL

SEQ ID NO: 1117192 - protein, 17 aa, Mycobacterium
LFMRVGDFAARRRGAPQ

SEQ ID NO: 1117193 - protein, 21 aa, Mycobacterium
LFSGKVSRPALALLGVLALAV

SEQ ID NO: 1117194 - protein, 26 aa, Mycobacterium
LFTIASILCGIAWDEVTLVIARLLQG

SEQ ID NO: 1117195 - protein, 17 aa, Mycobacterium
LFVFGALIALAGFITPS

SEQ ID NO: 1117196 - protein, 28 aa, Mycobacterium
LGAALMAYFKPLGKRGGDQLLVDRSTNQ

SEQ ID NO: 1117197 - protein, 25 aa, Mycobacterium
LGAAYNRLVLWFLDHVGGMRRVPAI

SEQ ID NO: 1117198 - protein, 18 aa, Mycobacterium
LGAGLVAFVLVGGLAADR

SEQ ID NO: 1117199 - protein, 19 aa, Mycobacterium
LGALIVFLGALALGRLSVR

SEQ ID NO: 1117200 - protein, 18 aa, Mycobacterium
LGALLLAGVRSRILASEV

SEQ ID NO: 1117201 - protein, 23 aa, Mycobacterium
LGAPSYLAIMVFALVAVTAVLGA

SEQ ID NO: 1117202 - protein, 23 aa, Mycobacterium
LGASKLRGAISLFLGLAIGVVGI

SEQ ID NO: 1117203 - protein, 24 aa, Mycobacterium
LGATLAALIVRWVPLAAGSGIQHV

SEQ ID NO: 1117204 - protein, 22 aa, Mycobacterium
LGCKRPSFHNSYLATYNRSNVS

SEQ ID NO: 1117205 - protein, 18 aa, Mycobacterium
LGDARLFTQFVVRSAAAG

SEQ ID NO: 1117206 - protein, 23 aa, Mycobacterium
LGDLLRLSWRTWLQLLAASALVS

SEQ ID NO: 1117207 - protein, 24 aa, Mycobacterium
LGFVAMALACRWGGTVKAFLIAGG

SEQ ID NO: 1117208 - protein, 17 aa, Mycobacterium
LGGGFIGVDVFFVVSGF

SEQ ID NO: 1117209 - protein, 17 aa, Mycobacterium
LGGGSHRTAMLWTAGLI

SEQ ID NO: 1117210 - protein, 20 aa, Mycobacterium
LGGLAIPVALYLDSPVLVMI

SEQ ID NO: 1117211 - protein, 17 aa, Mycobacterium
LGGSGWWIGLFNIVCAT

SEQ ID NO: 1117212 - protein, 25 aa, Mycobacterium
LGGWPASDAFPFYPSIKHLLLEQAA

SEQ ID NO: 1117213 - protein, 18 aa, Mycobacterium
LGGYLSSVQIDWSVALAV

SEQ ID NO: 1117214 - protein, 19 aa, Mycobacterium
LGHRMPRALVVVAAVTACG

SEQ ID NO: 1117215 - protein, 19 aa, Mycobacterium
LGIAGLVLIIDALKPELTQ

SEQ ID NO: 1117216 - protein, 17 aa, Mycobacterium
LGIEGIGILAMVILVAV

SEQ ID NO: 1117217 - protein, 17 aa, Mycobacterium
LGIVGWIVLVAFTDSGV

SEQ ID NO: 1117218 - protein, 19 aa, Mycobacterium
LGKAIPVYVGIVMGLSILV

SEQ ID NO: 1117219 - protein, 17 aa, Mycobacterium
LGLGWLALMVISVPSLL

SEQ ID NO: 1117220 - protein, 19 aa, Mycobacterium
LGLLGKFLCFAIVAVGIGL

SEQ ID NO: 1117221 - protein, 21 aa, Mycobacterium
LGLSMGVNFAAVRDMFGWIGP

SEQ ID NO: 1117222 - protein, 24 aa, Mycobacterium
LGNEGRAAFVWIGLHEPDDHQMQT

SEQ ID NO: 1117223 - protein, 24 aa, Mycobacterium
LGNRLPTLAALWHLRDFGAIVWFA

SEQ ID NO: 1117224 - protein, 26 aa, Mycobacterium
LGPAVALCFAIGLLASGLASTSVGAY

SEQ ID NO: 1117225 - protein, 24 aa, Mycobacterium
LGQTARLYIRPVVHAMQAQPAAAR

SEQ ID NO: 1117226 - protein, 26 aa, Mycobacterium
LGQVLRLPARFVLGALAGLRTVGLLR

SEQ ID NO: 1117227 - protein, 17 aa, Mycobacterium
LGRLLGWAARPAGLEAA

SEQ ID NO: 1117228 - protein, 19 aa, Mycobacterium
LGRYRVIALPARGPAEVIV

SEQ ID NO: 1117229 - protein, 17 aa, Mycobacterium
LGSIVFIVASWPVASKS

SEQ ID NO: 1117230 - protein, 18 aa, Mycobacterium
LGSLALVIGFIFDACLEI

SEQ ID NO: 1117231 - protein, 17 aa, Mycobacterium
LGSLWPYTSGTLKYPDA

SEQ ID NO: 1117232 - protein, 18 aa, Mycobacterium
LGSMAGQAAFAWLPDIAD

SEQ ID NO: 1117233 - protein, 20 aa, Mycobacterium
LGSNLVVKVLLAFTAGGRRF

SEQ ID NO: 1117234 - protein, 17 aa, Mycobacterium
LGSQWWQTFWRITLPSI

SEQ ID NO: 1117235 - protein, 24 aa, Mycobacterium
LGSTLVLRRRFKPATVLADVEKYR

SEQ ID NO: 1117236 - protein, 20 aa, Mycobacterium
LGSVVALDFVARTWSPLPDM

SEQ ID NO: 1117237 - protein, 21 aa, Mycobacterium
LGTSRRSRWARILDEGIGAAV

SEQ ID NO: 1117238 - protein, 18 aa, Mycobacterium
LGTVWGLPDGLRLAVDNL

SEQ ID NO: 1117239 - protein, 18 aa, Mycobacterium
LGVFCIGGALVIGALGRR

SEQ ID NO: 1117240 - protein, 31 aa, Mycobacterium
LGVGRLSVITPIRWVCAVIVEFFRAVPVLIM

SEQ ID NO: 1117241 - protein, 20 aa, Mycobacterium
LGVLCVIASIIALAVLDRRA

SEQ ID NO: 1117242 - protein, 23 aa, Mycobacterium
LGVLRDGQKWVALAVPGYAVAGA

SEQ ID NO: 1117243 - protein, 18 aa, Mycobacterium
LGVSWGLTAAAAIMVVAS

SEQ ID NO: 1117244 - protein, 18 aa, Mycobacterium
LGVTRGFRRPTPVLDLEE

SEQ ID NO: 1117245 - protein, 26 aa, Mycobacterium
LGVTWEMSFLYAVVFGGFVAFSNYLP

SEQ ID NO: 1117246 - protein, 28 aa, Mycobacterium
LGWLGFDGGLGWPAKIGLALSVGLLGGV

SEQ ID NO: 1117247 - protein, 25 aa, Mycobacterium
LGYWPAAFGLFAFVWLELASPDPGS

SEQ ID NO: 1117248 - protein, 18 aa, Mycobacterium
LHDHFPFPARITIADNAS

SEQ ID NO: 1117249 - protein, 24 aa, Mycobacterium
LHFGLAAILAFIGVKLFLHALHEN

SEQ ID NO: 1117250 - protein, 19 aa, Mycobacterium
LHLPEKVFIAIVPVLLIAA

SEQ ID NO: 1117251 - protein, 17 aa, Mycobacterium
LHLRVVLICGGVIAGTV

SEQ ID NO: 1117252 - protein, 17 aa, Mycobacterium
LHMGLLFGLVNQLALAA

SEQ ID NO: 1117253 - protein, 26 aa, Mycobacterium
LHRHPHWKRLIGAVLVLLFTSAAAAF

SEQ ID NO: 1117254 - protein, 17 aa, Mycobacterium
LHTLIAVSIVWWPFYAR

SEQ ID NO: 1117255 - protein, 25 aa, Mycobacterium
LIALALCVPAALFLFPPRHHDDLRR

SEQ ID NO: 1117256 - protein, 23 aa, Mycobacterium
LIALFPPWIMWAPNAIWKSFDLF

SEQ ID NO: 1117257 - protein, 17 aa, Mycobacterium
LIALPFAGGYVLALELT

SEQ ID NO: 1117258 - protein, 18 aa, Mycobacterium
LIATGGMGQVWEAVDSRL

SEQ ID NO: 1117259 - protein, 17 aa, Mycobacterium
LIESFNAMLDRLETERT

SEQ ID NO: 1117260 - protein, 19 aa, Mycobacterium
LIFGGLWLALGYAVAGILC

SEQ ID NO: 1117261 - protein, 27 aa, Mycobacterium
LIFGWLAFLIVFGFFTRKAWEIVVGVI

SEQ ID NO: 1117262 - protein, 22 aa, Mycobacterium
LIGGFRPLFRALDPEKVNNIAR

SEQ ID NO: 1117263 - protein, 28 aa, Mycobacterium
LIGPRFIDTYVNWLWFGELGYRSVFTTV

SEQ ID NO: 1117264 - protein, 19 aa, Mycobacterium
LIGVFSRLYVPQLLITGAA

SEQ ID NO: 1117265 - protein, 26 aa, Mycobacterium
LIHDCPKLLQLRSFPTIAIGGDPDGS

SEQ ID NO: 1117266 - protein, 17 aa, Mycobacterium
LIIGWLAVIVLTFHWAR

SEQ ID NO: 1117267 - protein, 20 aa, Mycobacterium
LIIVRQWRLLGAFAAAGVIA

SEQ ID NO: 1117268 - protein, 23 aa, Mycobacterium
LIKAGIIGVVLMILVIMIGLQPI

SEQ ID NO: 1117269 - protein, 19 aa, Mycobacterium
LILAKAVGVFVFLVLTVLA

SEQ ID NO: 1117270 - protein, 18 aa, Mycobacterium
LILGGTLPLYLPKVGLRF

SEQ ID NO: 1117271 - protein, 18 aa, Mycobacterium
LILPLVLPPLLFAAARRT

SEQ ID NO: 1117272 - protein, 18 aa, Mycobacterium
LINAFAWVFYLFALILLL

SEQ ID NO: 1117273 - protein, 18 aa, Mycobacterium
LIPLTGLTTPWMSYGGSS

SEQ ID NO: 1117274 - protein, 22 aa, Mycobacterium
LIRRPVVGYIWGWINGHSDQWR

SEQ ID NO: 1117275 - protein, 29 aa, Mycobacterium
LISDSRWFLPRLAVGVYIWVLRGTPILLQ

SEQ ID NO: 1117276 - protein, 17 aa, Mycobacterium
LISPTMLFFPFVLLLAA

SEQ ID NO: 1117277 - protein, 24 aa, Mycobacterium
LIVDALRLTAGFAKVDPVGPRAFP

SEQ ID NO: 1117278 - protein, 17 aa, Mycobacterium
LIVFGLVRFARRHSSSH

SEQ ID NO: 1117279 - protein, 30 aa, Mycobacterium
LIVIVVLVLGFWKPGFFVTTKLDVNAAQSG

SEQ ID NO: 1117280 - protein, 25 aa, Mycobacterium
LIVLHRWRVPLGWITAAFFVLVFPG

SEQ ID NO: 1117281 - protein, 43 aa, Mycobacterium
LIWADRRFNLGHGRLFALYVAGYCLGRFWIELLRSDMATELAG

SEQ ID NO: 1117282 - protein, 26 aa, Mycobacterium
LIYMLPLLLLVALFVFFSRMQTGGRM

SEQ ID NO: 1117283 - protein, 20 aa, Mycobacterium
LKASSLVYFLGLVADQRELF

SEQ ID NO: 1117284 - protein, 17 aa, Mycobacterium
LKFAMFMLAEYVNMTTV

SEQ ID NO: 1117285 - protein, 27 aa, Mycobacterium
LKKGLGKWALVPGIPLLWDLVITLTAS

SEQ ID NO: 1117286 - protein, 27 aa, Mycobacterium
LKLSGSRTAQAWARRHATLRAELTRLV

SEQ ID NO: 1117287 - protein, 20 aa, Mycobacterium
LKLTPAVFLLYFLLRRDTRA

SEQ ID NO: 1117288 - protein, 27 aa, Mycobacterium
LKRDFATALDYWPLVIGGSGILSITMV

SEQ ID NO: 1117289 - protein, 21 aa, Mycobacterium
LKSTVSIVLLIWVVLAVLNVV

SEQ ID NO: 1117290 - protein, 17 aa, Mycobacterium
LKTSSKTSMPWMFFFAG

SEQ ID NO: 1117291 - protein, 38 aa, Mycobacterium
LKVIPEYERGVVFRAGRLRPLYGPGVKFLIPVVDRLIR

SEQ ID NO: 1117292 - protein, 25 aa, Mycobacterium
LKVNQAGVIPVIFASSLIYIPHLVT

SEQ ID NO: 1117293 - protein, 23 aa, Mycobacterium
LLAAIALLVARQIVLPVRSASRI

SEQ ID NO: 1117294 - protein, 17 aa, Mycobacterium
LLAFCTFDAVVPVIPSE

SEQ ID NO: 1117295 - protein, 24 aa, Mycobacterium
LLAGALAAVVAFVFARIFVEPAID

SEQ ID NO: 1117296 - protein, 23 aa, Mycobacterium
LLAGLWHRGDLPLLVIAAAAGMA

SEQ ID NO: 1117297 - protein, 19 aa, Mycobacterium
LLALFGLFAYTGMRIARRS

SEQ ID NO: 1117298 - protein, 23 aa, Mycobacterium
LLALRIALLSLIIAWPAGLLLAL

SEQ ID NO: 1117299 - protein, 17 aa, Mycobacterium
LLARGRRSGRAAMTATL

SEQ ID NO: 1117300 - protein, 18 aa, Mycobacterium
LLATNFLGINTIPIAVNE

SEQ ID NO: 1117301 - protein, 23 aa, Mycobacterium
LLAYRYRLRVLIAATVAGATIAF

SEQ ID NO: 1117302 - protein, 17 aa, Mycobacterium
LLDRPPLGPMLLTADAE

SEQ ID NO: 1117303 - protein, 27 aa, Mycobacterium
LLDSSRLAAGVVRPQLSAVYLEEAVQR

SEQ ID NO: 1117304 - protein, 20 aa, Mycobacterium
LLDVRLFRRPDFATGAAGIT

SEQ ID NO: 1117305 - protein, 25 aa, Mycobacterium
LLEAAADLFARQGFHAVGIDDIGAA

SEQ ID NO: 1117306 - protein, 19 aa, Mycobacterium
LLEAASLDGASLWRSVREV

SEQ ID NO: 1117307 - protein, 22 aa, Mycobacterium
LLERAPRFARRRTDGQVSVIPL

SEQ ID NO: 1117308 - protein, 18 aa, Mycobacterium
LLESARIDGANQWRTFTT

SEQ ID NO: 1117309 - protein, 36 aa, Mycobacterium; identical to SEQ ID NO: 317100

SEQ ID NO: 1117310 - protein, 23 aa, Mycobacterium
LLFAMTMWKMLRRNPPPPPPDDA

SEQ ID NO: 1117311 - protein, 17 aa, Mycobacterium
LLFGIGAYVWWGLCPGF

SEQ ID NO: 1117312 - protein, 17 aa, Mycobacterium
LLFTIPVRYLRRGHHPD

SEQ ID NO: 1117313 - protein, 21 aa, Mycobacterium
LLGCTVAGLIVAMVARKPVVT

SEQ ID NO: 1117314 - protein, 18 aa, Mycobacterium
LLGGLPLLALAAGLAVIG

SEQ ID NO: 1117315 - protein, 26 aa, Mycobacterium
LLGLLPPQRRIASLTGPLGIAMVVLA

SEQ ID NO: 1117316 - protein, 26 aa, Mycobacterium
LLGLREFPLVIAILFALVIALPLGIW

SEQ ID NO: 1117317 - protein, 20 aa, Mycobacterium
LLGRSELFTEGFLVPVTTVA

SEQ ID NO: 1117318 - protein, 19 aa, Mycobacterium
LLGSFSLRAESALIDPGLD

SEQ ID NO: 1117319 - protein, 24 aa, Mycobacterium
LLHRAKGGGLSTLFGGGVQSSLSG

SEQ ID NO: 1117320 - protein, 24 aa, Mycobacterium
LLHWPESWPLVSLSPTVEPFLVFG

SEQ ID NO: 1117321 - protein, 18 aa, Mycobacterium
LLIAGFVTALPRSEGTNG

SEQ ID NO: 1117322 - protein, 21 aa, Mycobacterium
LLIIMGAFMFFASRRQKKAMQ

SEQ ID NO: 1117323 - protein, 23 aa, Mycobacterium
LLKPYRMTVFLLALVVVVENLAR

SEQ ID NO: 1117324 - protein, 20 aa, Mycobacterium
LLKTAGDVTGIFSERSQQVN

SEQ ID NO: 1117325 - protein, 29 aa, Mycobacterium
LLLACLVVPFILGLVWRKGTSTAALASIV

SEQ ID NO: 1117326 - protein, 18 aa, Mycobacterium
LLLGCAIIYGVESAASHY

SEQ ID NO: 1117327 - protein, 17 aa, Mycobacterium
LLLGMSLMGGNIRDHVA

SEQ ID NO: 1117328 - protein, 24 aa, Mycobacterium
LLLIAAGLLWPLLFDGGGSGGGTV

SEQ ID NO: 1117329 - protein, 29 aa, Mycobacterium
LLLLRIAQGFALGGEWAGAVLLAVEHSSA

SEQ ID NO: 1117330 - protein, 17 aa, Mycobacterium
LLLPAFVALIGVVAAIF

SEQ ID NO: 1117331 - protein, 26 aa, Mycobacterium
LLLSSLVVGAGWPLVVEQFSVKPNAA

SEQ ID NO: 1117332 - protein, 27 aa, Mycobacterium
LLLTIPVLLSHQWPLVFVAAALLGATF

SEQ ID NO: 1117333 - protein, 19 aa, Mycobacterium
LLLVLAVGLGALWLPWGAA

SEQ ID NO: 1117334 - protein, 17 aa, Mycobacterium
LLMTISFAALIAAQVSF

SEQ ID NO: 1117335 - protein, 23 aa, Mycobacterium
LLMVIFYFSYRSARFSTVENLIT

SEQ ID NO: 1117336 - protein, 19 aa, Mycobacterium
LLNNLPFATKVAVSDYNRD

SEQ ID NO: 1117337 - protein, 26 aa, Mycobacterium
LLPAYGETWLMVGITMALVVTIGIPV

SEQ ID NO: 1117338 - protein, 18 aa, Mycobacterium
LLPGSSWAVLLVIACIVV

SEQ ID NO: 1117339 - protein, 29 aa, Mycobacterium
LLPIAAIIACVWLMLNLTGLTWIRFLIWM

SEQ ID NO: 1117340 - protein, 18 aa, Mycobacterium
LLQGHWSLLVGYGCLPWV

SEQ ID NO: 1117341 - protein, 18 aa, Mycobacterium
LLRVHPLLAVGLNMVAVG

SEQ ID NO: 1117342 - protein, 24 aa, Mycobacterium
LLSIFRIIFGLAFTLHGSMKLFGW

SEQ ID NO: 1117343 - protein, 22 aa, Mycobacterium
LLSWGVVLLLYFANKHFLKRRP

SEQ ID NO: 1117344 - protein, 21 aa, Mycobacterium
LLTFYPGWVPIAAVGLLVVVA

SEQ ID NO: 1117345 - protein, 24 aa, Mycobacterium
LLTGACLTFGWSVPTVGDEGELPN

SEQ ID NO: 1117346 - protein, 18 aa, Mycobacterium
LLTPLFCLLLPVSVIPVV

SEQ ID NO: 1117347 - protein, 22 aa, Mycobacterium
LLVAGRLGDRFGPKNVYLVGLA

SEQ ID NO: 1117348 - protein, 34 aa, Mycobacterium
LLVALRFIQGFAVGGEWGGAVLLVAEHSPNRERG

SEQ ID NO: 1117349 - protein, 17 aa, Mycobacterium
LLVIAAAAGMAWEVLGA

SEQ ID NO: 1117350 - protein, 22 aa, Mycobacterium
LLVRFVVPPVRRMMTAQQETVR

SEQ ID NO: 1117351 - protein, 33 aa, Mycobacterium
LLVTAALTALAWRNRSRWLPAARTHRASAGLSR

SEQ ID NO: 1117352 - protein, 24 aa, Mycobacterium
LLVVLCRRAWRPGVLLVGLALFAA

SEQ ID NO: 1117353 - protein, 20 aa, Mycobacterium
LLVYLCNFGPIFEVSASDFL

SEQ ID NO: 1117354 - protein, 18 aa, Mycobacterium
LLWPFLLLPHLGMIRGAA

SEQ ID NO: 1117355 - protein, 22 aa, Mycobacterium
LLWRGHAAAARGLRTAPPTAHY

SEQ ID NO: 1117356 - protein, 26 aa, Mycobacterium
LLWYAGLPLKVFLSSLFAVMVSAAVL

SEQ ID NO: 1117357 - protein, 34 aa, Mycobacterium
LLYIGLALGWPLWWVSVCSVLCLLIVQGVIVNVA

SEQ ID NO: 1117358 - protein, 21 aa, Mycobacterium
LMAAAPLWFHIHVIIALVLFC

SEQ ID NO: 1117359 - protein, 17 aa, Mycobacterium
LMAFFFFIVGLEVKSEF

SEQ ID NO: 1117360 - protein, 26 aa, Mycobacterium
LMAMEAIAFPLSFLVLVWVFGGLFAA

SEQ ID NO: 1117361 - protein, 31 aa, Mycobacterium
LMAMFDRWNWWLPKWLDRVLPSVDFEKPLPK

SEQ ID NO: 1117362 - protein, 19 aa, Mycobacterium
LMIASPFRSGEKIGKLFST

SEQ ID NO: 1117363 - protein, 30 aa, Mycobacterium
LMLPAPRFPPPPGFPHRRIIRDDSGPGPAF

SEQ ID NO: 1117364 - protein, 23 aa, Mycobacterium
LMLYMALMGITWLLDVPARIGNR

SEQ ID NO: 1117365 - protein, 22 aa, Mycobacterium
LMTLLRRPVWWAGTGAAVAGFV

SEQ ID NO: 1117366 - protein, 21 aa, Mycobacterium
LMTPLRVMLIIAVVFLALGYS

SEQ ID NO: 1117367 - protein, 17 aa, Mycobacterium
LMVVPGVAAVAQPKLSL

SEQ ID NO: 1117368 - protein, 21 aa, Mycobacterium
LMWLLSWLIATPVRVVRAALK

SEQ ID NO: 1117369 - protein, 25 aa, Mycobacterium
LNALCNEFAQATGLPVVKHIALPAA

SEQ ID NO: 1117370 - protein, 18 aa, Mycobacterium
LNLMFLGFMFAFAVKAPL

SEQ ID NO: 1117371 - protein, 24 aa, Mycobacterium
LNMVMKKLTGWAAIIAVPTAITGF

SEQ ID NO: 1117372 - protein, 30 aa, Mycobacterium
LNSLPMLAALAWVCADAILLVRTGRRRYAV

SEQ ID NO: 1117373 - protein, 24 aa, Mycobacterium
LNTRNVFGPPAWAPVVNNVVAIAT

SEQ ID NO: 1117374 - protein, 20 aa, Mycobacterium
LNVFPAIFIAIYARIAPIET

SEQ ID NO: 1117375 - protein, 25 aa, Mycobacterium
LPAALLLSQFVPWLLTPILMLGATY

SEQ ID NO: 1117376 - protein, 23 aa, Mycobacterium
LPAGAEVRLCLGAINRDGSDALS

SEQ ID NO: 1117377 - protein, 20 aa, Mycobacterium
LPAGLRLVIDNAIANAVKHG

SEQ ID NO: 1117378 - protein, 23 aa, Mycobacterium
LPAGVRVRLALLLAYLAMPFDVI

SEQ ID NO: 1117379 - protein, 22 aa, Mycobacterium
LPAIALGVVCWIALTDRPADAN

SEQ ID NO: 1117380 - protein, 17 aa, Mycobacterium
LPAVGALLFLGGMAAAG

SEQ ID NO: 1117381 - protein, 30 aa, Mycobacterium
LPDDAFLSYGWRIAFLVSVVLVIFGVVVRL

SEQ ID NO: 1117382 - protein, 22 aa, Mycobacterium
LPDDEKRWLIGVLAAEEHAVSS

SEQ ID NO: 1117383 - protein, 19 aa, Mycobacterium
LPDGARIALRDDPAGQAIA

SEQ ID NO: 1117384 - protein, 21 aa, Mycobacterium
LPDTPHYGSWLLGKPEENQQR

SEQ ID NO: 1117385 - protein, 24 aa, Mycobacterium
LPELSMDITLRFDTLAAIMSVLIL

SEQ ID NO: 1117386 - protein, 19 aa, Mycobacterium
LPERWAAVVHAVFGASLAA

SEQ ID NO: 1117387 - protein, 24 aa, Mycobacterium
LPEVEWPTLVFFMGLFVMVAGLTH

SEQ ID NO: 1117388 - protein, 23 aa, Mycobacterium
LPFDRPGPAAVRITDHWHAPVGG

SEQ ID NO: 1117389 - protein, 29 aa, Mycobacterium
LPFLLLFRLTCYYYRKAYYRSVWQSPPGC

SEQ ID NO: 1117390 - protein, 32 aa, Mycobacterium; identical to SEQ ID NO: 317859

SEQ ID NO: 1117391 - protein, 20 aa, Mycobacterium
LPGGIAIPHCRSPYVDTATI

SEQ ID NO: 1117392 - protein, 25 aa, Mycobacterium
LPGLAVFRAVFFFAVDRNIPGGIAQ

SEQ ID NO: 1117393 - protein, 19 aa, Mycobacterium
LPGPGSLLFTIPVRYLRRG

SEQ ID NO: 1117394 - protein, 23 aa, Mycobacterium
LPGRAFWRPLFVAPLAVPAFVNS

SEQ ID NO: 1117395 - protein, 20 aa, Mycobacterium
LPGRIWEIILGVISVLAGII

SEQ ID NO: 1117396 - protein, 19 aa, Mycobacterium
LPILLGALVVNGFTRFVSS

SEQ ID NO: 1117397 - protein, 23 aa, Mycobacterium
LPLLVALGVCLVRQPRAVLYLPE

SEQ ID NO: 1117398 - protein, 17 aa, Mycobacterium
LPLPATALFVGAALPVA

SEQ ID NO: 1117399 - protein, 20 aa, Mycobacterium
LPNTLPSFLLPDVPYTLDTL

SEQ ID NO: 1117400 - protein, 23 aa, Mycobacterium
LPPFYPPGWFWLGGRLAALTGTP

SEQ ID NO: 1117401 - protein, 18 aa, Mycobacterium
LPRDGRAPVLLQVPGGAW

SEQ ID NO: 1117402 - protein, 21 aa, Mycobacterium
LPRFPEIKTDLALSNAVYGLT

SEQ ID NO: 1117403 - protein, 19 aa, Mycobacterium
LPRKVFGHVSVKFGTPTWA

SEQ ID NO: 1117404 - protein, 20 aa, Mycobacterium
LPSGTYCKIPKDFQANVVRG

SEQ ID NO: 1117405 - protein, 23 aa, Mycobacterium
LPTFDWPTDPAWLYRLTQGLHVG

SEQ ID NO: 1117406 - protein, 18 aa, Mycobacterium
LPTFLSYITEKKLAKRTG

SEQ ID NO: 1117407 - protein, 17 aa, Mycobacterium
LPTLVIFGVVSAVIVLG

SEQ ID NO: 1117408 - protein, 18 aa, Mycobacterium
LPTPLSVHVYRLVWRQMI

SEQ ID NO: 1117409 - protein, 17 aa, Mycobacterium
LPTYIKTIYGFSAVDAG

SEQ ID NO: 1117410 - protein, 20 aa, Mycobacterium
LPVMCAVYFMAYIDRTNVAL

SEQ ID NO: 1117411 - protein, 22 aa, Mycobacterium
LPVRAQRWWLALNVLGALLINH

SEQ ID NO: 1117412 - protein, 21 aa, Mycobacterium
LPVTYRVIATIKRREPTYEPA

SEQ ID NO: 1117413 - protein, 26 aa, Mycobacterium
LPWNRRRYRLPSALPGVALLLAKAPV

SEQ ID NO: 1117414 - protein, 17 aa, Mycobacterium
LPYSLATFFGLLPGTAA

SEQ ID NO: 1117415 - protein, 26 aa, Mycobacterium
LQLASAICRHYWPIALLAALVSRRCR

SEQ ID NO: 1117416 - protein, 18 aa, Mycobacterium
LQLLRLVTLITVMQRAVG

SEQ ID NO: 1117417 - protein, 24 aa, Mycobacterium
LQLSLAVALLAIWQGRRLGPLVAE

SEQ ID NO: 1117418 - protein, 25 aa, Mycobacterium
LQQWVPRLIPGFFRSPRWVPVVGWL

SEQ ID NO: 1117419 - protein, 17 aa, Mycobacterium
LQRSAVPTRQWRWPLGE

SEQ ID NO: 1117420 - protein, 17 aa, Mycobacterium
LQTGIYGALPFVYLAWI

SEQ ID NO: 1117421 - protein, 23 aa, Mycobacterium
LQVPRRRLIAIAAAIVILVAVAW

SEQ ID NO: 1117422 - protein, 18 aa, Mycobacterium
LRARKRLERYFGDQIADR

SEQ ID NO: 1117423 - protein, 19 aa, Mycobacterium
LRASDGFRKKVWMAPVVIG

SEQ ID NO: 1117424 - protein, 19 aa, Mycobacterium
LRDYGCDVAQGFHYSPPLS

SEQ ID NO: 1117425 - protein, 19 aa, Mycobacterium
LREGYAMGGLSGHPNIVNI

SEQ ID NO: 1117426 - protein, 24 aa, Mycobacterium
LREHLAGLCERVQLLPGSDERAFV

SEQ ID NO: 1117427 - protein, 19 aa, Mycobacterium
LRERLPRLAEVGVLNDPGV

SEQ ID NO: 1117428 - protein, 32 aa, Mycobacterium
LRFLLGVAEAGLFPGVILYLSRWFPTAYRARV

SEQ ID NO: 1117429 - protein, 18 aa, Mycobacterium
LRFSPRIVVAPVVVAALR

SEQ ID NO: 1117430 - protein, 20 aa, Mycobacterium
LRLDGAMFFGAAERISTEIA

SEQ ID NO: 1117431 - protein, 17 aa, Mycobacterium
LRLLVIGSVLGTVIGVV

SEQ ID NO: 1117432 - protein, 17 aa, Mycobacterium
LRLQPSVLRAQVVMGRD

SEQ ID NO: 1117433 - protein, 25 aa, Mycobacterium
LRLSRPHAPWARWRYTNRPRKMHRA

SEQ ID NO: 1117434 - protein, 19 aa, Mycobacterium
LRNALRTNPVFTSNGAPAR

SEQ ID NO: 1117435 - protein, 17 aa, Mycobacterium
LRPDIAVAYTDTDGYGQ

SEQ ID NO: 1117436 - protein, 25 aa, Mycobacterium
LRPESAHTYTRCAGRLAGIAGGILV

SEQ ID NO: 1117437 - protein, 21 aa, Mycobacterium
LRPVLWVVAVIFAFQLLFTDW

SEQ ID NO: 1117438 - protein, 17 aa, Mycobacterium
LRQRFPRGYARAEKLVA

SEQ ID NO: 1117439 - protein, 24 aa, Mycobacterium
LRRLDPAFTGFRIAVVSDIHLGPL

SEQ ID NO: 1117440 - protein, 19 aa, Mycobacterium
LRRPQYRALWVFVLVPVLI

SEQ ID NO: 1117441 - protein, 21 aa, Mycobacterium
LRRSATKFLFEFADDLQNDDA

SEQ ID NO: 1117442 - protein, 22 aa, Mycobacterium
LRSASGLDRPLIVQFFSYLGNA

SEQ ID NO: 1117443 - protein, 20 aa, Mycobacterium
LRSLARAVVHAANLGAQVIN

SEQ ID NO: 1117444 - protein, 18 aa, Mycobacterium
LRSRIVRIMPGYLVAVVI

SEQ ID NO: 1117445 - protein, 17 aa, Mycobacterium
LRSSAVVAVQFIAVAAA

SEQ ID NO: 1117446 - protein, 17 aa, Mycobacterium
LRTRVGIDGEEPGEFRD

SEQ ID NO: 1117447 - protein, 19 aa, Mycobacterium
LRTTIAWIAVPSVVWVVIA

SEQ ID NO: 1117448 - protein, 19 aa, Mycobacterium
LRVIAEWNPVSSLAQAMRE

SEQ ID NO: 1117449 - protein, 20 aa, Mycobacterium
LRVTGWRAGIDEAITAADAA

SEQ ID NO: 1117450 - protein, 21 aa, Mycobacterium
LRYLPDLVVVLALLMAVGFCA

SEQ ID NO: 1117451 - protein, 18 aa, Mycobacterium
LSAAEADLALARGAALAS

SEQ ID NO: 1117452 - protein, 22 aa, Mycobacterium
LSAETWTAIDIVCGAESPEIVV

SEQ ID NO: 1117453 - protein, 24 aa, Mycobacterium
LSAIYVLWMYQRMMTGPVRDGNER

SEQ ID NO: 1117454 - protein, 23 aa, Mycobacterium
LSALAASCRRITEGHFDERIVAQ

SEQ ID NO: 1117455 - protein, 18 aa, Mycobacterium
LSALWKSVLLSGSTALIG

SEQ ID NO: 1117456 - protein, 20 aa, Mycobacterium
LSARHDLGFVTLPVLDTDLV

SEQ ID NO: 1117457 - protein, 24 aa, Mycobacterium
LSAVSSRAGVEIAIDDDGVGVPEE

SEQ ID NO: 1117458 - protein, 30 aa, Mycobacterium
LSCLVIAGFWLRRRWPSRRQSGVFVAVTAV

SEQ ID NO: 1117459 - protein, 23 aa, Mycobacterium
LSDRLGRKPLLIAGAVGFAVFAY

SEQ ID NO: 1117460 - protein, 23 aa, Mycobacterium
LSDRYGRRRPLIIGTVACVAVSV

SEQ ID NO: 1117461 - protein, 21 aa, Mycobacterium
LSEALPGLAGALTVNTIAMIE

SEQ ID NO: 1117462 - protein, 24 aa, Mycobacterium
LSFLAWSALYARHEFVGPQAASEA

SEQ ID NO: 1117463 - protein, 24 aa, Mycobacterium
LSGAENGFASWLFGYNADEGAANV

SEQ ID NO: 1117464 - protein, 24 aa, Mycobacterium
LSGKSGDAFYKWAEDPRVTRIGRA

SEQ ID NO: 1117465 - protein, 20 aa, Mycobacterium
LSGLTAALGVDERTGLTGIG

SEQ ID NO: 1117466 - protein, 18 aa, Mycobacterium
LSGLVFFLSQYFQLVQGY

SEQ ID NO: 1117467 - protein, 17 aa, Mycobacterium
LSGTVWLSAIVFEPAAA

SEQ ID NO: 1117468 - protein, 19 aa, Mycobacterium
LSILLEFLIGWLWSETGSV

SEQ ID NO: 1117469 - protein, 20 aa, Mycobacterium
LSLFPAVLVMVSLLGVFGQG

SEQ ID NO: 1117470 - protein, 22 aa, Mycobacterium
LSLIGLLTLPGYRTNYNDRNYL

SEQ ID NO: 1117471 - protein, 20 aa, Mycobacterium
LSLSAAFGALVWIFQEGHLG

SEQ ID NO: 1117472 - protein, 20 aa, Mycobacterium
LSLTAAFGALVWIFQQGHLA

SEQ ID NO: 1117473 - protein, 17 aa, Mycobacterium
LSMIPALQFDNWQWLAL

SEQ ID NO: 1117474 - protein, 24 aa, Mycobacterium
LSMLGDLPWWVTGVILARELGVTV

SEQ ID NO: 1117475 - protein, 18 aa, Mycobacterium
LSMLVPILLVLGAPVTMA

SEQ ID NO: 1117476 - protein, 25 aa, Mycobacterium
LSMTGPRPGGFGQLNDRTFEICAPG

SEQ ID NO: 1117477 - protein, 18 aa, Mycobacterium
LSPNALRAVIVVVGLIGL

SEQ ID NO: 1117478 - protein, 17 aa, Mycobacterium
LSPRSSLLVLGDGRNNY

SEQ ID NO: 1117479 - protein, 22 aa, Mycobacterium
LSPYMLMMPLMMVMATVGFMAG

SEQ ID NO: 1117480 - protein, 20 aa, Mycobacterium
LSRASRSGVIIRSGGALENL

SEQ ID NO: 1117481 - protein, 24 aa, Mycobacterium
LSREVLPRLGPAVIASRPALWAAG

SEQ ID NO: 1117482 - protein, 18 aa, Mycobacterium
LSRPKWPEIKGVRDFAGV

SEQ ID NO: 1117483 - protein, 20 aa, Mycobacterium
LSRRIRWFVTATISYNIVEA

SEQ ID NO: 1117484 - protein, 17 aa, Mycobacterium
LSSGVPVLGILLLAVFS

SEQ ID NO: 1117485 - protein, 19 aa, Mycobacterium
LSSIFVVGVVALVISLAVN

SEQ ID NO: 1117486 - protein, 23 aa, Mycobacterium
LSSLARALVRKEFVASLRAAETS

SEQ ID NO: 1117487 - protein, 17 aa, Mycobacterium
LSTLDRLLPLWIGIAMA

SEQ ID NO: 1117488 - protein, 21 aa, Mycobacterium
LSTLRRAREGDPVLPIDSVPV

SEQ ID NO: 1117489 - protein, 20 aa, Mycobacterium
LSVLGLSGLVFFLSQYFQLV

SEQ ID NO: 1117490 - protein, 23 aa, Mycobacterium
LSWATALRYQALFTEAGGIAGGN

SEQ ID NO: 1117491 - protein, 22 aa, Mycobacterium
LSWFTPARWGFAASASTVDLIK

SEQ ID NO: 1117492 - protein, 21 aa, Mycobacterium
LSWLRFGHGLVLSSVLLWGGV

SEQ ID NO: 1117493 - protein, 24 aa, Mycobacterium
LTAFLLYLRMFFEPMQEISQFFNT

SEQ ID NO: 1117494 - protein, 26 aa, Mycobacterium
LTAKDRLRAGLAIVFQQFNLFQHMTV

SEQ ID NO: 1117495 - protein, 24 aa, Mycobacterium
LTALMVGALGGWVGNKTAETVQAF

SEQ ID NO: 1117496 - protein, 18 aa, Mycobacterium
LTARPGTLTAVIGPSGAG

SEQ ID NO: 1117497 - protein, 18 aa, Mycobacterium
LTASVVWSLVATRASDAP

SEQ ID NO: 1117498 - protein, 17 aa, Mycobacterium
LTAYFAWKRQMSPRAAA

SEQ ID NO: 1117499 - protein, 17 aa, Mycobacterium
LTDIGWMELLWMQPVGL

SEQ ID NO: 1117500 - protein, 18 aa, Mycobacterium
LTGAEWATALIPLALLVL

SEQ ID NO: 1117501 - protein, 24 aa, Mycobacterium
LTGAFERIGILAAVMLVFTLVFAN

SEQ ID NO: 1117502 - protein, 27 aa, Mycobacterium
LTGHTWQLLGALWLYAMAVGGAITGVA

SEQ ID NO: 1117503 - protein, 31 aa, Mycobacterium
LTGLTWIRFLIWMAIGVVVYFLYGRRHSLVG

SEQ ID NO: 1117504 - protein, 19 aa, Mycobacterium
LTLACLIAAVGVVTDSPVT

SEQ ID NO: 1117505 - protein, 18 aa, Mycobacterium
LTLFIRGVLCNWMVSTGV

SEQ ID NO: 1117506 - protein, 28 aa, Mycobacterium
LTLLRLAQGFAVGGEWGGATLMAVEHAT

SEQ ID NO: 1117507 - protein, 21 aa, Mycobacterium
LTLPHLRRFIELGVVLGAIYL

SEQ ID NO: 1117508 - protein, 19 aa, Mycobacterium
LTLPQSRSAVVNWIGFSLI

SEQ ID NO: 1117509 - protein, 24 aa, Mycobacterium
LTLTDKWDGLKLWIKQDGKRLMTP

SEQ ID NO: 1117510 - protein, 20 aa, Mycobacterium
LTLVDGRVVVWGTTDRTDEK

SEQ ID NO: 1117511 - protein, 25 aa, Mycobacterium
LTMVLFPMYFLKSFAYAGVATVVFA

SEQ ID NO: 1117512 - protein, 19 aa, Mycobacterium
LTPLLKRPIVFGLVSGLGI

SEQ ID NO: 1117513 - protein, 24 aa, Mycobacterium
LTQRLRWAQGTIQVMLRENPFVQK

SEQ ID NO: 1117514 - protein, 24 aa, Mycobacterium
LTQVCARSLAVARLEGLTDDAGAR

SEQ ID NO: 1117515 - protein, 18 aa, Mycobacterium
LTREARVNLDLGAETRLD

SEQ ID NO: 1117516 - protein, 19 aa, Mycobacterium
LTRISDFELAPGFVPEITW

SEQ ID NO: 1117517 - protein, 26 aa, Mycobacterium
LTRMLKIELPLAVPVLIASLRVVAVT

SEQ ID NO: 1117518 - protein, 17 aa, Mycobacterium
LTRPQWFLLPSLLLIGI

SEQ ID NO: 1117519 - protein, 18 aa, Mycobacterium
LTSLADWSGRRFKRPPWV

SEQ ID NO: 1117520 - protein, 23 aa, Mycobacterium
LTSLLLAAVLSWGAIEIAHLTGL

SEQ ID NO: 1117521 - protein, 23 aa, Mycobacterium
LTTAAGRWVLDGMDLMDAAAAVA

SEQ ID NO: 1117522 - protein, 24 aa, Mycobacterium
LTTESRQAFKIQQWRNKVRNHTVV

SEQ ID NO: 1117523 - protein, 22 aa, Mycobacterium
LTVFALAIVIGYYVIGNVHHAL

SEQ ID NO: 1117524 - protein, 25 aa, Mycobacterium
LVAARVGNPPVIRRSTLSLFSDRTP

SEQ ID NO: 1117525 - protein, 25 aa, Mycobacterium
LVADALRALLYALPRGHEPGAPIGV

SEQ ID NO: 1117526 - protein, 18 aa, Mycobacterium
LVAFLVILIIGWILAKLI

SEQ ID NO: 1117527 - protein, 27 aa, Mycobacterium
LVAGMPKLLAALALIGTVAMLWVGGHI

SEQ ID NO: 1117528 - protein, 19 aa, Mycobacterium
LVAHAMFKASLFMVVGVID

SEQ ID NO: 1117529 - protein, 18 aa, Mycobacterium
LVASMIATVVLFRAGARR

SEQ ID NO: 1117530 - protein, 20 aa, Mycobacterium
LVATCLGAGLVAFVLVGGLA

SEQ ID NO: 1117531 - protein, 20 aa, Mycobacterium
LVAVFLLVWSMNRHLKRLPE

SEQ ID NO: 1117532 - protein, 30 aa, Mycobacterium
LVERNRGGSIGRWIAAVAVLAVLTVVVAVA

SEQ ID NO: 1117533 - protein, 17 aa, Mycobacterium
LVFHLGYLWAAVLGGVV

SEQ ID NO: 1117534 - protein, 20 aa, Mycobacterium
LVGASRWYTQLPFLLEAMLA

SEQ ID NO: 1117535 - protein, 17 aa, Mycobacterium
LVGCFGFVTPAAYVAFL

SEQ ID NO: 1117536 - protein, 24 aa, Mycobacterium
LVGFKTKIVTLISWTVTFLSTKRG

SEQ ID NO: 1117537 - protein, 18 aa, Mycobacterium
LVGFLVVMLRRAWTPGAF

SEQ ID NO: 1117538 - protein, 17 aa, Mycobacterium
LVGGPWDWQRWAPASPW

SEQ ID NO: 1117539 - protein, 23 aa, Mycobacterium
LVGIPLLALWVFFRRRHHQAVLP

SEQ ID NO: 1117540 - protein, 24 aa, Mycobacterium
LVGQWLAAILFCRALIVERVPLRL

SEQ ID NO: 1117541 - protein, 18 aa, Mycobacterium
LVGVAAFVYRGANRTDHI

SEQ ID NO: 1117542 - protein, 24 aa, Mycobacterium
LVGYSAGFLPWFVDIDRQMYFFYA

SEQ ID NO: 1117543 - protein, 24 aa, Mycobacterium
LVHLRAPVRLRRELGTKGFLRLIN

SEQ ID NO: 1117544 - protein, 21 aa, Mycobacterium
LVHYFGIEWPWSTLIYSVIAV

SEQ ID NO: 1117545 - protein, 26 aa, Mycobacterium
LVLALPFLVLWPFWLVTKWLGGRWTI

SEQ ID NO: 1117546 - protein, 17 aa, Mycobacterium
LVLAMTFGLSMDYEIFL

SEQ ID NO: 1117547 - protein, 17 aa, Mycobacterium
LVLELLATLGVALVAVS

SEQ ID NO: 1117548 - protein, 23 aa, Mycobacterium
LVLLRQGYRWTRTLLTAGGFGSV

SEQ ID NO: 1117549 - protein, 20 aa, Mycobacterium
LVLPFLVMGIGMAFIWSPLA

SEQ ID NO: 1117550 - protein, 18 aa, Mycobacterium
LVLRTVAFQACFVSAGAV

SEQ ID NO: 1117551 - protein, 32 aa, Mycobacterium
LVLVGWLTVWPFLNWWTTHFVITDRRVMFRHG

SEQ ID NO: 1117552 - protein, 18 aa, Mycobacterium
LVLVSFGYTGLPFFPQGK

SEQ ID NO: 1117553 - protein, 24 aa, Mycobacterium
LVNDEARRLLGLPPGPIDRAALPP

SEQ ID NO: 1117554 - protein, 23 aa, Mycobacterium
LVNPTYRPAVIAIVVFYVIGLLV

SEQ ID NO: 1117555 - protein, 25 aa, Mycobacterium
LVRHCVRRFGGITGDVLGAAIEVTT

SEQ ID NO: 1117556 - protein, 26 aa, Mycobacterium
LVRHWRLTGKCLRPLPDKWKGLTDQE

SEQ ID NO: 1117557 - protein, 34 aa, Mycobacterium
LVRLPNALKIIGRAGGVYGDFFNFYACDVTLKLN

SEQ ID NO: 1117558 - protein, 24 aa, Mycobacterium
LVRRRTHLTRRALAALLIGFPIAM

SEQ ID NO: 1117559 - protein, 18 aa, Mycobacterium
LVRSELPETILVSVSHRS

SEQ ID NO: 1117560 - protein, 18 aa, Mycobacterium
LVSDAVASLTALRANPGL

SEQ ID NO: 1117561 - protein, 18 aa, Mycobacterium
LVTAAANCSWLFAWHHNR

SEQ ID NO: 1117562 - protein, 23 aa, Mycobacterium
LVTAVLALLAWRAIGGSADRLGA

SEQ ID NO: 1117563 - protein, 17 aa, Mycobacterium
LVTLITVMQRAVGNAIR

SEQ ID NO: 1117564 - protein, 17 aa, Mycobacterium
LVVAAMAGVVGFVLLAV

SEQ ID NO: 1117565 - protein, 29 aa, Mycobacterium
LVVACVVLAGLLGMCSFQGRGPTEGPAPA

SEQ ID NO: 1117566 - protein, 21 aa, Mycobacterium
LVVFGESLGSFGGEAPFLALN

SEQ ID NO: 1117567 - protein, 23 aa, Mycobacterium
LVVGAAVVFWAFNRDLTATQQEN

SEQ ID NO: 1117568 - protein, 17 aa, Mycobacterium
LVVLAGVGLIVWATPRL

SEQ ID NO: 1117569 - protein, 24 aa, Mycobacterium
LVVMLRRAWTPGAFSLGRATLPIA

SEQ ID NO: 1117570 - protein, 18 aa, Mycobacterium
LVVVAVSGAVTWQWSGWP

SEQ ID NO: 1117571 - protein, 18 aa, Mycobacterium
LVWCVRHLMQWAHSHRVG

SEQ ID NO: 1117572 - protein, 18 aa, Mycobacterium
LWDGRRSPVDLANRAVTD

SEQ ID NO: 1117573 - protein, 17 aa, Mycobacterium
LWFHIHVIIALVLFCLW

SEQ ID NO: 1117574 - protein, 23 aa, Mycobacterium
LWGGWLLVTGVVFSFMDGTIHPY

SEQ ID NO: 1117575 - protein, 21 aa, Mycobacterium
LWPLARAALTMTIPLTVISFA

SEQ ID NO: 1117576 - protein, 19 aa, Mycobacterium
LWSAASPKTRLPVVVGGSV

SEQ ID NO: 1117577 - protein, 23 aa, Mycobacterium
LWSQRHWAFALTYYWGLVLSAQA

SEQ ID NO: 1117578 - protein, 18 aa, Mycobacterium
LWTVRFLAQWLQGRLSQR

SEQ ID NO: 1117579 - protein, 25 aa, Mycobacterium
LWVSRADAAVIEWIQQYWNQLVLWA

SEQ ID NO: 1117580 - protein, 17 aa, Mycobacterium
LYAHKAFGLQFVTFLVA

SEQ ID NO: 1117581 - protein, 18 aa, Mycobacterium
LYALMGFPLDDVWHRIFG

SEQ ID NO: 1117582 - protein, 27 aa, Mycobacterium
LYDTWWRIPVLLAMSFANGWAEEIIVV

SEQ ID NO: 1117583 - protein, 25 aa, Mycobacterium
LYGARSSWFAALAVVALGLFIGGLV

SEQ ID NO: 1117584 - protein, 23 aa, Mycobacterium
LYIRLRLGDTPDFEELKESGEVS

SEQ ID NO: 1117585 - protein, 18 aa, Mycobacterium
LYLGWSSIAVFANVAAAL

SEQ ID NO: 1117586 - protein, 18 aa, Mycobacterium
LYLLLGWVAAWFIGPIMD

SEQ ID NO: 1117587 - protein, 18 aa, Mycobacterium
LYPIGGFGSVPAIVWVAF

SEQ ID NO: 1117588 - protein, 17 aa, Mycobacterium
LYPNPRVFAVLNTIVNI

SEQ ID NO: 1117589 - protein, 21 aa, Mycobacterium
LYRIRVGRRIGSVALVADGLH

SEQ ID NO: 1117590 - protein, 19 aa, Mycobacterium
LYRQQRLWGASPVVASWQL

SEQ ID NO: 1117591 - protein, 19 aa, Mycobacterium
LYSTVTFHRIWRDSPVPAY

SEQ ID NO: 1117592 - protein, 22 aa, Mycobacterium
MAALPPFLGFVAKEADFETVLH

SEQ ID NO: 1117593 - protein, 24 aa, Mycobacterium
MADVLSFRLKQRPVRLAAATNTLA

SEQ ID NO: 1117594 - protein, 18 aa, Mycobacterium
MAEVRDGWDTRLDRAVAI

SEQ ID NO: 1117595 - protein, 17 aa, Mycobacterium
MAGCYTAYVVQQVFSSA

SEQ ID NO: 1117596 - protein, 21 aa, Mycobacterium
MAGTVVEWYEFFLYGTAATLV

SEQ ID NO: 1117597 - protein, 22 aa, Mycobacterium
MAHSLIPIVIGYVFAHYLTYLV

SEQ ID NO: 1117598 - protein, 22 aa, Mycobacterium
MAIGLFALRFPVLIDGYDQWGW

SEQ ID NO: 1117599 - protein, 17 aa, Mycobacterium
MAPAISPKKSWEGLVGS

SEQ ID NO: 1117600 - protein, 18 aa, Mycobacterium
MAPFHHHFELVGWAETTV

SEQ ID NO: 1117601 - protein, 20 aa, Mycobacterium
MASATEIRATPTVRINGEDY

SEQ ID NO: 1117602 - protein, 23 aa, Mycobacterium
MDFIRFTGEWIVYLALLGIGGGV

SEQ ID NO: 1117603 - protein, 25 aa, Mycobacterium
MDSYGWRIPFLIAAPLGLVGLYIRL

SEQ ID NO: 1117604 - protein, 32 aa, Mycobacterium
MDWLQAFLPYIGFLCIIGLLSYHLLIGRDMPK

SEQ ID NO: 1117605 - protein, 19 aa, Mycobacterium
MEIGVPIFFVLSGFLLFRP

SEQ ID NO: 1117606 - protein, 17 aa, Mycobacterium
MEKAPGAVLGFLFWLGM

SEQ ID NO: 1117607 - protein, 26 aa, Mycobacterium
MEPTLHGCPGCVGDRIMVDKVTYRFS

SEQ ID NO: 1117608 - protein, 26 aa, Mycobacterium
MEVTGAVNLKEKFPGALPPEPEQDTF

SEQ ID NO: 1117609 - protein, 17 aa, Mycobacterium
MFAGCYLLPPLLPYSYT

SEQ ID NO: 1117610 - protein, 22 aa, Mycobacterium
MFGAYFCLDFILGFTPSGNAYN

SEQ ID NO: 1117611 - protein, 27 aa, Mycobacterium
MFMEELFWGCAGIGLAIVMPALALSAI

SEQ ID NO: 1117612 - protein, 20 aa, Mycobacterium
MGAGSSAVWTYGRSLLVETG

SEQ ID NO: 1117613 - protein, 21 aa, Mycobacterium
MGIPVVGTWMHWALFGGDFPG

SEQ ID NO: 1117614 - protein, 17 aa, Mycobacterium
MGMPVSQFTVAFMTAIL

SEQ ID NO: 1117615 - protein, 17 aa, Mycobacterium
MGVAWSVLYIPIGGVGT

SEQ ID NO: 1117616 - protein, 17 aa, Mycobacterium
MGVMIFGYLQAPTLLGI

SEQ ID NO: 1117617 - protein, 28 aa, Mycobacterium
MIACGILEFPYRRFLAFDAVAAVLWGSI

SEQ ID NO: 1117618 - protein, 18 aa, Mycobacterium
MIAIGGVIGAGLFVGSGV

SEQ ID NO: 1117619 - protein, 17 aa, Mycobacterium
MIFGYLQAPTLLGIGRM

SEQ ID NO: 1117620 - protein, 21 aa, Mycobacterium
MIFNVIWTYALVRGAAADVGN

SEQ ID NO: 1117621 - protein, 23 aa, Mycobacterium
MIPALQFDNWQWLALTLASPVVV

SEQ ID NO: 1117622 - protein, 24 aa, Mycobacterium
MKIFLIALGCVWPVLLSTADGARR

SEQ ID NO: 1117623 - protein, 19 aa, Mycobacterium
MKLVLAAAGTHLLTQVGLA

SEQ ID NO: 1117624 - protein, 20 aa, Mycobacterium
MKQNLWWGAGYNLIAVPLAA

SEQ ID NO: 1117625 - protein, 21 aa, Mycobacterium
MKVPTLLGIGRLTVTLELPAA

SEQ ID NO: 1117626 - protein, 21 aa, Mycobacterium
MKYQPQWVPRYACYEDARLIP

SEQ ID NO: 1117627 - protein, 19 aa, Mycobacterium
MLAGLAMLVAHAMFKASLF

SEQ ID NO: 1117628 - protein, 22 aa, Mycobacterium
MLFSVGFLLTFLLGGLSGVLLA

SEQ ID NO: 1117629 - protein, 17 aa, Mycobacterium
MLIVGALCAVVLVQAAS

SEQ ID NO: 1117630 - protein, 19 aa, Mycobacterium
MLLAIAVFVLTAFVLAGHL

SEQ ID NO: 1117631 - protein, 20 aa, Mycobacterium
MLLMCATFVALVLIPVDFDY

SEQ ID NO: 1117632 - protein, 23 aa, Mycobacterium
MLPADTPVGPGFAQVGFDTLWSG

SEQ ID NO: 1117633 - protein, 18 aa, Mycobacterium
MLQMISFVLLRRNFPNAR

SEQ ID NO: 1117634 - protein, 18 aa, Mycobacterium
MLTARPAAAIALSTAVNL

SEQ ID NO: 1117635 - protein, 25 aa, Mycobacterium
MLVPKAARLDPALMLLAVFSGIAMF

SEQ ID NO: 1117636 - protein, 25 aa, Mycobacterium
MMLSLVWPIASLGFLLSMMQESYTA

SEQ ID NO: 1117637 - protein, 23 aa, Mycobacterium
MNATRLDGLLALLASGGVAVYLW

SEQ ID NO: 1117638 - protein, 24 aa, Mycobacterium
MNLAGSAPRVIWFVPQEREGAGGT

SEQ ID NO: 1117639 - protein, 23 aa, Mycobacterium
MNNRCPLTSYVIVGFSQGAVIAG

SEQ ID NO: 1117640 - protein, 25 aa, Mycobacterium
MNPLAKLMWRICRIDGRPSRYRSEP

SEQ ID NO: 1117641 - protein, 18 aa, Mycobacterium
MNSAWGFSTWWVAVGTVI

SEQ ID NO: 1117642 - protein, 24 aa, Mycobacterium
MPDFLDPLVLLGYFGGWALVGLLV

SEQ ID NO: 1117643 - protein, 18 aa, Mycobacterium
MPFYRTVISVANWCLGSI

SEQ ID NO: 1117644 - protein, 20 aa, Mycobacterium
MPIAIWWFLIRPWRRERRIT

SEQ ID NO: 1117645 - protein, 24 aa, Mycobacterium
MPIVSLRTIVIVAALSVVVLVLTL

SEQ ID NO: 1117646 - protein, 24 aa, Mycobacterium
MPLLGRASDRFGRKLVLQLSLAGF

SEQ ID NO: 1117647 - protein, 19 aa, Mycobacterium
MPPALAWWAGTLELSGLNG

SEQ ID NO: 1117648 - protein, 23 aa, Mycobacterium
MPVGRWIGFALIWLALALLAADA

SEQ ID NO: 1117649 - protein, 27 aa, Mycobacterium
MRAFVALRWWPLVLLVAVTVALVALAA

SEQ ID NO: 1117650 - protein, 29 aa, Mycobacterium
MRGAVETCRLIPVIVTFAIGVGVLLSLQA

SEQ ID NO: 1117651 - protein, 17 aa, Mycobacterium
MRLFASPVFTVCCILSF

SEQ ID NO: 1117652 - protein, 22 aa, Mycobacterium
MRLLAEIMPVHFFAQPVVTLMG

SEQ ID NO: 1117653 - protein, 23 aa, Mycobacterium
MRMTRLLALLATFLTAGVLLAPV

SEQ ID NO: 1117654 - protein, 29 aa, Mycobacterium
MRPVGSWFFGRFADRRGRKAALMVSITVM

SEQ ID NO: 1117655 - protein, 18 aa, Mycobacterium
MRRRRSVGTWPLLAPLLA

SEQ ID NO: 1117656 - protein, 20 aa, Mycobacterium
MRYKDDYKAAGVPMLPAVAT

SEQ ID NO: 1117657 - protein, 24 aa, Mycobacterium
MSAVAAPIAWVLGRATDLVVRILG

SEQ ID NO: 1117658 - protein, 19 aa, Mycobacterium
MSFANGWAEEIIVVGFLLT

SEQ ID NO: 1117659 - protein, 26 aa, Mycobacterium
MSFVLQEFVHFILPKIIKGYGGSNAQ

SEQ ID NO: 1117660 - protein, 18 aa, Mycobacterium
MSGAQIWDASTVATLDAI

SEQ ID NO: 1117661 - protein, 30 aa, Mycobacterium
MSLATIWLRTGLMPRPLVYVTYLVAVALIV

SEQ ID NO: 1117662 - protein, 26 aa, Mycobacterium
MSSALPAAGGGYTFARRALGPWGGFA

SEQ ID NO: 1117663 - protein, 25 aa, Mycobacterium
MSSVGRGGLQFMLIIWLQGIWLPLR

SEQ ID NO: 1117664 - protein, 17 aa, Mycobacterium
MSTFGLTAAYVFIICWV

SEQ ID NO: 1117665 - protein, 20 aa, Mycobacterium
MSVAVYAVVSRALYDDIDNQ

SEQ ID NO: 1117666 - protein, 17 aa, Mycobacterium
MSYPVFALFNILGAVVW

SEQ ID NO: 1117667 - protein, 17 aa, Mycobacterium
MTGQIIGTMAYMSPERV

SEQ ID NO: 1117668 - protein, 30 aa, Mycobacterium
MTPSIAALLGRWFWWPQRVRQRPATTGSLI

SEQ ID NO: 1117669 - protein, 17 aa, Mycobacterium
MVALMPKMIETMKTMKV

SEQ ID NO: 1117670 - protein, 17 aa, Mycobacterium
MVDALGGVEVCSTEPLE

SEQ ID NO: 1117671 - protein, 19 aa, Mycobacterium
MVELIWQWTPFMMLLILAG

SEQ ID NO: 1117672 - protein, 19 aa, Mycobacterium
MVGAGAFFFWQYRSAQDRR

SEQ ID NO: 1117673 - protein, 22 aa, Mycobacterium
MVGALADWFAVTALFKHPLGIP

SEQ ID NO: 1117674 - protein, 23 aa, Mycobacterium
MVGARTGLGFVITQAQATFQLLT

SEQ ID NO: 1117675 - protein, 25 aa, Mycobacterium
MVLVAVAVGAGWLYSVGVTLTGGGE

SEQ ID NO: 1117676 - protein, 20 aa, Mycobacterium
MVNRLKALGLAVVYAAVAAM

SEQ ID NO: 1117677 - protein, 23 aa, Mycobacterium
MVSGATHLLGWVILAATIIPVAD

SEQ ID NO: 1117678 - protein, 19 aa, Mycobacterium
MVTLGRWSYGLFIWHLAAL

SEQ ID NO: 1117679 - protein, 29 aa, Mycobacterium
NAFSFIGIVMVLLWWRRPVEEATMPLERP

SEQ ID NO: 1117680 - protein, 20 aa, Mycobacterium
NAGFRYALVRLRDAGTAVGM

SEQ ID NO: 1117681 - protein, 21 aa, Mycobacterium
NAGLVNPVFWLGMMIALAAAF

SEQ ID NO: 1117682 - protein, 18 aa, Mycobacterium
NAIWKSFDLFVGAIQAFI

SEQ ID NO: 1117683 - protein, 20 aa, Mycobacterium
NANSWLGVQLFEYTGETSPD

SEQ ID NO: 1117684 - protein, 24 aa, Mycobacterium
NAPEEPELALARGAALASAHAPDF

SEQ ID NO: 1117685 - protein, 21 aa, Mycobacterium
NATAALVFAVFAPVHWVAVIP

SEQ ID NO: 1117686 - protein, 20 aa, Mycobacterium
NAVFRYALVRLRDASEAVAF

SEQ ID NO: 1117687 - protein, 19 aa, Mycobacterium
NAVLPAKLILLAIAVICAV

SEQ ID NO: 1117688 - protein, 21 aa, Mycobacterium
NDILPLLVLVAVPPLIGAAAL

SEQ ID NO: 1117689 - protein, 17 aa, Mycobacterium
NDPKGKFNYSWQGFTLD

SEQ ID NO: 1117690 - protein, 19 aa, Mycobacterium
NDRDELFPVSGTSYAAAYV

SEQ ID NO: 1117691 - protein, 19 aa, Mycobacterium
NERRFAMAFVTIGAVLFIS

SEQ ID NO: 1117692 - protein, 17 aa, Mycobacterium
NFPDTSFAWAFVLALLA

SEQ ID NO: 1117693 - protein, 27 aa, Mycobacterium
NGFVSAFVCGIAFKYLRHSDDLRGDLE

SEQ ID NO: 1117694 - protein, 23 aa, Mycobacterium
NGIGVGFISWVVVRSGAGKAREI

SEQ ID NO: 1117695 - protein, 19 aa, Mycobacterium
NGILNWLLSLVGIGRVDWI

SEQ ID NO: 1117696 - protein, 23 aa, Mycobacterium
NGRAPGGFARRRGTASLRVGVAT

SEQ ID NO: 1117697 - protein, 18 aa, Mycobacterium
NGVIPAPSINNGMNPLPA

SEQ ID NO: 1117698 - protein, 24 aa, Mycobacterium
NHHGRVAAGWGAGVGALLGLFAPP

SEQ ID NO: 1117699 - protein, 24 aa, Mycobacterium
NHLELGQPLAIEYVWGRQIGENTI

SEQ ID NO: 1117700 - protein, 23 aa, Mycobacterium
NIAALRAALSWTTPTVSTAVDAS

SEQ ID NO: 1117701 - protein, 18 aa, Mycobacterium
NLAWPRAAVYGEPWYNTW

SEQ ID NO: 1117702 - protein, 19 aa, Mycobacterium
NLERSRVGRAWVAVREDED

SEQ ID NO: 1117703 - protein, 19 aa, Mycobacterium
NLICLLFIVPVVARDGWSS

SEQ ID NO: 1117704 - protein, 26 aa, Mycobacterium
NLLQMAFRFWAFRRWVFPEEFGRNPD

SEQ ID NO: 1117705 - protein, 32 aa, Mycobacterium
NLPTILYSLYWRRFNTRGALWSMYGGLISTIV

SEQ ID NO: 1117706 - protein, 18 aa, Mycobacterium
NLRGKWRVTPGVAATGHF

SEQ ID NO: 1117707 - protein, 25 aa, Mycobacterium
NLSESIDLLAIWIGVGFIFRGVATA

SEQ ID NO: 1117708 - protein, 24 aa, Mycobacterium
NNERAHTGFVRRVMSSALPSGLVV

SEQ ID NO: 1117709 - protein, 22 aa, Mycobacterium
NPAGSFALRVWVNNAWVAAQCI

SEQ ID NO: 1117710 - protein, 18 aa, Mycobacterium
NPERPILRIADGRIERWQ

SEQ ID NO: 1117711 - protein, 27 aa, Mycobacterium
NPGMPLSFLPFMPLVWVAIRLTTRELI

SEQ ID NO: 1117712 - protein, 23 aa, Mycobacterium
NPGNPLWRYRLLMAVLGSMLLSW

SEQ ID NO: 1117713 - protein, 19 aa, Mycobacterium
NPLRFLARAANLWNSELPF

SEQ ID NO: 1117714 - protein, 22 aa, Mycobacterium
NPQKSIPVAAFVVAVVVAVGVV

SEQ ID NO: 1117715 - protein, 21 aa, Mycobacterium
NPSKIWLLVVLLTGIGWVGYI

SEQ ID NO: 1117716 - protein, 32 aa, Mycobacterium
NQDFTVPVPTGFAAIRLRGLIHAPVDLGAGFV

SEQ ID NO: 1117717 - protein, 19 aa, Mycobacterium
NQKSLGRSVAIKVLASDLD

SEQ ID NO: 1117718 - protein, 24 aa, Mycobacterium
NQNRIRWGNLLTLPVGPGGLLYVA

SEQ ID NO: 1117719 - protein, 29 aa, Mycobacterium
NQSALRLKGRLLFMPNVMVTSVPWQLNSS

SEQ ID NO: 1117720 - protein, 25 aa, Mycobacterium
NRGAQRWDLERQVRLVAGSIVLTSI

SEQ ID NO: 1117721 - protein, 18 aa, Mycobacterium
NRKPFLLVGSALSSIFVV

SEQ ID NO: 1117722 - protein, 19 aa, Mycobacterium
NRQLIDFVTVIYTDQQGAL

SEQ ID NO: 1117723 - protein, 18 aa, Mycobacterium
NRQRRLILDRGLSAADAA

SEQ ID NO: 1117724 - protein, 18 aa, Mycobacterium
NRRHPGWQVSADGRFFIL

SEQ ID NO: 1117725 - protein, 17 aa, Mycobacterium
NSAGWVFTEMGRQPWVV

SEQ ID NO: 1117726 - protein, 23 aa, Mycobacterium
NSPRTLFPHAWVQTKRLLMRFLR

SEQ ID NO: 1117727 - protein, 28 aa, Mycobacterium
NSWGAALSFKFALVVAIISIGILVLFGV

SEQ ID NO: 1117728 - protein, 19 aa, Mycobacterium
NTDIGWWRFNRLRMRDSKL

SEQ ID NO: 1117729 - protein, 22 aa, Mycobacterium
NTGRPGLFLLALVLVFGLAMAP

SEQ ID NO: 1117730 - protein, 24 aa, Mycobacterium
NTLYRAGLIGGLALLPLLALLVWL

SEQ ID NO: 1117731 - protein, 23 aa, Mycobacterium
NVEGLAALIFTRYLWAFELTGAL

SEQ ID NO: 1117732 - protein, 25 aa, Mycobacterium
NVFRAPWQVARMLLLFWGVGTALLT

SEQ ID NO: 1117733 - protein, 25 aa, Mycobacterium
NVKDAETWSAAPLLGLYWCAIGLII

SEQ ID NO: 1117734 - protein, 23 aa, Mycobacterium
NVPARVNAVVMFRVTDPLNAIVA

SEQ ID NO: 1117735 - protein, 27 aa, Mycobacterium
NWAGFSVGWLYWYFWVIVVGFEAIAGA

SEQ ID NO: 1117736 - protein, 20 aa, Mycobacterium
NWATLIALGIGDIVAIDFMQ

SEQ ID NO: 1117737 - protein, 39 aa, Mycobacterium
NWQWLALTLASPVVVWGAWPFHRAAWMNLRHGAATMDTL

SEQ ID NO: 1117738 - protein, 25 aa, Mycobacterium
NYECANCLTYALARQVFITLDEPLS

SEQ ID NO: 1117739 - protein, 17 aa, Mycobacterium
PAAAIALSTAVNLVAVW

SEQ ID NO: 1117740 - protein, 24 aa, Mycobacterium
PAAGLWPLVFARVAATALVVLIAA

SEQ ID NO: 1117741 - protein, 25 aa, Mycobacterium
PAALICLGAALLLTRRTPRTDTTRA

SEQ ID NO: 1117742 - protein, 23 aa, Mycobacterium
PAARFGSCHDFAVALAQATGSPA

SEQ ID NO: 1117743 - protein, 20 aa, Mycobacterium
PAAVGALVYAMCAVATSRDD

SEQ ID NO: 1117744 - protein, 19 aa, Mycobacterium
PADLHAAVRSVSAVGEQYV

SEQ ID NO: 1117745 - protein, 18 aa, Mycobacterium
PADLRILRETELRVDESA

SEQ ID NO: 1117746 - protein, 18 aa, Mycobacterium
PADVGWLKLPTFDWPTDP

SEQ ID NO: 1117747 - protein, 23 aa, Mycobacterium
PADVRALGVGLGYALANSAFGGT

SEQ ID NO: 1117748 - protein, 24 aa, Mycobacterium
PAEPLARWHVRAAALAVDVLPGLA

SEQ ID NO: 1117749 - protein, 22 aa, Mycobacterium
PAGLGADCQYPASGAASKPVEP

SEQ ID NO: 1117750 - protein, 17 aa, Mycobacterium
PAHAAAIVHTDFVAQVS

SEQ ID NO: 1117751 - protein, 22 aa, Mycobacterium
PAHLRGRVVGVMGSLAYAAGPL

SEQ ID NO: 1117752 - protein, 18 aa, Mycobacterium
PAHPGHRPHAGLWASAAI

SEQ ID NO: 1117753 - protein, 24 aa, Mycobacterium
PAIAKAAVIGAIIGLAMFVYPEAV

SEQ ID NO: 1117754 - protein, 22 aa, Mycobacterium
PALAWLPLFVVFGLLTGCLGAA

SEQ ID NO: 1117755 - protein, 23 aa, Mycobacterium
PALDAAVGAALFAAYSAAAEAPT

SEQ ID NO: 1117756 - protein, 19 aa, Mycobacterium
PALFALAAVTVRRLPGWPL

SEQ ID NO: 1117757 - protein, 20 aa, Mycobacterium
PALLYCFAFLALAGLGAGTL

SEQ ID NO: 1117758 - protein, 25 aa, Mycobacterium
PALMIGFAAVMVFAGIRMLTDQENT

SEQ ID NO: 1117759 - protein, 18 aa, Mycobacterium
PALSYAIRQLEDELGVTL

SEQ ID NO: 1117760 - protein, 18 aa, Mycobacterium
PAMLWRSTPAALRKLDPR

SEQ ID NO: 1117761 - protein, 17 aa, Mycobacterium
PAPIHIAAAKLVVASAV

SEQ ID NO: 1117762 - protein, 24 aa, Mycobacterium
PAPLARLHRRFGIGEAAPAGRHRG

SEQ ID NO: 1117763 - protein, 19 aa, Mycobacterium
PAPTGARPEVQYLPADEPE

SEQ ID NO: 1117764 - protein, 27 aa, Mycobacterium
PAQLLQPFLDYAFGFRRGMDAGQPPDD

SEQ ID NO: 1117765 - protein, 19 aa, Mycobacterium
PAQLWVFWIAPLLGAAIAG

SEQ ID NO: 1117766 - protein, 18 aa, Mycobacterium
PATFQYWPYFALAVGGAM

SEQ ID NO: 1117767 - protein, 24 aa, Mycobacterium
PATLLLLRYRWLRAEPLPPARSRA

SEQ ID NO: 1117768 - protein, 18 aa, Mycobacterium
PAVLSILVLEDFAMAAYL

SEQ ID NO: 1117769 - protein, 17 aa, Mycobacterium
PDALEDLGLQSALNALC

SEQ ID NO: 1117770 - protein, 20 aa, Mycobacterium
PDFPGARWIAPLLGTVMYAV

SEQ ID NO: 1117771 - protein, 18 aa, Mycobacterium
PDGAHGMYSWLHVLLAAG

SEQ ID NO: 1117772 - protein, 21 aa, Mycobacterium
PDGGTAFVRRLVTLATTLLLA

SEQ ID NO: 1117773 - protein, 18 aa, Mycobacterium
PDGVKCAAAMALSPEEPV

SEQ ID NO: 1117774 - protein, 25 aa, Mycobacterium
PDILDPALLRPGRFDRQIPVTSPDL

SEQ ID NO: 1117775 - protein, 24 aa, Mycobacterium
PDLPEYRTGLIIVGLARCIAMVII

SEQ ID NO: 1117776 - protein, 17 aa, Mycobacterium
PDLSGPVPRPPQRKPAT

SEQ ID NO: 1117777 - protein, 25 aa, Mycobacterium
PDPGRWPWPTFTVNIVGAFLLGYFT

SEQ ID NO: 1117778 - protein, 17 aa, Mycobacterium
PDPQLSAFASRTDTVLV

SEQ ID NO: 1117779 - protein, 17 aa, Mycobacterium
PDPRYGESLYYIDPQGV

SEQ ID NO: 1117780 - protein, 23 aa, Mycobacterium
PDQPEREGGRHSAPDEATEQVGA

SEQ ID NO: 1117781 - protein, 24 aa, Mycobacterium
PDQRGRPGARARLFGMTEAFGPYC

SEQ ID NO: 1117782 - protein, 19 aa, Mycobacterium
PDRNIGIPLAFHLGYHSLP

SEQ ID NO: 1117783 - protein, 25 aa, Mycobacterium
PDRPSGLAVAAVWIFGLVMAAIACS

SEQ ID NO: 1117784 - protein, 20 aa, Mycobacterium
PDRPWGTPRVVYLQHASDPI

SEQ ID NO: 1117785 - protein, 18 aa, Mycobacterium
PDSALTIVVMLAVAVAVA

SEQ ID NO: 1117786 - protein, 24 aa, Mycobacterium
PDSELRVKMWLFPVLSVLTAVGIV

SEQ ID NO: 1117787 - protein, 19 aa, Mycobacterium
PDTPIWRLVLPFLVMGIGM

SEQ ID NO: 1117788 - protein, 19 aa, Mycobacterium
PDTSFAWAFVLALLAGALA

SEQ ID NO: 1117789 - protein, 26 aa, Mycobacterium
PDTSKPVRLTMFWPLADKPRLAAGIP

SEQ ID NO: 1117790 - protein, 19 aa, Mycobacterium
PDVAQIFARMHVPERLGMG

SEQ ID NO: 1117791 - protein, 24 aa, Mycobacterium
PEAERRLVFERFYRSTAARAMPGS

SEQ ID NO: 1117792 - protein, 20 aa, Mycobacterium
PEAFEHGRPLNAFATAGGFF

SEQ ID NO: 1117793 - protein, 17 aa, Mycobacterium
PEAPRPLTIDGQPVPGV

SEQ ID NO: 1117794 - protein, 21 aa, Mycobacterium
PEFWRLLELRAVSQFGEGLFQ

SEQ ID NO: 1117795 - protein, 30 aa, Mycobacterium
PEGRPGCWQPITRDLWPAPYLVLDTGASLA

SEQ ID NO: 1117796 - protein, 18 aa, Mycobacterium
PEGRSIVVFAKQQYGLRA

SEQ ID NO: 1117797 - protein, 27 aa, Mycobacterium
PELDRGKEVPFTFAYPIRAADGPSLRI

SEQ ID NO: 1117798 - protein, 21 aa, Mycobacterium
PELPALRQVWSPDQLMAARAV

SEQ ID NO: 1117799 - protein, 34 aa, Mycobacterium
PELPRLVPPSLLRRVLPYLIVLLIVGMIVALIAT

SEQ ID NO: 1117800 - protein, 19 aa, Mycobacterium
PERLLVGGLGPRGTTTIVF

SEQ ID NO: 1117801 - protein, 30 aa, Mycobacterium
PERVWSGIVEGLGFVWRTPVLRTLAVVDLV

SEQ ID NO: 1117802 - protein, 17 aa, Mycobacterium
PESEQFSSGPYVPADPA

SEQ ID NO: 1117803 - protein, 28 aa, Mycobacterium
PETSFLSWGWRVAFWLSAVVVLIGYYIR

SEQ ID NO: 1117804 - protein, 24 aa, Mycobacterium
PEVFVNGCVLSWRDVDQPECVSGD

SEQ ID NO: 1117805 - protein, 21 aa, Mycobacterium
PEVGKSVGVLGSMFVDLIKMM

SEQ ID NO: 1117806 - protein, 21 aa, Mycobacterium
PEVKLRMIAERSGLSMDPGAK

SEQ ID NO: 1117807 - protein, 19 aa, Mycobacterium
PEWMPDWTSSAVIGHGGDT

SEQ ID NO: 1117808 - protein, 25 aa, Mycobacterium
PFAAALSLLGTVPMGLLAYRYRLRV

SEQ ID NO: 1117809 - protein, 17 aa, Mycobacterium
PFDDAHGTFSFDIANGS

SEQ ID NO: 1117810 - protein, 18 aa, Mycobacterium
PFEMIKFRTMVEGADRML

SEQ ID NO: 1117811 - protein, 18 aa, Mycobacterium
PFFARLVQNALREVRTDV

SEQ ID NO: 1117812 - protein, 17 aa, Mycobacterium
PFGIGMALFGNVIGGVF

SEQ ID NO: 1117813 - protein, 21 aa, Mycobacterium
PFIDLRFFRSIPFSAATVTAV

SEQ ID NO: 1117814 - protein, 24 aa, Mycobacterium
PFIQQESWHAWAHQIVLDHLAEQG

SEQ ID NO: 1117815 - protein, 17 aa, Mycobacterium
PFLANSAGWVFTEMGRQ

SEQ ID NO: 1117816 - protein, 17 aa, Mycobacterium
PFLIVGILAGIKEIVVL

SEQ ID NO: 1117817 - protein, 18 aa, Mycobacterium
PFLVFGYVMFYFAPYFPS

SEQ ID NO: 1117818 - protein, 19 aa, Mycobacterium
PFMLAVAFIGWSFVGFESA

SEQ ID NO: 1117819 - protein, 18 aa, Mycobacterium
PFSVFGYHVTGSTGTLFL

SEQ ID NO: 1117820 - protein, 22 aa, Mycobacterium
PFTACSQIGYELMFLVGHPLGW

SEQ ID NO: 1117821 - protein, 25 aa, Mycobacterium
PFTPVGAALLCDWTDDDSGLGRVSW

SEQ ID NO: 1117822 - protein, 20 aa, Mycobacterium
PFTYPAFAAMVFYPLHLLPF

SEQ ID NO: 1117823 - protein, 26 aa, Mycobacterium
PFVAAGGLLIALGFLFAGYDIANTPD

SEQ ID NO: 1117824 - protein, 26 aa, Mycobacterium
PFVMLGAALLWFGWFGFNVGSEGAAD

SEQ ID NO: 1117825 - protein, 27 aa, Mycobacterium
PFVYPPFAAILFRPLTALPFVVAGVLW

SEQ ID NO: 1117826 - protein, 25 aa, Mycobacterium
PGAPIGVTHPAHWHAGSVDALRAAL

SEQ ID NO: 1117827 - protein, 27 aa, Mycobacterium
PGAPLVRRGPYRWVHHPNYIAVAAEVA

SEQ ID NO: 1117828 - protein, 27 aa, Mycobacterium
PGCELDVARLWALLQIYRHNQVFGSAR

SEQ ID NO: 1117829 - protein, 27 aa, Mycobacterium
PGDVIVFKGPPNWNIGYKSIRSDNPAI

SEQ ID NO: 1117830 - protein, 21 aa, Mycobacterium
PGEGWMWLTAVAFVIAVAAVT

SEQ ID NO: 1117831 - protein, 26 aa, Mycobacterium
PGGGELRPVYNLTSARLVLGNPGTPV

SEQ ID NO: 1117832 - protein, 17 aa, Mycobacterium
PGGLDVLAAPSADQHTG

SEQ ID NO: 1117833 - protein, 24 aa, Mycobacterium
PGGRGIGLALVRLVTAQHGGVVDV

SEQ ID NO: 1117834 - protein, 24 aa, Mycobacterium
PGGVAGRYRVRLLLDGLVFALSLF

SEQ ID NO: 1117835 - protein, 24 aa, Mycobacterium
PGHRPPRAPLWVAVYGLTSMLLGG

SEQ ID NO: 1117836 - protein, 17 aa, Mycobacterium
PGIAPGFVAGYIATTVG

SEQ ID NO: 1117837 - protein, 19 aa, Mycobacterium
PGKSLLHRLPAGVKLVGLG

SEQ ID NO: 1117838 - protein, 17 aa, Mycobacterium
PGLMAHSLIPIVIGYVF

SEQ ID NO: 1117839 - protein, 25 aa, Mycobacterium
PGLPLWPYLLCAALAGFGGGNFASS

SEQ ID NO: 1117840 - protein, 19 aa, Mycobacterium
PGLRRAIGNVVALRPSAGQ

SEQ ID NO: 1117841 - protein, 27 aa, Mycobacterium
PGNGACFRLTLPLVRGHKVTTSPLPLK

SEQ ID NO: 1117842 - protein, 19 aa, Mycobacterium
PGQPWAALMNIAFVVQGVL

SEQ ID NO: 1117843 - protein, 25 aa, Mycobacterium
PGVMGFGVYLVWPAFYTDVTDSYRL

SEQ ID NO: 1117844 - protein, 23 aa, Mycobacterium
PHEMRAVLHFNRYCGHLVGVRCD

SEQ ID NO: 1117845 - protein, 20 aa, Mycobacterium
PHLFDRDGVDFATAPPPPNL

SEQ ID NO: 1117846 - protein, 17 aa, Mycobacterium
PHLPLPATALFVGAALP

SEQ ID NO: 1117847 - protein, 24 aa, Mycobacterium
PHVAEVLERVWSTLGGFIRTQALV

SEQ ID NO: 1117848 - protein, 23 aa, Mycobacterium
PIDDWAVAIALALRAFPMLVDEF

SEQ ID NO: 1117849 - protein, 20 aa, Mycobacterium
PIDLLWSFLQAVLMAITILL

SEQ ID NO: 1117850 - protein, 18 aa, Mycobacterium
PIGSLWYTVACFVVAALS

SEQ ID NO: 1117851 - protein, 17 aa, Mycobacterium
PILLVFSNFGPKSTIGV

SEQ ID NO: 1117852 - protein, 33 aa, Mycobacterium
PISELIAGVIAFLPRLLVAVIIIVVAAAIAAAV

SEQ ID NO: 1117853 - protein, 22 aa, Mycobacterium
PISWVHHWAWVVPLVLWLLSGP

SEQ ID NO: 1117854 - protein, 20 aa, Mycobacterium
PKGKFNYSWQGFTLDNWLDP

SEQ ID NO: 1117855 - protein, 25 aa, Mycobacterium
PKGSRRLGPMEAIPVSRTSSPYSLT

SEQ ID NO: 1117856 - protein, 18 aa, Mycobacterium
PLAAIAMVLIHFSLPARL

SEQ ID NO: 1117857 - protein, 25 aa, Mycobacterium
PLAAWPGPWLAVAWVIMVAAVVLTV

SEQ ID NO: 1117858 - protein, 20 aa, Mycobacterium
PLADKPRLAAGIPGGTTPVR

SEQ ID NO: 1117859 - protein, 22 aa, Mycobacterium
PLAVVWPSGWAWHQGAPHQSDY

SEQ ID NO: 1117860 - protein, 23 aa, Mycobacterium
PLDAKRAASIIAQVAAALDAAHA

SEQ ID NO: 1117861 - protein, 24 aa, Mycobacterium
PLDQPRIYFGPVIANTASDYAIVG

SEQ ID NO: 1117862 - protein, 22 aa, Mycobacterium
PLEREPVDLSRLVVDAVSDAHA

SEQ ID NO: 1117863 - protein, 20 aa, Mycobacterium
PLFDDPAGWLRHIVLPGLTV

SEQ ID NO: 1117864 - protein, 32 aa, Mycobacterium
PLGVVVGGPFLPLAVIMYWLANNIWTYGQQHY

SEQ ID NO: 1117865 - protein, 22 aa, Mycobacterium
PLHFLPFPVVAWIWQLAVVAGL

SEQ ID NO: 1117866 - protein, 28 aa, Mycobacterium
PLIWLSLAFGWGLLGIWAGLSTFMVLRL

SEQ ID NO: 1117867 - protein, 27 aa, Mycobacterium
PLLFALGDLVIGWLLLWQAKVANDALL

SEQ ID NO: 1117868 - protein, 19 aa, Mycobacterium
PLLGTGLCGGLTTFSTMQV

SEQ ID NO: 1117869 - protein, 19 aa, Mycobacterium
PLLHTWVGLPGAYSMVAWI

SEQ ID NO: 1117870 - protein, 21 aa, Mycobacterium
PLLIVGTAWLIARRFGPGAAR

SEQ ID NO: 1117871 - protein, 22 aa, Mycobacterium
PLLKKRLQGQWPPKDLKEGGYF

SEQ ID NO: 1117872 - protein, 30 aa, Mycobacterium
PLLRGLNHAANWCLRRVGVTPVDELADAQD

SEQ ID NO: 1117873 - protein, 19 aa, Mycobacterium
PLMRLRVTGWRAGIDEAIT

SEQ ID NO: 1117874 - protein, 24 aa, Mycobacterium
PLMVARWGRIAFYPLAVVPLVSLV

SEQ ID NO: 1117875 - protein, 28 aa, Mycobacterium
PLPTQIYWRRRALALGVAVVVIGIVAAV

SEQ ID NO: 1117876 - protein, 17 aa, Mycobacterium
PLQRGWNPFGLADAEVG

SEQ ID NO: 1117877 - protein, 19 aa, Mycobacterium
PLREVRPDLDPVLAGTIDR

SEQ ID NO: 1117878 - protein, 22 aa, Mycobacterium
PLRTGIFGIVLVTCLVLVSFGY

SEQ ID NO: 1117879 - protein, 18 aa, Mycobacterium
PLTALPFVVAGVLWQLGI

SEQ ID NO: 1117880 - protein, 24 aa, Mycobacterium
PLTGEYRGGPAYYLSRALSHTGAA

SEQ ID NO: 1117881 - protein, 25 aa, Mycobacterium
PLVGGLLGEISWRGPFFGVSALMVV

SEQ ID NO: 1117882 - protein, 20 aa, Mycobacterium
PLVICVALAFWQPGARRAVT

SEQ ID NO: 1117883 - protein, 25 aa, Mycobacterium
PLVISGWTLVVWVLMAMGSCIGYLA

SEQ ID NO: 1117884 - protein, 24 aa, Mycobacterium
PLVPRLRTGYNLPISNVPGPRTEM

SEQ ID NO: 1117885 - protein, 23 aa, Mycobacterium
PLWLWLVHSVDWLPDGARLWLPT

SEQ ID NO: 1117886 - protein, 24 aa, Mycobacterium
PLYCVALLMSFFSVRVITTAFYGQ

SEQ ID NO: 1117887 - protein, 19 aa, Mycobacterium
PMAQDRGAGWAALRGLGPV

SEQ ID NO: 1117888 - protein, 19 aa, Mycobacterium
PMMLAHALAAVALGLLICL

SEQ ID NO: 1117889 - protein, 18 aa, Mycobacterium
PMPHWLRVIAEWNPVSSL

SEQ ID NO: 1117890 - protein, 26 aa, Mycobacterium
PMTHMPRPEPRLVERNRGGSIGRWIA

SEQ ID NO: 1117891 - protein, 18 aa, Mycobacterium
PNAQWSVQRRLRREILRA

SEQ ID NO: 1117892 - protein, 20 aa, Mycobacterium
PNHFNIFGPYGYNGSSYFTL

SEQ ID NO: 1117893 - protein, 25 aa, Mycobacterium
PNPFPNFKNGVGLMLELPQPTTISS

SEQ ID NO: 1117894 - protein, 17 aa, Mycobacterium
PNQIRDCPAAGARCNQP

SEQ ID NO: 1117895 - protein, 28 aa, Mycobacterium
PNRPNRWRHLPAILLVASLVLLTVAMAG

SEQ ID NO: 1117896 - protein, 26 aa, Mycobacterium
PPACTVGFLPPSSWRSPDDESDIDTP

SEQ ID NO: 1117897 - protein, 23 aa, Mycobacterium
PPAPPMSRPQPRYPTGAQPHYPS

SEQ ID NO: 1117898 - protein, 18 aa, Mycobacterium
PPEIPPLFVMSLVEGESF

SEQ ID NO: 1117899 - protein, 17 aa, Mycobacterium
PPFRLPGYVTDQAGALS

SEQ ID NO: 1117900 - protein, 21 aa, Mycobacterium
PPGPREWLLAALHSRVSRVLT

SEQ ID NO: 1117901 - protein, 17 aa, Mycobacterium
PPKKISIGMVFVGAPVY

SEQ ID NO: 1117902 - protein, 19 aa, Mycobacterium
PPLGPVWVALLIVGAAAAV

SEQ ID NO: 1117903 - protein, 17 aa, Mycobacterium
PPLPRATTATVLPASGV

SEQ ID NO: 1117904 - protein, 21 aa, Mycobacterium
PPLVGLIADWTSLRIGLLTVP

SEQ ID NO: 1117905 - protein, 28 aa, Mycobacterium
PPPEGPKSPMWLWVLAGAVVLLVVALVI

SEQ ID NO: 1117906 - protein, 26 aa, Mycobacterium
PPPKKSKLWLILGLVALTVVVIAIAV

SEQ ID NO: 1117907 - protein, 41 aa, Mycobacterium
PPPPPSRWRQLPGRTRKAIFAAAILVCLTVSALALAAEPFS

SEQ ID NO: 1117908 - protein, 19 aa, Mycobacterium
PPRPSIMRRGISRAFDDVI

SEQ ID NO: 1117909 - protein, 19 aa, Mycobacterium
PPSEIGRSMGTTNWADIFS

SEQ ID NO: 1117910 - protein, 17 aa, Mycobacterium
PPSGIQRALPWVMGGCM

SEQ ID NO: 1117911 - protein, 26 aa, Mycobacterium
PQAKGVGLGLMVGWALVSLVTVGICT

SEQ ID NO: 1117912 - protein, 31 aa, Mycobacterium
PQDKRRRLRRPGWSTVVAVLAVFVTAASLAA

SEQ ID NO: 1117913 - protein, 25 aa, Mycobacterium
PQFPERERLVFYAFVVIVVTLLLQG

SEQ ID NO: 1117914 - protein, 19 aa, Mycobacterium
PQFREFAGFVNGRIGQEAK

SEQ ID NO: 1117915 - protein, 20 aa, Mycobacterium
PQLSAFASRTDTVLVVATSI

SEQ ID NO: 1117916 - protein, 19 aa, Mycobacterium
PQQLWSMATSVKYRAVFAE

SEQ ID NO: 1117917 - protein, 19 aa, Mycobacterium
PQRISWRMGGMIAAVGSVL

SEQ ID NO: 1117918 - protein, 21 aa, Mycobacterium
PQRRAILHLPTHWPWAQQWLT

SEQ ID NO: 1117919 - protein, 18 aa, Mycobacterium
PQRSGRISGIGWASGYLG

SEQ ID NO: 1117920 - protein, 19 aa, Mycobacterium
PQVTAAFRDLLARYWRPIL

SEQ ID NO: 1117921 - protein, 17 aa, Mycobacterium
PRADHVEALACLALDMA

SEQ ID NO: 1117922 - protein, 18 aa, Mycobacterium
PREAEPLAVRRAVRGAAI

SEQ ID NO: 1117923 - protein, 17 aa, Mycobacterium
PRFVTGIGFPGVPIEEL

SEQ ID NO: 1117924 - protein, 18 aa, Mycobacterium
PRGDLMAAAPLWFHIHVI

SEQ ID NO: 1117925 - protein, 20 aa, Mycobacterium
PRILPAEALLAANGVEGVVR

SEQ ID NO: 1117926 - protein, 37 aa, Mycobacterium
PRKVAALIPDEWDAVLRFGYWPALFLSLLVAVNILYR

SEQ ID NO: 1117927 - protein, 20 aa, Mycobacterium
PRLDATLQRLPEIYRKLARV

SEQ ID NO: 1117928 - protein, 21 aa, Mycobacterium
PRLRDEMAYRIAGEVVSRISP

SEQ ID NO: 1117929 - protein, 23 aa, Mycobacterium
PRLRDRIIERLPIINRFHEPQYP

SEQ ID NO: 1117930 - protein, 22 aa, Mycobacterium
PRPRDLAPLLAAWIASIAVMIF

SEQ ID NO: 1117931 - protein, 23 aa, Mycobacterium
PRPVAVLPPDSMRQFAWAGEAPV

SEQ ID NO: 1117932 - protein, 21 aa, Mycobacterium
PRRHPYGIVFGRVIAPRLGPV

SEQ ID NO: 1117933 - protein, 18 aa, Mycobacterium
PRRISFNVDREAVGQVGE

SEQ ID NO: 1117934 - protein, 18 aa, Mycobacterium
PRSKRRMIIAATLVVLVV

SEQ ID NO: 1117935 - protein, 17 aa, Mycobacterium
PRSSLLVLGDGRNNYRN

SEQ ID NO: 1117936 - protein, 22 aa, Mycobacterium
PRTDDMRALFTAIINDDPLPGE

SEQ ID NO: 1117937 - protein, 20 aa, Mycobacterium
PRTIGLGAQHVVAMFGATFL

SEQ ID NO: 1117938 - protein, 29 aa, Mycobacterium
PRTIRALAVPIILVWIAIVAVLNVIVPQL

SEQ ID NO: 1117939 - protein, 18 aa, Mycobacterium
PRTLHLRDGLLAPASATA

SEQ ID NO: 1117940 - protein, 23 aa, Mycobacterium
PRVVSQFRKPASLVGRLGDHILF

SEQ ID NO: 1117941 - protein, 26 aa, Mycobacterium
PRWRARAVGIYRLWRDSGYAAGAVVG

SEQ ID NO: 1117942 - protein, 21 aa, Mycobacterium
PRYEDIITMHECRSAKQLAAV

SEQ ID NO: 1117943 - protein, 21 aa, Mycobacterium
PSAALVTWGPLLSAVAYQVFT

SEQ ID NO: 1117944 - protein, 23 aa, Mycobacterium
PSAFGRGPLKWIYATLGLLMAAT

SEQ ID NO: 1117945 - protein, 31 aa, Mycobacterium
PSGDFALTISDPVACTVGFLPPSQWRSPEDM

SEQ ID NO: 1117946 - protein, 31 aa, Mycobacterium
PSGDIAIAVPAHWGTATVYALRNALRTNPVF

SEQ ID NO: 1117947 - protein, 17 aa, Mycobacterium
PSGFGFGLGNVILVVNV

SEQ ID NO: 1117948 - protein, 30 aa, Mycobacterium
PSPELRPGRLQAVATWGPWVSIGLAVLTAV

SEQ ID NO: 1117949 - protein, 17 aa, Mycobacterium
PSPNPGWGEPPRQQQPY

SEQ ID NO: 1117950 - protein, 17 aa, Mycobacterium
PSSGVSVDFPSALRQAD

SEQ ID NO: 1117951 - protein, 20 aa, Mycobacterium
PSYLRSSAGPLFGGGTVADD

SEQ ID NO: 1117952 - protein, 27 aa, Mycobacterium
PTADPGWKWLWWQYALADTRYVSGNPW

SEQ ID NO: 1117953 - protein, 18 aa, Mycobacterium
PTAELFVVMAATTVTAAM

SEQ ID NO: 1117954 - protein, 25 aa, Mycobacterium
PTAKEARRSVVWAIALIGAFYLFTL

SEQ ID NO: 1117955 - protein, 23 aa, Mycobacterium
PTERTRRAFGWLALLIGATIVGS

SEQ ID NO: 1117956 - protein, 19 aa, Mycobacterium
PTFGDWGFALARRGPTPPA

SEQ ID NO: 1117957 - protein, 19 aa, Mycobacterium
PTFMKAILFTWTAVIVVGM

SEQ ID NO: 1117958 - protein, 18 aa, Mycobacterium
PTGALFRTEFSTVVVQQD

SEQ ID NO: 1117959 - protein, 25 aa, Mycobacterium
PTHWPWAQQWLTLWRNTIGHSPPTA

SEQ ID NO: 1117960 - protein, 26 aa, Mycobacterium
PTHWQEWPAAGVFFVSIAVFQLIWAF

SEQ ID NO: 1117961 - protein, 19 aa, Mycobacterium
PTLLALRFLLGVAEAGLFP

SEQ ID NO: 1117962 - protein, 17 aa, Mycobacterium
PTLMWPLSQDVWSLQPE

SEQ ID NO: 1117963 - protein, 27 aa, Mycobacterium
PTLPWYQEFLRYYFLTVEESVDGSLTR

SEQ ID NO: 1117964 - protein, 20 aa, Mycobacterium
PTPGRTAIQLAVDASGVAPT

SEQ ID NO: 1117965 - protein, 28 aa, Mycobacterium
PTPRPVERSFWYRAARAVTRRGGALSVA

SEQ ID NO: 1117966 - protein, 20 aa, Mycobacterium
PTPWTALGAVCFAVSDAMIG

SEQ ID NO: 1117967 - protein, 18 aa, Mycobacterium
PTSFVLVWIDKLGTVNGE

SEQ ID NO: 1117968 - protein, 33 aa, Mycobacterium
PTSVTLRLAAPIEALFGFMLLTAAVSWVLEIYP

SEQ ID NO: 1117969 - protein, 19 aa, Mycobacterium
PTVGPWALYGLLFTIVILF

SEQ ID NO: 1117970 - protein, 21 aa, Mycobacterium
PVAGRLPGHMNVLLAEAKVPY

SEQ ID NO: 1117971 - protein, 21 aa, Mycobacterium
PVDLLWSFLQAILMALTVLFI

SEQ ID NO: 1117972 - protein, 25 aa, Mycobacterium
PVEIGCLQARLGYFNERQNLLTRFF

SEQ ID NO: 1117973 - protein, 18 aa, Mycobacterium
PVGGILFGHFGDRIGRKS

SEQ ID NO: 1117974 - protein, 22 aa, Mycobacterium
PVGRMGIAVLFARMLLGNLQPG

SEQ ID NO: 1117975 - protein, 22 aa, Mycobacterium
PVHPVTLWRGRLSVALDALETA

SEQ ID NO: 1117976 - protein, 20 aa, Mycobacterium
PVIFAHLSFVLPLVTWFLIG

SEQ ID NO: 1117977 - protein, 25 aa, Mycobacterium
PVIRLPRPQLPPIFRDDDEPERPSW

SEQ ID NO: 1117978 - protein, 18 aa, Mycobacterium
PVLIRLGVLIGIAAAQGM

SEQ ID NO: 1117979 - protein, 18 aa, Mycobacterium
PVLLVGWLLAIPVPLLLI

SEQ ID NO: 1117980 - protein, 26 aa, Mycobacterium
PVRRRGRFLVALGMGGMGYSFGAGIG

SEQ ID NO: 1117981 - protein, 24 aa, Mycobacterium
PVSWIHHWVWVIPLIIWLIHGPWR

SEQ ID NO: 1117982 - protein, 25 aa, Mycobacterium
PVVSVAAKVDWPRFTALVTSESSVA

SEQ ID NO: 1117983 - protein, 23 aa, Mycobacterium
PWDWQRWAPASPWATPPATVMVL

SEQ ID NO: 1117984 - protein, 27 aa, Mycobacterium
PWLTFLRALPPLAYFFLLVIWLGIDEA

SEQ ID NO: 1117985 - protein, 20 aa, Mycobacterium
PWYGDPNQIRDCPAAGARCN

SEQ ID NO: 1117986 - protein, 23 aa, Mycobacterium
PYAALSLIVPLLFMPLTIVAAGM

SEQ ID NO: 1117987 - protein, 17 aa, Mycobacterium
PYEGSIYQWTRRLAGEV

SEQ ID NO: 1117988 - protein, 17 aa, Mycobacterium
QAALARLLGPLSPADRL

SEQ ID NO: 1117989 - protein, 22 aa, Mycobacterium
QAAVRRYLGPRFDPNSRFTISM

SEQ ID NO: 1117990 - protein, 27 aa, Mycobacterium
QAEPGLPTRGLIALCDFGGSGTSITVV

SEQ ID NO: 1117991 - protein, 17 aa, Mycobacterium
QAPLPLRAAFECYCLGL

SEQ ID NO: 1117992 - protein, 20 aa, Mycobacterium
QAPVMYRIVRELSNAAHQPM

SEQ ID NO: 1117993 - protein, 27 aa, Mycobacterium
QAREFLEQSWFVARVSLAPTLLVAIPF

SEQ ID NO: 1117994 - protein, 23 aa, Mycobacterium
QARVDGFTRWQAFRLVVLPQVLP

SEQ ID NO: 1117995 - protein, 23 aa, Mycobacterium
QATPTRRALLLTALGGLLIAGFV

SEQ ID NO: 1117996 - protein, 21 aa, Mycobacterium
QAVLTLASAVARMYRPQSPVV

SEQ ID NO: 1117997 - protein, 25 aa, Mycobacterium
QAYASCDSCAAVAVAYQVVFVIDSD

SEQ ID NO: 1117998 - protein, 23 aa, Mycobacterium
QCPTARGGVLLVIGASPSSGSAE

SEQ ID NO: 1117999 - protein, 24 aa, Mycobacterium
QDAGLSWLLLVSIPVLAVANYWIV

SEQ ID NO: 1118000 - protein, 17 aa, Mycobacterium
QDNPAAVARAIMDDPPP

SEQ ID NO: 1118001 - protein, 28 aa, Mycobacterium
QDSPIGVRGARNYPCMGQPGKRAATAEQ

SEQ ID NO: 1118002 - protein, 28 aa, Mycobacterium
QDSPISVRGARNYPCIEHPGKRAPTVEL

SEQ ID NO: 1118003 - protein, 20 aa, Mycobacterium
QDVPSPWVRITKRIVIAFAV

SEQ ID NO: 1118004 - protein, 20 aa, Mycobacterium
QEAAVGWLNRLKVLARRMCV

SEQ ID NO: 1118005 - protein, 17 aa, Mycobacterium
QEAKLSWPNATTYLSPH

SEQ ID NO: 1118006 - protein, 25 aa, Mycobacterium
QEATAIPWHLVKWQLAAMAMLVVAS

SEQ ID NO: 1118007 - protein, 19 aa, Mycobacterium
QELFQARGLMQYGSVHGHG

SEQ ID NO: 1118008 - protein, 25 aa, Mycobacterium
QELIPYLVQFPRFYNGELTLGQLTQ

SEQ ID NO: 1118009 - protein, 22 aa, Mycobacterium
QEPRAWRMRVTVQKVGNDAKVA

SEQ ID NO: 1118010 - protein, 18 aa, Mycobacterium
QEPYLLGCLNARNELSLI

SEQ ID NO: 1118011 - protein, 33 aa, Mycobacterium
QERDRLRDLFGRHVGPEVVRRAEAATGAEGGVR

SEQ ID NO: 1118012 - protein, 19 aa, Mycobacterium
QFSTIARRQMRLIVSDRGY

SEQ ID NO: 1118013 - protein, 19 aa, Mycobacterium
QGFVGHYARCESGGSPAAM

SEQ ID NO: 1118014 - protein, 29 aa, Mycobacterium
QGGLSTVWLLSGFFFLFPVIIARRKYADR

SEQ ID NO: 1118015 - protein, 21 aa, Mycobacterium
QGWTLPPLIRWLQPSFEHDRQ

SEQ ID NO: 1118016 - protein, 19 aa, Mycobacterium
QHLRPSKAWVARHTGAIAA

SEQ ID NO: 1118017 - protein, 24 aa, Mycobacterium
QHRRRTETWWAWQASGLFLITLMV

SEQ ID NO: 1118018 - protein, 18 aa, Mycobacterium
QIGLLVFMIVASKGAAGV

SEQ ID NO: 1118019 - protein, 19 aa, Mycobacterium
QILTASGFRNSVPAEVDST

SEQ ID NO: 1118020 - protein, 19 aa, Mycobacterium
QIVVPPLVWSPRPDDAQAV

SEQ ID NO: 1118021 - protein, 18 aa, Mycobacterium
QKARAAGIHLVLATQRPS

SEQ ID NO: 1118022 - protein, 25 aa, Mycobacterium
QKAWRNLRFPLAWAPPEANVARIVA

SEQ ID NO: 1118023 - protein, 17 aa, Mycobacterium
QKLVHYFGIEWPWSTLI

SEQ ID NO: 1118024 - protein, 22 aa, Mycobacterium
QKRWRPAVALMLALWLVAVGFE

SEQ ID NO: 1118025 - protein, 24 aa, Mycobacterium
QLEASCYNPAYLGDQPRVFINEAR

SEQ ID NO: 1118026 - protein, 19 aa, Mycobacterium
QLFFLLGGLLKRLVYLSQG

SEQ ID NO: 1118027 - protein, 26 aa, Mycobacterium
QLFVLLCGIVGPIFLAIYFATGPDPM

SEQ ID NO: 1118028 - protein, 23 aa, Mycobacterium
QLGITICSILLGRVGEPAVAHLL

SEQ ID NO: 1118029 - protein, 21 aa, Mycobacterium
QLHEAAVLRFGRLRGPDLRGS

SEQ ID NO: 1118030 - protein, 22 aa, Mycobacterium
QLHPVLNLTSARLIAGRADNPT

SEQ ID NO: 1118031 - protein, 26 aa, Mycobacterium
QLIFLYNVLPQWGWQLSSETTAVLGL

SEQ ID NO: 1118032 - protein, 22 aa, Mycobacterium
QLIRRLVVFLVRQLNRVAPPRV

SEQ ID NO: 1118033 - protein, 17 aa, Mycobacterium
QLLLCGIIVPRNALPEW

SEQ ID NO: 1118034 - protein, 18 aa, Mycobacterium
QLMLPRPLAHPVKELAKT

SEQ ID NO: 1118035 - protein, 26 aa, Mycobacterium
QLPNWAEAAMAFWASAFLGAVVVPIV

SEQ ID NO: 1118036 - protein, 18 aa, Mycobacterium
QLRWWEWTLDNPLNQPFF

SEQ ID NO: 1118037 - protein, 18 aa, Mycobacterium
QLSMCFVLLITGVGSLIH

SEQ ID NO: 1118038 - protein, 17 aa, Mycobacterium
QLVAFARAFLADPAVLI

SEQ ID NO: 1118039 - protein, 19 aa, Mycobacterium
QLWSQVGGFHRMLCTDSAE

SEQ ID NO: 1118040 - protein, 22 aa, Mycobacterium
QMLFGPELWQWVDPENVSRTGA

SEQ ID NO: 1118041 - protein, 28 aa, Mycobacterium
QMLSFRFAPELMVIVPLFVIYNQIGLFD

SEQ ID NO: 1118042 - protein, 23 aa, Mycobacterium
QMQVGSLIAFLSYFMQILMAVLM

SEQ ID NO: 1118043 - protein, 26 aa, Mycobacterium
QPDIWEISRPWYLAWAEMVYIVASLS

SEQ ID NO: 1118044 - protein, 19 aa, Mycobacterium
QPGRPDWQSVESVASPAWY

SEQ ID NO: 1118045 - protein, 23 aa, Mycobacterium
QPPPCLTGFLPASEWRAPADTSM

SEQ ID NO: 1118046 - protein, 17 aa, Mycobacterium
QPVPSPWPSPGPGLPPK

SEQ ID NO: 1118047 - protein, 22 aa, Mycobacterium
QPWTWTNARGWLEVLPGAVTVV

SEQ ID NO: 1118048 - protein, 18 aa, Mycobacterium
QQAALTLVAELTRLYRPM

SEQ ID NO: 1118049 - protein, 18 aa, Mycobacterium
QQLIRELRSHLGTESVAR

SEQ ID NO: 1118050 - protein, 23 aa, Mycobacterium
QQVRWKKSFIRNLCFTGSFMWRR

SEQ ID NO: 1118051 - protein, 19 aa, Mycobacterium
QQWWIPVMPGLGVLVLALV

SEQ ID NO: 1118052 - protein, 18 aa, Mycobacterium
QRGPLPALERLLQTLRDT

SEQ ID NO: 1118053 - protein, 20 aa, Mycobacterium
QRIGPVWAVAVGYAVACQVP

SEQ ID NO: 1118054 - protein, 20 aa, Mycobacterium
QRKEHVWSSFVWGLAVSPVL

SEQ ID NO: 1118055 - protein, 20 aa, Mycobacterium
QRRSQLWQAFQIQRKEDKRL

SEQ ID NO: 1118056 - protein, 20 aa, Mycobacterium
QRSRWYKGYLQTMLVHLRAP

SEQ ID NO: 1118057 - protein, 25 aa, Mycobacterium
QSFLPRLAILVVVAFFITVAVYGVV

SEQ ID NO: 1118058 - protein, 24 aa, Mycobacterium
QSGSRAAADIADWVQARYPGRTVD

SEQ ID NO: 1118059 - protein, 24 aa, Mycobacterium
QSSMKEIFVAAAIQGLIVGVVRAA

SEQ ID NO: 1118060 - protein, 17 aa, Mycobacterium
QSTVRALVWSQIGIGAA

SEQ ID NO: 1118061 - protein, 23 aa, Mycobacterium
QTDGLSLLDCFYYATVSLSTTGY

SEQ ID NO: 1118062 - protein, 28 aa, Mycobacterium
QTEAVLLLLRFLIALPIGALLGGWLASR

SEQ ID NO: 1118063 - protein, 17 aa, Mycobacterium
QTLGPAVALCFAIGLLA

SEQ ID NO: 1118064 - protein, 17 aa, Mycobacterium
QVFGWPGIGQYIAQSIP

SEQ ID NO: 1118065 - protein, 32 aa, Mycobacterium
QVHLRISVGLTRFIGWCQWASVVGLIGGLFWR

SEQ ID NO: 1118066 - protein, 18 aa, Mycobacterium
QWASVVGLIGGLFWRPLA

SEQ ID NO: 1118067 - protein, 22 aa, Mycobacterium
QWDRIAVCWQLAQTHGLSIAAL

SEQ ID NO: 1118068 - protein, 25 aa, Mycobacterium
QWHRLRWQIPGSLLGAMAGAWLLLH

SEQ ID NO: 1118069 - protein, 18 aa, Mycobacterium
QYVRDCLINTLYEGTTAI

SEQ ID NO: 1118070 - protein, 19 aa, Mycobacterium
QYWVPAGAVAFGLIVLTNA

SEQ ID NO: 1118071 - protein, 21 aa, Mycobacterium
RAAGFPGWVPVVGAGAAVAAL

SEQ ID NO: 1118072 - protein, 21 aa, Mycobacterium
RAAGQSFALLVFAIRRGSMLA

SEQ ID NO: 1118073 - protein, 23 aa, Mycobacterium
RAALRSAGELSLLLAGAQLGITA

SEQ ID NO: 1118074 - protein, 19 aa, Mycobacterium
RAARGGVLVKDRLSLESMR

SEQ ID NO: 1118075 - protein, 23 aa, Mycobacterium
RAARLRSVSTIATLVLLVVLFGA

SEQ ID NO: 1118076 - protein, 31 aa, Mycobacterium
RAAVLRLPIAVAFRRHWRQILLVAGAYLSQG

SEQ ID NO: 1118077 - protein, 24 aa, Mycobacterium
RAAVYGEPWYNTWGAFVYIGVILG

SEQ ID NO: 1118078 - protein, 20 aa, Mycobacterium
RADETLALIRRGDEEVRKQS

SEQ ID NO: 1118079 - protein, 28 aa, Mycobacterium
RAEVAAIPLVCVVLFFVFGGVIAAALPG

SEQ ID NO: 1118080 - protein, 19 aa, Mycobacterium
RAEVLRRQKRGLLPGQQPR

SEQ ID NO: 1118081 - protein, 23 aa, Mycobacterium
RAHLVLRFDQGRWVAIDNGSLNG

SEQ ID NO: 1118082 - protein, 20 aa, Mycobacterium
RAHPEDVMLCVANPVTEPTT

SEQ ID NO: 1118083 - protein, 17 aa, Mycobacterium
RAIAPWYLVTAAANCSW

SEQ ID NO: 1118084 - protein, 17 aa, Mycobacterium
RALLLCFLITAGGTVAF

SEQ ID NO: 1118085 - protein, 19 aa, Mycobacterium
RALPPGWKPGSKAAPAPEL

SEQ ID NO: 1118086 - protein, 17 aa, Mycobacterium
RANELRALLAERIARLK

SEQ ID NO: 1118087 - protein, 26 aa, Mycobacterium
RANGPWGKVIDMLAIFATLFGSAASL

SEQ ID NO: 1118088 - protein, 19 aa, Mycobacterium
RAPAGPMRILIGLAGVGLA

SEQ ID NO: 1118089 - protein, 23 aa, Mycobacterium
RAQAYWTKLGWSERGPIKTQSRI

SEQ ID NO: 1118090 - protein, 19 aa, Mycobacterium
RARALRMPFYRTVISVANW

SEQ ID NO: 1118091 - protein, 18 aa, Mycobacterium
RARTLNWHGAVGGWIACG

SEQ ID NO: 1118092 - protein, 18 aa, Mycobacterium
RATARLAAEELLRTGGLN

SEQ ID NO: 1118093 - protein, 24 aa, Mycobacterium
RATLREMLVPLVPAAVIALALIVA

SEQ ID NO: 1118094 - protein, 22 aa, Mycobacterium
RAVAVAGTALWALVVMYAVATS

SEQ ID NO: 1118095 - protein, 17 aa, Mycobacterium
RAVMLAAAVGVLFGLVA

SEQ ID NO: 1118096 - protein, 23 aa, Mycobacterium
RAVTWRLPLVLLTASVVLLTVSD

SEQ ID NO: 1118097 - protein, 19 aa, Mycobacterium
RAVVHAANLGAQVINISEA

SEQ ID NO: 1118098 - protein, 27 aa, Mycobacterium
RCAATLAVAVLSYWLLERPIRRWRPAT

SEQ ID NO: 1118099 - protein, 26 aa, Mycobacterium
RDALRLRLGCLVPFVNLFFAPVYVLE

SEQ ID NO: 1118100 - protein, 24 aa, Mycobacterium
RDGGEAALGRLLLRELAHVLDTVA

SEQ ID NO: 1118101 - protein, 26 aa, Mycobacterium
RDGLGLKFVLYLAFAGVLIGASVYQI

SEQ ID NO: 1118102 - protein, 19 aa, Mycobacterium
RDGRQWAAIRRRRGADENR

SEQ ID NO: 1118103 - protein, 21 aa, Mycobacterium
RDGVPLLPFFAVLTIFLLIPT

SEQ ID NO: 1118104 - protein, 22 aa, Mycobacterium
RDIPKAGIWGLISLVGCGAIVF

SEQ ID NO: 1118105 - protein, 18 aa, Mycobacterium
RDLMGVPRMGFWDHPLTA

SEQ ID NO: 1118106 - protein, 32 aa, Mycobacterium
RDLPAAPTRWLILRIPLGTVWAEELAYRGALG

SEQ ID NO: 1118107 - protein, 20 aa, Mycobacterium
RDLPKAVLFSLAFIAIVVAY

SEQ ID NO: 1118108 - protein, 17 aa, Mycobacterium
RDLRWALHPYGVDLMVV

SEQ ID NO: 1118109 - protein, 20 aa, Mycobacterium
RDPMTFFFGVVFPIFMLLVL

SEQ ID NO: 1118110 - protein, 25 aa, Mycobacterium
RDRLLRLAMRADAVLTGLVGVAAVP

SEQ ID NO: 1118111 - protein, 23 aa, Mycobacterium
RDTIWLPTKWLLAGGDPYDGAAY

SEQ ID NO: 1118112 - protein, 17 aa, Mycobacterium
RDTWVISLLYIGTFGSF

SEQ ID NO: 1118113 - protein, 22 aa, Mycobacterium
RDVLVFICTVLFTVVWWHVSHS

SEQ ID NO: 1118114 - protein, 29 aa, Mycobacterium
RDVRGARRWRDRLGYAFGPPGWKPVENRH

SEQ ID NO: 1118115 - protein, 26 aa, Mycobacterium
RDYDIERLWSLIGLVPQRGYLFTGTV

SEQ ID NO: 1118116 - protein, 17 aa, Mycobacterium
REALLHSIREGVVAVNT

SEQ ID NO: 1118117 - protein, 19 aa, Mycobacterium
REAWRGEACCAAPPRDAAN

SEQ ID NO: 1118118 - protein, 17 aa, Mycobacterium
REEELRVPIGVTATGEP

SEQ ID NO: 1118119 - protein, 30 aa, Mycobacterium
REFMEVRHAPAWLCRLTDGWVVLIGTALIG

SEQ ID NO: 1118120 - protein, 21 aa, Mycobacterium
REILVLAGFLLLIWLPALRCP

SEQ ID NO: 1118121 - protein, 21 aa, Mycobacterium
REITRPVLDYVKRVTKESPRT

SEQ ID NO: 1118122 - protein, 18 aa, Mycobacterium
RELGETVEALSAKLDVKQ

SEQ ID NO: 1118123 - protein, 21 aa, Mycobacterium
RELGVTVLRFAVLRHGVIPAS

SEQ ID NO: 1118124 - protein, 20 aa, Mycobacterium
RELPGYWAPFASPAFTLLAI

SEQ ID NO: 1118125 - protein, 18 aa, Mycobacterium
RELRRARVGGPREYFSDT

SEQ ID NO: 1118126 - protein, 21 aa, Mycobacterium
RENRPPYPVRLGYWPAAFGLF

SEQ ID NO: 1118127 - protein, 25 aa, Mycobacterium
REPSPRPAQVFVVAWAGMRGVVSLA

SEQ ID NO: 1118128 - protein, 20 aa, Mycobacterium
REQPWTPIIVIIVVTTVKVI

SEQ ID NO: 1118129 - protein, 21 aa, Mycobacterium
RERAWHLLVVPVYRIIYEPLR

SEQ ID NO: 1118130 - protein, 17 aa, Mycobacterium
RERVIMLTFMIGGLLAG

SEQ ID NO: 1118131 - protein, 23 aa, Mycobacterium
RETWSAIKGRSTFTAAYSAPGGP

SEQ ID NO: 1118132 - protein, 17 aa, Mycobacterium
REVGFPLLTPAFLGSLL

SEQ ID NO: 1118133 - protein, 22 aa, Mycobacterium
REVPETVRAMFSTRGYRDEDYD

SEQ ID NO: 1118134 - protein, 20 aa, Mycobacterium
REYRVVAALADTPVPVARAV

SEQ ID NO: 1118135 - protein, 19 aa, Mycobacterium
REYVDAAVILAVVLVNAVI

SEQ ID NO: 1118136 - protein, 19 aa, Mycobacterium
RFALSPIPLYLLAGLAVGE

SEQ ID NO: 1118137 - protein, 19 aa, Mycobacterium
RFILWVVGCFAVLGLTVWA

SEQ ID NO: 1118138 - protein, 19 aa, Mycobacterium
RFIYATAIVWILGGLGTWL

SEQ ID NO: 1118139 - protein, 23 aa, Mycobacterium
RFKTFLLLVGMSALIVFVGSLFG

SEQ ID NO: 1118140 - protein, 18 aa, Mycobacterium
RFLVASVICGVVISAATI

SEQ ID NO: 1118141 - protein, 25 aa, Mycobacterium
RFLVPEWGVALVLVASAALVAAGGR

SEQ ID NO: 1118142 - protein, 17 aa, Mycobacterium
RFRPFLKQQVRWKKSFI

SEQ ID NO: 1118143 - protein, 18 aa, Mycobacterium
RFVLVEGATGDGATVDSG

SEQ ID NO: 1118144 - protein, 20 aa, Mycobacterium
RGAFTPEVKLRMIAERSGLS

SEQ ID NO: 1118145 - protein, 18 aa, Mycobacterium
RGALRAWIAQAVTWHDPS

SEQ ID NO: 1118146 - protein, 21 aa, Mycobacterium
RGEKGRRGLDWARRELDEHGG

SEQ ID NO: 1118147 - protein, 18 aa, Mycobacterium
RGELRIYLGAAPGVGKTY

SEQ ID NO: 1118148 - protein, 20 aa, Mycobacterium
RGEPVKPLRLFLQSNNYLAV

SEQ ID NO: 1118149 - protein, 20 aa, Mycobacterium
RGEVVSLGFVISLWAGSSAI

SEQ ID NO: 1118150 - protein, 25 aa, Mycobacterium
RGEYDGRLWISMDFVDGHDAARLLV

SEQ ID NO: 1118151 - protein, 25 aa, Mycobacterium
RGFVFPMSAAFLIWYTTYVLLSTFA

SEQ ID NO: 1118152 - protein, 26 aa, Mycobacterium
RGFWIRRARRLLPALLAMVAAVVAAR

SEQ ID NO: 1118153 - protein, 18 aa, Mycobacterium
RGGMVFAAVCAGALIIII

SEQ ID NO: 1118154 - protein, 24 aa, Mycobacterium
RGGPRLLDVVTIVFFFGVTMVAMG

SEQ ID NO: 1118155 - protein, 18 aa, Mycobacterium
RGLFSRRVNITALLFLGG

SEQ ID NO: 1118156 - protein, 19 aa, Mycobacterium
RGLISPHRLLTVLLAEHDE

SEQ ID NO: 1118157 - protein, 24 aa, Mycobacterium
RGMRPSWRSLRLVLLVTAAWAAVT

SEQ ID NO: 1118158 - protein, 26 aa, Mycobacterium
RGQAEAASALGLRWGQTQRSILLPQA

SEQ ID NO: 1118159 - protein, 17 aa, Mycobacterium
RGQFWIWAGANIAPINW

SEQ ID NO: 1118160 - protein, 22 aa, Mycobacterium
RGRIPEYVLVGLVTVLIAGGLG

SEQ ID NO: 1118161 - protein, 23 aa, Mycobacterium
RGSRAARLFAVMMLIGVLAPITA

SEQ ID NO: 1118162 - protein, 24 aa, Mycobacterium
RGTFPRLRSALIVEGAGAAVGGAS

SEQ ID NO: 1118163 - protein, 19 aa, Mycobacterium
RGTTTIVFGLLAFNVLDGG

SEQ ID NO: 1118164 - protein, 20 aa, Mycobacterium
RGTWEPGPWNLGRFGTPVAV

SEQ ID NO: 1118165 - protein, 23 aa, Mycobacterium
RHGEPFRMWKFRSMQPEADARLA

SEQ ID NO: 1118166 - protein, 25 aa, Mycobacterium
RHIVRCLRRARALGANCVEVKKEAN

SEQ ID NO: 1118167 - protein, 25 aa, Mycobacterium
RHQVSGWRFVMRRTASGVALHDTRM

SEQ ID NO: 1118168 - protein, 21 aa, Mycobacterium
RIAEPQWGPPVGRVLSQLLQE

SEQ ID NO: 1118169 - protein, 25 aa, Mycobacterium
RIAIGSLRNKLLFILPAALLLSQFV

SEQ ID NO: 1118170 - protein, 23 aa, Mycobacterium
RIGRLRVDPLLARKHREHHVDPR

SEQ ID NO: 1118171 - protein, 36 aa, Mycobacterium; identical to SEQ ID NO: 160134

SEQ ID NO: 1118172 - protein, 19 aa, Mycobacterium
RILLLGSVGGFALRRALRP

SEQ ID NO: 1118173 - protein, 21 aa, Mycobacterium
RILLVSGLLVAGSWWLFEWEL

SEQ ID NO: 1118174 - protein, 19 aa, Mycobacterium
RIRDLERPLADRAQTSELG

SEQ ID NO: 1118175 - protein, 20 aa, Mycobacterium
RIRTAIGPSQEWYTENLRYY

SEQ ID NO: 1118176 - protein, 26 aa, Mycobacterium
RITGFLRIVLLAAILGAALSSSFTVA

SEQ ID NO: 1118177 - protein, 19 aa, Mycobacterium
RITLPGSIYLGLIAVLPNL

SEQ ID NO: 1118178 - protein, 27 aa, Mycobacterium
RKAMPRMGFPPDVRRSSWVTAETAVVG

SEQ ID NO: 1118179 - protein, 17 aa, Mycobacterium
RKEIVRLIAEISMGAGT

SEQ ID NO: 1118180 - protein, 20 aa, Mycobacterium
RKEYLRYLSGLRTRVTSSAA

SEQ ID NO: 1118181 - protein, 17 aa, Mycobacterium
RKFPQYKDVAGKDAFPA

SEQ ID NO: 1118182 - protein, 19 aa, Mycobacterium
RKGAASSVAEWIRSEGGSV

SEQ ID NO: 1118183 - protein, 17 aa, Mycobacterium
RKISAWVAIAAVPTALA

SEQ ID NO: 1118184 - protein, 17 aa, Mycobacterium
RKKRKPEVSPRQDVDDA

SEQ ID NO: 1118185 - protein, 28 aa, Mycobacterium
RKQTWLGRFVSTYGWRAYALPILAVLTV

SEQ ID NO: 1118186 - protein, 20 aa, Mycobacterium
RKRWTYGNIQALWKHRAMLF

SEQ ID NO: 1118187 - protein, 18 aa, Mycobacterium
RKVIWPNRKQMVSYTSVV

SEQ ID NO: 1118188 - protein, 18 aa, Mycobacterium
RLAALVADERARRWTTVL

SEQ ID NO: 1118189 - protein, 17 aa, Mycobacterium
RLAARRGARVTGVDPSD

SEQ ID NO: 1118190 - protein, 25 aa, Mycobacterium
RLADRAAGWLFWFALATAAVTAVVW

SEQ ID NO: 1118191 - protein, 17 aa, Mycobacterium
RLADRVSAVFVPVVIGL

SEQ ID NO: 1118192 - protein, 28 aa, Mycobacterium
RLAGRRVTRGEWLWALLLTAALTVFVAL

SEQ ID NO: 1118193 - protein, 19 aa, Mycobacterium
RLAQLAFLVVAAFLLTNKV

SEQ ID NO: 1118194 - protein, 19 aa, Mycobacterium
RLASAQHAKSIIVATNRDD

SEQ ID NO: 1118195 - protein, 18 aa, Mycobacterium
RLASPRAVLTAAIASLAV

SEQ ID NO: 1118196 - protein, 26 aa, Mycobacterium
RLDRRLDEAAGFAIPFLPRGLDTIPK

SEQ ID NO: 1118197 - protein, 25 aa, Mycobacterium
RLDRSGPMWSGCLIDGLDDGRFAWF

SEQ ID NO: 1118198 - protein, 23 aa, Mycobacterium
RLELWRSDMVRMLSYGALDARVK

SEQ ID NO: 1118199 - protein, 22 aa, Mycobacterium
RLETRLMMLLGAGFGLGVALAV

SEQ ID NO: 1118200 - protein, 18 aa, Mycobacterium
RLGLPRRLMTLLGGESLL

SEQ ID NO: 1118201 - protein, 29 aa, Mycobacterium
RLGTRFGPYELRSLIGVGGMGEVYRAYDT

SEQ ID NO: 1118202 - protein, 17 aa, Mycobacterium
RLKPERPEKVDVVGGVL

SEQ ID NO: 1118203 - protein, 22 aa, Mycobacterium
RLKVLARRMCVTATPYAQADLD

SEQ ID NO: 1118204 - protein, 17 aa, Mycobacterium
RLLAGVIVVVPLYCVAL

SEQ ID NO: 1118205 - protein, 22 aa, Mycobacterium
RLLGPMERLLILGLGLAGQLAA

SEQ ID NO: 1118206 - protein, 19 aa, Mycobacterium
RLLHRVLGLAVLRVSTGQE

SEQ ID NO: 1118207 - protein, 19 aa, Mycobacterium
RLLIAAFERESDWRPSTEK

SEQ ID NO: 1118208 - protein, 26 aa, Mycobacterium
RLNHLCDRLWLIAAIEHYTAVMGDFA

SEQ ID NO: 1118209 - protein, 17 aa, Mycobacterium
RLPADWQRVPLRDLQTR

SEQ ID NO: 1118210 - protein, 25 aa, Mycobacterium
RLPDLICAVVCWLLLSREVLPRLGP

SEQ ID NO: 1118211 - protein, 41 aa, Mycobacterium
RLPEIYRKLARVGSYGAFFPYYICGITFRASDLEGRTVVFP

SEQ ID NO: 1118212 - protein, 19 aa, Mycobacterium
RLPSFAAEMVAFAGSMFGL

SEQ ID NO: 1118213 - protein, 20 aa, Mycobacterium
RLRGVPRAVVDRMWQLVAAI

SEQ ID NO: 1118214 - protein, 17 aa, Mycobacterium
RLRRGRRPTEEDPPTLQ

SEQ ID NO: 1118215 - protein, 19 aa, Mycobacterium
RLRRTRLGRLLGWAARPAG

SEQ ID NO: 1118216 - protein, 18 aa, Mycobacterium
RLRVPAVMTSVLVLMIRY

SEQ ID NO: 1118217 - protein, 17 aa, Mycobacterium
RLSAERSGEDIVISAVQ

SEQ ID NO: 1118218 - protein, 18 aa, Mycobacterium
RLSWRTLVPATWATSAAW

SEQ ID NO: 1118219 - protein, 18 aa, Mycobacterium
RLTEIPVLVVGLAVILSA

SEQ ID NO: 1118220 - protein, 27 aa, Mycobacterium
RLTFPGKRLLVGVALLIAMFPQISLVT

SEQ ID NO: 1118221 - protein, 31 aa, Mycobacterium
RLTVTLELPAAGGLYRFSNVTYRGVQIGKVM

SEQ ID NO: 1118222 - protein, 21 aa, Mycobacterium
RLVGFYAVAVFASFLAATIAC

SEQ ID NO: 1118223 - protein, 29 aa, Mycobacterium
RLVREWRSPAAATRAEWIAGAAVGVVVLW

SEQ ID NO: 1118224 - protein, 19 aa, Mycobacterium
RLVTDLRRNAGLTVVVISH

SEQ ID NO: 1118225 - protein, 23 aa, Mycobacterium
RLWEVLRRARLADVVAAMPDGLD

SEQ ID NO: 1118226 - protein, 20 aa, Mycobacterium
RLYALHILLIPGIMLALIAA

SEQ ID NO: 1118227 - protein, 26 aa, Mycobacterium
RLYNERKIRLWVVFVEDFSGQGAVNW

SEQ ID NO: 1118228 - protein, 20 aa, Mycobacterium
RMKFATWLVFGGIWVTLVYF

SEQ ID NO: 1118229 - protein, 17 aa, Mycobacterium
RMLLLFWGVGTALLTLL

SEQ ID NO: 1118230 - protein, 17 aa, Mycobacterium
RMTVFPYGRSGMIAASM

SEQ ID NO: 1118231 - protein, 20 aa, Mycobacterium
RNALPEWLQWVSNVMPASYA

SEQ ID NO: 1118232 - protein, 19 aa, Mycobacterium
RNATPQKVSGVLFCGLQAD

SEQ ID NO: 1118233 - protein, 17 aa, Mycobacterium
RNHRWFLVAVYGAARTG

SEQ ID NO: 1118234 - protein, 17 aa, Mycobacterium
RNLGKWWRENHFQTYEG

SEQ ID NO: 1118235 - protein, 17 aa, Mycobacterium
RNPDGAQIVDCKDEHRF

SEQ ID NO: 1118236 - protein, 17 aa, Mycobacterium
RNPFGLENWTLPVLEVL

SEQ ID NO: 1118237 - protein, 20 aa, Mycobacterium
RNPGSPVMLMFLCTTLIVWQ

SEQ ID NO: 1118238 - protein, 22 aa, Mycobacterium
RPADALAAAWQRAYRARAAFEA

SEQ ID NO: 1118239 - protein, 20 aa, Mycobacterium
RPAFKRRWTRWVPPVVERST

SEQ ID NO: 1118240 - protein, 22 aa, Mycobacterium
RPALWAAGFVLLGAWMPFNNGL

SEQ ID NO: 1118241 - protein, 22 aa, Mycobacterium
RPAWLALFVVVLAFAYLCFTVL

SEQ ID NO: 1118242 - protein, 20 aa, Mycobacterium
RPAYWISMVIVVGFQIPVDG

SEQ ID NO: 1118243 - protein, 19 aa, Mycobacterium
RPDELRVMYEHHDAILHSV

SEQ ID NO: 1118244 - protein, 17 aa, Mycobacterium
RPDLDPVLAGTIDRAMT

SEQ ID NO: 1118245 - protein, 29 aa, Mycobacterium
RPDTTQSRFWTRWTGWVMRRPWVAATSAA

SEQ ID NO: 1118246 - protein, 25 aa, Mycobacterium
RPEGIPVDVCAAIEKAMSREPADRY

SEQ ID NO: 1118247 - protein, 19 aa, Mycobacterium
RPELDLVRYGGRVDDPAGG

SEQ ID NO: 1118248 - protein, 19 aa, Mycobacterium
RPELRAFDAAMARALAKDP

SEQ ID NO: 1118249 - protein, 24 aa, Mycobacterium
RPELSGLGPVFGRALAKSPDKRFE

SEQ ID NO: 1118250 - protein, 26 aa, Mycobacterium
RPEPGLRTDLFVKFSRDFDDPVRDRG

SEQ ID NO: 1118251 - protein, 21 aa, Mycobacterium
RPFALRPALVLATVLTLALLV

SEQ ID NO: 1118252 - protein, 23 aa, Mycobacterium
RPGEGLVPIRFARINRFLVPEWG

SEQ ID NO: 1118253 - protein, 19 aa, Mycobacterium
RPGNLVLACAVGIGPFALT

SEQ ID NO: 1118254 - protein, 17 aa, Mycobacterium
RPGRVSRVIAHFSTAIE

SEQ ID NO: 1118255 - protein, 34 aa, Mycobacterium
RPKTVRGTPKWGDWSLRIVAGLVLLYLFIPIFVI

SEQ ID NO: 1118256 - protein, 19 aa, Mycobacterium
RPLGGVVFGHFGDKYGRKK

SEQ ID NO: 1118257 - protein, 24 aa, Mycobacterium
RPMVYCGHISFGLYMVHELVHTAW

SEQ ID NO: 1118258 - protein, 17 aa, Mycobacterium
RPPRPNQAPSIGRATPA

SEQ ID NO: 1118259 - protein, 24 aa, Mycobacterium
RPRPTALAFMAGWLIGLGALTAIF

SEQ ID NO: 1118260 - protein, 19 aa, Mycobacterium
RPRPVEIPATTFVAHPRTA

SEQ ID NO: 1118261 - protein, 27 aa, Mycobacterium
RPRRPRLPLKAGWGVKAAMAVVLVVLG

SEQ ID NO: 1118262 - protein, 20 aa, Mycobacterium
RPTEAMAFLAVAAILDALDG

SEQ ID NO: 1118263 - protein, 20 aa, Mycobacterium
RPVLRRRFYAGTGLPEPAKA

SEQ ID NO: 1118264 - protein, 20 aa, Mycobacterium
RQEFPWPVLEEAAQRGFYSP

SEQ ID NO: 1118265 - protein, 18 aa, Mycobacterium
RQFHHPLIYVLLVAGIVT

SEQ ID NO: 1118266 - protein, 17 aa, Mycobacterium
RQIPRGLWVAAVVVPVF

SEQ ID NO: 1118267 - protein, 19 aa, Mycobacterium
RQKVWKRVAVLFAGPGMNF

SEQ ID NO: 1118268 - protein, 24 aa, Mycobacterium
RQLSDSFLNWDLYRQAVPDLLKTG

SEQ ID NO: 1118269 - protein, 19 aa, Mycobacterium
RQQFSRVRVFAFIDTTDEV

SEQ ID NO: 1118270 - protein, 17 aa, Mycobacterium
RQQRFLSSLLRSLISKE

SEQ ID NO: 1118271 - protein, 21 aa, Mycobacterium
RQRFYALGLYVVMLVFAVGTA

SEQ ID NO: 1118272 - protein, 19 aa, Mycobacterium
RQRLAIARAVIRRPSVYLF

SEQ ID NO: 1118273 - protein, 20 aa, Mycobacterium
RQRTGAMEWGIFRSGESADT

SEQ ID NO: 1118274 - protein, 18 aa, Mycobacterium
RQVAAIAAQGLWSAALQL

SEQ ID NO: 1118275 - protein, 19 aa, Mycobacterium
RRAAILAAVVCVLTLTIAG

SEQ ID NO: 1118276 - protein, 20 aa, Mycobacterium
RRARGLRFSPRIVVAPVVVA

SEQ ID NO: 1118277 - protein, 19 aa, Mycobacterium
RRASCAELYRDGAFTRLDA

SEQ ID NO: 1118278 - protein, 20 aa, Mycobacterium
RRAVEHRALMAIAISEAGLA

SEQ ID NO: 1118279 - protein, 23 aa, Mycobacterium
RRAWLPSRRTLYAVKTGVVGLAI

SEQ ID NO: 1118280 - protein, 17 aa, Mycobacterium
RRELDVVYQPKYHLATS

SEQ ID NO: 1118281 - protein, 24 aa, Mycobacterium
RRERISLRPLWGIDDRLKKFGTMA

SEQ ID NO: 1118282 - protein, 17 aa, Mycobacterium
RRFWLPAYTAFEVLLLV

SEQ ID NO: 1118283 - protein, 25 aa, Mycobacterium
RRGAPRGGAVALVLLSGIAVVGGIL

SEQ ID NO: 1118284 - protein, 22 aa, Mycobacterium
RRGETMSAFYLAAYTAMAVPTL

SEQ ID NO: 1118285 - protein, 27 aa, Mycobacterium
RRGLAATGWPPVRWIPKIRPDPLRRLG

SEQ ID NO: 1118286 - protein, 18 aa, Mycobacterium
RRGLWAVVGQRFIPGISD

SEQ ID NO: 1118287 - protein, 19 aa, Mycobacterium
RRGVGPGDVVAFQLPNWAE

SEQ ID NO: 1118288 - protein, 20 aa, Mycobacterium
RRGWLEALLGHFCDPAVALV

SEQ ID NO: 1118289 - protein, 20 aa, Mycobacterium
RRHLPSAGVDLVLNAAPGAI

SEQ ID NO: 1118290 - protein, 17 aa, Mycobacterium
RRHTRWSIANGGREFGR

SEQ ID NO: 1118291 - protein, 23 aa, Mycobacterium
RRIESACKVWSAGVSASPLGRDL

SEQ ID NO: 1118292 - protein, 22 aa, Mycobacterium
RRKAHVAEPIGWREMTVSSWAG

SEQ ID NO: 1118293 - protein, 19 aa, Mycobacterium
RRKMIGVSLGVGLGAFGLG

SEQ ID NO: 1118294 - protein, 26 aa, Mycobacterium
RRLAWLGDRSRPMLIIAVGATASMAA

SEQ ID NO: 1118295 - protein, 19 aa, Mycobacterium
RRLRPDALEDLGLQSALNA

SEQ ID NO: 1118296 - protein, 20 aa, Mycobacterium
RRLRPMANIARLVRLPEYAR

SEQ ID NO: 1118297 - protein, 17 aa, Mycobacterium
RRLSPNALRAVIVVVGL

SEQ ID NO: 1118298 - protein, 25 aa, Mycobacterium
RRMSRLLVVVGCVIGLLIFGSLFVA

SEQ ID NO: 1118299 - protein, 19 aa, Mycobacterium
RRPELRKALRDNLDNVPAF

SEQ ID NO: 1118300 - protein, 20 aa, Mycobacterium
RRPGEVMDRGLWAWSRHPNY

SEQ ID NO: 1118301 - protein, 18 aa, Mycobacterium
RRRAEPEPEPPAPETEII

SEQ ID NO: 1118302 - protein, 24 aa, Mycobacterium
RRRGGESRWRTAVLAAAAVAVVGL

SEQ ID NO: 1118303 - protein, 22 aa, Mycobacterium
RRRHWWTVAVALALFVYTFVQA

SEQ ID NO: 1118304 - protein, 23 aa, Mycobacterium
RRRIRIQIILTFLILVTNILGIG

SEQ ID NO: 1118305 - protein, 18 aa, Mycobacterium
RRRLQGAALFVVGLAMLV

SEQ ID NO: 1118306 - protein, 26 aa, Mycobacterium
RRRPGRVTTIAAWVGIVAGVVFIVAV

SEQ ID NO: 1118307 - protein, 18 aa, Mycobacterium
RRRRSRWMTSAAVGLAAA

SEQ ID NO: 1118308 - protein, 30 aa, Mycobacterium
RRRTDRLWPLRWLRNAALLFTFLNAFVDFA

SEQ ID NO: 1118309 - protein, 24 aa, Mycobacterium
RRSDYPRSRFEVVAVNDGSTDGTL

SEQ ID NO: 1118310 - protein, 18 aa, Mycobacterium
RRTDGWLTIVVDDDGRGL

SEQ ID NO: 1118311 - protein, 17 aa, Mycobacterium
RRTGLQLAADSSVWINK

SEQ ID NO: 1118312 - protein, 17 aa, Mycobacterium
RRTRPDLKRGFKAPFVP

SEQ ID NO: 1118313 - protein, 20 aa, Mycobacterium
RRVALAASFLARTALVVLLI

SEQ ID NO: 1118314 - protein, 22 aa, Mycobacterium
RRVEAFALFNIFYQAGILAGPL

SEQ ID NO: 1118315 - protein, 21 aa, Mycobacterium
RRVPTDMLGRVSSLDFFVSLA

SEQ ID NO: 1118316 - protein, 19 aa, Mycobacterium
RRVSMIADGLSALSVAAVP

SEQ ID NO: 1118317 - protein, 20 aa, Mycobacterium
RRWGEFGMIPALNARRTPDR

SEQ ID NO: 1118318 - protein, 24 aa, Mycobacterium
RRWLNRTLLFIGWNVSMSQAINPL

SEQ ID NO: 1118319 - protein, 19 aa, Mycobacterium
RRWLVGYVRSAHVWTTVPA

SEQ ID NO: 1118320 - protein, 28 aa, Mycobacterium
RRWWMLPDHFDWVTGYLRSRGMMVAART

SEQ ID NO: 1118321 - protein, 19 aa, Mycobacterium
RRWYVLTFLMGLFFVLGQL

SEQ ID NO: 1118322 - protein, 25 aa, Mycobacterium
RRYGGLRKALPITFATFGLGYLAII

SEQ ID NO: 1118323 - protein, 19 aa, Mycobacterium
RRYLQPRLALAAMMAATGV

SEQ ID NO: 1118324 - protein, 20 aa, Mycobacterium
RSARLARGLLALGAGKGTHV

SEQ ID NO: 1118325 - protein, 32 aa, Mycobacterium
RSARNRMAFLAALLFVLALCFASTNGWWYVSN

SEQ ID NO: 1118326 - protein, 18 aa, Mycobacterium
RSDLALAGLAGDAFRKQF

SEQ ID NO: 1118327 - protein, 17 aa, Mycobacterium
RSGRIGQKVLLELRRRV

SEQ ID NO: 1118328 - protein, 19 aa, Mycobacterium
RSQLVLSLLSWGVVLLLYF

SEQ ID NO: 1118329 - protein, 24 aa, Mycobacterium
RSRRARFAPPLAVIIPAHNEAHDI

SEQ ID NO: 1118330 - protein, 22 aa, Mycobacterium
RSWKPWLRGTAYGFPFGALPAG

SEQ ID NO: 1118331 - protein, 19 aa, Mycobacterium
RTAFTLAAGLLFGPLLGIA

SEQ ID NO: 1118332 - protein, 24 aa, Mycobacterium
RTATEAITTLWSYTPEDMATLPDR

SEQ ID NO: 1118333 - protein, 21 aa, Mycobacterium
RTATIPTYLSDDWYRDWGSIE

SEQ ID NO: 1118334 - protein, 26 aa, Mycobacterium
RTATRTRLLPRLGLPANAQPPAVVQA

SEQ ID NO: 1118335 - protein, 23 aa, Mycobacterium
RTDDLRPIPVFGSDELARLTEAF

SEQ ID NO: 1118336 - protein, 23 aa, Mycobacterium
RTDTGPPWSLWAVILLTSSLLLG

SEQ ID NO: 1118337 - protein, 22 aa, Mycobacterium
RTDVDPILAGVIERAMTPDPPQ

SEQ ID NO: 1118338 - protein, 26 aa, Mycobacterium
RTFHPTPRLKAMRGAVETCRLIPVIV

SEQ ID NO: 1118339 - protein, 20 aa, Mycobacterium
RTGLFRRPAYWISMVIVVGF

SEQ ID NO: 1118340 - protein, 26 aa, Mycobacterium
RTGVLPRWSAGLAVFGVLPLLHTWVG

SEQ ID NO: 1118341 - protein, 19 aa, Mycobacterium
RTQSRAVLTGALILITGLA

SEQ ID NO: 1118342 - protein, 26 aa, Mycobacterium
RTSTLRKPIIVWWILWVLSTVVSVSS

SEQ ID NO: 1118343 - protein, 17 aa, Mycobacterium
RVAAIAVGVGFGVLLIA

SEQ ID NO: 1118344 - protein, 24 aa, Mycobacterium
RVAPCLPGATLLSVDGDEFTGAVK

SEQ ID NO: 1118345 - protein, 17 aa, Mycobacterium
RVARFMLSDGLSNLGGP

SEQ ID NO: 1118346 - protein, 19 aa, Mycobacterium
RVDALGVKTLIKFAEPDPI

SEQ ID NO: 1118347 - protein, 18 aa, Mycobacterium
RVECARDGEDYGTGQIVP

SEQ ID NO: 1118348 - protein, 21 aa, Mycobacterium
RVELPLAVPYILAGMRTSLVL

SEQ ID NO: 1118349 - protein, 18 aa, Mycobacterium
RVFERFSRGSTASHSGSG

SEQ ID NO: 1118350 - protein, 21 aa, Mycobacterium
RVGDPRLGAIATTGAADIVDQ

SEQ ID NO: 1118351 - protein, 17 aa, Mycobacterium
RVGDPVGILAADGTSHR

SEQ ID NO: 1118352 - protein, 19 aa, Mycobacterium
RVGIIFVVAVVFGLVNAIV

SEQ ID NO: 1118353 - protein, 26 aa, Mycobacterium
RVGPRRWIARIAVTWGTLSALMMFVQ

SEQ ID NO: 1118354 - protein, 21 aa, Mycobacterium
RVGQEVIAAGAPLGLRSTDTV

SEQ ID NO: 1118355 - protein, 19 aa, Mycobacterium
RVGVDVIAVLSLVGTLLVH

SEQ ID NO: 1118356 - protein, 19 aa, Mycobacterium
RVHLKARYTPVVGGEASIL

SEQ ID NO: 1118357 - protein, 17 aa, Mycobacterium
RVIMLTFMIGGLLAGAA

SEQ ID NO: 1118358 - protein, 21 aa, Mycobacterium
RVLAPEVDRAVALSGAALAEI

SEQ ID NO: 1118359 - protein, 18 aa, Mycobacterium
RVLGWGWLALTFVGVPSQ

SEQ ID NO: 1118360 - protein, 26 aa, Mycobacterium
RVLLRVEVPIALPLILGGLRTATLQI

SEQ ID NO: 1118361 - protein, 17 aa, Mycobacterium
RVLPKWFGYLGLCNALT

SEQ ID NO: 1118362 - protein, 19 aa, Mycobacterium
RVLRDFRPLTGRECLASAA

SEQ ID NO: 1118363 - protein, 19 aa, Mycobacterium
RVLTHPIVALALFVAGFYG

SEQ ID NO: 1118364 - protein, 26 aa, Mycobacterium
RVMHERPRYINLIVLLRIACEVTATV

SEQ ID NO: 1118365 - protein, 17 aa, Mycobacterium
RVMPMPIVSLRTIVIVA

SEQ ID NO: 1118366 - protein, 21 aa, Mycobacterium
RVNASKLGLSFTVREAALPVG

SEQ ID NO: 1118367 - protein, 24 aa, Mycobacterium
RVPEADAAVAFVRRRLGRSAPAPA

SEQ ID NO: 1118368 - protein, 19 aa, Mycobacterium
RVREMHRPSAAFLAAPAVL

SEQ ID NO: 1118369 - protein, 33 aa, Mycobacterium
RVSLAPTLLVAIPFTVLVSFTLNILLRELGAAD

SEQ ID NO: 1118370 - protein, 29 aa, Mycobacterium
RVSSQFGVSVPDFWLGILLIALFSSTLGW

SEQ ID NO: 1118371 - protein, 22 aa, Mycobacterium
RVTSVPPATGWVLAAVLAACAA

SEQ ID NO: 1118372 - protein, 24 aa, Mycobacterium
RVVLACGWGFLGWGMALYLWSGVL

SEQ ID NO: 1118373 - protein, 19 aa, Mycobacterium
RVVLAPLFIIWFGVGLISK

SEQ ID NO: 1118374 - protein, 19 aa, Mycobacterium
RVVLPQLRLAILGGALLIA

SEQ ID NO: 1118375 - protein, 20 aa, Mycobacterium
RWAVFGAWVLLLVPAIYLAL

SEQ ID NO: 1118376 - protein, 22 aa, Mycobacterium
RWISLGAGLAILTWIVASVGFG

SEQ ID NO: 1118377 - protein, 20 aa, Mycobacterium
RWLMSSDVCKHCTHAGCLDV

SEQ ID NO: 1118378 - protein, 26 aa, Mycobacterium
RWLRRPVVQAKLWLQDAIAGMPRFPD

SEQ ID NO: 1118379 - protein, 27 aa, Mycobacterium
RWRDYRFAVVVTLGWMAFTFAFNAVAG

SEQ ID NO: 1118380 - protein, 19 aa, Mycobacterium
RWVRAEVLSTGDLVIGGTT

SEQ ID NO: 1118381 - protein, 19 aa, Mycobacterium
RWWLIAAGVAVGFGFLAKM

SEQ ID NO: 1118382 - protein, 25 aa, Mycobacterium
RYARRRARRILPAYLVTVLLAYLVF

SEQ ID NO: 1118383 - protein, 24 aa, Mycobacterium
RYDPWDQRMCLSLDDDLYSAIADG

SEQ ID NO: 1118384 - protein, 24 aa, Mycobacterium
RYEVRRTRFAWLVAALDATFTLTL

SEQ ID NO: 1118385 - protein, 26 aa, Mycobacterium
RYLWAFELTGALLITAALGAMVLAHR

SEQ ID NO: 1118386 - protein, 26 aa, Mycobacterium
RYPHVGTDTGGLWTWRETDTVDLGRH

SEQ ID NO: 1118387 - protein, 27 aa, Mycobacterium
RYVPLARRPIVWWLHWLAEKTQKTKTR

SEQ ID NO: 1118388 - protein, 20 aa, Mycobacterium
RYVSGNPWIFALEVVGVITG

SEQ ID NO: 1118389 - protein, 23 aa, Mycobacterium
SAAWFERRYFFLILAAGAVGVGY

SEQ ID NO: 1118390 - protein, 17 aa, Mycobacterium
SAEATVVVVSQRLSTVA

SEQ ID NO: 1118391 - protein, 17 aa, Mycobacterium
SAEEFGLELQLAQRHNG

SEQ ID NO: 1118392 - protein, 22 aa, Mycobacterium
SAERLNVIYADFKGEAGADIFR

SEQ ID NO: 1118393 - protein, 17 aa, Mycobacterium
SAERVRAGISYVMVSMV

SEQ ID NO: 1118394 - protein, 25 aa, Mycobacterium
SAFIPRFLFAVGFPGIVVATACYLV

SEQ ID NO: 1118395 - protein, 22 aa, Mycobacterium
SAFPEMASEFGVSPSTIQLSLT

SEQ ID NO: 1118396 - protein, 23 aa, Mycobacterium
SAFREILSGLSFFRNAYDQFAGY

SEQ ID NO: 1118397 - protein, 19 aa, Mycobacterium
SAHELRTPLTAMRTNLEVL

SEQ ID NO: 1118398 - protein, 18 aa, Mycobacterium
SALARWAAMTLAVTLLLL

SEQ ID NO: 1118399 - protein, 17 aa, Mycobacterium
SALFLAVFAAFWQVLVP

SEQ ID NO: 1118400 - protein, 30 aa, Mycobacterium
SALGFAFVVSYRWGHHVGRLVVHPDNEQLL

SEQ ID NO: 1118401 - protein, 19 aa, Mycobacterium
SALRELWSAASPKTRLPVV

SEQ ID NO: 1118402 - protein, 18 aa, Mycobacterium
SANWKWKPVEARADADFV

SEQ ID NO: 1118403 - protein, 22 aa, Mycobacterium
SAPAVAVIATWSLRGQSHYLPV

SEQ ID NO: 1118404 - protein, 25 aa, Mycobacterium
SAPEACAAISRTLRSFLHQATGVRA

SEQ ID NO: 1118405 - protein, 18 aa, Mycobacterium
SASGLGFAIPVNEMKHVV

SEQ ID NO: 1118406 - protein, 20 aa, Mycobacterium
SASGYVGAFGRAMNRIYEVA

SEQ ID NO: 1118407 - protein, 17 aa, Mycobacterium
SATAEWIGGALLVGYGA

SEQ ID NO: 1118408 - protein, 18 aa, Mycobacterium
SATFLYRQQRLWGASPVV

SEQ ID NO: 1118409 - protein, 26 aa, Mycobacterium
SATLLALPMRGFMFLTRPLLRGLNHA

SEQ ID NO: 1118410 - protein, 23 aa, Mycobacterium
SATRLLIMTVIGLTIAYVFKPQG

SEQ ID NO: 1118411 - protein, 23 aa, Mycobacterium
SATSGRMLYAFGRDGFGPKALAH

SEQ ID NO: 1118412 - protein, 26 aa, Mycobacterium
SAVPVKEIFRPPVLKSTVLGMLSRWG

SEQ ID NO: 1118413 - protein, 23 aa, Mycobacterium
SAVTGTIQWPALVMFAIIFFWTP

SEQ ID NO: 1118414 - protein, 18 aa, Mycobacterium
SAYLPRRHRSAARAAGVA

SEQ ID NO: 1118415 - protein, 18 aa, Mycobacterium
SDAGRSWVITAYVLTFGG

SEQ ID NO: 1118416 - protein, 24 aa, Mycobacterium
SDAKKWKLSVIFNDGKTVPAHVVG

SEQ ID NO: 1118417 - protein, 17 aa, Mycobacterium
SDFRLGLLGKFLCFAIV

SEQ ID NO: 1118418 - protein, 23 aa, Mycobacterium
SDGRADILGVIHLKDVVKQGMRE

SEQ ID NO: 1118419 - protein, 25 aa, Mycobacterium
SDIDTPDGLYCKLPQDSPIGVRGAR

SEQ ID NO: 1118420 - protein, 19 aa, Mycobacterium
SDIRRAAAHLPAVIEDIQS

SEQ ID NO: 1118421 - protein, 20 aa, Mycobacterium
SDLLWSFLQAIVMSIAVMLV

SEQ ID NO: 1118422 - protein, 21 aa, Mycobacterium
SDLREPYWIALTVLLVLRPES

SEQ ID NO: 1118423 - protein, 24 aa, Mycobacterium
SDPIAWWNPDLLFARPDWLKEPPG

SEQ ID NO: 1118424 - protein, 21 aa, Mycobacterium
SDRPTAAPFMIALVIIVLVVI

SEQ ID NO: 1118425 - protein, 19 aa, Mycobacterium
SDSGAARAIAPWYLVTAAA

SEQ ID NO: 1118426 - protein, 25 aa, Mycobacterium
SDSTDSLLRFALRADATLCAALGLF

SEQ ID NO: 1118427 - protein, 22 aa, Mycobacterium
SDSVLVTGPWLAGVSSLIAVLR

SEQ ID NO: 1118428 - protein, 19 aa, Mycobacterium
SDVCKHCTHAGCLDVCPTG

SEQ ID NO: 1118429 - protein, 20 aa, Mycobacterium
SDVVAGWALGYVYFVMCWLW

SEQ ID NO: 1118430 - protein, 23 aa, Mycobacterium
SEGERRFTAPSGFDAGSTQKIDP

SEQ ID NO: 1118431 - protein, 25 aa, Mycobacterium
SEGPMPPKRALEVIADACQALNFSH

SEQ ID NO: 1118432 - protein, 19 aa, Mycobacterium
SEHPLARAIVRAAEERGLT

SEQ ID NO: 1118433 - protein, 19 aa, Mycobacterium
SEPRWGRWYDAEGVGPEER

SEQ ID NO: 1118434 - protein, 25 aa, Mycobacterium
SEREGCSLAFRVNEVPSGAKFYRVQ

SEQ ID NO: 1118435 - protein, 19 aa, Mycobacterium
SERQRLRDLFGRYVGEDVA

SEQ ID NO: 1118436 - protein, 17 aa, Mycobacterium
SETPQWQQPPAYTPQQY

SEQ ID NO: 1118437 - protein, 22 aa, Mycobacterium
SFAAGELYSRLSVADAAAATAF

SEQ ID NO: 1118438 - protein, 19 aa, Mycobacterium
SFAVLVWVFGGLLAAALPV

SEQ ID NO: 1118439 - protein, 23 aa, Mycobacterium
SFEGYEYLFWVGCAGAYEDRAKK

SEQ ID NO: 1118440 - protein, 23 aa, Mycobacterium
SFVTLELIGMVALTVLLLVVAAI

SEQ ID NO: 1118441 - protein, 22 aa, Mycobacterium
SFYLPPEVFDNADFKRGMEQFI

SEQ ID NO: 1118442 - protein, 26 aa, Mycobacterium
SGAYTVPDFAEFRLGSRRLRKVAMLV

SEQ ID NO: 1118443 - protein, 17 aa, Mycobacterium
SGDLHHLIESFNAMLDR

SEQ ID NO: 1118444 - protein, 24 aa, Mycobacterium
SGDWKTFDGRNFWITIVGLTSPDY

SEQ ID NO: 1118445 - protein, 19 aa, Mycobacterium
SGEQGFWATMLVFVVLAGC

SEQ ID NO: 1118446 - protein, 26 aa, Mycobacterium
SGGAQWARWYPMAMLLAGTVLIAMSS

SEQ ID NO: 1118447 - protein, 21 aa, Mycobacterium
SGGLIQYLGAVLFTIGNLAFF

SEQ ID NO: 1118448 - protein, 25 aa, Mycobacterium
SGGVPIGNWLTRSLFAAKFAERNFL

SEQ ID NO: 1118449 - protein, 33 aa, Mycobacterium
SGIQRALPWVMGGCMLGMISIMIFTGVRQLSPY

SEQ ID NO: 1118450 - protein, 20 aa, Mycobacterium
SGKSEFLRTLILSLAATHHP

SEQ ID NO: 1118451 - protein, 20 aa, Mycobacterium
SGKTTLLRHLIRTVREHSEP

SEQ ID NO: 1118452 - protein, 21 aa, Mycobacterium
SGLALLVVFLFWPWEYQPYGS

SEQ ID NO: 1118453 - protein, 24 aa, Mycobacterium
SGLCADRFGRRRTLLVVTAGIMVY

SEQ ID NO: 1118454 - protein, 21 aa, Mycobacterium
SGLELSRSVGLAFAVAASTLC

SEQ ID NO: 1118455 - protein, 23 aa, Mycobacterium
SGLLVDRFGAKRVYGTGIAAYAV

SEQ ID NO: 1118456 - protein, 19 aa, Mycobacterium
SGLRGDGGFIERPERLVIV

SEQ ID NO: 1118457 - protein, 18 aa, Mycobacterium
SGLVLIVAACTRVTATTP

SEQ ID NO: 1118458 - protein, 26 aa, Mycobacterium
SGPSAFWVCGLLLCLFIGPTQSSART

SEQ ID NO: 1118459 - protein, 24 aa, Mycobacterium
SGSALSWFSPIAWAQQMRAFVALR

SEQ ID NO: 1118460 - protein, 18 aa, Mycobacterium
SGSGLGLALVAQQAELHG

SEQ ID NO: 1118461 - protein, 18 aa, Mycobacterium
SGSRVIWSFARDRVLPGS

SEQ ID NO: 1118462 - protein, 17 aa, Mycobacterium
SGVAFKATMIGSFPILS

SEQ ID NO: 1118463 - protein, 17 aa, Mycobacterium
SGVTFDVAGAILIILFL

SEQ ID NO: 1118464 - protein, 19 aa, Mycobacterium
SGYSRKGVELCTAVDVDLP

SEQ ID NO: 1118465 - protein, 22 aa, Mycobacterium
SHELRTPLAAIRGYTELAQRHS

SEQ ID NO: 1118466 - protein, 23 aa, Mycobacterium
SHRRVVLLIYMWVGIVALGAAST

SEQ ID NO: 1118467 - protein, 23 aa, Mycobacterium
SIAALLVYHGMRLLGLRTSRSAE

SEQ ID NO: 1118468 - protein, 23 aa, Mycobacterium
SIAGEPVGAVLLRDPLRRDAPRT

SEQ ID NO: 1118469 - protein, 23 aa, Mycobacterium
SIANDIAKYFAIIPALFVGLFPG

SEQ ID NO: 1118470 - protein, 26 aa, Mycobacterium
SIGLADEVLYFFLVESALVFVAAYLI

SEQ ID NO: 1118471 - protein, 19 aa, Mycobacterium
SIGNAVEWFDFAIYGFLAT

SEQ ID NO: 1118472 - protein, 22 aa, Mycobacterium
SKAPHGGIFVFFAIGNLAWFLV

SEQ ID NO: 1118473 - protein, 21 aa, Mycobacterium
SKTGAVKVMDFGIARALADSS

SEQ ID NO: 1118474 - protein, 24 aa, Mycobacterium
SLADLRSEPFIAYASRHSAVNDAV

SEQ ID NO: 1118475 - protein, 27 aa, Mycobacterium
SLADRALLRRIWRFAGRHHRRLAAFVA

SEQ ID NO: 1118476 - protein, 19 aa, Mycobacterium
SLAIAFGVWVWVFHGGDYG

SEQ ID NO: 1118477 - protein, 18 aa, Mycobacterium
SLARAVVRAADLGARVIN

SEQ ID NO: 1118478 - protein, 30 aa, Mycobacterium
SLARERGWEIRDFRTARKAARIGVPSAVAL

SEQ ID NO: 1118479 - protein, 23 aa, Mycobacterium
SLDARAGTRLRLSGEHTVVALAG

SEQ ID NO: 1118480 - protein, 24 aa, Mycobacterium
SLFYLHLPAAVGIGAYDVTAKFTA

SEQ ID NO: 1118481 - protein, 29 aa, Mycobacterium
SLGAAVLLHASWQWVFAALVVLAGGLLLV

SEQ ID NO: 1118482 - protein, 17 aa, Mycobacterium
SLGRATLPIALIAVVWA

SEQ ID NO: 1118483 - protein, 23 aa, Mycobacterium
SLIRTGELWPHLTQTLLEVALGL

SEQ ID NO: 1118484 - protein, 19 aa, Mycobacterium
SLLARTFGTYALRPFGLQG

SEQ ID NO: 1118485 - protein, 18 aa, Mycobacterium
SLLLNWVLGPALMFALAW

SEQ ID NO: 1118486 - protein, 19 aa, Mycobacterium
SLLMWPRGASATVTAAVRD

SEQ ID NO: 1118487 - protein, 30 aa, Mycobacterium
SLLPDEQFLSWGWRIPFLASAVLIVIGLVI

SEQ ID NO: 1118488 - protein, 21 aa, Mycobacterium
SLNMSKDWARAVVDIPVPTTA

SEQ ID NO: 1118489 - protein, 26 aa, Mycobacterium
SLRSRIGMVLQDTWLFAGTIYDNIAY

SEQ ID NO: 1118490 - protein, 22 aa, Mycobacterium
SLRTRVAFATAIGAAIVVVIVG

SEQ ID NO: 1118491 - protein, 25 aa, Mycobacterium
SLSDRRGTAGLGLWIVQQIIDALGG

SEQ ID NO: 1118492 - protein, 17 aa, Mycobacterium
SLSVPQLSGSPFALPDL

SEQ ID NO: 1118493 - protein, 19 aa, Mycobacterium
SLTLLPLVLIYQGWTYWVF

SEQ ID NO: 1118494 - protein, 34 aa, Mycobacterium
SLTRRFSVLILLLCLFGLIVLLLRRGRLPGTFGG

SEQ ID NO: 1118495 - protein, 21 aa, Mycobacterium
SLTYLDVCDQVLLLAPGGKTA

SEQ ID NO: 1118496 - protein, 25 aa, Mycobacterium
SLYRIGALCPYCMVVWAVTVPLLVV

SEQ ID NO: 1118497 - protein, 18 aa, Mycobacterium
SMLFKLNIARGYLMIALP

SEQ ID NO: 1118498 - protein, 29 aa, Mycobacterium
SMQLSLPAWVRARGLSVYQLVFTGSQAIG

SEQ ID NO: 1118499 - protein, 20 aa, Mycobacterium
SMRLADWWPDPDTFDPARFI

SEQ ID NO: 1118500 - protein, 29 aa, Mycobacterium
SNFGVPWSNAFPEYKFGFTTILLGFSVLA

SEQ ID NO: 1118501 - protein, 26 aa, Mycobacterium
SNGYGAKNVRDVKCNNGESPEVKKGA

SEQ ID NO: 1118502 - protein, 20 aa, Mycobacterium
SNTAWEWALGNAWTIVAMVS

SEQ ID NO: 1118503 - protein, 22 aa, Mycobacterium
SPAREALRRWEFRRATPTHRAP

SEQ ID NO: 1118504 - protein, 19 aa, Mycobacterium
SPATRAVAQIVLLDNKFAT

SEQ ID NO: 1118505 - protein, 18 aa, Mycobacterium
SPDHGFPARVIVPALPGV

SEQ ID NO: 1118506 - protein, 22 aa, Mycobacterium
SPGDGRWSLRETAAAIAAAAVI

SEQ ID NO: 1118507 - protein, 26 aa, Mycobacterium
SPGRLDWAGAVTLGLGLTVLLTGITY

SEQ ID NO: 1118508 - protein, 20 aa, Mycobacterium
SPIAGMPVLTVWNANHVIVF

SEQ ID NO: 1118509 - protein, 18 aa, Mycobacterium
SPLPRQTLLIAIATGLGG

SEQ ID NO: 1118510 - protein, 21 aa, Mycobacterium
SPPAPKWAWVALVVVGVVGQV

SEQ ID NO: 1118511 - protein, 18 aa, Mycobacterium
SPPPRPATRVLAAPLPPT

SEQ ID NO: 1118512 - protein, 25 aa, Mycobacterium
SPPQGVWELGPFPLRAYALCIIAGI

SEQ ID NO: 1118513 - protein, 20 aa, Mycobacterium
SPRVPAEPGGDFVDQAGNGM

SEQ ID NO: 1118514 - protein, 17 aa, Mycobacterium
SPSGRPALLGFLGATLI

SEQ ID NO: 1118515 - protein, 21 aa, Mycobacterium
SPTMLFFPFVLLLAATAMYRG

SEQ ID NO: 1118516 - protein, 27 aa, Mycobacterium
SPTTPAHPRWFFLWTTPGRILTIGIVL

SEQ ID NO: 1118517 - protein, 22 aa, Mycobacterium
SPVLTLFPHRPPEVGVPSENPR

SEQ ID NO: 1118518 - protein, 19 aa, Mycobacterium
SPVPAPWPVLARLPRGPEL

SEQ ID NO: 1118519 - protein, 21 aa, Mycobacterium
SPVYGSGLPSDIWKATMDGAL

SEQ ID NO: 1118520 - protein, 18 aa, Mycobacterium
SQFDELVLRATMRDPADR

SEQ ID NO: 1118521 - protein, 33 aa, Mycobacterium
SQGALMWGALCGVSQGFGVWWFYAALGSGPISV

SEQ ID NO: 1118522 - protein, 30 aa, Mycobacterium
SQPELRGQGGWLRRIVPAAALGGVAGAALL

SEQ ID NO: 1118523 - protein, 22 aa, Mycobacterium
SRESLKALVSRFDELTADVDAD

SEQ ID NO: 1118524 - protein, 23 aa, Mycobacterium
SRNRATASLGAWLAVAAGAWFVV

SEQ ID NO: 1118525 - protein, 26 aa, Mycobacterium
SRPDQPRPAGAFPYSDGRSARPVRRS

SEQ ID NO: 1118526 - protein, 22 aa, Mycobacterium
SRRREARHAAREAELLALFAGA

SEQ ID NO: 1118527 - protein, 19 aa, Mycobacterium
SRSARPVLVHRAIDGSPGL

SEQ ID NO: 1118528 - protein, 19 aa, Mycobacterium
SRSAVVNWIGFSLIGIVTL

SEQ ID NO: 1118529 - protein, 22 aa, Mycobacterium
SRSRRGRALFVFTVGIALILVV

SEQ ID NO: 1118530 - protein, 19 aa, Mycobacterium
SRTLAAWAPMLVLLAGLWT

SEQ ID NO: 1118531 - protein, 24 aa, Mycobacterium
SRVARARLGRTLFAQCERPSGGQG

SEQ ID NO: 1118532 - protein, 21 aa, Mycobacterium
SRWAELPPLLQPRAAASAAVV

SEQ ID NO: 1118533 - protein, 19 aa, Mycobacterium
SRWQIARILLVLLLASMPI

SEQ ID NO: 1118534 - protein, 17 aa, Mycobacterium
SSAGPLFGGGTVADDLA

SEQ ID NO: 1118535 - protein, 23 aa, Mycobacterium
SSFKEAWSYVIVMVVIGALYLGY

SEQ ID NO: 1118536 - protein, 25 aa, Mycobacterium
SSFLPFGYLGIWAAVPFAIWFFLAI

SEQ ID NO: 1118537 - protein, 19 aa, Mycobacterium
SSFLTGFAVTGFAFCAAHG

SEQ ID NO: 1118538 - protein, 19 aa, Mycobacterium
SSLIFLLGIGLVYAATGTL

SEQ ID NO: 1118539 - protein, 17 aa, Mycobacterium
SSPLAYTAIGIWVVTAV

SEQ ID NO: 1118540 - protein, 19 aa, Mycobacterium
SSPVPFILAPATPPGQAPA

SEQ ID NO: 1118541 - protein, 18 aa, Mycobacterium
SSTFDRVTLEAGQDLAKT

SEQ ID NO: 1118542 - protein, 19 aa, Mycobacterium
SSVQIDWSVALAVTGAAVV

SEQ ID NO: 1118543 - protein, 26 aa, Mycobacterium
STDLDWKSVWDHGWSAAAAADEAPVR

SEQ ID NO: 1118544 - protein, 23 aa, Mycobacterium
STYPRLIRVAMFYNDQVGYGPTV

SEQ ID NO: 1118545 - protein, 23 aa, Mycobacterium
SVAGVPWPAYKVIALLVGLVAFL

SEQ ID NO: 1118546 - protein, 22 aa, Mycobacterium
SVGDPRIDLGWFLVNADPDTYR

SEQ ID NO: 1118547 - protein, 18 aa, Mycobacterium
SVGTWPLLAPLLAAGTVV

SEQ ID NO: 1118548 - protein, 20 aa, Mycobacterium
SVILVDLWIFTPFVAILVLA

SEQ ID NO: 1118549 - protein, 17 aa, Mycobacterium
SVIPAFLAFAVIPMGGE

SEQ ID NO: 1118550 - protein, 18 aa, Mycobacterium
SVLEPWLTFLRALPPLAY

SEQ ID NO: 1118551 - protein, 20 aa, Mycobacterium
SVLLGAIGIALGWRPEVVGL

SEQ ID NO: 1118552 - protein, 20 aa, Mycobacterium
SVLPICPPPATTSRRPPPPP

SEQ ID NO: 1118553 - protein, 19 aa, Mycobacterium
SVLVWAWLAGILLLVIVSV

SEQ ID NO: 1118554 - protein, 23 aa, Mycobacterium
SVRMPRRYLTVMMTMWGAGSIPL

SEQ ID NO: 1118555 - protein, 20 aa, Mycobacterium
SWAIGPVWRVLSPVRALFRV

SEQ ID NO: 1118556 - protein, 25 aa, Mycobacterium
SWYLWHWPVLILAPAMFGTDLGLAS

SEQ ID NO: 1118557 - protein, 23 aa, Mycobacterium
SYAEGLRALYLFTAVHQDAVPQL

SEQ ID NO: 1118558 - protein, 30 aa, Mycobacterium
SYAVSLAWTGDWPAWAFFSLPTRAWELAAG

SEQ ID NO: 1118559 - protein, 19 aa, Mycobacterium
SYCYGLSVVHSHLLRGAAL

SEQ ID NO: 1118560 - protein, 20 aa, Mycobacterium
SYTSVVLVFLAFMVALIAGF

SEQ ID NO: 1118561 - protein, 17 aa, Mycobacterium
TAADVLIALGITAFGAH

SEQ ID NO: 1118562 - protein, 18 aa, Mycobacterium
TAALYVRIGEQLHPVLNL

SEQ ID NO: 1118563 - protein, 24 aa, Mycobacterium
TAARAMPGSGLGLAIVKQVVLKHG

SEQ ID NO: 1118564 - protein, 18 aa, Mycobacterium
TADLRRKILFTLGVVLLY

SEQ ID NO: 1118565 - protein, 19 aa, Mycobacterium
TAEGLPLGEPVRLSVHSNA

SEQ ID NO: 1118566 - protein, 23 aa, Mycobacterium
TAFQWNWKFGYNKVNFADGTMNY

SEQ ID NO: 1118567 - protein, 28 aa, Mycobacterium
TAGAPRSTWQLILDNLWPLARAALTMTI

SEQ ID NO: 1118568 - protein, 25 aa, Mycobacterium
TAGERLRLLIQPGLVLVVGAAVVFW

SEQ ID NO: 1118569 - protein, 17 aa, Mycobacterium
TAGGFYLAFLFPLVGFL

SEQ ID NO: 1118570 - protein, 23 aa, Mycobacterium
TAHIRTGTLLGERMLTVEPKGSR

SEQ ID NO: 1118571 - protein, 18 aa, Mycobacterium
TALAMARDRHLPSGLAAV

SEQ ID NO: 1118572 - protein, 25 aa, Mycobacterium
TALAWTGPFAWDGVLSFWLKNVAIA

SEQ ID NO: 1118573 - protein, 21 aa, Mycobacterium
TALCGYAVLYLAARDLEPEGF

SEQ ID NO: 1118574 - protein, 23 aa, Mycobacterium
TALIPGRPAPRIITADMVASMKS

SEQ ID NO: 1118575 - protein, 19 aa, Mycobacterium
TALLDGFLTFFVVAAFGAL

SEQ ID NO: 1118576 - protein, 23 aa, Mycobacterium
TALRELALLWLADQVDAALAKYR

SEQ ID NO: 1118577 - protein, 30 aa, Mycobacterium
TALWGNCTIKVMVGFLFLYPAFVAKSHDAT

SEQ ID NO: 1118578 - protein, 25 aa, Mycobacterium
TAPLPDDRFDAFNANTWTFRPPPPP

SEQ ID NO: 1118579 - protein, 23 aa, Mycobacterium
TARIRYSMILFNWFGVGLIPLVM

SEQ ID NO: 1118580 - protein, 22 aa, Mycobacterium
TARMKWIPVVTFLQVSADMAVA

SEQ ID NO: 1118581 - protein, 23 aa, Mycobacterium
TARRACFGAAAGVVAICVPFGLV

SEQ ID NO: 1118582 - protein, 18 aa, Mycobacterium
TARTATRTPPAFMTVLGV

SEQ ID NO: 1118583 - protein, 24 aa, Mycobacterium
TASAWWFDMGMLALLSIAYVGFVR

SEQ ID NO: 1118584 - protein, 23 aa, Mycobacterium
TASETLGGIGLVLGVLTPLAATA

SEQ ID NO: 1118585 - protein, 20 aa, Mycobacterium
TASIIEAFSIPKVNVSSTAR

SEQ ID NO: 1118586 - protein, 40 aa, Mycobacterium
TASPRTRRAASWLAALAVPAAICALTVLLLDPLLGVAGES

SEQ ID NO: 1118587 - protein, 17 aa, Mycobacterium
TATLALRASHDDSWWLI

SEQ ID NO: 1118588 - protein, 17 aa, Mycobacterium
TAYKVALGLAIGGSASW

SEQ ID NO: 1118589 - protein, 21 aa, Mycobacterium
TCAAVLAWLAVEKIKDGHVTG

SEQ ID NO: 1118590 - protein, 26 aa, Mycobacterium
TDAEPRLRALGWTGVLDKGGDVQNSG

SEQ ID NO: 1118591 - protein, 22 aa, Mycobacterium
TDAGPWLRTGDLGFISDDELFI

SEQ ID NO: 1118592 - protein, 17 aa, Mycobacterium
TDITTFFIGSGLAAVAG

SEQ ID NO: 1118593 - protein, 24 aa, Mycobacterium
TDLLLRASVMSTYLSQDWGQDWGS

SEQ ID NO: 1118594 - protein, 18 aa, Mycobacterium
TDLPRLDATLQRLPEIYR

SEQ ID NO: 1118595 - protein, 21 aa, Mycobacterium
TDRHKVVIIGSGFGGLSAAKT

SEQ ID NO: 1118596 - protein, 24 aa, Mycobacterium
TEFALRPIAAQALEAGRPPRRLAQ

SEQ ID NO: 1118597 - protein, 21 aa, Mycobacterium
TEIEQLLGLLLSQGRAVGISV

SEQ ID NO: 1118598 - protein, 19 aa, Mycobacterium
TELLLRPTTLSTYLQDDWS

SEQ ID NO: 1118599 - protein, 26 aa, Mycobacterium
TELQADCYAGVWAHYAAVTTQESTGV

SEQ ID NO: 1118600 - protein, 36 aa, Mycobacterium
TEPVPAAARTELYWLLCLLAAGLLLGEIWLSVRELR

SEQ ID NO: 1118601 - protein, 21 aa, Mycobacterium
TERGIGNGMSLIIFASIAAAM

SEQ ID NO: 1118602 - protein, 20 aa, Mycobacterium
TERIWLPFTMWLVAAGALLP

SEQ ID NO: 1118603 - protein, 26 aa, Mycobacterium
TERLFYEPGASWAWLLAGPAAGGAML

SEQ ID NO: 1118604 - protein, 31 aa, Mycobacterium
TESAAMAFLGWRWNLPLGVAILLAAVCGGLI

SEQ ID NO: 1118605 - protein, 28 aa, Mycobacterium
TESALAIHRISAFVLPQGLITVRLSSDF

SEQ ID NO: 1118606 - protein, 25 aa, Mycobacterium
TESRIRCLWVAFAGCAVLMSSTAVY

SEQ ID NO: 1118607 - protein, 24 aa, Mycobacterium
TEVNVSLPWSKTVVLDPGVELKSV

SEQ ID NO: 1118608 - protein, 20 aa, Mycobacterium
TEVVEWKLNPGVVSTLNAQA

SEQ ID NO: 1118609 - protein, 23 aa, Mycobacterium
TFDGWPTFIAFAASLATYVVVAL

SEQ ID NO: 1118610 - protein, 23 aa, Mycobacterium
TFEGIRPTFPVLAANLANFGRIG

SEQ ID NO: 1118611 - protein, 22 aa, Mycobacterium
TFEICAPGDLICAAPESAFSIV

SEQ ID NO: 1118612 - protein, 18 aa, Mycobacterium
TFHRIWRDSPVPAYVANA

SEQ ID NO: 1118613 - protein, 19 aa, Mycobacterium
TFLECLSLAILLGLGYLAV

SEQ ID NO: 1118614 - protein, 21 aa, Mycobacterium
TFLTVEAWTFLQLGSRQQTGD

SEQ ID NO: 1118615 - protein, 18 aa, Mycobacterium
TFMVLRLVFVGWRALSGR

SEQ ID NO: 1118616 - protein, 24 aa, Mycobacterium
TFQVDPRSTLTMRRGGPPLGGFGA

SEQ ID NO: 1118617 - protein, 17 aa, Mycobacterium
TGALCIALVLTVQALLF

SEQ ID NO: 1118618 - protein, 19 aa, Mycobacterium
TGGPLRWGSALAGALNPAP

SEQ ID NO: 1118619 - protein, 18 aa, Mycobacterium
TGILPAGGPFTEAGARTW

SEQ ID NO: 1118620 - protein, 26 aa, Mycobacterium
TGLAFCIAVAPAIQFGVIGPFFHSED

SEQ ID NO: 1118621 - protein, 20 aa, Mycobacterium
TGLFDFLAIWAAKRSQGKPF

SEQ ID NO: 1118622 - protein, 20 aa, Mycobacterium
TGLGSVPLLFALGDLVIGWL

SEQ ID NO: 1118623 - protein, 20 aa, Mycobacterium
TGLHAAWGIVAKGTLGVAAA

SEQ ID NO: 1118624 - protein, 18 aa, Mycobacterium
TGLMLVLFVGLWAFTRGG

SEQ ID NO: 1118625 - protein, 22 aa, Mycobacterium
TGMKVRRYFVGFGPTLWSTHRP

SEQ ID NO: 1118626 - protein, 20 aa, Mycobacterium
TGNNPFPLGIAALGLMAAAY

SEQ ID NO: 1118627 - protein, 25 aa, Mycobacterium
TGPDFGKASPFGLLIVAALLVAVFL

SEQ ID NO: 1118628 - protein, 28 aa, Mycobacterium
TGPGRYGFDAGRGWARRPFVGSVVALLF

SEQ ID NO: 1118629 - protein, 18 aa, Mycobacterium
TGPVSPMLPGTWNPDSEP

SEQ ID NO: 1118630 - protein, 19 aa, Mycobacterium
TGSDLHWIPGHPVGSNVVS

SEQ ID NO: 1118631 - protein, 17 aa, Mycobacterium
TGTPVLVIAAVWILLAV

SEQ ID NO: 1118632 - protein, 17 aa, Mycobacterium
TGTSWLFDWPIWADGVV

SEQ ID NO: 1118633 - protein, 27 aa, Mycobacterium
THISGPRTKLFAALFLILALVVIGEIA

SEQ ID NO: 1118634 - protein, 20 aa, Mycobacterium
THREWLPVLIVPAAVVACAL

SEQ ID NO: 1118635 - protein, 31 aa, Mycobacterium
THVMKRPGTFAFPIIVVMILLIIPLGQLSLG

SEQ ID NO: 1118636 - protein, 25 aa, Mycobacterium
TIACARLSYRDGRRAALTVNVIGAV

SEQ ID NO: 1118637 - protein, 20 aa, Mycobacterium
TIACGVWAVVWAVERGLRSS

SEQ ID NO: 1118638 - protein, 18 aa, Mycobacterium
TIAGLWLQNCCKSPPEPP

SEQ ID NO: 1118639 - protein, 25 aa, Mycobacterium
TIATGCPFCRVMITDGVDDVAATRN

SEQ ID NO: 1118640 - protein, 25 aa, Mycobacterium
TIFEGEGLLHFGLSINQPPPCLTGF

SEQ ID NO: 1118641 - protein, 25 aa, Mycobacterium
TIGPRAGFFSGFAMLGAYVGFSIGT

SEQ ID NO: 1118642 - protein, 20 aa, Mycobacterium
TIICGVLFIILSYVSQLVFP

SEQ ID NO: 1118643 - protein, 21 aa, Mycobacterium
TILVIRGLRTAIAVRDSFGKL

SEQ ID NO: 1118644 - protein, 18 aa, Mycobacterium
TIMFSAVILVASSVPLLL

SEQ ID NO: 1118645 - protein, 31 aa, Mycobacterium
TIPVLLFCIAFGLSMDYEVFLMARIREYWLA

SEQ ID NO: 1118646 - protein, 19 aa, Mycobacterium
TKYPTGYAVTLFESLQDKN

SEQ ID NO: 1118647 - protein, 17 aa, Mycobacterium
TLDKLAIVGQAKPLVRR

SEQ ID NO: 1118648 - protein, 22 aa, Mycobacterium
TLFVCSATGFLILSTGAYRVFE

SEQ ID NO: 1118649 - protein, 18 aa, Mycobacterium
TLHTEFDAAALTSVAGNV

SEQ ID NO: 1118650 - protein, 24 aa, Mycobacterium
TLIAVSIVWWPFYARLVRGEITRL

SEQ ID NO: 1118651 - protein, 23 aa, Mycobacterium
TLLGAGLLWAGWYAFNGGSALAA

SEQ ID NO: 1118652 - protein, 26 aa, Mycobacterium
TLLMALACWWVISREVIPRLGHAVKA

SEQ ID NO: 1118653 - protein, 27 aa, Mycobacterium
TLLPAILVLAGPRGWVKPRRELTSRFW

SEQ ID NO: 1118654 - protein, 32 aa, Mycobacterium
TLMPDESFMSWGWRVPFLVSLLLLGLGIYVRL

SEQ ID NO: 1118655 - protein, 24 aa, Mycobacterium
TLPVQLGKDWLWLHAARTAAVTLP

SEQ ID NO: 1118656 - protein, 19 aa, Mycobacterium
TLRPRITTFDAAVGSGTGL

SEQ ID NO: 1118657 - protein, 26 aa, Mycobacterium
TLRTIKGNLFWAFAYNVAALPLAAFG

SEQ ID NO: 1118658 - protein, 30 aa, Mycobacterium
TLTAPHPWLGVALMFVLGVVVTFSGVLSEV

SEQ ID NO: 1118659 - protein, 23 aa, Mycobacterium
TLTHAVPKLSSALVHAYPAEPSR

SEQ ID NO: 1118660 - protein, 25 aa, Mycobacterium
TLVGACLRIPYTLATARFGGRNWTV

SEQ ID NO: 1118661 - protein, 26 aa, Mycobacterium
TLVGVIGFACVITFLSDHRMLARYGY

SEQ ID NO: 1118662 - protein, 17 aa, Mycobacterium
TLVITWFALYALYRLIT

SEQ ID NO: 1118663 - protein, 25 aa, Mycobacterium
TLVKRDFWRVLGIWILAALAAAVIA

SEQ ID NO: 1118664 - protein, 19 aa, Mycobacterium
TLVPATWATSAAWAFSLAM

SEQ ID NO: 1118665 - protein, 25 aa, Mycobacterium
TLVVDRLSALMLMVSSIVLLAVVAY

SEQ ID NO: 1118666 - protein, 26 aa, Mycobacterium
TLYQNIRIGIPFGPSFFEMNLQGLSI

SEQ ID NO: 1118667 - protein, 19 aa, Mycobacterium
TMAGLPFAMFFVVTIPAWF

SEQ ID NO: 1118668 - protein, 21 aa, Mycobacterium
TMARRLIGWAPGHPGTEEEVA

SEQ ID NO: 1118669 - protein, 35 aa, Mycobacterium
TMIWVRLRAPWARRPVEFLCLLPLTIPALVIVVGL

SEQ ID NO: 1118670 - protein, 31 aa, Mycobacterium
TMPLVRLTASWPRRRTLLLTLVCLTASQAVC

SEQ ID NO: 1118671 - protein, 23 aa, Mycobacterium
TMRRLRAAGLNRLVMLTGDRAEP

SEQ ID NO: 1118672 - protein, 17 aa, Mycobacterium
TNIVWPRTVSESWYMNW

SEQ ID NO: 1118673 - protein, 29 aa, Mycobacterium
TNRVELLKLAVILALWAAVAAAFVSVIYR

SEQ ID NO: 1118674 - protein, 24 aa, Mycobacterium
TNVSGLRPGQFVRASGVEVGKVSK

SEQ ID NO: 1118675 - protein, 19 aa, Mycobacterium
TPDAGFAIAEREVTPKEAG

SEQ ID NO: 1118676 - protein, 18 aa, Mycobacterium
TPDPRPAAVPKMLAAQFG

SEQ ID NO: 1118677 - protein, 25 aa, Mycobacterium
TPDWLPWLRWVVLALAILVAAILVV

SEQ ID NO: 1118678 - protein, 23 aa, Mycobacterium
TPESGNAFGGWLCPLGTDMDDPA

SEQ ID NO: 1118679 - protein, 20 aa, Mycobacterium
TPFLGRRTYVLLTHLEEAGP

SEQ ID NO: 1118680 - protein, 23 aa, Mycobacterium
TPGRRIWLAAAIVAPAVVLLEPI

SEQ ID NO: 1118681 - protein, 17 aa, Mycobacterium
TPILLQLIFLYNVLPQW

SEQ ID NO: 1118682 - protein, 28 aa, Mycobacterium
TPLSFLARPARWMQMVAGSPLAITAGPN

SEQ ID NO: 1118683 - protein, 28 aa, Mycobacterium
TPLWRAAQVFRLLSWVYALGFQLSVNDD

SEQ ID NO: 1118684 - protein, 23 aa, Mycobacterium
TPLYSVAVILSFLASQLTTVVLF

SEQ ID NO: 1118685 - protein, 24 aa, Mycobacterium
TPMLFSVGFLLTFLLGGLSGVLLA

SEQ ID NO: 1118686 - protein, 23 aa, Mycobacterium
TPREIKLAATYFLVTPLIVLIGT

SEQ ID NO: 1118687 - protein, 24 aa, Mycobacterium
TPRYPTIPRWGLVEHFDTVDPSAA

SEQ ID NO: 1118688 - protein, 19 aa, Mycobacterium
TPSAHWGEPALVFEPDPQD

SEQ ID NO: 1118689 - protein, 25 aa, Mycobacterium
TPTLLKLLVMFAGVALTVIALGALH

SEQ ID NO: 1118690 - protein, 24 aa, Mycobacterium
TPTTPRPIAAGLFNAIPEAPPLAA

SEQ ID NO: 1118691 - protein, 19 aa, Mycobacterium
TPWCAVGLVALPLAVRAAR

SEQ ID NO: 1118692 - protein, 23 aa, Mycobacterium
TPYSPWWLWAAILLVLLVIAWYA

SEQ ID NO: 1118693 - protein, 18 aa, Mycobacterium
TQASRVVVAAALIMMAVF

SEQ ID NO: 1118694 - protein, 18 aa, Mycobacterium
TQIWRFLLTGGFAAIVDF

SEQ ID NO: 1118695 - protein, 21 aa, Mycobacterium
TQRWAYPLLLVLSGVALGVSG

SEQ ID NO: 1118696 - protein, 18 aa, Mycobacterium
TRAWCGIAAAAVALGVTE

SEQ ID NO: 1118697 - protein, 25 aa, Mycobacterium
TRDFKGSALRLVRRLTPQRTLTASV

SEQ ID NO: 1118698 - protein, 18 aa, Mycobacterium
TRESLPFDAPREPAIEAA

SEQ ID NO: 1118699 - protein, 24 aa, Mycobacterium
TRFFSLEYDQWFGVVLPAVENAGC

SEQ ID NO: 1118700 - protein, 18 aa, Mycobacterium
TRHRIVFGLIALAGAIAW

SEQ ID NO: 1118701 - protein, 18 aa, Mycobacterium
TRMRYSGVSLGYQVTSIV

SEQ ID NO: 1118702 - protein, 23 aa, Mycobacterium
TRPDLKRGFKAPFVPLLPIAAII

SEQ ID NO: 1118703 - protein, 17 aa, Mycobacterium
TRQVDLFADRRFTLAQT

SEQ ID NO: 1118704 - protein, 20 aa, Mycobacterium
TRRRPRILLLGSVGGFALRR

SEQ ID NO: 1118705 - protein, 17 aa, Mycobacterium
TRSLLVRHWRLTGKCLR

SEQ ID NO: 1118706 - protein, 18 aa, Mycobacterium
TRSTWLLLGPAFVAAIAY

SEQ ID NO: 1118707 - protein, 19 aa, Mycobacterium
TRTPPAFMTVLGVLLLPFV

SEQ ID NO: 1118708 - protein, 19 aa, Mycobacterium
TRVPARRAAIVGDIGMALS

SEQ ID NO: 1118709 - protein, 21 aa, Mycobacterium
TRYAHCPLRRLTGVSASGGAA

SEQ ID NO: 1118710 - protein, 26 aa, Mycobacterium
TSAAWAFSLAMVDGWQRGFAGRLTAR

SEQ ID NO: 1118711 - protein, 24 aa, Mycobacterium
TSDILWYLLVAHLIHFAVVPLVGW

SEQ ID NO: 1118712 - protein, 18 aa, Mycobacterium
TSEAVVFWILGGIALIGA

SEQ ID NO: 1118713 - protein, 24 aa, Mycobacterium
TSIAFAVGVIRLGRRQCLVNELPA

SEQ ID NO: 1118714 - protein, 19 aa, Mycobacterium
TSLDELPQLINVVVGEMSL

SEQ ID NO: 1118715 - protein, 26 aa, Mycobacterium
TSMLQRKLRVGFAKAGRLMDLMETRG

SEQ ID NO: 1118716 - protein, 24 aa, Mycobacterium
TSPLPNWLPDAFRAAAAGVLALAG

SEQ ID NO: 1118717 - protein, 25 aa, Mycobacterium
TSQYRLSDPGLRRPVVYPRGTLVMA

SEQ ID NO: 1118718 - protein, 22 aa, Mycobacterium
TSSKTSMPWMFFFAGLAIPAFY

SEQ ID NO: 1118719 - protein, 23 aa, Mycobacterium
TSSMRWYPIVTFWQVGADMTNAS

SEQ ID NO: 1118720 - protein, 20 aa, Mycobacterium
TSWLFDWPIWADGVVFLLVS

SEQ ID NO: 1118721 - protein, 25 aa, Mycobacterium
TSWPYADVVVAVFVALWVLPRAISL

SEQ ID NO: 1118722 - protein, 21 aa, Mycobacterium
TTALFQWGWFQQLIGLSATGP

SEQ ID NO: 1118723 - protein, 23 aa, Mycobacterium
TTIGCGIARGGPYKTTGQTLTQK

SEQ ID NO: 1118724 - protein, 17 aa, Mycobacterium
TTLSTYLQDDWSRDWGA

SEQ ID NO: 1118725 - protein, 23 aa, Mycobacterium
TTLVNLLMRFYDVDSGRILIDGV

SEQ ID NO: 1118726 - protein, 21 aa, Mycobacterium
TTPDCPGCLTGQAMHPSFLYE

SEQ ID NO: 1118727 - protein, 24 aa, Mycobacterium
TTPDFPWTALTIVLVIGVAAATAA

SEQ ID NO: 1118728 - protein, 19 aa, Mycobacterium
TTPYYARMHKWIKRAVLVC

SEQ ID NO: 1118729 - protein, 22 aa, Mycobacterium
TTRAGGFGYGFLYGLAFYVPLL

SEQ ID NO: 1118730 - protein, 25 aa, Mycobacterium
TTTGRAVAFLAPWLFFMFIDLFDSD

SEQ ID NO: 1118731 - protein, 24 aa, Mycobacterium
TTVDTPDGLYCKLPQDSPISVRGA

SEQ ID NO: 1118732 - protein, 25 aa, Mycobacterium
TTVIIRFWLLTAIACGLGVALFYGE

SEQ ID NO: 1118733 - protein, 34 aa, Mycobacterium
TTWTNWVEIFLLSCIAFSLPRTFGRMVGSRKQGA

SEQ ID NO: 1118734 - protein, 29 aa, Mycobacterium
TVAFQACFVSAGAVAARFGAAAVAAHQVV

SEQ ID NO: 1118735 - protein, 17 aa, Mycobacterium
TVAGVPFFARLVQNALR

SEQ ID NO: 1118736 - protein, 25 aa, Mycobacterium
TVCSYADRVCFGWVAGAEVMPDIAT

SEQ ID NO: 1118737 - protein, 28 aa, Mycobacterium
TVERWTVHIPFRVYLGWISVATIANATI

SEQ ID NO: 1118738 - protein, 18 aa, Mycobacterium
TVIAGRRLPIAASALNTG

SEQ ID NO: 1118739 - protein, 17 aa, Mycobacterium
TVIRAGENLSLMLAGSQ

SEQ ID NO: 1118740 - protein, 22 aa, Mycobacterium
TVKPLLSWAGLLLIVASMVVLG

SEQ ID NO: 1118741 - protein, 17 aa, Mycobacterium
TVLACGLLLPSVQSNSM

SEQ ID NO: 1118742 - protein, 18 aa, Mycobacterium
TVLFSALTVALSMATMVL

SEQ ID NO: 1118743 - protein, 20 aa, Mycobacterium
TVLFTAPASALWGLLAVIAA

SEQ ID NO: 1118744 - protein, 20 aa, Mycobacterium
TVLLAAAVPAVWAQQNLVSE

SEQ ID NO: 1118745 - protein, 24 aa, Mycobacterium
TVLLFPVVQPWYLLWAIIPLATWA

SEQ ID NO: 1118746 - protein, 24 aa, Mycobacterium
TVLRSELYAIPALVAAMITVVAIR

SEQ ID NO: 1118747 - protein, 23 aa, Mycobacterium
TVLTLALLVSRWAADVLGPNGLV

SEQ ID NO: 1118748 - protein, 25 aa, Mycobacterium
TVPECIKKGRYVDMVKGMASATEIR

SEQ ID NO: 1118749 - protein, 27 aa, Mycobacterium
TVPLCVVIGVGVAWLVERTDLPGRAFW

SEQ ID NO: 1118750 - protein, 22 aa, Mycobacterium
TVPTRNALIFGLVLSVGSFFWL

SEQ ID NO: 1118751 - protein, 27 aa, Mycobacterium
TVQAAQLSAMWARFPLPVIPAPGDPTP

SEQ ID NO: 1118752 - protein, 22 aa, Mycobacterium
TVSESWYMNWAFFVAMGAILAL

SEQ ID NO: 1118753 - protein, 24 aa, Mycobacterium
TVSHTRFAAWLGRPMTSFHLIIAV

SEQ ID NO: 1118754 - protein, 29 aa, Mycobacterium
TVVVVVGGVILWRFFGDALSERSDAASAR

SEQ ID NO: 1118755 - protein, 24 aa, Mycobacterium
TVYDLRWRRLPNWLTLPGATVILV

SEQ ID NO: 1118756 - protein, 43 aa, Mycobacterium
TVYTEYKLNSAYAVGGPKCLVKVVQKLSGLSVNRFMAVDFAGF

SEQ ID NO: 1118757 - protein, 21 aa, Mycobacterium
TWATRPGFRGATIAVTLIVGI

SEQ ID NO: 1118758 - protein, 19 aa, Mycobacterium
TWMIARVSLIPTLLVAIPF

SEQ ID NO: 1118759 - protein, 19 aa, Mycobacterium
TWMTWVGGISLGMFALGLV

SEQ ID NO: 1118760 - protein, 25 aa, Mycobacterium
TWPGDLGERPALWIPASGVSAARLE

SEQ ID NO: 1118761 - protein, 22 aa, Mycobacterium
TWSARLLAGFLRGRVPFSAAER

SEQ ID NO: 1118762 - protein, 22 aa, Mycobacterium
TYALRHRWWVVLSGVGIAAVLV

SEQ ID NO: 1118763 - protein, 19 aa, Mycobacterium
TYEIPGIIAEYLALHHGKQ

SEQ ID NO: 1118764 - protein, 21 aa, Mycobacterium
TYRPELGVLYPSELETGMRIY

SEQ ID NO: 1118765 - protein, 24 aa, Mycobacterium
TYRRPRRQPTPSANRWLPPLDEPT

SEQ ID NO: 1118766 - protein, 25 aa, Mycobacterium
TYRVWKFRGTWPIWHGAGWFLFMLF

SEQ ID NO: 1118767 - protein, 18 aa, Mycobacterium
TYYVCLLLLLICAPLSVF

SEQ ID NO: 1118768 - protein, 18 aa, Mycobacterium
VAAFRRLPVEIGCLQARL

SEQ ID NO: 1118769 - protein, 22 aa, Mycobacterium
VAAGLWCGALVGLLVTVAHRGQ

SEQ ID NO: 1118770 - protein, 17 aa, Mycobacterium
VAAHGLGSVALVTVVAG

SEQ ID NO: 1118771 - protein, 17 aa, Mycobacterium
VAALGLLVYLCNFGPIF

SEQ ID NO: 1118772 - protein, 22 aa, Mycobacterium
VAAPTFEFFALYGTAAVYYWVI

SEQ ID NO: 1118773 - protein, 17 aa, Mycobacterium
VACGMYSALAIVVVSAI

SEQ ID NO: 1118774 - protein, 19 aa, Mycobacterium
VACQVPIYLMRSSRFTALE

SEQ ID NO: 1118775 - protein, 18 aa, Mycobacterium
VACTRYAHCPLRRLTGVS

SEQ ID NO: 1118776 - protein, 19 aa, Mycobacterium
VADSCSQPPSLSLTQLGNS

SEQ ID NO: 1118777 - protein, 19 aa, Mycobacterium
VAEAPAWAAPTPEPPPEPT

SEQ ID NO: 1118778 - protein, 21 aa, Mycobacterium
VAFAVLVVFLLPALRDGASAV

SEQ ID NO: 1118779 - protein, 17 aa, Mycobacterium
VAFLSALVLELLATLGV

SEQ ID NO: 1118780 - protein, 18 aa, Mycobacterium
VAFVFARIFVEPAIDLAI

SEQ ID NO: 1118781 - protein, 21 aa, Mycobacterium
VAFWIGRPIITLSFNNEKFNA

SEQ ID NO: 1118782 - protein, 18 aa, Mycobacterium
VAGAPLLVRLMLGDDPQV

SEQ ID NO: 1118783 - protein, 18 aa, Mycobacterium
VAGARVRRANYVYGSAKA

SEQ ID NO: 1118784 - protein, 38 aa, Mycobacterium
VAGCGIAGLGRTVTFIPWPVIEGFTLGIAVIIFAQQLP

SEQ ID NO: 1118785 - protein, 18 aa, Mycobacterium
VAGLGLWLLTRPRSADPR

SEQ ID NO: 1118786 - protein, 24 aa, Mycobacterium
VAGSVCLMVCYLLVEIAAAWFVGA

SEQ ID NO: 1118787 - protein, 25 aa, Mycobacterium
VAGVIYMLVRFVRRTVAGVWKSTAG

SEQ ID NO: 1118788 - protein, 18 aa, Mycobacterium
VAHIARWAGCVGNRSTIA

SEQ ID NO: 1118789 - protein, 17 aa, Mycobacterium
VAIEFVLGMALALVMHR

SEQ ID NO: 1118790 - protein, 21 aa, Mycobacterium
VAKTRIKAVQSRAGVTGNDVV

SEQ ID NO: 1118791 - protein, 23 aa, Mycobacterium
VALDRPDTLYSFAYSDQSPDQPL

SEQ ID NO: 1118792 - protein, 19 aa, Mycobacterium
VALEMVIATLILRGRHDRL

SEQ ID NO: 1118793 - protein, 20 aa, Mycobacterium
VALFFVWMIAVAFLYLVLGG

SEQ ID NO: 1118794 - protein, 21 aa, Mycobacterium
VALGFPLADPIIGLVITVAIL

SEQ ID NO: 1118795 - protein, 17 aa, Mycobacterium
VALGLTVTLVWLYIEIL

SEQ ID NO: 1118796 - protein, 19 aa, Mycobacterium
VALPWRTLGLPGDITLVGA

SEQ ID NO: 1118797 - protein, 17 aa, Mycobacterium
VALSWAIGPVWRVLSPV

SEQ ID NO: 1118798 - protein, 18 aa, Mycobacterium
VALWGRILPITFTAVGLV

SEQ ID NO: 1118799 - protein, 17 aa, Mycobacterium
VAPFPLSAFVVGAVNAA

SEQ ID NO: 1118800 - protein, 20 aa, Mycobacterium
VAPMLLEWYKRRKAAKRAGI

SEQ ID NO: 1118801 - protein, 25 aa, Mycobacterium
VAPPKPGTVYQMWLVGSDGPHSAGT

SEQ ID NO: 1118802 - protein, 19 aa, Mycobacterium
VAPPRGKWAGRLTRAALPL

SEQ ID NO: 1118803 - protein, 23 aa, Mycobacterium
VAQDSPPAWSGRTPRFALTVGGR

SEQ ID NO: 1118804 - protein, 22 aa, Mycobacterium
VARHRLLPRLMPGGDYVSTGDG

SEQ ID NO: 1118805 - protein, 17 aa, Mycobacterium
VARLEIIVVPVALATML

SEQ ID NO: 1118806 - protein, 26 aa, Mycobacterium
VARPYEWWRVALVAVSALAYVVIFSI

SEQ ID NO: 1118807 - protein, 20 aa, Mycobacterium
VARRLSPRVDRRWQQANLRR

SEQ ID NO: 1118808 - protein, 19 aa, Mycobacterium
VARYSDLREPYWIALTVLL

SEQ ID NO: 1118809 - protein, 25 aa, Mycobacterium
VASAISVLWPPTGMVAAISAAAFIG

SEQ ID NO: 1118810 - protein, 20 aa, Mycobacterium
VASHELRTPLTAMRTNLEVL

SEQ ID NO: 1118811 - protein, 23 aa, Mycobacterium
VASRLTWVEVRSFDGLGQPKTST

SEQ ID NO: 1118812 - protein, 27 aa, Mycobacterium
VAVAGFWLAGLGFGWAMTGLSTVVQER

SEQ ID NO: 1118813 - protein, 23 aa, Mycobacterium
VAVCVAEPDVALVAVVTADTVHV

SEQ ID NO: 1118814 - protein, 18 aa, Mycobacterium
VAVFLSRFIVQRHLYDAD

SEQ ID NO: 1118815 - protein, 24 aa, Mycobacterium
VAVGIWWRYRYDKFGWTTRSSQLY

SEQ ID NO: 1118816 - protein, 17 aa, Mycobacterium
VAVGVGCAALAALAVGA

SEQ ID NO: 1118817 - protein, 19 aa, Mycobacterium
VAVIAALWVSRADAAVIEW

SEQ ID NO: 1118818 - protein, 20 aa, Mycobacterium
VAVLFSWGAWERRWIADDGL

SEQ ID NO: 1118819 - protein, 19 aa, Mycobacterium
VAVPAAKTWEVLTDVERVA

SEQ ID NO: 1118820 - protein, 21 aa, Mycobacterium
VAVPLAKRFAPVVAGVAAGAA

SEQ ID NO: 1118821 - protein, 21 aa, Mycobacterium
VAVSGAVTWQWSGWPERTRAP

SEQ ID NO: 1118822 - protein, 21 aa, Mycobacterium
VAVVVAVRIARRAMRTDRGEP

SEQ ID NO: 1118823 - protein, 30 aa, Mycobacterium
VAWAVFLVLAWRIMRAPAYVPQELEAEVAV

SEQ ID NO: 1118824 - protein, 40 aa, Mycobacterium
VAYQVFTNLVGWPTWAMIFASPFLLAALIPLGIAGLVLII

SEQ ID NO: 1118825 - protein, 23 aa, Mycobacterium
VAYRPLRRRGARPLTFLITAIGM

SEQ ID NO: 1118826 - protein, 19 aa, Mycobacterium
VCIAGAWLYTGGSKPYGYL

SEQ ID NO: 1118827 - protein, 26 aa, Mycobacterium
VCLLLLLICAPLSVFAGLIVTAALGK

SEQ ID NO: 1118828 - protein, 22 aa, Mycobacterium
VCMGWCAVNTWIVLDLVMALLG

SEQ ID NO: 1118829 - protein, 41 aa, Mycobacterium
VDGANWFYMFRKLMLPMLWPYILVAVIFRFMDNLKVFDHIY

SEQ ID NO: 1118830 - protein, 26 aa, Mycobacterium
VDGQPATGWTLNWARNLIESAPQPKH

SEQ ID NO: 1118831 - protein, 18 aa, Mycobacterium
VDGVVLGGFAIWYVLGAN

SEQ ID NO: 1118832 - protein, 22 aa, Mycobacterium
VDHLGWQWIFFVNVPVGVAGLA

SEQ ID NO: 1118833 - protein, 23 aa, Mycobacterium
VDKLRPLGLLVRADGAQPALKKQ

SEQ ID NO: 1118834 - protein, 18 aa, Mycobacterium
VDLCWRLVEAGARLRYEP

SEQ ID NO: 1118835 - protein, 19 aa, Mycobacterium
VDLIKMMIAPVIFCTIVLG

SEQ ID NO: 1118836 - protein, 17 aa, Mycobacterium
VDLMVVPGVAAVAQPKL

SEQ ID NO: 1118837 - protein, 20 aa, Mycobacterium
VDLRDTAVVRALRLDGVTPR

SEQ ID NO: 1118838 - protein, 17 aa, Mycobacterium
VDMPGRLPDGSGAKTSV

SEQ ID NO: 1118839 - protein, 24 aa, Mycobacterium
VDMSRRYGADFGFVSYDPAWVEGL

SEQ ID NO: 1118840 - protein, 28 aa, Mycobacterium
VDPKGWQFAFKYALGRTIAALGVLLISP

SEQ ID NO: 1118841 - protein, 27 aa, Mycobacterium
VDPSNACGLRVGVAYSVIQETDELPAK

SEQ ID NO: 1118842 - protein, 21 aa, Mycobacterium
VDPVAALTWRVPSATAAAAVA

SEQ ID NO: 1118843 - protein, 26 aa, Mycobacterium
VDQKRWSFDLAMTWDLLARSITHAIV

SEQ ID NO: 1118844 - protein, 27 aa, Mycobacterium
VDRAHPRPIVGFGFSALAIGLTWLSIE

SEQ ID NO: 1118845 - protein, 18 aa, Mycobacterium
VDREIPFQISAAAAHAVQ

SEQ ID NO: 1118846 - protein, 37 aa, Mycobacterium
VDTWLQSWTIFYWAWWISWTPFVGMFIARISRGRTIR

SEQ ID NO: 1118847 - protein, 17 aa, Mycobacterium
VDYLAALALIVASGAAT

SEQ ID NO: 1118848 - protein, 21 aa, Mycobacterium
VDYSLFILMRFREELRAGRDA

SEQ ID NO: 1118849 - protein, 21 aa, Mycobacterium
VEALARWTAPNGMQISPETFV

SEQ ID NO: 1118850 - protein, 18 aa, Mycobacterium
VEAVAPWLTTDTTVYPAI

SEQ ID NO: 1118851 - protein, 28 aa, Mycobacterium
VEAVRRRLWHRLPWLVLGLLGAMVSAVL

SEQ ID NO: 1118852 - protein, 17 aa, Mycobacterium
VEEQFYLVWPLLIVGTA

SEQ ID NO: 1118853 - protein, 17 aa, Mycobacterium
VEEQFYLVWPLLLIAVV

SEQ ID NO: 1118854 - protein, 24 aa, Mycobacterium
VEGPGRREFIAFLQKFVVKKRILE

SEQ ID NO: 1118855 - protein, 19 aa, Mycobacterium
VEGREVWNTYGPTEATVVA

SEQ ID NO: 1118856 - protein, 26 aa, Mycobacterium
VELPSPARSSARISIINVGRDVTCSV

SEQ ID NO: 1118857 - protein, 20 aa, Mycobacterium
VEPAVMWLLLPVVAFGSAYV

SEQ ID NO: 1118858 - protein, 18 aa, Mycobacterium
VEQGFWGKLVTHVMKRPG

SEQ ID NO: 1118859 - protein, 17 aa, Mycobacterium
VFAILAIVFSVGFSIVA

SEQ ID NO: 1118860 - protein, 18 aa, Mycobacterium
VFAPVHWVAVIPLGAGCL

SEQ ID NO: 1118861 - protein, 18 aa, Mycobacterium
VFAVKSGAFFALTVGILG

SEQ ID NO: 1118862 - protein, 17 aa, Mycobacterium
VFAYICVAYLVSYATTV

SEQ ID NO: 1118863 - protein, 19 aa, Mycobacterium
VFDCLKFRSMRPAPAGATF

SEQ ID NO: 1118864 - protein, 27 aa, Mycobacterium
VFFALFAIAAAWAFWLHLTPRPESRIV

SEQ ID NO: 1118865 - protein, 24 aa, Mycobacterium
VFFDRTGKRLYYFAAGVIVLAVIV

SEQ ID NO: 1118866 - protein, 22 aa, Mycobacterium
VFKEPRWPVPGTRAEKRAERSV

SEQ ID NO: 1118867 - protein, 18 aa, Mycobacterium
VFLFWPWEYQPYGSEGEF

SEQ ID NO: 1118868 - protein, 28 aa, Mycobacterium
VFSACYVLGCLLAVLAVRQAGLFTAVIQ

SEQ ID NO: 1118869 - protein, 21 aa, Mycobacterium
VFSAPIGYLFRPYIVYRSRDV

SEQ ID NO: 1118870 - protein, 20 aa, Mycobacterium
VFVGAGAFAGAMLQPYLADR

SEQ ID NO: 1118871 - protein, 18 aa, Mycobacterium
VGALAFWVSHSVAGMTTQ

SEQ ID NO: 1118872 - protein, 20 aa, Mycobacterium
VGALIMFLAALSMGRLSVRS

SEQ ID NO: 1118873 - protein, 17 aa, Mycobacterium
VGALLGLLISGRNEHAD

SEQ ID NO: 1118874 - protein, 18 aa, Mycobacterium
VGALTAWFLVSANSGNAY

SEQ ID NO: 1118875 - protein, 21 aa, Mycobacterium
VGALVAFAALTVWFVIDPQLW

SEQ ID NO: 1118876 - protein, 19 aa, Mycobacterium
VGAMLAWARRRPVLAGALI

SEQ ID NO: 1118877 - protein, 17 aa, Mycobacterium
VGAWFPLVFLATHIVVT

SEQ ID NO: 1118878 - protein, 19 aa, Mycobacterium
VGDGLFGLAGWQFMMICSG

SEQ ID NO: 1118879 - protein, 18 aa, Mycobacterium
VGDLPILLGALVVNGFTR

SEQ ID NO: 1118880 - protein, 18 aa, Mycobacterium
VGESKGYFLLGIWMSLFW

SEQ ID NO: 1118881 - protein, 22 aa, Mycobacterium
VGFAVSFAPDFNGIELESDVLL

SEQ ID NO: 1118882 - protein, 17 aa, Mycobacterium
VGFEFTNIVWPRTVSES

SEQ ID NO: 1118883 - protein, 21 aa, Mycobacterium
VGGILWNLLTWLFGIPSSSSH

SEQ ID NO: 1118884 - protein, 17 aa, Mycobacterium
VGGLGTWFTEGYQANKS

SEQ ID NO: 1118885 - protein, 23 aa, Mycobacterium
VGGPRRKSRIISEHEKKITAYHE

SEQ ID NO: 1118886 - protein, 19 aa, Mycobacterium
VGGTWHWNTYPGIAVDIPS

SEQ ID NO: 1118887 - protein, 24 aa, Mycobacterium
VGGVPRRRIVIASMVGTTIEFYDF

SEQ ID NO: 1118888 - protein, 19 aa, Mycobacterium
VGGVTRLIPLTGLTTPWMS

SEQ ID NO: 1118889 - protein, 21 aa, Mycobacterium
VGGVVCLLLGMSLMGGNIRDH

SEQ ID NO: 1118890 - protein, 19 aa, Mycobacterium
VGGWQPVPAEGQWIPAGAP

SEQ ID NO: 1118891 - protein, 17 aa, Mycobacterium
VGIAELIPDAAYYRGQG

SEQ ID NO: 1118892 - protein, 22 aa, Mycobacterium
VGIAVVECWRGRRYLQPRLALA

SEQ ID NO: 1118893 - protein, 17 aa, Mycobacterium
VGLAIAVATRWLINKLP

SEQ ID NO: 1118894 - protein, 19 aa, Mycobacterium
VGLASYLLIGFWSYKPSAA

SEQ ID NO: 1118895 - protein, 25 aa, Mycobacterium
VGLIAQYTSFGWAFLISGVILGVAA

SEQ ID NO: 1118896 - protein, 27 aa, Mycobacterium
VGLPAEQSGGVVLDGFVERVGDPVPLV

SEQ ID NO: 1118897 - protein, 22 aa, Mycobacterium
VGLPGAYSMVAWIGLTGLLMLA

SEQ ID NO: 1118898 - protein, 21 aa, Mycobacterium
VGLRDEFFDNLGVVAALAVGG

SEQ ID NO: 1118899 - protein, 18 aa, Mycobacterium
VGLVTLWVLFTRARGEAD

SEQ ID NO: 1118900 - protein, 17 aa, Mycobacterium
VGMRRWAAVCFSLAAFL

SEQ ID NO: 1118901 - protein, 25 aa, Mycobacterium
VGPFIYCVIVFTALIDWIVWHHPPT

SEQ ID NO: 1118902 - protein, 35 aa, Mycobacterium
VGPLEFGGFIAWLAWLALHLVYLVGFKTKIVTLIS

SEQ ID NO: 1118903 - protein, 17 aa, Mycobacterium
VGPLRFLNQEVLDAATV

SEQ ID NO: 1118904 - protein, 20 aa, Mycobacterium
VGRKPLWWFSLIGLFVAGVP

SEQ ID NO: 1118905 - protein, 21 aa, Mycobacterium
VGRRLRIRIIAALTRAGIATK

SEQ ID NO: 1118906 - protein, 25 aa, Mycobacterium
VGTELPRRATIPFTSERQCMATLHG

SEQ ID NO: 1118907 - protein, 24 aa, Mycobacterium
VGTFGMLRYCLQLFPDAATLFRPL

SEQ ID NO: 1118908 - protein, 21 aa, Mycobacterium
VGTTIEWYDFFLYATAASLVF

SEQ ID NO: 1118909 - protein, 18 aa, Mycobacterium
VGTVLALIALVVVFIVGW

SEQ ID NO: 1118910 - protein, 29 aa, Mycobacterium
VGVAAMLLACLWKAAMLVSTVPFAALRKA

SEQ ID NO: 1118911 - protein, 17 aa, Mycobacterium
VGVASVIAEGFLVLPFS

SEQ ID NO: 1118912 - protein, 18 aa, Mycobacterium
VGVATIWLSVIVLLPLAA

SEQ ID NO: 1118913 - protein, 18 aa, Mycobacterium
VGVGFAFASLPALINAAV

SEQ ID NO: 1118914 - protein, 19 aa, Mycobacterium
VGVGGTFLFSHLFDMQSMT

SEQ ID NO: 1118915 - protein, 17 aa, Mycobacterium
VGVLARLLLPGKQSIGM

SEQ ID NO: 1118916 - protein, 20 aa, Mycobacterium
VGVLFAVVFLLTGRGNARLA

SEQ ID NO: 1118917 - protein, 26 aa, Mycobacterium
VGVLGVRIWLTNHVDFSLPVNQMTAA

SEQ ID NO: 1118918 - protein, 20 aa, Mycobacterium
VGVMAFELLTGVTPFNGDSA

SEQ ID NO: 1118919 - protein, 17 aa, Mycobacterium
VGVPIEQAWDVLTDLEQ

SEQ ID NO: 1118920 - protein, 21 aa, Mycobacterium
VHGTVPWWFVVTLLGRDVVLA

SEQ ID NO: 1118921 - protein, 24 aa, Mycobacterium
VHLEIAPGVVTTWMKLAVRDRIDP

SEQ ID NO: 1118922 - protein, 19 aa, Mycobacterium
VIAAFERWTVPPTVAILVA

SEQ ID NO: 1118923 - protein, 18 aa, Mycobacterium
VIACPCALGLATPTALLV

SEQ ID NO: 1118924 - protein, 23 aa, Mycobacterium
VIAGYWRRGALVLAIGVGVAAGL

SEQ ID NO: 1118925 - protein, 27 aa, Mycobacterium
VIAKYRAGGSLTRFGMLAAQVVPPAVM

SEQ ID NO: 1118926 - protein, 21 aa, Mycobacterium
VIAMIPLVWLLYTVVAKGVRA

SEQ ID NO: 1118927 - protein, 19 aa, Mycobacterium
VIAVAGWTLIYWAQMPEGF

SEQ ID NO: 1118928 - protein, 23 aa, Mycobacterium
VIAYCLGLGIPFVLLAFGSARAV

SEQ ID NO: 1118929 - protein, 24 aa, Mycobacterium
VIDAGDPTLHWAEIGAELEESVAT

SEQ ID NO: 1118930 - protein, 18 aa, Mycobacterium
VIFAVFAWWQLRAPAPIV

SEQ ID NO: 1118931 - protein, 19 aa, Mycobacterium
VIFPLIMVLSAYFFFAGHN

SEQ ID NO: 1118932 - protein, 22 aa, Mycobacterium
VIGMWMPIMLFFYMGFEHSVVN

SEQ ID NO: 1118933 - protein, 17 aa, Mycobacterium
VIIGSGFGGLSAAKTLK

SEQ ID NO: 1118934 - protein, 26 aa, Mycobacterium
VILGLMMCFDLGGPVNKAAYAFATTG

SEQ ID NO: 1118935 - protein, 18 aa, Mycobacterium
VILIAARLLQGFATGGEY

SEQ ID NO: 1118936 - protein, 26 aa, Mycobacterium
VIMIGLQPIRLLSWATALRYQALFTE

SEQ ID NO: 1118937 - protein, 25 aa, Mycobacterium
VIVSVRLSVLFSFQGNDMMTSFQVI

SEQ ID NO: 1118938 - protein, 23 aa, Mycobacterium
VIVVALFAQWLIPYGVNDIDVPN

SEQ ID NO: 1118939 - protein, 26 aa, Mycobacterium
VKADTRTGLYWVPGSRGYDDAVAEIY

SEQ ID NO: 1118940 - protein, 24 aa, Mycobacterium
VKAPLWPLHRWLPDAAVEATPASA

SEQ ID NO: 1118941 - protein, 30 aa, Mycobacterium
VKDARFLDALFPVWRYHPFFTDSDEPVDAS

SEQ ID NO: 1118942 - protein, 19 aa, Mycobacterium
VKDRQRFAGKPVVASGVKR

SEQ ID NO: 1118943 - protein, 20 aa, Mycobacterium
VKGANPAFRQPFEYFDKGSM

SEQ ID NO: 1118944 - protein, 33 aa, Mycobacterium
VKLFSREWLGAMALRYAMFIILLMVIFYFSYRS

SEQ ID NO: 1118945 - protein, 17 aa, Mycobacterium
VKLSALLLDTPQLMGVE

SEQ ID NO: 1118946 - protein, 24 aa, Mycobacterium
VKLSRPLARAALRVGFTPDSITIL

SEQ ID NO: 1118947 - protein, 23 aa, Mycobacterium
VKRKGQESFNFGEFFAYTKICSH

SEQ ID NO: 1118948 - protein, 31 aa, Mycobacterium
VKSELRSGINQILRFITYLLVPAGLLTIYTQ

SEQ ID NO: 1118949 - protein, 24 aa, Mycobacterium
VKVPEIPTLLSLGVIVVTLVITTV

SEQ ID NO: 1118950 - protein, 22 aa, Mycobacterium
VLAAQWRRLRAGRPHRDPSPTL

SEQ ID NO: 1118951 - protein, 17 aa, Mycobacterium
VLAEIKALLFGVVAGLV

SEQ ID NO: 1118952 - protein, 24 aa, Mycobacterium
VLAEVWKTTPFMALLLLSGLALVP

SEQ ID NO: 1118953 - protein, 23 aa, Mycobacterium
VLALAGSFARQGRTPESVGTLPT

SEQ ID NO: 1118954 - protein, 24 aa, Mycobacterium
VLAWATSGINGWFYVANYGVPWFD

SEQ ID NO: 1118955 - protein, 23 aa, Mycobacterium
VLCAVALAAVWPLSGWFLPLIRA

SEQ ID NO: 1118956 - protein, 27 aa, Mycobacterium
VLDGRLHKHWGFGGGPHRCLGAHLARM

SEQ ID NO: 1118957 - protein, 24 aa, Mycobacterium
VLDTVALFVGWLWPLWDRRNRTFA

SEQ ID NO: 1118958 - protein, 31 aa, Mycobacterium
VLDVEAVTAWGWRIGFFIGGIAALVVLWMRR

SEQ ID NO: 1118959 - protein, 18 aa, Mycobacterium
VLEPFGRTPIATVDAPDA

SEQ ID NO: 1118960 - protein, 19 aa, Mycobacterium
VLFLLFGLWMLFDAALGWR

SEQ ID NO: 1118961 - protein, 27 aa, Mycobacterium
VLFPVGFCLLYLLGFDLLTGVFTLVPL

SEQ ID NO: 1118962 - protein, 29 aa, Mycobacterium
VLGDDQMHDWGWRLPFLLAAPLGLVGVYL

SEQ ID NO: 1118963 - protein, 19 aa, Mycobacterium
VLGFLRFGLPPEDRVQLQD

SEQ ID NO: 1118964 - protein, 25 aa, Mycobacterium
VLHDLRDGFRFMLRTPWLLSTLLFA

SEQ ID NO: 1118965 - protein, 17 aa, Mycobacterium
VLILPLMIAPVIAGVIW

SEQ ID NO: 1118966 - protein, 24 aa, Mycobacterium
VLKRTGRLSLRHALDMLEQTGRAL

SEQ ID NO: 1118967 - protein, 28 aa, Mycobacterium
VLLCTMLGCWVMRLAKKRFPNINTFGLI

SEQ ID NO: 1118968 - protein, 17 aa, Mycobacterium
VLLEFAGLVTLGVLLLV

SEQ ID NO: 1118969 - protein, 18 aa, Mycobacterium
VLLFYVFFEAMLIPMYFL

SEQ ID NO: 1118970 - protein, 33 aa, Mycobacterium
VLLLRRGRLPGTFGGPVWRLAGTTAIGLLLLTL

SEQ ID NO: 1118971 - protein, 17 aa, Mycobacterium
VLLPSLIGWTLGRALCG

SEQ ID NO: 1118972 - protein, 20 aa, Mycobacterium
VLLVVGLIVGAALWRRRRDD

SEQ ID NO: 1118973 - protein, 28 aa, Mycobacterium
VLLYAVCIVLRLARFNAMLAEDLPAYTK

SEQ ID NO: 1118974 - protein, 25 aa, Mycobacterium
VLMRIVDVMFAFPVLLLALAVVAIL

SEQ ID NO: 1118975 - protein, 23 aa, Mycobacterium
VLNRWLERLKMSITVLDAIGLSV

SEQ ID NO: 1118976 - protein, 29 aa, Mycobacterium
VLPALAAFAAVCWWVFFEKGLASAAHDAF

SEQ ID NO: 1118977 - protein, 19 aa, Mycobacterium
VLPLSGLCADRFGRRRTLL

SEQ ID NO: 1118978 - protein, 17 aa, Mycobacterium
VLPQRRTPWVAIVATTV

SEQ ID NO: 1118979 - protein, 22 aa, Mycobacterium
VLPVVVGYLLVRFVAGPLSYSA

SEQ ID NO: 1118980 - protein, 20 aa, Mycobacterium
VLQMPELYALAAVAVAGTAW

SEQ ID NO: 1118981 - protein, 28 aa, Mycobacterium
VLREGLACAVLRRPDHRDTYDAMFDLFF

SEQ ID NO: 1118982 - protein, 18 aa, Mycobacterium
VLRLGSRLFGLAGQLMHL

SEQ ID NO: 1118983 - protein, 28 aa, Mycobacterium
VLRNSLRTGLGLALAVTVTQVFPVEHGF

SEQ ID NO: 1118984 - protein, 24 aa, Mycobacterium
VLSAFKVPTIWLLLDDDDAVPRKA

SEQ ID NO: 1118985 - protein, 24 aa, Mycobacterium
VLSARLFGFSAFAMLLPQALMGVA

SEQ ID NO: 1118986 - protein, 24 aa, Mycobacterium
VLSDRTALVIAHRLSTVAIADRVL

SEQ ID NO: 1118987 - protein, 17 aa, Mycobacterium
VLSRRAASVSGDRAAFA

SEQ ID NO: 1118988 - protein, 21 aa, Mycobacterium
VLTGGAWQWQTSKNGLMNRVS

SEQ ID NO: 1118989 - protein, 25 aa, Mycobacterium
VLTLADWWPALKTHGLAGVVQSALF

SEQ ID NO: 1118990 - protein, 25 aa, Mycobacterium
VLTVWNANHVIVFKRSMASGYAGVQ

SEQ ID NO: 1118991 - protein, 23 aa, Mycobacterium
VLVIFCVVAAIALIGATAAGVWI

SEQ ID NO: 1118992 - protein, 20 aa, Mycobacterium
VLVLLCLTLLVAEAAARGNA

SEQ ID NO: 1118993 - protein, 21 aa, Mycobacterium
VLVLTLGTWVWIGVTNEQYSQ

SEQ ID NO: 1118994 - protein, 23 aa, Mycobacterium
VLYPCALGMMVLSKSFSVLRSAV

SEQ ID NO: 1118995 - protein, 24 aa, Mycobacterium
VMAALCAATAIIAVVVPFAAALSL

SEQ ID NO: 1118996 - protein, 17 aa, Mycobacterium
VMFCGALAMALGALVVG

SEQ ID NO: 1118997 - protein, 21 aa, Mycobacterium
VMGIGMAFIWSPLAATATRNL

SEQ ID NO: 1118998 - protein, 21 aa, Mycobacterium
VMGPANWWAPAPLARLHRRFG

SEQ ID NO: 1118999 - protein, 24 aa, Mycobacterium
VMLEVLDGLLLIFIFVELLYAVRT

SEQ ID NO: 1119000 - protein, 17 aa, Mycobacterium
VMLIIAVVFLALGYSTK

SEQ ID NO: 1119001 - protein, 31 aa, Mycobacterium
VMSMLGDRAWWLPKRLARVLPDLDIEGDKLN

SEQ ID NO: 1119002 - protein, 21 aa, Mycobacterium
VNAFFGLLVAWVLTRDDFPGR

SEQ ID NO: 1119003 - protein, 18 aa, Mycobacterium
VNEQFWRIPGGMVGVWIT

SEQ ID NO: 1119004 - protein, 29 aa, Mycobacterium
VNFAAVRDMFGWIGPVLMALNGNAVCDAN

SEQ ID NO: 1119005 - protein, 17 aa, Mycobacterium
VNFLVVWLIPVVLGVAY

SEQ ID NO: 1119006 - protein, 28 aa, Mycobacterium
VNIPANRKRVVAVSFPRDLSIDPMECEP

SEQ ID NO: 1119007 - protein, 30 aa, Mycobacterium
VPAADRAERRWPFLFAVVFLAAGLALRYDI

SEQ ID NO: 1119008 - protein, 31 aa, Mycobacterium
VPAEGFWSFGDWTSAGPWMLGFLLGAFTIVG

SEQ ID NO: 1119009 - protein, 19 aa, Mycobacterium
VPFAIWFFLAIEGVPLAAE

SEQ ID NO: 1119010 - protein, 24 aa, Mycobacterium
VPGACSAWSRTALEEIGGFCDDTM

SEQ ID NO: 1119011 - protein, 17 aa, Mycobacterium
VPGAFVVAPFVDDAPSG

SEQ ID NO: 1119012 - protein, 17 aa, Mycobacterium
VPGFPNFFMLYGPNTNV

SEQ ID NO: 1119013 - protein, 18 aa, Mycobacterium
VPGGFPVVAMFLATSLDL

SEQ ID NO: 1119014 - protein, 24 aa, Mycobacterium
VPGMPRLLRWLSPFIPLVAGPLPI

SEQ ID NO: 1119015 - protein, 21 aa, Mycobacterium
VPGRFRDLIEADRLHPSAIAT

SEQ ID NO: 1119016 - protein, 26 aa, Mycobacterium
VPHRPAGRRLLIAAAAASVVFVGAGA

SEQ ID NO: 1119017 - protein, 20 aa, Mycobacterium
VPIYGRYDWFSVEGPGRREF

SEQ ID NO: 1119018 - protein, 18 aa, Mycobacterium
VPKAMLFSIAFIALVIAY

SEQ ID NO: 1119019 - protein, 18 aa, Mycobacterium
VPLAMQWSDAGPNTTFER

SEQ ID NO: 1119020 - protein, 22 aa, Mycobacterium
VPLGGFCDIAGMTSVEELAPED

SEQ ID NO: 1119021 - protein, 23 aa, Mycobacterium
VPLLHLLFGVAFLGVLLSLLRSA

SEQ ID NO: 1119022 - protein, 19 aa, Mycobacterium
VPMQLKLAITAGIGLFILF

SEQ ID NO: 1119023 - protein, 31 aa, Mycobacterium
VPQEIRGDFWFSALGAMASWSVLGVLLSLYP

SEQ ID NO: 1119024 - protein, 26 aa, Mycobacterium
VPQTEFNVALPWSKQVELPSPARSSA

SEQ ID NO: 1119025 - protein, 23 aa, Mycobacterium
VPTGIKFFNWIGTMWRGQLTFQT

SEQ ID NO: 1119026 - protein, 22 aa, Mycobacterium
VPTRQWRWPLGEIDKPFEMRRD

SEQ ID NO: 1119027 - protein, 21 aa, Mycobacterium
VPVAVWLLDGFVRRIPIEIDE

SEQ ID NO: 1119028 - protein, 21 aa, Mycobacterium
VPYLVIGVGFTFLHPEYVQFF

SEQ ID NO: 1119029 - protein, 21 aa, Mycobacterium
VPYPVVCRSSFGVLGANIPAI

SEQ ID NO: 1119030 - protein, 17 aa, Mycobacterium
VQIIKAVLLIGGAGIMT

SEQ ID NO: 1119031 - protein, 21 aa, Mycobacterium
VQLLLESFAFLLIGLQLPKVI

SEQ ID NO: 1119032 - protein, 23 aa, Mycobacterium
VQRFPIKYYLTAMLFIVFDIEIV

SEQ ID NO: 1119033 - protein, 19 aa, Mycobacterium
VQRRLRREILRAYDENGIE

SEQ ID NO: 1119034 - protein, 19 aa, Mycobacterium
VQVLTGFLLILPFQDRFGA

SEQ ID NO: 1119035 - protein, 18 aa, Mycobacterium
VQYPPGWAAAAAVINADP

SEQ ID NO: 1119036 - protein, 19 aa, Mycobacterium
VRAGISYVMVSMVSSLIFL

SEQ ID NO: 1119037 - protein, 37 aa, Mycobacterium
VRASMQIRRVDPWSALKVSLVLSVALFFVWMIAVAFL

SEQ ID NO: 1119038 - protein, 19 aa, Mycobacterium
VRDGDRIVGLVSAGITQQT

SEQ ID NO: 1119039 - protein, 18 aa, Mycobacterium
VRDICRRYGLPYNSGPLP

SEQ ID NO: 1119040 - protein, 18 aa, Mycobacterium
VRDRVRRHPEWDAERWGL

SEQ ID NO: 1119041 - protein, 18 aa, Mycobacterium
VRDWLGGPPLDISEAQLD

SEQ ID NO: 1119042 - protein, 34 aa, Mycobacterium
VREATPIPRRAVRGLKVLVWSALLSVAAVGVGLL

SEQ ID NO: 1119043 - protein, 19 aa, Mycobacterium
VRFLAQWLQGRLSQRGATA

SEQ ID NO: 1119044 - protein, 19 aa, Mycobacterium
VRFLARRIAYSLVVLIGVL

SEQ ID NO: 1119045 - protein, 18 aa, Mycobacterium
VRGAAIGNTVEWFDFAIY

SEQ ID NO: 1119046 - protein, 20 aa, Mycobacterium
VRHPIMLGFIVAFWATPTMS

SEQ ID NO: 1119047 - protein, 18 aa, Mycobacterium
VRILGLPAGLRLVIDNAI

SEQ ID NO: 1119048 - protein, 18 aa, Mycobacterium
VRMLAPIPGKSAVGIEVP

SEQ ID NO: 1119049 - protein, 22 aa, Mycobacterium
VRNRAGLTWLILVAATVVSWLV

SEQ ID NO: 1119050 - protein, 19 aa, Mycobacterium
VRQIHHWAALLFAASIMVH

SEQ ID NO: 1119051 - protein, 18 aa, Mycobacterium
VRQRWRGQRAVDTFLVLP

SEQ ID NO: 1119052 - protein, 35 aa, Mycobacterium
VRREGRIAWPEALRIGVKLCGALETAHRTGTLHRD

SEQ ID NO: 1119053 - protein, 24 aa, Mycobacterium
VRRRGLCWTELGLGREHWRSGAGY

SEQ ID NO: 1119054 - protein, 19 aa, Mycobacterium
VRRSGPRMILWGSTALVAI

SEQ ID NO: 1119055 - protein, 17 aa, Mycobacterium
VRTEIEQLLGLLLSQGR

SEQ ID NO: 1119056 - protein, 27 aa, Mycobacterium
VRTHFGDDLLYVWRHFPLERAHPRSFD

SEQ ID NO: 1119057 - protein, 20 aa, Mycobacterium
VRTHRFTKRVAWLTVGSGIA

SEQ ID NO: 1119058 - protein, 23 aa, Mycobacterium
VRTSWKPILQIAGLVIIHNVGFY

SEQ ID NO: 1119059 - protein, 23 aa, Mycobacterium
VRVPRNRAVVMLVIDVSQSMRAT

SEQ ID NO: 1119060 - protein, 25 aa, Mycobacterium
VRWAVAGRMAVAWLITLPAAGLVGA

SEQ ID NO: 1119061 - protein, 17 aa, Mycobacterium
VRYRPRKAMPRMGFPPD

SEQ ID NO: 1119062 - protein, 23 aa, Mycobacterium
VSAEPDHAVVLLFVNQTVTVGSE

SEQ ID NO: 1119063 - protein, 18 aa, Mycobacterium
VSALAYVVIFSIPWAQEL

SEQ ID NO: 1119064 - protein, 22 aa, Mycobacterium
VSCSIGATLGNGGWSTLLNSAK

SEQ ID NO: 1119065 - protein, 18 aa, Mycobacterium
VSEREGAKLIIHDDEYSK

SEQ ID NO: 1119066 - protein, 27 aa, Mycobacterium
VSFTTLRLVYNEAMANFRAGQPNSVLV

SEQ ID NO: 1119067 - protein, 18 aa, Mycobacterium
VSGVAALVRSRFPELTAE

SEQ ID NO: 1119068 - protein, 30 aa, Mycobacterium
VSGVAALVRSRWPHLTARQVMQRIEDTAHR

SEQ ID NO: 1119069 - protein, 28 aa, Mycobacterium
VSGWRFLLRRVEHAIVRRDTRMFDDPLQ

SEQ ID NO: 1119070 - protein, 19 aa, Mycobacterium
VSIDERFEIDRWLATAPPE

SEQ ID NO: 1119071 - protein, 27 aa, Mycobacterium
VSIVAIALTVMFAREVGAGDLFECLQE

SEQ ID NO: 1119072 - protein, 18 aa, Mycobacterium
VSKGCIPEASHFGQILPD

SEQ ID NO: 1119073 - protein, 20 aa, Mycobacterium
VSLALRFVGSIPFLDMLFVD

SEQ ID NO: 1119074 - protein, 25 aa, Mycobacterium
VSLYLGALLRLPQWLLDASPVGQTT

SEQ ID NO: 1119075 - protein, 19 aa, Mycobacterium
VSMVSSLIFLLGIGLVYAA

SEQ ID NO: 1119076 - protein, 17 aa, Mycobacterium
VSPLPWILVTAAAGGSD

SEQ ID NO: 1119077 - protein, 20 aa, Mycobacterium
VSRARVLLWVAIAASLPPTL

SEQ ID NO: 1119078 - protein, 20 aa, Mycobacterium
VSSAKWLAVAAMVVAGLVSA

SEQ ID NO: 1119079 - protein, 17 aa, Mycobacterium
VSVFPHLFFPKSDSTTA

SEQ ID NO: 1119080 - protein, 17 aa, Mycobacterium
VSYEIAMALSFATVFLY

SEQ ID NO: 1119081 - protein, 19 aa, Mycobacterium
VTACGGVWGMAAAPGVAVF

SEQ ID NO: 1119082 - protein, 30 aa, Mycobacterium
VTADAPRSWLTWRIPALTSVLVAAVVTFVV

SEQ ID NO: 1119083 - protein, 24 aa, Mycobacterium
VTADLWGLRAAVWAAAAITVASGL

SEQ ID NO: 1119084 - protein, 19 aa, Mycobacterium
VTAGVYSLVGFEVSPATVI

SEQ ID NO: 1119085 - protein, 24 aa, Mycobacterium
VTALYIAGFAWRHADYPQQAAVGF

SEQ ID NO: 1119086 - protein, 18 aa, Mycobacterium
VTEMVRRRFAILTRNRRG

SEQ ID NO: 1119087 - protein, 24 aa, Mycobacterium
VTFIAWSGVVGFLLGSVTVTVLQA

SEQ ID NO: 1119088 - protein, 17 aa, Mycobacterium
VTGFAVALVSGRFIDRY

SEQ ID NO: 1119089 - protein, 18 aa, Mycobacterium
VTIAIGFLASITLLPSLI

SEQ ID NO: 1119090 - protein, 19 aa, Mycobacterium
VTLIAWGYVVDRVGERFVL

SEQ ID NO: 1119091 - protein, 26 aa, Mycobacterium
VTLLAVAFGAYFLRGFFILIVVAAVG

SEQ ID NO: 1119092 - protein, 25 aa, Mycobacterium
VTLQLGLGIGRLVFRALNACEAVLA

SEQ ID NO: 1119093 - protein, 26 aa, Mycobacterium
VTLVICDRLRIAPQPYLIAEVLASNI

SEQ ID NO: 1119094 - protein, 35 aa, Mycobacterium
VTPYTARHMGLFVVGRLAAQHGFVVRLRSTVVDEP

SEQ ID NO: 1119095 - protein, 25 aa, Mycobacterium
VTRILFDWRFDLILGSAAIILALVY

SEQ ID NO: 1119096 - protein, 23 aa, Mycobacterium
VTTGIAGWVFAWLAERSGSLVAP

SEQ ID NO: 1119097 - protein, 24 aa, Mycobacterium
VTTPRPELSAAIGAGLTAVRGPDD

SEQ ID NO: 1119098 - protein, 31 aa, Mycobacterium
VTVELPGTGGLYRFSNVTYRGVEVGKVTDVR

SEQ ID NO: 1119099 - protein, 20 aa, Mycobacterium
VTVLLLPLGIPVLRLGSRLF

SEQ ID NO: 1119100 - protein, 22 aa, Mycobacterium
VVAAIIGGLAWSSRDRSPTLAD

SEQ ID NO: 1119101 - protein, 17 aa, Mycobacterium
VVAELRKVIWPNRKQMV

SEQ ID NO: 1119102 - protein, 26 aa, Mycobacterium
VVAGLLQLVGLLGIVGIGRMYLGQVG

SEQ ID NO: 1119103 - protein, 25 aa, Mycobacterium
VVALFLPWLLQRLGMDPAFGAGPLS

SEQ ID NO: 1119104 - protein, 17 aa, Mycobacterium
VVALKVLPPHLAQDATF

SEQ ID NO: 1119105 - protein, 22 aa, Mycobacterium
VVALPLLWWRFRHDDREALIGI

SEQ ID NO: 1119106 - protein, 18 aa, Mycobacterium
VVAMGVMIFGYLQAPTLL

SEQ ID NO: 1119107 - protein, 18 aa, Mycobacterium
VVCVLTLTIAGPVRTYFS

SEQ ID NO: 1119108 - protein, 27 aa, Mycobacterium
VVDIDVLRRLWPPVVIGALVLVGVAAF

SEQ ID NO: 1119109 - protein, 17 aa, Mycobacterium
VVDRVGERFVLTVGSAL

SEQ ID NO: 1119110 - protein, 36 aa, Mycobacterium
VVFGVIVVAVWWAARIPPRWALPRMLIEAPFVVLAV

SEQ ID NO: 1119111 - protein, 17 aa, Mycobacterium
VVFTFLPTYFIKTLEFG

SEQ ID NO: 1119112 - protein, 17 aa, Mycobacterium
VVFVEDFSGQGAVNWAR

SEQ ID NO: 1119113 - protein, 31 aa, Mycobacterium
VVGMSLSLLAMVVAAFGWLPPAAGALLQEGI

SEQ ID NO: 1119114 - protein, 22 aa, Mycobacterium
VVGVPIMLLAGIATHFNSRASV

SEQ ID NO: 1119115 - protein, 18 aa, Mycobacterium
VVIAWTFFFDFVIEGLFL

SEQ ID NO: 1119116 - protein, 25 aa, Mycobacterium
VVIGLSLLTLAGWLLVGGPVSAAFT

SEQ ID NO: 1119117 - protein, 26 aa, Mycobacterium
VVIRRPAVGVVWAWFTGRDGSWRRVR

SEQ ID NO: 1119118 - protein, 22 aa, Mycobacterium
VVIVVRFLWIFPVATIDERMHR

SEQ ID NO: 1119119 - protein, 25 aa, Mycobacterium
VVLAAVTGWFGYQAYRSDQDTKERN

SEQ ID NO: 1119120 - protein, 26 aa, Mycobacterium
VVLFGRLGDMFGRVRIYNLGFVIFTL

SEQ ID NO: 1119121 - protein, 26 aa, Mycobacterium
VVLILTLVWMQFRGAFTPEVKLRMIA

SEQ ID NO: 1119122 - protein, 27 aa, Mycobacterium
VVLLIRPVCVFAMFGRGVLSRKVESKL

SEQ ID NO: 1119123 - protein, 27 aa, Mycobacterium
VVLLRRFAPQQIMVWALAVASLAGVVF

SEQ ID NO: 1119124 - protein, 22 aa, Mycobacterium
VVLRQVLTWVLSTGVPVLAIVL

SEQ ID NO: 1119125 - protein, 24 aa, Mycobacterium
VVLVVLGMCIGWGLYGNTSSPLDF

SEQ ID NO: 1119126 - protein, 18 aa, Mycobacterium
VVMGASLLVLFLDLGWAT

SEQ ID NO: 1119127 - protein, 28 aa, Mycobacterium
VVPAVVWVVAALRRGRVGVDVIAVLSLV

SEQ ID NO: 1119128 - protein, 28 aa, Mycobacterium
VVPGVRGRLVLMWTVCTALPGAGIVTLV

SEQ ID NO: 1119129 - protein, 17 aa, Mycobacterium
VVQYLRVALVTASMPLV

SEQ ID NO: 1119130 - protein, 19 aa, Mycobacterium
VVRALRLDGVTPRPVSRAL

SEQ ID NO: 1119131 - protein, 19 aa, Mycobacterium
VVRQRIALGIIFLDIILYS

SEQ ID NO: 1119132 - protein, 18 aa, Mycobacterium
VVRTMPRDGGLLFGTAPA

SEQ ID NO: 1119133 - protein, 18 aa, Mycobacterium
VVSLSVALGLELTPQMRS

SEQ ID NO: 1119134 - protein, 19 aa, Mycobacterium
VVSPAWYSPLVLTVGSIND

SEQ ID NO: 1119135 - protein, 23 aa, Mycobacterium
VVTAGRMLLNFAGPAPLLKRCQL

SEQ ID NO: 1119136 - protein, 20 aa, Mycobacterium
VVTVRGRRLTGWVAALFSWR

SEQ ID NO: 1119137 - protein, 22 aa, Mycobacterium
VVVAGWCFMAGMQWALGANAGF

SEQ ID NO: 1119138 - protein, 23 aa, Mycobacterium
VVVAPRLQHRFGTVPTLIVNLLA

SEQ ID NO: 1119139 - protein, 33 aa, Mycobacterium
VVVAVARWRGLRALVGIVVAFAVLVVFLLPALR

SEQ ID NO: 1119140 - protein, 22 aa, Mycobacterium
VVVGRPLIRLSYLDEVRNAGFR

SEQ ID NO: 1119141 - protein, 17 aa, Mycobacterium
VVVLVGFLVSRRIAGDS

SEQ ID NO: 1119142 - protein, 18 aa, Mycobacterium
VVVLVPFVILTARNSLPT

SEQ ID NO: 1119143 - protein, 21 aa, Mycobacterium
VVVTCPHCFNTLGREYPQVGG

SEQ ID NO: 1119144 - protein, 25 aa, Mycobacterium
VWNRRCRPWVLAAGVVLHLSIFVSM

SEQ ID NO: 1119145 - protein, 21 aa, Mycobacterium
VWNWMIAAYLFSGGLSAGSAM

SEQ ID NO: 1119146 - protein, 17 aa, Mycobacterium
VWSAFYVGIAILFGLGV

SEQ ID NO: 1119147 - protein, 18 aa, Mycobacterium
VYAALGWVYKTVIEAAML

SEQ ID NO: 1119148 - protein, 25 aa, Mycobacterium
VYEGFPADVLYDFRLYSLGTQVVMW

SEQ ID NO: 1119149 - protein, 21 aa, Mycobacterium
VYERIKHSFVLEERGDVDVKG

SEQ ID NO: 1119150 - protein, 24 aa, Mycobacterium
VYGFRAARRAVFIGFAMQALAVLV

SEQ ID NO: 1119151 - protein, 25 aa, Mycobacterium
VYLLLERNLTRMLLGLLLIGNAINL

SEQ ID NO: 1119152 - protein, 26 aa, Mycobacterium
VYRIIYEPLRAYLLYASAYRAIKGTI

SEQ ID NO: 1119153 - protein, 23 aa, Mycobacterium
VYVPMTLVTFAWIIVASRTGTRR

SEQ ID NO: 1119154 - protein, 18 aa, Mycobacterium
WAAIYLTWGRGMRPSWRS

SEQ ID NO: 1119155 - protein, 20 aa, Mycobacterium
WAALAVVVAVSFARKQRIGP

SEQ ID NO: 1119156 - protein, 17 aa, Mycobacterium
WAALWAVGLLVTGTGIG

SEQ ID NO: 1119157 - protein, 21 aa, Mycobacterium
WAAMIRFSYALIVTTATTAVM

SEQ ID NO: 1119158 - protein, 22 aa, Mycobacterium
WAASAALPWLVLVVAQVAWWVT

SEQ ID NO: 1119159 - protein, 18 aa, Mycobacterium
WAAVCFSLAAFLATVLVS

SEQ ID NO: 1119160 - protein, 29 aa, Mycobacterium
WAAVLIPACIAIFVPLDLLWVGVTVSVLI

SEQ ID NO: 1119161 - protein, 19 aa, Mycobacterium
WAGFEACASMGEETDDPRR

SEQ ID NO: 1119162 - protein, 20 aa, Mycobacterium
WAGLIEFVLGILITVGLFTR

SEQ ID NO: 1119163 - protein, 18 aa, Mycobacterium
WAGLLLIVASMVVLGEAG

SEQ ID NO: 1119164 - protein, 17 aa, Mycobacterium
WAGLSTFMVLRLVFVGW

SEQ ID NO: 1119165 - protein, 29 aa, Mycobacterium
WAGVTSVSIPSWWQPYVLSVGSLTSTGQP

SEQ ID NO: 1119166 - protein, 21 aa, Mycobacterium
WAHDLAGPGWLAPMAAAALGA

SEQ ID NO: 1119167 - protein, 20 aa, Mycobacterium
WAHRLARRRILMAAIVVAAF

SEQ ID NO: 1119168 - protein, 19 aa, Mycobacterium
WALGNAWTIVAMVSFVYGF

SEQ ID NO: 1119169 - protein, 17 aa, Mycobacterium
WARRPFVGSVVALLFGI

SEQ ID NO: 1119170 - protein, 17 aa, Mycobacterium
WARRRPVLAGALIGLGV

SEQ ID NO: 1119171 - protein, 26 aa, Mycobacterium
WASFGLRIALVPLFVVEVLGRGPGAA

SEQ ID NO: 1119172 - protein, 24 aa, Mycobacterium
WAVIGGLIYNWIIFMILPLYVSLE

SEQ ID NO: 1119173 - protein, 24 aa, Mycobacterium
WDDKSWRVPVAFVIAQGTATVINF

SEQ ID NO: 1119174 - protein, 17 aa, Mycobacterium
WDGPAWSISAEWLAYLL

SEQ ID NO: 1119175 - protein, 19 aa, Mycobacterium
WDIAKSVLIFLGIPLLAGY

SEQ ID NO: 1119176 - protein, 17 aa, Mycobacterium
WDLLLAGPLRTVDAAAR

SEQ ID NO: 1119177 - protein, 17 aa, Mycobacterium
WEAGNKYIARRNLIWSV

SEQ ID NO: 1119178 - protein, 24 aa, Mycobacterium
WEAVDSRLGRRVAIKVLKAEYSTD

SEQ ID NO: 1119179 - protein, 22 aa, Mycobacterium
WEIVELLLTGSAFAFVGLQMRA

SEQ ID NO: 1119180 - protein, 18 aa, Mycobacterium
WEPFLTPNLWTTYVLPGV

SEQ ID NO: 1119181 - protein, 32 aa, Mycobacterium
WEVGTPEQRRWAAVAMERGWAGTMVLTEPDAG

SEQ ID NO: 1119182 - protein, 25 aa, Mycobacterium
WFLFSLFPIFWMLMLALKNAEQQTT

SEQ ID NO: 1119183 - protein, 25 aa, Mycobacterium
WFLLPSLLLIGIRLWYGHRRGYYRS

SEQ ID NO: 1119184 - protein, 17 aa, Mycobacterium
WFVIDPQLWLLVVVTVL

SEQ ID NO: 1119185 - protein, 18 aa, Mycobacterium
WGAIEIAHLTGLSEDQNN

SEQ ID NO: 1119186 - protein, 18 aa, Mycobacterium
WGCTVLATYFGFMGLADR

SEQ ID NO: 1119187 - protein, 24 aa, Mycobacterium
WGLAAGVCAACYFLMSERVATGEE

SEQ ID NO: 1119188 - protein, 21 aa, Mycobacterium
WGLEIYERVDASGARNDLIGV

SEQ ID NO: 1119189 - protein, 17 aa, Mycobacterium
WGSTGMWEYLSRPEAAD

SEQ ID NO: 1119190 - protein, 17 aa, Mycobacterium
WHLAGYLAMVVIVLTVW

SEQ ID NO: 1119191 - protein, 36 aa, Mycobacterium
WHPHIVGIHDRGRYRGRLWISMDFVDGTDVGRLLQQ

SEQ ID NO: 1119192 - protein, 18 aa, Mycobacterium
WHYNELWLGGAAGPGEKS

SEQ ID NO: 1119193 - protein, 17 aa, Mycobacterium
WIFTPFVAILVLAGIRS

SEQ ID NO: 1119194 - protein, 17 aa, Mycobacterium
WIGPVVVGGIVITNVVA

SEQ ID NO: 1119195 - protein, 19 aa, Mycobacterium
WILTCSVMTGAIALLAIVP

SEQ ID NO: 1119196 - protein, 17 aa, Mycobacterium
WISRIGVPHWARGLMPV

SEQ ID NO: 1119197 - protein, 22 aa, Mycobacterium
WKRVAVLFAGPGMNFVIGLVLV

SEQ ID NO: 1119198 - protein, 20 aa, Mycobacterium
WKSFDLFVGAIQAFIFALLT

SEQ ID NO: 1119199 - protein, 20 aa, Mycobacterium
WKSGEPLPVPVQHAMAVTWQ

SEQ ID NO: 1119200 - protein, 18 aa, Mycobacterium
WLAGVAIGLALVVKPSLA

SEQ ID NO: 1119201 - protein, 24 aa, Mycobacterium
WLAIGFLWLLGVTRGFRRPTPVLD

SEQ ID NO: 1119202 - protein, 22 aa, Mycobacterium
WLAQLAMWPTLIVTGVAVAAGA

SEQ ID NO: 1119203 - protein, 25 aa, Mycobacterium
WLAVIVLTFHWARVVWTRTAVQLAA

SEQ ID NO: 1119204 - protein, 25 aa, Mycobacterium
WLDGGGRTRWRWAVANYGYLLAATA

SEQ ID NO: 1119205 - protein, 27 aa, Mycobacterium
WLDRVQAFDVFSSFWFTAIYVLLFISL

SEQ ID NO: 1119206 - protein, 24 aa, Mycobacterium
WLGRLRFGALYALSALGGSVLVYL

SEQ ID NO: 1119207 - protein, 18 aa, Mycobacterium
WLIAIGVLGALVAATVGF

SEQ ID NO: 1119208 - protein, 17 aa, Mycobacterium
WLILLLAAFSWMISSRI

SEQ ID NO: 1119209 - protein, 25 aa, Mycobacterium
WLLAIPVPLLLIWAPSWTWVIVANV

SEQ ID NO: 1119210 - protein, 17 aa, Mycobacterium
WLLAVSLALRFVGSIPF

SEQ ID NO: 1119211 - protein, 23 aa, Mycobacterium
WLLERPIRRWRPATVPQLPLALA

SEQ ID NO: 1119212 - protein, 23 aa, Mycobacterium
WLMLCGMLIYLLGYGGRALLVLR

SEQ ID NO: 1119213 - protein, 25 aa, Mycobacterium
WLSSELMFFAGLFAMYFTARAQAGG

SEQ ID NO: 1119214 - protein, 17 aa, Mycobacterium
WLVLVVAQVAWWVTDPA

SEQ ID NO: 1119215 - protein, 17 aa, Mycobacterium
WLWASVVVFLVMAAALS

SEQ ID NO: 1119216 - protein, 19 aa, Mycobacterium
WMDLPRPRDLAPLLAAWIA

SEQ ID NO: 1119217 - protein, 19 aa, Mycobacterium
WMRRNPVVLTIVLAAALVY

SEQ ID NO: 1119218 - protein, 23 aa, Mycobacterium
WMTIDALVWVPRMLYLYGEANRG

SEQ ID NO: 1119219 - protein, 23 aa, Mycobacterium
WNEAHPYLPFVFTGSAAASGGGL

SEQ ID NO: 1119220 - protein, 17 aa, Mycobacterium
WPALVMFAIIFFWTPPH

SEQ ID NO: 1119221 - protein, 17 aa, Mycobacterium
WPDRPDNWISVANAIVG

SEQ ID NO: 1119222 - protein, 19 aa, Mycobacterium
WPEIKGVRDFAGVTLHTAR

SEQ ID NO: 1119223 - protein, 22 aa, Mycobacterium
WPLEGSIYQWSRRLLGTTYGWF

SEQ ID NO: 1119224 - protein, 18 aa, Mycobacterium
WPLGEIDKPFEMRRDPLV

SEQ ID NO: 1119225 - protein, 18 aa, Mycobacterium
WPPAAKLAAWGIQLHMGL

SEQ ID NO: 1119226 - protein, 19 aa, Mycobacterium
WQDVIKGVLIVSAVAIDVW

SEQ ID NO: 1119227 - protein, 17 aa, Mycobacterium
WQHIIGIELHWMVMAMS

SEQ ID NO: 1119228 - protein, 19 aa, Mycobacterium
WQPYFLGNPVYAFLLMVLF

SEQ ID NO: 1119229 - protein, 18 aa, Mycobacterium
WQSIALFAGFVAALHMII

SEQ ID NO: 1119230 - protein, 20 aa, Mycobacterium
WRANYAEPFIRSVGPGAPVD

SEQ ID NO: 1119231 - protein, 19 aa, Mycobacterium
WRAVAPLSRDDAWIIFTSG

SEQ ID NO: 1119232 - protein, 26 aa, Mycobacterium
WRAVREYDLKLILAFGTVSQLGLITI

SEQ ID NO: 1119233 - protein, 21 aa, Mycobacterium
WRDRKRYLWLMGLIAPTALFV

SEQ ID NO: 1119234 - protein, 22 aa, Mycobacterium
WRDVFWINVPLAAIAMVLIHFS

SEQ ID NO: 1119235 - protein, 21 aa, Mycobacterium
WRFLLTGGFAAIVDFGLYVLL

SEQ ID NO: 1119236 - protein, 27 aa, Mycobacterium
WRKVGAATVRWPGPILIATIALSLIGL

SEQ ID NO: 1119237 - protein, 25 aa, Mycobacterium
WRNRSRPWCAVSMAGAVLVTAVLAA

SEQ ID NO: 1119238 - protein, 18 aa, Mycobacterium
WRNVTAVDGVVLGGFAIW

SEQ ID NO: 1119239 - protein, 19 aa, Mycobacterium
WRPILQVIGLFIVFNVGYY

SEQ ID NO: 1119240 - protein, 23 aa, Mycobacterium
WRQLAGGSYVWWALLVIAAAGTL

SEQ ID NO: 1119241 - protein, 23 aa, Mycobacterium
WRQPEHFYWLTSFLAAREAQSAT

SEQ ID NO: 1119242 - protein, 23 aa, Mycobacterium
WRQRLTISAALSLPVVLLSMIPA

SEQ ID NO: 1119243 - protein, 27 aa, Mycobacterium
WRRRADWGIALGSWLPAILWGVAFAVL

SEQ ID NO: 1119244 - protein, 17 aa, Mycobacterium
WRTAGAIGLYAVLGAVL

SEQ ID NO: 1119245 - protein, 26 aa, Mycobacterium
WRTDQLFCVAIGFLTTISAAASIGGL

SEQ ID NO: 1119246 - protein, 21 aa, Mycobacterium
WRTLGLPGDITLVGADTNQDF

SEQ ID NO: 1119247 - protein, 21 aa, Mycobacterium
WRVTPGVAATGHFDAVHRVIG

SEQ ID NO: 1119248 - protein, 18 aa, Mycobacterium
WSDESDLDYAVRHTARLA

SEQ ID NO: 1119249 - protein, 24 aa, Mycobacterium
WSDMYRYAVAIGLDIEQFDQDVRV

SEQ ID NO: 1119250 - protein, 19 aa, Mycobacterium
WSGLRAEGRGWGAIVGVGL

SEQ ID NO: 1119251 - protein, 19 aa, Mycobacterium
WSLNAGEVIERVIERDSPT

SEQ ID NO: 1119252 - protein, 19 aa, Mycobacterium
WSPPGGRVGVRLTQTDPVH

SEQ ID NO: 1119253 - protein, 24 aa, Mycobacterium
WSPPKRVTGVLLAFASGALISALT

SEQ ID NO: 1119254 - protein, 18 aa, Mycobacterium
WSTLGGFIRTQALVSLVD

SEQ ID NO: 1119255 - protein, 25 aa, Mycobacterium
WTLGRALCGIRVLRRDGGEAALGRL

SEQ ID NO: 1119256 - protein, 17 aa, Mycobacterium
WTSSAVIGHGGDTSGAV

SEQ ID NO: 1119257 - protein, 19 aa, Mycobacterium
WTTVPARFRPFLKQQVRWK

SEQ ID NO: 1119258 - protein, 18 aa, Mycobacterium
WTVPWAMVLVVYLVQMTM

SEQ ID NO: 1119259 - protein, 20 aa, Mycobacterium
WVATIAGLLGFVMAVATPLL

SEQ ID NO: 1119260 - protein, 18 aa, Mycobacterium
WVFLFPAGVLVLIILCAN

SEQ ID NO: 1119261 - protein, 24 aa, Mycobacterium
WVGAILRNRVPAALAGLAVTGVIA

SEQ ID NO: 1119262 - protein, 24 aa, Mycobacterium
WVIGSLLLILAMFEGFFGYSLPDD

SEQ ID NO: 1119263 - protein, 18 aa, Mycobacterium
WVLSRVARRSHVVKDIEV

SEQ ID NO: 1119264 - protein, 27 aa, Mycobacterium
WVNNAWVAAQCIGFAILLGLPIPYILF

SEQ ID NO: 1119265 - protein, 18 aa, Mycobacterium
WVQAVALVMIFGFFIMGI

SEQ ID NO: 1119266 - protein, 20 aa, Mycobacterium
WVRITKRIVIAFAVLCAVVL

SEQ ID NO: 1119267 - protein, 27 aa, Mycobacterium
WVRVIFGVGMVAAWAVLLTAQRSSDPK

SEQ ID NO: 1119268 - protein, 17 aa, Mycobacterium
WVSDTGVRYGIEPGENG

SEQ ID NO: 1119269 - protein, 18 aa, Mycobacterium
WVVASALGGPLLIAAIAL

SEQ ID NO: 1119270 - protein, 20 aa, Mycobacterium
WWLALNVLGALLINHLILTN

SEQ ID NO: 1119271 - protein, 32 aa, Mycobacterium
WWQTFWRITLPSIRWGLTYGVVLTIARTLGEY

SEQ ID NO: 1119272 - protein, 22 aa, Mycobacterium
WYLLLAELWPADSRPYIGGSQH

SEQ ID NO: 1119273 - protein, 22 aa, Mycobacterium
WYTENLRYYYLILPTVDGAIAR

SEQ ID NO: 1119274 - protein, 23 aa, Mycobacterium
YALAAAVCWAGYILLTQRVGDQV

SEQ ID NO: 1119275 - protein, 20 aa, Mycobacterium
YALLVNRWPLPETGVPSGLA

SEQ ID NO: 1119276 - protein, 18 aa, Mycobacterium
YAMLTLLHDLAWKATLPD

SEQ ID NO: 1119277 - protein, 23 aa, Mycobacterium
YAPEEIFLVLSVAGLTSYTMAPW

SEQ ID NO: 1119278 - protein, 20 aa, Mycobacterium
YARNRADDVVSRVVSCVVED

SEQ ID NO: 1119279 - protein, 19 aa, Mycobacterium
YASLFPTRIRYTGLSTVYQ

SEQ ID NO: 1119280 - protein, 18 aa, Mycobacterium
YATFRFLVEFTRANETVW

SEQ ID NO: 1119281 - protein, 24 aa, Mycobacterium
YATHARTGTEWNRPVDPEQFTLPV

SEQ ID NO: 1119282 - protein, 23 aa, Mycobacterium
YAVGLKTRFGYDDSLDVVGVHLV

SEQ ID NO: 1119283 - protein, 24 aa, Mycobacterium
YAVLKGHVSINVFRNATIVIELAV

SEQ ID NO: 1119284 - protein, 25 aa, Mycobacterium
YAVRHTARLALLVRAERNDETSEVE

SEQ ID NO: 1119285 - protein, 27 aa, Mycobacterium
YCLPKPDFPIPTWGGRLLHFLPGAQLA

SEQ ID NO: 1119286 - protein, 26 aa, Mycobacterium
YDEYIMRTGSDWFPGLDRQIVDYPAG

SEQ ID NO: 1119287 - protein, 17 aa, Mycobacterium
YDPAHGVFWAGLAFLGF

SEQ ID NO: 1119288 - protein, 30 aa, Mycobacterium
YDQFLRYGPRWVFKLNEPWWGLIHVVLGVG

SEQ ID NO: 1119289 - protein, 21 aa, Mycobacterium
YEIAMALSFATVFLYAGTMST

SEQ ID NO: 1119290 - protein, 20 aa, Mycobacterium
YELGMALGIAVVGSILTGVY

SEQ ID NO: 1119291 - protein, 21 aa, Mycobacterium
YERDIRFIIIVTLIVVLLTLA

SEQ ID NO: 1119292 - protein, 26 aa, Mycobacterium
YEVAEGRPVWKLRPLQLVLTFAALLG

SEQ ID NO: 1119293 - protein, 17 aa, Mycobacterium
YFPSVWILRKLQAKKGP

SEQ ID NO: 1119294 - protein, 25 aa, Mycobacterium
YFTMGRWGLPVNIFAVVWGIGMALN

SEQ ID NO: 1119295 - protein, 19 aa, Mycobacterium
YGAPAGWHAPGWPPQQQPS

SEQ ID NO: 1119296 - protein, 22 aa, Mycobacterium
YGDPVARHAFGESFLTQNFPVG

SEQ ID NO: 1119297 - protein, 22 aa, Mycobacterium
YGELDRWLDWYLGEGSNTMRRG

SEQ ID NO: 1119298 - protein, 24 aa, Mycobacterium
YGLIHADLRLANLLVDPPTITVID

SEQ ID NO: 1119299 - protein, 18 aa, Mycobacterium
YGLLFDHDFHIPIIGTWD

SEQ ID NO: 1119300 - protein, 19 aa, Mycobacterium
YGRQILKTPVWNWMIAAYL

SEQ ID NO: 1119301 - protein, 17 aa, Mycobacterium
YGSFPPPGSEDGSKRSL

SEQ ID NO: 1119302 - protein, 25 aa, Mycobacterium
YGTDVFCAIVLRPALSAVDDRALVA

SEQ ID NO: 1119303 - protein, 22 aa, Mycobacterium
YGVGWVGVYLLIAGSLTFIAVL

SEQ ID NO: 1119304 - protein, 20 aa, Mycobacterium
YHARGSLAQRVRREGRIAWP

SEQ ID NO: 1119305 - protein, 20 aa, Mycobacterium
YHPVRSRIGWQVWATERLLD

SEQ ID NO: 1119306 - protein, 18 aa, Mycobacterium
YHRVFWLTTGFTVVVLAI

SEQ ID NO: 1119307 - protein, 17 aa, Mycobacterium
YKIFPVLGTAIMTVAFV

SEQ ID NO: 1119308 - protein, 24 aa, Mycobacterium
YKLSEPWRHSPILWAADEPAHQEH

SEQ ID NO: 1119309 - protein, 17 aa, Mycobacterium
YKVPREVVFLDELPRNP

SEQ ID NO: 1119310 - protein, 19 aa, Mycobacterium
YLGAVLFTIGNLAFFFLVP

SEQ ID NO: 1119311 - protein, 23 aa, Mycobacterium
YLGGWRVIRTLGKGLVEIESPQG

SEQ ID NO: 1119312 - protein, 24 aa, Mycobacterium
YLGLLWWMLVCWSQGLRSPSGPGR

SEQ ID NO: 1119313 - protein, 25 aa, Mycobacterium
YLGWRGEPYTGLKFQTLLLYRVVRH

SEQ ID NO: 1119314 - protein, 17 aa, Mycobacterium
YLSDDWYRDWGSIERFI

SEQ ID NO: 1119315 - protein, 20 aa, Mycobacterium
YLVGIVLTWVLSRVARRSHV

SEQ ID NO: 1119316 - protein, 20 aa, Mycobacterium
YLVRLGLARNRWRWFYRHLF

SEQ ID NO: 1119317 - protein, 17 aa, Mycobacterium
YMAPERFSGGPVGPPAD

SEQ ID NO: 1119318 - protein, 18 aa, Mycobacterium
YMLVALLFGTAWITSHIV

SEQ ID NO: 1119319 - protein, 19 aa, Mycobacterium
YMMAACVIGALALIKVPET

SEQ ID NO: 1119320 - protein, 29 aa, Mycobacterium
YMMWTDGLIRLWPAWEFYIGNYTIPQPVW

SEQ ID NO: 1119321 - protein, 17 aa, Mycobacterium
YNPRFVTGIGFPGVPIE

SEQ ID NO: 1119322 - protein, 18 aa, Mycobacterium
YPAPANRRTWIVLRADPE

SEQ ID NO: 1119323 - protein, 20 aa, Mycobacterium
YPDARLLWSGDWKTFDGRNF

SEQ ID NO: 1119324 - protein, 19 aa, Mycobacterium
YPIYTGSMLWLFVGTMVVT

SEQ ID NO: 1119325 - protein, 31 aa, Mycobacterium
YPRGVFTAMGLRFGENIMYYLVVTFSITYLK

SEQ ID NO: 1119326 - protein, 17 aa, Mycobacterium
YPTADKVSLASLEEVAV

SEQ ID NO: 1119327 - protein, 17 aa, Mycobacterium
YPYRWVVAVVLVVAIAT

SEQ ID NO: 1119328 - protein, 20 aa, Mycobacterium
YQIDWERSALVGGLMPATFT

SEQ ID NO: 1119329 - protein, 17 aa, Mycobacterium
YQLPERIAATLVALRRT

SEQ ID NO: 1119330 - protein, 25 aa, Mycobacterium
YQRAEALAAEVARTFMEAGLDAVRM

SEQ ID NO: 1119331 - protein, 17 aa, Mycobacterium
YQTGLRGSFDMGTAAAQ

SEQ ID NO: 1119332 - protein, 19 aa, Mycobacterium
YRAAEPGLALTRCYDGALV

SEQ ID NO: 1119333 - protein, 17 aa, Mycobacterium
YRDVLCAQRNALIAERD

SEQ ID NO: 1119334 - protein, 24 aa, Mycobacterium
YRFLMRRMEHALVRADVRMLDDPL

SEQ ID NO: 1119335 - protein, 24 aa, Mycobacterium
YRGDARAPLLILLPAKFVGGVLSI

SEQ ID NO: 1119336 - protein, 22 aa, Mycobacterium
YRKVRESAALVIVQFVETMTGI

SEQ ID NO: 1119337 - protein, 19 aa, Mycobacterium
YRLQKLIGRGGMGEVYQAY

SEQ ID NO: 1119338 - protein, 20 aa, Mycobacterium
YRLWDHIRFNTTITEACFDE

SEQ ID NO: 1119339 - protein, 24 aa, Mycobacterium
YRNACATSPGLGCYNVRDPLDLAL

SEQ ID NO: 1119340 - protein, 17 aa, Mycobacterium
YRPSSGVSVDFPSALRQ

SEQ ID NO: 1119341 - protein, 17 aa, Mycobacterium
YRSRFLFFGTGYYNYDE

SEQ ID NO: 1119342 - protein, 26 aa, Mycobacterium
YRVLTCWLPVFFGWQVMRWLTRREMI

SEQ ID NO: 1119343 - protein, 21 aa, Mycobacterium
YSALRPRRRTGLQLAADSSVW

SEQ ID NO: 1119344 - protein, 24 aa, Mycobacterium
YSDPNLRPAIVGVFTDLTGPAPPG

SEQ ID NO: 1119345 - protein, 20 aa, Mycobacterium
YSDREWILAIARQYRALDRE

SEQ ID NO: 1119346 - protein, 18 aa, Mycobacterium
YSGTGIGLALCKKIVEYH

SEQ ID NO: 1119347 - protein, 27 aa, Mycobacterium
YSLALFPVWIRACYTAFLNVVFGRPLG

SEQ ID NO: 1119348 - protein, 17 aa, Mycobacterium
YSLPRVVLAPLFIIWFG

SEQ ID NO: 1119349 - protein, 18 aa, Mycobacterium
YSMMLFPFLMTVVLPNSV

SEQ ID NO: 1119350 - protein, 18 aa, Mycobacterium
YSTWCTYNAWLWNQGSWA

SEQ ID NO: 1119351 - protein, 18 aa, Mycobacterium
YSYLPSWISFLGDQQRSM

SEQ ID NO: 1119352 - protein, 24 aa, Mycobacterium
YSYSFDLNANWSRLWSAQPEILDY

SEQ ID NO: 1119353 - protein, 17 aa, Mycobacterium
YTAFRFGDRDVEIRGYL

SEQ ID NO: 1119354 - protein, 18 aa, Mycobacterium
YTDVLAWCSDQGFDRDHC

SEQ ID NO: 1119355 - protein, 18 aa, Mycobacterium
YVAEPLIGRGLETLLGGA

SEQ ID NO: 1119356 - protein, 17 aa, Mycobacterium
YVARPVGGILFGHFGDR

SEQ ID NO: 1119357 - protein, 18 aa, Mycobacterium
YVGFEVLLSASFVLLTIG

SEQ ID NO: 1119358 - protein, 18 aa, Mycobacterium
YVRLEMTAPIYIWALLMA

SEQ ID NO: 1119359 - protein, 20 aa, Mycobacterium
YVVDTLRLQPVIFPDYNTVY

SEQ ID NO: 1119360 - protein, 19 aa, Mycobacterium
YVYDEIAPWVPTLWRRELR

SEQ ID NO: 1119361 - protein, 21 aa, Mycobacterium
YVYFVMCWLWYPPRVSPAAET

SEQ ID NO: 1119362 - protein, 31 aa, Mycobacterium
YVYGRERLGPFWGYLAGWGFVAGKTASCAAM

SEQ ID NO: 1119363 - protein, 27 aa, Mycobacterium
YWARQRAKRALLFWVVAVITLAGLLAA

SEQ ID NO: 1119364 - protein, 19 aa, Mycobacterium
YWYPPPSPNPGWGEPPRQQ

SEQ ID NO: 1119365 - protein, 20 aa, Mycobacterium
YYVTYRWAVSLQRSDREVLE

SEQ ID NO: 1119366 - protein, 24 aa, Mycobacterium
YYYMAETNLRFILGKSSTVEIPFI

SEQ ID NO: 1119367 - protein, 25 aa, Mycobacterium
AAAALCWLWPAGAGLLIRFTGPPLW

SEQ ID NO: 1119368 - protein, 17 aa, Mycobacterium
AAADLLAQHHMPKTRDL

SEQ ID NO: 1119369 - protein, 34 aa, Mycobacterium
AAANCSWLFAWHHNRFPLSMLLMLVLLGTLIVIY

SEQ ID NO: 1119370 - protein, 31 aa, Mycobacterium
AAAQGLRPDIPLEVPKGAMVTSVRLLGTTGA

SEQ ID NO: 1119371 - protein, 17 aa, Mycobacterium
AAAVLWAGSWAFGPHSA

SEQ ID NO: 1119372 - protein, 22 aa, Mycobacterium
AADAGWWPWVLAAAGIVLIVLA

SEQ ID NO: 1119373 - protein, 18 aa, Mycobacterium
AADRWNWVLDGMVEIGAL

SEQ ID NO: 1119374 - protein, 17 aa, Mycobacterium
AADTVRLLTRLGLTVAM

SEQ ID NO: 1119375 - protein, 25 aa, Mycobacterium
AAEQSPRSWRMRVGVEQTGDAAKVS

SEQ ID NO: 1119376 - protein, 26 aa, Mycobacterium
AAGDPRAAYEWHMRSAAWSRQRDIRA

SEQ ID NO: 1119377 - protein, 21 aa, Mycobacterium
AAGFLSGLAMYFQIRSARRAD

SEQ ID NO: 1119378 - protein, 19 aa, Mycobacterium
AAGLAFLPPALAWPLAVVA

SEQ ID NO: 1119379 - protein, 17 aa, Mycobacterium
AAGVCWAIYILLTQRVG

SEQ ID NO: 1119380 - protein, 20 aa, Mycobacterium
AAIRLRGNIDVGMLILAGLF

SEQ ID NO: 1119381 - protein, 19 aa, Mycobacterium
AALAVLWWVVPLLLLGRIS

SEQ ID NO: 1119382 - protein, 24 aa, Mycobacterium
AALGATLCGGWPAVAVTGALQVLR

SEQ ID NO: 1119383 - protein, 19 aa, Mycobacterium
AALLFLLPTEWEQREFTLR

SEQ ID NO: 1119384 - protein, 21 aa, Mycobacterium
AALLMKEMIENTAALLVVGSI

SEQ ID NO: 1119385 - protein, 31 aa, Mycobacterium
AALLPAGRQPLWWHYAVAAALILAFLGSWHG

SEQ ID NO: 1119386 - protein, 19 aa, Mycobacterium
AALMTLPWLAAIVGEYILL

SEQ ID NO: 1119387 - protein, 18 aa, Mycobacterium
AALTMTIPLTVISFAIGL

SEQ ID NO: 1119388 - protein, 27 aa, Mycobacterium
AANLILNGSWSWLFFNRHKLAVSAMAA

SEQ ID NO: 1119389 - protein, 21 aa, Mycobacterium
AAQWLRFGSLPGETNTYPNFA

SEQ ID NO: 1119390 - protein, 18 aa, Mycobacterium
AARIVVGLLALIGVAVAI

SEQ ID NO: 1119391 - protein, 25 aa, Mycobacterium
AARLMPSMMGMDGPRTYFMGFQTNA

SEQ ID NO: 1119392 - protein, 21 aa, Mycobacterium
AARRIAELVTRYGGDTPQVGI

SEQ ID NO: 1119393 - protein, 19 aa, Mycobacterium
AASPCALAIAVPLTVVAAI

SEQ ID NO: 1119394 - protein, 17 aa, Mycobacterium
AATCARLAVGDWQATEI

SEQ ID NO: 1119395 - protein, 24 aa, Mycobacterium
AAVIAVIAALVWWTSDARATISQP

SEQ ID NO: 1119396 - protein, 24 aa, Mycobacterium
AAVLLIGMGRWYLGMSSRHATGTS

SEQ ID NO: 1119397 - protein, 18 aa, Mycobacterium
AAVLVWLGVSAWRSANRP

SEQ ID NO: 1119398 - protein, 27 aa, Mycobacterium
AAVSGWRSGALGSLMSFIGVVLGAVAG

SEQ ID NO: 1119399 - protein, 18 aa, Mycobacterium
AAYSFLRFGGAAVAPWLA

SEQ ID NO: 1119400 - protein, 21 aa, Mycobacterium
ACAGLLCAAVMSGAVVWQVSP

SEQ ID NO: 1119401 - protein, 20 aa, Mycobacterium
ACYKITRPIDETGLGAAVNY

SEQ ID NO: 1119402 - protein, 26 aa, Mycobacterium
ADAGGVGSLVRLAVLGLIMVPVIAGV

SEQ ID NO: 1119403 - protein, 21 aa, Mycobacterium
ADAMPVRVGVGVIGSIVVFAL

SEQ ID NO: 1119404 - protein, 18 aa, Mycobacterium
ADARAVLRDVLISELHPE

SEQ ID NO: 1119405 - protein, 23 aa, Mycobacterium
ADDGWVFPVNRPLAPEPGDNQAL

SEQ ID NO: 1119406 - protein, 24 aa, Mycobacterium
ADGKSWYLPVGVTGTLGDPTAAES

SEQ ID NO: 1119407 - protein, 21 aa, Mycobacterium
ADGLQPISPVIAGILRANDAY

SEQ ID NO: 1119408 - protein, 23 aa, Mycobacterium
ADHPIWIAVPAFAPAIVVAGVVV

SEQ ID NO: 1119409 - protein, 28 aa, Mycobacterium
ADIARRAKRRPVWIKGFGEHVPFKTPTY

SEQ ID NO: 1119410 - protein, 18 aa, Mycobacterium
ADLCALLLQIYVVMGASW

SEQ ID NO: 1119411 - protein, 18 aa, Mycobacterium
ADLIGLNMARRLTDGEQI

SEQ ID NO: 1119412 - protein, 17 aa, Mycobacterium
ADLVDWPALGPVVRLMK

SEQ ID NO: 1119413 - protein, 31 aa, Mycobacterium
ADPEHRGRVLARWQPAWLRYSPLSFTGLAMI

SEQ ID NO: 1119414 - protein, 23 aa, Mycobacterium
ADTRNVLLYSWAFVPVLVLVLAT

SEQ ID NO: 1119415 - protein, 24 aa, Mycobacterium
ADWDGRLRPLLARQFELATGQRKA

SEQ ID NO: 1119416 - protein, 22 aa, Mycobacterium
AEADYRAALRLNPADAEAIHGS

SEQ ID NO: 1119417 - protein, 23 aa, Mycobacterium
AEAPAEAGCQCCAPTPQPDAKSS

SEQ ID NO: 1119418 - protein, 26 aa, Mycobacterium
AEDRDFYSNPGFSFTGFARAFKNNLF

SEQ ID NO: 1119419 - protein, 20 aa, Mycobacterium
AEFAFRHPLVRAVAYESQLR

SEQ ID NO: 1119420 - protein, 17 aa, Mycobacterium
AEFGEFRSLAHLEAKPL

SEQ ID NO: 1119421 - protein, 20 aa, Mycobacterium
AEFPGPWALVPVGATILLIL

SEQ ID NO: 1119422 - protein, 19 aa, Mycobacterium
AELGLDMAAFDAAYNDPAT

SEQ ID NO: 1119423 - protein, 21 aa, Mycobacterium
AELRVSGRLDGVVAEAQRRQR

SEQ ID NO: 1119424 - protein, 17 aa, Mycobacterium
AEPEGAVVLAAAPQRDT

SEQ ID NO: 1119425 - protein, 21 aa, Mycobacterium
AEPLIGLTFCTALAVSGGYIA

SEQ ID NO: 1119426 - protein, 25 aa, Mycobacterium
AEPLPIPWSVLSLFAPGPTLSKADA

SEQ ID NO: 1119427 - protein, 25 aa, Mycobacterium
AEQAFATALPWLAGRLRTPEVVATP

SEQ ID NO: 1119428 - protein, 21 aa, Mycobacterium
AESSRATALLAQRFDQGDTQL

SEQ ID NO: 1119429 - protein, 23 aa, Mycobacterium
AETKICVLLSISTLLGVGLFALT

SEQ ID NO: 1119430 - protein, 21 aa, Mycobacterium
AFAMAGGWHAGLGLLAGAAAF

SEQ ID NO: 1119431 - protein, 20 aa, Mycobacterium
AFAVLGLRSLYFCLSGLLRR

SEQ ID NO: 1119432 - protein, 19 aa, Mycobacterium
AFCGPPSEIGRSMGTTNWA

SEQ ID NO: 1119433 - protein, 18 aa, Mycobacterium
AFGWWGGPGLGGFQDSLA

SEQ ID NO: 1119434 - protein, 20 aa, Mycobacterium
AFIRPYVYDEIAPWVPTLWR

SEQ ID NO: 1119435 - protein, 21 aa, Mycobacterium
AFLSGPLHLGRICYRSRNQRP

SEQ ID NO: 1119436 - protein, 17 aa, Mycobacterium
AFPKVVKLLYGQHPRSV

SEQ ID NO: 1119437 - protein, 19 aa, Mycobacterium
AFPRLGMGLTFLVSLTVLG

SEQ ID NO: 1119438 - protein, 19 aa, Mycobacterium
AGAAMAFSSVFVVSNSLRL

SEQ ID NO: 1119439 - protein, 26 aa, Mycobacterium
AGAGFCLSLARLNYFHTMGPAVAISM

SEQ ID NO: 1119440 - protein, 17 aa, Mycobacterium
AGALVMIGGTVGVAAFL

SEQ ID NO: 1119441 - protein, 18 aa, Mycobacterium
AGDSTLARVVRLVAEAQT

SEQ ID NO: 1119442 - protein, 22 aa, Mycobacterium
AGFHEGFFFFAIVLSALSVIPL

SEQ ID NO: 1119443 - protein, 18 aa, Mycobacterium
AGGQDCAGIAYTISAVLV

SEQ ID NO: 1119444 - protein, 17 aa, Mycobacterium
AGGRLLVRATRIGADTQ

SEQ ID NO: 1119445 - protein, 17 aa, Mycobacterium
AGGRPILRILMRRRRSV

SEQ ID NO: 1119446 - protein, 19 aa, Mycobacterium
AGLALAYRTRPVFVPTAGP

SEQ ID NO: 1119447 - protein, 17 aa, Mycobacterium
AGLIAGAVGLAAVLLYS

SEQ ID NO: 1119448 - protein, 19 aa, Mycobacterium
AGLNLDPGTKVTFNGVEIG

SEQ ID NO: 1119449 - protein, 20 aa, Mycobacterium
AGPEKLWQVRELQFAVLAAV

SEQ ID NO: 1119450 - protein, 19 aa, Mycobacterium
AGSAVPWAFVAGAVVAAVS

SEQ ID NO: 1119451 - protein, 21 aa, Mycobacterium
AGSLLGFALVLLVSMFSPAGP

SEQ ID NO: 1119452 - protein, 24 aa, Mycobacterium
AGSYPLLLVFGFFLGIAGTVFAVG

SEQ ID NO: 1119453 - protein, 22 aa, Mycobacterium
AGTDFSIFFFSRYHELVREGME

SEQ ID NO: 1119454 - protein, 26 aa, Mycobacterium
AGTYLGQGYLRWSIRAQQAPPRLADA

SEQ ID NO: 1119455 - protein, 17 aa, Mycobacterium
AGVFRWQPVRALTHRSP

SEQ ID NO: 1119456 - protein, 22 aa, Mycobacterium
AGVPAARCWPGPGTQLDDQALR

SEQ ID NO: 1119457 - protein, 28 aa, Mycobacterium
AGVVAYCFLEVWRVQILVYGIVIFLLLL

SEQ ID NO: 1119458 - protein, 18 aa, Mycobacterium
AGWLGDVDFTADIRGITE

SEQ ID NO: 1119459 - protein, 33 aa, Mycobacterium
AGYLGLANGLGFLAGAVVGHFLLKSSLRPPGGR

SEQ ID NO: 1119460 - protein, 20 aa, Mycobacterium
AGYPKYWLLVILAAAIATSF

SEQ ID NO: 1119461 - protein, 18 aa, Mycobacterium
AGYRNGVVLAARLGVVAV

SEQ ID NO: 1119462 - protein, 25 aa, Mycobacterium
AHAFGEGWAFIPLGALLVDFTLTVA

SEQ ID NO: 1119463 - protein, 24 aa, Mycobacterium
AHPEKDRRVAVGIVVLAALTAATS

SEQ ID NO: 1119464 - protein, 20 aa, Mycobacterium
AHPERLQRCSEWIRAWSPAV

SEQ ID NO: 1119465 - protein, 27 aa, Mycobacterium
AHWFGFRFTTGFGYGAAFVLMALTLTL

SEQ ID NO: 1119466 - protein, 25 aa, Mycobacterium
AIGDRYGRRGALLVGLAIFAVASLA

SEQ ID NO: 1119467 - protein, 17 aa, Mycobacterium
AIGIVCYAWPFYALVDM

SEQ ID NO: 1119468 - protein, 17 aa, Mycobacterium
AIHEGREAWEGELVEDD

SEQ ID NO: 1119469 - protein, 17 aa, Mycobacterium
AILGPRVDALGVKTLIK

SEQ ID NO: 1119470 - protein, 17 aa, Mycobacterium
AISFSIIAGVDPRVGLF

SEQ ID NO: 1119471 - protein, 18 aa, Mycobacterium
AIVIPGTVAFSFAGAFGL

SEQ ID NO: 1119472 - protein, 24 aa, Mycobacterium
AIVVAICWAAAGAVLVALAALRER

SEQ ID NO: 1119473 - protein, 19 aa, Mycobacterium
AKAGSSWLGSPPVRLRRQP

SEQ ID NO: 1119474 - protein, 22 aa, Mycobacterium
AKGGIVFRVQQELGVPVKLVGL

SEQ ID NO: 1119475 - protein, 22 aa, Mycobacterium
AKLDVGALWAPRTLPVGTGEPV

SEQ ID NO: 1119476 - protein, 18 aa, Mycobacterium
AKLYPLLLLVPLALLAVR

SEQ ID NO: 1119477 - protein, 17 aa, Mycobacterium
AKVKYRGIQIGEVKEIE

SEQ ID NO: 1119478 - protein, 24 aa, Mycobacterium
ALAGALVHHVRWPMWLRTVVSVVA

SEQ ID NO: 1119479 - protein, 21 aa, Mycobacterium
ALAGAWLWREALASAVIVVAV

SEQ ID NO: 1119480 - protein, 24 aa, Mycobacterium
ALALVMARIFLGRGAALIAALIAI

SEQ ID NO: 1119481 - protein, 19 aa, Mycobacterium
ALAPTMEWLLVGRTVQGGA

SEQ ID NO: 1119482 - protein, 17 aa, Mycobacterium
ALAWPLAVVAVAASVAI

SEQ ID NO: 1119483 - protein, 27 aa, Mycobacterium
ALDAALERTRIGWAGVSAVVTIGGGAS

SEQ ID NO: 1119484 - protein, 20 aa, Mycobacterium
ALERARNAGLVTVRGSATDS

SEQ ID NO: 1119485 - protein, 17 aa, Mycobacterium
ALFVFTVGIALILVVAA

SEQ ID NO: 1119486 - protein, 19 aa, Mycobacterium
ALGVPEWAVQPVTAMGDDH

SEQ ID NO: 1119487 - protein, 18 aa, Mycobacterium
ALIASVGATAWLYFFQFR

SEQ ID NO: 1119488 - protein, 24 aa, Mycobacterium
ALLALPLIGVWVMVSTLQAGFAHQ

SEQ ID NO: 1119489 - protein, 18 aa, Mycobacterium
ALLGVPMVGLFFAIGLGL

SEQ ID NO: 1119490 - protein, 20 aa, Mycobacterium
ALLVLTVAVGLAYPVLIWLV

SEQ ID NO: 1119491 - protein, 26 aa, Mycobacterium
ALMYKRPDGQFAYRGDGGLLNFVQMA

SEQ ID NO: 1119492 - protein, 22 aa, Mycobacterium
ALNQFARLSYMILLSVPLVAPV

SEQ ID NO: 1119493 - protein, 26 aa, Mycobacterium
ALRAWVLCWLTLVWVLLWGTLSAANV

SEQ ID NO: 1119494 - protein, 21 aa, Mycobacterium
ALRPLLGMLPFDGLIGAPMLF

SEQ ID NO: 1119495 - protein, 29 aa, Mycobacterium
ALRREVWTRLAAAVVFSGVAAWTITALLY

SEQ ID NO: 1119496 - protein, 28 aa, Mycobacterium
ALSAFFTPRFVNWFGLFTTHLVIAIALA

SEQ ID NO: 1119497 - protein, 18 aa, Mycobacterium
ALSVDWLGLAVLAAWGGV

SEQ ID NO: 1119498 - protein, 26 aa, Mycobacterium
ALSVGEQFWLVWPLLLLLVGLLKARK

SEQ ID NO: 1119499 - protein, 17 aa, Mycobacterium
ALTGFLAAFINVRIAAP

SEQ ID NO: 1119500 - protein, 18 aa, Mycobacterium
ALTGFLAAFINVRIAAPT

SEQ ID NO: 1119501 - protein, 24 aa, Mycobacterium
ALTLELLLILALRIPLRAVLIRGA

SEQ ID NO: 1119502 - protein, 17 aa, Mycobacterium
ALVALGVGILFTWMFMY

SEQ ID NO: 1119503 - protein, 19 aa, Mycobacterium
ALVLVGAVGGRLLRLPGAG

SEQ ID NO: 1119504 - protein, 25 aa, Mycobacterium
ALWRKRWRLAAVTALCPPVAVVSAQ

SEQ ID NO: 1119505 - protein, 18 aa, Mycobacterium
AMGRLRSKDAAIMMFNDA

SEQ ID NO: 1119506 - protein, 24 aa, Mycobacterium
AMIEREAADLGLKVSVRQSDSEAE

SEQ ID NO: 1119507 - protein, 31 aa, Mycobacterium
AMLYLSMDIAIHWGLLRRLRHDVDFKVWVPL

SEQ ID NO: 1119508 - protein, 24 aa, Mycobacterium
AMVAVFPFVEWVVHVCILHWRPRR

SEQ ID NO: 1119509 - protein, 17 aa, Mycobacterium
ANPQVALGYVFFGTVCA

SEQ ID NO: 1119510 - protein, 18 aa, Mycobacterium
APDPKRRLVEIADEVAAR

SEQ ID NO: 1119511 - protein, 22 aa, Mycobacterium
APEVFWPLRRVGVEFHAAQDGK

SEQ ID NO: 1119512 - protein, 19 aa, Mycobacterium
APFGWYYDLLALWSQVSTA

SEQ ID NO: 1119513 - protein, 24 aa, Mycobacterium
APGQRFADRAAFWLVLVALIGGTA

SEQ ID NO: 1119514 - protein, 24 aa, Mycobacterium
APGQRLADRAAFWLVLVALIGGTA

SEQ ID NO: 1119515 - protein, 34 aa, Mycobacterium
APMPELPWFMALACFKSAATWSLIVKHNRRKSTP

SEQ ID NO: 1119516 - protein, 17 aa, Mycobacterium
APNELKTLPAARTGIAG

SEQ ID NO: 1119517 - protein, 22 aa, Mycobacterium
APPKAGKSWMVAGIGLACAIGG

SEQ ID NO: 1119518 - protein, 17 aa, Mycobacterium
APQPRLLPTRIAAEQLP

SEQ ID NO: 1119519 - protein, 25 aa, Mycobacterium
APSVSAWRWVAAVLAVSQLVASPVS

SEQ ID NO: 1119520 - protein, 19 aa, Mycobacterium
APSYAWFVAAWVLAGVAMS

SEQ ID NO: 1119521 - protein, 23 aa, Mycobacterium
APTLKHLNEVMAMLERNRDNLAK

SEQ ID NO: 1119522 - protein, 24 aa, Mycobacterium
APVPVLPAPVFRPPVVLPPPVIRL

SEQ ID NO: 1119523 - protein, 18 aa, Mycobacterium
AQALRWWCITTLGWQWNT

SEQ ID NO: 1119524 - protein, 20 aa, Mycobacterium
AQGAEWLIAIGVLGALVAAT

SEQ ID NO: 1119525 - protein, 18 aa, Mycobacterium
AQPPRFTTMAIERVQTNS

SEQ ID NO: 1119526 - protein, 18 aa, Mycobacterium
AQTVCVGLAFGTLAPPER

SEQ ID NO: 1119527 - protein, 17 aa, Mycobacterium
ARAWRRFWFSYDSAYPL

SEQ ID NO: 1119528 - protein, 20 aa, Mycobacterium
ARIEMPVALTADVAQAERVA

SEQ ID NO: 1119529 - protein, 19 aa, Mycobacterium
ARIPMRRRLTRRAAAVTGV

SEQ ID NO: 1119530 - protein, 18 aa, Mycobacterium
ARIRRMCESLAEQLAAIH

SEQ ID NO: 1119531 - protein, 18 aa, Mycobacterium
ARIVPLVAGGGHGSSGPP

SEQ ID NO: 1119532 - protein, 19 aa, Mycobacterium
ARLLRRSGPAAGHHSDPDW

SEQ ID NO: 1119533 - protein, 17 aa, Mycobacterium
ARLMPFAMLVAAGGMML

SEQ ID NO: 1119534 - protein, 17 aa, Mycobacterium
ARLPCLTTDMGYNPKDG

SEQ ID NO: 1119535 - protein, 22 aa, Mycobacterium
ARRAMMLPLLLFGLLIFGLFRE

SEQ ID NO: 1119536 - protein, 17 aa, Mycobacterium
ARRGCALLAVASAGLHV

SEQ ID NO: 1119537 - protein, 25 aa, Mycobacterium
ARRRAETRPGVAVRMLTSGTTGPPK

SEQ ID NO: 1119538 - protein, 18 aa, Mycobacterium
ARRRGFQVIPDLGAPFAV

SEQ ID NO: 1119539 - protein, 18 aa, Mycobacterium
ARRRILLADFGIARHAED

SEQ ID NO: 1119540 - protein, 18 aa, Mycobacterium
ARRSRRIMLQNIGLSLAI

SEQ ID NO: 1119541 - protein, 18 aa, Mycobacterium
ARSAAMLSHPNIVAVHDY

SEQ ID NO: 1119542 - protein, 20 aa, Mycobacterium
ARSGAFIALVAAFALGGVAS

SEQ ID NO: 1119543 - protein, 29 aa, Mycobacterium
ARTAALRAWCGMAGYILATQYWLLPSAGP

SEQ ID NO: 1119544 - protein, 18 aa, Mycobacterium
ARTSRNGYRMTLVPDAVV

SEQ ID NO: 1119545 - protein, 24 aa, Mycobacterium
ARVWEFGVGALLAMAAAQLAQIPH

SEQ ID NO: 1119546 - protein, 19 aa, Mycobacterium
ARYTPVVGGEASILVRSGS

SEQ ID NO: 1119547 - protein, 18 aa, Mycobacterium
ASAARFTRKPIAFAGIRQ

SEQ ID NO: 1119548 - protein, 19 aa, Mycobacterium
ASAIAAYFYVRLIVLMFFT

SEQ ID NO: 1119549 - protein, 32 aa, Mycobacterium
ASAVAAYLVAPWAWWLCGAVGAVTVLYLGYLR

SEQ ID NO: 1119550 - protein, 22 aa, Mycobacterium
ASAVGLLSVFGWPPLARLTTFM

SEQ ID NO: 1119551 - protein, 26 aa, Mycobacterium
ASAWVGAPVLGWWAGVLVQILPQRGA

SEQ ID NO: 1119552 - protein, 17 aa, Mycobacterium
ASGFAILAAGLWAGLLW

SEQ ID NO: 1119553 - protein, 24 aa, Mycobacterium
ASHIWRRATARRSWTPVHGPSTTA

SEQ ID NO: 1119554 - protein, 28 aa, Mycobacterium
ASIVGVSVMIFAYMKVPTLLGIGRLTVT

SEQ ID NO: 1119555 - protein, 18 aa, Mycobacterium
ASLSLLAAIFFSNLPESL

SEQ ID NO: 1119556 - protein, 18 aa, Mycobacterium
ASPCALAIAVPLTVVAAI

SEQ ID NO: 1119557 - protein, 18 aa, Mycobacterium
ASPCALAIAVPVTVVAAI

SEQ ID NO: 1119558 - protein, 21 aa, Mycobacterium
ASRLFIQWRRYPMVPLQALLF

SEQ ID NO: 1119559 - protein, 23 aa, Mycobacterium
ASTRVLFRKDLRANDIRMDEVMA

SEQ ID NO: 1119560 - protein, 26 aa, Mycobacterium
ASTVARRIVAKWKPAVRSMGSVAASV

SEQ ID NO: 1119561 - protein, 22 aa, Mycobacterium
ASVSRPVHRWVMVPDDAQDAQH

SEQ ID NO: 1119562 - protein, 17 aa, Mycobacterium
ASVVAFMGIGLVDPILK

SEQ ID NO: 1119563 - protein, 26 aa, Mycobacterium
ATAHLPGRLLVVAVLAAALFGYGQFA

SEQ ID NO: 1119564 - protein, 18 aa, Mycobacterium
ATGGYSFESFRWAWTAQY

SEQ ID NO: 1119565 - protein, 19 aa, Mycobacterium
ATGQALWWAFALGACFSGN

SEQ ID NO: 1119566 - protein, 17 aa, Mycobacterium
ATGTTWEIVELLLTGSA

SEQ ID NO: 1119567 - protein, 20 aa, Mycobacterium
ATGVATRPALPVITPTPTAE

SEQ ID NO: 1119568 - protein, 25 aa, Mycobacterium
ATIAGGCLWQAEPLIGLTFCTALAV

SEQ ID NO: 1119569 - protein, 18 aa, Mycobacterium
ATIQQCRDPEGFVPIGSN

SEQ ID NO: 1119570 - protein, 28 aa, Mycobacterium
ATLGRVELRLVWPSILSAMRIGTQMSMG

SEQ ID NO: 1119571 - protein, 17 aa, Mycobacterium
ATPPRPATKVLDQPLPP

SEQ ID NO: 1119572 - protein, 22 aa, Mycobacterium
ATRIRWSTRIAVILLAVAIVAA

SEQ ID NO: 1119573 - protein, 18 aa, Mycobacterium
ATSAEWAAPWGSLRLSAT

SEQ ID NO: 1119574 - protein, 25 aa, Mycobacterium
ATSVLWLAIAGWSLWAANSPGMGPD

SEQ ID NO: 1119575 - protein, 22 aa, Mycobacterium
ATVPPDAPPVVLPEVPSDLPLP

SEQ ID NO: 1119576 - protein, 29 aa, Mycobacterium
AVAAALWVLAWVVGKAWVILLPVVLALVV

SEQ ID NO: 1119577 - protein, 21 aa, Mycobacterium
AVGERRIAVWSSVPAEQELLE

SEQ ID NO: 1119578 - protein, 22 aa, Mycobacterium
AVGRPGTRWLALALRAVAVAGT

SEQ ID NO: 1119579 - protein, 18 aa, Mycobacterium
AVGYTATALFFIDRDAAT

SEQ ID NO: 1119580 - protein, 19 aa, Mycobacterium
AVIRRRRIIVAIFVVIGFG

SEQ ID NO: 1119581 - protein, 17 aa, Mycobacterium
AVLRLRNGHPMPTLDDV

SEQ ID NO: 1119582 - protein, 17 aa, Mycobacterium
AVMGAITLLALVTHRRR

SEQ ID NO: 1119583 - protein, 23 aa, Mycobacterium
AVPFLAILGVAGWTTAYTSGAAL

SEQ ID NO: 1119584 - protein, 27 aa, Mycobacterium
AVQSRRRLVGAVGMAVLAIALIASVGA

SEQ ID NO: 1119585 - protein, 19 aa, Mycobacterium
AVRMDRWHNFRWQTFCAEP

SEQ ID NO: 1119586 - protein, 23 aa, Mycobacterium
AVTLGLAAAVGWFVPMLGLSLVG

SEQ ID NO: 1119587 - protein, 24 aa, Mycobacterium
AVTRRLADLGLFVFRSYGSTEHPS

SEQ ID NO: 1119588 - protein, 29 aa, Mycobacterium
AVTVRRLPGWPLWFAALWVAQEWLKSSVP

SEQ ID NO: 1119589 - protein, 21 aa, Mycobacterium
AVVALRLGRCLAGLRTRSHEH

SEQ ID NO: 1119590 - protein, 19 aa, Mycobacterium
AVVLCYGLWAFGRDDQGGT

SEQ ID NO: 1119591 - protein, 30 aa, Mycobacterium
AVVPTHWQEWMPAGLFFASFALFQLLWARL

SEQ ID NO: 1119592 - protein, 28 aa, Mycobacterium
AVVPTHWQEWMPAGLFFATIALFQLLWA

SEQ ID NO: 1119593 - protein, 18 aa, Mycobacterium
AVVQRSGKIDVHMVTHDE

SEQ ID NO: 1119594 - protein, 18 aa, Mycobacterium
AVVRRISARDGVTVIAYR

SEQ ID NO: 1119595 - protein, 22 aa, Mycobacterium
AWKRAKSVGLAIANFAIAFSAL

SEQ ID NO: 1119596 - protein, 20 aa, Mycobacterium
AWLACVPLAMAVTALAGLIL

SEQ ID NO: 1119597 - protein, 25 aa, Mycobacterium
AWLIKSLYLGPLVPRSVLELLRRRE

SEQ ID NO: 1119598 - protein, 18 aa, Mycobacterium
AYHALTYGWLVSGLARAV

SEQ ID NO: 1119599 - protein, 26 aa, Mycobacterium
AYLLAKVCIYAVFAILQSTIVTAITV

SEQ ID NO: 1119600 - protein, 21 aa, Mycobacterium
AYTSRSWLSGLLVGLSAGVKV

SEQ ID NO: 1119601 - protein, 17 aa, Mycobacterium
CAAVMSGAVVWQVSPHS

SEQ ID NO: 1119602 - protein, 19 aa, Mycobacterium
CAELSAPLIEVHISNVHRR

SEQ ID NO: 1119603 - protein, 21 aa, Mycobacterium
CDLTLLRFRALLSRLRGDETV

SEQ ID NO: 1119604 - protein, 30 aa, Mycobacterium
CGLLSLFLVAFACYFVWHVVKAAVQAMLFA

SEQ ID NO: 1119605 - protein, 21 aa, Mycobacterium
CMVGSGSIAVWLAITEAQAAL

SEQ ID NO: 1119606 - protein, 18 aa, Mycobacterium
CQGVAGAISIYVAGFHEG

SEQ ID NO: 1119607 - protein, 19 aa, Mycobacterium
CRAAFPMVEQLRAEYGDRV

SEQ ID NO: 1119608 - protein, 20 aa, Mycobacterium
CSLNPVLSCGSVMVTPQAAL

SEQ ID NO: 1119609 - protein, 18 aa, Mycobacterium
CVGLLLVFGTMAVRLQGR

SEQ ID NO: 1119610 - protein, 19 aa, Mycobacterium
CVIDPKGGMELGAGAPLFT

SEQ ID NO: 1119611 - protein, 26 aa, Mycobacterium
CVQRRIRSWWLLLPLGVATWVLMHES

SEQ ID NO: 1119612 - protein, 24 aa, Mycobacterium
DAAPAMSGTMGWLAGLWQDVLAAP

SEQ ID NO: 1119613 - protein, 27 aa, Mycobacterium
DAAPRRPGGPWWPLGEIDRPRQLNHGL

SEQ ID NO: 1119614 - protein, 24 aa, Mycobacterium
DACVRRLAASAGRVAQAPVRGTPR

SEQ ID NO: 1119615 - protein, 22 aa, Mycobacterium
DADGFLWILGRADQAIIRGGFK

SEQ ID NO: 1119616 - protein, 19 aa, Mycobacterium
DAIPLFGSFLNGVSTNPSA

SEQ ID NO: 1119617 - protein, 33 aa, Mycobacterium
DAIRNVFRRPFQWREFLEQSWFVAKVSLAPTVL

SEQ ID NO: 1119618 - protein, 17 aa, Mycobacterium
DAMTWLRGVDRTFDAVI

SEQ ID NO: 1119619 - protein, 25 aa, Mycobacterium
DATGWEQLRILGLIGAAAAVGNFAG

SEQ ID NO: 1119620 - protein, 25 aa, Mycobacterium
DATPQWRMLVAFAVFGVGTSMVNAP

SEQ ID NO: 1119621 - protein, 20 aa, Mycobacterium
DCSGLTRFAFAGVGVLLPRW

SEQ ID NO: 1119622 - protein, 21 aa, Mycobacterium
DDGHLWIALQYVEGTDAEAAL

SEQ ID NO: 1119623 - protein, 17 aa, Mycobacterium
DDPRNWAGATVISTPSY

SEQ ID NO: 1119624 - protein, 28 aa, Mycobacterium
DDQLPWRFITGWLNRYGVRADVLTITAV

SEQ ID NO: 1119625 - protein, 23 aa, Mycobacterium
DDSRSDRRLAFMLIAPAVVLMLA

SEQ ID NO: 1119626 - protein, 31 aa, Mycobacterium
DEIGALLVGLAWLAGLLILAGIILARGSKSV

SEQ ID NO: 1119627 - protein, 18 aa, Mycobacterium
DEMSFRRIRESPIVLASD

SEQ ID NO: 1119628 - protein, 21 aa, Mycobacterium
DFECEACRAAFPMVEQLRAEY

SEQ ID NO: 1119629 - protein, 29 aa, Mycobacterium
DFFAVSPRRPRRWGLPLIATVAALLLAAA

SEQ ID NO: 1119630 - protein, 27 aa, Mycobacterium
DFLQQELPALFVPGSPALVVMVMPAVL

SEQ ID NO: 1119631 - protein, 22 aa, Mycobacterium
DGGETNWLIWGNKRSEIDLENA

SEQ ID NO: 1119632 - protein, 22 aa, Mycobacterium
DGGLPQLGRFIVRHPVLIIVAW

SEQ ID NO: 1119633 - protein, 17 aa, Mycobacterium
DGKSVKGTGYFVRAPGA

SEQ ID NO: 1119634 - protein, 18 aa, Mycobacterium
DGPTVILVHGWPDSHVVW

SEQ ID NO: 1119635 - protein, 20 aa, Mycobacterium
DGRWRWRRIVQSPLAIAAWL

SEQ ID NO: 1119636 - protein, 23 aa, Mycobacterium
DGTAWLRLAWAGVLLLVVVRPRP

SEQ ID NO: 1119637 - protein, 18 aa, Mycobacterium
DGVSEWKYVHAEPYLTDD

SEQ ID NO: 1119638 - protein, 24 aa, Mycobacterium
DHRRLEGLIAPGSWNIDPSATPQD

SEQ ID NO: 1119639 - protein, 20 aa, Mycobacterium
DIPQSLWLIGCLVVLVCTLA

SEQ ID NO: 1119640 - protein, 29 aa, Mycobacterium
DISADLKNRFRAFTLPHARPDRPSGVPVE

SEQ ID NO: 1119641 - protein, 17 aa, Mycobacterium
DKPIPVRYAQWLGDAVR

SEQ ID NO: 1119642 - protein, 27 aa, Mycobacterium
DKQPRAWRLSVDIVRDVGRLKMSKMEF

SEQ ID NO: 1119643 - protein, 20 aa, Mycobacterium
DKTWPVYVVLVYLLGCTVAG

SEQ ID NO: 1119644 - protein, 20 aa, Mycobacterium
DLAHEIRTPLAVLEAYFEAI

SEQ ID NO: 1119645 - protein, 17 aa, Mycobacterium
DLCALLLQIYVVMGAGW

SEQ ID NO: 1119646 - protein, 29 aa, Mycobacterium
DLEIKKHKRWPWIAGAVVAVLAVTGGVVY

SEQ ID NO: 1119647 - protein, 19 aa, Mycobacterium
DLLMLVAMLTRIAEFGVTP

SEQ ID NO: 1119648 - protein, 17 aa, Mycobacterium
DLLTMFIALEVLSLPLY

SEQ ID NO: 1119649 - protein, 20 aa, Mycobacterium
DLPVGTGYAVWVGIGAALTV

SEQ ID NO: 1119650 - protein, 19 aa, Mycobacterium
DLRAAVEGVGRFSQTLGER

SEQ ID NO: 1119651 - protein, 29 aa, Mycobacterium
DLTGRFWRRSGIHIVRRPVVHLVGSLTVL

SEQ ID NO: 1119652 - protein, 22 aa, Mycobacterium
DLTPYYCRDGSCPAVIGDVIVY

SEQ ID NO: 1119653 - protein, 30 aa, Mycobacterium
DLYITQRFIMRWRIWLSRNLIDDWLDHHAY

SEQ ID NO: 1119654 - protein, 18 aa, Mycobacterium
DMARLAVSFNDMAESLQR

SEQ ID NO: 1119655 - protein, 22 aa, Mycobacterium
DMFWSLAPLVVACVVLAGLLGM

SEQ ID NO: 1119656 - protein, 31 aa, Mycobacterium
DMRRPMLHKYLGLVGPVGFSTVLSGGASLSE

SEQ ID NO: 1119657 - protein, 21 aa, Mycobacterium
DNDNFWFSWIVPLAAIIFAGA

SEQ ID NO: 1119658 - protein, 34 aa, Mycobacterium
DNSVARPNGGFGTRYPVFAVIGVNPLPTPTSPGA

SEQ ID NO: 1119659 - protein, 20 aa, Mycobacterium
DPDMRTAVVSIDPKNGGVKA

SEQ ID NO: 1119660 - protein, 23 aa, Mycobacterium
DPHHPRLLTAYARAKLGQSDWAA

SEQ ID NO: 1119661 - protein, 17 aa, Mycobacterium
DPIYTCLLQGAKFALDN

SEQ ID NO: 1119662 - protein, 18 aa, Mycobacterium
DPLRRQGRALSIGVMLGV

SEQ ID NO: 1119663 - protein, 20 aa, Mycobacterium
DPLSEHYVRPVLAQRRPTMD

SEQ ID NO: 1119664 - protein, 19 aa, Mycobacterium
DPPRFVWPVRGEQPPAIGA

SEQ ID NO: 1119665 - protein, 23 aa, Mycobacterium
DPQDLRPRLMFGAAESAADDRPA

SEQ ID NO: 1119666 - protein, 22 aa, Mycobacterium
DPSRVRRSGGTGLGLAISIEDA

SEQ ID NO: 1119667 - protein, 17 aa, Mycobacterium
DQVLLWAALLTMVVGIL

SEQ ID NO: 1119668 - protein, 19 aa, Mycobacterium
DRAAVRRSPVLTLFPHRPP

SEQ ID NO: 1119669 - protein, 19 aa, Mycobacterium
DRAPFVWDGAPGVRPFLLF

SEQ ID NO: 1119670 - protein, 23 aa, Mycobacterium
DRDSGLLTRMWVMPVHRTAPLTG

SEQ ID NO: 1119671 - protein, 20 aa, Mycobacterium
DRDVKVFGFLLLGLVVAAAV

SEQ ID NO: 1119672 - protein, 17 aa, Mycobacterium
DRFSALIFGLALIALGA

SEQ ID NO: 1119673 - protein, 18 aa, Mycobacterium
DRLWKQLVLMPAAPDARA

SEQ ID NO: 1119674 - protein, 18 aa, Mycobacterium
DRRVWTVSLAVAGAAVVA

SEQ ID NO: 1119675 - protein, 18 aa, Mycobacterium
DRSYLAFDEIETLGTSDE

SEQ ID NO: 1119676 - protein, 18 aa, Mycobacterium
DRYGARRVLVVAAMAGVV

SEQ ID NO: 1119677 - protein, 21 aa, Mycobacterium
DSAIPALWFLAAPFLTVAALT

SEQ ID NO: 1119678 - protein, 22 aa, Mycobacterium
DSDAPRKWWQPRNIAGTGGMHI

SEQ ID NO: 1119679 - protein, 23 aa, Mycobacterium
DTDTPVTFVFYWVIPFLLVAAGA

SEQ ID NO: 1119680 - protein, 30 aa, Mycobacterium
DTELPRQFGYNMPLELVLTVIPFLIISVLF

SEQ ID NO: 1119681 - protein, 21 aa, Mycobacterium
DTLWFPGLLLIALGVIGLAAI

SEQ ID NO: 1119682 - protein, 25 aa, Mycobacterium
DTRLPGAVERILFGGGADAAREVLS

SEQ ID NO: 1119683 - protein, 19 aa, Mycobacterium
DTRVSRMLIAAAVLTAFFV

SEQ ID NO: 1119684 - protein, 17 aa, Mycobacterium
DTSPPAPKWAWVALVVV

SEQ ID NO: 1119685 - protein, 30 aa, Mycobacterium; identical to SEQ ID NO: 304167

SEQ ID NO: 1119686 - protein, 26 aa, Mycobacterium
DTVRLLTRLGLTVAMLTGDNARTAEA

SEQ ID NO: 1119687 - protein, 18 aa, Mycobacterium
DTVVGFMEAGGWRLPGLA

SEQ ID NO: 1119688 - protein, 20 aa, Mycobacterium
DVKTGQWVRRRYRVALQTDA

SEQ ID NO: 1119689 - protein, 17 aa, Mycobacterium
DVRLDRPVALKVMDARY

SEQ ID NO: 1119690 - protein, 21 aa, Mycobacterium
DWSALPLLRASIDALYSGGLV

SEQ ID NO: 1119691 - protein, 32 aa, Mycobacterium
DYDAYAAAIDSRWKWIAGVAGAVLLVAVICTL

SEQ ID NO: 1119692 - protein, 24 aa, Mycobacterium
DYGQSWASGRYAAADVEDPDFEDY

SEQ ID NO: 1119693 - protein, 19 aa, Mycobacterium
DYRFTLANERTFLAWIRTS

SEQ ID NO: 1119694 - protein, 19 aa, Mycobacterium
DYYLRRQIEYVADGCDAET

SEQ ID NO: 1119695 - protein, 21 aa, Mycobacterium
EAAETFALVWCVRHLMQWAHS

SEQ ID NO: 1119696 - protein, 21 aa, Mycobacterium
EADELPEFVPAAATERRETWT

SEQ ID NO: 1119697 - protein, 26 aa, Mycobacterium
EADSLRSRLLISLVLTVPVIAMSMIP

SEQ ID NO: 1119698 - protein, 20 aa, Mycobacterium
EAFRKLRTNLQFLAVDNPPR

SEQ ID NO: 1119699 - protein, 30 aa, Mycobacterium
EAFSEVNIWFLVQFLERPFVPLIPTLGIPG

SEQ ID NO: 1119700 - protein, 18 aa, Mycobacterium
EAGARTWRVVPGTTPQVG

SEQ ID NO: 1119701 - protein, 24 aa, Mycobacterium
EAHDRRLASVLPFLMGLNSRPRLS

SEQ ID NO: 1119702 - protein, 26 aa, Mycobacterium
EALPDGRAAIRLAMDPSQLAIIPSNV

SEQ ID NO: 1119703 - protein, 22 aa, Mycobacterium
EAMLIPMYFLIGGFGADRAASS

SEQ ID NO: 1119704 - protein, 20 aa, Mycobacterium
EAPPRVSATFNEAMQPAFAA

SEQ ID NO: 1119705 - protein, 31 aa, Mycobacterium
EAQGLGVSRAEGWRRRGPLLPALIFMIIVTQ

SEQ ID NO: 1119706 - protein, 18 aa, Mycobacterium
EAVSHWRTVLAYGAVPIA

SEQ ID NO: 1119707 - protein, 26 aa, Mycobacterium
EAVVRRLRVLTIATWIASAVSALFGL

SEQ ID NO: 1119708 - protein, 19 aa, Mycobacterium
ECSTGDFGVQAGLYGGLLV

SEQ ID NO: 1119709 - protein, 22 aa, Mycobacterium
EDAGFCEKGKGMAFVSDHDLTF

SEQ ID NO: 1119710 - protein, 22 aa, Mycobacterium
EDGRGLALAGLIIGYVMTALTV

SEQ ID NO: 1119711 - protein, 23 aa, Mycobacterium
EDYLRCWDMFGEAGVDLSNYPSV

SEQ ID NO: 1119712 - protein, 19 aa, Mycobacterium
EEHPRPRLFTAVRQEPDHP

SEQ ID NO: 1119713 - protein, 24 aa, Mycobacterium
EELFFRGALYTSLGNRWNGWWAVL

SEQ ID NO: 1119714 - protein, 22 aa, Mycobacterium
EESWEEIEDTLLIADLGPVVTE

SEQ ID NO: 1119715 - protein, 25 aa, Mycobacterium
EFGRMTFQPDLCADVPIVGLVGEAG

SEQ ID NO: 1119716 - protein, 20 aa, Mycobacterium
EFVRLLRARWMAVCVTTLIT

SEQ ID NO: 1119717 - protein, 21 aa, Mycobacterium
EGIVALILLAALQYVAAIVAS

SEQ ID NO: 1119718 - protein, 25 aa, Mycobacterium
EGQPSGFTMAGPWVGIAAPGEQITS

SEQ ID NO: 1119719 - protein, 23 aa, Mycobacterium
EGSSRRAVFVGAMRVGRDHIAST

SEQ ID NO: 1119720 - protein, 23 aa, Mycobacterium
EHAMIPRSRVDVVRADEAVPDVL

SEQ ID NO: 1119721 - protein, 20 aa, Mycobacterium
EIVAEPFLIVGILAGIKEIV

SEQ ID NO: 1119722 - protein, 23 aa, Mycobacterium
EKPAEGDWLYFVTIDLQGTTLFT

SEQ ID NO: 1119723 - protein, 20 aa, Mycobacterium
EKWLFAHIPLAKRVYRTRLW

SEQ ID NO: 1119724 - protein, 19 aa, Mycobacterium
EKYGRCITRLLVVGNPHAV

SEQ ID NO: 1119725 - protein, 18 aa, Mycobacterium
ELAFRGVLHGALNRAWGF

SEQ ID NO: 1119726 - protein, 20 aa, Mycobacterium
ELGHPARLVVRAATAVTAVA

SEQ ID NO: 1119727 - protein, 20 aa, Mycobacterium
ELRSALTKVGLRRWLDGLPD

SEQ ID NO: 1119728 - protein, 18 aa, Mycobacterium
ELRSRRPTAMVGDGVNDA

SEQ ID NO: 1119729 - protein, 19 aa, Mycobacterium
ELVDGAAIAAVIPLLLWIA

SEQ ID NO: 1119730 - protein, 20 aa, Mycobacterium
ELYPQCFDWVQAAMREIVSD

SEQ ID NO: 1119731 - protein, 18 aa, Mycobacterium
EMDRSIRALPHADKPSVL

SEQ ID NO: 1119732 - protein, 18 aa, Mycobacterium
EMRTSMGASATWAGVLTT

SEQ ID NO: 1119733 - protein, 18 aa, Mycobacterium
EPARITVTGTREFHVGII

SEQ ID NO: 1119734 - protein, 22 aa, Mycobacterium
EPEVKGLGIAAGARRPGAKKKP

SEQ ID NO: 1119735 - protein, 20 aa, Mycobacterium
EQLPSLAIVVLAEVWKTTPF

SEQ ID NO: 1119736 - protein, 20 aa, Mycobacterium
EQLVLCKLPPGPAAPPVVED

SEQ ID NO: 1119737 - protein, 17 aa, Mycobacterium
EQQRWLRDNALQMTNTI

SEQ ID NO: 1119738 - protein, 21 aa, Mycobacterium
ERFPSEWIYAQGLLFIVVVGF

SEQ ID NO: 1119739 - protein, 23 aa, Mycobacterium
ERITYRRGFVTRHQVSGWRFVMR

SEQ ID NO: 1119740 - protein, 24 aa, Mycobacterium
ERLGKLHFWLTFIGFHTTFLVQHW

SEQ ID NO: 1119741 - protein, 27 aa, Mycobacterium
ERPHPYPRWVATAGWAGFALGIAMLLG

SEQ ID NO: 1119742 - protein, 23 aa, Mycobacterium
ERPRLRIPLWSLLLLGAAALVVS

SEQ ID NO: 1119743 - protein, 19 aa, Mycobacterium
ERRAWRFEGPIIYLVVDDL

SEQ ID NO: 1119744 - protein, 22 aa, Mycobacterium
ERTRFVAWLNRRLAPLDPSPDQ

SEQ ID NO: 1119745 - protein, 18 aa, Mycobacterium
ERVYKPYPYILAIVDELA

SEQ ID NO: 1119746 - protein, 24 aa, Mycobacterium
ESADGRVLTGFGVASAVLAALSVA

SEQ ID NO: 1119747 - protein, 21 aa, Mycobacterium
ESADRLIELALRGGGPDNVTV

SEQ ID NO: 1119748 - protein, 22 aa, Mycobacterium
ESGRDGFWMSMAVFTILAVSNV

SEQ ID NO: 1119749 - protein, 27 aa, Mycobacterium
ESGWFAWPGYLWFGMAAYLLLTLLVLE

SEQ ID NO: 1119750 - protein, 17 aa, Mycobacterium
ESMRGAGLLLVIMAAGG

SEQ ID NO: 1119751 - protein, 19 aa, Mycobacterium
ESRLLRIGSPMFHFGILVV

SEQ ID NO: 1119752 - protein, 29 aa, Mycobacterium
ESTASWARVFDWLPIFVVITGIVGWVSDS

SEQ ID NO: 1119753 - protein, 19 aa, Mycobacterium
ETLFGLLDLRGRIFNETGN

SEQ ID NO: 1119754 - protein, 18 aa, Mycobacterium
ETLLSDLLEISRHDAGVA

SEQ ID NO: 1119755 - protein, 19 aa, Mycobacterium
EVKAHLGRLLSLPINAPEE

SEQ ID NO: 1119756 - protein, 24 aa, Mycobacterium
EVLGWPLWLLYVVVFALTLLIGVR

SEQ ID NO: 1119757 - protein, 27 aa, Mycobacterium
EVLSLPLYLLCGLARRRRLLSQEAALK

SEQ ID NO: 1119758 - protein, 19 aa, Mycobacterium
EVNRCCDLVIELAHDDPVL

SEQ ID NO: 1119759 - protein, 21 aa, Mycobacterium
EVPDVKSLTYAEAVRKLTDAG

SEQ ID NO: 1119760 - protein, 19 aa, Mycobacterium
EVYGSFTVAFLFVGYGVDM

SEQ ID NO: 1119761 - protein, 21 aa, Mycobacterium
EWLKSSVPFGGFPWGVVAFGQ

SEQ ID NO: 1119762 - protein, 25 aa, Mycobacterium
EYAGDRAKLTLAIRSDEMKYIPANA

SEQ ID NO: 1119763 - protein, 23 aa, Mycobacterium
EYILLRALFRNDLAAVPAPDKTV

SEQ ID NO: 1119764 - protein, 27 aa, Mycobacterium
EYLDLPRLWQILLIVGLFLWIAIVWRG

SEQ ID NO: 1119765 - protein, 23 aa, Mycobacterium
EYVPLRPLFGWATRHTKAAAEDR

SEQ ID NO: 1119766 - protein, 20 aa, Mycobacterium
FAAQCALAFTGAYEVALVVT

SEQ ID NO: 1119767 - protein, 23 aa, Mycobacterium
FAFAGVGVLLPRWSGDQYDAGRK

SEQ ID NO: 1119768 - protein, 21 aa, Mycobacterium
FAFCAAHGVFLGVILLLLDRN

SEQ ID NO: 1119769 - protein, 24 aa, Mycobacterium
FALALPFVLAWPFWALGKLCGVPW

SEQ ID NO: 1119770 - protein, 19 aa, Mycobacterium
FALSWWLGLYLLARNPRKP

SEQ ID NO: 1119771 - protein, 18 aa, Mycobacterium
FALVTVWLTRRGRIPHQR

SEQ ID NO: 1119772 - protein, 17 aa, Mycobacterium
FALWAVRAPRPVLIRLG

SEQ ID NO: 1119773 - protein, 30 aa, Mycobacterium
FAQAGLPTGSSFKVFALVAALQQGIGLGYQ

SEQ ID NO: 1119774 - protein, 23 aa, Mycobacterium
FATVVRRGWLREAVSHWRTVLAY

SEQ ID NO: 1119775 - protein, 26 aa, Mycobacterium
FAVDLPRIIGNALKPATPALAKVAST

SEQ ID NO: 1119776 - protein, 20 aa, Mycobacterium
FAVFWGVQTWDVWDAGDRYP

SEQ ID NO: 1119777 - protein, 41 aa, Mycobacterium
FAVIATLVAFQFRGDFTPREKLTMMAARAGLNLDPGTKVTF

SEQ ID NO: 1119778 - protein, 17 aa, Mycobacterium
FAVLIWADRRFNLGHGR

SEQ ID NO: 1119779 - protein, 34 aa, Mycobacterium
FAWREFLEQSWFVARVSLVPTLMLAIPFTVLLIF

SEQ ID NO: 1119780 - protein, 17 aa, Mycobacterium
FDGRWKLPGGPYTIPEL

SEQ ID NO: 1119781 - protein, 18 aa, Mycobacterium
FDVLAVTTIYEWIAAPVG

SEQ ID NO: 1119782 - protein, 17 aa, Mycobacterium
FEFPLLIVMLNFIGMLP

SEQ ID NO: 1119783 - protein, 17 aa, Mycobacterium
FEGGPRWRAMKANLDDW

SEQ ID NO: 1119784 - protein, 24 aa, Mycobacterium
FEQITARLTWIWVGVFAAMAVSAA

SEQ ID NO: 1119785 - protein, 17 aa, Mycobacterium
FESFRWAWTAQYAVWTL

SEQ ID NO: 1119786 - protein, 18 aa, Mycobacterium
FFSLHVLVVWAAIYLTWG

SEQ ID NO: 1119787 - protein, 18 aa, Mycobacterium
FGAFAMVRFDTFTVAIFQ

SEQ ID NO: 1119788 - protein, 18 aa, Mycobacterium
FGAGVLLGLACATKWSGL

SEQ ID NO: 1119789 - protein, 24 aa, Mycobacterium
FGALGALLCVLLGVAIVTQVRQNE

SEQ ID NO: 1119790 - protein, 26 aa, Mycobacterium
FGARRWLARIAVSWGLVVVAIGFAPN

SEQ ID NO: 1119791 - protein, 19 aa, Mycobacterium
FGILGALFLLPLVTAPVLV

SEQ ID NO: 1119792 - protein, 17 aa, Mycobacterium
FGLFGAMFVVARKLNLD

SEQ ID NO: 1119793 - protein, 17 aa, Mycobacterium
FGLSWGLFPILFATTGM

SEQ ID NO: 1119794 - protein, 23 aa, Mycobacterium
FGMILRIVGIEWRGKIDDPTWRR

SEQ ID NO: 1119795 - protein, 64 aa, Mycobacterium
FGPDGAGLIAAFRIWEGGLGIWGAVALGGVGAWIACRRRGIPLPAFGDAIAPGIILAQAIGRLG

SEQ ID NO: 1119796 - protein, 18 aa, Mycobacterium
FGSVLIGAAAAGFAAYGL

SEQ ID NO: 1119797 - protein, 22 aa, Mycobacterium
FIEPVIRLLQPVTKLLIDLGYD

SEQ ID NO: 1119798 - protein, 23 aa, Mycobacterium
FIGLWIFGWSRLPRLVHLACIWI

SEQ ID NO: 1119799 - protein, 17 aa, Mycobacterium
FLACAPVASAQPAAGPW

SEQ ID NO: 1119800 - protein, 29 aa, Mycobacterium
FLASPGLGWPDLRAGRVRVLRCAYPRGQA

SEQ ID NO: 1119801 - protein, 18 aa, Mycobacterium
FLDRLRAESGYIAITIAL

SEQ ID NO: 1119802 - protein, 21 aa, Mycobacterium
FLINPRHTFTIAEPDSALTIV

SEQ ID NO: 1119803 - protein, 25 aa, Mycobacterium
FLMSRIREFWLASGRTAADVTESVA

SEQ ID NO: 1119804 - protein, 17 aa, Mycobacterium
FLRFGGAAVAPWLAGVL

SEQ ID NO: 1119805 - protein, 17 aa, Mycobacterium
FLTGALNEIRSRKPGMM

SEQ ID NO: 1119806 - protein, 17 aa, Mycobacterium
FMRMFGVGFTLAVLADA

SEQ ID NO: 1119807 - protein, 25 aa, Mycobacterium
FNDGKEVPANLVGRDPKTDLAVLKV

SEQ ID NO: 1119808 - protein, 18 aa, Mycobacterium
FNRLPRKLVDRVLPAPGT

SEQ ID NO: 1119809 - protein, 24 aa, Mycobacterium
FPAPSWWWLAWIGVVPLLLVVRAA

SEQ ID NO: 1119810 - protein, 21 aa, Mycobacterium
FPKPEEIGGYAGVPQAPPPRP

SEQ ID NO: 1119811 - protein, 22 aa, Mycobacterium
FPLISSFAIWALTGWVVSGELF

SEQ ID NO: 1119812 - protein, 28 aa, Mycobacterium
FPLRAYALCIIAGIIVALVLGDRRWEAR

SEQ ID NO: 1119813 - protein, 17 aa, Mycobacterium
FPMMGMIDMSNALCRDD

SEQ ID NO: 1119814 - protein, 25 aa, Mycobacterium
FQAVPRLHAVAVVAAILPNLAQWAH

SEQ ID NO: 1119815 - protein, 19 aa, Mycobacterium
FQRIPYFYGRRLPASMRTW

SEQ ID NO: 1119816 - protein, 19 aa, Mycobacterium
FRDEARSAAMLSHPNIVAV

SEQ ID NO: 1119817 - protein, 21 aa, Mycobacterium
FRFAGGWTGMLVYLLIPVIVV

SEQ ID NO: 1119818 - protein, 37 aa, Mycobacterium
FRGGDGARFTWRMVLVMVGALLVWLLVVLTLMRISGW

SEQ ID NO: 1119819 - protein, 21 aa, Mycobacterium
FRLSGPDMRAVRQAVTRARRA

SEQ ID NO: 1119820 - protein, 37 aa, Mycobacterium
FRPLKNYFYWEPHCFNIPICWAFRSLFDGLDNIDALE

SEQ ID NO: 1119821 - protein, 25 aa, Mycobacterium
FRPPPPPWYRTRQAVTALMIVALAA

SEQ ID NO: 1119822 - protein, 21 aa, Mycobacterium
FRSGLMLAVGSAFAFGMSGPL

SEQ ID NO: 1119823 - protein, 21 aa, Mycobacterium
FSDDDALRWAAALETRSEHPL

SEQ ID NO: 1119824 - protein, 22 aa, Mycobacterium
FSGAVCGVVLILLVARIARRIS

SEQ ID NO: 1119825 - protein, 20 aa, Mycobacterium
FSGFEHPWFFLFLIVVLALA

SEQ ID NO: 1119826 - protein, 30 aa, Mycobacterium
FSLVSWAVPLNWWVMLAGFVLFVSPVGRMG

SEQ ID NO: 1119827 - protein, 20 aa, Mycobacterium
FSNLAVALGQFYKAYGTNKE

SEQ ID NO: 1119828 - protein, 17 aa, Mycobacterium
FSQERVISYAELLMGET

SEQ ID NO: 1119829 - protein, 20 aa, Mycobacterium
FSSVFVVGNSLRLRGFTSTS

SEQ ID NO: 1119830 - protein, 18 aa, Mycobacterium
FSSVFVVSNSLRLRRFTS

SEQ ID NO: 1119831 - protein, 20 aa, Mycobacterium
FSVFEYFRSWEFFRTTGESF

SEQ ID NO: 1119832 - protein, 30 aa, Mycobacterium; identical to SEQ ID NO: 296141

SEQ ID NO: 1119833 - protein, 25 aa, Mycobacterium
FSVVWAVAYLRGFGRTPVWVAAEVG

SEQ ID NO: 1119834 - protein, 23 aa, Mycobacterium
FTALEAVAVLLLIVVVVVAIIAA

SEQ ID NO: 1119835 - protein, 20 aa, Mycobacterium
FTGSFMWRRGFGAAALFYGH

SEQ ID NO: 1119836 - protein, 17 aa, Mycobacterium
FTLIGPKIWWPALRASP

SEQ ID NO: 1119837 - protein, 20 aa, Mycobacterium
FTVPAPFGLRDDVFTLLLSL

SEQ ID NO: 1119838 - protein, 23 aa, Mycobacterium
FTVSTLHEWRPFTIAGLGIGVFG

SEQ ID NO: 1119839 - protein, 23 aa, Mycobacterium
FVIRYFPIQSHFNAERAARAVEA

SEQ ID NO: 1119840 - protein, 18 aa, Mycobacterium
FVLFALASGRAMRALGWL

SEQ ID NO: 1119841 - protein, 17 aa, Mycobacterium
FVPDPDYTWVPRTQVEA

SEQ ID NO: 1119842 - protein, 17 aa, Mycobacterium
FVSNWRFEAVGTDYFQQ

SEQ ID NO: 1119843 - protein, 24 aa, Mycobacterium
FVVVCVVAAFGLLAVFSNLRFSGE

SEQ ID NO: 1119844 - protein, 22 aa, Mycobacterium
FWFPEVHAGAMAPIGIGALAAL

SEQ ID NO: 1119845 - protein, 17 aa, Mycobacterium
FWRRLAVHLELTGVLIL

SEQ ID NO: 1119846 - protein, 19 aa, Mycobacterium
FYFVWPWVLIALFALTRKV

SEQ ID NO: 1119847 - protein, 17 aa, Mycobacterium
GAALRALLDLGAKDVSV

SEQ ID NO: 1119848 - protein, 17 aa, Mycobacterium
GAAMAVAAMLSVQLGVA

SEQ ID NO: 1119849 - protein, 20 aa, Mycobacterium
GAFMLAKWVGGGGHRDRTRT

SEQ ID NO: 1119850 - protein, 19 aa, Mycobacterium
GAFTDVMRLLVPTTDLTNQ

SEQ ID NO: 1119851 - protein, 18 aa, Mycobacterium
GAGERLVLYLGLAAALGL

SEQ ID NO: 1119852 - protein, 24 aa, Mycobacterium
GAGGPRPDPVLMRRHLMLYMALMG

SEQ ID NO: 1119853 - protein, 33 aa, Mycobacterium
GAGQARSPMFGFFPVMMVMSLVGTLAFGARGTQ

SEQ ID NO: 1119854 - protein, 24 aa, Mycobacterium
GAGQRLADRIARPLVPAIMALAAA

SEQ ID NO: 1119855 - protein, 20 aa, Mycobacterium
GAGWAALRGLGPVAYGDGWF

SEQ ID NO: 1119856 - protein, 21 aa, Mycobacterium
GAKIPRGVLLYGPPGTGKTLL

SEQ ID NO: 1119857 - protein, 25 aa, Mycobacterium
GALAARKRIAWWILLLYMVAAAGWN

SEQ ID NO: 1119858 - protein, 26 aa, Mycobacterium
GALGCGLALDGWRRGYQLWAAAGLGA

SEQ ID NO: 1119859 - protein, 18 aa, Mycobacterium
GALSHWLEPVVGTHEETH

SEQ ID NO: 1119860 - protein, 23 aa, Mycobacterium
GAMVFAILVLLGRYINYTLDLAG

SEQ ID NO: 1119861 - protein, 31 aa, Mycobacterium
GAQEVPAATAWRGEGAIILHVIRDGEVLGGL

SEQ ID NO: 1119862 - protein, 18 aa, Mycobacterium
GAWAAWRRRASAEEDPHV

SEQ ID NO: 1119863 - protein, 18 aa, Mycobacterium
GAYAGGLLARYIPGTILL

SEQ ID NO: 1119864 - protein, 26 aa, Mycobacterium
GCLMGSRLGPVVVRRAPAGPMRILIG

SEQ ID NO: 1119865 - protein, 18 aa, Mycobacterium
GDADFRSAVKARRTPVKP

SEQ ID NO: 1119866 - protein, 19 aa, Mycobacterium
GDALLARFPGAGVSLETSR

SEQ ID NO: 1119867 - protein, 28 aa, Mycobacterium
GDDLRLYLDGGLQFSTRDEFRYTESLVH

SEQ ID NO: 1119868 - protein, 21 aa, Mycobacterium
GDGKAHHGLGLALVAQVAARH

SEQ ID NO: 1119869 - protein, 17 aa, Mycobacterium
GDLPIVILPGGPSGGGG

SEQ ID NO: 1119870 - protein, 23 aa, Mycobacterium
GDTTKPRLCVHYDAEAASATEVQ

SEQ ID NO: 1119871 - protein, 20 aa, Mycobacterium
GDVFGLRRWYVVTFVMGLFF

SEQ ID NO: 1119872 - protein, 27 aa, Mycobacterium
GEALAGLLRRWAWLVLIVGFAVIVTYT

SEQ ID NO: 1119873 - protein, 18 aa, Mycobacterium
GEALFGYNGLGWRFSGAV

SEQ ID NO: 1119874 - protein, 19 aa, Mycobacterium
GEAQADQSAAQICVVLTAQ

SEQ ID NO: 1119875 - protein, 23 aa, Mycobacterium
GEIDGRLYLDMRLIEGRNLGTIL

SEQ ID NO: 1119876 - protein, 18 aa, Mycobacterium
GELRITLMRADVLAEPIV

SEQ ID NO: 1119877 - protein, 19 aa, Mycobacterium
GESAGLVPPIHQWSGSTFS

SEQ ID NO: 1119878 - protein, 19 aa, Mycobacterium
GFAELYRQGAARDVEMLMN

SEQ ID NO: 1119879 - protein, 23 aa, Mycobacterium
GFALAWRDSWEYWTETVRNTDRI

SEQ ID NO: 1119880 - protein, 35 aa, Mycobacterium
GFGVLVFQWIFGQEIAWPVPLLAFIILVAVGADYN

SEQ ID NO: 1119881 - protein, 19 aa, Mycobacterium
GFLGVDVFFVLSGFLITSL

SEQ ID NO: 1119882 - protein, 28 aa, Mycobacterium
GFMEAGGWRLPGLAAFMVTASETLGGIG

SEQ ID NO: 1119883 - protein, 19 aa, Mycobacterium
GFPTDIFVIVDGWENFLED

SEQ ID NO: 1119884 - protein, 21 aa, Mycobacterium
GFQTYSVVVDAEIPKAANSQS

SEQ ID NO: 1119885 - protein, 17 aa, Mycobacterium
GFVAWLIGVFYKNLYVE

SEQ ID NO: 1119886 - protein, 45 aa, Mycobacterium
GFVRMCVLTGKALFRPFQWREFILQAWFLFRVSFLPTVAVSVPLT

SEQ ID NO: 1119887 - protein, 18 aa, Mycobacterium
GGAALEALGRIRGIALDK

SEQ ID NO: 1119888 - protein, 20 aa, Mycobacterium
GGAARAMFDPLLARLRDLGA

SEQ ID NO: 1119889 - protein, 19 aa, Mycobacterium
GGAIAWLLLLICSPATRAA

SEQ ID NO: 1119890 - protein, 17 aa, Mycobacterium
GGAPRRARGPKAASAQG

SEQ ID NO: 1119891 - protein, 22 aa, Mycobacterium
GGEPRFQPVLGNRVSTYVGDLS

SEQ ID NO: 1119892 - protein, 33 aa, Mycobacterium
GGHPHWRERVNWRWVRRGLIAAAVVLIVLPLVT

SEQ ID NO: 1119893 - protein, 21 aa, Mycobacterium
GGIEYGARHYPVMVVLHTGLL

SEQ ID NO: 1119894 - protein, 18 aa, Mycobacterium
GGITRKAKELVISTKMSG

SEQ ID NO: 1119895 - protein, 17 aa, Mycobacterium
GGIVRRPRRVRVTEPEP

SEQ ID NO: 1119896 - protein, 23 aa, Mycobacterium
GGLLGGFGVLRFDNGTATVDTLA

SEQ ID NO: 1119897 - protein, 17 aa, Mycobacterium
GGLTGFLVSVWTILAAM

SEQ ID NO: 1119898 - protein, 34 aa, Mycobacterium
GGMGYSFGAGIGVAFGRRRRTVVIAGDGSFFMHG

SEQ ID NO: 1119899 - protein, 28 aa, Mycobacterium
GGRFPELDVDAVLARRPEVVLVDELAHT

SEQ ID NO: 1119900 - protein, 18 aa, Mycobacterium
GGRLLRLPGAGLLGPMAL

SEQ ID NO: 1119901 - protein, 29 aa, Mycobacterium
GGRMSAFLRGAWIVGQCIIAVAFGAGLFI

SEQ ID NO: 1119902 - protein, 20 aa, Mycobacterium
GGSADRLGAIVIVQLFGLLL

SEQ ID NO: 1119903 - protein, 20 aa, Mycobacterium
GGWLRAATFGAMDGLVSNTA

SEQ ID NO: 1119904 - protein, 20 aa, Mycobacterium
GHALTRGTAVVLVLASPNGA

SEQ ID NO: 1119905 - protein, 17 aa, Mycobacterium
GHSARYLVQTSLNPFSP

SEQ ID NO: 1119906 - protein, 27 aa, Mycobacterium
GHWSLLVGYGCLPWVATAVLRLRDGSG

SEQ ID NO: 1119907 - protein, 27 aa, Mycobacterium
GIALVVLWRWRWVRLAAGAAVLGLVAW

SEQ ID NO: 1119908 - protein, 26 aa, Mycobacterium
GIARLRPRFASLVGLSEVLFAVLAAW

SEQ ID NO: 1119909 - protein, 23 aa, Mycobacterium
GIGKSRMAREIAMSAAGRGVEVF

SEQ ID NO: 1119910 - protein, 20 aa, Mycobacterium
GIGRPTRRDLTVAVLSATGE

SEQ ID NO: 1119911 - protein, 23 aa, Mycobacterium
GKSELLRTLTLGLIASHPPDELN

SEQ ID NO: 1119912 - protein, 19 aa, Mycobacterium
GLACGAALALLVGNPLSGL

SEQ ID NO: 1119913 - protein, 20 aa, Mycobacterium
GLAGCFVFSLIRPAGSAGTD

SEQ ID NO: 1119914 - protein, 24 aa, Mycobacterium
GLAPLEAFPSWLQGFVQYQPVSQI

SEQ ID NO: 1119915 - protein, 28 aa, Mycobacterium
GLARPRMRPDLLGGLGLAVLIGLPGLAF

SEQ ID NO: 1119916 - protein, 25 aa, Mycobacterium
GLASLPVYVTNAFFNGFVPPFPTRS

SEQ ID NO: 1119917 - protein, 19 aa, Mycobacterium
GLAVILWRTMRFRADRTVP

SEQ ID NO: 1119918 - protein, 17 aa, Mycobacterium
GLAWQHYSSEPVAPPAQ

SEQ ID NO: 1119919 - protein, 18 aa, Mycobacterium
GLGPPWVLTVGFILSAVS

SEQ ID NO: 1119920 - protein, 18 aa, Mycobacterium
GLIFAVSMFGLMVGSVAI

SEQ ID NO: 1119921 - protein, 27 aa, Mycobacterium
GLIFFGWGVALAFTSVVVAPRLQHRFG

SEQ ID NO: 1119922 - protein, 17 aa, Mycobacterium
GLIGRRRPRGLQVADTI

SEQ ID NO: 1119923 - protein, 25 aa, Mycobacterium
GLIVAFIALFWLYQVYEPPVRPAQN

SEQ ID NO: 1119924 - protein, 18 aa, Mycobacterium
GLLAKGRDTGLEIATSVS

SEQ ID NO: 1119925 - protein, 31 aa, Mycobacterium
GLLIRFTGPPLWWLLRVADWAAAVPGASVPV

SEQ ID NO: 1119926 - protein, 20 aa, Mycobacterium
GLMLLILGAARAWADPGTGS

SEQ ID NO: 1119927 - protein, 26 aa, Mycobacterium
GLPLRAIVMVLLFLGIVFLLVGFQAL

SEQ ID NO: 1119928 - protein, 18 aa, Mycobacterium
GLPMPIAVGTSLIVIAMK

SEQ ID NO: 1119929 - protein, 21 aa, Mycobacterium
GLPSDIWKATMDGALEDTDNE

SEQ ID NO: 1119930 - protein, 17 aa, Mycobacterium
GLTFNDFLVHMAPIVLV

SEQ ID NO: 1119931 - protein, 22 aa, Mycobacterium
GLTLPRALFWIVIAYVVVVTYV

SEQ ID NO: 1119932 - protein, 19 aa, Mycobacterium
GLTYRFPFDTEKKTYPLFD

SEQ ID NO: 1119933 - protein, 20 aa, Mycobacterium
GLYGGLLVDAYRAAQVQVQV

SEQ ID NO: 1119934 - protein, 18 aa, Mycobacterium
GNLRRLQDGIGQLASGAQ

SEQ ID NO: 1119935 - protein, 17 aa, Mycobacterium
GNVLISWMGIKDSDGVP

SEQ ID NO: 1119936 - protein, 17 aa, Mycobacterium
GNYIPALIVIAVLMISV

SEQ ID NO: 1119937 - protein, 18 aa, Mycobacterium
GPAPEVPARVAPPQQPSV

SEQ ID NO: 1119938 - protein, 24 aa, Mycobacterium
GPERYAEMLKKFGLGQRTGVGLPG

SEQ ID NO: 1119939 - protein, 19 aa, Mycobacterium
GPFTEAGARTWRVVPGTTP

SEQ ID NO: 1119940 - protein, 26 aa, Mycobacterium
GPKTNALAIWSLVASLIGFVCCLGSV

SEQ ID NO: 1119941 - protein, 19 aa, Mycobacterium
GPQTFAWKTVLDCAMAYAA

SEQ ID NO: 1119942 - protein, 20 aa, Mycobacterium
GPSCWTELEAPLKSCTYGYQ

SEQ ID NO: 1119943 - protein, 22 aa, Mycobacterium
GPYGHPFHPILVTVPIGAWASS

SEQ ID NO: 1119944 - protein, 24 aa, Mycobacterium
GQGGEPRLTLPDAITGNPGDPRYP

SEQ ID NO: 1119945 - protein, 17 aa, Mycobacterium
GQLNCAITDAAGAALVT

SEQ ID NO: 1119946 - protein, 24 aa, Mycobacterium
GQVAQRYAAVYGYDERAMAKIVVD

SEQ ID NO: 1119947 - protein, 18 aa, Mycobacterium
GRAFPAIVVLIGVAVWLN

SEQ ID NO: 1119948 - protein, 17 aa, Mycobacterium
GREGWLQTANILAAVLA

SEQ ID NO: 1119949 - protein, 25 aa, Mycobacterium
GRFFGRFDLAVAVFFALSGFLLWRG

SEQ ID NO: 1119950 - protein, 21 aa, Mycobacterium
GRGTLRKMRQNLGWAVGYNVI

SEQ ID NO: 1119951 - protein, 19 aa, Mycobacterium
GRGVGVIALADAVRETSAE

SEQ ID NO: 1119952 - protein, 23 aa, Mycobacterium
GRHPHRRSWLVLGIIGSNALVWT

SEQ ID NO: 1119953 - protein, 18 aa, Mycobacterium
GRIALLVTAVAWALLGVI

SEQ ID NO: 1119954 - protein, 20 aa, Mycobacterium
GRLAHYEVPSEIAVVDTIPR

SEQ ID NO: 1119955 - protein, 22 aa, Mycobacterium
GRLGDHMLFYIRAIGGVPHATL

SEQ ID NO: 1119956 - protein, 20 aa, Mycobacterium
GRLSWPKVLGGGVLTGAWLG

SEQ ID NO: 1119957 - protein, 27 aa, Mycobacterium
GRMRWHAWVRLAVPLAVAFVAAAWIED

SEQ ID NO: 1119958 - protein, 17 aa, Mycobacterium
GRNIFGFITKVFPPDVR

SEQ ID NO: 1119959 - protein, 20 aa, Mycobacterium
GRNIGRIVAYVVLPVAVLAM

SEQ ID NO: 1119960 - protein, 21 aa, Mycobacterium
GRPILRILMRRRRSVGTWPLL

SEQ ID NO: 1119961 - protein, 22 aa, Mycobacterium
GRPKMFRHLRRRHIAFAGLFLL

SEQ ID NO: 1119962 - protein, 31 aa, Mycobacterium
GRRPPRLGRGWLTAICAVLLLLGAGAGVGGY

SEQ ID NO: 1119963 - protein, 26 aa, Mycobacterium
GRRRLGRLTLWLMIGIVGALTVSFAA

SEQ ID NO: 1119964 - protein, 24 aa, Mycobacterium
GSADGFAAALFRLLAIATGLFAAT

SEQ ID NO: 1119965 - protein, 24 aa, Mycobacterium
GSADRWLLIGAHVAWLAVLVGSLV

SEQ ID NO: 1119966 - protein, 29 aa, Mycobacterium
GSALPRWIYVPAVAGALFVGLPVVSVAAK

SEQ ID NO: 1119967 - protein, 20 aa, Mycobacterium
GSASPARTYGWHRAEVFTAV

SEQ ID NO: 1119968 - protein, 18 aa, Mycobacterium
GSFREMQAFYTPRVPATE

SEQ ID NO: 1119969 - protein, 22 aa, Mycobacterium
GSGPWWPLPFWIALAGLTPTGL

SEQ ID NO: 1119970 - protein, 22 aa, Mycobacterium
GSLAVYVGLLISWHADTAGGAT

SEQ ID NO: 1119971 - protein, 27 aa, Mycobacterium
GSLPDVSKNFPVRYLVTDTGFGTGLDI

SEQ ID NO: 1119972 - protein, 19 aa, Mycobacterium
GSPAYTFPESLPIVNATGG

SEQ ID NO: 1119973 - protein, 26 aa, Mycobacterium
GSSAAPLFHNIASWLLQRQNVPLSPP

SEQ ID NO: 1119974 - protein, 17 aa, Mycobacterium
GSTEGLAAVGAAVAAFI

SEQ ID NO: 1119975 - protein, 17 aa, Mycobacterium
GSVRAWLVVALMNIAMI

SEQ ID NO: 1119976 - protein, 20 aa, Mycobacterium
GSVVTLCLELFGFSDHTPLA

SEQ ID NO: 1119977 - protein, 26 aa, Mycobacterium
GSYQFLKRWVFALVLSAVWVVAAAVG

SEQ ID NO: 1119978 - protein, 25 aa, Mycobacterium
GTAGARCRPAVVVPETLPLPNVVRE

SEQ ID NO: 1119979 - protein, 34 aa, Mycobacterium
GTARAIERFAPIIGGIRPGLFVSSNFLPGSPAYT

SEQ ID NO: 1119980 - protein, 20 aa, Mycobacterium
GTATGLVFVWFSLTPSLLPR

SEQ ID NO: 1119981 - protein, 17 aa, Mycobacterium
GTFDYWQAWVFIAVFVV

SEQ ID NO: 1119982 - protein, 18 aa, Mycobacterium
GTPLWPGVPPAPAPAPAP

SEQ ID NO: 1119983 - protein, 23 aa, Mycobacterium
GTRLRRPTIVLGLVVTLLGGALT

SEQ ID NO: 1119984 - protein, 22 aa, Mycobacterium
GTSADISWLLPLIYVLLAMSLV

SEQ ID NO: 1119985 - protein, 23 aa, Mycobacterium
GTVCAACVFLPGAREPVLVDESD

SEQ ID NO: 1119986 - protein, 26 aa, Mycobacterium
GTVLLNYLASIGFGVLVFQWIFGQEI

SEQ ID NO: 1119987 - protein, 19 aa, Mycobacterium
GVDEAMDRFGLAATAVAVL

SEQ ID NO: 1119988 - protein, 22 aa, Mycobacterium
GVDTWVLGRPGALNVDGATLNP

SEQ ID NO: 1119989 - protein, 23 aa, Mycobacterium
GVFAWNGAIAWWINMVVFLLYTA

SEQ ID NO: 1119990 - protein, 22 aa, Mycobacterium
GVGILFTWMFMYGMTPLLQGPV

SEQ ID NO: 1119991 - protein, 19 aa, Mycobacterium
GVIPGGPQTFAWKTVLDCA

SEQ ID NO: 1119992 - protein, 23 aa, Mycobacterium
GVITRLLAWVGIEDIPGLRWGLR

SEQ ID NO: 1119993 - protein, 18 aa, Mycobacterium
GVLILVCAVVDFSAYLGY

SEQ ID NO: 1119994 - protein, 17 aa, Mycobacterium
GVLLGFTVPVLRSVAAG

SEQ ID NO: 1119995 - protein, 27 aa, Mycobacterium
GVLMPMDFPLVMSVAGGHWQVDRINDS

SEQ ID NO: 1119996 - protein, 24 aa, Mycobacterium
GVSLFLALWLVWAPALFRSLDDVG

SEQ ID NO: 1119997 - protein, 22 aa, Mycobacterium
GVSRIAWSELFGTMKTSVKGAT

SEQ ID NO: 1119998 - protein, 19 aa, Mycobacterium
GVTVGDAWKHGTMPYTTTG

SEQ ID NO: 1119999 - protein, 19 aa, Mycobacterium
GVVIGIIWMGRRLVSPWWA

SEQ ID NO: 1120000 - protein, 19 aa, Mycobacterium
GVVLHLSIFVSMSIGLFSL

SEQ ID NO: 1120001 - protein, 20 aa, Mycobacterium
GVVLLCRPFDGGIDVKGALL

SEQ ID NO: 1120002 - protein, 19 aa, Mycobacterium
GVVMVLRWLPVHRAQAQSV

SEQ ID NO: 1120003 - protein, 17 aa, Mycobacterium
GVVVKVLLVAGLWAAGW

SEQ ID NO: 1120004 - protein, 24 aa, Mycobacterium
GVYLWHWPIFLFLNGERTGWTGWR

SEQ ID NO: 1120005 - protein, 25 aa, Mycobacterium
GWACPACGGLRMTHDLLHGDLAAAV

SEQ ID NO: 1120006 - protein, 18 aa, Mycobacterium
GWLPEVFIDSGVSKSTAG

SEQ ID NO: 1120007 - protein, 23 aa, Mycobacterium
GWLSTRRRIRELVLPIVTTATGA

SEQ ID NO: 1120008 - protein, 18 aa, Mycobacterium
GWPSIALPGGRSIDRNLA

SEQ ID NO: 1120009 - protein, 18 aa, Mycobacterium
GWPSRLLMINQFGINLGF

SEQ ID NO: 1120010 - protein, 24 aa, Mycobacterium
GWTGWRLLIARCAATLAVAVLSYW

SEQ ID NO: 1120011 - protein, 18 aa, Mycobacterium
GYMLYNFGVALYVGVLQT

SEQ ID NO: 1120012 - protein, 23 aa, Mycobacterium
HAAAAVPFWIGPILLYLLLPALD

SEQ ID NO: 1120013 - protein, 17 aa, Mycobacterium
HADERKERIALKLVAST

SEQ ID NO: 1120014 - protein, 25 aa, Mycobacterium
HARGRRWSAVRGFLRVEGLDPSYRE

SEQ ID NO: 1120015 - protein, 19 aa, Mycobacterium
HARRARRIMLQNVGLSLGL

SEQ ID NO: 1120016 - protein, 23 aa, Mycobacterium
HAVAHALLAKGIKGGDGVAVLAR

SEQ ID NO: 1120017 - protein, 25 aa, Mycobacterium
HDGARPDTALSRWLPDTATPTGPGW

SEQ ID NO: 1120018 - protein, 17 aa, Mycobacterium
HDLTFRGDFPLNTAGGQ

SEQ ID NO: 1120019 - protein, 21 aa, Mycobacterium
HEAAEVLVILNAIRAARTHTL

SEQ ID NO: 1120020 - protein, 18 aa, Mycobacterium
HEFGHAAAARYGGATPGV

SEQ ID NO: 1120021 - protein, 19 aa, Mycobacterium
HEFGHAAAARYGGATPGVM

SEQ ID NO: 1120022 - protein, 22 aa, Mycobacterium
HELRTPLTTVRMAADLIHDHSD

SEQ ID NO: 1120023 - protein, 19 aa, Mycobacterium
HFSSLPGLIAAAVIAGVGQ

SEQ ID NO: 1120024 - protein, 17 aa, Mycobacterium
HGLGLALVAQVAARHGG

SEQ ID NO: 1120025 - protein, 27 aa, Mycobacterium
HGYHYYARDALRPEVTFADYTVTTNEE

SEQ ID NO: 1120026 - protein, 18 aa, Mycobacterium
HHDGRLSTVPAFVGDDSL

SEQ ID NO: 1120027 - protein, 22 aa, Mycobacterium
HHSVTRFYGLNGLMKHPLHQTV

SEQ ID NO: 1120028 - protein, 17 aa, Mycobacterium
HLFGWPSGGFVGVDVFF

SEQ ID NO: 1120029 - protein, 20 aa, Mycobacterium
HNPQFAFTRIDAGAGVPDFR

SEQ ID NO: 1120030 - protein, 22 aa, Mycobacterium
HPARYLSLFLVLLVGAFLLVFL

SEQ ID NO: 1120031 - protein, 27 aa, Mycobacterium
HPLLMRLGPRQAYWSGLSVFAAGSLGC

SEQ ID NO: 1120032 - protein, 19 aa, Mycobacterium
HPRELLLRVEAASEGAVRM

SEQ ID NO: 1120033 - protein, 18 aa, Mycobacterium
HRAAGWRTGGFVYHPDHD

SEQ ID NO: 1120034 - protein, 21 aa, Mycobacterium
HRFGWSEVPVAVVIAGNLAVL

SEQ ID NO: 1120035 - protein, 18 aa, Mycobacterium
HRGELVYLPPAWYATNPP

SEQ ID NO: 1120036 - protein, 24 aa, Mycobacterium
HRGIACAIAGLAFVMPLAQAAITH

SEQ ID NO: 1120037 - protein, 19 aa, Mycobacterium
HSESRARLVSRILAVLILA

SEQ ID NO: 1120038 - protein, 24 aa, Mycobacterium
HSRRARRIMVQNIAFSLAIIAVLI

SEQ ID NO: 1120039 - protein, 19 aa, Mycobacterium
HVEALACLALDMAEAVADL

SEQ ID NO: 1120040 - protein, 22 aa, Mycobacterium
HVQRAYCRLMLRSFGVRIAVSG

SEQ ID NO: 1120041 - protein, 19 aa, Mycobacterium
HVVAHDWGSTGMWEYLSRP

SEQ ID NO: 1120042 - protein, 17 aa, Mycobacterium
HYFFLTSIHCIHVLIGF

SEQ ID NO: 1120043 - protein, 18 aa, Mycobacterium
HYLGYTLVMAFAAAAMFG

SEQ ID NO: 1120044 - protein, 17 aa, Mycobacterium
IAAAIGFLQMKRWGHQW

SEQ ID NO: 1120045 - protein, 21 aa, Mycobacterium
IAAIQRLRAPLKVAGEYSPEY

SEQ ID NO: 1120046 - protein, 17 aa, Mycobacterium
IAAQLGIDTVIAEVLPG

SEQ ID NO: 1120047 - protein, 20 aa, Mycobacterium
IAARRARPRASSDLWRLLPY

SEQ ID NO: 1120048 - protein, 17 aa, Mycobacterium
IAERFAEGHLSERMPVR

SEQ ID NO: 1120049 - protein, 19 aa, Mycobacterium
IAGFTVHRIRGFFGADGIT

SEQ ID NO: 1120050 - protein, 22 aa, Mycobacterium
IALGLWRLAEAFIGAKPGEQYG

SEQ ID NO: 1120051 - protein, 20 aa, Mycobacterium
IAMVPKPVWIAIGIGVAVIV

SEQ ID NO: 1120052 - protein, 17 aa, Mycobacterium
IARDVRGARRWRDRLGY

SEQ ID NO: 1120053 - protein, 21 aa, Mycobacterium
IARNLSILPFNPFAFNPVQFS

SEQ ID NO: 1120054 - protein, 27 aa, Mycobacterium
IASADVAHAFWVPEFLFKRDVYPNPEQ

SEQ ID NO: 1120055 - protein, 17 aa, Mycobacterium
IASGLFVFILMVSGATH

SEQ ID NO: 1120056 - protein, 27 aa, Mycobacterium
IATALWLIKFVLDFQWMSLFTVPFQTI

SEQ ID NO: 1120057 - protein, 19 aa, Mycobacterium
IATAMLSYRADQVEQDLTA

SEQ ID NO: 1120058 - protein, 23 aa, Mycobacterium
IAVGLLLPWTRPMFMNNNYATIS

SEQ ID NO: 1120059 - protein, 21 aa, Mycobacterium
IAVVDWRSAVIVLIALPLIPI

SEQ ID NO: 1120060 - protein, 25 aa, Mycobacterium
IDINLRMSVVLGFVGAGGIGFALQD

SEQ ID NO: 1120061 - protein, 18 aa, Mycobacterium
IDPQLWLLVVVTVLALLL

SEQ ID NO: 1120062 - protein, 20 aa, Mycobacterium
IDPVAALTWDIPEGEEVPAN

SEQ ID NO: 1120063 - protein, 33 aa, Mycobacterium
IDPVAALTWEVPEGPTAIPYRVKQLPPPVYVPP

SEQ ID NO: 1120064 - protein, 23 aa, Mycobacterium
IDVPAIPAAMVFLGLVAALNARG

SEQ ID NO: 1120065 - protein, 27 aa, Mycobacterium
IEDRMPVPVAWMREWALMGGVGPGIFL

SEQ ID NO: 1120066 - protein, 35 aa, Mycobacterium
IETVSWRAVFWINLPICAAAIILTAVFVPETKSAT

SEQ ID NO: 1120067 - protein, 29 aa, Mycobacterium
IEVSAVKKALPWVFGVVIVGMVVMMFVSG

SEQ ID NO: 1120068 - protein, 18 aa, Mycobacterium
IFLIIGMLLLVYRSVSSV

SEQ ID NO: 1120069 - protein, 22 aa, Mycobacterium
IFMAMMGIALFQSMQQQGGNSE

SEQ ID NO: 1120070 - protein, 19 aa, Mycobacterium
IGAVVYLMAAPRGREDPAT

SEQ ID NO: 1120071 - protein, 41 aa, Mycobacterium
IGAWALACSIPVVLAGALVIRLARTWSLAVSMVVLVLIPVI

SEQ ID NO: 1120072 - protein, 35 aa, Mycobacterium
IGEIQIRGPHVMRGVCRRSREEVFTADGFYPTGDL

SEQ ID NO: 1120073 - protein, 25 aa, Mycobacterium
IGFREAAVWSAIWIAAGLGFGAIVW

SEQ ID NO: 1120074 - protein, 24 aa, Mycobacterium
IGGGFWLIAVAWRHLHAAAQADRL

SEQ ID NO: 1120075 - protein, 19 aa, Mycobacterium
IGGLRAHGYQVAMLTGDNE

SEQ ID NO: 1120076 - protein, 23 aa, Mycobacterium
IGGMTCASCAARIEKKLNKIDGV

SEQ ID NO: 1120077 - protein, 28 aa, Mycobacterium
IGGTLAPMPMVWAVREILHSANLSAAFF

SEQ ID NO: 1120078 - protein, 17 aa, Mycobacterium
IGGVVTIVMGLVFMGFF

SEQ ID NO: 1120079 - protein, 27 aa, Mycobacterium
IGHAGMPGMRMAFSLLPDAGSETEHIY

SEQ ID NO: 1120080 - protein, 18 aa, Mycobacterium
IGIALGWRPEVVGLALGG

SEQ ID NO: 1120081 - protein, 24 aa, Mycobacterium
IGLFNIVCATLFLGIPLLYRLGEL

SEQ ID NO: 1120082 - protein, 28 aa, Mycobacterium
IGLVRYMLRIGVFHWFRHGVLGALGSLV

SEQ ID NO: 1120083 - protein, 20 aa, Mycobacterium
IGPAPTLDDPCCGPQRSTPP

SEQ ID NO: 1120084 - protein, 24 aa, Mycobacterium
IGQLRITRWFARRWGSGRSLVIGM

SEQ ID NO: 1120085 - protein, 18 aa, Mycobacterium
IGRSRPRSLAGQAIALQI

SEQ ID NO: 1120086 - protein, 18 aa, Mycobacterium
IHTGTAPQVETARRRGEA

SEQ ID NO: 1120087 - protein, 17 aa, Mycobacterium
IIASLVLAISHGPRVGL

SEQ ID NO: 1120088 - protein, 19 aa, Mycobacterium
IISCVKAALFGLIAGLVAC

SEQ ID NO: 1120089 - protein, 22 aa, Mycobacterium
IKIPRMRAGLRSMPLRAVLRTD

SEQ ID NO: 1120090 - protein, 24 aa, Mycobacterium
ILAFAGAWIPWFGVHLAGGSLDDP

SEQ ID NO: 1120091 - protein, 22 aa, Mycobacterium
ILAGPLVGLALMLLDFRTTAAA

SEQ ID NO: 1120092 - protein, 17 aa, Mycobacterium
ILECSTGDFGVQAGLYG

SEQ ID NO: 1120093 - protein, 24 aa, Mycobacterium
ILHLLIAYIIFRIAIGSGHGDADQ

SEQ ID NO: 1120094 - protein, 20 aa, Mycobacterium
ILLRTARAVGIHMALGIQRP

SEQ ID NO: 1120095 - protein, 19 aa, Mycobacterium
ILPAIALVLALRREVWTRL

SEQ ID NO: 1120096 - protein, 25 aa, Mycobacterium
ILTQPEFKKAANLFVSKDGHTARYL

SEQ ID NO: 1120097 - protein, 18 aa, Mycobacterium
ILTSAFMRNALLGGTIVA

SEQ ID NO: 1120098 - protein, 20 aa, Mycobacterium
ILVTSILVLLAFPLLTAALF

SEQ ID NO: 1120099 - protein, 24 aa, Mycobacterium
IMATARPKVFITVAEFGRMTFQPD

SEQ ID NO: 1120100 - protein, 25 aa, Mycobacterium
INEPAPIEVVRDGRPVTLTVTPTPD

SEQ ID NO: 1120101 - protein, 18 aa, Mycobacterium
INILEPTTSLLLKYDPIY

SEQ ID NO: 1120102 - protein, 25 aa, Mycobacterium
INPDSLRKTFGWFVLVMSSVILAQE

SEQ ID NO: 1120103 - protein, 20 aa, Mycobacterium
IPALQFTNWQWLALTLASPV

SEQ ID NO: 1120104 - protein, 18 aa, Mycobacterium
IPGALFVAAATVWLTVWL

SEQ ID NO: 1120105 - protein, 19 aa, Mycobacterium
IPGLRWGLRAASLLVAVGI

SEQ ID NO: 1120106 - protein, 26 aa, Mycobacterium
IPLIPYLLGYESLWVGLLFGGVGLLI

SEQ ID NO: 1120107 - protein, 30 aa, Mycobacterium
IPLYCVAVLSAFWAARFGTIAIYGQSSGVY

SEQ ID NO: 1120108 - protein, 25 aa, Mycobacterium
IPTPHLWPRSWPFLLQVLAAILVAD

SEQ ID NO: 1120109 - protein, 24 aa, Mycobacterium
IPTYLFMAGMFVMLGWGLFQIYML

SEQ ID NO: 1120110 - protein, 26 aa, Mycobacterium
IPVGRWLDRVGPRWIMTAGSALGCVS

SEQ ID NO: 1120111 - protein, 24 aa, Mycobacterium
IPVVAFSTMFAMLLGYDVPDFPGA

SEQ ID NO: 1120112 - protein, 26 aa, Mycobacterium
IPWWTRGDLNAFFGLGFNILVNVLTL

SEQ ID NO: 1120113 - protein, 17 aa, Mycobacterium
IQAGLRKAVDFDTVVGF

SEQ ID NO: 1120114 - protein, 19 aa, Mycobacterium
IQVVIAWFGYRVIAAFERW

SEQ ID NO: 1120115 - protein, 28 aa, Mycobacterium
IRAWSPAVLLRWCGRHRLITTLAAAGLM

SEQ ID NO: 1120116 - protein, 20 aa, Mycobacterium
IRGGFWRSGPLIRGLTALGR

SEQ ID NO: 1120117 - protein, 17 aa, Mycobacterium
IRIAFGVLMMVWTVSLY

SEQ ID NO: 1120118 - protein, 17 aa, Mycobacterium
IRPGERAATDGIIRSGQ

SEQ ID NO: 1120119 - protein, 29 aa, Mycobacterium
IRPSDVMVRIWLCAAILVPAVRLMRSVTQ

SEQ ID NO: 1120120 - protein, 17 aa, Mycobacterium
IRRDVRGLADLGEVYAN

SEQ ID NO: 1120121 - protein, 18 aa, Mycobacterium
IRTPLAVLEAYFEAIEDG

SEQ ID NO: 1120122 - protein, 22 aa, Mycobacterium
ISALHRPVPLSGDGSDTDTVID

SEQ ID NO: 1120123 - protein, 21 aa, Mycobacterium
ISTKMSGEWSKDQVLQSYLNI

SEQ ID NO: 1120124 - protein, 25 aa, Mycobacterium
ITLLPSLIVLAGRRGWVNPRKDLTG

SEQ ID NO: 1120125 - protein, 22 aa, Mycobacterium
ITLPLLLWAGRPAALATALAFA

SEQ ID NO: 1120126 - protein, 23 aa, Mycobacterium
IVAGCLLRTAGFGLLIFAESLPA

SEQ ID NO: 1120127 - protein, 18 aa, Mycobacterium
IVAIIPLFFLLRHAGLTN

SEQ ID NO: 1120128 - protein, 18 aa, Mycobacterium
IVALAAIALVVSAVLLIL

SEQ ID NO: 1120129 - protein, 17 aa, Mycobacterium
IVFLLVGFQALRSDDSS

SEQ ID NO: 1120130 - protein, 23 aa, Mycobacterium
IVGGIDWDGHGLLGLEDSLDAVL

SEQ ID NO: 1120131 - protein, 25 aa, Mycobacterium
IVLANPRWFAVLLVIPVVASVFIMR

SEQ ID NO: 1120132 - protein, 19 aa, Mycobacterium
IVMGLVFMGFFPALQRDAR

SEQ ID NO: 1120133 - protein, 17 aa, Mycobacterium
IVMPCVGGAAVVVASAD

SEQ ID NO: 1120134 - protein, 18 aa, Mycobacterium
IVPAMLWLVGLVSLIRNR

SEQ ID NO: 1120135 - protein, 33 aa, Mycobacterium
IVRSFVVPCLLRIMGPWFWWPTLVRTRPLRQVS

SEQ ID NO: 1120136 - protein, 17 aa, Mycobacterium
IVTGAIGIVCYAWPFYA

SEQ ID NO: 1120137 - protein, 27 aa, Mycobacterium
IVVALAALVLVAALVWAARNKRNQSRH

SEQ ID NO: 1120138 - protein, 17 aa, Mycobacterium
IVYFLIFWVSAFHRKKA

SEQ ID NO: 1120139 - protein, 22 aa, Mycobacterium
IYSLGCTLFRLLTGRQPFSQAD

SEQ ID NO: 1120140 - protein, 24 aa, Mycobacterium
KAGDVLDALFTRGGINGITKAVLA

SEQ ID NO: 1120141 - protein, 19 aa, Mycobacterium
KAGESVRIAGIRVGTVKSV

SEQ ID NO: 1120142 - protein, 23 aa, Mycobacterium
KEAAESWRWIVLGAVAVVAIFGY

SEQ ID NO: 1120143 - protein, 19 aa, Mycobacterium
KELVISTKMSGEWSKDQVL

SEQ ID NO: 1120144 - protein, 26 aa, Mycobacterium
KGAGQRLADRIARPLVPAIMGLAALI

SEQ ID NO: 1120145 - protein, 18 aa, Mycobacterium
KGLIHTWYLVGRRNDTAV

SEQ ID NO: 1120146 - protein, 26 aa, Mycobacterium
KHQVSGWRFLIRRISNGVALRDTRML

SEQ ID NO: 1120147 - protein, 19 aa, Mycobacterium
KHWRAERVAYRIIGADPAA

SEQ ID NO: 1120148 - protein, 19 aa, Mycobacterium
KIPIRLPALPDGWRSNSGG

SEQ ID NO: 1120149 - protein, 23 aa, Mycobacterium
KITSARFFARTALPGISAIRAAV

SEQ ID NO: 1120150 - protein, 26 aa, Mycobacterium
KLDRLRARYGWFDHVMRAQERYKESK

SEQ ID NO: 1120151 - protein, 20 aa, Mycobacterium
KLKEEVIRHNKLRPGLAKYV

SEQ ID NO: 1120152 - protein, 34 aa, Mycobacterium
KMLGDDCWWAPRWMKRLQERLGLGEVELPDERKR

SEQ ID NO: 1120153 - protein, 20 aa, Mycobacterium
KRALADITFDFQQRVDAAAR

SEQ ID NO: 1120154 - protein, 26 aa, Mycobacterium
KRIVQPFGEYLPWRGFFSKLSPYAER

SEQ ID NO: 1120155 - protein, 20 aa, Mycobacterium
KRRLLVRPGITGLWQVSGRS

SEQ ID NO: 1120156 - protein, 19 aa, Mycobacterium
KRRLVEIADEVAARLNNKP

SEQ ID NO: 1120157 - protein, 17 aa, Mycobacterium
KRVACDDSLISVSGVSN

SEQ ID NO: 1120158 - protein, 32 aa, Mycobacterium
KRVWPRYMPGGRVRTSTLGLIVAFIALFWLYQ

SEQ ID NO: 1120159 - protein, 23 aa, Mycobacterium
KRVYRTRLWLRSERNISVIENGS

SEQ ID NO: 1120160 - protein, 38 aa, Mycobacterium
KSRKFSVWGVLAWLVGLGFFFPVFWMILTSFKQEGDAA

SEQ ID NO: 1120161 - protein, 18 aa, Mycobacterium
KTLPKARSGWALDSGGFS

SEQ ID NO: 1120162 - protein, 24 aa, Mycobacterium
KTVLDCAMAYAAMVIFTAAFGAYN

SEQ ID NO: 1120163 - protein, 27 aa, Mycobacterium
KVALGLAIGGSASWTGGLWTFALAAVG

SEQ ID NO: 1120164 - protein, 27 aa, Mycobacterium
KVGGVKFELGLPPGRGFALAINDDNGG

SEQ ID NO: 1120165 - protein, 27 aa, Mycobacterium
KVKRRGHVWVRLWTLFGSMFVIVAASF

SEQ ID NO: 1120166 - protein, 21 aa, Mycobacterium
KVRGPKLLWRTLSVVQPVGPL

SEQ ID NO: 1120167 - protein, 19 aa, Mycobacterium
KVSGVLFCGLQADRPVVAW

SEQ ID NO: 1120168 - protein, 32 aa, Mycobacterium
KWPERLARLSFWSLNIGLAWMVFATLLPLGVL

SEQ ID NO: 1120169 - protein, 22 aa, Mycobacterium
LAAAGALLRWAAPATAHLPGRL

SEQ ID NO: 1120170 - protein, 22 aa, Mycobacterium
LAAAGLQKLFGWFGGPGLTDTG

SEQ ID NO: 1120171 - protein, 19 aa, Mycobacterium
LAAIALVVSAVLLILGGLG

SEQ ID NO: 1120172 - protein, 17 aa, Mycobacterium
LAALVLLLLTAISTVLP

SEQ ID NO: 1120173 - protein, 19 aa, Mycobacterium
LAANIVGGIDWDGHGLLGL

SEQ ID NO: 1120174 - protein, 32 aa, Mycobacterium
LAAVVVSSIGMWLIRRRLMRQTHGLRPDELRV

SEQ ID NO: 1120175 - protein, 18 aa, Mycobacterium
LADRFLRSPTQMINFGVV

SEQ ID NO: 1120176 - protein, 17 aa, Mycobacterium
LAEARRGPQVGIAGAPA

SEQ ID NO: 1120177 - protein, 26 aa, Mycobacterium
LAENYLRLNALGAYGSFFNIFYCSTR

SEQ ID NO: 1120178 - protein, 26 aa, Mycobacterium
LAENYLRLNALGAYGSFFNIFYCSVR

SEQ ID NO: 1120179 - protein, 23 aa, Mycobacterium
LAFSKPFFDQGLLNRRAVLKSTY

SEQ ID NO: 1120180 - protein, 17 aa, Mycobacterium
LAFWIVIVGAEWALPGT

SEQ ID NO: 1120181 - protein, 22 aa, Mycobacterium
LAGGVALLGVWFYRAGSGHSGI

SEQ ID NO: 1120182 - protein, 18 aa, Mycobacterium
LAIGPGWLGTLALIEVVN

SEQ ID NO: 1120183 - protein, 37 aa, Mycobacterium
LALALAIRCTAAWWLGRPGWRRDFDRAVAMAAEADPI

SEQ ID NO: 1120184 - protein, 24 aa, Mycobacterium
LALLRGRIAAGWVSSVGLWLLCAG

SEQ ID NO: 1120185 - protein, 20 aa, Mycobacterium
LANAGDPPRFVWPVRGEQPP

SEQ ID NO: 1120186 - protein, 22 aa, Mycobacterium
LASRLVGWTSGWLMLTASIVTI

SEQ ID NO: 1120187 - protein, 21 aa, Mycobacterium
LATSIPPTWAAASRPPIRSLT

SEQ ID NO: 1120188 - protein, 18 aa, Mycobacterium
LAVLPREKIDALLTETAD

SEQ ID NO: 1120189 - protein, 21 aa, Mycobacterium
LAVSAVLAWLTMRYIEEPLRY

SEQ ID NO: 1120190 - protein, 29 aa, Mycobacterium
LAVVGSVAAAVLCLGGFGSVVYGAGPGDP

SEQ ID NO: 1120191 - protein, 18 aa, Mycobacterium
LAVVLAGVWVVRRRPAAR

SEQ ID NO: 1120192 - protein, 20 aa, Mycobacterium
LAYRTRPVFVPTAGPNDPIA

SEQ ID NO: 1120193 - protein, 25 aa, Mycobacterium
LCDIAELTAAYALWSQRHRAFVLTY

SEQ ID NO: 1120194 - protein, 20 aa, Mycobacterium
LCDVWDPGKVLGLIETEGLS

SEQ ID NO: 1120195 - protein, 20 aa, Mycobacterium
LDALLPVPAIVPILLYIGLL

SEQ ID NO: 1120196 - protein, 24 aa, Mycobacterium
LDDHLRLRTEIVSARWDADSRNWE

SEQ ID NO: 1120197 - protein, 17 aa, Mycobacterium
LDDPCCGPQRSTPPSAT

SEQ ID NO: 1120198 - protein, 23 aa, Mycobacterium
LDELPWDPPTVFLMRRGSEDSYT

SEQ ID NO: 1120199 - protein, 19 aa, Mycobacterium
LDGSLVRLGRPGWIQPGPL

SEQ ID NO: 1120200 - protein, 29 aa, Mycobacterium
LDPELLEQGAAVWRRWAYALGALGNAGTN

SEQ ID NO: 1120201 - protein, 21 aa, Mycobacterium
LDRVAKALIRLPGIAMVQSVT

SEQ ID NO: 1120202 - protein, 17 aa, Mycobacterium
LDVKAELVCPAVQLRVQ

SEQ ID NO: 1120203 - protein, 26 aa, Mycobacterium
LDVSSARFWKTFAHHYLRMIYDILAT

SEQ ID NO: 1120204 - protein, 19 aa, Mycobacterium
LEAPLKFRAPGVTLQLGLG

SEQ ID NO: 1120205 - protein, 17 aa, Mycobacterium
LEEYSLARTRRGLRALL

SEQ ID NO: 1120206 - protein, 21 aa, Mycobacterium
LEMTHFTGVGALIMFLAALSM

SEQ ID NO: 1120207 - protein, 22 aa, Mycobacterium
LETARPADLLVLLDSLQQREAA

SEQ ID NO: 1120208 - protein, 19 aa, Mycobacterium
LETEFALALIDLRKRGHTV

SEQ ID NO: 1120209 - protein, 27 aa, Mycobacterium
LFAQFGSWRWAFGVLVGLTVAMGVLVP

SEQ ID NO: 1120210 - protein, 21 aa, Mycobacterium
LFDRLPLMVTILIVTTTILMF

SEQ ID NO: 1120211 - protein, 17 aa, Mycobacterium
LFHAAGVLMARRGAGDP

SEQ ID NO: 1120212 - protein, 29 aa, Mycobacterium
LGAALARRVEWRVLPAYWLTQVIAGVAAG

SEQ ID NO: 1120213 - protein, 20 aa, Mycobacterium
LGAALRYAAIDKDIVVIAAA

SEQ ID NO: 1120214 - protein, 17 aa, Mycobacterium
LGAARAWADPGTGSASD

SEQ ID NO: 1120215 - protein, 17 aa, Mycobacterium
LGAGCLMGSRLGPVVVR

SEQ ID NO: 1120216 - protein, 22 aa, Mycobacterium
LGALALGRLSVRSVRDVEYAQR

SEQ ID NO: 1120217 - protein, 23 aa, Mycobacterium
LGDRIGRQRVLAVVILLMSAATL

SEQ ID NO: 1120218 - protein, 28 aa, Mycobacterium
LGDRRWEARGGERGVIYDIALWAVPFGL

SEQ ID NO: 1120219 - protein, 18 aa, Mycobacterium
LGFTLPREAVQPALDAFT

SEQ ID NO: 1120220 - protein, 23 aa, Mycobacterium
LGIGDIVAIDFMQRVFAAKSPET

SEQ ID NO: 1120221 - protein, 18 aa, Mycobacterium
LGLAAAFVVGALPALAFP

SEQ ID NO: 1120222 - protein, 18 aa, Mycobacterium
LGLALRLATVVVCVVAAI

SEQ ID NO: 1120223 - protein, 27 aa, Mycobacterium
LGLCDVVLCALPARYLTPTSDKKPAPL

SEQ ID NO: 1120224 - protein, 18 aa, Mycobacterium
LGLRANLAQFSLLVAVNA

SEQ ID NO: 1120225 - protein, 19 aa, Mycobacterium
LGLVAATLVLVAFGLLASG

SEQ ID NO: 1120226 - protein, 18 aa, Mycobacterium
LGMGLTFLVSLTVLGLVY

SEQ ID NO: 1120227 - protein, 17 aa, Mycobacterium
LGNRHWVRNIAIGLALS

SEQ ID NO: 1120228 - protein, 20 aa, Mycobacterium
LGQRQRLGLARVFGSDAAVL

SEQ ID NO: 1120229 - protein, 25 aa, Mycobacterium
LGREHWRSGAGYALAAVAVVVSVIA

SEQ ID NO: 1120230 - protein, 27 aa, Mycobacterium
LGSALALAAVAAWLITRAWQMPPVLDL

SEQ ID NO: 1120231 - protein, 19 aa, Mycobacterium
LGVSAWRSANRPEMIAVPV

SEQ ID NO: 1120232 - protein, 20 aa, Mycobacterium
LGVSLAWCVGLLLVFGTMAV

SEQ ID NO: 1120233 - protein, 25 aa, Mycobacterium
LGYDVPDFPGARWIAPLLGTVMYVV

SEQ ID NO: 1120234 - protein, 17 aa, Mycobacterium
LHMLGIVMPCVGGAAVV

SEQ ID NO: 1120235 - protein, 25 aa, Mycobacterium
LHTPAPRQARRGLVHALTVPGALSA

SEQ ID NO: 1120236 - protein, 19 aa, Mycobacterium
LHVLVVWAAIYLTWGRGMR

SEQ ID NO: 1120237 - protein, 18 aa, Mycobacterium
LIAARFALRGEVAPASTA

SEQ ID NO: 1120238 - protein, 22 aa, Mycobacterium
LIALSLVASGAMVFAILVLLGR

SEQ ID NO: 1120239 - protein, 23 aa, Mycobacterium
LIAQCLLLALAIYWDHQAQPVFT

SEQ ID NO: 1120240 - protein, 26 aa, Mycobacterium
LIDPGAAPLLWSILVGLGLSVFSLAL

SEQ ID NO: 1120241 - protein, 18 aa, Mycobacterium
LIGIFAFFFKNFLSSQFG

SEQ ID NO: 1120242 - protein, 26 aa, Mycobacterium
LILVDFKGGATFLGLERTAHVSAVIT

SEQ ID NO: 1120243 - protein, 27 aa, Mycobacterium
LINEYPGDPWKWWAVLSSAVGVAVAIA

SEQ ID NO: 1120244 - protein, 18 aa, Mycobacterium
LIRPALAYIGLIGVVASL

SEQ ID NO: 1120245 - protein, 18 aa, Mycobacterium
LIVWSALSLIALLGGTGI

SEQ ID NO: 1120246 - protein, 22 aa, Mycobacterium
LKAFAYWLDRYELLSHTRGGKP

SEQ ID NO: 1120247 - protein, 17 aa, Mycobacterium
LKARAEAGDHAAARALT

SEQ ID NO: 1120248 - protein, 21 aa, Mycobacterium
LKKAQWGPVGASWEHILYFEA

SEQ ID NO: 1120249 - protein, 17 aa, Mycobacterium
LKSMVFGLFARHSPDAV

SEQ ID NO: 1120250 - protein, 17 aa, Mycobacterium
LKYIVKVDWPFLWLVAP

SEQ ID NO: 1120251 - protein, 18 aa, Mycobacterium
LLAGVALRGRIPGAEPAA

SEQ ID NO: 1120252 - protein, 25 aa, Mycobacterium
LLAIPFLWVCLRIPKTLRGMGIEVD

SEQ ID NO: 1120253 - protein, 18 aa, Mycobacterium
LLALFGVAVGFPLCYAAY

SEQ ID NO: 1120254 - protein, 17 aa, Mycobacterium
LLDSFVLGTERYRYPQN

SEQ ID NO: 1120255 - protein, 26 aa, Mycobacterium
LLEYDAPVARFWPEFGANGKERITVR

SEQ ID NO: 1120256 - protein, 19 aa, Mycobacterium
LLGECGLALALDRDKLSDL

SEQ ID NO: 1120257 - protein, 21 aa, Mycobacterium
LLGTVFVHWLIFQSLYRIGAL

SEQ ID NO: 1120258 - protein, 20 aa, Mycobacterium
LLHDLAWKATLPDHRAAIAE

SEQ ID NO: 1120259 - protein, 17 aa, Mycobacterium
LLHGGRNIFGFITKVFP

SEQ ID NO: 1120260 - protein, 17 aa, Mycobacterium
LLIVFSFVAGASADLSK

SEQ ID NO: 1120261 - protein, 17 aa, Mycobacterium
LLLPVSVIPVVLPDGSR

SEQ ID NO: 1120262 - protein, 18 aa, Mycobacterium
LLQGRLPLHLNDPATEMT

SEQ ID NO: 1120263 - protein, 21 aa, Mycobacterium
LLRAAGMRRARVVDAVVVASN

SEQ ID NO: 1120264 - protein, 26 aa, Mycobacterium
LLRSRCYAAGACRWALTLSGSCSLTA

SEQ ID NO: 1120265 - protein, 23 aa, Mycobacterium
LLSLLRLVATVAYYLVVSSVQVA

SEQ ID NO: 1120266 - protein, 20 aa, Mycobacterium
LLTHRPDFHGALSRVPGAQT

SEQ ID NO: 1120267 - protein, 18 aa, Mycobacterium
LLTSAVVALRLGRCLAGL

SEQ ID NO: 1120268 - protein, 26 aa, Mycobacterium
LLVAGSWWLFEWELAHGAEVTEARTA

SEQ ID NO: 1120269 - protein, 17 aa, Mycobacterium
LLVDAYRAAQVQVQVSD

SEQ ID NO: 1120270 - protein, 18 aa, Mycobacterium
LLVFAVLIWADRRFNLGH

SEQ ID NO: 1120271 - protein, 19 aa, Mycobacterium
LLVVAGYCVTRACEPDARR

SEQ ID NO: 1120272 - protein, 17 aa, Mycobacterium
LLYREVLSVLDRQRDED

SEQ ID NO: 1120273 - protein, 23 aa, Mycobacterium
LMACLRAGVIALVLLAILALIVL

SEQ ID NO: 1120274 - protein, 22 aa, Mycobacterium
LMQGENTVAFLIGLFSSAIILG

SEQ ID NO: 1120275 - protein, 18 aa, Mycobacterium
LMRTFSFDRTRRFDSHQL

SEQ ID NO: 1120276 - protein, 19 aa, Mycobacterium
LMRTFSYDPARRFDSTQLG

SEQ ID NO: 1120277 - protein, 17 aa, Mycobacterium
LNCAITDAAGAALVTQN

SEQ ID NO: 1120278 - protein, 19 aa, Mycobacterium
LNSAFGWSWADSVAALVIA

SEQ ID NO: 1120279 - protein, 25 aa, Mycobacterium
LNSAPEMLPRGWGEVGQLFPQGATA

SEQ ID NO: 1120280 - protein, 19 aa, Mycobacterium
LNSNETFVYLARAVDPVIS

SEQ ID NO: 1120281 - protein, 18 aa, Mycobacterium
LNYFSWQSIFYMFAGGAL

SEQ ID NO: 1120282 - protein, 20 aa, Mycobacterium
LPGAEITWDGLRLKAEGGPD

SEQ ID NO: 1120283 - protein, 22 aa, Mycobacterium
LPGVALSALLGFDVLVGGFVAA

SEQ ID NO: 1120284 - protein, 26 aa, Mycobacterium
LPHARPDRPSGVPVELATQTLVAEDR

SEQ ID NO: 1120285 - protein, 18 aa, Mycobacterium
LPILGFGSLFGRVGLACG

SEQ ID NO: 1120286 - protein, 20 aa, Mycobacterium
LPLREILPAVQRMARPHDDG

SEQ ID NO: 1120287 - protein, 23 aa, Mycobacterium
LPMVVGCVRVRASITVSPDDRVS

SEQ ID NO: 1120288 - protein, 19 aa, Mycobacterium
LPTALRFGLVDLRRNGVLL

SEQ ID NO: 1120289 - protein, 19 aa, Mycobacterium
LPTSVSLWLPYLPLLVGGT

SEQ ID NO: 1120290 - protein, 29 aa, Mycobacterium
LPVAVLAMACGVGFLKWQANSIGTSQATA

SEQ ID NO: 1120291 - protein, 28 aa, Mycobacterium
LPVVFYSAWIFFDGAWRALRARTLDMMV

SEQ ID NO: 1120292 - protein, 18 aa, Mycobacterium
LQELERLGVQPLRNEHTP

SEQ ID NO: 1120293 - protein, 24 aa, Mycobacterium
LQGMRAVAVLVVFADHLFGWPSGG

SEQ ID NO: 1120294 - protein, 24 aa, Mycobacterium
LQIYVVMGAGWVWHRGLQGEPVPA

SEQ ID NO: 1120295 - protein, 24 aa, Mycobacterium
LQIYVVMGASWVWYRGLQGEPVPV

SEQ ID NO: 1120296 - protein, 24 aa, Mycobacterium
LQTLRWIVVPSLVPWLITGLRLSI

SEQ ID NO: 1120297 - protein, 18 aa, Mycobacterium
LRAAADAIRLARSTLRTI

SEQ ID NO: 1120298 - protein, 19 aa, Mycobacterium
LRADMRRSFVATAAVALLF

SEQ ID NO: 1120299 - protein, 20 aa, Mycobacterium
LRALSPPRGVSVWVGGTPAL

SEQ ID NO: 1120300 - protein, 19 aa, Mycobacterium
LRAPLKVAGEYSPEYGCML

SEQ ID NO: 1120301 - protein, 17 aa, Mycobacterium
LRAVRWGAFGLAVVGGA

SEQ ID NO: 1120302 - protein, 22 aa, Mycobacterium
LRGADVVIHLALAVHPVRDEHY

SEQ ID NO: 1120303 - protein, 17 aa, Mycobacterium
LRIALSGHPAMAVVDLF

SEQ ID NO: 1120304 - protein, 20 aa, Mycobacterium
LRIGSPMFHFGILVVIVGHI

SEQ ID NO: 1120305 - protein, 20 aa, Mycobacterium
LRIIDPLLIELGRRHPDVGI

SEQ ID NO: 1120306 - protein, 19 aa, Mycobacterium
LRMRIWDSAIPALWFLAAP

SEQ ID NO: 1120307 - protein, 29 aa, Mycobacterium
LRPEAAEAVTLLKGLGMTVAMLTGDNIRT

SEQ ID NO: 1120308 - protein, 23 aa, Mycobacterium
LRQLFTVRIGLRLTEATQTTMVL

SEQ ID NO: 1120309 - protein, 17 aa, Mycobacterium
LRQVPVLIGSVVLGSAT

SEQ ID NO: 1120310 - protein, 22 aa, Mycobacterium
LRREALMRLGIRGYVRAVEEGV

SEQ ID NO: 1120311 - protein, 24 aa, Mycobacterium
LRRFTHLHYGLAILLAFAGVKLIL

SEQ ID NO: 1120312 - protein, 18 aa, Mycobacterium
LRRLPPYATTLGEVVGSG

SEQ ID NO: 1120313 - protein, 21 aa, Mycobacterium
LRSEMFKRMSMISNPAVVLTG

SEQ ID NO: 1120314 - protein, 29 aa, Mycobacterium
LRSVKTVWLRPGTRLGFFTHMGTQFSVTV

SEQ ID NO: 1120315 - protein, 17 aa, Mycobacterium
LRTAMITVAGTEPSTVS

SEQ ID NO: 1120316 - protein, 18 aa, Mycobacterium
LRTLPMVAGLLITSTGSG

SEQ ID NO: 1120317 - protein, 20 aa, Mycobacterium
LSAQLSWRSTYLVLAVVMAV

SEQ ID NO: 1120318 - protein, 24 aa, Mycobacterium
LSGEGFAQAVARKMAMDEPAELNV

SEQ ID NO: 1120319 - protein, 18 aa, Mycobacterium
LSGYWTAAFAMAGPNTRI

SEQ ID NO: 1120320 - protein, 17 aa, Mycobacterium
LSIGGLVGALGYAALSR

SEQ ID NO: 1120321 - protein, 22 aa, Mycobacterium
LSILACGIAWLVIQHAGRGERL

SEQ ID NO: 1120322 - protein, 20 aa, Mycobacterium
LSILRPAGLAGNRPVLADRS

SEQ ID NO: 1120323 - protein, 25 aa, Mycobacterium
LSIPIMLWSPMGRDMFGFTVPAPFG

SEQ ID NO: 1120324 - protein, 24 aa, Mycobacterium
LSKDRRKQAAIGFESDNSGIAEAF

SEQ ID NO: 1120325 - protein, 20 aa, Mycobacterium
LSLASFYAFYSGLGIPLPVG

SEQ ID NO: 1120326 - protein, 38 aa, Mycobacterium
LSLLGWCSFMLLWVLQACVFWRGMESIRKFIDFCGPAV

SEQ ID NO: 1120327 - protein, 19 aa, Mycobacterium
LSPDHWIALTPPRIAELRS

SEQ ID NO: 1120328 - protein, 31 aa, Mycobacterium
LSSFFGLDLARWLPYNLARTWHVQLSLFWTA

SEQ ID NO: 1120329 - protein, 17 aa, Mycobacterium
LSSVVGRYARTTAALIL

SEQ ID NO: 1120330 - protein, 18 aa, Mycobacterium
LTALPVLLIVVDEFSELL

SEQ ID NO: 1120331 - protein, 19 aa, Mycobacterium
LTKRFPMMGMIDMSNALCR

SEQ ID NO: 1120332 - protein, 22 aa, Mycobacterium
LTMIRLVMYIAPIGVFCLLAAL

SEQ ID NO: 1120333 - protein, 21 aa, Mycobacterium
LTSVHINWTLALAVTAAAVIG

SEQ ID NO: 1120334 - protein, 27 aa, Mycobacterium
LTTLPGLCFAAAGLTAPWLSRRFGLSR

SEQ ID NO: 1120335 - protein, 19 aa, Mycobacterium
LTVFTMRIAAAIGFLQMKR

SEQ ID NO: 1120336 - protein, 19 aa, Mycobacterium
LVAPIHGWVYFAYLLFTAN

SEQ ID NO: 1120337 - protein, 20 aa, Mycobacterium
LVASLIGFVCCLGSVAGIAL

SEQ ID NO: 1120338 - protein, 25 aa, Mycobacterium
LVEAFLPRRSRYAAQLTLALGATVA

SEQ ID NO: 1120339 - protein, 17 aa, Mycobacterium
LVFAALMVIVRLLQGAM

SEQ ID NO: 1120340 - protein, 26 aa, Mycobacterium
LVGVCVGALLGGLAFAAMGTDTTATA

SEQ ID NO: 1120341 - protein, 22 aa, Mycobacterium
LVGVVLLLFAGFVVDEPFTDTV

SEQ ID NO: 1120342 - protein, 26 aa, Mycobacterium
LVIVTFGLTLARYVPLARRPIVWWLH

SEQ ID NO: 1120343 - protein, 18 aa, Mycobacterium
LVLCFYVVARTGSVEGLA

SEQ ID NO: 1120344 - protein, 17 aa, Mycobacterium
LVLCVVALFAVNVVLTT

SEQ ID NO: 1120345 - protein, 20 aa, Mycobacterium
LVLIACLAMVFAIQNATARQ

SEQ ID NO: 1120346 - protein, 17 aa, Mycobacterium
LVLSSVVGRYARTTAAL

SEQ ID NO: 1120347 - protein, 27 aa, Mycobacterium
LVPSLVSLVWFCILGGAAIDTQQGGVD

SEQ ID NO: 1120348 - protein, 23 aa, Mycobacterium
LVRPTDRFEALVVTLAIVVVLLA

SEQ ID NO: 1120349 - protein, 19 aa, Mycobacterium
LVRYRRRRIRLSKTDTATP

SEQ ID NO: 1120350 - protein, 18 aa, Mycobacterium
LVSLRRTRLFGATGTVLM

SEQ ID NO: 1120351 - protein, 19 aa, Mycobacterium
LVSQFIGRRVHVDIPTSLF

SEQ ID NO: 1120352 - protein, 24 aa, Mycobacterium
LVVAGALLSFWGWFLDHAHIIAAV

SEQ ID NO: 1120353 - protein, 24 aa, Mycobacterium
LVVLTLMRISGWLDVSVDPPAAPS

SEQ ID NO: 1120354 - protein, 23 aa, Mycobacterium
LVVRPRVGELLLNTVALVAVTVP

SEQ ID NO: 1120355 - protein, 27 aa, Mycobacterium
LVVSAAFAERWLAPLSFAGIFVTALVG

SEQ ID NO: 1120356 - protein, 18 aa, Mycobacterium
LVWDHLMRTFSFDRTRRF

SEQ ID NO: 1120357 - protein, 25 aa, Mycobacterium
LVWQHLIGLHLHWLVLPLTFIILVA

SEQ ID NO: 1120358 - protein, 18 aa, Mycobacterium
LWAGRVFVEARWLSVLLL

SEQ ID NO: 1120359 - protein, 28 aa, Mycobacterium
LWFGELGYRSVFTTVLLTRVVVFLVVSL

SEQ ID NO: 1120360 - protein, 17 aa, Mycobacterium
LWIGSMIAALVVGGIVY

SEQ ID NO: 1120361 - protein, 25 aa, Mycobacterium
LWLPAAPALLAWWLVVATITVTVLR

SEQ ID NO: 1120362 - protein, 17 aa, Mycobacterium
LWLQDAIAGMPRFPDDA

SEQ ID NO: 1120363 - protein, 25 aa, Mycobacterium
LWMLFDAALGWRVVALAATGGVTAV

SEQ ID NO: 1120364 - protein, 19 aa, Mycobacterium
LWQVRELQFAVLAAVLLSV

SEQ ID NO: 1120365 - protein, 27 aa, Mycobacterium
LWQVSEIRAAALAGVLLLAGLIVGWAG

SEQ ID NO: 1120366 - protein, 24 aa, Mycobacterium
LYDHPRLGSLAGYLDELAPPPQVV

SEQ ID NO: 1120367 - protein, 18 aa, Mycobacterium
LYERLRRRFGTGLSATLT

SEQ ID NO: 1120368 - protein, 24 aa, Mycobacterium
LYLWHWPLLIFWLAYSGHTQANLA

SEQ ID NO: 1120369 - protein, 24 aa, Mycobacterium
LYLWHWPLLIFWLSYSGRSRVDFW

SEQ ID NO: 1120370 - protein, 22 aa, Mycobacterium
LYLWHWPVIILLLAVIPEGLVF

SEQ ID NO: 1120371 - protein, 29 aa, Mycobacterium
LYSGGLVAFCPWATTVLVTALLDRGTDHD

SEQ ID NO: 1120372 - protein, 17 aa, Mycobacterium
LYVLIRWVSGPYFEPVA

SEQ ID NO: 1120373 - protein, 18 aa, Mycobacterium
LYVTRGAGFWGPPVRIGA

SEQ ID NO: 1120374 - protein, 20 aa, Mycobacterium
MAAMLAGIGILHFVAPKPFD

SEQ ID NO: 1120375 - protein, 18 aa, Mycobacterium
MAESLLIASIPALAGGAA

SEQ ID NO: 1120376 - protein, 26 aa, Mycobacterium
MALIGWASGLGFGWLFTLGTANVVRS

SEQ ID NO: 1120377 - protein, 17 aa, Mycobacterium
MAPNPLALIGFVLLLTS

SEQ ID NO: 1120378 - protein, 29 aa, Mycobacterium
MARFGRRVAAMLVDWFIAYGLAALAMTLG

SEQ ID NO: 1120379 - protein, 17 aa, Mycobacterium
MATAMRRGLALVAASLA

SEQ ID NO: 1120380 - protein, 17 aa, Mycobacterium
MCQAVLASGVLGFLFLV

SEQ ID NO: 1120381 - protein, 20 aa, Mycobacterium
MEVGMILTVFTMRIAAAIGF

SEQ ID NO: 1120382 - protein, 18 aa, Mycobacterium
MFADVRFAGVIFPVVGWW

SEQ ID NO: 1120383 - protein, 18 aa, Mycobacterium
MGGTCAVDLSVMHPELFS

SEQ ID NO: 1120384 - protein, 17 aa, Mycobacterium
MGPAVAISMLFTIAAAL

SEQ ID NO: 1120385 - protein, 23 aa, Mycobacterium
MGPGSWGPGGMMGPGSWGPGMMG

SEQ ID NO: 1120386 - protein, 19 aa, Mycobacterium
MGRLSVRSLRDIRYEHASA

SEQ ID NO: 1120387 - protein, 26 aa, Mycobacterium
MGTPIRARWGRWVARVLSVVGLAGLA

SEQ ID NO: 1120388 - protein, 19 aa, Mycobacterium
MHALLWFSAWATVGRLRRW

SEQ ID NO: 1120389 - protein, 21 aa, Mycobacterium
MHRRVAPGLAVTGFAHEDVTL

SEQ ID NO: 1120390 - protein, 17 aa, Mycobacterium
MIFASAFGLDSAFGAII

SEQ ID NO: 1120391 - protein, 17 aa, Mycobacterium
MIIGVGVYLSAQDKDTP

SEQ ID NO: 1120392 - protein, 20 aa, Mycobacterium
MIISCVKALLFGLIAGLVAC

SEQ ID NO: 1120393 - protein, 43 aa, Mycobacterium
MIPVLQFTYWQWASLTLAAPVIVWAAWPFHRAAWTNLRHGTAT

SEQ ID NO: 1120394 - protein, 20 aa, Mycobacterium
MKQNLWWGAGYNLISVPLAA

SEQ ID NO: 1120395 - protein, 17 aa, Mycobacterium
MLACLVGGTAVAMSRAG

SEQ ID NO: 1120396 - protein, 24 aa, Mycobacterium
MLAFCVAMGALFAIVFAVAYGRVG

SEQ ID NO: 1120397 - protein, 24 aa, Mycobacterium
MLAIPFTVLLIFTFNILLLEFGAA

SEQ ID NO: 1120398 - protein, 25 aa, Mycobacterium
MLALWLVAVGFEWTQPGAGHPHHGP

SEQ ID NO: 1120399 - protein, 17 aa, Mycobacterium
MLASGLVALLLNSLVVI

SEQ ID NO: 1120400 - protein, 25 aa, Mycobacterium
MLFASPLLARFVVWASRRLSRHAGD

SEQ ID NO: 1120401 - protein, 25 aa, Mycobacterium
MLFVLRDWLPFALVLLAYDLSRGAA

SEQ ID NO: 1120402 - protein, 20 aa, Mycobacterium
MLLGIVAFLVIVTFGLTLAR

SEQ ID NO: 1120403 - protein, 26 aa, Mycobacterium
MLPMAVFPMYFLRSFAYAGVAVVGFA

SEQ ID NO: 1120404 - protein, 31 aa, Mycobacterium
MLRRFEWSVADGYRIPLTWGTGPTPADDLPI

SEQ ID NO: 1120405 - protein, 22 aa, Mycobacterium
MNLPIAVWMMRSFFLEVPAELL

SEQ ID NO: 1120406 - protein, 21 aa, Mycobacterium
MPLALGSYWGLVPMLAGVPVL

SEQ ID NO: 1120407 - protein, 19 aa, Mycobacterium
MPLHVFIGVILMMAPRTLT

SEQ ID NO: 1120408 - protein, 21 aa, Mycobacterium
MPQPRVSEHVSWATPELDQVI

SEQ ID NO: 1120409 - protein, 18 aa, Mycobacterium
MPRPDFSRPALPLRTDAQ

SEQ ID NO: 1120410 - protein, 44 aa, Mycobacterium
MPVLLFCIAFGLSMDYEVFLMSRIREFWLKSGRTRQDGTVPAPR

SEQ ID NO: 1120411 - protein, 20 aa, Mycobacterium
MSAAGRGVEVFWSFCESHTS

SEQ ID NO: 1120412 - protein, 20 aa, Mycobacterium
MSGLFAYIAGAAFVLQGDYG

SEQ ID NO: 1120413 - protein, 20 aa, Mycobacterium
MSGLMAAASLAFINTIGLIG

SEQ ID NO: 1120414 - protein, 23 aa, Mycobacterium
MSSRLTYGMAEHGLLPSVLSRVL

SEQ ID NO: 1120415 - protein, 18 aa, Mycobacterium
MSTAFGEQGSKTVLIVAM

SEQ ID NO: 1120416 - protein, 23 aa, Mycobacterium
MSVALCFMELAAKYPVAGSVYNW

SEQ ID NO: 1120417 - protein, 18 aa, Mycobacterium
MTDPYTLSPDRSAEPELG

SEQ ID NO: 1120418 - protein, 17 aa, Mycobacterium
MTPWNTYVRPGLPATPI

SEQ ID NO: 1120419 - protein, 20 aa, Mycobacterium
MVKAAAVARDSPALYIVEDA

SEQ ID NO: 1120420 - protein, 17 aa, Mycobacterium
MVLKYIVKVDWPFLWLV

SEQ ID NO: 1120421 - protein, 20 aa, Mycobacterium
MVMPAVLRSLGFLATPAPPP

SEQ ID NO: 1120422 - protein, 19 aa, Mycobacterium
MVNMGGFLASLLVMQAMGQ

SEQ ID NO: 1120423 - protein, 25 aa, Mycobacterium
MVTGCFVAYLLLCAVVVLRTGSTEG

SEQ ID NO: 1120424 - protein, 17 aa, Mycobacterium
MYIAPIGVFCLLAALAG

SEQ ID NO: 1120425 - protein, 22 aa, Mycobacterium
NALGPICAIILITGAGGMFGGV

SEQ ID NO: 1120426 - protein, 24 aa, Mycobacterium
NAPTLSAAWARFPLPNVPAPGEPT

SEQ ID NO: 1120427 - protein, 24 aa, Mycobacterium
NAQARLAALSILIGAVGATGPGVV

SEQ ID NO: 1120428 - protein, 18 aa, Mycobacterium
NCGFTRAAFDAVGGFDET

SEQ ID NO: 1120429 - protein, 22 aa, Mycobacterium
NCGLAGMLPLAMAPPPPVPGVL

SEQ ID NO: 1120430 - protein, 17 aa, Mycobacterium
NDAYGLVEPPALTPDQV

SEQ ID NO: 1120431 - protein, 19 aa, Mycobacterium
NDDKLAFTIEARALTFQPV

SEQ ID NO: 1120432 - protein, 23 aa, Mycobacterium
NDILRLVLATALLAIVVTSSFIT

SEQ ID NO: 1120433 - protein, 24 aa, Mycobacterium
NGIPRLPVVAALLVEPLVAAVIGA

SEQ ID NO: 1120434 - protein, 18 aa, Mycobacterium
NGNTPAYVLNPFAMANSL

SEQ ID NO: 1120435 - protein, 24 aa, Mycobacterium
NHLELGQPIAIEYVWGRQIGENTI

SEQ ID NO: 1120436 - protein, 20 aa, Mycobacterium
NIFYCSVRIKVNGPAGSDIL

SEQ ID NO: 1120437 - protein, 18 aa, Mycobacterium
NKLRPGLAKYVVREVTEP

SEQ ID NO: 1120438 - protein, 26 aa, Mycobacterium
NLDDALRWIDVFGVALLAGIGFTVSL

SEQ ID NO: 1120439 - protein, 20 aa, Mycobacterium
NLFTLLPIIPFIGGLLGVIA

SEQ ID NO: 1120440 - protein, 28 aa, Mycobacterium
NLPEAWKTSRGRGVAVAVIDSGVTPQPR

SEQ ID NO: 1120441 - protein, 27 aa, Mycobacterium
NLPEEVLRPAYGLAEATLYVATNSPGK

SEQ ID NO: 1120442 - protein, 21 aa, Mycobacterium
NMTGNVIFLGFWFVPHSGVDL

SEQ ID NO: 1120443 - protein, 17 aa, Mycobacterium
NMVRLWWDKPWPMRIAA

SEQ ID NO: 1120444 - protein, 17 aa, Mycobacterium
NNASYSYGYYGYGEEAT

SEQ ID NO: 1120445 - protein, 26 aa, Mycobacterium
NPLAMLNALMAFEYVHGYYLDPNSNG

SEQ ID NO: 1120446 - protein, 31 aa, Mycobacterium
NPQGLWSRLSFLRYIPLLDVSFGPQLPTDIG

SEQ ID NO: 1120447 - protein, 41 aa, Mycobacterium
NPRLPGCAHAKCSNCLKWALRWRRGLVAGGCAEHGEPCDGT

SEQ ID NO: 1120448 - protein, 23 aa, Mycobacterium
NPTQFPIALLLNVTNPLRAEFGN

SEQ ID NO: 1120449 - protein, 19 aa, Mycobacterium
NRCTRRARLADSRRRPPVR

SEQ ID NO: 1120450 - protein, 17 aa, Mycobacterium
NRFSQERVISYAELLMG

SEQ ID NO: 1120451 - protein, 21 aa, Mycobacterium
NRLTQSAAWVGIVAGVVFIVA

SEQ ID NO: 1120452 - protein, 19 aa, Mycobacterium
NRMAWTVTLFFGCQSLLAY

SEQ ID NO: 1120453 - protein, 21 aa, Mycobacterium
NRMTDIYAWADPVLRSLDTSP

SEQ ID NO: 1120454 - protein, 25 aa, Mycobacterium
NRPWYRAFHAYKMAVICLIGAMLFD

SEQ ID NO: 1120455 - protein, 22 aa, Mycobacterium
NRRAVLKSTYAQFFFLMSGADH

SEQ ID NO: 1120456 - protein, 30 aa, Mycobacterium
NSNLSSHFPYAAQIWKSMWAEQTGMNVDGV

SEQ ID NO: 1120457 - protein, 17 aa, Mycobacterium
NVNMWWALLGLAVSALK

SEQ ID NO: 1120458 - protein, 35 aa, Mycobacterium; identical to SEQ ID NO: 321583

SEQ ID NO: 1120459 - protein, 38 aa, Mycobacterium
NYLDRMGQSWSTRTTLRFLWLRLARVWPVYLVTMHLAA

SEQ ID NO: 1120460 - protein, 26 aa, Mycobacterium
PAAALFRRVFLINGLIFTLGTLVLAV

SEQ ID NO: 1120461 - protein, 25 aa, Mycobacterium
PACGCYYSDVYWITFAGMATVDDPR

SEQ ID NO: 1120462 - protein, 25 aa, Mycobacterium
PADEVPRTLALDGLGRYRVIALPAR

SEQ ID NO: 1120463 - protein, 22 aa, Mycobacterium
PAETKIVCLVAFVLAVVAAPRE

SEQ ID NO: 1120464 - protein, 18 aa, Mycobacterium
PAFAMVVGFVLLDQAPGV

SEQ ID NO: 1120465 - protein, 26 aa, Mycobacterium
PAGAHLPPMPYMFVWVDEFSLLLKDH

SEQ ID NO: 1120466 - protein, 19 aa, Mycobacterium
PALAVGLLLLVLVLNVAVP

SEQ ID NO: 1120467 - protein, 27 aa, Mycobacterium
PALLARASWPMRAPRAAVVLWQSIALA

SEQ ID NO: 1120468 - protein, 20 aa, Mycobacterium
PALLQFIYVRAFASVVDASF

SEQ ID NO: 1120469 - protein, 22 aa, Mycobacterium
PAPELPLFVLVVLGLTLGGFAV

SEQ ID NO: 1120470 - protein, 22 aa, Mycobacterium
PAPFLLEQWAELSAAALEDAGL

SEQ ID NO: 1120471 - protein, 28 aa, Mycobacterium
PAQRREVPKHVVWLWAVAIVLMVLAGVL

SEQ ID NO: 1120472 - protein, 20 aa, Mycobacterium
PAVAISMLFTIAAALTLGPA

SEQ ID NO: 1120473 - protein, 23 aa, Mycobacterium
PAVRGATVVGCPDDRLGETPVAM

SEQ ID NO: 1120474 - protein, 21 aa, Mycobacterium
PAVVLFFSVFEYFRSWEFFRT

SEQ ID NO: 1120475 - protein, 32 aa, Mycobacterium
PDAPTARLMMAWTVLGDTVWVAGGMSHGESLQ

SEQ ID NO: 1120476 - protein, 18 aa, Mycobacterium
PDARGRVFGFHRAMDTFG

SEQ ID NO: 1120477 - protein, 25 aa, Mycobacterium
PDFAELFVAIGRVGRSLGMHLLLAS

SEQ ID NO: 1120478 - protein, 21 aa, Mycobacterium
PDKQRGAAYFGSYYSRDKHST

SEQ ID NO: 1120479 - protein, 20 aa, Mycobacterium
PDLLFAVLFVRALGIGVLPG

SEQ ID NO: 1120480 - protein, 23 aa, Mycobacterium
PDLPEYRTGLIIVGLARCIAMVI

SEQ ID NO: 1120481 - protein, 22 aa, Mycobacterium
PDLVPPPGFGGAHRRPSEAEPP

SEQ ID NO: 1120482 - protein, 22 aa, Mycobacterium
PDRRTAVVVPLSIVITALAGFG

SEQ ID NO: 1120483 - protein, 19 aa, Mycobacterium
PDTLWAIAGSARMWEKTVD

SEQ ID NO: 1120484 - protein, 20 aa, Mycobacterium
PDVLPGYGRESARLVTGDGV

SEQ ID NO: 1120485 - protein, 18 aa, Mycobacterium
PDVYLPIWQAFAESGVKV

SEQ ID NO: 1120486 - protein, 17 aa, Mycobacterium
PEDLFKVQRALLAKYHV

SEQ ID NO: 1120487 - protein, 27 aa, Mycobacterium
PEGAAWLRLAWAGLLFLVFLRPRRADF

SEQ ID NO: 1120488 - protein, 17 aa, Mycobacterium
PEGAVVLAAAPQRDTEP

SEQ ID NO: 1120489 - protein, 17 aa, Mycobacterium
PEGMRTLDLVGGGNGVT

SEQ ID NO: 1120490 - protein, 18 aa, Mycobacterium
PEGYDPAQLIAVVEKTGY

SEQ ID NO: 1120491 - protein, 31 aa, Mycobacterium
PELGAQPDMRWRRGAEIAPELSGYWTAAFAM

SEQ ID NO: 1120492 - protein, 23 aa, Mycobacterium
PEPEVKGLGLAAGARRPGAKKAP

SEQ ID NO: 1120493 - protein, 22 aa, Mycobacterium
PEQPPRAWRMRLTVQRVDDGAK

SEQ ID NO: 1120494 - protein, 19 aa, Mycobacterium
PERRAEVNSTYFVVAYVAI

SEQ ID NO: 1120495 - protein, 24 aa, Mycobacterium
PEVRRLIRRLFPALVVVLTACAGL

SEQ ID NO: 1120496 - protein, 17 aa, Mycobacterium
PEYGCMLKGTARAIERF

SEQ ID NO: 1120497 - protein, 20 aa, Mycobacterium
PFGALTFTGLQAMLDPPRAA

SEQ ID NO: 1120498 - protein, 29 aa, Mycobacterium
PFGVDAYGNVVGWDFKQSPHFLIAGATST

SEQ ID NO: 1120499 - protein, 29 aa, Mycobacterium
PGDYRPNLFVTYWAFRAMIGLLLVPVAFA

SEQ ID NO: 1120500 - protein, 23 aa, Mycobacterium
PGNIQSPGPWRRNATPQKVSGVL

SEQ ID NO: 1120501 - protein, 26 aa, Mycobacterium
PGNTESGWKLGFYAASRASQLRRMRA

SEQ ID NO: 1120502 - protein, 20 aa, Mycobacterium
PGPLPGRLPGPLPAEAPMAS

SEQ ID NO: 1120503 - protein, 19 aa, Mycobacterium
PGSATFRALAWSQDDTTSD

SEQ ID NO: 1120504 - protein, 20 aa, Mycobacterium
PGTERRELLRLAGALENASE

SEQ ID NO: 1120505 - protein, 19 aa, Mycobacterium
PGTKVTFNGVEIGRVAEVN

SEQ ID NO: 1120506 - protein, 21 aa, Mycobacterium
PGVHNRGGFPVLPMAFTPDFD

SEQ ID NO: 1120507 - protein, 20 aa, Mycobacterium
PHGPLVFRVAERMSLISDAL

SEQ ID NO: 1120508 - protein, 28 aa, Mycobacterium
PIGLVALILFRWIARRVVASVREKYGRC

SEQ ID NO: 1120509 - protein, 17 aa, Mycobacterium
PIGQGLSMTLLQMAGMY

SEQ ID NO: 1120510 - protein, 24 aa, Mycobacterium
PIGSNPWRGPPVPIGEPIQDPRMI

SEQ ID NO: 1120511 - protein, 19 aa, Mycobacterium
PIIMCGLLSLFLVAFACYF

SEQ ID NO: 1120512 - protein, 19 aa, Mycobacterium
PILPMRLFASPVFTVCCIL

SEQ ID NO: 1120513 - protein, 24 aa, Mycobacterium
PIQAWQAGLAWAFLIGVIVMIGAF

SEQ ID NO: 1120514 - protein, 22 aa, Mycobacterium
PISWAHHWVWVVPLTIWLLHGP

SEQ ID NO: 1120515 - protein, 25 aa, Mycobacterium
PKLTRRSRVLIGVALAAVVLLLIGP

SEQ ID NO: 1120516 - protein, 25 aa, Mycobacterium
PKRGRKRLLWAVAVAVVVATLVGVV

SEQ ID NO: 1120517 - protein, 39 aa, Mycobacterium
PKRPSRWSPANWPVRWKVLAIVLVPLVLAGVFGGARIAA

SEQ ID NO: 1120518 - protein, 26 aa, Mycobacterium
PKTYWSNDVLNAWAMSVVFYGALIAV

SEQ ID NO: 1120519 - protein, 20 aa, Mycobacterium
PKVNFADIWRRSDLPRDGRA

SEQ ID NO: 1120520 - protein, 17 aa, Mycobacterium
PKWFGYLGLCNALTEVV

SEQ ID NO: 1120521 - protein, 27 aa, Mycobacterium
PLIKPAILVALLFRTLDAFRIFDNIYI

SEQ ID NO: 1120522 - protein, 17 aa, Mycobacterium
PLPRVSLLVAVRDEVDG

SEQ ID NO: 1120523 - protein, 19 aa, Mycobacterium
PLRTAFLVTVLVVVLILTL

SEQ ID NO: 1120524 - protein, 24 aa, Mycobacterium
PLTAAMSQLWGWRTAVVVVTAAAA

SEQ ID NO: 1120525 - protein, 17 aa, Mycobacterium
PLVPAVMVAAAIIAVAG

SEQ ID NO: 1120526 - protein, 17 aa, Mycobacterium
PLYAIAVILSFVASQFT

SEQ ID NO: 1120527 - protein, 23 aa, Mycobacterium
PLYSLSVLAAFFAARFTTVYING

SEQ ID NO: 1120528 - protein, 18 aa, Mycobacterium
PMINRGGKVLGVVFGAAV

SEQ ID NO: 1120529 - protein, 17 aa, Mycobacterium
PMMLAPWVLLPVILALR

SEQ ID NO: 1120530 - protein, 20 aa, Mycobacterium
PNPLALIGFVLLLTSIELQV

SEQ ID NO: 1120531 - protein, 28 aa, Mycobacterium
PNSVLRNWPAWLAVYGFMTMDRWLMWRW

SEQ ID NO: 1120532 - protein, 21 aa, Mycobacterium
PPAFRAAGIVIALAAVVAIVA

SEQ ID NO: 1120533 - protein, 20 aa, Mycobacterium
PPDELNLILVDFKGGATFLG

SEQ ID NO: 1120534 - protein, 59 aa, Mycobacterium
PPDGYGGQRRPPGPPPEEPVPWYRTPAAMFAAGVLLTLVLVLLVWAVFGSSSDEADTTP

SEQ ID NO: 1120535 - protein, 22 aa, Mycobacterium
PPEARSVFVIAALAAFAGFAVT

SEQ ID NO: 1120536 - protein, 24 aa, Mycobacterium
PPKRAWWLRHYTFFGTATGLVFVW

SEQ ID NO: 1120537 - protein, 21 aa, Mycobacterium
PPLFREHLNRAGLPHSSNEQF

SEQ ID NO: 1120538 - protein, 17 aa, Mycobacterium
PPPARIVLFSDGKETVP

SEQ ID NO: 1120539 - protein, 22 aa, Mycobacterium
PPPRLPAVLMIGGEFNTPADWV

SEQ ID NO: 1120540 - protein, 20 aa, Mycobacterium
PPPVPGVLLLDSFVLGTERY

SEQ ID NO: 1120541 - protein, 19 aa, Mycobacterium
PPSGDRLPAFVAPRNLGAN

SEQ ID NO: 1120542 - protein, 20 aa, Mycobacterium
PPSVRVRHGGVVGDPTLTPE

SEQ ID NO: 1120543 - protein, 18 aa, Mycobacterium
PQGGVLGRWRHRKATRDR

SEQ ID NO: 1120544 - protein, 20 aa, Mycobacterium
PQRGTLPIFMPLVDLGNATG

SEQ ID NO: 1120545 - protein, 27 aa, Mycobacterium
PQRHNGIRLAVAFSVVAIVGLGGVAGW

SEQ ID NO: 1120546 - protein, 19 aa, Mycobacterium
PQWRVTWVLIGVLTAVCAL

SEQ ID NO: 1120547 - protein, 27 aa, Mycobacterium
PRPLGGGRLMFRAVLHAVDGRPMSGRV

SEQ ID NO: 1120548 - protein, 25 aa, Mycobacterium
PRPRNPRLVTLAALTLLGVTGHFMA

SEQ ID NO: 1120549 - protein, 20 aa, Mycobacterium
PRPSAFTWRTFGMCVVLGCV

SEQ ID NO: 1120550 - protein, 17 aa, Mycobacterium
PRRLLTVVFVVASATTA

SEQ ID NO: 1120551 - protein, 25 aa, Mycobacterium
PRRLRTEVLAGLVVALALIPEAISF

SEQ ID NO: 1120552 - protein, 24 aa, Mycobacterium
PRRREARALLGNLLKPYRMTVFLL

SEQ ID NO: 1120553 - protein, 22 aa, Mycobacterium
PRRYWRVTALLVGFGVVNFPDA

SEQ ID NO: 1120554 - protein, 31 aa, Mycobacterium
PRTTNAWAVAALVCAFLFAPLGIVFGHLSLS

SEQ ID NO: 1120555 - protein, 26 aa, Mycobacterium
PRVLLAAACLLAWALLLLVLTSTWVA

SEQ ID NO: 1120556 - protein, 17 aa, Mycobacterium
PRVVSLIFIPWQALMWV

SEQ ID NO: 1120557 - protein, 17 aa, Mycobacterium
PRWPLLVRLFDRGPLVR

SEQ ID NO: 1120558 - protein, 23 aa, Mycobacterium
PSLLPRGPLFQGLVSGGAGAAGY

SEQ ID NO: 1120559 - protein, 31 aa, Mycobacterium
PSRPPRRPLGGLLRRGRSQVLFGALGALLCV

SEQ ID NO: 1120560 - protein, 18 aa, Mycobacterium
PSSGLAIGFVHNRLLTPM

SEQ ID NO: 1120561 - protein, 26 aa, Mycobacterium
PSVKPSRFLGRLFARASRSVKPEPAE

SEQ ID NO: 1120562 - protein, 17 aa, Mycobacterium
PTEQWYRRLMVNDRALA

SEQ ID NO: 1120563 - protein, 24 aa, Mycobacterium
PTRDAKWMVCDAVGGPDAGTTVIA

SEQ ID NO: 1120564 - protein, 18 aa, Mycobacterium
PTSYLRQMIYPFTHASGC

SEQ ID NO: 1120565 - protein, 20 aa, Mycobacterium
PTTSLLLKYDPIYTCLLQGA

SEQ ID NO: 1120566 - protein, 34 aa, Mycobacterium
PTVVRGARNYPCMEFPGKRAATIQQCRDPEGFVP

SEQ ID NO: 1120567 - protein, 23 aa, Mycobacterium
PTWPQCFPGSFTPIPHAEVPGIH

SEQ ID NO: 1120568 - protein, 19 aa, Mycobacterium
PVDHFRSGLMLAVGSAFAF

SEQ ID NO: 1120569 - protein, 19 aa, Mycobacterium
PVLALVCVAMFGLVVSPVS

SEQ ID NO: 1120570 - protein, 30 aa, Mycobacterium
PVLAYLLWVVWCRRTWRPVRLLGGLAAMAA

SEQ ID NO: 1120571 - protein, 32 aa, Mycobacterium
PVLLFCIAFGLSMDYEVFLMSRIREFWLASGR

SEQ ID NO: 1120572 - protein, 18 aa, Mycobacterium
PVPAFGSAMVLLGAIGIV

SEQ ID NO: 1120573 - protein, 17 aa, Mycobacterium
PVPALLARASWPMRAPR

SEQ ID NO: 1120574 - protein, 19 aa, Mycobacterium
PVPMLSWLGTAYVNVIRNT

SEQ ID NO: 1120575 - protein, 18 aa, Mycobacterium
PVRLVAAAVALACAALGP

SEQ ID NO: 1120576 - protein, 20 aa, Mycobacterium
PVSWSHHWVWSLPTVLVTLV

SEQ ID NO: 1120577 - protein, 21 aa, Mycobacterium
PVTARAGLDAVLAGTRTLSIG

SEQ ID NO: 1120578 - protein, 17 aa, Mycobacterium
PVVANFAVDAAMAVALA

SEQ ID NO: 1120579 - protein, 17 aa, Mycobacterium
PVVAVAMMFALGLLVGR

SEQ ID NO: 1120580 - protein, 18 aa, Mycobacterium
PVVPRPAQRREVPKHVVW

SEQ ID NO: 1120581 - protein, 26 aa, Mycobacterium
PVWERLRPVWRWVLRTRDRLREWWAN

SEQ ID NO: 1120582 - protein, 26 aa, Mycobacterium
PWGPRLGVRWWRFGAGVLLGLACATK

SEQ ID NO: 1120583 - protein, 27 aa, Mycobacterium
PWGPRLGVRWWRFGAGVLLGLACATKW

SEQ ID NO: 1120584 - protein, 23 aa, Mycobacterium
PYIRKLTPRAAMLGTLAGISITF

SEQ ID NO: 1120585 - protein, 18 aa, Mycobacterium
PYRYPQNLPVVAAKGGPG

SEQ ID NO: 1120586 - protein, 23 aa, Mycobacterium
PYTIPELVALVIGILGTLFALPR

SEQ ID NO: 1120587 - protein, 17 aa, Mycobacterium
QALRADMRRSFVATAAV

SEQ ID NO: 1120588 - protein, 17 aa, Mycobacterium
QASTFLLTMRKDAAGSS

SEQ ID NO: 1120589 - protein, 23 aa, Mycobacterium
QAVRRLSGVIAIVVLLFLACAPV

SEQ ID NO: 1120590 - protein, 18 aa, Mycobacterium
QDSAVWKAVQLLLESFAF

SEQ ID NO: 1120591 - protein, 26 aa, Mycobacterium
QEAALKYFLLGAFSSAFFLYGIAMLY

SEQ ID NO: 1120592 - protein, 22 aa, Mycobacterium
QEDLRKAGVVANIYGDAGPGIA

SEQ ID NO: 1120593 - protein, 26 aa, Mycobacterium
QELYGRATTVPWGLEIYERVDASGAR

SEQ ID NO: 1120594 - protein, 24 aa, Mycobacterium
QGEPVPVFGSALVLMGAFGVVALA

SEQ ID NO: 1120595 - protein, 20 aa, Mycobacterium
QGNAWGWGSGRTVACALGGA

SEQ ID NO: 1120596 - protein, 17 aa, Mycobacterium
QGNRFSQERVISYAELL

SEQ ID NO: 1120597 - protein, 17 aa, Mycobacterium
QGRALSIGVMLGVVLLG

SEQ ID NO: 1120598 - protein, 18 aa, Mycobacterium
QHRDTWLTYTLRAESNVG

SEQ ID NO: 1120599 - protein, 36 aa, Mycobacterium
QIRLTGSLDQRWCNPDHEIGALVMLDPEATRIRGRL

SEQ ID NO: 1120600 - protein, 18 aa, Mycobacterium
QKRAEPFLQVVKEAKSKS

SEQ ID NO: 1120601 - protein, 18 aa, Mycobacterium
QKTSHRRSVIYLGPPTLR

SEQ ID NO: 1120602 - protein, 17 aa, Mycobacterium
QLALGSDENVAWARVDD

SEQ ID NO: 1120603 - protein, 17 aa, Mycobacterium
QLFPGRRFGGGALCIYL

SEQ ID NO: 1120604 - protein, 21 aa, Mycobacterium
QLGTRIELRLGDPAESEMDRK

SEQ ID NO: 1120605 - protein, 20 aa, Mycobacterium
QLMQHGWGKALLILVGLGVI

SEQ ID NO: 1120606 - protein, 24 aa, Mycobacterium
QLRREFSLWSAFAFISPIVALYGI

SEQ ID NO: 1120607 - protein, 25 aa, Mycobacterium
QNGTCSFYGAMPGFDPAAVPPSQNM

SEQ ID NO: 1120608 - protein, 24 aa, Mycobacterium
QNLRMILLPQAFRSVVIPLGSVLI

SEQ ID NO: 1120609 - protein, 18 aa, Mycobacterium
QPLAGIPQPHGRRVSTRR

SEQ ID NO: 1120610 - protein, 19 aa, Mycobacterium
QPLLRHFGNAVDRGLRVIV

SEQ ID NO: 1120611 - protein, 23 aa, Mycobacterium
QPPPDLWSAATFITLAVFLGVGT

SEQ ID NO: 1120612 - protein, 20 aa, Mycobacterium
QPPPGLGWEERRAWRFEGPI

SEQ ID NO: 1120613 - protein, 19 aa, Mycobacterium
QQKKPVWLIAAAVLGVVVI

SEQ ID NO: 1120614 - protein, 20 aa, Mycobacterium
QQLAFGRLRAVEHDRYVVVA

SEQ ID NO: 1120615 - protein, 19 aa, Mycobacterium
QQLSGLGFTLPREAVQPAL

SEQ ID NO: 1120616 - protein, 24 aa, Mycobacterium
QQPEVANPALWILAGAVAGLIAIA

SEQ ID NO: 1120617 - protein, 25 aa, Mycobacterium
QQSTAPWYLSLAMLAALVLVGAVGG

SEQ ID NO: 1120618 - protein, 18 aa, Mycobacterium
QRQLRMIAIGGVIGAGLF

SEQ ID NO: 1120619 - protein, 21 aa, Mycobacterium
QRRRFSLAVVGSVAAAVLCLG

SEQ ID NO: 1120620 - protein, 18 aa, Mycobacterium
QRSQPFIDVVNKVKSKSV

SEQ ID NO: 1120621 - protein, 23 aa, Mycobacterium
QRTRLVAWVLLLLMLPMVVGCVR

SEQ ID NO: 1120622 - protein, 27 aa, Mycobacterium
QSDSGFPFFLPSGFEFQVTLIVIAAAL

SEQ ID NO: 1120623 - protein, 21 aa, Mycobacterium
QSSNMLLRLLRIEPVHDVEHS

SEQ ID NO: 1120624 - protein, 18 aa, Mycobacterium
QTASGVLMPMDFPLVMSV

SEQ ID NO: 1120625 - protein, 23 aa, Mycobacterium
QTDRTLLLWAIPLLIAPPMYSKD

SEQ ID NO: 1120626 - protein, 18 aa, Mycobacterium
QTHGLRPDELRVMYEHHD

SEQ ID NO: 1120627 - protein, 18 aa, Mycobacterium
QTLCAASVIGMRFDTALL

SEQ ID NO: 1120628 - protein, 22 aa, Mycobacterium
QTPDPRGAGLIYDTVGGNGPLS

SEQ ID NO: 1120629 - protein, 21 aa, Mycobacterium
QWRCARVTVGMAPRASIRIGR

SEQ ID NO: 1120630 - protein, 17 aa, Mycobacterium
QYPSGPLILAGAAVLLA

SEQ ID NO: 1120631 - protein, 20 aa, Mycobacterium
QYRILKALADTAVRVPRVMW

SEQ ID NO: 1120632 - protein, 21 aa, Mycobacterium
QYSPRLLRTFAADQVVQRTLA

SEQ ID NO: 1120633 - protein, 18 aa, Mycobacterium
QYWWTAFAVTLAITVVSV

SEQ ID NO: 1120634 - protein, 17 aa, Mycobacterium
RAAAALLAVLALVLTGG

SEQ ID NO: 1120635 - protein, 19 aa, Mycobacterium
RAAAEPLGLGSVDAPVATG

SEQ ID NO: 1120636 - protein, 22 aa, Mycobacterium
RAAPLLRTALRLSIIAAVVAAV

SEQ ID NO: 1120637 - protein, 23 aa, Mycobacterium
RAARGGVLIKDRLALEGMRTVDA

SEQ ID NO: 1120638 - protein, 30 aa, Mycobacterium
RAASGRMRNVWVCFAVAFGGWTAGEVLFGY

SEQ ID NO: 1120639 - protein, 26 aa, Mycobacterium
RAASLLVAVGISWLLFTWMISRLPRE

SEQ ID NO: 1120640 - protein, 19 aa, Mycobacterium
RAELEEMLQRPLAGVLAAL

SEQ ID NO: 1120641 - protein, 20 aa, Mycobacterium
RAELHAKLSAMLYGIEAAPN

SEQ ID NO: 1120642 - protein, 24 aa, Mycobacterium
RAGLLAAVAFEIFKQVASIYLRTV

SEQ ID NO: 1120643 - protein, 25 aa, Mycobacterium
RAKTSTWLPSRRFFAAVIAIAGMQL

SEQ ID NO: 1120644 - protein, 17 aa, Mycobacterium
RANKRVIGASVVSVGLV

SEQ ID NO: 1120645 - protein, 20 aa, Mycobacterium
RAQAELNEFVEAARQGAINL

SEQ ID NO: 1120646 - protein, 22 aa, Mycobacterium
RAQRLCRPVFWYLAAWAAGLLV

SEQ ID NO: 1120647 - protein, 24 aa, Mycobacterium
RARATQSILAFIMVSYIPLIGVVA

SEQ ID NO: 1120648 - protein, 22 aa, Mycobacterium
RARPRMEFFYRIAVGVIGLLVL

SEQ ID NO: 1120649 - protein, 26 aa, Mycobacterium
RARWMAVCVTTLITFLGAVAVTMLTT

SEQ ID NO: 1120650 - protein, 17 aa, Mycobacterium
RATIGLSLAIAVVLVLL

SEQ ID NO: 1120651 - protein, 20 aa, Mycobacterium
RAVAVALVLADHGGVPGVSG

SEQ ID NO: 1120652 - protein, 18 aa, Mycobacterium
RDAAAMWRYAGMAASALV

SEQ ID NO: 1120653 - protein, 20 aa, Mycobacterium
RDAKGMKVGIDIQDVRLEDT

SEQ ID NO: 1120654 - protein, 19 aa, Mycobacterium
RDLIKLAAGIALLIVFACL

SEQ ID NO: 1120655 - protein, 17 aa, Mycobacterium
RDVLEAQAAPALAEAAR

SEQ ID NO: 1120656 - protein, 19 aa, Mycobacterium
REAAGYGFGASVLQSSVVY

SEQ ID NO: 1120657 - protein, 23 aa, Mycobacterium
REDYRAFQAYTCRAEHATESEVL

SEQ ID NO: 1120658 - protein, 23 aa, Mycobacterium
REGWPSQRQSAGFVVAAALAIGV

SEQ ID NO: 1120659 - protein, 17 aa, Mycobacterium
RELPAAIGRIGAVALIL

SEQ ID NO: 1120660 - protein, 19 aa, Mycobacterium
REPMVKLLMALAVASTNHR

SEQ ID NO: 1120661 - protein, 18 aa, Mycobacterium
RFARRPLIATGYGMAALG

SEQ ID NO: 1120662 - protein, 27 aa, Mycobacterium
RFDETWPLLTGFVWLGGLLIVASVVLT

SEQ ID NO: 1120663 - protein, 17 aa, Mycobacterium
RFIDRYGARRVLVVAAM

SEQ ID NO: 1120664 - protein, 19 aa, Mycobacterium
RFLRVPIGLSDNGTPVELD

SEQ ID NO: 1120665 - protein, 18 aa, Mycobacterium
RFSQGLALGGEWSGAALL

SEQ ID NO: 1120666 - protein, 25 aa, Mycobacterium
RGAHVELRRSFGWRTVAAAGGLLST

SEQ ID NO: 1120667 - protein, 25 aa, Mycobacterium
RGEILLATRFKPSMVSLPMAAVAAM

SEQ ID NO: 1120668 - protein, 17 aa, Mycobacterium
RGFAAELGLDMAAFDAA

SEQ ID NO: 1120669 - protein, 20 aa, Mycobacterium
RGFMLPDRYEPPTTINRRVI

SEQ ID NO: 1120670 - protein, 20 aa, Mycobacterium
RGLPDLPSKQYGGSWYHTPF

SEQ ID NO: 1120671 - protein, 19 aa, Mycobacterium
RGSAGWRQVTRWRRLDGRT

SEQ ID NO: 1120672 - protein, 19 aa, Mycobacterium
RGSDGVVIPGSYRNRHDAV

SEQ ID NO: 1120673 - protein, 18 aa, Mycobacterium
RGVGVIALADAVRETSAD

SEQ ID NO: 1120674 - protein, 17 aa, Mycobacterium
RHDLVLEMFTAVHAAFP

SEQ ID NO: 1120675 - protein, 28 aa, Mycobacterium
RHRWRQIPTRTRMGVVVAVVAIAGLAWQ

SEQ ID NO: 1120676 - protein, 32 aa, Mycobacterium
RIAVLGGLCAATLWVVRWPTRAQSVAYILAAN

SEQ ID NO: 1120677 - protein, 23 aa, Mycobacterium
RILPITFTAVGLVLLVGGALLGS

SEQ ID NO: 1120678 - protein, 17 aa, Mycobacterium
RIMLQNIGLSLAIITIL

SEQ ID NO: 1120679 - protein, 22 aa, Mycobacterium
RIPPKYVVLTSFAGTAALAFVA

SEQ ID NO: 1120680 - protein, 19 aa, Mycobacterium
RIREFTIGFVYNQKVGSAY

SEQ ID NO: 1120681 - protein, 18 aa, Mycobacterium
RIRESPIVLASDRPDLDP

SEQ ID NO: 1120682 - protein, 20 aa, Mycobacterium
RISARDGVTVIAYRDTAGPD

SEQ ID NO: 1120683 - protein, 26 aa, Mycobacterium
RISDCLAEPGTLVWADVYASDHAILK

SEQ ID NO: 1120684 - protein, 32 aa, Mycobacterium
RISGVFVPIVIAIAVITLGAWLGAGFSVAAAF

SEQ ID NO: 1120685 - protein, 18 aa, Mycobacterium
RISNGVALRDTRMLTDPL

SEQ ID NO: 1120686 - protein, 18 aa, Mycobacterium
RITDHWHAPVGGLVMAGC

SEQ ID NO: 1120687 - protein, 19 aa, Mycobacterium
RKERIALKLVASTFFLLAG

SEQ ID NO: 1120688 - protein, 23 aa, Mycobacterium
RKERIMLAIKYLNQYTMGLGETV

SEQ ID NO: 1120689 - protein, 25 aa, Mycobacterium
RKITEVKGRGYADVYMDYEDDPDEP

SEQ ID NO: 1120690 - protein, 18 aa, Mycobacterium
RKITGPLLFLFILGDVLG

SEQ ID NO: 1120691 - protein, 42 aa, Mycobacterium
RKSAGVARWWRLLVIAAMGSWLVAEMVWFFGGAGRGGDEAHP

SEQ ID NO: 1120692 - protein, 28 aa, Mycobacterium
RKSVLALKEAGWWRLGIPEDIGGTLAPM

SEQ ID NO: 1120693 - protein, 26 aa, Mycobacterium
RKVFPARIAFHLVRLYNLAFIVSTYA

SEQ ID NO: 1120694 - protein, 25 aa, Mycobacterium
RLADKAAGWLFWFALITAAITAAAW

SEQ ID NO: 1120695 - protein, 19 aa, Mycobacterium
RLAFSNGILMLAFAAVAFI

SEQ ID NO: 1120696 - protein, 34 aa, Mycobacterium
RLANAHLYRRIGASVVRWPVPILAASTAVVMLGA

SEQ ID NO: 1120697 - protein, 18 aa, Mycobacterium
RLARHGYRTLILDSITLE

SEQ ID NO: 1120698 - protein, 28 aa, Mycobacterium
RLDADRSLPGYRWRKLKEEVIRHNKLRP

SEQ ID NO: 1120699 - protein, 29 aa, Mycobacterium
RLERGRRKRRMAGALSLALLIVVVVGAVF

SEQ ID NO: 1120700 - protein, 17 aa, Mycobacterium
RLGAIVIVQLFGLLLSP

SEQ ID NO: 1120701 - protein, 18 aa, Mycobacterium
RLIYEMAKRPDLQGMRAV

SEQ ID NO: 1120702 - protein, 25 aa, Mycobacterium
RLLNELRAQFDYVIVDSTPLLAVTD

SEQ ID NO: 1120703 - protein, 21 aa, Mycobacterium
RLMVFAVVAVLAWVNALAIFG

SEQ ID NO: 1120704 - protein, 17 aa, Mycobacterium
RLMVMLMLITAFASPVL

SEQ ID NO: 1120705 - protein, 18 aa, Mycobacterium
RLRIGRAVLTSRPSLLFA

SEQ ID NO: 1120706 - protein, 19 aa, Mycobacterium
RLSVLSLPTTIIFDAHGRP

SEQ ID NO: 1120707 - protein, 31 aa, Mycobacterium
RLTLDLLRPRLGRLLLAIGLGVLSLGSALAL

SEQ ID NO: 1120708 - protein, 20 aa, Mycobacterium
RLTPPGAFTAIPGHWHETAA

SEQ ID NO: 1120709 - protein, 23 aa, Mycobacterium
RLVDLLPLPSLRVQRAIAVAVIL

SEQ ID NO: 1120710 - protein, 19 aa, Mycobacterium
RLVGAGFDLQAFRDGLVVQ

SEQ ID NO: 1120711 - protein, 18 aa, Mycobacterium
RLVLYLGLAAALGLVASW

SEQ ID NO: 1120712 - protein, 20 aa, Mycobacterium
RLYHVITDWQTYFGPDGAGL

SEQ ID NO: 1120713 - protein, 18 aa, Mycobacterium
RMFGVGFTLAVLADATLI

SEQ ID NO: 1120714 - protein, 19 aa, Mycobacterium
RMLASGLVALLLNSLVVII

SEQ ID NO: 1120715 - protein, 22 aa, Mycobacterium
RMLRLSEIHTGTAPQVETARRR

SEQ ID NO: 1120716 - protein, 18 aa, Mycobacterium
RNAKRWQDVEALLAAGIT

SEQ ID NO: 1120717 - protein, 22 aa, Mycobacterium
RNDLPVPIRVRLAVDAPPGMTV

SEQ ID NO: 1120718 - protein, 18 aa, Mycobacterium
RNGYVAGIMSRLPDAQVL

SEQ ID NO: 1120719 - protein, 19 aa, Mycobacterium
RPEAPEVIGGLRAHGYQVA

SEQ ID NO: 1120720 - protein, 22 aa, Mycobacterium
RPMSGRVVVFASAKGFSEVSAG

SEQ ID NO: 1120721 - protein, 17 aa, Mycobacterium
RPNRLTQSAAWVGIVAG

SEQ ID NO: 1120722 - protein, 36 aa, Mycobacterium
RPRASSDLWRLLPYLMPYRVRWIAMFVVAIASLGAT

SEQ ID NO: 1120723 - protein, 19 aa, Mycobacterium
RPRVVEFGFWALVAGAALL

SEQ ID NO: 1120724 - protein, 19 aa, Mycobacterium
RPSWPNPWQPKPQTPPKQD

SEQ ID NO: 1120725 - protein, 19 aa, Mycobacterium
RPTGGHPLARLMPFAMLVA

SEQ ID NO: 1120726 - protein, 22 aa, Mycobacterium
RPTKANAWIRRGVSPEKAAESA

SEQ ID NO: 1120727 - protein, 27 aa, Mycobacterium
RQAGERRMLCGLQLPGPNNQQLAFTGK

SEQ ID NO: 1120728 - protein, 17 aa, Mycobacterium
RQLAPLVRFDGYHVLAD

SEQ ID NO: 1120729 - protein, 29 aa, Mycobacterium
RQMRLIVSDRGYFIFLALLPFIMGVLSLS

SEQ ID NO: 1120730 - protein, 24 aa, Mycobacterium
RQPDHFDWITGYLAARGMLGVARW

SEQ ID NO: 1120731 - protein, 24 aa, Mycobacterium
RQVQRELLELFNISEQQLNTEGLQ

SEQ ID NO: 1120732 - protein, 18 aa, Mycobacterium
RRADPVALLAPVAVLAAL

SEQ ID NO: 1120733 - protein, 23 aa, Mycobacterium
RRAEVRDAAALDYVRSFMTSYTT

SEQ ID NO: 1120734 - protein, 24 aa, Mycobacterium
RRAGARALRWGWLALTLIGVPWLL

SEQ ID NO: 1120735 - protein, 24 aa, Mycobacterium
RRAGTQIGVPYSWGGGSLTGPSRG

SEQ ID NO: 1120736 - protein, 18 aa, Mycobacterium
RRAIKAAAPGIGNLACAT

SEQ ID NO: 1120737 - protein, 17 aa, Mycobacterium
RRAKRIVPSAVLVLAVT

SEQ ID NO: 1120738 - protein, 23 aa, Mycobacterium
RRDCIAGPGIIGWTVQQTFFQRR

SEQ ID NO: 1120739 - protein, 18 aa, Mycobacterium
RREIGHALTRGTAVVLVL

SEQ ID NO: 1120740 - protein, 31 aa, Mycobacterium
RRELSAGAIGEIWVRGENVCLGYWGKPEQTE

SEQ ID NO: 1120741 - protein, 20 aa, Mycobacterium
RRGAFHCWTDVADISVPATL

SEQ ID NO: 1120742 - protein, 21 aa, Mycobacterium
RRGDPKFRRATIGLSLAIAVV

SEQ ID NO: 1120743 - protein, 20 aa, Mycobacterium
RRGVGWFLILAFAGAWIPWF

SEQ ID NO: 1120744 - protein, 17 aa, Mycobacterium
RRGYQLWAAAGLGALTV

SEQ ID NO: 1120745 - protein, 18 aa, Mycobacterium
RRILMAAIVVAAFAVAAS

SEQ ID NO: 1120746 - protein, 18 aa, Mycobacterium
RRIRAEAFDLVLHTGAAA

SEQ ID NO: 1120747 - protein, 22 aa, Mycobacterium
RRKRWLIEIVDVLAAAVTAALR

SEQ ID NO: 1120748 - protein, 22 aa, Mycobacterium
RRLEAFALFNVFYQAGILAGPL

SEQ ID NO: 1120749 - protein, 17 aa, Mycobacterium
RRPLIATGYGMAALGKV

SEQ ID NO: 1120750 - protein, 20 aa, Mycobacterium
RRPVVHLVGSLTVLIALAAC

SEQ ID NO: 1120751 - protein, 36 aa, Mycobacterium
RRRHIAFAGLFLLVVVVGFGSWLALRAVEAKANLEA

SEQ ID NO: 1120752 - protein, 19 aa, Mycobacterium
RRRIIVAIFVVIGFGLLGY

SEQ ID NO: 1120753 - protein, 24 aa, Mycobacterium
RRRLFEQNNILSLDEWRQKRSQGV

SEQ ID NO: 1120754 - protein, 20 aa, Mycobacterium
RRRPLMAGIVLHMLASVLCM

SEQ ID NO: 1120755 - protein, 25 aa, Mycobacterium
RRRRAEGSIDWLGAVGLAAGLSALL

SEQ ID NO: 1120756 - protein, 27 aa, Mycobacterium
RRRRELTCPRWLAVLATVSFGLYLGWS

SEQ ID NO: 1120757 - protein, 22 aa, Mycobacterium
RRRREVLVYAWLMPASTVAQAV

SEQ ID NO: 1120758 - protein, 19 aa, Mycobacterium
RRRRIRLSKTDTATPVDRS

SEQ ID NO: 1120759 - protein, 17 aa, Mycobacterium
RRRYLDLFENTLLITIV

SEQ ID NO: 1120760 - protein, 20 aa, Mycobacterium
RRTLAKWVALAVSLVALAVT

SEQ ID NO: 1120761 - protein, 17 aa, Mycobacterium
RRWGSGRSLVIGMLILA

SEQ ID NO: 1120762 - protein, 18 aa, Mycobacterium
RSAEVVVYGLAFFFGAFF

SEQ ID NO: 1120763 - protein, 20 aa, Mycobacterium
RSARAFWSMTRRFRPRDYTF

SEQ ID NO: 1120764 - protein, 23 aa, Mycobacterium
RSFARVILPLSLPGVLAGSLLVF

SEQ ID NO: 1120765 - protein, 23 aa, Mycobacterium
RSLGHRAGHGWLVARTGSLERRR

SEQ ID NO: 1120766 - protein, 19 aa, Mycobacterium
RSQVLFGALGALLCVLLGV

SEQ ID NO: 1120767 - protein, 24 aa, Mycobacterium
RSSPVIRRILLRTVLFTAPASALW

SEQ ID NO: 1120768 - protein, 17 aa, Mycobacterium
RTARSGAFIALVAAFAL

SEQ ID NO: 1120769 - protein, 21 aa, Mycobacterium
RTGRLWPLIIAHTLIDAVAFV

SEQ ID NO: 1120770 - protein, 17 aa, Mycobacterium
RTLQSIVLTAIFIFGIV

SEQ ID NO: 1120771 - protein, 25 aa, Mycobacterium
RVAAEFIGTFWLVFGGCGSAVFAAK

SEQ ID NO: 1120772 - protein, 20 aa, Mycobacterium
RVGRDGVVFDCLKFRSMRPA

SEQ ID NO: 1120773 - protein, 20 aa, Mycobacterium
RVIGASVVSVGLVLSAALYP

SEQ ID NO: 1120774 - protein, 17 aa, Mycobacterium
RVLDTAVGIVTGIVIAA

SEQ ID NO: 1120775 - protein, 20 aa, Mycobacterium
RVPPEQLPAAVAVPGLGRDL

SEQ ID NO: 1120776 - protein, 31 aa, Mycobacterium
RVRKYLTLMSFRIPALILAAVAYSIWENGLI

SEQ ID NO: 1120777 - protein, 18 aa, Mycobacterium
RVRLRRRPRPDPDAPPAP

SEQ ID NO: 1120778 - protein, 21 aa, Mycobacterium
RVRVLRCAYPRGQAAFPKVVK

SEQ ID NO: 1120779 - protein, 19 aa, Mycobacterium
RVSPLRLGEDFANLSRAFN

SEQ ID NO: 1120780 - protein, 18 aa, Mycobacterium
RVTVVVDDAMTWLRGVDR

SEQ ID NO: 1120781 - protein, 19 aa, Mycobacterium
RWHNFRWQTFCAEPDVLDS

SEQ ID NO: 1120782 - protein, 18 aa, Mycobacterium
RWLLDGRGSREWLAGVAI

SEQ ID NO: 1120783 - protein, 18 aa, Mycobacterium
RWRSVWAPAAGVFAVGLA

SEQ ID NO: 1120784 - protein, 26 aa, Mycobacterium
RWSDAVGRRPMLLAGVGFAIASALVF

SEQ ID NO: 1120785 - protein, 17 aa, Mycobacterium
RYFEKRSKRQAGAALRA

SEQ ID NO: 1120786 - protein, 28 aa, Mycobacterium
RYPQNLPKVAARGGPQCVGLPDVGYETR

SEQ ID NO: 1120787 - protein, 24 aa, Mycobacterium
RYVELPATLCIPLLLAAFSAGNGA

SEQ ID NO: 1120788 - protein, 19 aa, Mycobacterium
SAAGMVWRAAAAIELGLCD

SEQ ID NO: 1120789 - protein, 47 aa, Mycobacterium
SAATVALAFLAMVFARLSVFAALGPACAIAVLFGFLATVTLLPPVLA

SEQ ID NO: 1120790 - protein, 47 aa, Mycobacterium
SAATVALAFLAMVFARLSVFAALGPACAIAVLFGFLATVTLLPPVLS

SEQ ID NO: 1120791 - protein, 20 aa, Mycobacterium
SAFAGWGAFLFMMSLYLQGE

SEQ ID NO: 1120792 - protein, 21 aa, Mycobacterium
SAFATQLGAFIAENREQMRPA

SEQ ID NO: 1120793 - protein, 20 aa, Mycobacterium
SAFFLYGIAMLYGYAGTLDL

SEQ ID NO: 1120794 - protein, 20 aa, Mycobacterium
SAHSMPRRNKFLAAGAAVVG

SEQ ID NO: 1120795 - protein, 18 aa, Mycobacterium
SAHTRVPVITTRQPALDA

SEQ ID NO: 1120796 - protein, 25 aa, Mycobacterium
SAIVLCLGLPWVIYLPICYALPGPV

SEQ ID NO: 1120797 - protein, 20 aa, Mycobacterium
SAKPRARVFTAARVDPDADT

SEQ ID NO: 1120798 - protein, 19 aa, Mycobacterium
SALYLILGAYSFPDADPTR

SEQ ID NO: 1120799 - protein, 22 aa, Mycobacterium
SARQRALAAIERMQWEREMRSQ

SEQ ID NO: 1120800 - protein, 27 aa, Mycobacterium
SAYDIALFYRYAWRNPTFTEIVATRTY

SEQ ID NO: 1120801 - protein, 26 aa, Mycobacterium
SDDLRASLPLLTRGLIGRRRPRGLQV

SEQ ID NO: 1120802 - protein, 24 aa, Mycobacterium
SDKLQVGEEVIAAGAPLGLRSTVT

SEQ ID NO: 1120803 - protein, 18 aa, Mycobacterium
SDLAMTWLLTGLFAGIVS

SEQ ID NO: 1120804 - protein, 18 aa, Mycobacterium
SDQIGWFIVYVTVVIGVS

SEQ ID NO: 1120805 - protein, 19 aa, Mycobacterium
SDVPFCVVGQLLRTIVGLP

SEQ ID NO: 1120806 - protein, 17 aa, Mycobacterium
SDVVNWIRQRSRWYKGY

SEQ ID NO: 1120807 - protein, 24 aa, Mycobacterium
SEHPLAGAIVRYAAAHGIASASLT

SEQ ID NO: 1120808 - protein, 20 aa, Mycobacterium
SELPETILVSVSHRSTVEQH

SEQ ID NO: 1120809 - protein, 18 aa, Mycobacterium
SELSRYATDLSRVADVSS

SEQ ID NO: 1120810 - protein, 24 aa, Mycobacterium
SFWTAEQRRIWPVRLMQIQVSVIY

SEQ ID NO: 1120811 - protein, 25 aa, Mycobacterium
SGAAAAREWEWLKWTPHHRSSGGHT

SEQ ID NO: 1120812 - protein, 23 aa, Mycobacterium
SGCSWTEALALGWPKGITPEAHL

SEQ ID NO: 1120813 - protein, 25 aa, Mycobacterium
SGEREKLRYGVVLTMCAGAVVGATL

SEQ ID NO: 1120814 - protein, 17 aa, Mycobacterium
SGPAAGHHSDPDWRPSA

SEQ ID NO: 1120815 - protein, 34 aa, Mycobacterium
SGPPIELGQGVLPTLVILLDFLQQELPALFVPGS

SEQ ID NO: 1120816 - protein, 23 aa, Mycobacterium
SGRRRFPGFEWLRQPESYSDREW

SEQ ID NO: 1120817 - protein, 17 aa, Mycobacterium
SGVLMAITAQVSVQMGM

SEQ ID NO: 1120818 - protein, 18 aa, Mycobacterium
SGVLSFRLSEPTSAGQAR

SEQ ID NO: 1120819 - protein, 22 aa, Mycobacterium
SHHVDLLWRFHAVHHSITRFYG

SEQ ID NO: 1120820 - protein, 18 aa, Mycobacterium
SHVRIAAAIMAAIVAAAA

SEQ ID NO: 1120821 - protein, 21 aa, Mycobacterium
SIAAPKLKWLAAGVGGGLTFA

SEQ ID NO: 1120822 - protein, 24 aa, Mycobacterium
SIAAVLVALRLSARLRHGHADERK

SEQ ID NO: 1120823 - protein, 19 aa, Mycobacterium
SIASMYAFTSILWNLSGPV

SEQ ID NO: 1120824 - protein, 18 aa, Mycobacterium
SIGLLVWNRRCRPWVLAA

SEQ ID NO: 1120825 - protein, 17 aa, Mycobacterium
SKINAGAVQPTFDRVAL

SEQ ID NO: 1120826 - protein, 17 aa, Mycobacterium
SKRKWGVRESGATITWP

SEQ ID NO: 1120827 - protein, 19 aa, Mycobacterium
SKVALYLLITIAPFAVIAP

SEQ ID NO: 1120828 - protein, 23 aa, Mycobacterium
SLETVGGILLMLGLFTPLACSIV

SEQ ID NO: 1120829 - protein, 32 aa, Mycobacterium
SLIASVSPLVRWIIRVPREFVDDYIFNFPDTS

SEQ ID NO: 1120830 - protein, 19 aa, Mycobacterium
SLIAVLVMLGLSMAVIAVS

SEQ ID NO: 1120831 - protein, 20 aa, Mycobacterium
SLLVALGFALWAVRAPRPVL

SEQ ID NO: 1120832 - protein, 17 aa, Mycobacterium
SLPAGIIKAIRPRQWVK

SEQ ID NO: 1120833 - protein, 26 aa, Mycobacterium
SLPIVNATGGPNCRGLPDLPSKQYGG

SEQ ID NO: 1120834 - protein, 21 aa, Mycobacterium
SLSAAFGAMVWIFQEGHLGAL

SEQ ID NO: 1120835 - protein, 18 aa, Mycobacterium
SNKFFAFRDGAWVDLPPL

SEQ ID NO: 1120836 - protein, 26 aa, Mycobacterium
SNLTAHGGFMPMGFGVITVGIVTVIF

SEQ ID NO: 1120837 - protein, 25 aa, Mycobacterium
SPGKYPSPWLRLLILCTALLGINYI

SEQ ID NO: 1120838 - protein, 28 aa, Mycobacterium
SPLSGRLVGRFGARPSLLIAGVFITAAS

SEQ ID NO: 1120839 - protein, 26 aa, Mycobacterium
SPLSGRLVGRFGARPSLMIAGALIVA

SEQ ID NO: 1120840 - protein, 32 aa, Mycobacterium
SPLVRKAAAWSWRLLIIFGALVAVLWLVARLE

SEQ ID NO: 1120841 - protein, 18 aa, Mycobacterium
SPNPVFKSVAWVYLWIFR

SEQ ID NO: 1120842 - protein, 19 aa, Mycobacterium
SPQAPANFVDPSFSSMTTR

SEQ ID NO: 1120843 - protein, 17 aa, Mycobacterium
SPWAQSYSIFWDTDVAV

SEQ ID NO: 1120844 - protein, 19 aa, Mycobacterium
SQWDWAKWLVHTESQDIDG

SEQ ID NO: 1120845 - protein, 20 aa, Mycobacterium
SRARLPFNLDPARTPVLGSW

SEQ ID NO: 1120846 - protein, 22 aa, Mycobacterium
SRKAPRLVRRFIRNQAAKTLPD

SEQ ID NO: 1120847 - protein, 21 aa, Mycobacterium
SRLAAVLVFVMVVSFERRNPF

SEQ ID NO: 1120848 - protein, 22 aa, Mycobacterium
SRLRPLIEPALVVLTVAALAAG

SEQ ID NO: 1120849 - protein, 17 aa, Mycobacterium
SRMVKAAAVARDSPALY

SEQ ID NO: 1120850 - protein, 17 aa, Mycobacterium
SRNGYRMTLVPDAVVDK

SEQ ID NO: 1120851 - protein, 17 aa, Mycobacterium
SRQRGGIEYGARHYPVM

SEQ ID NO: 1120852 - protein, 20 aa, Mycobacterium
SRYSWVPAAAGWTVGVIATL

SEQ ID NO: 1120853 - protein, 21 aa, Mycobacterium
SSIPSVIGFILAAVVFIYLVR

SEQ ID NO: 1120854 - protein, 18 aa, Mycobacterium
SSPGPIFFRQPRVGRDGV

SEQ ID NO: 1120855 - protein, 22 aa, Mycobacterium
SSPVYRALWIAQFVSNLGTWMQ

SEQ ID NO: 1120856 - protein, 22 aa, Mycobacterium
SSRAGWAALIYVAAIIAMFGVS

SEQ ID NO: 1120857 - protein, 19 aa, Mycobacterium
STEAWIRFVTSAPKHAAGM

SEQ ID NO: 1120858 - protein, 26 aa, Mycobacterium
STLPFLWNIFKSWRYGEVVTVDDPWG

SEQ ID NO: 1120859 - protein, 19 aa, Mycobacterium
STMCANVFIYGAAFLIPTL

SEQ ID NO: 1120860 - protein, 27 aa, Mycobacterium
STQRFTDRFQRVFVPVILVGVVLLLFA

SEQ ID NO: 1120861 - protein, 24 aa, Mycobacterium
STRDEFRYTESLVHPALGQGARSV

SEQ ID NO: 1120862 - protein, 21 aa, Mycobacterium
STTFGWFRFYLLAIPLVICVA

SEQ ID NO: 1120863 - protein, 20 aa, Mycobacterium
STYGHLRWLTTGTHDDEAIR

SEQ ID NO: 1120864 - protein, 25 aa, Mycobacterium
SVDLGREFIDMYGFTNPTTDFRNSN

SEQ ID NO: 1120865 - protein, 25 aa, Mycobacterium
SVEGPLRPGHWVMFAAVSVSALAAM

SEQ ID NO: 1120866 - protein, 28 aa, Mycobacterium
SVFAAAMRAWIAQLVCWHTPNDTALAVV

SEQ ID NO: 1120867 - protein, 24 aa, Mycobacterium
SVGATAWLYFFQFRPDQETDSEAA

SEQ ID NO: 1120868 - protein, 19 aa, Mycobacterium
SVIPRLFVWPPARSIAQLL

SEQ ID NO: 1120869 - protein, 30 aa, Mycobacterium
SVLELLRRRELPVLPVPAPLALQFVHADDV

SEQ ID NO: 1120870 - protein, 23 aa, Mycobacterium
SVLGVGVNLFWVIFDLLILSVVI

SEQ ID NO: 1120871 - protein, 23 aa, Mycobacterium
SVRAGFIGLVLIVLVIVVGLQPQ

SEQ ID NO: 1120872 - protein, 17 aa, Mycobacterium
SVTGLHAAWGIVAKGTL

SEQ ID NO: 1120873 - protein, 22 aa, Mycobacterium
SVWQDWRRVAANRSFLLFAAAM

SEQ ID NO: 1120874 - protein, 24 aa, Mycobacterium
SWRHYAAAVTIPWGVLLLAVGIAA

SEQ ID NO: 1120875 - protein, 19 aa, Mycobacterium
TAAAIHWHTAAAVLVLLGG

SEQ ID NO: 1120876 - protein, 24 aa, Mycobacterium
TAGRARIVAWALWDCGNTGMNAIV

SEQ ID NO: 1120877 - protein, 24 aa, Mycobacterium
TAHIRTGTLLGERVLALESEGSGT

SEQ ID NO: 1120878 - protein, 23 aa, Mycobacterium
TAIEMLVPLALLFSHGGWPTAIA

SEQ ID NO: 1120879 - protein, 25 aa, Mycobacterium
TAILLSMYWPLGVVVLVSIVPITLT

SEQ ID NO: 1120880 - protein, 17 aa, Mycobacterium
TAIQLAVDASGVAPTGY

SEQ ID NO: 1120881 - protein, 24 aa, Mycobacterium
TASALEFLGPLGVAVVRGSGLGRV

SEQ ID NO: 1120882 - protein, 23 aa, Mycobacterium
TATALEFLGPLAVAVVHGSGRHR

SEQ ID NO: 1120883 - protein, 20 aa, Mycobacterium
TAVGCYFAFKGASRRFRDDL

SEQ ID NO: 1120884 - protein, 18 aa, Mycobacterium
TCASCANRIERKLNKLDG

SEQ ID NO: 1120885 - protein, 21 aa, Mycobacterium
TCDRIRSAAWQHDLDTLVDGG

SEQ ID NO: 1120886 - protein, 21 aa, Mycobacterium
TCLPLFRHLWSTQVIAPEHLP

SEQ ID NO: 1120887 - protein, 28 aa, Mycobacterium
TDANRDAWMVGFTPSLSTAVWVGTVDGT

SEQ ID NO: 1120888 - protein, 21 aa, Mycobacterium
TDFKDGAGFDAFVDYPHVVAV

SEQ ID NO: 1120889 - protein, 23 aa, Mycobacterium
TDFPKLAAPLSVGDDAARVKLAE

SEQ ID NO: 1120890 - protein, 23 aa, Mycobacterium
TDGDPRPGVEIRLTDDGEILSRG

SEQ ID NO: 1120891 - protein, 19 aa, Mycobacterium
TDIIWSFFQAIAMAIVIML

SEQ ID NO: 1120892 - protein, 17 aa, Mycobacterium
TDTDWWLLGVAIAVVVL

SEQ ID NO: 1120893 - protein, 23 aa, Mycobacterium
TEALAVPIWWAYAASLLLITAGL

SEQ ID NO: 1120894 - protein, 22 aa, Mycobacterium
TEHTTHWGLYIDDFWWTAVWAG

SEQ ID NO: 1120895 - protein, 20 aa, Mycobacterium
TEMFGIPVLTSYAATEFGGG

SEQ ID NO: 1120896 - protein, 18 aa, Mycobacterium
TETMIGWSEASRADWDGR

SEQ ID NO: 1120897 - protein, 23 aa, Mycobacterium
TEVFPLTMFAVAGMLLFPASDDL

SEQ ID NO: 1120898 - protein, 23 aa, Mycobacterium
TFDARKAATLGLRPDIAVPTLTV

SEQ ID NO: 1120899 - protein, 23 aa, Mycobacterium
TFQRFGNWVLAMALSILACGIAW

SEQ ID NO: 1120900 - protein, 25 aa, Mycobacterium
TFYDYARGWPLALLAAAFAVVVVAV

SEQ ID NO: 1120901 - protein, 22 aa, Mycobacterium
TGALSFLYYVVFEVTQGWTPGK

SEQ ID NO: 1120902 - protein, 19 aa, Mycobacterium
TGAVGGFVRVRVLVSAPDA

SEQ ID NO: 1120903 - protein, 18 aa, Mycobacterium
TGEIPIVTDRASDTREER

SEQ ID NO: 1120904 - protein, 20 aa, Mycobacterium
TGGTSRYAAPSARRATATKQ

SEQ ID NO: 1120905 - protein, 21 aa, Mycobacterium
TGIAGPIKLSGYDAVQVEGTY

SEQ ID NO: 1120906 - protein, 30 aa, Mycobacterium
TGLDIRPNPGIGFPGWANYFPVTKAVPEPP

SEQ ID NO: 1120907 - protein, 21 aa, Mycobacterium
TGLLGAFLFSVYFQHVTPGSF

SEQ ID NO: 1120908 - protein, 18 aa, Mycobacterium
TGQSLWWALALAVLGLGL

SEQ ID NO: 1120909 - protein, 17 aa, Mycobacterium
TGWKATISVAMSNYIEA

SEQ ID NO: 1120910 - protein, 19 aa, Mycobacterium
THRRSTCRSFFEVVIVIVI

SEQ ID NO: 1120911 - protein, 18 aa, Mycobacterium
TKESVFWVSDLGVRYGME

SEQ ID NO: 1120912 - protein, 18 aa, Mycobacterium
TKFVMHRAVPVGLAGIAV

SEQ ID NO: 1120913 - protein, 20 aa, Mycobacterium
TKSRPRPAQQPAPAPHDEGW

SEQ ID NO: 1120914 - protein, 25 aa, Mycobacterium
TKYPRAGGAAVFAERAFKRPVVSFL

SEQ ID NO: 1120915 - protein, 21 aa, Mycobacterium
TLAGVCLWVTRARRGSRLFTV

SEQ ID NO: 1120916 - protein, 25 aa, Mycobacterium
TLATIKTNLFWAFAYNVAAIPVAAL

SEQ ID NO: 1120917 - protein, 18 aa, Mycobacterium
TLLELAPPVAVVLRDGEP

SEQ ID NO: 1120918 - protein, 18 aa, Mycobacterium
TLPISPYAMLTARMIYCL

SEQ ID NO: 1120919 - protein, 19 aa, Mycobacterium
TLRLGRPGWLDPGPLAGDV

SEQ ID NO: 1120920 - protein, 26 aa, Mycobacterium
TLRTIKGNLFWAFAYNVAALPLAALG

SEQ ID NO: 1120921 - protein, 17 aa, Mycobacterium
TLTGARPPRDLLPGLSG

SEQ ID NO: 1120922 - protein, 18 aa, Mycobacterium
TLTRSQRATVWFFAIVSV

SEQ ID NO: 1120923 - protein, 21 aa, Mycobacterium
TLVTIPRRPFAWREFLEQSWF

SEQ ID NO: 1120924 - protein, 19 aa, Mycobacterium
TNLEILFDADLAHRPALEH

SEQ ID NO: 1120925 - protein, 22 aa, Mycobacterium
TNLELYLIFPLNNEESTISLVR

SEQ ID NO: 1120926 - protein, 22 aa, Mycobacterium
TNLRCMLSRSCIADAYRSAVPE

SEQ ID NO: 1120927 - protein, 18 aa, Mycobacterium
TPALPVPFPRTGQGGEPR

SEQ ID NO: 1120928 - protein, 19 aa, Mycobacterium
TPKMMAFNFVVALLTSTVL

SEQ ID NO: 1120929 - protein, 24 aa, Mycobacterium
TPPYKLAGLILLVVFAVIATLVAF

SEQ ID NO: 1120930 - protein, 18 aa, Mycobacterium
TPTDFWLSAYWLMLCGML

SEQ ID NO: 1120931 - protein, 19 aa, Mycobacterium
TPVQAGRNIGRIVAYVVLP

SEQ ID NO: 1120932 - protein, 17 aa, Mycobacterium
TQVLIGLMCVALVVYFL

SEQ ID NO: 1120933 - protein, 21 aa, Mycobacterium
TRAVPPRRRWTATLETSVALR

SEQ ID NO: 1120934 - protein, 19 aa, Mycobacterium
TRGAGFWGPPVRIGAPPDI

SEQ ID NO: 1120935 - protein, 22 aa, Mycobacterium
TRGKARRGMRLEQERMLLESFE

SEQ ID NO: 1120936 - protein, 19 aa, Mycobacterium
TRIASWRLLLGNPVTVVSA

SEQ ID NO: 1120937 - protein, 26 aa, Mycobacterium
TRIVRRSNALLGYAYGRRLEYSEVMS

SEQ ID NO: 1120938 - protein, 17 aa, Mycobacterium
TRLSGLLDTSGLPEVLE

SEQ ID NO: 1120939 - protein, 25 aa, Mycobacterium
TRTVGRLAVRQVRRGTLIVAGVAAG

SEQ ID NO: 1120940 - protein, 18 aa, Mycobacterium
TSAMNRFRRDFLAAYMSA

SEQ ID NO: 1120941 - protein, 19 aa, Mycobacterium
TSIHCIHVLIGFVVLGVVV

SEQ ID NO: 1120942 - protein, 23 aa, Mycobacterium
TSYRADALLVEALDAMTEAVDAA

SEQ ID NO: 1120943 - protein, 17 aa, Mycobacterium
TSYTFYDYARGWPLALL

SEQ ID NO: 1120944 - protein, 18 aa, Mycobacterium
TTMIRSGVTFDVAGAILI

SEQ ID NO: 1120945 - protein, 17 aa, Mycobacterium
TTPLFAFLFLVALGVDY

SEQ ID NO: 1120946 - protein, 29 aa, Mycobacterium
TVAAAFRRVVLPLLWPGIVAALLVVFFLS

SEQ ID NO: 1120947 - protein, 17 aa, Mycobacterium
TVADAWRILFMADAARS

SEQ ID NO: 1120948 - protein, 23 aa, Mycobacterium
TVATQCARRGFNVVWIDPKGFDS

SEQ ID NO: 1120949 - protein, 23 aa, Mycobacterium
TVDDPRYVIGIMMDAPHRAADGS

SEQ ID NO: 1120950 - protein, 19 aa, Mycobacterium
TVDGLGCYGAPERALRVMR

SEQ ID NO: 1120951 - protein, 18 aa, Mycobacterium
TVFTMRIAAAIGFLQMKR

SEQ ID NO: 1120952 - protein, 17 aa, Mycobacterium
TVGGLVAFELGRVPLPG

SEQ ID NO: 1120953 - protein, 25 aa, Mycobacterium
TVHPRRLTPWVAIVFTTLIAFGLIF

SEQ ID NO: 1120954 - protein, 37 aa, Mycobacterium
TVIALVALGWYYLRVPSLMGIGQYKLYAELPRSGGLY

SEQ ID NO: 1120955 - protein, 25 aa, Mycobacterium
TVIGLVVVCSLTFAGAFRRDVPVML

SEQ ID NO: 1120956 - protein, 21 aa, Mycobacterium
TVILRRRGYTVAAGRMGVATT

SEQ ID NO: 1120957 - protein, 26 aa, Mycobacterium
TVISVIVAICLRQFVASWENRRLMRM

SEQ ID NO: 1120958 - protein, 27 aa, Mycobacterium
TVLIAGGLGWVLAGPAIRPLRKLTEQT

SEQ ID NO: 1120959 - protein, 23 aa, Mycobacterium
TVLIALAACAGFIKFNYDDRKAL

SEQ ID NO: 1120960 - protein, 18 aa, Mycobacterium
TVLLEFAIQIARIHDKRK

SEQ ID NO: 1120961 - protein, 18 aa, Mycobacterium
TVLTAGWLLGGTVGVGTV

SEQ ID NO: 1120962 - protein, 27 aa, Mycobacterium
TVLVAIPFTVLVSFTLNILLRELGAAD

SEQ ID NO: 1120963 - protein, 23 aa, Mycobacterium
TVPGALSAIVLWSVTSVGVVLAA

SEQ ID NO: 1120964 - protein, 24 aa, Mycobacterium
TVPMCLLSVLLVVNLWTGYFPTAQ

SEQ ID NO: 1120965 - protein, 23 aa, Mycobacterium
TVSRFRPTVVVQREAAWLIKSLY

SEQ ID NO: 1120966 - protein, 23 aa, Mycobacterium
TVTRKGRSQGVFFLFASQTLDEG

SEQ ID NO: 1120967 - protein, 17 aa, Mycobacterium
TVVMPRLSRNAAADDIP

SEQ ID NO: 1120968 - protein, 27 aa, Mycobacterium
TVVSPRAGLVMETEAKVKYRGIQIGEV

SEQ ID NO: 1120969 - protein, 17 aa, Mycobacterium
TWDGGEWTGSHRAVTPG

SEQ ID NO: 1120970 - protein, 19 aa, Mycobacterium
TYFKYRDARRYDLIGRIVY

SEQ ID NO: 1120971 - protein, 19 aa, Mycobacterium
TYSGFTIVKTFGHRAAAQE

SEQ ID NO: 1120972 - protein, 23 aa, Mycobacterium
VAACAACGLVYELALLTLSSTIH

SEQ ID NO: 1120973 - protein, 29 aa, Mycobacterium
VAACVAFWFLWPLLRAVIRLARRHRHRRR

SEQ ID NO: 1120974 - protein, 20 aa, Mycobacterium
VAADAPWLVQVRLNGQLLDS

SEQ ID NO: 1120975 - protein, 26 aa, Mycobacterium
VAAITSRLPLVLGLIAVSTFCLLFLL

SEQ ID NO: 1120976 - protein, 17 aa, Mycobacterium
VAAKLYPLLLLVPLALL

SEQ ID NO: 1120977 - protein, 26 aa, Mycobacterium
VAALLRRLHFYAGVLVGPFLLIAAVS

SEQ ID NO: 1120978 - protein, 19 aa, Mycobacterium
VAASFGWAMIQSGTNPTTA

SEQ ID NO: 1120979 - protein, 24 aa, Mycobacterium
VAASSRGAGAMGFTGTAPGAADAR

SEQ ID NO: 1120980 - protein, 19 aa, Mycobacterium
VAASVCLVTACSGGAAPPA

SEQ ID NO: 1120981 - protein, 26 aa, Mycobacterium
VAAVTMGALTSWLGFQTHQAHQASEQ

SEQ ID NO: 1120982 - protein, 29 aa, Mycobacterium
VAGESGLRSSSFVFRHRAGTAVMLVLLLV

SEQ ID NO: 1120983 - protein, 23 aa, Mycobacterium
VAHLCFLAALVPLAARSAPRSVA

SEQ ID NO: 1120984 - protein, 19 aa, Mycobacterium
VAIALKLTPAVFLLYFLLR

SEQ ID NO: 1120985 - protein, 25 aa, Mycobacterium
VAIHLLVSMAMVWLSVLLFVKIGEP

SEQ ID NO: 1120986 - protein, 18 aa, Mycobacterium
VAILGGRPAMISAATGAV

SEQ ID NO: 1120987 - protein, 26 aa, Mycobacterium
VALLTTVIFAIRWRRDEESESKKREA

SEQ ID NO: 1120988 - protein, 18 aa, Mycobacterium
VALVVGLVRYRRRRIRLS

SEQ ID NO: 1120989 - protein, 17 aa, Mycobacterium
VANMSIFALFVLVTLFI

SEQ ID NO: 1120990 - protein, 25 aa, Mycobacterium
VAPRRWPRALPIAAAVTVAVLAAAG

SEQ ID NO: 1120991 - protein, 20 aa, Mycobacterium
VAVGAGWLYSLGVTLTGGGE

SEQ ID NO: 1120992 - protein, 26 aa, Mycobacterium
VAVGLAYPVLIWLVAQLPGLRDQADG

SEQ ID NO: 1120993 - protein, 17 aa, Mycobacterium
VAVLAWVNALAIFGDDV

SEQ ID NO: 1120994 - protein, 17 aa, Mycobacterium
VAVPGAAGILMLTGLGG

SEQ ID NO: 1120995 - protein, 22 aa, Mycobacterium
VAVTMCAIGTWAAFSLNTTVTY

SEQ ID NO: 1120996 - protein, 20 aa, Mycobacterium
VAVVALVFWILASRGIAGGQ

SEQ ID NO: 1120997 - protein, 19 aa, Mycobacterium
VCAVVDFSAYLGYHVGLFY

SEQ ID NO: 1120998 - protein, 25 aa, Mycobacterium
VCSAGYAGWAWLQPGSFRAWVTEPV

SEQ ID NO: 1120999 - protein, 20 aa, Mycobacterium
VCYAWPFYALVDMGSVPLLT

SEQ ID NO: 1121000 - protein, 20 aa, Mycobacterium
VDAAARCLLAVVGAAVVIGT

SEQ ID NO: 1121001 - protein, 22 aa, Mycobacterium
VDEMGEVIGLAFHLAAVAFLLL

SEQ ID NO: 1121002 - protein, 18 aa, Mycobacterium
VDFLDRRGAPRGGAVALV

SEQ ID NO: 1121003 - protein, 22 aa, Mycobacterium
VDGKAAYVLIRIAGDSGQLRAN

SEQ ID NO: 1121004 - protein, 18 aa, Mycobacterium
VDGRFYRTLIPVIDARLA

SEQ ID NO: 1121005 - protein, 19 aa, Mycobacterium
VDLGEGFAMPGAESSEQML

SEQ ID NO: 1121006 - protein, 18 aa, Mycobacterium
VDLLSARHDLGFVTLPVL

SEQ ID NO: 1121007 - protein, 27 aa, Mycobacterium
VDPAPRPRRRLGLLLSVAAVVLVLDVV

SEQ ID NO: 1121008 - protein, 18 aa, Mycobacterium
VDVNRMTDIYAWADPVLR

SEQ ID NO: 1121009 - protein, 32 aa, Mycobacterium
VDYPASFWPIPLPGWCPGLTCDTWNKSVGEGV

SEQ ID NO: 1121010 - protein, 23 aa, Mycobacterium
VEADLPAAYCVIGRPHAIVVTSA

SEQ ID NO: 1121011 - protein, 17 aa, Mycobacterium
VEGPPGLRRAIGNVVAL

SEQ ID NO: 1121012 - protein, 18 aa, Mycobacterium
VEGVGRFSQTLGERDAEL

SEQ ID NO: 1121013 - protein, 20 aa, Mycobacterium
VEIRAAALVTEGADGEATVT

SEQ ID NO: 1121014 - protein, 24 aa, Mycobacterium
VELDGTRVLVDFDVDENVHLGELT

SEQ ID NO: 1121015 - protein, 28 aa, Mycobacterium
VETTLEMDITGWKVSTVVPVSTPADPAG

SEQ ID NO: 1121016 - protein, 22 aa, Mycobacterium
VEYVIPLPRAWLLTSAMLVGAA

SEQ ID NO: 1121017 - protein, 20 aa, Mycobacterium
VFGAAMATYFKYRDARRYDL

SEQ ID NO: 1121018 - protein, 23 aa, Mycobacterium
VFSACGDFLLAIPWWEPSFVLGL

SEQ ID NO: 1121019 - protein, 31 aa, Mycobacterium
VFTWLRKRSGSLLAPIALHWSLNGMGALAAA

SEQ ID NO: 1121020 - protein, 19 aa, Mycobacterium
VGAIFVWLGMVLAISFLEA

SEQ ID NO: 1121021 - protein, 18 aa, Mycobacterium
VGAMSTVILVIWFVIGAV

SEQ ID NO: 1121022 - protein, 19 aa, Mycobacterium
VGARRWKAAVFSAVVFAGT

SEQ ID NO: 1121023 - protein, 21 aa, Mycobacterium
VGEARSFALLERFELQRWADA

SEQ ID NO: 1121024 - protein, 18 aa, Mycobacterium
VGFDCSGLTRFAFAGVGV

SEQ ID NO: 1121025 - protein, 19 aa, Mycobacterium
VGIGLAWGRGGMLVLGQGV

SEQ ID NO: 1121026 - protein, 17 aa, Mycobacterium
VGLGWALLISLATFVLG

SEQ ID NO: 1121027 - protein, 20 aa, Mycobacterium
VGLIKRWPHAAGVGTPPPPQ

SEQ ID NO: 1121028 - protein, 27 aa, Mycobacterium
VGLWLASTFAAAIAFGAIALIVPGTGT

SEQ ID NO: 1121029 - protein, 27 aa, Mycobacterium
VGLWLLCAGCAVLAFGTVTPVAVAGFW

SEQ ID NO: 1121030 - protein, 17 aa, Mycobacterium
VGMVLFWGLIIVGIVAL

SEQ ID NO: 1121031 - protein, 17 aa, Mycobacterium
VGPTVAVAVPWLTELHR

SEQ ID NO: 1121032 - protein, 24 aa, Mycobacterium
VGRVLNRWGTPFFFQQAAGAFIAT

SEQ ID NO: 1121033 - protein, 26 aa, Mycobacterium
VGTSAAMGWRLRPRRDVRAAVDRAHD

SEQ ID NO: 1121034 - protein, 17 aa, Mycobacterium
VGVVLFAGMLGRPAEDR

SEQ ID NO: 1121035 - protein, 24 aa, Mycobacterium
VHERAAEVLRGWNTRRRNSAWEQL

SEQ ID NO: 1121036 - protein, 23 aa, Mycobacterium
VHHSITRFYGLNGLMKHPLHQSV

SEQ ID NO: 1121037 - protein, 17 aa, Mycobacterium
VHSSRWWWSGLLVGLAA

SEQ ID NO: 1121038 - protein, 25 aa, Mycobacterium
VIACGALLVWFWPRLLADGMAVPVT

SEQ ID NO: 1121039 - protein, 20 aa, Mycobacterium
VIATLILRGRHDRLPSLSEP

SEQ ID NO: 1121040 - protein, 24 aa, Mycobacterium
VIGILCFIGLFGVLDALLPVPAIV

SEQ ID NO: 1121041 - protein, 27 aa, Mycobacterium
VIHYKVELFRLVAQMSLGVGALAVVGG

SEQ ID NO: 1121042 - protein, 19 aa, Mycobacterium
VIIAVAWMLAMSINRARSP

SEQ ID NO: 1121043 - protein, 22 aa, Mycobacterium
VIPFLIISVLFYFTVVVQEQMV

SEQ ID NO: 1121044 - protein, 18 aa, Mycobacterium
VIVGRGLQGFGMPIIPLG

SEQ ID NO: 1121045 - protein, 22 aa, Mycobacterium
VIVTGFGWRAVFLALAVLNLAT

SEQ ID NO: 1121046 - protein, 32 aa, Mycobacterium
VIYDIALWAVPFGLIGGRLYHVITDWQTYFGP

SEQ ID NO: 1121047 - protein, 17 aa, Mycobacterium
VKAALFGLIAGLVACYR

SEQ ID NO: 1121048 - protein, 17 aa, Mycobacterium
VKKELFFRAPESRQFLR

SEQ ID NO: 1121049 - protein, 21 aa, Mycobacterium
VKLRTGAGLWRGGRNGHGDGN

SEQ ID NO: 1121050 - protein, 23 aa, Mycobacterium
VLACPVWLHQVWAFITPGLYRNE

SEQ ID NO: 1121051 - protein, 19 aa, Mycobacterium
VLDRIAYRTTIFAFPTFGF

SEQ ID NO: 1121052 - protein, 18 aa, Mycobacterium
VLEGFDFGVGMLMAPMGI

SEQ ID NO: 1121053 - protein, 23 aa, Mycobacterium
VLEPVRLILRVRLRRRPRPDPDA

SEQ ID NO: 1121054 - protein, 21 aa, Mycobacterium
VLGWSMRWRSPLAWAAAIVLV

SEQ ID NO: 1121055 - protein, 18 aa, Mycobacterium
VLLALGWSVGQFGVNGVA

SEQ ID NO: 1121056 - protein, 19 aa, Mycobacterium
VLLLAGLIVGWAGGPGPVT

SEQ ID NO: 1121057 - protein, 18 aa, Mycobacterium
VLLPQWRVTWVLIGVLTA

SEQ ID NO: 1121058 - protein, 24 aa, Mycobacterium
VLLVAVICTLVILGGGDSGSVSAT

SEQ ID NO: 1121059 - protein, 22 aa, Mycobacterium
VLPALLRLFGKKLFWPLIPKEG

SEQ ID NO: 1121060 - protein, 25 aa, Mycobacterium
VLPEVPSDLPLPALLSPDATPPATL

SEQ ID NO: 1121061 - protein, 17 aa, Mycobacterium
VLPQAMRVIIPPTGNEI

SEQ ID NO: 1121062 - protein, 24 aa, Mycobacterium
VLRGSWLGHPVHPLLVTLPIGTWM

SEQ ID NO: 1121063 - protein, 17 aa, Mycobacterium
VLRPEIAALSMSGSSFI

SEQ ID NO: 1121064 - protein, 24 aa, Mycobacterium
VLRRPQFRALWVFVLIPVLILLAV

SEQ ID NO: 1121065 - protein, 18 aa, Mycobacterium
VLRSVLHGLDLEEATLNR

SEQ ID NO: 1121066 - protein, 24 aa, Mycobacterium
VLSLSVPGTVGFGVPNPMGDAPNE

SEQ ID NO: 1121067 - protein, 36 aa, Mycobacterium
VLTVPLSLLAIRWITRRSQRLFVAQWRNTGRLNAHI

SEQ ID NO: 1121068 - protein, 17 aa, Mycobacterium
VLVGLILGAMVTFILEK

SEQ ID NO: 1121069 - protein, 17 aa, Mycobacterium
VLVPALMAMFDRWNWWL

SEQ ID NO: 1121070 - protein, 26 aa, Mycobacterium
VLVVGWRGAGWWRRAVSVATVPMCLL

SEQ ID NO: 1121071 - protein, 27 aa, Mycobacterium
VMALIGWASGLGFGWLFTLGTANVVRS

SEQ ID NO: 1121072 - protein, 27 aa, Mycobacterium
VMFILCGYLLWKSGWHVSLSLGGEKQG

SEQ ID NO: 1121073 - protein, 18 aa, Mycobacterium
VMPEGKVDVIARLQAEGK

SEQ ID NO: 1121074 - protein, 17 aa, Mycobacterium
VNADGFQTYSVVVDAEI

SEQ ID NO: 1121075 - protein, 27 aa, Mycobacterium
VNIGRSLPFLILMAAIIPVTRFIVGTT

SEQ ID NO: 1121076 - protein, 27 aa, Mycobacterium
VNPDSLRKAFGWFVLAMSWVILGQEIH

SEQ ID NO: 1121077 - protein, 17 aa, Mycobacterium
VNTEWYNTALGLAMVFG

SEQ ID NO: 1121078 - protein, 17 aa, Mycobacterium
VPAELLEAASLDGASLW

SEQ ID NO: 1121079 - protein, 23 aa, Mycobacterium
VPAEVPVGSALTVAARRDLYGDA

SEQ ID NO: 1121080 - protein, 24 aa, Mycobacterium
VPAVAIVLAALWSMLLALSNHRAR

SEQ ID NO: 1121081 - protein, 20 aa, Mycobacterium
VPAVDIRDGQSLNIGNPDGP

SEQ ID NO: 1121082 - protein, 17 aa, Mycobacterium
VPDGGRFGGGAAVAALL

SEQ ID NO: 1121083 - protein, 20 aa, Mycobacterium
VPIALRIGRGTLRKMRQNLG

SEQ ID NO: 1121084 - protein, 22 aa, Mycobacterium
VPIGVLGTVWAMRSLREVGERS

SEQ ID NO: 1121085 - protein, 22 aa, Mycobacterium
VPPELLFATTLADLGHRDGIRL

SEQ ID NO: 1121086 - protein, 33 aa, Mycobacterium
VPQLIRLALRRDRVRLSVWISVLTLMMVYAPNA

SEQ ID NO: 1121087 - protein, 19 aa, Mycobacterium
VPSAWALNRLTWRPADNSP

SEQ ID NO: 1121088 - protein, 20 aa, Mycobacterium
VPSEVRLDLQVPVVAADAPW

SEQ ID NO: 1121089 - protein, 20 aa, Mycobacterium
VPSPLLKGGLAFVDTPGVGG

SEQ ID NO: 1121090 - protein, 24 aa, Mycobacterium
VPVEPRAGTPVAAFRAALLSIAAN

SEQ ID NO: 1121091 - protein, 17 aa, Mycobacterium
VPVGIVVFFVAAAAIPA

SEQ ID NO: 1121092 - protein, 21 aa, Mycobacterium
VPWNIASAVPLVGDPFTTGQE

SEQ ID NO: 1121093 - protein, 19 aa, Mycobacterium
VPWWWWLPGLGLAGLIAYE

SEQ ID NO: 1121094 - protein, 17 aa, Mycobacterium
VQHYWSLSIEEQFYFVW

SEQ ID NO: 1121095 - protein, 19 aa, Mycobacterium
VQIPREAAGYGFGASVLQS

SEQ ID NO: 1121096 - protein, 19 aa, Mycobacterium
VRARQGPRLAELIRQPDTT

SEQ ID NO: 1121097 - protein, 21 aa, Mycobacterium
VRLWWDKPWPMRIAAIARLPL

SEQ ID NO: 1121098 - protein, 34 aa, Mycobacterium
VRMVLVPAFMRVLGRWNWWSPKPLARLHRRIGLA

SEQ ID NO: 1121099 - protein, 19 aa, Mycobacterium
VRSGDPAAVPASFRAGYGE

SEQ ID NO: 1121100 - protein, 18 aa, Mycobacterium
VRSIPRVMTVSAVLGSLA

SEQ ID NO: 1121101 - protein, 19 aa, Mycobacterium
VRVNSRLTTFGLLGGTVVG

SEQ ID NO: 1121102 - protein, 34 aa, Mycobacterium
VRWPWVVIGVWVAMAVALPLSFPSLGEMAQKHPL

SEQ ID NO: 1121103 - protein, 26 aa, Mycobacterium
VSAAVWLLTELVRLVVVSAQTAALPV

SEQ ID NO: 1121104 - protein, 23 aa, Mycobacterium
VSAFLWSLYALFFGTAGTAGMTH

SEQ ID NO: 1121105 - protein, 23 aa, Mycobacterium
VSAKSAALVGVFISVTTVPAAGF

SEQ ID NO: 1121106 - protein, 25 aa, Mycobacterium
VSDALGGSWEAEWSMASRRVRFVRS

SEQ ID NO: 1121107 - protein, 18 aa, Mycobacterium
VSELDRFETLLSDLLEIS

SEQ ID NO: 1121108 - protein, 22 aa, Mycobacterium
VSEPYPSVWQLLSGAGERLVLY

SEQ ID NO: 1121109 - protein, 21 aa, Mycobacterium
VSFGEYRAELSVKHLVNDGLM

SEQ ID NO: 1121110 - protein, 17 aa, Mycobacterium
VSFMRMFGVGFTLAVLA

SEQ ID NO: 1121111 - protein, 20 aa, Mycobacterium
VSGCVLRTAGFGLLAFADTL

SEQ ID NO: 1121112 - protein, 21 aa, Mycobacterium
VSLIATVGLWLASTFAAAIAF

SEQ ID NO: 1121113 - protein, 18 aa, Mycobacterium
VSLRADRKVVVEFDTDKN

SEQ ID NO: 1121114 - protein, 17 aa, Mycobacterium
VSLRLLVIGSVLGTVIG

SEQ ID NO: 1121115 - protein, 18 aa, Mycobacterium
VSPATGLLLSFATFGVGF

SEQ ID NO: 1121116 - protein, 17 aa, Mycobacterium
VSQFIGRRVHVDIPTSL

SEQ ID NO: 1121117 - protein, 23 aa, Mycobacterium
VTAAAYRPSYSYVRDYISELGAP

SEQ ID NO: 1121118 - protein, 25 aa, Mycobacterium
VTAGRVAALVACRRGIPAAEGSALG

SEQ ID NO: 1121119 - protein, 25 aa, Mycobacterium
VTASMPLVVAFVYHPDKSHPSAGMA

SEQ ID NO: 1121120 - protein, 21 aa, Mycobacterium
VTAVLALLAWRELGRGPGGRD

SEQ ID NO: 1121121 - protein, 24 aa, Mycobacterium
VTDPQFGLDLGFYAFDLPFYRLVL

SEQ ID NO: 1121122 - protein, 24 aa, Mycobacterium
VTEPVRRRWLTWSRYTRTWESTCT

SEQ ID NO: 1121123 - protein, 19 aa, Mycobacterium
VTGTREFHVGIIARLALSG

SEQ ID NO: 1121124 - protein, 17 aa, Mycobacterium
VTIPGAVMLGRYQARRT

SEQ ID NO: 1121125 - protein, 26 aa, Mycobacterium
VTLTAARWGRYPVRANVRVAGRGGLL

SEQ ID NO: 1121126 - protein, 31 aa, Mycobacterium
VTVIVRGYLMWWRRRPTRGAGPVGGPPERGV

SEQ ID NO: 1121127 - protein, 17 aa, Mycobacterium
VTYGWSLMLVVVFAVLY

SEQ ID NO: 1121128 - protein, 23 aa, Mycobacterium
VVAGVGVGWFWILFIAVPAVAIV

SEQ ID NO: 1121129 - protein, 27 aa, Mycobacterium
VVAIVGLGGVAGWLGYRIVDDRRAQAE

SEQ ID NO: 1121130 - protein, 17 aa, Mycobacterium
VVASVFIMRLRTVADRD

SEQ ID NO: 1121131 - protein, 19 aa, Mycobacterium
VVCPGNILSPGPWRRNADP

SEQ ID NO: 1121132 - protein, 18 aa, Mycobacterium
VVEKRAAVDEVLLVLDAT

SEQ ID NO: 1121133 - protein, 20 aa, Mycobacterium
VVGGVSWLLTMSTLNASMQL

SEQ ID NO: 1121134 - protein, 22 aa, Mycobacterium
VVHPGWVDAYWRAFQSGAHTAG

SEQ ID NO: 1121135 - protein, 17 aa, Mycobacterium
VVHRAWVGPMILLVLDD

SEQ ID NO: 1121136 - protein, 17 aa, Mycobacterium
VVIKGSFPTRVGLMTGV

SEQ ID NO: 1121137 - protein, 31 aa, Mycobacterium
VVLALVVCTVLWPPVRWLRGKGVPPAAAVLL

SEQ ID NO: 1121138 - protein, 28 aa, Mycobacterium
VVLAVRPELKPALAQQNWGTLPDLQTNP

SEQ ID NO: 1121139 - protein, 25 aa, Mycobacterium
VVMAVWALMTWPWERMRHPADHRAV

SEQ ID NO: 1121140 - protein, 17 aa, Mycobacterium
VVNELRAAGAEAIQIQG

SEQ ID NO: 1121141 - protein, 19 aa, Mycobacterium
VVSAMPWLVAAAVSGSLAV

SEQ ID NO: 1121142 - protein, 23 aa, Mycobacterium
VVSVGALVMFLAHLVRQIRVESL

SEQ ID NO: 1121143 - protein, 21 aa, Mycobacterium
VVTHITLLIVFSFVAGASADL

SEQ ID NO: 1121144 - protein, 18 aa, Mycobacterium
VVVDAEIPKAANSQSMVF

SEQ ID NO: 1121145 - protein, 26 aa, Mycobacterium
VVVFGEFRFASGNSYHANFTEASRLK

SEQ ID NO: 1121146 - protein, 17 aa, Mycobacterium
VVVQAMLFGALTTTDRA

SEQ ID NO: 1121147 - protein, 22 aa, Mycobacterium
VVVVFLVTWPLVYLASKTTWAA

SEQ ID NO: 1121148 - protein, 17 aa, Mycobacterium
VWASRRLSRHAGDQSDA

SEQ ID NO: 1121149 - protein, 29 aa, Mycobacterium
VWLTRRGRIPHQRWYGWAGVLTIPTPFLA

SEQ ID NO: 1121150 - protein, 18 aa, Mycobacterium
VWTLPRLVGTAWASLNKQ

SEQ ID NO: 1121151 - protein, 18 aa, Mycobacterium
VYHKPHFVQKVVNSQGDV

SEQ ID NO: 1121152 - protein, 22 aa, Mycobacterium
WAEETWGRFWGWDPKETVSFIA

SEQ ID NO: 1121153 - protein, 17 aa, Mycobacterium
WAQSYSIFWDTDVAVSF

SEQ ID NO: 1121154 - protein, 26 aa, Mycobacterium
WASEVAGLVGRWSEWTQLPAVGAVSP

SEQ ID NO: 1121155 - protein, 18 aa, Mycobacterium
WAVVAVVALVFWILASRG

SEQ ID NO: 1121156 - protein, 23 aa, Mycobacterium
WDEIEGLRFSKANWARATRKDGS

SEQ ID NO: 1121157 - protein, 19 aa, Mycobacterium
WDGAPGVRPFLLFGDAPAG

SEQ ID NO: 1121158 - protein, 21 aa, Mycobacterium
WDPKETVSFIAWVAYAAYLHA

SEQ ID NO: 1121159 - protein, 17 aa, Mycobacterium
WDRLGGSAGVLGVPAED

SEQ ID NO: 1121160 - protein, 17 aa, Mycobacterium
WEERRAWRFEGPIIYLV

SEQ ID NO: 1121161 - protein, 18 aa, Mycobacterium
WGPLLSAVAYQVFTNLVG

SEQ ID NO: 1121162 - protein, 17 aa, Mycobacterium
WHSRLAAVLVFVMVVSF

SEQ ID NO: 1121163 - protein, 17 aa, Mycobacterium
WHYNELWLGGAAGPGEK

SEQ ID NO: 1121164 - protein, 18 aa, Mycobacterium
WHYNELWLGGAAGPGEKA

SEQ ID NO: 1121165 - protein, 19 aa, Mycobacterium
WIGAAAALFGYAARRPKAE

SEQ ID NO: 1121166 - protein, 19 aa, Mycobacterium
WIGVVPLLLVVRAAPTART

SEQ ID NO: 1121167 - protein, 23 aa, Mycobacterium
WIPAGAPGSHWTAPVAEEPPSEY

SEQ ID NO: 1121168 - protein, 20 aa, Mycobacterium
WIPIVVVVVVLIAGFTVHRI

SEQ ID NO: 1121169 - protein, 24 aa, Mycobacterium
WIPNRPEYVTAPGLVTAADAGWWP

SEQ ID NO: 1121170 - protein, 19 aa, Mycobacterium
WKATISVAMSNYIEAGSII

SEQ ID NO: 1121171 - protein, 17 aa, Mycobacterium
WLFFGTMPTVWLQERLK

SEQ ID NO: 1121172 - protein, 17 aa, Mycobacterium
WLFMRFSGMVLVFLALG

SEQ ID NO: 1121173 - protein, 17 aa, Mycobacterium
WLGAVGLAAGLSALLLA

SEQ ID NO: 1121174 - protein, 17 aa, Mycobacterium
WLGSPPVRLRRQPTAAD

SEQ ID NO: 1121175 - protein, 25 aa, Mycobacterium
WLITGLRLSIGIALIGAVIAELIAA

SEQ ID NO: 1121176 - protein, 25 aa, Mycobacterium
WLPDTATPTGPGWVAAVRADPGRAG

SEQ ID NO: 1121177 - protein, 25 aa, Mycobacterium
WLPFYHDMGLLLGVFAPILAGWPTV

SEQ ID NO: 1121178 - protein, 17 aa, Mycobacterium
WLPWGAATYLLLREPNT

SEQ ID NO: 1121179 - protein, 25 aa, Mycobacterium
WLQAAGMVAAFIPAMAIVGALVPVH

SEQ ID NO: 1121180 - protein, 19 aa, Mycobacterium
WLRCHPVYVAPRTAKKTDS

SEQ ID NO: 1121181 - protein, 25 aa, Mycobacterium
WLSSELMFFAGLFAMYFTARAQADE

SEQ ID NO: 1121182 - protein, 17 aa, Mycobacterium
WLVLPLTFIILVAVGSD

SEQ ID NO: 1121183 - protein, 20 aa, Mycobacterium
WLVRNGEPFFPSDCLADGGD

SEQ ID NO: 1121184 - protein, 18 aa, Mycobacterium
WMSCAFVVVAGRLRRWAA

SEQ ID NO: 1121185 - protein, 27 aa, Mycobacterium
WNSVAVAVVRRPVPLLIVSLVTLLALS

SEQ ID NO: 1121186 - protein, 18 aa, Mycobacterium
WPAAQRFLYQPSPARDYV

SEQ ID NO: 1121187 - protein, 19 aa, Mycobacterium
WPFLWLVAPIHGWVYFAYL

SEQ ID NO: 1121188 - protein, 19 aa, Mycobacterium
WPSGGFVGVDVFFVLSGFF

SEQ ID NO: 1121189 - protein, 32 aa, Mycobacterium
WPVAGIAVGLGIRFPRRQVWAPAAAVAAITLP

SEQ ID NO: 1121190 - protein, 18 aa, Mycobacterium
WQDVEALLAAGITVISTV

SEQ ID NO: 1121191 - protein, 22 aa, Mycobacterium
WQTRYLPVFGLWAAVALVVIPP

SEQ ID NO: 1121192 - protein, 17 aa, Mycobacterium
WRDEIRQPPMASVVTPR

SEQ ID NO: 1121193 - protein, 21 aa, Mycobacterium
WRPTLLLTRSFIADYVRNPVN

SEQ ID NO: 1121194 - protein, 17 aa, Mycobacterium
WRSANRPEMIAVPVEPR

SEQ ID NO: 1121195 - protein, 20 aa, Mycobacterium
WRSRMAGLQTMALVSTGSAL

SEQ ID NO: 1121196 - protein, 17 aa, Mycobacterium
WRSVREVILPLVSPGIA

SEQ ID NO: 1121197 - protein, 18 aa, Mycobacterium
WSALGFAVFGGGLYIAYA

SEQ ID NO: 1121198 - protein, 20 aa, Mycobacterium
WSDLESLRWPTGAAGVPIGF

SEQ ID NO: 1121199 - protein, 17 aa, Mycobacterium
WSNLDCAPSNETLVKTF

SEQ ID NO: 1121200 - protein, 27 aa, Mycobacterium
WSSELWTSLLWIGRAWVVAAVITLVIL

SEQ ID NO: 1121201 - protein, 19 aa, Mycobacterium
WTGDSVMVFDGSGLRYKYT

SEQ ID NO: 1121202 - protein, 17 aa, Mycobacterium
WTLFGSMFVIVAASFGW

SEQ ID NO: 1121203 - protein, 19 aa, Mycobacterium
WVIVIAVFVLLFGAKKLPD

SEQ ID NO: 1121204 - protein, 17 aa, Mycobacterium
WVTRARRGSRLFTVDPT

SEQ ID NO: 1121205 - protein, 17 aa, Mycobacterium
WVTRQGFRDSGMRLRLR

SEQ ID NO: 1121206 - protein, 17 aa, Mycobacterium
WWLGLYLLARNPRKPVL

SEQ ID NO: 1121207 - protein, 17 aa, Mycobacterium
YAAIALHVATGGLTVGL

SEQ ID NO: 1121208 - protein, 22 aa, Mycobacterium
YADSLGLVFLCAAPIAAVGFLV

SEQ ID NO: 1121209 - protein, 26 aa, Mycobacterium
YAMLTARMIYCLIRGVLAVIASVLAA

SEQ ID NO: 1121210 - protein, 26 aa, Mycobacterium
YASLLRDPRFVVLVLVAALGMSGLFA

SEQ ID NO: 1121211 - protein, 17 aa, Mycobacterium
YATEMVRRLVAAEAVEL

SEQ ID NO: 1121212 - protein, 28 aa, Mycobacterium
YDNYYRPRICNPYRNPLRVVYYYEGAPR

SEQ ID NO: 1121213 - protein, 28 aa, Mycobacterium
YDSGEAELAYLLAGWRDEIRQPPMASVV

SEQ ID NO: 1121214 - protein, 18 aa, Mycobacterium
YDTLKLSLQMFGGSGYLQ

SEQ ID NO: 1121215 - protein, 18 aa, Mycobacterium
YEGFGLPVLEAQILGCPV

SEQ ID NO: 1121216 - protein, 17 aa, Mycobacterium
YGAAFVLMALTLTLALS

SEQ ID NO: 1121217 - protein, 18 aa, Mycobacterium
YGAVIVRGAMNAGWSKLD

SEQ ID NO: 1121218 - protein, 17 aa, Mycobacterium
YGDKLDERGVEYIKYAV

SEQ ID NO: 1121219 - protein, 21 aa, Mycobacterium
YGQFARWAYARGAITRQLNKV

SEQ ID NO: 1121220 - protein, 19 aa, Mycobacterium
YGVPLTVYLLGGWLGSRFP

SEQ ID NO: 1121221 - protein, 26 aa, Mycobacterium
YKLYAELPRSGGLYETANVTYRGTTI

SEQ ID NO: 1121222 - protein, 24 aa, Mycobacterium
YKMAVICLIGAMLFDEGRSDDMKL

SEQ ID NO: 1121223 - protein, 17 aa, Mycobacterium
YKPYPYILAIVDELADL

SEQ ID NO: 1121224 - protein, 25 aa, Mycobacterium
YLAARGMLGVARWNLASSTVALALV

SEQ ID NO: 1121225 - protein, 20 aa, Mycobacterium
YLASLGIGVVVFQWGLGHEI

SEQ ID NO: 1121226 - protein, 18 aa, Mycobacterium
YLHGEPVVDVWTGYSDRR

SEQ ID NO: 1121227 - protein, 17 aa, Mycobacterium
YLLGGWLGSRFPLLRDT

SEQ ID NO: 1121228 - protein, 17 aa, Mycobacterium
YLMLGYVALLFAEALLI

SEQ ID NO: 1121229 - protein, 18 aa, Mycobacterium
YLSQGVFAYICVAYLVSY

SEQ ID NO: 1121230 - protein, 45 aa, Mycobacterium
YNGDIRFIIGFTLLVVFLVLCLLLRAVVAPIYLVASVVLSYVSAI

SEQ ID NO: 1121231 - protein, 18 aa, Mycobacterium
YNIGAIFYGVRWPNPWPN

SEQ ID NO: 1121232 - protein, 25 aa, Mycobacterium
YNVDSFWPRRVVDSALRNYDPEDEE

SEQ ID NO: 1121233 - protein, 19 aa, Mycobacterium
YPAVMLAFGLALAFIPGVP

SEQ ID NO: 1121234 - protein, 17 aa, Mycobacterium
YPYREPLPAPPPGGPPP

SEQ ID NO: 1121235 - protein, 24 aa, Mycobacterium
YQALGAKIPKGVLLYGPPGTGKTL

SEQ ID NO: 1121236 - protein, 17 aa, Mycobacterium
YQALGAKIPRGVLLYGP

SEQ ID NO: 1121237 - protein, 25 aa, Mycobacterium
YQLNLPRLWSGFQIVGDGSGEYDYA

SEQ ID NO: 1121238 - protein, 17 aa, Mycobacterium
YQRQMLWVVAGVFITVM

SEQ ID NO: 1121239 - protein, 19 aa, Mycobacterium
YRGGWLDTVLMRIVDVMFA

SEQ ID NO: 1121240 - protein, 20 aa, Mycobacterium
YRLSDSLFREAKVIIERSHA

SEQ ID NO: 1121241 - protein, 27 aa, Mycobacterium
YRVCVSVLCWLTLTLVHRGRPSAPRRH

SEQ ID NO: 1121242 - protein, 25 aa, Mycobacterium
YSLLYYRLLGVLIALSLVASGAMVF

SEQ ID NO: 1121243 - protein, 19 aa, Mycobacterium
YSPVNFGTRVHRIIRLYTS

SEQ ID NO: 1121244 - protein, 17 aa, Mycobacterium
YTARAGFAASGVLHLLV

SEQ ID NO: 1121245 - protein, 19 aa, Mycobacterium
YVARDAWTSLAMGLVSVGT

SEQ ID NO: 1121246 - protein, 23 aa, Mycobacterium
YVFTRWFPTHFVTLWMVDTPSHH

SEQ ID NO: 1121247 - protein, 20 aa, Mycobacterium
YVLPAVVVQAMLFGALTTTD

SEQ ID NO: 1121248 - protein, 19 aa, Mycobacterium
YVLWWAVLFPAINVPIIAS

SEQ ID NO: 1121249 - protein, 26 aa, Mycobacterium
YVQCTRCGRFICPECMRSAAVGHQCP

SEQ ID NO: 1121250 - protein, 21 aa, Mycobacterium
YVSAIGIGVLFFQFILGQELA

SEQ ID NO: 1121251 - protein, 19 aa, Mycobacterium
YVVGGRPFLTGALNEIRSR

SEQ ID NO: 1121252 - protein, 18 aa, Mycobacterium
YWQAWVFIAVFVVTTLVP

SEQ ID NO: 1121253 - protein, 21 aa, Mycobacterium
YWTRARRILPVAAVVLAATYV

SEQ ID NO: 1121254 - protein, 25 aa, Mycobacterium
AAAADARPVWARALGLRLPPTGASD

SEQ ID NO: 1121255 - protein, 22 aa, Mycobacterium
AAAAFFPLWLLLQIVSGRQGDA

SEQ ID NO: 1121256 - protein, 29 aa, Mycobacterium
AAAAIGIAAYWLGTRRRATGGGSPGDSDS

SEQ ID NO: 1121257 - protein, 18 aa, Mycobacterium
AAAALWACADRLVSFRDL

SEQ ID NO: 1121258 - protein, 27 aa, Mycobacterium
AAAAWDGRYAWLAVVVFVNTLVSLFYY

SEQ ID NO: 1121259 - protein, 36 aa, Mycobacterium
AAADPRAKLLRKRRWALRLGVFFTLSTVLWVGVTAL

SEQ ID NO: 1121260 - protein, 27 aa, Mycobacterium
AAAFIKACKLIYDIVMFFVNNAERIMK

SEQ ID NO: 1121261 - protein, 18 aa, Mycobacterium
AAAGAWAVCAVLMVPLTV

SEQ ID NO: 1121262 - protein, 19 aa, Mycobacterium
AAAITWCVLGDGPGAACGV

SEQ ID NO: 1121263 - protein, 17 aa, Mycobacterium
AAALGIGVLVFQYGFGQ

SEQ ID NO: 1121264 - protein, 25 aa, Mycobacterium
AAALIGWWAARRRLRGGADRRALGS

SEQ ID NO: 1121265 - protein, 24 aa, Mycobacterium
AAALILAVLCFRSLQESILLLAIW

SEQ ID NO: 1121266 - protein, 26 aa, Mycobacterium
AAALIPACILVFARLELLWLGITLGV

SEQ ID NO: 1121267 - protein, 19 aa, Mycobacterium
AAALMTRALRSARRATAAP

SEQ ID NO: 1121268 - protein, 34 aa, Mycobacterium
AAANCSWLFAWHHNRFPLSMLLMLVLLGALIVIY

SEQ ID NO: 1121269 - protein, 25 aa, Mycobacterium
AAAPKRLALVAGLSLVIVLGALSGW

SEQ ID NO: 1121270 - protein, 24 aa, Mycobacterium
AAARPLWFVCMALGLVILGLGLFA

SEQ ID NO: 1121271 - protein, 21 aa, Mycobacterium
AAASIWLVAPCTELFQDGRTD

SEQ ID NO: 1121272 - protein, 17 aa, Mycobacterium
AAASLAQAVGRAVGYDT

SEQ ID NO: 1121273 - protein, 28 aa, Mycobacterium
AAAVILCIFIYWGWDACLAVGEETKDPG

SEQ ID NO: 1121274 - protein, 18 aa, Mycobacterium
AACACVLGATFGIVSEYL

SEQ ID NO: 1121275 - protein, 18 aa, Mycobacterium
AACGVVIAVIGPAVEIAL

SEQ ID NO: 1121276 - protein, 19 aa, Mycobacterium
AADPHGVPGPREWLVSALN

SEQ ID NO: 1121277 - protein, 23 aa, Mycobacterium
AADQPRGAVLVIHENKGLNDYIR

SEQ ID NO: 1121278 - protein, 19 aa, Mycobacterium
AADVLRTAISPSFEEIGKL

SEQ ID NO: 1121279 - protein, 19 aa, Mycobacterium
AAERWFLQRGLPAVLRPGV

SEQ ID NO: 1121280 - protein, 24 aa, Mycobacterium
AAESGWVGLLGWMVVILGFLTITV

SEQ ID NO: 1121281 - protein, 23 aa, Mycobacterium
AAFAVLRTRGRRGGGDELFGVPG

SEQ ID NO: 1121282 - protein, 20 aa, Mycobacterium
AAFLGLLAVWSRQTAPEPYP

SEQ ID NO: 1121283 - protein, 20 aa, Mycobacterium
AAFLLLRFLIALPVGALLGG

SEQ ID NO: 1121284 - protein, 23 aa, Mycobacterium
AAFLLYLRMFFEPMQEISQFFNT

SEQ ID NO: 1121285 - protein, 26 aa, Mycobacterium
AAFPFFEWLVHVCILHWRPRKIGVLR

SEQ ID NO: 1121286 - protein, 33 aa, Mycobacterium
AAFSIGRLTQSWGRRVGLGIGFTAGGVGAAGVV

SEQ ID NO: 1121287 - protein, 17 aa, Mycobacterium
AAFSMATGYTWVLTLVA

SEQ ID NO: 1121288 - protein, 26 aa, Mycobacterium
AAFTWSPSMWYICGAVGTVTALYLAY

SEQ ID NO: 1121289 - protein, 24 aa, Mycobacterium
AAFWCALSLPPLLLGMLGSLAYVA

SEQ ID NO: 1121290 - protein, 19 aa, Mycobacterium
AAGAAVFWVDSMARATYAL

SEQ ID NO: 1121291 - protein, 19 aa, Mycobacterium
AAGAGHRALLRWTTTTVAM

SEQ ID NO: 1121292 - protein, 21 aa, Mycobacterium
AAGARLVLRVTNVDAMPHDLR

SEQ ID NO: 1121293 - protein, 18 aa, Mycobacterium
AAGASWGNAGWVSPALTA

SEQ ID NO: 1121294 - protein, 22 aa, Mycobacterium
AAGDIALCFAFAGPLVAGAAAV

SEQ ID NO: 1121295 - protein, 22 aa, Mycobacterium
AAGFLSGLAMYFQIRSARRADK

SEQ ID NO: 1121296 - protein, 24 aa, Mycobacterium
AAGISVLFPIVWIALASLKTPEQL

SEQ ID NO: 1121297 - protein, 17 aa, Mycobacterium
AAGLGWLPLMRQSPSLV

SEQ ID NO: 1121298 - protein, 22 aa, Mycobacterium
AAGLLARLAADFVRIVVITLVV

SEQ ID NO: 1121299 - protein, 21 aa, Mycobacterium
AAGLSFLPPALAWPLAVVAVA

SEQ ID NO: 1121300 - protein, 25 aa, Mycobacterium
AAGPSFWWGFALVFAGQFLVALVFA

SEQ ID NO: 1121301 - protein, 24 aa, Mycobacterium
AAGRWAPLVTRARRLLEGRSLWTA

SEQ ID NO: 1121302 - protein, 29 aa, Mycobacterium
AAGSIFAALLFWWTWYRLETKRRSDLTTA

SEQ ID NO: 1121303 - protein, 18 aa, Mycobacterium
AAGVFRLGEFLSDAVPPD

SEQ ID NO: 1121304 - protein, 20 aa, Mycobacterium
AAGVGMRLGWSVISPGDRPR

SEQ ID NO: 1121305 - protein, 24 aa, Mycobacterium
AAGVVPEWLAYTLAVVLGVAALGI

SEQ ID NO: 1121306 - protein, 17 aa, Mycobacterium
AAGWALWTGRRWGRGIA

SEQ ID NO: 1121307 - protein, 25 aa, Mycobacterium
AAHDRAVVIPAILVVVLLVLYLLLR

SEQ ID NO: 1121308 - protein, 25 aa, Mycobacterium
AAHLRRRPVDVIPVGRPWMSKQDWG

SEQ ID NO: 1121309 - protein, 18 aa, Mycobacterium
AAIAFLWFIGVMRDVLGD

SEQ ID NO: 1121310 - protein, 20 aa, Mycobacterium
AAIGTWLIVSRCVLPRLGRR

SEQ ID NO: 1121311 - protein, 17 aa, Mycobacterium
AAIIILNLVFTFVYPLI

SEQ ID NO: 1121312 - protein, 17 aa, Mycobacterium
AAIKTNSLLGLKVLEVT

SEQ ID NO: 1121313 - protein, 22 aa, Mycobacterium
AAIPGQLSPAVPGARPPLPPAP

SEQ ID NO: 1121314 - protein, 19 aa, Mycobacterium
AAIRLRGNIDVGMLILAGL

SEQ ID NO: 1121315 - protein, 19 aa, Mycobacterium
AAIRLRGNVDIGMLILTGM

SEQ ID NO: 1121316 - protein, 26 aa, Mycobacterium
AAISGWRSGAPGSLLALVGVALGAAA

SEQ ID NO: 1121317 - protein, 27 aa, Mycobacterium
AALAARKRIAWWILVGYMIAAAGWNIA

SEQ ID NO: 1121318 - protein, 17 aa, Mycobacterium
AALACASNGDFDVWPGP

SEQ ID NO: 1121319 - protein, 17 aa, Mycobacterium
AALAVLVEFRFVYVRTR

SEQ ID NO: 1121320 - protein, 30 aa, Mycobacterium
AALAWSRSIPRVMLLSALIGSAAVYLGLLI

SEQ ID NO: 1121321 - protein, 43 aa, Mycobacterium
AALCPLWPAGAELLIRFTGPEVWWLLGVARWAAGLPIAAVPVP

SEQ ID NO: 1121322 - protein, 24 aa, Mycobacterium
AALFRRVFLINGLIFTLGTLVLAV

SEQ ID NO: 1121323 - protein, 26 aa, Mycobacterium
AALFTLRWELVAFVAPMLGVLCSVGW

SEQ ID NO: 1121324 - protein, 19 aa, Mycobacterium
AALGEFGKEFGIRIRLWDQ

SEQ ID NO: 1121325 - protein, 23 aa, Mycobacterium
AALGWSIYALFWGTAGIPGMTHP

SEQ ID NO: 1121326 - protein, 27 aa, Mycobacterium
AALHARARLVIMPSFDLGEFLGNIAEH

SEQ ID NO: 1121327 - protein, 17 aa, Mycobacterium
AALIALQLVIRAVLAFG

SEQ ID NO: 1121328 - protein, 26 aa, Mycobacterium
AALIFAVVAPVAWPAVLALGTGCLLG

SEQ ID NO: 1121329 - protein, 32 aa, Mycobacterium
AALIGAALLVWRLRWAAQPFWLSPAIFAVTAG

SEQ ID NO: 1121330 - protein, 32 aa, Mycobacterium
AALIGICVVELWRGRRHFAPRTTLAVMSAGTG

SEQ ID NO: 1121331 - protein, 20 aa, Mycobacterium
AALLMKEMIENTAALLVVGS

SEQ ID NO: 1121332 - protein, 20 aa, Mycobacterium
AALLMKEMIENTAAVLVVGG

SEQ ID NO: 1121333 - protein, 35 aa, Mycobacterium
AALLYIGVALGWPLWWVSVCSVLCVLVAEGVVVNF

SEQ ID NO: 1121334 - protein, 28 aa, Mycobacterium
AALPRPGRRPGRPRPGGGAIAVLAGAAV

SEQ ID NO: 1121335 - protein, 18 aa, Mycobacterium
AALPSCWAASLITATWLA

SEQ ID NO: 1121336 - protein, 21 aa, Mycobacterium
AALPWHSWADLGWSAVALAVC

SEQ ID NO: 1121337 - protein, 17 aa, Mycobacterium
AALRALLVLTVAVGLAY

SEQ ID NO: 1121338 - protein, 17 aa, Mycobacterium
AALRALLVLTVVVGLAY

SEQ ID NO: 1121339 - protein, 68 aa, Mycobacterium
AALRIWDGGLGIWGAVALGGIGAWIACRRRGIPLPAFGDAIAPGIVLAQAIGRLGNYFNQELFGRETT

SEQ ID NO: 1121340 - protein, 17 aa, Mycobacterium
AALRRARLDDVVAAMPD

SEQ ID NO: 1121341 - protein, 18 aa, Mycobacterium
AALRRVATLVARGAPLSE

SEQ ID NO: 1121342 - protein, 19 aa, Mycobacterium
AALSLCFVNLPGQFVGPLG

SEQ ID NO: 1121343 - protein, 30 aa, Mycobacterium; identical to SEQ ID NO: 297632

SEQ ID NO: 1121344 - protein, 28 aa, Mycobacterium
AALTGTPAWEMFKPWSVVSIAVAIVLAY

SEQ ID NO: 1121345 - protein, 33 aa, Mycobacterium
AALVPTLAHFRGWLQPMSFVWDGLPSDRPFFLF

SEQ ID NO: 1121346 - protein, 26 aa, Mycobacterium
AALVRSRFPDLTARQVIERLTGTAQS

SEQ ID NO: 1121347 - protein, 17 aa, Mycobacterium
AALVVGLAVRWSVGTWL

SEQ ID NO: 1121348 - protein, 29 aa, Mycobacterium
AALYAHKAFGIHFITFLVAFVVMCSGITS

SEQ ID NO: 1121349 - protein, 24 aa, Mycobacterium
AAMALAYRTRPVFVPTAGPNDPIA

SEQ ID NO: 1121350 - protein, 25 aa, Mycobacterium
AAMLLFPMYFLKSFAYAGLATVALC

SEQ ID NO: 1121351 - protein, 20 aa, Mycobacterium
AAMLVDWFIAYGLAALAMTL

SEQ ID NO: 1121352 - protein, 27 aa, Mycobacterium
AANLILNGSWSWLFFNRHKLAVSAVAA

SEQ ID NO: 1121353 - protein, 18 aa, Mycobacterium
AANQGWQPPTPGAGQQPE

SEQ ID NO: 1121354 - protein, 21 aa, Mycobacterium
AAPAFLVPIAFVLTAPGEYLL

SEQ ID NO: 1121355 - protein, 23 aa, Mycobacterium
AAPAMSGTMGWLAGLWHDVLAAP

SEQ ID NO: 1121356 - protein, 27 aa, Mycobacterium
AAPEPHYRPSAALQDFVRCRDLTCRFP

SEQ ID NO: 1121357 - protein, 25 aa, Mycobacterium
AAPFPNFKNGVGLMLQLPEPAKIGS

SEQ ID NO: 1121358 - protein, 23 aa, Mycobacterium
AAPGENLIALGYDGNPVNALQGE

SEQ ID NO: 1121359 - protein, 22 aa, Mycobacterium
AAPLAALILVYAYRTLNGGFVA

SEQ ID NO: 1121360 - protein, 18 aa, Mycobacterium
AAPLFVLALLWKRFDLSR

SEQ ID NO: 1121361 - protein, 22 aa, Mycobacterium
AAPLGKLGVRDVLFGGKVSYVA

SEQ ID NO: 1121362 - protein, 22 aa, Mycobacterium
AAPLLRTALRLSIIVAVVAAVV

SEQ ID NO: 1121363 - protein, 17 aa, Mycobacterium
AAPLPIAVAEYDPATGT

SEQ ID NO: 1121364 - protein, 20 aa, Mycobacterium
AAPPPLRLVFARFVGGVLAI

SEQ ID NO: 1121365 - protein, 18 aa, Mycobacterium
AAPPRPRTLGVAASASLL

SEQ ID NO: 1121366 - protein, 21 aa, Mycobacterium
AAPPSGDRLPAFVAPRNLGAN

SEQ ID NO: 1121367 - protein, 18 aa, Mycobacterium
AAPPWAAARCTAADVEGG

SEQ ID NO: 1121368 - protein, 23 aa, Mycobacterium
AAPRMLLSIGYGVLFVLAVCRVI

SEQ ID NO: 1121369 - protein, 20 aa, Mycobacterium
AAPRRWVVRVVLLGVATISG

SEQ ID NO: 1121370 - protein, 36 aa, Mycobacterium
AAPSRPKLPRFIRTFAVPIVLAWVAIVALLNTVVPQ

SEQ ID NO: 1121371 - protein, 19 aa, Mycobacterium
AAQCALTFTGAYEVALVVT

SEQ ID NO: 1121372 - protein, 21 aa, Mycobacterium
AAQLRRDGFHIAMLTGDNRTT

SEQ ID NO: 1121373 - protein, 21 aa, Mycobacterium
AAQRIRYLLATARIEPALTVG

SEQ ID NO: 1121374 - protein, 18 aa, Mycobacterium
AAQVQWALVGIAAVTLTI

SEQ ID NO: 1121375 - protein, 20 aa, Mycobacterium
AAQWLRFGSLPGETNTYPNF

SEQ ID NO: 1121376 - protein, 22 aa, Mycobacterium
AAQYPNNVFLKFEDREITYREA

SEQ ID NO: 1121377 - protein, 23 aa, Mycobacterium
AARGEVYGSLAVCFLFSGADIII

SEQ ID NO: 1121378 - protein, 17 aa, Mycobacterium
AARGRVFGFHRAMDTFG

SEQ ID NO: 1121379 - protein, 18 aa, Mycobacterium
AARKACFSAATGTVAICV

SEQ ID NO: 1121380 - protein, 18 aa, Mycobacterium
AARLPARNALGLMFDPVF

SEQ ID NO: 1121381 - protein, 32 aa, Mycobacterium
AARPALSTVERWTVHIPFRVYLGWISVATIAN

SEQ ID NO: 1121382 - protein, 17 aa, Mycobacterium
AARRAGISVDRIRVSVF

SEQ ID NO: 1121383 - protein, 24 aa, Mycobacterium
AARRFSGLALWCFAAMAVSGFVNA

SEQ ID NO: 1121384 - protein, 24 aa, Mycobacterium
AARRFSGLALWCFAAMAVSGIVNA

SEQ ID NO: 1121385 - protein, 18 aa, Mycobacterium
AARRHLGALLALQSEGPY

SEQ ID NO: 1121386 - protein, 21 aa, Mycobacterium
AARSALKFFLYTFLGSLALLV

SEQ ID NO: 1121387 - protein, 24 aa, Mycobacterium
AASAVGLLSVFRRPALARFTTFML

SEQ ID NO: 1121388 - protein, 35 aa, Mycobacterium
AASFPPLSWWICAIAGLALLAWVLADPFTRAVGGF

SEQ ID NO: 1121389 - protein, 17 aa, Mycobacterium
AASKASTVWQRAAVTAV

SEQ ID NO: 1121390 - protein, 20 aa, Mycobacterium
AASKSSTVWQRLAVTTALAV

SEQ ID NO: 1121391 - protein, 24 aa, Mycobacterium
AASLWCGLSDSIGMLVAARVLQGV

SEQ ID NO: 1121392 - protein, 17 aa, Mycobacterium
AASRLAYSYGRDEMIMG

SEQ ID NO: 1121393 - protein, 23 aa, Mycobacterium
AASSYAWFVAAWVLAGVAMSAVF

SEQ ID NO: 1121394 - protein, 23 aa, Mycobacterium
AASWLLLRIPFGTVWSEEATFRA

SEQ ID NO: 1121395 - protein, 17 aa, Mycobacterium
AATAALWASMRERAEPE

SEQ ID NO: 1121396 - protein, 18 aa, Mycobacterium
AATAIIWSAVERLMSPAP

SEQ ID NO: 1121397 - protein, 18 aa, Mycobacterium
AATLAWIAVEKIKDGHVT

SEQ ID NO: 1121398 - protein, 23 aa, Mycobacterium
AATRRYTYGFGRAEDLAGLFVVA

SEQ ID NO: 1121399 - protein, 24 aa, Mycobacterium
AATTLWWMLHAWRSPESLHSTGFR

SEQ ID NO: 1121400 - protein, 17 aa, Mycobacterium
AATVIRLAVSRSREYQA

SEQ ID NO: 1121401 - protein, 29 aa, Mycobacterium
AATVLCLLLAFPLAYVIAFKAGRFKNLIL

SEQ ID NO: 1121402 - protein, 18 aa, Mycobacterium
AATVVLAIVVLRERVTRW

SEQ ID NO: 1121403 - protein, 25 aa, Mycobacterium
AAVAFEIFKFFGSVYLRSVVTGPAG

SEQ ID NO: 1121404 - protein, 19 aa, Mycobacterium
AAVALAALTLVGFVVVVQP

SEQ ID NO: 1121405 - protein, 20 aa, Mycobacterium
AAVAVVWAWDHTGGATGLAI

SEQ ID NO: 1121406 - protein, 24 aa, Mycobacterium
AAVFAICIYGGYFGAAAGVLLLAL

SEQ ID NO: 1121407 - protein, 18 aa, Mycobacterium
AAVFLIATWGLRVYLTWI

SEQ ID NO: 1121408 - protein, 24 aa, Mycobacterium
AAVIAVTAALVWWTSDARATISQP

SEQ ID NO: 1121409 - protein, 25 aa, Mycobacterium
AAVICVLTLTIAGPVRTYFAQRTEM

SEQ ID NO: 1121410 - protein, 24 aa, Mycobacterium
AAVLALPVHVPWLPLAAPLALLAG

SEQ ID NO: 1121411 - protein, 20 aa, Mycobacterium
AAVLRLRSGHPMPTLDDVRA

SEQ ID NO: 1121412 - protein, 24 aa, Mycobacterium
AAVLSRAGATLVDIVPTLVGTACG

SEQ ID NO: 1121413 - protein, 18 aa, Mycobacterium
AAVLTVWSALVAAAVLGA

SEQ ID NO: 1121414 - protein, 18 aa, Mycobacterium
AAVLVWLGVSAWRSAKRP

SEQ ID NO: 1121415 - protein, 19 aa, Mycobacterium
AAVMGAITLLALVTHRRRQ

SEQ ID NO: 1121416 - protein, 29 aa, Mycobacterium
AAVPASFRAGYGEYLRTAGVMQVAAVAVP

SEQ ID NO: 1121417 - protein, 20 aa, Mycobacterium
AAVRRTVMTSGRTVMFSAVI

SEQ ID NO: 1121418 - protein, 20 aa, Mycobacterium
AAVSVPLAFATMLAVSRLTR

SEQ ID NO: 1121419 - protein, 20 aa, Mycobacterium
AAVSWWLIEQPIREWRPAFV

SEQ ID NO: 1121420 - protein, 25 aa, Mycobacterium
AAVTMGALTSWLGFQTHQAHQASEQ

SEQ ID NO: 1121421 - protein, 19 aa, Mycobacterium
AAVVAYCVVFLVLVAVLVI

SEQ ID NO: 1121422 - protein, 20 aa, Mycobacterium
AAVVVFAAFGAVFVIRRVRR

SEQ ID NO: 1121423 - protein, 18 aa, Mycobacterium
AAVYRLSRRGSPWSTRRT

SEQ ID NO: 1121424 - protein, 25 aa, Mycobacterium
AAWARIATDPGQRWRLTVPQKRLSK

SEQ ID NO: 1121425 - protein, 30 aa, Mycobacterium
AAWLRLRDVRWTRPRLSPAATVEIIVTGGV

SEQ ID NO: 1121426 - protein, 22 aa, Mycobacterium
AAYDEALPWPARQALVQLVVRR

SEQ ID NO: 1121427 - protein, 20 aa, Mycobacterium
AAYFLRTYLLLIAISAVLAY

SEQ ID NO: 1121428 - protein, 19 aa, Mycobacterium
AAYSFLRFGGAAVAPWLAG

SEQ ID NO: 1121429 - protein, 19 aa, Mycobacterium
AAYTRRTEIGIMRSVGATR

SEQ ID NO: 1121430 - protein, 23 aa, Mycobacterium
ACAAGTFALIMIFAQLRFAPSNH

SEQ ID NO: 1121431 - protein, 20 aa, Mycobacterium
ACFWHLVDLLWIFLFALLYL

SEQ ID NO: 1121432 - protein, 17 aa, Mycobacterium
ACGVALLVIALVVSGAL

SEQ ID NO: 1121433 - protein, 35 aa, Mycobacterium
ACLHFTRLPYFQSMGFPLAVGMIIVVAAALTLGPA

SEQ ID NO: 1121434 - protein, 17 aa, Mycobacterium
ACMPSFVTTSMFALESS

SEQ ID NO: 1121435 - protein, 18 aa, Mycobacterium
ACPPELAERLAAGPDSAG

SEQ ID NO: 1121436 - protein, 28 aa, Mycobacterium
ACSMAAGRSRWRCAGLSLAASMIAALPW

SEQ ID NO: 1121437 - protein, 17 aa, Mycobacterium
ACSVPVVLVGAAVVRLA

SEQ ID NO: 1121438 - protein, 17 aa, Mycobacterium
ACVPLAMAVTALAGLIL

SEQ ID NO: 1121439 - protein, 21 aa, Mycobacterium
ACYKITRPIDETGLGAAVNYA

SEQ ID NO: 1121440 - protein, 24 aa, Mycobacterium
ADAEAIHGFALLDHARGRRWSAVR

SEQ ID NO: 1121441 - protein, 31 aa, Mycobacterium
ADAELAPPPRWPWVVGIVAIVAAIALVVSVS

SEQ ID NO: 1121442 - protein, 20 aa, Mycobacterium
ADAGALRDLFGAALAIAALA

SEQ ID NO: 1121443 - protein, 34 aa, Mycobacterium
ADAIRYVFRRPFQWREFLEQSWFVAKVSLAPTVL

SEQ ID NO: 1121444 - protein, 18 aa, Mycobacterium
ADAKALMIAPNLVAARFI

SEQ ID NO: 1121445 - protein, 22 aa, Mycobacterium
ADAMPVRVGVGVIGSIVVFALM

SEQ ID NO: 1121446 - protein, 17 aa, Mycobacterium
ADAPPFFILHGRDDSII

SEQ ID NO: 1121447 - protein, 17 aa, Mycobacterium
ADARLLTAAALRLSEAS

SEQ ID NO: 1121448 - protein, 21 aa, Mycobacterium
ADARVTICIDDRDGLAISVLD

SEQ ID NO: 1121449 - protein, 18 aa, Mycobacterium
ADASPWWSGSAVRSQRRR

SEQ ID NO: 1121450 - protein, 21 aa, Mycobacterium
ADAVPRRARLVVGVVGVGLVA

SEQ ID NO: 1121451 - protein, 20 aa, Mycobacterium
ADAWASIMLPPGWTQDKTEK

SEQ ID NO: 1121452 - protein, 24 aa, Mycobacterium
ADDIKAGVIRFVQKPQVAVTLAGV

SEQ ID NO: 1121453 - protein, 27 aa, Mycobacterium
ADFDFKAQGVWSFARPGAPPIKLTESL

SEQ ID NO: 1121454 - protein, 17 aa, Mycobacterium
ADFSRYLPADVSPVRVF

SEQ ID NO: 1121455 - protein, 20 aa, Mycobacterium
ADGFSGPALIVGSPTATSES

SEQ ID NO: 1121456 - protein, 20 aa, Mycobacterium
ADGFSGPALIVGSPTSSEVT

SEQ ID NO: 1121457 - protein, 22 aa, Mycobacterium
ADGGPKYWLLIILAVAIGTAFL

SEQ ID NO: 1121458 - protein, 20 aa, Mycobacterium
ADGPLSVFARLGGVPLVSFT

SEQ ID NO: 1121459 - protein, 19 aa, Mycobacterium
ADGRSGLVVAELTGDENTA

SEQ ID NO: 1121460 - protein, 27 aa, Mycobacterium
ADGSPSWPLTLLVVLSYPSGIDVGLQD

SEQ ID NO: 1121461 - protein, 19 aa, Mycobacterium
ADHAGYMSNYFRWFGSPED

SEQ ID NO: 1121462 - protein, 23 aa, Mycobacterium
ADHPIWIAVPAFAPAIVVAAVVV

SEQ ID NO: 1121463 - protein, 21 aa, Mycobacterium
ADHRRPLKARGIALTYLELLR

SEQ ID NO: 1121464 - protein, 17 aa, Mycobacterium
ADIRGTGRLVIGVNVPY

SEQ ID NO: 1121465 - protein, 17 aa, Mycobacterium
ADKSGLTALTWPVVANF

SEQ ID NO: 1121466 - protein, 19 aa, Mycobacterium
ADLILFFVFFDLSIVAMYF

SEQ ID NO: 1121467 - protein, 21 aa, Mycobacterium
ADLKSGIAEVARRTPGKKVAA

SEQ ID NO: 1121468 - protein, 24 aa, Mycobacterium
ADLLPPLWHLVGWTVGVAAASYLV

SEQ ID NO: 1121469 - protein, 17 aa, Mycobacterium
ADLRMAESISDARRRRR

SEQ ID NO: 1121470 - protein, 31 aa, Mycobacterium
ADLYLTQRFIMRWRIWLSRNLIDDWLDHHAY

SEQ ID NO: 1121471 - protein, 17 aa, Mycobacterium
ADMAVAVNVPDGHGHVY

SEQ ID NO: 1121472 - protein, 31 aa, Mycobacterium
ADMYLTQRFMMRWRVWLSRRFIDDWLGDLAY

SEQ ID NO: 1121473 - protein, 23 aa, Mycobacterium
ADNRNVLLYSWAFVPVLVLVLAT

SEQ ID NO: 1121474 - protein, 24 aa, Mycobacterium
ADPAELGVPQWATEPVEALGSDLR

SEQ ID NO: 1121475 - protein, 24 aa, Mycobacterium
ADPQRVAHRLDWQPWTPAADAGPD

SEQ ID NO: 1121476 - protein, 23 aa, Mycobacterium
ADPSRVRRSGGTGLGLAISIEDA

SEQ ID NO: 1121477 - protein, 20 aa, Mycobacterium
ADPSSGLAIGFVHNRLLTPM

SEQ ID NO: 1121478 - protein, 26 aa, Mycobacterium
ADPVALRLLWTVPLLSFFAAGAGVGV

SEQ ID NO: 1121479 - protein, 30 aa, Mycobacterium
ADPYSQQQPYDWRYAAQPQQQFRAPYDPYR

SEQ ID NO: 1121480 - protein, 19 aa, Mycobacterium
ADQRKAIRRVLAERDFEVV

SEQ ID NO: 1121481 - protein, 19 aa, Mycobacterium
ADRIAKPLVPGIMIVAGLI

SEQ ID NO: 1121482 - protein, 17 aa, Mycobacterium
ADRIAKPLVPGVMIAAA

SEQ ID NO: 1121483 - protein, 22 aa, Mycobacterium
ADRLATTGPYAWVRHPQYDGFL

SEQ ID NO: 1121484 - protein, 21 aa, Mycobacterium
ADRWGWQLFVMYGATEATARM

SEQ ID NO: 1121485 - protein, 17 aa, Mycobacterium
ADSDARNLFLTLLGVSG

SEQ ID NO: 1121486 - protein, 25 aa, Mycobacterium
ADSEHRGRVLASWQPAWLRYSPLSF

SEQ ID NO: 1121487 - protein, 28 aa, Mycobacterium
ADSGLRLNWRSSWMYCIAATTIPWAVLL

SEQ ID NO: 1121488 - protein, 21 aa, Mycobacterium
ADSLGLVFLCAAPIAAVGFLV

SEQ ID NO: 1121489 - protein, 17 aa, Mycobacterium
ADSTYALAWSQDDSPVD

SEQ ID NO: 1121490 - protein, 21 aa, Mycobacterium
ADVARPALLLPDSLRVTAAMS

SEQ ID NO: 1121491 - protein, 17 aa, Mycobacterium
ADVSLSVAFPGEVTSTN

SEQ ID NO: 1121492 - protein, 20 aa, Mycobacterium
AEAACGANLDPGGPPSATYT

SEQ ID NO: 1121493 - protein, 18 aa, Mycobacterium
AEAALGFDLAEPPTIARV

SEQ ID NO: 1121494 - protein, 22 aa, Mycobacterium
AEADYRAALRLNPADAEAIHGF

SEQ ID NO: 1121495 - protein, 18 aa, Mycobacterium
AEAFGRPPYAGADSLQRH

SEQ ID NO: 1121496 - protein, 21 aa, Mycobacterium
AEAKTSVLDDWRVVAANRSFL

SEQ ID NO: 1121497 - protein, 17 aa, Mycobacterium
AEAMAAAAKARARAARL

SEQ ID NO: 1121498 - protein, 18 aa, Mycobacterium
AEANRVREAYVLQYGEIF

SEQ ID NO: 1121499 - protein, 21 aa, Mycobacterium
AEARFRALNLTIVFSGLLFLL

SEQ ID NO: 1121500 - protein, 26 aa, Mycobacterium
AEAVIRRLRVLTIATWIASAVSALFG

SEQ ID NO: 1121501 - protein, 22 aa, Mycobacterium
AEAVLAFALLLLFGFGMIWFGI

SEQ ID NO: 1121502 - protein, 25 aa, Mycobacterium
AEAYAELVAEGWLASRQGAGTWVAD

SEQ ID NO: 1121503 - protein, 19 aa, Mycobacterium
AEDLAGLFVVAMITLSAII

SEQ ID NO: 1121504 - protein, 25 aa, Mycobacterium
AEDRDFYSNPGFSFTGFLRAAKNNI

SEQ ID NO: 1121505 - protein, 25 aa, Mycobacterium
AEEAYRYATAISIAVAIGVAALTAL

SEQ ID NO: 1121506 - protein, 22 aa, Mycobacterium
AEEMFFRGAVYTALLKFHPVIF

SEQ ID NO: 1121507 - protein, 21 aa, Mycobacterium
AEERQIWPALGNIVISVALGL

SEQ ID NO: 1121508 - protein, 20 aa, Mycobacterium
AEFIHVVAITGAVPDVPTIE

SEQ ID NO: 1121509 - protein, 26 aa, Mycobacterium
AEGPKAVLWTSGWTPRFHGETIYLAR

SEQ ID NO: 1121510 - protein, 19 aa, Mycobacterium
AEGQWSGVVLAHLVALVGA

SEQ ID NO: 1121511 - protein, 18 aa, Mycobacterium
AEGTWFARYDELRQQFPW

SEQ ID NO: 1121512 - protein, 17 aa, Mycobacterium
AEIIGALVVGGWLLIAH

SEQ ID NO: 1121513 - protein, 19 aa, Mycobacterium
AEILLPPGVLDDGSVTVQM

SEQ ID NO: 1121514 - protein, 18 aa, Mycobacterium
AEIPSMRVLTAVALLAVV

SEQ ID NO: 1121515 - protein, 19 aa, Mycobacterium
AELHAKLSAMLYGIEAAPN

SEQ ID NO: 1121516 - protein, 21 aa, Mycobacterium
AELHNAWGIDGMAYPWTVASH

SEQ ID NO: 1121517 - protein, 21 aa, Mycobacterium
AELLALFAGAVLRGADLNTLL

SEQ ID NO: 1121518 - protein, 19 aa, Mycobacterium
AELLCGFLDGGKYVRSTYM

SEQ ID NO: 1121519 - protein, 21 aa, Mycobacterium
AELPAAVTATVFGVLAGVAVR

SEQ ID NO: 1121520 - protein, 23 aa, Mycobacterium
AELRVSGRLDGVVAEAQRRQRDW

SEQ ID NO: 1121521 - protein, 26 aa, Mycobacterium
AEMPKRALMWGEWGFVLLFGVLAVAP

SEQ ID NO: 1121522 - protein, 17 aa, Mycobacterium
AEMSRRQLVAFVSHDLR

SEQ ID NO: 1121523 - protein, 23 aa, Mycobacterium
AEPAREVATVLGLDEVYAQQTPA

SEQ ID NO: 1121524 - protein, 17 aa, Mycobacterium
AEPEGAVVLAAAPQRDA

SEQ ID NO: 1121525 - protein, 22 aa, Mycobacterium
AEPRAGTPVAAFRAALLSIAAN

SEQ ID NO: 1121526 - protein, 26 aa, Mycobacterium
AEPRRPSRLGTGWVATICVVLLLLGG

SEQ ID NO: 1121527 - protein, 19 aa, Mycobacterium
AEPSEFLQWGRAGEITLVL

SEQ ID NO: 1121528 - protein, 17 aa, Mycobacterium
AERAVEALMRMSAATAT

SEQ ID NO: 1121529 - protein, 24 aa, Mycobacterium
AERERKRRLYTIIGSAVAAVVVIA

SEQ ID NO: 1121530 - protein, 17 aa, Mycobacterium
AERNPFVIGLAGITVTA

SEQ ID NO: 1121531 - protein, 19 aa, Mycobacterium
AERQRLRDLFGRYVGEDVA

SEQ ID NO: 1121532 - protein, 18 aa, Mycobacterium
AERVARKLAGWSITGTII

SEQ ID NO: 1121533 - protein, 28 aa, Mycobacterium
AERWSSPFWQTWDLLLLWLAQLHGGNGM

SEQ ID NO: 1121534 - protein, 17 aa, Mycobacterium
AESLLIASIPALAGGAA

SEQ ID NO: 1121535 - protein, 22 aa, Mycobacterium
AESSRATALLAQRFDQGDTQLL

SEQ ID NO: 1121536 - protein, 20 aa, Mycobacterium
AETGGPRRATWLVVVVALLV

SEQ ID NO: 1121537 - protein, 22 aa, Mycobacterium
AETLRLRPAAPITGRMTTGPYR

SEQ ID NO: 1121538 - protein, 19 aa, Mycobacterium
AEVAAIPLVAVVLFFVFGG

SEQ ID NO: 1121539 - protein, 25 aa, Mycobacterium
AEVLERWEHVLFPIVLIALGLFILV

SEQ ID NO: 1121540 - protein, 24 aa, Mycobacterium
AEVLKGTQIPGVFAGGAPVSTVTG

SEQ ID NO: 1121541 - protein, 17 aa, Mycobacterium
AEVTGGPAFGADIANSF

SEQ ID NO: 1121542 - protein, 17 aa, Mycobacterium
AEVTNIYGDAGPDIARI

SEQ ID NO: 1121543 - protein, 25 aa, Mycobacterium
AEVVDCAAEHRFEVAESVDMRTFPG

SEQ ID NO: 1121544 - protein, 20 aa, Mycobacterium
AEVVLPELPNGYADATIEGV

SEQ ID NO: 1121545 - protein, 17 aa, Mycobacterium
AEYGDRVNFVLRYFPLR

SEQ ID NO: 1121546 - protein, 23 aa, Mycobacterium
AFAAGALLAWARRRPTLAGVLIG

SEQ ID NO: 1121547 - protein, 26 aa, Mycobacterium
AFALLSLWLTRRGRIPGQRWYGTFGL

SEQ ID NO: 1121548 - protein, 19 aa, Mycobacterium
AFAVLGLRSLYFCLSGLLR

SEQ ID NO: 1121549 - protein, 32 aa, Mycobacterium
AFCPGDHRGAPGFCPNCGAPLEVSPEPEGRRR

SEQ ID NO: 1121550 - protein, 22 aa, Mycobacterium
AFCVAMGALFAIVFAVAYGRVG

SEQ ID NO: 1121551 - protein, 23 aa, Mycobacterium
AFDGWPTFIAFAAAILTYVSVSL

SEQ ID NO: 1121552 - protein, 27 aa, Mycobacterium
AFDLPFYRLMLTYLFAATFLAFIANLL

SEQ ID NO: 1121553 - protein, 17 aa, Mycobacterium
AFDVLAPVAAVAALLYI

SEQ ID NO: 1121554 - protein, 25 aa, Mycobacterium
AFFIAGAVLICLMYVFLQQSLHNRP

SEQ ID NO: 1121555 - protein, 23 aa, Mycobacterium
AFFIYFGVPSALDFRMTALTAGI

SEQ ID NO: 1121556 - protein, 20 aa, Mycobacterium
AFFLYGVAMLYGYAGTLDLR

SEQ ID NO: 1121557 - protein, 22 aa, Mycobacterium
AFGAIVWWMWGAEFAAQYYAGY

SEQ ID NO: 1121558 - protein, 21 aa, Mycobacterium
AFGGFIVPLAYAWSKSQFGNI

SEQ ID NO: 1121559 - protein, 19 aa, Mycobacterium
AFGKVILPLSMPGVLAGSM

SEQ ID NO: 1121560 - protein, 26 aa, Mycobacterium
AFGLLGFAAFQLWMARGLALIVTHSG

SEQ ID NO: 1121561 - protein, 22 aa, Mycobacterium
AFGLVLRPEIAALSMSGSSFIV

SEQ ID NO: 1121562 - protein, 18 aa, Mycobacterium
AFGRKGLPHPSTRVEEMH

SEQ ID NO: 1121563 - protein, 18 aa, Mycobacterium
AFGRPPVRGGMRGLSPVV

SEQ ID NO: 1121564 - protein, 31 aa, Mycobacterium
AFGSARAVAGLGWLRRHTRTIQVLGGVLMIL

SEQ ID NO: 1121565 - protein, 28 aa, Mycobacterium
AFGVLVSGWRGARWWRRTAATLAVPLCV

SEQ ID NO: 1121566 - protein, 27 aa, Mycobacterium
AFIGLPPARFGWWPAAVITAVALLLLV

SEQ ID NO: 1121567 - protein, 17 aa, Mycobacterium
AFLALLVLYFLGFDQGA

SEQ ID NO: 1121568 - protein, 19 aa, Mycobacterium
AFLPPHVIPYFGLIPLALG

SEQ ID NO: 1121569 - protein, 23 aa, Mycobacterium
AFLSWAGFEACASMGEETDDPKR

SEQ ID NO: 1121570 - protein, 18 aa, Mycobacterium
AFLYLVLGGMGVWSKLNS

SEQ ID NO: 1121571 - protein, 27 aa, Mycobacterium
AFMHVLGRWNWWAPKPLARLHERIGFS

SEQ ID NO: 1121572 - protein, 20 aa, Mycobacterium
AFMIGMYAMLAWGFLQILVL

SEQ ID NO: 1121573 - protein, 22 aa, Mycobacterium
AFPRLGMGLTFLVSLTVLGLVY

SEQ ID NO: 1121574 - protein, 21 aa, Mycobacterium
AFSSVFVVGNSLRLRRFKTTS

SEQ ID NO: 1121575 - protein, 18 aa, Mycobacterium
AFSVIAYFHFHKNHPSSA

SEQ ID NO: 1121576 - protein, 23 aa, Mycobacterium
AFVAYCLGVLAFSVWGPFSPALA

SEQ ID NO: 1121577 - protein, 19 aa, Mycobacterium
AFVGLCVYVLILRFTAAQL

SEQ ID NO: 1121578 - protein, 19 aa, Mycobacterium
AGAALRALLELGAREVTVR

SEQ ID NO: 1121579 - protein, 22 aa, Mycobacterium
AGAELRSRFAGAKGGNDRPGAF

SEQ ID NO: 1121580 - protein, 18 aa, Mycobacterium
AGAIRVVEDGVLREDPLI

SEQ ID NO: 1121581 - protein, 25 aa, Mycobacterium
AGAMFIFFGLWTLRGDSLTDEETSR

SEQ ID NO: 1121582 - protein, 18 aa, Mycobacterium
AGAPFVWTLLLAGAVFAL

SEQ ID NO: 1121583 - protein, 20 aa, Mycobacterium
AGAPKYWLLAVMAVAIATAL

SEQ ID NO: 1121584 - protein, 22 aa, Mycobacterium
AGAYVMWGLFPAFFPLLKPAGA

SEQ ID NO: 1121585 - protein, 20 aa, Mycobacterium
AGCFVVRLLADLYLTQRFIM

SEQ ID NO: 1121586 - protein, 22 aa, Mycobacterium
AGEIPMGSWPTVSTFYTTVEIP

SEQ ID NO: 1121587 - protein, 19 aa, Mycobacterium
AGEPSRWSVADGAVIGSVL

SEQ ID NO: 1121588 - protein, 17 aa, Mycobacterium
AGFALAAVLARPVGGAL

SEQ ID NO: 1121589 - protein, 26 aa, Mycobacterium
AGFALGIAMLLGGSWLTWILAAVSSA

SEQ ID NO: 1121590 - protein, 27 aa, Mycobacterium
AGFATDWLGARPVRRFGVRFREQVWPG

SEQ ID NO: 1121591 - protein, 20 aa, Mycobacterium
AGFHDGFFFFAIVLSALSVI

SEQ ID NO: 1121592 - protein, 20 aa, Mycobacterium
AGFQLDWGALVIIALVTLIL

SEQ ID NO: 1121593 - protein, 21 aa, Mycobacterium
AGFRSLIGYIRATFLVALVDA

SEQ ID NO: 1121594 - protein, 18 aa, Mycobacterium
AGFTAVGAALVFAGVGPM

SEQ ID NO: 1121595 - protein, 20 aa, Mycobacterium
AGGAAVFAERAFKRPVVSFL

SEQ ID NO: 1121596 - protein, 20 aa, Mycobacterium
AGGALTMFLWELRLGTSVET

SEQ ID NO: 1121597 - protein, 30 aa, Mycobacterium
AGGRMSAFLRGAWIVGQCIIAVAFGAGLFI

SEQ ID NO: 1121598 - protein, 25 aa, Mycobacterium
AGGRPILRILMRRRQLVGLWPLLAP

SEQ ID NO: 1121599 - protein, 25 aa, Mycobacterium
AGGRYELGETLPLDAGKILGAGLTL

SEQ ID NO: 1121600 - protein, 23 aa, Mycobacterium
AGGSWPKSRIRAVQKATGVTGND

SEQ ID NO: 1121601 - protein, 29 aa, Mycobacterium
AGIRVNSFTSTFVFIGAVVYIMAAPKGRE

SEQ ID NO: 1121602 - protein, 30 aa, Mycobacterium
AGISKSRWLRWPARIYTDIFRGLPEVVIIL

SEQ ID NO: 1121603 - protein, 23 aa, Mycobacterium
AGISPELDAVVLKALAKNPDNRY

SEQ ID NO: 1121604 - protein, 19 aa, Mycobacterium
AGISVDRIRVSVFVVCSSL

SEQ ID NO: 1121605 - protein, 23 aa, Mycobacterium
AGIVGALSFWLSHGAESLTGSSL

SEQ ID NO: 1121606 - protein, 19 aa, Mycobacterium
AGKELSRWIGDARVLTDDY

SEQ ID NO: 1121607 - protein, 19 aa, Mycobacterium
AGKSTFARLVAGYTHPTTG

SEQ ID NO: 1121608 - protein, 24 aa, Mycobacterium
AGLALAYRTRPVFVPTAGPNDPIA

SEQ ID NO: 1121609 - protein, 24 aa, Mycobacterium
AGLARLGSYVAMFFVLRRALPALA

SEQ ID NO: 1121610 - protein, 26 aa, Mycobacterium
AGLAYLVLWLSRWPTRNQSIGFALTI

SEQ ID NO: 1121611 - protein, 20 aa, Mycobacterium
AGLCALALVVAAMWLQHCCR

SEQ ID NO: 1121612 - protein, 19 aa, Mycobacterium
AGLGGWLGWTIPLAVVHWW

SEQ ID NO: 1121613 - protein, 25 aa, Mycobacterium
AGLIGGILWNLLTWLFGIPSSSSHA

SEQ ID NO: 1121614 - protein, 18 aa, Mycobacterium
AGLLEIVLGLLITVGLFT

SEQ ID NO: 1121615 - protein, 32 aa, Mycobacterium
AGLLIRFTGPPLWWLLRVADWAAAVPGASVPV

SEQ ID NO: 1121616 - protein, 26 aa, Mycobacterium
AGLLMTLPALCFAGAGFAAPWLAARV

SEQ ID NO: 1121617 - protein, 17 aa, Mycobacterium
AGLLPQDKVEAVRELEA

SEQ ID NO: 1121618 - protein, 23 aa, Mycobacterium
AGLMLRTDLSWWAALSTNGIYLA

SEQ ID NO: 1121619 - protein, 18 aa, Mycobacterium
AGLNLDPGTKVTYNGVEI

SEQ ID NO: 1121620 - protein, 20 aa, Mycobacterium
AGLQMFGFIGIVLGPVLMIV

SEQ ID NO: 1121621 - protein, 40 aa, Mycobacterium
AGLSLLGWCSFLLLWVLQACVFWRGMESIRKFIDFCGPAV

SEQ ID NO: 1121622 - protein, 24 aa, Mycobacterium
AGLSRFIFATAIVWIVGGVGTWLI

SEQ ID NO: 1121623 - protein, 19 aa, Mycobacterium
AGLSVDWRATVEQAGAQPL

SEQ ID NO: 1121624 - protein, 17 aa, Mycobacterium
AGLVLPLLGAVVIVTVL

SEQ ID NO: 1121625 - protein, 18 aa, Mycobacterium
AGMWLPAHLAWFAGGMAL

SEQ ID NO: 1121626 - protein, 28 aa, Mycobacterium
AGPFFKPYITNLLPGQFIQPFIEAAFSD

SEQ ID NO: 1121627 - protein, 33 aa, Mycobacterium
AGPRRSLREQINWKWVRRGSIIAAAVLILLPLL

SEQ ID NO: 1121628 - protein, 29 aa, Mycobacterium
AGPTCAANLKCLCRKHHLLKTFWTGENGW

SEQ ID NO: 1121629 - protein, 17 aa, Mycobacterium
AGQCVAVTIAIWNPYVA

SEQ ID NO: 1121630 - protein, 25 aa, Mycobacterium
AGQEIPRWLRFVLASDRAGSAWYIG

SEQ ID NO: 1121631 - protein, 22 aa, Mycobacterium
AGRDAFPASFVVKLNDPEQHQA

SEQ ID NO: 1121632 - protein, 18 aa, Mycobacterium
AGREAFSAAMTRGLTSRH

SEQ ID NO: 1121633 - protein, 21 aa, Mycobacterium
AGRIADGWFPLVGPGPALDEA

SEQ ID NO: 1121634 - protein, 23 aa, Mycobacterium
AGRTPLPPRRDWDDESIDADTRH

SEQ ID NO: 1121635 - protein, 23 aa, Mycobacterium
AGSALPLLLLFSVANRSLGDVLT

SEQ ID NO: 1121636 - protein, 25 aa, Mycobacterium
AGSAPKLAALFAVGAFASLGLPGFS

SEQ ID NO: 1121637 - protein, 19 aa, Mycobacterium
AGSFLRRQRQWWVGVMAAA

SEQ ID NO: 1121638 - protein, 20 aa, Mycobacterium
AGSGFLFGPLVGTFVTLGAT

SEQ ID NO: 1121639 - protein, 23 aa, Mycobacterium
AGSGSIAAWMFVQPGLTGLAAAV

SEQ ID NO: 1121640 - protein, 18 aa, Mycobacterium
AGSLPRGAGSRFREAATL

SEQ ID NO: 1121641 - protein, 20 aa, Mycobacterium
AGSPLRYRAGRISDFLRVEG

SEQ ID NO: 1121642 - protein, 17 aa, Mycobacterium
AGSSWLGSPPVRLRRKP

SEQ ID NO: 1121643 - protein, 23 aa, Mycobacterium
AGSWYFWPVWPILGAGVGVLAHA

SEQ ID NO: 1121644 - protein, 23 aa, Mycobacterium
AGSYPLLLVFGFFLGIAGTVFAV

SEQ ID NO: 1121645 - protein, 24 aa, Mycobacterium
AGTPGMKHPFAFTLAPSHGAANIY

SEQ ID NO: 1121646 - protein, 18 aa, Mycobacterium
AGTVAGKPPRTLPGKPGA

SEQ ID NO: 1121647 - protein, 18 aa, Mycobacterium
AGTVERPGAVGLGKIGGT

SEQ ID NO: 1121648 - protein, 26 aa, Mycobacterium
AGVETLRWAGPRVKALLRVLAVTGFL

SEQ ID NO: 1121649 - protein, 17 aa, Mycobacterium
AGVFRWQPVRALTHRGP

SEQ ID NO: 1121650 - protein, 30 aa, Mycobacterium
AGVFTFLIAPMFVRLLKFFPPVVTGTLITI

SEQ ID NO: 1121651 - protein, 25 aa, Mycobacterium
AGVITRLAPLEWIGPAISLVILASA

SEQ ID NO: 1121652 - protein, 20 aa, Mycobacterium
AGVLAPIGIVLPMSVGAIFM

SEQ ID NO: 1121653 - protein, 20 aa, Mycobacterium
AGVLAPIGIVLPMSVGALLM

SEQ ID NO: 1121654 - protein, 21 aa, Mycobacterium
AGVLRRLVARVPRHVPPVTMS

SEQ ID NO: 1121655 - protein, 26 aa, Mycobacterium
AGVMLWLWHWPSRLQSAAFATVTAFS

SEQ ID NO: 1121656 - protein, 23 aa, Mycobacterium
AGVRTIVTPAWFSDYVLTVGAVT

SEQ ID NO: 1121657 - protein, 19 aa, Mycobacterium
AGVTARVVPSNVFAVSSVQ

SEQ ID NO: 1121658 - protein, 27 aa, Mycobacterium
AGVVAYCFLEVWRVQILVYGIVIFLLL

SEQ ID NO: 1121659 - protein, 17 aa, Mycobacterium
AGWLGDVDFTADIRGIT

SEQ ID NO: 1121660 - protein, 18 aa, Mycobacterium
AGWNRIGTQTEFYGRTVR

SEQ ID NO: 1121661 - protein, 19 aa, Mycobacterium
AGYCVGRFFVELMRSDAAT

SEQ ID NO: 1121662 - protein, 18 aa, Mycobacterium
AGYLGLANGLGFLAGAVV

SEQ ID NO: 1121663 - protein, 17 aa, Mycobacterium
AGYWRRGALVMAIGVAV

SEQ ID NO: 1121664 - protein, 20 aa, Mycobacterium
AGYYRGWIDAVLSRVLDVIW

SEQ ID NO: 1121665 - protein, 24 aa, Mycobacterium
AHAFGEGWAFIPLGALLVDFTLTV

SEQ ID NO: 1121666 - protein, 17 aa, Mycobacterium
AHFPSGLTAPARVIAST

SEQ ID NO: 1121667 - protein, 19 aa, Mycobacterium
AHHAGAWLYHCSTMPMALH

SEQ ID NO: 1121668 - protein, 22 aa, Mycobacterium
AHLCFLAALVPLAARSAPRSVA

SEQ ID NO: 1121669 - protein, 21 aa, Mycobacterium
AHLFVVAAIVWWVRQGLQESQ

SEQ ID NO: 1121670 - protein, 22 aa, Mycobacterium
AHLTRLPLRATLVVIAAGAAVR

SEQ ID NO: 1121671 - protein, 20 aa, Mycobacterium
AHLVLRFDQGRWLAIDNGSL

SEQ ID NO: 1121672 - protein, 26 aa, Mycobacterium
AHPPFSVVVRRRWRPAARIETVTGTP

SEQ ID NO: 1121673 - protein, 23 aa, Mycobacterium
AHPYVDIAHRAALLYAFATMLLA

SEQ ID NO: 1121674 - protein, 24 aa, Mycobacterium
AHQLWPHSWPFVAQVLTAILVADF

SEQ ID NO: 1121675 - protein, 21 aa, Mycobacterium
AHRAVPALLVFGFAVMTLTDS

SEQ ID NO: 1121676 - protein, 21 aa, Mycobacterium
AHSLIPIVIGYVFAHYLTYLV

SEQ ID NO: 1121677 - protein, 17 aa, Mycobacterium
AHTRVPVITTRQPALDA

SEQ ID NO: 1121678 - protein, 21 aa, Mycobacterium
AHTSIPFLISMQGVGQQQNMK

SEQ ID NO: 1121679 - protein, 17 aa, Mycobacterium
AHVHLTLLGWVGLTVLG

SEQ ID NO: 1121680 - protein, 25 aa, Mycobacterium
AHVSDIRSAMNWQRPQLDSTLAGHG

SEQ ID NO: 1121681 - protein, 20 aa, Mycobacterium
AHYFILIGLFGIFVAGCTAM

SEQ ID NO: 1121682 - protein, 20 aa, Mycobacterium
AIAAGVCWAIYILLTQRVGD

SEQ ID NO: 1121683 - protein, 19 aa, Mycobacterium
AIAALWLRDHWPTRVQSLV

SEQ ID NO: 1121684 - protein, 19 aa, Mycobacterium
AIAAYFYVRVIMLMFFTDR

SEQ ID NO: 1121685 - protein, 17 aa, Mycobacterium
AIAAYFYVRVIVLMFFT

SEQ ID NO: 1121686 - protein, 18 aa, Mycobacterium
AIADRPGIAPGFTAGALA

SEQ ID NO: 1121687 - protein, 17 aa, Mycobacterium
AIAEPVAALAERYNETA

SEQ ID NO: 1121688 - protein, 29 aa, Mycobacterium
AIAITRWNVPFARLFDQLTIIPAYIPAFV

SEQ ID NO: 1121689 - protein, 18 aa, Mycobacterium
AIALKLTPAVFLLYFLLR

SEQ ID NO: 1121690 - protein, 19 aa, Mycobacterium
AIARLPLQIPMITQALKIY

SEQ ID NO: 1121691 - protein, 27 aa, Mycobacterium
AIARPEPLARWLAWSTTLYLKVFGWLI

SEQ ID NO: 1121692 - protein, 24 aa, Mycobacterium
AIATGCPFCRVMMTDGVDDVSAAR

SEQ ID NO: 1121693 - protein, 18 aa, Mycobacterium
AIATGFLVERIIPYDPEW

SEQ ID NO: 1121694 - protein, 19 aa, Mycobacterium
AIATGFLVERIIPYDPEWN

SEQ ID NO: 1121695 - protein, 20 aa, Mycobacterium
AIAVILSFLASQFVTVMLFG

SEQ ID NO: 1121696 - protein, 18 aa, Mycobacterium
AIAVLLILRSRNWLLDES

SEQ ID NO: 1121697 - protein, 20 aa, Mycobacterium
AICTYVIGFRFYARLIEMKI

SEQ ID NO: 1121698 - protein, 17 aa, Mycobacterium
AIDYLWRLSDSFAGTLA

SEQ ID NO: 1121699 - protein, 26 aa, Mycobacterium
AIEHPLWSAFVWRNEVSDTFVETVAA

SEQ ID NO: 1121700 - protein, 27 aa, Mycobacterium
AIEKGVEIFKLIATGGVAALWQMLIEK

SEQ ID NO: 1121701 - protein, 18 aa, Mycobacterium
AIELAAWAGWDNDLWASL

SEQ ID NO: 1121702 - protein, 26 aa, Mycobacterium
AIGAAIPWMFAVAAQAVWFMVDGRVP

SEQ ID NO: 1121703 - protein, 18 aa, Mycobacterium
AIGIVCYAWPFYALVDMG

SEQ ID NO: 1121704 - protein, 20 aa, Mycobacterium
AIGVVVYFLYGRRHSLVGRR

SEQ ID NO: 1121705 - protein, 26 aa, Mycobacterium
AIGYSLGVFAVWLVRFMRSKDTSPPA

SEQ ID NO: 1121706 - protein, 31 aa, Mycobacterium
AIHHLPARRDGRFLVALGMGGMGYSFGAGIG

SEQ ID NO: 1121707 - protein, 20 aa, Mycobacterium
AIIPVTRFLVGTTIGIAAAI

SEQ ID NO: 1121708 - protein, 24 aa, Mycobacterium
AIIYACGSIGRVILASAATVALAL

SEQ ID NO: 1121709 - protein, 26 aa, Mycobacterium
AILAVCVPLGWLAGVAIKSVLVNLIP

SEQ ID NO: 1121710 - protein, 24 aa, Mycobacterium
AILIATSISMVFGELVPKNLAVAR

SEQ ID NO: 1121711 - protein, 24 aa, Mycobacterium
AILLAMYWPLGVVVLVSIVPITLT

SEQ ID NO: 1121712 - protein, 21 aa, Mycobacterium
AILLLSGRRSDRWGHLLGTAA

SEQ ID NO: 1121713 - protein, 20 aa, Mycobacterium
AIMPFTRFITGTNIGIAAAV

SEQ ID NO: 1121714 - protein, 22 aa, Mycobacterium
AIPKPQLFSAGWVDPEPDTVIV

SEQ ID NO: 1121715 - protein, 18 aa, Mycobacterium
AIPLSFLVLVWVFGGLVA

SEQ ID NO: 1121716 - protein, 18 aa, Mycobacterium
AIPLSFVVLVWVFGGLLA

SEQ ID NO: 1121717 - protein, 19 aa, Mycobacterium
AIPLTFLVLVWVFKGLLAA

SEQ ID NO: 1121718 - protein, 26 aa, Mycobacterium
AIPRLCPLGELIAPLTFVVFAYTSVG

SEQ ID NO: 1121719 - protein, 25 aa, Mycobacterium
AIRGRCGLRPYYLPVYGPLGHAVFS

SEQ ID NO: 1121720 - protein, 18 aa, Mycobacterium
AIRPDLAERLAIVELRRI

SEQ ID NO: 1121721 - protein, 22 aa, Mycobacterium
AISAFAAWGAFLFLMSLYLQGE

SEQ ID NO: 1121722 - protein, 29 aa, Mycobacterium
AISAMLIYRLISWIFISAIGWVVFFFMFR

SEQ ID NO: 1121723 - protein, 18 aa, Mycobacterium
AISFSIIAGVDPRVGLFA

SEQ ID NO: 1121724 - protein, 18 aa, Mycobacterium
AISIWITIHYTLRLYRLN

SEQ ID NO: 1121725 - protein, 18 aa, Mycobacterium
AITLWLGLVGQFGELVGD

SEQ ID NO: 1121726 - protein, 24 aa, Mycobacterium
AITSRLPTVLAVIAAITFVLLFLL

SEQ ID NO: 1121727 - protein, 17 aa, Mycobacterium
AIVAALVTFSDTDAPAA

SEQ ID NO: 1121728 - protein, 22 aa, Mycobacterium
AIVCGLAFIALKVFEYISLAAA

SEQ ID NO: 1121729 - protein, 26 aa, Mycobacterium
AIVGLLLCWTVAGGVLLGIAAIVMGF

SEQ ID NO: 1121730 - protein, 28 aa, Mycobacterium
AIVLRDLRIPAIGVVLLLLSSLIVGAGW

SEQ ID NO: 1121731 - protein, 26 aa, Mycobacterium
AIVPVIGFWFGFELFARVLVVVIIAL

SEQ ID NO: 1121732 - protein, 25 aa, Mycobacterium
AIVRFALRPLRRVAATAAEVAGLPL

SEQ ID NO: 1121733 - protein, 22 aa, Mycobacterium
AIVVGIVGTVVWVGITNDRQER

SEQ ID NO: 1121734 - protein, 26 aa, Mycobacterium
AIVVLAIPVNYAWDFFVEGIAAAMGW

SEQ ID NO: 1121735 - protein, 21 aa, Mycobacterium
AIVVLTCWTLAGTALTVTAAV

SEQ ID NO: 1121736 - protein, 24 aa, Mycobacterium
AKAAELLEQIPVRADRGVRVVSGR

SEQ ID NO: 1121737 - protein, 19 aa, Mycobacterium
AKAGSSWLGSPPVRLRRRP

SEQ ID NO: 1121738 - protein, 26 aa, Mycobacterium
AKANVRRFVDDVAFVVGKESRDRLKG

SEQ ID NO: 1121739 - protein, 27 aa, Mycobacterium
AKAPKVVRPPLRERLLIKLSTIELNPK

SEQ ID NO: 1121740 - protein, 20 aa, Mycobacterium
AKAPKVVRPPLRQRILVRLA

SEQ ID NO: 1121741 - protein, 26 aa, Mycobacterium
AKDFYLPGIWMYLAMAVLFTGSIVVG

SEQ ID NO: 1121742 - protein, 21 aa, Mycobacterium
AKGGIVFRVQQELGVPVKLVG

SEQ ID NO: 1121743 - protein, 19 aa, Mycobacterium
AKGIRSRRRRPLTAFIPVA

SEQ ID NO: 1121744 - protein, 19 aa, Mycobacterium
AKGLGLAAGAKRPGAKKTA

SEQ ID NO: 1121745 - protein, 20 aa, Mycobacterium
AKLADPVFIAAQARERLGFV

SEQ ID NO: 1121746 - protein, 17 aa, Mycobacterium
AKLGYIFGPPGWEPSTA

SEQ ID NO: 1121747 - protein, 23 aa, Mycobacterium
AKLWLPGYLAWFVGGMVLAALRP

SEQ ID NO: 1121748 - protein, 20 aa, Mycobacterium
AKLYPLLLLVPLTLLAVRTG

SEQ ID NO: 1121749 - protein, 25 aa, Mycobacterium
AKPLKFGHKVVTGMRGSYGGVLMFG

SEQ ID NO: 1121750 - protein, 21 aa, Mycobacterium
AKPLLPGIMIVAALIAVIGSL

SEQ ID NO: 1121751 - protein, 21 aa, Mycobacterium
AKPLVPGIMIVAGLIAVIGSL

SEQ ID NO: 1121752 - protein, 26 aa, Mycobacterium
AKSRFANEVFPDFLLVMQRSDATTHI

SEQ ID NO: 1121753 - protein, 18 aa, Mycobacterium
AKTLPRNTTVIFADRGGT

SEQ ID NO: 1121754 - protein, 17 aa, Mycobacterium
AKTVVFGAIVAIVSSLR

SEQ ID NO: 1121755 - protein, 17 aa, Mycobacterium
AKVILPLSLPGVLAGSL

SEQ ID NO: 1121756 - protein, 17 aa, Mycobacterium
AKYKMTVVFNDGKEVPA

SEQ ID NO: 1121757 - protein, 19 aa, Mycobacterium
AKYKMTVVFNDGKEVPANL

SEQ ID NO: 1121758 - protein, 24 aa, Mycobacterium
ALAAAFGPWLLREAFGAQYHADGT

SEQ ID NO: 1121759 - protein, 17 aa, Mycobacterium
ALAAGLAVIGWGVRGTP

SEQ ID NO: 1121760 - protein, 25 aa, Mycobacterium
ALAALAVSWYISRRLQRSVTEVAEA

SEQ ID NO: 1121761 - protein, 21 aa, Mycobacterium
ALAALLPTPVKSVAILRDGQL

SEQ ID NO: 1121762 - protein, 20 aa, Mycobacterium
ALAASLLWLFRWPSRAQSLA

SEQ ID NO: 1121763 - protein, 20 aa, Mycobacterium
ALAATVALTFVTGVVDAVGF

SEQ ID NO: 1121764 - protein, 22 aa, Mycobacterium
ALAAVAAWLITRAWQMPPVLDL

SEQ ID NO: 1121765 - protein, 32 aa, Mycobacterium
ALACSAGLVAHCVRRFGGITGDVLGAALEVTT

SEQ ID NO: 1121766 - protein, 17 aa, Mycobacterium
ALADAIRNRDVYGGFVM

SEQ ID NO: 1121767 - protein, 19 aa, Mycobacterium
ALADRLPHVAALFTAGLIT

SEQ ID NO: 1121768 - protein, 18 aa, Mycobacterium
ALAEARRGPQVGIAGAPA

SEQ ID NO: 1121769 - protein, 19 aa, Mycobacterium
ALAFVLSFLDRWGRLTPRR

SEQ ID NO: 1121770 - protein, 22 aa, Mycobacterium
ALAGLGPDLARLVKGSTTLAID

SEQ ID NO: 1121771 - protein, 25 aa, Mycobacterium
ALAGLVQAFGVWWFYAALGSGPISV

SEQ ID NO: 1121772 - protein, 21 aa, Mycobacterium
ALALGLAWMLAISIWLFGMSA

SEQ ID NO: 1121773 - protein, 22 aa, Mycobacterium
ALALPFVLAWPFWALGKLCGVP

SEQ ID NO: 1121774 - protein, 19 aa, Mycobacterium
ALAPSVSLLVAFRAVQGLG

SEQ ID NO: 1121775 - protein, 19 aa, Mycobacterium
ALAPTMEWLLVGRTVQGAA

SEQ ID NO: 1121776 - protein, 19 aa, Mycobacterium
ALAQWRQGRLGQHGASAVI

SEQ ID NO: 1121777 - protein, 26 aa, Mycobacterium
ALARLQRRLRLAVASQIVLGIVVVTG

SEQ ID NO: 1121778 - protein, 18 aa, Mycobacterium
ALAVLWWVVPLLLLGRIS

SEQ ID NO: 1121779 - protein, 18 aa, Mycobacterium
ALAWWQWTRWESTTGSFQ

SEQ ID NO: 1121780 - protein, 22 aa, Mycobacterium
ALCAAACWAGYILLTQKVGDEV

SEQ ID NO: 1121781 - protein, 19 aa, Mycobacterium
ALCGVVVVQACSRMYFLRR

SEQ ID NO: 1121782 - protein, 17 aa, Mycobacterium
ALCLFIMRDSPNFTPNH

SEQ ID NO: 1121783 - protein, 25 aa, Mycobacterium
ALCTVMYGLLLAWRRGGIGHVKLTP

SEQ ID NO: 1121784 - protein, 23 aa, Mycobacterium
ALDAAVGAALFAGYGRGAETATV

SEQ ID NO: 1121785 - protein, 20 aa, Mycobacterium
ALDAGYTYSLLWVAAVSVLV

SEQ ID NO: 1121786 - protein, 17 aa, Mycobacterium
ALDLRFGPDGQNPPDEV

SEQ ID NO: 1121787 - protein, 19 aa, Mycobacterium
ALEAGRWQALMLPATTLVI

SEQ ID NO: 1121788 - protein, 22 aa, Mycobacterium
ALERAKSAGLVTVRGSATDSEV

SEQ ID NO: 1121789 - protein, 21 aa, Mycobacterium
ALERARNAGLVTVRGSATDSE

SEQ ID NO: 1121790 - protein, 25 aa, Mycobacterium
ALERRFGPLLFKELLALHFSPTRPS

SEQ ID NO: 1121791 - protein, 23 aa, Mycobacterium
ALESKCLVVAAGYRPRLLGEQWN

SEQ ID NO: 1121792 - protein, 26 aa, Mycobacterium
ALGALIRYALAQAWPQPKQLLISTIV

SEQ ID NO: 1121793 - protein, 18 aa, Mycobacterium
ALGAVCFAVSDAMIGISR

SEQ ID NO: 1121794 - protein, 25 aa, Mycobacterium
ALGDRYGRRGALLVGLAIFAVASLA

SEQ ID NO: 1121795 - protein, 26 aa, Mycobacterium
ALGGFLIGAGIGWLVQRRRGDAGSPG

SEQ ID NO: 1121796 - protein, 18 aa, Mycobacterium
ALGGLRCRASRIVLHPGF

SEQ ID NO: 1121797 - protein, 24 aa, Mycobacterium
ALGIGDIVAIDFMQRVFAAKSPET

SEQ ID NO: 1121798 - protein, 24 aa, Mycobacterium
ALGIPALAGPFLLAAVAYVAAGSV

SEQ ID NO: 1121799 - protein, 25 aa, Mycobacterium
ALGLAGFVVGGGWLMIEHHRVRHLE

SEQ ID NO: 1121800 - protein, 24 aa, Mycobacterium
ALGLAMAVGGSWIKELSSPPWEDG

SEQ ID NO: 1121801 - protein, 17 aa, Mycobacterium
ALGLIVFIGVATAGLGI

SEQ ID NO: 1121802 - protein, 18 aa, Mycobacterium
ALGLRVIKSFGREDYVYE

SEQ ID NO: 1121803 - protein, 18 aa, Mycobacterium
ALGLRVVKSFGREDYVYD

SEQ ID NO: 1121804 - protein, 20 aa, Mycobacterium
ALGLRVVKSFGREDYVYDRF

SEQ ID NO: 1121805 - protein, 17 aa, Mycobacterium
ALGLTFLTFLTVLGLCY

SEQ ID NO: 1121806 - protein, 19 aa, Mycobacterium
ALGLWRLAEAFIGAKPGEQ

SEQ ID NO: 1121807 - protein, 18 aa, Mycobacterium
ALGMMVLSKSFSVLRSAV

SEQ ID NO: 1121808 - protein, 19 aa, Mycobacterium
ALGRIGDHTSFYGRALAGV

SEQ ID NO: 1121809 - protein, 23 aa, Mycobacterium
ALGYELPLMFALVAPAVAAGSLR

SEQ ID NO: 1121810 - protein, 23 aa, Mycobacterium
ALHAPGDVSFYCLDYGGGQLRAL

SEQ ID NO: 1121811 - protein, 22 aa, Mycobacterium
ALHEVDGAWTIAGDPTEAALLV

SEQ ID NO: 1121812 - protein, 19 aa, Mycobacterium
ALHHFRIYVDIAIVVVVLA

SEQ ID NO: 1121813 - protein, 19 aa, Mycobacterium
ALHPAWWTLILLVVLVTIV

SEQ ID NO: 1121814 - protein, 25 aa, Mycobacterium
ALIALAVLIWRSLPEGGIEAPSGGA

SEQ ID NO: 1121815 - protein, 31 aa, Mycobacterium
ALIAWVLLCVEILRLPALENVMPKALAKENA

SEQ ID NO: 1121816 - protein, 28 aa, Mycobacterium
ALIDGVREFPGPWALVPVGATLLFILSA

SEQ ID NO: 1121817 - protein, 24 aa, Mycobacterium
ALIELRISPWALVTWVGPSIEVFG

SEQ ID NO: 1121818 - protein, 19 aa, Mycobacterium
ALIGAFYLFTLVLGYGAAA

SEQ ID NO: 1121819 - protein, 22 aa, Mycobacterium
ALIPGRPAPRIITADMVASMKS

SEQ ID NO: 1121820 - protein, 36 aa, Mycobacterium
ALIWYLAEAVGIAFLAPVLLRWNRYWRRHSARQVVT

SEQ ID NO: 1121821 - protein, 18 aa, Mycobacterium
ALKARIAVLPADSGVGLW

SEQ ID NO: 1121822 - protein, 22 aa, Mycobacterium
ALKGRTSIVIAHRLSTVRAADV

SEQ ID NO: 1121823 - protein, 30 aa, Mycobacterium
ALLDRLLGRPVHAIGLTWTVEAERTASAVW

SEQ ID NO: 1121824 - protein, 20 aa, Mycobacterium
ALLGAVSWAIIAFFRGETVN

SEQ ID NO: 1121825 - protein, 27 aa, Mycobacterium
ALLLEYTAPILVVGWLWATTRRRPTTM

SEQ ID NO: 1121826 - protein, 26 aa, Mycobacterium
ALLLISIVFGFTWWLGGRLGLEDKLR

SEQ ID NO: 1121827 - protein, 24 aa, Mycobacterium
ALLMLGLWLAGWGAARLVATVLPD

SEQ ID NO: 1121828 - protein, 22 aa, Mycobacterium
ALLPHWRERRFGHVVNVSSAGV

SEQ ID NO: 1121829 - protein, 25 aa, Mycobacterium
ALLPNLAEWGRGMIDNALSAAGTSA

SEQ ID NO: 1121830 - protein, 20 aa, Mycobacterium
ALLRLVEPNWSMTLVERLDG

SEQ ID NO: 1121831 - protein, 19 aa, Mycobacterium
ALLTRRWTLAWIALAGSTV

SEQ ID NO: 1121832 - protein, 18 aa, Mycobacterium
ALLWVVPLVEAFRAGDDR

SEQ ID NO: 1121833 - protein, 18 aa, Mycobacterium
ALMFRFNNPDALLVLLLV

SEQ ID NO: 1121834 - protein, 21 aa, Mycobacterium
ALMLLLPRIHRAIPESLAAVI

SEQ ID NO: 1121835 - protein, 26 aa, Mycobacterium
ALMMPRYRVLWGIAINVVGGMAVIYL

SEQ ID NO: 1121836 - protein, 18 aa, Mycobacterium
ALMPRMAVGINPDSFVDT

SEQ ID NO: 1121837 - protein, 17 aa, Mycobacterium
ALMTLPWLAAIIGEYIL

SEQ ID NO: 1121838 - protein, 25 aa, Mycobacterium
ALMYKRPDGQFAYRGDGGMLNFVQM

SEQ ID NO: 1121839 - protein, 27 aa, Mycobacterium
ALNLALNAGWSWVFFNRRMLGPAAVVA

SEQ ID NO: 1121840 - protein, 19 aa, Mycobacterium
ALNQFARLSYMILLSVPLV

SEQ ID NO: 1121841 - protein, 17 aa, Mycobacterium
ALNRPVAAGGDTRNQNT

SEQ ID NO: 1121842 - protein, 17 aa, Mycobacterium
ALNWDDRVQPLVGELTV

SEQ ID NO: 1121843 - protein, 22 aa, Mycobacterium
ALPDRLRPAVLRPSAPSAVDIA

SEQ ID NO: 1121844 - protein, 26 aa, Mycobacterium
ALPGLRDDWRPVLWAIAILTMVVGTV

SEQ ID NO: 1121845 - protein, 18 aa, Mycobacterium
ALPSRVFAWFSLVFGVGF

SEQ ID NO: 1121846 - protein, 17 aa, Mycobacterium
ALPVKDVKLVAAGVIPR

SEQ ID NO: 1121847 - protein, 17 aa, Mycobacterium
ALRDIAGQLGLPYVQRG

SEQ ID NO: 1121848 - protein, 18 aa, Mycobacterium
ALRPDKFMEVGWVVLLPA

SEQ ID NO: 1121849 - protein, 20 aa, Mycobacterium
ALRRDRVRLSVWIAALTAMT

SEQ ID NO: 1121850 - protein, 26 aa, Mycobacterium
ALRREVWTGFAAAVVFSGVAGVTIAA

SEQ ID NO: 1121851 - protein, 28 aa, Mycobacterium
ALRREVWTRLAAAVVFSGVAAWTITALL

SEQ ID NO: 1121852 - protein, 24 aa, Mycobacterium
ALRRMKLVALGFLLGASVIFLICT

SEQ ID NO: 1121853 - protein, 17 aa, Mycobacterium
ALRRPRMQLPMSGFYVV

SEQ ID NO: 1121854 - protein, 19 aa, Mycobacterium
ALRSARRRWTLTLIGATLF

SEQ ID NO: 1121855 - protein, 25 aa, Mycobacterium
ALRSLHGRLLRYRYAKTAGDVTRRY

SEQ ID NO: 1121856 - protein, 18 aa, Mycobacterium
ALRVFLGFERQPVQRPSR

SEQ ID NO: 1121857 - protein, 28 aa, Mycobacterium
ALSAFFTPRFVNWFGLFTTHLVVAIALA

SEQ ID NO: 1121858 - protein, 17 aa, Mycobacterium
ALSAPRLPREWMTEPGL

SEQ ID NO: 1121859 - protein, 26 aa, Mycobacterium
ALSDRIGRRPLLIGGAVAFVIFAYPL

SEQ ID NO: 1121860 - protein, 26 aa, Mycobacterium
ALSDRIGRRPLLIGGTVAFVILAYPL

SEQ ID NO: 1121861 - protein, 22 aa, Mycobacterium
ALSDRWGRKHLITAGMFTQAGG

SEQ ID NO: 1121862 - protein, 29 aa, Mycobacterium
ALSDRWGRKWMIAGGMWLQAIALAMIANG

SEQ ID NO: 1121863 - protein, 19 aa, Mycobacterium
ALSIGGLIGALGYAVMSRY

SEQ ID NO: 1121864 - protein, 24 aa, Mycobacterium
ALSILACGIAWLVIQHAGRGERLG

SEQ ID NO: 1121865 - protein, 26 aa, Mycobacterium
ALSKSAIVPMHFWLPGAMAAPTPVSA

SEQ ID NO: 1121866 - protein, 19 aa, Mycobacterium
ALSLCPKVGAVIVAVPAGV

SEQ ID NO: 1121867 - protein, 31 aa, Mycobacterium
ALSLTASGAMVFAILVLLGRYISYTLDLAGI

SEQ ID NO: 1121868 - protein, 25 aa, Mycobacterium
ALSNWPVRVKVLAIVVVPLLLACVF

SEQ ID NO: 1121869 - protein, 20 aa, Mycobacterium
ALSSRRSWAIPVAVVGLVVL

SEQ ID NO: 1121870 - protein, 30 aa, Mycobacterium
ALSVGEQFWLVWPLLFLLVGLLKARKAAVA

SEQ ID NO: 1121871 - protein, 23 aa, Mycobacterium
ALTAFSIMAFNYMKLPNLLFGIG

SEQ ID NO: 1121872 - protein, 29 aa, Mycobacterium
ALTALVVTWYFSRRLQHSIAEVASAATAV

SEQ ID NO: 1121873 - protein, 18 aa, Mycobacterium
ALTGFISAFFNVRLIGPL

SEQ ID NO: 1121874 - protein, 27 aa, Mycobacterium
ALTGHIWQVFGALWLYSMAVAGAVTGV

SEQ ID NO: 1121875 - protein, 18 aa, Mycobacterium
ALTGVFGVDAWVLAAVGA

SEQ ID NO: 1121876 - protein, 17 aa, Mycobacterium
ALTMTIPLTVISFAIGL

SEQ ID NO: 1121877 - protein, 26 aa, Mycobacterium
ALTVVSWRLAFLINVPIGIAIIAIAV

SEQ ID NO: 1121878 - protein, 26 aa, Mycobacterium
ALVAFTVSWYVSRRLQRSITEVASAA

SEQ ID NO: 1121879 - protein, 17 aa, Mycobacterium
ALVALGVGILFTWMFMF

SEQ ID NO: 1121880 - protein, 17 aa, Mycobacterium
ALVALLLGKTAQADERG

SEQ ID NO: 1121881 - protein, 19 aa, Mycobacterium
ALVGVLWVLFGFSMTFGSS

SEQ ID NO: 1121882 - protein, 24 aa, Mycobacterium
ALVIPGIASVGSWLQGAALTAMFL

SEQ ID NO: 1121883 - protein, 18 aa, Mycobacterium
ALVKAIIITALIALAVLI

SEQ ID NO: 1121884 - protein, 18 aa, Mycobacterium
ALVLELLATLGVALVAVG

SEQ ID NO: 1121885 - protein, 17 aa, Mycobacterium
ALVLLPALLWDRKRTPA

SEQ ID NO: 1121886 - protein, 18 aa, Mycobacterium
ALVLLPLVLPPVVAGIAL

SEQ ID NO: 1121887 - protein, 21 aa, Mycobacterium
ALVLTLVAGFLKWQDTAATQA

SEQ ID NO: 1121888 - protein, 19 aa, Mycobacterium
ALVPIAIACMFVLKVPVPL

SEQ ID NO: 1121889 - protein, 19 aa, Mycobacterium
ALVVSDAFAERWLAPLSFA

SEQ ID NO: 1121890 - protein, 29 aa, Mycobacterium
ALVWPAAAVATVWLLAARRFSRWQRVAHL

SEQ ID NO: 1121891 - protein, 23 aa, Mycobacterium
ALWAAMIRFEYALVVSTATAAAT

SEQ ID NO: 1121892 - protein, 29 aa, Mycobacterium
ALWGNCTVKVMVGFLFLYPAFVAKAHDAS

SEQ ID NO: 1121893 - protein, 26 aa, Mycobacterium
ALWRKRWRLAAVTALCPPVAVVSAQL

SEQ ID NO: 1121894 - protein, 18 aa, Mycobacterium
ALYTWRWSLVTLWFTGVA

SEQ ID NO: 1121895 - protein, 21 aa, Mycobacterium
AMAAAAKARARAARLRRQALA

SEQ ID NO: 1121896 - protein, 34 aa, Mycobacterium
AMAAACLYCAYELWRFDTVRSWVLVAVMNIAMIA

SEQ ID NO: 1121897 - protein, 19 aa, Mycobacterium
AMAAPRVVLALILGTVIST

SEQ ID NO: 1121898 - protein, 22 aa, Mycobacterium
AMAHRWHWRSAAPLPAMQDRSV

SEQ ID NO: 1121899 - protein, 17 aa, Mycobacterium
AMATMRIAFLSALVLEL

SEQ ID NO: 1121900 - protein, 24 aa, Mycobacterium
AMDIARWSRRIAVQSAGVGMGLSL

SEQ ID NO: 1121901 - protein, 22 aa, Mycobacterium
AMEVGMILTVFTMRIAAAIGFL

SEQ ID NO: 1121902 - protein, 24 aa, Mycobacterium
AMEVMGVSVIRRLVVPRFAAAIMI

SEQ ID NO: 1121903 - protein, 29 aa, Mycobacterium
AMFDEWNWWLPRWLDRILPSVDFEKPLPK

SEQ ID NO: 1121904 - protein, 25 aa, Mycobacterium
AMFGLCAGLIACYKGLSVGGGPAGV

SEQ ID NO: 1121905 - protein, 24 aa, Mycobacterium
AMGSSRRFALRTVLAEAAGIGVVG

SEQ ID NO: 1121906 - protein, 24 aa, Mycobacterium
AMHCLWMSCLFVAAAGAIGRWAQR

SEQ ID NO: 1121907 - protein, 23 aa, Mycobacterium
AMIPALQFTYWQWASLTLAAPVV

SEQ ID NO: 1121908 - protein, 18 aa, Mycobacterium
AMLAWLVVERIRDGHATS

SEQ ID NO: 1121909 - protein, 23 aa, Mycobacterium
AMLNRLKVLSIVAVAVTAASVAV

SEQ ID NO: 1121910 - protein, 27 aa, Mycobacterium
AMLYLSMDIAIHWGLLRRLRHDVDFKV

SEQ ID NO: 1121911 - protein, 27 aa, Mycobacterium
AMNSFGWRIPFLIAGALGAVGLYIRLR

SEQ ID NO: 1121912 - protein, 26 aa, Mycobacterium
AMPMLPQAWRDWAWPIIAVGVVSVIY

SEQ ID NO: 1121913 - protein, 23 aa, Mycobacterium
AMSIRREVERLVGLELSATMLFN

SEQ ID NO: 1121914 - protein, 24 aa, Mycobacterium
AMSQAMLLPAFVALFGVIAALFLV

SEQ ID NO: 1121915 - protein, 19 aa, Mycobacterium
AMVPKPVWIAIGIGVAVIV

SEQ ID NO: 1121916 - protein, 18 aa, Mycobacterium
AMWSYRWSPPDILWTQVV

SEQ ID NO: 1121917 - protein, 20 aa, Mycobacterium
AMYFCAKGIRSRRRRPLTAF

SEQ ID NO: 1121918 - protein, 18 aa, Mycobacterium
ANCRPSAWERAVRANAIL

SEQ ID NO: 1121919 - protein, 18 aa, Mycobacterium
ANFSLGFTYLSPVVGIYT

SEQ ID NO: 1121920 - protein, 17 aa, Mycobacterium
ANIVGGIDWDGHGLLGL

SEQ ID NO: 1121921 - protein, 30 aa, Mycobacterium
ANPRVGTWWRRMEAYSWGGLTSRKATRALW

SEQ ID NO: 1121922 - protein, 26 aa, Mycobacterium
ANRDAWMVGFTPSLSTAVWVGTTDGT

SEQ ID NO: 1121923 - protein, 19 aa, Mycobacterium
ANSAWPWVSGAFILIGGLV

SEQ ID NO: 1121924 - protein, 27 aa, Mycobacterium
ANSILAFTVIKWIGVAYLAYLAVRQWR

SEQ ID NO: 1121925 - protein, 23 aa, Mycobacterium
ANTNLRIALRLNDIDDSLDVIDD

SEQ ID NO: 1121926 - protein, 20 aa, Mycobacterium
ANVEARIRATTAFGAKYVDL

SEQ ID NO: 1121927 - protein, 22 aa, Mycobacterium
ANVPEYRYLLAADDELDDGSER

SEQ ID NO: 1121928 - protein, 17 aa, Mycobacterium
ANWWRTLAAPVIGGAGM

SEQ ID NO: 1121929 - protein, 24 aa, Mycobacterium
APADEPRYVIGVMLDAPHRAADGS

SEQ ID NO: 1121930 - protein, 18 aa, Mycobacterium
APAFILISLTAIWLTYLG

SEQ ID NO: 1121931 - protein, 20 aa, Mycobacterium
APAPELPDFAAIAAQNQSAQ

SEQ ID NO: 1121932 - protein, 21 aa, Mycobacterium
APAQLWVFWLAPLIDAAIAGV

SEQ ID NO: 1121933 - protein, 18 aa, Mycobacterium
APARTGGWYRRALSCRPV

SEQ ID NO: 1121934 - protein, 20 aa, Mycobacterium
APDRHRGFVVSFLVWSVVVG

SEQ ID NO: 1121935 - protein, 22 aa, Mycobacterium
APEAFRAQMMALYFFSVGLGTS

SEQ ID NO: 1121936 - protein, 19 aa, Mycobacterium
APEKAAWGIALGLTVTLVW

SEQ ID NO: 1121937 - protein, 21 aa, Mycobacterium
APELPLFVLVVLGLTLGGFAV

SEQ ID NO: 1121938 - protein, 21 aa, Mycobacterium
APEPEPVVLVPHRPAGRKLVI

SEQ ID NO: 1121939 - protein, 25 aa, Mycobacterium
APEPPVVIPEPKFEIPVPDVPEVPV

SEQ ID NO: 1121940 - protein, 23 aa, Mycobacterium
APEQPPRAWRMRLTVQRVDDGAK

SEQ ID NO: 1121941 - protein, 19 aa, Mycobacterium
APESEQFVSPPYVPADASL

SEQ ID NO: 1121942 - protein, 25 aa, Mycobacterium
APFCAMCGAAMQACSHRSRQARRAD

SEQ ID NO: 1121943 - protein, 17 aa, Mycobacterium
APFDWYQSVLAQLASIS

SEQ ID NO: 1121944 - protein, 19 aa, Mycobacterium
APFGWYYDLLAVWAQVSTA

SEQ ID NO: 1121945 - protein, 23 aa, Mycobacterium
APFQRTLRCTGFAITPDGYIGTA

SEQ ID NO: 1121946 - protein, 17 aa, Mycobacterium
APGAPGYPAPGSEEGSK

SEQ ID NO: 1121947 - protein, 17 aa, Mycobacterium
APGATLVKLFGRPDSES

SEQ ID NO: 1121948 - protein, 22 aa, Mycobacterium
APGCQKVLEGTGFVVSPNRVMS

SEQ ID NO: 1121949 - protein, 24 aa, Mycobacterium
APGELRTVIDLTPGSLVGLLDAAV

SEQ ID NO: 1121950 - protein, 18 aa, Mycobacterium
APGLPIDAILPFMTMFAV

SEQ ID NO: 1121951 - protein, 17 aa, Mycobacterium
APGLPVVVPMAPIAVPV

SEQ ID NO: 1121952 - protein, 24 aa, Mycobacterium
APGQRLADRAAFWLVLVALLGGTA

SEQ ID NO: 1121953 - protein, 18 aa, Mycobacterium
APHAMEVTGAVNLAAKFP

SEQ ID NO: 1121954 - protein, 18 aa, Mycobacterium
APHGGIFVLFAIDNKLGF

SEQ ID NO: 1121955 - protein, 19 aa, Mycobacterium
APIARRLLGGWGLLLALVA

SEQ ID NO: 1121956 - protein, 17 aa, Mycobacterium
APISVPILVTVPTGGGA

SEQ ID NO: 1121957 - protein, 29 aa, Mycobacterium
APKRPSRWRHLPAVLLILSLMSFTVAMAG

SEQ ID NO: 1121958 - protein, 19 aa, Mycobacterium
APLCPFKALTGWACPACGG

SEQ ID NO: 1121959 - protein, 27 aa, Mycobacterium
APLDGGRILRAYLWHRHGDPVRAAIGA

SEQ ID NO: 1121960 - protein, 29 aa, Mycobacterium
APLGVCYLPAFLCLGIVPVVVGLAGDVLQ

SEQ ID NO: 1121961 - protein, 23 aa, Mycobacterium
APLNRLGPWSPLALLVPAAVLAA

SEQ ID NO: 1121962 - protein, 20 aa, Mycobacterium
APLRLPDSWFQAGQAVVGVI

SEQ ID NO: 1121963 - protein, 22 aa, Mycobacterium
APLRNIIRVLRQWMRKSKNKDP

SEQ ID NO: 1121964 - protein, 17 aa, Mycobacterium
APMFHALGFLHATIAMM

SEQ ID NO: 1121965 - protein, 17 aa, Mycobacterium
APMISRFAVTLGAPSYL

SEQ ID NO: 1121966 - protein, 33 aa, Mycobacterium
APMPELPWFMALACFKSAATWSLIVKHNRRKST

SEQ ID NO: 1121967 - protein, 17 aa, Mycobacterium
APNDWAVGVAYGVFALL

SEQ ID NO: 1121968 - protein, 17 aa, Mycobacterium
APNELKTLPAARTGISG

SEQ ID NO: 1121969 - protein, 23 aa, Mycobacterium
APPEGRDVLLTGLAQINRDSADA

SEQ ID NO: 1121970 - protein, 21 aa, Mycobacterium
APPGRIPFWSLLLLGAAALLV

SEQ ID NO: 1121971 - protein, 33 aa, Mycobacterium
APPILALMMPWLFLRVRFFRRKWTAVTLSSTWA

SEQ ID NO: 1121972 - protein, 18 aa, Mycobacterium
APPPRPDDAAGWPQWLLY

SEQ ID NO: 1121973 - protein, 17 aa, Mycobacterium
APPRQLWLPPLGAPPAA

SEQ ID NO: 1121974 - protein, 20 aa, Mycobacterium
APQLWPRTWALPLQVLAAIM

SEQ ID NO: 1121975 - protein, 19 aa, Mycobacterium
APQQSACRAPAFVIGAGVT

SEQ ID NO: 1121976 - protein, 23 aa, Mycobacterium
APQRRATAVVWQFFRHAIEVLVY

SEQ ID NO: 1121977 - protein, 21 aa, Mycobacterium
APQRWRSRAAAVATVANIGGL

SEQ ID NO: 1121978 - protein, 19 aa, Mycobacterium
APQWMKRIQQRIGLGEVHL

SEQ ID NO: 1121979 - protein, 21 aa, Mycobacterium
APRLPREWMTEPGLGVVGVVV

SEQ ID NO: 1121980 - protein, 26 aa, Mycobacterium
APRLTLRSWMVIPGIAAAGLLTGVCS

SEQ ID NO: 1121981 - protein, 18 aa, Mycobacterium
APRQPVRKTARRGVEAAP

SEQ ID NO: 1121982 - protein, 17 aa, Mycobacterium
APRRAWWVRHYTFTGTA

SEQ ID NO: 1121983 - protein, 24 aa, Mycobacterium
APRTRRAGALSAIALFVGVFPGNV

SEQ ID NO: 1121984 - protein, 25 aa, Mycobacterium
APSDVAISVPSYWSPATTAALADTL

SEQ ID NO: 1121985 - protein, 34 aa, Mycobacterium
APSEIPGFSQPRLVLSGFVERVGDPVPLVAADGS

SEQ ID NO: 1121986 - protein, 21 aa, Mycobacterium
APSRARMIVVLGALVALGPLT

SEQ ID NO: 1121987 - protein, 31 aa, Mycobacterium
APSRRRRIPRPGWKAAVATVVALATVALLGA

SEQ ID NO: 1121988 - protein, 21 aa, Mycobacterium
APSYLAIMLFALVAVTAVLGS

SEQ ID NO: 1121989 - protein, 19 aa, Mycobacterium
APTAMGHAAWAAGAAGLAA

SEQ ID NO: 1121990 - protein, 24 aa, Mycobacterium
APTDPRLQSGAGIADEVPPVHLDT

SEQ ID NO: 1121991 - protein, 28 aa, Mycobacterium
APTELRREFSLWSAFAFAFAFISPIVAM

SEQ ID NO: 1121992 - protein, 24 aa, Mycobacterium
APTLKHLNEVMAMLEKNRDNLAKI

SEQ ID NO: 1121993 - protein, 18 aa, Mycobacterium
APTRIPVPSLLRSLLTEH

SEQ ID NO: 1121994 - protein, 19 aa, Mycobacterium
APVMLRFASEELVYPMRMS

SEQ ID NO: 1121995 - protein, 18 aa, Mycobacterium
APVMYKIVRELATTARQP

SEQ ID NO: 1121996 - protein, 17 aa, Mycobacterium
APVPVLPAPAFRPPVVL

SEQ ID NO: 1121997 - protein, 22 aa, Mycobacterium
APVSRPVHRWVMVPDDAQDAQH

SEQ ID NO: 1121998 - protein, 18 aa, Mycobacterium
APYDPYRGAAQPTAVMPQ

SEQ ID NO: 1121999 - protein, 25 aa, Mycobacterium
AQAFRTLGVAYRWVDDPDTCGPLDV

SEQ ID NO: 1122000 - protein, 29 aa, Mycobacterium
AQAGLPTGSSFKVFALVAALQQGMGLGYQ

SEQ ID NO: 1122001 - protein, 24 aa, Mycobacterium
AQAPIEISEFVFGRRRPWHNPTAA

SEQ ID NO: 1122002 - protein, 17 aa, Mycobacterium
AQEALQHTALWQQVLND

SEQ ID NO: 1122003 - protein, 23 aa, Mycobacterium
AQEWLKSSVPFGGFPWGVVAFGQ

SEQ ID NO: 1122004 - protein, 39 aa, Mycobacterium
AQFPVAGGVYPWARRLWGRRYAWMTGWVYLVALLVTIAS

SEQ ID NO: 1122005 - protein, 19 aa, Mycobacterium
AQGAEWLIAIGVLGALVAA

SEQ ID NO: 1122006 - protein, 18 aa, Mycobacterium
AQGLRVLLLGSSDRSVDA

SEQ ID NO: 1122007 - protein, 21 aa, Mycobacterium
AQGRIALAAVDLFLVVQINIA

SEQ ID NO: 1122008 - protein, 24 aa, Mycobacterium
AQGTALIDIMAWIVVFVAGVALLN

SEQ ID NO: 1122009 - protein, 22 aa, Mycobacterium
AQGWLDYMERIGWDVLHNRHVV

SEQ ID NO: 1122010 - protein, 18 aa, Mycobacterium
AQHAFDFYYGSPRAHYTA

SEQ ID NO: 1122011 - protein, 17 aa, Mycobacterium
AQIRSGEDIRALADGLA

SEQ ID NO: 1122012 - protein, 17 aa, Mycobacterium
AQLPDWLQWISNALPAS

SEQ ID NO: 1122013 - protein, 17 aa, Mycobacterium
AQLPFPVNSLPQPGDLP

SEQ ID NO: 1122014 - protein, 24 aa, Mycobacterium
AQLVGAPPWLYWTLYLACYVTGGW

SEQ ID NO: 1122015 - protein, 23 aa, Mycobacterium
AQRAFGRPSGVRGSFLGVDQQRD

SEQ ID NO: 1122016 - protein, 27 aa, Mycobacterium
AQRGVQKWWLLVPLSVATWVLVHESGV

SEQ ID NO: 1122017 - protein, 25 aa, Mycobacterium
AQRTRLTEVLSRIYGTPVSIQLEVD

SEQ ID NO: 1122018 - protein, 26 aa, Mycobacterium
AQSVGRWRFVLVVAGMWIVAAAAGAG

SEQ ID NO: 1122019 - protein, 25 aa, Mycobacterium
AQTSHHWVPAFVKLNGLSRKFFDEV

SEQ ID NO: 1122020 - protein, 19 aa, Mycobacterium
AQVPWSLLAIPGDDPRRLL

SEQ ID NO: 1122021 - protein, 18 aa, Mycobacterium
ARAAARSVQTFALQSDRD

SEQ ID NO: 1122022 - protein, 20 aa, Mycobacterium
ARADGGFTLFYLGINLGAFI

SEQ ID NO: 1122023 - protein, 17 aa, Mycobacterium
ARAGLALRTESIARFMN

SEQ ID NO: 1122024 - protein, 22 aa, Mycobacterium
ARAGLLAAVAFEVFKQLGSVYL

SEQ ID NO: 1122025 - protein, 23 aa, Mycobacterium
ARAGRVQWRTGLIFGAAGMAGAY

SEQ ID NO: 1122026 - protein, 18 aa, Mycobacterium
ARALGTVLGRGRAADAPL

SEQ ID NO: 1122027 - protein, 18 aa, Mycobacterium
ARARYDTAMAWFKRQGLW

SEQ ID NO: 1122028 - protein, 19 aa, Mycobacterium
ARAVLAARGLDHSTVQVEP

SEQ ID NO: 1122029 - protein, 18 aa, Mycobacterium
ARCGIGYLHTGIEKNLEF

SEQ ID NO: 1122030 - protein, 17 aa, Mycobacterium
ARDAFGAAMTRGLTNQH

SEQ ID NO: 1122031 - protein, 26 aa, Mycobacterium
ARDGRPGGRVEFDRVWFGYEHGAPVI

SEQ ID NO: 1122032 - protein, 25 aa, Mycobacterium
ARDGSWRWFVTHTRRAARGLSVAVL

SEQ ID NO: 1122033 - protein, 23 aa, Mycobacterium
ARDLGQPWLLWVLLSAIGLASAA

SEQ ID NO: 1122034 - protein, 19 aa, Mycobacterium
ARDLSLYRSVIRLCDDLGL

SEQ ID NO: 1122035 - protein, 31 aa, Mycobacterium
ARDNMLPFSHVWRHVSPKSKAPTYAVVGLGF

SEQ ID NO: 1122036 - protein, 18 aa, Mycobacterium
ARDPRKAVLVLAATGLTS

SEQ ID NO: 1122037 - protein, 19 aa, Mycobacterium
ARDRLTGPPAHLFTIGSSL

SEQ ID NO: 1122038 - protein, 20 aa, Mycobacterium
ARELREARDLFAGVLEAASE

SEQ ID NO: 1122039 - protein, 24 aa, Mycobacterium
ARETRLTWLTAVFAVVASFAMLLS

SEQ ID NO: 1122040 - protein, 18 aa, Mycobacterium
ARGAMELLGGYRREIAFY

SEQ ID NO: 1122041 - protein, 28 aa, Mycobacterium
ARGDTGPPWPLWAVIFITSGMVLGAAIV

SEQ ID NO: 1122042 - protein, 17 aa, Mycobacterium
ARGLRAKLGYIFGPPGW

SEQ ID NO: 1122043 - protein, 18 aa, Mycobacterium
ARGLVYIVDRLKELIKYK

SEQ ID NO: 1122044 - protein, 24 aa, Mycobacterium
ARGRRWSAVRGFLRVEGLDASYRE

SEQ ID NO: 1122045 - protein, 27 aa, Mycobacterium
ARHLGSRPRPWLSVALGVEVVALMVLA

SEQ ID NO: 1122046 - protein, 21 aa, Mycobacterium
ARIALPLLVYFAVMWGGGYAL

SEQ ID NO: 1122047 - protein, 19 aa, Mycobacterium
ARIDYWSDYSLIAKLADWG

SEQ ID NO: 1122048 - protein, 19 aa, Mycobacterium
ARIEMPVALTADVAQAERV

SEQ ID NO: 1122049 - protein, 21 aa, Mycobacterium
ARILEHLQYTVIAVFFSAVIA

SEQ ID NO: 1122050 - protein, 17 aa, Mycobacterium
ARILRRTAFAVSHAVTR

SEQ ID NO: 1122051 - protein, 43 aa, Mycobacterium
ARKSAGVARWWRLLVIAAMGSWLVAEMVWFFGGAGRGGDEAHP

SEQ ID NO: 1122052 - protein, 18 aa, Mycobacterium
ARLITAMIVREDSMTLYG

SEQ ID NO: 1122053 - protein, 19 aa, Mycobacterium
ARLLHRLLGLTVVRVSTGQ

SEQ ID NO: 1122054 - protein, 21 aa, Mycobacterium
ARLLLRSMGYRDALIGGMLLA

SEQ ID NO: 1122055 - protein, 18 aa, Mycobacterium
ARLLRRSGPAAGHHSDPD

SEQ ID NO: 1122056 - protein, 19 aa, Mycobacterium
ARLPVASLIPDIVRLAGAD

SEQ ID NO: 1122057 - protein, 20 aa, Mycobacterium
ARLRCFVVKIEGAAVDEDAI

SEQ ID NO: 1122058 - protein, 20 aa, Mycobacterium
ARLRRDGYHVAMLTGDNQAT

SEQ ID NO: 1122059 - protein, 18 aa, Mycobacterium
ARLSSFLTDGHEYQVVLV

SEQ ID NO: 1122060 - protein, 22 aa, Mycobacterium
ARLVSLRDFLLFFFFLNLGAGL

SEQ ID NO: 1122061 - protein, 18 aa, Mycobacterium
ARMHLPEHLGMGIERMPR

SEQ ID NO: 1122062 - protein, 20 aa, Mycobacterium
ARMRALKMPFYRSLISATNW

SEQ ID NO: 1122063 - protein, 25 aa, Mycobacterium
ARNVPFEVPRGTMVTSVRLLATANS

SEQ ID NO: 1122064 - protein, 17 aa, Mycobacterium
ARPALVGALGATLITAG

SEQ ID NO: 1122065 - protein, 22 aa, Mycobacterium
ARPAVRGSGLVLALGNALFTVA

SEQ ID NO: 1122066 - protein, 17 aa, Mycobacterium
ARPPSDFYVRAVDPDGH

SEQ ID NO: 1122067 - protein, 17 aa, Mycobacterium
ARPQFLMAPATFVRNPL

SEQ ID NO: 1122068 - protein, 17 aa, Mycobacterium
ARPTAEAQPGWRPIADS

SEQ ID NO: 1122069 - protein, 28 aa, Mycobacterium
ARQDPLRRRACLTYALWITIAQIGWVVA

SEQ ID NO: 1122070 - protein, 19 aa, Mycobacterium
ARQLHKLPVDFGIGVSAGP

SEQ ID NO: 1122071 - protein, 28 aa, Mycobacterium
ARQLKWWARAVVTLWVILVVPLLLATVA

SEQ ID NO: 1122072 - protein, 19 aa, Mycobacterium
ARRAVLAFDAATLVWVAVF

SEQ ID NO: 1122073 - protein, 24 aa, Mycobacterium
ARRFSAVALWCFVAMAFSGVINAL

SEQ ID NO: 1122074 - protein, 18 aa, Mycobacterium
ARRHPLRMLALPIGLTVT

SEQ ID NO: 1122075 - protein, 18 aa, Mycobacterium
ARRKLLLALMALFTIGNL

SEQ ID NO: 1122076 - protein, 18 aa, Mycobacterium
ARRLPIQDLLGFVSQAIV

SEQ ID NO: 1122077 - protein, 26 aa, Mycobacterium
ARRRHWPAYLVTFAFFQYVPAWVLLD

SEQ ID NO: 1122078 - protein, 18 aa, Mycobacterium
ARRRILLADFGIARHTED

SEQ ID NO: 1122079 - protein, 17 aa, Mycobacterium
ARRRKGLIVGLSVAGAI

SEQ ID NO: 1122080 - protein, 23 aa, Mycobacterium
ARRRREVLVYAWLMPASTVAQAV

SEQ ID NO: 1122081 - protein, 27 aa, Mycobacterium
ARRRVRARRGVMRIAVAVLGAAAAAAV

SEQ ID NO: 1122082 - protein, 20 aa, Mycobacterium
ARSGAFIALVAVFALGGVAS

SEQ ID NO: 1122083 - protein, 18 aa, Mycobacterium
ARSGLSMDPGAKVTYNGV

SEQ ID NO: 1122084 - protein, 21 aa, Mycobacterium
ARSSLDAALSEARREEPAVNI

SEQ ID NO: 1122085 - protein, 17 aa, Mycobacterium
ARSSTLTSVGWIGYIII

SEQ ID NO: 1122086 - protein, 17 aa, Mycobacterium
ARTIRAARQVLPDATST

SEQ ID NO: 1122087 - protein, 19 aa, Mycobacterium
ARTKFVAMGAVVLATAALA

SEQ ID NO: 1122088 - protein, 24 aa, Mycobacterium
ARTPGELAHAAWIEFSATTRMSGV

SEQ ID NO: 1122089 - protein, 20 aa, Mycobacterium
ARTQPALDLDALVGGFRPLF

SEQ ID NO: 1122090 - protein, 19 aa, Mycobacterium
ARTRRGLRALLSLVPDEAT

SEQ ID NO: 1122091 - protein, 19 aa, Mycobacterium
ARTRRGLRALLSLVPDQAT

SEQ ID NO: 1122092 - protein, 20 aa, Mycobacterium
ARTVALYGLVPIAGAQLFYF

SEQ ID NO: 1122093 - protein, 25 aa, Mycobacterium
ARTVGRLAVRQVRRGTLIVAGVAAG

SEQ ID NO: 1122094 - protein, 22 aa, Mycobacterium
ARVAPYLAPRWIILGAGLLVPC

SEQ ID NO: 1122095 - protein, 18 aa, Mycobacterium
ARVKAVALVSGHSGGTVS

SEQ ID NO: 1122096 - protein, 21 aa, Mycobacterium
ARVSLLPTLLLAIPFSVLLVF

SEQ ID NO: 1122097 - protein, 24 aa, Mycobacterium
ARVWEFGVGALLAMAATQLAQIPH

SEQ ID NO: 1122098 - protein, 32 aa, Mycobacterium
ARYDELRQQFPWYRNEFGPGFWTVCNYEGILE

SEQ ID NO: 1122099 - protein, 20 aa, Mycobacterium
ARYTPVVGGEASILVRSGST

SEQ ID NO: 1122100 - protein, 24 aa, Mycobacterium
ASAALDMGEGFGMPSTDTPEKMLE

SEQ ID NO: 1122101 - protein, 18 aa, Mycobacterium
ASAINFWAWNMIGPLSTT

SEQ ID NO: 1122102 - protein, 30 aa, Mycobacterium
ASALLPFGLLGIWAAIPFAIWFFLAIEGVP

SEQ ID NO: 1122103 - protein, 19 aa, Mycobacterium
ASAPGAAIIQFFGGIHEIY

SEQ ID NO: 1122104 - protein, 24 aa, Mycobacterium
ASASLELLHTFALIQDDVMDSSPM

SEQ ID NO: 1122105 - protein, 31 aa, Mycobacterium
ASAVAAYLVAPWAWWLCGAVGAVTVLYLGYL

SEQ ID NO: 1122106 - protein, 23 aa, Mycobacterium
ASAVGLLSVFGWPPLARITTFML

SEQ ID NO: 1122107 - protein, 26 aa, Mycobacterium
ASAWVGAPVLGWWAGVLVQVLPQRGA

SEQ ID NO: 1122108 - protein, 20 aa, Mycobacterium
ASDDTLVWCDIYSPDHAILK

SEQ ID NO: 1122109 - protein, 24 aa, Mycobacterium
ASEAARAGWLGDIDFAADIRGITD

SEQ ID NO: 1122110 - protein, 23 aa, Mycobacterium
ASFKEAWSYVIVMVAVGAAYLAY

SEQ ID NO: 1122111 - protein, 21 aa, Mycobacterium
ASFLAAGWRPGEPFPGGAVMW

SEQ ID NO: 1122112 - protein, 20 aa, Mycobacterium
ASGLPRAAIRVIDVDEIPRL

SEQ ID NO: 1122113 - protein, 24 aa, Mycobacterium
ASGWEQLRILGMIGAAAAVGNFAG

SEQ ID NO: 1122114 - protein, 21 aa, Mycobacterium
ASGWKPVPAEGQWIPAGEPGS

SEQ ID NO: 1122115 - protein, 23 aa, Mycobacterium
ASHELRTPLAAIRGYTELAQRKQ

SEQ ID NO: 1122116 - protein, 19 aa, Mycobacterium
ASHELRTPLTAMRTNLEVL

SEQ ID NO: 1122117 - protein, 20 aa, Mycobacterium
ASHKIGVLWRFHAVHHSITR

SEQ ID NO: 1122118 - protein, 20 aa, Mycobacterium
ASILYPSLLLLPLVATTLAI

SEQ ID NO: 1122119 - protein, 32 aa, Mycobacterium
ASIPDFWFAITGVWLFAVLLGWLPTSGTDAGM

SEQ ID NO: 1122120 - protein, 25 aa, Mycobacterium
ASIVGVSVMIFAYMKVPTLLGIGRL

SEQ ID NO: 1122121 - protein, 17 aa, Mycobacterium
ASLDHLGGWPALGAGGV

SEQ ID NO: 1122122 - protein, 27 aa, Mycobacterium
ASLDSSLRWVDVLGMSMLAGIGFTVSL

SEQ ID NO: 1122123 - protein, 17 aa, Mycobacterium
ASLFLAVWLVWAPALFR

SEQ ID NO: 1122124 - protein, 17 aa, Mycobacterium
ASLHQWLNYTLIAGGAL

SEQ ID NO: 1122125 - protein, 25 aa, Mycobacterium
ASLKAFWYHFAIMFEALFILTTVDA

SEQ ID NO: 1122126 - protein, 17 aa, Mycobacterium
ASLLLAAVLSWAAIELA

SEQ ID NO: 1122127 - protein, 17 aa, Mycobacterium
ASLLVSLLVSWLLFTWI

SEQ ID NO: 1122128 - protein, 20 aa, Mycobacterium
ASLPLHAFFGVVLMGTQSVL

SEQ ID NO: 1122129 - protein, 17 aa, Mycobacterium
ASLSLLAAIFFSNLPES

SEQ ID NO: 1122130 - protein, 18 aa, Mycobacterium
ASLSVCLLVLLRFDGPQD

SEQ ID NO: 1122131 - protein, 27 aa, Mycobacterium
ASLTVLRWSWTPALLAGGLMTLMPLAV

SEQ ID NO: 1122132 - protein, 28 aa, Mycobacterium
ASLVVFPFVILRHARLPKPVDLPPVGRI

SEQ ID NO: 1122133 - protein, 23 aa, Mycobacterium
ASLWPAEALEAVRLLIFGGEACP

SEQ ID NO: 1122134 - protein, 19 aa, Mycobacterium
ASMACSFVDVPRLAHHCAA

SEQ ID NO: 1122135 - protein, 28 aa, Mycobacterium
ASMVIGAAIGVVWFWIPLGLLVLGTSSI

SEQ ID NO: 1122136 - protein, 29 aa, Mycobacterium
ASMVIGAAIGVVWFWIPLGLLVLGTSSIP

SEQ ID NO: 1122137 - protein, 19 aa, Mycobacterium
ASPCVIPLVPGYLSYLAAV

SEQ ID NO: 1122138 - protein, 22 aa, Mycobacterium
ASPDLDRALGLWPPAAADGELY

SEQ ID NO: 1122139 - protein, 22 aa, Mycobacterium
ASPHHLVELGVLVTANLLATVV

SEQ ID NO: 1122140 - protein, 18 aa, Mycobacterium
ASPNPLAHRMIQVTEYAA

SEQ ID NO: 1122141 - protein, 22 aa, Mycobacterium
ASPTRRAVVFGCDTGAVRVTGG

SEQ ID NO: 1122142 - protein, 20 aa, Mycobacterium
ASQIIKYTWPVKRMRRADVR

SEQ ID NO: 1122143 - protein, 30 aa, Mycobacterium
ASRLLGRMCALPLTVGMLMSAALWSGTPGS

SEQ ID NO: 1122144 - protein, 17 aa, Mycobacterium
ASRPFRKWLDPVDGAGA

SEQ ID NO: 1122145 - protein, 23 aa, Mycobacterium
ASRRELERFFAVASDLLFIGTYV

SEQ ID NO: 1122146 - protein, 21 aa, Mycobacterium
ASSRAGWAAVIYVAAIVAMFG

SEQ ID NO: 1122147 - protein, 21 aa, Mycobacterium
ASSREAMWWISDQGVRYGIEL

SEQ ID NO: 1122148 - protein, 24 aa, Mycobacterium
ASTLCPLLVLGIWWRGLTATGAMA

SEQ ID NO: 1122149 - protein, 20 aa, Mycobacterium
ASTLLSFGRGNWKRMSVVAA

SEQ ID NO: 1122150 - protein, 28 aa, Mycobacterium
ASTLPFLWNVFKSWRYGEVVTVDDPWGY

SEQ ID NO: 1122151 - protein, 20 aa, Mycobacterium
ASTPRSPLSLGPINDLLFAA

SEQ ID NO: 1122152 - protein, 25 aa, Mycobacterium
ASVLAFALLRPHRWPEAVIAVPAAA

SEQ ID NO: 1122153 - protein, 24 aa, Mycobacterium
ASVLAFVFGWAIFRITDWLSPPEP

SEQ ID NO: 1122154 - protein, 21 aa, Mycobacterium
ASVLRRKIQQAGFGDVKVTNS

SEQ ID NO: 1122155 - protein, 27 aa, Mycobacterium
ASVQSWRPGASWGNWLMRRCTRLYRPV

SEQ ID NO: 1122156 - protein, 25 aa, Mycobacterium
ASWPARAGAITVDILPGLGVIVTTA

SEQ ID NO: 1122157 - protein, 19 aa, Mycobacterium
ATAALAALRVTPGLPSQGV

SEQ ID NO: 1122158 - protein, 18 aa, Mycobacterium
ATAALGQRTPEDMVADLK

SEQ ID NO: 1122159 - protein, 30 aa, Mycobacterium
ATAAQYSWFIGCGVAFAIYYLVAKRDTLVA

SEQ ID NO: 1122160 - protein, 23 aa, Mycobacterium
ATACAMAGPARARVHTLAATLLP

SEQ ID NO: 1122161 - protein, 20 aa, Mycobacterium
ATAFLALLVLYFLGFDQGAT

SEQ ID NO: 1122162 - protein, 22 aa, Mycobacterium
ATALIGVAAWLRLRDVRWTRPR

SEQ ID NO: 1122163 - protein, 23 aa, Mycobacterium
ATAPFKSATKWSGTSYGDHGNWV

SEQ ID NO: 1122164 - protein, 18 aa, Mycobacterium
ATAPMMLIPQLTLGLASV

SEQ ID NO: 1122165 - protein, 26 aa, Mycobacterium
ATARGVVAFLGWHEIIGLSLFATNLL

SEQ ID NO: 1122166 - protein, 24 aa, Mycobacterium
ATASFGVLPPFLMQHVSGHYTNIR

SEQ ID NO: 1122167 - protein, 19 aa, Mycobacterium
ATAVFYFDFVRLRRIPALR

SEQ ID NO: 1122168 - protein, 35 aa, Mycobacterium
ATAVGYRPLTRMLKIELPLALPVLIASLRVVAVTN

SEQ ID NO: 1122169 - protein, 25 aa, Mycobacterium
ATDGRVEYYWAFTMLAALLLLIEIF

SEQ ID NO: 1122170 - protein, 25 aa, Mycobacterium
ATDPLFCVAMGFLAAVSAAASISGL

SEQ ID NO: 1122171 - protein, 17 aa, Mycobacterium
ATEISFERETWSMVKGR

SEQ ID NO: 1122172 - protein, 21 aa, Mycobacterium
ATEPQYRMIAALDDHLGSRTP

SEQ ID NO: 1122173 - protein, 26 aa, Mycobacterium
ATERPRWMWPALLALLGATAVLYLWG

SEQ ID NO: 1122174 - protein, 19 aa, Mycobacterium
ATFAPAVFLWFFGIGALTV

SEQ ID NO: 1122175 - protein, 28 aa, Mycobacterium
ATFCLSFTRLPYFQSLGVPLALGMLVLI

SEQ ID NO: 1122176 - protein, 24 aa, Mycobacterium
ATFGGWLLAAFAVRPFKRLAQQTR

SEQ ID NO: 1122177 - protein, 17 aa, Mycobacterium
ATFVCLSLILAVADIPA

SEQ ID NO: 1122178 - protein, 25 aa, Mycobacterium
ATGDIYPRYSCDYGTPRLPPSSADY

SEQ ID NO: 1122179 - protein, 19 aa, Mycobacterium
ATGHALRKFLLEQEYIDDM

SEQ ID NO: 1122180 - protein, 26 aa, Mycobacterium
ATGPLLEMLDRVAGLSLNPDEVAVAA

SEQ ID NO: 1122181 - protein, 18 aa, Mycobacterium
ATGTTWEIVELLLTGSAF

SEQ ID NO: 1122182 - protein, 23 aa, Mycobacterium
ATHARTGGEWNRPAGSEDFAIPV

SEQ ID NO: 1122183 - protein, 31 aa, Mycobacterium
ATIAGGCLWQAEPLIGLTFCTALAVSGGYIA

SEQ ID NO: 1122184 - protein, 21 aa, Mycobacterium
ATIRPDLAIGLVIGVPSIVGM

SEQ ID NO: 1122185 - protein, 17 aa, Mycobacterium
ATLAWLALWVLYLSIVN

SEQ ID NO: 1122186 - protein, 23 aa, Mycobacterium
ATLCIPLLLAAFWVGNGASIYRP

SEQ ID NO: 1122187 - protein, 28 aa, Mycobacterium
ATLGRVELRLVWPSILSAMRISTQMSMG

SEQ ID NO: 1122188 - protein, 20 aa, Mycobacterium
ATLNLPVMIVCGFLLGAAGQ

SEQ ID NO: 1122189 - protein, 40 aa, Mycobacterium
ATLPDAYRVLGRQGIYGDFFAFYLCDLVLKVNGKGGQPVY

SEQ ID NO: 1122190 - protein, 19 aa, Mycobacterium
ATLSCWLVLIGWSLMGDAV

SEQ ID NO: 1122191 - protein, 25 aa, Mycobacterium
ATLVRMLLVPAFMHVLGRWNWWAPK

SEQ ID NO: 1122192 - protein, 20 aa, Mycobacterium
ATLWLWFTLNGYRQARRRRF

SEQ ID NO: 1122193 - protein, 20 aa, Mycobacterium
ATMVDMYVPLFGQRLAHLTP

SEQ ID NO: 1122194 - protein, 27 aa, Mycobacterium
ATPDRTALRLSEAWTHSRGEGQTVAVL

SEQ ID NO: 1122195 - protein, 18 aa, Mycobacterium
ATPQLSAWFVLVNLALAL

SEQ ID NO: 1122196 - protein, 24 aa, Mycobacterium
ATPRELFWPFGLYGLIILAVWRVA

SEQ ID NO: 1122197 - protein, 21 aa, Mycobacterium
ATRLIFPVMMVLSAYFFFAGH

SEQ ID NO: 1122198 - protein, 22 aa, Mycobacterium
ATRLRQPLIVAFIMVGVAVGPV

SEQ ID NO: 1122199 - protein, 22 aa, Mycobacterium
ATRRLWPYAVAIVVAVFSVTLA

SEQ ID NO: 1122200 - protein, 21 aa, Mycobacterium
ATRVPARYSAILGDAGMAAAL

SEQ ID NO: 1122201 - protein, 23 aa, Mycobacterium
ATRWFPTHFVTLWMVGTPSHHAG

SEQ ID NO: 1122202 - protein, 17 aa, Mycobacterium
ATSSSWFVTRWVVASAL

SEQ ID NO: 1122203 - protein, 24 aa, Mycobacterium
ATSVLWLAIAGWSLWAANSPGMGP

SEQ ID NO: 1122204 - protein, 18 aa, Mycobacterium
ATTRFARSAPAVLLAAGV

SEQ ID NO: 1122205 - protein, 18 aa, Mycobacterium
ATVFGLGIGPAVLIHEGS

SEQ ID NO: 1122206 - protein, 17 aa, Mycobacterium
ATVGGAIAWLLLLVCSP

SEQ ID NO: 1122207 - protein, 18 aa, Mycobacterium
ATVGYLLLRARLDPPGGR

SEQ ID NO: 1122208 - protein, 23 aa, Mycobacterium
ATVMSRLMLVLGVAPVLAPSFGA

SEQ ID NO: 1122209 - protein, 23 aa, Mycobacterium
ATVPPDAPPVVLPEVPSDLPLPA

SEQ ID NO: 1122210 - protein, 23 aa, Mycobacterium
ATVPPGSPLPTFPDVPVAVLDPG

SEQ ID NO: 1122211 - protein, 27 aa, Mycobacterium
ATYCLSFTRLPYFQTLGVPLAIGMFVV

SEQ ID NO: 1122212 - protein, 21 aa, Mycobacterium
ATYPADSWVPAVLAIDRILTR

SEQ ID NO: 1122213 - protein, 29 aa, Mycobacterium
AVAAALWVLAWVVGKAWVILLPVVLALIV

SEQ ID NO: 1122214 - protein, 23 aa, Mycobacterium
AVAAAVLALVVWTGHRDEADELR

SEQ ID NO: 1122215 - protein, 26 aa, Mycobacterium
AVAAVGCLLAFLWVERTAENPVVPFA

SEQ ID NO: 1122216 - protein, 19 aa, Mycobacterium
AVAAYCYIASAGVADDSNP

SEQ ID NO: 1122217 - protein, 17 aa, Mycobacterium
AVADLKDPLGRAVPVRI

SEQ ID NO: 1122218 - protein, 22 aa, Mycobacterium
AVAEIPDARFVVYVADVGDVDS

SEQ ID NO: 1122219 - protein, 26 aa, Mycobacterium
AVAERMKFGTWLLFGGIWVTLVYFPL

SEQ ID NO: 1122220 - protein, 17 aa, Mycobacterium
AVAFAGAGVLALVVLTV

SEQ ID NO: 1122221 - protein, 25 aa, Mycobacterium
AVAFNLYWRTRFVLPQIGNAETGTQ

SEQ ID NO: 1122222 - protein, 28 aa, Mycobacterium
AVAIRRLPGWPLWFAGLWSAQEWLKSAV

SEQ ID NO: 1122223 - protein, 30 aa, Mycobacterium
AVALLAAVALRFAPRVGTWTSVIGASWAYV

SEQ ID NO: 1122224 - protein, 26 aa, Mycobacterium
AVALPGLAGLIFLTFSGGVIGYRQAN

SEQ ID NO: 1122225 - protein, 19 aa, Mycobacterium
AVAMVLYVLISQVGFIVGN

SEQ ID NO: 1122226 - protein, 22 aa, Mycobacterium
AVARYGYVPVMLLGLNGAGVAL

SEQ ID NO: 1122227 - protein, 18 aa, Mycobacterium
AVATLPGDDGVVFSTIPA

SEQ ID NO: 1122228 - protein, 26 aa, Mycobacterium
AVATLWCFGASMLWALGANPGLIGAA

SEQ ID NO: 1122229 - protein, 29 aa, Mycobacterium
AVAVGVTEAVLWFIRRWLVARATMGVEAD

SEQ ID NO: 1122230 - protein, 18 aa, Mycobacterium
AVAVLLLIVVVVVAIIAA

SEQ ID NO: 1122231 - protein, 17 aa, Mycobacterium
AVAVTTVLLVALPLMGA

SEQ ID NO: 1122232 - protein, 19 aa, Mycobacterium
AVAYGRVGGVSARLLSLYI

SEQ ID NO: 1122233 - protein, 19 aa, Mycobacterium
AVAYGRVGNVSARLLSLYV

SEQ ID NO: 1122234 - protein, 18 aa, Mycobacterium
AVCGVVLVLLVVRIARRI

SEQ ID NO: 1122235 - protein, 17 aa, Mycobacterium
AVDDVDTGFVLTADEVA

SEQ ID NO: 1122236 - protein, 20 aa, Mycobacterium
AVDFLDRRGAPRGGAVALVL

SEQ ID NO: 1122237 - protein, 20 aa, Mycobacterium
AVDLGEGFAMPGAESPEQML

SEQ ID NO: 1122238 - protein, 24 aa, Mycobacterium
AVEILAHRVIWSFAMMVVVVAAVR

SEQ ID NO: 1122239 - protein, 22 aa, Mycobacterium
AVEREIGGWLLLSVIAATTVMV

SEQ ID NO: 1122240 - protein, 24 aa, Mycobacterium
AVEREISSWLVLSLVVATGVAVAG

SEQ ID NO: 1122241 - protein, 18 aa, Mycobacterium
AVFACAVSFWLLGLDTAG

SEQ ID NO: 1122242 - protein, 25 aa, Mycobacterium
AVFDRGDIALMWAFLGAGIGSVARP

SEQ ID NO: 1122243 - protein, 18 aa, Mycobacterium
AVFLARFERDVGRGEARA

SEQ ID NO: 1122244 - protein, 18 aa, Mycobacterium
AVFLWFFGIGALTVAMSG

SEQ ID NO: 1122245 - protein, 19 aa, Mycobacterium
AVFPIAVLPIIYAILILCI

SEQ ID NO: 1122246 - protein, 18 aa, Mycobacterium
AVGERRIAVWSSVPTEQE

SEQ ID NO: 1122247 - protein, 23 aa, Mycobacterium
AVGFKAGLFTADFWGRTTEIDGA

SEQ ID NO: 1122248 - protein, 24 aa, Mycobacterium
AVGFVIKYIWWFVGGAVLVGVFAG

SEQ ID NO: 1122249 - protein, 22 aa, Mycobacterium
AVGFVPWWVVALLLGRDLVLAG

SEQ ID NO: 1122250 - protein, 22 aa, Mycobacterium
AVGGGWWKTLFAAVIPQALPAM

SEQ ID NO: 1122251 - protein, 20 aa, Mycobacterium
AVGIGLAWGRGGMLVLGQGV

SEQ ID NO: 1122252 - protein, 28 aa, Mycobacterium
AVGLAAALFTMRWELVAFVAPLLGVLCS

SEQ ID NO: 1122253 - protein, 21 aa, Mycobacterium
AVGLKERFGYDDSLDVVGVHL

SEQ ID NO: 1122254 - protein, 24 aa, Mycobacterium
AVGMALWLPWLIVAGVCFILTTVA

SEQ ID NO: 1122255 - protein, 17 aa, Mycobacterium
AVHPDWHCGSAPSWFPP

SEQ ID NO: 1122256 - protein, 29 aa, Mycobacterium
AVIADGTWSRLYTDWVPRAVPPGWKPGSK

SEQ ID NO: 1122257 - protein, 26 aa, Mycobacterium
AVIAFASRPAIEWPLSEDTWSLAPVV

SEQ ID NO: 1122258 - protein, 23 aa, Mycobacterium
AVICAAAVFSAIVLRDLRIPAIG

SEQ ID NO: 1122259 - protein, 18 aa, Mycobacterium
AVIFGAIVAVVSCQKGLA

SEQ ID NO: 1122260 - protein, 18 aa, Mycobacterium
AVIRPKLTRLHRAGLLIG

SEQ ID NO: 1122261 - protein, 17 aa, Mycobacterium
AVISWSATLFFQLQAHG

SEQ ID NO: 1122262 - protein, 17 aa, Mycobacterium
AVITMIIGVGVYLSAQD

SEQ ID NO: 1122263 - protein, 18 aa, Mycobacterium
AVITMIIGVGVYLSAQDK

SEQ ID NO: 1122264 - protein, 18 aa, Mycobacterium
AVIVIRLYVGVVFASEGV

SEQ ID NO: 1122265 - protein, 17 aa, Mycobacterium
AVLAIAIPRGFRGEADA

SEQ ID NO: 1122266 - protein, 19 aa, Mycobacterium
AVLALLAWRELGRGPGGRD

SEQ ID NO: 1122267 - protein, 19 aa, Mycobacterium
AVLFLPYSLLGPFAGALLD

SEQ ID NO: 1122268 - protein, 18 aa, Mycobacterium
AVLGVGSRVGRRLLSASP

SEQ ID NO: 1122269 - protein, 25 aa, Mycobacterium
AVLIAEIVLTFTFLLVILGSTDDRA

SEQ ID NO: 1122270 - protein, 17 aa, Mycobacterium
AVLLAVAVGVLFGVVAV

SEQ ID NO: 1122271 - protein, 17 aa, Mycobacterium
AVLLIAGAGFMTVMVLA

SEQ ID NO: 1122272 - protein, 17 aa, Mycobacterium
AVLMVMISVCLLLYRNF

SEQ ID NO: 1122273 - protein, 24 aa, Mycobacterium
AVLTGRILRRWSRDPATLVQSLVM

SEQ ID NO: 1122274 - protein, 29 aa, Mycobacterium
AVLTKETMLLFLPMVAWLVWTKTAPATRR

SEQ ID NO: 1122275 - protein, 17 aa, Mycobacterium
AVLVVWLVLSVVSVRLF

SEQ ID NO: 1122276 - protein, 20 aa, Mycobacterium
AVLYPFFSFMTFLIAVPTGI

SEQ ID NO: 1122277 - protein, 20 aa, Mycobacterium
AVMLRRVMKPPLLALFFGTV

SEQ ID NO: 1122278 - protein, 23 aa, Mycobacterium
AVMTTLMALAFWLSGVGVAAAHT

SEQ ID NO: 1122279 - protein, 24 aa, Mycobacterium
AVNERRSDLALANLSSDAFRKQYE

SEQ ID NO: 1122280 - protein, 23 aa, Mycobacterium
AVNNEFFYWMSIALMMLIHAGFL

SEQ ID NO: 1122281 - protein, 22 aa, Mycobacterium
AVNTILALVGRSIPPIPTGTRE

SEQ ID NO: 1122282 - protein, 23 aa, Mycobacterium
AVPAALSAIVLWSVTSVGVVMAA

SEQ ID NO: 1122283 - protein, 32 aa, Mycobacterium
AVPAEIRADFWFSALGAMASWSVLGVLLSLYP

SEQ ID NO: 1122284 - protein, 17 aa, Mycobacterium
AVPARRRVRARRGVMRI

SEQ ID NO: 1122285 - protein, 21 aa, Mycobacterium
AVPAVSGPLVITGEDDARAVI

SEQ ID NO: 1122286 - protein, 17 aa, Mycobacterium
AVPECINKGTYVDMVAG

SEQ ID NO: 1122287 - protein, 23 aa, Mycobacterium
AVPFLAILGVAGWTTAYTSVAAL

SEQ ID NO: 1122288 - protein, 26 aa, Mycobacterium
AVPGAICAATVLLLDRFLGIGGESAM

SEQ ID NO: 1122289 - protein, 24 aa, Mycobacterium
AVPGLAGILILTGVGGYVGYRQAK

SEQ ID NO: 1122290 - protein, 23 aa, Mycobacterium
AVPGPWWAQRLVGVAAVVGLAAL

SEQ ID NO: 1122291 - protein, 19 aa, Mycobacterium
AVPMAKRYAPVLAAAAVAG

SEQ ID NO: 1122292 - protein, 17 aa, Mycobacterium
AVPPGWKPGSKAAPAPE

SEQ ID NO: 1122293 - protein, 21 aa, Mycobacterium
AVPSILGGLTINIIAMIEYSA

SEQ ID NO: 1122294 - protein, 17 aa, Mycobacterium
AVPTVWAQTHIVGEDGY

SEQ ID NO: 1122295 - protein, 20 aa, Mycobacterium
AVPVAGRPSATWPSQPPPSQ

SEQ ID NO: 1122296 - protein, 21 aa, Mycobacterium
AVQDALFWLAFIVAISAAAFV

SEQ ID NO: 1122297 - protein, 18 aa, Mycobacterium
AVQECHRAGIRVKMITGD

SEQ ID NO: 1122298 - protein, 23 aa, Mycobacterium
AVQHWPARVAVLAAALSLLLGII

SEQ ID NO: 1122299 - protein, 19 aa, Mycobacterium
AVQTMGGWGYVKDHPVEKW

SEQ ID NO: 1122300 - protein, 19 aa, Mycobacterium
AVRAWLRRRDRTRTEAVAP

SEQ ID NO: 1122301 - protein, 22 aa, Mycobacterium
AVREIPWWRRLLPGKPKPAPEP

SEQ ID NO: 1122302 - protein, 28 aa, Mycobacterium
AVRNSLRTGLGLALAVAVTHLFPVEHGF

SEQ ID NO: 1122303 - protein, 18 aa, Mycobacterium
AVRTSLVAAVFVTLFVSL

SEQ ID NO: 1122304 - protein, 17 aa, Mycobacterium
AVRVSMAVAWLMFAVDY

SEQ ID NO: 1122305 - protein, 20 aa, Mycobacterium
AVSAVLAWLTMRYIEEPLRY

SEQ ID NO: 1122306 - protein, 23 aa, Mycobacterium
AVSAVLCPLLVYGWLGAPELGLP

SEQ ID NO: 1122307 - protein, 21 aa, Mycobacterium
AVSFGEYRAELSVKHLVNDGL

SEQ ID NO: 1122308 - protein, 28 aa, Mycobacterium
AVSLRRHRFGWCVAAAYLSGVSTVVGLG

SEQ ID NO: 1122309 - protein, 20 aa, Mycobacterium
AVSRPRWLSTAVLSAVLGAS

SEQ ID NO: 1122310 - protein, 19 aa, Mycobacterium
AVSSWLVVVPLTFATALVL

SEQ ID NO: 1122311 - protein, 30 aa, Mycobacterium
AVSVGLLAAHSWLGLPGWVAVHALLLGAVT

SEQ ID NO: 1122312 - protein, 23 aa, Mycobacterium
AVTAVLALLAWRAIGGADDRLGA

SEQ ID NO: 1122313 - protein, 26 aa, Mycobacterium
AVTFPDLPDRLGLPSVHSDHWDPLLS

SEQ ID NO: 1122314 - protein, 24 aa, Mycobacterium
AVTGTIQWPALVMFLIIFFWTPPH

SEQ ID NO: 1122315 - protein, 17 aa, Mycobacterium
AVTHLFPVEHGFWVVLG

SEQ ID NO: 1122316 - protein, 22 aa, Mycobacterium
AVTMCAIGTWAAFSLDTTVTYS

SEQ ID NO: 1122317 - protein, 24 aa, Mycobacterium
AVTRRLSDLGLFVFRSYGSTEHPS

SEQ ID NO: 1122318 - protein, 20 aa, Mycobacterium
AVTTSWRPILQIIGLVVVHN

SEQ ID NO: 1122319 - protein, 22 aa, Mycobacterium
AVTVCAVLAFIRPGGELGDAPL

SEQ ID NO: 1122320 - protein, 29 aa, Mycobacterium
AVTVRRLPGWPLWFAALWAAQEWLKSSVP

SEQ ID NO: 1122321 - protein, 17 aa, Mycobacterium
AVVAGLVAAVFGGSAVQ

SEQ ID NO: 1122322 - protein, 24 aa, Mycobacterium
AVVAGSLVVHWSTMHDLFSITDSM

SEQ ID NO: 1122323 - protein, 17 aa, Mycobacterium
AVVALGICAWRAREELD

SEQ ID NO: 1122324 - protein, 19 aa, Mycobacterium
AVVALVFWILASRGIAGGQ

SEQ ID NO: 1122325 - protein, 26 aa, Mycobacterium
AVVAWRAVSTAVRWVLASYVRLALVT

SEQ ID NO: 1122326 - protein, 18 aa, Mycobacterium
AVVAYCVVFLVLVAVLVI

SEQ ID NO: 1122327 - protein, 19 aa, Mycobacterium
AVVGAVLGWNLYKQMTTKT

SEQ ID NO: 1122328 - protein, 25 aa, Mycobacterium
AVVGTGLLWLLARRIGMTRPAAAAA

SEQ ID NO: 1122329 - protein, 24 aa, Mycobacterium
AVVLAVGGDGAWVPVLDDVIIVAL

SEQ ID NO: 1122330 - protein, 17 aa, Mycobacterium
AVVLCYGLWAFGRDDQG

SEQ ID NO: 1122331 - protein, 20 aa, Mycobacterium
AVVLFFSVFEYFRSWEFFRT

SEQ ID NO: 1122332 - protein, 19 aa, Mycobacterium
AVVLVDAAYKWFRRRHRRH

SEQ ID NO: 1122333 - protein, 26 aa, Mycobacterium
AVVPARSLLGLAVGWFVGALVVLVVG

SEQ ID NO: 1122334 - protein, 18 aa, Mycobacterium
AVVQRSGKIDVHMVTHNE

SEQ ID NO: 1122335 - protein, 17 aa, Mycobacterium
AVVRRVAGVEKFAEVKR

SEQ ID NO: 1122336 - protein, 19 aa, Mycobacterium
AVVSQPGNHDWPFASTAFT

SEQ ID NO: 1122337 - protein, 26 aa, Mycobacterium
AVVSVLCAFGIDWAPLIWLPAAAAFF

SEQ ID NO: 1122338 - protein, 18 aa, Mycobacterium
AVVTLCLELFGFSEHTPM

SEQ ID NO: 1122339 - protein, 25 aa, Mycobacterium
AVVVLAFFVWHCLRTPEPFVDVRLV

SEQ ID NO: 1122340 - protein, 19 aa, Mycobacterium
AVVVPIVHFYGRRELAHIM

SEQ ID NO: 1122341 - protein, 22 aa, Mycobacterium
AVVVSAWWRPAATGAVLLAVLT

SEQ ID NO: 1122342 - protein, 26 aa, Mycobacterium
AVVVVVATVIVWRFVGDALSGRSDVA

SEQ ID NO: 1122343 - protein, 17 aa, Mycobacterium
AVVYLMAAPRGREDPAT

SEQ ID NO: 1122344 - protein, 18 aa, Mycobacterium
AVWARVMDWWDGLTRAQK

SEQ ID NO: 1122345 - protein, 17 aa, Mycobacterium
AVWERRTEWPLAAMAVV

SEQ ID NO: 1122346 - protein, 23 aa, Mycobacterium
AWDQERMMRFSFAPDRFDIPPGG

SEQ ID NO: 1122347 - protein, 17 aa, Mycobacterium
AWFAALLGLVVLVLTAY

SEQ ID NO: 1122348 - protein, 18 aa, Mycobacterium
AWLACVPLAMAVTALAGL

SEQ ID NO: 1122349 - protein, 18 aa, Mycobacterium
AWLMLWVGLPLMARRGTR

SEQ ID NO: 1122350 - protein, 17 aa, Mycobacterium
AWLTFGVVPAYMVVALV

SEQ ID NO: 1122351 - protein, 26 aa, Mycobacterium
AWNYKFCGQCGSPIGVVAFPDDDAVA

SEQ ID NO: 1122352 - protein, 19 aa, Mycobacterium
AWSHARWLTTTAVVMGVVV

SEQ ID NO: 1122353 - protein, 17 aa, Mycobacterium
AWSTTLYLKVFGWLIWL

SEQ ID NO: 1122354 - protein, 17 aa, Mycobacterium
AYDFSRGAALLVGTPTL

SEQ ID NO: 1122355 - protein, 25 aa, Mycobacterium
AYDIGLFYRYAWQNPVFTDIVATRS

SEQ ID NO: 1122356 - protein, 28 aa, Mycobacterium
AYGELLRFLFEPIFDFLRDPLGNTIKLI

SEQ ID NO: 1122357 - protein, 18 aa, Mycobacterium
AYGWGTAQVVGWDDVGRV

SEQ ID NO: 1122358 - protein, 30 aa, Mycobacterium
AYHEGGHTLAAWAMPDIDPIYKVTILARGR

SEQ ID NO: 1122359 - protein, 20 aa, Mycobacterium
AYIPAFVGAIAWSFLLSPQS

SEQ ID NO: 1122360 - protein, 35 aa, Mycobacterium
AYKKDRYSGWLGGWRWAKDKLFGMPDKVNTFYTAG

SEQ ID NO: 1122361 - protein, 23 aa, Mycobacterium
AYLGLLCTWLLVAVRTVRGGLRG

SEQ ID NO: 1122362 - protein, 26 aa, Mycobacterium
AYLLAKVCIYAVFAILQSTIVTAITI

SEQ ID NO: 1122363 - protein, 17 aa, Mycobacterium
AYLNWVRRHLPRINRAG

SEQ ID NO: 1122364 - protein, 17 aa, Mycobacterium
AYLPFQAGRPFAAAVRG

SEQ ID NO: 1122365 - protein, 17 aa, Mycobacterium
AYPRTTNAWAVAALVCA

SEQ ID NO: 1122366 - protein, 22 aa, Mycobacterium
AYQWNWKFGYQKVDFADGTLTY

SEQ ID NO: 1122367 - protein, 19 aa, Mycobacterium
AYRTLAVAYLRLQRADPPE

SEQ ID NO: 1122368 - protein, 20 aa, Mycobacterium
AYRYRLRVLLAATVAGGLVA

SEQ ID NO: 1122369 - protein, 26 aa, Mycobacterium
AYSEERLRPPPGYKDTTVPGIFSRDT

SEQ ID NO: 1122370 - protein, 20 aa, Mycobacterium
AYTSRSWLSGLLVGLSAGVK

SEQ ID NO: 1122371 - protein, 24 aa, Mycobacterium
AYVYSLDNQRLWSNLDCAPSNETL

SEQ ID NO: 1122372 - protein, 18 aa, Mycobacterium
CAALGPAWFWLGPAPPAG

SEQ ID NO: 1122373 - protein, 25 aa, Mycobacterium
CAFAETYWQLLLFRSLGGIGSAMFT

SEQ ID NO: 1122374 - protein, 19 aa, Mycobacterium
CAGLSAPLIEVHISNVHRR

SEQ ID NO: 1122375 - protein, 25 aa, Mycobacterium
CAGRPTVSRWGLWSSDRTIAVRRIP

SEQ ID NO: 1122376 - protein, 17 aa, Mycobacterium
CALVIREIYRPGLDLVR

SEQ ID NO: 1122377 - protein, 22 aa, Mycobacterium
CARLASSGAPLWSLYPGEIPHP

SEQ ID NO: 1122378 - protein, 20 aa, Mycobacterium
CASNGDFDVWPGPASERQTR

SEQ ID NO: 1122379 - protein, 38 aa, Mycobacterium
CATRWGDRAERRWPFGVAAAFLALGMALRWDVFGTGLG

SEQ ID NO: 1122380 - protein, 18 aa, Mycobacterium
CAVVDFSAYLGYHVGLFY

SEQ ID NO: 1122381 - protein, 18 aa, Mycobacterium
CCAADAQLARIVLGGPAA

SEQ ID NO: 1122382 - protein, 19 aa, Mycobacterium
CDIREGMVAWLQRTNPCAL

SEQ ID NO: 1122383 - protein, 27 aa, Mycobacterium
CDQLSPADAVACARRLARYRPGAGARR

SEQ ID NO: 1122384 - protein, 21 aa, Mycobacterium
CDVETKYHCAQVIADPERDSG

SEQ ID NO: 1122385 - protein, 21 aa, Mycobacterium
CEKMGEKLDRIRLSKAQLDTL

SEQ ID NO: 1122386 - protein, 19 aa, Mycobacterium
CEPWNPETREYGPISDPES

SEQ ID NO: 1122387 - protein, 18 aa, Mycobacterium
CFSDRYPSWEPKLKEMVP

SEQ ID NO: 1122388 - protein, 21 aa, Mycobacterium
CFTGSFMWRRGFGAAALFYGH

SEQ ID NO: 1122389 - protein, 21 aa, Mycobacterium
CGAGFALTSAHSWRNKTRWFT

SEQ ID NO: 1122390 - protein, 17 aa, Mycobacterium
CGALIDGVREFPGPWAL

SEQ ID NO: 1122391 - protein, 19 aa, Mycobacterium
CGDEQRLSQVLANLLDNAL

SEQ ID NO: 1122392 - protein, 20 aa, Mycobacterium
CGIMGLGAALLIAALLLSTY

SEQ ID NO: 1122393 - protein, 29 aa, Mycobacterium
CGKSVEPGTHFCPYCAHPVDGGAAQQSPA

SEQ ID NO: 1122394 - protein, 18 aa, Mycobacterium
CGLVAAALVLRRPQYRAL

SEQ ID NO: 1122395 - protein, 17 aa, Mycobacterium
CGMPRALVLDNVNPAAD

SEQ ID NO: 1122396 - protein, 21 aa, Mycobacterium
CGPEGNWPCSDLYRAMNVALL

SEQ ID NO: 1122397 - protein, 18 aa, Mycobacterium
CGPGGPGMYGPGMQGGMP

SEQ ID NO: 1122398 - protein, 19 aa, Mycobacterium
CGTPEDWAGLTGSAGYAGT

SEQ ID NO: 1122399 - protein, 18 aa, Mycobacterium
CIYGFRFMLLVNKVAVVA

SEQ ID NO: 1122400 - protein, 20 aa, Mycobacterium
CLLAPVSVVPLMLPDSRRMA

SEQ ID NO: 1122401 - protein, 23 aa, Mycobacterium
CLLGSRLGPVVVRHAPDQPLRVA

SEQ ID NO: 1122402 - protein, 25 aa, Mycobacterium
CLLQGAKLALDRGWYDAAGGNGKSI

SEQ ID NO: 1122403 - protein, 20 aa, Mycobacterium
CLPLFRHLWSTQVIAPEHLP

SEQ ID NO: 1122404 - protein, 19 aa, Mycobacterium
CLTGCAIGEIAGLIIGTAL

SEQ ID NO: 1122405 - protein, 19 aa, Mycobacterium
CLTGCAIGEVAGLIIGTAL

SEQ ID NO: 1122406 - protein, 21 aa, Mycobacterium
CMVGSGSIAVWLAITEAQAAS

SEQ ID NO: 1122407 - protein, 17 aa, Mycobacterium
CPHCRHPVLTHPIHAIA

SEQ ID NO: 1122408 - protein, 18 aa, Mycobacterium
CPKAINFAGYGMIGVYGD

SEQ ID NO: 1122409 - protein, 19 aa, Mycobacterium
CPKAINFAGYGMIGVYGDR

SEQ ID NO: 1122410 - protein, 20 aa, Mycobacterium
CPNPSWASPTRRAVVFGCDT

SEQ ID NO: 1122411 - protein, 18 aa, Mycobacterium
CQGVAGAISIYVAGFHDG

SEQ ID NO: 1122412 - protein, 23 aa, Mycobacterium
CQLEDIRAALAYARAHEAIDARR

SEQ ID NO: 1122413 - protein, 24 aa, Mycobacterium
CRASRIVLHPGFTIPVFLLSYYGL

SEQ ID NO: 1122414 - protein, 25 aa, Mycobacterium
CRQHPRFSLHPDLPPWKDIWSYFGS

SEQ ID NO: 1122415 - protein, 20 aa, Mycobacterium
CRVVATGNSLDGVWEQLMPG

SEQ ID NO: 1122416 - protein, 22 aa, Mycobacterium
CSAAVKRYLGARFDPNSRFTIS

SEQ ID NO: 1122417 - protein, 19 aa, Mycobacterium
CSECRHLTFSSANRNQASC

SEQ ID NO: 1122418 - protein, 19 aa, Mycobacterium
CSGLTRFAFAGVGVLLPRW

SEQ ID NO: 1122419 - protein, 19 aa, Mycobacterium
CSRDPRIRRVLSREMVVYR

SEQ ID NO: 1122420 - protein, 24 aa, Mycobacterium
CTDLPKVGFEKHPPFVITDVNANP

SEQ ID NO: 1122421 - protein, 21 aa, Mycobacterium
CTQLRLARLAGRRSSGSRLAG

SEQ ID NO: 1122422 - protein, 20 aa, Mycobacterium
CTSLAFILFFALIREVGAPR

SEQ ID NO: 1122423 - protein, 19 aa, Mycobacterium
CTVAGHRAAGMTMTIRTDG

SEQ ID NO: 1122424 - protein, 21 aa, Mycobacterium
CVALLMSFFSVRVITTAFYGQ

SEQ ID NO: 1122425 - protein, 19 aa, Mycobacterium
CVIDPKGGMELGAGAPMFT

SEQ ID NO: 1122426 - protein, 20 aa, Mycobacterium
CVKAVMLVGTPAMWFIAAPV

SEQ ID NO: 1122427 - protein, 20 aa, Mycobacterium
CVKAVMLVGTPAMWFIAVPV

SEQ ID NO: 1122428 - protein, 24 aa, Mycobacterium
CVLLGVPMALVLARARFAGQSVLR

SEQ ID NO: 1122429 - protein, 26 aa, Mycobacterium
CVLLLRRLPILLLLRRPLRLSVPDAL

SEQ ID NO: 1122430 - protein, 27 aa, Mycobacterium
CVQRRIRSWWLLLPLGVATWVLVHESG

SEQ ID NO: 1122431 - protein, 18 aa, Mycobacterium
CVVRRWITGQGFADSGLR

SEQ ID NO: 1122432 - protein, 20 aa, Mycobacterium
CWIAMAAALFGYAARLPRED

SEQ ID NO: 1122433 - protein, 20 aa, Mycobacterium
CWMGILIWCLYVFNMTMYAD

SEQ ID NO: 1122434 - protein, 21 aa, Mycobacterium
CWMGVLIWCLYVFNMTMYADV

SEQ ID NO: 1122435 - protein, 19 aa, Mycobacterium
CWMHRRRVTVPSSKPHKPE

SEQ ID NO: 1122436 - protein, 21 aa, Mycobacterium
CYHAAGIWRRGIVGHPIKVVK

SEQ ID NO: 1122437 - protein, 17 aa, Mycobacterium
DAAAMWRYAGMAASALV

SEQ ID NO: 1122438 - protein, 19 aa, Mycobacterium
DAAEAVAFYRGEIAERTGL

SEQ ID NO: 1122439 - protein, 24 aa, Mycobacterium
DAAGRRFLCSVGRPEFTAPELIGV

SEQ ID NO: 1122440 - protein, 18 aa, Mycobacterium
DAALIPGLLVYRYDAPLC

SEQ ID NO: 1122441 - protein, 17 aa, Mycobacterium
DAARTGTVALLSYSPES

SEQ ID NO: 1122442 - protein, 17 aa, Mycobacterium
DAAWLSSFDDGMQVIEV

SEQ ID NO: 1122443 - protein, 18 aa, Mycobacterium
DAAYKWFRRRHRRHHGGE

SEQ ID NO: 1122444 - protein, 22 aa, Mycobacterium
DADALARVWPRYDAMRTELAIG

SEQ ID NO: 1122445 - protein, 26 aa, Mycobacterium
DADTRLYLPMPFFWIGGLGGGLLSAL

SEQ ID NO: 1122446 - protein, 18 aa, Mycobacterium
DAEALCWDVGEIVELRGR

SEQ ID NO: 1122447 - protein, 18 aa, Mycobacterium
DAENDRGLQFGFISDAAG

SEQ ID NO: 1122448 - protein, 26 aa, Mycobacterium
DAERRVRTGPCGDRHRPLTLPGDDAL

SEQ ID NO: 1122449 - protein, 20 aa, Mycobacterium
DAFAERWLAPLSFAGIFVTA

SEQ ID NO: 1122450 - protein, 20 aa, Mycobacterium
DAFNDAWNADSFYLPPEAFE

SEQ ID NO: 1122451 - protein, 29 aa, Mycobacterium
DAFVQMFRPPFAWREFLLQTWFVARVALF

SEQ ID NO: 1122452 - protein, 23 aa, Mycobacterium
DAGEVLRLAASVDQLSQHVLGEA

SEQ ID NO: 1122453 - protein, 19 aa, Mycobacterium
DAKGMKVGIDIQDVRLEDT

SEQ ID NO: 1122454 - protein, 17 aa, Mycobacterium
DALDELSRKIVVDVDNE

SEQ ID NO: 1122455 - protein, 33 aa, Mycobacterium
DALHRIGERDALLGWAHLLLWAMFTCIELLPVL

SEQ ID NO: 1122456 - protein, 22 aa, Mycobacterium
DALLVTCLERLRAILVGHAGWP

SEQ ID NO: 1122457 - protein, 17 aa, Mycobacterium
DALRRSPNWTVFYEDGE

SEQ ID NO: 1122458 - protein, 24 aa, Mycobacterium
DALTAVPLWIAFALSTKAATRRYT

SEQ ID NO: 1122459 - protein, 31 aa, Mycobacterium
DALWTLSLIHLRLSLIPILLGLLIAVPLGAL

SEQ ID NO: 1122460 - protein, 25 aa, Mycobacterium
DANYGTWWFWLGLILIVGILLLVGN

SEQ ID NO: 1122461 - protein, 21 aa, Mycobacterium
DAPLNWFPLYLGAALVVEILA

SEQ ID NO: 1122462 - protein, 25 aa, Mycobacterium
DAPSDGLPVWPFVAAATVIVAAGAL

SEQ ID NO: 1122463 - protein, 21 aa, Mycobacterium
DARGVGAVVRRVAGVEKFAEV

SEQ ID NO: 1122464 - protein, 23 aa, Mycobacterium
DARQRLRGIATIEAMLAADPGQR

SEQ ID NO: 1122465 - protein, 22 aa, Mycobacterium
DASALDVAALWAPRNRDDELRV

SEQ ID NO: 1122466 - protein, 21 aa, Mycobacterium
DASAVRWSWVLDGMVEIGALS

SEQ ID NO: 1122467 - protein, 24 aa, Mycobacterium
DASRGWAQVPRRVLTVPMEGPNPA

SEQ ID NO: 1122468 - protein, 18 aa, Mycobacterium
DATAGMVCVVSREPKPDL

SEQ ID NO: 1122469 - protein, 19 aa, Mycobacterium
DATGGYSFESFRWAWTAQY

SEQ ID NO: 1122470 - protein, 25 aa, Mycobacterium
DATGWEQLRILGLIGAAAAVGNFVG

SEQ ID NO: 1122471 - protein, 27 aa, Mycobacterium
DATIIRMFLVPAIMKLLGDDCWWAPRW

SEQ ID NO: 1122472 - protein, 24 aa, Mycobacterium
DATVCAPEHRWLTSVPDELVNVLG

SEQ ID NO: 1122473 - protein, 24 aa, Mycobacterium
DAVEHVARLALLVRAEREGQSEEV

SEQ ID NO: 1122474 - protein, 25 aa, Mycobacterium
DAVPFVWSSPFWFPILVGAATASLA

SEQ ID NO: 1122475 - protein, 22 aa, Mycobacterium
DAVPRISRAQSLDVLSSMANIA

SEQ ID NO: 1122476 - protein, 23 aa, Mycobacterium
DAWLKLCQAYGWAPGVMGASAAG

SEQ ID NO: 1122477 - protein, 23 aa, Mycobacterium
DAYWRFLMEGRSAVRQVPEERWE

SEQ ID NO: 1122478 - protein, 19 aa, Mycobacterium
DCGTTFTWGTKAFGPWIGW

SEQ ID NO: 1122479 - protein, 17 aa, Mycobacterium
DDAFALDAVEAAQVPHL

SEQ ID NO: 1122480 - protein, 25 aa, Mycobacterium
DDAIYQKMLSEWLVDPHELSHSTDL

SEQ ID NO: 1122481 - protein, 25 aa, Mycobacterium
DDARRRLAQAIAEFAGQIGATVIAE

SEQ ID NO: 1122482 - protein, 25 aa, Mycobacterium
DDAWRHYRFAVAYLMVLPVITLIGW

SEQ ID NO: 1122483 - protein, 22 aa, Mycobacterium
DDCADAIPVARVWDSLAVLHSQ

SEQ ID NO: 1122484 - protein, 23 aa, Mycobacterium
DDGELGRQCALVLGIGSLANDAT

SEQ ID NO: 1122485 - protein, 21 aa, Mycobacterium
DDGRWRWRRIVQSPLAIAAWL

SEQ ID NO: 1122486 - protein, 21 aa, Mycobacterium
DDGTNMVWIWFWDVLSIGGSI

SEQ ID NO: 1122487 - protein, 22 aa, Mycobacterium
DDGWVFPVNRPLAPEPGDNQAL

SEQ ID NO: 1122488 - protein, 27 aa, Mycobacterium
DDKGLMTRSEMIARLVFAMGGRAAEEL

SEQ ID NO: 1122489 - protein, 19 aa, Mycobacterium
DDMARLAVSFNDMAESLQR

SEQ ID NO: 1122490 - protein, 17 aa, Mycobacterium
DDPRAAVLVPLVQTATT

SEQ ID NO: 1122491 - protein, 23 aa, Mycobacterium
DDPRRLLEFADILVAAPPNIANA

SEQ ID NO: 1122492 - protein, 21 aa, Mycobacterium
DDPSRPVVCIVRARSYDGDET

SEQ ID NO: 1122493 - protein, 24 aa, Mycobacterium
DDSVGLWYAFLVVIELALRMPVRV

SEQ ID NO: 1122494 - protein, 24 aa, Mycobacterium
DDWPYRLTTMLQMVGVIVLALGLP

SEQ ID NO: 1122495 - protein, 21 aa, Mycobacterium
DEFARRLPLMAEKRDFSNPVG

SEQ ID NO: 1122496 - protein, 21 aa, Mycobacterium
DEHRRELFLQVGRQGALNLTT

SEQ ID NO: 1122497 - protein, 22 aa, Mycobacterium
DEIEGLRFSKANWARATRKDGS

SEQ ID NO: 1122498 - protein, 24 aa, Mycobacterium
DELARSAGYPSVFAQGMFSAALLA

SEQ ID NO: 1122499 - protein, 26 aa, Mycobacterium
DELGRSGLPVVHDWQASPARQATIDF

SEQ ID NO: 1122500 - protein, 33 aa, Mycobacterium
DELLRWLNDDPRGWSRLRGNAVVAIEGAEPQLV

SEQ ID NO: 1122501 - protein, 30 aa, Mycobacterium
DELPGLRAGTGLTVLTWLMRVGFLGAPLIV

SEQ ID NO: 1122502 - protein, 22 aa, Mycobacterium
DELPWDPPTVFLMRRGSEDSYT

SEQ ID NO: 1122503 - protein, 30 aa, Mycobacterium
DELTARADLFLRARVNSFTSYRKSTGQTLP

SEQ ID NO: 1122504 - protein, 21 aa, Mycobacterium
DEPRLRQVLSNLVANALQHTP

SEQ ID NO: 1122505 - protein, 19 aa, Mycobacterium
DEQARIAAELNDRVIQRVF

SEQ ID NO: 1122506 - protein, 18 aa, Mycobacterium
DEQASMTLESGRVFDRLR

SEQ ID NO: 1122507 - protein, 24 aa, Mycobacterium
DEQFVPLNDGFNWKGDPNATLSGQ

SEQ ID NO: 1122508 - protein, 21 aa, Mycobacterium
DERGFSMALGRLGDPADGDCL

SEQ ID NO: 1122509 - protein, 22 aa, Mycobacterium
DERRAVRVGVVFGLMALAAVVV

SEQ ID NO: 1122510 - protein, 19 aa, Mycobacterium
DEVLRFGLMATDLDPAVGG

SEQ ID NO: 1122511 - protein, 27 aa, Mycobacterium
DFAKILRARWITVAVTLVLAVLGAAAV

SEQ ID NO: 1122512 - protein, 17 aa, Mycobacterium
DFDYRWDEPPHVGGARA

SEQ ID NO: 1122513 - protein, 37 aa, Mycobacterium
DFFRPIRNYFYWEPHCYNIPVCWALRSVFDTLDGINV

SEQ ID NO: 1122514 - protein, 18 aa, Mycobacterium
DFFSVVKSLALFVNALHQ

SEQ ID NO: 1122515 - protein, 17 aa, Mycobacterium
DFGEFKSLAQLEAKPLK

SEQ ID NO: 1122516 - protein, 17 aa, Mycobacterium
DFPALPPLPRVSLLVAV

SEQ ID NO: 1122517 - protein, 18 aa, Mycobacterium
DFRRAAEVTNIYGDAGPD

SEQ ID NO: 1122518 - protein, 18 aa, Mycobacterium
DFVNGAIFYSPETGANVV

SEQ ID NO: 1122519 - protein, 17 aa, Mycobacterium
DGAALQLDDVRPMAVGF

SEQ ID NO: 1122520 - protein, 17 aa, Mycobacterium
DGAAWAALVGLVLAGAS

SEQ ID NO: 1122521 - protein, 19 aa, Mycobacterium
DGADVLGLNMARRVADGEQ

SEQ ID NO: 1122522 - protein, 17 aa, Mycobacterium
DGAFAASSVKVGLKKID

SEQ ID NO: 1122523 - protein, 25 aa, Mycobacterium
DGANSGWWPLLWFTVKVWLFLFFFM

SEQ ID NO: 1122524 - protein, 26 aa, Mycobacterium
DGAQWSSRCPHIMTWLRCALIACAIA

SEQ ID NO: 1122525 - protein, 24 aa, Mycobacterium
DGASRRAVFVGAMRVGRDHIASTV

SEQ ID NO: 1122526 - protein, 23 aa, Mycobacterium
DGAWYRRIRLAAVVGVLMSAVVY

SEQ ID NO: 1122527 - protein, 17 aa, Mycobacterium
DGCGERRLLFSSPAQLE

SEQ ID NO: 1122528 - protein, 18 aa, Mycobacterium
DGDLGGAVRTMIELADAA

SEQ ID NO: 1122529 - protein, 21 aa, Mycobacterium
DGDPAFEVLVPFAVDGGPTVL

SEQ ID NO: 1122530 - protein, 25 aa, Mycobacterium
DGDYDRPIIRPGLRETAEIADAVEQ

SEQ ID NO: 1122531 - protein, 17 aa, Mycobacterium
DGDYMWAFAAAALIGLY

SEQ ID NO: 1122532 - protein, 25 aa, Mycobacterium
DGFGCVRIGLGRAPMSVRLIAPEAG

SEQ ID NO: 1122533 - protein, 19 aa, Mycobacterium
DGFGRWRYHDGFHHGGQQW

SEQ ID NO: 1122534 - protein, 22 aa, Mycobacterium
DGGFPQLGRFIVRHPVLIIVAW

SEQ ID NO: 1122535 - protein, 21 aa, Mycobacterium
DGGRASLLVRGFLVNATNPKG

SEQ ID NO: 1122536 - protein, 17 aa, Mycobacterium
DGHTIRLGRPGWLDPGP

SEQ ID NO: 1122537 - protein, 24 aa, Mycobacterium
DGIGLKFVQYLAFAGVLIGASVYQ

SEQ ID NO: 1122538 - protein, 23 aa, Mycobacterium
DGKTVLPSWGLPVLIAAAVAAVA

SEQ ID NO: 1122539 - protein, 17 aa, Mycobacterium
DGLAISVLDTGPGVPEH

SEQ ID NO: 1122540 - protein, 30 aa, Mycobacterium
DGLGLQGWGGLRLALPLGDDSDASYLAAEA

SEQ ID NO: 1122541 - protein, 30 aa, Mycobacterium
DGLIFLLLCGLSFYLWWRAQQQKVDHSNVN

SEQ ID NO: 1122542 - protein, 17 aa, Mycobacterium
DGLPATLIAKLPAESQA

SEQ ID NO: 1122543 - protein, 29 aa, Mycobacterium
DGNIDRWVDVPGRLVARYTSVVVGLDTSG

SEQ ID NO: 1122544 - protein, 17 aa, Mycobacterium
DGPALGAACQRMHDSAG

SEQ ID NO: 1122545 - protein, 25 aa, Mycobacterium
DGPEGMPPKLDEPGPIAPSVIDAAP

SEQ ID NO: 1122546 - protein, 26 aa, Mycobacterium
DGPEGMPPKLDEPGPIAPSVIDAAPG

SEQ ID NO: 1122547 - protein, 19 aa, Mycobacterium
DGQARFAAFVDAFVESARG

SEQ ID NO: 1122548 - protein, 18 aa, Mycobacterium
DGQLRTSVLAEFTEAPAR

SEQ ID NO: 1122549 - protein, 23 aa, Mycobacterium
DGRAKFPGLAWLRQPSTFSDREW

SEQ ID NO: 1122550 - protein, 26 aa, Mycobacterium
DGRFFGRFDLAVAVFFALSGFLLWRG

SEQ ID NO: 1122551 - protein, 33 aa, Mycobacterium
DGRRPPRLGRGWLTAICAVLLLLGAGAGVGGYL

SEQ ID NO: 1122552 - protein, 19 aa, Mycobacterium
DGRTARFAITSSHDPFSAE

SEQ ID NO: 1122553 - protein, 24 aa, Mycobacterium
DGRWSIASAAPVRFLRNKKLTGAM

SEQ ID NO: 1122554 - protein, 38 aa, Mycobacterium
DGTDIYAQWTAFFAVWAWFCEATGLPAITAAHYFTPVI

SEQ ID NO: 1122555 - protein, 22 aa, Mycobacterium
DGTNIWVGLVFVVVALLLGAFM

SEQ ID NO: 1122556 - protein, 23 aa, Mycobacterium
DGTPELRLPVAYRDDDLTVYAVG

SEQ ID NO: 1122557 - protein, 18 aa, Mycobacterium
DGVARGDYYFSITLPPDF

SEQ ID NO: 1122558 - protein, 19 aa, Mycobacterium
DGVDFATAPPPPGIPYLDT

SEQ ID NO: 1122559 - protein, 17 aa, Mycobacterium
DGVELWLSGLPFLAQTV

SEQ ID NO: 1122560 - protein, 18 aa, Mycobacterium
DGVTPWIAAPLLFIGVLF

SEQ ID NO: 1122561 - protein, 23 aa, Mycobacterium
DGVVVGGFALWYVIGANSSDDGY

SEQ ID NO: 1122562 - protein, 17 aa, Mycobacterium
DGYDPALLIAEVEKTGY

SEQ ID NO: 1122563 - protein, 18 aa, Mycobacterium
DGYGVLFCDIERFKSVND

SEQ ID NO: 1122564 - protein, 19 aa, Mycobacterium
DHFDWLSGYLQTRGMATAM

SEQ ID NO: 1122565 - protein, 21 aa, Mycobacterium
DHGSGVFSRAGPRGETRGAAQ

SEQ ID NO: 1122566 - protein, 17 aa, Mycobacterium
DHGYPCRLIAPSRPGVL

SEQ ID NO: 1122567 - protein, 18 aa, Mycobacterium
DHLPSLPVRPGIVAVLSV

SEQ ID NO: 1122568 - protein, 25 aa, Mycobacterium
DHLVPVVAGALVWGAAVGIQESTLR

SEQ ID NO: 1122569 - protein, 27 aa, Mycobacterium
DHPPAGWLQLAGWMLLTGPGFGGNAVT

SEQ ID NO: 1122570 - protein, 22 aa, Mycobacterium
DHREHFHWDPAKLVAAVGTERM

SEQ ID NO: 1122571 - protein, 26 aa, Mycobacterium
DHVQRMPVAFFTRTRTGALVSRLGND

SEQ ID NO: 1122572 - protein, 19 aa, Mycobacterium
DHYEWFSGFLDARGAKPAV

SEQ ID NO: 1122573 - protein, 19 aa, Mycobacterium
DHYYWLTAFLAARGAQRGI

SEQ ID NO: 1122574 - protein, 20 aa, Mycobacterium
DIAATLWHPHIVAVHDRGEY

SEQ ID NO: 1122575 - protein, 26 aa, Mycobacterium
DIDAATEWQLFLSAQWLAAAGSIFAA

SEQ ID NO: 1122576 - protein, 26 aa, Mycobacterium
DIEIKKRRRRPWIAGAAAAVVVIAGG

SEQ ID NO: 1122577 - protein, 20 aa, Mycobacterium
DILLFYVFFEAMLIPMYFLI

SEQ ID NO: 1122578 - protein, 18 aa, Mycobacterium
DIPAFRHAEIAPKVQEIC

SEQ ID NO: 1122579 - protein, 20 aa, Mycobacterium
DIPVGTGYAVWVGIGAALTV

SEQ ID NO: 1122580 - protein, 24 aa, Mycobacterium
DIQPESAEVLVFINQTTTSKENPD

SEQ ID NO: 1122581 - protein, 26 aa, Mycobacterium
DIQSVSWLPLFHDMGLLMIMFPAVAG

SEQ ID NO: 1122582 - protein, 27 aa, Mycobacterium
DIRPNPGIGHPCWANYFPVTRANPEPP

SEQ ID NO: 1122583 - protein, 19 aa, Mycobacterium
DISTWFHWSSWYGEVIQGI

SEQ ID NO: 1122584 - protein, 42 aa, Mycobacterium
DKHGRPFRRRNFLPGAALFACLAIAALLVWVIALSRPPEVQQ

SEQ ID NO: 1122585 - protein, 24 aa, Mycobacterium
DKIPALSWRTVRMLIAVAVVGCAG

SEQ ID NO: 1122586 - protein, 20 aa, Mycobacterium
DKLALGLAFFYPVADMVILA

SEQ ID NO: 1122587 - protein, 23 aa, Mycobacterium
DKLQVGEEVIAAGAPLGLRSTVT

SEQ ID NO: 1122588 - protein, 27 aa, Mycobacterium
DKQPRAWRLSVDIVRDAGRLKMSKMEF

SEQ ID NO: 1122589 - protein, 19 aa, Mycobacterium
DKTWPVYVVLVYLLGCTVA

SEQ ID NO: 1122590 - protein, 33 aa, Mycobacterium
DKWPEKLARLSFWSLNIGLAWMVFATLLPLGVL

SEQ ID NO: 1122591 - protein, 20 aa, Mycobacterium
DLATAVVIGTAFTGLVTAFT

SEQ ID NO: 1122592 - protein, 26 aa, Mycobacterium
DLAVIKFRRCVIINGIDVGAIRPDLA

SEQ ID NO: 1122593 - protein, 31 aa, Mycobacterium
DLCALLLQIYIVMGASWVWYRGLQGQPVPVF

SEQ ID NO: 1122594 - protein, 30 aa, Mycobacterium
DLDGLGRYRVVAFPAHIPGQVVVAGLPTGD

SEQ ID NO: 1122595 - protein, 25 aa, Mycobacterium
DLEHPVGGWVLFAVLIGWSAACATA

SEQ ID NO: 1122596 - protein, 19 aa, Mycobacterium
DLFVGRPPIFAGLSRSDSR

SEQ ID NO: 1122597 - protein, 20 aa, Mycobacterium
DLGEAFSWSLFNWIADVACL

SEQ ID NO: 1122598 - protein, 19 aa, Mycobacterium
DLGGLYFNALVAIVITGLW

SEQ ID NO: 1122599 - protein, 19 aa, Mycobacterium
DLGRFRLPLYVTALSVFLG

SEQ ID NO: 1122600 - protein, 22 aa, Mycobacterium
DLGWEAWLALCVAIAGLWAVAI

SEQ ID NO: 1122601 - protein, 17 aa, Mycobacterium
DLICGATGWPDMGTGNA

SEQ ID NO: 1122602 - protein, 17 aa, Mycobacterium
DLIKLRMTVKVRPNAQW

SEQ ID NO: 1122603 - protein, 18 aa, Mycobacterium
DLLDRLGTHLTRHIGPGV

SEQ ID NO: 1122604 - protein, 19 aa, Mycobacterium
DLLFRPRAFAALLVAKLAA

SEQ ID NO: 1122605 - protein, 30 aa, Mycobacterium
DLLLACLAVPFILGLYWRRGTVKAAMAAMV

SEQ ID NO: 1122606 - protein, 18 aa, Mycobacterium
DLLPQRRPGASGIVETPA

SEQ ID NO: 1122607 - protein, 18 aa, Mycobacterium
DLLRGWWGLLISVGLGLA

SEQ ID NO: 1122608 - protein, 17 aa, Mycobacterium
DLLSARHDLGFVTLPVL

SEQ ID NO: 1122609 - protein, 19 aa, Mycobacterium
DLLTGEFRDSYTSLTNDVV

SEQ ID NO: 1122610 - protein, 18 aa, Mycobacterium
DLLWSFLQAILMAMAVLL

SEQ ID NO: 1122611 - protein, 22 aa, Mycobacterium
DLMGPWPVYLLVGFTLVAAVWA

SEQ ID NO: 1122612 - protein, 27 aa, Mycobacterium
DLMGVPRLTFWDYPLAAAISVVTLFVL

SEQ ID NO: 1122613 - protein, 17 aa, Mycobacterium
DLMHRFIYLKLGLALVL

SEQ ID NO: 1122614 - protein, 19 aa, Mycobacterium
DLPKAVLFSLAFIALVVGY

SEQ ID NO: 1122615 - protein, 23 aa, Mycobacterium
DLPRPEASAVIARLAELGVKNTV

SEQ ID NO: 1122616 - protein, 31 aa, Mycobacterium
DLREPWPGLRWRPLLIAAAALLVWSVLMLLL

SEQ ID NO: 1122617 - protein, 28 aa, Mycobacterium
DLRLQWSWRSAGIGLLFGILGLFVTIPA

SEQ ID NO: 1122618 - protein, 21 aa, Mycobacterium
DLRVMVCLLGAGQLVGHVVLA

SEQ ID NO: 1122619 - protein, 18 aa, Mycobacterium
DLSARLFGFNPWSVLVPQ

SEQ ID NO: 1122620 - protein, 23 aa, Mycobacterium
DLSEAMSAMLDRLAAAQRATTNS

SEQ ID NO: 1122621 - protein, 32 aa, Mycobacterium
DLSSFFGLDLARWLPYNLARTWHVQLSLFWTA

SEQ ID NO: 1122622 - protein, 18 aa, Mycobacterium
DLVKRIIAVGGQTVQCRV

SEQ ID NO: 1122623 - protein, 23 aa, Mycobacterium
DMAKVIWLQRFAGVSFIGDMDEA

SEQ ID NO: 1122624 - protein, 17 aa, Mycobacterium
DMARLAVSFNDMAESLH

SEQ ID NO: 1122625 - protein, 25 aa, Mycobacterium
DMDEARALLRAMVCQLAAFHSPADL

SEQ ID NO: 1122626 - protein, 23 aa, Mycobacterium
DMEPLAWALCLFPVVIGMKQRDY

SEQ ID NO: 1122627 - protein, 24 aa, Mycobacterium
DMFGFGVPAPFGLRDDVFALILSL

SEQ ID NO: 1122628 - protein, 25 aa, Mycobacterium
DMFGFTLPAPFGLRDDVFTLVLSLP

SEQ ID NO: 1122629 - protein, 23 aa, Mycobacterium
DMGSLPAVLGLVVLFVVFGLAND

SEQ ID NO: 1122630 - protein, 29 aa, Mycobacterium
DMPTPRGSYGAAYLDGRIVVVGGEEPTRV

SEQ ID NO: 1122631 - protein, 36 aa, Mycobacterium
DMPYLRASPWHLWRKRIGWLLLLFVAEAYTGTVLRH

SEQ ID NO: 1122632 - protein, 23 aa, Mycobacterium
DMRNRFLVALALSIPIMLWSPMG

SEQ ID NO: 1122633 - protein, 19 aa, Mycobacterium
DMSAAHIWDASTVATLDAV

SEQ ID NO: 1122634 - protein, 17 aa, Mycobacterium
DMYRYAVAAGCDIEQFD

SEQ ID NO: 1122635 - protein, 22 aa, Mycobacterium
DNDNFWFSWIVPLAAIIFAGAF

SEQ ID NO: 1122636 - protein, 17 aa, Mycobacterium
DNHAHAMCVTREQLFYG

SEQ ID NO: 1122637 - protein, 19 aa, Mycobacterium
DNLAVAWMLAGLVLVCSPR

SEQ ID NO: 1122638 - protein, 37 aa, Mycobacterium
DNNDWFAELVVSLFTAAGYVLWWAVLFPAISLPIIAS

SEQ ID NO: 1122639 - protein, 23 aa, Mycobacterium
DNPNWVSVLGWQGGLPNERGQFV

SEQ ID NO: 1122640 - protein, 18 aa, Mycobacterium
DNPVIFWTPATGARVVRG

SEQ ID NO: 1122641 - protein, 18 aa, Mycobacterium
DNTAVRWVQNALSVVGFV

SEQ ID NO: 1122642 - protein, 31 aa, Mycobacterium
DNYKRAEICRQRMGPVFKRIAMNYPPLLFHP

SEQ ID NO: 1122643 - protein, 26 aa, Mycobacterium
DNYYRPRICNPYRNPLRVVYYYEGAP

SEQ ID NO: 1122644 - protein, 23 aa, Mycobacterium
DPAFSGAVLIIFTVLALVGYPTI

SEQ ID NO: 1122645 - protein, 20 aa, Mycobacterium
DPALAVGLLLLVLVLNVAVP

SEQ ID NO: 1122646 - protein, 28 aa, Mycobacterium
DPANEAQGLWLLERAGLITLNPAVDKWT

SEQ ID NO: 1122647 - protein, 21 aa, Mycobacterium
DPDMRTAVVSIDPRTGGVRAY

SEQ ID NO: 1122648 - protein, 24 aa, Mycobacterium
DPDRRQDLAMAWLLAGLFAGVVSG

SEQ ID NO: 1122649 - protein, 35 aa, Mycobacterium
DPDRVRRLAGLGGWAGWRFFVMYGATEATARMAYL

SEQ ID NO: 1122650 - protein, 19 aa, Mycobacterium
DPGRWPWPTFTVNIVGALL

SEQ ID NO: 1122651 - protein, 23 aa, Mycobacterium
DPHHPRLLTAYARAQFGQSNWAA

SEQ ID NO: 1122652 - protein, 17 aa, Mycobacterium
DPIAGAIEPLATAENDL

SEQ ID NO: 1122653 - protein, 24 aa, Mycobacterium
DPIAWWNPDLLFARPDWLHEPRGY

SEQ ID NO: 1122654 - protein, 27 aa, Mycobacterium
DPIVALAVGVNILWTGYRLLRGSMSSL

SEQ ID NO: 1122655 - protein, 21 aa, Mycobacterium
DPKETVSFIAWVAYAAYLHAR

SEQ ID NO: 1122656 - protein, 21 aa, Mycobacterium
DPKETVSFIAWVIYAAYLHAR

SEQ ID NO: 1122657 - protein, 19 aa, Mycobacterium
DPLDWAYHLVLPWFTLAVL

SEQ ID NO: 1122658 - protein, 22 aa, Mycobacterium
DPLINWFQPVLFYNAGLVNFGN

SEQ ID NO: 1122659 - protein, 19 aa, Mycobacterium
DPLPRWVRADVLSTGDLTI

SEQ ID NO: 1122660 - protein, 25 aa, Mycobacterium
DPNSKLRVFLARALDGGLRSDVAKL

SEQ ID NO: 1122661 - protein, 22 aa, Mycobacterium
DPQDLRPRLMFGAAESAADDRP

SEQ ID NO: 1122662 - protein, 23 aa, Mycobacterium
DPQQWWPKVAWLAQRPVLIPGTV

SEQ ID NO: 1122663 - protein, 25 aa, Mycobacterium
DPRGRPELRSALAEYLARARGVRTS

SEQ ID NO: 1122664 - protein, 18 aa, Mycobacterium
DPRLAAFDEVIAKGMAKK

SEQ ID NO: 1122665 - protein, 23 aa, Mycobacterium
DPRNPRTTIILAVSGALLTALVV

SEQ ID NO: 1122666 - protein, 18 aa, Mycobacterium
DPSRIGARVDLGVSRADE

SEQ ID NO: 1122667 - protein, 22 aa, Mycobacterium
DPTARRPLLRLALTEAALFGVA

SEQ ID NO: 1122668 - protein, 22 aa, Mycobacterium
DPTIPASDWPPALRSQYEAVAT

SEQ ID NO: 1122669 - protein, 17 aa, Mycobacterium
DPTSAGLSVDWRATVEQ

SEQ ID NO: 1122670 - protein, 22 aa, Mycobacterium
DPTSRRPLLRLALTEAALFGVA

SEQ ID NO: 1122671 - protein, 17 aa, Mycobacterium
DPVPGRTATELARAAGR

SEQ ID NO: 1122672 - protein, 25 aa, Mycobacterium
DPVREIRLEFGRLSGRRSDPDLDAA

SEQ ID NO: 1122673 - protein, 18 aa, Mycobacterium
DPWEQPRVVYLQHASDPI

SEQ ID NO: 1122674 - protein, 19 aa, Mycobacterium
DPYFESGVQMAVLDSNDTI

SEQ ID NO: 1122675 - protein, 17 aa, Mycobacterium
DQIPHIVRRASLGPYGR

SEQ ID NO: 1122676 - protein, 24 aa, Mycobacterium
DQIPHRRLPFWVALALSVALVGPT

SEQ ID NO: 1122677 - protein, 17 aa, Mycobacterium
DQLSITAAERFARAMAR

SEQ ID NO: 1122678 - protein, 24 aa, Mycobacterium
DQPFLPRLLILLVVAVVITAAVYG

SEQ ID NO: 1122679 - protein, 17 aa, Mycobacterium
DQPPPEEPQPWYRKPGA

SEQ ID NO: 1122680 - protein, 22 aa, Mycobacterium
DQPWRVPVAFVIAQGTATVINF

SEQ ID NO: 1122681 - protein, 26 aa, Mycobacterium
DQRVGYRLRATMAFDEGQYRISSLDQ

SEQ ID NO: 1122682 - protein, 27 aa, Mycobacterium
DQTHLFRTGLLFAIGSAFAFGSSGPFA

SEQ ID NO: 1122683 - protein, 17 aa, Mycobacterium
DQVLLWAALLTMVVGVL

SEQ ID NO: 1122684 - protein, 19 aa, Mycobacterium
DRAAGIVVADHAYVDDLLN

SEQ ID NO: 1122685 - protein, 17 aa, Mycobacterium
DRAGIPYLTHWDAGAVV

SEQ ID NO: 1122686 - protein, 19 aa, Mycobacterium
DRFAPKYVVLASFAGTAAM

SEQ ID NO: 1122687 - protein, 19 aa, Mycobacterium
DRFARRPLIATGYGMAALG

SEQ ID NO: 1122688 - protein, 22 aa, Mycobacterium
DRFDRCVDFARALANRSGTELP

SEQ ID NO: 1122689 - protein, 21 aa, Mycobacterium
DRFGRKPVLVAGWVVAVPVPL

SEQ ID NO: 1122690 - protein, 23 aa, Mycobacterium
DRFIPVVMLPFWDVEASVKEIHR

SEQ ID NO: 1122691 - protein, 18 aa, Mycobacterium
DRGLCCGAGGARMWMEEH

SEQ ID NO: 1122692 - protein, 23 aa, Mycobacterium
DRGLMRRILKWLAIPELPGLSIG

SEQ ID NO: 1122693 - protein, 17 aa, Mycobacterium
DRIPDLLDETFKAFNGA

SEQ ID NO: 1122694 - protein, 33 aa, Mycobacterium
DRISGVFVPIVIAIAVITLGAWLGAGFSVAAAF

SEQ ID NO: 1122695 - protein, 21 aa, Mycobacterium
DRLATTGPYAWVRHPQYDGFL

SEQ ID NO: 1122696 - protein, 23 aa, Mycobacterium
DRLERRHPFALAIGFLAFGMALR

SEQ ID NO: 1122697 - protein, 27 aa, Mycobacterium
DRLIDREMWRGIVFIGLVMGFATLLTM

SEQ ID NO: 1122698 - protein, 23 aa, Mycobacterium
DRLPRWLGTAAAVFTVEQLIETI

SEQ ID NO: 1122699 - protein, 18 aa, Mycobacterium
DRLQRWFAYLVFAVAAYV

SEQ ID NO: 1122700 - protein, 20 aa, Mycobacterium
DRLWKQLVLMPAVPDARAGG

SEQ ID NO: 1122701 - protein, 20 aa, Mycobacterium
DRNETCQLLDAALAEGQLSM

SEQ ID NO: 1122702 - protein, 23 aa, Mycobacterium
DRNRVATFAAVFLAGGVMFTLTV

SEQ ID NO: 1122703 - protein, 25 aa, Mycobacterium
DRNSREAVHILALFSSAVLILMLGS

SEQ ID NO: 1122704 - protein, 21 aa, Mycobacterium
DRPGPAAVRITDDWYAPVGGI

SEQ ID NO: 1122705 - protein, 28 aa, Mycobacterium
DRPNRLNRIAALVGIVAGVVFIIAAIFF

SEQ ID NO: 1122706 - protein, 20 aa, Mycobacterium
DRPRAVLARVVITLAMALSL

SEQ ID NO: 1122707 - protein, 19 aa, Mycobacterium
DRPTPRPAGAGAPPPPPGV

SEQ ID NO: 1122708 - protein, 17 aa, Mycobacterium
DRRKARRAALDAVDDDE

SEQ ID NO: 1122709 - protein, 24 aa, Mycobacterium
DRRRSASGSIDWLGAAGLAVGLTS

SEQ ID NO: 1122710 - protein, 25 aa, Mycobacterium
DRRRTLWLLWVLRHAIFRSVRRVIL

SEQ ID NO: 1122711 - protein, 20 aa, Mycobacterium
DRSALYRFVGLILPLAAFMV

SEQ ID NO: 1122712 - protein, 21 aa, Mycobacterium
DRSCCGPHLTALGGHHLPPAR

SEQ ID NO: 1122713 - protein, 18 aa, Mycobacterium
DRSEALRRVLEWPRESAA

SEQ ID NO: 1122714 - protein, 26 aa, Mycobacterium
DRSRGKYWWLRWALIALAVIVLTVEL

SEQ ID NO: 1122715 - protein, 23 aa, Mycobacterium
DRTDRILLGAAVVVWLAALGAGV

SEQ ID NO: 1122716 - protein, 32 aa, Mycobacterium
DRTPRGRLRRAVLPAAFSGVIVASVVAAGGVA

SEQ ID NO: 1122717 - protein, 31 aa, Mycobacterium
DRTPRGRLRRAVLPAAFSSVIVASVVAAGGV

SEQ ID NO: 1122718 - protein, 23 aa, Mycobacterium
DRTRRLRLLGAHQVGLSAERQIA

SEQ ID NO: 1122719 - protein, 19 aa, Mycobacterium
DRVALPPGTGYFVDSAGSL

SEQ ID NO: 1122720 - protein, 17 aa, Mycobacterium
DRVEAVAPWLTTDTTVY

SEQ ID NO: 1122721 - protein, 28 aa, Mycobacterium
DRVNFVLRYFPLRSHFNAERAARAVEAA

SEQ ID NO: 1122722 - protein, 23 aa, Mycobacterium
DRYEVGEILGFGGMSEVHLARDL

SEQ ID NO: 1122723 - protein, 20 aa, Mycobacterium
DSAARCVLTSAAHRAELYSH

SEQ ID NO: 1122724 - protein, 17 aa, Mycobacterium
DSAITIVVLLVVAVAVA

SEQ ID NO: 1122725 - protein, 19 aa, Mycobacterium
DSAQRWIRHLTARVAHRVA

SEQ ID NO: 1122726 - protein, 23 aa, Mycobacterium
DSARRSGNEFLFQQLAAQNVETL

SEQ ID NO: 1122727 - protein, 17 aa, Mycobacterium
DSARYWRVGVARRAAHR

SEQ ID NO: 1122728 - protein, 20 aa, Mycobacterium
DSASGLGFAIPVNEVKTVVE

SEQ ID NO: 1122729 - protein, 21 aa, Mycobacterium
DSDAPRKWWQPRNIAGTGGMH

SEQ ID NO: 1122730 - protein, 25 aa, Mycobacterium
DSDHPRTSVVIIRMSQLGMLDATGA

SEQ ID NO: 1122731 - protein, 17 aa, Mycobacterium
DSEARSSLDAALSEARR

SEQ ID NO: 1122732 - protein, 17 aa, Mycobacterium
DSEKIRVGEEVIAAGAP

SEQ ID NO: 1122733 - protein, 24 aa, Mycobacterium
DSFGRIGVLAAVMLVFTLVFANFF

SEQ ID NO: 1122734 - protein, 18 aa, Mycobacterium
DSFPEAVNILAPTTALLL

SEQ ID NO: 1122735 - protein, 29 aa, Mycobacterium
DSILLSRARIPFYVGVGVVTVLIAGVLGW

SEQ ID NO: 1122736 - protein, 17 aa, Mycobacterium
DSIQAWASHLAGVTKQL

SEQ ID NO: 1122737 - protein, 19 aa, Mycobacterium
DSLPLLPFLTVVVIFLIIP

SEQ ID NO: 1122738 - protein, 17 aa, Mycobacterium
DSPEWRPTVVTLGLLTM

SEQ ID NO: 1122739 - protein, 25 aa, Mycobacterium
DSPPGNWRSRILLGPVDRLTELGWT

SEQ ID NO: 1122740 - protein, 19 aa, Mycobacterium
DSPTVWGAMIWFVAIAGLT

SEQ ID NO: 1122741 - protein, 20 aa, Mycobacterium
DSRGYLLRDGELTQITKDDT

SEQ ID NO: 1122742 - protein, 22 aa, Mycobacterium
DSRSDRRLAFMLIAPAVVLMLA

SEQ ID NO: 1122743 - protein, 24 aa, Mycobacterium
DSTAARVGIIFVVAVIFGLVNAVI

SEQ ID NO: 1122744 - protein, 18 aa, Mycobacterium
DSTEFWLQKRFQDVGRIS

SEQ ID NO: 1122745 - protein, 17 aa, Mycobacterium
DSTKFWLNTLLALSMAF

SEQ ID NO: 1122746 - protein, 28 aa, Mycobacterium
DSVAALCCLVVFAAFMAYFGIYSRHHLV

SEQ ID NO: 1122747 - protein, 17 aa, Mycobacterium
DSWDSALQFAYYPVLFV

SEQ ID NO: 1122748 - protein, 18 aa, Mycobacterium
DSWEEIEDTLLIADLGPV

SEQ ID NO: 1122749 - protein, 30 aa, Mycobacterium; identical to SEQ ID NO: 304103

SEQ ID NO: 1122750 - protein, 26 aa, Mycobacterium
DTFILMFQRPFAFREYVIQTWFVARV

SEQ ID NO: 1122751 - protein, 24 aa, Mycobacterium
DTGGPFFIEFRTYRFRAHSMFDPE

SEQ ID NO: 1122752 - protein, 24 aa, Mycobacterium
DTLFICSATGFLILSTGAYRVFEG

SEQ ID NO: 1122753 - protein, 17 aa, Mycobacterium
DTLKLSLQMFGGSGYLQ

SEQ ID NO: 1122754 - protein, 17 aa, Mycobacterium
DTPAREVMVPRTEMVWI

SEQ ID NO: 1122755 - protein, 34 aa, Mycobacterium
DTPPWKPMAAAFCAQLATLVPFLFGLVTAAVVAT

SEQ ID NO: 1122756 - protein, 17 aa, Mycobacterium
DTRMFDDPLQFYSRAVT

SEQ ID NO: 1122757 - protein, 23 aa, Mycobacterium
DTSDILWWLLAAHAVHFLVVPQV

SEQ ID NO: 1122758 - protein, 28 aa, Mycobacterium
DTSPPAPRRAWPVLGVIGVIGMVIMVIQ

SEQ ID NO: 1122759 - protein, 27 aa, Mycobacterium
DTSRAWRNRMPPQRLALVMGSVAAVTM

SEQ ID NO: 1122760 - protein, 23 aa, Mycobacterium
DVAAGRRKALAFIEGRSTAELVA

SEQ ID NO: 1122761 - protein, 24 aa, Mycobacterium
DVAEFPRSQWLASTRRALGGAPTE

SEQ ID NO: 1122762 - protein, 25 aa, Mycobacterium
DVAGMPRGLVPLALMMFGLGMVLGN

SEQ ID NO: 1122763 - protein, 18 aa, Mycobacterium
DVALLWALIQIYRQSQVF

SEQ ID NO: 1122764 - protein, 26 aa, Mycobacterium
DVDGPLRLGHWVMFAAVSLPSVGAMI

SEQ ID NO: 1122765 - protein, 19 aa, Mycobacterium
DVDIKLIARTTHHLFQPLL

SEQ ID NO: 1122766 - protein, 20 aa, Mycobacterium
DVDLCWRLNEAGARLRYEPI

SEQ ID NO: 1122767 - protein, 18 aa, Mycobacterium
DVFGLRRWYTLTLAMGTF

SEQ ID NO: 1122768 - protein, 20 aa, Mycobacterium
DVGAAPAWRNLRTPLSAIPA

SEQ ID NO: 1122769 - protein, 17 aa, Mycobacterium
DVGNMRVNLSFTPTYSY

SEQ ID NO: 1122770 - protein, 17 aa, Mycobacterium
DVLAVTTIYEWIAAPVG

SEQ ID NO: 1122771 - protein, 19 aa, Mycobacterium
DVLCTLLGPGAFRLAVLVV

SEQ ID NO: 1122772 - protein, 25 aa, Mycobacterium
DVLFGRKVSYAGLAILLLTALMVGA

SEQ ID NO: 1122773 - protein, 21 aa, Mycobacterium
DVLFGRKVSYVGLAILLLTAL

SEQ ID NO: 1122774 - protein, 20 aa, Mycobacterium
DVLLMEAIAIPLTFLVLVWV

SEQ ID NO: 1122775 - protein, 18 aa, Mycobacterium
DVMFAFPVLLLALAVVAI

SEQ ID NO: 1122776 - protein, 20 aa, Mycobacterium
DVNAALPWSKTIVLNPGVTL

SEQ ID NO: 1122777 - protein, 19 aa, Mycobacterium
DVNGDGCFLIFCAPGGGRG

SEQ ID NO: 1122778 - protein, 23 aa, Mycobacterium
DVPADGWGEVAFVDADGNRVRAR

SEQ ID NO: 1122779 - protein, 24 aa, Mycobacterium
DVPAQRIAIVMLMAVLIASRAATA

SEQ ID NO: 1122780 - protein, 18 aa, Mycobacterium
DVPLTFDTLRIIAPYALA

SEQ ID NO: 1122781 - protein, 17 aa, Mycobacterium
DVPMFLGAMIMGPLGGW

SEQ ID NO: 1122782 - protein, 20 aa, Mycobacterium
DVRFSYPAADQVSLASLEEV

SEQ ID NO: 1122783 - protein, 20 aa, Mycobacterium
DVRIARWVATIAGLLGFVMA

SEQ ID NO: 1122784 - protein, 24 aa, Mycobacterium
DVRIPRNRAVVMLVIDVSQSMRAT

SEQ ID NO: 1122785 - protein, 17 aa, Mycobacterium
DVRLDRPVALKVMDPRY

SEQ ID NO: 1122786 - protein, 19 aa, Mycobacterium
DVRPAGALTSFAQAIADAD

SEQ ID NO: 1122787 - protein, 20 aa, Mycobacterium
DVRRVLKDDGMYIANLIDYG

SEQ ID NO: 1122788 - protein, 19 aa, Mycobacterium
DVRVTRPELEQLISEPLTG

SEQ ID NO: 1122789 - protein, 20 aa, Mycobacterium
DVSAEAWLVADLDSGDVIAA

SEQ ID NO: 1122790 - protein, 24 aa, Mycobacterium
DVVVFKGPPNWSVGYKSIRSDNTA

SEQ ID NO: 1122791 - protein, 24 aa, Mycobacterium
DVVVVFLVTWPLVYLASKTTWAAK

SEQ ID NO: 1122792 - protein, 24 aa, Mycobacterium
DWDIERLWGAIGLVPQRGYLFAGT

SEQ ID NO: 1122793 - protein, 21 aa, Mycobacterium
DWILHRDRFGIVEGSVVALCM

SEQ ID NO: 1122794 - protein, 25 aa, Mycobacterium
DWLNRLKALARRMCVAPTTYAQADL

SEQ ID NO: 1122795 - protein, 20 aa, Mycobacterium
DWPVRHLVTNTGWGTGLDLR

SEQ ID NO: 1122796 - protein, 27 aa, Mycobacterium
DWYETRFLPRIGPWALYGLLFTIVILF

SEQ ID NO: 1122797 - protein, 19 aa, Mycobacterium
DYDEMAINILIAFVAFSLA

SEQ ID NO: 1122798 - protein, 19 aa, Mycobacterium
DYRFTLANERTFLAWIRTA

SEQ ID NO: 1122799 - protein, 21 aa, Mycobacterium
DYRVRVAVRYVLRDRPLLLAL

SEQ ID NO: 1122800 - protein, 19 aa, Mycobacterium
DYYLRRQIEYVADGCSADT

SEQ ID NO: 1122801 - protein, 23 aa, Mycobacterium
EAAARGFYSPLFYRDLIGDPTGL

SEQ ID NO: 1122802 - protein, 20 aa, Mycobacterium
EAAARGWPVRTFSKPVSLRD

SEQ ID NO: 1122803 - protein, 19 aa, Mycobacterium
EAACGANLDPGGPPSATYT

SEQ ID NO: 1122804 - protein, 20 aa, Mycobacterium
EAAETFALVWCVRHLMQWAH

SEQ ID NO: 1122805 - protein, 20 aa, Mycobacterium
EADGTIWIFGGMGADNRVSG

SEQ ID NO: 1122806 - protein, 17 aa, Mycobacterium
EAEAKAAEAARLAETAS

SEQ ID NO: 1122807 - protein, 19 aa, Mycobacterium
EAGADIFRNFPQVVAVISN

SEQ ID NO: 1122808 - protein, 17 aa, Mycobacterium
EAGARTWHVVPGTTPQV

SEQ ID NO: 1122809 - protein, 20 aa, Mycobacterium
EAGLSFLPTPLAWLLALVAL

SEQ ID NO: 1122810 - protein, 17 aa, Mycobacterium
EAHAGPVARAYVLLEDL

SEQ ID NO: 1122811 - protein, 19 aa, Mycobacterium
EAIFGWPGIGKLMIDAILQ

SEQ ID NO: 1122812 - protein, 17 aa, Mycobacterium
EAIFGYNGLGWRFSGAV

SEQ ID NO: 1122813 - protein, 26 aa, Mycobacterium
EAIPKRFANVHPRYMTPAFGTIVMGL

SEQ ID NO: 1122814 - protein, 22 aa, Mycobacterium
EAKGFGGFPVGGQWLRTGNQDL

SEQ ID NO: 1122815 - protein, 21 aa, Mycobacterium
EALARLQVVCFDKTGTLSENR

SEQ ID NO: 1122816 - protein, 22 aa, Mycobacterium
EALAVPIWWAYAASLLLITAGL

SEQ ID NO: 1122817 - protein, 28 aa, Mycobacterium
EALEGKVLSVDFGKSFMVSGVEVTPGWV

SEQ ID NO: 1122818 - protein, 17 aa, Mycobacterium
EALFGYNGLGWRFSGAV

SEQ ID NO: 1122819 - protein, 20 aa, Mycobacterium
EALKVMFVITAIALVGLVVF

SEQ ID NO: 1122820 - protein, 20 aa, Mycobacterium
EALLQLLADRAFQWSLNAGE

SEQ ID NO: 1122821 - protein, 26 aa, Mycobacterium
EALPDGRAAIHLAMDPSYMDIIPSDV

SEQ ID NO: 1122822 - protein, 23 aa, Mycobacterium
EALRAASGLDRPIVSQFFGYLGS

SEQ ID NO: 1122823 - protein, 19 aa, Mycobacterium
EALTGFLAAFINVRISAPV

SEQ ID NO: 1122824 - protein, 21 aa, Mycobacterium
EAMLIPMYFLIGGFGGADRSR

SEQ ID NO: 1122825 - protein, 21 aa, Mycobacterium
EAMLIPMYFLIGGFGSGPSQD

SEQ ID NO: 1122826 - protein, 17 aa, Mycobacterium
EAPAPAPAAPRTVYVEK

SEQ ID NO: 1122827 - protein, 18 aa, Mycobacterium
EAPLKFRAPGVTLQLGLG

SEQ ID NO: 1122828 - protein, 18 aa, Mycobacterium
EAPPPVYDEPLAPPPVVA

SEQ ID NO: 1122829 - protein, 20 aa, Mycobacterium
EAQAALAAVRRRLGTRGPAA

SEQ ID NO: 1122830 - protein, 21 aa, Mycobacterium
EAQGLGVSRAEGWRRRGPLLP

SEQ ID NO: 1122831 - protein, 17 aa, Mycobacterium
EARQGYRALSFWDRVRL

SEQ ID NO: 1122832 - protein, 23 aa, Mycobacterium
EASRRIELHVGRDLQFIRINGTV

SEQ ID NO: 1122833 - protein, 20 aa, Mycobacterium
EATIPNFAVAGFLYGTVLLY

SEQ ID NO: 1122834 - protein, 23 aa, Mycobacterium
EATSRFLGYFARQATTYGSERIG

SEQ ID NO: 1122835 - protein, 18 aa, Mycobacterium
EAVSHWRTVFAYGAVPIA

SEQ ID NO: 1122836 - protein, 23 aa, Mycobacterium
EAYSDSLGLVFLYAAPVALLGFL

SEQ ID NO: 1122837 - protein, 36 aa, Mycobacterium
EAYTEYKLNSAFAVGGPKCLVKVIQKLSGLHVNRFM

SEQ ID NO: 1122838 - protein, 20 aa, Mycobacterium
ECPFCSRATGAIDEVRAHFG

SEQ ID NO: 1122839 - protein, 17 aa, Mycobacterium
EDAIATAVGDNFVWAYQ

SEQ ID NO: 1122840 - protein, 24 aa, Mycobacterium
EDERPLRRRGLAVGGAIAAVLLAV

SEQ ID NO: 1122841 - protein, 21 aa, Mycobacterium
EDIEARLAVYTEQLMGVLQTA

SEQ ID NO: 1122842 - protein, 23 aa, Mycobacterium
EDLDLLEALPLDRAKYVISAIPV

SEQ ID NO: 1122843 - protein, 22 aa, Mycobacterium
EDLLSFCLLMFMAGLDTVSVTL

SEQ ID NO: 1122844 - protein, 17 aa, Mycobacterium
EDLNALFLPPAPAAPAA

SEQ ID NO: 1122845 - protein, 22 aa, Mycobacterium
EDPPRPSVAAVLRTCRHAGIRV

SEQ ID NO: 1122846 - protein, 17 aa, Mycobacterium
EDRGVEVTVHFDGDLPP

SEQ ID NO: 1122847 - protein, 22 aa, Mycobacterium
EDRPQLQAALFLFLQSVSLGLF

SEQ ID NO: 1122848 - protein, 18 aa, Mycobacterium
EDRYASAGEMARAATAAL

SEQ ID NO: 1122849 - protein, 22 aa, Mycobacterium
EDYQAFQAYTCRAEHATESEVL

SEQ ID NO: 1122850 - protein, 18 aa, Mycobacterium
EEALARNSIGWSSISSVA

SEQ ID NO: 1122851 - protein, 24 aa, Mycobacterium
EEAYRYATAISIAVAIGVAALTAL

SEQ ID NO: 1122852 - protein, 20 aa, Mycobacterium
EECDRMRAMIDGLSMLARAQ

SEQ ID NO: 1122853 - protein, 21 aa, Mycobacterium
EEGEEVPKAFVVRQASTDADG

SEQ ID NO: 1122854 - protein, 17 aa, Mycobacterium
EEIEDTLLIADLGPVVT

SEQ ID NO: 1122855 - protein, 20 aa, Mycobacterium
EEITLTYVVVHLWDERRLVL

SEQ ID NO: 1122856 - protein, 24 aa, Mycobacterium
EEKALKLAALLTQPGQVYDVSSPD

SEQ ID NO: 1122857 - protein, 17 aa, Mycobacterium
EELGFTHLLAYDHVVGA

SEQ ID NO: 1122858 - protein, 20 aa, Mycobacterium
EELMARPLDGVFVALEEALA

SEQ ID NO: 1122859 - protein, 20 aa, Mycobacterium
EELRSARSPQELVSLVRSSA

SEQ ID NO: 1122860 - protein, 17 aa, Mycobacterium
EELRVQRNTAMVGDGVN

SEQ ID NO: 1122861 - protein, 17 aa, Mycobacterium
EEMGEVIGLAFHLAAVA

SEQ ID NO: 1122862 - protein, 18 aa, Mycobacterium
EEMQRITLELSEVTREMA

SEQ ID NO: 1122863 - protein, 36 aa, Mycobacterium
EEPRPPCCKDGDKDCEPGWPWPWPWPDDPDDRPKPD

SEQ ID NO: 1122864 - protein, 20 aa, Mycobacterium
EEQLRPLGLMTLPDGSQPAT

SEQ ID NO: 1122865 - protein, 22 aa, Mycobacterium
EESNFPAIVKFLSEEVLASQRG

SEQ ID NO: 1122866 - protein, 37 aa, Mycobacterium
EEVRGWRAPRSSAWSLPEVRWALIATVLFVVGGLAQL

SEQ ID NO: 1122867 - protein, 19 aa, Mycobacterium
EEYRRVWLATLTVFGGVAI

SEQ ID NO: 1122868 - protein, 27 aa, Mycobacterium
EFAFLGWHWSLPLGVAILFAAVAGGLL

SEQ ID NO: 1122869 - protein, 27 aa, Mycobacterium
EFGRMSFQPDLCANVPIVGLVGEVDER

SEQ ID NO: 1122870 - protein, 23 aa, Mycobacterium
EFKSDAAKVWADFTAANVGTQTA

SEQ ID NO: 1122871 - protein, 35 aa, Mycobacterium
EFLQWGRAGEITLVLPPELARRLTVTTQQETGVVF

SEQ ID NO: 1122872 - protein, 17 aa, Mycobacterium
EFLTAFFALSTVVYAVL

SEQ ID NO: 1122873 - protein, 22 aa, Mycobacterium
EFNRSPRVVARFDEHEFTAPRP

SEQ ID NO: 1122874 - protein, 27 aa, Mycobacterium
EFPGKRAPTVQLCRDPRGYVPVGNNPW

SEQ ID NO: 1122875 - protein, 19 aa, Mycobacterium
EFVLLRWFFAKDLAVEPRR

SEQ ID NO: 1122876 - protein, 18 aa, Mycobacterium
EFWLEMTHFTGVGALIMF

SEQ ID NO: 1122877 - protein, 26 aa, Mycobacterium
EGAAWLRLAWAGILFLVIVRPRRKAF

SEQ ID NO: 1122878 - protein, 26 aa, Mycobacterium
EGAAWLRLAWAGLLFLVFLRPRRADF

SEQ ID NO: 1122879 - protein, 20 aa, Mycobacterium
EGALPPARAVSILRQVAAAL

SEQ ID NO: 1122880 - protein, 23 aa, Mycobacterium
EGDEVREGVKWVSITPKNDEKLS

SEQ ID NO: 1122881 - protein, 18 aa, Mycobacterium
EGDGRTGILDSTFLLGDD

SEQ ID NO: 1122882 - protein, 24 aa, Mycobacterium
EGDYETIGGLVLEKLGHIPEEGES

SEQ ID NO: 1122883 - protein, 28 aa, Mycobacterium
EGFTRLWPTLACLLLYGAAFMLLAQSIS

SEQ ID NO: 1122884 - protein, 25 aa, Mycobacterium
EGGFPDRGTLEWDYGPSERYAERIG

SEQ ID NO: 1122885 - protein, 39 aa, Mycobacterium
EGGVELPDTFDLKGIIKLLASLFGLTWANIRNRLVKQIG

SEQ ID NO: 1122886 - protein, 26 aa, Mycobacterium
EGKGGRFRCTFGFTFDVTEGQDRYVV

SEQ ID NO: 1122887 - protein, 22 aa, Mycobacterium
EGQARCYWRSSGELVLSGNGPA

SEQ ID NO: 1122888 - protein, 25 aa, Mycobacterium
EGRHVPGRVGLLFLDLDGFKPVNDT

SEQ ID NO: 1122889 - protein, 24 aa, Mycobacterium
EGSSRRAVFVGAMRVGRDHIASTV

SEQ ID NO: 1122890 - protein, 26 aa, Mycobacterium
EGSVVALCMPVSFAAGLNVLIGALLS

SEQ ID NO: 1122891 - protein, 19 aa, Mycobacterium
EGTVRFAGREPVGVNPQAG

SEQ ID NO: 1122892 - protein, 19 aa, Mycobacterium
EGVAVMAGPVFQEENQGFV

SEQ ID NO: 1122893 - protein, 24 aa, Mycobacterium
EGWLAIPGSDQWWPLTPAEPALSP

SEQ ID NO: 1122894 - protein, 21 aa, Mycobacterium
EHAMIPRSRVDTVPAGESISS

SEQ ID NO: 1122895 - protein, 23 aa, Mycobacterium
EHEDRIVSWVGWLRAPDSTAETV

SEQ ID NO: 1122896 - protein, 19 aa, Mycobacterium
EHFAVAWCRMPSPPQRRLA

SEQ ID NO: 1122897 - protein, 21 aa, Mycobacterium
EHGRTHLLNSLALLSTGDRLP

SEQ ID NO: 1122898 - protein, 19 aa, Mycobacterium
EHLHRAGVPMDSLEEVHAE

SEQ ID NO: 1122899 - protein, 20 aa, Mycobacterium
EHPAFLTVRLGLGDAASRCR

SEQ ID NO: 1122900 - protein, 24 aa, Mycobacterium
EHPLAAAIVKYAAGRGVKPLPLND

SEQ ID NO: 1122901 - protein, 23 aa, Mycobacterium
EHTRSNWLLMFILLLVLTVIVGI

SEQ ID NO: 1122902 - protein, 26 aa, Mycobacterium
EHTTHWGLSIDDFWWTAIWAAIVLSI

SEQ ID NO: 1122903 - protein, 23 aa, Mycobacterium
EIDGDRVLIGYGLGGTEIGTESR

SEQ ID NO: 1122904 - protein, 19 aa, Mycobacterium
EIFMLGMFGAYFALDIILG

SEQ ID NO: 1122905 - protein, 30 aa, Mycobacterium
EIGGRALLFGGIFPPFWLAGTAMLGLSKII

SEQ ID NO: 1122906 - protein, 18 aa, Mycobacterium
EIGVPIFFVLSGFLLFLP

SEQ ID NO: 1122907 - protein, 18 aa, Mycobacterium
EIISRCYNLILKSTLSAG

SEQ ID NO: 1122908 - protein, 17 aa, Mycobacterium
EILRRPRTLVLACAVGI

SEQ ID NO: 1122909 - protein, 20 aa, Mycobacterium
EIPGRAVARTGPGRLTAFQA

SEQ ID NO: 1122910 - protein, 21 aa, Mycobacterium
EIPSQYLLSAFAPESRTLIDI

SEQ ID NO: 1122911 - protein, 19 aa, Mycobacterium
EIRAAALVNEGPDGEAAVT

SEQ ID NO: 1122912 - protein, 19 aa, Mycobacterium
EITALRLLAPYLGLTLETS

SEQ ID NO: 1122913 - protein, 19 aa, Mycobacterium
EITSWGVLYYAFSVLSPAI

SEQ ID NO: 1122914 - protein, 19 aa, Mycobacterium
EIVAEPFLIVGILAGIKEI

SEQ ID NO: 1122915 - protein, 24 aa, Mycobacterium
EKFGELPAVTAFTNLRGLGVSGQV

SEQ ID NO: 1122916 - protein, 25 aa, Mycobacterium
EKLDASMPWPVRRGGVALRFYEHSL

SEQ ID NO: 1122917 - protein, 17 aa, Mycobacterium
EKLGLRVNFVGTEFSGL

SEQ ID NO: 1122918 - protein, 24 aa, Mycobacterium
EKRDFSNPVGLNWTQDGTDVDFGS

SEQ ID NO: 1122919 - protein, 19 aa, Mycobacterium
EKWLFAHIPLAKRVYRTRL

SEQ ID NO: 1122920 - protein, 18 aa, Mycobacterium
ELAFRGVLHGALDRAWGW

SEQ ID NO: 1122921 - protein, 19 aa, Mycobacterium
ELAFRGVLHGALNRAWGFR

SEQ ID NO: 1122922 - protein, 23 aa, Mycobacterium
ELAGGAWAAFTMVLASAVLSWLL

SEQ ID NO: 1122923 - protein, 17 aa, Mycobacterium
ELAGSPLRYRAGRISDF

SEQ ID NO: 1122924 - protein, 20 aa, Mycobacterium
ELDDAIGVVHLRDLLGSTGT

SEQ ID NO: 1122925 - protein, 23 aa, Mycobacterium
ELDGGLRWLYLATVGCSISATAM

SEQ ID NO: 1122926 - protein, 17 aa, Mycobacterium
ELDPRYADLYDHVLRAS

SEQ ID NO: 1122927 - protein, 18 aa, Mycobacterium
ELELSRSVGLAFAVAAST

SEQ ID NO: 1122928 - protein, 27 aa, Mycobacterium
ELEMLLIDFKHGLEFQRLGPDENGRNW

SEQ ID NO: 1122929 - protein, 33 aa, Mycobacterium
ELFEWSKERVPYFALPRYVEFRTELPTSPLGRV

SEQ ID NO: 1122930 - protein, 31 aa, Mycobacterium
ELFGRETTVPWGLEIYERVNAAGVPDSLNGV

SEQ ID NO: 1122931 - protein, 26 aa, Mycobacterium
ELGALRRPQVWLALLVGMIGFGGMFA

SEQ ID NO: 1122932 - protein, 20 aa, Mycobacterium
ELGQPLLTEYVWGRQVGEHT

SEQ ID NO: 1122933 - protein, 17 aa, Mycobacterium
ELIKFAIVGATTFVIDS

SEQ ID NO: 1122934 - protein, 19 aa, Mycobacterium
ELLGVLGIIRGRVALGIIG

SEQ ID NO: 1122935 - protein, 19 aa, Mycobacterium
ELLLRPVTVPTYLKDAWYR

SEQ ID NO: 1122936 - protein, 27 aa, Mycobacterium
ELNDTWWRIPILILVSFANAWAEEIIV

SEQ ID NO: 1122937 - protein, 26 aa, Mycobacterium
ELNDTWWRIPLLLLLSFGNGWAEEVI

SEQ ID NO: 1122938 - protein, 19 aa, Mycobacterium
ELPETILVSVSHRSTVEQH

SEQ ID NO: 1122939 - protein, 23 aa, Mycobacterium
ELPEYRIMPNFKQIVVSSNQWQA

SEQ ID NO: 1122940 - protein, 33 aa, Mycobacterium
ELPRVIPPSLLRRALPYLIVILIVGMIVALVAT

SEQ ID NO: 1122941 - protein, 27 aa, Mycobacterium
ELQPGKLRALATWGPWVSIGAAVVTGM

SEQ ID NO: 1122942 - protein, 26 aa, Mycobacterium
ELRDALRLAGLGAWLDGLPQGLSTLL

SEQ ID NO: 1122943 - protein, 19 aa, Mycobacterium
ELRSALTKVGLRRWLDGLP

SEQ ID NO: 1122944 - protein, 18 aa, Mycobacterium
ELRTAMITVAGTEPSTVS

SEQ ID NO: 1122945 - protein, 19 aa, Mycobacterium
ELRVPIGVTATGEPLIFDL

SEQ ID NO: 1122946 - protein, 20 aa, Mycobacterium
ELSLVDWVKPIDWWWILGGF

SEQ ID NO: 1122947 - protein, 34 aa, Mycobacterium
ELTARFWRRSGIRIVRRPVPHLVASVLVLILLAG

SEQ ID NO: 1122948 - protein, 18 aa, Mycobacterium
ELVDGAAIAAVIPLLLWI

SEQ ID NO: 1122949 - protein, 20 aa, Mycobacterium
ELVRKLVVWNIVGGVYGSFV

SEQ ID NO: 1122950 - protein, 19 aa, Mycobacterium
ELYGRATTVPWGLEIYERV

SEQ ID NO: 1122951 - protein, 17 aa, Mycobacterium
EMFPTRMRYSGVSLGYQ

SEQ ID NO: 1122952 - protein, 23 aa, Mycobacterium
EMLGRTPMDFHYPPEVRARAEEL

SEQ ID NO: 1122953 - protein, 19 aa, Mycobacterium
EMLPAGWGQLGQLLPQGAT

SEQ ID NO: 1122954 - protein, 20 aa, Mycobacterium
ENGFWGRLVTRVMKRPLIYA

SEQ ID NO: 1122955 - protein, 20 aa, Mycobacterium
ENKWGSPVYGSGLPSDIWKA

SEQ ID NO: 1122956 - protein, 18 aa, Mycobacterium
ENLLPVGRPPGGGHLNRS

SEQ ID NO: 1122957 - protein, 22 aa, Mycobacterium
ENPLRYASLDALRQAREDMRHN

SEQ ID NO: 1122958 - protein, 19 aa, Mycobacterium
ENRARRFARVNASTLTEYR

SEQ ID NO: 1122959 - protein, 23 aa, Mycobacterium
ENRPGLSSVLFYLFAYGFSTLGA

SEQ ID NO: 1122960 - protein, 21 aa, Mycobacterium
ENWRALRDFNDTYSVAAQDIL

SEQ ID NO: 1122961 - protein, 19 aa, Mycobacterium
EPADAFGPEGPRFVRAGAP

SEQ ID NO: 1122962 - protein, 19 aa, Mycobacterium
EPAFAMVVGFVLLDQAPGV

SEQ ID NO: 1122963 - protein, 21 aa, Mycobacterium
EPALNLDLLLGGLKPVIQGLN

SEQ ID NO: 1122964 - protein, 18 aa, Mycobacterium
EPANEWIETLALLAHIAI

SEQ ID NO: 1122965 - protein, 24 aa, Mycobacterium
EPASGVAPAGRWLLTGVLLWSLLR

SEQ ID NO: 1122966 - protein, 21 aa, Mycobacterium
EPDYRFTLANERTFLAWIRTS

SEQ ID NO: 1122967 - protein, 22 aa, Mycobacterium
EPEKRPQVAGVFTDLEAGPDSG

SEQ ID NO: 1122968 - protein, 28 aa, Mycobacterium
EPERGGSLGRWLIAVAILAVLTVVVTIG

SEQ ID NO: 1122969 - protein, 22 aa, Mycobacterium
EPEVKGLGIAAGARRPGAKKAP

SEQ ID NO: 1122970 - protein, 22 aa, Mycobacterium
EPEVKGLGIAAGARRPGAKKKT

SEQ ID NO: 1122971 - protein, 23 aa, Mycobacterium
EPEVKGLGIAGGAKRPGAKKQAA

SEQ ID NO: 1122972 - protein, 25 aa, Mycobacterium
EPFARITSTLTWIWIAAFGGMTVSS

SEQ ID NO: 1122973 - protein, 20 aa, Mycobacterium
EPFNVPFLIGLGAAALIFTG

SEQ ID NO: 1122974 - protein, 28 aa, Mycobacterium
EPGKGACFRLTLPLVRGHKVTSSPLPVK

SEQ ID NO: 1122975 - protein, 22 aa, Mycobacterium
EPGLDWAVAVTFSEETPLHSWL

SEQ ID NO: 1122976 - protein, 20 aa, Mycobacterium
EPGLICVTGDPVAVRDLARS

SEQ ID NO: 1122977 - protein, 18 aa, Mycobacterium
EPGPRPDQGAAYASEIPD

SEQ ID NO: 1122978 - protein, 20 aa, Mycobacterium
EPGQILVMLNVGAIFMGTAL

SEQ ID NO: 1122979 - protein, 25 aa, Mycobacterium
EPIAVIGLGCRFPGGDGLDGNITGP

SEQ ID NO: 1122980 - protein, 40 aa, Mycobacterium
EPKGNGRARGWRKLGSATVRWPGAVLVMATVLCLVGLLAL

SEQ ID NO: 1122981 - protein, 17 aa, Mycobacterium
EPLLPPDIESVVAPAPD

SEQ ID NO: 1122982 - protein, 24 aa, Mycobacterium
EPNVNIRLAMDWLDTYADDMSLSI

SEQ ID NO: 1122983 - protein, 19 aa, Mycobacterium
EPPPARIVLMSDGKETVPS

SEQ ID NO: 1122984 - protein, 30 aa, Mycobacterium
EPPTIARVFFEWRFDLIFGTAAVVMAGIYL

SEQ ID NO: 1122985 - protein, 24 aa, Mycobacterium
EPRTVRWTLRLDVTDVDGRLAVSR

SEQ ID NO: 1122986 - protein, 25 aa, Mycobacterium
EPTQLSNYGTGYGEYDQSPTEADSA

SEQ ID NO: 1122987 - protein, 26 aa, Mycobacterium
EPVAWACAPIGYRVVLEGAPAGVEQL

SEQ ID NO: 1122988 - protein, 19 aa, Mycobacterium
EPVEVAAYYVVAESLTNVA

SEQ ID NO: 1122989 - protein, 23 aa, Mycobacterium
EPVTWAGLRGELQGAWAAADQPR

SEQ ID NO: 1122990 - protein, 20 aa, Mycobacterium
EPYARYAARVGRFLPGLGRL

SEQ ID NO: 1122991 - protein, 22 aa, Mycobacterium
EPYIRLEMNHGYFTDADYENEP

SEQ ID NO: 1122992 - protein, 20 aa, Mycobacterium
EPYLGRWLLLVAAMFTLSAA

SEQ ID NO: 1122993 - protein, 18 aa, Mycobacterium
EPYVPLGTNPWYGDPNQI

SEQ ID NO: 1122994 - protein, 23 aa, Mycobacterium
EQEPRAWRMRISVEKIGDDAKVS

SEQ ID NO: 1122995 - protein, 17 aa, Mycobacterium
EQILPKVMTTFGLTAAY

SEQ ID NO: 1122996 - protein, 19 aa, Mycobacterium
EQIMPLLVVAIMSQLVFSG

SEQ ID NO: 1122997 - protein, 26 aa, Mycobacterium
EQKLFFPRYYLKVEPYIRLEMNHGYF

SEQ ID NO: 1122998 - protein, 27 aa, Mycobacterium
EQPHPYPRWIATAGWAGFALGIAMLLG

SEQ ID NO: 1122999 - protein, 22 aa, Mycobacterium
EQQLAFGRLRAVEHDRFVVVSG

SEQ ID NO: 1123000 - protein, 17 aa, Mycobacterium
EQQRWLRDNALQMTNSI

SEQ ID NO: 1123001 - protein, 24 aa, Mycobacterium
EQRRICAAPTVFPNSNFADRPWAS

SEQ ID NO: 1123002 - protein, 25 aa, Mycobacterium
EQSARWAWQAAGWTLLALMVLSVVL

SEQ ID NO: 1123003 - protein, 18 aa, Mycobacterium
EQVWSVLAVYYFALQWVT

SEQ ID NO: 1123004 - protein, 17 aa, Mycobacterium
EQWYRRLMVNDRALAAY

SEQ ID NO: 1123005 - protein, 18 aa, Mycobacterium
ERAESVPVTALVNAAASE

SEQ ID NO: 1123006 - protein, 23 aa, Mycobacterium
EREEVPAQLVVRAVGYRGLPTPG

SEQ ID NO: 1123007 - protein, 42 aa, Mycobacterium
ERFLGSRPHPYAWIPFGGGVKRCIGAAFAMRELTTTLHTVLR

SEQ ID NO: 1123008 - protein, 22 aa, Mycobacterium
ERFPSEWIYAQGLLFIVVVGFF

SEQ ID NO: 1123009 - protein, 28 aa, Mycobacterium
ERGDASSGPPTWVLFAAGLGALVVVGGG

SEQ ID NO: 1123010 - protein, 18 aa, Mycobacterium
ERGWPVVLATRMIPAVPF

SEQ ID NO: 1123011 - protein, 18 aa, Mycobacterium
ERHTRKVLDLTIRLAEVM

SEQ ID NO: 1123012 - protein, 19 aa, Mycobacterium
ERIALRLLVQRDWDDDRAE

SEQ ID NO: 1123013 - protein, 22 aa, Mycobacterium
ERIDLTIPVLIGAAVLVLTVAV

SEQ ID NO: 1123014 - protein, 24 aa, Mycobacterium
ERITYRRGFVTRHQVSGWRFVMRR

SEQ ID NO: 1123015 - protein, 21 aa, Mycobacterium
ERLKPGVAQTWYFRQPDRDAE

SEQ ID NO: 1123016 - protein, 20 aa, Mycobacterium
ERPFVPLIPTLGIPGDIADA

SEQ ID NO: 1123017 - protein, 23 aa, Mycobacterium
ERPRLRIPLWSLLLLGAAALIVS

SEQ ID NO: 1123018 - protein, 18 aa, Mycobacterium
ERRAEVNSTYFVVAYVAI

SEQ ID NO: 1123019 - protein, 18 aa, Mycobacterium
ERSVLKSRLDSVMDNYRG

SEQ ID NO: 1123020 - protein, 19 aa, Mycobacterium
ERTELVFAGLAGSLLLTGW

SEQ ID NO: 1123021 - protein, 21 aa, Mycobacterium
ERTKEKYLWARLIGSTFVGQL

SEQ ID NO: 1123022 - protein, 21 aa, Mycobacterium
ERVRAGISYVMVSMVSSLVFL

SEQ ID NO: 1123023 - protein, 20 aa, Mycobacterium
ERVYKPYPYILAIVDELADL

SEQ ID NO: 1123024 - protein, 21 aa, Mycobacterium
ERWLDCSGHAEALRFGQELGF

SEQ ID NO: 1123025 - protein, 20 aa, Mycobacterium
ESADRLIELALRGGGPDNVT

SEQ ID NO: 1123026 - protein, 22 aa, Mycobacterium
ESADRLIELALRGGGPDNVTVV

SEQ ID NO: 1123027 - protein, 27 aa, Mycobacterium
ESAEALACGIADLAGCERVVVGLAEPG

SEQ ID NO: 1123028 - protein, 25 aa, Mycobacterium
ESAELCAQYLGPILDAIKFNYLPFG

SEQ ID NO: 1123029 - protein, 25 aa, Mycobacterium
ESAIARGAALAGTRRPGNSVAGQAL

SEQ ID NO: 1123030 - protein, 20 aa, Mycobacterium
ESALKLAGRHARHLSDMLDS

SEQ ID NO: 1123031 - protein, 21 aa, Mycobacterium
ESALPRLIAKMEHLGVDRSTV

SEQ ID NO: 1123032 - protein, 19 aa, Mycobacterium
ESELSRYATDLSRVADVSS

SEQ ID NO: 1123033 - protein, 18 aa, Mycobacterium
ESGALGICGPRGVVDGVA

SEQ ID NO: 1123034 - protein, 22 aa, Mycobacterium
ESGRDGFWMSMAVFTILAVLNV

SEQ ID NO: 1123035 - protein, 18 aa, Mycobacterium
ESIFAQFATRLSFKNTAE

SEQ ID NO: 1123036 - protein, 28 aa, Mycobacterium
ESINAGVFSALWLGFRSGTSIFEDAPPE

SEQ ID NO: 1123037 - protein, 17 aa, Mycobacterium
ESIRGAGLLLVIMAAGG

SEQ ID NO: 1123038 - protein, 22 aa, Mycobacterium
ESKSRVALYLLITIAPFAVIAP

SEQ ID NO: 1123039 - protein, 20 aa, Mycobacterium
ESLAELMGGPDIVPPPAPPA

SEQ ID NO: 1123040 - protein, 17 aa, Mycobacterium
ESPFMSWAYDIFSVTTF

SEQ ID NO: 1123041 - protein, 20 aa, Mycobacterium
ESPQAPANFVDPSFSSMTTR

SEQ ID NO: 1123042 - protein, 24 aa, Mycobacterium
ESRLLRIGSPMFHFGILVVIVGHI

SEQ ID NO: 1123043 - protein, 21 aa, Mycobacterium
ESRRGSFGFLAPGFQARVVDP

SEQ ID NO: 1123044 - protein, 17 aa, Mycobacterium
ESSGLVPPIDQWSGSTF

SEQ ID NO: 1123045 - protein, 24 aa, Mycobacterium
ESTDILKRWKRGVMSTVGDVTARN

SEQ ID NO: 1123046 - protein, 25 aa, Mycobacterium
ESTDTLLRVAMRADAVLSGLTGIGL

SEQ ID NO: 1123047 - protein, 23 aa, Mycobacterium
ESYTASYLRFVWTVAATAMVVCY

SEQ ID NO: 1123048 - protein, 24 aa, Mycobacterium
ETAARMGVALTQRGYRVSYHAVAD

SEQ ID NO: 1123049 - protein, 25 aa, Mycobacterium
ETAEPARRFGFGRFGRKSSTVDAEQ

SEQ ID NO: 1123050 - protein, 20 aa, Mycobacterium
ETASRAMLVVETWNARQAFR

SEQ ID NO: 1123051 - protein, 22 aa, Mycobacterium
ETATALTFYVGLAIAFGLWTWF

SEQ ID NO: 1123052 - protein, 18 aa, Mycobacterium
ETAYCLGVEKLLGITDAI

SEQ ID NO: 1123053 - protein, 19 aa, Mycobacterium
ETDFGIGVSAGRAIAGHIG

SEQ ID NO: 1123054 - protein, 24 aa, Mycobacterium
ETFGRGDMQLVFAVTDPAGVDSAS

SEQ ID NO: 1123055 - protein, 18 aa, Mycobacterium
ETFWEFLPRSVFGSLKSA

SEQ ID NO: 1123056 - protein, 26 aa, Mycobacterium
ETIKGDASVGWLRIGSLVLALAALGA

SEQ ID NO: 1123057 - protein, 18 aa, Mycobacterium
ETKFAVELDPLYADLYDH

SEQ ID NO: 1123058 - protein, 20 aa, Mycobacterium
ETLARGCLAAAQTRYDTKGV

SEQ ID NO: 1123059 - protein, 25 aa, Mycobacterium
ETMAYFCVAELLANVSKHSGAGAAA

SEQ ID NO: 1123060 - protein, 18 aa, Mycobacterium
ETPDYGSWLLGKPEESQA

SEQ ID NO: 1123061 - protein, 21 aa, Mycobacterium
ETPRGAPVLELRGVGHEYGSG

SEQ ID NO: 1123062 - protein, 21 aa, Mycobacterium
ETPVRYALRRFGALRRWGRLS

SEQ ID NO: 1123063 - protein, 23 aa, Mycobacterium
ETTLTLDPGIRFGSLQTVSEGQR

SEQ ID NO: 1123064 - protein, 25 aa, Mycobacterium
EVAFRRADGATVWGAVSASLVAPPG

SEQ ID NO: 1123065 - protein, 24 aa, Mycobacterium
EVAPGRFERRWTFGGSAPGPTLHG

SEQ ID NO: 1123066 - protein, 19 aa, Mycobacterium
EVAVFVFFGLVAVLGTQYT

SEQ ID NO: 1123067 - protein, 24 aa, Mycobacterium
EVDPEVLGGLLITVGDEVIDGSIS

SEQ ID NO: 1123068 - protein, 28 aa, Mycobacterium
EVEPVLARSGARWMPNFIDLLQRNLTQI

SEQ ID NO: 1123069 - protein, 25 aa, Mycobacterium
EVFSGLRASWGWAVAVFVLIAVIAP

SEQ ID NO: 1123070 - protein, 19 aa, Mycobacterium
EVFSSRIAYDDMISPVPLV

SEQ ID NO: 1123071 - protein, 28 aa, Mycobacterium
EVGGAAWLPFLVAFAIATVTAFSYLELV

SEQ ID NO: 1123072 - protein, 17 aa, Mycobacterium
EVGRLAPVVGFLAAVLV

SEQ ID NO: 1123073 - protein, 20 aa, Mycobacterium
EVGRRLRALVVAALRREGIA

SEQ ID NO: 1123074 - protein, 18 aa, Mycobacterium
EVKAHLGRLLSLPINAPE

SEQ ID NO: 1123075 - protein, 19 aa, Mycobacterium
EVKEQLTALSAQLGPQQGS

SEQ ID NO: 1123076 - protein, 25 aa, Mycobacterium
EVLGWPLWLLYVVVFALTLLIGVRL

SEQ ID NO: 1123077 - protein, 20 aa, Mycobacterium
EVLILLALAFTVIFSGGGPD

SEQ ID NO: 1123078 - protein, 27 aa, Mycobacterium
EVLSLPLYLLCGLARRRRLLSQEASLK

SEQ ID NO: 1123079 - protein, 25 aa, Mycobacterium
EVLSSFKVPTVWLLLDSQDGVPRGA

SEQ ID NO: 1123080 - protein, 20 aa, Mycobacterium
EVPDVKSLTYAEAVRTLTDA

SEQ ID NO: 1123081 - protein, 20 aa, Mycobacterium
EVPDVSGLSYTEAVRRLTEA

SEQ ID NO: 1123082 - protein, 17 aa, Mycobacterium
EVPFVPVPIPIPVPDTP

SEQ ID NO: 1123083 - protein, 22 aa, Mycobacterium
EVPPGMGPGAWLAVGGALLGAA

SEQ ID NO: 1123084 - protein, 25 aa, Mycobacterium
EVQRRRADFGWNRLEVAKPQSAVWR

SEQ ID NO: 1123085 - protein, 18 aa, Mycobacterium
EVRPHLTPYFAYGAAALI

SEQ ID NO: 1123086 - protein, 17 aa, Mycobacterium
EVRRAWVARHQGWSLIQ

SEQ ID NO: 1123087 - protein, 22 aa, Mycobacterium
EVRRTRYAWLVSLLDTGFSLVL

SEQ ID NO: 1123088 - protein, 19 aa, Mycobacterium
EVSEREGAKLVIYDDEYTA

SEQ ID NO: 1123089 - protein, 18 aa, Mycobacterium
EVTPRFLFHAPRYRDGTV

SEQ ID NO: 1123090 - protein, 18 aa, Mycobacterium
EVTRLIRRLLPALVVVLA

SEQ ID NO: 1123091 - protein, 18 aa, Mycobacterium
EVVSLGFVISLWAGSSAI

SEQ ID NO: 1123092 - protein, 28 aa, Mycobacterium
EVVVPRPRVFRLRADLPVPQALTALAAS

SEQ ID NO: 1123093 - protein, 18 aa, Mycobacterium
EWRPTVVTLGLLTMLLAG

SEQ ID NO: 1123094 - protein, 31 aa, Mycobacterium
EWYNTALGLAMVFGRFLPIILALALAGSLAQ

SEQ ID NO: 1123095 - protein, 23 aa, Mycobacterium
EYDPEQRRSAALILGVMFTLLAM

SEQ ID NO: 1123096 - protein, 18 aa, Mycobacterium
EYELAVETHLRRELASEL

SEQ ID NO: 1123097 - protein, 17 aa, Mycobacterium
EYGALMVTDAVLRVVVA

SEQ ID NO: 1123098 - protein, 18 aa, Mycobacterium
EYGILRIGIGGGQTIDLN

SEQ ID NO: 1123099 - protein, 23 aa, Mycobacterium
EYILLRALFRNDLAAVPAPDTTV

SEQ ID NO: 1123100 - protein, 17 aa, Mycobacterium
EYILPGYAIPVALAACV

SEQ ID NO: 1123101 - protein, 38 aa, Mycobacterium
EYLDLPRLWQILLIVGLFLWIAIVWRGLRSSLKTSSKT

SEQ ID NO: 1123102 - protein, 22 aa, Mycobacterium
EYLRGLTPVVLRHDTRVTNHGF

SEQ ID NO: 1123103 - protein, 19 aa, Mycobacterium
EYQGAALPKRMNKLGSAGA

SEQ ID NO: 1123104 - protein, 34 aa, Mycobacterium
EYSERLAALARFTLRHKALVIGVWLGAAVVLALL

SEQ ID NO: 1123105 - protein, 21 aa, Mycobacterium
EYVIPLPRAWLLTSAMLVGAA

SEQ ID NO: 1123106 - protein, 25 aa, Mycobacterium
EYVLRVEPFPSPADFFYLAFSVLVV

SEQ ID NO: 1123107 - protein, 24 aa, Mycobacterium
EYVPLRPLFGWATRHTKAAAEDRK

SEQ ID NO: 1123108 - protein, 18 aa, Mycobacterium
FAAACALRTAQRPGVRAS

SEQ ID NO: 1123109 - protein, 18 aa, Mycobacterium
FAACCIVIGYIVLTAERR

SEQ ID NO: 1123110 - protein, 17 aa, Mycobacterium
FAAFGAVFVIRRVRRPA

SEQ ID NO: 1123111 - protein, 19 aa, Mycobacterium
FAAFPNWYATLFSALYLPL

SEQ ID NO: 1123112 - protein, 20 aa, Mycobacterium
FAAGLGALVVVGGGVLAFLY

SEQ ID NO: 1123113 - protein, 20 aa, Mycobacterium
FAALVSRWPLEGSIYQWSRR

SEQ ID NO: 1123114 - protein, 19 aa, Mycobacterium
FADRPWASDYLRLTEAQKF

SEQ ID NO: 1123115 - protein, 23 aa, Mycobacterium
FAEFSRAGLVTAPLTLVAAVLGL

SEQ ID NO: 1123116 - protein, 18 aa, Mycobacterium
FAELYRQGAARDVEMLMN

SEQ ID NO: 1123117 - protein, 30 aa, Mycobacterium
FAEQAFATALPWLAGRLRTPEVVATPLPGP

SEQ ID NO: 1123118 - protein, 24 aa, Mycobacterium
FAEVKRLPEMVPLSDVLARVNGGA

SEQ ID NO: 1123119 - protein, 22 aa, Mycobacterium
FAFCAAHGVFLGVILFLLDRNG

SEQ ID NO: 1123120 - protein, 23 aa, Mycobacterium
FAFLTKMLQAFLVMPGLALAFLV

SEQ ID NO: 1123121 - protein, 17 aa, Mycobacterium
FAGAKAWYLVASRKPIR

SEQ ID NO: 1123122 - protein, 37 aa, Mycobacterium
FAGALLDRWDRRLVLIGANCGRLVVILVVGALLSAGL

SEQ ID NO: 1123123 - protein, 22 aa, Mycobacterium
FAGIELDEFYWARQRSRRVLFF

SEQ ID NO: 1123124 - protein, 20 aa, Mycobacterium
FAGLRLLDVVTVVFFAGVTV

SEQ ID NO: 1123125 - protein, 19 aa, Mycobacterium
FAGQRPWTALIGLLAQASD

SEQ ID NO: 1123126 - protein, 17 aa, Mycobacterium
FAGRYVLRGVLGAGGMA

SEQ ID NO: 1123127 - protein, 20 aa, Mycobacterium
FAGSLSLLGTVPMGLLAYRY

SEQ ID NO: 1123128 - protein, 24 aa, Mycobacterium
FAGTFSPEFDRVTLEAGEDLAKTG

SEQ ID NO: 1123129 - protein, 18 aa, Mycobacterium
FAIGRPLIRLSYLNELRN

SEQ ID NO: 1123130 - protein, 19 aa, Mycobacterium
FALAQAKFQLTGRENSGDV

SEQ ID NO: 1123131 - protein, 27 aa, Mycobacterium
FALASGRAMRALGWLRRNARRIQVFGG

SEQ ID NO: 1123132 - protein, 26 aa, Mycobacterium
FALASGRAMRALGWLRRNTRRIQVFG

SEQ ID NO: 1123133 - protein, 22 aa, Mycobacterium
FALAWRDSWEYWLETVRNTDRI

SEQ ID NO: 1123134 - protein, 21 aa, Mycobacterium
FALAWRDSWEYWTETVRNTDR

SEQ ID NO: 1123135 - protein, 25 aa, Mycobacterium
FALGRLRFVALYLFSALGGSVLVYL

SEQ ID NO: 1123136 - protein, 25 aa, Mycobacterium
FALMSWRARPKLAITDGSLTYRGWF

SEQ ID NO: 1123137 - protein, 21 aa, Mycobacterium
FALSWWLGLYLLARDPRKAVL

SEQ ID NO: 1123138 - protein, 22 aa, Mycobacterium
FALTICVCIALGSFTAADPAIG

SEQ ID NO: 1123139 - protein, 18 aa, Mycobacterium
FALVTVWLTRRGRIPNQR

SEQ ID NO: 1123140 - protein, 20 aa, Mycobacterium
FAMAGGWHAGLGLLAGAAAF

SEQ ID NO: 1123141 - protein, 24 aa, Mycobacterium
FAMGGRAAEELVFREPTTGAVSDI

SEQ ID NO: 1123142 - protein, 17 aa, Mycobacterium
FAPQTRSTRSFDLQFRD

SEQ ID NO: 1123143 - protein, 25 aa, Mycobacterium
FAQANRIAHRWMFTGAVPSGNSTDE

SEQ ID NO: 1123144 - protein, 18 aa, Mycobacterium
FARLSYMILLSVPLVAPV

SEQ ID NO: 1123145 - protein, 22 aa, Mycobacterium
FASDARRGLTITFMAWSGVLGF

SEQ ID NO: 1123146 - protein, 18 aa, Mycobacterium
FASWRGRFVTAIFGRRTA

SEQ ID NO: 1123147 - protein, 28 aa, Mycobacterium
FATGADPMMRWMFWTGLLVTAIDVLIAL

SEQ ID NO: 1123148 - protein, 18 aa, Mycobacterium
FAVAAGVAALWAKKYEAY

SEQ ID NO: 1123149 - protein, 21 aa, Mycobacterium
FAVAAPSRYSASADVAFLPAP

SEQ ID NO: 1123150 - protein, 17 aa, Mycobacterium
FAVAERGATMLSGEVCR

SEQ ID NO: 1123151 - protein, 23 aa, Mycobacterium
FAVASLIAGLVMSIGYMGLPSLL

SEQ ID NO: 1123152 - protein, 20 aa, Mycobacterium
FAVFWGVQTWGVWDAGDRYP

SEQ ID NO: 1123153 - protein, 18 aa, Mycobacterium
FAVILLTYHWARVVATRT

SEQ ID NO: 1123154 - protein, 25 aa, Mycobacterium
FAVLAAVLLSVGWIVGRFGGYEDVV

SEQ ID NO: 1123155 - protein, 24 aa, Mycobacterium
FAVLAAVLLSVGWIVGRFGGYEGV

SEQ ID NO: 1123156 - protein, 19 aa, Mycobacterium
FAVLAGLYLGDLILSSDRV

SEQ ID NO: 1123157 - protein, 29 aa, Mycobacterium
FAVNRGATRWDLERQVRLVAGSLVLSAIL

SEQ ID NO: 1123158 - protein, 29 aa, Mycobacterium
FAVNRGATRWDLERQVRLVAGSLVLTAIL

SEQ ID NO: 1123159 - protein, 19 aa, Mycobacterium
FAVSLSRRSSRVIKQNLWA

SEQ ID NO: 1123160 - protein, 18 aa, Mycobacterium
FAVVALLGAVSWAIIAFF

SEQ ID NO: 1123161 - protein, 41 aa, Mycobacterium
FAVVATLVAFQFRGDFASREKLTMMAARAGLNLDPGTKVTY

SEQ ID NO: 1123162 - protein, 27 aa, Mycobacterium
FAVVPAHWQEWMLAGVFFAGIALFQLI

SEQ ID NO: 1123163 - protein, 30 aa, Mycobacterium
FAVVPAHWQEWMPAGLFFAAIALFQLLWAR

SEQ ID NO: 1123164 - protein, 30 aa, Mycobacterium
FAVVPAHWQEWMPAGLFFAAIALFQLSWAR

SEQ ID NO: 1123165 - protein, 17 aa, Mycobacterium
FAYTKVCSHLGCPSSLY

SEQ ID NO: 1123166 - protein, 23 aa, Mycobacterium
FCGCRRRYQLALQRLRVHGLPER

SEQ ID NO: 1123167 - protein, 17 aa, Mycobacterium
FCGPPSEIGRSMGTTNW

SEQ ID NO: 1123168 - protein, 26 aa, Mycobacterium
FCLSLTPSLLPRDWLFQGLIGGLNAA

SEQ ID NO: 1123169 - protein, 24 aa, Mycobacterium
FCSCSSIPLFIGFVAAGIPLSITL

SEQ ID NO: 1123170 - protein, 22 aa, Mycobacterium
FCWIVAVGCSVGMIAGGAAAFE

SEQ ID NO: 1123171 - protein, 17 aa, Mycobacterium
FDARKAATLGLRPDIAV

SEQ ID NO: 1123172 - protein, 21 aa, Mycobacterium
FDCSGLMLYAFAGVGIKLDHY

SEQ ID NO: 1123173 - protein, 19 aa, Mycobacterium
FDDLVLCATSRDPADRFAD

SEQ ID NO: 1123174 - protein, 17 aa, Mycobacterium
FDGVQGRSAVSVGPLSE

SEQ ID NO: 1123175 - protein, 25 aa, Mycobacterium
FDHMPELHWTFGYPAVLMVMISVCL

SEQ ID NO: 1123176 - protein, 19 aa, Mycobacterium
FDIPPGGSTAAWLSVSAPK

SEQ ID NO: 1123177 - protein, 18 aa, Mycobacterium
FDKVEGFVYCRPEEAEAE

SEQ ID NO: 1123178 - protein, 24 aa, Mycobacterium
FDLASRWHGFWRGDIGVWILDRGV

SEQ ID NO: 1123179 - protein, 19 aa, Mycobacterium
FDLAVAVFFALSGFLLWRG

SEQ ID NO: 1123180 - protein, 24 aa, Mycobacterium
FDLRNWRVAWNGAEPVRPDTLHQF

SEQ ID NO: 1123181 - protein, 17 aa, Mycobacterium
FDMRRLRGGTLREPLLV

SEQ ID NO: 1123182 - protein, 25 aa, Mycobacterium
FDMWRGLGIYDTWLGLIIPYLTFAL

SEQ ID NO: 1123183 - protein, 17 aa, Mycobacterium
FDNGVPFVDDLGKNIEL

SEQ ID NO: 1123184 - protein, 37 aa, Mycobacterium
FDPKRAISSRGWRRIGVSVVRWPGPVLAATLALALVG

SEQ ID NO: 1123185 - protein, 26 aa, Mycobacterium
FDPNSRFTISMLWSGDKAWRQSGERR

SEQ ID NO: 1123186 - protein, 23 aa, Mycobacterium
FDRLVECGHALRTGDQLWLTQSG

SEQ ID NO: 1123187 - protein, 17 aa, Mycobacterium
FDSQGFVTLAWWMAVFP

SEQ ID NO: 1123188 - protein, 26 aa, Mycobacterium
FDSRVCRELIRFGLPVTAVTLLAYAI

SEQ ID NO: 1123189 - protein, 24 aa, Mycobacterium
FDVALCVLGVALVVIAFVTSTADR

SEQ ID NO: 1123190 - protein, 25 aa, Mycobacterium
FDVTPSRLRRPGAAVLEIDDEDPAF

SEQ ID NO: 1123191 - protein, 17 aa, Mycobacterium
FEAMSLPNLRYVTQAGG

SEQ ID NO: 1123192 - protein, 19 aa, Mycobacterium
FEAPELDSHILLSVVLPPL

SEQ ID NO: 1123193 - protein, 17 aa, Mycobacterium
FEEKVSWIPGVNSSYHI

SEQ ID NO: 1123194 - protein, 18 aa, Mycobacterium
FEGYLAWVAGAGAIATVT

SEQ ID NO: 1123195 - protein, 17 aa, Mycobacterium
FEIGENIAIGDRSEAAI

SEQ ID NO: 1123196 - protein, 28 aa, Mycobacterium
FELAILLALPWWRAFRSTLAIATLFHLG

SEQ ID NO: 1123197 - protein, 19 aa, Mycobacterium
FELPGEASGGFGGAATSLP

SEQ ID NO: 1123198 - protein, 19 aa, Mycobacterium
FERAPRLQVGGGRVRPVVP

SEQ ID NO: 1123199 - protein, 25 aa, Mycobacterium
FERVFEVLDLVPLIRERPGAVEVPR

SEQ ID NO: 1123200 - protein, 18 aa, Mycobacterium
FESFRWAWTAQYVIWTLA

SEQ ID NO: 1123201 - protein, 18 aa, Mycobacterium
FESPWPRVIGCAVTALVA

SEQ ID NO: 1123202 - protein, 19 aa, Mycobacterium
FETLLSDLLEISRHDAGVA

SEQ ID NO: 1123203 - protein, 21 aa, Mycobacterium
FEVALSPGWTFGQLWRTDRRR

SEQ ID NO: 1123204 - protein, 27 aa, Mycobacterium
FEVGRRLRVLVIRELRRSGIVAPGEAP

SEQ ID NO: 1123205 - protein, 20 aa, Mycobacterium
FEVYFVPAGYVFAIWSVIYA

SEQ ID NO: 1123206 - protein, 17 aa, Mycobacterium
FEYLARAGFAASGVLHL

SEQ ID NO: 1123207 - protein, 28 aa, Mycobacterium
FFAASPRRPRRWGLPLIATVAALLLAAA

SEQ ID NO: 1123208 - protein, 23 aa, Mycobacterium
FFIAKVIDIRGAFGVPGTGESMP

SEQ ID NO: 1123209 - protein, 17 aa, Mycobacterium
FFIPLLIGTGGNTGTQI

SEQ ID NO: 1123210 - protein, 33 aa, Mycobacterium
FFLAELLDNWLWKWASYLIVFGIMVVLTGLLAL

SEQ ID NO: 1123211 - protein, 18 aa, Mycobacterium
FFLYATAATLVFNKVFFA

SEQ ID NO: 1123212 - protein, 17 aa, Mycobacterium
FFLYTFLGSLALLVGFI

SEQ ID NO: 1123213 - protein, 20 aa, Mycobacterium
FFQYHLPGVQAHHLDVVPDP

SEQ ID NO: 1123214 - protein, 18 aa, Mycobacterium
FFTGRRSAAAWLLVAVLL

SEQ ID NO: 1123215 - protein, 25 aa, Mycobacterium
FFTLFGVAALWAFWLHLRNKQDSRV

SEQ ID NO: 1123216 - protein, 20 aa, Mycobacterium
FFVEGIAAAMGWWTYDPGMG

SEQ ID NO: 1123217 - protein, 17 aa, Mycobacterium
FFWLWWTTNMLSAHLAG

SEQ ID NO: 1123218 - protein, 21 aa, Mycobacterium
FGAAVGLPWTADPAVQPDAGG

SEQ ID NO: 1123219 - protein, 24 aa, Mycobacterium
FGAAVLLHGSWHWVFAALVVVAGA

SEQ ID NO: 1123220 - protein, 26 aa, Mycobacterium
FGARRWLARIAVSWGLVVVAVGFAPN

SEQ ID NO: 1123221 - protein, 19 aa, Mycobacterium
FGAVAAMRFEAFTWVIYGA

SEQ ID NO: 1123222 - protein, 18 aa, Mycobacterium
FGAVCAVIATLIMGVSAG

SEQ ID NO: 1123223 - protein, 17 aa, Mycobacterium
FGDAIAPGIILAQAIGR

SEQ ID NO: 1123224 - protein, 17 aa, Mycobacterium
FGDPRVVGLLHEETYAL

SEQ ID NO: 1123225 - protein, 18 aa, Mycobacterium
FGELRRRGATTFEITEEA

SEQ ID NO: 1123226 - protein, 25 aa, Mycobacterium
FGEYLPWRGFFRHFSGYADRAGYFT

SEQ ID NO: 1123227 - protein, 24 aa, Mycobacterium
FGFASLRIAAYALWPFGRTIVEKP

SEQ ID NO: 1123228 - protein, 18 aa, Mycobacterium
FGFGCAMTGLSTVVQERA

SEQ ID NO: 1123229 - protein, 17 aa, Mycobacterium
FGFGMGADIAWLLPAAV

SEQ ID NO: 1123230 - protein, 20 aa, Mycobacterium
FGGAAFLVGYGLLAARRAVK

SEQ ID NO: 1123231 - protein, 26 aa, Mycobacterium
FGGIHEIYFPYVLMKPKLIVATILGG

SEQ ID NO: 1123232 - protein, 22 aa, Mycobacterium
FGGNSFGTWLFFILAVVLFVGF

SEQ ID NO: 1123233 - protein, 24 aa, Mycobacterium
FGGQVPGTLGMRFLARLIDGIIVG

SEQ ID NO: 1123234 - protein, 24 aa, Mycobacterium
FGGTVVVCMIWRLVSGGLSDAPQN

SEQ ID NO: 1123235 - protein, 20 aa, Mycobacterium
FGHDPWWLVLAKSLGIFAFL

SEQ ID NO: 1123236 - protein, 18 aa, Mycobacterium
FGILGALFLLPLVTAPVL

SEQ ID NO: 1123237 - protein, 19 aa, Mycobacterium
FGKGGLKGTAGWFDSMGMR

SEQ ID NO: 1123238 - protein, 23 aa, Mycobacterium
FGKRELWLHLGWQDIKQRYRRSV

SEQ ID NO: 1123239 - protein, 18 aa, Mycobacterium
FGLFGAMFVVARKLNLDI

SEQ ID NO: 1123240 - protein, 21 aa, Mycobacterium
FGLFRVSRSIWLRAIGTTYVD

SEQ ID NO: 1123241 - protein, 17 aa, Mycobacterium
FGLGRFGSHLADRLSGA

SEQ ID NO: 1123242 - protein, 18 aa, Mycobacterium
FGLILMWLLSWLIATPVR

SEQ ID NO: 1123243 - protein, 19 aa, Mycobacterium
FGLNARIGPYGSLSVGFSR

SEQ ID NO: 1123244 - protein, 17 aa, Mycobacterium
FGLSVLVWQHLVGIELH

SEQ ID NO: 1123245 - protein, 23 aa, Mycobacterium
FGLTLPRALFWIVIAYVVVVTYV

SEQ ID NO: 1123246 - protein, 18 aa, Mycobacterium
FGMALRYGVVGVDEGRDA

SEQ ID NO: 1123247 - protein, 18 aa, Mycobacterium
FGMILRIVGIEWRGKIDD

SEQ ID NO: 1123248 - protein, 22 aa, Mycobacterium
FGPDGLPFLSLTSMSAGLLGAG

SEQ ID NO: 1123249 - protein, 24 aa, Mycobacterium
FGPGRALFTLAFIDVWQWTPFMVL

SEQ ID NO: 1123250 - protein, 17 aa, Mycobacterium
FGPKNVYLVGLAVFTAA

SEQ ID NO: 1123251 - protein, 19 aa, Mycobacterium
FGQIWKRIGENDAEPPDPK

SEQ ID NO: 1123252 - protein, 20 aa, Mycobacterium
FGQMRFDRTTGYSAIFSSAS

SEQ ID NO: 1123253 - protein, 20 aa, Mycobacterium
FGRGLARASAPGAAIIQFFG

SEQ ID NO: 1123254 - protein, 28 aa, Mycobacterium
FGRIAVKLHLPATGGLYEFSNVTYRGIE

SEQ ID NO: 1123255 - protein, 25 aa, Mycobacterium
FGSAARRAAILAAVICVLTLTIAGP

SEQ ID NO: 1123256 - protein, 17 aa, Mycobacterium
FGSALVLMGAVGVVTLA

SEQ ID NO: 1123257 - protein, 17 aa, Mycobacterium
FGSRIRVTAALATAFAA

SEQ ID NO: 1123258 - protein, 23 aa, Mycobacterium
FGTDRLEVFTVPYTAQFHNPLSA

SEQ ID NO: 1123259 - protein, 28 aa, Mycobacterium
FGTGIDWRPNPGIGFPAWANYLPTTRAV

SEQ ID NO: 1123260 - protein, 24 aa, Mycobacterium
FGTQWRDVVAFVLLVLVLLVRPTG

SEQ ID NO: 1123261 - protein, 18 aa, Mycobacterium
FGVAPAFIVYGTLLSTSR

SEQ ID NO: 1123262 - protein, 25 aa, Mycobacterium
FGVEVLPWLLGQAVVGICLLESINY

SEQ ID NO: 1123263 - protein, 18 aa, Mycobacterium
FGVLAGVAVRYVSHRAVL

SEQ ID NO: 1123264 - protein, 18 aa, Mycobacterium
FGVQAGLFSSVLAEAYQA

SEQ ID NO: 1123265 - protein, 23 aa, Mycobacterium
FGVRIDPFPAAVIAFSLNVGGYA

SEQ ID NO: 1123266 - protein, 23 aa, Mycobacterium
FGVSIRITVVWWLVFTAIATWVL

SEQ ID NO: 1123267 - protein, 18 aa, Mycobacterium
FGVVWQFAAASGVWNQTF

SEQ ID NO: 1123268 - protein, 17 aa, Mycobacterium
FGYDDSLDVVGVHLVGG

SEQ ID NO: 1123269 - protein, 20 aa, Mycobacterium
FGYRLFPWDQVIDVSFHKGA

SEQ ID NO: 1123270 - protein, 18 aa, Mycobacterium
FHCQGRAVPDHICEPIPM

SEQ ID NO: 1123271 - protein, 17 aa, Mycobacterium
FHIHVMLGLTLFCLWPF

SEQ ID NO: 1123272 - protein, 18 aa, Mycobacterium
FHRNRVRMIFLLPPDPAH

SEQ ID NO: 1123273 - protein, 23 aa, Mycobacterium
FIADSGFRLAVLGLTVYTASFVC

SEQ ID NO: 1123274 - protein, 33 aa, Mycobacterium
FIAVPVLGWAVWRAFVKRDWRYAVVLVGYSAGF

SEQ ID NO: 1123275 - protein, 25 aa, Mycobacterium
FIGIGWLVGYLMRIQQELLLEQREA

SEQ ID NO: 1123276 - protein, 17 aa, Mycobacterium
FIGLLFVVVWLLIAYLR

SEQ ID NO: 1123277 - protein, 20 aa, Mycobacterium
FIGLWIFGWNRLPRVVHLAC

SEQ ID NO: 1123278 - protein, 20 aa, Mycobacterium
FIGTFWLVFGGCGSAVFAAK

SEQ ID NO: 1123279 - protein, 17 aa, Mycobacterium
FILALCFASTNGWWYVS

SEQ ID NO: 1123280 - protein, 23 aa, Mycobacterium
FINDHKVWFAVIAILVLASLNLR

SEQ ID NO: 1123281 - protein, 17 aa, Mycobacterium
FIPMLLVAFAYKELSQD

SEQ ID NO: 1123282 - protein, 19 aa, Mycobacterium
FIRPYVYDEIAPWVPTLWR

SEQ ID NO: 1123283 - protein, 20 aa, Mycobacterium
FISAIGWVVFFFMFRTAHDV

SEQ ID NO: 1123284 - protein, 26 aa, Mycobacterium
FISDAAGFMTVWARMYAPDGAAFEQR

SEQ ID NO: 1123285 - protein, 19 aa, Mycobacterium
FITPIAVGLTFRFLLNDQL

SEQ ID NO: 1123286 - protein, 19 aa, Mycobacterium
FIVGLEVTREFTIGELTDR

SEQ ID NO: 1123287 - protein, 26 aa, Mycobacterium
FIVIWRRHGAPWGFAVLAFSPAMILA

SEQ ID NO: 1123288 - protein, 21 aa, Mycobacterium
FKAIGRPGILTAINAGKLAVL

SEQ ID NO: 1123289 - protein, 24 aa, Mycobacterium
FKHLGERGEYTWRVPAYQVLKRHA

SEQ ID NO: 1123290 - protein, 18 aa, Mycobacterium
FKKRGINPEEFWRNAGLP

SEQ ID NO: 1123291 - protein, 17 aa, Mycobacterium
FKLVRYLAREYLLIVST

SEQ ID NO: 1123292 - protein, 23 aa, Mycobacterium
FKTARRGMLLWPSGVEADSLFNT

SEQ ID NO: 1123293 - protein, 37 aa, Mycobacterium
FLAGDVLGVPGWVTQRLWWALLLVVGFWGMLRLAEAL

SEQ ID NO: 1123294 - protein, 20 aa, Mycobacterium
FLAGRARRGDARFRLATLAL

SEQ ID NO: 1123295 - protein, 36 aa, Mycobacterium
FLALIMLSAWLFRRLLGKRARAGFVVLLGALTIASF

SEQ ID NO: 1123296 - protein, 26 aa, Mycobacterium
FLATLAFLRYRWLRGEPLPPQRSRAA

SEQ ID NO: 1123297 - protein, 34 aa, Mycobacterium
FLAVPVLAWAVWRAFVKRDWRYAVLLVGYSAGFL

SEQ ID NO: 1123298 - protein, 25 aa, Mycobacterium
FLDAAGEPFFWMADTAWSLPINLTR

SEQ ID NO: 1123299 - protein, 27 aa, Mycobacterium
FLDRMRARMPWFDHVMRAQERYKDAKG

SEQ ID NO: 1123300 - protein, 35 aa, Mycobacterium
FLFTALCLFSSLFIMLRRKRVPGVARGPAWRLMGV

SEQ ID NO: 1123301 - protein, 19 aa, Mycobacterium
FLGFWAIHLLVVWAAIYLT

SEQ ID NO: 1123302 - protein, 18 aa, Mycobacterium
FLGTGLCGGLTTFSTMQV

SEQ ID NO: 1123303 - protein, 25 aa, Mycobacterium
FLIPARRIGTAMARLSREAAAHNAT

SEQ ID NO: 1123304 - protein, 23 aa, Mycobacterium
FLIVLGVIAKWVVPPVSKVLAER

SEQ ID NO: 1123305 - protein, 21 aa, Mycobacterium
FLLDVYKILLVIGSFACALAF

SEQ ID NO: 1123306 - protein, 20 aa, Mycobacterium
FLLHGGRNIFAFVTKMFPVH

SEQ ID NO: 1123307 - protein, 18 aa, Mycobacterium
FLLHGGRNIFGFITQVFP

SEQ ID NO: 1123308 - protein, 19 aa, Mycobacterium
FLLIGGRLGDRFGSKPVYL

SEQ ID NO: 1123309 - protein, 18 aa, Mycobacterium
FLLVAAGLYLTSRITVDA

SEQ ID NO: 1123310 - protein, 17 aa, Mycobacterium
FLPRPFPAPVDGRAETV

SEQ ID NO: 1123311 - protein, 18 aa, Mycobacterium
FLPVAGHRAGELISRGFL

SEQ ID NO: 1123312 - protein, 20 aa, Mycobacterium
FLREGYAMGGLSGHPNIVNI

SEQ ID NO: 1123313 - protein, 18 aa, Mycobacterium
FLRFGGAAVAPWLAGVLG

SEQ ID NO: 1123314 - protein, 19 aa, Mycobacterium
FLRRPGHVPDQMFGIWRAV

SEQ ID NO: 1123315 - protein, 19 aa, Mycobacterium
FLSSGAMRFDPPGGTYSDE

SEQ ID NO: 1123316 - protein, 26 aa, Mycobacterium
FLTNPAQALITWGPFLAAVAYQAVSW

SEQ ID NO: 1123317 - protein, 17 aa, Mycobacterium
FLTTGFVNVARYFDLMA

SEQ ID NO: 1123318 - protein, 18 aa, Mycobacterium
FLVLVWVFGGLLAAAVPV

SEQ ID NO: 1123319 - protein, 17 aa, Mycobacterium
FLVMELVEGGTLRELLR

SEQ ID NO: 1123320 - protein, 27 aa, Mycobacterium
FLVSPKPPVRWGLPLVSVIVAVVMTAA

SEQ ID NO: 1123321 - protein, 20 aa, Mycobacterium
FLYMRRNREPALAGVGPSPH

SEQ ID NO: 1123322 - protein, 24 aa, Mycobacterium
FMAFLAGDLFNLFVGFEVLLTASF

SEQ ID NO: 1123323 - protein, 27 aa, Mycobacterium
FMEAGGWRLPGLAAFMVTASETLGGIG

SEQ ID NO: 1123324 - protein, 21 aa, Mycobacterium
FMGLYLRFLRPGRVSEVSLIG

SEQ ID NO: 1123325 - protein, 35 aa, Mycobacterium
FMHLMGGLNWWAPGWLRRVHERLGFTEAPSVNPEV

SEQ ID NO: 1123326 - protein, 19 aa, Mycobacterium
FMLRLKVGMTAGIVLACPV

SEQ ID NO: 1123327 - protein, 18 aa, Mycobacterium
FMLSDGLGNLGGPLKQLR

SEQ ID NO: 1123328 - protein, 18 aa, Mycobacterium
FMVWTWVVIWPYDPAETA

SEQ ID NO: 1123329 - protein, 24 aa, Mycobacterium
FNAVFGVAVGRVVTLAFLMLQLVS

SEQ ID NO: 1123330 - protein, 17 aa, Mycobacterium
FNFLVRLEQPVVHGLST

SEQ ID NO: 1123331 - protein, 22 aa, Mycobacterium
FNFPDTSFAWAFVLALLAAALA

SEQ ID NO: 1123332 - protein, 19 aa, Mycobacterium
FNHEVFAMSPDRGHADLNE

SEQ ID NO: 1123333 - protein, 20 aa, Mycobacterium
FNKPAGKFNYTWQGFTLENW

SEQ ID NO: 1123334 - protein, 31 aa, Mycobacterium
FNNGLRPEPLIAFGVVAAWILTERALATRRL

SEQ ID NO: 1123335 - protein, 24 aa, Mycobacterium
FNPTEFPIALLLNVTNPLRAEFGN

SEQ ID NO: 1123336 - protein, 22 aa, Mycobacterium
FNRDRPVAVNVIDFGDDSDRAT

SEQ ID NO: 1123337 - protein, 23 aa, Mycobacterium
FNRSAGLQRLRLLEASYGVVVNV

SEQ ID NO: 1123338 - protein, 17 aa, Mycobacterium
FNTAWICTRAQNQDGQT

SEQ ID NO: 1123339 - protein, 33 aa, Mycobacterium
FNVRGAKNYPCLTVPGKRAPSVKMCESDQQYVP

SEQ ID NO: 1123340 - protein, 22 aa, Mycobacterium
FNVRGARNLPCVNKPGKRAPTA

SEQ ID NO: 1123341 - protein, 25 aa, Mycobacterium
FNVVWAVAYLRGFGRTPVWVAAEVG

SEQ ID NO: 1123342 - protein, 24 aa, Mycobacterium
FNWVIPIVGGLVILLAIADSVRRR

SEQ ID NO: 1123343 - protein, 26 aa, Mycobacterium
FNYFLGMPYWLGVVLIAAIAVAYTGT

SEQ ID NO: 1123344 - protein, 17 aa, Mycobacterium
FPAAPPWAAARCTAADV

SEQ ID NO: 1123345 - protein, 17 aa, Mycobacterium
FPAMMLVSSIGTLAYGA

SEQ ID NO: 1123346 - protein, 20 aa, Mycobacterium
FPEFAMHWGGPGSLGYFTAV

SEQ ID NO: 1123347 - protein, 24 aa, Mycobacterium
FPGLREHLGLAYGFYGLCAVLSGL

SEQ ID NO: 1123348 - protein, 21 aa, Mycobacterium
FPIIGAFPFNGHFTVVLVLTV

SEQ ID NO: 1123349 - protein, 21 aa, Mycobacterium
FPKPEEIGGYAGVPQAPPPPP

SEQ ID NO: 1123350 - protein, 19 aa, Mycobacterium
FPLDDMWHRIFGQDVTLWG

SEQ ID NO: 1123351 - protein, 17 aa, Mycobacterium
FPLGLAWVAVDAQRRSL

SEQ ID NO: 1123352 - protein, 19 aa, Mycobacterium
FPLHRVRGVPAKLYSTYTL

SEQ ID NO: 1123353 - protein, 24 aa, Mycobacterium
FPLLAGPFAPWVFAGNMTANLMRN

SEQ ID NO: 1123354 - protein, 22 aa, Mycobacterium
FPLLGGLSMLAAFTISAKDMIQ

SEQ ID NO: 1123355 - protein, 18 aa, Mycobacterium
FPLPWLLDVAMWVLALSS

SEQ ID NO: 1123356 - protein, 17 aa, Mycobacterium
FPLVEWVVHVCILHWRP

SEQ ID NO: 1123357 - protein, 18 aa, Mycobacterium
FPLYEGIFWGCGMVGLSA

SEQ ID NO: 1123358 - protein, 22 aa, Mycobacterium
FPPMGSILYWLRPRTIRLPPWP

SEQ ID NO: 1123359 - protein, 19 aa, Mycobacterium
FPRGNLIGIPGAPERMVAN

SEQ ID NO: 1123360 - protein, 20 aa, Mycobacterium
FPVAMGITALLTLAGRAVGW

SEQ ID NO: 1123361 - protein, 17 aa, Mycobacterium
FPVAVVILAVYALQDQV

SEQ ID NO: 1123362 - protein, 23 aa, Mycobacterium
FQAAPSKARFIAVVALYAVTYAV

SEQ ID NO: 1123363 - protein, 18 aa, Mycobacterium
FQAGRPFAAAIVGTRLTI

SEQ ID NO: 1123364 - protein, 26 aa, Mycobacterium
FQAVPRLHAVAVVAALLPNLAEWGRG

SEQ ID NO: 1123365 - protein, 38 aa, Mycobacterium
FQGDEWEDWNIKRLAAVRPAEEPIKTFVLSDVVAAQNL

SEQ ID NO: 1123366 - protein, 18 aa, Mycobacterium
FQLRKDLVALRRVVLPMR

SEQ ID NO: 1123367 - protein, 25 aa, Mycobacterium
FQPPRAAFPIAWNVLYTDIAAVSAS

SEQ ID NO: 1123368 - protein, 17 aa, Mycobacterium
FQRNGRARALYVILPRQ

SEQ ID NO: 1123369 - protein, 17 aa, Mycobacterium
FQTADFQRGIKLFMSPD

SEQ ID NO: 1123370 - protein, 18 aa, Mycobacterium
FQVVPVFFAVAGYASAVS

SEQ ID NO: 1123371 - protein, 24 aa, Mycobacterium
FQWREFLEQCWFVARVSMAPTLLV

SEQ ID NO: 1123372 - protein, 25 aa, Mycobacterium
FQYRTRELLPWGNLRRLLRTAHHST

SEQ ID NO: 1123373 - protein, 24 aa, Mycobacterium
FRAAWRRLDVAFVLGPRTRDLAVT

SEQ ID NO: 1123374 - protein, 20 aa, Mycobacterium
FRAEARTVAMLNHPGIAGVY

SEQ ID NO: 1123375 - protein, 19 aa, Mycobacterium
FRDPLTLVWNRAGVSRRVG

SEQ ID NO: 1123376 - protein, 21 aa, Mycobacterium
FREMINAVLPQVVPSWIGTFV

SEQ ID NO: 1123377 - protein, 21 aa, Mycobacterium
FRGLPEVVIILLIGLGVGPVV

SEQ ID NO: 1123378 - protein, 25 aa, Mycobacterium
FRGMIGRLAIFVAVATGYVLALLLG

SEQ ID NO: 1123379 - protein, 20 aa, Mycobacterium
FRHRQEWVYLPPAWYASDPP

SEQ ID NO: 1123380 - protein, 18 aa, Mycobacterium
FRIRARDGSWRWFVTHTR

SEQ ID NO: 1123381 - protein, 23 aa, Mycobacterium
FRLNCASCHNFTGKGGALSSGKY

SEQ ID NO: 1123382 - protein, 17 aa, Mycobacterium
FRMPIVLVPSNTALWAP

SEQ ID NO: 1123383 - protein, 18 aa, Mycobacterium
FRNFPQVVAVISNMAEKR

SEQ ID NO: 1123384 - protein, 17 aa, Mycobacterium
FRPIAAGVVPEWLAYTL

SEQ ID NO: 1123385 - protein, 19 aa, Mycobacterium
FRQAHALREVVDKLSALDK

SEQ ID NO: 1123386 - protein, 24 aa, Mycobacterium
FRQALRELSQTAGRLGDSRTDLFG

SEQ ID NO: 1123387 - protein, 18 aa, Mycobacterium
FRQQRLWGASPLVASWQL

SEQ ID NO: 1123388 - protein, 25 aa, Mycobacterium
FRRAVRELSQTAGRLGDSRTDLFGT

SEQ ID NO: 1123389 - protein, 20 aa, Mycobacterium
FRRLFANPWLWVAIAVSALL

SEQ ID NO: 1123390 - protein, 18 aa, Mycobacterium
FRRPFQFREFLDQTWMIA

SEQ ID NO: 1123391 - protein, 18 aa, Mycobacterium
FRRVVLPLLLPGIVAALL

SEQ ID NO: 1123392 - protein, 18 aa, Mycobacterium
FRSLSGFSAAYSAAAQNL

SEQ ID NO: 1123393 - protein, 29 aa, Mycobacterium
FRSRLYAERWCAWALMAAAVAVPTGVVVR

SEQ ID NO: 1123394 - protein, 17 aa, Mycobacterium
FRSVATMVLILFMVFAE

SEQ ID NO: 1123395 - protein, 25 aa, Mycobacterium
FRTVFRHRAYRAALFSNFATGWASF

SEQ ID NO: 1123396 - protein, 18 aa, Mycobacterium
FRVYLGWISVATIANATI

SEQ ID NO: 1123397 - protein, 19 aa, Mycobacterium
FSAGSWRDGVGTRRTAAGR

SEQ ID NO: 1123398 - protein, 33 aa, Mycobacterium
FSDSGILSWSVLRFTRRRARLRSVQELADLLFR

SEQ ID NO: 1123399 - protein, 17 aa, Mycobacterium
FSDVLIIGAGISGIGAA

SEQ ID NO: 1123400 - protein, 24 aa, Mycobacterium
FSELRSANWWWALAGLAVSALKYL

SEQ ID NO: 1123401 - protein, 19 aa, Mycobacterium
FSFAPDRFDIPPGGSTAAW

SEQ ID NO: 1123402 - protein, 18 aa, Mycobacterium
FSGLLAQVAARRFDVGSS

SEQ ID NO: 1123403 - protein, 17 aa, Mycobacterium
FSKRLPTSGGLYTWNSK

SEQ ID NO: 1123404 - protein, 19 aa, Mycobacterium
FSLPRTFGRMVGNKKQGYA

SEQ ID NO: 1123405 - protein, 25 aa, Mycobacterium
FSLVSWAVPLNWWVVLAGFVLFVSP

SEQ ID NO: 1123406 - protein, 19 aa, Mycobacterium
FSMALAVLGLRARTAADTA

SEQ ID NO: 1123407 - protein, 29 aa, Mycobacterium
FSPLSGRLVGRFGARPSLLIAGVFITAAS

SEQ ID NO: 1123408 - protein, 29 aa, Mycobacterium
FSRDDYFGALRVMRWIPTVAFGLGLAALI

SEQ ID NO: 1123409 - protein, 18 aa, Mycobacterium
FSSLPGLIAAAVIAGVGQ

SEQ ID NO: 1123410 - protein, 28 aa, Mycobacterium
FSSPQSRASWQWLEWMPHTGSIHSPLSG

SEQ ID NO: 1123411 - protein, 19 aa, Mycobacterium
FSSVFVVGNSLRLRRFKTT

SEQ ID NO: 1123412 - protein, 19 aa, Mycobacterium
FSTPWLKVPDLLLPAYGET

SEQ ID NO: 1123413 - protein, 18 aa, Mycobacterium
FSVALPVVLTVAVMPFSY

SEQ ID NO: 1123414 - protein, 22 aa, Mycobacterium
FSVDYSRGFVRRGLAGEILNLF

SEQ ID NO: 1123415 - protein, 21 aa, Mycobacterium
FSVFEYFRSWEFFRTTGESFW

SEQ ID NO: 1123416 - protein, 19 aa, Mycobacterium
FSVLLVFTFNILLTEFGAA

SEQ ID NO: 1123417 - protein, 18 aa, Mycobacterium
FSVLYAARRLRPREVDGN

SEQ ID NO: 1123418 - protein, 17 aa, Mycobacterium
FTAGAPFVWTLLLAGAV

SEQ ID NO: 1123419 - protein, 20 aa, Mycobacterium
FTALEAVAVLLLIVVVVVAI

SEQ ID NO: 1123420 - protein, 20 aa, Mycobacterium
FTAMGLRFAENIMYYLVVTF

SEQ ID NO: 1123421 - protein, 17 aa, Mycobacterium
FTANVFALMGLRQLYFL

SEQ ID NO: 1123422 - protein, 17 aa, Mycobacterium
FTAPELIGVDLRRYPRE

SEQ ID NO: 1123423 - protein, 19 aa, Mycobacterium
FTATMPVVGWIGDRIGRRR

SEQ ID NO: 1123424 - protein, 24 aa, Mycobacterium
FTEAPARETLRCRPDAAYLITGGM

SEQ ID NO: 1123425 - protein, 26 aa, Mycobacterium
FTGALSFLYYVVFEVTQGWTPGKKLL

SEQ ID NO: 1123426 - protein, 19 aa, Mycobacterium
FTGSALRLFRRLTPQRGMT

SEQ ID NO: 1123427 - protein, 25 aa, Mycobacterium
FTIASVLCGIAWDEATLVIARLLQG

SEQ ID NO: 1123428 - protein, 24 aa, Mycobacterium
FTLARLPTPLLFGGLAGALLYALV

SEQ ID NO: 1123429 - protein, 18 aa, Mycobacterium
FTMAGPWVGIAAPGEDIT

SEQ ID NO: 1123430 - protein, 30 aa, Mycobacterium
FTPPFAFGMPRFDIVAIITMIIVMMIIAVE

SEQ ID NO: 1123431 - protein, 24 aa, Mycobacterium
FTPTKWIHHFGLFAAVGGAMAALA

SEQ ID NO: 1123432 - protein, 17 aa, Mycobacterium
FTQNIGFDADGKLVEPV

SEQ ID NO: 1123433 - protein, 17 aa, Mycobacterium
FTRMVPPNFGALGGDLF

SEQ ID NO: 1123434 - protein, 17 aa, Mycobacterium
FTRRAPRTCAVRASLLL

SEQ ID NO: 1123435 - protein, 19 aa, Mycobacterium
FTSAFGYWMSAWVGNVAYL

SEQ ID NO: 1123436 - protein, 20 aa, Mycobacterium
FTTDAGWRRAVLAMVGALVP

SEQ ID NO: 1123437 - protein, 17 aa, Mycobacterium
FTTLRLVYTDASTKYRE

SEQ ID NO: 1123438 - protein, 17 aa, Mycobacterium
FTTYLPSLFLAAVLTPA

SEQ ID NO: 1123439 - protein, 19 aa, Mycobacterium
FTVAAAVCAFLFMNNLTEA

SEQ ID NO: 1123440 - protein, 22 aa, Mycobacterium
FTVAALHQWRPVTVAGLAVGAL

SEQ ID NO: 1123441 - protein, 17 aa, Mycobacterium
FTWEPLSAIATRGLTSE

SEQ ID NO: 1123442 - protein, 18 aa, Mycobacterium
FVAAEGLGSDCQYPKSAE

SEQ ID NO: 1123443 - protein, 25 aa, Mycobacterium
FVAAGGLLIALGFLFAGYEIADTGN

SEQ ID NO: 1123444 - protein, 23 aa, Mycobacterium
FVAEAYTGTVLRHFEEEMEAVVA

SEQ ID NO: 1123445 - protein, 17 aa, Mycobacterium
FVAMAFSGVINALVRIR

SEQ ID NO: 1123446 - protein, 28 aa, Mycobacterium
FVAMFKPPFQWREFLLQTWFVARVSMVP

SEQ ID NO: 1123447 - protein, 26 aa, Mycobacterium
FVAPMLGVLCSVGWQPRPPGVSVSTS

SEQ ID NO: 1123448 - protein, 18 aa, Mycobacterium
FVAYRWAVGLQRSDRAVL

SEQ ID NO: 1123449 - protein, 23 aa, Mycobacterium
FVDHKLWIRFGVSGALLSAVLAL

SEQ ID NO: 1123450 - protein, 29 aa, Mycobacterium
FVDQGVLRLEWRDMPIFGEQSMRAARAGR

SEQ ID NO: 1123451 - protein, 23 aa, Mycobacterium
FVENYRWIPSFGTGYILGVDGIA

SEQ ID NO: 1123452 - protein, 17 aa, Mycobacterium
FVFICYHAAGIWRRGIV

SEQ ID NO: 1123453 - protein, 21 aa, Mycobacterium
FVFLAALLVAVAWAWREGALR

SEQ ID NO: 1123454 - protein, 32 aa, Mycobacterium
FVFTWLRRRSGSLIAPIALHWSLNGLGALAAA

SEQ ID NO: 1123455 - protein, 17 aa, Mycobacterium
FVGAIAWSFLLSPQSGY

SEQ ID NO: 1123456 - protein, 21 aa, Mycobacterium
FVIGCGQALTAPAWQAIQPDL

SEQ ID NO: 1123457 - protein, 26 aa, Mycobacterium
FVITRIITAGITWLIGLLNPAAAFIK

SEQ ID NO: 1123458 - protein, 22 aa, Mycobacterium
FVLAVCRVIVGVALVPRVPPLN

SEQ ID NO: 1123459 - protein, 24 aa, Mycobacterium
FVPAALPWYYTWPLAVVAALATSR

SEQ ID NO: 1123460 - protein, 22 aa, Mycobacterium
FVPALDMLLAIIRRTRKGLSPF

SEQ ID NO: 1123461 - protein, 30 aa, Mycobacterium
FVPPFPTRSTFPGVFSDGGPVDYFAVDLPR

SEQ ID NO: 1123462 - protein, 27 aa, Mycobacterium
FVQKAWRNLRFPLEWAPPEANVARIVA

SEQ ID NO: 1123463 - protein, 22 aa, Mycobacterium
FVSRMPVSVILIGLGSILVLGG

SEQ ID NO: 1123464 - protein, 17 aa, Mycobacterium
FVTARTALLDGFLTVFV

SEQ ID NO: 1123465 - protein, 18 aa, Mycobacterium
FVTMAWWMAVFPGAAIFV

SEQ ID NO: 1123466 - protein, 20 aa, Mycobacterium
FVTVPTVGYADEWGNEIPRT

SEQ ID NO: 1123467 - protein, 17 aa, Mycobacterium
FVVSLSVALGMTLTPDS

SEQ ID NO: 1123468 - protein, 28 aa, Mycobacterium
FVVVELRIAHPLLQLRMFADRSFGGGAL

SEQ ID NO: 1123469 - protein, 23 aa, Mycobacterium
FVWNVFKSWRYGEVVTVDDPWGY

SEQ ID NO: 1123470 - protein, 18 aa, Mycobacterium
FWARVRRGALLKAAATLV

SEQ ID NO: 1123471 - protein, 31 aa, Mycobacterium
FWLSTGIPLGFLVLLPAMWVALRYSTTVSTV

SEQ ID NO: 1123472 - protein, 18 aa, Mycobacterium
FWQYPTINALAKFLTGGE

SEQ ID NO: 1123473 - protein, 19 aa, Mycobacterium
FWSFGDWTSAGPWMLGFLL

SEQ ID NO: 1123474 - protein, 20 aa, Mycobacterium
FWSLAPLVVACVVLAGLLGM

SEQ ID NO: 1123475 - protein, 26 aa, Mycobacterium
FWTLLEIIPNLTLIVVLGFGAYAAGN

SEQ ID NO: 1123476 - protein, 20 aa, Mycobacterium
FWVVGVTFLLCAFKRARPRW

SEQ ID NO: 1123477 - protein, 19 aa, Mycobacterium
FYALSFPLHRVRGVPAKLY

SEQ ID NO: 1123478 - protein, 24 aa, Mycobacterium
FYAREEPWTPILLIIVITIVKIAA

SEQ ID NO: 1123479 - protein, 20 aa, Mycobacterium
FYIFGAFLLYTAVKLVKDTD

SEQ ID NO: 1123480 - protein, 22 aa, Mycobacterium
FYILCGYPLVAVAAYWLTTAPT

SEQ ID NO: 1123481 - protein, 17 aa, Mycobacterium
FYLALPLLALLARRLPV

SEQ ID NO: 1123482 - protein, 18 aa, Mycobacterium
FYLSLVIFVGAAFGMTYL

SEQ ID NO: 1123483 - protein, 24 aa, Mycobacterium
FYLVGTALYVWARRESGLPAFTKG

SEQ ID NO: 1123484 - protein, 18 aa, Mycobacterium
FYQIGGLLAAGFLLLMTH

SEQ ID NO: 1123485 - protein, 21 aa, Mycobacterium
FYRRDILRLIAEISMGAGTLA

SEQ ID NO: 1123486 - protein, 17 aa, Mycobacterium
FYRSLKLSWHADLLSDQ

SEQ ID NO: 1123487 - protein, 25 aa, Mycobacterium
FYTPWSWLPRIVMQFTAGALACAAV

SEQ ID NO: 1123488 - protein, 19 aa, Mycobacterium
FYVAMVITNFAWLYPILTG

SEQ ID NO: 1123489 - protein, 18 aa, Mycobacterium
FYVGFFIVLLGVTWFFYM

SEQ ID NO: 1123490 - protein, 18 aa, Mycobacterium
GAAAKWVLGGLALLVVVV

SEQ ID NO: 1123491 - protein, 20 aa, Mycobacterium
GAAALWLLYRYYRTRDPFFW

SEQ ID NO: 1123492 - protein, 29 aa, Mycobacterium
GAAGILMLTGLGGLVGYRQARAGLALRTE

SEQ ID NO: 1123493 - protein, 29 aa, Mycobacterium
GAAGLVEWPVLVTVGGAALVMHQLGQRAR

SEQ ID NO: 1123494 - protein, 19 aa, Mycobacterium
GAAIVWSWVLPAAFITATI

SEQ ID NO: 1123495 - protein, 17 aa, Mycobacterium
GAALFTGLCGYGVSMAM

SEQ ID NO: 1123496 - protein, 20 aa, Mycobacterium
GAALLFLLPTEWEQREFTLR

SEQ ID NO: 1123497 - protein, 21 aa, Mycobacterium
GAALLSLFSFMFLLFGLLLIF

SEQ ID NO: 1123498 - protein, 26 aa, Mycobacterium
GAALLTLFLDLSWPAGYTTILLSHIA

SEQ ID NO: 1123499 - protein, 18 aa, Mycobacterium
GAALRALLDLGAKDVSVL

SEQ ID NO: 1123500 - protein, 20 aa, Mycobacterium
GAALRALLDMGAKDVAVVRN

SEQ ID NO: 1123501 - protein, 21 aa, Mycobacterium
GAALRALLDMGAKDVAVVRNG

SEQ ID NO: 1123502 - protein, 18 aa, Mycobacterium
GAAMAFSSVFVVSNSLRL

SEQ ID NO: 1123503 - protein, 26 aa, Mycobacterium
GAAMGWAGGQALKWGDRFGATAAAPA

SEQ ID NO: 1123504 - protein, 18 aa, Mycobacterium
GAAQFVRHALPWRGAVFT

SEQ ID NO: 1123505 - protein, 27 aa, Mycobacterium
GAARWWRLLYVAALVSWVSGQILWWTG

SEQ ID NO: 1123506 - protein, 27 aa, Mycobacterium
GAAVVRLARAWSLAVSMVALVLIPVLA

SEQ ID NO: 1123507 - protein, 17 aa, Mycobacterium
GACLTVASYARLRSVLT

SEQ ID NO: 1123508 - protein, 25 aa, Mycobacterium
GACSELRIWAGVGAVGADFVGIPGA

SEQ ID NO: 1123509 - protein, 19 aa, Mycobacterium
GADLIGLNMARRLTDGEQI

SEQ ID NO: 1123510 - protein, 27 aa, Mycobacterium
GADLQRAPLLASYRSVARFPRFAGNVP

SEQ ID NO: 1123511 - protein, 22 aa, Mycobacterium
GADPSPGWTPRDARLQPVAGTV

SEQ ID NO: 1123512 - protein, 22 aa, Mycobacterium
GADRDAVCAISWTQTALSTGML

SEQ ID NO: 1123513 - protein, 25 aa, Mycobacterium
GADRSRAAVKFLLYNLFGGLIMLAS

SEQ ID NO: 1123514 - protein, 24 aa, Mycobacterium
GAETLRLKGFLIMSRNTARDYRDF

SEQ ID NO: 1123515 - protein, 21 aa, Mycobacterium
GAEVIKLYRDGTVGVVPDATQ

SEQ ID NO: 1123516 - protein, 20 aa, Mycobacterium
GAFAVLLAIHIWQWTPFAVL

SEQ ID NO: 1123517 - protein, 20 aa, Mycobacterium
GAFFFCVFVQNVSAGAFISG

SEQ ID NO: 1123518 - protein, 25 aa, Mycobacterium
GAFLPPDVIPYFGLIPLALGLWAAW

SEQ ID NO: 1123519 - protein, 23 aa, Mycobacterium
GAFLPPHVIPYFGLIPLALGLWA

SEQ ID NO: 1123520 - protein, 24 aa, Mycobacterium
GAFREILTGLSFFRNAYDQFAGYR

SEQ ID NO: 1123521 - protein, 23 aa, Mycobacterium
GAFSDRWGRKHLITAGMFTQAGG

SEQ ID NO: 1123522 - protein, 24 aa, Mycobacterium
GAFSDRWGRKHLITAGMFTQAGGL

SEQ ID NO: 1123523 - protein, 26 aa, Mycobacterium
GAFVAGICAWLMVRAHRRGGEEVEAR

SEQ ID NO: 1123524 - protein, 23 aa, Mycobacterium
GAGKAVALVWLWAAILIPLGRLL

SEQ ID NO: 1123525 - protein, 19 aa, Mycobacterium
GAGLAAMLPGLVAFDVTDV

SEQ ID NO: 1123526 - protein, 18 aa, Mycobacterium
GAGLALGGLIAFWQSRRH

SEQ ID NO: 1123527 - protein, 34 aa, Mycobacterium
GAGLFVAFDQLWKWNNIIALVLSVLVILGLVVGV

SEQ ID NO: 1123528 - protein, 21 aa, Mycobacterium
GAGLPAVFALGLVAFSRGAGS

SEQ ID NO: 1123529 - protein, 25 aa, Mycobacterium
GAGPMGFAGTVSRDAAQAGGLTTLP

SEQ ID NO: 1123530 - protein, 17 aa, Mycobacterium
GAGRIDPVAALTWNVPA

SEQ ID NO: 1123531 - protein, 27 aa, Mycobacterium
GAGRLRIAREILLPAIRPAVLSSALIV

SEQ ID NO: 1123532 - protein, 19 aa, Mycobacterium
GAGSGRPRVKLSNVAEMLR

SEQ ID NO: 1123533 - protein, 23 aa, Mycobacterium
GAGTDFSIFFFSRYHELVREGLA

SEQ ID NO: 1123534 - protein, 20 aa, Mycobacterium
GAGVGAHFFGPVSTVVTLLA

SEQ ID NO: 1123535 - protein, 17 aa, Mycobacterium
GAGVLLGLACATKWSGL

SEQ ID NO: 1123536 - protein, 25 aa, Mycobacterium
GAGWAALRGLGPVAFGDGWFYLTER

SEQ ID NO: 1123537 - protein, 17 aa, Mycobacterium
GAIGAAGLVEWPVLVTV

SEQ ID NO: 1123538 - protein, 24 aa, Mycobacterium
GAIGSLRATLTWRSDGIKDTVAAN

SEQ ID NO: 1123539 - protein, 25 aa, Mycobacterium
GAIRVTPKFTRMIVAGLFGVVALML

SEQ ID NO: 1123540 - protein, 29 aa, Mycobacterium
GAKPAKPRSFRRLWLLLTAPFAVLAGLYL

SEQ ID NO: 1123541 - protein, 18 aa, Mycobacterium
GAKRLRHLFASPKTWRLL

SEQ ID NO: 1123542 - protein, 25 aa, Mycobacterium
GALAARKRIAWWILLLYMVAAVGWN

SEQ ID NO: 1123543 - protein, 17 aa, Mycobacterium
GALAPMWPVPAEPVRRL

SEQ ID NO: 1123544 - protein, 18 aa, Mycobacterium
GALARAAKMGRRWIERQS

SEQ ID NO: 1123545 - protein, 27 aa, Mycobacterium
GALAVALQFMVMFGVAYLIVQYVQLVL

SEQ ID NO: 1123546 - protein, 25 aa, Mycobacterium
GALIPQMFATLFISWAARAARDARA

SEQ ID NO: 1123547 - protein, 18 aa, Mycobacterium
GALLAIAAGVCWAIYILL

SEQ ID NO: 1123548 - protein, 23 aa, Mycobacterium
GALLDERIEAIKALWTAEPAEYH

SEQ ID NO: 1123549 - protein, 26 aa, Mycobacterium
GALLRVVSGVSIFKLVRYLAREYLLI

SEQ ID NO: 1123550 - protein, 30 aa, Mycobacterium
GALPRIRAGQVRWRMAGIFAAAGIPATVAG

SEQ ID NO: 1123551 - protein, 18 aa, Mycobacterium
GALTFLPTFMQFVDGVSA

SEQ ID NO: 1123552 - protein, 22 aa, Mycobacterium
GAMADRFGRRRTLQIGLTIFAS

SEQ ID NO: 1123553 - protein, 28 aa, Mycobacterium
GAMLCLSFTRLPYFQTMGVPCAVGTFVA

SEQ ID NO: 1123554 - protein, 26 aa, Mycobacterium
GAMLGLVASWLLSRRIKRHTRGLEVA

SEQ ID NO: 1123555 - protein, 24 aa, Mycobacterium
GAMVFAILVLLGRYINYTLDLAGI

SEQ ID NO: 1123556 - protein, 22 aa, Mycobacterium
GANLPLLLKGFARITGEGAYAN

SEQ ID NO: 1123557 - protein, 21 aa, Mycobacterium
GAPALWLSIPIATLVYSVGAV

SEQ ID NO: 1123558 - protein, 17 aa, Mycobacterium
GAPDGPADLAFLIAAPD

SEQ ID NO: 1123559 - protein, 22 aa, Mycobacterium
GAPLAERACMLYAGSTLVAGTA

SEQ ID NO: 1123560 - protein, 25 aa, Mycobacterium
GAPLGLRPPMLWRGLQWGSAAVAPV

SEQ ID NO: 1123561 - protein, 18 aa, Mycobacterium
GAPLRVDLLAGLSVSAYL

SEQ ID NO: 1123562 - protein, 21 aa, Mycobacterium
GAPPGFRLVYQPVVRLPEGTP

SEQ ID NO: 1123563 - protein, 22 aa, Mycobacterium
GAPPIRGVIHAAGMTEAQLLTE

SEQ ID NO: 1123564 - protein, 24 aa, Mycobacterium
GAQLAEPGLMAWRDTVRTAVREHL

SEQ ID NO: 1123565 - protein, 17 aa, Mycobacterium
GARFAVIAFASRPAIEW

SEQ ID NO: 1123566 - protein, 26 aa, Mycobacterium
GARLRRRGGPAAGHRSDPDWRPSASD

SEQ ID NO: 1123567 - protein, 26 aa, Mycobacterium
GARMGAWLVGMGILHFAAPKPFDSIV

SEQ ID NO: 1123568 - protein, 24 aa, Mycobacterium
GASGFAAAMVQPYLVQRALVETKL

SEQ ID NO: 1123569 - protein, 18 aa, Mycobacterium
GASGFAILAAGLWAGLLW

SEQ ID NO: 1123570 - protein, 19 aa, Mycobacterium
GASLNLRAASREALAELVK

SEQ ID NO: 1123571 - protein, 18 aa, Mycobacterium
GASQRLADRIAKPLVPGV

SEQ ID NO: 1123572 - protein, 23 aa, Mycobacterium
GASSATFRALAWSQDDDAAGDPL

SEQ ID NO: 1123573 - protein, 18 aa, Mycobacterium
GASWAYVGVIARAATILP

SEQ ID NO: 1123574 - protein, 17 aa, Mycobacterium
GATACLHFTRLPYFQSM

SEQ ID NO: 1123575 - protein, 26 aa, Mycobacterium
GATGDRFGRRRVFQIGLAVFALGSLA

SEQ ID NO: 1123576 - protein, 24 aa, Mycobacterium
GATSVLWLAVAGWALWAANSPGMG

SEQ ID NO: 1123577 - protein, 18 aa, Mycobacterium
GAVFVHWLIFQSLYRIGA

SEQ ID NO: 1123578 - protein, 26 aa, Mycobacterium
GAVIVRGAMNAAWQKLGGATGELGAP

SEQ ID NO: 1123579 - protein, 19 aa, Mycobacterium
GAVLIVRPSLRWLDSGRPP

SEQ ID NO: 1123580 - protein, 26 aa, Mycobacterium
GAWLYHCSTMPMALHIANGMFGAVII

SEQ ID NO: 1123581 - protein, 17 aa, Mycobacterium
GAYTRYVKPSLQPWLLA

SEQ ID NO: 1123582 - protein, 24 aa, Mycobacterium
GCDVETKYHCARVIADPERDSGRT

SEQ ID NO: 1123583 - protein, 19 aa, Mycobacterium
GCFMLRARQIAAADPTDPV

SEQ ID NO: 1123584 - protein, 23 aa, Mycobacterium
GCLLAIVMLLAFWGAVIAALAAL

SEQ ID NO: 1123585 - protein, 26 aa, Mycobacterium
GCLMGSRLGPMVVRRAPAGPMRILIG

SEQ ID NO: 1123586 - protein, 19 aa, Mycobacterium
GCQKVLEGTGFVVSPNRVM

SEQ ID NO: 1123587 - protein, 20 aa, Mycobacterium
GCTMFAAIGGFVAYFHALAH

SEQ ID NO: 1123588 - protein, 20 aa, Mycobacterium
GDALSGCGVITAPGTPPVPA

SEQ ID NO: 1123589 - protein, 21 aa, Mycobacterium
GDALVGFTIDGKYALGSDTTA

SEQ ID NO: 1123590 - protein, 28 aa, Mycobacterium
GDDLRLYLDGGLQFSTRDEFRYTESLVY

SEQ ID NO: 1123591 - protein, 19 aa, Mycobacterium
GDEVPDFMQIQGIRELPGY

SEQ ID NO: 1123592 - protein, 17 aa, Mycobacterium
GDGDTRGLLGIPVSDGQ

SEQ ID NO: 1123593 - protein, 26 aa, Mycobacterium
GDGFGCVRIGLGRAPMSVRLVAPEAG

SEQ ID NO: 1123594 - protein, 23 aa, Mycobacterium
GDGKAHHGLGLALVAQVAARHGG

SEQ ID NO: 1123595 - protein, 20 aa, Mycobacterium
GDGPHWLRARAFSAAPGQRL

SEQ ID NO: 1123596 - protein, 17 aa, Mycobacterium
GDGPVMIAATVRTNDPQ

SEQ ID NO: 1123597 - protein, 24 aa, Mycobacterium
GDGTRACAAVRAYARAGGSRRLIV

SEQ ID NO: 1123598 - protein, 18 aa, Mycobacterium
GDILIPRLYALHILLIPG

SEQ ID NO: 1123599 - protein, 22 aa, Mycobacterium
GDKMKVTFHYAGKYKVPQDATA

SEQ ID NO: 1123600 - protein, 19 aa, Mycobacterium
GDLCLVWAEEMLRRSGVDA

SEQ ID NO: 1123601 - protein, 20 aa, Mycobacterium
GDLLSVPGVFVFGSNDYFAP

SEQ ID NO: 1123602 - protein, 17 aa, Mycobacterium
GDLRAVLSYPRQVGDIP

SEQ ID NO: 1123603 - protein, 18 aa, Mycobacterium
GDNAHAWGVVISTDTAFL

SEQ ID NO: 1123604 - protein, 20 aa, Mycobacterium
GDNPAWKRGKALALAVVNFA

SEQ ID NO: 1123605 - protein, 19 aa, Mycobacterium
GDPAAPVVMVMFADYRCPF

SEQ ID NO: 1123606 - protein, 17 aa, Mycobacterium
GDPAVWIERALVVLVAA

SEQ ID NO: 1123607 - protein, 26 aa, Mycobacterium
GDPVGLRLLWTVPILAFFAAALGVGV

SEQ ID NO: 1123608 - protein, 25 aa, Mycobacterium
GDQACGLPGLPLPGPGCYPYREPLP

SEQ ID NO: 1123609 - protein, 28 aa, Mycobacterium
GDRLAFSNGILFLAFGAIAFVVAFQAEV

SEQ ID NO: 1123610 - protein, 21 aa, Mycobacterium
GDRPVLVGGLAVMLAAVLLLR

SEQ ID NO: 1123611 - protein, 26 aa, Mycobacterium
GDRRWEARGGERGVIYDIALWAVPFG

SEQ ID NO: 1123612 - protein, 19 aa, Mycobacterium
GDSRTDLFGTVRNLQVLVN

SEQ ID NO: 1123613 - protein, 18 aa, Mycobacterium
GDTVFKSIAIAAGATIIG

SEQ ID NO: 1123614 - protein, 25 aa, Mycobacterium
GDVIRLEIGELIPADVRLIEVNGLE

SEQ ID NO: 1123615 - protein, 18 aa, Mycobacterium
GDVLMIRPGERIGGDGTV

SEQ ID NO: 1123616 - protein, 17 aa, Mycobacterium
GDVRYRGQTWPGFELEQ

SEQ ID NO: 1123617 - protein, 19 aa, Mycobacterium
GDVVAIDFMARVFSAKSPD

SEQ ID NO: 1123618 - protein, 22 aa, Mycobacterium
GDWTSAGPWMLGFLLGAFTIVG

SEQ ID NO: 1123619 - protein, 19 aa, Mycobacterium
GEAFGPVGSKIILVIVLIS

SEQ ID NO: 1123620 - protein, 24 aa, Mycobacterium
GEALMGPHMLTMAVISPVMVATIV

SEQ ID NO: 1123621 - protein, 24 aa, Mycobacterium
GEALSVLLGIPFWVAVLIVLGVQG

SEQ ID NO: 1123622 - protein, 18 aa, Mycobacterium
GEASGGFGGAATSLPAMS

SEQ ID NO: 1123623 - protein, 24 aa, Mycobacterium
GEDGRGLALAGLIIGYVMTALTVI

SEQ ID NO: 1123624 - protein, 22 aa, Mycobacterium
GEGTGGPGYEFANEYPTDQYQP

SEQ ID NO: 1123625 - protein, 22 aa, Mycobacterium
GEIAEGALLLFLFSVGHALEGY

SEQ ID NO: 1123626 - protein, 22 aa, Mycobacterium
GEIDGRLYLDMRLIEGRNLGTI

SEQ ID NO: 1123627 - protein, 22 aa, Mycobacterium
GEIDGVLYIDMRLVEGASLKDV

SEQ ID NO: 1123628 - protein, 21 aa, Mycobacterium
GEIPAELSALLDRILDFPTST

SEQ ID NO: 1123629 - protein, 24 aa, Mycobacterium
GEIPEERPNPYALSGAYETEVVVP

SEQ ID NO: 1123630 - protein, 17 aa, Mycobacterium
GELPPVAIVAMAWMLTA

SEQ ID NO: 1123631 - protein, 22 aa, Mycobacterium
GELPSHLPAPVLPHADAGALRD

SEQ ID NO: 1123632 - protein, 20 aa, Mycobacterium
GELWQLSARMTRERLWQTIG

SEQ ID NO: 1123633 - protein, 20 aa, Mycobacterium
GEPLIPLIIFGDRNFSMSNL

SEQ ID NO: 1123634 - protein, 22 aa, Mycobacterium
GEPPCAGTWFGVHIPIPQTVVH

SEQ ID NO: 1123635 - protein, 26 aa, Mycobacterium
GEQDRLPIEIAIAVLVLGVLLLVYRS

SEQ ID NO: 1123636 - protein, 24 aa, Mycobacterium
GEREKLRNGVVLTMCAGAVVGATL

SEQ ID NO: 1123637 - protein, 24 aa, Mycobacterium
GESEVSGWGQAWLLAQPFKTARRG

SEQ ID NO: 1123638 - protein, 43 aa, Mycobacterium
GESGVIYDIALWAVPFGLIGGRLYHVITDWPTYFGEGGAGPAA

SEQ ID NO: 1123639 - protein, 25 aa, Mycobacterium
GESPRKPHFYGIARVIRRASIPIIL

SEQ ID NO: 1123640 - protein, 24 aa, Mycobacterium
GESRGWPTYLLGGRIRASTAGLIL

SEQ ID NO: 1123641 - protein, 21 aa, Mycobacterium
GESSMALILLVTFVVIIVLLL

SEQ ID NO: 1123642 - protein, 20 aa, Mycobacterium
GETIEAWLPIDSGWKGTTSA

SEQ ID NO: 1123643 - protein, 20 aa, Mycobacterium
GEVFVQAWTLLKVTTMPALL

SEQ ID NO: 1123644 - protein, 17 aa, Mycobacterium
GEVGLQYGIASGVTGIL

SEQ ID NO: 1123645 - protein, 25 aa, Mycobacterium
GEVREGKAAVLGVIHLKDVVKQGMR

SEQ ID NO: 1123646 - protein, 19 aa, Mycobacterium
GFAELYRQGAARDVEMLMS

SEQ ID NO: 1123647 - protein, 19 aa, Mycobacterium
GFALGWRPPLAGLALGAVI

SEQ ID NO: 1123648 - protein, 21 aa, Mycobacterium
GFAPGTWWLTWILFIPALFQV

SEQ ID NO: 1123649 - protein, 17 aa, Mycobacterium
GFARITGEGAYANAYAC

SEQ ID NO: 1123650 - protein, 25 aa, Mycobacterium
GFARKRTGELGNFWVDLVRGTIRIL

SEQ ID NO: 1123651 - protein, 20 aa, Mycobacterium
GFATLLTMDIFLPGGLVEGS

SEQ ID NO: 1123652 - protein, 23 aa, Mycobacterium
GFCLLPLLLRWDTRRAAGTLLAY

SEQ ID NO: 1123653 - protein, 18 aa, Mycobacterium
GFCLSRPKPHAHGFPPSF

SEQ ID NO: 1123654 - protein, 18 aa, Mycobacterium
GFEHPWFFLFLIVVLALA

SEQ ID NO: 1123655 - protein, 21 aa, Mycobacterium
GFEKLVPVLLGFASLAILLPV

SEQ ID NO: 1123656 - protein, 20 aa, Mycobacterium
GFFHVATWLLVWAGTTMTVV

SEQ ID NO: 1123657 - protein, 20 aa, Mycobacterium
GFFSPHSWWPVMIALAGSVT

SEQ ID NO: 1123658 - protein, 24 aa, Mycobacterium
GFGARAGLIAAMLALIMNWTGQDY

SEQ ID NO: 1123659 - protein, 18 aa, Mycobacterium
GFGAYPTRTWARPSRFGA

SEQ ID NO: 1123660 - protein, 25 aa, Mycobacterium
GFGHLDAGLFFIAFVRNPVTQFVPM

SEQ ID NO: 1123661 - protein, 20 aa, Mycobacterium
GFGTVAVRYSQLGFGRTSST

SEQ ID NO: 1123662 - protein, 19 aa, Mycobacterium
GFIIGCGLLLDTFVVRTLT

SEQ ID NO: 1123663 - protein, 23 aa, Mycobacterium
GFLAAEVLAVFALKKIAPENAFG

SEQ ID NO: 1123664 - protein, 23 aa, Mycobacterium
GFLTMDRWLLWQLPTTGRALEYL

SEQ ID NO: 1123665 - protein, 23 aa, Mycobacterium
GFPALDYTAPLFAFLFLVALGVD

SEQ ID NO: 1123666 - protein, 19 aa, Mycobacterium
GFPLLPSRLSRGSQATRTT

SEQ ID NO: 1123667 - protein, 19 aa, Mycobacterium
GFRPLFKALDPTQVNALSA

SEQ ID NO: 1123668 - protein, 18 aa, Mycobacterium
GFVAWLIGVFYKNLYVEA

SEQ ID NO: 1123669 - protein, 19 aa, Mycobacterium
GFVPDPDYTWVPRTQVEAP

SEQ ID NO: 1123670 - protein, 25 aa, Mycobacterium
GFVPDPNYTWVPRTNVAPRQPEVTT

SEQ ID NO: 1123671 - protein, 20 aa, Mycobacterium
GFWGMLRLAEALGIGSTTSR

SEQ ID NO: 1123672 - protein, 19 aa, Mycobacterium
GGAAWPTAVAVAGTLVFVA

SEQ ID NO: 1123673 - protein, 27 aa, Mycobacterium
GGAGWKPTLAWRLFQLLTFAALAAAAW

SEQ ID NO: 1123674 - protein, 19 aa, Mycobacterium
GGAIAWLLLLVCSPATRAA

SEQ ID NO: 1123675 - protein, 26 aa, Mycobacterium
GGALTEVSWRLAFLVNVPIGLIMIYL

SEQ ID NO: 1123676 - protein, 18 aa, Mycobacterium
GGALVIGALGKRAADREV

SEQ ID NO: 1123677 - protein, 27 aa, Mycobacterium
GGAPVAIAVPAHWGPGTVGALRGALRA

SEQ ID NO: 1123678 - protein, 18 aa, Mycobacterium
GGAVSFTTLRLVYTDAST

SEQ ID NO: 1123679 - protein, 22 aa, Mycobacterium
GGCALILFMMFWLVLPLSMRDG

SEQ ID NO: 1123680 - protein, 24 aa, Mycobacterium
GGDGSASPWAWLLVGATALGAVLR

SEQ ID NO: 1123681 - protein, 21 aa, Mycobacterium
GGDWRIVRMSTITSFDLTPQL

SEQ ID NO: 1123682 - protein, 23 aa, Mycobacterium
GGEGVPTWWIAGGVVAAAAIGIA

SEQ ID NO: 1123683 - protein, 18 aa, Mycobacterium
GGERVVVAGMHLSVTGLY

SEQ ID NO: 1123684 - protein, 20 aa, Mycobacterium
GGFLGVDVFFVLSGFLITSL

SEQ ID NO: 1123685 - protein, 20 aa, Mycobacterium
GGFSSGQRALLWAAGVLGAL

SEQ ID NO: 1123686 - protein, 22 aa, Mycobacterium
GGGGLTFPRYLAATRPGSHNVV

SEQ ID NO: 1123687 - protein, 22 aa, Mycobacterium
GGGGLTFPRYLAATRPGTRNVV

SEQ ID NO: 1123688 - protein, 17 aa, Mycobacterium
GGGPAFCADTYEGAVNR

SEQ ID NO: 1123689 - protein, 28 aa, Mycobacterium
GGIALVVLWRWRWVRLAAGAAVLGLVAW

SEQ ID NO: 1123690 - protein, 18 aa, Mycobacterium
GGIFGERTELVFAGLAGA

SEQ ID NO: 1123691 - protein, 19 aa, Mycobacterium
GGIFGERTELVFAGLAGSL

SEQ ID NO: 1123692 - protein, 22 aa, Mycobacterium
GGIRLAGRSGALSRAARIQLIA

SEQ ID NO: 1123693 - protein, 21 aa, Mycobacterium
GGKLPPPVIGATYTLEYGTAT

SEQ ID NO: 1123694 - protein, 24 aa, Mycobacterium
GGKWFLDNGGYKWGGGQNGKSAIL

SEQ ID NO: 1123695 - protein, 27 aa, Mycobacterium
GGLCAATLWVVRWPTRAQSVAYILAAN

SEQ ID NO: 1123696 - protein, 20 aa, Mycobacterium
GGLFALLGHALRRGGHTDVA

SEQ ID NO: 1123697 - protein, 29 aa, Mycobacterium
GGLFAQVGSWRWAFGVLVGLTVAMGVLVP

SEQ ID NO: 1123698 - protein, 18 aa, Mycobacterium
GGLPDVQSAIAFAAAAMI

SEQ ID NO: 1123699 - protein, 24 aa, Mycobacterium
GGLVARFIPATVLLIAFAAIMIAA

SEQ ID NO: 1123700 - protein, 17 aa, Mycobacterium
GGMDRVLLVAGLLTMII

SEQ ID NO: 1123701 - protein, 27 aa, Mycobacterium
GGMGYSFGAGIGMGFHRRRPAVVIAGD

SEQ ID NO: 1123702 - protein, 31 aa, Mycobacterium
GGMGYSFGAGIGVAFGRRRRTVVIAGDGSFF

SEQ ID NO: 1123703 - protein, 23 aa, Mycobacterium
GGMTCASCAARVEKKLNKLDGVT

SEQ ID NO: 1123704 - protein, 33 aa, Mycobacterium
GGPGGRPGCWQPITRDLWPAPFLVLDTGASIAP

SEQ ID NO: 1123705 - protein, 22 aa, Mycobacterium
GGPGRGYPPPGYQQGYPPPGYQ

SEQ ID NO: 1123706 - protein, 17 aa, Mycobacterium
GGPWWFHVAALSACGFS

SEQ ID NO: 1123707 - protein, 18 aa, Mycobacterium
GGQAMIWLTWPFGAAGAL

SEQ ID NO: 1123708 - protein, 25 aa, Mycobacterium
GGQDRWLQHRVVTRLQYIFLNGNVV

SEQ ID NO: 1123709 - protein, 21 aa, Mycobacterium
GGQIWPFNFLVRLEQPVVHGL

SEQ ID NO: 1123710 - protein, 20 aa, Mycobacterium
GGQLCLPFYGAIVTNCDLDR

SEQ ID NO: 1123711 - protein, 21 aa, Mycobacterium
GGRARWERLALLTLLAATAVL

SEQ ID NO: 1123712 - protein, 20 aa, Mycobacterium
GGRARWERPALLTLLAATAV

SEQ ID NO: 1123713 - protein, 25 aa, Mycobacterium
GGRFPELDVDAVLARRPEVALVDEL

SEQ ID NO: 1123714 - protein, 19 aa, Mycobacterium
GGRSDRIVVRLAREPNRFL

SEQ ID NO: 1123715 - protein, 22 aa, Mycobacterium
GGSADRLGAIVIVQLFGLLLSP

SEQ ID NO: 1123716 - protein, 17 aa, Mycobacterium
GGSFEWKFVNYTPILVG

SEQ ID NO: 1123717 - protein, 19 aa, Mycobacterium
GGSGLGLAIVRAIVTSYGG

SEQ ID NO: 1123718 - protein, 19 aa, Mycobacterium
GGSVSWTGVLVVLAVIALA

SEQ ID NO: 1123719 - protein, 17 aa, Mycobacterium
GGTRPAPDPAPAPVAGG

SEQ ID NO: 1123720 - protein, 17 aa, Mycobacterium
GGTYLVARRIRMLIEQW

SEQ ID NO: 1123721 - protein, 30 aa, Mycobacterium
GGVAVLIAWWFWERRAARPLVSTRMLARRS

SEQ ID NO: 1123722 - protein, 18 aa, Mycobacterium
GGVGLSLGQRQRLGLVRV

SEQ ID NO: 1123723 - protein, 23 aa, Mycobacterium
GGVKRIATFASIVVPFMAVVYIV

SEQ ID NO: 1123724 - protein, 18 aa, Mycobacterium
GGVLAFLYMRRNREPALA

SEQ ID NO: 1123725 - protein, 24 aa, Mycobacterium
GGVLLAGLGWQWIFFVNAPIGAIG

SEQ ID NO: 1123726 - protein, 18 aa, Mycobacterium
GGVVVKVLLVAGLWAAGW

SEQ ID NO: 1123727 - protein, 17 aa, Mycobacterium
GGWGDPWGSPSTLDSDD

SEQ ID NO: 1123728 - protein, 18 aa, Mycobacterium
GGWGDPWGSPSTLDSDDR

SEQ ID NO: 1123729 - protein, 29 aa, Mycobacterium
GGYFTDHLTWRWAFWINVPIGIVVLIVAL

SEQ ID NO: 1123730 - protein, 27 aa, Mycobacterium
GHAEALRFGQELGFWRAATPMVLADDA

SEQ ID NO: 1123731 - protein, 21 aa, Mycobacterium
GHALRFYRREMLRLIAEIGMG

SEQ ID NO: 1123732 - protein, 25 aa, Mycobacterium
GHAPFGYLDWLGWFGYTVVGNIAGG

SEQ ID NO: 1123733 - protein, 24 aa, Mycobacterium
GHATQEFRLHLLGTHTPVPPEVGA

SEQ ID NO: 1123734 - protein, 17 aa, Mycobacterium
GHLEAAAGVAGFIKAVL

SEQ ID NO: 1123735 - protein, 17 aa, Mycobacterium
GHRAAGMTMTIRTDGGE

SEQ ID NO: 1123736 - protein, 21 aa, Mycobacterium
GHRSDPDWRPSASDLDEDLDD

SEQ ID NO: 1123737 - protein, 18 aa, Mycobacterium
GHSARYLVQTSLNPFSPE

SEQ ID NO: 1123738 - protein, 17 aa, Mycobacterium
GHSLGGWEAQYVAQQIG

SEQ ID NO: 1123739 - protein, 28 aa, Mycobacterium
GHWSLLVGYGCLPWVAAAVLRLRDGSGP

SEQ ID NO: 1123740 - protein, 20 aa, Mycobacterium
GIAALSAWGLYRFNQHLASL

SEQ ID NO: 1123741 - protein, 24 aa, Mycobacterium
GIAEPRADLSRRYWNRIAVTVVRR

SEQ ID NO: 1123742 - protein, 17 aa, Mycobacterium
GIAESFPGVEHTLSEDG

SEQ ID NO: 1123743 - protein, 19 aa, Mycobacterium
GIAFIFRPLLFTSVNSKVA

SEQ ID NO: 1123744 - protein, 17 aa, Mycobacterium
GIAGFVFTWLRKRSGSL

SEQ ID NO: 1123745 - protein, 17 aa, Mycobacterium
GIALPLLATQILWINLL

SEQ ID NO: 1123746 - protein, 17 aa, Mycobacterium
GIARVIRRASIPIILSW

SEQ ID NO: 1123747 - protein, 17 aa, Mycobacterium
GIAVFSGLVSFVGVLSF

SEQ ID NO: 1123748 - protein, 23 aa, Mycobacterium
GIDDEFPHSILFPAPNAGGNGIW

SEQ ID NO: 1123749 - protein, 25 aa, Mycobacterium
GIGIAAEFTDKVFVIFQRLHGRDAY

SEQ ID NO: 1123750 - protein, 23 aa, Mycobacterium
GIGLRLLAAQAIVLAAGAATTSI

SEQ ID NO: 1123751 - protein, 35 aa, Mycobacterium; identical to SEQ ID NO: 309002

SEQ ID NO: 1123752 - protein, 22 aa, Mycobacterium
GILRIGIGGGQAIDLNLVLSAI

SEQ ID NO: 1123753 - protein, 17 aa, Mycobacterium
GIMIVAALIAVIGSLLG

SEQ ID NO: 1123754 - protein, 19 aa, Mycobacterium
GIMYCVVCFAFFLIGGLMA

SEQ ID NO: 1123755 - protein, 34 aa, Mycobacterium
GINPEEFWRNAGLPAFRFPDPNGVGFENGAPPPA

SEQ ID NO: 1123756 - protein, 17 aa, Mycobacterium
GIPEFTAASILFGIGAA

SEQ ID NO: 1123757 - protein, 22 aa, Mycobacterium
GIPILLCAGGYVVFFHGPRLHL

SEQ ID NO: 1123758 - protein, 21 aa, Mycobacterium
GIPSDVCSAIEKAMSLESAAR

SEQ ID NO: 1123759 - protein, 26 aa, Mycobacterium
GIQLAPSWWAKFVVLGLILFAGVAAA

SEQ ID NO: 1123760 - protein, 23 aa, Mycobacterium
GIVACAVALVWSGTAAPTHWHLW

SEQ ID NO: 1123761 - protein, 20 aa, Mycobacterium
GIVALILLAALQYVAAIVAS

SEQ ID NO: 1123762 - protein, 22 aa, Mycobacterium
GIVLACPVWLYQLWAFITPGLY

SEQ ID NO: 1123763 - protein, 20 aa, Mycobacterium
GIVRVLEVPYVLPFLAESKF

SEQ ID NO: 1123764 - protein, 20 aa, Mycobacterium
GIVYFLIFWVSAFHRKKASD

SEQ ID NO: 1123765 - protein, 17 aa, Mycobacterium
GIYAGPSAHVFVDMVTE

SEQ ID NO: 1123766 - protein, 24 aa, Mycobacterium
GKAMRRTVLPQAMRVIIPPTGNEL

SEQ ID NO: 1123767 - protein, 18 aa, Mycobacterium
GKESLSMPDMHSIDAELR

SEQ ID NO: 1123768 - protein, 18 aa, Mycobacterium
GKEYKAYFAEAGGLKTGE

SEQ ID NO: 1123769 - protein, 18 aa, Mycobacterium
GKFNYTWQGFTLENWLDP

SEQ ID NO: 1123770 - protein, 17 aa, Mycobacterium
GKKVAAIGFCMGGGLVW

SEQ ID NO: 1123771 - protein, 27 aa, Mycobacterium
GKLDRLRARYGWFDHVMRAQERYKDSK

SEQ ID NO: 1123772 - protein, 18 aa, Mycobacterium
GKLWLPVEFIFNTPSHHR

SEQ ID NO: 1123773 - protein, 18 aa, Mycobacterium
GKNVGVWTVAAVTFANGG

SEQ ID NO: 1123774 - protein, 25 aa, Mycobacterium
GKPQRTGEVSLPWSLTLETTLPSVM

SEQ ID NO: 1123775 - protein, 19 aa, Mycobacterium
GKSEFLRTLILSLAATHHP

SEQ ID NO: 1123776 - protein, 23 aa, Mycobacterium
GKSEFLRTLVLGMITAHPPELLN

SEQ ID NO: 1123777 - protein, 28 aa, Mycobacterium
GKSKWHWSNDVLNAWAMSVVFYGALIAV

SEQ ID NO: 1123778 - protein, 28 aa, Mycobacterium
GKSKWHWSNDVLNAWAMSVVLYGALIAV

SEQ ID NO: 1123779 - protein, 24 aa, Mycobacterium
GKSPCTVNSFASLAQQGFFNDTPC

SEQ ID NO: 1123780 - protein, 18 aa, Mycobacterium
GKSTLAWIMAGLTVPTVG

SEQ ID NO: 1123781 - protein, 17 aa, Mycobacterium
GKVAGKNVGVWTVAAVT

SEQ ID NO: 1123782 - protein, 31 aa, Mycobacterium
GKVFIADLVQGWIKVLTCTPDYTACGDVQTF

SEQ ID NO: 1123783 - protein, 19 aa, Mycobacterium
GKVGSGYRQDGRFSRVGEI

SEQ ID NO: 1123784 - protein, 17 aa, Mycobacterium
GKVKRFNMFDTWVQAAP

SEQ ID NO: 1123785 - protein, 26 aa, Mycobacterium
GKVLFDWRFDLIFGTAAIVFALVYLA

SEQ ID NO: 1123786 - protein, 24 aa, Mycobacterium
GKVLKRLGTVLLIVGGLGVAVAAI

SEQ ID NO: 1123787 - protein, 26 aa, Mycobacterium
GLAAAVAIEVIWWVQGRVLGEHRRLW

SEQ ID NO: 1123788 - protein, 23 aa, Mycobacterium
GLADGRFVYYIKVHHTVIDGVAG

SEQ ID NO: 1123789 - protein, 19 aa, Mycobacterium
GLAEEGYCLDEENPVGLVN

SEQ ID NO: 1123790 - protein, 23 aa, Mycobacterium
GLAEELRPLIPVVKAASAVGLLS

SEQ ID NO: 1123791 - protein, 26 aa, Mycobacterium
GLAGFFFAMFAVCWAWINFSWFASAY

SEQ ID NO: 1123792 - protein, 27 aa, Mycobacterium
GLAMLVSGVAFKATWIGSLPVLSVIGF

SEQ ID NO: 1123793 - protein, 17 aa, Mycobacterium
GLAQLVGAPPWLYWTLY

SEQ ID NO: 1123794 - protein, 24 aa, Mycobacterium
GLAQWLRFGGLSGEVSTFRYVDYT

SEQ ID NO: 1123795 - protein, 25 aa, Mycobacterium
GLARPRMRPDLIGGLGLAALIGLPG

SEQ ID NO: 1123796 - protein, 25 aa, Mycobacterium
GLAVKRWMGLFALAIPFTLFFEVPM

SEQ ID NO: 1123797 - protein, 24 aa, Mycobacterium
GLAVSWLLQRLGRRSAVMHDVAHL

SEQ ID NO: 1123798 - protein, 19 aa, Mycobacterium
GLDFVSAFCGCLYAGAIAV

SEQ ID NO: 1123799 - protein, 19 aa, Mycobacterium
GLDGLRVYFTTYLPSLFLA

SEQ ID NO: 1123800 - protein, 26 aa, Mycobacterium
GLDSSRLPIVAALVAGVLALVVILLA

SEQ ID NO: 1123801 - protein, 25 aa, Mycobacterium
GLEGGDLWGGIGLIIGPMVIAFAML

SEQ ID NO: 1123802 - protein, 18 aa, Mycobacterium
GLEPRKLMRRVIAPQAFR

SEQ ID NO: 1123803 - protein, 23 aa, Mycobacterium
GLFNIVCATLFLGIPLLYRLGEL

SEQ ID NO: 1123804 - protein, 25 aa, Mycobacterium
GLGALGRALSLAWRRSLQLRVVSLT

SEQ ID NO: 1123805 - protein, 20 aa, Mycobacterium
GLGDGTGWSALAVFLGLAAA

SEQ ID NO: 1123806 - protein, 25 aa, Mycobacterium
GLGGWASVHVFGFPALDYTAPLFAF

SEQ ID NO: 1123807 - protein, 18 aa, Mycobacterium
GLGLRLELRLHDPRDSNV

SEQ ID NO: 1123808 - protein, 19 aa, Mycobacterium
GLGPPWVLTVGFILSAVSA

SEQ ID NO: 1123809 - protein, 18 aa, Mycobacterium
GLGRLVFNAVAARDYPLI

SEQ ID NO: 1123810 - protein, 18 aa, Mycobacterium
GLGSIALVTLLGGLIVLL

SEQ ID NO: 1123811 - protein, 18 aa, Mycobacterium
GLGSPFADAVQAFLDGDG

SEQ ID NO: 1123812 - protein, 19 aa, Mycobacterium
GLGVFCVGGALVIGALGKR

SEQ ID NO: 1123813 - protein, 19 aa, Mycobacterium
GLHDFHLILVLALVPVLPT

SEQ ID NO: 1123814 - protein, 20 aa, Mycobacterium
GLHLWRGQALLSILAGTTCY

SEQ ID NO: 1123815 - protein, 20 aa, Mycobacterium
GLIGCFLFSLIRPSGAAGTD

SEQ ID NO: 1123816 - protein, 21 aa, Mycobacterium
GLIGFGGYRWVTRKKSEHMPG

SEQ ID NO: 1123817 - protein, 20 aa, Mycobacterium
GLIGPGGLLIGNGVLPGQNG

SEQ ID NO: 1123818 - protein, 24 aa, Mycobacterium
GLLAAIALLVARQIVLPVRSASRI

SEQ ID NO: 1123819 - protein, 21 aa, Mycobacterium
GLLAARFINWAAQRITRRIDA

SEQ ID NO: 1123820 - protein, 18 aa, Mycobacterium
GLLAWGYVEAMRVPRVKN

SEQ ID NO: 1123821 - protein, 22 aa, Mycobacterium
GLLDPRPVIAVIAGVWLVATVL

SEQ ID NO: 1123822 - protein, 40 aa, Mycobacterium
GLLEPKRAMRIRAWRRVGATVVRWPGPILVASLALALIGL

SEQ ID NO: 1123823 - protein, 20 aa, Mycobacterium
GLLERRPMDIFDDFAKTVLP

SEQ ID NO: 1123824 - protein, 19 aa, Mycobacterium
GLLGSRLIFAHLFVVAAIV

SEQ ID NO: 1123825 - protein, 27 aa, Mycobacterium
GLLLCASFPPIGWWFTAILAFAVFGWV

SEQ ID NO: 1123826 - protein, 20 aa, Mycobacterium
GLLLNYFLIAPRHTFTIAEP

SEQ ID NO: 1123827 - protein, 20 aa, Mycobacterium
GLLMAFWSWVGFESTAIYGE

SEQ ID NO: 1123828 - protein, 23 aa, Mycobacterium
GLLSVAGLFAFLGLATVIAAAVA

SEQ ID NO: 1123829 - protein, 27 aa, Mycobacterium
GLLVAGSWWLFEWELAHGAEVTEARTA

SEQ ID NO: 1123830 - protein, 26 aa, Mycobacterium
GLLWGAVEQRWGRWVAFGVTTVVFSI

SEQ ID NO: 1123831 - protein, 19 aa, Mycobacterium
GLMMRRFGLPVLPLIIGVI

SEQ ID NO: 1123832 - protein, 18 aa, Mycobacterium
GLMRMRWFALAMLGISLI

SEQ ID NO: 1123833 - protein, 32 aa, Mycobacterium
GLMYGEGGLLEFARRVGFSVAQAATPGHNGTF

SEQ ID NO: 1123834 - protein, 24 aa, Mycobacterium
GLNGLRLLRDAAWPSTRGTKATAK

SEQ ID NO: 1123835 - protein, 21 aa, Mycobacterium
GLPERRACGATQGYPWSNATS

SEQ ID NO: 1123836 - protein, 17 aa, Mycobacterium
GLPESYCVRVIDGRLPA

SEQ ID NO: 1123837 - protein, 19 aa, Mycobacterium
GLPILGLGSLFGRVGLACG

SEQ ID NO: 1123838 - protein, 17 aa, Mycobacterium
GLPLPDSINGPWVSVAA

SEQ ID NO: 1123839 - protein, 21 aa, Mycobacterium
GLPLREILPAVQRMARPHDDG

SEQ ID NO: 1123840 - protein, 18 aa, Mycobacterium
GLPPELVVGSVFVTVTDA

SEQ ID NO: 1123841 - protein, 21 aa, Mycobacterium
GLPSDIWKATMDGALDGTDNE

SEQ ID NO: 1123842 - protein, 24 aa, Mycobacterium
GLPSQGVVVLVDLGGSGSSITLAD

SEQ ID NO: 1123843 - protein, 21 aa, Mycobacterium
GLPVDVASALALAVAIQLLLQ

SEQ ID NO: 1123844 - protein, 18 aa, Mycobacterium
GLQAEYPLATVAFLVLIA

SEQ ID NO: 1123845 - protein, 19 aa, Mycobacterium
GLQVRWRMATFVFTVLLVA

SEQ ID NO: 1123846 - protein, 21 aa, Mycobacterium
GLRFRIYRPAVVVGDSRTGEM

SEQ ID NO: 1123847 - protein, 22 aa, Mycobacterium
GLRPGEEKLVFSRFWRADPSRV

SEQ ID NO: 1123848 - protein, 27 aa, Mycobacterium
GLRQEFLENWPVVVGLMVGGVIAAPFA

SEQ ID NO: 1123849 - protein, 22 aa, Mycobacterium
GLSEPRLWAVFLGLPMLVAIAV

SEQ ID NO: 1123850 - protein, 18 aa, Mycobacterium
GLSNGRPRVVWTNDAQRL

SEQ ID NO: 1123851 - protein, 24 aa, Mycobacterium
GLSSPRTAPWQVVSLLVDGPVLSQ

SEQ ID NO: 1123852 - protein, 26 aa, Mycobacterium
GLTALGRALSLVWRRSLQVRVVSLTL

SEQ ID NO: 1123853 - protein, 19 aa, Mycobacterium
GLTATLFYLAERDLVALRQ

SEQ ID NO: 1123854 - protein, 17 aa, Mycobacterium
GLTFNDFLVHMAPIVLI

SEQ ID NO: 1123855 - protein, 22 aa, Mycobacterium
GLTLPRALFWIVIVYVLVATIV

SEQ ID NO: 1123856 - protein, 18 aa, Mycobacterium
GLTYRFPFDTEKKTYPLF

SEQ ID NO: 1123857 - protein, 19 aa, Mycobacterium
GLTYRFPFDTEKKTYQVFD

SEQ ID NO: 1123858 - protein, 17 aa, Mycobacterium
GLVDLRRNGVLLVLLVI

SEQ ID NO: 1123859 - protein, 17 aa, Mycobacterium
GLVEVRNPFALENWTLP

SEQ ID NO: 1123860 - protein, 23 aa, Mycobacterium
GLVGGAFRWCLQAAESLRVDVVE

SEQ ID NO: 1123861 - protein, 18 aa, Mycobacterium
GLVGGFGFSVFVQNVTPG

SEQ ID NO: 1123862 - protein, 27 aa, Mycobacterium
GLVGVLALAGLTAWMGYRTYEANRDEH

SEQ ID NO: 1123863 - protein, 29 aa, Mycobacterium
GLVIFRSRWARWVAWSLPAVGLVVLFSAA

SEQ ID NO: 1123864 - protein, 18 aa, Mycobacterium
GLVIPTLVPMSWAAAALT

SEQ ID NO: 1123865 - protein, 19 aa, Mycobacterium
GLVRYRRRRISLSAPDTAT

SEQ ID NO: 1123866 - protein, 19 aa, Mycobacterium
GLVTLELIGMVALTVLLLV

SEQ ID NO: 1123867 - protein, 19 aa, Mycobacterium
GLWHWPLPWVGYFGGDAPV

SEQ ID NO: 1123868 - protein, 21 aa, Mycobacterium
GLYWCALGLVIAVALSGIAKR

SEQ ID NO: 1123869 - protein, 19 aa, Mycobacterium
GMAFIPFALALGVGTVVAA

SEQ ID NO: 1123870 - protein, 20 aa, Mycobacterium
GMASGFLATFAYVVFEGSLI

SEQ ID NO: 1123871 - protein, 26 aa, Mycobacterium
GMDLPRPRDLAPLLAAWIASIAVMIF

SEQ ID NO: 1123872 - protein, 25 aa, Mycobacterium
GMHRELAARFGFLLAIPAVFASGLF

SEQ ID NO: 1123873 - protein, 27 aa, Mycobacterium
GMLCSGLLLQWWSWESIFIGFAAAGCT

SEQ ID NO: 1123874 - protein, 25 aa, Mycobacterium
GMSEVHLARDLRLHRDVAIKVLRAD

SEQ ID NO: 1123875 - protein, 18 aa, Mycobacterium
GMVAKTWVTPQGQIIIAY

SEQ ID NO: 1123876 - protein, 21 aa, Mycobacterium
GMVIAHAVGLPAVGDEVVIAL

SEQ ID NO: 1123877 - protein, 20 aa, Mycobacterium
GMVNMGGFLASLLVMQAMGQ

SEQ ID NO: 1123878 - protein, 22 aa, Mycobacterium
GNALPWLLPLLYVLMALSLVVW

SEQ ID NO: 1123879 - protein, 23 aa, Mycobacterium
GNALRVPRVMELLAVVPTMAANV

SEQ ID NO: 1123880 - protein, 17 aa, Mycobacterium
GNARLFTQFVVRSAAAG

SEQ ID NO: 1123881 - protein, 18 aa, Mycobacterium
GNEYPPLYSTLLADRPAA

SEQ ID NO: 1123882 - protein, 20 aa, Mycobacterium
GNGADAMFVNVGTYGSAAPY

SEQ ID NO: 1123883 - protein, 17 aa, Mycobacterium
GNIQSPGPWRRNATPQK

SEQ ID NO: 1123884 - protein, 17 aa, Mycobacterium
GNLFGLQLCPLGTDLAD

SEQ ID NO: 1123885 - protein, 22 aa, Mycobacterium
GNLWPGQGGVYIWATRTMGETW

SEQ ID NO: 1123886 - protein, 20 aa, Mycobacterium
GNMRVNLSFTPTYSYTRADC

SEQ ID NO: 1123887 - protein, 24 aa, Mycobacterium
GNRSWRRRVLAGAIAAVTIGAVAT

SEQ ID NO: 1123888 - protein, 19 aa, Mycobacterium
GNSTDEWLIDVAPMLSDPS

SEQ ID NO: 1123889 - protein, 23 aa, Mycobacterium
GNTDLAFGFGFWAGATLPLGLAL

SEQ ID NO: 1123890 - protein, 24 aa, Mycobacterium
GNTESGWKLGFYAASRASQLRRMR

SEQ ID NO: 1123891 - protein, 24 aa, Mycobacterium
GNVFTRINAILGVLLIIVLATGSV

SEQ ID NO: 1123892 - protein, 17 aa, Mycobacterium
GNYDMWDVVPAYPPPPD

SEQ ID NO: 1123893 - protein, 24 aa, Mycobacterium
GNYFTFYLCDLLLKVNGKGGQPVY

SEQ ID NO: 1123894 - protein, 24 aa, Mycobacterium
GPAPALAAPEGWTATHVVSGLVEV

SEQ ID NO: 1123895 - protein, 19 aa, Mycobacterium
GPARVPRRLGVAAQGVLGV

SEQ ID NO: 1123896 - protein, 26 aa, Mycobacterium
GPAVSGSRAALWAAGLVLLAAWMPFN

SEQ ID NO: 1123897 - protein, 59 aa, Mycobacterium
GPDGAGLIAAFRIWEGGLGIWGAVALGGIGAWIACRRRGIPLPAFGDAIAPGIILAQAI

SEQ ID NO: 1123898 - protein, 27 aa, Mycobacterium
GPERLPGAIRWTAGAVRQARDYVTGAT

SEQ ID NO: 1123899 - protein, 25 aa, Mycobacterium
GPETKLRIARALQRRGHVVAMTGDG

SEQ ID NO: 1123900 - protein, 19 aa, Mycobacterium
GPFTEAGARTWHVVPGTTP

SEQ ID NO: 1123901 - protein, 25 aa, Mycobacterium
GPGDALYGLRTMLFGEQAQTRDDAV

SEQ ID NO: 1123902 - protein, 17 aa, Mycobacterium
GPGSIARFGRRIAALLV

SEQ ID NO: 1123903 - protein, 24 aa, Mycobacterium
GPIAVESYGLFVFRDAIAAAGAST

SEQ ID NO: 1123904 - protein, 25 aa, Mycobacterium
GPKTNALAIWSLVASLIGFVCCLGS

SEQ ID NO: 1123905 - protein, 17 aa, Mycobacterium
GPLAPDQVRSMLDDVLA

SEQ ID NO: 1123906 - protein, 18 aa, Mycobacterium
GPLAWNGVFAFYIPGLVL

SEQ ID NO: 1123907 - protein, 18 aa, Mycobacterium
GPLSWFFHHLPKPLHRVE

SEQ ID NO: 1123908 - protein, 18 aa, Mycobacterium
GPMAPQRAIEVIADACQA

SEQ ID NO: 1123909 - protein, 18 aa, Mycobacterium
GPNDPRLDQLYAWWGTHS

SEQ ID NO: 1123910 - protein, 39 aa, Mycobacterium
GPNRLPVQRSRPWWRVLAAEMVHFFAVLFWAAGVLAFVA

SEQ ID NO: 1123911 - protein, 25 aa, Mycobacterium
GPPAYSVGDAFNWAWNKFSKNAMPL

SEQ ID NO: 1123912 - protein, 26 aa, Mycobacterium
GPPSYSTVWLWLGLGLLLLVLLWYAT

SEQ ID NO: 1123913 - protein, 21 aa, Mycobacterium
GPRAPQLWLPPLDEPIPLRDV

SEQ ID NO: 1123914 - protein, 27 aa, Mycobacterium
GPRIGLRLLTVPGFLLVAAGLYLTSRI

SEQ ID NO: 1123915 - protein, 18 aa, Mycobacterium
GPSPETRRALTWYAVQLV

SEQ ID NO: 1123916 - protein, 25 aa, Mycobacterium
GPSRRRPATYRGWYALPERIADTLT

SEQ ID NO: 1123917 - protein, 17 aa, Mycobacterium
GPTVILVHGWPDSHVVW

SEQ ID NO: 1123918 - protein, 18 aa, Mycobacterium
GPTVTRYEVELGPGVKVE

SEQ ID NO: 1123919 - protein, 19 aa, Mycobacterium
GPVDYFAVDLPRIIGNALK

SEQ ID NO: 1123920 - protein, 24 aa, Mycobacterium
GPVGERLLGWAIALAVCVPAALFV

SEQ ID NO: 1123921 - protein, 26 aa, Mycobacterium
GPVLDGWSVQPWLALWLSQVASVVLM

SEQ ID NO: 1123922 - protein, 23 aa, Mycobacterium
GPVSGMLAGLVVVAASAALKGYV

SEQ ID NO: 1123923 - protein, 28 aa, Mycobacterium
GPVTAALPRRVLASRVNVVVLQTSRPPA

SEQ ID NO: 1123924 - protein, 25 aa, Mycobacterium
GPWDWQRWAPASPWATPPPAVMVLG

SEQ ID NO: 1123925 - protein, 22 aa, Mycobacterium
GPYPLPVRVDFGATEVPRRLPS

SEQ ID NO: 1123926 - protein, 17 aa, Mycobacterium
GQALLSILAGTTCYVTL

SEQ ID NO: 1123927 - protein, 18 aa, Mycobacterium
GQARGVLMVADAVKPTSA

SEQ ID NO: 1123928 - protein, 17 aa, Mycobacterium
GQDAQTWTQTTFARSDL

SEQ ID NO: 1123929 - protein, 22 aa, Mycobacterium
GQETSWRITAFVVFAVAVITDR

SEQ ID NO: 1123930 - protein, 21 aa, Mycobacterium
GQGAFDWLPDIPRMGFSSVLW

SEQ ID NO: 1123931 - protein, 23 aa, Mycobacterium
GQGGEPRLTVPDAITGNPGDQAC

SEQ ID NO: 1123932 - protein, 23 aa, Mycobacterium
GQGMSRVGLLARVELPLAVPYIL

SEQ ID NO: 1123933 - protein, 22 aa, Mycobacterium
GQGSRFRVSLPRIADAGPDAGP

SEQ ID NO: 1123934 - protein, 23 aa, Mycobacterium
GQHERWSWWIWVAIAGGLVSITA

SEQ ID NO: 1123935 - protein, 24 aa, Mycobacterium
GQKAGEFALGFARDSVGGIVAMVT

SEQ ID NO: 1123936 - protein, 19 aa, Mycobacterium
GQLNCAITDAAGAALVTQN

SEQ ID NO: 1123937 - protein, 22 aa, Mycobacterium
GQLREMERRGGRSDRIVVRLAR

SEQ ID NO: 1123938 - protein, 18 aa, Mycobacterium
GQLVGRFVRFLDRQVKRV

SEQ ID NO: 1123939 - protein, 19 aa, Mycobacterium
GQMLVCAFAAFAGVLLVRM

SEQ ID NO: 1123940 - protein, 25 aa, Mycobacterium
GQPHREALVFIGLALLIWLPAIRCP

SEQ ID NO: 1123941 - protein, 21 aa, Mycobacterium
GQPRATFGIPLLSDGIDIVVI

SEQ ID NO: 1123942 - protein, 22 aa, Mycobacterium
GQPSGFSMQGPWVGAAAPGENL

SEQ ID NO: 1123943 - protein, 17 aa, Mycobacterium
GQQLSAWMRSEERDSVL

SEQ ID NO: 1123944 - protein, 24 aa, Mycobacterium
GQRRIPVQYAKRMVGRKMYGGTST

SEQ ID NO: 1123945 - protein, 25 aa, Mycobacterium
GQRSADYWLGWWVIIGTIPISVVGL

SEQ ID NO: 1123946 - protein, 19 aa, Mycobacterium
GQRVAAIVVGLGFGVLLVA

SEQ ID NO: 1123947 - protein, 20 aa, Mycobacterium
GQSGELSFRLSEPTSAGEAR

SEQ ID NO: 1123948 - protein, 24 aa, Mycobacterium
GQSLGWRAAFGLVVGVGLVTLTAL

SEQ ID NO: 1123949 - protein, 17 aa, Mycobacterium
GQSLWYVKLKKPSFQPP

SEQ ID NO: 1123950 - protein, 24 aa, Mycobacterium
GQSYRLELMLAIARSEDGLVTLSD

SEQ ID NO: 1123951 - protein, 22 aa, Mycobacterium
GQTARLYIRPVVHVIPSAAAAP

SEQ ID NO: 1123952 - protein, 20 aa, Mycobacterium
GQTLPRLLLVIDEFQVLFDG

SEQ ID NO: 1123953 - protein, 35 aa, Mycobacterium
GQTRLLRWSVPGIAHFFTMWGFFVLATVYIEAFGQ

SEQ ID NO: 1123954 - protein, 35 aa, Mycobacterium
GQWDRLRWQIPASFLGAGCGAWLLLHLPEKVFTRV

SEQ ID NO: 1123955 - protein, 20 aa, Mycobacterium
GRAAAEPLGLGSVDAPVATG

SEQ ID NO: 1123956 - protein, 19 aa, Mycobacterium
GRAFPAIVVLIGVAVWLNR

SEQ ID NO: 1123957 - protein, 24 aa, Mycobacterium
GRAGFPMDGRSGVTVITLGNHRSA

SEQ ID NO: 1123958 - protein, 17 aa, Mycobacterium
GRAWNRLYRALAQLVGA

SEQ ID NO: 1123959 - protein, 20 aa, Mycobacterium
GRDAVLWSPPHMLVVFASTT

SEQ ID NO: 1123960 - protein, 26 aa, Mycobacterium
GRDAWFSMLAFWFFAAGWAASKASTV

SEQ ID NO: 1123961 - protein, 18 aa, Mycobacterium
GRDGRVFQCLKFRSMRPP

SEQ ID NO: 1123962 - protein, 21 aa, Mycobacterium
GRDSLAPALIIFLTLALLTNA

SEQ ID NO: 1123963 - protein, 25 aa, Mycobacterium
GRDTSSGWLPWALGGLFVAGLAGLA

SEQ ID NO: 1123964 - protein, 18 aa, Mycobacterium
GREGWLQTANILAAVLAV

SEQ ID NO: 1123965 - protein, 24 aa, Mycobacterium
GRELWSRAGGFHRMLATDSAETRF

SEQ ID NO: 1123966 - protein, 25 aa, Mycobacterium
GREMWVCGPLGWLTVLLAGLCGALA

SEQ ID NO: 1123967 - protein, 27 aa, Mycobacterium
GRFTMADVLSFRLKQRPVRLAAATNTL

SEQ ID NO: 1123968 - protein, 24 aa, Mycobacterium
GRGIDWAQLVLPYLGFLGIAVMFG

SEQ ID NO: 1123969 - protein, 26 aa, Mycobacterium
GRGLARWRPYLEPALVVLTFGALGAG

SEQ ID NO: 1123970 - protein, 25 aa, Mycobacterium
GRGMWVCGPLGWLTVLLAGLCGALA

SEQ ID NO: 1123971 - protein, 20 aa, Mycobacterium
GRGPLRTAILIPYGIVTVVS

SEQ ID NO: 1123972 - protein, 21 aa, Mycobacterium
GRGSISGTHVIGWWPNVAAMQ

SEQ ID NO: 1123973 - protein, 27 aa, Mycobacterium
GRGTLRKMRQNLGWAVGYNVIALPIAA

SEQ ID NO: 1123974 - protein, 19 aa, Mycobacterium
GRGVGVIALADAARETSAA

SEQ ID NO: 1123975 - protein, 25 aa, Mycobacterium
GRGWQIGPYLPFANMFRFLDVQWLF

SEQ ID NO: 1123976 - protein, 19 aa, Mycobacterium
GRGYPPPGYQQGYPPPGYQ

SEQ ID NO: 1123977 - protein, 24 aa, Mycobacterium
GRHPHRRSWLVLGIIGSNALVWTV

SEQ ID NO: 1123978 - protein, 17 aa, Mycobacterium
GRHTFPVACESIEVADA

SEQ ID NO: 1123979 - protein, 17 aa, Mycobacterium
GRIALLVTAVAWALLGV

SEQ ID NO: 1123980 - protein, 21 aa, Mycobacterium
GRIDPVAALTWNVPATEEIGT

SEQ ID NO: 1123981 - protein, 22 aa, Mycobacterium
GRIGDMALFYARAAAGVPYALR

SEQ ID NO: 1123982 - protein, 31 aa, Mycobacterium
GRIGLKGFWIRRARRLLPALLVMVLAVVALR

SEQ ID NO: 1123983 - protein, 24 aa, Mycobacterium
GRINARLAVYTGLVETARTNNRAG

SEQ ID NO: 1123984 - protein, 22 aa, Mycobacterium
GRKLFWPFIPQVGAKPLTDSGV

SEQ ID NO: 1123985 - protein, 19 aa, Mycobacterium
GRLAPVVGFLAAVLVLARL

SEQ ID NO: 1123986 - protein, 22 aa, Mycobacterium
GRLGDHMLFYIRAIGGVPHATV

SEQ ID NO: 1123987 - protein, 17 aa, Mycobacterium
GRLIPFLVLNQLMFIII

SEQ ID NO: 1123988 - protein, 20 aa, Mycobacterium
GRLLLILLGLWSVYRLATRS

SEQ ID NO: 1123989 - protein, 24 aa, Mycobacterium
GRLRRERTSFIIAHRLSTIRDADL

SEQ ID NO: 1123990 - protein, 28 aa, Mycobacterium
GRLTRGYLHRRWEHGARLDVRHSGEGGA

SEQ ID NO: 1123991 - protein, 18 aa, Mycobacterium
GRLYCCAAIPAALCALVI

SEQ ID NO: 1123992 - protein, 18 aa, Mycobacterium
GRMQLRFGPNRVGPHGLL

SEQ ID NO: 1123993 - protein, 26 aa, Mycobacterium
GRMRWHAWVRLAVPLAVAFVAAAWIE

SEQ ID NO: 1123994 - protein, 19 aa, Mycobacterium
GRNLGKWWRETRFQAYQGV

SEQ ID NO: 1123995 - protein, 26 aa, Mycobacterium
GRPGSLDWFAGVGFLVAIAVAVAAPA

SEQ ID NO: 1123996 - protein, 25 aa, Mycobacterium
GRPHGIDLPSVWALTRGAGQTVAVI

SEQ ID NO: 1123997 - protein, 20 aa, Mycobacterium
GRPILRILMRRRRSVGTWPL

SEQ ID NO: 1123998 - protein, 20 aa, Mycobacterium
GRPLIRLSYLNELRNAGFRY

SEQ ID NO: 1123999 - protein, 18 aa, Mycobacterium
GRPWQRAGARWAAASIVT

SEQ ID NO: 1124000 - protein, 19 aa, Mycobacterium
GRQPMGPGGMMGPGQMGPG

SEQ ID NO: 1124001 - protein, 17 aa, Mycobacterium
GRRCHPGSVAPRTAKKT

SEQ ID NO: 1124002 - protein, 18 aa, Mycobacterium
GRREFIAFLQEFVVKKPI

SEQ ID NO: 1124003 - protein, 17 aa, Mycobacterium
GRRGAIELAAWAGWDND

SEQ ID NO: 1124004 - protein, 17 aa, Mycobacterium
GRRGWLTPRKDLTGRFW

SEQ ID NO: 1124005 - protein, 19 aa, Mycobacterium
GRRRGRTAAVARILDGPDA

SEQ ID NO: 1124006 - protein, 21 aa, Mycobacterium
GRRRPLMAGIVLHMLASVLCM

SEQ ID NO: 1124007 - protein, 39 aa, Mycobacterium
GRRSVAELPPIRAAQRAAVWSGRLARDFLSEMRNNLADP

SEQ ID NO: 1124008 - protein, 24 aa, Mycobacterium
GRSAFLRTMMHSVMAHYSPDEATI

SEQ ID NO: 1124009 - protein, 23 aa, Mycobacterium
GRSDSLRSWRRFVLYGVIVAPAF

SEQ ID NO: 1124010 - protein, 20 aa, Mycobacterium
GRTAASLPFRIRARDGSWRW

SEQ ID NO: 1124011 - protein, 17 aa, Mycobacterium
GRTAVLIAIDGRGVGVI

SEQ ID NO: 1124012 - protein, 19 aa, Mycobacterium
GRTAYLVMELVNGEPLNSV

SEQ ID NO: 1124013 - protein, 20 aa, Mycobacterium
GRTVLFSALTVALSMVAMVL

SEQ ID NO: 1124014 - protein, 20 aa, Mycobacterium
GRTVMFSAILIVASSAGVLL

SEQ ID NO: 1124015 - protein, 19 aa, Mycobacterium
GRVFTGFGVASAVLAALSV

SEQ ID NO: 1124016 - protein, 21 aa, Mycobacterium
GRVGPALPLLVAIAVGAVGTF

SEQ ID NO: 1124017 - protein, 26 aa, Mycobacterium
GRVSWRPAVDVNRLITVLGVVAVAAL

SEQ ID NO: 1124018 - protein, 28 aa, Mycobacterium
GRVTKPPRRRLSLAVIGSAAAAVLAIGG

SEQ ID NO: 1124019 - protein, 28 aa, Mycobacterium
GRWSDAVGRRPMLLAGVGFAIASALVFL

SEQ ID NO: 1124020 - protein, 18 aa, Mycobacterium
GRYFEKRSKRQAGAALRA

SEQ ID NO: 1124021 - protein, 20 aa, Mycobacterium
GRYVLRGVLGAGGMAEVRDA

SEQ ID NO: 1124022 - protein, 22 aa, Mycobacterium
GRYVMISALGGLRCRASRIVLH

SEQ ID NO: 1124023 - protein, 24 aa, Mycobacterium
GSAAEFRSGLLIVVALAAVLVIAP

SEQ ID NO: 1124024 - protein, 18 aa, Mycobacterium
GSAAQMRAALAGDVTALS

SEQ ID NO: 1124025 - protein, 19 aa, Mycobacterium
GSAGFPAPWALLPVAGAAL

SEQ ID NO: 1124026 - protein, 25 aa, Mycobacterium
GSAGYAGTCFVRLAPSVPPPSPHDA

SEQ ID NO: 1124027 - protein, 31 aa, Mycobacterium
GSALGLTAVSAWLITRAWEMPPVLHLTVAAV

SEQ ID NO: 1124028 - protein, 18 aa, Mycobacterium
GSALWVLIGGVIGLAAAL

SEQ ID NO: 1124029 - protein, 26 aa, Mycobacterium
GSAPSWFPPEFGWVVGCDYRGLPPDG

SEQ ID NO: 1124030 - protein, 18 aa, Mycobacterium
GSATEKPGGWSLSVPTLS

SEQ ID NO: 1124031 - protein, 17 aa, Mycobacterium
GSAVGLWDLGSELLGRQ

SEQ ID NO: 1124032 - protein, 23 aa, Mycobacterium
GSAVMCWIDLPAAVTMAAVVGIS

SEQ ID NO: 1124033 - protein, 20 aa, Mycobacterium
GSCKRRKPLSSNRTKAMAHQ

SEQ ID NO: 1124034 - protein, 18 aa, Mycobacterium
GSEPLRANGVLPLGQTTT

SEQ ID NO: 1124035 - protein, 24 aa, Mycobacterium
GSFPARIGLMTGIYTAALQGGGAL

SEQ ID NO: 1124036 - protein, 19 aa, Mycobacterium
GSFWMSFGTFTKVVDVWFA

SEQ ID NO: 1124037 - protein, 25 aa, Mycobacterium
GSFWTAEQRRIWPVRLMQIQVSVIY

SEQ ID NO: 1124038 - protein, 27 aa, Mycobacterium
GSFYRPEMRAGYLFRGAAWLIGPQPRQ

SEQ ID NO: 1124039 - protein, 26 aa, Mycobacterium
GSGMPGLLKSVACNWTGIVIATCTLL

SEQ ID NO: 1124040 - protein, 23 aa, Mycobacterium
GSGPWWPLPFWIAVAGLTPTGLL

SEQ ID NO: 1124041 - protein, 18 aa, Mycobacterium
GSKPHYGPIVMIGDPAAI

SEQ ID NO: 1124042 - protein, 20 aa, Mycobacterium
GSLAAVDFVGWYNAHPYFEG

SEQ ID NO: 1124043 - protein, 25 aa, Mycobacterium
GSLAWAARWAFLPWPTARESAVLVG

SEQ ID NO: 1124044 - protein, 18 aa, Mycobacterium
GSLERWLDCSGHAEALRF

SEQ ID NO: 1124045 - protein, 24 aa, Mycobacterium
GSLETVGGILLMLGLFTPLACSIV

SEQ ID NO: 1124046 - protein, 26 aa, Mycobacterium
GSLIGGAWLAFIGWFLLTAARDENAA

SEQ ID NO: 1124047 - protein, 27 aa, Mycobacterium
GSLPDVAKNWPVRNLVTNTGFGTGIDW

SEQ ID NO: 1124048 - protein, 24 aa, Mycobacterium
GSLSARGRLALGILLMTSGTQVMW

SEQ ID NO: 1124049 - protein, 20 aa, Mycobacterium
GSLVRLAVLGLIMVPVIAGV

SEQ ID NO: 1124050 - protein, 26 aa, Mycobacterium
GSPERFRQALFRALAGVIELWMLTGG

SEQ ID NO: 1124051 - protein, 22 aa, Mycobacterium
GSPIFRALWIAQFVSNLGTWMQ

SEQ ID NO: 1124052 - protein, 17 aa, Mycobacterium
GSRPRLIPDSEAALTAL

SEQ ID NO: 1124053 - protein, 29 aa, Mycobacterium
GSSAAPLFHNIASWLLRRENVPLSPDPGA

SEQ ID NO: 1124054 - protein, 26 aa, Mycobacterium
GSSRGWRAAAPLSRDDAWIIFTSGST

SEQ ID NO: 1124055 - protein, 25 aa, Mycobacterium
GSTIKRRKMIGLSLGIGFGAFGLGT

SEQ ID NO: 1124056 - protein, 17 aa, Mycobacterium
GSTRLAVDARKNLEPLV

SEQ ID NO: 1124057 - protein, 23 aa, Mycobacterium
GSTSPSRTYGWHRAEVFTAVANA

SEQ ID NO: 1124058 - protein, 19 aa, Mycobacterium
GSVLCFARAGAYSPAGDPD

SEQ ID NO: 1124059 - protein, 19 aa, Mycobacterium
GSVVFGWWLAVVVYLLPRR

SEQ ID NO: 1124060 - protein, 23 aa, Mycobacterium
GTAQCSVGFGVGRECDELTVDGN

SEQ ID NO: 1124061 - protein, 24 aa, Mycobacterium
GTARARCRPAVVVPETLPLPNVVR

SEQ ID NO: 1124062 - protein, 23 aa, Mycobacterium
GTARREFRLGGPRDQLQAAAGFI

SEQ ID NO: 1124063 - protein, 25 aa, Mycobacterium
GTASALEFLGPLGVAVARGRGQGRW

SEQ ID NO: 1124064 - protein, 24 aa, Mycobacterium
GTAVYACGPAPMLTAVRAALVGRD

SEQ ID NO: 1124065 - protein, 18 aa, Mycobacterium
GTDRPCPNPDLPLPTKHS

SEQ ID NO: 1124066 - protein, 18 aa, Mycobacterium
GTEHGDPFLGRTMGTQAD

SEQ ID NO: 1124067 - protein, 27 aa, Mycobacterium
GTGGGFRPNPGIGHPWYVNYFPVTRAV

SEQ ID NO: 1124068 - protein, 28 aa, Mycobacterium
GTGGLLGGFGILRFDNGVPFVDDLGKNI

SEQ ID NO: 1124069 - protein, 23 aa, Mycobacterium
GTGGLLGGFGLLRFDNGTATVDT

SEQ ID NO: 1124070 - protein, 33 aa, Mycobacterium
GTGLDLRPNPGIGFPGWANYFPVTRGVPEPPSI

SEQ ID NO: 1124071 - protein, 22 aa, Mycobacterium
GTGLTFGMWWIYYVLPQADILH

SEQ ID NO: 1124072 - protein, 19 aa, Mycobacterium
GTGQALWWAFALGACFSGN

SEQ ID NO: 1124073 - protein, 17 aa, Mycobacterium
GTGRAMTSIVLRVPVAK

SEQ ID NO: 1124074 - protein, 19 aa, Mycobacterium
GTHVIGWWPNVAAMQEALG

SEQ ID NO: 1124075 - protein, 19 aa, Mycobacterium
GTIKPSRGIVVFWGTATGA

SEQ ID NO: 1124076 - protein, 25 aa, Mycobacterium
GTMYARLEIGVAVFFVLSGFLLFRP

SEQ ID NO: 1124077 - protein, 17 aa, Mycobacterium
GTPAMWFLAVPVLAWAV

SEQ ID NO: 1124078 - protein, 17 aa, Mycobacterium
GTPAPILGGILSPEVGE

SEQ ID NO: 1124079 - protein, 20 aa, Mycobacterium
GTPWGAWLFTRAQRLYRPVF

SEQ ID NO: 1124080 - protein, 17 aa, Mycobacterium
GTRVWRAVFGTAIGFLF

SEQ ID NO: 1124081 - protein, 17 aa, Mycobacterium
GTRWLDLTLPPIVTGAI

SEQ ID NO: 1124082 - protein, 22 aa, Mycobacterium
GTSYGDHGNWVIGAPDVLLDPT

SEQ ID NO: 1124083 - protein, 25 aa, Mycobacterium
GTSYRAEALLVEALDAMTEAVGAAP

SEQ ID NO: 1124084 - protein, 24 aa, Mycobacterium
GTTKLRPGDAIPLDRTAPALDLDA

SEQ ID NO: 1124085 - protein, 21 aa, Mycobacterium
GTTPYYARMHKWIKRAVLVCL

SEQ ID NO: 1124086 - protein, 17 aa, Mycobacterium
GTTRWGAFLRDLDAFDA

SEQ ID NO: 1124087 - protein, 26 aa, Mycobacterium
GTVAFSFAGAFGLSVLVWQHLIGLHL

SEQ ID NO: 1124088 - protein, 27 aa, Mycobacterium
GTVAFSFAGAFGLSVLVWQHLIGLHLH

SEQ ID NO: 1124089 - protein, 17 aa, Mycobacterium
GTVCAAMGFVLEYSLGG

SEQ ID NO: 1124090 - protein, 30 aa, Mycobacterium
GTVGALRGALRAAPRLSPNGIPPALIPDAT

SEQ ID NO: 1124091 - protein, 17 aa, Mycobacterium
GTVLGRLGGEEFVIADV

SEQ ID NO: 1124092 - protein, 17 aa, Mycobacterium
GTVLTGFVFVSRMPVSV

SEQ ID NO: 1124093 - protein, 20 aa, Mycobacterium
GTVNAVWDGRAGVLLLIETG

SEQ ID NO: 1124094 - protein, 22 aa, Mycobacterium
GTWLVYRITRNVMKNRREQGFR

SEQ ID NO: 1124095 - protein, 18 aa, Mycobacterium
GTYTVRWRVTGGDGDQVE

SEQ ID NO: 1124096 - protein, 21 aa, Mycobacterium
GVAAIRGGWQLSRTGRQRRRL

SEQ ID NO: 1124097 - protein, 20 aa, Mycobacterium
GVAGALAWSYGEPVALLTTV

SEQ ID NO: 1124098 - protein, 23 aa, Mycobacterium
GVALGFPLADPIIGLVITVAILA

SEQ ID NO: 1124099 - protein, 17 aa, Mycobacterium
GVALVVAAVFLIDGSAG

SEQ ID NO: 1124100 - protein, 25 aa, Mycobacterium
GVAPLPPAVCARLRQLGTPVSHRDH

SEQ ID NO: 1124101 - protein, 25 aa, Mycobacterium
GVAPRWIPYLAGLKLAGAAGLLLGF

SEQ ID NO: 1124102 - protein, 23 aa, Mycobacterium
GVDPCGCALFVGCDRTRRLRLLG

SEQ ID NO: 1124103 - protein, 17 aa, Mycobacterium
GVDPSVLLPSELTDPPV

SEQ ID NO: 1124104 - protein, 19 aa, Mycobacterium
GVELIRIIAQMGLGAGALI

SEQ ID NO: 1124105 - protein, 19 aa, Mycobacterium
GVEYGARHYPVMVVLHTGL

SEQ ID NO: 1124106 - protein, 17 aa, Mycobacterium
GVFADPAGGIGVYAPGA

SEQ ID NO: 1124107 - protein, 23 aa, Mycobacterium
GVFEVVSAFGIRSASKKLSEAPQ

SEQ ID NO: 1124108 - protein, 18 aa, Mycobacterium
GVGFEGYLAWVAGAGAIA

SEQ ID NO: 1124109 - protein, 24 aa, Mycobacterium
GVGLGLSVARGFVEAMGGTISATD

SEQ ID NO: 1124110 - protein, 25 aa, Mycobacterium
GVGPACAIAVLIGFLATVTLLPPVM

SEQ ID NO: 1124111 - protein, 17 aa, Mycobacterium
GVGRLSTHTAIRWASSV

SEQ ID NO: 1124112 - protein, 20 aa, Mycobacterium
GVGSRVGRRLLSASPLPGWL

SEQ ID NO: 1124113 - protein, 19 aa, Mycobacterium
GVGTMLIVRAVWLRAATRR

SEQ ID NO: 1124114 - protein, 21 aa, Mycobacterium
GVGVITDWAGGYVKRHPLASL

SEQ ID NO: 1124115 - protein, 24 aa, Mycobacterium
GVGWCVLLQVLPMRTRHGVVILTG

SEQ ID NO: 1124116 - protein, 19 aa, Mycobacterium
GVHFKDLTPVLADARGLAE

SEQ ID NO: 1124117 - protein, 25 aa, Mycobacterium
GVIAACLCSLVGCWVLLRGNVFLGE

SEQ ID NO: 1124118 - protein, 17 aa, Mycobacterium
GVIALILLIVYRSVFTA

SEQ ID NO: 1124119 - protein, 27 aa, Mycobacterium
GVIGMGLAFLCFVPLAGITAVPALLVM

SEQ ID NO: 1124120 - protein, 26 aa, Mycobacterium
GVILLLEVLFFRWLLDGNRSHEWWAG

SEQ ID NO: 1124121 - protein, 32 aa, Mycobacterium; identical to SEQ ID NO: 310731

SEQ ID NO: 1124122 - protein, 18 aa, Mycobacterium
GVLCVIAAIVALAVLDRA

SEQ ID NO: 1124123 - protein, 17 aa, Mycobacterium
GVLILVCAVVDFSAYLG

SEQ ID NO: 1124124 - protein, 25 aa, Mycobacterium
GVLLEHFWWGSVFLINIPVMVILLV

SEQ ID NO: 1124125 - protein, 26 aa, Mycobacterium
GVLLWQHLFWYFGHPEVYVIALPFFG

SEQ ID NO: 1124126 - protein, 18 aa, Mycobacterium
GVLREWLLARDELPNSSL

SEQ ID NO: 1124127 - protein, 23 aa, Mycobacterium
GVLSEWHWQAIFWVGVPIGLAGT

SEQ ID NO: 1124128 - protein, 18 aa, Mycobacterium
GVLTLWVQQVFGFNLAGS

SEQ ID NO: 1124129 - protein, 25 aa, Mycobacterium
GVNGSRARLPFGLDPAGTPVLGSWR

SEQ ID NO: 1124130 - protein, 24 aa, Mycobacterium
GVNGSRVFLPFGLDPATTPVMGSF

SEQ ID NO: 1124131 - protein, 21 aa, Mycobacterium
GVPAARCWPGPGTQLDDQALR

SEQ ID NO: 1124132 - protein, 24 aa, Mycobacterium
GVPDSWRLLNIVFILVVLFTVIQG

SEQ ID NO: 1124133 - protein, 20 aa, Mycobacterium
GVPLRLAVLAGVLDNVATLL

SEQ ID NO: 1124134 - protein, 25 aa, Mycobacterium
GVPMPVAVNLFAPFLRDAQLPSALC

SEQ ID NO: 1124135 - protein, 18 aa, Mycobacterium
GVPVAKSLSPSGFSDPGS

SEQ ID NO: 1124136 - protein, 20 aa, Mycobacterium
GVPVPLPYYGPPDHLVPPYG

SEQ ID NO: 1124137 - protein, 24 aa, Mycobacterium
GVPVWTIVRWLWIGGSDVWTLGEI

SEQ ID NO: 1124138 - protein, 18 aa, Mycobacterium
GVRDWRFIALTPPATVSK

SEQ ID NO: 1124139 - protein, 30 aa, Mycobacterium
GVRESRWFAWPGYLWFGMAAYLLLTLLVLE

SEQ ID NO: 1124140 - protein, 20 aa, Mycobacterium
GVRVPPRIIKDVLAPDGTRT

SEQ ID NO: 1124141 - protein, 23 aa, Mycobacterium
GVSLAVLGWALWRRLTALRSCPV

SEQ ID NO: 1124142 - protein, 19 aa, Mycobacterium
GVTLVVCAGIPLLVADPGF

SEQ ID NO: 1124143 - protein, 32 aa, Mycobacterium
GVTRPLGEVPREFRATFQAGLVGDRLAAGSAQ

SEQ ID NO: 1124144 - protein, 24 aa, Mycobacterium
GVVARLPFALAAGLGINSFLATTV

SEQ ID NO: 1124145 - protein, 17 aa, Mycobacterium
GVVGVLAAVVIAAVLVL

SEQ ID NO: 1124146 - protein, 18 aa, Mycobacterium
GVVIGIIWMGRRLVSPWW

SEQ ID NO: 1124147 - protein, 20 aa, Mycobacterium
GVVLHLSIFVSMSIGLFSLA

SEQ ID NO: 1124148 - protein, 21 aa, Mycobacterium
GVVLLCRPFDGGIDVKGALLA

SEQ ID NO: 1124149 - protein, 18 aa, Mycobacterium
GVVLPFLRRQQSNSQRGR

SEQ ID NO: 1124150 - protein, 22 aa, Mycobacterium
GVVVFGVVVWLLVPSGDGGSTA

SEQ ID NO: 1124151 - protein, 22 aa, Mycobacterium
GVVVIGVVVWLLVPSGDGGSTA

SEQ ID NO: 1124152 - protein, 19 aa, Mycobacterium
GVVVLLAWIPLRNRPGIGT

SEQ ID NO: 1124153 - protein, 25 aa, Mycobacterium
GVWHRVAAAVARRPARVAIVSIGGL

SEQ ID NO: 1124154 - protein, 24 aa, Mycobacterium
GVYLWHWPIFLFLNGERTGWTGWP

SEQ ID NO: 1124155 - protein, 24 aa, Mycobacterium
GVYLWHWPIFLVLNGERTGIEGWE

SEQ ID NO: 1124156 - protein, 17 aa, Mycobacterium
GWAASKSSTVWQRLAVT

SEQ ID NO: 1124157 - protein, 27 aa, Mycobacterium
GWAATRWDLAAVFPWFAGVVAAACMGA

SEQ ID NO: 1124158 - protein, 27 aa, Mycobacterium
GWALWTGRRWGRGIAVFAQLLLLPVTW

SEQ ID NO: 1124159 - protein, 17 aa, Mycobacterium
GWGITWLGYAGDYSRFV

SEQ ID NO: 1124160 - protein, 19 aa, Mycobacterium
GWGPLALLGSWPVGVRLLV

SEQ ID NO: 1124161 - protein, 18 aa, Mycobacterium
GWIPAPRRRNVVAAGAAS

SEQ ID NO: 1124162 - protein, 20 aa, Mycobacterium
GWLAARRRVREMVLPAVTTG

SEQ ID NO: 1124163 - protein, 18 aa, Mycobacterium
GWLPEVFIDSGVSKSAAG

SEQ ID NO: 1124164 - protein, 25 aa, Mycobacterium
GWLSTCRRIRELVLPIVTTATGAFL

SEQ ID NO: 1124165 - protein, 21 aa, Mycobacterium
GWNDWVPAGAIAFGLIVVTNA

SEQ ID NO: 1124166 - protein, 23 aa, Mycobacterium
GWPSSEGLCTSACTGKTDPVFTY

SEQ ID NO: 1124167 - protein, 19 aa, Mycobacterium
GWQCSRLPDQILAAYDEAL

SEQ ID NO: 1124168 - protein, 17 aa, Mycobacterium
GWRCHPGSVAPRTAKKT

SEQ ID NO: 1124169 - protein, 18 aa, Mycobacterium
GWRCHPGSVAPRTAKKTD

SEQ ID NO: 1124170 - protein, 20 aa, Mycobacterium
GWRDEIRQPPMAGVVTPRDA

SEQ ID NO: 1124171 - protein, 25 aa, Mycobacterium
GWRPGEPFPGGAVMWSASGAAFTAI

SEQ ID NO: 1124172 - protein, 17 aa, Mycobacterium
GWRRAVLAMVGALVPMV

SEQ ID NO: 1124173 - protein, 23 aa, Mycobacterium
GWVATICVVLLLLGGGGITAGYL

SEQ ID NO: 1124174 - protein, 23 aa, Mycobacterium
GYAEAQTSWPLIGLITGVLIAGA

SEQ ID NO: 1124175 - protein, 33 aa, Mycobacterium
GYAMQWPLFAGFCVYAYFKFVRYEEAPPEPHPH

SEQ ID NO: 1124176 - protein, 18 aa, Mycobacterium
GYAWPFYALVDMRSQAYL

SEQ ID NO: 1124177 - protein, 25 aa, Mycobacterium
GYDGFLYSIGFLVAWLVALLLVAEL

SEQ ID NO: 1124178 - protein, 21 aa, Mycobacterium
GYFGAWRSAALMWIVDLLLVV

SEQ ID NO: 1124179 - protein, 17 aa, Mycobacterium
GYFTAGAPFVWTLLLAG

SEQ ID NO: 1124180 - protein, 20 aa, Mycobacterium
GYGCLLIVGFLCVDLVLDVA

SEQ ID NO: 1124181 - protein, 23 aa, Mycobacterium
GYLHIKDVLPLVAGDSGGTAVIE

SEQ ID NO: 1124182 - protein, 25 aa, Mycobacterium
GYLLFGGVCVAFWFLPGAKEPVVVD

SEQ ID NO: 1124183 - protein, 25 aa, Mycobacterium
GYPDPNLRPAIVGVFTDLTGPAPPG

SEQ ID NO: 1124184 - protein, 25 aa, Mycobacterium
GYQTRLQERFVWNSVDVLLEVFVFA

SEQ ID NO: 1124185 - protein, 28 aa, Mycobacterium
GYSALRAGIGFIPFVIALGIGLGLSSAL

SEQ ID NO: 1124186 - protein, 23 aa, Mycobacterium
GYWPAAAGLFAFVWLELASPDPG

SEQ ID NO: 1124187 - protein, 22 aa, Mycobacterium
HAAAAVPFWIGPILLYVLLPAL

SEQ ID NO: 1124188 - protein, 19 aa, Mycobacterium
HADEFPDERILSFLDDRLE

SEQ ID NO: 1124189 - protein, 17 aa, Mycobacterium
HADRGWLAAQLTREPSR

SEQ ID NO: 1124190 - protein, 17 aa, Mycobacterium
HAGIGTGIIRAMGGSGS

SEQ ID NO: 1124191 - protein, 24 aa, Mycobacterium
HAGPAEFRTGWFIESLATQTLIIF

SEQ ID NO: 1124192 - protein, 23 aa, Mycobacterium
HAILKELAHELGLNEWAVEDAVA

SEQ ID NO: 1124193 - protein, 18 aa, Mycobacterium
HALLRGVPMTSIMAEMFG

SEQ ID NO: 1124194 - protein, 22 aa, Mycobacterium
HAMIPRSRVDVVRADEAVPDVL

SEQ ID NO: 1124195 - protein, 25 aa, Mycobacterium
HAPLWREFTRFWTVSFPVVVYRSWR

SEQ ID NO: 1124196 - protein, 22 aa, Mycobacterium
HAVAHALLAKGIKGGDGVAVLA

SEQ ID NO: 1124197 - protein, 33 aa, Mycobacterium
HAVLAENGGRTWLLWDGKRSPIDLADRAVTGGL

SEQ ID NO: 1124198 - protein, 28 aa, Mycobacterium
HAVLWSQWRFAFEPMFVVAVSTLLRSSI

SEQ ID NO: 1124199 - protein, 29 aa, Mycobacterium
HDAGAGPRFPLSVIGVVAALALLAVGGAA

SEQ ID NO: 1124200 - protein, 23 aa, Mycobacterium
HDFGEHDGRPFIVMERLPGRTLA

SEQ ID NO: 1124201 - protein, 22 aa, Mycobacterium
HDGTWKPFLLSFAISYGVGLTV

SEQ ID NO: 1124202 - protein, 17 aa, Mycobacterium
HDLPPLPTLFVVADEFT

SEQ ID NO: 1124203 - protein, 20 aa, Mycobacterium
HDRPDVVLLMIGRWELVDRI

SEQ ID NO: 1124204 - protein, 20 aa, Mycobacterium
HDRRVWTVSLAVAGAAVVAA

SEQ ID NO: 1124205 - protein, 19 aa, Mycobacterium
HDVSHGWTVPWMMFLAVYA

SEQ ID NO: 1124206 - protein, 24 aa, Mycobacterium
HDYGEVDGLLFVDMRLIDGTDLRK

SEQ ID NO: 1124207 - protein, 24 aa, Mycobacterium
HDYRPVWELADWSTVVFELAILLA

SEQ ID NO: 1124208 - protein, 23 aa, Mycobacterium
HEHRSGIVWLLLVPVALLAFIVP

SEQ ID NO: 1124209 - protein, 21 aa, Mycobacterium
HELKTGDVMYLDIKEGAEFGA

SEQ ID NO: 1124210 - protein, 21 aa, Mycobacterium
HELRRSATRFLFEFADDLQND

SEQ ID NO: 1124211 - protein, 20 aa, Mycobacterium
HELRTPLAAIHGYAELTRQD

SEQ ID NO: 1124212 - protein, 21 aa, Mycobacterium
HELRTPLTTVRMAADLIHDHA

SEQ ID NO: 1124213 - protein, 24 aa, Mycobacterium
HETSRAGNTFGIVGMVVALVATIA

SEQ ID NO: 1124214 - protein, 18 aa, Mycobacterium
HFAELRARCEVLPDVAST

SEQ ID NO: 1124215 - protein, 24 aa, Mycobacterium
HFPHAAQIWKSMWAQKTGMNVDGV

SEQ ID NO: 1124216 - protein, 17 aa, Mycobacterium
HFTGVGALIMFLAALSM

SEQ ID NO: 1124217 - protein, 18 aa, Mycobacterium
HFYGRRELAHIMATAKPR

SEQ ID NO: 1124218 - protein, 24 aa, Mycobacterium
HGAAGLLNLFTFGLLGSSGHRSTQ

SEQ ID NO: 1124219 - protein, 25 aa, Mycobacterium
HGAHVELRRSFGWRTVAAAGGLLST

SEQ ID NO: 1124220 - protein, 23 aa, Mycobacterium
HGDEIARAVVLIAVTVLLVGVAE

SEQ ID NO: 1124221 - protein, 27 aa, Mycobacterium
HGEPLPWQDLRAAFTERGWLDMTHTRR

SEQ ID NO: 1124222 - protein, 25 aa, Mycobacterium
HGFELKKRPTWIWIAESLVLVVAVL

SEQ ID NO: 1124223 - protein, 25 aa, Mycobacterium
HGIRLRTKLRLFGFDTVETVSEEAA

SEQ ID NO: 1124224 - protein, 17 aa, Mycobacterium
HGLGQVWGMASGFLATF

SEQ ID NO: 1124225 - protein, 19 aa, Mycobacterium
HGLPAIVIAISMVSLGVLL

SEQ ID NO: 1124226 - protein, 25 aa, Mycobacterium
HGNHEPGWVVAPGMQGVEVQPFTQN

SEQ ID NO: 1124227 - protein, 19 aa, Mycobacterium
HGPAVMLVVAVGVWAVALS

SEQ ID NO: 1124228 - protein, 18 aa, Mycobacterium
HGPLVFRVAERMSLISDA

SEQ ID NO: 1124229 - protein, 21 aa, Mycobacterium
HGTDFRPGFLVAGVVLGTLVM

SEQ ID NO: 1124230 - protein, 20 aa, Mycobacterium
HGVPGPREWLVSALNSSLLR

SEQ ID NO: 1124231 - protein, 27 aa, Mycobacterium
HGYGEIDGRLYLDMRLIEGRNLGTMLQ

SEQ ID NO: 1124232 - protein, 26 aa, Mycobacterium
HGYHYYARDALRPEVTFADYKVTTNE

SEQ ID NO: 1124233 - protein, 21 aa, Mycobacterium
HHSITRFYGLNGLMKHPLHQT

SEQ ID NO: 1124234 - protein, 22 aa, Mycobacterium
HHSITRFYGLNGLMKHPLHQTV

SEQ ID NO: 1124235 - protein, 21 aa, Mycobacterium
HHSITRFYGLNGQMKHPLHQT

SEQ ID NO: 1124236 - protein, 22 aa, Mycobacterium
HHSVTRFYGLNGQMKHPLHQTV

SEQ ID NO: 1124237 - protein, 17 aa, Mycobacterium
HHWVWVVPLTIWLLHGP

SEQ ID NO: 1124238 - protein, 17 aa, Mycobacterium
HHYEWMSDYLVARGMTA

SEQ ID NO: 1124239 - protein, 19 aa, Mycobacterium
HILGSSFMRNAWAGGTIVA

SEQ ID NO: 1124240 - protein, 19 aa, Mycobacterium
HILLGVAGYNFGRFCLTPL

SEQ ID NO: 1124241 - protein, 20 aa, Mycobacterium
HILLGVAGYNFGRFCLTPLP

SEQ ID NO: 1124242 - protein, 17 aa, Mycobacterium
HITMFLTALTFMYLAAR

SEQ ID NO: 1124243 - protein, 19 aa, Mycobacterium
HKGACWARLDLPDDEYVPV

SEQ ID NO: 1124244 - protein, 17 aa, Mycobacterium
HKPVRIRMAADVDTVAV

SEQ ID NO: 1124245 - protein, 17 aa, Mycobacterium
HLAHPYVDIAHRAALLY

SEQ ID NO: 1124246 - protein, 26 aa, Mycobacterium
HLDGGAIWLIAWRVIQGIGGAMLMAS

SEQ ID NO: 1124247 - protein, 25 aa, Mycobacterium
HLESARWWWLRNRRHAGNRIERSGR

SEQ ID NO: 1124248 - protein, 25 aa, Mycobacterium
HLFFEQRGPFAIVVARFVPIVRTLA

SEQ ID NO: 1124249 - protein, 20 aa, Mycobacterium
HLFVVAAIVWWVRQGLQESQ

SEQ ID NO: 1124250 - protein, 20 aa, Mycobacterium
HLFVVAAVVWWVRQGLQESQ

SEQ ID NO: 1124251 - protein, 25 aa, Mycobacterium
HLGSRPRHWLSVALGVEVVALMVLA

SEQ ID NO: 1124252 - protein, 26 aa, Mycobacterium
HLLDTLAVFVGWLWPLWDRRRRTFAD

SEQ ID NO: 1124253 - protein, 34 aa, Mycobacterium
HLLGRIPLPGSVPRPVWRDAFAHPENDKRVAVGI

SEQ ID NO: 1124254 - protein, 18 aa, Mycobacterium
HLLRWIALTYVAVLVIVP

SEQ ID NO: 1124255 - protein, 25 aa, Mycobacterium
HLLSLLRLVATVAYYLVVSSVQVAW

SEQ ID NO: 1124256 - protein, 17 aa, Mycobacterium
HLNRAGLPHSSNEQFHA

SEQ ID NO: 1124257 - protein, 20 aa, Mycobacterium
HLPQAFSHARRARRIMLQNV

SEQ ID NO: 1124258 - protein, 21 aa, Mycobacterium
HLPQAFSHARRARRIMLQNVG

SEQ ID NO: 1124259 - protein, 24 aa, Mycobacterium
HLPRTRVGAWLGRPMTSFHLIVAV

SEQ ID NO: 1124260 - protein, 23 aa, Mycobacterium
HLVVGAAGFFFARSYAGARAYLL

SEQ ID NO: 1124261 - protein, 20 aa, Mycobacterium
HLWQARLAPQAKPYPQPHKF

SEQ ID NO: 1124262 - protein, 17 aa, Mycobacterium
HMIPEALAITSELTVAD

SEQ ID NO: 1124263 - protein, 23 aa, Mycobacterium
HMQVGSLIAFLSYFMQILVAVLM

SEQ ID NO: 1124264 - protein, 22 aa, Mycobacterium
HNCASRYLYALGREGLSTRLQD

SEQ ID NO: 1124265 - protein, 17 aa, Mycobacterium
HNPWTALLVLFLIGLTG

SEQ ID NO: 1124266 - protein, 25 aa, Mycobacterium
HPADRLIVIYADFKGEAGADIFRNF

SEQ ID NO: 1124267 - protein, 17 aa, Mycobacterium
HPALMLLAVFAGLQMFG

SEQ ID NO: 1124268 - protein, 22 aa, Mycobacterium
HPAWWTLILVILTVVALWLTYS

SEQ ID NO: 1124269 - protein, 25 aa, Mycobacterium
HPEDFRLSGPDMRAVRQAVTRARRA

SEQ ID NO: 1124270 - protein, 23 aa, Mycobacterium
HPEKDRRVAVGIVVLAALTAATS

SEQ ID NO: 1124271 - protein, 26 aa, Mycobacterium
HPHAGLDTAGLWVWHTDEIIDMRKHL

SEQ ID NO: 1124272 - protein, 20 aa, Mycobacterium
HPIWIAVPAFAPAIVVAGVV

SEQ ID NO: 1124273 - protein, 23 aa, Mycobacterium
HPLAAAIVKYAAGRGVKPLPLND

SEQ ID NO: 1124274 - protein, 19 aa, Mycobacterium
HPLISRAHLVLRFDQGRWL

SEQ ID NO: 1124275 - protein, 25 aa, Mycobacterium
HPLLMRLGPRRAYWSGLSVFAAGSL

SEQ ID NO: 1124276 - protein, 26 aa, Mycobacterium
HPLSVLRLVATVAYWLVVSSIQVAAL

SEQ ID NO: 1124277 - protein, 21 aa, Mycobacterium
HPPGALLTFVWLDRIGLGGGA

SEQ ID NO: 1124278 - protein, 18 aa, Mycobacterium
HPPRVIVVTSSMPGEGKS

SEQ ID NO: 1124279 - protein, 20 aa, Mycobacterium
HPSYEVQVLIPPGQSGELVF

SEQ ID NO: 1124280 - protein, 17 aa, Mycobacterium
HPWYVNYFPVTRAVPEP

SEQ ID NO: 1124281 - protein, 20 aa, Mycobacterium
HPYGRVFAALIAPRLAPATD

SEQ ID NO: 1124282 - protein, 24 aa, Mycobacterium
HQDAGLSWLLLVSVPLLALTNYWI

SEQ ID NO: 1124283 - protein, 22 aa, Mycobacterium
HQGEPIPAFANAMVLLGVGAVV

SEQ ID NO: 1124284 - protein, 23 aa, Mycobacterium
HQPEPRSAGSLFAGFPALLIVVA

SEQ ID NO: 1124285 - protein, 24 aa, Mycobacterium
HQVTGWRFVMRRIASGVALHDTRM

SEQ ID NO: 1124286 - protein, 24 aa, Mycobacterium
HRFLMRRMEHALVRGDARMLDDPL

SEQ ID NO: 1124287 - protein, 21 aa, Mycobacterium
HRGEAGRGWTMILIALTMPAL

SEQ ID NO: 1124288 - protein, 24 aa, Mycobacterium
HRGIACAIAGLAFVMPLAQAALTH

SEQ ID NO: 1124289 - protein, 18 aa, Mycobacterium
HRLVVPRVVASTFVAILL

SEQ ID NO: 1124290 - protein, 33 aa, Mycobacterium
HRPFIPRMIRLFAVPIILGWIALIVILNVTVPQ

SEQ ID NO: 1124291 - protein, 20 aa, Mycobacterium
HRQMHLGRLPKIVRGQRKPL

SEQ ID NO: 1124292 - protein, 19 aa, Mycobacterium
HRRAARLVAALAVTSCLAG

SEQ ID NO: 1124293 - protein, 30 aa, Mycobacterium
HRRRARRWAPRGALAFLALSVVLVVVFVVA

SEQ ID NO: 1124294 - protein, 26 aa, Mycobacterium
HRRRARRWAPRGALAFLTLSVVLVVV

SEQ ID NO: 1124295 - protein, 23 aa, Mycobacterium
HRRVTRWELLWAAVLAGAVAVIV

SEQ ID NO: 1124296 - protein, 23 aa, Mycobacterium
HRRWTPCRGHFRYEPSTTNRRSP

SEQ ID NO: 1124297 - protein, 22 aa, Mycobacterium
HRTSLRPALEKLSGVMALIDNR

SEQ ID NO: 1124298 - protein, 19 aa, Mycobacterium
HRTVWPKIAGAKVLDELFP

SEQ ID NO: 1124299 - protein, 21 aa, Mycobacterium
HSAWWLSFIPGLAIVITTVSA

SEQ ID NO: 1124300 - protein, 21 aa, Mycobacterium
HSLFGCFFYGVFVTKMLLLTR

SEQ ID NO: 1124301 - protein, 20 aa, Mycobacterium
HSLIPIVVGYIFAHYLSYLV

SEQ ID NO: 1124302 - protein, 21 aa, Mycobacterium
HSRRARRIMVQNIAFSLAIIA

SEQ ID NO: 1124303 - protein, 21 aa, Mycobacterium
HSTIRITRAELEEMLQRPLAG

SEQ ID NO: 1124304 - protein, 22 aa, Mycobacterium
HSTIRITRAELEEMLQRPLAGV

SEQ ID NO: 1124305 - protein, 26 aa, Mycobacterium
HSTIRITRAELEEMLQRPLAGVLAAL

SEQ ID NO: 1124306 - protein, 28 aa, Mycobacterium
HSVLTRLGPRWAYLLGLTVFGLGSLVCA

SEQ ID NO: 1124307 - protein, 26 aa, Mycobacterium
HSVPWNIASAVPWLGDPFTTGQEISD

SEQ ID NO: 1124308 - protein, 17 aa, Mycobacterium
HTALNYVRARQVTTETN

SEQ ID NO: 1124309 - protein, 29 aa, Mycobacterium
HTGTLLVPRDLPLASVRRIHRMVPSLQAL

SEQ ID NO: 1124310 - protein, 18 aa, Mycobacterium
HTSMRFVEALTFLVITIM

SEQ ID NO: 1124311 - protein, 18 aa, Mycobacterium
HTVSFLVALSIVVTLHVL

SEQ ID NO: 1124312 - protein, 21 aa, Mycobacterium
HTYRTRFLFFATGYYDYDHPY

SEQ ID NO: 1124313 - protein, 19 aa, Mycobacterium
HVCVFPLAAPQSVSVPRTD

SEQ ID NO: 1124314 - protein, 19 aa, Mycobacterium
HVCVFPLAAPQSVTVPRTD

SEQ ID NO: 1124315 - protein, 17 aa, Mycobacterium
HVIIALVLFCLWPFTRL

SEQ ID NO: 1124316 - protein, 18 aa, Mycobacterium
HVLVVWAAIYLTWGRGMR

SEQ ID NO: 1124317 - protein, 27 aa, Mycobacterium
HVMLGLTLFCLWPFTRLVHAFSAPIGY

SEQ ID NO: 1124318 - protein, 18 aa, Mycobacterium
HVVAHDWGSTGMWEYLSR

SEQ ID NO: 1124319 - protein, 21 aa, Mycobacterium
HWQPRCPVYVIPHGAEPGVRG

SEQ ID NO: 1124320 - protein, 18 aa, Mycobacterium
HWRAERVAYRLIGADPAA

SEQ ID NO: 1124321 - protein, 18 aa, Mycobacterium
HWSSWYGEVIQGIFNVTP

SEQ ID NO: 1124322 - protein, 17 aa, Mycobacterium
HWVYLAGIVVILVTMAL

SEQ ID NO: 1124323 - protein, 18 aa, Mycobacterium
HYFFLTSIHCIHVLIGFV

SEQ ID NO: 1124324 - protein, 25 aa, Mycobacterium
HYFWNRRNAAALSHHGVRLEYDPEQ

SEQ ID NO: 1124325 - protein, 27 aa, Mycobacterium
HYRLDGEQWPAFSLQTVVAVKYAATDN

SEQ ID NO: 1124326 - protein, 18 aa, Mycobacterium
IAAAMGWWTYDPGMGPVL

SEQ ID NO: 1124327 - protein, 20 aa, Mycobacterium
IAAGLLRLSVDSSWTAIVVA

SEQ ID NO: 1124328 - protein, 21 aa, Mycobacterium
IAAIQRLRAPLKVAGEYSPVI

SEQ ID NO: 1124329 - protein, 24 aa, Mycobacterium
IAAMTVEMAMGFAVATALHRERRA

SEQ ID NO: 1124330 - protein, 17 aa, Mycobacterium
IAAPRRIIAAAILAAVA

SEQ ID NO: 1124331 - protein, 18 aa, Mycobacterium
IAATFVWLGMVLAISFLE

SEQ ID NO: 1124332 - protein, 24 aa, Mycobacterium
IACGALLVWFWPRLLADGMAVPVT

SEQ ID NO: 1124333 - protein, 20 aa, Mycobacterium
IACVVFPLGLAWVAVDAQRR

SEQ ID NO: 1124334 - protein, 20 aa, Mycobacterium
IADAIKGLVERVWEEQGRTK

SEQ ID NO: 1124335 - protein, 19 aa, Mycobacterium
IAEAYKMPPGWTATATAPF

SEQ ID NO: 1124336 - protein, 26 aa, Mycobacterium
IAEVLERWEHVLFPIVLIALGIFILV

SEQ ID NO: 1124337 - protein, 27 aa, Mycobacterium
IAFGGPGALFWMWAVAFLGASTSFVEC

SEQ ID NO: 1124338 - protein, 19 aa, Mycobacterium
IAFSAARYAMGSGQSSAQQ

SEQ ID NO: 1124339 - protein, 17 aa, Mycobacterium
IAFSSAVLIFGMPLLIP

SEQ ID NO: 1124340 - protein, 18 aa, Mycobacterium
IAFWTVIVGAEWALPGVN

SEQ ID NO: 1124341 - protein, 19 aa, Mycobacterium
IAGDSIWIPILIIGLVYVP

SEQ ID NO: 1124342 - protein, 20 aa, Mycobacterium
IAGGFLFMATFVGGVVGAAI

SEQ ID NO: 1124343 - protein, 18 aa, Mycobacterium
IAGLVLLVIFAVVATLVA

SEQ ID NO: 1124344 - protein, 18 aa, Mycobacterium
IAGQLGLPYVQRGVGEAL

SEQ ID NO: 1124345 - protein, 17 aa, Mycobacterium
IAGTVLTGFVFVSRMPV

SEQ ID NO: 1124346 - protein, 26 aa, Mycobacterium
IAGVDPRVGLFASFTMAVTIAIVGGR

SEQ ID NO: 1124347 - protein, 17 aa, Mycobacterium
IAGYTIVRMLGSGGMGK

SEQ ID NO: 1124348 - protein, 23 aa, Mycobacterium
IAHLEWSRVPLLLVVAIPIGLAR

SEQ ID NO: 1124349 - protein, 19 aa, Mycobacterium
IAIPHPRFGDFHAGTGTGI

SEQ ID NO: 1124350 - protein, 17 aa, Mycobacterium
IAIPRGFRGEADAGEDI

SEQ ID NO: 1124351 - protein, 23 aa, Mycobacterium
IAKRSRTLFVAQWTNTGRLNAHI

SEQ ID NO: 1124352 - protein, 17 aa, Mycobacterium
IALAGLWLGLLGVAMAT

SEQ ID NO: 1124353 - protein, 19 aa, Mycobacterium
IALAVCVPAALFVLPPRHH

SEQ ID NO: 1124354 - protein, 19 aa, Mycobacterium
IALCYEMVMKYAFQDDSLG

SEQ ID NO: 1124355 - protein, 30 aa, Mycobacterium
IALDVWAGAWAVVLAHLWIGDQADNRNVLL

SEQ ID NO: 1124356 - protein, 30 aa, Mycobacterium
IALDVWAGAWAVVLAHLWIGDQADTRNVLL

SEQ ID NO: 1124357 - protein, 25 aa, Mycobacterium
IALFALRVGLHLALLHEAQDGAHID

SEQ ID NO: 1124358 - protein, 29 aa, Mycobacterium
IALIASVGATAWLYFFQFRPDQETDSEAA

SEQ ID NO: 1124359 - protein, 22 aa, Mycobacterium
IALNFTLSWLATRLERRMRRSR

SEQ ID NO: 1124360 - protein, 18 aa, Mycobacterium
IALTLVLIALAWRNRELW

SEQ ID NO: 1124361 - protein, 18 aa, Mycobacterium
IALTPPATVSKLLIRVAE

SEQ ID NO: 1124362 - protein, 18 aa, Mycobacterium
IALVTCLVLVSFGYTSLP

SEQ ID NO: 1124363 - protein, 19 aa, Mycobacterium
IANASAWTLGARLIPAIGL

SEQ ID NO: 1124364 - protein, 17 aa, Mycobacterium
IANDIAKYFAIIPALFV

SEQ ID NO: 1124365 - protein, 18 aa, Mycobacterium
IANQLGLPIASLVAPAAV

SEQ ID NO: 1124366 - protein, 18 aa, Mycobacterium
IAPMEAIMLDGGRTQPVT

SEQ ID NO: 1124367 - protein, 28 aa, Mycobacterium
IARFGRRIAALLVDWLVSYGLAALAMTF

SEQ ID NO: 1124368 - protein, 18 aa, Mycobacterium
IARISDRGAYGLVISGCL

SEQ ID NO: 1124369 - protein, 23 aa, Mycobacterium
IARSQELLVLFGVAYAVSVASFS

SEQ ID NO: 1124370 - protein, 17 aa, Mycobacterium
IARWVATIAGLLGFVMA

SEQ ID NO: 1124371 - protein, 31 aa, Mycobacterium
IARYRTAVMARLRLVGIGVPVAVGLLAGLIA

SEQ ID NO: 1124372 - protein, 23 aa, Mycobacterium
IASEAGMLAEWMAGPEGSLASLP

SEQ ID NO: 1124373 - protein, 25 aa, Mycobacterium
IASIVGVAVMLFAYMQVPTLLGVGR

SEQ ID NO: 1124374 - protein, 29 aa, Mycobacterium
IASLVASCVGLFCCIGSIAGIAMGVIALS

SEQ ID NO: 1124375 - protein, 25 aa, Mycobacterium
IASPKTRRLALVGLVVYLLYLAGNV

SEQ ID NO: 1124376 - protein, 19 aa, Mycobacterium
IASVSRLLGLTVIVIAVVV

SEQ ID NO: 1124377 - protein, 22 aa, Mycobacterium
IATERFSWVVLGLALFAAGSVA

SEQ ID NO: 1124378 - protein, 26 aa, Mycobacterium
IATHQLRFALEVADRAVFMAGGVVVE

SEQ ID NO: 1124379 - protein, 19 aa, Mycobacterium
IATLILRGRHDRLPSLSEP

SEQ ID NO: 1124380 - protein, 18 aa, Mycobacterium
IATWGLRVYLTWITSTGY

SEQ ID NO: 1124381 - protein, 25 aa, Mycobacterium
IATWLLDRFGTWVPIAVYLAGAAVI

SEQ ID NO: 1124382 - protein, 17 aa, Mycobacterium
IAVIAAILTMVVGAAGF

SEQ ID NO: 1124383 - protein, 19 aa, Mycobacterium
IAVIAALWVSRADAAVIEW

SEQ ID NO: 1124384 - protein, 18 aa, Mycobacterium
IAVRRIPDGGGGSVEVHD

SEQ ID NO: 1124385 - protein, 28 aa, Mycobacterium
IAVTLVYLQFRGDFMARTQLTMISARSG

SEQ ID NO: 1124386 - protein, 25 aa, Mycobacterium
IAVVCRIGRALGRMRTHTFAHADAV

SEQ ID NO: 1124387 - protein, 20 aa, Mycobacterium
IAVVDWRSAVIVLIALPLIP

SEQ ID NO: 1124388 - protein, 25 aa, Mycobacterium
IAVVFRIGRALGRMRTHTFAHADAV

SEQ ID NO: 1124389 - protein, 22 aa, Mycobacterium
IAVVPKPVWITLGILVAVAALV

SEQ ID NO: 1124390 - protein, 20 aa, Mycobacterium
IAVVVAVGFFVSRRIEGDSS

SEQ ID NO: 1124391 - protein, 27 aa, Mycobacterium
IAVWVAMAVALPLSFPSLGEMAQKHPL

SEQ ID NO: 1124392 - protein, 22 aa, Mycobacterium
IAYCLGLGIPFVLLAFGSARAV

SEQ ID NO: 1124393 - protein, 22 aa, Mycobacterium
ICAVVLIGPAVMWLRKRMYLPP

SEQ ID NO: 1124394 - protein, 38 aa, Mycobacterium
ICGNGLRPAIWDAFTERFGIKRVCEFYAASEGNTAFVN

SEQ ID NO: 1124395 - protein, 23 aa, Mycobacterium
ICLSEIWKTTPFISLLLLAGLVQ

SEQ ID NO: 1124396 - protein, 27 aa, Mycobacterium
ICSVAVVWYFWVRKTHRGNVLTTLVCP

SEQ ID NO: 1124397 - protein, 28 aa, Mycobacterium
IDAAVPSLREWLRLVFIVLGGYAVATRT

SEQ ID NO: 1124398 - protein, 28 aa, Mycobacterium
IDAAVPSLRGWLRLVFIVLGGYAVATGT

SEQ ID NO: 1124399 - protein, 29 aa, Mycobacterium
IDAIPLKHPWRWLAAAAIIVLVGLFLYGA

SEQ ID NO: 1124400 - protein, 18 aa, Mycobacterium
IDARRFGMKPAHQQSESP

SEQ ID NO: 1124401 - protein, 29 aa, Mycobacterium
IDAVVDPILRLFGFGALAAAPLAAVEAVA

SEQ ID NO: 1124402 - protein, 26 aa, Mycobacterium
IDDALELRGRILGAFEQAERSSDPAR

SEQ ID NO: 1124403 - protein, 29 aa, Mycobacterium
IDEERLDRRWMWIAGVAGAILFVAVITAS

SEQ ID NO: 1124404 - protein, 17 aa, Mycobacterium
IDEHRTSLRPALEKLSG

SEQ ID NO: 1124405 - protein, 24 aa, Mycobacterium
IDEWLRLDPVLPLLAAPIALSALL

SEQ ID NO: 1124406 - protein, 26 aa, Mycobacterium
IDFSGTKAALWLSITAFLALVVLYFI

SEQ ID NO: 1124407 - protein, 29 aa, Mycobacterium
IDFVIKQGLKLAGPIIRGLKGIGKKVKAK

SEQ ID NO: 1124408 - protein, 17 aa, Mycobacterium
IDGHKMWIGNGGIADVH

SEQ ID NO: 1124409 - protein, 19 aa, Mycobacterium
IDGRLPAVIPDTSADQTTA

SEQ ID NO: 1124410 - protein, 21 aa, Mycobacterium
IDLATAVVIGTAFTGLVTAFT

SEQ ID NO: 1124411 - protein, 25 aa, Mycobacterium
IDLATAVVIGTAFTGLVTAFTNAVI

SEQ ID NO: 1124412 - protein, 23 aa, Mycobacterium
IDMACSYGDWGRRDAPPQNLGMV

SEQ ID NO: 1124413 - protein, 17 aa, Mycobacterium
IDPLRIAAADAIKGTPL

SEQ ID NO: 1124414 - protein, 17 aa, Mycobacterium
IDPPRPEAAAAIAEARG

SEQ ID NO: 1124415 - protein, 18 aa, Mycobacterium
IDPQLWLLVVVTVLALAL

SEQ ID NO: 1124416 - protein, 19 aa, Mycobacterium
IDPQLWLLVVVTVLALLLG

SEQ ID NO: 1124417 - protein, 33 aa, Mycobacterium
IDPVAALTWEVPEGPTAIPYRVKQLPPPVHVPP

SEQ ID NO: 1124418 - protein, 22 aa, Mycobacterium
IDRARWSAGVVERVNELDADVV

SEQ ID NO: 1124419 - protein, 17 aa, Mycobacterium
IDRRELDVVYQPKYHLA

SEQ ID NO: 1124420 - protein, 18 aa, Mycobacterium
IDRVRLIYGTALTAYAIA

SEQ ID NO: 1124421 - protein, 22 aa, Mycobacterium
IDSLKGVELVNVLSAAFDFTFP

SEQ ID NO: 1124422 - protein, 24 aa, Mycobacterium
IDTFSDPRIAEFLETTDNALIRDT

SEQ ID NO: 1124423 - protein, 21 aa, Mycobacterium
IDVADKWSEWMAHPITVTVLT

SEQ ID NO: 1124424 - protein, 24 aa, Mycobacterium
IDVPAIPAAMVFLGLVAALNARGI

SEQ ID NO: 1124425 - protein, 17 aa, Mycobacterium
IDWGRVLIFGALPGLAL

SEQ ID NO: 1124426 - protein, 22 aa, Mycobacterium
IEARAAAALNHPHVVAVHDSGV

SEQ ID NO: 1124427 - protein, 17 aa, Mycobacterium
IEARALGTVLGRGRAAD

SEQ ID NO: 1124428 - protein, 25 aa, Mycobacterium
IEASEPAAYCVAGRPPAIVVTTAAM

SEQ ID NO: 1124429 - protein, 26 aa, Mycobacterium
IEASEPAAYCVAGRPPAIVVTTAAMA

SEQ ID NO: 1124430 - protein, 26 aa, Mycobacterium
IEDRMPVPVAWMREWALMGGVGPGIF

SEQ ID NO: 1124431 - protein, 33 aa, Mycobacterium
IEFANAVGAAAYLAFAVPSLLFTIPLQLLTGQR

SEQ ID NO: 1124432 - protein, 18 aa, Mycobacterium
IEGFASRTDTVMVVATSL

SEQ ID NO: 1124433 - protein, 20 aa, Mycobacterium
IEGYNFLDLLGLGPATGIIS

SEQ ID NO: 1124434 - protein, 25 aa, Mycobacterium
IEHPGKRAPTVELCNDPRGFVPTAI

SEQ ID NO: 1124435 - protein, 25 aa, Mycobacterium
IEIAGAWRWTALLAVLVTVVSIPVL

SEQ ID NO: 1124436 - protein, 17 aa, Mycobacterium
IELTLIVGEWLQRIPDF

SEQ ID NO: 1124437 - protein, 19 aa, Mycobacterium
IEQRYSIGMVLATIALFTI

SEQ ID NO: 1124438 - protein, 23 aa, Mycobacterium
IERDSPTWSPRWVDHLVGDRIHR

SEQ ID NO: 1124439 - protein, 28 aa, Mycobacterium
IERGEPWPKPLPEPAFKTAIAQASRAAA

SEQ ID NO: 1124440 - protein, 19 aa, Mycobacterium
IESGSRWVATAIKEGQQWK

SEQ ID NO: 1124441 - protein, 35 aa, Mycobacterium
IETVSWRAVFWINLPICAAAIILTAVFVPETKSTT

SEQ ID NO: 1124442 - protein, 19 aa, Mycobacterium
IEVPVALTADVDRAEQVAH

SEQ ID NO: 1124443 - protein, 17 aa, Mycobacterium
IFAHLFVVAAIVWWVRQ

SEQ ID NO: 1124444 - protein, 25 aa, Mycobacterium
IFASFAVNWLLQWAAGGPNEPLWFG

SEQ ID NO: 1124445 - protein, 18 aa, Mycobacterium
IFDHLGPQLRWWEWTLEH

SEQ ID NO: 1124446 - protein, 18 aa, Mycobacterium
IFFDGAFRALRARTLDMM

SEQ ID NO: 1124447 - protein, 20 aa, Mycobacterium
IFFVLSGFLLFLPWVSAAAA

SEQ ID NO: 1124448 - protein, 18 aa, Mycobacterium
IFGLAASLIACYKGISVG

SEQ ID NO: 1124449 - protein, 17 aa, Mycobacterium
IFLVGRFLQGAAFAAVF

SEQ ID NO: 1124450 - protein, 17 aa, Mycobacterium
IFSHLSFVLPVVTWFLI

SEQ ID NO: 1124451 - protein, 18 aa, Mycobacterium
IGAAAALFGYAARRPKAE

SEQ ID NO: 1124452 - protein, 24 aa, Mycobacterium
IGAAIGLWRAKIVEMTGMPELIAL

SEQ ID NO: 1124453 - protein, 24 aa, Mycobacterium
IGAGRWSDTFVRRSGDVIASRLRP

SEQ ID NO: 1124454 - protein, 19 aa, Mycobacterium
IGAIAGWIAGKIVKGSGSG

SEQ ID NO: 1124455 - protein, 18 aa, Mycobacterium
IGAIIWGIVDAILILTDK

SEQ ID NO: 1124456 - protein, 20 aa, Mycobacterium
IGAILAVSVGLGFVNEYRAE

SEQ ID NO: 1124457 - protein, 20 aa, Mycobacterium
IGALMLIPGVIGRGPESINA

SEQ ID NO: 1124458 - protein, 26 aa, Mycobacterium
IGAVATAGYLGWLLWQQNQVSRAGEQ

SEQ ID NO: 1124459 - protein, 18 aa, Mycobacterium
IGCGVLILVGMLTRLAAL

SEQ ID NO: 1124460 - protein, 21 aa, Mycobacterium
IGCPVCNKLVLAAVGTTGALG

SEQ ID NO: 1124461 - protein, 35 aa, Mycobacterium
IGEIQIRGPHVMRGICRRSREEVFTADGFYTTGDL

SEQ ID NO: 1124462 - protein, 18 aa, Mycobacterium
IGENIAIGDRSEAAIKTN

SEQ ID NO: 1124463 - protein, 25 aa, Mycobacterium
IGFAVIVFILVKWVVPPIKGLMQKQ

SEQ ID NO: 1124464 - protein, 24 aa, Mycobacterium
IGFREAAVWSAIWIAAGLGFGAIV

SEQ ID NO: 1124465 - protein, 21 aa, Mycobacterium
IGGTERYAEFAGDQIDQAVLG

SEQ ID NO: 1124466 - protein, 21 aa, Mycobacterium
IGHGLQKVFGWWGGPGLDGFR

SEQ ID NO: 1124467 - protein, 18 aa, Mycobacterium
IGIALGWRPEVVGLALGA

SEQ ID NO: 1124468 - protein, 17 aa, Mycobacterium
IGIEALTGFLAAFINVR

SEQ ID NO: 1124469 - protein, 18 aa, Mycobacterium
IGIGGGQAIDLNLVLSAI

SEQ ID NO: 1124470 - protein, 17 aa, Mycobacterium
IGIGWGITWLGYAGDYS

SEQ ID NO: 1124471 - protein, 19 aa, Mycobacterium
IGIPDLRIDMLFNGLADLA

SEQ ID NO: 1124472 - protein, 27 aa, Mycobacterium
IGIPDRFVGGLALTLAILIATSISMVF

SEQ ID NO: 1124473 - protein, 24 aa, Mycobacterium
IGIREFPVVVALLFAMVIGLPLGI

SEQ ID NO: 1124474 - protein, 24 aa, Mycobacterium
IGITRISLNFAMFRSAFEQGAQLG

SEQ ID NO: 1124475 - protein, 17 aa, Mycobacterium
IGIWLFNLFSGDGLTDE

SEQ ID NO: 1124476 - protein, 17 aa, Mycobacterium
IGIWLVNLFEGDEPTPE

SEQ ID NO: 1124477 - protein, 22 aa, Mycobacterium
IGLCMSELVSAFPTSGGIYWWA

SEQ ID NO: 1124478 - protein, 24 aa, Mycobacterium
IGLERPGWPPPWGADVFVPDLLSV

SEQ ID NO: 1124479 - protein, 25 aa, Mycobacterium
IGLFMFVGFCAWFVGMHLLFAFNTV

SEQ ID NO: 1124480 - protein, 29 aa, Mycobacterium
IGLGRPRYRLDLLGGIGLAALIGLPGLAL

SEQ ID NO: 1124481 - protein, 28 aa, Mycobacterium
IGLIFFGWGVALAFTSVVVAPRLQHRFG

SEQ ID NO: 1124482 - protein, 29 aa, Mycobacterium
IGLLATLWVLMRFVLPWLMPQIARSQELL

SEQ ID NO: 1124483 - protein, 23 aa, Mycobacterium
IGLMCFWPNLIAYWAGKPPVRGL

SEQ ID NO: 1124484 - protein, 19 aa, Mycobacterium
IGLSEGGIGWIPYILERCD

SEQ ID NO: 1124485 - protein, 27 aa, Mycobacterium
IGLVALILFRWIARRVVASVREKYGRC

SEQ ID NO: 1124486 - protein, 19 aa, Mycobacterium
IGLVGFRAATAVGPPQVLT

SEQ ID NO: 1124487 - protein, 17 aa, Mycobacterium
IGMAIGWWREGWPSQRQ

SEQ ID NO: 1124488 - protein, 20 aa, Mycobacterium
IGMEGRVRWRHDLDQTAADI

SEQ ID NO: 1124489 - protein, 33 aa, Mycobacterium
IGMTNLVAARVGRPPVTRRSILNLYTDRAPEVG

SEQ ID NO: 1124490 - protein, 18 aa, Mycobacterium
IGNLRGALLGGLLLGVME

SEQ ID NO: 1124491 - protein, 36 aa, Mycobacterium
IGPLEFEGFVAWLAWLVLHLVYLVGFKTKIVTLLSW

SEQ ID NO: 1124492 - protein, 19 aa, Mycobacterium
IGQKVLLELRRRVFRHFGR

SEQ ID NO: 1124493 - protein, 20 aa, Mycobacterium
IGRCNDFRPITLTIAGSTVV

SEQ ID NO: 1124494 - protein, 18 aa, Mycobacterium
IGRPTRRDLTVAVLSATG

SEQ ID NO: 1124495 - protein, 22 aa, Mycobacterium
IGRRRVYCASMIGTALCAIGAA

SEQ ID NO: 1124496 - protein, 17 aa, Mycobacterium
IGSAFAFGSSGPFAKSL

SEQ ID NO: 1124497 - protein, 19 aa, Mycobacterium
IGSGFPVAAAFTAAVAVLI

SEQ ID NO: 1124498 - protein, 20 aa, Mycobacterium
IGSGRLSLDYALFHGTGFYD

SEQ ID NO: 1124499 - protein, 23 aa, Mycobacterium
IGSNPWRGPPVPIGEPIQDPRMI

SEQ ID NO: 1124500 - protein, 28 aa, Mycobacterium
IGSTLAPMPMVWAVREILHSANLSAAFF

SEQ ID NO: 1124501 - protein, 19 aa, Mycobacterium
IGTDVFPALALGAEPPDRR

SEQ ID NO: 1124502 - protein, 18 aa, Mycobacterium
IGVGALLLAPRTRRAGAL

SEQ ID NO: 1124503 - protein, 25 aa, Mycobacterium
IGVGLMAWLNIIGIIILQQPAYKAL

SEQ ID NO: 1124504 - protein, 18 aa, Mycobacterium
IGVGQSFASVPMLFATPT

SEQ ID NO: 1124505 - protein, 26 aa, Mycobacterium
IGVIRRSDFPPGRGVLIERGKGVWMQ

SEQ ID NO: 1124506 - protein, 18 aa, Mycobacterium
IGVLAALYPAVWGVGQLV

SEQ ID NO: 1124507 - protein, 33 aa, Mycobacterium
IGVVVFQWGLGHEIAWPVPLLAFIILVAVGADY

SEQ ID NO: 1124508 - protein, 25 aa, Mycobacterium
IGWTPDSWMAWTLHAMETMAFNVTS

SEQ ID NO: 1124509 - protein, 18 aa, Mycobacterium
IGYLPTMRKVILPQAIRT

SEQ ID NO: 1124510 - protein, 20 aa, Mycobacterium
IHHVLPVWVVTVIVLSVVAV

SEQ ID NO: 1124511 - protein, 23 aa, Mycobacterium
IIAISAPVLWWRLRHTDREALMG

SEQ ID NO: 1124512 - protein, 23 aa, Mycobacterium
IIGGIRPGLFVSSNFLPGSPAYT

SEQ ID NO: 1124513 - protein, 25 aa, Mycobacterium
IIGRRSRFVKMYGLRIDLQQLENTL

SEQ ID NO: 1124514 - protein, 17 aa, Mycobacterium
IIGVALGRWLVDRKTPD

SEQ ID NO: 1124515 - protein, 25 aa, Mycobacterium
IIHLLAVPIVLGWIALTVLTNVAVP

SEQ ID NO: 1124516 - protein, 26 aa, Mycobacterium
IILGLMMCFDLGGPVNKAAYAFATAG

SEQ ID NO: 1124517 - protein, 19 aa, Mycobacterium
IILVLCAIVGFVYGPIAPI

SEQ ID NO: 1124518 - protein, 17 aa, Mycobacterium
IIQFFGGIHEIYFPYVL

SEQ ID NO: 1124519 - protein, 18 aa, Mycobacterium
IIRHGRTALDVSAITGES

SEQ ID NO: 1124520 - protein, 19 aa, Mycobacterium
IISCVKALLFGLIAGLVAC

SEQ ID NO: 1124521 - protein, 26 aa, Mycobacterium
IITEPKKAAAALAWLVEEMEQRYQDM

SEQ ID NO: 1124522 - protein, 19 aa, Mycobacterium
IIVEARCGIGYLHTGIEKN

SEQ ID NO: 1124523 - protein, 20 aa, Mycobacterium
IIVIGVIVFLARRARNQRRA

SEQ ID NO: 1124524 - protein, 17 aa, Mycobacterium
IKAVLLIAGAGFMTVMV

SEQ ID NO: 1124525 - protein, 17 aa, Mycobacterium
IKELQFAALSGVFLLAA

SEQ ID NO: 1124526 - protein, 21 aa, Mycobacterium
IKIPRMRAGLRSMPLRAVLRT

SEQ ID NO: 1124527 - protein, 26 aa, Mycobacterium
IKKFLRYLLSSNMGEVFTVFFGVVFA

SEQ ID NO: 1124528 - protein, 23 aa, Mycobacterium
IKPKFPARVRLFLLTLAVVDDVG

SEQ ID NO: 1124529 - protein, 23 aa, Mycobacterium
IKRTGRLSLRHALDMLEQTGRAL

SEQ ID NO: 1124530 - protein, 17 aa, Mycobacterium
IKTNSLLGLKVLEVTPR

SEQ ID NO: 1124531 - protein, 19 aa, Mycobacterium
ILADEGWVVSALGTVGLLP

SEQ ID NO: 1124532 - protein, 24 aa, Mycobacterium
ILAGPLVGLALMFVDFRATAAAAA

SEQ ID NO: 1124533 - protein, 24 aa, Mycobacterium
ILAGPLVGLALMFVDFRMTAAAAA

SEQ ID NO: 1124534 - protein, 19 aa, Mycobacterium
ILAIGPGWLGTLALIEVVN

SEQ ID NO: 1124535 - protein, 18 aa, Mycobacterium
ILALPFVILIGLIVSRQW

SEQ ID NO: 1124536 - protein, 25 aa, Mycobacterium
ILDVAEPLAYCLPGVRSRVVVSEGA

SEQ ID NO: 1124537 - protein, 21 aa, Mycobacterium
ILFARRLDEAMAHGRFVLIFV

SEQ ID NO: 1124538 - protein, 24 aa, Mycobacterium
ILHLLIAYIIFRIAIGSGHNDADQ

SEQ ID NO: 1124539 - protein, 24 aa, Mycobacterium
ILIAFGVLWPVVFHGGSSASEIDD

SEQ ID NO: 1124540 - protein, 17 aa, Mycobacterium
ILIALAVTDSVVSRDRD

SEQ ID NO: 1124541 - protein, 17 aa, Mycobacterium
ILIFLIMVILTRAVAAA

SEQ ID NO: 1124542 - protein, 30 aa, Mycobacterium
ILINCGYPLIERFPLMFFTSAAVLMIGLAR

SEQ ID NO: 1124543 - protein, 25 aa, Mycobacterium
ILIPLGRLLWLWYRRYQFRRNVLSA

SEQ ID NO: 1124544 - protein, 19 aa, Mycobacterium
ILLIPGIILALIGVHLALV

SEQ ID NO: 1124545 - protein, 20 aa, Mycobacterium
ILLMQLCFHLLWVTGATIGG

SEQ ID NO: 1124546 - protein, 17 aa, Mycobacterium
ILLNSEFSGPQIKEVSE

SEQ ID NO: 1124547 - protein, 17 aa, Mycobacterium
ILLTAALFLRALQRVFT

SEQ ID NO: 1124548 - protein, 19 aa, Mycobacterium
ILLWGSAGLFGFLENDFGW

SEQ ID NO: 1124549 - protein, 19 aa, Mycobacterium
ILMGLVFIGLVPVLQRDTR

SEQ ID NO: 1124550 - protein, 18 aa, Mycobacterium
ILMLAFAAIAFIVAFRAE

SEQ ID NO: 1124551 - protein, 18 aa, Mycobacterium
ILPAIALVLALRREVWTG

SEQ ID NO: 1124552 - protein, 18 aa, Mycobacterium
ILPAIALVLALRREVWTR

SEQ ID NO: 1124553 - protein, 18 aa, Mycobacterium
ILPMRLFASPVFTVCCIL

SEQ ID NO: 1124554 - protein, 20 aa, Mycobacterium
ILRIVGIEWRGKIDDPTWRR

SEQ ID NO: 1124555 - protein, 17 aa, Mycobacterium
ILRPEIAALSMSGSSLI

SEQ ID NO: 1124556 - protein, 18 aa, Mycobacterium
ILSCGALIDGVREFPGPW

SEQ ID NO: 1124557 - protein, 27 aa, Mycobacterium
ILSMLFKLEIARGYLMIALPAGLLFLG

SEQ ID NO: 1124558 - protein, 25 aa, Mycobacterium
ILTAEAGLFIGIIALALWLMKMTVS

SEQ ID NO: 1124559 - protein, 34 aa, Mycobacterium
ILTAFGCAVWRWRRKRPVFALGILAFSSFGLLFG

SEQ ID NO: 1124560 - protein, 20 aa, Mycobacterium
ILTGVGGYVGYRQAKAGQGV

SEQ ID NO: 1124561 - protein, 17 aa, Mycobacterium
ILTSAFMRNALVGGTIV

SEQ ID NO: 1124562 - protein, 27 aa, Mycobacterium
ILVSLGAMLLRGFTFGIDFEGGTKVSL

SEQ ID NO: 1124563 - protein, 18 aa, Mycobacterium
ILVTSILVLIAFPILTAA

SEQ ID NO: 1124564 - protein, 24 aa, Mycobacterium
ILWNLSGPVTLPFVGFELPKAMFV

SEQ ID NO: 1124565 - protein, 18 aa, Mycobacterium
IMAGCYTAYVVQQLVSSA

SEQ ID NO: 1124566 - protein, 24 aa, Mycobacterium
IMATARPKVFITVAEFGRMSFQPD

SEQ ID NO: 1124567 - protein, 17 aa, Mycobacterium
IMFHISYLVLCSAPVLV

SEQ ID NO: 1124568 - protein, 17 aa, Mycobacterium
IMLAGKALTPWTRAQPR

SEQ ID NO: 1124569 - protein, 19 aa, Mycobacterium
IMLAIPFTVLTVFTINVLL

SEQ ID NO: 1124570 - protein, 18 aa, Mycobacterium
IMLEAAASSGSSPWMESI

SEQ ID NO: 1124571 - protein, 20 aa, Mycobacterium
IMMLIGMAGMLFRGRGAAQK

SEQ ID NO: 1124572 - protein, 25 aa, Mycobacterium
IMNARDFLRIDIIIFGLIVYALLGI

SEQ ID NO: 1124573 - protein, 25 aa, Mycobacterium
IMRIFAEFMPVHFFAQPVVTLMGLG

SEQ ID NO: 1124574 - protein, 24 aa, Mycobacterium
IMSSRLTYGMAEHGLLPSVLSRVL

SEQ ID NO: 1124575 - protein, 26 aa, Mycobacterium
IMSVMRYPVRVGFLVGLPLAQISEFS

SEQ ID NO: 1124576 - protein, 26 aa, Mycobacterium
INKPAEASIGWGLYLVIAFILLQAAV

SEQ ID NO: 1124577 - protein, 26 aa, Mycobacterium
INLDGGRVLVNFEIGENIAIGDRSEA

SEQ ID NO: 1124578 - protein, 19 aa, Mycobacterium
INLGPRIGRFLPDGTAVTI

SEQ ID NO: 1124579 - protein, 17 aa, Mycobacterium
INLPPPCVTGFLPPQQR

SEQ ID NO: 1124580 - protein, 17 aa, Mycobacterium
INPVLSCGSVMITPQAS

SEQ ID NO: 1124581 - protein, 17 aa, Mycobacterium
INRAGLIGFLMILMFAQ

SEQ ID NO: 1124582 - protein, 17 aa, Mycobacterium
INTDVWPVFGYLNLTMW

SEQ ID NO: 1124583 - protein, 21 aa, Mycobacterium
IPADDVFRGFAQQLGLDMEAF

SEQ ID NO: 1124584 - protein, 22 aa, Mycobacterium
IPAGAPGSHWTAPVAEEPPSEY

SEQ ID NO: 1124585 - protein, 20 aa, Mycobacterium
IPAIIRGLIAVAWYGIQTFL

SEQ ID NO: 1124586 - protein, 20 aa, Mycobacterium
IPCLPWFVDSAWNLAFGVLP

SEQ ID NO: 1124587 - protein, 18 aa, Mycobacterium
IPEAFTPGPDKRSVATTN

SEQ ID NO: 1124588 - protein, 17 aa, Mycobacterium
IPEALAITSELTVADAV

SEQ ID NO: 1124589 - protein, 21 aa, Mycobacterium
IPEVDTYLSLVVIVVILTIVT

SEQ ID NO: 1124590 - protein, 17 aa, Mycobacterium
IPFGTVWSEEATFRAAL

SEQ ID NO: 1124591 - protein, 19 aa, Mycobacterium
IPFIGGLLGVIAIVVIAVT

SEQ ID NO: 1124592 - protein, 21 aa, Mycobacterium
IPFIIISVLFYFTVVVQEKMV

SEQ ID NO: 1124593 - protein, 18 aa, Mycobacterium
IPGALFVAAATVWLTAWL

SEQ ID NO: 1124594 - protein, 19 aa, Mycobacterium
IPGATLWAGQTVQIPLYGP

SEQ ID NO: 1124595 - protein, 18 aa, Mycobacterium
IPGRLAVVQVQSGESLQH

SEQ ID NO: 1124596 - protein, 17 aa, Mycobacterium
IPHIVRRASLGPYGRDD

SEQ ID NO: 1124597 - protein, 23 aa, Mycobacterium
IPIMLWSPMGRDMFGFGVPAPFG

SEQ ID NO: 1124598 - protein, 18 aa, Mycobacterium
IPIRVPKLPDGWQANSGS

SEQ ID NO: 1124599 - protein, 20 aa, Mycobacterium
IPKFRISPDYFAKLQSTDTW

SEQ ID NO: 1124600 - protein, 17 aa, Mycobacterium
IPLARELFILDPSNTAL

SEQ ID NO: 1124601 - protein, 20 aa, Mycobacterium
IPLFASDPFWLVAARTVAGA

SEQ ID NO: 1124602 - protein, 21 aa, Mycobacterium
IPLLALLVMSGRAWNRLYRAL

SEQ ID NO: 1124603 - protein, 22 aa, Mycobacterium
IPLYCIAVWMSFMSARFATTVY

SEQ ID NO: 1124604 - protein, 21 aa, Mycobacterium
IPLYCVAVMMAFLAARFGTTV

SEQ ID NO: 1124605 - protein, 26 aa, Mycobacterium
IPLYCVGVLMAFWAARFGTTVIYGQS

SEQ ID NO: 1124606 - protein, 21 aa, Mycobacterium
IPMGVPLEWNVFMMFSVLALF

SEQ ID NO: 1124607 - protein, 17 aa, Mycobacterium
IPPPCTTGFLPVQQMRP

SEQ ID NO: 1124608 - protein, 17 aa, Mycobacterium
IPPPVYVPPPDRSPITG

SEQ ID NO: 1124609 - protein, 19 aa, Mycobacterium
IPQSLWLIGCLVVLVCTLA

SEQ ID NO: 1124610 - protein, 23 aa, Mycobacterium
IPTVIAVAVGGLFAIAVSTVVQM

SEQ ID NO: 1124611 - protein, 24 aa, Mycobacterium
IPTYLFMAGMFVMLGWGLFQIYVL

SEQ ID NO: 1124612 - protein, 32 aa, Mycobacterium
IPVRADTALARFLLRFAANCRPSAWERAVRAN

SEQ ID NO: 1124613 - protein, 22 aa, Mycobacterium
IPVSIVSLVLVYGFVGVFVNAV

SEQ ID NO: 1124614 - protein, 18 aa, Mycobacterium
IPVTAMKLNGSVLVVTEE

SEQ ID NO: 1124615 - protein, 18 aa, Mycobacterium
IPVTASFVIGWVIIGPAL

SEQ ID NO: 1124616 - protein, 18 aa, Mycobacterium
IQGAIPLVGSFVTGVTTN

SEQ ID NO: 1124617 - protein, 27 aa, Mycobacterium
IQIYGDWPSFFALMAWFSSVSGVDSLT

SEQ ID NO: 1124618 - protein, 17 aa, Mycobacterium
IQLAIFAVIALAAMAIM

SEQ ID NO: 1124619 - protein, 17 aa, Mycobacterium
IQLALFMAVTLGAFGVL

SEQ ID NO: 1124620 - protein, 17 aa, Mycobacterium
IQLGFVIGVGLLLDTFI

SEQ ID NO: 1124621 - protein, 17 aa, Mycobacterium
IQLGVFLAVALTAFSIM

SEQ ID NO: 1124622 - protein, 17 aa, Mycobacterium
IQLLVFAVASLIAGLVM

SEQ ID NO: 1124623 - protein, 20 aa, Mycobacterium
IQPALQFYVGFFIVLLGVTW

SEQ ID NO: 1124624 - protein, 18 aa, Mycobacterium
IQVVIAWFGYRVIAAFER

SEQ ID NO: 1124625 - protein, 23 aa, Mycobacterium
IRAGELPTAMALNSIPMTIGRII

SEQ ID NO: 1124626 - protein, 23 aa, Mycobacterium
IRALPGWLPYAVLLPVAAVVLLG

SEQ ID NO: 1124627 - protein, 19 aa, Mycobacterium
IRATTAFGAKYVDLIYPSD

SEQ ID NO: 1124628 - protein, 17 aa, Mycobacterium
IRDDHRYLWAGLVLLAC

SEQ ID NO: 1124629 - protein, 17 aa, Mycobacterium
IRDEARVAGRQVVDEKR

SEQ ID NO: 1124630 - protein, 17 aa, Mycobacterium
IREIYRPGLDLVRQGGV

SEQ ID NO: 1124631 - protein, 21 aa, Mycobacterium
IRELPGYWAPFASPLVTLIAI

SEQ ID NO: 1124632 - protein, 18 aa, Mycobacterium
IRGAGLLLVIMAAGGLAK

SEQ ID NO: 1124633 - protein, 17 aa, Mycobacterium
IRGTGRLVIGVNVPYAP

SEQ ID NO: 1124634 - protein, 18 aa, Mycobacterium
IRHLDPWSALFASAGLVV

SEQ ID NO: 1124635 - protein, 17 aa, Mycobacterium
IRKAAGELAELFDRRTP

SEQ ID NO: 1124636 - protein, 20 aa, Mycobacterium
IRKFLRYLLSSNMGEVLTVF

SEQ ID NO: 1124637 - protein, 17 aa, Mycobacterium
IRLAMYIAPIGVFCLLA

SEQ ID NO: 1124638 - protein, 23 aa, Mycobacterium
IRLARTWSLAVSMVVLVLIPVIA

SEQ ID NO: 1124639 - protein, 21 aa, Mycobacterium
IRLASPFILLAVWQLGSAVGL

SEQ ID NO: 1124640 - protein, 19 aa, Mycobacterium
IRLGRPGWLDAGALADAVV

SEQ ID NO: 1124641 - protein, 23 aa, Mycobacterium
IRLSPVPMLSWLGTAYVNVIRNT

SEQ ID NO: 1124642 - protein, 26 aa, Mycobacterium
IRLSRPHAPWARWRYTKRPRKMHRAL

SEQ ID NO: 1124643 - protein, 33 aa, Mycobacterium; identical to SEQ ID NO: 313478

SEQ ID NO: 1124644 - protein, 18 aa, Mycobacterium
IRPRQWVKNLLVLAAPIA

SEQ ID NO: 1124645 - protein, 30 aa, Mycobacterium
IRPSDVMVRIWLCAAILVPAVRLMRSVTQR

SEQ ID NO: 1124646 - protein, 18 aa, Mycobacterium
IRQPPMAGVVTPRDAAIA

SEQ ID NO: 1124647 - protein, 17 aa, Mycobacterium
IRQRTLLYLAIVVLSAA

SEQ ID NO: 1124648 - protein, 19 aa, Mycobacterium
IRRLLPALVVVLAVSAVLT

SEQ ID NO: 1124649 - protein, 20 aa, Mycobacterium
IRRRPERFVLAVLGIALAIA

SEQ ID NO: 1124650 - protein, 23 aa, Mycobacterium
IRSHAGTTFGGWGAVLTGVHLAA

SEQ ID NO: 1124651 - protein, 25 aa, Mycobacterium
IRSSPVIRRILLRTVLFTAPASALW

SEQ ID NO: 1124652 - protein, 20 aa, Mycobacterium
IRVAVVPVWAHGQVGDLVTH

SEQ ID NO: 1124653 - protein, 18 aa, Mycobacterium
IRVRIGIHTGKSVRRGED

SEQ ID NO: 1124654 - protein, 17 aa, Mycobacterium
IRWLELWAGELSNVALA

SEQ ID NO: 1124655 - protein, 23 aa, Mycobacterium
ISAAALFLLFGFYMVFDNLLPTA

SEQ ID NO: 1124656 - protein, 34 aa, Mycobacterium
ISALEIMRMRLTPAAFERGAALAATFAGDDAVAG

SEQ ID NO: 1124657 - protein, 21 aa, Mycobacterium
ISALHRPVPLSGDGSDTDTVI

SEQ ID NO: 1124658 - protein, 17 aa, Mycobacterium
ISARIDTVVMDKTGTLT

SEQ ID NO: 1124659 - protein, 17 aa, Mycobacterium
ISARSGLSMDPGAKVTY

SEQ ID NO: 1124660 - protein, 17 aa, Mycobacterium
ISATNWLLGSVVFIVAS

SEQ ID NO: 1124661 - protein, 26 aa, Mycobacterium
ISDGAVFCGLLWWAAFGLHSTGLVVA

SEQ ID NO: 1124662 - protein, 25 aa, Mycobacterium
ISFESFRSAWMVQYVVWALAVVGIL

SEQ ID NO: 1124663 - protein, 24 aa, Mycobacterium
ISFEVRGGLFVRQVHHWAALLFAA

SEQ ID NO: 1124664 - protein, 21 aa, Mycobacterium
ISGCLSLWGVMTMLGGAVQSG

SEQ ID NO: 1124665 - protein, 19 aa, Mycobacterium
ISGDGRFAYLRTGGRTTVV

SEQ ID NO: 1124666 - protein, 23 aa, Mycobacterium
ISGEIPGGGTATVVFSREQNSGV

SEQ ID NO: 1124667 - protein, 17 aa, Mycobacterium
ISGPFGWVRNPIFTAVL

SEQ ID NO: 1124668 - protein, 27 aa, Mycobacterium
ISIGRSLPFLILMAAIMPFTRFITGTN

SEQ ID NO: 1124669 - protein, 25 aa, Mycobacterium
ISLDGPRVLVTFKILGNINLGEQTE

SEQ ID NO: 1124670 - protein, 19 aa, Mycobacterium
ISLFFWPTPAVPLVGAVLI

SEQ ID NO: 1124671 - protein, 17 aa, Mycobacterium
ISLFGWFLLLRGLALLT

SEQ ID NO: 1124672 - protein, 32 aa, Mycobacterium; identical to SEQ ID NO: 313580

SEQ ID NO: 1124673 - protein, 23 aa, Mycobacterium
ISLLKRLGLTPIMVTGDNEAVAR

SEQ ID NO: 1124674 - protein, 17 aa, Mycobacterium
ISLPIALGLLIMMYPVL

SEQ ID NO: 1124675 - protein, 25 aa, Mycobacterium
ISNLKVPQWFRGLMPVVIVPLGASL

SEQ ID NO: 1124676 - protein, 20 aa, Mycobacterium
ISPAAALAAPWHELLVDVDP

SEQ ID NO: 1124677 - protein, 18 aa, Mycobacterium
ISPKKSWEGLAGSLVLGV

SEQ ID NO: 1124678 - protein, 20 aa, Mycobacterium
ISPPDARGRVAGLFSSGFMV

SEQ ID NO: 1124679 - protein, 17 aa, Mycobacterium
ISPQRLLGVLLQEHDED

SEQ ID NO: 1124680 - protein, 17 aa, Mycobacterium
ISQVLLRTILQVPTEAL

SEQ ID NO: 1124681 - protein, 24 aa, Mycobacterium
ISREVAPRHGIKVGFRGLADSNTI

SEQ ID NO: 1124682 - protein, 19 aa, Mycobacterium
ISSKGFEWDTACPADQWRH

SEQ ID NO: 1124683 - protein, 26 aa, Mycobacterium
ISSQFGVSIPDFWMGILLIALFSTVL

SEQ ID NO: 1124684 - protein, 17 aa, Mycobacterium
ISVAELLAKNGTIGSPP

SEQ ID NO: 1124685 - protein, 24 aa, Mycobacterium
ISVLGVGVNLFWVIFDLLILSVVI

SEQ ID NO: 1124686 - protein, 25 aa, Mycobacterium
ISVLRLVPHWFAPRQIPVVTQLTGI

SEQ ID NO: 1124687 - protein, 24 aa, Mycobacterium
ISWTHHWVWLIPLMIWLLHGPLRA

SEQ ID NO: 1124688 - protein, 24 aa, Mycobacterium
ITAFACVWYFRRTLFESTRNLFFR

SEQ ID NO: 1124689 - protein, 17 aa, Mycobacterium
ITAGLFAAVGLLPRQNN

SEQ ID NO: 1124690 - protein, 34 aa, Mycobacterium
ITALIMGGLWARFGLPRWITRRVPHEHSTGGSRW

SEQ ID NO: 1124691 - protein, 17 aa, Mycobacterium
ITALLTLAGRAVGWLSF

SEQ ID NO: 1124692 - protein, 23 aa, Mycobacterium
ITDGSLTYRGWFGVKRLTSADIE

SEQ ID NO: 1124693 - protein, 19 aa, Mycobacterium
ITDGWWVYLAAYAIFIGIH

SEQ ID NO: 1124694 - protein, 28 aa, Mycobacterium
ITDRWRGLRWALAAVVAIVAVAALTTWL

SEQ ID NO: 1124695 - protein, 23 aa, Mycobacterium
ITEHTTHWGLYIDDFWWTAVWAG

SEQ ID NO: 1124696 - protein, 18 aa, Mycobacterium
ITELPRIGSATDDVERTQ

SEQ ID NO: 1124697 - protein, 22 aa, Mycobacterium
ITFDALFAFFFVANWHFAAAGT

SEQ ID NO: 1124698 - protein, 24 aa, Mycobacterium
ITFMAWSGVLGFLIGSVTVTLLQA

SEQ ID NO: 1124699 - protein, 21 aa, Mycobacterium
ITIMLVLFFRSIVTTLLILVM

SEQ ID NO: 1124700 - protein, 25 aa, Mycobacterium
ITLAGVCLWGARARRGSRLFTVDPT

SEQ ID NO: 1124701 - protein, 18 aa, Mycobacterium
ITLFVLVVITLVFGGFGV

SEQ ID NO: 1124702 - protein, 25 aa, Mycobacterium
ITLLPSLIVLAGRRGWLTPRKDLTG

SEQ ID NO: 1124703 - protein, 17 aa, Mycobacterium
ITLPGSIYLGIIAVLPN

SEQ ID NO: 1124704 - protein, 18 aa, Mycobacterium
ITLPLLLWAGRPAALATA

SEQ ID NO: 1124705 - protein, 17 aa, Mycobacterium
ITMGIPIVGTWMHWALF

SEQ ID NO: 1124706 - protein, 30 aa, Mycobacterium
ITPLLAVLLRIDWPNFLPLITSESSRTALL

SEQ ID NO: 1124707 - protein, 32 aa, Mycobacterium
ITPMLPGMAVFRAVFYFAVERDFAAGMAQALA

SEQ ID NO: 1124708 - protein, 24 aa, Mycobacterium
ITPREIKLAATYFLVTPLIVLTGT

SEQ ID NO: 1124709 - protein, 24 aa, Mycobacterium
ITSEADGGLAPASRISSFAAEDKP

SEQ ID NO: 1124710 - protein, 19 aa, Mycobacterium
ITTMIRSGVTFDVAGAILI

SEQ ID NO: 1124711 - protein, 18 aa, Mycobacterium
ITTVLSFLLVGHYAERAT

SEQ ID NO: 1124712 - protein, 24 aa, Mycobacterium
ITVIVAICLRQFVASWENRRLMRM

SEQ ID NO: 1124713 - protein, 19 aa, Mycobacterium
ITVLPAILGILGRNVDALG

SEQ ID NO: 1124714 - protein, 28 aa, Mycobacterium
ITVPAIAALVGRANWWPSKVGPQQAAPR

SEQ ID NO: 1124715 - protein, 23 aa, Mycobacterium
ITYLLPVLIGYTGGRMVHGNRGA

SEQ ID NO: 1124716 - protein, 18 aa, Mycobacterium
IVASHGLGSIALVTLLGG

SEQ ID NO: 1124717 - protein, 22 aa, Mycobacterium
IVAVCLAAPLWADYVAHTGPND

SEQ ID NO: 1124718 - protein, 20 aa, Mycobacterium
IVAYLTVALVIRFVVHRMID

SEQ ID NO: 1124719 - protein, 23 aa, Mycobacterium
IVDRLKELIKYKGYQVPPAELEA

SEQ ID NO: 1124720 - protein, 23 aa, Mycobacterium
IVELRKALFDAFQPKGADGQPSE

SEQ ID NO: 1124721 - protein, 25 aa, Mycobacterium
IVFLAGSLPLVFLAYRSGIRSSRSS

SEQ ID NO: 1124722 - protein, 30 aa, Mycobacterium
IVGASMDWHSLGALGPRWLVVVGVSCFSLV

SEQ ID NO: 1124723 - protein, 21 aa, Mycobacterium
IVGGIDWDGHGLLGLEDSMDS

SEQ ID NO: 1124724 - protein, 29 aa, Mycobacterium
IVGVARLRPRFASLVGLSEVMFAVLAAWV

SEQ ID NO: 1124725 - protein, 20 aa, Mycobacterium
IVGWALACSVPVVLVGAAVV

SEQ ID NO: 1124726 - protein, 19 aa, Mycobacterium
IVIAILMFFSIGFVPLDQY

SEQ ID NO: 1124727 - protein, 24 aa, Mycobacterium
IVIPVAGVLYMLGRLARRTAAGSW

SEQ ID NO: 1124728 - protein, 19 aa, Mycobacterium
IVLALANLLWFVFAGLGAL

SEQ ID NO: 1124729 - protein, 18 aa, Mycobacterium
IVLALRWLLIHTPKARVK

SEQ ID NO: 1124730 - protein, 19 aa, Mycobacterium
IVLALRWLLIHTPKARVKA

SEQ ID NO: 1124731 - protein, 25 aa, Mycobacterium
IVLANPRWFAVLLVIPVVASVYIMR

SEQ ID NO: 1124732 - protein, 17 aa, Mycobacterium
IVLLVWVVLAVLNVLGV

SEQ ID NO: 1124733 - protein, 17 aa, Mycobacterium
IVLSVLWSIAIVAIIIA

SEQ ID NO: 1124734 - protein, 17 aa, Mycobacterium
IVPAYVVTVVAVFEIYT

SEQ ID NO: 1124735 - protein, 18 aa, Mycobacterium
IVPPRLPAPAALVTITGV

SEQ ID NO: 1124736 - protein, 18 aa, Mycobacterium
IVRPRRRSIFFPHYNYDE

SEQ ID NO: 1124737 - protein, 22 aa, Mycobacterium
IVSALHRPVPLSGDGSDTDTVI

SEQ ID NO: 1124738 - protein, 18 aa, Mycobacterium
IVSPAWYSPLVLTVGSIA

SEQ ID NO: 1124739 - protein, 24 aa, Mycobacterium
IVSRCVLPRLGRRVADNRVAVLTG

SEQ ID NO: 1124740 - protein, 18 aa, Mycobacterium
IVSVRINVLLTYYVNDLF

SEQ ID NO: 1124741 - protein, 25 aa, Mycobacterium
IVTLLWLILRLEIIVVPVALATILA

SEQ ID NO: 1124742 - protein, 22 aa, Mycobacterium
IVVAICWAVAGAVLVALAALRE

SEQ ID NO: 1124743 - protein, 23 aa, Mycobacterium
IVVANALRLLGMPMQSINPAAPR

SEQ ID NO: 1124744 - protein, 22 aa, Mycobacterium
IVVANALRLLGMPMQSVTPAAP

SEQ ID NO: 1124745 - protein, 19 aa, Mycobacterium
IVVAVCLRQVVAAWENRQL

SEQ ID NO: 1124746 - protein, 27 aa, Mycobacterium
IVVAWAALVIYAWRTSRGPKFAPEPAA

SEQ ID NO: 1124747 - protein, 22 aa, Mycobacterium
IVVRRGGRMGALVNYISISPLA

SEQ ID NO: 1124748 - protein, 21 aa, Mycobacterium
IVVVFLVTWPLVYMASKSTLW

SEQ ID NO: 1124749 - protein, 25 aa, Mycobacterium
IWAGLSAFMVLRLVFVGWRALSGRW

SEQ ID NO: 1124750 - protein, 23 aa, Mycobacterium
IWGVWHWPLPWVGYFGGETPVAE

SEQ ID NO: 1124751 - protein, 17 aa, Mycobacterium
IWIAVPAFAPAIVVAGV

SEQ ID NO: 1124752 - protein, 41 aa, Mycobacterium
IWRLAIFVTVCGLTLFGLYAVFGQWRFQAEKKYNAEFTNVG

SEQ ID NO: 1124753 - protein, 19 aa, Mycobacterium
IWVAFWFFLAQLNFVLGAV

SEQ ID NO: 1124754 - protein, 33 aa, Mycobacterium
IWVRLRAPWAKGLVEFMCLLPLTIPALVIVVGL

SEQ ID NO: 1124755 - protein, 22 aa, Mycobacterium
IYAGLLTPWWLRLLGAKVGKGT

SEQ ID NO: 1124756 - protein, 18 aa, Mycobacterium
IYALMALVRGELIPGPGH

SEQ ID NO: 1124757 - protein, 31 aa, Mycobacterium
IYDIALWAVPFGLIGGRLYHVITDWQTYFGP

SEQ ID NO: 1124758 - protein, 18 aa, Mycobacterium
IYELMVWVAVLHNRQTRG

SEQ ID NO: 1124759 - protein, 20 aa, Mycobacterium
IYFATEWVVSASWRGYYAYR

SEQ ID NO: 1124760 - protein, 18 aa, Mycobacterium
IYGLAASVLPVWLLLAPR

SEQ ID NO: 1124761 - protein, 29 aa, Mycobacterium
IYGRERLGPWWGFIAGWGFVVGKTASCAA

SEQ ID NO: 1124762 - protein, 19 aa, Mycobacterium
IYLPICYALPGPAFRASRR

SEQ ID NO: 1124763 - protein, 18 aa, Mycobacterium
IYPGVGFIGLLFVVVWLL

SEQ ID NO: 1124764 - protein, 23 aa, Mycobacterium
IYQHKLWLGQVLEANPDFQEEAA

SEQ ID NO: 1124765 - protein, 18 aa, Mycobacterium
IYSELAASWLWVVASGGL

SEQ ID NO: 1124766 - protein, 24 aa, Mycobacterium
IYVPGGAGLYWLVRHYWKHPGDRE

SEQ ID NO: 1124767 - protein, 26 aa, Mycobacterium
IYYPVSAIMWVWYKAFAFLIGLIPGV

SEQ ID NO: 1124768 - protein, 19 aa, Mycobacterium
KAADIGVAMGRSGTEVAKE

SEQ ID NO: 1124769 - protein, 17 aa, Mycobacterium
KAAEAARLAETASSRRD

SEQ ID NO: 1124770 - protein, 26 aa, Mycobacterium
KAAQLPFSFWLSRAMSGPSPVSALLH

SEQ ID NO: 1124771 - protein, 17 aa, Mycobacterium
KADRRFAVVYVDDHSEY

SEQ ID NO: 1124772 - protein, 19 aa, Mycobacterium
KAFGWWGGPGLGGFQDSLA

SEQ ID NO: 1124773 - protein, 19 aa, Mycobacterium
KAGESVRIAGIRVGTVKNV

SEQ ID NO: 1124774 - protein, 24 aa, Mycobacterium
KAGEVKGEVKGLVTQGKEGQTKDV

SEQ ID NO: 1124775 - protein, 19 aa, Mycobacterium
KAGFYTGWLNLIGLIAILA

SEQ ID NO: 1124776 - protein, 18 aa, Mycobacterium
KAGLIAGAVGLAAVLLYS

SEQ ID NO: 1124777 - protein, 24 aa, Mycobacterium
KAIPLGGFCDIAGMTAVEELDPED

SEQ ID NO: 1124778 - protein, 22 aa, Mycobacterium
KAIRRVLAERDFEVVFQAVHDA

SEQ ID NO: 1124779 - protein, 27 aa, Mycobacterium
KALVIGAWLGVAVILAVVFPQLETVVR

SEQ ID NO: 1124780 - protein, 24 aa, Mycobacterium
KAPKGARRRIVFRFRTSPIEIKGG

SEQ ID NO: 1124781 - protein, 18 aa, Mycobacterium
KATAGKPLMRTMAMMAGG

SEQ ID NO: 1124782 - protein, 17 aa, Mycobacterium
KAVAVGLAAMFVLTGVA

SEQ ID NO: 1124783 - protein, 17 aa, Mycobacterium
KAVLSMYEDFLCPHCGA

SEQ ID NO: 1124784 - protein, 24 aa, Mycobacterium
KAVSQRAGWSFPLGTLAVNVSGAL

SEQ ID NO: 1124785 - protein, 25 aa, Mycobacterium
KDDPEEFWLLLAGRRLDARDRRVLG

SEQ ID NO: 1124786 - protein, 17 aa, Mycobacterium
KDGRPSTVPAFVGDDTL

SEQ ID NO: 1124787 - protein, 24 aa, Mycobacterium
KDHLELGESLGLIDMERGAKVSGS

SEQ ID NO: 1124788 - protein, 18 aa, Mycobacterium
KDMFSDPLSIVLAVVIVV

SEQ ID NO: 1124789 - protein, 29 aa, Mycobacterium
KDNILTHLRKGLMGWLFGALAEGGVELPD

SEQ ID NO: 1124790 - protein, 24 aa, Mycobacterium
KDRKSEIWAAFLFGLSISPVLFSL

SEQ ID NO: 1124791 - protein, 25 aa, Mycobacterium
KDRTEPALDLDLLLGGLKPVIRGLN

SEQ ID NO: 1124792 - protein, 25 aa, Mycobacterium
KDTIRRTGLSFVRYAEPIDWNGKPA

SEQ ID NO: 1124793 - protein, 24 aa, Mycobacterium
KDTRGIIRVHQFDKVEGFVYCRPE

SEQ ID NO: 1124794 - protein, 18 aa, Mycobacterium
KDVAGRDAFPASFVVKLN

SEQ ID NO: 1124795 - protein, 27 aa, Mycobacterium
KDVESFDGFEYLFWVGCAGAYEDRAKK

SEQ ID NO: 1124796 - protein, 17 aa, Mycobacterium
KEDYEAAGVPMLPVVAT

SEQ ID NO: 1124797 - protein, 17 aa, Mycobacterium
KEGGYFTMGRWGLPVNI

SEQ ID NO: 1124798 - protein, 17 aa, Mycobacterium
KEIPPPVYVPPPDRSPI

SEQ ID NO: 1124799 - protein, 17 aa, Mycobacterium
KEKRLPSFAAELVAFSG

SEQ ID NO: 1124800 - protein, 19 aa, Mycobacterium
KELLALHFSPTRPSTDEWS

SEQ ID NO: 1124801 - protein, 18 aa, Mycobacterium
KELVISTKMSSEWSKDQV

SEQ ID NO: 1124802 - protein, 20 aa, Mycobacterium
KEPLLIWTLIASLFIGNFLL

SEQ ID NO: 1124803 - protein, 21 aa, Mycobacterium
KFGAWMGFATLWAVLVYFPVA

SEQ ID NO: 1124804 - protein, 19 aa, Mycobacterium
KFRSLFWRIMRQGRAYHMF

SEQ ID NO: 1124805 - protein, 19 aa, Mycobacterium
KFSDEILLPAARERAVRSE

SEQ ID NO: 1124806 - protein, 18 aa, Mycobacterium
KGEFTLDAPPPVPRPTGG

SEQ ID NO: 1124807 - protein, 21 aa, Mycobacterium
KGHFEFAKGALIAVLGVVAFE

SEQ ID NO: 1124808 - protein, 17 aa, Mycobacterium
KGIGFLIMNARDFLRID

SEQ ID NO: 1124809 - protein, 17 aa, Mycobacterium
KGLIHTWYLVGRRNDTA

SEQ ID NO: 1124810 - protein, 19 aa, Mycobacterium
KGLLFFLAVMPQFVVPTTP

SEQ ID NO: 1124811 - protein, 22 aa, Mycobacterium
KGPSCFTAPLVPTRPELPDVLL

SEQ ID NO: 1124812 - protein, 18 aa, Mycobacterium
KGQWEAAETIGLNYAGTL

SEQ ID NO: 1124813 - protein, 18 aa, Mycobacterium
KGVGWLLFVLPIAAILTQ

SEQ ID NO: 1124814 - protein, 17 aa, Mycobacterium
KHRFGAPALIVGSGPIT

SEQ ID NO: 1124815 - protein, 18 aa, Mycobacterium
KIANYRFTDLVADANPIA

SEQ ID NO: 1124816 - protein, 17 aa, Mycobacterium
KIARWVATIAGLLGFVL

SEQ ID NO: 1124817 - protein, 24 aa, Mycobacterium
KIHYFRLEAGLIVYEICVTAQTEL

SEQ ID NO: 1124818 - protein, 18 aa, Mycobacterium
KILLYILVAWLIVLTTSG

SEQ ID NO: 1124819 - protein, 23 aa, Mycobacterium
KIPEARRVLSMLLGKKNLEITIT

SEQ ID NO: 1124820 - protein, 20 aa, Mycobacterium
KIPIRLPALPDGWRSNSGGR

SEQ ID NO: 1124821 - protein, 28 aa, Mycobacterium
KIQLFVLLCGIVGPIFLVIYFATGADPM

SEQ ID NO: 1124822 - protein, 18 aa, Mycobacterium
KISLPIVRPRRRSIFFPH

SEQ ID NO: 1124823 - protein, 21 aa, Mycobacterium
KITEVKGRGYADAYMDYEDDP

SEQ ID NO: 1124824 - protein, 20 aa, Mycobacterium
KITLPNMKAAIMVALLFRTL

SEQ ID NO: 1124825 - protein, 27 aa, Mycobacterium
KITSARFFARTALPGILAIRAAVEAED

SEQ ID NO: 1124826 - protein, 19 aa, Mycobacterium
KKRPAWMVGGLTVLSFVVL

SEQ ID NO: 1124827 - protein, 25 aa, Mycobacterium
KKTDSRLAARLAALASLGAAVIHFA

SEQ ID NO: 1124828 - protein, 21 aa, Mycobacterium
KKYVNRMAGFLGWNLSISQAQ

SEQ ID NO: 1124829 - protein, 18 aa, Mycobacterium
KLAVLVVPIWWAAGHSAL

SEQ ID NO: 1124830 - protein, 22 aa, Mycobacterium
KLDLFPDQIKYIPANVEARIRA

SEQ ID NO: 1124831 - protein, 19 aa, Mycobacterium
KLEASPAFEGRPDRGEVEA

SEQ ID NO: 1124832 - protein, 21 aa, Mycobacterium
KLGGATGELGAPVADQTQNGD

SEQ ID NO: 1124833 - protein, 25 aa, Mycobacterium
KLGIPSFVVTLAFFLGLQGVTLKLI

SEQ ID NO: 1124834 - protein, 29 aa, Mycobacterium
KLLGDDCWWAPRWMKRVQEKLGLGETELP

SEQ ID NO: 1124835 - protein, 17 aa, Mycobacterium
KLLLSSLLLNWVLGPAL

SEQ ID NO: 1124836 - protein, 26 aa, Mycobacterium
KLNGLSRKFFDEVWMHDRDVGNMRVN

SEQ ID NO: 1124837 - protein, 23 aa, Mycobacterium
KLQRPGSRIGVERTEPALNLDLL

SEQ ID NO: 1124838 - protein, 25 aa, Mycobacterium
KLSTLDRFLPVWIGAAMVAGLLLGR

SEQ ID NO: 1124839 - protein, 18 aa, Mycobacterium
KLTKPVWLVILGVGVLLA

SEQ ID NO: 1124840 - protein, 18 aa, Mycobacterium
KLTRLHRAGLLIGACAVA

SEQ ID NO: 1124841 - protein, 25 aa, Mycobacterium
KLVERLRPSLPVLLANLTGIADVAL

SEQ ID NO: 1124842 - protein, 18 aa, Mycobacterium
KLVIAAAVASAVFVGASG

SEQ ID NO: 1124843 - protein, 25 aa, Mycobacterium
KMFEYFRYRLRYALLVDGATFVVHV

SEQ ID NO: 1124844 - protein, 19 aa, Mycobacterium
KMPFYRSLISATNWLLGSV

SEQ ID NO: 1124845 - protein, 18 aa, Mycobacterium
KNAMPLIVATLVFGIVVI

SEQ ID NO: 1124846 - protein, 19 aa, Mycobacterium
KNFPVRQLITNTGWGRGVD

SEQ ID NO: 1124847 - protein, 24 aa, Mycobacterium
KNIPSLRYLSYRLSLQRDGGDWRI

SEQ ID NO: 1124848 - protein, 20 aa, Mycobacterium
KNWPVRHLVTDTGYGTGLDL

SEQ ID NO: 1124849 - protein, 19 aa, Mycobacterium
KPADMKRVVKRRGQESFNF

SEQ ID NO: 1124850 - protein, 18 aa, Mycobacterium
KPGKRAPTARMCESLEEY

SEQ ID NO: 1124851 - protein, 22 aa, Mycobacterium
KPGPRPGALVGNVIWVIVAGVW

SEQ ID NO: 1124852 - protein, 17 aa, Mycobacterium
KPKTAAYRAVWRNHRQH

SEQ ID NO: 1124853 - protein, 20 aa, Mycobacterium
KPLARLHERIGFSETLDDSS

SEQ ID NO: 1124854 - protein, 19 aa, Mycobacterium
KPLLTMLFLRAGAAGGLLT

SEQ ID NO: 1124855 - protein, 19 aa, Mycobacterium
KPLPSHRLLLGSVLAAAVF

SEQ ID NO: 1124856 - protein, 20 aa, Mycobacterium
KPPTRRPVRGLVTAILLAVA

SEQ ID NO: 1124857 - protein, 18 aa, Mycobacterium
KPSYGMAEATLFVSTTAP

SEQ ID NO: 1124858 - protein, 17 aa, Mycobacterium
KPTLPVLLANLTTIGQV

SEQ ID NO: 1124859 - protein, 18 aa, Mycobacterium
KQFGREWHEYAARTPAFV

SEQ ID NO: 1124860 - protein, 18 aa, Mycobacterium
KQLWRRVQSAVSMLLGGN

SEQ ID NO: 1124861 - protein, 20 aa, Mycobacterium
KQTWTSYNIFAFWMSDVHSV

SEQ ID NO: 1124862 - protein, 21 aa, Mycobacterium
KRALADITFDFQQRVDAAART

SEQ ID NO: 1124863 - protein, 19 aa, Mycobacterium
KRAPTARMCESLEEYVPLN

SEQ ID NO: 1124864 - protein, 17 aa, Mycobacterium
KRDIVAYVREAAETPTP

SEQ ID NO: 1124865 - protein, 24 aa, Mycobacterium
KRFLPNRWWSVSALDGLVAAVLVW

SEQ ID NO: 1124866 - protein, 18 aa, Mycobacterium
KRFVLLCGGAATAGCVAL

SEQ ID NO: 1124867 - protein, 18 aa, Mycobacterium
KRGALREAAILISIALVL

SEQ ID NO: 1124868 - protein, 19 aa, Mycobacterium
KRGELRIYLGAAPGVGKTY

SEQ ID NO: 1124869 - protein, 25 aa, Mycobacterium
KRIAIGSLRNKIVFILPAALLLSQF

SEQ ID NO: 1124870 - protein, 20 aa, Mycobacterium
KRIVQPFGEYLPWRDFFSKL

SEQ ID NO: 1124871 - protein, 20 aa, Mycobacterium
KRLPSFAAELVAFSGAMFGL

SEQ ID NO: 1124872 - protein, 28 aa, Mycobacterium
KRREICRQRMGPVFKRITMNFPPLLAHP

SEQ ID NO: 1124873 - protein, 22 aa, Mycobacterium
KRRFGFPTKHNIVYTEGERPSD

SEQ ID NO: 1124874 - protein, 21 aa, Mycobacterium
KRRKEMRGPKLSREERKAERM

SEQ ID NO: 1124875 - protein, 20 aa, Mycobacterium
KRRSGLHLLVLGALLAIVVA

SEQ ID NO: 1124876 - protein, 22 aa, Mycobacterium
KRSLAVIGGVVGVLAAVVIAAV

SEQ ID NO: 1124877 - protein, 18 aa, Mycobacterium
KRSRLHPWIGRIYVCTAI

SEQ ID NO: 1124878 - protein, 18 aa, Mycobacterium
KRTARLVGDVPIYDVIIG

SEQ ID NO: 1124879 - protein, 21 aa, Mycobacterium
KRVWLPVLVIAAVAVGAVTVA

SEQ ID NO: 1124880 - protein, 19 aa, Mycobacterium
KRWGHQWMIITCWMGILIW

SEQ ID NO: 1124881 - protein, 18 aa, Mycobacterium
KRWGHQWMIITCWMGVLI

SEQ ID NO: 1124882 - protein, 18 aa, Mycobacterium
KRWGHQWMIVTCWMGVLI

SEQ ID NO: 1124883 - protein, 17 aa, Mycobacterium
KSAMMVMLVLYPTVMLL

SEQ ID NO: 1124884 - protein, 21 aa, Mycobacterium
KSGLTALTWPVVANFAVDAAM

SEQ ID NO: 1124885 - protein, 22 aa, Mycobacterium
KSIELDGSLALVTFTVARDIRL

SEQ ID NO: 1124886 - protein, 18 aa, Mycobacterium
KSIVGRMDWLGGRAELST

SEQ ID NO: 1124887 - protein, 23 aa, Mycobacterium
KSMRAAMAGHMFTFIPGPALIGA

SEQ ID NO: 1124888 - protein, 37 aa, Mycobacterium
KSRKFSVWGVLAWLVGLGFFFPVFWMILTSFKQEGDA

SEQ ID NO: 1124889 - protein, 18 aa, Mycobacterium
KSRLDSVMDNYRGWLHRM

SEQ ID NO: 1124890 - protein, 20 aa, Mycobacterium
KTGAVKVMDFGIARALADAG

SEQ ID NO: 1124891 - protein, 26 aa, Mycobacterium
KTGAVVLSGFVERVGDPVPLVAADGN

SEQ ID NO: 1124892 - protein, 25 aa, Mycobacterium
KTGELWFKGPNVMAGYLNNDEATRS

SEQ ID NO: 1124893 - protein, 17 aa, Mycobacterium
KTQLVAMMFALRYRWWV

SEQ ID NO: 1124894 - protein, 19 aa, Mycobacterium
KTSEVDWVLDRLGRELDML

SEQ ID NO: 1124895 - protein, 19 aa, Mycobacterium
KTTDLRGQFWIWAGANIAP

SEQ ID NO: 1124896 - protein, 17 aa, Mycobacterium
KTTLLMQTPGVFFAEDA

SEQ ID NO: 1124897 - protein, 25 aa, Mycobacterium
KTVWLRPGTRLGFFTHMGTQFSITV

SEQ ID NO: 1124898 - protein, 19 aa, Mycobacterium
KVAAGKAWVKGKVDAGKKW

SEQ ID NO: 1124899 - protein, 21 aa, Mycobacterium
KVGARIILLNSEFSGPQIKEV

SEQ ID NO: 1124900 - protein, 17 aa, Mycobacterium
KVGYWTQHFQYRNARDA

SEQ ID NO: 1124901 - protein, 24 aa, Mycobacterium
KVHRHWGFGGGPHRCLGSHLARIE

SEQ ID NO: 1124902 - protein, 20 aa, Mycobacterium
KVKLHAFIALVLVSLLTALA

SEQ ID NO: 1124903 - protein, 20 aa, Mycobacterium
KVLFICAAAGLAIGSAGLDS

SEQ ID NO: 1124904 - protein, 17 aa, Mycobacterium
KVLRLVGRPNPPLASVS

SEQ ID NO: 1124905 - protein, 26 aa, Mycobacterium
KVPAEAKALVIAPNLVSARFIQLAPA

SEQ ID NO: 1124906 - protein, 39 aa, Mycobacterium
KVRPAWWSLALCAALALIIFICWSLFAGTFRSYVPVTLT

SEQ ID NO: 1124907 - protein, 18 aa, Mycobacterium
KVRVTSRIAGPGAAATWV

SEQ ID NO: 1124908 - protein, 25 aa, Mycobacterium
KVSGSRFYFLTGFGALLQLGLFQLA

SEQ ID NO: 1124909 - protein, 18 aa, Mycobacterium
KVSGVLFCGLQADRPVVA

SEQ ID NO: 1124910 - protein, 25 aa, Mycobacterium
KVVNELRAQFDYVVIDSTPLVAVTD

SEQ ID NO: 1124911 - protein, 18 aa, Mycobacterium
KYGRCITRLLVVGNPHAV

SEQ ID NO: 1124912 - protein, 20 aa, Mycobacterium
KYNPSYTCMLLGATWFLDNG

SEQ ID NO: 1124913 - protein, 23 aa, Mycobacterium
KYNRDAVETGELWISAEQRGATE

SEQ ID NO: 1124914 - protein, 19 aa, Mycobacterium
KYNRIGFRELVQIHQEREA

SEQ ID NO: 1124915 - protein, 18 aa, Mycobacterium
KYPENLPVIGAKGGPGGK

SEQ ID NO: 1124916 - protein, 17 aa, Mycobacterium
KYSHPLLSLGLPVLFIA

SEQ ID NO: 1124917 - protein, 20 aa, Mycobacterium
KYVRSTYMYLGWLCGEREDT

SEQ ID NO: 1124918 - protein, 27 aa, Mycobacterium
LAAAAWRLLGHVPYRIDIDVYRMGGRA

SEQ ID NO: 1124919 - protein, 21 aa, Mycobacterium
LAAAFYLWTLISPRADARVGL

SEQ ID NO: 1124920 - protein, 24 aa, Mycobacterium
LAAAHIGGLWGFVIPVWAILAAMG

SEQ ID NO: 1124921 - protein, 19 aa, Mycobacterium
LAAAPGDRLLIAPIGKTRE

SEQ ID NO: 1124922 - protein, 21 aa, Mycobacterium
LAACAHCTGEVRPCAQPGKAV

SEQ ID NO: 1124923 - protein, 22 aa, Mycobacterium
LAAEAICTLILVGPTIALFRRA

SEQ ID NO: 1124924 - protein, 27 aa, Mycobacterium
LAAEAWDARVAWRRHEPRLAAYPPEGG

SEQ ID NO: 1124925 - protein, 17 aa, Mycobacterium
LAAFFWAIAVHRTVWAV

SEQ ID NO: 1124926 - protein, 17 aa, Mycobacterium
LAAGCFMLRARQIAAAD

SEQ ID NO: 1124927 - protein, 26 aa, Mycobacterium
LAAGEPRLAAAVPFYGPTPENPDFSG

SEQ ID NO: 1124928 - protein, 17 aa, Mycobacterium
LAAGVLGAMALRRIALP

SEQ ID NO: 1124929 - protein, 30 aa, Mycobacterium
LAAGWALWTGRRWGRGIAVFAQLLLLPVTW

SEQ ID NO: 1124930 - protein, 19 aa, Mycobacterium
LAALAFWATIYLPAADFYP

SEQ ID NO: 1124931 - protein, 18 aa, Mycobacterium
LAALGGRAALEPLEVTSL

SEQ ID NO: 1124932 - protein, 17 aa, Mycobacterium
LAALPGFTPMLLPDVGR

SEQ ID NO: 1124933 - protein, 22 aa, Mycobacterium
LAALRANLEFLFDTDLSHRPAI

SEQ ID NO: 1124934 - protein, 18 aa, Mycobacterium
LAALRPLGVRAYALACVP

SEQ ID NO: 1124935 - protein, 19 aa, Mycobacterium
LAALVFAVADWWRRDATAR

SEQ ID NO: 1124936 - protein, 33 aa, Mycobacterium
LAAMAIMVFQFMKLPAQLFGVGRYTVIMQLSKT

SEQ ID NO: 1124937 - protein, 26 aa, Mycobacterium
LAANLVGGWVLMWLIMTALPRLRAQT

SEQ ID NO: 1124938 - protein, 17 aa, Mycobacterium
LAAPRLPQRWNPLPQTM

SEQ ID NO: 1124939 - protein, 25 aa, Mycobacterium
LAAQAGILRPEFRVAAGAVLAGALV

SEQ ID NO: 1124940 - protein, 20 aa, Mycobacterium
LAARHDLGFVSLPVLDTDLA

SEQ ID NO: 1124941 - protein, 29 aa, Mycobacterium
LAASRWADLRPALKDQLGTRIELRLGDPA

SEQ ID NO: 1124942 - protein, 23 aa, Mycobacterium
LAASVLPVWLLLAPRDYLSTFMK

SEQ ID NO: 1124943 - protein, 25 aa, Mycobacterium
LAAVFCVLGVLPLIVLTQVGIIVGL

SEQ ID NO: 1124944 - protein, 33 aa, Mycobacterium
LAAVVVSSIGMWLIRRRLMRQTHGLRPDELRVM

SEQ ID NO: 1124945 - protein, 27 aa, Mycobacterium
LAAVVWLTAAGLLCYAVGVGVVAVPLV

SEQ ID NO: 1124946 - protein, 18 aa, Mycobacterium
LAAWSVGLLAAWAALGAD

SEQ ID NO: 1124947 - protein, 20 aa, Mycobacterium
LAAYSMAPWIGLAVAGVMII

SEQ ID NO: 1124948 - protein, 19 aa, Mycobacterium
LACATKWSGLYFVMFFGVM

SEQ ID NO: 1124949 - protein, 18 aa, Mycobacterium
LACGAALALLVGNPLSGL

SEQ ID NO: 1124950 - protein, 17 aa, Mycobacterium
LACGIAMPEVDAALDTR

SEQ ID NO: 1124951 - protein, 17 aa, Mycobacterium
LADERVTLFRGWPDQAE

SEQ ID NO: 1124952 - protein, 20 aa, Mycobacterium
LADPDEPRVLLLVDAIGPFR

SEQ ID NO: 1124953 - protein, 22 aa, Mycobacterium
LADPFGLGWRLFGLAPDDVSYV

SEQ ID NO: 1124954 - protein, 25 aa, Mycobacterium
LADRRLLGRIWRFAARHHRRLAVFV

SEQ ID NO: 1124955 - protein, 23 aa, Mycobacterium
LADRTAVVIAHRLSTVQIADRVL

SEQ ID NO: 1124956 - protein, 25 aa, Mycobacterium
LADWGIRAHMGFLFGLVNQLLLLGI

SEQ ID NO: 1124957 - protein, 19 aa, Mycobacterium
LAFFCMTTIIAYYYMAETN

SEQ ID NO: 1124958 - protein, 17 aa, Mycobacterium
LAFGGLLLLGGRIGDAV

SEQ ID NO: 1124959 - protein, 26 aa, Mycobacterium
LAFIGVKLVLHWGHVDINPSIPEVDT

SEQ ID NO: 1124960 - protein, 28 aa, Mycobacterium
LAFLEPSWFAWLIVVWLWLTVLFANLAE

SEQ ID NO: 1124961 - protein, 24 aa, Mycobacterium
LAFSGCLPCGKISGNRVGRDERIT

SEQ ID NO: 1124962 - protein, 18 aa, Mycobacterium
LAFSNGILMLAFAAIAFI

SEQ ID NO: 1124963 - protein, 18 aa, Mycobacterium
LAGAIFGQIWKRIGENDA

SEQ ID NO: 1124964 - protein, 20 aa, Mycobacterium
LAGAIVHFSSPGPAPAAPEA

SEQ ID NO: 1124965 - protein, 20 aa, Mycobacterium
LAGAWLWREALASAVIVVAV

SEQ ID NO: 1124966 - protein, 21 aa, Mycobacterium
LAGCFAFSLIRPAGSAGTDTV

SEQ ID NO: 1124967 - protein, 20 aa, Mycobacterium
LAGFCLHTTLLGALAGMNRW

SEQ ID NO: 1124968 - protein, 17 aa, Mycobacterium
LAGFLIALVSGRFIDRF

SEQ ID NO: 1124969 - protein, 23 aa, Mycobacterium
LAGGRPEVLAVVPGARTKFVAMG

SEQ ID NO: 1124970 - protein, 23 aa, Mycobacterium
LAGGVALLGVWFYRAGSGHSGIA

SEQ ID NO: 1124971 - protein, 19 aa, Mycobacterium
LAGLADWSARRFKRPPWVA

SEQ ID NO: 1124972 - protein, 26 aa, Mycobacterium
LAGLAMLCAHAMFKAALFMTVGIIDH

SEQ ID NO: 1124973 - protein, 19 aa, Mycobacterium
LAGLCALTSVPAVFYRERR

SEQ ID NO: 1124974 - protein, 28 aa, Mycobacterium
LAGNRWSWFYRHLFDLAIVVLPLLRPLR

SEQ ID NO: 1124975 - protein, 19 aa, Mycobacterium
LAGPLAPVMLRFASEELVY

SEQ ID NO: 1124976 - protein, 22 aa, Mycobacterium
LAGTHPRMIWYAPQRSEGGESG

SEQ ID NO: 1124977 - protein, 25 aa, Mycobacterium
LAIAACVWLMLNLTGLTWIRFLIWM

SEQ ID NO: 1124978 - protein, 17 aa, Mycobacterium
LAIAIPRGFRGEADAGE

SEQ ID NO: 1124979 - protein, 17 aa, Mycobacterium
LAIEGIGILAMIVLVVA

SEQ ID NO: 1124980 - protein, 26 aa, Mycobacterium
LAIIGRSGGVYGDFFNFYACDVTLKL

SEQ ID NO: 1124981 - protein, 23 aa, Mycobacterium
LAIPECAKALLPIAESLRRSAQP

SEQ ID NO: 1124982 - protein, 23 aa, Mycobacterium
LAISLKYKFGYDDSLDVVGVHLV

SEQ ID NO: 1124983 - protein, 18 aa, Mycobacterium
LAKAGFRVEGTAPPASDV

SEQ ID NO: 1124984 - protein, 25 aa, Mycobacterium
LAKHPRLPRYDALKVLSTTVCADSE

SEQ ID NO: 1124985 - protein, 25 aa, Mycobacterium
LALALPVWLSAVIVAVVVFAAAGIA

SEQ ID NO: 1124986 - protein, 18 aa, Mycobacterium
LALAWWQWTRWESTTGSF

SEQ ID NO: 1124987 - protein, 19 aa, Mycobacterium
LALAWWQWTRWESTTGSFQ

SEQ ID NO: 1124988 - protein, 19 aa, Mycobacterium
LALAWWQWTRYESTSGSFQ

SEQ ID NO: 1124989 - protein, 17 aa, Mycobacterium
LALFSAVSVHCRRITRA

SEQ ID NO: 1124990 - protein, 20 aa, Mycobacterium
LALGGLIAFWQSRRHRRKNA

SEQ ID NO: 1124991 - protein, 18 aa, Mycobacterium
LALLPLFIVRSFIGTYQV

SEQ ID NO: 1124992 - protein, 18 aa, Mycobacterium
LALLPLFLVRSLIGTYQI

SEQ ID NO: 1124993 - protein, 23 aa, Mycobacterium
LALLPLLLVLAFVPARRPGPAAQ

SEQ ID NO: 1124994 - protein, 17 aa, Mycobacterium
LALLRLLRRIKRLIWAA

SEQ ID NO: 1124995 - protein, 22 aa, Mycobacterium
LALPFLAAIVLRIRRVEGRWGM

SEQ ID NO: 1124996 - protein, 17 aa, Mycobacterium
LALPFVILVGLIIVRQW

SEQ ID NO: 1124997 - protein, 17 aa, Mycobacterium
LALRGRRDPASGAGQRR

SEQ ID NO: 1124998 - protein, 19 aa, Mycobacterium
LALTAVFAPFALYAYKRRT

SEQ ID NO: 1124999 - protein, 31 aa, Mycobacterium
LALTGCGSGCYFARPAWRDGDNVLTLRAGAT

SEQ ID NO: 1125000 - protein, 23 aa, Mycobacterium
LALVMARIFLGRGAALIAALIAI

SEQ ID NO: 1125001 - protein, 19 aa, Mycobacterium
LALVWPSGWAWHHGAPYDS

SEQ ID NO: 1125002 - protein, 19 aa, Mycobacterium
LAMVFPIIGAFPFNGHFTV

SEQ ID NO: 1125003 - protein, 17 aa, Mycobacterium
LANIRRRPARFVLAVLG

SEQ ID NO: 1125004 - protein, 25 aa, Mycobacterium
LANPDVYRPAALLPTPRETATFLRN

SEQ ID NO: 1125005 - protein, 26 aa, Mycobacterium
LANPDVYRPAALLPTPRETATFLRNL

SEQ ID NO: 1125006 - protein, 23 aa, Mycobacterium
LANPFRRDRVLAAAVCAAIVAWS

SEQ ID NO: 1125007 - protein, 17 aa, Mycobacterium
LAPDSPTVLPARDGRPG

SEQ ID NO: 1125008 - protein, 25 aa, Mycobacterium
LAPERAREIGLHRQLSRITGRALPF

SEQ ID NO: 1125009 - protein, 32 aa, Mycobacterium
LAPKRLGMQYARRWAALVAPVLRALAIAATPV

SEQ ID NO: 1125010 - protein, 20 aa, Mycobacterium
LAPLCPFKALTGWACPACGG

SEQ ID NO: 1125011 - protein, 17 aa, Mycobacterium
LAPPLAVVLRDGEPVEV

SEQ ID NO: 1125012 - protein, 27 aa, Mycobacterium
LAPQAKPYPQPHKFAGVEIVPLSVLLQ

SEQ ID NO: 1125013 - protein, 46 aa, Mycobacterium
LAPQPPFAWREFIFQMWFVARVSIFPTVMLSIPFTVLSVFIFNILL

SEQ ID NO: 1125014 - protein, 17 aa, Mycobacterium
LAPRLRRGYNVSISSVP

SEQ ID NO: 1125015 - protein, 23 aa, Mycobacterium
LAQALGWRTAFLVMGALSVVFVP

SEQ ID NO: 1125016 - protein, 20 aa, Mycobacterium
LAQRFSASRFWPEIERTGAR

SEQ ID NO: 1125017 - protein, 19 aa, Mycobacterium
LAQVFGAAVGLPWTADPAV

SEQ ID NO: 1125018 - protein, 23 aa, Mycobacterium
LARAGFIGVVLIILVIAVGLQPE

SEQ ID NO: 1125019 - protein, 28 aa, Mycobacterium
LARERGWEIRDFRTARKAARIGVPSALA

SEQ ID NO: 1125020 - protein, 22 aa, Mycobacterium
LARFRRSELVLALLTTFAVAVF

SEQ ID NO: 1125021 - protein, 25 aa, Mycobacterium
LARGQRVPFRLAYPLRSGVPSSMRI

SEQ ID NO: 1125022 - protein, 17 aa, Mycobacterium
LARIGFGTVAVRYSQLG

SEQ ID NO: 1125023 - protein, 18 aa, Mycobacterium
LARLGGFMRDVESVRTTS

SEQ ID NO: 1125024 - protein, 22 aa, Mycobacterium
LARNSIGWSSISSVALVGGGAA

SEQ ID NO: 1125025 - protein, 26 aa, Mycobacterium
LARQELPTLCWAWQRVAGDQAPKMTV

SEQ ID NO: 1125026 - protein, 28 aa, Mycobacterium
LARRGFRAGQLIFAWTVLSVRLLAARPH

SEQ ID NO: 1125027 - protein, 23 aa, Mycobacterium
LARRLPAVIATVILLLLACAPVA

SEQ ID NO: 1125028 - protein, 19 aa, Mycobacterium
LARWPAIPHDISVRVSLWL

SEQ ID NO: 1125029 - protein, 23 aa, Mycobacterium
LARYIPGTILLIGFALMMIATAI

SEQ ID NO: 1125030 - protein, 24 aa, Mycobacterium
LARYIPGTILLIGFAVMMIATAIA

SEQ ID NO: 1125031 - protein, 17 aa, Mycobacterium
LASLPLAVRLYRRETAR

SEQ ID NO: 1125032 - protein, 23 aa, Mycobacterium
LASRLVGWTSGWLMLTASIVTIS

SEQ ID NO: 1125033 - protein, 24 aa, Mycobacterium
LASTIQRRLVLRLASDDDYVLAGV

SEQ ID NO: 1125034 - protein, 17 aa, Mycobacterium
LASVVGRYARTTAALIL

SEQ ID NO: 1125035 - protein, 18 aa, Mycobacterium
LATCTRPDLDLIDVITAA

SEQ ID NO: 1125036 - protein, 29 aa, Mycobacterium
LATFGRRAAKRSSYLHWGRGVEATQSKFW

SEQ ID NO: 1125037 - protein, 27 aa, Mycobacterium
LATIWLRTRLMPTWLVIVTYVVALCVL

SEQ ID NO: 1125038 - protein, 19 aa, Mycobacterium
LATLGGGQFLLSRLDGDVP

SEQ ID NO: 1125039 - protein, 20 aa, Mycobacterium
LATNIPPTWAAASRPPIRSL

SEQ ID NO: 1125040 - protein, 18 aa, Mycobacterium
LATRSQLWQFTAADFCWI

SEQ ID NO: 1125041 - protein, 18 aa, Mycobacterium
LATTRWLVAILENHQQPD

SEQ ID NO: 1125042 - protein, 23 aa, Mycobacterium
LATYGFQHVVAFYAGAVLVPILI

SEQ ID NO: 1125043 - protein, 22 aa, Mycobacterium
LAVALRQSWIGWLAVTFVVASL

SEQ ID NO: 1125044 - protein, 17 aa, Mycobacterium
LAVDVGFALSVAATAAL

SEQ ID NO: 1125045 - protein, 23 aa, Mycobacterium
LAVGCPVCNKVVVAAIGVSGALN

SEQ ID NO: 1125046 - protein, 23 aa, Mycobacterium
LAVGWRRRNGWGYVRLTLAGVEN

SEQ ID NO: 1125047 - protein, 26 aa, Mycobacterium
LAVIALALAALVLWQRRRRRKRREAE

SEQ ID NO: 1125048 - protein, 18 aa, Mycobacterium
LAVLFGYLSAVHAGRFAD

SEQ ID NO: 1125049 - protein, 25 aa, Mycobacterium
LAVLIVLAACAGFIKFNYDDRKALP

SEQ ID NO: 1125050 - protein, 35 aa, Mycobacterium
LAVLLPWNIATGITIAGSPGWIMGLLIVAALTSLA

SEQ ID NO: 1125051 - protein, 19 aa, Mycobacterium
LAVLPREKIDALLTETADA

SEQ ID NO: 1125052 - protein, 22 aa, Mycobacterium
LAVLVEFRFVYVRTRELRRSLA

SEQ ID NO: 1125053 - protein, 17 aa, Mycobacterium
LAVPWSFGAVVLGVLFA

SEQ ID NO: 1125054 - protein, 19 aa, Mycobacterium
LAVRIMQLIAGVVFGVATA

SEQ ID NO: 1125055 - protein, 18 aa, Mycobacterium
LAVTWWVVALLHLGRISP

SEQ ID NO: 1125056 - protein, 25 aa, Mycobacterium
LAVVATRLLQKWGKRSSASEEAATS

SEQ ID NO: 1125057 - protein, 17 aa, Mycobacterium
LAWPADLKVGPDGLGNS

SEQ ID NO: 1125058 - protein, 19 aa, Mycobacterium
LCAAALTAALGAWSLMRRP

SEQ ID NO: 1125059 - protein, 19 aa, Mycobacterium
LCAFKRARPRWVAFAMAAI

SEQ ID NO: 1125060 - protein, 24 aa, Mycobacterium
LCDIAELTAAYALWSQRHRAYVLT

SEQ ID NO: 1125061 - protein, 20 aa, Mycobacterium
LCDVWDPGKVLGLIQTEGLS

SEQ ID NO: 1125062 - protein, 19 aa, Mycobacterium
LCGVAYAWWPQEGRYQPIQ

SEQ ID NO: 1125063 - protein, 23 aa, Mycobacterium
LCIGWCAVNTWIVLDLVMALLGR

SEQ ID NO: 1125064 - protein, 22 aa, Mycobacterium
LCIVPGVIASFLLMFTTIAVLD

SEQ ID NO: 1125065 - protein, 24 aa, Mycobacterium
LCNDPRGFVPTAIRNHITGPYPFD

SEQ ID NO: 1125066 - protein, 17 aa, Mycobacterium
LCRVLSKVLRLVGRPNP

SEQ ID NO: 1125067 - protein, 21 aa, Mycobacterium
LCVLSAALVVNLWVGYFPTVQ

SEQ ID NO: 1125068 - protein, 25 aa, Mycobacterium
LCVSLTIGAIVLWSSFIASILPPLL

SEQ ID NO: 1125069 - protein, 17 aa, Mycobacterium
LCVVALFAVNVVLTTIG

SEQ ID NO: 1125070 - protein, 18 aa, Mycobacterium
LCVVALFAVNVVLTTIGV

SEQ ID NO: 1125071 - protein, 21 aa, Mycobacterium
LDAALAFAVWASVPGSGRLHR

SEQ ID NO: 1125072 - protein, 26 aa, Mycobacterium
LDAALERTRIGWAGVSAVVTIGGGAS

SEQ ID NO: 1125073 - protein, 27 aa, Mycobacterium
LDAARLLTWRASWMAATGVPFERGEGS

SEQ ID NO: 1125074 - protein, 18 aa, Mycobacterium
LDAGLTWATDPYRYPDHL

SEQ ID NO: 1125075 - protein, 17 aa, Mycobacterium
LDALLLNMIGFSRSGTD

SEQ ID NO: 1125076 - protein, 18 aa, Mycobacterium
LDALMPQLIALLPSQIES

SEQ ID NO: 1125077 - protein, 20 aa, Mycobacterium
LDALVGGFRPLFKALDPTQV

SEQ ID NO: 1125078 - protein, 19 aa, Mycobacterium
LDAMIDRWLLPPSSTAELQ

SEQ ID NO: 1125079 - protein, 23 aa, Mycobacterium
LDAMPWEPPSVFLMRRGANDTYT

SEQ ID NO: 1125080 - protein, 25 aa, Mycobacterium
LDDRLEVADSLTFGRLDDRARSVAA

SEQ ID NO: 1125081 - protein, 19 aa, Mycobacterium
LDEAMAHGRFVLIFVDLDD

SEQ ID NO: 1125082 - protein, 25 aa, Mycobacterium
LDFECEGCRALYPAVEQLRAEYGDR

SEQ ID NO: 1125083 - protein, 21 aa, Mycobacterium
LDGLPATGWTLNWAQGLIEGA

SEQ ID NO: 1125084 - protein, 23 aa, Mycobacterium
LDGRPVPYQMLWEDVGRFRVAKI

SEQ ID NO: 1125085 - protein, 17 aa, Mycobacterium
LDGVFDWVTRNGNADED

SEQ ID NO: 1125086 - protein, 19 aa, Mycobacterium
LDGWAGVAPPRGWTQEDTE

SEQ ID NO: 1125087 - protein, 19 aa, Mycobacterium
LDHLGGWPALGAGGVYGVL

SEQ ID NO: 1125088 - protein, 21 aa, Mycobacterium
LDHVFTLSVPSMWRETPAPYG

SEQ ID NO: 1125089 - protein, 17 aa, Mycobacterium
LDKLGCRASHTAELKLT

SEQ ID NO: 1125090 - protein, 25 aa, Mycobacterium
LDKPIPVRYGDWVAGAVRGDFGTTV

SEQ ID NO: 1125091 - protein, 21 aa, Mycobacterium
LDKRRGVTVGSMLRNWGLVFV

SEQ ID NO: 1125092 - protein, 22 aa, Mycobacterium
LDKYSPSFFCMIRNYHDVEPKI

SEQ ID NO: 1125093 - protein, 30 aa, Mycobacterium
LDLEIKKRKRWPWIAGAVVAVLAVTGGIVY

SEQ ID NO: 1125094 - protein, 28 aa, Mycobacterium
LDLGAGPARTFFKVTLPLIVPGIVAAAM

SEQ ID NO: 1125095 - protein, 20 aa, Mycobacterium
LDLSSARFWKTVAHHYLRMA

SEQ ID NO: 1125096 - protein, 23 aa, Mycobacterium
LDLTGCMALGITGPVLRSTGLPH

SEQ ID NO: 1125097 - protein, 24 aa, Mycobacterium
LDNHLRLRTEIVSARWDADSRNWE

SEQ ID NO: 1125098 - protein, 19 aa, Mycobacterium
LDPEAAAAFIADYPSVEVA

SEQ ID NO: 1125099 - protein, 23 aa, Mycobacterium
LDPPARQAWQWLVTEVPQRSLHN

SEQ ID NO: 1125100 - protein, 18 aa, Mycobacterium
LDPQIELVCYRIAQESLT

SEQ ID NO: 1125101 - protein, 19 aa, Mycobacterium
LDPRPVIAVIAGVWLVATV

SEQ ID NO: 1125102 - protein, 20 aa, Mycobacterium
LDPRPVIAVIAGVWLVATVL

SEQ ID NO: 1125103 - protein, 20 aa, Mycobacterium
LDQGYSYGLLWVAAVAVIVG

SEQ ID NO: 1125104 - protein, 19 aa, Mycobacterium
LDRDIGYGILRMSSDQKWR

SEQ ID NO: 1125105 - protein, 21 aa, Mycobacterium
LDRFLGIGGESAMFFIGVLVV

SEQ ID NO: 1125106 - protein, 18 aa, Mycobacterium
LDRLGRELDMLRGELATV

SEQ ID NO: 1125107 - protein, 25 aa, Mycobacterium
LDRLHAVAGPGGREVLMTGTAQVNR

SEQ ID NO: 1125108 - protein, 19 aa, Mycobacterium
LDRPAEFVAGAPVQVVDAV

SEQ ID NO: 1125109 - protein, 27 aa, Mycobacterium
LDRWEPEPPRLLVFAFVWGTSVAVVIS

SEQ ID NO: 1125110 - protein, 23 aa, Mycobacterium
LDSSLGLMCTVVVVPVCAGILGA

SEQ ID NO: 1125111 - protein, 17 aa, Mycobacterium
LDSTTRMSDCGRHVGRV

SEQ ID NO: 1125112 - protein, 25 aa, Mycobacterium
LDTRTPLSFLCYWVVPFSLLGVAAL

SEQ ID NO: 1125113 - protein, 18 aa, Mycobacterium
LDVGLLFGNDPYKYPENL

SEQ ID NO: 1125114 - protein, 33 aa, Mycobacterium
LDVKLGLMCLAAFPILVLLVMWFRRESSKTYRE

SEQ ID NO: 1125115 - protein, 20 aa, Mycobacterium
LDVPRGAMVTSVRLLATTGA

SEQ ID NO: 1125116 - protein, 27 aa, Mycobacterium
LDVSSARFWKTFAHHYLRMIYDILATA

SEQ ID NO: 1125117 - protein, 19 aa, Mycobacterium
LDWSVWIGVVVLGMIGAVL

SEQ ID NO: 1125118 - protein, 18 aa, Mycobacterium
LEAAAGVAGFIKAVLALQ

SEQ ID NO: 1125119 - protein, 23 aa, Mycobacterium
LEADGRKAFVWIGLHEPDEHQMQ

SEQ ID NO: 1125120 - protein, 21 aa, Mycobacterium
LEAQVPRWADGTAFEGVAKSV

SEQ ID NO: 1125121 - protein, 18 aa, Mycobacterium
LEEMLYRLLRTELPDTIV

SEQ ID NO: 1125122 - protein, 20 aa, Mycobacterium
LEIARLGRVLGIAVLSIAVV

SEQ ID NO: 1125123 - protein, 19 aa, Mycobacterium
LEIECARLSLIDDAAAERV

SEQ ID NO: 1125124 - protein, 24 aa, Mycobacterium
LELFGRLLRDGRWWVGSGTAAAGF

SEQ ID NO: 1125125 - protein, 21 aa, Mycobacterium
LELLLILALRIPLRAVLIRGA

SEQ ID NO: 1125126 - protein, 21 aa, Mycobacterium
LELLRDVRFVILVFVGALGMS

SEQ ID NO: 1125127 - protein, 32 aa, Mycobacterium
LELTAALLIAVKPWWPKLSIIGSVIAVGLFVA

SEQ ID NO: 1125128 - protein, 17 aa, Mycobacterium
LELYLIFPLNNEDSTIA

SEQ ID NO: 1125129 - protein, 22 aa, Mycobacterium
LENDFGWRIIFGFPGIVLASIF

SEQ ID NO: 1125130 - protein, 25 aa, Mycobacterium
LEPAGFSVFGVFWGAFGLASGAAFG

SEQ ID NO: 1125131 - protein, 37 aa, Mycobacterium
LEPKRAMRIRGWRKIGAAVVRWPGPILVATLAITLVG

SEQ ID NO: 1125132 - protein, 36 aa, Mycobacterium
LEPKRAMRVRGWRKIGAVTVRWPGAILVASVAVSLI

SEQ ID NO: 1125133 - protein, 24 aa, Mycobacterium
LEPRGVHFRPFLAALGASLTAGAA

SEQ ID NO: 1125134 - protein, 24 aa, Mycobacterium
LEQGAAVWRRWAYALGALGNAGTN

SEQ ID NO: 1125135 - protein, 23 aa, Mycobacterium
LERAPRFARRRVGSEVTMVALSD

SEQ ID NO: 1125136 - protein, 18 aa, Mycobacterium
LERIGIVTAMVGDGANDA

SEQ ID NO: 1125137 - protein, 18 aa, Mycobacterium
LERIGMVTAMVGDGANDA

SEQ ID NO: 1125138 - protein, 21 aa, Mycobacterium
LERSRPMWMAYLIDGLADGRF

SEQ ID NO: 1125139 - protein, 21 aa, Mycobacterium
LERWEHVLFPVVLIALGIFIL

SEQ ID NO: 1125140 - protein, 23 aa, Mycobacterium
LESDAWSWLKWLPHTDVPGQNDG

SEQ ID NO: 1125141 - protein, 24 aa, Mycobacterium
LESLFRLDHLAARMRRNGSNLMVL

SEQ ID NO: 1125142 - protein, 18 aa, Mycobacterium
LESLRSIALVMLAFGLWT

SEQ ID NO: 1125143 - protein, 25 aa, Mycobacterium
LEYDAPVARFWPEFGANGKERITVR

SEQ ID NO: 1125144 - protein, 19 aa, Mycobacterium
LFALYVAGYCVGRFFVELM

SEQ ID NO: 1125145 - protein, 27 aa, Mycobacterium
LFAQYSSWRWAFGILVVMTTAMSALVP

SEQ ID NO: 1125146 - protein, 20 aa, Mycobacterium
LFASPKTWRLLDGVIAATML

SEQ ID NO: 1125147 - protein, 18 aa, Mycobacterium
LFATLIVMPYRFRGVAMF

SEQ ID NO: 1125148 - protein, 18 aa, Mycobacterium
LFDKEPLLIWTLIASLFI

SEQ ID NO: 1125149 - protein, 17 aa, Mycobacterium
LFDRDGVDFATAPPPPG

SEQ ID NO: 1125150 - protein, 19 aa, Mycobacterium
LFDRLPLMVTILIVTTTIL

SEQ ID NO: 1125151 - protein, 17 aa, Mycobacterium
LFERFYRADTARDREHG

SEQ ID NO: 1125152 - protein, 19 aa, Mycobacterium
LFFVSALLMLLGLVGGLTL

SEQ ID NO: 1125153 - protein, 19 aa, Mycobacterium
LFGFNPWSVLVPQALMGVA

SEQ ID NO: 1125154 - protein, 17 aa, Mycobacterium
LFGFSPFTMLLPQALMG

SEQ ID NO: 1125155 - protein, 18 aa, Mycobacterium
LFGLVAALIGCYKGISVG

SEQ ID NO: 1125156 - protein, 19 aa, Mycobacterium
LFGRNIMFLAVLFAIGMNA

SEQ ID NO: 1125157 - protein, 18 aa, Mycobacterium
LFIVRSFIGTYQVRLFAE

SEQ ID NO: 1125158 - protein, 21 aa, Mycobacterium
LFLGMALGRPGCFFTGCCAGR

SEQ ID NO: 1125159 - protein, 18 aa, Mycobacterium
LFPAAPPWAAARCTAADV

SEQ ID NO: 1125160 - protein, 24 aa, Mycobacterium
LFPRKVSFLPGMRYYAGNWDTTLW

SEQ ID NO: 1125161 - protein, 22 aa, Mycobacterium
LFPVGFCLLYLMGFDLLTGVFT

SEQ ID NO: 1125162 - protein, 21 aa, Mycobacterium
LFTAGLFAFFLALGVIAIPDD

SEQ ID NO: 1125163 - protein, 23 aa, Mycobacterium
LFTCGIASIIQAVGFKNIGVRLP

SEQ ID NO: 1125164 - protein, 24 aa, Mycobacterium
LFTFAIVMGTLWLLGALAFVGELV

SEQ ID NO: 1125165 - protein, 25 aa, Mycobacterium
LFTWVWPALEVFTRMVPPNFGALGG

SEQ ID NO: 1125166 - protein, 18 aa, Mycobacterium
LFVALSFTALVIYAIVPA

SEQ ID NO: 1125167 - protein, 27 aa, Mycobacterium
LFVWELARPPLWLLLVFAVGAYAAYGL

SEQ ID NO: 1125168 - protein, 18 aa, Mycobacterium
LGAACQRMHDSAGVDVAA

SEQ ID NO: 1125169 - protein, 30 aa, Mycobacterium
LGAALARRVEWRVLPAYWLTQVIAGVAAGL

SEQ ID NO: 1125170 - protein, 18 aa, Mycobacterium
LGAFSLVLLMFTAIIIVV

SEQ ID NO: 1125171 - protein, 17 aa, Mycobacterium
LGAGAPMFTVFTHDATD

SEQ ID NO: 1125172 - protein, 17 aa, Mycobacterium
LGAGCLMGSRLGPMVVR

SEQ ID NO: 1125173 - protein, 18 aa, Mycobacterium
LGAGLVGFVLVGGLAADR

SEQ ID NO: 1125174 - protein, 24 aa, Mycobacterium
LGAGYNLVVLWALDHVAAIRRIPT

SEQ ID NO: 1125175 - protein, 21 aa, Mycobacterium
LGALALGRLSVRSVRDVEYAQ

SEQ ID NO: 1125176 - protein, 34 aa, Mycobacterium
LGALAVSLLGGWGIRRRLMRQTRGLRPEELRVMY

SEQ ID NO: 1125177 - protein, 20 aa, Mycobacterium
LGALCGALALFVVASHNPWT

SEQ ID NO: 1125178 - protein, 17 aa, Mycobacterium
LGALVFRAVFIAAGSVL

SEQ ID NO: 1125179 - protein, 23 aa, Mycobacterium
LGAPLSWDIGFLIFGALLVAAGW

SEQ ID NO: 1125180 - protein, 17 aa, Mycobacterium
LGAPVFLSAFAVVTLAM

SEQ ID NO: 1125181 - protein, 20 aa, Mycobacterium
LGASLFVGLIMFFLVGRPLA

SEQ ID NO: 1125182 - protein, 20 aa, Mycobacterium
LGATLAWSMGRLTGTPRRAS

SEQ ID NO: 1125183 - protein, 19 aa, Mycobacterium
LGAYGSWLNQYLCGLSVRV

SEQ ID NO: 1125184 - protein, 18 aa, Mycobacterium
LGCPGIREALVVARQDRE

SEQ ID NO: 1125185 - protein, 28 aa, Mycobacterium
LGDAYSGDTWRLWSFPWDARETGFHTIT

SEQ ID NO: 1125186 - protein, 22 aa, Mycobacterium
LGDGFTMLALVGIIDPLRPEAV

SEQ ID NO: 1125187 - protein, 19 aa, Mycobacterium
LGDGPGAACGVVIAVIGPA

SEQ ID NO: 1125188 - protein, 17 aa, Mycobacterium
LGDIGVGLMAWLNIIGI

SEQ ID NO: 1125189 - protein, 25 aa, Mycobacterium
LGDIKAIDRRTWLLLVAAAALISAN

SEQ ID NO: 1125190 - protein, 24 aa, Mycobacterium
LGDRHGRRAVLIAGLAVFSAASTI

SEQ ID NO: 1125191 - protein, 23 aa, Mycobacterium
LGDRIGRQRVLAVVILLMSVATL

SEQ ID NO: 1125192 - protein, 18 aa, Mycobacterium
LGDWLRGPYCALPDSARA

SEQ ID NO: 1125193 - protein, 18 aa, Mycobacterium
LGEAPAYRYLDFDHDCTV

SEQ ID NO: 1125194 - protein, 24 aa, Mycobacterium
LGEIAEGALLLFLFSVGHALEGYA

SEQ ID NO: 1125195 - protein, 21 aa, Mycobacterium
LGERAREAVTFTPYGLTTSVG

SEQ ID NO: 1125196 - protein, 17 aa, Mycobacterium
LGFALVFLVARAFSSGS

SEQ ID NO: 1125197 - protein, 17 aa, Mycobacterium
LGFCVAALALLVRRSAR

SEQ ID NO: 1125198 - protein, 19 aa, Mycobacterium
LGFIPAYLLSLLLKKVGLL

SEQ ID NO: 1125199 - protein, 24 aa, Mycobacterium
LGFVAMALACRWGGTVKAFVVASG

SEQ ID NO: 1125200 - protein, 24 aa, Mycobacterium
LGFVMPGEIPYQVQLPPGAAQPAA

SEQ ID NO: 1125201 - protein, 25 aa, Mycobacterium
LGFYLTCAIFVFGVLGALLRVVSGV

SEQ ID NO: 1125202 - protein, 21 aa, Mycobacterium
LGGAFYRSLKLSWHADLLSDQ

SEQ ID NO: 1125203 - protein, 23 aa, Mycobacterium
LGGALAGWGWWALRRRQDRPPLT

SEQ ID NO: 1125204 - protein, 20 aa, Mycobacterium
LGGFGTVPAIVWVAFQLTFA

SEQ ID NO: 1125205 - protein, 22 aa, Mycobacterium
LGGGRLMFRAVLHAVDGRPMSG

SEQ ID NO: 1125206 - protein, 19 aa, Mycobacterium
LGGLAVVLAAVTTLVGVWS

SEQ ID NO: 1125207 - protein, 19 aa, Mycobacterium
LGGLLIVVVALFLGVDPST

SEQ ID NO: 1125208 - protein, 18 aa, Mycobacterium
LGGLLVLRTRSHVVVHRR

SEQ ID NO: 1125209 - protein, 17 aa, Mycobacterium
LGGVVFGHFGDKYGRKK

SEQ ID NO: 1125210 - protein, 19 aa, Mycobacterium
LGGVVTILMGLVFIGLVPV

SEQ ID NO: 1125211 - protein, 22 aa, Mycobacterium
LGGWRAAVAVWAVVSLLALMVW

SEQ ID NO: 1125212 - protein, 28 aa, Mycobacterium
LGHAVAKRLGCKVVQGYGMSELSPVSHI

SEQ ID NO: 1125213 - protein, 19 aa, Mycobacterium
LGHPARLVVRAATAVTAVA

SEQ ID NO: 1125214 - protein, 25 aa, Mycobacterium
LGHVEWLKAAGVGALVFAVVETEKY

SEQ ID NO: 1125215 - protein, 17 aa, Mycobacterium
LGITGPVLRSTGLPHDL

SEQ ID NO: 1125216 - protein, 19 aa, Mycobacterium
LGKVHFWLTFIGFHATFLV

SEQ ID NO: 1125217 - protein, 18 aa, Mycobacterium
LGLAALIYVGPAAATWPA

SEQ ID NO: 1125218 - protein, 17 aa, Mycobacterium
LGLALRLATVVVCVVAA

SEQ ID NO: 1125219 - protein, 19 aa, Mycobacterium
LGLAMPFTLVGALGGLALV

SEQ ID NO: 1125220 - protein, 21 aa, Mycobacterium
LGLANGLGFLAGATVGYLLLR

SEQ ID NO: 1125221 - protein, 30 aa, Mycobacterium
LGLANGLGFLAGAVVGHFLLKSSLRPPGGR

SEQ ID NO: 1125222 - protein, 23 aa, Mycobacterium
LGLFLRIVVRPFVAVGAARRRRK

SEQ ID NO: 1125223 - protein, 17 aa, Mycobacterium
LGLGALSFVLTQTRRTE

SEQ ID NO: 1125224 - protein, 19 aa, Mycobacterium
LGLITAWFAVILLTYHWAR

SEQ ID NO: 1125225 - protein, 24 aa, Mycobacterium
LGLLLRSLLLLTLLLLELPLRIGV

SEQ ID NO: 1125226 - protein, 19 aa, Mycobacterium
LGLLMADWLADRGARRVVL

SEQ ID NO: 1125227 - protein, 20 aa, Mycobacterium
LGLNLARLFQLLAWGALAVY

SEQ ID NO: 1125228 - protein, 17 aa, Mycobacterium
LGLPLLFVLYLRESDVF

SEQ ID NO: 1125229 - protein, 17 aa, Mycobacterium
LGLRSMLLVSMSISDPL

SEQ ID NO: 1125230 - protein, 26 aa, Mycobacterium
LGLSSLRAGLIAGVVGLVAVLLYSLL

SEQ ID NO: 1125231 - protein, 17 aa, Mycobacterium
LGLVEFLLGSLIGGAWL

SEQ ID NO: 1125232 - protein, 17 aa, Mycobacterium
LGLVWWLLGAGWAAVLL

SEQ ID NO: 1125233 - protein, 18 aa, Mycobacterium
LGMALRWDVFGTGLGKAA

SEQ ID NO: 1125234 - protein, 22 aa, Mycobacterium
LGMSGLFAYIAGAAFVLQGDYG

SEQ ID NO: 1125235 - protein, 18 aa, Mycobacterium
LGNGFGPDGLPFLSLTSM

SEQ ID NO: 1125236 - protein, 24 aa, Mycobacterium
LGNLRSATVPFILAQPAQAPPPAP

SEQ ID NO: 1125237 - protein, 17 aa, Mycobacterium
LGPEFNQQYGFTNPKTD

SEQ ID NO: 1125238 - protein, 18 aa, Mycobacterium
LGPVPLPISALLSGALNL

SEQ ID NO: 1125239 - protein, 20 aa, Mycobacterium
LGPWFWWPQRVRTRPVPAPW

SEQ ID NO: 1125240 - protein, 30 aa, Mycobacterium
LGPWLDRLQAFDVFSSFWFTAIYVLLFVSL

SEQ ID NO: 1125241 - protein, 19 aa, Mycobacterium
LGQRQRLGLARVFGSDAAV

SEQ ID NO: 1125242 - protein, 20 aa, Mycobacterium
LGQRQRLGLVRVLGSAAPLL

SEQ ID NO: 1125243 - protein, 24 aa, Mycobacterium
LGREHWKSGAGYALGAVALVGTVI

SEQ ID NO: 1125244 - protein, 25 aa, Mycobacterium
LGREHWRSGAGYALAAVAVVLSVIA

SEQ ID NO: 1125245 - protein, 23 aa, Mycobacterium
LGRHLISAAGWDLITRHSARQYP

SEQ ID NO: 1125246 - protein, 40 aa, Mycobacterium
LGRLPADWPRLPLRELQNLPAPSRRWWQFWGSTLETSVAL

SEQ ID NO: 1125247 - protein, 26 aa, Mycobacterium
LGRYVVISALGGLRCRASRIVLHPGF

SEQ ID NO: 1125248 - protein, 26 aa, Mycobacterium
LGSDLRRLEGLIAPGSWNIDPSAQPQ

SEQ ID NO: 1125249 - protein, 24 aa, Mycobacterium
LGSEALAVPIWWAYATSLLLITAG

SEQ ID NO: 1125250 - protein, 28 aa, Mycobacterium
LGSGAWWLARLEWELVLAVVTAGLLCLL

SEQ ID NO: 1125251 - protein, 18 aa, Mycobacterium
LGSLFWVVLNWPAKGQSH

SEQ ID NO: 1125252 - protein, 23 aa, Mycobacterium
LGSLRSAWRLERRRLSRHGKSPW

SEQ ID NO: 1125253 - protein, 31 aa, Mycobacterium
LGSYGSWLNLYICGVSIRVSDLQGRTAHFPW

SEQ ID NO: 1125254 - protein, 19 aa, Mycobacterium
LGTARRGAAVAAVGKSVYV

SEQ ID NO: 1125255 - protein, 26 aa, Mycobacterium
LGTEMNAYFSMCWLVVNTLGVLVGAT

SEQ ID NO: 1125256 - protein, 22 aa, Mycobacterium
LGTSRRSRWARIFDEGIGATVV

SEQ ID NO: 1125257 - protein, 27 aa, Mycobacterium
LGTTLVLRRRFKPATVLADIEKHRATA

SEQ ID NO: 1125258 - protein, 19 aa, Mycobacterium
LGTVFVHWLIFQSLYRIGA

SEQ ID NO: 1125259 - protein, 19 aa, Mycobacterium
LGTVLGWPGGLRLAVDNLV

SEQ ID NO: 1125260 - protein, 17 aa, Mycobacterium
LGVAGSVFAVWPGVGGD

SEQ ID NO: 1125261 - protein, 17 aa, Mycobacterium
LGVDLIAVLSLVGTLLV

SEQ ID NO: 1125262 - protein, 23 aa, Mycobacterium
LGVGYLLYLAWITWRDKTELVAD

SEQ ID NO: 1125263 - protein, 23 aa, Mycobacterium
LGVIRDGQKWVALAMPAYALAGA

SEQ ID NO: 1125264 - protein, 19 aa, Mycobacterium
LGVLAFYLAFVAELPPPPP

SEQ ID NO: 1125265 - protein, 23 aa, Mycobacterium
LGVMPLLPVLVMIYGTARTTAAA

SEQ ID NO: 1125266 - protein, 19 aa, Mycobacterium
LGVSAWRSAKRPAMIAVPA

SEQ ID NO: 1125267 - protein, 19 aa, Mycobacterium
LGVTLLRLVVLRRGVIPAS

SEQ ID NO: 1125268 - protein, 21 aa, Mycobacterium
LGVVMVLRWLPVHRAQAQSVG

SEQ ID NO: 1125269 - protein, 28 aa, Mycobacterium
LGWAGWRLLGETPYRIDIDVYRMGGRAW

SEQ ID NO: 1125270 - protein, 27 aa, Mycobacterium
LGYKPLIVCGCVLRTAGFGLLVFAESL

SEQ ID NO: 1125271 - protein, 18 aa, Mycobacterium
LGYWLGRFEVIQKLLEPI

SEQ ID NO: 1125272 - protein, 25 aa, Mycobacterium
LHAELPRSGGLYSTANVTYRGTTIG

SEQ ID NO: 1125273 - protein, 24 aa, Mycobacterium
LHALLGWTWADPVAALGIAALAVR

SEQ ID NO: 1125274 - protein, 21 aa, Mycobacterium
LHGCNGCVGDRIMVDKLTYRF

SEQ ID NO: 1125275 - protein, 18 aa, Mycobacterium
LHGDRWISVRDRVAGALT

SEQ ID NO: 1125276 - protein, 19 aa, Mycobacterium
LHLEGRDSLAPALIIFLTL

SEQ ID NO: 1125277 - protein, 19 aa, Mycobacterium
LHLRRERSFWFGYVHIVVF

SEQ ID NO: 1125278 - protein, 25 aa, Mycobacterium
LHMRPSQRRKQAWVRDLARWQPDFV

SEQ ID NO: 1125279 - protein, 32 aa, Mycobacterium
LHPEPPYPLPSWRWALELDRISATLAAEPLPL

SEQ ID NO: 1125280 - protein, 18 aa, Mycobacterium
LHTVVTMVEMGRAEEAIT

SEQ ID NO: 1125281 - protein, 24 aa, Mycobacterium
LHVHLPQPLPPLWADEQRLSQVLG

SEQ ID NO: 1125282 - protein, 17 aa, Mycobacterium
LHWRPRKIGVLRIDPLL

SEQ ID NO: 1125283 - protein, 18 aa, Mycobacterium
LHWSVPPLAFVVLVAVGA

SEQ ID NO: 1125284 - protein, 18 aa, Mycobacterium
LIAEIGMGTGAMAVVGGT

SEQ ID NO: 1125285 - protein, 19 aa, Mycobacterium
LIAEISMGAGTLAMIGGTL

SEQ ID NO: 1125286 - protein, 18 aa, Mycobacterium
LIAELRPDLDRSIKALPH

SEQ ID NO: 1125287 - protein, 17 aa, Mycobacterium
LIALMPQQIETMKSQRE

SEQ ID NO: 1125288 - protein, 23 aa, Mycobacterium
LIALSLVASGAMVFAILVLLGRY

SEQ ID NO: 1125289 - protein, 32 aa, Mycobacterium
LIALVGFLMLLKAVAYWLDRYELLSHTRGGKP

SEQ ID NO: 1125290 - protein, 22 aa, Mycobacterium
LIAMFPWYVQWLPNAIWKTFDL

SEQ ID NO: 1125291 - protein, 17 aa, Mycobacterium
LIAPRHTFTIAEPDSAL

SEQ ID NO: 1125292 - protein, 19 aa, Mycobacterium
LIAPTGWQVGLIRVEDVVM

SEQ ID NO: 1125293 - protein, 23 aa, Mycobacterium
LIAQCLLLALAIYWDHQAQPVFK

SEQ ID NO: 1125294 - protein, 18 aa, Mycobacterium
LIATGGMGQVWEGVDSRL

SEQ ID NO: 1125295 - protein, 25 aa, Mycobacterium
LIDPGAAPLLWSILVGLGLSVFSLA

SEQ ID NO: 1125296 - protein, 36 aa, Mycobacterium
LIDTIGWRSVFWINLPICAAAILLTAIFVPESKSQT

SEQ ID NO: 1125297 - protein, 27 aa, Mycobacterium
LIEQPIREWRPAFVPMLPLAAATAATA

SEQ ID NO: 1125298 - protein, 25 aa, Mycobacterium
LIFGWLAFLIVFGFFTRKVWEIVVG

SEQ ID NO: 1125299 - protein, 18 aa, Mycobacterium
LIFIWALILGVWKYRQMA

SEQ ID NO: 1125300 - protein, 19 aa, Mycobacterium
LIFVSGLERHLPRIFTHLN

SEQ ID NO: 1125301 - protein, 22 aa, Mycobacterium
LIGGFRPLFRALDPHQVNTLTR

SEQ ID NO: 1125302 - protein, 17 aa, Mycobacterium
LIGGLGLAALIGLPGLA

SEQ ID NO: 1125303 - protein, 17 aa, Mycobacterium
LIGGRLYHVITDWRTYF

SEQ ID NO: 1125304 - protein, 17 aa, Mycobacterium
LIGIFAFFFKNFLSSQF

SEQ ID NO: 1125305 - protein, 17 aa, Mycobacterium
LIGMVALTVLLLVVAAV

SEQ ID NO: 1125306 - protein, 24 aa, Mycobacterium
LIGRLRAAYTLALTAYAIIGLATA

SEQ ID NO: 1125307 - protein, 27 aa, Mycobacterium
LIGWLSSVFARADWAPEALVLVGSAED

SEQ ID NO: 1125308 - protein, 25 aa, Mycobacterium
LIKSDFWRVFGIWLLAAIVAQFIAG

SEQ ID NO: 1125309 - protein, 28 aa, Mycobacterium
LIPGPGHVSLWEGVKFQLWQREASGSIG

SEQ ID NO: 1125310 - protein, 25 aa, Mycobacterium
LIPLALGLWAAWGAWRGNDDDDDDN

SEQ ID NO: 1125311 - protein, 26 aa, Mycobacterium
LIPLALGLWAAWQAWRDDDDDDDDAK

SEQ ID NO: 1125312 - protein, 26 aa, Mycobacterium
LIPLALGLWAAWRAWRGNDDDDDDDD

SEQ ID NO: 1125313 - protein, 24 aa, Mycobacterium
LIPPGQSGELVFRLSEPTSAGAPR

SEQ ID NO: 1125314 - protein, 18 aa, Mycobacterium
LIQRRRAEQLGRRVRARQ

SEQ ID NO: 1125315 - protein, 25 aa, Mycobacterium
LIRRWRLSDEIALFVGTAVVVVLVI

SEQ ID NO: 1125316 - protein, 33 aa, Mycobacterium
LISLGVSAAYLWSLWALFIGHAGMPGMRMAFSL

SEQ ID NO: 1125317 - protein, 23 aa, Mycobacterium
LISNWLAVLPLQYGGSDGAAGEL

SEQ ID NO: 1125318 - protein, 17 aa, Mycobacterium
LISPRADARVGLRGAAV

SEQ ID NO: 1125319 - protein, 18 aa, Mycobacterium
LITFPTLVTLGFPPVTAT

SEQ ID NO: 1125320 - protein, 25 aa, Mycobacterium
LIVAGCLLRTAGFGLLIFAESLPAV

SEQ ID NO: 1125321 - protein, 25 aa, Mycobacterium
LIVGLFLWIAIVWRGLRSSLKTSSK

SEQ ID NO: 1125322 - protein, 26 aa, Mycobacterium
LIVGLFLWIAIVWRGLRSSLKTSSKT

SEQ ID NO: 1125323 - protein, 18 aa, Mycobacterium
LIVLVVFVAFTFRPRIPK

SEQ ID NO: 1125324 - protein, 25 aa, Mycobacterium
LIVSDRGYFIFLALLPFIMGVLSLS

SEQ ID NO: 1125325 - protein, 19 aa, Mycobacterium
LIVSRQWKLLGAYAAAGLI

SEQ ID NO: 1125326 - protein, 24 aa, Mycobacterium
LIVTYRSPVLWLVPLLVIGFADRV

SEQ ID NO: 1125327 - protein, 17 aa, Mycobacterium
LIVWSALSLIALLGGTG

SEQ ID NO: 1125328 - protein, 22 aa, Mycobacterium
LIWLPAVRCPAGIAVVAGVVAE

SEQ ID NO: 1125329 - protein, 27 aa, Mycobacterium
LIWVDRRFRIGHGRLFALYVAGYCVGR

SEQ ID NO: 1125330 - protein, 18 aa, Mycobacterium
LIYAIPIIVGMVLLILPL

SEQ ID NO: 1125331 - protein, 18 aa, Mycobacterium
LIYLAIRTAMRTLPKGAE

SEQ ID NO: 1125332 - protein, 27 aa, Mycobacterium
LIYMLPLLLLVGLFVMFSRMQTGGRMG

SEQ ID NO: 1125333 - protein, 17 aa, Mycobacterium
LIYNVVSALTFLVGALL

SEQ ID NO: 1125334 - protein, 32 aa, Mycobacterium
LKAAARLPVTWEMSFLYAVVFGGFVAFSNYLP

SEQ ID NO: 1125335 - protein, 22 aa, Mycobacterium
LKADDRFIVIPSLEQQVADAKA

SEQ ID NO: 1125336 - protein, 21 aa, Mycobacterium
LKAFAYWLDRYELLSHTRGGK

SEQ ID NO: 1125337 - protein, 18 aa, Mycobacterium
LKARAEAGDHAAARALTV

SEQ ID NO: 1125338 - protein, 21 aa, Mycobacterium
LKASSLVYFLGLIANQRELFQ

SEQ ID NO: 1125339 - protein, 20 aa, Mycobacterium
LKEEIHAGIGTGIIRAMGGS

SEQ ID NO: 1125340 - protein, 19 aa, Mycobacterium
LKFAMFMLAEYVNMTTVSA

SEQ ID NO: 1125341 - protein, 17 aa, Mycobacterium
LKGFARITGEGAYANAY

SEQ ID NO: 1125342 - protein, 18 aa, Mycobacterium
LKGTAGWFDSMGMRPGMF

SEQ ID NO: 1125343 - protein, 21 aa, Mycobacterium
LKKFGMMAVAMVLYVLISQVG

SEQ ID NO: 1125344 - protein, 24 aa, Mycobacterium
LKKLRSNETFVYLARAVDPAIAEA

SEQ ID NO: 1125345 - protein, 18 aa, Mycobacterium
LKPLSIIGGLYAMTLDMF

SEQ ID NO: 1125346 - protein, 22 aa, Mycobacterium
LKRKITGSLLFLFILGDVLGAG

SEQ ID NO: 1125347 - protein, 17 aa, Mycobacterium
LKSAAGVLEQFPHVVAS

SEQ ID NO: 1125348 - protein, 31 aa, Mycobacterium
LKSTFPILMEGLRLTLILTVVSIAIALVLGV

SEQ ID NO: 1125349 - protein, 21 aa, Mycobacterium
LKSTVSIVLLVWVVLAVLNVL

SEQ ID NO: 1125350 - protein, 25 aa, Mycobacterium
LKVNQAGVIPVIFASSLIYIPHLIT

SEQ ID NO: 1125351 - protein, 17 aa, Mycobacterium
LLAAAAVAVVWAWDHTG

SEQ ID NO: 1125352 - protein, 17 aa, Mycobacterium
LLAAYPFIEKKLSGDDA

SEQ ID NO: 1125353 - protein, 17 aa, Mycobacterium
LLADPVIPADKRVALLK

SEQ ID NO: 1125354 - protein, 30 aa, Mycobacterium
LLAFCIPAGLFSLGCFYVFGSLEHLHGATP

SEQ ID NO: 1125355 - protein, 23 aa, Mycobacterium
LLAGAVFALWAFIAADLTAKLPL

SEQ ID NO: 1125356 - protein, 17 aa, Mycobacterium
LLAGLALVVVLAAVTGW

SEQ ID NO: 1125357 - protein, 19 aa, Mycobacterium
LLAGWAAAVLTVWSALVAA

SEQ ID NO: 1125358 - protein, 31 aa, Mycobacterium
LLAGWRAIREYDLKLILAFGTVSQLGFITVM

SEQ ID NO: 1125359 - protein, 18 aa, Mycobacterium
LLALPLVAIVLFFVFGGV

SEQ ID NO: 1125360 - protein, 24 aa, Mycobacterium
LLALWRLDRLDGRRMHRVIPTRWR

SEQ ID NO: 1125361 - protein, 17 aa, Mycobacterium
LLANILVATRLTYSMAR

SEQ ID NO: 1125362 - protein, 29 aa, Mycobacterium
LLAPLLVYRWGRMAFYPLALVPLGSLFWV

SEQ ID NO: 1125363 - protein, 25 aa, Mycobacterium
LLASGLAWRRGRTVLARLGAPVFLS

SEQ ID NO: 1125364 - protein, 20 aa, Mycobacterium
LLAYWCGPAIIAFVRDPGKP

SEQ ID NO: 1125365 - protein, 18 aa, Mycobacterium
LLCAGWPARVAAINVAVP

SEQ ID NO: 1125366 - protein, 20 aa, Mycobacterium
LLCGIVVPRAQLPDWLQWIS

SEQ ID NO: 1125367 - protein, 20 aa, Mycobacterium
LLCLPQLRTLLSVQLHLQAV

SEQ ID NO: 1125368 - protein, 19 aa, Mycobacterium
LLCMVFKPGDDIVFGGVGI

SEQ ID NO: 1125369 - protein, 23 aa, Mycobacterium
LLDAAVCFIGFLCPLWDRRRQTL

SEQ ID NO: 1125370 - protein, 17 aa, Mycobacterium
LLDRIAAAAAAWTTDAA

SEQ ID NO: 1125371 - protein, 18 aa, Mycobacterium
LLDSPMYFDVMYGDKELA

SEQ ID NO: 1125372 - protein, 29 aa, Mycobacterium
LLDSSRLAAGVVRPELQPVYLEEAVPRAL

SEQ ID NO: 1125373 - protein, 18 aa, Mycobacterium
LLEGLNYYVARLNPKLPT

SEQ ID NO: 1125374 - protein, 26 aa, Mycobacterium
LLELRRRVFRHFGRLDIAFHDRYTSG

SEQ ID NO: 1125375 - protein, 23 aa, Mycobacterium
LLERRSRIGGTWDLHRYPGIRSD

SEQ ID NO: 1125376 - protein, 27 aa, Mycobacterium
LLFAAFREFERLLGLDQPPAVQPEVPA

SEQ ID NO: 1125377 - protein, 17 aa, Mycobacterium
LLFGVPWSTLVVGGAAW

SEQ ID NO: 1125378 - protein, 18 aa, Mycobacterium
LLFHPINSITAYKGQIIY

SEQ ID NO: 1125379 - protein, 19 aa, Mycobacterium
LLFNVLGSWVYVKIFAGLL

SEQ ID NO: 1125380 - protein, 20 aa, Mycobacterium
LLFTIPLQLLTGQRSAIVTS

SEQ ID NO: 1125381 - protein, 22 aa, Mycobacterium
LLGAFMVLSGWAVLKVSVKAIY

SEQ ID NO: 1125382 - protein, 25 aa, Mycobacterium
LLGALCLLGTAWLVIYARSSTRAGA

SEQ ID NO: 1125383 - protein, 18 aa, Mycobacterium
LLGASRVADLCWVAGTVV

SEQ ID NO: 1125384 - protein, 17 aa, Mycobacterium
LLGATLLGLLALTAVVA

SEQ ID NO: 1125385 - protein, 17 aa, Mycobacterium
LLGGYGAMFVVLGAVAL

SEQ ID NO: 1125386 - protein, 17 aa, Mycobacterium
LLGIRAWLQKPAPPEVI

SEQ ID NO: 1125387 - protein, 23 aa, Mycobacterium
LLGLLWYAGLPLRVFLSSLGAVL

SEQ ID NO: 1125388 - protein, 17 aa, Mycobacterium
LLGMVAVLFAISVIVFL

SEQ ID NO: 1125389 - protein, 22 aa, Mycobacterium
LLGRSELFTEGFLIPVTTVAAK

SEQ ID NO: 1125390 - protein, 17 aa, Mycobacterium
LLGSRLIFAHLFVVAAI

SEQ ID NO: 1125391 - protein, 17 aa, Mycobacterium
LLGSRLIFAHLFVVAAV

SEQ ID NO: 1125392 - protein, 20 aa, Mycobacterium
LLGTFSLRAESLLIDPGLDD

SEQ ID NO: 1125393 - protein, 18 aa, Mycobacterium
LLGTTLVGFGFVVGGPAM

SEQ ID NO: 1125394 - protein, 19 aa, Mycobacterium
LLGWRAVVQVARRRAAHRS

SEQ ID NO: 1125395 - protein, 19 aa, Mycobacterium
LLHDLAWKATLPDHRAAIA

SEQ ID NO: 1125396 - protein, 22 aa, Mycobacterium
LLHRAKGGGLSSLFGGGVQSSL

SEQ ID NO: 1125397 - protein, 21 aa, Mycobacterium
LLIFLFWPWEYKPFGDEGEFL

SEQ ID NO: 1125398 - protein, 21 aa, Mycobacterium
LLIIMGAFMYFASRRQKKAMQ

SEQ ID NO: 1125399 - protein, 26 aa, Mycobacterium
LLIMLPFMLMWPFWLLAKWLGVPWTI

SEQ ID NO: 1125400 - protein, 23 aa, Mycobacterium
LLIPCLGLAWAVSNPDINFAVLL

SEQ ID NO: 1125401 - protein, 19 aa, Mycobacterium
LLIRPEMGAGIGAIGIFVF

SEQ ID NO: 1125402 - protein, 27 aa, Mycobacterium
LLISVALVWKGFREGVAFVSMVVVIAA

SEQ ID NO: 1125403 - protein, 27 aa, Mycobacterium
LLLAAACAGIAVATEFALQRFLMNQLD

SEQ ID NO: 1125404 - protein, 21 aa, Mycobacterium
LLLAAVLSWAAIELAHLTGLS

SEQ ID NO: 1125405 - protein, 21 aa, Mycobacterium
LLLAIPFSVLLVFTFNILLTE

SEQ ID NO: 1125406 - protein, 19 aa, Mycobacterium
LLLCDHHGAALIVTVGHTA

SEQ ID NO: 1125407 - protein, 19 aa, Mycobacterium
LLLFALACPLMMMFMMGGM

SEQ ID NO: 1125408 - protein, 17 aa, Mycobacterium
LLLGGRIGDAVGHKRAF

SEQ ID NO: 1125409 - protein, 27 aa, Mycobacterium
LLLGPRLVDTYVNWLWFGELGYRSVFT

SEQ ID NO: 1125410 - protein, 23 aa, Mycobacterium
LLLGRPLIESALFGLAIAVGITP

SEQ ID NO: 1125411 - protein, 17 aa, Mycobacterium
LLLIIAIGFLTSVFVEP

SEQ ID NO: 1125412 - protein, 29 aa, Mycobacterium
LLLLELPLRIGVFFNLPLNCEVVVIVIIV

SEQ ID NO: 1125413 - protein, 17 aa, Mycobacterium
LLLLLPRIDEFIKKLKR

SEQ ID NO: 1125414 - protein, 19 aa, Mycobacterium
LLLPAGALGDRHGRRAVLI

SEQ ID NO: 1125415 - protein, 18 aa, Mycobacterium
LLLPAGALGDRYGRRGAL

SEQ ID NO: 1125416 - protein, 18 aa, Mycobacterium
LLLPYSMRAAVTAFQQLD

SEQ ID NO: 1125417 - protein, 23 aa, Mycobacterium
LLLRAIVAPLYLLGTVVLNYAAA

SEQ ID NO: 1125418 - protein, 24 aa, Mycobacterium
LLLRARLDPPGGRLLDNAVIRTIL

SEQ ID NO: 1125419 - protein, 17 aa, Mycobacterium
LLLSPAVTRSFDQLEAM

SEQ ID NO: 1125420 - protein, 26 aa, Mycobacterium
LLLSSLIVGAGWPLVVEQISVRPNAA

SEQ ID NO: 1125421 - protein, 25 aa, Mycobacterium
LLLTIPVLLTHQWQLVFVAAALLGA

SEQ ID NO: 1125422 - protein, 25 aa, Mycobacterium
LLLVAWAVVMAMLYEPGRPYRKNYL

SEQ ID NO: 1125423 - protein, 17 aa, Mycobacterium
LLLVFGISFEFPLLIIM

SEQ ID NO: 1125424 - protein, 18 aa, Mycobacterium
LLLVIDEFQVLFDGNDDV

SEQ ID NO: 1125425 - protein, 18 aa, Mycobacterium
LLLWAGRPAALATALAFA

SEQ ID NO: 1125426 - protein, 34 aa, Mycobacterium
LLLYRLKGLRAMLARFLFHCWVALTVLIAVLTVV

SEQ ID NO: 1125427 - protein, 18 aa, Mycobacterium
LLMLLAFGSLVLTAYPLK

SEQ ID NO: 1125428 - protein, 17 aa, Mycobacterium
LLMNMGASSAYDRVQQN

SEQ ID NO: 1125429 - protein, 18 aa, Mycobacterium
LLMSISFAALIAAKVAFM

SEQ ID NO: 1125430 - protein, 27 aa, Mycobacterium
LLNGLVCLIGLSGGYVFSVFLQGVNPG

SEQ ID NO: 1125431 - protein, 18 aa, Mycobacterium
LLNNLPFAQKVAVSDYSR

SEQ ID NO: 1125432 - protein, 24 aa, Mycobacterium
LLNNRFLLEPVLNRIGLFGNKIAL

SEQ ID NO: 1125433 - protein, 18 aa, Mycobacterium
LLNRQWRALVTAFAVPVA

SEQ ID NO: 1125434 - protein, 18 aa, Mycobacterium
LLNSLALLSTGDRLPEGA

SEQ ID NO: 1125435 - protein, 26 aa, Mycobacterium
LLPAAARGLAKWVALSVSLIVLGVAA

SEQ ID NO: 1125436 - protein, 18 aa, Mycobacterium
LLPAALGLIVFIGVATAG

SEQ ID NO: 1125437 - protein, 22 aa, Mycobacterium
LLPDSLRVTAAMSRLMDEREQF

SEQ ID NO: 1125438 - protein, 17 aa, Mycobacterium
LLPGQFVQPFIDAAFSD

SEQ ID NO: 1125439 - protein, 19 aa, Mycobacterium
LLPHLFERFVRADRSRSRQ

SEQ ID NO: 1125440 - protein, 27 aa, Mycobacterium
LLPPRSARWWLALNVIGALAINHLILT

SEQ ID NO: 1125441 - protein, 34 aa, Mycobacterium
LLQGHWSLLVGYGCLPWVALCFAPKLHSSSGSAS

SEQ ID NO: 1125442 - protein, 23 aa, Mycobacterium
LLQLPGRLINAFLQVFDLTSSAS

SEQ ID NO: 1125443 - protein, 23 aa, Mycobacterium
LLQTRIGFHYGFGAAAIGMALGL

SEQ ID NO: 1125444 - protein, 25 aa, Mycobacterium
LLRARWITLCVALIVAVLGAVAVSM

SEQ ID NO: 1125445 - protein, 28 aa, Mycobacterium
LLRDRLQAEFPRSATLPFASENRIMATL

SEQ ID NO: 1125446 - protein, 17 aa, Mycobacterium
LLRGAYEATAVFYFDFV

SEQ ID NO: 1125447 - protein, 19 aa, Mycobacterium
LLRNRLAWTVTLFFGCQSL

SEQ ID NO: 1125448 - protein, 20 aa, Mycobacterium
LLRTAGDVTGIFSERSSQVN

SEQ ID NO: 1125449 - protein, 27 aa, Mycobacterium
LLSGGRLRFGVGVGWNAVEYEALGEQF

SEQ ID NO: 1125450 - protein, 24 aa, Mycobacterium
LLSRREALRRLSLIGIGTAGATAL

SEQ ID NO: 1125451 - protein, 24 aa, Mycobacterium
LLSVLGLSGLVFFLSQYFQLVHGY

SEQ ID NO: 1125452 - protein, 17 aa, Mycobacterium
LLTAAALRLSEASLTGE

SEQ ID NO: 1125453 - protein, 18 aa, Mycobacterium
LLTAWVFSGSIVTGLSSI

SEQ ID NO: 1125454 - protein, 20 aa, Mycobacterium
LLTDRFQRMLLIAPATAVFA

SEQ ID NO: 1125455 - protein, 18 aa, Mycobacterium
LLTEARPPLAGTVDQLNR

SEQ ID NO: 1125456 - protein, 17 aa, Mycobacterium
LLTEYVWGRQVGEHTIN

SEQ ID NO: 1125457 - protein, 17 aa, Mycobacterium
LLTILAGPIFGYSDRAA

SEQ ID NO: 1125458 - protein, 25 aa, Mycobacterium
LLTLAGRAVGWLSFDTIGDIHDVDF

SEQ ID NO: 1125459 - protein, 25 aa, Mycobacterium
LLTRAGEGLLVYLGLGAMLGLVASW

SEQ ID NO: 1125460 - protein, 23 aa, Mycobacterium
LLTRREAMRRLALLGVGGAAATA

SEQ ID NO: 1125461 - protein, 18 aa, Mycobacterium
LLVAAWFAVFALPLLISP

SEQ ID NO: 1125462 - protein, 18 aa, Mycobacterium
LLVASFEREADWKPSAEK

SEQ ID NO: 1125463 - protein, 17 aa, Mycobacterium
LLVFAVLIWADRRFNLG

SEQ ID NO: 1125464 - protein, 17 aa, Mycobacterium
LLVGGAIASVWFWVPLG

SEQ ID NO: 1125465 - protein, 25 aa, Mycobacterium
LLVGRGVCPVAWWQPVAWLAYPAAY

SEQ ID NO: 1125466 - protein, 19 aa, Mycobacterium
LLVIGSFACALAFHNAASR

SEQ ID NO: 1125467 - protein, 17 aa, Mycobacterium
LLVPSLVSLIWFAVFGG

SEQ ID NO: 1125468 - protein, 28 aa, Mycobacterium
LLVPSLVSLVWFCILGGAAIDTQQGGVD

SEQ ID NO: 1125469 - protein, 17 aa, Mycobacterium
LLVQAFFIYFGVPSALD

SEQ ID NO: 1125470 - protein, 19 aa, Mycobacterium
LLVSGRLGDRYGPKTVYLV

SEQ ID NO: 1125471 - protein, 24 aa, Mycobacterium
LLVTCLERLGAILVGHAGWPARIV

SEQ ID NO: 1125472 - protein, 25 aa, Mycobacterium
LLVTVCILPALQFGFWLLQGSSKQS

SEQ ID NO: 1125473 - protein, 18 aa, Mycobacterium
LLVVCFYVAMVITNFAWL

SEQ ID NO: 1125474 - protein, 33 aa, Mycobacterium
LLVVFLVLCILLRAVIAPIYLVASVVLSYVSAI

SEQ ID NO: 1125475 - protein, 21 aa, Mycobacterium
LLWLFRWPSRAQSLAYSTVCS

SEQ ID NO: 1125476 - protein, 24 aa, Mycobacterium
LLWRGHAAAARGLRSRPTTGHYLR

SEQ ID NO: 1125477 - protein, 25 aa, Mycobacterium
LLYLRVPALNALFPAHRTSVLDAIG

SEQ ID NO: 1125478 - protein, 18 aa, Mycobacterium
LLYRYYRTRDPFFWMLTS

SEQ ID NO: 1125479 - protein, 25 aa, Mycobacterium
LLYSLLYYRVLGVLIALSLTASGAM

SEQ ID NO: 1125480 - protein, 23 aa, Mycobacterium
LLYVCSLFTAIFVVAAVERTVRH

SEQ ID NO: 1125481 - protein, 18 aa, Mycobacterium
LLYYAIANASAWTLGARL

SEQ ID NO: 1125482 - protein, 17 aa, Mycobacterium
LMAANRLVLPVATGWTL

SEQ ID NO: 1125483 - protein, 28 aa, Mycobacterium
LMALVRLSAWYVFRFGRRRLDEQIADTG

SEQ ID NO: 1125484 - protein, 24 aa, Mycobacterium
LMGDQKLGGGIAWAAGEIPLVVVL

SEQ ID NO: 1125485 - protein, 18 aa, Mycobacterium
LMGLQLALTELWRSYDVH

SEQ ID NO: 1125486 - protein, 19 aa, Mycobacterium
LMGTNLWGAVIGFAVLGLL

SEQ ID NO: 1125487 - protein, 24 aa, Mycobacterium
LMKPVIDMFGYRGVFVAAALLAVG

SEQ ID NO: 1125488 - protein, 17 aa, Mycobacterium
LMLALNCILTYFDVNLT

SEQ ID NO: 1125489 - protein, 26 aa, Mycobacterium
LMLALWLVAVGFEWTQPGAGHPHHGP

SEQ ID NO: 1125490 - protein, 24 aa, Mycobacterium
LMLHRSGICIMTFATPVRHQLDPN

SEQ ID NO: 1125491 - protein, 28 aa, Mycobacterium
LMPLLYGAMYLWAFWNPFAEVNKVPVAL

SEQ ID NO: 1125492 - protein, 23 aa, Mycobacterium
LMPWTQWITWGFQVVPVFFAVAG

SEQ ID NO: 1125493 - protein, 20 aa, Mycobacterium
LMQGENTVAFLIGLFSSAII

SEQ ID NO: 1125494 - protein, 17 aa, Mycobacterium
LMRVGFLGAPLIVGVVA

SEQ ID NO: 1125495 - protein, 19 aa, Mycobacterium
LMRVVDVMFAFPVLLLALA

SEQ ID NO: 1125496 - protein, 22 aa, Mycobacterium
LMSRHVSCVRVLDIGSRGDGVY

SEQ ID NO: 1125497 - protein, 25 aa, Mycobacterium
LMTALRSPLTWGVVAGLVIGKFVGI

SEQ ID NO: 1125498 - protein, 19 aa, Mycobacterium
LMTEARPPLAGSIDQLNRV

SEQ ID NO: 1125499 - protein, 24 aa, Mycobacterium
LMVARAGLGVALAFLMGLSLAIVN

SEQ ID NO: 1125500 - protein, 23 aa, Mycobacterium
LMVPNLIALIGWVLALSGIQTQV

SEQ ID NO: 1125501 - protein, 18 aa, Mycobacterium
LMVPSAAESVRFGDDATG

SEQ ID NO: 1125502 - protein, 20 aa, Mycobacterium
LMVTPFRRVMRAGTSSFVVL

SEQ ID NO: 1125503 - protein, 23 aa, Mycobacterium
LMVTSFRMISWSTIRKIVTSTRS

SEQ ID NO: 1125504 - protein, 21 aa, Mycobacterium
LMWLLSWLIATPVRVVRSALK

SEQ ID NO: 1125505 - protein, 25 aa, Mycobacterium
LNAAANWCLRRVGVTPVDELADTQD

SEQ ID NO: 1125506 - protein, 18 aa, Mycobacterium
LNAAWKHIKERGAGSLML

SEQ ID NO: 1125507 - protein, 17 aa, Mycobacterium
LNAGEVIERVIERDSPT

SEQ ID NO: 1125508 - protein, 17 aa, Mycobacterium
LNALFLPPAPAAPAAPP

SEQ ID NO: 1125509 - protein, 25 aa, Mycobacterium
LNARELRRHPGRTAMSLAVVAISAT

SEQ ID NO: 1125510 - protein, 19 aa, Mycobacterium
LNLALAVPVTLVLIASSFT

SEQ ID NO: 1125511 - protein, 25 aa, Mycobacterium
LNLEVLDVAGPFPKEAVQSALDDLT

SEQ ID NO: 1125512 - protein, 18 aa, Mycobacterium
LNPAAAFIKACKLIYDIV

SEQ ID NO: 1125513 - protein, 22 aa, Mycobacterium
LNPKLTIFFFAFLPQFVDPARP

SEQ ID NO: 1125514 - protein, 18 aa, Mycobacterium
LNRSCARAVVTSTREEIT

SEQ ID NO: 1125515 - protein, 18 aa, Mycobacterium
LNSLPMLAAMAWVCADAI

SEQ ID NO: 1125516 - protein, 17 aa, Mycobacterium
LNSVMAMSIRREVERLV

SEQ ID NO: 1125517 - protein, 24 aa, Mycobacterium
LNTRNVFGPPAWAPVVNNVVAILT

SEQ ID NO: 1125518 - protein, 19 aa, Mycobacterium
LNYFSWQSIFYMFAGGALL

SEQ ID NO: 1125519 - protein, 26 aa, Mycobacterium
LPAALLLSQFVPWLLTPILMLGATYL

SEQ ID NO: 1125520 - protein, 19 aa, Mycobacterium
LPAIMTVTLAIGVQRMSRR

SEQ ID NO: 1125521 - protein, 17 aa, Mycobacterium
LPALRQAVATAFEDPTL

SEQ ID NO: 1125522 - protein, 18 aa, Mycobacterium
LPALRQAVATAFEDPTLF

SEQ ID NO: 1125523 - protein, 24 aa, Mycobacterium
LPAMSVLRPEWWEAVQTAGGTRWQ

SEQ ID NO: 1125524 - protein, 19 aa, Mycobacterium
LPATLCIPLLLAAFSAGNG

SEQ ID NO: 1125525 - protein, 17 aa, Mycobacterium
LPAVEALGSVTVICSDK

SEQ ID NO: 1125526 - protein, 26 aa, Mycobacterium
LPAVLRPGVLVQRVWTRSAPALAALA

SEQ ID NO: 1125527 - protein, 17 aa, Mycobacterium
LPDPAVMNIPPDRPESR

SEQ ID NO: 1125528 - protein, 18 aa, Mycobacterium
LPEPPWWEVAISSVYMSF

SEQ ID NO: 1125529 - protein, 18 aa, Mycobacterium
LPFKEKWRAPDAIAAVLG

SEQ ID NO: 1125530 - protein, 19 aa, Mycobacterium
LPFLQGKEYKAYFAEAGGL

SEQ ID NO: 1125531 - protein, 22 aa, Mycobacterium
LPFVILIGLIVSRQWKLLGAYA

SEQ ID NO: 1125532 - protein, 20 aa, Mycobacterium
LPGCECGSVPIARRLFGEST

SEQ ID NO: 1125533 - protein, 19 aa, Mycobacterium
LPGGIAIPHCRSPYVDTPT

SEQ ID NO: 1125534 - protein, 37 aa, Mycobacterium
LPGGRVPREVRLQLRLPLIGEEARWMVQIQLNGQLLD

SEQ ID NO: 1125535 - protein, 20 aa, Mycobacterium
LPGIFGGLLNLAATVHYLLE

SEQ ID NO: 1125536 - protein, 21 aa, Mycobacterium
LPGLCITLVLLAATLAWPNVR

SEQ ID NO: 1125537 - protein, 23 aa, Mycobacterium
LPGRAWEIFIGVISLIAGVVMLA

SEQ ID NO: 1125538 - protein, 18 aa, Mycobacterium
LPGWQQIVTVLLLIGVGL

SEQ ID NO: 1125539 - protein, 21 aa, Mycobacterium
LPGWRPQRRRRIIVAGLASTF

SEQ ID NO: 1125540 - protein, 17 aa, Mycobacterium
LPIALGLLIMMYPVLAK

SEQ ID NO: 1125541 - protein, 29 aa, Mycobacterium
LPIIYAILILCIFLNFLIRQKKNKLDWLV

SEQ ID NO: 1125542 - protein, 17 aa, Mycobacterium
LPIVILPGGPSGGGGAV

SEQ ID NO: 1125543 - protein, 24 aa, Mycobacterium
LPIVNASGGPNCRGLPDVPNKQYG

SEQ ID NO: 1125544 - protein, 19 aa, Mycobacterium
LPIWSARPQFLMAPATFVR

SEQ ID NO: 1125545 - protein, 20 aa, Mycobacterium
LPKADIGDLVIIPDDISALA

SEQ ID NO: 1125546 - protein, 18 aa, Mycobacterium
LPKWFGYLGLCNALTEVV

SEQ ID NO: 1125547 - protein, 22 aa, Mycobacterium
LPLALLMAGSAWLASGSAVRAV

SEQ ID NO: 1125548 - protein, 17 aa, Mycobacterium
LPLAPVAPRDDRDEPPP

SEQ ID NO: 1125549 - protein, 18 aa, Mycobacterium
LPLDPERTKPAASQSNPD

SEQ ID NO: 1125550 - protein, 19 aa, Mycobacterium
LPLIPVFMVLIGLATADRS

SEQ ID NO: 1125551 - protein, 17 aa, Mycobacterium
LPLLFVLYLRESDVFRD

SEQ ID NO: 1125552 - protein, 17 aa, Mycobacterium
LPLLNRQWRALVTAFAV

SEQ ID NO: 1125553 - protein, 17 aa, Mycobacterium
LPLLSFIVAPARTRIWV

SEQ ID NO: 1125554 - protein, 21 aa, Mycobacterium
LPLLWCQAAKAPIRGPPRNAR

SEQ ID NO: 1125555 - protein, 20 aa, Mycobacterium
LPLMQRLMGRVGMIDSVLVV

SEQ ID NO: 1125556 - protein, 17 aa, Mycobacterium
LPLMVTILIVTTTILMF

SEQ ID NO: 1125557 - protein, 17 aa, Mycobacterium
LPLPAPYVPTRTEALRD

SEQ ID NO: 1125558 - protein, 18 aa, Mycobacterium
LPLREIVPAVQRIVAPSD

SEQ ID NO: 1125559 - protein, 23 aa, Mycobacterium
LPLSDGWLTGAWVIMLAAVALTV

SEQ ID NO: 1125560 - protein, 25 aa, Mycobacterium
LPMAVFPMYFLRSFAYAGVAVVGFA

SEQ ID NO: 1125561 - protein, 19 aa, Mycobacterium
LPMLAAMAWVCADAILLVR

SEQ ID NO: 1125562 - protein, 21 aa, Mycobacterium
LPMLVAIAVCLSRQPRAVLYI

SEQ ID NO: 1125563 - protein, 27 aa, Mycobacterium
LPMRTRHGVVILTGFWLAAAAVEVGRY

SEQ ID NO: 1125564 - protein, 24 aa, Mycobacterium
LPMVVGCVRVRASITVSPDDRVSG

SEQ ID NO: 1125565 - protein, 17 aa, Mycobacterium
LPNIVSTIIVFFTLNIA

SEQ ID NO: 1125566 - protein, 29 aa, Mycobacterium
LPNSVLRNWPAWLAVYGFMTMDRWLMWRW

SEQ ID NO: 1125567 - protein, 20 aa, Mycobacterium
LPPIEDWCRPGSTTLWLHND

SEQ ID NO: 1125568 - protein, 22 aa, Mycobacterium
LPPLLKKCRLDPALVSAPAIAT

SEQ ID NO: 1125569 - protein, 19 aa, Mycobacterium
LPPLMAVTMFGAFFIVLFN

SEQ ID NO: 1125570 - protein, 17 aa, Mycobacterium
LPPPCVTGFLPPQQRRN

SEQ ID NO: 1125571 - protein, 18 aa, Mycobacterium
LPPVAIVAMAWMLTAWQD

SEQ ID NO: 1125572 - protein, 21 aa, Mycobacterium
LPPWKDIWSYFGSSFGIAAML

SEQ ID NO: 1125573 - protein, 18 aa, Mycobacterium
LPPWPNRVPLTAGDSRTP

SEQ ID NO: 1125574 - protein, 18 aa, Mycobacterium
LPQAFTHARRARRIMLQN

SEQ ID NO: 1125575 - protein, 18 aa, Mycobacterium
LPQLWQLALHLTLTGIAL

SEQ ID NO: 1125576 - protein, 23 aa, Mycobacterium
LPRHPSFARRDLSSMRRGNLYPI

SEQ ID NO: 1125577 - protein, 23 aa, Mycobacterium
LPRRYWRVTALLVGFGVVNFPDA

SEQ ID NO: 1125578 - protein, 18 aa, Mycobacterium
LPRSEWTPPASGLHGAGN

SEQ ID NO: 1125579 - protein, 26 aa, Mycobacterium
LPRWIYVPAVAGALFVGLPVVSVAAK

SEQ ID NO: 1125580 - protein, 22 aa, Mycobacterium
LPSGAFLQRFMPVLNGVYATGQ

SEQ ID NO: 1125581 - protein, 17 aa, Mycobacterium
LPSIFLLPWLARVFGLP

SEQ ID NO: 1125582 - protein, 20 aa, Mycobacterium
LPSLLFGIGRYQVAMELPTT

SEQ ID NO: 1125583 - protein, 20 aa, Mycobacterium
LPSLLLFLGVGVLVGEDGLG

SEQ ID NO: 1125584 - protein, 20 aa, Mycobacterium
LPSLRRVAGQRGMSYLRLTA

SEQ ID NO: 1125585 - protein, 18 aa, Mycobacterium
LPTFLSYITEKKLSKHPE

SEQ ID NO: 1125586 - protein, 20 aa, Mycobacterium
LPTMRKVILPQAIRTMIPSY

SEQ ID NO: 1125587 - protein, 17 aa, Mycobacterium
LPTPLSVHVYRLVWRQM

SEQ ID NO: 1125588 - protein, 17 aa, Mycobacterium
LPVASLIPDIVRLAGAD

SEQ ID NO: 1125589 - protein, 17 aa, Mycobacterium
LPVDVASALALAVAIQL

SEQ ID NO: 1125590 - protein, 21 aa, Mycobacterium
LPVDVASALALTVAIQLLLQH

SEQ ID NO: 1125591 - protein, 20 aa, Mycobacterium
LPVLCAGLALTAAGMLAAVV

SEQ ID NO: 1125592 - protein, 18 aa, Mycobacterium
LPVPRFVAQVPFRVAPSV

SEQ ID NO: 1125593 - protein, 22 aa, Mycobacterium
LPVQLGKDWIWLHAARIAAAAL

SEQ ID NO: 1125594 - protein, 21 aa, Mycobacterium
LPVRARIPAIVVVAAASLFWV

SEQ ID NO: 1125595 - protein, 20 aa, Mycobacterium
LPVRLVAAAVALACAALGPA

SEQ ID NO: 1125596 - protein, 19 aa, Mycobacterium
LPVRRPGARLVPGHANGEP

SEQ ID NO: 1125597 - protein, 19 aa, Mycobacterium
LPVSFYPATRLRLVDTAVN

SEQ ID NO: 1125598 - protein, 23 aa, Mycobacterium
LPVVFYSAWIFFDGAFRALRART

SEQ ID NO: 1125599 - protein, 27 aa, Mycobacterium
LPVVFYSAWIFFDGAFRALRARTLDMM

SEQ ID NO: 1125600 - protein, 21 aa, Mycobacterium
LPVVFYSAWIFFDGAYRALRA

SEQ ID NO: 1125601 - protein, 22 aa, Mycobacterium
LPWQFFAALVALTIGYLVLVDV

SEQ ID NO: 1125602 - protein, 17 aa, Mycobacterium
LQAFRDGLVVQRAAAGP

SEQ ID NO: 1125603 - protein, 19 aa, Mycobacterium
LQDRGCLAFCSATSLVFYE

SEQ ID NO: 1125604 - protein, 19 aa, Mycobacterium
LQDSAVWKAVQLLLESFAF

SEQ ID NO: 1125605 - protein, 18 aa, Mycobacterium
LQEPYLLGCLNARNELSL

SEQ ID NO: 1125606 - protein, 26 aa, Mycobacterium
LQGFGRRPAWVLAEIVVVVALMLSTE

SEQ ID NO: 1125607 - protein, 24 aa, Mycobacterium
LQHTKWGVGIALLFVTLPFVVRSV

SEQ ID NO: 1125608 - protein, 23 aa, Mycobacterium
LQIYVVMGASWVCYRGLQGEPIP

SEQ ID NO: 1125609 - protein, 19 aa, Mycobacterium
LQKAVKLLNSYAMSLGESV

SEQ ID NO: 1125610 - protein, 21 aa, Mycobacterium
LQLALTELWRSYDVHPDAVIG

SEQ ID NO: 1125611 - protein, 27 aa, Mycobacterium
LQLASAICRHYWPIALIAALVSRRSRR

SEQ ID NO: 1125612 - protein, 21 aa, Mycobacterium
LQPERLLSWATAIRYQALFAE

SEQ ID NO: 1125613 - protein, 25 aa, Mycobacterium
LQQLGRKRLILWAAVLTLANVLADV

SEQ ID NO: 1125614 - protein, 19 aa, Mycobacterium
LQQRAQLLAAGRDGAVLLT

SEQ ID NO: 1125615 - protein, 23 aa, Mycobacterium
LQRLRGMTPRAALTKHLLDGDDS

SEQ ID NO: 1125616 - protein, 17 aa, Mycobacterium
LQSLGGFNGLFEQMRKK

SEQ ID NO: 1125617 - protein, 18 aa, Mycobacterium
LQVGGGRVRPVVPVRRSP

SEQ ID NO: 1125618 - protein, 18 aa, Mycobacterium
LQVIFTRTTPWAFHDALY

SEQ ID NO: 1125619 - protein, 32 aa, Mycobacterium
LQVLCRGRWRPGRALVGIALLAAVTPVWLVVV

SEQ ID NO: 1125620 - protein, 17 aa, Mycobacterium
LQVTAHYFWNRRNAAAL

SEQ ID NO: 1125621 - protein, 21 aa, Mycobacterium
LRADIRIAHPLISRAHLVLRF

SEQ ID NO: 1125622 - protein, 19 aa, Mycobacterium
LRADMRRSFVATTAVALLF

SEQ ID NO: 1125623 - protein, 18 aa, Mycobacterium
LRALLAPLYLLGTVVLNY

SEQ ID NO: 1125624 - protein, 21 aa, Mycobacterium
LRALLVLTVVVGLAYPVLIWL

SEQ ID NO: 1125625 - protein, 23 aa, Mycobacterium
LRALPFAALAPMRHSRVVKYLSV

SEQ ID NO: 1125626 - protein, 18 aa, Mycobacterium
LRALPFAVSLSRRSSRVI

SEQ ID NO: 1125627 - protein, 17 aa, Mycobacterium
LRALPGPGGRPVQMTGI

SEQ ID NO: 1125628 - protein, 19 aa, Mycobacterium
LRALSPPRGVSVWVGGTPA

SEQ ID NO: 1125629 - protein, 33 aa, Mycobacterium
LRAQGRRSLLPGHWDRLAVCWHLAQAQGLAIAT

SEQ ID NO: 1125630 - protein, 20 aa, Mycobacterium
LRARLKGWVPSGKYSLGKWG

SEQ ID NO: 1125631 - protein, 17 aa, Mycobacterium
LRAVLSYPRQVGDIPDS

SEQ ID NO: 1125632 - protein, 17 aa, Mycobacterium
LRAVRWGVFGLAVVGGA

SEQ ID NO: 1125633 - protein, 19 aa, Mycobacterium
LRDACAGLSAPLIEVHISN

SEQ ID NO: 1125634 - protein, 20 aa, Mycobacterium
LRDPNPPLPPWLSPSPPVPG

SEQ ID NO: 1125635 - protein, 18 aa, Mycobacterium
LREGRLSDALVRISSQFG

SEQ ID NO: 1125636 - protein, 17 aa, Mycobacterium
LRELGIRSAAGSPLTVD

SEQ ID NO: 1125637 - protein, 20 aa, Mycobacterium
LRFAENIMYYLVVTFSIVYL

SEQ ID NO: 1125638 - protein, 20 aa, Mycobacterium
LRFCCRPEATMLTLVAAPTG

SEQ ID NO: 1125639 - protein, 28 aa, Mycobacterium
LRFGHGLVVSSLLLWGGVALMLMAWLWL

SEQ ID NO: 1125640 - protein, 29 aa, Mycobacterium
LRFMQGFAVGGEWGGAVLLVAEHSPNKER

SEQ ID NO: 1125641 - protein, 28 aa, Mycobacterium
LRFSKSEAFVSITLACLVALILILPLAA

SEQ ID NO: 1125642 - protein, 20 aa, Mycobacterium
LRGALLGGLLLGVMENYGQA

SEQ ID NO: 1125643 - protein, 18 aa, Mycobacterium
LRGGRAGLRADLAARYFT

SEQ ID NO: 1125644 - protein, 19 aa, Mycobacterium
LRGHYKWMAPVALIEIVVT

SEQ ID NO: 1125645 - protein, 18 aa, Mycobacterium
LRGQFWIWAGANIAPINW

SEQ ID NO: 1125646 - protein, 23 aa, Mycobacterium
LRGSWLGHPVHPLLVTLPIGTWM

SEQ ID NO: 1125647 - protein, 22 aa, Mycobacterium
LRGWRRTIRRGGDVAGAAPAAT

SEQ ID NO: 1125648 - protein, 26 aa, Mycobacterium
LRGYDFEVTPLWAAIYMLPITVGFLL

SEQ ID NO: 1125649 - protein, 23 aa, Mycobacterium
LRHAIFRSVRRVILRKPVQHDDN

SEQ ID NO: 1125650 - protein, 22 aa, Mycobacterium
LRHIPRYPGTRMSFDAVGATAL

SEQ ID NO: 1125651 - protein, 23 aa, Mycobacterium
LRHRLRASAVLTVPVVAMAMIPA

SEQ ID NO: 1125652 - protein, 17 aa, Mycobacterium
LRIDMLFNGLADLAPLL

SEQ ID NO: 1125653 - protein, 21 aa, Mycobacterium
LRIEIAVVLAVTFALSAYTAL

SEQ ID NO: 1125654 - protein, 18 aa, Mycobacterium
LRIGDRMLVKPGERVATD

SEQ ID NO: 1125655 - protein, 17 aa, Mycobacterium
LRIGIGGGQAIDLNLVL

SEQ ID NO: 1125656 - protein, 19 aa, Mycobacterium
LRIIDPLLIELGRRHPDVG

SEQ ID NO: 1125657 - protein, 23 aa, Mycobacterium
LRIRRVEGRWGMLSMTQLMAATV

SEQ ID NO: 1125658 - protein, 19 aa, Mycobacterium
LRIVGIEWRGKINDPQWRR

SEQ ID NO: 1125659 - protein, 23 aa, Mycobacterium
LRIVLLPQAFRAVLIPLGSVLIA

SEQ ID NO: 1125660 - protein, 19 aa, Mycobacterium
LRKAVDFDTVVGFMEAGGW

SEQ ID NO: 1125661 - protein, 20 aa, Mycobacterium
LRKGEPWGAEVAFRRADGAT

SEQ ID NO: 1125662 - protein, 18 aa, Mycobacterium
LRKVIWPNRKEMATYTTV

SEQ ID NO: 1125663 - protein, 21 aa, Mycobacterium
LRLAEALGIGSTTSRVIGALA

SEQ ID NO: 1125664 - protein, 19 aa, Mycobacterium
LRLDGAMFFGVAERISNAI

SEQ ID NO: 1125665 - protein, 20 aa, Mycobacterium
LRLLAAQAIVLVAGAVTTSV

SEQ ID NO: 1125666 - protein, 17 aa, Mycobacterium
LRLLAPYLGLTLETSTL

SEQ ID NO: 1125667 - protein, 30 aa, Mycobacterium
LRLSVPDALYLGWFGPVGVSALFYLTMEAD

SEQ ID NO: 1125668 - protein, 21 aa, Mycobacterium
LRMCAHGKEGVTFGFYTTAGR

SEQ ID NO: 1125669 - protein, 18 aa, Mycobacterium
LRMGDPRGRPELRSALAE

SEQ ID NO: 1125670 - protein, 19 aa, Mycobacterium
LRMTPNWKSAMMVMLVLYP

SEQ ID NO: 1125671 - protein, 26 aa, Mycobacterium
LRNAGFRYALVRVRDAGAAIGLYRGE

SEQ ID NO: 1125672 - protein, 18 aa, Mycobacterium
LRNHIIIVGYGTKGRTAA

SEQ ID NO: 1125673 - protein, 24 aa, Mycobacterium
LRNRSRLLDRFTLGVTAGGLTLAG

SEQ ID NO: 1125674 - protein, 19 aa, Mycobacterium
LRPEELRVMYDHHDAILHS

SEQ ID NO: 1125675 - protein, 22 aa, Mycobacterium
LRPELVEQLATRRITVLAMDAV

SEQ ID NO: 1125676 - protein, 17 aa, Mycobacterium
LRPEVLTSVLDRVSARR

SEQ ID NO: 1125677 - protein, 20 aa, Mycobacterium
LRPLLGMLPFDGLIGAPMLF

SEQ ID NO: 1125678 - protein, 20 aa, Mycobacterium
LRPVPEVTRLIRRLLPALVV

SEQ ID NO: 1125679 - protein, 32 aa, Mycobacterium; identical to SEQ ID NO: 318482

SEQ ID NO: 1125680 - protein, 17 aa, Mycobacterium
LRQGLYGNYFTFYLCDL

SEQ ID NO: 1125681 - protein, 22 aa, Mycobacterium
LRQLRVNPWLALVISSLLRGLY

SEQ ID NO: 1125682 - protein, 18 aa, Mycobacterium
LRQVPVLIGSVVLGSATG

SEQ ID NO: 1125683 - protein, 19 aa, Mycobacterium
LRRAFGWVPGAVDTMGEQA

SEQ ID NO: 1125684 - protein, 21 aa, Mycobacterium
LRRAPQAGGREVLRVEVNAPS

SEQ ID NO: 1125685 - protein, 25 aa, Mycobacterium
LRRDRVRLSVWISVLTLMMVYAPNA

SEQ ID NO: 1125686 - protein, 24 aa, Mycobacterium
LRREFSLWSAFAFAFAFISPIVAL

SEQ ID NO: 1125687 - protein, 23 aa, Mycobacterium
LRRFTHLHYGLAILLAFAGVKLI

SEQ ID NO: 1125688 - protein, 18 aa, Mycobacterium
LRRGAWAPVLAHWRPVVA

SEQ ID NO: 1125689 - protein, 20 aa, Mycobacterium
LRRHILPNIAGPLIVQTSLS

SEQ ID NO: 1125690 - protein, 18 aa, Mycobacterium
LRRIKRLIWAAVVVAAAG

SEQ ID NO: 1125691 - protein, 18 aa, Mycobacterium
LRRKHRFGAPALIVGSGP

SEQ ID NO: 1125692 - protein, 18 aa, Mycobacterium
LRRLPPYATALGEVVGSG

SEQ ID NO: 1125693 - protein, 19 aa, Mycobacterium
LRRMLFGHICLKGRHRFQI

SEQ ID NO: 1125694 - protein, 18 aa, Mycobacterium
LRRQFEHRLGRDSTDLLL

SEQ ID NO: 1125695 - protein, 19 aa, Mycobacterium
LRRTAFAVSHAVTRERSTL

SEQ ID NO: 1125696 - protein, 18 aa, Mycobacterium
LRRTVVGLAAGWNRIGTQ

SEQ ID NO: 1125697 - protein, 19 aa, Mycobacterium
LRRVFRWVPGAVDTVGEQA

SEQ ID NO: 1125698 - protein, 21 aa, Mycobacterium
LRRWAAEVIDLLAAAITVSLR

SEQ ID NO: 1125699 - protein, 25 aa, Mycobacterium
LRSDEVVLTLSLFKRRYVEAPDGDG

SEQ ID NO: 1125700 - protein, 22 aa, Mycobacterium
LRSEMFKRMSMISNPAVVLTGN

SEQ ID NO: 1125701 - protein, 18 aa, Mycobacterium
LRSFPIAALLWSGAALGA

SEQ ID NO: 1125702 - protein, 18 aa, Mycobacterium
LRSGHPMPTLDDVRAHFG

SEQ ID NO: 1125703 - protein, 25 aa, Mycobacterium
LRSRIGMVLQDTWLFAGTVYENIAY

SEQ ID NO: 1125704 - protein, 18 aa, Mycobacterium
LRSRLLIAVLAVLVTTIL

SEQ ID NO: 1125705 - protein, 18 aa, Mycobacterium
LRSVGGWDRDCLAEDCEI

SEQ ID NO: 1125706 - protein, 23 aa, Mycobacterium
LRTGESAAEMALRAFPATLQLAL

SEQ ID NO: 1125707 - protein, 19 aa, Mycobacterium
LRTLPMVAGLLITSTGSGA

SEQ ID NO: 1125708 - protein, 17 aa, Mycobacterium
LRTPLTKIQGWSELYFQ

SEQ ID NO: 1125709 - protein, 19 aa, Mycobacterium
LRTRAHWWWENLRPQVISS

SEQ ID NO: 1125710 - protein, 21 aa, Mycobacterium
LRTRRPEFGTPQMALNLRTTS

SEQ ID NO: 1125711 - protein, 17 aa, Mycobacterium
LRVIKSFGREDYVYERF

SEQ ID NO: 1125712 - protein, 20 aa, Mycobacterium
LRVPLLGAALTFVVFSPGIL

SEQ ID NO: 1125713 - protein, 17 aa, Mycobacterium
LRVSGRLDDVVAAAGDE

SEQ ID NO: 1125714 - protein, 17 aa, Mycobacterium
LRVVKSFGREDYVYDRF

SEQ ID NO: 1125715 - protein, 25 aa, Mycobacterium
LRWSRARGGVEFGATHYPLMVLLHT

SEQ ID NO: 1125716 - protein, 24 aa, Mycobacterium
LSAADPRWLLWLVAAMTATLIPFS

SEQ ID NO: 1125717 - protein, 24 aa, Mycobacterium
LSAGHFPLAIGVLQVLALDIGTDV

SEQ ID NO: 1125718 - protein, 24 aa, Mycobacterium
LSAGRDAHRADAPTRIPVPSLLRS

SEQ ID NO: 1125719 - protein, 23 aa, Mycobacterium
LSAIYVLWMYQRMMTGPAPLSLV

SEQ ID NO: 1125720 - protein, 23 aa, Mycobacterium
LSAMCARLPVPVIPAPGDPTPSA

SEQ ID NO: 1125721 - protein, 21 aa, Mycobacterium
LSAQLSWRSAYLVLAVVMAVI

SEQ ID NO: 1125722 - protein, 26 aa, Mycobacterium
LSARGIVSFLGFYEVFGLTTFATSMV

SEQ ID NO: 1125723 - protein, 21 aa, Mycobacterium
LSATRAAVWLSATAFLALLVL

SEQ ID NO: 1125724 - protein, 23 aa, Mycobacterium
LSAWRFVTTFGVVSLLADIVYEG

SEQ ID NO: 1125725 - protein, 20 aa, Mycobacterium
LSCRCSIKLMTQAFEERQLP

SEQ ID NO: 1125726 - protein, 23 aa, Mycobacterium
LSDRIGRRPLLIGGAVSFAVLGY

SEQ ID NO: 1125727 - protein, 25 aa, Mycobacterium
LSDRIGRRPLLIGGTVAFVILAYPL

SEQ ID NO: 1125728 - protein, 27 aa, Mycobacterium
LSENRLRVKAVRPIDGFTEEQALDAAL

SEQ ID NO: 1125729 - protein, 19 aa, Mycobacterium
LSESWRIRFAYFETYGPVP

SEQ ID NO: 1125730 - protein, 18 aa, Mycobacterium
LSEVMFAVLAAWVLLGEA

SEQ ID NO: 1125731 - protein, 20 aa, Mycobacterium
LSFARMPYFQSMGVPCAVGI

SEQ ID NO: 1125732 - protein, 19 aa, Mycobacterium
LSFLDCLYYATVSLSTTGY

SEQ ID NO: 1125733 - protein, 25 aa, Mycobacterium
LSFLDRWGRLTPRRLFDALSVGVRG

SEQ ID NO: 1125734 - protein, 18 aa, Mycobacterium
LSGFAFGVLVSGWRGARW

SEQ ID NO: 1125735 - protein, 20 aa, Mycobacterium
LSGFEHPWFFLFFLVVLGLV

SEQ ID NO: 1125736 - protein, 22 aa, Mycobacterium
LSGGFLGVDVFFVLSGFLITSL

SEQ ID NO: 1125737 - protein, 20 aa, Mycobacterium
LSGIAKRVGESLAIELELVP

SEQ ID NO: 1125738 - protein, 20 aa, Mycobacterium
LSGIPGLLAMLDLDEVSALD

SEQ ID NO: 1125739 - protein, 19 aa, Mycobacterium
LSGPDMRAVRQAVTRARRA

SEQ ID NO: 1125740 - protein, 22 aa, Mycobacterium
LSGRYRLQRLIATGGMGQVWEG

SEQ ID NO: 1125741 - protein, 17 aa, Mycobacterium
LSGSFGALAYVHAAYAV

SEQ ID NO: 1125742 - protein, 17 aa, Mycobacterium
LSGYGAAIGEAFQLRDD

SEQ ID NO: 1125743 - protein, 18 aa, Mycobacterium
LSHMVWGGGLLSNADSGI

SEQ ID NO: 1125744 - protein, 29 aa, Mycobacterium
LSHSTDLNWKSVWDHGWSAAEAAEAAPVL

SEQ ID NO: 1125745 - protein, 17 aa, Mycobacterium
LSIDWLGLAVLAAWGGV

SEQ ID NO: 1125746 - protein, 18 aa, Mycobacterium
LSIGGLMGALGYAALSRY

SEQ ID NO: 1125747 - protein, 21 aa, Mycobacterium
LSIGGSIVFVAWIVRKRLREG

SEQ ID NO: 1125748 - protein, 17 aa, Mycobacterium
LSIGMVLAALVVGSAFA

SEQ ID NO: 1125749 - protein, 22 aa, Mycobacterium
LSIRGVGSWIAATVVVWLVTAL

SEQ ID NO: 1125750 - protein, 29 aa, Mycobacterium
LSITAAERFARAMARFRASGGVTTVTDSG

SEQ ID NO: 1125751 - protein, 25 aa, Mycobacterium
LSKYLDLVAPVGFSTVLSGAATLSE

SEQ ID NO: 1125752 - protein, 24 aa, Mycobacterium
LSLAFGWGLLGIWAGLSAFMVLRL

SEQ ID NO: 1125753 - protein, 20 aa, Mycobacterium
LSLASFYAFYSGLGIPLPAG

SEQ ID NO: 1125754 - protein, 17 aa, Mycobacterium
LSLDYALFHGTGFYDLL

SEQ ID NO: 1125755 - protein, 26 aa, Mycobacterium
LSLFMVVAVTLTWLVYVTLRRDVAGS

SEQ ID NO: 1125756 - protein, 28 aa, Mycobacterium
LSLIGFRVPWREQLFLSWAGLRGAVPIV

SEQ ID NO: 1125757 - protein, 37 aa, Mycobacterium
LSLLGWCSFMLLWVLQACVFWRGMESIRKFIDFCGPA

SEQ ID NO: 1125758 - protein, 36 aa, Mycobacterium
LSLPFLLLFRLTCYYYRGAYYRTVWQSPTACAVAEP

SEQ ID NO: 1125759 - protein, 23 aa, Mycobacterium
LSLSAAFGAMVWIFQEGHLGALG

SEQ ID NO: 1125760 - protein, 23 aa, Mycobacterium
LSLSVPGTVGFGVPNPMGDAPNE

SEQ ID NO: 1125761 - protein, 20 aa, Mycobacterium
LSLTAAFGALVWIFQDGHLG

SEQ ID NO: 1125762 - protein, 20 aa, Mycobacterium
LSLTAAFGALVWIFQDGHLS

SEQ ID NO: 1125763 - protein, 31 aa, Mycobacterium
LSLVGISMPVFWLAAILLYFLSFKVQLFPTG

SEQ ID NO: 1125764 - protein, 24 aa, Mycobacterium
LSLWVTLVFPAWVGAVSLMVLFTR

SEQ ID NO: 1125765 - protein, 25 aa, Mycobacterium
LSMTGPRPGGFGALNDRTYEICARG

SEQ ID NO: 1125766 - protein, 18 aa, Mycobacterium
LSPAICADTGWSAPAVTA

SEQ ID NO: 1125767 - protein, 18 aa, Mycobacterium
LSPDHWIALTPPRIAELR

SEQ ID NO: 1125768 - protein, 19 aa, Mycobacterium
LSPEDRAGQVFPPTIPPDQ

SEQ ID NO: 1125769 - protein, 26 aa, Mycobacterium
LSPGGRTAVRVLLILAAAALVLGTVA

SEQ ID NO: 1125770 - protein, 24 aa, Mycobacterium
LSPLFALMWTRLGKRAPTTPRKFA

SEQ ID NO: 1125771 - protein, 20 aa, Mycobacterium
LSPNGIPPALIPDATAALAA

SEQ ID NO: 1125772 - protein, 25 aa, Mycobacterium
LSQKYIRRRFPALSGEDHNDVIRFT

SEQ ID NO: 1125773 - protein, 17 aa, Mycobacterium
LSRHGKSPWTLRNDVLN

SEQ ID NO: 1125774 - protein, 20 aa, Mycobacterium
LSSLARALVRKDFVESLRNA

SEQ ID NO: 1125775 - protein, 19 aa, Mycobacterium
LSSPGPIFFRQPRVGRDGV

SEQ ID NO: 1125776 - protein, 28 aa, Mycobacterium
LSTHTAIRWASSVFVEFFRAVPVLIMMI

SEQ ID NO: 1125777 - protein, 21 aa, Mycobacterium
LSTIFVRAGHRAHHATDDAIR

SEQ ID NO: 1125778 - protein, 22 aa, Mycobacterium
LSTLDRFLPLWIGAAMVAGLLL

SEQ ID NO: 1125779 - protein, 26 aa, Mycobacterium
LSTPIAILLALWVFRALAQWRQGRLG

SEQ ID NO: 1125780 - protein, 25 aa, Mycobacterium
LSTTFARPGHRAHHATDDAIRRAVH

SEQ ID NO: 1125781 - protein, 17 aa, Mycobacterium
LSTVPAFVGDDSLLASV

SEQ ID NO: 1125782 - protein, 17 aa, Mycobacterium
LSTVPAFVGDDSLLGSV

SEQ ID NO: 1125783 - protein, 18 aa, Mycobacterium
LSVIRLVLVPVFLYLLLA

SEQ ID NO: 1125784 - protein, 26 aa, Mycobacterium
LSVLGDLPWWVTVVILVRELGVTLLR

SEQ ID NO: 1125785 - protein, 24 aa, Mycobacterium
LSVLPMLIEWYRRRKAAKQAGGAT

SEQ ID NO: 1125786 - protein, 18 aa, Mycobacterium
LSVLSFFWLWWTTNMLSA

SEQ ID NO: 1125787 - protein, 20 aa, Mycobacterium
LSVPGDVGFGVPKTALEGGE

SEQ ID NO: 1125788 - protein, 17 aa, Mycobacterium
LSVVCRGVVDPPALAAA

SEQ ID NO: 1125789 - protein, 19 aa, Mycobacterium
LSWLIDLLLHHPRALARVR

SEQ ID NO: 1125790 - protein, 20 aa, Mycobacterium
LTAACLGLAALIYVGPAAAT

SEQ ID NO: 1125791 - protein, 17 aa, Mycobacterium
LTAAFGALVWIFQDGNL

SEQ ID NO: 1125792 - protein, 18 aa, Mycobacterium
LTAALWVFIALAGLWLGL

SEQ ID NO: 1125793 - protein, 27 aa, Mycobacterium
LTAALWVLIGLAGLWLGLLGIAMATGL

SEQ ID NO: 1125794 - protein, 19 aa, Mycobacterium
LTAATALAWTGRLTPPGAF

SEQ ID NO: 1125795 - protein, 22 aa, Mycobacterium
LTAAVAVWWLLRPGSPGAAEVG

SEQ ID NO: 1125796 - protein, 21 aa, Mycobacterium
LTACLLGVVAFWIFGALGRRI

SEQ ID NO: 1125797 - protein, 22 aa, Mycobacterium
LTADLWRTYVLPGIEGTLTAAA

SEQ ID NO: 1125798 - protein, 25 aa, Mycobacterium
LTALGRALSLVWRRSLQVRVVSLTL

SEQ ID NO: 1125799 - protein, 24 aa, Mycobacterium
LTALSFATVNGWWYVSNFGVPWSN

SEQ ID NO: 1125800 - protein, 17 aa, Mycobacterium
LTAMFLPAMAIVGALVP

SEQ ID NO: 1125801 - protein, 29 aa, Mycobacterium
LTAPADGWVRWMFIVALAVTFFLMAANRL

SEQ ID NO: 1125802 - protein, 18 aa, Mycobacterium
LTARGVRDVVALSPAESA

SEQ ID NO: 1125803 - protein, 17 aa, Mycobacterium
LTAWMLIGVYGLFTACT

SEQ ID NO: 1125804 - protein, 18 aa, Mycobacterium
LTAYKFTQNIGFDADGKL

SEQ ID NO: 1125805 - protein, 19 aa, Mycobacterium
LTCMKELPVTLLLHPTGTD

SEQ ID NO: 1125806 - protein, 25 aa, Mycobacterium
LTDAPRRASCLAGLGYAPTLEVLGG

SEQ ID NO: 1125807 - protein, 44 aa, Mycobacterium
LTDLIPAQVYWMVLQLILAVALLAWWKGRRVGPLVAEALPVVVR

SEQ ID NO: 1125808 - protein, 19 aa, Mycobacterium
LTDPEGRSFVGLSNYLVIL

SEQ ID NO: 1125809 - protein, 24 aa, Mycobacterium
LTDSVGWRSLGFLTLHAVLMTPIG

SEQ ID NO: 1125810 - protein, 23 aa, Mycobacterium
LTEVPVLAVGLVIILTANAVLVR

SEQ ID NO: 1125811 - protein, 25 aa, Mycobacterium
LTFDTLRIIAPYALAMALVGLLESL

SEQ ID NO: 1125812 - protein, 24 aa, Mycobacterium
LTFETPMLFSIGFIATFLLGGLSG

SEQ ID NO: 1125813 - protein, 18 aa, Mycobacterium
LTFYPGWVPIGAVALLVV

SEQ ID NO: 1125814 - protein, 17 aa, Mycobacterium
LTGALLATVAWVVGVFL

SEQ ID NO: 1125815 - protein, 17 aa, Mycobacterium
LTGCAIGEIAGLIIGTA

SEQ ID NO: 1125816 - protein, 19 aa, Mycobacterium
LTGEIPIVRPDEPTPVEEQ

SEQ ID NO: 1125817 - protein, 18 aa, Mycobacterium
LTGESVLIRNAHSVEALA

SEQ ID NO: 1125818 - protein, 23 aa, Mycobacterium
LTGEYRGGPAYYLSTALSHTAAA

SEQ ID NO: 1125819 - protein, 17 aa, Mycobacterium
LTGFASAFFNVRLIVPG

SEQ ID NO: 1125820 - protein, 17 aa, Mycobacterium
LTGLLSAIDDVLQRNGI

SEQ ID NO: 1125821 - protein, 28 aa, Mycobacterium
LTGLTWIRFLIWMAIGVVVYFLYGRRHS

SEQ ID NO: 1125822 - protein, 28 aa, Mycobacterium
LTGRFWRRSGVHIVRRPVAHLVGSLAVL

SEQ ID NO: 1125823 - protein, 23 aa, Mycobacterium
LTGRPLLGLAACWAVILFEIGFV

SEQ ID NO: 1125824 - protein, 18 aa, Mycobacterium
LTGSSFGVILAVISAITA

SEQ ID NO: 1125825 - protein, 18 aa, Mycobacterium
LTGTPRRASTVALIGLVY

SEQ ID NO: 1125826 - protein, 20 aa, Mycobacterium
LTGVKSRWVVAAAGVIMILL

SEQ ID NO: 1125827 - protein, 17 aa, Mycobacterium
LTHLVNFIDTRLRRGRK

SEQ ID NO: 1125828 - protein, 18 aa, Mycobacterium
LTITFVIACVAERFATIP

SEQ ID NO: 1125829 - protein, 19 aa, Mycobacterium
LTLACLLAAIGAVTDSMVT

SEQ ID NO: 1125830 - protein, 24 aa, Mycobacterium
LTLARKCFLPVMAGLVLSTLFAII

SEQ ID NO: 1125831 - protein, 18 aa, Mycobacterium
LTLMSPVAFVRRPYRWIK

SEQ ID NO: 1125832 - protein, 23 aa, Mycobacterium
LTLPAVGLMTIFTALARLQRRLR

SEQ ID NO: 1125833 - protein, 19 aa, Mycobacterium
LTLPYSVLLVFTFNILLKE

SEQ ID NO: 1125834 - protein, 18 aa, Mycobacterium
LTMITLIPIVAMMTVGGP

SEQ ID NO: 1125835 - protein, 19 aa, Mycobacterium
LTNLCVQALLLWTLANEST

SEQ ID NO: 1125836 - protein, 19 aa, Mycobacterium
LTPPGAFTAIPGYWHETAA

SEQ ID NO: 1125837 - protein, 22 aa, Mycobacterium
LTPTKWAVQFGVFAGLAGALGA

SEQ ID NO: 1125838 - protein, 19 aa, Mycobacterium
LTQIPVLRTLTAIAENAHT

SEQ ID NO: 1125839 - protein, 18 aa, Mycobacterium
LTRIGRPRPPAGQSAGLR

SEQ ID NO: 1125840 - protein, 29 aa, Mycobacterium
LTRKGLRPWVIPVTGGLLFFVLVYVWLTS

SEQ ID NO: 1125841 - protein, 19 aa, Mycobacterium
LTSAMNRFRRDFLAAYISA

SEQ ID NO: 1125842 - protein, 20 aa, Mycobacterium
LTSIHCIHVLIGFVVLGVVV

SEQ ID NO: 1125843 - protein, 23 aa, Mycobacterium
LTTALAFPFAWIAVRHRGFYARF

SEQ ID NO: 1125844 - protein, 25 aa, Mycobacterium
LTTPLRRLDLLAAYGTAFALAAAAQ

SEQ ID NO: 1125845 - protein, 19 aa, Mycobacterium
LTTVLPDTLAWPVLIAVFA

SEQ ID NO: 1125846 - protein, 20 aa, Mycobacterium
LTVAFVFREHGGIAVLFGLA

SEQ ID NO: 1125847 - protein, 18 aa, Mycobacterium
LTVALMWVHVPRYLGSSG

SEQ ID NO: 1125848 - protein, 20 aa, Mycobacterium
LTVFALAIVIGYYVIGNVHH

SEQ ID NO: 1125849 - protein, 24 aa, Mycobacterium
LTVGCGFLAFDRARSLGHRVGGGW

SEQ ID NO: 1125850 - protein, 27 aa, Mycobacterium
LTVGGVDSRLWIAIAVLAGLLVASLAA

SEQ ID NO: 1125851 - protein, 26 aa, Mycobacterium
LTVIAVVLLLGWSFFYFSDDTRGYKP

SEQ ID NO: 1125852 - protein, 19 aa, Mycobacterium
LTVLGLCYEWCHYLVHTDY

SEQ ID NO: 1125853 - protein, 19 aa, Mycobacterium
LTVLLEFAIQVARIHDKRK

SEQ ID NO: 1125854 - protein, 25 aa, Mycobacterium
LTVVALWLTYSLFFGTFRAHETVTL

SEQ ID NO: 1125855 - protein, 20 aa, Mycobacterium
LTYLDVCDQVLLLAPGGKTA

SEQ ID NO: 1125856 - protein, 33 aa, Mycobacterium
LVAAALVVVFGEFRFASGNSYHANFTEASRLKA

SEQ ID NO: 1125857 - protein, 26 aa, Mycobacterium
LVAADELFNIFLIIALVTAMLGALRE

SEQ ID NO: 1125858 - protein, 22 aa, Mycobacterium
LVAGVFTWLLPVGRDLDAFHGI

SEQ ID NO: 1125859 - protein, 30 aa, Mycobacterium
LVAIGAYVLLRFSLRTPLTLVRGSSHSVKF

SEQ ID NO: 1125860 - protein, 18 aa, Mycobacterium
LVAIVLFFVFGGVVAATL

SEQ ID NO: 1125861 - protein, 18 aa, Mycobacterium
LVAKRVRGGILIGLVIGT

SEQ ID NO: 1125862 - protein, 18 aa, Mycobacterium
LVALDIANQLGLPIASLV

SEQ ID NO: 1125863 - protein, 26 aa, Mycobacterium
LVALGARWLPVSGHPSLIVAAASPYL

SEQ ID NO: 1125864 - protein, 17 aa, Mycobacterium
LVALPIGVTLSIQFALL

SEQ ID NO: 1125865 - protein, 20 aa, Mycobacterium
LVALVFAALVSRWPLEGSIY

SEQ ID NO: 1125866 - protein, 19 aa, Mycobacterium
LVALVVGLVRYRRRRISLS

SEQ ID NO: 1125867 - protein, 18 aa, Mycobacterium
LVALWAVGLIITGAGVGI

SEQ ID NO: 1125868 - protein, 26 aa, Mycobacterium
LVAPAPIPVVWLAFYAVSVLGAAEVF

SEQ ID NO: 1125869 - protein, 19 aa, Mycobacterium
LVASLIGFVCCLGSVAGIA

SEQ ID NO: 1125870 - protein, 17 aa, Mycobacterium
LVASVLVLILLAGCAAF

SEQ ID NO: 1125871 - protein, 20 aa, Mycobacterium
LVATCLGAGLVGFVLVGGLA

SEQ ID NO: 1125872 - protein, 29 aa, Mycobacterium
LVATLAIGAYLVWPNRAGHKVTAYFTSAV

SEQ ID NO: 1125873 - protein, 23 aa, Mycobacterium
LVAVSALAPWLGPRIGLRLLTVP

SEQ ID NO: 1125874 - protein, 18 aa, Mycobacterium
LVAVVLFFVFGGVIAATL

SEQ ID NO: 1125875 - protein, 18 aa, Mycobacterium
LVCSRSVAIGELDGVDGT

SEQ ID NO: 1125876 - protein, 24 aa, Mycobacterium
LVEGRVAVAVPAQWTDERVTTGPG

SEQ ID NO: 1125877 - protein, 17 aa, Mycobacterium
LVFAALMVIVRLLQGAL

SEQ ID NO: 1125878 - protein, 19 aa, Mycobacterium
LVFKRRDFTLYAFDATHAH

SEQ ID NO: 1125879 - protein, 27 aa, Mycobacterium
LVFQYGFGQAIAWPVPLLAFILLVAVG

SEQ ID NO: 1125880 - protein, 17 aa, Mycobacterium
LVFVAGRYAVLVAGAAF

SEQ ID NO: 1125881 - protein, 19 aa, Mycobacterium
LVGAVPWLALSFAEALFPA

SEQ ID NO: 1125882 - protein, 28 aa, Mycobacterium
LVGAVVPHVRWPMWLRTLLAVVALAAIL

SEQ ID NO: 1125883 - protein, 38 aa, Mycobacterium
LVGKATLRPPFQWREFILQSWFLMRVAFLPTLAVSIPL

SEQ ID NO: 1125884 - protein, 17 aa, Mycobacterium
LVGLGFGLLAVRTSGDV

SEQ ID NO: 1125885 - protein, 18 aa, Mycobacterium
LVGPTVAVAVPWLTELHR

SEQ ID NO: 1125886 - protein, 19 aa, Mycobacterium
LVGVLGFSAVVIFLRDHRT

SEQ ID NO: 1125887 - protein, 24 aa, Mycobacterium
LVHAFSAPIGYLFRPYIVYRSREA

SEQ ID NO: 1125888 - protein, 23 aa, Mycobacterium
LVHFFDIQWPWSTGIYSVIVVAW

SEQ ID NO: 1125889 - protein, 26 aa, Mycobacterium
LVHVAYRWFPPIDVWTGVSLLGVAAA

SEQ ID NO: 1125890 - protein, 21 aa, Mycobacterium
LVIFGAYFVAYMFYRGQHPDL

SEQ ID NO: 1125891 - protein, 20 aa, Mycobacterium
LVIGWIFSRFDLSRWVEPMV

SEQ ID NO: 1125892 - protein, 20 aa, Mycobacterium
LVITPLRVAFLIVLIGTTVE

SEQ ID NO: 1125893 - protein, 26 aa, Mycobacterium
LVIVLGALSGWLGYQAYQSHEADKQR

SEQ ID NO: 1125894 - protein, 26 aa, Mycobacterium
LVIVTFGLALARYVPLARRPIVWWLH

SEQ ID NO: 1125895 - protein, 17 aa, Mycobacterium
LVLASVVGRYARTTAAL

SEQ ID NO: 1125896 - protein, 21 aa, Mycobacterium
LVLCVVALFAVNVVLTTIGVR

SEQ ID NO: 1125897 - protein, 18 aa, Mycobacterium
LVLGLEFQLAADVLRTAI

SEQ ID NO: 1125898 - protein, 17 aa, Mycobacterium
LVLIAVWCGGSAVLRIV

SEQ ID NO: 1125899 - protein, 18 aa, Mycobacterium
LVLIEFGIAAAFWQMAVG

SEQ ID NO: 1125900 - protein, 28 aa, Mycobacterium
LVLLVVVVAFGLWLGVRALDAKSSLEQA

SEQ ID NO: 1125901 - protein, 17 aa, Mycobacterium
LVLSVLVILGLVVGVRV

SEQ ID NO: 1125902 - protein, 19 aa, Mycobacterium
LVLTLGVWVWVGVTNDQYD

SEQ ID NO: 1125903 - protein, 17 aa, Mycobacterium
LVLVSFGYTSLPFWPQG

SEQ ID NO: 1125904 - protein, 27 aa, Mycobacterium
LVNEYPGDPWKWWAVLSSAVGVAVAIA

SEQ ID NO: 1125905 - protein, 18 aa, Mycobacterium
LVPREIAVVAPLIALLLV

SEQ ID NO: 1125906 - protein, 58 aa, Mycobacterium
LVPRKKELWLRAANVAAFVLMICGFFRWGFPATMWALPFAAFFLFSAGSWRDGVGTRR

SEQ ID NO: 1125907 - protein, 23 aa, Mycobacterium
LVQRLGERRVYISGLIIVALSTA

SEQ ID NO: 1125908 - protein, 21 aa, Mycobacterium
LVRAGDRWLGAIGLMDLPRPE

SEQ ID NO: 1125909 - protein, 24 aa, Mycobacterium
LVRGTIRILLPISVIAAILLITGG

SEQ ID NO: 1125910 - protein, 24 aa, Mycobacterium
LVRPTDRFEALVVTLAIVVVLLAV

SEQ ID NO: 1125911 - protein, 20 aa, Mycobacterium
LVRRRFRLAVFLTVTVELSA

SEQ ID NO: 1125912 - protein, 26 aa, Mycobacterium
LVRYMLRIGEFHWFRHGVLGALGSLV

SEQ ID NO: 1125913 - protein, 23 aa, Mycobacterium
LVSAFPTSGGIYWWAAKLGGPKA

SEQ ID NO: 1125914 - protein, 17 aa, Mycobacterium
LVSEVLILLALAFTVIF

SEQ ID NO: 1125915 - protein, 21 aa, Mycobacterium
LVSRIPVSVILIGLGSILVLG

SEQ ID NO: 1125916 - protein, 24 aa, Mycobacterium
LVSTRMLARRSMLFTNLATVFVGM

SEQ ID NO: 1125917 - protein, 20 aa, Mycobacterium
LVTGEWAVFVGWIRDQFVTT

SEQ ID NO: 1125918 - protein, 18 aa, Mycobacterium
LVTGIALLIQRDPIITAK

SEQ ID NO: 1125919 - protein, 23 aa, Mycobacterium
LVTLRLGGMPTRLNASYAEVTLH

SEQ ID NO: 1125920 - protein, 22 aa, Mycobacterium
LVTQRLSERLRAPVVTTPEPAL

SEQ ID NO: 1125921 - protein, 19 aa, Mycobacterium
LVTRLPWSTRVRVALLVLA

SEQ ID NO: 1125922 - protein, 18 aa, Mycobacterium
LVVAGFLIFNAMSMAITQ

SEQ ID NO: 1125923 - protein, 18 aa, Mycobacterium
LVVAGYCVTRACEPDARR

SEQ ID NO: 1125924 - protein, 23 aa, Mycobacterium
LVVDRLSALMLVVSSIVLLAVVF

SEQ ID NO: 1125925 - protein, 17 aa, Mycobacterium
LVVELNAGVPLAIQIMV

SEQ ID NO: 1125926 - protein, 25 aa, Mycobacterium
LVVFCVVELRVAQPMVNVRLFRSAA

SEQ ID NO: 1125927 - protein, 17 aa, Mycobacterium
LVVGFWGMLRLAEALGI

SEQ ID NO: 1125928 - protein, 29 aa, Mycobacterium
LVVLGLVALVIGVAGGWVGRTTAEVVSAF

SEQ ID NO: 1125929 - protein, 18 aa, Mycobacterium
LVVLRFMQGFAVGGEWGG

SEQ ID NO: 1125930 - protein, 24 aa, Mycobacterium
LVVLTLMRISGWLDVSVDQPAAPS

SEQ ID NO: 1125931 - protein, 17 aa, Mycobacterium
LVVMAAIVFQITLPLTP

SEQ ID NO: 1125932 - protein, 28 aa, Mycobacterium
LVVPFGRLGDMFGRVRIYNVGFAVFTVA

SEQ ID NO: 1125933 - protein, 18 aa, Mycobacterium
LVVPRIVAATVVSLMLTS

SEQ ID NO: 1125934 - protein, 18 aa, Mycobacterium
LVVSEWIRGGSLAEVADT

SEQ ID NO: 1125935 - protein, 26 aa, Mycobacterium
LVVTLAVGIYLVWPSRTGNKITAYFT

SEQ ID NO: 1125936 - protein, 33 aa, Mycobacterium
LVVTLELPESGGLYRFSNVTYRGVQVGKVTGVS

SEQ ID NO: 1125937 - protein, 25 aa, Mycobacterium
LVVVLRKVWKPASFSLRGWTLPVAV

SEQ ID NO: 1125938 - protein, 17 aa, Mycobacterium
LVWQHLVGIELHWMVLP

SEQ ID NO: 1125939 - protein, 26 aa, Mycobacterium
LVWRRFLRNRAAVLSLFVLAALFIGC

SEQ ID NO: 1125940 - protein, 25 aa, Mycobacterium
LVYIRMARPFIAFYNWCANATLRAF

SEQ ID NO: 1125941 - protein, 18 aa, Mycobacterium
LWAGWLVVTALVFSYMNG

SEQ ID NO: 1125942 - protein, 19 aa, Mycobacterium
LWAKGMSLGTVMAFTMSTI

SEQ ID NO: 1125943 - protein, 23 aa, Mycobacterium
LWASLRQGMPLGIAYGIWAAAGV

SEQ ID NO: 1125944 - protein, 20 aa, Mycobacterium
LWDQVRLVLGAFPYQLLLAA

SEQ ID NO: 1125945 - protein, 23 aa, Mycobacterium
LWFGELGYRSVFTTQIVTRLLLF

SEQ ID NO: 1125946 - protein, 29 aa, Mycobacterium
LWFGELGYRSVFTTVLFTRVVVFLVVSLL

SEQ ID NO: 1125947 - protein, 17 aa, Mycobacterium
LWFTRRAPRTCAVRASL

SEQ ID NO: 1125948 - protein, 22 aa, Mycobacterium
LWGWPGGGFVGIDVFFVVSGYL

SEQ ID NO: 1125949 - protein, 18 aa, Mycobacterium
LWLKRWPTRTESVLFAAI

SEQ ID NO: 1125950 - protein, 18 aa, Mycobacterium
LWLPWGAATYLLLREPNT

SEQ ID NO: 1125951 - protein, 17 aa, Mycobacterium
LWLQDAIAGMPRFPDDG

SEQ ID NO: 1125952 - protein, 20 aa, Mycobacterium
LWLRDHWPTRVQSLVCVVLV

SEQ ID NO: 1125953 - protein, 17 aa, Mycobacterium
LWLVFALFFLFPLYAMA

SEQ ID NO: 1125954 - protein, 25 aa, Mycobacterium
LWLVLSGNFAWLNWLTILLAFSAVD

SEQ ID NO: 1125955 - protein, 25 aa, Mycobacterium
LWMLFDAALGWRVVALAATGGVSAV

SEQ ID NO: 1125956 - protein, 19 aa, Mycobacterium
LWNPRTWWQSIAVWFAAAV

SEQ ID NO: 1125957 - protein, 19 aa, Mycobacterium
LWPLPMFALAAALACGIAM

SEQ ID NO: 1125958 - protein, 19 aa, Mycobacterium
LWQTIGFLSIVALVFMIAT

SEQ ID NO: 1125959 - protein, 25 aa, Mycobacterium
LWRAAQVFRLLSCIYAFGFQLAVNP

SEQ ID NO: 1125960 - protein, 34 aa, Mycobacterium
LWRLGIFVVVCALGAFALIAVFAQLRFEREQRYT

SEQ ID NO: 1125961 - protein, 19 aa, Mycobacterium
LWTSLWWIAQGWAYAAVAT

SEQ ID NO: 1125962 - protein, 19 aa, Mycobacterium
LWVEGDWRSLLLPATTAVA

SEQ ID NO: 1125963 - protein, 19 aa, Mycobacterium
LWVNAGCAIHTSWNRDEID

SEQ ID NO: 1125964 - protein, 25 aa, Mycobacterium
LWVSRADAAVIEWVSQYWNQFLLWA

SEQ ID NO: 1125965 - protein, 25 aa, Mycobacterium
LYAKERRFAVAFVMVGAVLFVAGAI

SEQ ID NO: 1125966 - protein, 18 aa, Mycobacterium
LYALLGFPLDDMWHRIFG

SEQ ID NO: 1125967 - protein, 18 aa, Mycobacterium
LYALVLIPFGVYLASYAP

SEQ ID NO: 1125968 - protein, 17 aa, Mycobacterium
LYCVALISAFVAAKVGT

SEQ ID NO: 1125969 - protein, 24 aa, Mycobacterium
LYDHPRLGSLAGYLDELAPPPAVE

SEQ ID NO: 1125970 - protein, 24 aa, Mycobacterium
LYDHPRLGSLAGYLDELDPPPQVV

SEQ ID NO: 1125971 - protein, 36 aa, Mycobacterium
LYFNALVAIVITGLWLWLRYDALLLVVATQILQMLR

SEQ ID NO: 1125972 - protein, 17 aa, Mycobacterium
LYGGRTSIYIGLAAAAV

SEQ ID NO: 1125973 - protein, 17 aa, Mycobacterium
LYGIVWVGLGLSIFQQF

SEQ ID NO: 1125974 - protein, 22 aa, Mycobacterium
LYGSALAWWAPPVLRRMTRHGI

SEQ ID NO: 1125975 - protein, 18 aa, Mycobacterium
LYILLGWVAVWFIGPIAH

SEQ ID NO: 1125976 - protein, 23 aa, Mycobacterium
LYIRLRLGDTPEFEALRESGEVS

SEQ ID NO: 1125977 - protein, 21 aa, Mycobacterium
LYIRLRLGDTPQFAELDKAEK

SEQ ID NO: 1125978 - protein, 20 aa, Mycobacterium
LYIVGVFVSFTFSQIGMVRH

SEQ ID NO: 1125979 - protein, 17 aa, Mycobacterium
LYLACYVTGGWEPGWAG

SEQ ID NO: 1125980 - protein, 17 aa, Mycobacterium
LYLIFPLNNEDSTIALV

SEQ ID NO: 1125981 - protein, 18 aa, Mycobacterium
LYLVIAFILLQAAVSVVV

SEQ ID NO: 1125982 - protein, 22 aa, Mycobacterium
LYLWHWPLLIFWLSHSGRSRVD

SEQ ID NO: 1125983 - protein, 22 aa, Mycobacterium
LYLWHWPLLIFYLAHTGNSRVT

SEQ ID NO: 1125984 - protein, 27 aa, Mycobacterium
LYRILTCWLPVFLGWPIMRWLTRKDMI

SEQ ID NO: 1125985 - protein, 36 aa, Mycobacterium
LYSRIKPTLLGVLPWRWGDPQARQLKWWARAVVTLW

SEQ ID NO: 1125986 - protein, 25 aa, Mycobacterium
LYTSRGTGFWGPPFRVFAPSEITVL

SEQ ID NO: 1125987 - protein, 18 aa, Mycobacterium
LYVFIRWVSGPYFEPVAG

SEQ ID NO: 1125988 - protein, 21 aa, Mycobacterium
LYVFWEITTVLSFLLVGHYAE

SEQ ID NO: 1125989 - protein, 26 aa, Mycobacterium
LYVILGWRPVLLVPLTFALFTPLAVP

SEQ ID NO: 1125990 - protein, 18 aa, Mycobacterium
LYVLIRWVSGPYFEPVAG

SEQ ID NO: 1125991 - protein, 23 aa, Mycobacterium
LYVTRGAGFWGPPVRIGAPPDIT

SEQ ID NO: 1125992 - protein, 21 aa, Mycobacterium
LYVVGCLVAVLAVQQSNLFTA

SEQ ID NO: 1125993 - protein, 23 aa, Mycobacterium
LYWLRPRTIRLPPWPNRVPLTAG

SEQ ID NO: 1125994 - protein, 18 aa, Mycobacterium
LYYFFLGVVVLQFSGALG

SEQ ID NO: 1125995 - protein, 26 aa, Mycobacterium
LYYGLPMWLIMSLRIAFVVLGAAALW

SEQ ID NO: 1125996 - protein, 17 aa, Mycobacterium
LYYTFLARRLAKRENRS

SEQ ID NO: 1125997 - protein, 19 aa, Mycobacterium
MAAAALGWLPPAAGALLQE

SEQ ID NO: 1125998 - protein, 20 aa, Mycobacterium
MAAIMPELIALMPQQIETMK

SEQ ID NO: 1125999 - protein, 23 aa, Mycobacterium
MAALCAAIAIIAVVVPFAGSLSL

SEQ ID NO: 1126000 - protein, 27 aa, Mycobacterium
MAAMVLFPMHFLKSFAYAGVATVAFAA

SEQ ID NO: 1126001 - protein, 18 aa, Mycobacterium
MAAPARMLAPFDVVLGSA

SEQ ID NO: 1126002 - protein, 17 aa, Mycobacterium
MADGVPMPVAVNLFAPF

SEQ ID NO: 1126003 - protein, 28 aa, Mycobacterium
MAFQACFISAGAVAARFGAAAVAAHQVV

SEQ ID NO: 1126004 - protein, 22 aa, Mycobacterium
MAGTVVEWYEFFLYATAATLVF

SEQ ID NO: 1126005 - protein, 29 aa, Mycobacterium
MAIADRFLEWQLPPIWMMFFFAPTVVALS

SEQ ID NO: 1126006 - protein, 17 aa, Mycobacterium
MAIAGIVLSVLWSIAIV

SEQ ID NO: 1126007 - protein, 23 aa, Mycobacterium
MAIGLFFAFWSWVGFETTAVYGE

SEQ ID NO: 1126008 - protein, 19 aa, Mycobacterium
MAIGWWREGWPSQRQSAGF

SEQ ID NO: 1126009 - protein, 19 aa, Mycobacterium
MAINILIAFVAFSLAASCI

SEQ ID NO: 1126010 - protein, 23 aa, Mycobacterium
MALEPAFAMLLGFLILNQAPGAA

SEQ ID NO: 1126011 - protein, 21 aa, Mycobacterium
MALSGRLFGFSPFTMLLPQAL

SEQ ID NO: 1126012 - protein, 17 aa, Mycobacterium
MALVPVFLFALFAGDGQ

SEQ ID NO: 1126013 - protein, 17 aa, Mycobacterium
MAQRIAALPDIDMVRGI

SEQ ID NO: 1126014 - protein, 25 aa, Mycobacterium
MARDPRWRFATADQMLACLDGPAQR

SEQ ID NO: 1126015 - protein, 19 aa, Mycobacterium
MARPAFKRWWTRYIPPPVE

SEQ ID NO: 1126016 - protein, 18 aa, Mycobacterium
MARYPGALTAIFNSVLLS

SEQ ID NO: 1126017 - protein, 23 aa, Mycobacterium
MASLVVAGIIGWLAYSNRDRSPR

SEQ ID NO: 1126018 - protein, 25 aa, Mycobacterium
MATVLCLVGLLALPGYHTNYNDRIY

SEQ ID NO: 1126019 - protein, 21 aa, Mycobacterium
MAVALPLSFPSLGEMAQKHPL

SEQ ID NO: 1126020 - protein, 17 aa, Mycobacterium
MAVLLSELERTGAFDRE

SEQ ID NO: 1126021 - protein, 18 aa, Mycobacterium
MCQAVLASGVLGFLFLVA

SEQ ID NO: 1126022 - protein, 18 aa, Mycobacterium
MDALRATFLGADFRPVGL

SEQ ID NO: 1126023 - protein, 17 aa, Mycobacterium
MDGRGFVNTAARCDAAA

SEQ ID NO: 1126024 - protein, 25 aa, Mycobacterium
MDRWLFGGTMPTVWLQERLKLPEPP

SEQ ID NO: 1126025 - protein, 23 aa, Mycobacterium
MEAVVALAFFIPLLIGTGGNTGT

SEQ ID NO: 1126026 - protein, 24 aa, Mycobacterium
MELLARLGLAVLLFLVGLRLDLHM

SEQ ID NO: 1126027 - protein, 25 aa, Mycobacterium
MESYGWRIPFLIAGPLGLVGLYIRL

SEQ ID NO: 1126028 - protein, 21 aa, Mycobacterium
MEVGMILTVFTMRIAAAIGFL

SEQ ID NO: 1126029 - protein, 25 aa, Mycobacterium
MFADYRCPFCAKFSRDTEPDLVERF

SEQ ID NO: 1126030 - protein, 25 aa, Mycobacterium
MFAGTFKRFVPVTLTSDRSGLVMEP

SEQ ID NO: 1126031 - protein, 23 aa, Mycobacterium
MFEAGGVPAHFWVPDAAQGANAT

SEQ ID NO: 1126032 - protein, 26 aa, Mycobacterium
MFGVALGLLLGFGVAIVRDLLDNTVK

SEQ ID NO: 1126033 - protein, 25 aa, Mycobacterium
MFKPPFQWREFLLQTWFVARVSMVP

SEQ ID NO: 1126034 - protein, 20 aa, Mycobacterium
MFLWELRLGTSVETARTMAV

SEQ ID NO: 1126035 - protein, 27 aa, Mycobacterium
MFMEELFWGCAGIGLAVVMPALALSAI

SEQ ID NO: 1126036 - protein, 18 aa, Mycobacterium
MFRHLRRRHIALGGLFVL

SEQ ID NO: 1126037 - protein, 21 aa, Mycobacterium
MFVRRQLRLPAPLIDVRLFAN

SEQ ID NO: 1126038 - protein, 19 aa, Mycobacterium
MGADIAWLLPAAVICLAAG

SEQ ID NO: 1126039 - protein, 20 aa, Mycobacterium
MGAGALVMIGGTVGVAAFLT

SEQ ID NO: 1126040 - protein, 19 aa, Mycobacterium
MGEVIGLAFHLAAVAFLLL

SEQ ID NO: 1126041 - protein, 26 aa, Mycobacterium
MGGFIADAWGWRWVFVPLVPVALAGL

SEQ ID NO: 1126042 - protein, 19 aa, Mycobacterium
MGGHPVRARALRFDNPVVI

SEQ ID NO: 1126043 - protein, 17 aa, Mycobacterium
MGGILLEYVDWRAVFWI

SEQ ID NO: 1126044 - protein, 17 aa, Mycobacterium
MGGTCAVDLTVMHPEVF

SEQ ID NO: 1126045 - protein, 27 aa, Mycobacterium
MGIARLRPRFASLVGLSEVLFAVLAAW

SEQ ID NO: 1126046 - protein, 21 aa, Mycobacterium
MGIGMVVFWALIIGGIVVLVR

SEQ ID NO: 1126047 - protein, 18 aa, Mycobacterium
MGMPVSQFTVAFMTAILL

SEQ ID NO: 1126048 - protein, 24 aa, Mycobacterium
MGMTESRILLRVETPIAMPLILGG

SEQ ID NO: 1126049 - protein, 18 aa, Mycobacterium
MGQGGLLYVAPVYASPGA

SEQ ID NO: 1126050 - protein, 18 aa, Mycobacterium
MGRLSVRSLRDIRYEHAS

SEQ ID NO: 1126051 - protein, 22 aa, Mycobacterium
MGTGDLYILRRHILPNIAGPLI

SEQ ID NO: 1126052 - protein, 26 aa, Mycobacterium
MGTPIRARWGRWVARLLSVVGLAGLA

SEQ ID NO: 1126053 - protein, 20 aa, Mycobacterium
MHALVADLLLLARLDEGQDR

SEQ ID NO: 1126054 - protein, 31 aa, Mycobacterium
MHAPAHWNIAFIRRFMLTFGPVSSLFDFLTF

SEQ ID NO: 1126055 - protein, 24 aa, Mycobacterium
MHPVFNLASARLILGTAAEPRMVT

SEQ ID NO: 1126056 - protein, 23 aa, Mycobacterium
MIAALPWLVASAVGGGWAAAADQ

SEQ ID NO: 1126057 - protein, 17 aa, Mycobacterium
MIASWIAAAASVGFGVF

SEQ ID NO: 1126058 - protein, 23 aa, Mycobacterium
MIEREAADLGLKVSVRQSDSEAE

SEQ ID NO: 1126059 - protein, 25 aa, Mycobacterium
MIFAQLRFAPSNHYDAQFVNVSGLK

SEQ ID NO: 1126060 - protein, 21 aa, Mycobacterium
MIFNVIWTYALVRGAGANTGA

SEQ ID NO: 1126061 - protein, 27 aa, Mycobacterium
MIGGCLYCAHDLWVAGSVRAWLVVALM

SEQ ID NO: 1126062 - protein, 28 aa, Mycobacterium
MIGGCLYCAHDLWVAGSVRAWLVVALMN

SEQ ID NO: 1126063 - protein, 21 aa, Mycobacterium
MIGLARWYFAKSGHQFGAQAR

SEQ ID NO: 1126064 - protein, 17 aa, Mycobacterium
MILVLGLLVALGPLTID

SEQ ID NO: 1126065 - protein, 39 aa, Mycobacterium
MIMGPLGGWCMKKLDALWEGKIRPGFEMLVDNFSAGILG

SEQ ID NO: 1126066 - protein, 23 aa, Mycobacterium
MINRQGRVLGVVFGAAVDDVDTG

SEQ ID NO: 1126067 - protein, 28 aa, Mycobacterium
MIQLSAGYGIQWVVPGLFFVLVSGFLAI

SEQ ID NO: 1126068 - protein, 23 aa, Mycobacterium
MISPTMLFFPFVLLLAATALYRG

SEQ ID NO: 1126069 - protein, 24 aa, Mycobacterium
MIVALAAIALVVSAVLLILGGLGG

SEQ ID NO: 1126070 - protein, 17 aa, Mycobacterium
MKAAIMVALLFRTLDAW

SEQ ID NO: 1126071 - protein, 19 aa, Mycobacterium
MKVTYGWSLMLVVVFAVLY

SEQ ID NO: 1126072 - protein, 21 aa, Mycobacterium
MKYQPEWVPRYACYDDARLVP

SEQ ID NO: 1126073 - protein, 19 aa, Mycobacterium
MLAAVLLLRLFDENTSLTV

SEQ ID NO: 1126074 - protein, 19 aa, Mycobacterium
MLCCIIGLTLMIPGLALFY

SEQ ID NO: 1126075 - protein, 32 aa, Mycobacterium
MLDVGVTMGGLWAASLLADWVAHLSVHEQTPR

SEQ ID NO: 1126076 - protein, 26 aa, Mycobacterium
MLFAAPFLARAVVWAGRRFGKGQSRA

SEQ ID NO: 1126077 - protein, 25 aa, Mycobacterium
MLFASPLLARFVVWASRRLSRHPAD

SEQ ID NO: 1126078 - protein, 18 aa, Mycobacterium
MLFLRAGAAGGLLTPALA

SEQ ID NO: 1126079 - protein, 17 aa, Mycobacterium
MLFWAPRGSKVIADLAD

SEQ ID NO: 1126080 - protein, 33 aa, Mycobacterium
MLGDDCWWAPRWMKRLQERLGLGEVELPDERKR

SEQ ID NO: 1126081 - protein, 26 aa, Mycobacterium
MLGLARRLGVDWSMVYTGRSVDSLPF

SEQ ID NO: 1126082 - protein, 19 aa, Mycobacterium
MLGRLARRTAAGSWKATAG

SEQ ID NO: 1126083 - protein, 18 aa, Mycobacterium
MLLCGLAPLLPVKQSTAT

SEQ ID NO: 1126084 - protein, 20 aa, Mycobacterium
MLLGIVAFLVIVTFGLALAR

SEQ ID NO: 1126085 - protein, 17 aa, Mycobacterium
MLLGLPFLGVRWGLPDD

SEQ ID NO: 1126086 - protein, 20 aa, Mycobacterium
MLLLVFRSVATMVLILFMVF

SEQ ID NO: 1126087 - protein, 18 aa, Mycobacterium
MLRTSRVVLTLAADKNAG

SEQ ID NO: 1126088 - protein, 19 aa, Mycobacterium
MLSIPFTVLTVFTLNVLLL

SEQ ID NO: 1126089 - protein, 18 aa, Mycobacterium
MLSLVPWGGNGVSLDLMR

SEQ ID NO: 1126090 - protein, 19 aa, Mycobacterium
MLTGMQWVVWLAVANNVAA

SEQ ID NO: 1126091 - protein, 19 aa, Mycobacterium
MLVPLVLLFSHGGWPTAIA

SEQ ID NO: 1126092 - protein, 18 aa, Mycobacterium
MLVPLVPAAVIALGLIVS

SEQ ID NO: 1126093 - protein, 21 aa, Mycobacterium
MLVRAGERWLGAIGLMDLPRP

SEQ ID NO: 1126094 - protein, 18 aa, Mycobacterium
MLWVIAGVFIAVFIAALG

SEQ ID NO: 1126095 - protein, 23 aa, Mycobacterium
MMGGLLVSLVVRRRRVWVRLAPG

SEQ ID NO: 1126096 - protein, 24 aa, Mycobacterium
MMLSLVWPIASLGFLLSMTQESFT

SEQ ID NO: 1126097 - protein, 18 aa, Mycobacterium
MMNRDGRQPMGPGGMMGP

SEQ ID NO: 1126098 - protein, 28 aa, Mycobacterium
MMWTDGLIRLWPAWEFYPFGHTIPQGVW

SEQ ID NO: 1126099 - protein, 24 aa, Mycobacterium
MNAAEIPAIISLIFSSAFGVDSAF

SEQ ID NO: 1126100 - protein, 21 aa, Mycobacterium
MNLPIAVWMMRSFFLEVPAEL

SEQ ID NO: 1126101 - protein, 23 aa, Mycobacterium
MNNRCPLTSYVLVGFSQGAVIAG

SEQ ID NO: 1126102 - protein, 23 aa, Mycobacterium
MNVLARVAGVVGDIIKHPVAFLS

SEQ ID NO: 1126103 - protein, 20 aa, Mycobacterium
MPAGLRLVIDNAIANAVKHG

SEQ ID NO: 1126104 - protein, 27 aa, Mycobacterium
MPAIATLLGRWFWWPLVVRSRPLRLPP

SEQ ID NO: 1126105 - protein, 18 aa, Mycobacterium
MPEGMRTLDLVGGGNGVT

SEQ ID NO: 1126106 - protein, 17 aa, Mycobacterium
MPILWGQAALFAGASGW

SEQ ID NO: 1126107 - protein, 32 aa, Mycobacterium
MPLAMGKLAGWAMRRARRRWPTLGPVRTFFAG

SEQ ID NO: 1126108 - protein, 23 aa, Mycobacterium
MPLLGRASDRFGRKILIQVSLAG

SEQ ID NO: 1126109 - protein, 19 aa, Mycobacterium
MPLLIPVAIAIKLTSKGPV

SEQ ID NO: 1126110 - protein, 31 aa, Mycobacterium
MPLPEGRIAKARIDAGVGMVFQHFNLFNHMT

SEQ ID NO: 1126111 - protein, 17 aa, Mycobacterium
MPLRMADLAVVGAAAGV

SEQ ID NO: 1126112 - protein, 17 aa, Mycobacterium
MPVFFIAFMFLFVATGI

SEQ ID NO: 1126113 - protein, 28 aa, Mycobacterium
MPVLLFCIAFGLSMDYEVFLLARIREFW

SEQ ID NO: 1126114 - protein, 43 aa, Mycobacterium
MPVLLFCIAFGLSMDYEVFLMSRIREFWLKSGRTRQDNDESVA

SEQ ID NO: 1126115 - protein, 27 aa, Mycobacterium
MPVLLFCIAFGLSMDYEVFLVSRIREF

SEQ ID NO: 1126116 - protein, 27 aa, Mycobacterium
MPVLLFCIAFGLSMDYEVFLVSRIREY

SEQ ID NO: 1126117 - protein, 30 aa, Mycobacterium
MPVWRVSVRTNWLLVVAVVIELALLLMLLY

SEQ ID NO: 1126118 - protein, 24 aa, Mycobacterium
MQFLCSAIQAGSRLGYQESAELCA

SEQ ID NO: 1126119 - protein, 20 aa, Mycobacterium
MQGPLSAFVNQAADTFDGNG

SEQ ID NO: 1126120 - protein, 30 aa, Mycobacterium
MQKALPWVMGGCMLGMIAILIFGGMRNFSP

SEQ ID NO: 1126121 - protein, 22 aa, Mycobacterium
MQVCALLPFALPFVVLAYGIKR

SEQ ID NO: 1126122 - protein, 25 aa, Mycobacterium
MQVKRMSVSPVFRYTIIVGATTGAI

SEQ ID NO: 1126123 - protein, 17 aa, Mycobacterium
MRAAMTLVNRILTAQTP

SEQ ID NO: 1126124 - protein, 22 aa, Mycobacterium
MRCTSCGAVNVGGTWHESAYVV

SEQ ID NO: 1126125 - protein, 19 aa, Mycobacterium
MRFSQGLALGGEWSGAALL

SEQ ID NO: 1126126 - protein, 18 aa, Mycobacterium
MRFVEALTFLVITIMLVL

SEQ ID NO: 1126127 - protein, 24 aa, Mycobacterium
MRGICRRSREEVFTSDGWYATGDL

SEQ ID NO: 1126128 - protein, 17 aa, Mycobacterium
MRGVPIGRVERLDITPA

SEQ ID NO: 1126129 - protein, 21 aa, Mycobacterium
MRGWRRRVERQAKIIGALPPL

SEQ ID NO: 1126130 - protein, 21 aa, Mycobacterium
MRITRWFAHRWGAGRSLVIGM

SEQ ID NO: 1126131 - protein, 18 aa, Mycobacterium
MRKIHTFAIPPNMVAPLL

SEQ ID NO: 1126132 - protein, 22 aa, Mycobacterium
MRKKFGSTMGYELDIHSDMAFL

SEQ ID NO: 1126133 - protein, 19 aa, Mycobacterium
MRLPAVTFSSLPQLTAASG

SEQ ID NO: 1126134 - protein, 17 aa, Mycobacterium
MRNRFLVALLLSIPIML

SEQ ID NO: 1126135 - protein, 23 aa, Mycobacterium
MRNSPEPILLMLAAVKCGAISGM

SEQ ID NO: 1126136 - protein, 20 aa, Mycobacterium
MRPRWIKRKFFEHFPDDLRP

SEQ ID NO: 1126137 - protein, 20 aa, Mycobacterium
MRQNLAWAVGYNVIALPIAA

SEQ ID NO: 1126138 - protein, 22 aa, Mycobacterium
MRQPLKRRWGFRESGATIIWPP

SEQ ID NO: 1126139 - protein, 17 aa, Mycobacterium
MRQRWEAALPGIFGGLL

SEQ ID NO: 1126140 - protein, 21 aa, Mycobacterium
MRRLRGGTLREPLLVRLFGGA

SEQ ID NO: 1126141 - protein, 18 aa, Mycobacterium
MRRQPVALAVVLAGTLAY

SEQ ID NO: 1126142 - protein, 17 aa, Mycobacterium
MRTSMGASATWAGVLTT

SEQ ID NO: 1126143 - protein, 17 aa, Mycobacterium
MRYRIPGVLDPGDTGAD

SEQ ID NO: 1126144 - protein, 22 aa, Mycobacterium
MSAMCGYAVLYLAARDLEPAGF

SEQ ID NO: 1126145 - protein, 17 aa, Mycobacterium
MSARFATTVYYGQATGI

SEQ ID NO: 1126146 - protein, 21 aa, Mycobacterium
MSAVLLGIFAVTGRYDAAWWT

SEQ ID NO: 1126147 - protein, 29 aa, Mycobacterium
MSDCGRHVGRVGALALTLGVGLAVTAVPL

SEQ ID NO: 1126148 - protein, 19 aa, Mycobacterium
MSGANWSRVMFSIVAPLVM

SEQ ID NO: 1126149 - protein, 29 aa, Mycobacterium
MSGMRSFASGFGIFGIMMLIGMAGMLFRG

SEQ ID NO: 1126150 - protein, 19 aa, Mycobacterium
MSKINAGAVQPTFDRVALD

SEQ ID NO: 1126151 - protein, 17 aa, Mycobacterium
MSLAVLFGYLSAVHAGR

SEQ ID NO: 1126152 - protein, 18 aa, Mycobacterium
MSLPNLRYVTQAGGRLDP

SEQ ID NO: 1126153 - protein, 19 aa, Mycobacterium
MSPCDAVTLANDLDADPAT

SEQ ID NO: 1126154 - protein, 25 aa, Mycobacterium
MSPVAFVRRPYRWIKELGATDAPTF

SEQ ID NO: 1126155 - protein, 27 aa, Mycobacterium
MSQRRLSWEIAWKPVLVLIVLIYAIVA

SEQ ID NO: 1126156 - protein, 20 aa, Mycobacterium
MSRDPRRRFGSAAQMRAALA

SEQ ID NO: 1126157 - protein, 19 aa, Mycobacterium
MSRIREFWLASGRTAADVT

SEQ ID NO: 1126158 - protein, 19 aa, Mycobacterium
MSRYMKRRTVMLTAVLTLG

SEQ ID NO: 1126159 - protein, 21 aa, Mycobacterium
MSSGVAGFWASMRVFAVLAVC

SEQ ID NO: 1126160 - protein, 23 aa, Mycobacterium
MSSKSAALVGVFISVTTVPAAGF

SEQ ID NO: 1126161 - protein, 25 aa, Mycobacterium
MSSMGRGGLQFMLIIWLQGIWLPLR

SEQ ID NO: 1126162 - protein, 24 aa, Mycobacterium
MSVALCFMELAAKYPVAGSVYNWS

SEQ ID NO: 1126163 - protein, 25 aa, Mycobacterium
MSVLLLRLVADRALLTAFTAAGGAA

SEQ ID NO: 1126164 - protein, 18 aa, Mycobacterium
MSVLRLVAMWTDVSIFAL

SEQ ID NO: 1126165 - protein, 17 aa, Mycobacterium
MSVTAWVYLAAGPVVCV

SEQ ID NO: 1126166 - protein, 19 aa, Mycobacterium
MTADSFVVFFERIKDEIRE

SEQ ID NO: 1126167 - protein, 22 aa, Mycobacterium
MTAGAALVMWMGELVTERGVGN

SEQ ID NO: 1126168 - protein, 24 aa, Mycobacterium
MTASSIRWVLVDGATGEESVTIDR

SEQ ID NO: 1126169 - protein, 23 aa, Mycobacterium
MTCDRIRSAAWQHDLDTLVDGGG

SEQ ID NO: 1126170 - protein, 25 aa, Mycobacterium
MTEAGWRLPAFAAFMVTATETLSGV

SEQ ID NO: 1126171 - protein, 20 aa, Mycobacterium
MTGNVIFLGFWFVPHSGVDL

SEQ ID NO: 1126172 - protein, 17 aa, Mycobacterium
MTPARATAIVAQVASAL

SEQ ID NO: 1126173 - protein, 21 aa, Mycobacterium
MTPERAVHIITEVARALDYAH

SEQ ID NO: 1126174 - protein, 28 aa, Mycobacterium
MTPSIAALLGRWFWWPQQIRTRPAPSPW

SEQ ID NO: 1126175 - protein, 22 aa, Mycobacterium
MTPVPWWSYAVWVLTAVLSGIL

SEQ ID NO: 1126176 - protein, 17 aa, Mycobacterium
MTSIVLRVPVAKLDEVV

SEQ ID NO: 1126177 - protein, 17 aa, Mycobacterium
MTTFGLTAAYVFIICWI

SEQ ID NO: 1126178 - protein, 18 aa, Mycobacterium
MTVDAAFMSQCPGGNTEA

SEQ ID NO: 1126179 - protein, 17 aa, Mycobacterium
MTWQMWLAFVGAAILIA

SEQ ID NO: 1126180 - protein, 22 aa, Mycobacterium
MVAAPWLVRPGEPINVALWLID

SEQ ID NO: 1126181 - protein, 22 aa, Mycobacterium
MVAGLLLGRWIPGLNTALEKVA

SEQ ID NO: 1126182 - protein, 22 aa, Mycobacterium
MVAGLLLGRWIPGLNTALESVA

SEQ ID NO: 1126183 - protein, 25 aa, Mycobacterium
MVALPALGLWHLWSGAPQDPTARQH

SEQ ID NO: 1126184 - protein, 26 aa, Mycobacterium
MVAMVLFPMYFLKSFAYAGIAVVGFA

SEQ ID NO: 1126185 - protein, 23 aa, Mycobacterium
MVDGRLHPALNLMSARLIAGQPN

SEQ ID NO: 1126186 - protein, 17 aa, Mycobacterium
MVDMYVPLFGQRLAGMA

SEQ ID NO: 1126187 - protein, 24 aa, Mycobacterium
MVERPRYINLIVLLRITCEVSATV

SEQ ID NO: 1126188 - protein, 17 aa, Mycobacterium
MVKRGREGWLQTANILA

SEQ ID NO: 1126189 - protein, 18 aa, Mycobacterium
MVLAALVVGSAFATSTTI

SEQ ID NO: 1126190 - protein, 17 aa, Mycobacterium
MVLIFFNLIAPTGWQVG

SEQ ID NO: 1126191 - protein, 17 aa, Mycobacterium
MVLPVITLIGWDTLPER

SEQ ID NO: 1126192 - protein, 30 aa, Mycobacterium
MVLSGVLAFWVCGLLLCLFIGPTLSSARTL

SEQ ID NO: 1126193 - protein, 19 aa, Mycobacterium
MVLVAVAVGAGWLYSLGVT

SEQ ID NO: 1126194 - protein, 20 aa, Mycobacterium
MVLVAVAVGAGWLYSLGVTL

SEQ ID NO: 1126195 - protein, 28 aa, Mycobacterium
MVLVPAFMRVLGRWNWWSPKPLARLHRR

SEQ ID NO: 1126196 - protein, 18 aa, Mycobacterium
MVNAVLPQVIPSWIGTFI

SEQ ID NO: 1126197 - protein, 18 aa, Mycobacterium
MVNMGGFIASLLLMQAMG

SEQ ID NO: 1126198 - protein, 23 aa, Mycobacterium
MVPAGRMGDIFGRRRALLTGVAL

SEQ ID NO: 1126199 - protein, 19 aa, Mycobacterium
MVSGVEVTPGWVAKTPGGQ

SEQ ID NO: 1126200 - protein, 18 aa, Mycobacterium
MVVIEFANLSGLLAPKTG

SEQ ID NO: 1126201 - protein, 25 aa, Mycobacterium
MVVPALVTRLSWRGTRASLDGYVIG

SEQ ID NO: 1126202 - protein, 19 aa, Mycobacterium
MVWLGEISYEIFLVHVAVM

SEQ ID NO: 1126203 - protein, 35 aa, Mycobacterium
MWFIAAPVLGWAVWRAFVKRDWRYAVVLVGYSAGF

SEQ ID NO: 1126204 - protein, 19 aa, Mycobacterium
MWGGWGMGGWILMGAVMVL

SEQ ID NO: 1126205 - protein, 24 aa, Mycobacterium
MWGGWGWGGWILMGVVMVLLSGAL

SEQ ID NO: 1126206 - protein, 25 aa, Mycobacterium
MWGGWGWSGWILMGAVMVLSSAALI

SEQ ID NO: 1126207 - protein, 25 aa, Mycobacterium
MWGGWGWSGWILMSAVMVLFSAALI

SEQ ID NO: 1126208 - protein, 18 aa, Mycobacterium
MWLIPGMFGVAYRRGLLS

SEQ ID NO: 1126209 - protein, 18 aa, Mycobacterium
MWSGRLAVLASVPVAVHC

SEQ ID NO: 1126210 - protein, 17 aa, Mycobacterium
MYAMLAWGFLQILVLGR

SEQ ID NO: 1126211 - protein, 22 aa, Mycobacterium
MYATPDFWNLDGLPATGWTLNW

SEQ ID NO: 1126212 - protein, 26 aa, Mycobacterium
MYGDFFSFYLCDLIVKVNGKGGQPVF

SEQ ID NO: 1126213 - protein, 17 aa, Mycobacterium
MYGFRAVPEQVPAGSAL

SEQ ID NO: 1126214 - protein, 18 aa, Mycobacterium
MYSQSSVQLRQLLIDNKA

SEQ ID NO: 1126215 - protein, 18 aa, Mycobacterium
MYVAGLLGTIAFGVLGAA

SEQ ID NO: 1126216 - protein, 20 aa, Mycobacterium
NAAFRYALVRLRDAAEAVAF

SEQ ID NO: 1126217 - protein, 28 aa, Mycobacterium
NADGLPRVVAFVGSVAFWPVLLVTDVCT

SEQ ID NO: 1126218 - protein, 21 aa, Mycobacterium
NAFALLGLRALFFLVKGLLDR

SEQ ID NO: 1126219 - protein, 22 aa, Mycobacterium
NAIPPQIFKTGAVDTVAKDVLP

SEQ ID NO: 1126220 - protein, 18 aa, Mycobacterium
NAIWKTFDLFVGLIQAFI

SEQ ID NO: 1126221 - protein, 18 aa, Mycobacterium
NAKGGPGGRPGCWQPITR

SEQ ID NO: 1126222 - protein, 23 aa, Mycobacterium
NALGPICAIILITGAGGMFGGVL

SEQ ID NO: 1126223 - protein, 22 aa, Mycobacterium
NALSIWITVHFALRLYRLNGVS

SEQ ID NO: 1126224 - protein, 20 aa, Mycobacterium
NALYWPSFVGAALIVMSNPV

SEQ ID NO: 1126225 - protein, 22 aa, Mycobacterium
NAMSSARLAARYPQSGGTYVYG

SEQ ID NO: 1126226 - protein, 29 aa, Mycobacterium
NANPGLDRRGVAVLLDFGGGGTSITLVDA

SEQ ID NO: 1126227 - protein, 18 aa, Mycobacterium
NAPATWLGVGRYTVIVEL

SEQ ID NO: 1126228 - protein, 19 aa, Mycobacterium
NAPEVPAEVTARVSAALRA

SEQ ID NO: 1126229 - protein, 20 aa, Mycobacterium
NAPLLFAALFIYGAGTATNL

SEQ ID NO: 1126230 - protein, 24 aa, Mycobacterium
NASHELRTPLAINRTLIEVALEDP

SEQ ID NO: 1126231 - protein, 27 aa, Mycobacterium
NATLPVAVTIGVLWGVVILLIDRALVV

SEQ ID NO: 1126232 - protein, 24 aa, Mycobacterium
NATYRAGLIGGLALLPLLLVLAFV

SEQ ID NO: 1126233 - protein, 20 aa, Mycobacterium
NAVEGVMRFSATLNSRDQQL

SEQ ID NO: 1126234 - protein, 23 aa, Mycobacterium
NAYFRYRLRYALLVDGMTFVVHV

SEQ ID NO: 1126235 - protein, 21 aa, Mycobacterium
NCGFGMEPGIRFCPRCGKPQS

SEQ ID NO: 1126236 - protein, 19 aa, Mycobacterium
NCSWLFAWHYNLFPLSMLL

SEQ ID NO: 1126237 - protein, 24 aa, Mycobacterium
NDGKEVPANLVGRDPKTDLAVLKV

SEQ ID NO: 1126238 - protein, 19 aa, Mycobacterium
NDIAKYFAIIPALFVGLFP

SEQ ID NO: 1126239 - protein, 23 aa, Mycobacterium
NDILRLALAGVFLVVIVTSSLIT

SEQ ID NO: 1126240 - protein, 17 aa, Mycobacterium
NDLLFAAFREFERLLGL

SEQ ID NO: 1126241 - protein, 21 aa, Mycobacterium
NDLLHGLLMYSGNDAAHALAM

SEQ ID NO: 1126242 - protein, 23 aa, Mycobacterium
NDVPRGQVGRIFVGNFFPFQGYT

SEQ ID NO: 1126243 - protein, 26 aa, Mycobacterium
NDYQIDWERSALVSGMMPATFSVAED

SEQ ID NO: 1126244 - protein, 23 aa, Mycobacterium
NEIAKRLGWDTEFVRTDNVAGQL

SEQ ID NO: 1126245 - protein, 30 aa, Mycobacterium
NELRAKAPVPMWRKVVRQFQDPLIYLLLVA

SEQ ID NO: 1126246 - protein, 25 aa, Mycobacterium
NENYIWKARTQGIGYLDLTGCMALG

SEQ ID NO: 1126247 - protein, 24 aa, Mycobacterium
NEPAPIEVVRDGRPVTLTVTPTPD

SEQ ID NO: 1126248 - protein, 22 aa, Mycobacterium
NEVYVPLWARRVARVAATVLIV

SEQ ID NO: 1126249 - protein, 22 aa, Mycobacterium
NEWIETLALLAHIAIMLVFLLI

SEQ ID NO: 1126250 - protein, 23 aa, Mycobacterium
NFALHSTFRWPLSAAAALWIVAT

SEQ ID NO: 1126251 - protein, 24 aa, Mycobacterium
NFFLVEPRHTFTISEPDSAITIVV

SEQ ID NO: 1126252 - protein, 18 aa, Mycobacterium
NFGLSWGLFPILFATTGM

SEQ ID NO: 1126253 - protein, 31 aa, Mycobacterium
NFGVPWSNSFPEWKFGFTTMLLGLSVVALLI

SEQ ID NO: 1126254 - protein, 28 aa, Mycobacterium
NFRAPGVILRQVLSWVLSTGVPVLAILL

SEQ ID NO: 1126255 - protein, 19 aa, Mycobacterium
NGAFFSQFMGWIMHPLGEP

SEQ ID NO: 1126256 - protein, 22 aa, Mycobacterium
NGAKIWIQFEGFSIQPAEFSKI

SEQ ID NO: 1126257 - protein, 22 aa, Mycobacterium
NGDAGYHRVFWLTTVFTLLVIA

SEQ ID NO: 1126258 - protein, 24 aa, Mycobacterium
NGDIRFIIIFTLLVVFLVLCILLR

SEQ ID NO: 1126259 - protein, 19 aa, Mycobacterium
NGDKLAFTIEARALTFQPV

SEQ ID NO: 1126260 - protein, 26 aa, Mycobacterium
NGGEPAILFCFGFLLLVAMGAGAWSI

SEQ ID NO: 1126261 - protein, 17 aa, Mycobacterium
NGIGVGFITWVVMRTAA

SEQ ID NO: 1126262 - protein, 24 aa, Mycobacterium
NGIPRLPVVAALLVEPLVAAVLGA

SEQ ID NO: 1126263 - protein, 18 aa, Mycobacterium
NGIWSRYPLTPLSPTRYW

SEQ ID NO: 1126264 - protein, 29 aa, Mycobacterium
NGPDLAWFTGFIALMGWVCGMTGVGFILS

SEQ ID NO: 1126265 - protein, 19 aa, Mycobacterium
NGRIAAKVVDRLRITPEYG

SEQ ID NO: 1126266 - protein, 23 aa, Mycobacterium
NGTFPRLRSALVVEGAGAVVGGA

SEQ ID NO: 1126267 - protein, 26 aa, Mycobacterium
NGVAWARIALALMRFGAVVVPLSTLL

SEQ ID NO: 1126268 - protein, 17 aa, Mycobacterium
NGYDFGYFSLVVPKGSA

SEQ ID NO: 1126269 - protein, 20 aa, Mycobacterium
NHDVGWGRLFGFGMGADIAW

SEQ ID NO: 1126270 - protein, 25 aa, Mycobacterium
NHLELGQPIAIEYVWGRQIGENTIN

SEQ ID NO: 1126271 - protein, 23 aa, Mycobacterium
NIAAPLRWIQRLGKEEAAERADA

SEQ ID NO: 1126272 - protein, 24 aa, Mycobacterium
NIAEHRCTIAFIAPPVAVALAKHP

SEQ ID NO: 1126273 - protein, 18 aa, Mycobacterium
NILACLLANILVATRLTY

SEQ ID NO: 1126274 - protein, 19 aa, Mycobacterium
NILDSRGGMVFTLVCVAAV

SEQ ID NO: 1126275 - protein, 17 aa, Mycobacterium
NILPKWLGYYTVWQYLT

SEQ ID NO: 1126276 - protein, 31 aa, Mycobacterium
NIRGHARHVGRVGALAFALGVGGAVLTGTAV

SEQ ID NO: 1126277 - protein, 24 aa, Mycobacterium
NLAPDGWADYGWVVSTPSMRANMP

SEQ ID NO: 1126278 - protein, 25 aa, Mycobacterium
NLDDALRWIDVFGVALLAGIGFTVS

SEQ ID NO: 1126279 - protein, 24 aa, Mycobacterium
NLDKPIPVRYARWLGDAVRGDFGT

SEQ ID NO: 1126280 - protein, 21 aa, Mycobacterium
NLERSRVGRAWIAVREDEDAA

SEQ ID NO: 1126281 - protein, 21 aa, Mycobacterium
NLGGIEILRRGYNFTDGSDGF

SEQ ID NO: 1126282 - protein, 19 aa, Mycobacterium
NLIGLIAILASVAYGSATF

SEQ ID NO: 1126283 - protein, 25 aa, Mycobacterium
NLLQMAFRFWAFRRFVFPDEFARNP

SEQ ID NO: 1126284 - protein, 18 aa, Mycobacterium
NLPDYWITELPRIGSATD

SEQ ID NO: 1126285 - protein, 27 aa, Mycobacterium
NLPEEVLRPAYGLAEATLYVATNLPGK

SEQ ID NO: 1126286 - protein, 21 aa, Mycobacterium
NLPPPCTTGFLPAQQRRVPTE

SEQ ID NO: 1126287 - protein, 32 aa, Mycobacterium
NLPTIIYSLYWRRFNTRGALWSMYGGLISTIV

SEQ ID NO: 1126288 - protein, 18 aa, Mycobacterium
NLRHGRIGVGTLMTIAAI

SEQ ID NO: 1126289 - protein, 25 aa, Mycobacterium
NLSGIPPWLSDSLCRAATGDATVKR

SEQ ID NO: 1126290 - protein, 25 aa, Mycobacterium
NLTPRAVVTFVALGLFVALFAATGV

SEQ ID NO: 1126291 - protein, 17 aa, Mycobacterium
NLVAIAALVGWAIALRY

SEQ ID NO: 1126292 - protein, 20 aa, Mycobacterium
NMAGAPWLVYYARALGNNVG

SEQ ID NO: 1126293 - protein, 27 aa, Mycobacterium
NMGEVFTVFFGVVFAGFIGITTTSGEA

SEQ ID NO: 1126294 - protein, 19 aa, Mycobacterium
NMIAALVLEATFTAIFVPV

SEQ ID NO: 1126295 - protein, 25 aa, Mycobacterium
NNERAHPGFVRRVMTSALPSGIVVG

SEQ ID NO: 1126296 - protein, 21 aa, Mycobacterium
NNLPAVLVLLPLVTPIGPAAV

SEQ ID NO: 1126297 - protein, 18 aa, Mycobacterium
NNPFPLGIAALGLMAAAY

SEQ ID NO: 1126298 - protein, 23 aa, Mycobacterium
NPCTVGFLPSTQWRSPEDETTID

SEQ ID NO: 1126299 - protein, 18 aa, Mycobacterium
NPDGWVAKIGGWGAYDGA

SEQ ID NO: 1126300 - protein, 20 aa, Mycobacterium
NPKALIARVPFVVLVIGSLG

SEQ ID NO: 1126301 - protein, 19 aa, Mycobacterium
NPKNLKFTLLDFAAQSRSL

SEQ ID NO: 1126302 - protein, 23 aa, Mycobacterium
NPPPRLPAVLMIGGEFNTPADWV

SEQ ID NO: 1126303 - protein, 18 aa, Mycobacterium
NPQFAFTRIDPGAGVPDF

SEQ ID NO: 1126304 - protein, 18 aa, Mycobacterium
NPTLLPAVREIAHEMVDD

SEQ ID NO: 1126305 - protein, 25 aa, Mycobacterium
NPTVLAAFLRRARLRTIQHPGNAAP

SEQ ID NO: 1126306 - protein, 19 aa, Mycobacterium
NPWRGPPVPVGTPIQDGRN

SEQ ID NO: 1126307 - protein, 17 aa, Mycobacterium
NPYGRLALENLYALFRS

SEQ ID NO: 1126308 - protein, 23 aa, Mycobacterium
NQNRIRWGNLLTLPMGQGGLLYV

SEQ ID NO: 1126309 - protein, 18 aa, Mycobacterium
NQYLCGLSVRVTDLQGRT

SEQ ID NO: 1126310 - protein, 20 aa, Mycobacterium
NRAFPDWTVAAAARRHLGAL

SEQ ID NO: 1126311 - protein, 25 aa, Mycobacterium
NRLRVRATRAVDGWTGEQVLDAALS

SEQ ID NO: 1126312 - protein, 17 aa, Mycobacterium
NRLSALWETAGLHDVLK

SEQ ID NO: 1126313 - protein, 21 aa, Mycobacterium
NRPGLSSVLFYLFAYGFSTLG

SEQ ID NO: 1126314 - protein, 22 aa, Mycobacterium
NRPGLSSVLFYLFAYGFSTLGA

SEQ ID NO: 1126315 - protein, 19 aa, Mycobacterium
NRQTVPLLAIIVVAVLVGG

SEQ ID NO: 1126316 - protein, 19 aa, Mycobacterium
NRRLILASLAPRTTTRPAR

SEQ ID NO: 1126317 - protein, 19 aa, Mycobacterium
NRSHEWWAGVSIGLTLVVK

SEQ ID NO: 1126318 - protein, 18 aa, Mycobacterium
NRSVELFTDIAVTCVAAA

SEQ ID NO: 1126319 - protein, 20 aa, Mycobacterium
NRVATFLSLFLAGGVMLSAT

SEQ ID NO: 1126320 - protein, 18 aa, Mycobacterium
NRVRRPLIDLSLFRAGRF

SEQ ID NO: 1126321 - protein, 17 aa, Mycobacterium
NSAFLLPLVYFGISISL

SEQ ID NO: 1126322 - protein, 25 aa, Mycobacterium
NSGSVLSWFSPIAWAQQMRPFVELR

SEQ ID NO: 1126323 - protein, 23 aa, Mycobacterium
NSIIWRHVLPIVLPTLLTVATLD

SEQ ID NO: 1126324 - protein, 17 aa, Mycobacterium
NSITAYKGQIIYDTPAT

SEQ ID NO: 1126325 - protein, 30 aa, Mycobacterium
NSNLSSHFPYAAQIWKSMWAEQTGLNVDGV

SEQ ID NO: 1126326 - protein, 18 aa, Mycobacterium
NSPTGLPMGDFALTISDP

SEQ ID NO: 1126327 - protein, 23 aa, Mycobacterium
NTFSLDNFIAWAVAGDNQPLIDA

SEQ ID NO: 1126328 - protein, 22 aa, Mycobacterium
NTFTCLVRFALANIRRRPERFV

SEQ ID NO: 1126329 - protein, 17 aa, Mycobacterium
NTVAFLIGLFSSAIILG

SEQ ID NO: 1126330 - protein, 17 aa, Mycobacterium
NVDLVFRDGTLVRRTET

SEQ ID NO: 1126331 - protein, 18 aa, Mycobacterium
NVGNVIIAGLIVGVITTV

SEQ ID NO: 1126332 - protein, 25 aa, Mycobacterium
NVGRSLPFLILMAAIIPVTRFLVGT

SEQ ID NO: 1126333 - protein, 18 aa, Mycobacterium
NVNMWWALLGLAVSALKY

SEQ ID NO: 1126334 - protein, 17 aa, Mycobacterium
NVPPPCLTGYLPPTQQR

SEQ ID NO: 1126335 - protein, 24 aa, Mycobacterium
NVTPHPWCHWAARGWILLVRSVPE

SEQ ID NO: 1126336 - protein, 27 aa, Mycobacterium
NVVLLKRFAPQQIMVWALVAASLSGAV

SEQ ID NO: 1126337 - protein, 18 aa, Mycobacterium
NWHFRGGGASLTLQDFAK

SEQ ID NO: 1126338 - protein, 24 aa, Mycobacterium
NWILRRLGIEPAEELRSARSPQEL

SEQ ID NO: 1126339 - protein, 24 aa, Mycobacterium
NYAPARLARPFAMLVDLLAAVPSI

SEQ ID NO: 1126340 - protein, 37 aa, Mycobacterium
NYLDRMGQSWSTRTTLRFLWLRLARVWPVYLVTMHLA

SEQ ID NO: 1126341 - protein, 26 aa, Mycobacterium
NYMKLPNLLFGIGRYSVTLQLPEAGG

SEQ ID NO: 1126342 - protein, 25 aa, Mycobacterium
NYNCVNCLTYALARQIFVTLDDPLS

SEQ ID NO: 1126343 - protein, 17 aa, Mycobacterium
PAAELEELVALYEAKGI

SEQ ID NO: 1126344 - protein, 17 aa, Mycobacterium
PAAKPPVLAWWTRGDTN

SEQ ID NO: 1126345 - protein, 21 aa, Mycobacterium
PAALIRTSLSLAIICETSDGD

SEQ ID NO: 1126346 - protein, 20 aa, Mycobacterium
PAALQWLSSIAWDALVGLFG

SEQ ID NO: 1126347 - protein, 19 aa, Mycobacterium
PAALWTLAGGERMWERADD

SEQ ID NO: 1126348 - protein, 27 aa, Mycobacterium
PAATFGTGFAPFFMPLALFIGALIIWM

SEQ ID NO: 1126349 - protein, 25 aa, Mycobacterium
PAAVICLAAGFVLTRGRPRTDRTRA

SEQ ID NO: 1126350 - protein, 30 aa, Mycobacterium
PAAVPASFRAGYGEYLRTAGVMQVAAVAVP

SEQ ID NO: 1126351 - protein, 19 aa, Mycobacterium
PAAWLRRSMNFSARLMPEF

SEQ ID NO: 1126352 - protein, 27 aa, Mycobacterium
PACSVGFLPPSSWRSPADLTDVDTPDG

SEQ ID NO: 1126353 - protein, 23 aa, Mycobacterium
PADARATTRLATLVQPVTKVPST

SEQ ID NO: 1126354 - protein, 25 aa, Mycobacterium
PADEVPRTLTLDGLGRYRVIALPAR

SEQ ID NO: 1126355 - protein, 17 aa, Mycobacterium
PADLAFLIAAPDSGGQE

SEQ ID NO: 1126356 - protein, 20 aa, Mycobacterium
PADLRLTGVDGLRVEEAMLT

SEQ ID NO: 1126357 - protein, 22 aa, Mycobacterium
PADRPRALLLGSTVAAVVVVGF

SEQ ID NO: 1126358 - protein, 19 aa, Mycobacterium
PAFRAAGIVIALAAVVAIV

SEQ ID NO: 1126359 - protein, 19 aa, Mycobacterium
PAFTRYSLFEDRGALDAAF

SEQ ID NO: 1126360 - protein, 24 aa, Mycobacterium
PAGEYCGLCGVPLAEHSGDGPHWL

SEQ ID NO: 1126361 - protein, 18 aa, Mycobacterium
PAGGIGVYAPGADKLAPA

SEQ ID NO: 1126362 - protein, 17 aa, Mycobacterium
PAGLRLAVDNAIANAVK

SEQ ID NO: 1126363 - protein, 17 aa, Mycobacterium
PAGRKLVIAAAVASAVF

SEQ ID NO: 1126364 - protein, 19 aa, Mycobacterium
PAGVTLTAFLARNVAELGE

SEQ ID NO: 1126365 - protein, 30 aa, Mycobacterium
PAIPHDISVRVSLWLGVAVVAGLFGWGAWQ

SEQ ID NO: 1126366 - protein, 20 aa, Mycobacterium
PAKYKMTVVFNDGKEVPANL

SEQ ID NO: 1126367 - protein, 20 aa, Mycobacterium
PALGVFGRKLFWPFIPQVGA

SEQ ID NO: 1126368 - protein, 24 aa, Mycobacterium
PALPARRELFHFFASSYAINAVDV

SEQ ID NO: 1126369 - protein, 31 aa, Mycobacterium
PALPEPRSDFGVAVTDARLVAVGGTAAGRPL

SEQ ID NO: 1126370 - protein, 19 aa, Mycobacterium
PALQWAGLVAPLLTATGIH

SEQ ID NO: 1126371 - protein, 27 aa, Mycobacterium
PALREYRVWFFHRLLWITPVVTLYFWV

SEQ ID NO: 1126372 - protein, 18 aa, Mycobacterium
PALVALLLGKTAQADERG

SEQ ID NO: 1126373 - protein, 17 aa, Mycobacterium
PAPDPAPAPVAGGAPTA

SEQ ID NO: 1126374 - protein, 28 aa, Mycobacterium
PAPELVWLPLFLVFGVLTGFLGAGYNLV

SEQ ID NO: 1126375 - protein, 26 aa, Mycobacterium
PAPPLWPHSWPFIAQVLAAILVADLG

SEQ ID NO: 1126376 - protein, 24 aa, Mycobacterium
PAQPRRSGADIAVSIVVLVLTVLF

SEQ ID NO: 1126377 - protein, 22 aa, Mycobacterium
PAQVGKLGVRDVLFGRKVSYAG

SEQ ID NO: 1126378 - protein, 23 aa, Mycobacterium
PARAVKRRIYWAGTAVGVVLLFL

SEQ ID NO: 1126379 - protein, 20 aa, Mycobacterium
PARIRRMCESLAEQLAAIHS

SEQ ID NO: 1126380 - protein, 25 aa, Mycobacterium
PARLDDSRFLLPVLGVPPEGDSDSA

SEQ ID NO: 1126381 - protein, 23 aa, Mycobacterium
PARRITVRVIYALAALFAAVLIV
